United States Patent 12,644,137 (MATERIALS AND METHODS FOR TREATMENT OF HEMOGLOBINOPATHIES) - sequence listing, part 2

SEQ ID NO: 19937 - DNA, 20 bp, Artificial Sequence
  Synthetic oligonucleotide; TGG chr11 5323881 5323900 5323897 +
gactctagtattggtgagaa

SEQ ID NO: 19938 - DNA, 20 bp, Artificial Sequence
  Synthetic oligonucleotide; AAG chr11 5323884 5323903 5323900 +
tctagtattggtgagaatgg

SEQ ID NO: 19939 - DNA, 20 bp, Artificial Sequence
  Synthetic oligonucleotide; AAG chr11 5323896 5323915 5323912 +
gagaatggaagcatatctca

SEQ ID NO: 19940 - DNA, 20 bp, Artificial Sequence
  Synthetic oligonucleotide; AGG chr11 5323897 5323916 5323913 +
agaatggaagcatatctcaa

SEQ ID NO: 19941 - DNA, 20 bp, Artificial Sequence
  Synthetic oligonucleotide; CGG chr11 5323904 5323923 5323920 +
aagcatatctcaaaggattg

SEQ ID NO: 19942 - DNA, 20 bp, Artificial Sequence
  Synthetic oligonucleotide; TGG chr11 5323908 5323927 5323924 +
atatctcaaaggattgcgga

SEQ ID NO: 19943 - DNA, 20 bp, Artificial Sequence
  Synthetic oligonucleotide; CAG chr11 5323936 5323955 5323952 +
aaacaatcatatgccattgc

SEQ ID NO: 19944 - DNA, 20 bp, Artificial Sequence
  Synthetic oligonucleotide; AGG chr11 5323937 5323956 5323953 +
aacaatcatatgccattgcc

SEQ ID NO: 19945 - DNA, 20 bp, Artificial Sequence
  Synthetic oligonucleotide; GAG chr11 5323939 5323958 5323955 +
caatcatatgccattgccag

SEQ ID NO: 19946 - DNA, 20 bp, Artificial Sequence
  Synthetic oligonucleotide; AGG chr11 5323940 5323959 5323956 +
aatcatatgccattgccagg

SEQ ID NO: 19947 - DNA, 20 bp, Artificial Sequence
  Synthetic oligonucleotide; GGG chr11 5323941 5323960 5323957 +
atcatatgccattgccagga

SEQ ID NO: 19948 - DNA, 20 bp, Artificial Sequence
  Synthetic oligonucleotide; CAG chr11 5323959 5323978 5323975 +
gagggaacctgattccacaa

SEQ ID NO: 19949 - DNA, 20 bp, Artificial Sequence
  Synthetic oligonucleotide; AAG chr11 5323963 5323982 5323979 +
gaacctgattccacaacaga

SEQ ID NO: 19950 - DNA, 20 bp, Artificial Sequence
  Synthetic oligonucleotide; AGG chr11 5323964 5323983 5323980 +
aacctgattccacaacagaa

SEQ ID NO: 19951 - DNA, 20 bp, Artificial Sequence
  Synthetic oligonucleotide; GGG chr11 5323965 5323984 5323981 +
acctgattccacaacagaaa

SEQ ID NO: 19952 - DNA, 20 bp, Artificial Sequence
  Synthetic oligonucleotide; GAG chr11 5323967 5323986 5323983 +
ctgattccacaacagaaagg

SEQ ID NO: 19953 - DNA, 20 bp, Artificial Sequence
  Synthetic oligonucleotide; AAG chr11 5323976 5323995 5323992 +
caacagaaagggagtgaata

SEQ ID NO: 19954 - DNA, 20 bp, Artificial Sequence
  Synthetic oligonucleotide; AAG chr11 5323980 5323999 5323996 +
agaaagggagtgaataaagt

SEQ ID NO: 19955 - DNA, 20 bp, Artificial Sequence
  Synthetic oligonucleotide; TAG chr11 5323987 5324006 5324003 +
gagtgaataaagtaagcctg

SEQ ID NO: 19956 - DNA, 20 bp, Artificial Sequence
  Synthetic oligonucleotide; AGG chr11 5323988 5324007 5324004 +
agtgaataaagtaagcctgt

SEQ ID NO: 19957 - DNA, 20 bp, Artificial Sequence
  Synthetic oligonucleotide; AAG chr11 5323991 5324010 5324007 +
gaataaagtaagcctgtagg

SEQ ID NO: 19958 - DNA, 20 bp, Artificial Sequence
  Synthetic oligonucleotide; CAG chr11 5323994 5324013 5324010 +
taaagtaagcctgtaggaag

SEQ ID NO: 19959 - DNA, 20 bp, Artificial Sequence
  Synthetic oligonucleotide; TAG chr11 5324029 5324048 5324045 +
atctccctgtgattcaccca

SEQ ID NO: 19960 - DNA, 20 bp, Artificial Sequence
  Synthetic oligonucleotide; AGG chr11 5324030 5324049 5324046 +
tctccctgtgattcacccat

SEQ ID NO: 19961 - DNA, 20 bp, Artificial Sequence
  Synthetic oligonucleotide; CAG chr11 5324043 5324062 5324059 +
cacccataggatgcccatta

SEQ ID NO: 19962 - DNA, 20 bp, Artificial Sequence
  Synthetic oligonucleotide; TAG chr11 5324046 5324065 5324062 +
ccataggatgcccattacag

SEQ ID NO: 19963 - DNA, 20 bp, Artificial Sequence
  Synthetic oligonucleotide; AGG chr11 5324047 5324066 5324063 +
cataggatgcccattacagt

SEQ ID NO: 19964 - DNA, 20 bp, Artificial Sequence
  Synthetic oligonucleotide; TGG chr11 5324055 5324074 5324071 +
gcccattacagtaggcatcg

SEQ ID NO: 19965 - DNA, 20 bp, Artificial Sequence
  Synthetic oligonucleotide; GAG chr11 5324071 5324090 5324087 +
atcgtggtcaatgtcaccat

SEQ ID NO: 19966 - DNA, 20 bp, Artificial Sequence
  Synthetic oligonucleotide; AGG chr11 5324072 5324091 5324088 +
tcgtggtcaatgtcaccatg

SEQ ID NO: 19967 - DNA, 20 bp, Artificial Sequence
  Synthetic oligonucleotide; CAG chr11 5324086 5324105 5324102 +
accatgaggtctgtgcctgc

SEQ ID NO: 19968 - DNA, 20 bp, Artificial Sequence
  Synthetic oligonucleotide; TGG chr11 5324091 5324110 5324107 +
gaggtctgtgcctgccagca

SEQ ID NO: 19969 - DNA, 20 bp, Artificial Sequence
  Synthetic oligonucleotide; GAG chr11 5324095 5324114 5324111 +
tctgtgcctgccagcatggt

SEQ ID NO: 19970 - DNA, 20 bp, Artificial Sequence
  Synthetic oligonucleotide; AGG chr11 5324096 5324115 5324112 +
ctgtgcctgccagcatggtg

SEQ ID NO: 19971 - DNA, 20 bp, Artificial Sequence
  Synthetic oligonucleotide; AAG chr11 5324099 5324118 5324115 +
tgcctgccagcatggtgagg

SEQ ID NO: 19972 - DNA, 20 bp, Artificial Sequence
  Synthetic oligonucleotide; TAG chr11 5324102 5324121 5324118 +
ctgccagcatggtgaggaag

SEQ ID NO: 19973 - DNA, 20 bp, Artificial Sequence
  Synthetic oligonucleotide; TGG chr11 5324109 5324128 5324125 +
catggtgaggaagtagtaca

SEQ ID NO: 19974 - DNA, 20 bp, Artificial Sequence
  Synthetic oligonucleotide; GGG chr11 5324110 5324129 5324126 +
atggtgaggaagtagtacat

SEQ ID NO: 19975 - DNA, 20 bp, Artificial Sequence
  Synthetic oligonucleotide; AAG chr11 5324119 5324138 5324135 +
aagtagtacatgggctcatg

SEQ ID NO: 19976 - DNA, 20 bp, Artificial Sequence
  Synthetic oligonucleotide; TGG chr11 5324126 5324145 5324142 +
acatgggctcatgaagactg

SEQ ID NO: 19977 - DNA, 20 bp, Artificial Sequence
  Synthetic oligonucleotide; GAG chr11 5324140 5324159 5324156 +
agactgtggtcatgcttgat

SEQ ID NO: 19978 - DNA, 20 bp, Artificial Sequence
  Synthetic oligonucleotide; AGG chr11 5324141 5324160 5324157 +
gactgtggtcatgcttgatg

SEQ ID NO: 19979 - DNA, 20 bp, Artificial Sequence
  Synthetic oligonucleotide; TAG chr11 5324144 5324163 5324160 +
tgtggtcatgcttgatgagg

SEQ ID NO: 19980 - DNA, 20 bp, Artificial Sequence
  Synthetic oligonucleotide; GAG chr11 5324146 5324165 5324162 +
tggtcatgcttgatgaggta

SEQ ID NO: 19981 - DNA, 20 bp, Artificial Sequence
  Synthetic oligonucleotide; AGG chr11 5324147 5324166 5324163 +
ggtcatgcttgatgaggtag

SEQ ID NO: 19982 - DNA, 20 bp, Artificial Sequence
  Synthetic oligonucleotide; GAG chr11 5324149 5324168 5324165 +
tcatgcttgatgaggtagag

SEQ ID NO: 19983 - DNA, 20 bp, Artificial Sequence
  Synthetic oligonucleotide; CAG chr11 5324164 5324183 5324180 +
tagaggagcatgccattgcc

SEQ ID NO: 19984 - DNA, 20 bp, Artificial Sequence
  Synthetic oligonucleotide; AAG chr11 5324167 5324186 5324183 +
aggagcatgccattgcccag

SEQ ID NO: 19985 - DNA, 20 bp, Artificial Sequence
  Synthetic oligonucleotide; AGG chr11 5324168 5324187 5324184 +
ggagcatgccattgcccaga

SEQ ID NO: 19986 - DNA, 20 bp, Artificial Sequence
  Synthetic oligonucleotide; CAG chr11 5324184 5324203 5324200 +
cagaaggatgcacacataaa

SEQ ID NO: 19987 - DNA, 20 bp, Artificial Sequence
  Synthetic oligonucleotide; AAG chr11 5324189 5324208 5324205 +
ggatgcacacataaacagca

SEQ ID NO: 19988 - DNA, 20 bp, Artificial Sequence
  Synthetic oligonucleotide; AAG chr11 5324192 5324211 5324208 +
tgcacacataaacagcaaag

SEQ ID NO: 19989 - DNA, 20 bp, Artificial Sequence
  Synthetic oligonucleotide; AGG chr11 5324193 5324212 5324209 +
gcacacataaacagcaaaga

SEQ ID NO: 19990 - DNA, 20 bp, Artificial Sequence
  Synthetic oligonucleotide; GGG chr11 5324194 5324213 5324210 +
cacacataaacagcaaagaa

SEQ ID NO: 19991 - DNA, 20 bp, Artificial Sequence
  Synthetic oligonucleotide; GGG chr11 5324195 5324214 5324211 +
acacataaacagcaaagaag

SEQ ID NO: 19992 - DNA, 20 bp, Artificial Sequence
  Synthetic oligonucleotide; TGG chr11 5324199 5324218 5324215 +
ataaacagcaaagaagggga

SEQ ID NO: 19993 - DNA, 20 bp, Artificial Sequence
  Synthetic oligonucleotide; GAG chr11 5324201 5324220 5324217 +
aaacagcaaagaaggggatg

SEQ ID NO: 19994 - DNA, 20 bp, Artificial Sequence
  Synthetic oligonucleotide; CAG chr11 5324207 5324226 5324223 +
caaagaaggggatggagatc

SEQ ID NO: 19995 - DNA, 20 bp, Artificial Sequence
  Synthetic oligonucleotide; GAG chr11 5324214 5324233 5324230 +
ggggatggagatccagtgat

SEQ ID NO: 19996 - DNA, 20 bp, Artificial Sequence
  Synthetic oligonucleotide; CAG chr11 5324224 5324243 5324240 +
atccagtgatgagctgcctc

SEQ ID NO: 19997 - DNA, 20 bp, Artificial Sequence
  Synthetic oligonucleotide; TGG chr11 5324230 5324249 5324246 +
tgatgagctgcctccagccc

SEQ ID NO: 19998 - DNA, 20 bp, Artificial Sequence
  Synthetic oligonucleotide; AAG chr11 5324234 5324253 5324250 +
gagctgcctccagccctgga

SEQ ID NO: 19999 - DNA, 20 bp, Artificial Sequence
  Synthetic oligonucleotide; CAG chr11 5324238 5324257 5324254 +
tgcctccagccctggaaagc

SEQ ID NO: 20000 - DNA, 20 bp, Artificial Sequence
  Synthetic oligonucleotide; CAG chr11 5324242 5324261 5324258 +
tccagccctggaaagccagt

SEQ ID NO: 20001 - DNA, 20 bp, Artificial Sequence
  Synthetic oligonucleotide; AAG chr11 5324250 5324269 5324266 +
tggaaagccagtcagcaaaa

SEQ ID NO: 20002 - DNA, 20 bp, Artificial Sequence
  Synthetic oligonucleotide; AGG chr11 5324251 5324270 5324267 +
ggaaagccagtcagcaaaaa

SEQ ID NO: 20003 - DNA, 20 bp, Artificial Sequence
  Synthetic oligonucleotide; GGG chr11 5324252 5324271 5324268 +
gaaagccagtcagcaaaaaa

SEQ ID NO: 20004 - DNA, 20 bp, Artificial Sequence
  Synthetic oligonucleotide; GGG chr11 5324253 5324272 5324269 +
aaagccagtcagcaaaaaag

SEQ ID NO: 20005 - DNA, 20 bp, Artificial Sequence
  Synthetic oligonucleotide; CAG chr11 5324259 5324278 5324275 +
agtcagcaaaaaaggggctg

SEQ ID NO: 20006 - DNA, 20 bp, Artificial Sequence
  Synthetic oligonucleotide; TGG chr11 5324268 5324287 5324284 +
aaaaggggctgcagtaatat

SEQ ID NO: 20007 - DNA, 20 bp, Artificial Sequence
  Synthetic oligonucleotide; GGG chr11 5324269 5324288 5324285 +
aaaggggctgcagtaatatt

SEQ ID NO: 20008 - DNA, 20 bp, Artificial Sequence
  Synthetic oligonucleotide; TAG chr11 5324277 5324296 5324293 +
tgcagtaatattgggccaca

SEQ ID NO: 20009 - DNA, 20 bp, Artificial Sequence
  Synthetic oligonucleotide; CGG chr11 5324289 5324308 5324305 +
gggccacatagtgtatccac

SEQ ID NO: 20010 - DNA, 20 bp, Artificial Sequence
  Synthetic oligonucleotide; AAG chr11 5324294 5324313 5324310 +
acatagtgtatccaccggta

SEQ ID NO: 20011 - DNA, 20 bp, Artificial Sequence
  Synthetic oligonucleotide; CAG chr11 5324299 5324318 5324315 +
gtgtatccaccggtaaagat

SEQ ID NO: 20012 - DNA, 20 bp, Artificial Sequence
  Synthetic oligonucleotide; CAG chr11 5324322 5324341 5324338 +
atttcttgaaaccttgaaac

SEQ ID NO: 20013 - DNA, 20 bp, Artificial Sequence
  Synthetic oligonucleotide; AGG chr11 5324323 5324342 5324339 +
tttcttgaaaccttgaaacc

SEQ ID NO: 20014 - DNA, 20 bp, Artificial Sequence
  Synthetic oligonucleotide; GAG chr11 5324325 5324344 5324341 +
tcttgaaaccttgaaaccag

SEQ ID NO: 20015 - DNA, 20 bp, Artificial Sequence
  Synthetic oligonucleotide; TGG chr11 5324345 5324364 5324361 +
gagcctccaatcttcctgct

SEQ ID NO: 20016 - DNA, 20 bp, Artificial Sequence
  Synthetic oligonucleotide; GAG chr11 5324347 5324366 5324363 +
gcctccaatcttcctgcttg

SEQ ID NO: 20017 - DNA, 20 bp, Artificial Sequence
  Synthetic oligonucleotide; TGG chr11 5324359 5324378 5324375 +
cctgcttggagatgattaac

SEQ ID NO: 20018 - DNA, 20 bp, Artificial Sequence
  Synthetic oligonucleotide; AAG chr11 5324395 5324414 5324411 +
actctgcaactattttcctg

SEQ ID NO: 20019 - DNA, 20 bp, Artificial Sequence
  Synthetic oligonucleotide; AAG chr11 5324398 5324417 5324414 +
ctgcaactattttcctgaag

SEQ ID NO: 20020 - DNA, 20 bp, Artificial Sequence
  Synthetic oligonucleotide; TAG chr11 5324403 5324422 5324419 +
actattttcctgaagaagaa

SEQ ID NO: 20021 - DNA, 20 bp, Artificial Sequence
  Synthetic oligonucleotide; CAG chr11 5324412 5324431 5324428 +
ctgaagaagaatagcatgta

SEQ ID NO: 20022 - DNA, 20 bp, Artificial Sequence
  Synthetic oligonucleotide; TGG chr11 5324419 5324438 5324435 +
agaatagcatgtacagacta

SEQ ID NO: 20023 - DNA, 20 bp, Artificial Sequence
  Synthetic oligonucleotide; TAG chr11 5324435 5324454 5324451 +
actatggttttttccctaat

SEQ ID NO: 20024 - DNA, 20 bp, Artificial Sequence
  Synthetic oligonucleotide; GAG chr11 5324448 5324467 5324464 +
ccctaattagaaaaaatact

SEQ ID NO: 20025 - DNA, 20 bp, Artificial Sequence
  Synthetic oligonucleotide; TGG chr11 5324455 5324474 5324471 +
tagaaaaaatactgagttaa

SEQ ID NO: 20026 - DNA, 20 bp, Artificial Sequence
  Synthetic oligonucleotide; GAG chr11 5324521 5324540 5324537 +
atattatccgcaactatttt

SEQ ID NO: 20027 - DNA, 20 bp, Artificial Sequence
  Synthetic oligonucleotide; AGG chr11 5324522 5324541 5324538 +
tattatccgcaactattttg

SEQ ID NO: 20028 - DNA, 20 bp, Artificial Sequence
  Synthetic oligonucleotide; GGG chr11 5324523 5324542 5324539 +
attatccgcaactattttga

SEQ ID NO: 20029 - DNA, 20 bp, Artificial Sequence
  Synthetic oligonucleotide; CAG chr11 5324548 5324567 5324564 +
cttataaatatttgcaacaa

SEQ ID NO: 20030 - DNA, 20 bp, Artificial Sequence
  Synthetic oligonucleotide; TGG chr11 5324586 5324605 5324602 +
ataacataaatatacataaa

SEQ ID NO: 20031 - DNA, 20 bp, Artificial Sequence
  Synthetic oligonucleotide; TGG chr11 5324598 5324617 5324614 +
tacataaatggataataatc

SEQ ID NO: 20032 - DNA, 20 bp, Artificial Sequence
  Synthetic oligonucleotide; TAG chr11 5324603 5324622 5324619 +
aaatggataataatctggct

SEQ ID NO: 20033 - DNA, 20 bp, Artificial Sequence
  Synthetic oligonucleotide; TGG chr11 5324635 5324654 5324651 +
tgctgtgattactgaccatt

SEQ ID NO: 20034 - DNA, 20 bp, Artificial Sequence
  Synthetic oligonucleotide; AAG chr11 5324676 5324695 5324692 +
tacatttcacgattatgatg

SEQ ID NO: 20035 - DNA, 20 bp, Artificial Sequence
  Synthetic oligonucleotide; CAG chr11 5324680 5324699 5324696 +
tttcacgattatgatgaaga

SEQ ID NO: 20036 - DNA, 20 bp, Artificial Sequence
  Synthetic oligonucleotide; CAG chr11 5324689 5324708 5324705 +
tatgatgaagacagtttttt

SEQ ID NO: 20037 - DNA, 20 bp, Artificial Sequence
  Synthetic oligonucleotide; CAG chr11 5324698 5324717 5324714 +
gacagttttttcagttaatg

SEQ ID NO: 20038 - DNA, 20 bp, Artificial Sequence
  Synthetic oligonucleotide; TGG chr11 5324717 5324736 5324733 +
gcagtttttctcattttttt

SEQ ID NO: 20039 - DNA, 20 bp, Artificial Sequence
  Synthetic oligonucleotide; CAG chr11 5324731 5324750 5324747 +
tttttttggaaattgaatgt

SEQ ID NO: 20040 - DNA, 20 bp, Artificial Sequence
  Synthetic oligonucleotide; TAG chr11 5324748 5324767 5324764 +
tgtcagtgttttatgcacta

SEQ ID NO: 20041 - DNA, 20 bp, Artificial Sequence
  Synthetic oligonucleotide; CGG chr11 5324777 5324796 5324793 +
tcaccatcactaccaatgaa

SEQ ID NO: 20042 - DNA, 20 bp, Artificial Sequence
  Synthetic oligonucleotide; CAG chr11 5324794 5324813 5324810 +
gaacggctttgtcactctaa

SEQ ID NO: 20043 - DNA, 20 bp, Artificial Sequence
  Synthetic oligonucleotide; GAG chr11 5324803 5324822 5324819 +
tgtcactctaacagttactt

SEQ ID NO: 20044 - DNA, 20 bp, Artificial Sequence
  Synthetic oligonucleotide; TGG chr11 5324808 5324827 5324824 +
ctctaacagttacttgagct

SEQ ID NO: 20045 - DNA, 20 bp, Artificial Sequence
  Synthetic oligonucleotide; CAG chr11 5324815 5324834 5324831 +
agttacttgagcttggccac

SEQ ID NO: 20046 - DNA, 20 bp, Artificial Sequence
  Synthetic oligonucleotide; GAG chr11 5324817 5324836 5324833 +
ttacttgagcttggccacca

SEQ ID NO: 20047 - DNA, 20 bp, Artificial Sequence
  Synthetic oligonucleotide; TGG chr11 5324823 5324842 5324839 +
gagcttggccaccagagttg

SEQ ID NO: 20048 - DNA, 20 bp, Artificial Sequence
  Synthetic oligonucleotide; CAG chr11 5324830 5324849 5324846 +
gccaccagagttgtggatca

SEQ ID NO: 20049 - DNA, 20 bp, Artificial Sequence
  Synthetic oligonucleotide; TAG chr11 5324835 5324854 5324851 +
cagagttgtggatcacagac

SEQ ID NO: 20050 - DNA, 20 bp, Artificial Sequence
  Synthetic oligonucleotide; CAG chr11 5324841 5324860 5324857 +
tgtggatcacagactagacg

SEQ ID NO: 20051 - DNA, 20 bp, Artificial Sequence
  Synthetic oligonucleotide; AAG chr11 5324849 5324868 5324865 +
acagactagacgcagctaac

SEQ ID NO: 20052 - DNA, 20 bp, Artificial Sequence
  Synthetic oligonucleotide; CAG chr11 5324852 5324871 5324868 +
gactagacgcagctaacaag

SEQ ID NO: 20053 - DNA, 20 bp, Artificial Sequence
  Synthetic oligonucleotide; CGG chr11 5324855 5324874 5324871 +
tagacgcagctaacaagcag

SEQ ID NO: 20054 - DNA, 20 bp, Artificial Sequence
  Synthetic oligonucleotide; GGG chr11 5324856 5324875 5324872 +
agacgcagctaacaagcagc

SEQ ID NO: 20055 - DNA, 20 bp, Artificial Sequence
  Synthetic oligonucleotide; TAG chr11 5324864 5324883 5324880 +
ctaacaagcagcgggcttgt

SEQ ID NO: 20056 - DNA, 20 bp, Artificial Sequence
  Synthetic oligonucleotide; AGG chr11 5324865 5324884 5324881 +
taacaagcagcgggcttgtt

SEQ ID NO: 20057 - DNA, 20 bp, Artificial Sequence
  Synthetic oligonucleotide; CAG chr11 5324872 5324891 5324888 +
cagcgggcttgttaggcatg

SEQ ID NO: 20058 - DNA, 20 bp, Artificial Sequence
  Synthetic oligonucleotide; CAG chr11 5324878 5324897 5324894 +
gcttgttaggcatgcagcct

SEQ ID NO: 20059 - DNA, 20 bp, Artificial Sequence
  Synthetic oligonucleotide; CAG chr11 5324922 5324941 5324938 +
tgaatcaaattcgctttttt

SEQ ID NO: 20060 - DNA, 20 bp, Artificial Sequence
  Synthetic oligonucleotide; AGG chr11 5324923 5324942 5324939 +
gaatcaaattcgcttttttc

SEQ ID NO: 20061 - DNA, 20 bp, Artificial Sequence
  Synthetic oligonucleotide; CAG chr11 5324930 5324949 5324946 +
attcgcttttttcaggtcct

SEQ ID NO: 20062 - DNA, 20 bp, Artificial Sequence
  Synthetic oligonucleotide; AGG chr11 5324931 5324950 5324947 +
ttcgcttttttcaggtcctc

SEQ ID NO: 20063 - DNA, 20 bp, Artificial Sequence
  Synthetic oligonucleotide; CAG chr11 5324940 5324959 5324956 +
ttcaggtcctcaggtgattc

SEQ ID NO: 20064 - DNA, 20 bp, Artificial Sequence
  Synthetic oligonucleotide; TGG chr11 5324957 5324976 5324973 +
ttccagtgcaaaacaatgtc

SEQ ID NO: 20065 - DNA, 20 bp, Artificial Sequence
  Synthetic oligonucleotide; GGG chr11 5324958 5324977 5324974 +
tccagtgcaaaacaatgtct

SEQ ID NO: 20066 - DNA, 20 bp, Artificial Sequence
  Synthetic oligonucleotide; AAG chr11 5324973 5324992 5324989 +
tgtctgggcatcactgctat

SEQ ID NO: 20067 - DNA, 20 bp, Artificial Sequence
  Synthetic oligonucleotide; GAG chr11 5325000 5325019 5325016 +
tcatacctaatccatctttc

SEQ ID NO: 20068 - DNA, 20 bp, Artificial Sequence
  Synthetic oligonucleotide; TAG chr11 5325004 5325023 5325020 +
acctaatccatctttcgaga

SEQ ID NO: 20069 - DNA, 20 bp, Artificial Sequence
  Synthetic oligonucleotide; CAG chr11 5325028 5325047 5325044 +
aaccttttaatgcttccatc

SEQ ID NO: 20070 - DNA, 20 bp, Artificial Sequence
  Synthetic oligonucleotide; TGG chr11 5325098 5325117 5325114 +
atgtttctttcaccatttac

SEQ ID NO: 20071 - DNA, 20 bp, Artificial Sequence
  Synthetic oligonucleotide; TAG chr11 5325153 5325172 5325169 +
atttcccataattaaatact

SEQ ID NO: 20072 - DNA, 20 bp, Artificial Sequence
  Synthetic oligonucleotide; TGG chr11 5325157 5325176 5325173 +
cccataattaaatacttagc

SEQ ID NO: 20073 - DNA, 20 bp, Artificial Sequence
  Synthetic oligonucleotide; GAG chr11 5325210 5325229 5325226 +
tccatcaactccaaactcct

SEQ ID NO: 20074 - DNA, 20 bp, Artificial Sequence
  Synthetic oligonucleotide; AGG chr11 5325211 5325230 5325227 +
ccatcaactccaaactcctg

SEQ ID NO: 20075 - DNA, 20 bp, Artificial Sequence
  Synthetic oligonucleotide; CAG chr11 5325222 5325241 5325238 +
aaactcctgaggaactgttg

SEQ ID NO: 20076 - DNA, 20 bp, Artificial Sequence
  Synthetic oligonucleotide; CAG chr11 5325233 5325252 5325249 +
gaactgttgcagttctgtaa

SEQ ID NO: 20077 - DNA, 20 bp, Artificial Sequence
  Synthetic oligonucleotide; AGG chr11 5325234 5325253 5325250 +
aactgttgcagttctgtaac

SEQ ID NO: 20078 - DNA, 20 bp, Artificial Sequence
  Synthetic oligonucleotide; CAG chr11 5325256 5325275 5325272 +
gtaaaattataatgtttcca

SEQ ID NO: 20079 - DNA, 20 bp, Artificial Sequence
  Synthetic oligonucleotide; AAG chr11 5325262 5325281 5325278 +
ttataatgtttccacagcct

SEQ ID NO: 20080 - DNA, 20 bp, Artificial Sequence
  Synthetic oligonucleotide; AGG chr11 5325263 5325282 5325279 +
tataatgtttccacagccta

SEQ ID NO: 20081 - DNA, 20 bp, Artificial Sequence
  Synthetic oligonucleotide; CAG chr11 5325270 5325289 5325286 +
tttccacagcctaaggatgc

SEQ ID NO: 20082 - DNA, 20 bp, Artificial Sequence
  Synthetic oligonucleotide; TGG chr11 5325297 5325316 5325313 +
cactactgtttctgttttct

SEQ ID NO: 20083 - DNA, 20 bp, Artificial Sequence
  Synthetic oligonucleotide; AAG chr11 5325312 5325331 5325328 +
tttcttggttgccacgatcc

SEQ ID NO: 20084 - DNA, 20 bp, Artificial Sequence
  Synthetic oligonucleotide; GAG chr11 5325314 5325333 5325330 +
tcttggttgccacgatccaa

SEQ ID NO: 20085 - DNA, 20 bp, Artificial Sequence
  Synthetic oligonucleotide; AGG chr11 5325315 5325334 5325331 +
cttggttgccacgatccaag

SEQ ID NO: 20086 - DNA, 20 bp, Artificial Sequence
  Synthetic oligonucleotide; GGG chr11 5325316 5325335 5325332 +
ttggttgccacgatccaaga

SEQ ID NO: 20087 - DNA, 20 bp, Artificial Sequence
  Synthetic oligonucleotide; GGG chr11 5325317 5325336 5325333 +
tggttgccacgatccaagag

SEQ ID NO: 20088 - DNA, 20 bp, Artificial Sequence
  Synthetic oligonucleotide; TGG chr11 5325322 5325341 5325338 +
gccacgatccaagaggggta

SEQ ID NO: 20089 - DNA, 20 bp, Artificial Sequence
  Synthetic oligonucleotide; GGG chr11 5325323 5325342 5325339 +
ccacgatccaagaggggtat

SEQ ID NO: 20090 - DNA, 20 bp, Artificial Sequence
  Synthetic oligonucleotide; GAG chr11 5325325 5325344 5325341 +
acgatccaagaggggtatgg

SEQ ID NO: 20091 - DNA, 20 bp, Artificial Sequence
  Synthetic oligonucleotide; AAG chr11 5325329 5325348 5325345 +
tccaagaggggtatgggaga

SEQ ID NO: 20092 - DNA, 20 bp, Artificial Sequence
  Synthetic oligonucleotide; AAG chr11 5325332 5325351 5325348 +
aagaggggtatgggagaaag

SEQ ID NO: 20093 - DNA, 20 bp, Artificial Sequence
  Synthetic oligonucleotide; AAG chr11 5325335 5325354 5325351 +
aggggtatgggagaaagaag

SEQ ID NO: 20094 - DNA, 20 bp, Artificial Sequence
  Synthetic oligonucleotide; CAG chr11 5325346 5325365 5325362 +
agaaagaagaagcttattac

SEQ ID NO: 20095 - DNA, 20 bp, Artificial Sequence
  Synthetic oligonucleotide; CAG chr11 5325357 5325376 5325373 +
gcttattaccagctctgctg

SEQ ID NO: 20096 - DNA, 20 bp, Artificial Sequence
  Synthetic oligonucleotide; GAG chr11 5325371 5325390 5325387 +
ctgctgcagtcttatttaac

SEQ ID NO: 20097 - DNA, 20 bp, Artificial Sequence
  Synthetic oligonucleotide; CAG chr11 5325379 5325398 5325395 +
gtcttatttaacgagaaatt

SEQ ID NO: 20098 - DNA, 20 bp, Artificial Sequence
  Synthetic oligonucleotide; TGG chr11 5325387 5325406 5325403 +
taacgagaaattcagaatcc

SEQ ID NO: 20099 - DNA, 20 bp, Artificial Sequence
  Synthetic oligonucleotide; GAG chr11 5325389 5325408 5325405 +
acgagaaattcagaatcctg

SEQ ID NO: 20100 - DNA, 20 bp, Artificial Sequence
  Synthetic oligonucleotide; AGG chr11 5325390 5325409 5325406 +
cgagaaattcagaatcctgg

SEQ ID NO: 20101 - DNA, 20 bp, Artificial Sequence
  Synthetic oligonucleotide; AAG chr11 5325394 5325413 5325410 +
aaattcagaatcctggaggc

SEQ ID NO: 20102 - DNA, 20 bp, Artificial Sequence
  Synthetic oligonucleotide; TAG chr11 5325401 5325420 5325417 +
gaatcctggaggcaagtctt

SEQ ID NO: 20103 - DNA, 20 bp, Artificial Sequence
  Synthetic oligonucleotide; TAG chr11 5325408 5325427 5325424 +
ggaggcaagtctttagcacc

SEQ ID NO: 20104 - DNA, 20 bp, Artificial Sequence
  Synthetic oligonucleotide; CAG chr11 5325411 5325430 5325427 +
ggcaagtctttagcacctag

SEQ ID NO: 20105 - DNA, 20 bp, Artificial Sequence
  Synthetic oligonucleotide; TGG chr11 5325428 5325447 5325444 +
tagcagttttcttcataaaa

SEQ ID NO: 20106 - DNA, 20 bp, Artificial Sequence
  Synthetic oligonucleotide; CAG chr11 5325434 5325453 5325450 +
ttttcttcataaaatggcct

SEQ ID NO: 20107 - DNA, 20 bp, Artificial Sequence
  Synthetic oligonucleotide; CAG chr11 5325451 5325470 5325467 +
cctcagtatcaaaaataaat

SEQ ID NO: 20108 - DNA, 20 bp, Artificial Sequence
  Synthetic oligonucleotide; CAG chr11 5325457 5325476 5325473 +
tatcaaaaataaatcagaat

SEQ ID NO: 20109 - DNA, 20 bp, Artificial Sequence
  Synthetic oligonucleotide; AAG chr11 5325460 5325479 5325476 +
caaaaataaatcagaatcag

SEQ ID NO: 20110 - DNA, 20 bp, Artificial Sequence
  Synthetic oligonucleotide; AAG chr11 5325471 5325490 5325487 +
cagaatcagaagaaatcaca

SEQ ID NO: 20111 - DNA, 20 bp, Artificial Sequence
  Synthetic oligonucleotide; AAG chr11 5325489 5325508 5325505 +
caaagcatttcatattgtat

SEQ ID NO: 20112 - DNA, 20 bp, Artificial Sequence
  Synthetic oligonucleotide; AGG chr11 5325490 5325509 5325506 +
aaagcatttcatattgtata

SEQ ID NO: 20113 - DNA, 20 bp, Artificial Sequence
  Synthetic oligonucleotide; CAG chr11 5325518 5325537 5325534 +
ttctgatgctacctctgtat

SEQ ID NO: 20114 - DNA, 20 bp, Artificial Sequence
  Synthetic oligonucleotide; GAG chr11 5325528 5325547 5325544 +
acctctgtatcagctcctgt

SEQ ID NO: 20115 - DNA, 20 bp, Artificial Sequence
  Synthetic oligonucleotide; CAG chr11 5325532 5325551 5325548 +
ctgtatcagctcctgtgagt

SEQ ID NO: 20116 - DNA, 20 bp, Artificial Sequence
  Synthetic oligonucleotide; AGG chr11 5325533 5325552 5325549 +
tgtatcagctcctgtgagtc

SEQ ID NO: 20117 - DNA, 20 bp, Artificial Sequence
  Synthetic oligonucleotide; GAG chr11 5325550 5325569 5325566 +
gtcaggattactaacttact

SEQ ID NO: 20118 - DNA, 20 bp, Artificial Sequence
  Synthetic oligonucleotide; TAG chr11 5325570 5325589 5325586 +
gagattgaaatcaccaacac

SEQ ID NO: 20119 - DNA, 20 bp, Artificial Sequence
  Synthetic oligonucleotide; AGG chr11 5325571 5325590 5325587 +
agattgaaatcaccaacact

SEQ ID NO: 20120 - DNA, 20 bp, Artificial Sequence
  Synthetic oligonucleotide; GGG chr11 5325572 5325591 5325588 +
gattgaaatcaccaacacta

SEQ ID NO: 20121 - DNA, 20 bp, Artificial Sequence
  Synthetic oligonucleotide; TAG chr11 5325607 5325626 5325623 +
taaatcacattgaattcata

SEQ ID NO: 20122 - DNA, 20 bp, Artificial Sequence
  Synthetic oligonucleotide; AAG chr11 5325610 5325629 5325626 +
atcacattgaattcatatag

SEQ ID NO: 20123 - DNA, 20 bp, Artificial Sequence
  Synthetic oligonucleotide; AAG chr11 5325654 5325673 5325670 +
aaatgttgttctaccttcga

SEQ ID NO: 20124 - DNA, 20 bp, Artificial Sequence
  Synthetic oligonucleotide; CAG chr11 5325677 5325696 5325693 +
atccttcatgcttaaaaaca

SEQ ID NO: 20125 - DNA, 20 bp, Artificial Sequence
  Synthetic oligonucleotide; GAG chr11 5325683 5325702 5325699 +
catgcttaaaaacacagatt

SEQ ID NO: 20126 - DNA, 20 bp, Artificial Sequence
  Synthetic oligonucleotide; AGG chr11 5325684 5325703 5325700 +
atgcttaaaaacacagattg

SEQ ID NO: 20127 - DNA, 20 bp, Artificial Sequence
  Synthetic oligonucleotide; AAG chr11 5325690 5325709 5325706 +
aaaaacacagattgaggaat

SEQ ID NO: 20128 - DNA, 20 bp, Artificial Sequence
  Synthetic oligonucleotide; GAG chr11 5325692 5325711 5325708 +
aaacacagattgaggaataa

SEQ ID NO: 20129 - DNA, 20 bp, Artificial Sequence
  Synthetic oligonucleotide; AGG chr11 5325693 5325712 5325709 +
aacacagattgaggaataag

SEQ ID NO: 20130 - DNA, 20 bp, Artificial Sequence
  Synthetic oligonucleotide; CGG chr11 5325701 5325720 5325717 +
ttgaggaataagaggatgta

SEQ ID NO: 20131 - DNA, 20 bp, Artificial Sequence
  Synthetic oligonucleotide; GAG chr11 5325707 5325726 5325723 +
aataagaggatgtacggaat

SEQ ID NO: 20132 - DNA, 20 bp, Artificial Sequence
  Synthetic oligonucleotide; AGG chr11 5325708 5325727 5325724 +
ataagaggatgtacggaatg

SEQ ID NO: 20133 - DNA, 20 bp, Artificial Sequence
  Synthetic oligonucleotide; TAG chr11 5325713 5325732 5325729 +
aggatgtacggaatgaggta

SEQ ID NO: 20134 - DNA, 20 bp, Artificial Sequence
  Synthetic oligonucleotide; AGG chr11 5325714 5325733 5325730 +
ggatgtacggaatgaggtat

SEQ ID NO: 20135 - DNA, 20 bp, Artificial Sequence
  Synthetic oligonucleotide; GAG chr11 5325716 5325735 5325732 +
atgtacggaatgaggtatag

SEQ ID NO: 20136 - DNA, 20 bp, Artificial Sequence
  Synthetic oligonucleotide; AGG chr11 5325717 5325736 5325733 +
tgtacggaatgaggtatagg

SEQ ID NO: 20137 - DNA, 20 bp, Artificial Sequence
  Synthetic oligonucleotide; AAG chr11 5325720 5325739 5325736 +
acggaatgaggtataggagg

SEQ ID NO: 20138 - DNA, 20 bp, Artificial Sequence
  Synthetic oligonucleotide; GAG chr11 5325722 5325741 5325738 +
ggaatgaggtataggaggaa

SEQ ID NO: 20139 - DNA, 20 bp, Artificial Sequence
  Synthetic oligonucleotide; TGG chr11 5325727 5325746 5325743 +
gaggtataggaggaagagaa

SEQ ID NO: 20140 - DNA, 20 bp, Artificial Sequence
  Synthetic oligonucleotide; CAG chr11 5325730 5325749 5325746 +
gtataggaggaagagaatgg

SEQ ID NO: 20141 - DNA, 20 bp, Artificial Sequence
  Synthetic oligonucleotide; TAG chr11 5325735 5325754 5325751 +
ggaggaagagaatggcagat

SEQ ID NO: 20142 - DNA, 20 bp, Artificial Sequence
  Synthetic oligonucleotide; GAG chr11 5325737 5325756 5325753 +
aggaagagaatggcagatta

SEQ ID NO: 20143 - DNA, 20 bp, Artificial Sequence
  Synthetic oligonucleotide; AAG chr11 5325741 5325760 5325757 +
agagaatggcagattagaga

SEQ ID NO: 20144 - DNA, 20 bp, Artificial Sequence
  Synthetic oligonucleotide; AGG chr11 5325742 5325761 5325758 +
gagaatggcagattagagaa

SEQ ID NO: 20145 - DNA, 20 bp, Artificial Sequence
  Synthetic oligonucleotide; TGG chr11 5325751 5325770 5325767 +
agattagagaaaggacaaat

SEQ ID NO: 20146 - DNA, 20 bp, Artificial Sequence
  Synthetic oligonucleotide; AAG chr11 5325768 5325787 5325784 +
aattggtgacacatattctg

SEQ ID NO: 20147 - DNA, 20 bp, Artificial Sequence
  Synthetic oligonucleotide; AGG chr11 5325769 5325788 5325785 +
attggtgacacatattctga

SEQ ID NO: 20148 - DNA, 20 bp, Artificial Sequence
  Synthetic oligonucleotide; GGG chr11 5325770 5325789 5325786 +
ttggtgacacatattctgaa

SEQ ID NO: 20149 - DNA, 20 bp, Artificial Sequence
  Synthetic oligonucleotide; TAG chr11 5325779 5325798 5325795 +
catattctgaagggtaaaca

SEQ ID NO: 20150 - DNA, 20 bp, Artificial Sequence
  Synthetic oligonucleotide; AAG chr11 5325782 5325801 5325798 +
attctgaagggtaaacatag

SEQ ID NO: 20151 - DNA, 20 bp, Artificial Sequence
  Synthetic oligonucleotide; AAG chr11 5325786 5325805 5325802 +
tgaagggtaaacatagaaga

SEQ ID NO: 20152 - DNA, 20 bp, Artificial Sequence
  Synthetic oligonucleotide; AAG chr11 5325813 5325832 5325829 +
attaaaattttttttaatta

SEQ ID NO: 20153 - DNA, 20 bp, Artificial Sequence
  Synthetic oligonucleotide; AAG chr11 5325850 5325869 5325866 +
aaaaataaaaaatttttaaa

SEQ ID NO: 20154 - DNA, 20 bp, Artificial Sequence
  Synthetic oligonucleotide; AAG chr11 5325854 5325873 5325870 +
ataaaaaatttttaaaaaga

SEQ ID NO: 20155 - DNA, 20 bp, Artificial Sequence
  Synthetic oligonucleotide; TGG chr11 5325867 5325886 5325883 +
aaaaagaaagccataaaatc

SEQ ID NO: 20156 - DNA, 20 bp, Artificial Sequence
  Synthetic oligonucleotide; GGG chr11 5325868 5325887 5325884 +
aaaagaaagccataaaatct

SEQ ID NO: 20157 - DNA, 20 bp, Artificial Sequence
  Synthetic oligonucleotide; AAG chr11 5325893 5325912 5325909 +
tcctttaaaaaaaattgtgt

SEQ ID NO: 20158 - DNA, 20 bp, Artificial Sequence
  Synthetic oligonucleotide; AGG chr11 5325894 5325913 5325910 +
cctttaaaaaaaattgtgta

SEQ ID NO: 20159 - DNA, 20 bp, Artificial Sequence
  Synthetic oligonucleotide; TAG chr11 5325904 5325923 5325920 +
aaattgtgtaaggatcaaac

SEQ ID NO: 20160 - DNA, 20 bp, Artificial Sequence
  Synthetic oligonucleotide; CAG chr11 5325912 5325931 5325928 +
taaggatcaaactagatttc

SEQ ID NO: 20161 - DNA, 20 bp, Artificial Sequence
  Synthetic oligonucleotide; GAG chr11 5325914 5325933 5325930 +
aggatcaaactagatttcca

SEQ ID NO: 20162 - DNA, 20 bp, Artificial Sequence
  Synthetic oligonucleotide; AAG chr11 5325920 5325939 5325936 +
aaactagatttccagagcac

SEQ ID NO: 20163 - DNA, 20 bp, Artificial Sequence
  Synthetic oligonucleotide; GAG chr11 5325942 5325961 5325958 +
gtactttttaaaatgtttgt

SEQ ID NO: 20164 - DNA, 20 bp, Artificial Sequence
  Synthetic oligonucleotide; TAG chr11 5325972 5325991 5325988 +
ttaaaaaacaataacgtctt

SEQ ID NO: 20165 - DNA, 20 bp, Artificial Sequence
  Synthetic oligonucleotide; GAG chr11 5325974 5325993 5325990 +
aaaaaacaataacgtcttta

SEQ ID NO: 20166 - DNA, 20 bp, Artificial Sequence
  Synthetic oligonucleotide; TGG chr11 5325981 5326000 5325997 +
aataacgtctttagagaaat

SEQ ID NO: 20167 - DNA, 20 bp, Artificial Sequence
  Synthetic oligonucleotide; AAG chr11 5326007 5326026 5326023 +
taaaacacttgaaaccaaaa

SEQ ID NO: 20168 - DNA, 20 bp, Artificial Sequence
  Synthetic oligonucleotide; AAG chr11 5326011 5326030 5326027 +
acacttgaaaccaaaaaaga

SEQ ID NO: 20169 - DNA, 20 bp, Artificial Sequence
  Synthetic oligonucleotide; GAG chr11 5326031 5326050 5326047 +
aagttttttattatatttat

SEQ ID NO: 20170 - DNA, 20 bp, Artificial Sequence
  Synthetic oligonucleotide; CAG chr11 5326034 5326053 5326050 +
ttttttattatatttatgag

SEQ ID NO: 20171 - DNA, 20 bp, Artificial Sequence
  Synthetic oligonucleotide; CAG chr11 5326050 5326069 5326066 +
tgagcagaaaaaaatgttta

SEQ ID NO: 20172 - DNA, 20 bp, Artificial Sequence
  Synthetic oligonucleotide; AAG chr11 5326073 5326092 5326089 +
tcatatctccctccatctct

SEQ ID NO: 20173 - DNA, 20 bp, Artificial Sequence
  Synthetic oligonucleotide; TGG chr11 5326078 5326097 5326094 +
tctccctccatctctaagct

SEQ ID NO: 20174 - DNA, 20 bp, Artificial Sequence
  Synthetic oligonucleotide; GGG chr11 5326079 5326098 5326095 +
ctccctccatctctaagctt

SEQ ID NO: 20175 - DNA, 20 bp, Artificial Sequence
  Synthetic oligonucleotide; AAG chr11 5326089 5326108 5326105 +
ctctaagcttgggtcattaa

SEQ ID NO: 20176 - DNA, 20 bp, Artificial Sequence
  Synthetic oligonucleotide; AAG chr11 5326093 5326112 5326109 +
aagcttgggtcattaaaagt

SEQ ID NO: 20177 - DNA, 20 bp, Artificial Sequence
  Synthetic oligonucleotide; CAG chr11 5326097 5326116 5326113 +
ttgggtcattaaaagtaaga

SEQ ID NO: 20178 - DNA, 20 bp, Artificial Sequence
  Synthetic oligonucleotide; AGG chr11 5326098 5326117 5326114 +
tgggtcattaaaagtaagac

SEQ ID NO: 20179 - DNA, 20 bp, Artificial Sequence
  Synthetic oligonucleotide; GGG chr11 5326099 5326118 5326115 +
gggtcattaaaagtaagaca

SEQ ID NO: 20180 - DNA, 20 bp, Artificial Sequence
  Synthetic oligonucleotide; AAG chr11 5326102 5326121 5326118 +
tcattaaaagtaagacaggg

SEQ ID NO: 20181 - DNA, 20 bp, Artificial Sequence
  Synthetic oligonucleotide; AGG chr11 5326103 5326122 5326119 +
cattaaaagtaagacaggga

SEQ ID NO: 20182 - DNA, 20 bp, Artificial Sequence
  Synthetic oligonucleotide; TGG chr11 5326109 5326128 5326125 +
aagtaagacagggaaggtta

SEQ ID NO: 20183 - DNA, 20 bp, Artificial Sequence
  Synthetic oligonucleotide; AAG chr11 5326119 5326138 5326135 +
gggaaggttatggtacctca

SEQ ID NO: 20184 - DNA, 20 bp, Artificial Sequence
  Synthetic oligonucleotide; AAG chr11 5326129 5326148 5326145 +
tggtacctcaaagaaaatga

SEQ ID NO: 20185 - DNA, 20 bp, Artificial Sequence
  Synthetic oligonucleotide; AGG chr11 5326130 5326149 5326146 +
ggtacctcaaagaaaatgaa

SEQ ID NO: 20186 - DNA, 20 bp, Artificial Sequence
  Synthetic oligonucleotide; GAG chr11 5326145 5326164 5326161 +
atgaaaggtaaatcatgtct

SEQ ID NO: 20187 - DNA, 20 bp, Artificial Sequence
  Synthetic oligonucleotide; TGG chr11 5326152 5326171 5326168 +
gtaaatcatgtctgagattt

SEQ ID NO: 20188 - DNA, 20 bp, Artificial Sequence
  Synthetic oligonucleotide; GGG chr11 5326153 5326172 5326169 +
taaatcatgtctgagatttt

SEQ ID NO: 20189 - DNA, 20 bp, Artificial Sequence
  Synthetic oligonucleotide; AAG chr11 5326162 5326181 5326178 +
tctgagattttgggaataaa

SEQ ID NO: 20190 - DNA, 20 bp, Artificial Sequence
  Synthetic oligonucleotide; AAG chr11 5326173 5326192 5326189 +
gggaataaaaagaaacacaa

SEQ ID NO: 20191 - DNA, 20 bp, Artificial Sequence
  Synthetic oligonucleotide; AAG chr11 5326176 5326195 5326192 +
aataaaaagaaacacaaaag

SEQ ID NO: 20192 - DNA, 20 bp, Artificial Sequence
  Synthetic oligonucleotide; TGG chr11 5326191 5326210 5326207 +
aaaagaagcctgcccaacac

SEQ ID NO: 20193 - DNA, 20 bp, Artificial Sequence
  Synthetic oligonucleotide; GGG chr11 5326192 5326211 5326208 +
aaagaagcctgcccaacact

SEQ ID NO: 20194 - DNA, 20 bp, Artificial Sequence
  Synthetic oligonucleotide; AAG chr11 5326195 5326214 5326211 +
gaagcctgcccaacactggg

SEQ ID NO: 20195 - DNA, 20 bp, Artificial Sequence
  Synthetic oligonucleotide; CAG chr11 5326213 5326232 5326229 +
ggaagccgttgatatttacc

SEQ ID NO: 20196 - DNA, 20 bp, Artificial Sequence
  Synthetic oligonucleotide; GAG chr11 5326215 5326234 5326231 +
aagccgttgatatttaccca

SEQ ID NO: 20197 - DNA, 20 bp, Artificial Sequence
  Synthetic oligonucleotide; AGG chr11 5326216 5326235 5326232 +
agccgttgatatttacccag

SEQ ID NO: 20198 - DNA, 20 bp, Artificial Sequence
  Synthetic oligonucleotide; CAG chr11 5326219 5326238 5326235 +
cgttgatatttacccagagg

SEQ ID NO: 20199 - DNA, 20 bp, Artificial Sequence
  Synthetic oligonucleotide; AGG chr11 5326220 5326239 5326236 +
gttgatatttacccagaggc

SEQ ID NO: 20200 - DNA, 20 bp, Artificial Sequence
  Synthetic oligonucleotide; TGG chr11 5326227 5326246 5326243 +
tttacccagaggcaggcgtg

SEQ ID NO: 20201 - DNA, 20 bp, Artificial Sequence
  Synthetic oligonucleotide; GGG chr11 5326228 5326247 5326244 +
ttacccagaggcaggcgtgt

SEQ ID NO: 20202 - DNA, 20 bp, Artificial Sequence
  Synthetic oligonucleotide; GGG chr11 5326229 5326248 5326245 +
tacccagaggcaggcgtgtg

SEQ ID NO: 20203 - DNA, 20 bp, Artificial Sequence
  Synthetic oligonucleotide; TAG chr11 5326236 5326255 5326252 +
aggcaggcgtgtggggattc

SEQ ID NO: 20204 - DNA, 20 bp, Artificial Sequence
  Synthetic oligonucleotide; AGG chr11 5326237 5326256 5326253 +
ggcaggcgtgtggggattct

SEQ ID NO: 20205 - DNA, 20 bp, Artificial Sequence
  Synthetic oligonucleotide; GAG chr11 5326239 5326258 5326255 +
caggcgtgtggggattctag

SEQ ID NO: 20206 - DNA, 20 bp, Artificial Sequence
  Synthetic oligonucleotide; GAG chr11 5326241 5326260 5326257 +
ggcgtgtggggattctagga

SEQ ID NO: 20207 - DNA, 20 bp, Artificial Sequence
  Synthetic oligonucleotide; TAG chr11 5326245 5326264 5326261 +
tgtggggattctaggagagc

SEQ ID NO: 20208 - DNA, 20 bp, Artificial Sequence
  Synthetic oligonucleotide; GAG chr11 5326264 5326283 5326280 +
ctagatactgtcatcaaact

SEQ ID NO: 20209 - DNA, 20 bp, Artificial Sequence
  Synthetic oligonucleotide; AGG chr11 5326265 5326284 5326281 +
tagatactgtcatcaaactg

SEQ ID NO: 20210 - DNA, 20 bp, Artificial Sequence
  Synthetic oligonucleotide; AAG chr11 5326276 5326295 5326292 +
atcaaactgaggcccactat

SEQ ID NO: 20211 - DNA, 20 bp, Artificial Sequence
  Synthetic oligonucleotide; CAG chr11 5326279 5326298 5326295 +
aaactgaggcccactataag

SEQ ID NO: 20212 - DNA, 20 bp, Artificial Sequence
  Synthetic oligonucleotide; CAG chr11 5326288 5326307 5326304 +
cccactataagcagtgtcac

SEQ ID NO: 20213 - DNA, 20 bp, Artificial Sequence
  Synthetic oligonucleotide; GAG chr11 5326290 5326309 5326306 +
cactataagcagtgtcacca

SEQ ID NO: 20214 - DNA, 20 bp, Artificial Sequence
  Synthetic oligonucleotide; AAG chr11 5326296 5326315 5326312 +
aagcagtgtcaccagagatg

SEQ ID NO: 20215 - DNA, 20 bp, Artificial Sequence
  Synthetic oligonucleotide; AAG chr11 5326320 5326339 5326336 +
catactgtatgcatgctccc

SEQ ID NO: 20216 - DNA, 20 bp, Artificial Sequence
  Synthetic oligonucleotide; AGG chr11 5326321 5326340 5326337 +
atactgtatgcatgctccca

SEQ ID NO: 20217 - DNA, 20 bp, Artificial Sequence
  Synthetic oligonucleotide; TGG chr11 5326334 5326353 5326350 +
gctcccaaggctgcactatg

SEQ ID NO: 20218 - DNA, 20 bp, Artificial Sequence
  Synthetic oligonucleotide; CAG chr11 5326349 5326368 5326365 +
ctatgtggcaaaattccatt

SEQ ID NO: 20219 - DNA, 20 bp, Artificial Sequence
  Synthetic oligonucleotide; TGG chr11 5326353 5326372 5326369 +
gtggcaaaattccattcaga

SEQ ID NO: 20220 - DNA, 20 bp, Artificial Sequence
  Synthetic oligonucleotide; TAG chr11 5326358 5326377 5326374 +
aaaattccattcagatggct

SEQ ID NO: 20221 - DNA, 20 bp, Artificial Sequence
  Synthetic oligonucleotide; AAG chr11 5326369 5326388 5326385 +
cagatggcttagctattaac

SEQ ID NO: 20222 - DNA, 20 bp, Artificial Sequence
  Synthetic oligonucleotide; AAG chr11 5326376 5326395 5326392 +
cttagctattaacaagtgtt

SEQ ID NO: 20223 - DNA, 20 bp, Artificial Sequence
  Synthetic oligonucleotide; TAG chr11 5326389 5326408 5326405 +
aagtgttaagaaaattatac

SEQ ID NO: 20224 - DNA, 20 bp, Artificial Sequence
  Synthetic oligonucleotide; AAG chr11 5326392 5326411 5326408 +
tgttaagaaaattatactag

SEQ ID NO: 20225 - DNA, 20 bp, Artificial Sequence
  Synthetic oligonucleotide; AAG chr11 5326398 5326417 5326414 +
gaaaattatactagaagcac

SEQ ID NO: 20226 - DNA, 20 bp, Artificial Sequence
  Synthetic oligonucleotide; TAG chr11 5326404 5326423 5326420 +
tatactagaagcacaagaac

SEQ ID NO: 20227 - DNA, 20 bp, Artificial Sequence
  Synthetic oligonucleotide; TGG chr11 5326413 5326432 5326429 +
agcacaagaactagtttttc

SEQ ID NO: 20228 - DNA, 20 bp, Artificial Sequence
  Synthetic oligonucleotide; AAG chr11 5326419 5326438 5326435 +
agaactagtttttctggata

SEQ ID NO: 20229 - DNA, 20 bp, Artificial Sequence
  Synthetic oligonucleotide; AGG chr11 5326420 5326439 5326436 +
gaactagtttttctggataa

SEQ ID NO: 20230 - DNA, 20 bp, Artificial Sequence
  Synthetic oligonucleotide; TGG chr11 5326423 5326442 5326439 +
ctagtttttctggataaagg

SEQ ID NO: 20231 - DNA, 20 bp, Artificial Sequence
  Synthetic oligonucleotide; GAG chr11 5326425 5326444 5326441 +
agtttttctggataaaggtg

SEQ ID NO: 20232 - DNA, 20 bp, Artificial Sequence
  Synthetic oligonucleotide; CAG chr11 5326428 5326447 5326444 +
ttttctggataaaggtggag

SEQ ID NO: 20233 - DNA, 20 bp, Artificial Sequence
  Synthetic oligonucleotide; TGG chr11 5326434 5326453 5326450 +
ggataaaggtggagcagcta

SEQ ID NO: 20234 - DNA, 20 bp, Artificial Sequence
  Synthetic oligonucleotide; TAG chr11 5326449 5326468 5326465 +
agctatggctgtgaaattga

SEQ ID NO: 20235 - DNA, 20 bp, Artificial Sequence
  Synthetic oligonucleotide; AGG chr11 5326450 5326469 5326466 +
gctatggctgtgaaattgat

SEQ ID NO: 20236 - DNA, 20 bp, Artificial Sequence
  Synthetic oligonucleotide; CAG chr11 5326453 5326472 5326469 +
atggctgtgaaattgatagg

SEQ ID NO: 20237 - DNA, 20 bp, Artificial Sequence
  Synthetic oligonucleotide; CAG chr11 5326465 5326484 5326481 +
ttgataggcagctctcaact

SEQ ID NO: 20238 - DNA, 20 bp, Artificial Sequence
  Synthetic oligonucleotide; TAG chr11 5326480 5326499 5326496 +
caactcagaacataaatgtt

SEQ ID NO: 20239 - DNA, 20 bp, Artificial Sequence
  Synthetic oligonucleotide; AAG chr11 5326492 5326511 5326508 +
taaatgtttagtgatttcct

SEQ ID NO: 20240 - DNA, 20 bp, Artificial Sequence
  Synthetic oligonucleotide; AGG chr11 5326493 5326512 5326509 +
aaatgtttagtgatttccta

SEQ ID NO: 20241 - DNA, 20 bp, Artificial Sequence
  Synthetic oligonucleotide; TGG chr11 5326499 5326518 5326515 +
ttagtgatttcctaaggatc

SEQ ID NO: 20242 - DNA, 20 bp, Artificial Sequence
  Synthetic oligonucleotide; GGG chr11 5326500 5326519 5326516 +
tagtgatttcctaaggatct

SEQ ID NO: 20243 - DNA, 20 bp, Artificial Sequence
  Synthetic oligonucleotide; GGG chr11 5326501 5326520 5326517 +
agtgatttcctaaggatctg

SEQ ID NO: 20244 - DNA, 20 bp, Artificial Sequence
  Synthetic oligonucleotide; AAG chr11 5326554 5326573 5326570 +
gaactgatatatcatatatg

SEQ ID NO: 20245 - DNA, 20 bp, Artificial Sequence
  Synthetic oligonucleotide; AAG chr11 5326561 5326580 5326577 +
tatatcatatatgaagatat

SEQ ID NO: 20246 - DNA, 20 bp, Artificial Sequence
  Synthetic oligonucleotide; TAG chr11 5326571 5326590 5326587 +
atgaagatataagcaacctg

SEQ ID NO: 20247 - DNA, 20 bp, Artificial Sequence
  Synthetic oligonucleotide; AGG chr11 5326572 5326591 5326588 +
tgaagatataagcaacctgt

SEQ ID NO: 20248 - DNA, 20 bp, Artificial Sequence
  Synthetic oligonucleotide; GAG chr11 5326574 5326593 5326590 +
aagatataagcaacctgtag

SEQ ID NO: 20249 - DNA, 20 bp, Artificial Sequence
  Synthetic oligonucleotide; TGG chr11 5326597 5326616 5326613 +
ctccattcaccaataccatc

SEQ ID NO: 20250 - DNA, 20 bp, Artificial Sequence
  Synthetic oligonucleotide; GGG chr11 5326598 5326617 5326614 +
tccattcaccaataccatct

SEQ ID NO: 20251 - DNA, 20 bp, Artificial Sequence
  Synthetic oligonucleotide; AAG chr11 5326603 5326622 5326619 +
tcaccaataccatctgggac

SEQ ID NO: 20252 - DNA, 20 bp, Artificial Sequence
  Synthetic oligonucleotide; TGG chr11 5326607 5326626 5326623 +
caataccatctgggacaagt

SEQ ID NO: 20253 - DNA, 20 bp, Artificial Sequence
  Synthetic oligonucleotide; GAG chr11 5326624 5326643 5326640 +
agttggaaaatgactatttt

SEQ ID NO: 20254 - DNA, 20 bp, Artificial Sequence
  Synthetic oligonucleotide; CAG chr11 5326628 5326647 5326644 +
ggaaaatgactattttgagt

SEQ ID NO: 20255 - DNA, 20 bp, Artificial Sequence
  Synthetic oligonucleotide; CAG chr11 5326633 5326652 5326649 +
atgactattttgagtcagca

SEQ ID NO: 20256 - DNA, 20 bp, Artificial Sequence
  Synthetic oligonucleotide; TGG chr11 5326639 5326658 5326655 +
attttgagtcagcacagaat

SEQ ID NO: 20257 - DNA, 20 bp, Artificial Sequence
  Synthetic oligonucleotide; GAG chr11 5326643 5326662 5326659 +
tgagtcagcacagaattggt

SEQ ID NO: 20258 - DNA, 20 bp, Artificial Sequence
  Synthetic oligonucleotide; TAG chr11 5326672 5326691 5326688 +
ccacacaactgcactgtgtt

SEQ ID NO: 20259 - DNA, 20 bp, Artificial Sequence
  Synthetic oligonucleotide; AAG chr11 5326694 5326713 5326710 +
gttctaaataaccatgtaat

SEQ ID NO: 20260 - DNA, 20 bp, Artificial Sequence
  Synthetic oligonucleotide; CAG chr11 5326699 5326718 5326715 +
aaataaccatgtaataagca

SEQ ID NO: 20261 - DNA, 20 bp, Artificial Sequence
  Synthetic oligonucleotide; AAG chr11 5326711 5326730 5326727 +
aataagcacagtctgctctt

SEQ ID NO: 20262 - DNA, 20 bp, Artificial Sequence
  Synthetic oligonucleotide; AAG chr11 5326714 5326733 5326730 +
aagcacagtctgctcttaag

SEQ ID NO: 20263 - DNA, 20 bp, Artificial Sequence
  Synthetic oligonucleotide; TGG chr11 5326726 5326745 5326742 +
ctcttaagaagctctcaata

SEQ ID NO: 20264 - DNA, 20 bp, Artificial Sequence
  Synthetic oligonucleotide; GAG chr11 5326734 5326753 5326750 +
aagctctcaatatggcctat

SEQ ID NO: 20265 - DNA, 20 bp, Artificial Sequence
  Synthetic oligonucleotide; TAG chr11 5326744 5326763 5326760 +
tatggcctatgagtttataa

SEQ ID NO: 20266 - DNA, 20 bp, Artificial Sequence
  Synthetic oligonucleotide; CAG chr11 5326775 5326794 5326791 +
attctcccttcaattttatg

SEQ ID NO: 20267 - DNA, 20 bp, Artificial Sequence
  Synthetic oligonucleotide; CAG chr11 5326801 5326820 5326817 +
attgcccttgaatgtctcaa

SEQ ID NO: 20268 - DNA, 20 bp, Artificial Sequence
  Synthetic oligonucleotide; AGG chr11 5326802 5326821 5326818 +
ttgcccttgaatgtctcaac

SEQ ID NO: 20269 - DNA, 20 bp, Artificial Sequence
  Synthetic oligonucleotide; GAG chr11 5326825 5326844 5326841 +
atccataatgctgaaaactt

SEQ ID NO: 20270 - DNA, 20 bp, Artificial Sequence
  Synthetic oligonucleotide; TAG chr11 5326836 5326855 5326852 +
tgaaaacttgagaaaaatca

SEQ ID NO: 20271 - DNA, 20 bp, Artificial Sequence
  Synthetic oligonucleotide; AAG chr11 5326843 5326862 5326859 +
ttgagaaaaatcatagatct

SEQ ID NO: 20272 - DNA, 20 bp, Artificial Sequence
  Synthetic oligonucleotide; TAG chr11 5326859 5326878 5326875 +
atctaagccctgcttcattc

SEQ ID NO: 20273 - DNA, 20 bp, Artificial Sequence
  Synthetic oligonucleotide; TAG chr11 5326870 5326889 5326886 +
gcttcattctagcttcattc

SEQ ID NO: 20274 - DNA, 20 bp, Artificial Sequence
  Synthetic oligonucleotide; TAG chr11 5326912 5326931 5326928 +
ttcacatgatgatatatttc

SEQ ID NO: 20275 - DNA, 20 bp, Artificial Sequence
  Synthetic oligonucleotide; AAG chr11 5326921 5326940 5326937 +
tgatatatttctagatgaat

SEQ ID NO: 20276 - DNA, 20 bp, Artificial Sequence
  Synthetic oligonucleotide; TAG chr11 5326937 5326956 5326953 +
gaataagattcctatacttg

SEQ ID NO: 20277 - DNA, 20 bp, Artificial Sequence
  Synthetic oligonucleotide; AAG chr11 5326953 5326972 5326969 +
cttgtagcaacactctcacc

SEQ ID NO: 20278 - DNA, 20 bp, Artificial Sequence
  Synthetic oligonucleotide; CAG chr11 5326971 5326990 5326987 +
ccaagatgcataaatacata

SEQ ID NO: 20279 - DNA, 20 bp, Artificial Sequence
  Synthetic oligonucleotide; AGG chr11 5326972 5326991 5326988 +
caagatgcataaatacatac

SEQ ID NO: 20280 - DNA, 20 bp, Artificial Sequence
  Synthetic oligonucleotide; TGG chr11 5326979 5326998 5326995 +
cataaatacatacaggtcca

SEQ ID NO: 20281 - DNA, 20 bp, Artificial Sequence
  Synthetic oligonucleotide; AAG chr11 5326986 5327005 5327002 +
acatacaggtccatggaaaa

SEQ ID NO: 20282 - DNA, 20 bp, Artificial Sequence
  Synthetic oligonucleotide; GAG chr11 5327005 5327024 5327021 +
aaagttgtcatgctcacttt

SEQ ID NO: 20283 - DNA, 20 bp, Artificial Sequence
  Synthetic oligonucleotide; CAG chr11 5327027 5327046 5327043 +
gaacataatttgaatgttac

SEQ ID NO: 20284 - DNA, 20 bp, Artificial Sequence
  Synthetic oligonucleotide; AAG chr11 5327034 5327053 5327050 +
atttgaatgttaccagatac

SEQ ID NO: 20285 - DNA, 20 bp, Artificial Sequence
  Synthetic oligonucleotide; AGG chr11 5327035 5327054 5327051 +
tttgaatgttaccagataca

SEQ ID NO: 20286 - DNA, 20 bp, Artificial Sequence
  Synthetic oligonucleotide; GGG chr11 5327036 5327055 5327052 +
ttgaatgttaccagatacaa

SEQ ID NO: 20287 - DNA, 20 bp, Artificial Sequence
  Synthetic oligonucleotide; GAG chr11 5327038 5327057 5327054 +
gaatgttaccagatacaagg

SEQ ID NO: 20288 - DNA, 20 bp, Artificial Sequence
  Synthetic oligonucleotide; AAG chr11 5327043 5327062 5327059 +
ttaccagatacaagggagta

SEQ ID NO: 20289 - DNA, 20 bp, Artificial Sequence
  Synthetic oligonucleotide; AGG chr11 5327044 5327063 5327060 +
taccagatacaagggagtaa

SEQ ID NO: 20290 - DNA, 20 bp, Artificial Sequence
  Synthetic oligonucleotide; GAG chr11 5327046 5327065 5327062 +
ccagatacaagggagtaaag

SEQ ID NO: 20291 - DNA, 20 bp, Artificial Sequence
  Synthetic oligonucleotide; CAG chr11 5327050 5327069 5327066 +
atacaagggagtaaaggaga

SEQ ID NO: 20292 - DNA, 20 bp, Artificial Sequence
  Synthetic oligonucleotide; GAG chr11 5327052 5327071 5327068 +
acaagggagtaaaggagaca

SEQ ID NO: 20293 - DNA, 20 bp, Artificial Sequence
  Synthetic oligonucleotide; AGG chr11 5327053 5327072 5327069 +
caagggagtaaaggagacag

SEQ ID NO: 20294 - DNA, 20 bp, Artificial Sequence
  Synthetic oligonucleotide; GGG chr11 5327054 5327073 5327070 +
aagggagtaaaggagacaga

SEQ ID NO: 20295 - DNA, 20 bp, Artificial Sequence
  Synthetic oligonucleotide; TAG chr11 5327064 5327083 5327080 +
aggagacagagggaactttg

SEQ ID NO: 20296 - DNA, 20 bp, Artificial Sequence
  Synthetic oligonucleotide; AAG chr11 5327071 5327090 5327087 +
agagggaactttgtagtatg

SEQ ID NO: 20297 - DNA, 20 bp, Artificial Sequence
  Synthetic oligonucleotide; AAG chr11 5327074 5327093 5327090 +
gggaactttgtagtatgaag

SEQ ID NO: 20298 - DNA, 20 bp, Artificial Sequence
  Synthetic oligonucleotide; AGG chr11 5327075 5327094 5327091 +
ggaactttgtagtatgaaga

SEQ ID NO: 20299 - DNA, 20 bp, Artificial Sequence
  Synthetic oligonucleotide; CAG chr11 5327080 5327099 5327096 +
tttgtagtatgaagaaggaa

SEQ ID NO: 20300 - DNA, 20 bp, Artificial Sequence
  Synthetic oligonucleotide; CAG chr11 5327084 5327103 5327100 +
tagtatgaagaaggaacaga

SEQ ID NO: 20301 - DNA, 20 bp, Artificial Sequence
  Synthetic oligonucleotide; AGG chr11 5327085 5327104 5327101 +
agtatgaagaaggaacagac

SEQ ID NO: 20302 - DNA, 20 bp, Artificial Sequence
  Synthetic oligonucleotide; AAG chr11 5327089 5327108 5327105 +
tgaagaaggaacagacagga

SEQ ID NO: 20303 - DNA, 20 bp, Artificial Sequence
  Synthetic oligonucleotide; TAG chr11 5327098 5327117 5327114 +
aacagacaggaaagatctgt

SEQ ID NO: 20304 - DNA, 20 bp, Artificial Sequence
  Synthetic oligonucleotide; AAG chr11 5327105 5327124 5327121 +
aggaaagatctgttagcctc

SEQ ID NO: 20305 - DNA, 20 bp, Artificial Sequence
  Synthetic oligonucleotide; TAG chr11 5327114 5327133 5327130 +
ctgttagcctcaagaaaatg

SEQ ID NO: 20306 - DNA, 20 bp, Artificial Sequence
  Synthetic oligonucleotide; TAG chr11 5327121 5327140 5327137 +
cctcaagaaaatgtagtaaa

SEQ ID NO: 20307 - DNA, 20 bp, Artificial Sequence
  Synthetic oligonucleotide; CAG chr11 5327137 5327156 5327153 +
taaatagtgaatctattata

SEQ ID NO: 20308 - DNA, 20 bp, Artificial Sequence
  Synthetic oligonucleotide; AAG chr11 5327151 5327170 5327167 +
attatacagtctacataaac

SEQ ID NO: 20309 - DNA, 20 bp, Artificial Sequence
  Synthetic oligonucleotide; AAG chr11 5327157 5327176 5327173 +
cagtctacataaacaagtga

SEQ ID NO: 20310 - DNA, 20 bp, Artificial Sequence
  Synthetic oligonucleotide; GAG chr11 5327159 5327178 5327175 +
gtctacataaacaagtgaaa

SEQ ID NO: 20311 - DNA, 20 bp, Artificial Sequence
  Synthetic oligonucleotide; AGG chr11 5327160 5327179 5327176 +
tctacataaacaagtgaaag

SEQ ID NO: 20312 - DNA, 20 bp, Artificial Sequence
  Synthetic oligonucleotide; GAG chr11 5327220 5327239 5327236 +
tcctactctgccctccttct

SEQ ID NO: 20313 - DNA, 20 bp, Artificial Sequence
  Synthetic oligonucleotide; TGG chr11 5327224 5327243 5327240 +
actctgccctccttctgagt

SEQ ID NO: 20314 - DNA, 20 bp, Artificial Sequence
  Synthetic oligonucleotide; TGG chr11 5327228 5327247 5327244 +
tgccctccttctgagttgga

SEQ ID NO: 20315 - DNA, 20 bp, Artificial Sequence
  Synthetic oligonucleotide; AAG chr11 5327231 5327250 5327247 +
cctccttctgagttggatgg

SEQ ID NO: 20316 - DNA, 20 bp, Artificial Sequence
  Synthetic oligonucleotide; AAG chr11 5327254 5327273 5327270 +
atgtgtccccgcaccttcct

SEQ ID NO: 20317 - DNA, 20 bp, Artificial Sequence
  Synthetic oligonucleotide; AGG chr11 5327255 5327274 5327271 +
tgtgtccccgcaccttccta

SEQ ID NO: 20318 - DNA, 20 bp, Artificial Sequence
  Synthetic oligonucleotide; GAG chr11 5327257 5327276 5327273 +
tgtccccgcaccttcctaag

SEQ ID NO: 20319 - DNA, 20 bp, Artificial Sequence
  Synthetic oligonucleotide; TGG chr11 5327261 5327280 5327277 +
cccgcaccttcctaaggaga

SEQ ID NO: 20320 - DNA, 20 bp, Artificial Sequence
  Synthetic oligonucleotide; GGG chr11 5327262 5327281 5327278 +
ccgcaccttcctaaggagat

SEQ ID NO: 20321 - DNA, 20 bp, Artificial Sequence
  Synthetic oligonucleotide; TAG chr11 5327274 5327293 5327290 +
aaggagatgggccctgtctc

SEQ ID NO: 20322 - DNA, 20 bp, Artificial Sequence
  Synthetic oligonucleotide; TAG chr11 5327285 5327304 5327301 +
ccctgtctctagaatttttc

SEQ ID NO: 20323 - DNA, 20 bp, Artificial Sequence
  Synthetic oligonucleotide; GAG chr11 5327289 5327308 5327305 +
gtctctagaatttttctagt

SEQ ID NO: 20324 - DNA, 20 bp, Artificial Sequence
  Synthetic oligonucleotide; TAG chr11 5327318 5327337 5327334 +
tgactactcatgccatctct

SEQ ID NO: 20325 - DNA, 20 bp, Artificial Sequence
  Synthetic oligonucleotide; GAG chr11 5327320 5327339 5327336 +
actactcatgccatctctta

SEQ ID NO: 20326 - DNA, 20 bp, Artificial Sequence
  Synthetic oligonucleotide; CAG chr11 5327323 5327342 5327339 +
actcatgccatctcttagag

SEQ ID NO: 20327 - DNA, 20 bp, Artificial Sequence
  Synthetic oligonucleotide; CAG chr11 5327343 5327362 5327359 +
cagttcttcaaacaaacaca

SEQ ID NO: 20328 - DNA, 20 bp, Artificial Sequence
  Synthetic oligonucleotide; AAG chr11 5327369 5327388 5327385 +
cacatgcatgtgtgtgtttc

SEQ ID NO: 20329 - DNA, 20 bp, Artificial Sequence
  Synthetic oligonucleotide; AGG chr11 5327370 5327389 5327386 +
acatgcatgtgtgtgtttca

SEQ ID NO: 20330 - DNA, 20 bp, Artificial Sequence
  Synthetic oligonucleotide; GGG chr11 5327371 5327390 5327387 +
catgcatgtgtgtgtttcaa

SEQ ID NO: 20331 - DNA, 20 bp, Artificial Sequence
  Synthetic oligonucleotide; GGG chr11 5327372 5327391 5327388 +
atgcatgtgtgtgtttcaag

SEQ ID NO: 20332 - DNA, 20 bp, Artificial Sequence
  Synthetic oligonucleotide; TGG chr11 5327382 5327401 5327398 +
gtgtttcaaggggtgttgtt

SEQ ID NO: 20333 - DNA, 20 bp, Artificial Sequence
  Synthetic oligonucleotide; TGG chr11 5327416 5327435 5327432 +
taaattgttatatgttaaaa

SEQ ID NO: 20334 - DNA, 20 bp, Artificial Sequence
  Synthetic oligonucleotide; CAG chr11 5327441 5327460 5327457 +
acttttctttctataaattt

SEQ ID NO: 20335 - DNA, 20 bp, Artificial Sequence
  Synthetic oligonucleotide; AGG chr11 5327442 5327461 5327458 +
cttttctttctataaatttc

SEQ ID NO: 20336 - DNA, 20 bp, Artificial Sequence
  Synthetic oligonucleotide; TAG chr11 5327449 5327468 5327465 +
ttctataaatttcaggatct

SEQ ID NO: 20337 - DNA, 20 bp, Artificial Sequence
  Synthetic oligonucleotide; CAG chr11 5327452 5327471 5327468 +
tataaatttcaggatcttag

SEQ ID NO: 20338 - DNA, 20 bp, Artificial Sequence
  Synthetic oligonucleotide; GAG chr11 5327454 5327473 5327470 +
taaatttcaggatcttagca

SEQ ID NO: 20339 - DNA, 20 bp, Artificial Sequence
  Synthetic oligonucleotide; CAG chr11 5327459 5327478 5327475 +
ttcaggatcttagcagagtg

SEQ ID NO: 20340 - DNA, 20 bp, Artificial Sequence
  Synthetic oligonucleotide; AAG chr11 5327462 5327481 5327478 +
aggatcttagcagagtgcag

SEQ ID NO: 20341 - DNA, 20 bp, Artificial Sequence
  Synthetic oligonucleotide; CAG chr11 5327467 5327486 5327483 +
cttagcagagtgcagaagct

SEQ ID NO: 20342 - DNA, 20 bp, Artificial Sequence
  Synthetic oligonucleotide; TAG chr11 5327476 5327495 5327492 +
gtgcagaagctcagcctgtt

SEQ ID NO: 20343 - DNA, 20 bp, Artificial Sequence
  Synthetic oligonucleotide; AGG chr11 5327477 5327496 5327493 +
tgcagaagctcagcctgttt

SEQ ID NO: 20344 - DNA, 20 bp, Artificial Sequence
  Synthetic oligonucleotide; CAG chr11 5327482 5327501 5327498 +
aagctcagcctgtttaggtt

SEQ ID NO: 20345 - DNA, 20 bp, Artificial Sequence
  Synthetic oligonucleotide; AAG chr11 5327523 5327542 5327539 +
attgtctttaatcttcaaaa

SEQ ID NO: 20346 - DNA, 20 bp, Artificial Sequence
  Synthetic oligonucleotide; GAG chr11 5327527 5327546 5327543 +
tctttaatcttcaaaaaagt

SEQ ID NO: 20347 - DNA, 20 bp, Artificial Sequence
  Synthetic oligonucleotide; TGG chr11 5327539 5327558 5327555 +
aaaaaagtgagtcctccatt

SEQ ID NO: 20348 - DNA, 20 bp, Artificial Sequence
  Synthetic oligonucleotide; CAG chr11 5327545 5327564 5327561 +
gtgagtcctccatttggccc

SEQ ID NO: 20349 - DNA, 20 bp, Artificial Sequence
  Synthetic oligonucleotide; GAG chr11 5327552 5327571 5327568 +
ctccatttggccccagtcct

SEQ ID NO: 20350 - DNA, 20 bp, Artificial Sequence
  Synthetic oligonucleotide; AGG chr11 5327553 5327572 5327569 +
tccatttggccccagtcctg

SEQ ID NO: 20351 - DNA, 20 bp, Artificial Sequence
  Synthetic oligonucleotide; GGG chr11 5327554 5327573 5327570 +
ccatttggccccagtcctga

SEQ ID NO: 20352 - DNA, 20 bp, Artificial Sequence
  Synthetic oligonucleotide; CAG chr11 5327562 5327581 5327578 +
ccccagtcctgagggcctga

SEQ ID NO: 20353 - DNA, 20 bp, Artificial Sequence
  Synthetic oligonucleotide; TGG chr11 5327566 5327585 5327582 +
agtcctgagggcctgacagt

SEQ ID NO: 20354 - DNA, 20 bp, Artificial Sequence
  Synthetic oligonucleotide; GGG chr11 5327567 5327586 5327583 +
gtcctgagggcctgacagtt

SEQ ID NO: 20355 - DNA, 20 bp, Artificial Sequence
  Synthetic oligonucleotide; CAG chr11 5327583 5327602 5327599 +
agttgggactacccaactct

SEQ ID NO: 20356 - DNA, 20 bp, Artificial Sequence
  Synthetic oligonucleotide; AAG chr11 5327601 5327620 5327617 +
ctcagatttctattgtccac

SEQ ID NO: 20357 - DNA, 20 bp, Artificial Sequence
  Synthetic oligonucleotide; CAG chr11 5327630 5327649 5327646 +
tcctcctgccttctccaacc

SEQ ID NO: 20358 - DNA, 20 bp, Artificial Sequence
  Synthetic oligonucleotide; TAG chr11 5327691 5327710 5327707 +
ttcaatccaatttgctttct

SEQ ID NO: 20359 - DNA, 20 bp, Artificial Sequence
  Synthetic oligonucleotide; TGG chr11 5327703 5327722 5327719 +
tgctttcttagatcttaatt

SEQ ID NO: 20360 - DNA, 20 bp, Artificial Sequence
  Synthetic oligonucleotide; AAG chr11 5327718 5327737 5327734 +
taatttggctgcccttttct

SEQ ID NO: 20361 - DNA, 20 bp, Artificial Sequence
  Synthetic oligonucleotide; CAG chr11 5327736 5327755 5327752 +
ctaagcctttcaactcgatt

SEQ ID NO: 20362 - DNA, 20 bp, Artificial Sequence
  Synthetic oligonucleotide; CAG chr11 5327757 5327776 5327773 +
agaattttttgtctactctt

SEQ ID NO: 20363 - DNA, 20 bp, Artificial Sequence
  Synthetic oligonucleotide; GAG chr11 5327759 5327778 5327775 +
aattttttgtctactcttca

SEQ ID NO: 20364 - DNA, 20 bp, Artificial Sequence
  Synthetic oligonucleotide; CAG chr11 5327790 5327809 5327806 +
tcaacaaaaaatcctctgaa

SEQ ID NO: 20365 - DNA, 20 bp, Artificial Sequence
  Synthetic oligonucleotide; AGG chr11 5327791 5327810 5327807 +
caacaaaaaatcctctgaac

SEQ ID NO: 20366 - DNA, 20 bp, Artificial Sequence
  Synthetic oligonucleotide; AAG chr11 5327795 5327814 5327811 +
aaaaaatcctctgaacagga

SEQ ID NO: 20367 - DNA, 20 bp, Artificial Sequence
  Synthetic oligonucleotide; AAG chr11 5327824 5327843 5327840 +
ataaaaaataaacgtaaaat

SEQ ID NO: 20368 - DNA, 20 bp, Artificial Sequence
  Synthetic oligonucleotide; TGG chr11 5327834 5327853 5327850 +
aacgtaaaataagccctttc

SEQ ID NO: 20369 - DNA, 20 bp, Artificial Sequence
  Synthetic oligonucleotide; GAG chr11 5327850 5327869 5327866 +
tttctggataaacaaaaact

SEQ ID NO: 20370 - DNA, 20 bp, Artificial Sequence
  Synthetic oligonucleotide; AAG chr11 5327865 5327884 5327881 +
aaactgagttgatttcaact

SEQ ID NO: 20371 - DNA, 20 bp, Artificial Sequence
  Synthetic oligonucleotide; AAG chr11 5327885 5327904 5327901 +
aagttgaaaccaaatgacca

SEQ ID NO: 20372 - DNA, 20 bp, Artificial Sequence
  Synthetic oligonucleotide; AAG chr11 5327918 5327937 5327934 +
gaatctacataaaatgacaa

SEQ ID NO: 20373 - DNA, 20 bp, Artificial Sequence
  Synthetic oligonucleotide; CAG chr11 5327924 5327943 5327940 +
acataaaatgacaaaagcac

SEQ ID NO: 20374 - DNA, 20 bp, Artificial Sequence
  Synthetic oligonucleotide; AAG chr11 5327929 5327948 5327945 +
aaatgacaaaagcaccagta

SEQ ID NO: 20375 - DNA, 20 bp, Artificial Sequence
  Synthetic oligonucleotide; TAG chr11 5327933 5327952 5327949 +
gacaaaagcaccagtaaaga

SEQ ID NO: 20376 - DNA, 20 bp, Artificial Sequence
  Synthetic oligonucleotide; TAG chr11 5327947 5327966 5327963 +
taaagatagtcatgtcatta

SEQ ID NO: 20377 - DNA, 20 bp, Artificial Sequence
  Synthetic oligonucleotide; AAG chr11 5327950 5327969 5327966 +
agatagtcatgtcattatag

SEQ ID NO: 20378 - DNA, 20 bp, Artificial Sequence
  Synthetic oligonucleotide; TAG chr11 5328017 5328036 5328033 +
gaatgtattacaataaaaaa

SEQ ID NO: 20379 - DNA, 20 bp, Artificial Sequence
  Synthetic oligonucleotide; TGG chr11 5328031 5328050 5328047 +
aaaaaatagaattgcattgc

SEQ ID NO: 20380 - DNA, 20 bp, Artificial Sequence
  Synthetic oligonucleotide; AAG chr11 5328079 5328098 5328095 +
tatttaccaataactgaaca

SEQ ID NO: 20381 - DNA, 20 bp, Artificial Sequence
  Synthetic oligonucleotide; AGG chr11 5328080 5328099 5328096 +
atttaccaataactgaacaa

SEQ ID NO: 20382 - DNA, 20 bp, Artificial Sequence
  Synthetic oligonucleotide; GAG chr11 5328082 5328101 5328098 +
ttaccaataactgaacaaag

SEQ ID NO: 20383 - DNA, 20 bp, Artificial Sequence
  Synthetic oligonucleotide; AGG chr11 5328083 5328102 5328099 +
taccaataactgaacaaagg

SEQ ID NO: 20384 - DNA, 20 bp, Artificial Sequence
  Synthetic oligonucleotide; GAG chr11 5328087 5328106 5328103 +
aataactgaacaaaggaggt

SEQ ID NO: 20385 - DNA, 20 bp, Artificial Sequence
  Synthetic oligonucleotide; AAG chr11 5328098 5328117 5328114 +
aaaggaggtgagtgataaca

SEQ ID NO: 20386 - DNA, 20 bp, Artificial Sequence
  Synthetic oligonucleotide; TGG chr11 5328107 5328126 5328123 +
gagtgataacaaagctgttt

SEQ ID NO: 20387 - DNA, 20 bp, Artificial Sequence
  Synthetic oligonucleotide; AAG chr11 5328114 5328133 5328130 +
aacaaagctgttttggaatg

SEQ ID NO: 20388 - DNA, 20 bp, Artificial Sequence
  Synthetic oligonucleotide; AAG chr11 5328135 5328154 5328151 +
agaaatattctctgaaaaaa

SEQ ID NO: 20389 - DNA, 20 bp, Artificial Sequence
  Synthetic oligonucleotide; TAG chr11 5328153 5328172 5328169 +
aaaagctataaacatctaca

SEQ ID NO: 20390 - DNA, 20 bp, Artificial Sequence
  Synthetic oligonucleotide; GAG chr11 5328162 5328181 5328178 +
aaacatctacatagaaaaat

SEQ ID NO: 20391 - DNA, 20 bp, Artificial Sequence
  Synthetic oligonucleotide; AAG chr11 5328166 5328185 5328182 +
atctacatagaaaaatgagt

SEQ ID NO: 20392 - DNA, 20 bp, Artificial Sequence
  Synthetic oligonucleotide; CAG chr11 5328187 5328206 5328203 +
agaatgcacaatgacacatg

SEQ ID NO: 20393 - DNA, 20 bp, Artificial Sequence
  Synthetic oligonucleotide; GAG chr11 5328194 5328213 5328210 +
acaatgacacatgcagttct

SEQ ID NO: 20394 - DNA, 20 bp, Artificial Sequence
  Synthetic oligonucleotide; AAG chr11 5328224 5328243 5328240 +
aattatacttatgccaatcc

SEQ ID NO: 20395 - DNA, 20 bp, Artificial Sequence
  Synthetic oligonucleotide; AGG chr11 5328225 5328244 5328241 +
attatacttatgccaatcca

SEQ ID NO: 20396 - DNA, 20 bp, Artificial Sequence
  Synthetic oligonucleotide; GGG chr11 5328226 5328245 5328242 +
ttatacttatgccaatccaa

SEQ ID NO: 20397 - DNA, 20 bp, Artificial Sequence
  Synthetic oligonucleotide; CAG chr11 5328232 5328251 5328248 +
ttatgccaatccaagggtcc

SEQ ID NO: 20398 - DNA, 20 bp, Artificial Sequence
  Synthetic oligonucleotide; TAG chr11 5328237 5328256 5328253 +
ccaatccaagggtcccagat

SEQ ID NO: 20399 - DNA, 20 bp, Artificial Sequence
  Synthetic oligonucleotide; CAG chr11 5328257 5328276 5328273 +
tagaaaacctaaatctatca

SEQ ID NO: 20400 - DNA, 20 bp, Artificial Sequence
  Synthetic oligonucleotide; AAG chr11 5328282 5328301 5328298 +
ccttaaatactctttcaaaa

SEQ ID NO: 20401 - DNA, 20 bp, Artificial Sequence
  Synthetic oligonucleotide; TAG chr11 5328305 5328324 5328321 +
aaaaaaaaaaatctgtgctg

SEQ ID NO: 20402 - DNA, 20 bp, Artificial Sequence
  Synthetic oligonucleotide; AGG chr11 5328306 5328325 5328322 +
aaaaaaaaaatctgtgctgt

SEQ ID NO: 20403 - DNA, 20 bp, Artificial Sequence
  Synthetic oligonucleotide; CAG chr11 5328320 5328339 5328336 +
tgctgtaggatatcccacct

SEQ ID NO: 20404 - DNA, 20 bp, Artificial Sequence
  Synthetic oligonucleotide; TAG chr11 5328339 5328358 5328355 +
tcagctgtgatctttacctc

SEQ ID NO: 20405 - DNA, 20 bp, Artificial Sequence
  Synthetic oligonucleotide; AGG chr11 5328340 5328359 5328356 +
cagctgtgatctttacctct

SEQ ID NO: 20406 - DNA, 20 bp, Artificial Sequence
  Synthetic oligonucleotide; CAG chr11 5328343 5328362 5328359 +
ctgtgatctttacctctagg

SEQ ID NO: 20407 - DNA, 20 bp, Artificial Sequence
  Synthetic oligonucleotide; TGG chr11 5328351 5328370 5328367 +
tttacctctaggcagacctc

SEQ ID NO: 20408 - DNA, 20 bp, Artificial Sequence
  Synthetic oligonucleotide; GAG chr11 5328378 5328397 5328394 +
ccttcttatatgctttcctt

SEQ ID NO: 20409 - DNA, 20 bp, Artificial Sequence
  Synthetic oligonucleotide; CAG chr11 5328393 5328412 5328409 +
tccttgagtgcatctcacat

SEQ ID NO: 20410 - DNA, 20 bp, Artificial Sequence
  Synthetic oligonucleotide; AAG chr11 5328396 5328415 5328412 +
ttgagtgcatctcacatcag

SEQ ID NO: 20411 - DNA, 20 bp, Artificial Sequence
  Synthetic oligonucleotide; GAG chr11 5328398 5328417 5328414 +
gagtgcatctcacatcagaa

SEQ ID NO: 20412 - DNA, 20 bp, Artificial Sequence
  Synthetic oligonucleotide; GAG chr11 5328400 5328419 5328416 +
gtgcatctcacatcagaaga

SEQ ID NO: 20413 - DNA, 20 bp, Artificial Sequence
  Synthetic oligonucleotide; GAG chr11 5328402 5328421 5328418 +
gcatctcacatcagaagaga

SEQ ID NO: 20414 - DNA, 20 bp, Artificial Sequence
  Synthetic oligonucleotide; AGG chr11 5328403 5328422 5328419 +
catctcacatcagaagagag

SEQ ID NO: 20415 - DNA, 20 bp, Artificial Sequence
  Synthetic oligonucleotide; AAG chr11 5328421 5328440 5328437 +
agaggaatcattccatattc

SEQ ID NO: 20416 - DNA, 20 bp, Artificial Sequence
  Synthetic oligonucleotide; TGG chr11 5328428 5328447 5328444 +
tcattccatattcaagttcc

SEQ ID NO: 20417 - DNA, 20 bp, Artificial Sequence
  Synthetic oligonucleotide; CAG chr11 5328445 5328464 5328461 +
tcctggcactcacccactca

SEQ ID NO: 20418 - DNA, 20 bp, Artificial Sequence
  Synthetic oligonucleotide; TGG chr11 5328453 5328472 5328469 +
ctcacccactcacagtattg

SEQ ID NO: 20419 - DNA, 20 bp, Artificial Sequence
  Synthetic oligonucleotide; TAG chr11 5328462 5328481 5328478 +
tcacagtattgtggctaaaa

SEQ ID NO: 20420 - DNA, 20 bp, Artificial Sequence
  Synthetic oligonucleotide; AGG chr11 5328463 5328482 5328479 +
cacagtattgtggctaaaat

SEQ ID NO: 20421 - DNA, 20 bp, Artificial Sequence
  Synthetic oligonucleotide; GAG chr11 5328486 5328505 5328502 +
aacctattcctgtcctcttt

SEQ ID NO: 20422 - DNA, 20 bp, Artificial Sequence
  Synthetic oligonucleotide; AGG chr11 5328487 5328506 5328503 +
acctattcctgtcctctttg

SEQ ID NO: 20423 - DNA, 20 bp, Artificial Sequence
  Synthetic oligonucleotide; CAG chr11 5328493 5328512 5328509 +
tcctgtcctctttgaggact

SEQ ID NO: 20424 - DNA, 20 bp, Artificial Sequence
  Synthetic oligonucleotide; CAG chr11 5328498 5328517 5328514 +
tcctctttgaggactcagtt

SEQ ID NO: 20425 - DNA, 20 bp, Artificial Sequence
  Synthetic oligonucleotide; CAG chr11 5328513 5328532 5328529 +
cagttcagatcattcactca

SEQ ID NO: 20426 - DNA, 20 bp, Artificial Sequence
  Synthetic oligonucleotide; GAG chr11 5328525 5328544 5328541 +
ttcactcacagacctctcat

SEQ ID NO: 20427 - DNA, 20 bp, Artificial Sequence
  Synthetic oligonucleotide; AGG chr11 5328526 5328545 5328542 +
tcactcacagacctctcatg

SEQ ID NO: 20428 - DNA, 20 bp, Artificial Sequence
  Synthetic oligonucleotide; AAG chr11 5328539 5328558 5328555 +
tctcatgaggcctcatttta

SEQ ID NO: 20429 - DNA, 20 bp, Artificial Sequence
  Synthetic oligonucleotide; TGG chr11 5328552 5328571 5328568 +
cattttaaagcttatgcatg

SEQ ID NO: 20430 - DNA, 20 bp, Artificial Sequence
  Synthetic oligonucleotide; GAG chr11 5328569 5328588 5328585 +
atgtggaaatcacctcccct

SEQ ID NO: 20431 - DNA, 20 bp, Artificial Sequence
  Synthetic oligonucleotide; TAG chr11 5328583 5328602 5328599 +
tcccctgagtttcatctttc

SEQ ID NO: 20432 - DNA, 20 bp, Artificial Sequence
  Synthetic oligonucleotide; CAG chr11 5328591 5328610 5328607 +
gtttcatctttctagcatct

SEQ ID NO: 20433 - DNA, 20 bp, Artificial Sequence
  Synthetic oligonucleotide; AGG chr11 5328592 5328611 5328608 +
tttcatctttctagcatctc

SEQ ID NO: 20434 - DNA, 20 bp, Artificial Sequence
  Synthetic oligonucleotide; GAG chr11 5328594 5328613 5328610 +
tcatctttctagcatctcag

SEQ ID NO: 20435 - DNA, 20 bp, Artificial Sequence
  Synthetic oligonucleotide; CGG chr11 5328630 5328649 5328646 +
ccttccctctcttctctgtt

SEQ ID NO: 20436 - DNA, 20 bp, Artificial Sequence
  Synthetic oligonucleotide; GGG chr11 5328631 5328650 5328647 +
cttccctctcttctctgttc

SEQ ID NO: 20437 - DNA, 20 bp, Artificial Sequence
  Synthetic oligonucleotide; GAG chr11 5328633 5328652 5328649 +
tccctctcttctctgttcgg

SEQ ID NO: 20438 - DNA, 20 bp, Artificial Sequence
  Synthetic oligonucleotide; AGG chr11 5328634 5328653 5328650 +
ccctctcttctctgttcggg

SEQ ID NO: 20439 - DNA, 20 bp, Artificial Sequence
  Synthetic oligonucleotide; CAG chr11 5328639 5328658 5328655 +
tcttctctgttcgggaggaa

SEQ ID NO: 20440 - DNA, 20 bp, Artificial Sequence
  Synthetic oligonucleotide; AGG chr11 5328640 5328659 5328656 +
cttctctgttcgggaggaac

SEQ ID NO: 20441 - DNA, 20 bp, Artificial Sequence
  Synthetic oligonucleotide; GGG chr11 5328641 5328660 5328657 +
ttctctgttcgggaggaaca

SEQ ID NO: 20442 - DNA, 20 bp, Artificial Sequence
  Synthetic oligonucleotide; CGG chr11 5328662 5328681 5328678 +
ggccccacaactgatgtcct

SEQ ID NO: 20443 - DNA, 20 bp, Artificial Sequence
  Synthetic oligonucleotide; GGG chr11 5328663 5328682 5328679 +
gccccacaactgatgtcctc

SEQ ID NO: 20444 - DNA, 20 bp, Artificial Sequence
  Synthetic oligonucleotide; CAG chr11 5328671 5328690 5328687 +
actgatgtcctcgggatttt

SEQ ID NO: 20445 - DNA, 20 bp, Artificial Sequence
  Synthetic oligonucleotide; AGG chr11 5328672 5328691 5328688 +
ctgatgtcctcgggattttc

SEQ ID NO: 20446 - DNA, 20 bp, Artificial Sequence
  Synthetic oligonucleotide; AAG chr11 5328684 5328703 5328700 +
ggattttcaggtgtttcctg

SEQ ID NO: 20447 - DNA, 20 bp, Artificial Sequence
  Synthetic oligonucleotide; TGG chr11 5328689 5328708 5328705 +
ttcaggtgtttcctgaagaa

SEQ ID NO: 20448 - DNA, 20 bp, Artificial Sequence
  Synthetic oligonucleotide; GGG chr11 5328690 5328709 5328706 +
tcaggtgtttcctgaagaat

SEQ ID NO: 20449 - DNA, 20 bp, Artificial Sequence
  Synthetic oligonucleotide; GGG chr11 5328691 5328710 5328707 +
caggtgtttcctgaagaatg

SEQ ID NO: 20450 - DNA, 20 bp, Artificial Sequence
  Synthetic oligonucleotide; GAG chr11 5328695 5328714 5328711 +
tgtttcctgaagaatggggt

SEQ ID NO: 20451 - DNA, 20 bp, Artificial Sequence
  Synthetic oligonucleotide; AGG chr11 5328696 5328715 5328712 +
gtttcctgaagaatggggtg

SEQ ID NO: 20452 - DNA, 20 bp, Artificial Sequence
  Synthetic oligonucleotide; CAG chr11 5328719 5328738 5328735 +
aaaatttgaaattcaaaaac

SEQ ID NO: 20453 - DNA, 20 bp, Artificial Sequence
  Synthetic oligonucleotide; AAG chr11 5328729 5328748 5328745 +
attcaaaaaccagctgatgt

SEQ ID NO: 20454 - DNA, 20 bp, Artificial Sequence
  Synthetic oligonucleotide; TAG chr11 5328733 5328752 5328749 +
aaaaaccagctgatgtaaga

SEQ ID NO: 20455 - DNA, 20 bp, Artificial Sequence
  Synthetic oligonucleotide; AGG chr11 5328734 5328753 5328750 +
aaaaccagctgatgtaagat

SEQ ID NO: 20456 - DNA, 20 bp, Artificial Sequence
  Synthetic oligonucleotide; GGG chr11 5328735 5328754 5328751 +
aaaccagctgatgtaagata

SEQ ID NO: 20457 - DNA, 20 bp, Artificial Sequence
  Synthetic oligonucleotide; CAG chr11 5328742 5328761 5328758 +
ctgatgtaagatagggatac

SEQ ID NO: 20458 - DNA, 20 bp, Artificial Sequence
  Synthetic oligonucleotide; AGG chr11 5328743 5328762 5328759 +
tgatgtaagatagggatacc

SEQ ID NO: 20459 - DNA, 20 bp, Artificial Sequence
  Synthetic oligonucleotide; GGG chr11 5328744 5328763 5328760 +
gatgtaagatagggatacca

SEQ ID NO: 20460 - DNA, 20 bp, Artificial Sequence
  Synthetic oligonucleotide; TGG chr11 5328749 5328768 5328765 +
aagatagggataccagggct

SEQ ID NO: 20461 - DNA, 20 bp, Artificial Sequence
  Synthetic oligonucleotide; AAG chr11 5328763 5328782 5328779 +
agggcttggttatgtgaccc

SEQ ID NO: 20462 - DNA, 20 bp, Artificial Sequence
  Synthetic oligonucleotide; AGG chr11 5328764 5328783 5328780 +
gggcttggttatgtgaccca

SEQ ID NO: 20463 - DNA, 20 bp, Artificial Sequence
  Synthetic oligonucleotide; GAG chr11 5328766 5328785 5328782 +
gcttggttatgtgacccaag

SEQ ID NO: 20464 - DNA, 20 bp, Artificial Sequence
  Synthetic oligonucleotide; AGG chr11 5328767 5328786 5328783 +
cttggttatgtgacccaagg

SEQ ID NO: 20465 - DNA, 20 bp, Artificial Sequence
  Synthetic oligonucleotide; CAG chr11 5328772 5328791 5328788 +
ttatgtgacccaaggaggct

SEQ ID NO: 20466 - DNA, 20 bp, Artificial Sequence
  Synthetic oligonucleotide; TAG chr11 5328785 5328804 5328801 +
ggaggctcagcatcataact

SEQ ID NO: 20467 - DNA, 20 bp, Artificial Sequence
  Synthetic oligonucleotide; AAG chr11 5328797 5328816 5328813 +
tcataacttagtttatttga

SEQ ID NO: 20468 - DNA, 20 bp, Artificial Sequence
  Synthetic oligonucleotide; AGG chr11 5328798 5328817 5328814 +
cataacttagtttatttgaa

SEQ ID NO: 20469 - DNA, 20 bp, Artificial Sequence
  Synthetic oligonucleotide; GGG chr11 5328799 5328818 5328815 +
ataacttagtttatttgaaa

SEQ ID NO: 20470 - DNA, 20 bp, Artificial Sequence
  Synthetic oligonucleotide; TAG chr11 5328803 5328822 5328819 +
cttagtttatttgaaagggt

SEQ ID NO: 20471 - DNA, 20 bp, Artificial Sequence
  Synthetic oligonucleotide; AGG chr11 5328804 5328823 5328820 +
ttagtttatttgaaagggtt

SEQ ID NO: 20472 - DNA, 20 bp, Artificial Sequence
  Synthetic oligonucleotide; GGG chr11 5328805 5328824 5328821 +
tagtttatttgaaagggtta

SEQ ID NO: 20473 - DNA, 20 bp, Artificial Sequence
  Synthetic oligonucleotide; GGG chr11 5328806 5328825 5328822 +
agtttatttgaaagggttag

SEQ ID NO: 20474 - DNA, 20 bp, Artificial Sequence
  Synthetic oligonucleotide; CGG chr11 5328813 5328832 5328829 +
ttgaaagggttaggggatat

SEQ ID NO: 20475 - DNA, 20 bp, Artificial Sequence
  Synthetic oligonucleotide; CAG chr11 5328823 5328842 5328839 +
taggggatatcggttgtctt

SEQ ID NO: 20476 - DNA, 20 bp, Artificial Sequence
  Synthetic oligonucleotide; AGG chr11 5328824 5328843 5328840 +
aggggatatcggttgtcttc

SEQ ID NO: 20477 - DNA, 20 bp, Artificial Sequence
  Synthetic oligonucleotide; GGG chr11 5328825 5328844 5328841 +
ggggatatcggttgtcttca

SEQ ID NO: 20478 - DNA, 20 bp, Artificial Sequence
  Synthetic oligonucleotide; CGG chr11 5328844 5328863 5328860 +
agggatcatatgtacctcta

SEQ ID NO: 20479 - DNA, 20 bp, Artificial Sequence
  Synthetic oligonucleotide; GGG chr11 5328845 5328864 5328861 +
gggatcatatgtacctctac

SEQ ID NO: 20480 - DNA, 20 bp, Artificial Sequence
  Synthetic oligonucleotide; TAG chr11 5328851 5328870 5328867 +
atatgtacctctacgggtcc

SEQ ID NO: 20481 - DNA, 20 bp, Artificial Sequence
  Synthetic oligonucleotide; GAG chr11 5328853 5328872 5328869 +
atgtacctctacgggtccta

SEQ ID NO: 20482 - DNA, 20 bp, Artificial Sequence
  Synthetic oligonucleotide; TGG chr11 5328896 5328915 5328912 +
ttttgtctttcctgttactt

SEQ ID NO: 20483 - DNA, 20 bp, Artificial Sequence
  Synthetic oligonucleotide; TGG chr11 5328919 5328938 5328935 +
taaaatttgttcttatctac

SEQ ID NO: 20484 - DNA, 20 bp, Artificial Sequence
  Synthetic oligonucleotide; TGG chr11 5328930 5328949 5328946 +
cttatctactggaacttcaa

SEQ ID NO: 20485 - DNA, 20 bp, Artificial Sequence
  Synthetic oligonucleotide; TAG chr11 5328942 5328961 5328958 +
aacttcaatggatctgttaa

SEQ ID NO: 20486 - DNA, 20 bp, Artificial Sequence
  Synthetic oligonucleotide; CAG chr11 5328950 5328969 5328966 +
tggatctgttaatagtcatg

SEQ ID NO: 20487 - DNA, 20 bp, Artificial Sequence
  Synthetic oligonucleotide; CAG chr11 5328965 5328984 5328981 +
tcatgcagattcatgacatt

SEQ ID NO: 20488 - DNA, 20 bp, Artificial Sequence
  Synthetic oligonucleotide; TAG chr11 5328996 5329015 5329012 +
tttttttttttttttttttt

SEQ ID NO: 20489 - DNA, 20 bp, Artificial Sequence
  Synthetic oligonucleotide; TAG chr11 5329000 5329019 5329016 +
tttttttttttttttttaga

SEQ ID NO: 20490 - DNA, 20 bp, Artificial Sequence
  Synthetic oligonucleotide; GAG chr11 5329002 5329021 5329018 +
tttttttttttttttagata

SEQ ID NO: 20491 - DNA, 20 bp, Artificial Sequence
  Synthetic oligonucleotide; CAG chr11 5329019 5329038 5329035 +
atagagtctcactctgtcgc

SEQ ID NO: 20492 - DNA, 20 bp, Artificial Sequence
  Synthetic oligonucleotide; AGG chr11 5329020 5329039 5329036 +
tagagtctcactctgtcgcc

SEQ ID NO: 20493 - DNA, 20 bp, Artificial Sequence
  Synthetic oligonucleotide; TGG chr11 5329024 5329043 5329040 +
gtctcactctgtcgccaggc

SEQ ID NO: 20494 - DNA, 20 bp, Artificial Sequence
  Synthetic oligonucleotide; GAG chr11 5329026 5329045 5329042 +
ctcactctgtcgccaggctg

SEQ ID NO: 20495 - DNA, 20 bp, Artificial Sequence
  Synthetic oligonucleotide; CAG chr11 5329031 5329050 5329047 +
tctgtcgccaggctggagtg

SEQ ID NO: 20496 - DNA, 20 bp, Artificial Sequence
  Synthetic oligonucleotide; TAG chr11 5329034 5329053 5329050 +
gtcgccaggctggagtgcag

SEQ ID NO: 20497 - DNA, 20 bp, Artificial Sequence
  Synthetic oligonucleotide; CAG chr11 5329045 5329064 5329061 +
ggagtgcagtagcacaatct

SEQ ID NO: 20498 - DNA, 20 bp, Artificial Sequence
  Synthetic oligonucleotide; CAG chr11 5329069 5329088 5329085 +
tcactgcaaactccacctcc

SEQ ID NO: 20499 - DNA, 20 bp, Artificial Sequence
  Synthetic oligonucleotide; AGG chr11 5329070 5329089 5329086 +
cactgcaaactccacctccc

SEQ ID NO: 20500 - DNA, 20 bp, Artificial Sequence
  Synthetic oligonucleotide; AAG chr11 5329076 5329095 5329092 +
aaactccacctcccaggttc

SEQ ID NO: 20501 - DNA, 20 bp, Artificial Sequence
  Synthetic oligonucleotide; CAG chr11 5329093 5329112 5329109 +
ttcaagtgattctcctgcca

SEQ ID NO: 20502 - DNA, 20 bp, Artificial Sequence
  Synthetic oligonucleotide; GAG chr11 5329102 5329121 5329118 +
ttctcctgccacagcctcct

SEQ ID NO: 20503 - DNA, 20 bp, Artificial Sequence
  Synthetic oligonucleotide; AAG chr11 5329105 5329124 5329121 +
tcctgccacagcctcctgag

SEQ ID NO: 20504 - DNA, 20 bp, Artificial Sequence
  Synthetic oligonucleotide; TGG chr11 5329109 5329128 5329125 +
gccacagcctcctgagaagc

SEQ ID NO: 20505 - DNA, 20 bp, Artificial Sequence
  Synthetic oligonucleotide; GGG chr11 5329110 5329129 5329126 +
ccacagcctcctgagaagct

SEQ ID NO: 20506 - DNA, 20 bp, Artificial Sequence
  Synthetic oligonucleotide; CAG chr11 5329117 5329136 5329133 +
ctcctgagaagctgggacta

SEQ ID NO: 20507 - DNA, 20 bp, Artificial Sequence
  Synthetic oligonucleotide; TAG chr11 5329120 5329139 5329136 +
ctgagaagctgggactacag

SEQ ID NO: 20508 - DNA, 20 bp, Artificial Sequence
  Synthetic oligonucleotide; CAG chr11 5329137 5329156 5329153 +
cagtagcgcgtcaccacacc

SEQ ID NO: 20509 - DNA, 20 bp, Artificial Sequence
  Synthetic oligonucleotide; TAG chr11 5329156 5329175 5329172 +
ccagctaatttttgtatttt

SEQ ID NO: 20510 - DNA, 20 bp, Artificial Sequence
  Synthetic oligonucleotide; TAG chr11 5329159 5329178 5329175 +
gctaatttttgtatttttag

SEQ ID NO: 20511 - DNA, 20 bp, Artificial Sequence
  Synthetic oligonucleotide; CGG chr11 5329165 5329184 5329181 +
ttttgtatttttagtagaca

SEQ ID NO: 20512 - DNA, 20 bp, Artificial Sequence
  Synthetic oligonucleotide; GGG chr11 5329166 5329185 5329182 +
tttgtatttttagtagacac

SEQ ID NO: 20513 - DNA, 20 bp, Artificial Sequence
  Synthetic oligonucleotide; GGG chr11 5329167 5329186 5329183 +
ttgtatttttagtagacacg

SEQ ID NO: 20514 - DNA, 20 bp, Artificial Sequence
  Synthetic oligonucleotide; TGG chr11 5329181 5329200 5329197 +
gacacggggtttcaccatat

SEQ ID NO: 20515 - DNA, 20 bp, Artificial Sequence
  Synthetic oligonucleotide; CAG chr11 5329185 5329204 5329201 +
cggggtttcaccatattggc

SEQ ID NO: 20516 - DNA, 20 bp, Artificial Sequence
  Synthetic oligonucleotide; AGG chr11 5329186 5329205 5329202 +
ggggtttcaccatattggcc

SEQ ID NO: 20517 - DNA, 20 bp, Artificial Sequence
  Synthetic oligonucleotide; TGG chr11 5329190 5329209 5329206 +
tttcaccatattggccagga

SEQ ID NO: 20518 - DNA, 20 bp, Artificial Sequence
  Synthetic oligonucleotide; TGG chr11 5329226 5329245 5329242 +
acctcgtgatccaccctcct

SEQ ID NO: 20519 - DNA, 20 bp, Artificial Sequence
  Synthetic oligonucleotide; AAG chr11 5329236 5329255 5329252 +
ccaccctccttggcctccca

SEQ ID NO: 20520 - DNA, 20 bp, Artificial Sequence
  Synthetic oligonucleotide; TGG chr11 5329242 5329261 5329258 +
tccttggcctcccaaagtgc

SEQ ID NO: 20521 - DNA, 20 bp, Artificial Sequence
  Synthetic oligonucleotide; GGG chr11 5329243 5329262 5329259 +
ccttggcctcccaaagtgct

SEQ ID NO: 20522 - DNA, 20 bp, Artificial Sequence
  Synthetic oligonucleotide; CAG chr11 5329250 5329269 5329266 +
ctcccaaagtgctgggattg

SEQ ID NO: 20523 - DNA, 20 bp, Artificial Sequence
  Synthetic oligonucleotide; AGG chr11 5329251 5329270 5329267 +
tcccaaagtgctgggattgc

SEQ ID NO: 20524 - DNA, 20 bp, Artificial Sequence
  Synthetic oligonucleotide; GAG chr11 5329257 5329276 5329273 +
agtgctgggattgcaggtgt

SEQ ID NO: 20525 - DNA, 20 bp, Artificial Sequence
  Synthetic oligonucleotide; CGG chr11 5329270 5329289 5329286 +
caggtgtgagtcactgcgcc

SEQ ID NO: 20526 - DNA, 20 bp, Artificial Sequence
  Synthetic oligonucleotide; CAG chr11 5329281 5329300 5329297 +
cactgcgcccggctgacatt

SEQ ID NO: 20527 - DNA, 20 bp, Artificial Sequence
  Synthetic oligonucleotide; TAG chr11 5329311 5329330 5329327 +
tcttaaaattatattacttg

SEQ ID NO: 20528 - DNA, 20 bp, Artificial Sequence
  Synthetic oligonucleotide; CAG chr11 5329341 5329360 5329357 +
ccctttttttttttttttgc

SEQ ID NO: 20529 - DNA, 20 bp, Artificial Sequence
  Synthetic oligonucleotide; GAG chr11 5329353 5329372 5329369 +
ttttttgccagatacacaat

SEQ ID NO: 20530 - DNA, 20 bp, Artificial Sequence
  Synthetic oligonucleotide; AGG chr11 5329354 5329373 5329370 +
tttttgccagatacacaatg

SEQ ID NO: 20531 - DNA, 20 bp, Artificial Sequence
  Synthetic oligonucleotide; GAG chr11 5329356 5329375 5329372 +
tttgccagatacacaatgag

SEQ ID NO: 20532 - DNA, 20 bp, Artificial Sequence
  Synthetic oligonucleotide; TAG chr11 5329361 5329380 5329377 +
cagatacacaatgaggagca

SEQ ID NO: 20533 - DNA, 20 bp, Artificial Sequence
  Synthetic oligonucleotide; CAG chr11 5329374 5329393 5329390 +
aggagcatagtctttattca

SEQ ID NO: 20534 - DNA, 20 bp, Artificial Sequence
  Synthetic oligonucleotide; TAG chr11 5329385 5329404 5329401 +
ctttattcacagaatgtaaa

SEQ ID NO: 20535 - DNA, 20 bp, Artificial Sequence
  Synthetic oligonucleotide; AAG chr11 5329399 5329418 5329415 +
tgtaaatagtgtgtaatata

SEQ ID NO: 20536 - DNA, 20 bp, Artificial Sequence
  Synthetic oligonucleotide; TAG chr11 5329406 5329425 5329422 +
agtgtgtaatataaagaaaa

SEQ ID NO: 20537 - DNA, 20 bp, Artificial Sequence
  Synthetic oligonucleotide; TAG chr11 5329425 5329444 5329441 +
atagttaccacaaattttca

SEQ ID NO: 20538 - DNA, 20 bp, Artificial Sequence
  Synthetic oligonucleotide; TAG chr11 5329444 5329463 5329460 +
atagcactatcattactgca

SEQ ID NO: 20539 - DNA, 20 bp, Artificial Sequence
  Synthetic oligonucleotide; TGG chr11 5329448 5329467 5329464 +
cactatcattactgcataga

SEQ ID NO: 20540 - DNA, 20 bp, Artificial Sequence
  Synthetic oligonucleotide; TAG chr11 5329451 5329470 5329467 +
tatcattactgcatagatgg

SEQ ID NO: 20541 - DNA, 20 bp, Artificial Sequence
  Synthetic oligonucleotide; AAG chr11 5329461 5329480 5329477 +
gcatagatggtagcatgcta

SEQ ID NO: 20542 - DNA, 20 bp, Artificial Sequence
  Synthetic oligonucleotide; AGG chr11 5329462 5329481 5329478 +
catagatggtagcatgctaa

SEQ ID NO: 20543 - DNA, 20 bp, Artificial Sequence
  Synthetic oligonucleotide; GGG chr11 5329463 5329482 5329479 +
atagatggtagcatgctaaa

SEQ ID NO: 20544 - DNA, 20 bp, Artificial Sequence
  Synthetic oligonucleotide; GAG chr11 5329465 5329484 5329481 +
agatggtagcatgctaaagg

SEQ ID NO: 20545 - DNA, 20 bp, Artificial Sequence
  Synthetic oligonucleotide; CAG chr11 5329472 5329491 5329488 +
agcatgctaaagggagccca

SEQ ID NO: 20546 - DNA, 20 bp, Artificial Sequence
  Synthetic oligonucleotide; AAG chr11 5329476 5329495 5329492 +
tgctaaagggagcccacaga

SEQ ID NO: 20547 - DNA, 20 bp, Artificial Sequence
  Synthetic oligonucleotide; TGG chr11 5329485 5329504 5329501 +
gagcccacagaaagcatctt

SEQ ID NO: 20548 - DNA, 20 bp, Artificial Sequence
  Synthetic oligonucleotide; GGG chr11 5329486 5329505 5329502 +
agcccacagaaagcatcttt

SEQ ID NO: 20549 - DNA, 20 bp, Artificial Sequence
  Synthetic oligonucleotide; GGG chr11 5329487 5329506 5329503 +
gcccacagaaagcatctttg

SEQ ID NO: 20550 - DNA, 20 bp, Artificial Sequence
  Synthetic oligonucleotide; CAG chr11 5329490 5329509 5329506 +
cacagaaagcatctttgggg

SEQ ID NO: 20551 - DNA, 20 bp, Artificial Sequence
  Synthetic oligonucleotide; AGG chr11 5329491 5329510 5329507 +
acagaaagcatctttggggc

SEQ ID NO: 20552 - DNA, 20 bp, Artificial Sequence
  Synthetic oligonucleotide; GGG chr11 5329492 5329511 5329508 +
cagaaagcatctttggggca

SEQ ID NO: 20553 - DNA, 20 bp, Artificial Sequence
  Synthetic oligonucleotide; GGG chr11 5329493 5329512 5329509 +
agaaagcatctttggggcag

SEQ ID NO: 20554 - DNA, 20 bp, Artificial Sequence
  Synthetic oligonucleotide; AAG chr11 5329508 5329527 5329524 +
ggcaggggaaaatttctcaa

SEQ ID NO: 20555 - DNA, 20 bp, Artificial Sequence
  Synthetic oligonucleotide; AAG chr11 5329522 5329541 5329538 +
tctcaaaagaaatattattt

SEQ ID NO: 20556 - DNA, 20 bp, Artificial Sequence
  Synthetic oligonucleotide; AAG chr11 5329541 5329560 5329557 +
taagctaataattgaaaaac

SEQ ID NO: 20557 - DNA, 20 bp, Artificial Sequence
  Synthetic oligonucleotide; AGG chr11 5329542 5329561 5329558 +
aagctaataattgaaaaaca

SEQ ID NO: 20558 - DNA, 20 bp, Artificial Sequence
  Synthetic oligonucleotide; AAG chr11 5329545 5329564 5329561 +
ctaataattgaaaaacaagg

SEQ ID NO: 20559 - DNA, 20 bp, Artificial Sequence
  Synthetic oligonucleotide; AGG chr11 5329546 5329565 5329562 +
taataattgaaaaacaagga

SEQ ID NO: 20560 - DNA, 20 bp, Artificial Sequence
  Synthetic oligonucleotide; TAG chr11 5329558 5329577 5329574 +
aacaaggaaggtaacaaata

SEQ ID NO: 20561 - DNA, 20 bp, Artificial Sequence
  Synthetic oligonucleotide; AAG chr11 5329570 5329589 5329586 +
aacaaatatagtgtttgtat

SEQ ID NO: 20562 - DNA, 20 bp, Artificial Sequence
  Synthetic oligonucleotide; TGG chr11 5329573 5329592 5329589 +
aaatatagtgtttgtataag

SEQ ID NO: 20563 - DNA, 20 bp, Artificial Sequence
  Synthetic oligonucleotide; GGG chr11 5329574 5329593 5329590 +
aatatagtgtttgtataagt

SEQ ID NO: 20564 - DNA, 20 bp, Artificial Sequence
  Synthetic oligonucleotide; GGG chr11 5329575 5329594 5329591 +
atatagtgtttgtataagtg

SEQ ID NO: 20565 - DNA, 20 bp, Artificial Sequence
  Synthetic oligonucleotide; CAG chr11 5329580 5329599 5329596 +
gtgtttgtataagtggggta

SEQ ID NO: 20566 - DNA, 20 bp, Artificial Sequence
  Synthetic oligonucleotide; AAG chr11 5329589 5329608 5329605 +
taagtggggtacagtttata

SEQ ID NO: 20567 - DNA, 20 bp, Artificial Sequence
  Synthetic oligonucleotide; AGG chr11 5329590 5329609 5329606 +
aagtggggtacagtttataa

SEQ ID NO: 20568 - DNA, 20 bp, Artificial Sequence
  Synthetic oligonucleotide; AAG chr11 5329593 5329612 5329609 +
tggggtacagtttataaagg

SEQ ID NO: 20569 - DNA, 20 bp, Artificial Sequence
  Synthetic oligonucleotide; CAG chr11 5329606 5329625 5329622 +
ataaaggaagaaaaaataca

SEQ ID NO: 20570 - DNA, 20 bp, Artificial Sequence
  Synthetic oligonucleotide; AGG chr11 5329607 5329626 5329623 +
taaaggaagaaaaaatacac

SEQ ID NO: 20571 - DNA, 20 bp, Artificial Sequence
  Synthetic oligonucleotide; TGG chr11 5329613 5329632 5329629 +
aagaaaaaatacacaggcta

SEQ ID NO: 20572 - DNA, 20 bp, Artificial Sequence
  Synthetic oligonucleotide; GGG chr11 5329614 5329633 5329630 +
agaaaaaatacacaggctat

SEQ ID NO: 20573 - DNA, 20 bp, Artificial Sequence
  Synthetic oligonucleotide; GGG chr11 5329615 5329634 5329631 +
gaaaaaatacacaggctatg

SEQ ID NO: 20574 - DNA, 20 bp, Artificial Sequence
  Synthetic oligonucleotide; AAG chr11 5329619 5329638 5329635 +
aaatacacaggctatgggga

SEQ ID NO: 20575 - DNA, 20 bp, Artificial Sequence
  Synthetic oligonucleotide; GAG chr11 5329621 5329640 5329637 +
atacacaggctatggggaaa

SEQ ID NO: 20576 - DNA, 20 bp, Artificial Sequence
  Synthetic oligonucleotide; AAG chr11 5329645 5329664 5329661 +
aaatatgacaaactcaaatc

SEQ ID NO: 20577 - DNA, 20 bp, Artificial Sequence
  Synthetic oligonucleotide; GAG chr11 5329647 5329666 5329663 +
atatgacaaactcaaatcaa

SEQ ID NO: 20578 - DNA, 20 bp, Artificial Sequence
  Synthetic oligonucleotide; TAG chr11 5329655 5329674 5329671 +
aactcaaatcaagagaattc

SEQ ID NO: 20579 - DNA, 20 bp, Artificial Sequence
  Synthetic oligonucleotide; CAG chr11 5329658 5329677 5329674 +
tcaaatcaagagaattctag

SEQ ID NO: 20580 - DNA, 20 bp, Artificial Sequence
  Synthetic oligonucleotide; GAG chr11 5329660 5329679 5329676 +
aaatcaagagaattctagca

SEQ ID NO: 20581 - DNA, 20 bp, Artificial Sequence
  Synthetic oligonucleotide; CAG chr11 5329664 5329683 5329680 +
caagagaattctagcagagc

SEQ ID NO: 20582 - DNA, 20 bp, Artificial Sequence
  Synthetic oligonucleotide; GAG chr11 5329682 5329701 5329698 +
gccagaataacaaaacatgt

SEQ ID NO: 20583 - DNA, 20 bp, Artificial Sequence
  Synthetic oligonucleotide; AAG chr11 5329698 5329717 5329714 +
atgtgagaaaattgaacaca

SEQ ID NO: 20584 - DNA, 20 bp, Artificial Sequence
  Synthetic oligonucleotide; GAG chr11 5329700 5329719 5329716 +
gtgagaaaattgaacacaaa

SEQ ID NO: 20585 - DNA, 20 bp, Artificial Sequence
  Synthetic oligonucleotide; TGG chr11 5329709 5329728 5329725 +
ttgaacacaaagagaatctg

SEQ ID NO: 20586 - DNA, 20 bp, Artificial Sequence
  Synthetic oligonucleotide; TAG chr11 5329712 5329731 5329728 +
aacacaaagagaatctgtgg

SEQ ID NO: 20587 - DNA, 20 bp, Artificial Sequence
  Synthetic oligonucleotide; TGG chr11 5329720 5329739 5329736 +
gagaatctgtggtagcctgt

SEQ ID NO: 20588 - DNA, 20 bp, Artificial Sequence
  Synthetic oligonucleotide; AAG chr11 5329774 5329793 5329790 +
tattattattattatacttt

SEQ ID NO: 20589 - DNA, 20 bp, Artificial Sequence
  Synthetic oligonucleotide; TAG chr11 5329780 5329799 5329796 +
tattattatactttaagttt

SEQ ID NO: 20590 - DNA, 20 bp, Artificial Sequence
  Synthetic oligonucleotide; AGG chr11 5329781 5329800 5329797 +
attattatactttaagtttt

SEQ ID NO: 20591 - DNA, 20 bp, Artificial Sequence
  Synthetic oligonucleotide; GGG chr11 5329782 5329801 5329798 +
ttattatactttaagtttta

SEQ ID NO: 20592 - DNA, 20 bp, Artificial Sequence
  Synthetic oligonucleotide; CAG chr11 5329802 5329821 5329818 +
gggtacatgtgcacaatgtg

SEQ ID NO: 20593 - DNA, 20 bp, Artificial Sequence
  Synthetic oligonucleotide; AGG chr11 5329803 5329822 5329819 +
ggtacatgtgcacaatgtgc

SEQ ID NO: 20594 - DNA, 20 bp, Artificial Sequence
  Synthetic oligonucleotide; TGG chr11 5329835 5329854 5329851 +
tatgtatacatgtgccatgt

SEQ ID NO: 20595 - DNA, 20 bp, Artificial Sequence
  Synthetic oligonucleotide; TAG chr11 5329864 5329883 5329880 +
gcacccattaacttgtcact

SEQ ID NO: 20596 - DNA, 20 bp, Artificial Sequence
  Synthetic oligonucleotide; TAG chr11 5329870 5329889 5329886 +
attaacttgtcacttagcat

SEQ ID NO: 20597 - DNA, 20 bp, Artificial Sequence
  Synthetic oligonucleotide; AGG chr11 5329871 5329890 5329887 +
ttaacttgtcacttagcatt

SEQ ID NO: 20598 - DNA, 20 bp, Artificial Sequence
  Synthetic oligonucleotide; CAG chr11 5329918 5329937 5329934 +
cccttccccccacctcacaa

SEQ ID NO: 20599 - DNA, 20 bp, Artificial Sequence
  Synthetic oligonucleotide; CGG chr11 5329925 5329944 5329941 +
ccccacctcacaacagtccc

SEQ ID NO: 20600 - DNA, 20 bp, Artificial Sequence
  Synthetic oligonucleotide; GAG chr11 5329927 5329946 5329943 +
ccacctcacaacagtccccg

SEQ ID NO: 20601 - DNA, 20 bp, Artificial Sequence
  Synthetic oligonucleotide; GAG chr11 5329984 5330003 5330000 +
attgttcaattcccacctat

SEQ ID NO: 20602 - DNA, 20 bp, Artificial Sequence
  Synthetic oligonucleotide; GAG chr11 5329988 5330007 5330004 +
ttcaattcccacctatgagt

SEQ ID NO: 20603 - DNA, 20 bp, Artificial Sequence
  Synthetic oligonucleotide; CAG chr11 5329997 5330016 5330013 +
cacctatgagtgagaacatg

SEQ ID NO: 20604 - DNA, 20 bp, Artificial Sequence
  Synthetic oligonucleotide; TGG chr11 5330004 5330023 5330020 +
gagtgagaacatgcagtgct

SEQ ID NO: 20605 - DNA, 20 bp, Artificial Sequence
  Synthetic oligonucleotide; TAG chr11 5330023 5330042 5330039 +
ttggttttttgtccttgcga

SEQ ID NO: 20606 - DNA, 20 bp, Artificial Sequence
  Synthetic oligonucleotide; GAG chr11 5330032 5330051 5330048 +
tgtccttgcgatagtttgct

SEQ ID NO: 20607 - DNA, 20 bp, Artificial Sequence
  Synthetic oligonucleotide; TGG chr11 5330040 5330059 5330056 +
cgatagtttgctgagaatga

SEQ ID NO: 20608 - DNA, 20 bp, Artificial Sequence
  Synthetic oligonucleotide; CAG chr11 5330047 5330066 5330063 +
ttgctgagaatgatggtttc

SEQ ID NO: 20609 - DNA, 20 bp, Artificial Sequence
  Synthetic oligonucleotide; TGG chr11 5330094 5330113 5330110 +
catgaactcttcatttttta

SEQ ID NO: 20610 - DNA, 20 bp, Artificial Sequence
  Synthetic oligonucleotide; TAG chr11 5330102 5330121 5330118 +
cttcattttttatggctgca

SEQ ID NO: 20611 - DNA, 20 bp, Artificial Sequence
  Synthetic oligonucleotide; TGG chr11 5330112 5330131 5330128 +
tatggctgcatagtattcca

SEQ ID NO: 20612 - DNA, 20 bp, Artificial Sequence
  Synthetic oligonucleotide; CAG chr11 5330141 5330160 5330157 +
tgtgccacattttcttaatt

SEQ ID NO: 20613 - DNA, 20 bp, Artificial Sequence
  Synthetic oligonucleotide; TGG chr11 5330155 5330174 5330171 +
ttaattcagtctatcattgt

SEQ ID NO: 20614 - DNA, 20 bp, Artificial Sequence
  Synthetic oligonucleotide; TGG chr11 5330163 5330182 5330179 +
gtctatcattgttggacatt

SEQ ID NO: 20615 - DNA, 20 bp, Artificial Sequence
  Synthetic oligonucleotide; GGG chr11 5330164 5330183 5330180 +
tctatcattgttggacattt

SEQ ID NO: 20616 - DNA, 20 bp, Artificial Sequence
  Synthetic oligonucleotide; TGG chr11 5330168 5330187 5330184 +
tcattgttggacatttgggt

SEQ ID NO: 20617 - DNA, 20 bp, Artificial Sequence
  Synthetic oligonucleotide; AAG chr11 5330175 5330194 5330191 +
tggacatttgggttggttcc

SEQ ID NO: 20618 - DNA, 20 bp, Artificial Sequence
  Synthetic oligonucleotide; TAG chr11 5330194 5330213 5330210 +
caagtctttgctattgtgaa

SEQ ID NO: 20619 - DNA, 20 bp, Artificial Sequence
  Synthetic oligonucleotide; CAG chr11 5330202 5330221 5330218 +
tgctattgtgaatagtgcca

SEQ ID NO: 20620 - DNA, 20 bp, Artificial Sequence
  Synthetic oligonucleotide; TAG chr11 5330231 5330250 5330247 +
tacgtgtgcatgtgtcttta

SEQ ID NO: 20621 - DNA, 20 bp, Artificial Sequence
  Synthetic oligonucleotide; CAG chr11 5330234 5330253 5330250 +
gtgtgcatgtgtctttatag

SEQ ID NO: 20622 - DNA, 20 bp, Artificial Sequence
  Synthetic oligonucleotide; TGG chr11 5330254 5330273 5330270 +
cagcatgatttataatccgt

SEQ ID NO: 20623 - DNA, 20 bp, Artificial Sequence
  Synthetic oligonucleotide; GGG chr11 5330255 5330274 5330271 +
agcatgatttataatccgtt

SEQ ID NO: 20624 - DNA, 20 bp, Artificial Sequence
  Synthetic oligonucleotide; CAG chr11 5330266 5330285 5330282 +
taatccgttgggtatatacc

SEQ ID NO: 20625 - DNA, 20 bp, Artificial Sequence
  Synthetic oligonucleotide; TGG chr11 5330272 5330291 5330288 +
gttgggtatatacccagtaa

SEQ ID NO: 20626 - DNA, 20 bp, Artificial Sequence
  Synthetic oligonucleotide; GGG chr11 5330273 5330292 5330289 +
ttgggtatatacccagtaat

SEQ ID NO: 20627 - DNA, 20 bp, Artificial Sequence
  Synthetic oligonucleotide; TGG chr11 5330277 5330296 5330293 +
gtatatacccagtaatggga

SEQ ID NO: 20628 - DNA, 20 bp, Artificial Sequence
  Synthetic oligonucleotide; TGG chr11 5330281 5330300 5330297 +
atacccagtaatgggatggc

SEQ ID NO: 20629 - DNA, 20 bp, Artificial Sequence
  Synthetic oligonucleotide; GGG chr11 5330282 5330301 5330298 +
tacccagtaatgggatggct

SEQ ID NO: 20630 - DNA, 20 bp, Artificial Sequence
  Synthetic oligonucleotide; TGG chr11 5330290 5330309 5330306 +
aatgggatggctgggtcaaa

SEQ ID NO: 20631 - DNA, 20 bp, Artificial Sequence
  Synthetic oligonucleotide; TAG chr11 5330299 5330318 5330315 +
gctgggtcaaatggtatttc

SEQ ID NO: 20632 - DNA, 20 bp, Artificial Sequence
  Synthetic oligonucleotide; TAG chr11 5330305 5330324 5330321 +
tcaaatggtatttctagttc

SEQ ID NO: 20633 - DNA, 20 bp, Artificial Sequence
  Synthetic oligonucleotide; GAG chr11 5330314 5330333 5330330 +
atttctagttctagatccct

SEQ ID NO: 20634 - DNA, 20 bp, Artificial Sequence
  Synthetic oligonucleotide; AGG chr11 5330315 5330334 5330331 +
tttctagttctagatccctg

SEQ ID NO: 20635 - DNA, 20 bp, Artificial Sequence
  Synthetic oligonucleotide; TGG chr11 5330341 5330360 5330357 +
cgccacactgacttccacaa

SEQ ID NO: 20636 - DNA, 20 bp, Artificial Sequence
  Synthetic oligonucleotide; TAG chr11 5330350 5330369 5330366 +
gacttccacaatggttgaac

SEQ ID NO: 20637 - DNA, 20 bp, Artificial Sequence
  Synthetic oligonucleotide; CAG chr11 5330357 5330376 5330373 +
acaatggttgaactagttta

SEQ ID NO: 20638 - DNA, 20 bp, Artificial Sequence
  Synthetic oligonucleotide; AAG chr11 5330367 5330386 5330383 +
aactagtttacagtcccacc

SEQ ID NO: 20639 - DNA, 20 bp, Artificial Sequence
  Synthetic oligonucleotide; GAG chr11 5330369 5330388 5330385 +
ctagtttacagtcccaccaa

SEQ ID NO: 20640 - DNA, 20 bp, Artificial Sequence
  Synthetic oligonucleotide; AAG chr11 5330377 5330396 5330393 +
cagtcccaccaagagtgtaa

SEQ ID NO: 20641 - DNA, 20 bp, Artificial Sequence
  Synthetic oligonucleotide; CAG chr11 5330405 5330424 5330421 +
ctatttctccacatcctctc

SEQ ID NO: 20642 - DNA, 20 bp, Artificial Sequence
  Synthetic oligonucleotide; TGG chr11 5330449 5330468 5330465 +
ttaatgattgccattctaac

SEQ ID NO: 20643 - DNA, 20 bp, Artificial Sequence
  Synthetic oligonucleotide; GAG chr11 5330455 5330474 5330471 +
attgccattctaactggtgt

SEQ ID NO: 20644 - DNA, 20 bp, Artificial Sequence
  Synthetic oligonucleotide; TGG chr11 5330459 5330478 5330475 +
ccattctaactggtgtgaga

SEQ ID NO: 20645 - DNA, 20 bp, Artificial Sequence
  Synthetic oligonucleotide; TGG chr11 5330472 5330491 5330488 +
tgtgagatggtatctctttg

SEQ ID NO: 20646 - DNA, 20 bp, Artificial Sequence
  Synthetic oligonucleotide; TAG chr11 5330498 5330517 5330514 +
tgatttgcattgtgacgtgt

SEQ ID NO: 20647 - DNA, 20 bp, Artificial Sequence
  Synthetic oligonucleotide; AAG chr11 5330506 5330525 5330522 +
attgtgacgtgttagtttta

SEQ ID NO: 20648 - DNA, 20 bp, Artificial Sequence
  Synthetic oligonucleotide; AAG chr11 5330549 5330568 5330565 +
ttcttaacatttttttgatg

SEQ ID NO: 20649 - DNA, 20 bp, Artificial Sequence
  Synthetic oligonucleotide; CAG chr11 5330554 5330573 5330570 +
aacatttttttgatgaagca

SEQ ID NO: 20650 - DNA, 20 bp, Artificial Sequence
  Synthetic oligonucleotide; AAG chr11 5330564 5330583 5330580 +
tgatgaagcacagtgtctga

SEQ ID NO: 20651 - DNA, 20 bp, Artificial Sequence
  Synthetic oligonucleotide; AGG chr11 5330565 5330584 5330581 +
gatgaagcacagtgtctgaa

SEQ ID NO: 20652 - DNA, 20 bp, Artificial Sequence
  Synthetic oligonucleotide; GGG chr11 5330566 5330585 5330582 +
atgaagcacagtgtctgaaa

SEQ ID NO: 20653 - DNA, 20 bp, Artificial Sequence
  Synthetic oligonucleotide; TGG chr11 5330569 5330588 5330585 +
aagcacagtgtctgaaaggg

SEQ ID NO: 20654 - DNA, 20 bp, Artificial Sequence
  Synthetic oligonucleotide; TAG chr11 5330572 5330591 5330588 +
cacagtgtctgaaagggtgg

SEQ ID NO: 20655 - DNA, 20 bp, Artificial Sequence
  Synthetic oligonucleotide; AAG chr11 5330582 5330601 5330598 +
gaaagggtggtagcccaatc

SEQ ID NO: 20656 - DNA, 20 bp, Artificial Sequence
  Synthetic oligonucleotide; CAG chr11 5330598 5330617 5330614 +
aatcaagtgacattaaaaac

SEQ ID NO: 20657 - DNA, 20 bp, Artificial Sequence
  Synthetic oligonucleotide; CAG chr11 5330605 5330624 5330621 +
tgacattaaaaaccagaaca

SEQ ID NO: 20658 - DNA, 20 bp, Artificial Sequence
  Synthetic oligonucleotide; GAG chr11 5330615 5330634 5330631 +
aaccagaacacagctaatgt

SEQ ID NO: 20659 - DNA, 20 bp, Artificial Sequence
  Synthetic oligonucleotide; AAG chr11 5330624 5330643 5330640 +
acagctaatgtgagaaatac

SEQ ID NO: 20660 - DNA, 20 bp, Artificial Sequence
  Synthetic oligonucleotide; TAG chr11 5330631 5330650 5330647 +
atgtgagaaatacaagtatt

SEQ ID NO: 20661 - DNA, 20 bp, Artificial Sequence
  Synthetic oligonucleotide; AGG chr11 5330632 5330651 5330648 +
tgtgagaaatacaagtattt

SEQ ID NO: 20662 - DNA, 20 bp, Artificial Sequence
  Synthetic oligonucleotide; GGG chr11 5330633 5330652 5330649 +
gtgagaaatacaagtattta

SEQ ID NO: 20663 - DNA, 20 bp, Artificial Sequence
  Synthetic oligonucleotide; TAG chr11 5330639 5330658 5330655 +
aatacaagtatttagggcct

SEQ ID NO: 20664 - DNA, 20 bp, Artificial Sequence
  Synthetic oligonucleotide; GAG chr11 5330656 5330675 5330672 +
ccttagtctgctccttgtct

SEQ ID NO: 20665 - DNA, 20 bp, Artificial Sequence
  Synthetic oligonucleotide; AGG chr11 5330657 5330676 5330673 +
cttagtctgctccttgtctg

SEQ ID NO: 20666 - DNA, 20 bp, Artificial Sequence
  Synthetic oligonucleotide; AAG chr11 5330679 5330698 5330695 +
gcaattcccatgaccttctt

SEQ ID NO: 20667 - DNA, 20 bp, Artificial Sequence
  Synthetic oligonucleotide; AGG chr11 5330680 5330699 5330696 +
caattcccatgaccttctta

SEQ ID NO: 20668 - DNA, 20 bp, Artificial Sequence
  Synthetic oligonucleotide; CAG chr11 5330685 5330704 5330701 +
cccatgaccttcttaaggat

SEQ ID NO: 20669 - DNA, 20 bp, Artificial Sequence
  Synthetic oligonucleotide; AAG chr11 5330693 5330712 5330709 +
cttcttaaggatcagaatgt

SEQ ID NO: 20670 - DNA, 20 bp, Artificial Sequence
  Synthetic oligonucleotide; GAG chr11 5330695 5330714 5330711 +
tcttaaggatcagaatgtaa

SEQ ID NO: 20671 - DNA, 20 bp, Artificial Sequence
  Synthetic oligonucleotide; AAG chr11 5330700 5330719 5330716 +
aggatcagaatgtaagagat

SEQ ID NO: 20672 - DNA, 20 bp, Artificial Sequence
  Synthetic oligonucleotide; AGG chr11 5330701 5330720 5330717 +
ggatcagaatgtaagagata

SEQ ID NO: 20673 - DNA, 20 bp, Artificial Sequence
  Synthetic oligonucleotide; AAG chr11 5330706 5330725 5330722 +
agaatgtaagagataaggat

SEQ ID NO: 20674 - DNA, 20 bp, Artificial Sequence
  Synthetic oligonucleotide; AAG chr11 5330713 5330732 5330729 +
aagagataaggataagcaca

SEQ ID NO: 20675 - DNA, 20 bp, Artificial Sequence
  Synthetic oligonucleotide; AAG chr11 5330719 5330738 5330735 +
taaggataagcacaaagtcc

SEQ ID NO: 20676 - DNA, 20 bp, Artificial Sequence
  Synthetic oligonucleotide; CAG chr11 5330726 5330745 5330742 +
aagcacaaagtccaagaaac

SEQ ID NO: 20677 - DNA, 20 bp, Artificial Sequence
  Synthetic oligonucleotide; GAG chr11 5330734 5330753 5330750 +
agtccaagaaaccagttgat

SEQ ID NO: 20678 - DNA, 20 bp, Artificial Sequence
  Synthetic oligonucleotide; CAG chr11 5330739 5330758 5330755 +
aagaaaccagttgatgagac

SEQ ID NO: 20679 - DNA, 20 bp, Artificial Sequence
  Synthetic oligonucleotide; AGG chr11 5330740 5330759 5330756 +
agaaaccagttgatgagacc

SEQ ID NO: 20680 - DNA, 20 bp, Artificial Sequence
  Synthetic oligonucleotide; TAG chr11 5330747 5330766 5330763 +
agttgatgagaccaggacta

SEQ ID NO: 20681 - DNA, 20 bp, Artificial Sequence
  Synthetic oligonucleotide; AGG chr11 5330748 5330767 5330764 +
gttgatgagaccaggactat

SEQ ID NO: 20682 - DNA, 20 bp, Artificial Sequence
  Synthetic oligonucleotide; AAG chr11 5330754 5330773 5330770 +
gagaccaggactataggata

SEQ ID NO: 20683 - DNA, 20 bp, Artificial Sequence
  Synthetic oligonucleotide; AAG chr11 5330764 5330783 5330780 +
ctataggataaagtctatta

SEQ ID NO: 20684 - DNA, 20 bp, Artificial Sequence
  Synthetic oligonucleotide; AGG chr11 5330765 5330784 5330781 +
tataggataaagtctattaa

SEQ ID NO: 20685 - DNA, 20 bp, Artificial Sequence
  Synthetic oligonucleotide; CAG chr11 5330779 5330798 5330795 +
tattaaaggtgatgtctgca

SEQ ID NO: 20686 - DNA, 20 bp, Artificial Sequence
  Synthetic oligonucleotide; AGG chr11 5330780 5330799 5330796 +
attaaaggtgatgtctgcac

SEQ ID NO: 20687 - DNA, 20 bp, Artificial Sequence
  Synthetic oligonucleotide; CAG chr11 5330784 5330803 5330800 +
aaggtgatgtctgcacaggc

SEQ ID NO: 20688 - DNA, 20 bp, Artificial Sequence
  Synthetic oligonucleotide; TGG chr11 5330799 5330818 5330815 +
caggccagtttgatcacatc

SEQ ID NO: 20689 - DNA, 20 bp, Artificial Sequence
  Synthetic oligonucleotide; CAG chr11 5330804 5330823 5330820 +
cagtttgatcacatctggtg

SEQ ID NO: 20690 - DNA, 20 bp, Artificial Sequence
  Synthetic oligonucleotide; AGG chr11 5330805 5330824 5330821 +
agtttgatcacatctggtgc

SEQ ID NO: 20691 - DNA, 20 bp, Artificial Sequence
  Synthetic oligonucleotide; CAG chr11 5330808 5330827 5330824 +
ttgatcacatctggtgcagg

SEQ ID NO: 20692 - DNA, 20 bp, Artificial Sequence
  Synthetic oligonucleotide; AAG chr11 5330812 5330831 5330828 +
tcacatctggtgcaggcaga

SEQ ID NO: 20693 - DNA, 20 bp, Artificial Sequence
  Synthetic oligonucleotide; TGG chr11 5330817 5330836 5330833 +
tctggtgcaggcagaaagca

SEQ ID NO: 20694 - DNA, 20 bp, Artificial Sequence
  Synthetic oligonucleotide; GGG chr11 5330818 5330837 5330834 +
ctggtgcaggcagaaagcat

SEQ ID NO: 20695 - DNA, 20 bp, Artificial Sequence
  Synthetic oligonucleotide; GAG chr11 5330820 5330839 5330836 +
ggtgcaggcagaaagcatgg

SEQ ID NO: 20696 - DNA, 20 bp, Artificial Sequence
  Synthetic oligonucleotide; GAG chr11 5330822 5330841 5330838 +
tgcaggcagaaagcatggga

SEQ ID NO: 20697 - DNA, 20 bp, Artificial Sequence
  Synthetic oligonucleotide; AGG chr11 5330823 5330842 5330839 +
gcaggcagaaagcatgggag

SEQ ID NO: 20698 - DNA, 20 bp, Artificial Sequence
  Synthetic oligonucleotide; TGG chr11 5330829 5330848 5330845 +
agaaagcatgggagaggaca

SEQ ID NO: 20699 - DNA, 20 bp, Artificial Sequence
  Synthetic oligonucleotide; GGG chr11 5330830 5330849 5330846 +
gaaagcatgggagaggacat

SEQ ID NO: 20700 - DNA, 20 bp, Artificial Sequence
  Synthetic oligonucleotide; CAG chr11 5330838 5330857 5330854 +
gggagaggacatgggattga

SEQ ID NO: 20701 - DNA, 20 bp, Artificial Sequence
  Synthetic oligonucleotide; TAG chr11 5330841 5330860 5330857 +
agaggacatgggattgacag

SEQ ID NO: 20702 - DNA, 20 bp, Artificial Sequence
  Synthetic oligonucleotide; AGG chr11 5330842 5330861 5330858 +
gaggacatgggattgacagt

SEQ ID NO: 20703 - DNA, 20 bp, Artificial Sequence
  Synthetic oligonucleotide; GGG chr11 5330843 5330862 5330859 +
aggacatgggattgacagta

SEQ ID NO: 20704 - DNA, 20 bp, Artificial Sequence
  Synthetic oligonucleotide; GGG chr11 5330844 5330863 5330860 +
ggacatgggattgacagtag

SEQ ID NO: 20705 - DNA, 20 bp, Artificial Sequence
  Synthetic oligonucleotide; CAG chr11 5330851 5330870 5330867 +
ggattgacagtaggggaatc

SEQ ID NO: 20706 - DNA, 20 bp, Artificial Sequence
  Synthetic oligonucleotide; GAG chr11 5330853 5330872 5330869 +
attgacagtaggggaatcca

SEQ ID NO: 20707 - DNA, 20 bp, Artificial Sequence
  Synthetic oligonucleotide; GAG chr11 5330855 5330874 5330871 +
tgacagtaggggaatccaga

SEQ ID NO: 20708 - DNA, 20 bp, Artificial Sequence
  Synthetic oligonucleotide; AGG chr11 5330856 5330875 5330872 +
gacagtaggggaatccagag

SEQ ID NO: 20709 - DNA, 20 bp, Artificial Sequence
  Synthetic oligonucleotide; GGG chr11 5330857 5330876 5330873 +
acagtaggggaatccagaga

SEQ ID NO: 20710 - DNA, 20 bp, Artificial Sequence
  Synthetic oligonucleotide; TGG chr11 5330869 5330888 5330885 +
tccagagagggtgatgatta

SEQ ID NO: 20711 - DNA, 20 bp, Artificial Sequence
  Synthetic oligonucleotide; GGG chr11 5330870 5330889 5330886 +
ccagagagggtgatgattat

SEQ ID NO: 20712 - DNA, 20 bp, Artificial Sequence
  Synthetic oligonucleotide; TAG chr11 5330879 5330898 5330895 +
gtgatgattatgggcacaat

SEQ ID NO: 20713 - DNA, 20 bp, Artificial Sequence
  Synthetic oligonucleotide; CAG chr11 5330909 5330928 5330925 +
aatcccctcatttgaacccc

SEQ ID NO: 20714 - DNA, 20 bp, Artificial Sequence
  Synthetic oligonucleotide; TAG chr11 5330929 5330948 5330945 +
cagatctatcttcaccacct

SEQ ID NO: 20715 - DNA, 20 bp, Artificial Sequence
  Synthetic oligonucleotide; TGG chr11 5330935 5330954 5330951 +
tatcttcaccaccttagcat

SEQ ID NO: 20716 - DNA, 20 bp, Artificial Sequence
  Synthetic oligonucleotide; GAG chr11 5330939 5330958 5330955 +
ttcaccaccttagcattggt

SEQ ID NO: 20717 - DNA, 20 bp, Artificial Sequence
  Synthetic oligonucleotide; TGG chr11 5330944 5330963 5330960 +
caccttagcattggtgagaa

SEQ ID NO: 20718 - DNA, 20 bp, Artificial Sequence
  Synthetic oligonucleotide; GAG chr11 5330946 5330965 5330962 +
ccttagcattggtgagaatg

SEQ ID NO: 20719 - DNA, 20 bp, Artificial Sequence
  Synthetic oligonucleotide; AGG chr11 5330947 5330966 5330963 +
cttagcattggtgagaatgg

SEQ ID NO: 20720 - DNA, 20 bp, Artificial Sequence
  Synthetic oligonucleotide; CAG chr11 5330957 5330976 5330973 +
gtgagaatggaggtgtatct

SEQ ID NO: 20721 - DNA, 20 bp, Artificial Sequence
  Synthetic oligonucleotide; AGG chr11 5330958 5330977 5330974 +
tgagaatggaggtgtatctc

SEQ ID NO: 20722 - DNA, 20 bp, Artificial Sequence
  Synthetic oligonucleotide; GGG chr11 5330959 5330978 5330975 +
gagaatggaggtgtatctca

SEQ ID NO: 20723 - DNA, 20 bp, Artificial Sequence
  Synthetic oligonucleotide; GGG chr11 5330960 5330979 5330976 +
agaatggaggtgtatctcag

SEQ ID NO: 20724 - DNA, 20 bp, Artificial Sequence
  Synthetic oligonucleotide; TGG chr11 5330967 5330986 5330983 +
aggtgtatctcaggggatta

SEQ ID NO: 20725 - DNA, 20 bp, Artificial Sequence
  Synthetic oligonucleotide; CAG chr11 5330982 5331001 5330998 +
gattatggatgccaataaaa

SEQ ID NO: 20726 - DNA, 20 bp, Artificial Sequence
  Synthetic oligonucleotide; TGG chr11 5330988 5331007 5331004 +
ggatgccaataaaacagtca

SEQ ID NO: 20727 - DNA, 20 bp, Artificial Sequence
  Synthetic oligonucleotide; GGG chr11 5330989 5331008 5331005 +
gatgccaataaaacagtcat

SEQ ID NO: 20728 - DNA, 20 bp, Artificial Sequence
  Synthetic oligonucleotide; GAG chr11 5330999 5331018 5331015 +
aaacagtcatgggccatgat

SEQ ID NO: 20729 - DNA, 20 bp, Artificial Sequence
  Synthetic oligonucleotide; TGG chr11 5331010 5331029 5331026 +
ggccatgatgagcaacactc

SEQ ID NO: 20730 - DNA, 20 bp, Artificial Sequence
  Synthetic oligonucleotide; TAG chr11 5331022 5331041 5331038 +
caacactctggactccacga

SEQ ID NO: 20731 - DNA, 20 bp, Artificial Sequence
  Synthetic oligonucleotide; GAG chr11 5331024 5331043 5331040 +
acactctggactccacgata

SEQ ID NO: 20732 - DNA, 20 bp, Artificial Sequence
  Synthetic oligonucleotide; GAG chr11 5331026 5331045 5331042 +
actctggactccacgataga

SEQ ID NO: 20733 - DNA, 20 bp, Artificial Sequence
  Synthetic oligonucleotide; AGG chr11 5331027 5331046 5331043 +
ctctggactccacgatagag

SEQ ID NO: 20734 - DNA, 20 bp, Artificial Sequence
  Synthetic oligonucleotide; GGG chr11 5331028 5331047 5331044 +
tctggactccacgatagaga

SEQ ID NO: 20735 - DNA, 20 bp, Artificial Sequence
  Synthetic oligonucleotide; GAG chr11 5331030 5331049 5331046 +
tggactccacgatagagagg

SEQ ID NO: 20736 - DNA, 20 bp, Artificial Sequence
  Synthetic oligonucleotide; TGG chr11 5331033 5331052 5331049 +
actccacgatagagagggag

SEQ ID NO: 20737 - DNA, 20 bp, Artificial Sequence
  Synthetic oligonucleotide; TAG chr11 5331038 5331057 5331054 +
acgatagagagggagtggat

SEQ ID NO: 20738 - DNA, 20 bp, Artificial Sequence
  Synthetic oligonucleotide; TAG chr11 5331042 5331061 5331058 +
tagagagggagtggattaga

SEQ ID NO: 20739 - DNA, 20 bp, Artificial Sequence
  Synthetic oligonucleotide; AGG chr11 5331043 5331062 5331059 +
agagagggagtggattagat

SEQ ID NO: 20740 - DNA, 20 bp, Artificial Sequence
  Synthetic oligonucleotide; TGG chr11 5331048 5331067 5331064 +
gggagtggattagataggcc

SEQ ID NO: 20741 - DNA, 20 bp, Artificial Sequence
  Synthetic oligonucleotide; GAG chr11 5331050 5331069 5331066 +
gagtggattagataggcctg

SEQ ID NO: 20742 - DNA, 20 bp, Artificial Sequence
  Synthetic oligonucleotide; AGG chr11 5331051 5331070 5331067 +
agtggattagataggcctgg

SEQ ID NO: 20743 - DNA, 20 bp, Artificial Sequence
  Synthetic oligonucleotide; AAG chr11 5331054 5331073 5331070 +
ggattagataggcctggagg

SEQ ID NO: 20744 - DNA, 20 bp, Artificial Sequence
  Synthetic oligonucleotide; CAG chr11 5331057 5331076 5331073 +
ttagataggcctggaggaag

SEQ ID NO: 20745 - DNA, 20 bp, Artificial Sequence
  Synthetic oligonucleotide; AGG chr11 5331058 5331077 5331074 +
tagataggcctggaggaagc

SEQ ID NO: 20746 - DNA, 20 bp, Artificial Sequence
  Synthetic oligonucleotide; TGG chr11 5331066 5331085 5331082 +
cctggaggaagcaggctcca

SEQ ID NO: 20747 - DNA, 20 bp, Artificial Sequence
  Synthetic oligonucleotide; TAG chr11 5331086 5331105 5331102 +
tggctcattttcctgtgatc

SEQ ID NO: 20748 - DNA, 20 bp, Artificial Sequence
  Synthetic oligonucleotide; CAG chr11 5331090 5331109 5331106 +
tcattttcctgtgatctagc

SEQ ID NO: 20749 - DNA, 20 bp, Artificial Sequence
  Synthetic oligonucleotide; GAG chr11 5331092 5331111 5331108 +
attttcctgtgatctagcca

SEQ ID NO: 20750 - DNA, 20 bp, Artificial Sequence
  Synthetic oligonucleotide; AAG chr11 5331101 5331120 5331117 +
tgatctagccagagaacacc

SEQ ID NO: 20751 - DNA, 20 bp, Artificial Sequence
  Synthetic oligonucleotide; AGG chr11 5331102 5331121 5331118 +
gatctagccagagaacacca

SEQ ID NO: 20752 - DNA, 20 bp, Artificial Sequence
  Synthetic oligonucleotide; CAG chr11 5331106 5331125 5331122 +
tagccagagaacaccaagga

SEQ ID NO: 20753 - DNA, 20 bp, Artificial Sequence
  Synthetic oligonucleotide; TGG chr11 5331109 5331128 5331125 +
ccagagaacaccaaggacag

SEQ ID NO: 20754 - DNA, 20 bp, Artificial Sequence
  Synthetic oligonucleotide; AAG chr11 5331124 5331143 5331140 +
gacagtggacattgttgtca

SEQ ID NO: 20755 - DNA, 20 bp, Artificial Sequence
  Synthetic oligonucleotide; AAG chr11 5331134 5331153 5331150 +
attgttgtcaaagttacacc

SEQ ID NO: 20756 - DNA, 20 bp, Artificial Sequence
  Synthetic oligonucleotide; AGG chr11 5331135 5331154 5331151 +
ttgttgtcaaagttacacca

SEQ ID NO: 20757 - DNA, 20 bp, Artificial Sequence
  Synthetic oligonucleotide; TGG chr11 5331142 5331161 5331158 +
caaagttacaccaaggtcta

SEQ ID NO: 20758 - DNA, 20 bp, Artificial Sequence
  Synthetic oligonucleotide; CAG chr11 5331149 5331168 5331165 +
acaccaaggtctatggctgc

SEQ ID NO: 20759 - DNA, 20 bp, Artificial Sequence
  Synthetic oligonucleotide; TAG chr11 5331154 5331173 5331170 +
aaggtctatggctgccagta

SEQ ID NO: 20760 - DNA, 20 bp, Artificial Sequence
  Synthetic oligonucleotide; CAG chr11 5331158 5331177 5331174 +
tctatggctgccagtatagt

SEQ ID NO: 20761 - DNA, 20 bp, Artificial Sequence
  Synthetic oligonucleotide; GAG chr11 5331160 5331179 5331176 +
tatggctgccagtatagtca

SEQ ID NO: 20762 - DNA, 20 bp, Artificial Sequence
  Synthetic oligonucleotide; GAG chr11 5331162 5331181 5331178 +
tggctgccagtatagtcaga

SEQ ID NO: 20763 - DNA, 20 bp, Artificial Sequence
  Synthetic oligonucleotide; TAG chr11 5331165 5331184 5331181 +
ctgccagtatagtcagagag

SEQ ID NO: 20764 - DNA, 20 bp, Artificial Sequence
  Synthetic oligonucleotide; CGG chr11 5331172 5331191 5331188 +
tatagtcagagagtagtaca

SEQ ID NO: 20765 - DNA, 20 bp, Artificial Sequence
  Synthetic oligonucleotide; GGG chr11 5331173 5331192 5331189 +
atagtcagagagtagtacac

SEQ ID NO: 20766 - DNA, 20 bp, Artificial Sequence
  Synthetic oligonucleotide; AAG chr11 5331182 5331201 5331198 +
gagtagtacacgggctcatg

SEQ ID NO: 20767 - DNA, 20 bp, Artificial Sequence
  Synthetic oligonucleotide; GAG chr11 5331184 5331203 5331200 +
gtagtacacgggctcatgaa

SEQ ID NO: 20768 - DNA, 20 bp, Artificial Sequence
  Synthetic oligonucleotide; CAG chr11 5331189 5331208 5331205 +
acacgggctcatgaagagtg

SEQ ID NO: 20769 - DNA, 20 bp, Artificial Sequence
  Synthetic oligonucleotide; AAG chr11 5331204 5331223 5331220 +
gagtgcagtcttctctgata

SEQ ID NO: 20770 - DNA, 20 bp, Artificial Sequence
  Synthetic oligonucleotide; GAG chr11 5331206 5331225 5331222 +
gtgcagtcttctctgataaa

SEQ ID NO: 20771 - DNA, 20 bp, Artificial Sequence
  Synthetic oligonucleotide; AGG chr11 5331207 5331226 5331223 +
tgcagtcttctctgataaag

SEQ ID NO: 20772 - DNA, 20 bp, Artificial Sequence
  Synthetic oligonucleotide; GAG chr11 5331209 5331228 5331225 +
cagtcttctctgataaagag

SEQ ID NO: 20773 - DNA, 20 bp, Artificial Sequence
  Synthetic oligonucleotide; AGG chr11 5331210 5331229 5331226 +
agtcttctctgataaagagg

SEQ ID NO: 20774 - DNA, 20 bp, Artificial Sequence
  Synthetic oligonucleotide; GAG chr11 5331212 5331231 5331228 +
tcttctctgataaagaggag

SEQ ID NO: 20775 - DNA, 20 bp, Artificial Sequence
  Synthetic oligonucleotide; AGG chr11 5331213 5331232 5331229 +
cttctctgataaagaggagg

SEQ ID NO: 20776 - DNA, 20 bp, Artificial Sequence
  Synthetic oligonucleotide; AAG chr11 5331227 5331246 5331243 +
aggaggaggctgccattgcc

SEQ ID NO: 20777 - DNA, 20 bp, Artificial Sequence
  Synthetic oligonucleotide; AGG chr11 5331228 5331247 5331244 +
ggaggaggctgccattgcca

SEQ ID NO: 20778 - DNA, 20 bp, Artificial Sequence
  Synthetic oligonucleotide; TAG chr11 5331235 5331254 5331251 +
gctgccattgccaaggactg

SEQ ID NO: 20779 - DNA, 20 bp, Artificial Sequence
  Synthetic oligonucleotide; GAG chr11 5331237 5331256 5331253 +
tgccattgccaaggactgta

SEQ ID NO: 20780 - DNA, 20 bp, Artificial Sequence
  Synthetic oligonucleotide; TAG chr11 5331243 5331262 5331259 +
tgccaaggactgtagagaca

SEQ ID NO: 20781 - DNA, 20 bp, Artificial Sequence
  Synthetic oligonucleotide; AAG chr11 5331252 5331271 5331268 +
ctgtagagacatagatgata

SEQ ID NO: 20782 - DNA, 20 bp, Artificial Sequence
  Synthetic oligonucleotide; AAG chr11 5331255 5331274 5331271 +
tagagacatagatgataaag

SEQ ID NO: 20783 - DNA, 20 bp, Artificial Sequence
  Synthetic oligonucleotide; AGG chr11 5331256 5331275 5331272 +
agagacatagatgataaaga

SEQ ID NO: 20784 - DNA, 20 bp, Artificial Sequence
  Synthetic oligonucleotide; GAG chr11 5331258 5331277 5331274 +
agacatagatgataaagaag

SEQ ID NO: 20785 - DNA, 20 bp, Artificial Sequence
  Synthetic oligonucleotide; TAG chr11 5331262 5331281 5331278 +
atagatgataaagaaggaga

SEQ ID NO: 20786 - DNA, 20 bp, Artificial Sequence
  Synthetic oligonucleotide; AAG chr11 5331271 5331290 5331287 +
aaagaaggagatagaactcc

SEQ ID NO: 20787 - DNA, 20 bp, Artificial Sequence
  Synthetic oligonucleotide; AGG chr11 5331272 5331291 5331288 +
aagaaggagatagaactcca

SEQ ID NO: 20788 - DNA, 20 bp, Artificial Sequence
  Synthetic oligonucleotide; CAG chr11 5331287 5331306 5331303 +
ctccaaggatgaaatctctc

SEQ ID NO: 20789 - DNA, 20 bp, Artificial Sequence
  Synthetic oligonucleotide; TGG chr11 5331293 5331312 5331309 +
ggatgaaatctctccagacc

SEQ ID NO: 20790 - DNA, 20 bp, Artificial Sequence
  Synthetic oligonucleotide; AAG chr11 5331297 5331316 5331313 +
gaaatctctccagacctgga

SEQ ID NO: 20791 - DNA, 20 bp, Artificial Sequence
  Synthetic oligonucleotide; CAG chr11 5331301 5331320 5331317 +
tctctccagacctggaaagc

SEQ ID NO: 20792 - DNA, 20 bp, Artificial Sequence
  Synthetic oligonucleotide; GAG chr11 5331305 5331324 5331321 +
tccagacctggaaagccagt

SEQ ID NO: 20793 - DNA, 20 bp, Artificial Sequence
  Synthetic oligonucleotide; AGG chr11 5331306 5331325 5331322 +
ccagacctggaaagccagtg

SEQ ID NO: 20794 - DNA, 20 bp, Artificial Sequence
  Synthetic oligonucleotide; GAG chr11 5331308 5331327 5331324 +
agacctggaaagccagtgag

SEQ ID NO: 20795 - DNA, 20 bp, Artificial Sequence
  Synthetic oligonucleotide; AAG chr11 5331313 5331332 5331329 +
tggaaagccagtgaggagaa

SEQ ID NO: 20796 - DNA, 20 bp, Artificial Sequence
  Synthetic oligonucleotide; AGG chr11 5331314 5331333 5331330 +
ggaaagccagtgaggagaaa

SEQ ID NO: 20797 - DNA, 20 bp, Artificial Sequence
  Synthetic oligonucleotide; GGG chr11 5331315 5331334 5331331 +
gaaagccagtgaggagaaaa

SEQ ID NO: 20798 - DNA, 20 bp, Artificial Sequence
  Synthetic oligonucleotide; GGG chr11 5331316 5331335 5331332 +
aaagccagtgaggagaaaag

SEQ ID NO: 20799 - DNA, 20 bp, Artificial Sequence
  Synthetic oligonucleotide; CAG chr11 5331319 5331338 5331335 +
gccagtgaggagaaaagggg

SEQ ID NO: 20800 - DNA, 20 bp, Artificial Sequence
  Synthetic oligonucleotide; CAG chr11 5331322 5331341 5331338 +
agtgaggagaaaaggggcag

SEQ ID NO: 20801 - DNA, 20 bp, Artificial Sequence
  Synthetic oligonucleotide; TGG chr11 5331328 5331347 5331344 +
gagaaaaggggcagcagtaa

SEQ ID NO: 20802 - DNA, 20 bp, Artificial Sequence
  Synthetic oligonucleotide; TGG chr11 5331331 5331350 5331347 +
aaaaggggcagcagtaatgg

SEQ ID NO: 20803 - DNA, 20 bp, Artificial Sequence
  Synthetic oligonucleotide; GGG chr11 5331332 5331351 5331348 +
aaaggggcagcagtaatggt

SEQ ID NO: 20804 - DNA, 20 bp, Artificial Sequence
  Synthetic oligonucleotide; TGG chr11 5331340 5331359 5331356 +
agcagtaatggtgggtgaca

SEQ ID NO: 20805 - DNA, 20 bp, Artificial Sequence
  Synthetic oligonucleotide; TGG chr11 5331343 5331362 5331359 +
agtaatggtgggtgacatgg

SEQ ID NO: 20806 - DNA, 20 bp, Artificial Sequence
  Synthetic oligonucleotide; GAG chr11 5331352 5331371 5331368 +
gggtgacatggtggatacct

SEQ ID NO: 20807 - DNA, 20 bp, Artificial Sequence
  Synthetic oligonucleotide; AGG chr11 5331353 5331372 5331369 +
ggtgacatggtggatacctg

SEQ ID NO: 20808 - DNA, 20 bp, Artificial Sequence
  Synthetic oligonucleotide; GAG chr11 5331355 5331374 5331371 +
tgacatggtggatacctgag

SEQ ID NO: 20809 - DNA, 20 bp, Artificial Sequence
  Synthetic oligonucleotide; CAG chr11 5331374 5331393 5331390 +
ggagaaacaaacaaacaaaa

SEQ ID NO: 20810 - DNA, 20 bp, Artificial Sequence
  Synthetic oligonucleotide; TAG chr11 5331382 5331401 5331398 +
aaacaaacaaaacagctctc

SEQ ID NO: 20811 - DNA, 20 bp, Artificial Sequence
  Synthetic oligonucleotide; CAG chr11 5331387 5331406 5331403 +
aacaaaacagctctctagac

SEQ ID NO: 20812 - DNA, 20 bp, Artificial Sequence
  Synthetic oligonucleotide; TGG chr11 5331397 5331416 5331413 +
ctctctagaccagcactatg

SEQ ID NO: 20813 - DNA, 20 bp, Artificial Sequence
  Synthetic oligonucleotide; TGG chr11 5331400 5331419 5331416 +
tctagaccagcactatgtgg

SEQ ID NO: 20814 - DNA, 20 bp, Artificial Sequence
  Synthetic oligonucleotide; TAG chr11 5331412 5331431 5331428 +
ctatgtggtggaaatataat

SEQ ID NO: 20815 - DNA, 20 bp, Artificial Sequence
  Synthetic oligonucleotide; GAG chr11 5331414 5331433 5331430 +
atgtggtggaaatataatta

SEQ ID NO: 20816 - DNA, 20 bp, Artificial Sequence
  Synthetic oligonucleotide; TGG chr11 5331441 5331460 5331457 +
atatgtgatgttaaatgttc

SEQ ID NO: 20817 - DNA, 20 bp, Artificial Sequence
  Synthetic oligonucleotide; TAG chr11 5331444 5331463 5331460 +
tgtgatgttaaatgttctgg

SEQ ID NO: 20818 - DNA, 20 bp, Artificial Sequence
  Synthetic oligonucleotide; AAG chr11 5331456 5331475 5331472 +
tgttctggtagtcacattaa

SEQ ID NO: 20819 - DNA, 20 bp, Artificial Sequence
  Synthetic oligonucleotide; AGG chr11 5331457 5331476 5331473 +
gttctggtagtcacattaaa

SEQ ID NO: 20820 - DNA, 20 bp, Artificial Sequence
  Synthetic oligonucleotide; GAG chr11 5331459 5331478 5331475 +
tctggtagtcacattaaaag

SEQ ID NO: 20821 - DNA, 20 bp, Artificial Sequence
  Synthetic oligonucleotide; AAG chr11 5331466 5331485 5331482 +
gtcacattaaaaggagtaaa

SEQ ID NO: 20822 - DNA, 20 bp, Artificial Sequence
  Synthetic oligonucleotide; AAG chr11 5331471 5331490 5331487 +
attaaaaggagtaaaaagaa

SEQ ID NO: 20823 - DNA, 20 bp, Artificial Sequence
  Synthetic oligonucleotide; TGG chr11 5331474 5331493 5331490 +
aaaaggagtaaaaagaaaag

SEQ ID NO: 20824 - DNA, 20 bp, Artificial Sequence
  Synthetic oligonucleotide; TAG chr11 5331489 5331508 5331505 +
aaaagtggtaaaattaatat

SEQ ID NO: 20825 - DNA, 20 bp, Artificial Sequence
  Synthetic oligonucleotide; AAG chr11 5331504 5331523 5331520 +
aatattagtatgtcttattt

SEQ ID NO: 20826 - DNA, 20 bp, Artificial Sequence
  Synthetic oligonucleotide; TAG chr11 5331536 5331555 5331552 +
caaaaatattatcattttaa

SEQ ID NO: 20827 - DNA, 20 bp, Artificial Sequence
  Synthetic oligonucleotide; CAG chr11 5331544 5331563 5331560 +
ttatcattttaatagataat

SEQ ID NO: 20828 - DNA, 20 bp, Artificial Sequence
  Synthetic oligonucleotide; GAG chr11 5331563 5331582 5331579 +
tcagcataaaaatcatatat

SEQ ID NO: 20829 - DNA, 20 bp, Artificial Sequence
  Synthetic oligonucleotide; TAG chr11 5331567 5331586 5331583 +
cataaaaatcatatatgaga

SEQ ID NO: 20830 - DNA, 20 bp, Artificial Sequence
  Synthetic oligonucleotide; TGG chr11 5331587 5331606 5331603 +
tagttcccacgatttttttt

SEQ ID NO: 20831 - DNA, 20 bp, Artificial Sequence
  Synthetic oligonucleotide; GAG chr11 5331608 5331627 5331624 +
ggtacaaattcttcaaaatc

SEQ ID NO: 20832 - DNA, 20 bp, Artificial Sequence
  Synthetic oligonucleotide; CAG chr11 5331623 5331642 5331639 +
aaatcgagtgtttacactta

SEQ ID NO: 20833 - DNA, 20 bp, Artificial Sequence
  Synthetic oligonucleotide; AAG chr11 5331639 5331658 5331655 +
cttacagaaaattctgactc

SEQ ID NO: 20834 - DNA, 20 bp, Artificial Sequence
  Synthetic oligonucleotide; CAG chr11 5331647 5331666 5331663 +
aaattctgactcaagctaac

SEQ ID NO: 20835 - DNA, 20 bp, Artificial Sequence
  Synthetic oligonucleotide; TGG chr11 5331662 5331681 5331678 +
ctaaccagatgctactgttt

SEQ ID NO: 20836 - DNA, 20 bp, Artificial Sequence
  Synthetic oligonucleotide; CAG chr11 5331666 5331685 5331682 +
ccagatgctactgttttgga

SEQ ID NO: 20837 - DNA, 20 bp, Artificial Sequence
  Synthetic oligonucleotide; CAG chr11 5331671 5331690 5331687 +
tgctactgttttggacagca

SEQ ID NO: 20838 - DNA, 20 bp, Artificial Sequence
  Synthetic oligonucleotide; TAG chr11 5331677 5331696 5331693 +
tgttttggacagcacagctc

SEQ ID NO: 20839 - DNA, 20 bp, Artificial Sequence
  Synthetic oligonucleotide; CAG chr11 5331698 5331717 5331714 +
agactatacgacttcatcct

SEQ ID NO: 20840 - DNA, 20 bp, Artificial Sequence
  Synthetic oligonucleotide; CAG chr11 5331710 5331729 5331726 +
ttcatcctcagtttcgactc

SEQ ID NO: 20841 - DNA, 20 bp, Artificial Sequence
  Synthetic oligonucleotide; CAG chr11 5331732 5331751 5331748 +
gctgctttctaccacccttt

SEQ ID NO: 20842 - DNA, 20 bp, Artificial Sequence
  Synthetic oligonucleotide; AAG chr11 5331761 5331780 5331777 +
tgcttcatcaaaaaaatgtt

SEQ ID NO: 20843 - DNA, 20 bp, Artificial Sequence
  Synthetic oligonucleotide; TGG chr11 5331807 5331826 5331823 +
tttaaaactaacacatatat

SEQ ID NO: 20844 - DNA, 20 bp, Artificial Sequence
  Synthetic oligonucleotide; AAG chr11 5331812 5331831 5331828 +
aactaacacatatattggaa

SEQ ID NO: 20845 - DNA, 20 bp, Artificial Sequence
  Synthetic oligonucleotide; AAG chr11 5331816 5331835 5331832 +
aacacatatattggaaaaga

SEQ ID NO: 20846 - DNA, 20 bp, Artificial Sequence
  Synthetic oligonucleotide; TAG chr11 5331832 5331851 5331848 +
aagaaagtctcctctctcac

SEQ ID NO: 20847 - DNA, 20 bp, Artificial Sequence
  Synthetic oligonucleotide; TGG chr11 5331847 5331866 5331863 +
ctcactagctattttttaaa

SEQ ID NO: 20848 - DNA, 20 bp, Artificial Sequence
  Synthetic oligonucleotide; TAG chr11 5331855 5331874 5331871 +
ctattttttaaatggtgtga

SEQ ID NO: 20849 - DNA, 20 bp, Artificial Sequence
  Synthetic oligonucleotide; AGG chr11 5331856 5331875 5331872 +
tattttttaaatggtgtgat

SEQ ID NO: 20850 - DNA, 20 bp, Artificial Sequence
  Synthetic oligonucleotide; AAG chr11 5331885 5331904 5331901 +
tttaaaaacctttctaccac

SEQ ID NO: 20851 - DNA, 20 bp, Artificial Sequence
  Synthetic oligonucleotide; TAG chr11 5331906 5331925 5331922 +
agatttcctatcctaatttc

SEQ ID NO: 20852 - DNA, 20 bp, Artificial Sequence
  Synthetic oligonucleotide; AGG chr11 5331907 5331926 5331923 +
gatttcctatcctaatttct

SEQ ID NO: 20853 - DNA, 20 bp, Artificial Sequence
  Synthetic oligonucleotide; TGG chr11 5331937 5331956 5331953 +
atatgatacaatatcatgct

SEQ ID NO: 20854 - DNA, 20 bp, Artificial Sequence
  Synthetic oligonucleotide; GGG chr11 5331938 5331957 5331954 +
tatgatacaatatcatgctt

SEQ ID NO: 20855 - DNA, 20 bp, Artificial Sequence
  Synthetic oligonucleotide; GGG chr11 5331939 5331958 5331955 +
atgatacaatatcatgcttg

SEQ ID NO: 20856 - DNA, 20 bp, Artificial Sequence
  Synthetic oligonucleotide; CAG chr11 5331947 5331966 5331963 +
atatcatgcttggggttata

SEQ ID NO: 20857 - DNA, 20 bp, Artificial Sequence
  Synthetic oligonucleotide; AAG chr11 5331959 5331978 5331975 +
gggttatacagatgtaatta

SEQ ID NO: 20858 - DNA, 20 bp, Artificial Sequence
  Synthetic oligonucleotide; GAG chr11 5331981 5332000 5331997 +
gttgctgatctattgacttt

SEQ ID NO: 20859 - DNA, 20 bp, Artificial Sequence
  Synthetic oligonucleotide; AAG chr11 5331993 5332012 5332009 +
ttgactttgagttaattgaa

SEQ ID NO: 20860 - DNA, 20 bp, Artificial Sequence
  Synthetic oligonucleotide; AGG chr11 5331994 5332013 5332010 +
tgactttgagttaattgaaa

SEQ ID NO: 20861 - DNA, 20 bp, Artificial Sequence
  Synthetic oligonucleotide; CAG chr11 5332005 5332024 5332021 +
taattgaaaaggaaattact

SEQ ID NO: 20862 - DNA, 20 bp, Artificial Sequence
  Synthetic oligonucleotide; AGG chr11 5332006 5332025 5332022 +
aattgaaaaggaaattactc

SEQ ID NO: 20863 - DNA, 20 bp, Artificial Sequence
  Synthetic oligonucleotide; GGG chr11 5332007 5332026 5332023 +
attgaaaaggaaattactca

SEQ ID NO: 20864 - DNA, 20 bp, Artificial Sequence
  Synthetic oligonucleotide; GGG chr11 5332008 5332027 5332024 +
ttgaaaaggaaattactcag

SEQ ID NO: 20865 - DNA, 20 bp, Artificial Sequence
  Synthetic oligonucleotide; TAG chr11 5332015 5332034 5332031 +
ggaaattactcaggggaacc

SEQ ID NO: 20866 - DNA, 20 bp, Artificial Sequence
  Synthetic oligonucleotide; GAG chr11 5332029 5332048 5332045 +
ggaacctagtctaattccat

SEQ ID NO: 20867 - DNA, 20 bp, Artificial Sequence
  Synthetic oligonucleotide; AAG chr11 5332039 5332058 5332055 +
ctaattccatgagcccctaa

SEQ ID NO: 20868 - DNA, 20 bp, Artificial Sequence
  Synthetic oligonucleotide; CAG chr11 5332042 5332061 5332058 +
attccatgagcccctaaaag

SEQ ID NO: 20869 - DNA, 20 bp, Artificial Sequence
  Synthetic oligonucleotide; GAG chr11 5332044 5332063 5332060 +
tccatgagcccctaaaagca

SEQ ID NO: 20870 - DNA, 20 bp, Artificial Sequence
  Synthetic oligonucleotide; AAG chr11 5332055 5332074 5332071 +
ctaaaagcagagttttcacc

SEQ ID NO: 20871 - DNA, 20 bp, Artificial Sequence
  Synthetic oligonucleotide; TAG chr11 5332058 5332077 5332074 +
aaagcagagttttcaccaag

SEQ ID NO: 20872 - DNA, 20 bp, Artificial Sequence
  Synthetic oligonucleotide; TAG chr11 5332061 5332080 5332077 +
gcagagttttcaccaagtag

SEQ ID NO: 20873 - DNA, 20 bp, Artificial Sequence
  Synthetic oligonucleotide; AGG chr11 5332062 5332081 5332078 +
cagagttttcaccaagtagt

SEQ ID NO: 20874 - DNA, 20 bp, Artificial Sequence
  Synthetic oligonucleotide; GAG chr11 5332064 5332083 5332080 +
gagttttcaccaagtagtag

SEQ ID NO: 20875 - DNA, 20 bp, Artificial Sequence
  Synthetic oligonucleotide; TAG chr11 5332069 5332088 5332085 +
ttcaccaagtagtaggagaa

SEQ ID NO: 20876 - DNA, 20 bp, Artificial Sequence
  Synthetic oligonucleotide; AGG chr11 5332070 5332089 5332086 +
tcaccaagtagtaggagaat

SEQ ID NO: 20877 - DNA, 20 bp, Artificial Sequence
  Synthetic oligonucleotide; AAG chr11 5332073 5332092 5332089 +
ccaagtagtaggagaatagg

SEQ ID NO: 20878 - DNA, 20 bp, Artificial Sequence
  Synthetic oligonucleotide; CAG chr11 5332077 5332096 5332093 +
gtagtaggagaataggaagc

SEQ ID NO: 20879 - DNA, 20 bp, Artificial Sequence
  Synthetic oligonucleotide; GAG chr11 5332095 5332114 5332111 +
gccagacatattcaaaattt

SEQ ID NO: 20880 - DNA, 20 bp, Artificial Sequence
  Synthetic oligonucleotide; AAG chr11 5332099 5332118 5332115 +
gacatattcaaaatttgaga

SEQ ID NO: 20881 - DNA, 20 bp, Artificial Sequence
  Synthetic oligonucleotide; AGG chr11 5332100 5332119 5332116 +
acatattcaaaatttgagaa

SEQ ID NO: 20882 - DNA, 20 bp, Artificial Sequence
  Synthetic oligonucleotide; TGG chr11 5332107 5332126 5332123 +
caaaatttgagaaaggttca

SEQ ID NO: 20883 - DNA, 20 bp, Artificial Sequence
  Synthetic oligonucleotide; GGG chr11 5332108 5332127 5332124 +
aaaatttgagaaaggttcat

SEQ ID NO: 20884 - DNA, 20 bp, Artificial Sequence
  Synthetic oligonucleotide; CAG chr11 5332112 5332131 5332128 +
tttgagaaaggttcatgggt

SEQ ID NO: 20885 - DNA, 20 bp, Artificial Sequence
  Synthetic oligonucleotide; TGG chr11 5332119 5332138 5332135 +
aaggttcatgggtcagttgc

SEQ ID NO: 20886 - DNA, 20 bp, Artificial Sequence
  Synthetic oligonucleotide; AAG chr11 5332132 5332151 5332148 +
cagttgctggtttgaaatat

SEQ ID NO: 20887 - DNA, 20 bp, Artificial Sequence
  Synthetic oligonucleotide; AGG chr11 5332133 5332152 5332149 +
agttgctggtttgaaatata

SEQ ID NO: 20888 - DNA, 20 bp, Artificial Sequence
  Synthetic oligonucleotide; GAG chr11 5332135 5332154 5332151 +
ttgctggtttgaaatataag

SEQ ID NO: 20889 - DNA, 20 bp, Artificial Sequence
  Synthetic oligonucleotide; AGG chr11 5332136 5332155 5332152 +
tgctggtttgaaatataagg

SEQ ID NO: 20890 - DNA, 20 bp, Artificial Sequence
  Synthetic oligonucleotide; AAG chr11 5332145 5332164 5332161 +
gaaatataaggaggtcacaa

SEQ ID NO: 20891 - DNA, 20 bp, Artificial Sequence
  Synthetic oligonucleotide; AAG chr11 5332148 5332167 5332164 +
atataaggaggtcacaaaag

SEQ ID NO: 20892 - DNA, 20 bp, Artificial Sequence
  Synthetic oligonucleotide; AGG chr11 5332149 5332168 5332165 +
tataaggaggtcacaaaaga

SEQ ID NO: 20893 - DNA, 20 bp, Artificial Sequence
  Synthetic oligonucleotide; AAG chr11 5332157 5332176 5332173 +
ggtcacaaaagaaggaatgc

SEQ ID NO: 20894 - DNA, 20 bp, Artificial Sequence
  Synthetic oligonucleotide; AAG chr11 5332160 5332179 5332176 +
cacaaaagaaggaatgcaag

SEQ ID NO: 20895 - DNA, 20 bp, Artificial Sequence
  Synthetic oligonucleotide; TAG chr11 5332167 5332186 5332183 +
gaaggaatgcaagaagcccc

SEQ ID NO: 20896 - DNA, 20 bp, Artificial Sequence
  Synthetic oligonucleotide; AGG chr11 5332168 5332187 5332184 +
aaggaatgcaagaagcccct

SEQ ID NO: 20897 - DNA, 20 bp, Artificial Sequence
  Synthetic oligonucleotide; CAG chr11 5332173 5332192 5332189 +
atgcaagaagcccctaggta

SEQ ID NO: 20898 - DNA, 20 bp, Artificial Sequence
  Synthetic oligonucleotide; CGG chr11 5332178 5332197 5332194 +
agaagcccctaggtacagaa

SEQ ID NO: 20899 - DNA, 20 bp, Artificial Sequence
  Synthetic oligonucleotide; GGG chr11 5332179 5332198 5332195 +
gaagcccctaggtacagaac

SEQ ID NO: 20900 - DNA, 20 bp, Artificial Sequence
  Synthetic oligonucleotide; TAG chr11 5332187 5332206 5332203 +
taggtacagaacgggcatcc

SEQ ID NO: 20901 - DNA, 20 bp, Artificial Sequence
  Synthetic oligonucleotide; CAG chr11 5332194 5332213 5332210 +
agaacgggcatcctagctaa

SEQ ID NO: 20902 - DNA, 20 bp, Artificial Sequence
  Synthetic oligonucleotide; CAG chr11 5332236 5332255 5332252 +
aaaacaaaaacaaaaacaaa

SEQ ID NO: 20903 - DNA, 20 bp, Artificial Sequence
  Synthetic oligonucleotide; AGG chr11 5332237 5332256 5332253 +
aaacaaaaacaaaaacaaac

SEQ ID NO: 20904 - DNA, 20 bp, Artificial Sequence
  Synthetic oligonucleotide; GGG chr11 5332238 5332257 5332254 +
aacaaaaacaaaaacaaaca

SEQ ID NO: 20905 - DNA, 20 bp, Artificial Sequence
  Synthetic oligonucleotide; CAG chr11 5332245 5332264 5332261 +
acaaaaacaaacagggactt

SEQ ID NO: 20906 - DNA, 20 bp, Artificial Sequence
  Synthetic oligonucleotide; GAG chr11 5332247 5332266 5332263 +
aaaaacaaacagggacttca

SEQ ID NO: 20907 - DNA, 20 bp, Artificial Sequence
  Synthetic oligonucleotide; CAG chr11 5332252 5332271 5332268 +
caaacagggacttcagagtt

SEQ ID NO: 20908 - DNA, 20 bp, Artificial Sequence
  Synthetic oligonucleotide; CAG chr11 5332255 5332274 5332271 +
acagggacttcagagttcag

SEQ ID NO: 20909 - DNA, 20 bp, Artificial Sequence
  Synthetic oligonucleotide; TAG chr11 5332258 5332277 5332274 +
gggacttcagagttcagcag

SEQ ID NO: 20910 - DNA, 20 bp, Artificial Sequence
  Synthetic oligonucleotide; AGG chr11 5332259 5332278 5332275 +
ggacttcagagttcagcagt

SEQ ID NO: 20911 - DNA, 20 bp, Artificial Sequence
  Synthetic oligonucleotide; CAG chr11 5332276 5332295 5332292 +
agtaggaaactgaactctga

SEQ ID NO: 20912 - DNA, 20 bp, Artificial Sequence
  Synthetic oligonucleotide; CGG chr11 5332280 5332299 5332296 +
ggaaactgaactctgacagc

SEQ ID NO: 20913 - DNA, 20 bp, Artificial Sequence
  Synthetic oligonucleotide; GGG chr11 5332281 5332300 5332297 +
gaaactgaactctgacagcc

SEQ ID NO: 20914 - DNA, 20 bp, Artificial Sequence
  Synthetic oligonucleotide; TGG chr11 5332289 5332308 5332305 +
actctgacagccgggtgcaa

SEQ ID NO: 20915 - DNA, 20 bp, Artificial Sequence
  Synthetic oligonucleotide; AAG chr11 5332299 5332318 5332315 +
ccgggtgcaatggctcattc

SEQ ID NO: 20916 - DNA, 20 bp, Artificial Sequence
  Synthetic oligonucleotide; CAG chr11 5332312 5332331 5332328 +
ctcattcaagcctgtaatcc

SEQ ID NO: 20917 - DNA, 20 bp, Artificial Sequence
  Synthetic oligonucleotide; TGG chr11 5332320 5332339 5332336 +
agcctgtaatcccagcactt

SEQ ID NO: 20918 - DNA, 20 bp, Artificial Sequence
  Synthetic oligonucleotide; GGG chr11 5332321 5332340 5332337 +
gcctgtaatcccagcacttt

SEQ ID NO: 20919 - DNA, 20 bp, Artificial Sequence
  Synthetic oligonucleotide; GAG chr11 5332323 5332342 5332339 +
ctgtaatcccagcactttgg

SEQ ID NO: 20920 - DNA, 20 bp, Artificial Sequence
  Synthetic oligonucleotide; AGG chr11 5332324 5332343 5332340 +
tgtaatcccagcactttggg

SEQ ID NO: 20921 - DNA, 20 bp, Artificial Sequence
  Synthetic oligonucleotide; AAG chr11 5332329 5332348 5332345 +
tcccagcactttgggaggcc

SEQ ID NO: 20922 - DNA, 20 bp, Artificial Sequence
  Synthetic oligonucleotide; AGG chr11 5332330 5332349 5332346 +
cccagcactttgggaggcca

SEQ ID NO: 20923 - DNA, 20 bp, Artificial Sequence
  Synthetic oligonucleotide; CGG chr11 5332333 5332352 5332349 +
agcactttgggaggccaagg

SEQ ID NO: 20924 - DNA, 20 bp, Artificial Sequence
  Synthetic oligonucleotide; GGG chr11 5332334 5332353 5332350 +
gcactttgggaggccaaggc

SEQ ID NO: 20925 - DNA, 20 bp, Artificial Sequence
  Synthetic oligonucleotide; CGG chr11 5332337 5332356 5332353 +
ctttgggaggccaaggcggg

SEQ ID NO: 20926 - DNA, 20 bp, Artificial Sequence
  Synthetic oligonucleotide; GAG chr11 5332347 5332366 5332363 +
ccaaggcgggcggatcacct

SEQ ID NO: 20927 - DNA, 20 bp, Artificial Sequence
  Synthetic oligonucleotide; AGG chr11 5332348 5332367 5332364 +
caaggcgggcggatcacctg

SEQ ID NO: 20928 - DNA, 20 bp, Artificial Sequence
  Synthetic oligonucleotide; CAG chr11 5332352 5332371 5332368 +
gcgggcggatcacctgaggt

SEQ ID NO: 20929 - DNA, 20 bp, Artificial Sequence
  Synthetic oligonucleotide; AGG chr11 5332353 5332372 5332369 +
cgggcggatcacctgaggtc

SEQ ID NO: 20930 - DNA, 20 bp, Artificial Sequence
  Synthetic oligonucleotide; GAG chr11 5332355 5332374 5332371 +
ggcggatcacctgaggtcag

SEQ ID NO: 20931 - DNA, 20 bp, Artificial Sequence
  Synthetic oligonucleotide; CAG chr11 5332361 5332380 5332377 +
tcacctgaggtcaggagttc

SEQ ID NO: 20932 - DNA, 20 bp, Artificial Sequence
  Synthetic oligonucleotide; CAG chr11 5332366 5332385 5332382 +
tgaggtcaggagttccagac

SEQ ID NO: 20933 - DNA, 20 bp, Artificial Sequence
  Synthetic oligonucleotide; TGG chr11 5332371 5332390 5332387 +
tcaggagttccagaccagcc

SEQ ID NO: 20934 - DNA, 20 bp, Artificial Sequence
  Synthetic oligonucleotide; TGG chr11 5332380 5332399 5332396 +
ccagaccagcctggccaaca

SEQ ID NO: 20935 - DNA, 20 bp, Artificial Sequence
  Synthetic oligonucleotide; TAG chr11 5332416 5332435 5332432 +
ctaccaaaaaatataaaaat

SEQ ID NO: 20936 - DNA, 20 bp, Artificial Sequence
  Synthetic oligonucleotide; CAG chr11 5332420 5332439 5332436 +
caaaaaatataaaaattagc

SEQ ID NO: 20937 - DNA, 20 bp, Artificial Sequence
  Synthetic oligonucleotide; AGG chr11 5332421 5332440 5332437 +
aaaaaatataaaaattagcc

SEQ ID NO: 20938 - DNA, 20 bp, Artificial Sequence
  Synthetic oligonucleotide; TGG chr11 5332426 5332445 5332442 +
atataaaaattagccaggtg

SEQ ID NO: 20939 - DNA, 20 bp, Artificial Sequence
  Synthetic oligonucleotide; CAG chr11 5332432 5332451 5332448 +
aaattagccaggtgtggttg

SEQ ID NO: 20940 - DNA, 20 bp, Artificial Sequence
  Synthetic oligonucleotide; TAG chr11 5332442 5332461 5332458 +
ggtgtggttgcagttgcctg

SEQ ID NO: 20941 - DNA, 20 bp, Artificial Sequence
  Synthetic oligonucleotide; CAG chr11 5332448 5332467 5332464 +
gttgcagttgcctgtagttc

SEQ ID NO: 20942 - DNA, 20 bp, Artificial Sequence
  Synthetic oligonucleotide; TGG chr11 5332456 5332475 5332472 +
tgcctgtagttccagctact

SEQ ID NO: 20943 - DNA, 20 bp, Artificial Sequence
  Synthetic oligonucleotide; GGG chr11 5332457 5332476 5332473 +
gcctgtagttccagctactt

SEQ ID NO: 20944 - DNA, 20 bp, Artificial Sequence
  Synthetic oligonucleotide; GAG chr11 5332465 5332484 5332481 +
ttccagctacttgggaaact

SEQ ID NO: 20945 - DNA, 20 bp, Artificial Sequence
  Synthetic oligonucleotide; AGG chr11 5332466 5332485 5332482 +
tccagctacttgggaaactg

SEQ ID NO: 20946 - DNA, 20 bp, Artificial Sequence
  Synthetic oligonucleotide; CAG chr11 5332469 5332488 5332485 +
agctacttgggaaactgagg

SEQ ID NO: 20947 - DNA, 20 bp, Artificial Sequence
  Synthetic oligonucleotide; AGG chr11 5332470 5332489 5332486 +
gctacttgggaaactgaggc

SEQ ID NO: 20948 - DNA, 20 bp, Artificial Sequence
  Synthetic oligonucleotide; GAG chr11 5332472 5332491 5332488 +
tacttgggaaactgaggcag

SEQ ID NO: 20949 - DNA, 20 bp, Artificial Sequence
  Synthetic oligonucleotide; CGG chr11 5332488 5332507 5332504 +
gcaggagaattgcttgaacc

SEQ ID NO: 20950 - DNA, 20 bp, Artificial Sequence
  Synthetic oligonucleotide; GGG chr11 5332489 5332508 5332505 +
caggagaattgcttgaaccc

SEQ ID NO: 20951 - DNA, 20 bp, Artificial Sequence
  Synthetic oligonucleotide; GAG chr11 5332491 5332510 5332507 +
ggagaattgcttgaacccgg

SEQ ID NO: 20952 - DNA, 20 bp, Artificial Sequence
  Synthetic oligonucleotide; AGG chr11 5332492 5332511 5332508 +
gagaattgcttgaacccggg

SEQ ID NO: 20953 - DNA, 20 bp, Artificial Sequence
  Synthetic oligonucleotide; CAG chr11 5332497 5332516 5332513 +
ttgcttgaacccgggaggca

SEQ ID NO: 20954 - DNA, 20 bp, Artificial Sequence
  Synthetic oligonucleotide; AGG chr11 5332498 5332517 5332514 +
tgcttgaacccgggaggcac

SEQ ID NO: 20955 - DNA, 20 bp, Artificial Sequence
  Synthetic oligonucleotide; CAG chr11 5332504 5332523 5332520 +
aacccgggaggcacaggttg

SEQ ID NO: 20956 - DNA, 20 bp, Artificial Sequence
  Synthetic oligonucleotide; AGG chr11 5332505 5332524 5332521 +
acccgggaggcacaggttgc

SEQ ID NO: 20957 - DNA, 20 bp, Artificial Sequence
  Synthetic oligonucleotide; GGG chr11 5332506 5332525 5332522 +
cccgggaggcacaggttgca

SEQ ID NO: 20958 - DNA, 20 bp, Artificial Sequence
  Synthetic oligonucleotide; GAG chr11 5332508 5332527 5332524 +
cgggaggcacaggttgcagg

SEQ ID NO: 20959 - DNA, 20 bp, Artificial Sequence
  Synthetic oligonucleotide; AAG chr11 5332512 5332531 5332528 +
aggcacaggttgcagggagc

SEQ ID NO: 20960 - DNA, 20 bp, Artificial Sequence
  Synthetic oligonucleotide; GAG chr11 5332514 5332533 5332530 +
gcacaggttgcagggagcaa

SEQ ID NO: 20961 - DNA, 20 bp, Artificial Sequence
  Synthetic oligonucleotide; CAG chr11 5332534 5332553 5332550 +
gagattgtgccactgcactc

SEQ ID NO: 20962 - DNA, 20 bp, Artificial Sequence
  Synthetic oligonucleotide; AGG chr11 5332535 5332554 5332551 +
agattgtgccactgcactcc

SEQ ID NO: 20963 - DNA, 20 bp, Artificial Sequence
  Synthetic oligonucleotide; TGG chr11 5332539 5332558 5332555 +
tgtgccactgcactccaggc

SEQ ID NO: 20964 - DNA, 20 bp, Artificial Sequence
  Synthetic oligonucleotide; GGG chr11 5332540 5332559 5332556 +
gtgccactgcactccaggct

SEQ ID NO: 20965 - DNA, 20 bp, Artificial Sequence
  Synthetic oligonucleotide; CAG chr11 5332546 5332565 5332562 +
ctgcactccaggctgggtga

SEQ ID NO: 20966 - DNA, 20 bp, Artificial Sequence
  Synthetic oligonucleotide; GAG chr11 5332548 5332567 5332564 +
gcactccaggctgggtgaca

SEQ ID NO: 20967 - DNA, 20 bp, Artificial Sequence
  Synthetic oligonucleotide; GAG chr11 5332552 5332571 5332568 +
tccaggctgggtgacagagc

SEQ ID NO: 20968 - DNA, 20 bp, Artificial Sequence
  Synthetic oligonucleotide; AAG chr11 5332583 5332602 5332599 +
tcaaaaaaaaaaaaaaaaaa

SEQ ID NO: 20969 - DNA, 20 bp, Artificial Sequence
  Synthetic oligonucleotide; AAG chr11 5332593 5332612 5332609 +
aaaaaaaaaaaagaaaaaaa

SEQ ID NO: 20970 - DNA, 20 bp, Artificial Sequence
  Synthetic oligonucleotide; GAG chr11 5332601 5332620 5332617 +
aaaagaaaaaaaaagaaact

SEQ ID NO: 20971 - DNA, 20 bp, Artificial Sequence
  Synthetic oligonucleotide; TGG chr11 5332628 5332647 5332644 +
gactacaatctgaatgaacg

SEQ ID NO: 20972 - DNA, 20 bp, Artificial Sequence
  Synthetic oligonucleotide; AAG chr11 5332631 5332650 5332647 +
tacaatctgaatgaacgtgg

SEQ ID NO: 20973 - DNA, 20 bp, Artificial Sequence
  Synthetic oligonucleotide; CAG chr11 5332646 5332665 5332662 +
cgtggaagcgaattcttccc

SEQ ID NO: 20974 - DNA, 20 bp, Artificial Sequence
  Synthetic oligonucleotide; GAG chr11 5332648 5332667 5332664 +
tggaagcgaattcttcccca

SEQ ID NO: 20975 - DNA, 20 bp, Artificial Sequence
  Synthetic oligonucleotide; TGG chr11 5332655 5332674 5332671 +
gaattcttccccagagcctt

SEQ ID NO: 20976 - DNA, 20 bp, Artificial Sequence
  Synthetic oligonucleotide; AAG chr11 5332660 5332679 5332676 +
cttccccagagcctttggat

SEQ ID NO: 20977 - DNA, 20 bp, Artificial Sequence
  Synthetic oligonucleotide; GAG chr11 5332662 5332681 5332678 +
tccccagagcctttggataa

SEQ ID NO: 20978 - DNA, 20 bp, Artificial Sequence
  Synthetic oligonucleotide; CAG chr11 5332667 5332686 5332683 +
agagcctttggataagagcc

SEQ ID NO: 20979 - DNA, 20 bp, Artificial Sequence
  Synthetic oligonucleotide; AAG chr11 5332707 5332726 5332723 +
atttgaccttatgataccct

SEQ ID NO: 20980 - DNA, 20 bp, Artificial Sequence
  Synthetic oligonucleotide; CAG chr11 5332710 5332729 5332726 +
tgaccttatgataccctaag

SEQ ID NO: 20981 - DNA, 20 bp, Artificial Sequence
  Synthetic oligonucleotide; GAG chr11 5332712 5332731 5332728 +
accttatgataccctaagca

SEQ ID NO: 20982 - DNA, 20 bp, Artificial Sequence
  Synthetic oligonucleotide; CAG chr11 5332719 5332738 5332735 +
gataccctaagcagagaact

SEQ ID NO: 20983 - DNA, 20 bp, Artificial Sequence
  Synthetic oligonucleotide; AAG chr11 5332724 5332743 5332740 +
cctaagcagagaactcagtt

SEQ ID NO: 20984 - DNA, 20 bp, Artificial Sequence
  Synthetic oligonucleotide; GAG chr11 5332732 5332751 5332748 +
gagaactcagttaagcctat

SEQ ID NO: 20985 - DNA, 20 bp, Artificial Sequence
  Synthetic oligonucleotide; GAG chr11 5332734 5332753 5332750 +
gaactcagttaagcctatga

SEQ ID NO: 20986 - DNA, 20 bp, Artificial Sequence
  Synthetic oligonucleotide; CAG chr11 5332739 5332758 5332755 +
cagttaagcctatgagagtg

SEQ ID NO: 20987 - DNA, 20 bp, Artificial Sequence
  Synthetic oligonucleotide; TAG chr11 5332747 5332766 5332763 +
cctatgagagtgcagaccta

SEQ ID NO: 20988 - DNA, 20 bp, Artificial Sequence
  Synthetic oligonucleotide; AAG chr11 5332780 5332799 5332796 +
taataaactaataatgtttg

SEQ ID NO: 20989 - DNA, 20 bp, Artificial Sequence
  Synthetic oligonucleotide; CAG chr11 5332783 5332802 5332799 +
taaactaataatgtttgaag

SEQ ID NO: 20990 - DNA, 20 bp, Artificial Sequence
  Synthetic oligonucleotide; AAG chr11 5332789 5332808 5332805 +
aataatgtttgaagcagctc

SEQ ID NO: 20991 - DNA, 20 bp, Artificial Sequence
  Synthetic oligonucleotide; CAG chr11 5332795 5332814 5332811 +
gtttgaagcagctcaagttg

SEQ ID NO: 20992 - DNA, 20 bp, Artificial Sequence
  Synthetic oligonucleotide; TAG chr11 5332815 5332834 5332831 +
cagtaatttatgtataacaa

SEQ ID NO: 20993 - DNA, 20 bp, Artificial Sequence
  Synthetic oligonucleotide; AAG chr11 5332830 5332849 5332846 +
aacaatagaaaactaatgca

SEQ ID NO: 20994 - DNA, 20 bp, Artificial Sequence
  Synthetic oligonucleotide; AAG chr11 5332857 5332876 5332873 +
actattatccatattttatt

SEQ ID NO: 20995 - DNA, 20 bp, Artificial Sequence
  Synthetic oligonucleotide; GAG chr11 5332859 5332878 5332875 +
tattatccatattttattaa

SEQ ID NO: 20996 - DNA, 20 bp, Artificial Sequence
  Synthetic oligonucleotide; TAG chr11 5332866 5332885 5332882 +
catattttattaagagttta

SEQ ID NO: 20997 - DNA, 20 bp, Artificial Sequence
  Synthetic oligonucleotide; GAG chr11 5332868 5332887 5332884 +
tattttattaagagtttata

SEQ ID NO: 20998 - DNA, 20 bp, Artificial Sequence
  Synthetic oligonucleotide; CAG chr11 5332893 5332912 5332909 +
ctataataaactaatattta

SEQ ID NO: 20999 - DNA, 20 bp, Artificial Sequence
  Synthetic oligonucleotide; AGG chr11 5332894 5332913 5332910 +
tataataaactaatatttac

SEQ ID NO: 21000 - DNA, 20 bp, Artificial Sequence
  Synthetic oligonucleotide; GGG chr11 5332895 5332914 5332911 +
ataataaactaatatttaca

SEQ ID NO: 21001 - DNA, 20 bp, Artificial Sequence
  Synthetic oligonucleotide; CAG chr11 5332933 5332952 5332949 +
gtatcatttatctattatca

SEQ ID NO: 21002 - DNA, 20 bp, Artificial Sequence
  Synthetic oligonucleotide; AAG chr11 5332951 5332970 5332967 +
cacagaattgtcacatcaca

SEQ ID NO: 21003 - DNA, 20 bp, Artificial Sequence
  Synthetic oligonucleotide; TAG chr11 5332961 5332980 5332977 +
tcacatcacaaagccctgta

SEQ ID NO: 21004 - DNA, 20 bp, Artificial Sequence
  Synthetic oligonucleotide; CAG chr11 5332967 5332986 5332983 +
cacaaagccctgtatagcat

SEQ ID NO: 21005 - DNA, 20 bp, Artificial Sequence
  Synthetic oligonucleotide; TGG chr11 5332970 5332989 5332986 +
aaagccctgtatagcatcag

SEQ ID NO: 21006 - DNA, 20 bp, Artificial Sequence
  Synthetic oligonucleotide; TGG chr11 5333010 5333029 5333026 +
ttatttttcactctaatgca

SEQ ID NO: 21007 - DNA, 20 bp, Artificial Sequence
  Synthetic oligonucleotide; TAG chr11 5333024 5333043 5333040 +
aatgcatggttcaacttatt

SEQ ID NO: 21008 - DNA, 20 bp, Artificial Sequence
  Synthetic oligonucleotide; AGG chr11 5333025 5333044 5333041 +
atgcatggttcaacttattt

SEQ ID NO: 21009 - DNA, 20 bp, Artificial Sequence
  Synthetic oligonucleotide; TGG chr11 5333029 5333048 5333045 +
atggttcaacttatttaggc

SEQ ID NO: 21010 - DNA, 20 bp, Artificial Sequence
  Synthetic oligonucleotide; GGG chr11 5333030 5333049 5333046 +
tggttcaacttatttaggct

SEQ ID NO: 21011 - DNA, 20 bp, Artificial Sequence
  Synthetic oligonucleotide; TGG chr11 5333035 5333054 5333051 +
caacttatttaggctgggct

SEQ ID NO: 21012 - DNA, 20 bp, Artificial Sequence
  Synthetic oligonucleotide; TGG chr11 5333039 5333058 5333055 +
ttatttaggctgggcttggc

SEQ ID NO: 21013 - DNA, 20 bp, Artificial Sequence
  Synthetic oligonucleotide; GGG chr11 5333040 5333059 5333056 +
tatttaggctgggcttggct

SEQ ID NO: 21014 - DNA, 20 bp, Artificial Sequence
  Synthetic oligonucleotide; CAG chr11 5333043 5333062 5333059 +
ttaggctgggcttggctggg

SEQ ID NO: 21015 - DNA, 20 bp, Artificial Sequence
  Synthetic oligonucleotide; CAG chr11 5333072 5333091 5333088 +
tcatttctgcaccatctgct

SEQ ID NO: 21016 - DNA, 20 bp, Artificial Sequence
  Synthetic oligonucleotide; AGG chr11 5333073 5333092 5333089 +
catttctgcaccatctgctc

SEQ ID NO: 21017 - DNA, 20 bp, Artificial Sequence
  Synthetic oligonucleotide; TAG chr11 5333080 5333099 5333096 +
gcaccatctgctcaggtaca

SEQ ID NO: 21018 - DNA, 20 bp, Artificial Sequence
  Synthetic oligonucleotide; AGG chr11 5333081 5333100 5333097 +
caccatctgctcaggtacat

SEQ ID NO: 21019 - DNA, 20 bp, Artificial Sequence
  Synthetic oligonucleotide; GGG chr11 5333082 5333101 5333098 +
accatctgctcaggtacata

SEQ ID NO: 21020 - DNA, 20 bp, Artificial Sequence
  Synthetic oligonucleotide; CAG chr11 5333087 5333106 5333103 +
ctgctcaggtacatagggtg

SEQ ID NO: 21021 - DNA, 20 bp, Artificial Sequence
  Synthetic oligonucleotide; CAG chr11 5333203 5333222 5333219 +
tgccctctctaactaaaccc

SEQ ID NO: 21022 - DNA, 20 bp, Artificial Sequence
  Synthetic oligonucleotide; CAG chr11 5333225 5333244 5333241 +
gatgtctcttttgcatcacc

SEQ ID NO: 21023 - DNA, 20 bp, Artificial Sequence
  Synthetic oligonucleotide; TAG chr11 5333232 5333251 5333248 +
cttttgcatcacccagactt

SEQ ID NO: 21024 - DNA, 20 bp, Artificial Sequence
  Synthetic oligonucleotide; TAG chr11 5333244 5333263 5333260 +
ccagactttagcataaaact

SEQ ID NO: 21025 - DNA, 20 bp, Artificial Sequence
  Synthetic oligonucleotide; TAG chr11 5333278 5333297 5333294 +
tactgtttacattcttttac

SEQ ID NO: 21026 - DNA, 20 bp, Artificial Sequence
  Synthetic oligonucleotide; CAG chr11 5333286 5333305 5333302 +
acattcttttactagtctct

SEQ ID NO: 21027 - DNA, 20 bp, Artificial Sequence
  Synthetic oligonucleotide; TAG chr11 5333292 5333311 5333308 +
ttttactagtctctcagacc

SEQ ID NO: 21028 - DNA, 20 bp, Artificial Sequence
  Synthetic oligonucleotide; TGG chr11 5333295 5333314 5333311 +
tactagtctctcagacctag

SEQ ID NO: 21029 - DNA, 20 bp, Artificial Sequence
  Synthetic oligonucleotide; TAG chr11 5333311 5333330 5333327 +
ctagtggctctaactcattg

SEQ ID NO: 21030 - DNA, 20 bp, Artificial Sequence
  Synthetic oligonucleotide; CGG chr11 5333323 5333342 5333339 +
actcattgtagtaaaaaaca

SEQ ID NO: 21031 - DNA, 20 bp, Artificial Sequence
  Synthetic oligonucleotide; AAG chr11 5333365 5333384 5333381 +
ctaacattgcttactttact

SEQ ID NO: 21032 - DNA, 20 bp, Artificial Sequence
  Synthetic oligonucleotide; TGG chr11 5333387 5333406 5333403 +
gtgttgtattaacacaccaa

SEQ ID NO: 21033 - DNA, 20 bp, Artificial Sequence
  Synthetic oligonucleotide; TGG chr11 5333393 5333412 5333409 +
tattaacacaccaatggccc

SEQ ID NO: 21034 - DNA, 20 bp, Artificial Sequence
  Synthetic oligonucleotide; AAG chr11 5333396 5333415 5333412 +
taacacaccaatggccctgg

SEQ ID NO: 21035 - DNA, 20 bp, Artificial Sequence
  Synthetic oligonucleotide; CAG chr11 5333405 5333424 5333421 +
aatggccctggaagcaatga

SEQ ID NO: 21036 - DNA, 20 bp, Artificial Sequence
  Synthetic oligonucleotide; GAG chr11 5333407 5333426 5333423 +
tggccctggaagcaatgaca

SEQ ID NO: 21037 - DNA, 20 bp, Artificial Sequence
  Synthetic oligonucleotide; AAG chr11 5333427 5333446 5333443 +
gagtttgacatattgattgt

SEQ ID NO: 21038 - DNA, 20 bp, Artificial Sequence
  Synthetic oligonucleotide; AGG chr11 5333428 5333447 5333444 +
agtttgacatattgattgta

SEQ ID NO: 21039 - DNA, 20 bp, Artificial Sequence
  Synthetic oligonucleotide; TGG chr11 5333484 5333503 5333500 +
cacattgatcactaactgac

SEQ ID NO: 21040 - DNA, 20 bp, Artificial Sequence
  Synthetic oligonucleotide; TAG chr11 5333509 5333528 5333525 +
tgctgattgttaaactgact

SEQ ID NO: 21041 - DNA, 20 bp, Artificial Sequence
  Synthetic oligonucleotide; AGG chr11 5333510 5333529 5333526 +
gctgattgttaaactgactt

SEQ ID NO: 21042 - DNA, 20 bp, Artificial Sequence
  Synthetic oligonucleotide; AAG chr11 5333514 5333533 5333530 +
attgttaaactgacttaggt

SEQ ID NO: 21043 - DNA, 20 bp, Artificial Sequence
  Synthetic oligonucleotide; CAG chr11 5333519 5333538 5333535 +
taaactgacttaggtaagaa

SEQ ID NO: 21044 - DNA, 20 bp, Artificial Sequence
  Synthetic oligonucleotide; TGG chr11 5333551 5333570 5333567 +
aatattactaatatactaat

SEQ ID NO: 21045 - DNA, 20 bp, Artificial Sequence
  Synthetic oligonucleotide; AAG chr11 5333563 5333582 5333579 +
atactaattggctaatatat

SEQ ID NO: 21046 - DNA, 20 bp, Artificial Sequence
  Synthetic oligonucleotide; TGG chr11 5333575 5333594 5333591 +
taatatataagctgaaaatg

SEQ ID NO: 21047 - DNA, 20 bp, Artificial Sequence
  Synthetic oligonucleotide; GGG chr11 5333576 5333595 5333592 +
aatatataagctgaaaatgt

SEQ ID NO: 21048 - DNA, 20 bp, Artificial Sequence
  Synthetic oligonucleotide; GAG chr11 5333578 5333597 5333594 +
tatataagctgaaaatgtgg

SEQ ID NO: 21049 - DNA, 20 bp, Artificial Sequence
  Synthetic oligonucleotide; AAG chr11 5333586 5333605 5333602 +
ctgaaaatgtgggagctaca

SEQ ID NO: 21050 - DNA, 20 bp, Artificial Sequence
  Synthetic oligonucleotide; TAG chr11 5333589 5333608 5333605 +
aaaatgtgggagctacaaag

SEQ ID NO: 21051 - DNA, 20 bp, Artificial Sequence
  Synthetic oligonucleotide; GAG chr11 5333591 5333610 5333607 +
aatgtgggagctacaaagta

SEQ ID NO: 21052 - DNA, 20 bp, Artificial Sequence
  Synthetic oligonucleotide; AGG chr11 5333592 5333611 5333608 +
atgtgggagctacaaagtag

SEQ ID NO: 21053 - DNA, 20 bp, Artificial Sequence
  Synthetic oligonucleotide; GAG chr11 5333594 5333613 5333610 +
gtgggagctacaaagtagag

SEQ ID NO: 21054 - DNA, 20 bp, Artificial Sequence
  Synthetic oligonucleotide; AGG chr11 5333595 5333614 5333611 +
tgggagctacaaagtagagg

SEQ ID NO: 21055 - DNA, 20 bp, Artificial Sequence
  Synthetic oligonucleotide; AAG chr11 5333598 5333617 5333614 +
gagctacaaagtagaggagg

SEQ ID NO: 21056 - DNA, 20 bp, Artificial Sequence
  Synthetic oligonucleotide; AAG chr11 5333601 5333620 5333617 +
ctacaaagtagaggaggaag

SEQ ID NO: 21057 - DNA, 20 bp, Artificial Sequence
  Synthetic oligonucleotide; AGG chr11 5333602 5333621 5333618 +
tacaaagtagaggaggaaga

SEQ ID NO: 21058 - DNA, 20 bp, Artificial Sequence
  Synthetic oligonucleotide; CAG chr11 5333605 5333624 5333621 +
aaagtagaggaggaagaagg

SEQ ID NO: 21059 - DNA, 20 bp, Artificial Sequence
  Synthetic oligonucleotide; AAG chr11 5333609 5333628 5333625 +
tagaggaggaagaaggcaga

SEQ ID NO: 21060 - DNA, 20 bp, Artificial Sequence
  Synthetic oligonucleotide; AGG chr11 5333610 5333629 5333626 +
agaggaggaagaaggcagaa

SEQ ID NO: 21061 - DNA, 20 bp, Artificial Sequence
  Synthetic oligonucleotide; GGG chr11 5333611 5333630 5333627 +
gaggaggaagaaggcagaaa

SEQ ID NO: 21062 - DNA, 20 bp, Artificial Sequence
  Synthetic oligonucleotide; TAG chr11 5333618 5333637 5333634 +
aagaaggcagaaagggaaca

SEQ ID NO: 21063 - DNA, 20 bp, Artificial Sequence
  Synthetic oligonucleotide; AGG chr11 5333619 5333638 5333635 +
agaaggcagaaagggaacat

SEQ ID NO: 21064 - DNA, 20 bp, Artificial Sequence
  Synthetic oligonucleotide; TGG chr11 5333622 5333641 5333638 +
aggcagaaagggaacatagg

SEQ ID NO: 21065 - DNA, 20 bp, Artificial Sequence
  Synthetic oligonucleotide; AAG chr11 5333629 5333648 5333645 +
aagggaacataggtggatgt

SEQ ID NO: 21066 - DNA, 20 bp, Artificial Sequence
  Synthetic oligonucleotide; TAG chr11 5333633 5333652 5333649 +
gaacataggtggatgtaaga

SEQ ID NO: 21067 - DNA, 20 bp, Artificial Sequence
  Synthetic oligonucleotide; GAG chr11 5333635 5333654 5333651 +
acataggtggatgtaagata

SEQ ID NO: 21068 - DNA, 20 bp, Artificial Sequence
  Synthetic oligonucleotide; GAG chr11 5333644 5333663 5333660 +
gatgtaagatagagaaaact

SEQ ID NO: 21069 - DNA, 20 bp, Artificial Sequence
  Synthetic oligonucleotide; TAG chr11 5333649 5333668 5333665 +
aagatagagaaaactgagcc

SEQ ID NO: 21070 - DNA, 20 bp, Artificial Sequence
  Synthetic oligonucleotide; GAG chr11 5333651 5333670 5333667 +
gatagagaaaactgagccta

SEQ ID NO: 21071 - DNA, 20 bp, Artificial Sequence
  Synthetic oligonucleotide; AAG chr11 5333663 5333682 5333679 +
tgagcctagagaactgcatc

SEQ ID NO: 21072 - DNA, 20 bp, Artificial Sequence
  Synthetic oligonucleotide; GAG chr11 5333665 5333684 5333681 +
agcctagagaactgcatcaa

SEQ ID NO: 21073 - DNA, 20 bp, Artificial Sequence
  Synthetic oligonucleotide; AGG chr11 5333666 5333685 5333682 +
gcctagagaactgcatcaag

SEQ ID NO: 21074 - DNA, 20 bp, Artificial Sequence
  Synthetic oligonucleotide; GAG chr11 5333668 5333687 5333684 +
ctagagaactgcatcaagag

SEQ ID NO: 21075 - DNA, 20 bp, Artificial Sequence
  Synthetic oligonucleotide; AGG chr11 5333669 5333688 5333685 +
tagagaactgcatcaagagg

SEQ ID NO: 21076 - DNA, 20 bp, Artificial Sequence
  Synthetic oligonucleotide; GAG chr11 5333671 5333690 5333687 +
gagaactgcatcaagaggag

SEQ ID NO: 21077 - DNA, 20 bp, Artificial Sequence
  Synthetic oligonucleotide; AGG chr11 5333672 5333691 5333688 +
agaactgcatcaagaggagg

SEQ ID NO: 21078 - DNA, 20 bp, Artificial Sequence
  Synthetic oligonucleotide; GAG chr11 5333674 5333693 5333690 +
aactgcatcaagaggaggag

SEQ ID NO: 21079 - DNA, 20 bp, Artificial Sequence
  Synthetic oligonucleotide; GAG chr11 5333676 5333695 5333692 +
ctgcatcaagaggaggagga

SEQ ID NO: 21080 - DNA, 20 bp, Artificial Sequence
  Synthetic oligonucleotide; AGG chr11 5333677 5333696 5333693 +
tgcatcaagaggaggaggag

SEQ ID NO: 21081 - DNA, 20 bp, Artificial Sequence
  Synthetic oligonucleotide; TAG chr11 5333680 5333699 5333696 +
atcaagaggaggaggagagg

SEQ ID NO: 21082 - DNA, 20 bp, Artificial Sequence
  Synthetic oligonucleotide; TAG chr11 5333685 5333704 5333701 +
gaggaggaggagaggtagta

SEQ ID NO: 21083 - DNA, 20 bp, Artificial Sequence
  Synthetic oligonucleotide; GAG chr11 5333687 5333706 5333703 +
ggaggaggagaggtagtata

SEQ ID NO: 21084 - DNA, 20 bp, Artificial Sequence
  Synthetic oligonucleotide; CAG chr11 5333695 5333714 5333711 +
agaggtagtatagagaccta

SEQ ID NO: 21085 - DNA, 20 bp, Artificial Sequence
  Synthetic oligonucleotide; AGG chr11 5333696 5333715 5333712 +
gaggtagtatagagacctac

SEQ ID NO: 21086 - DNA, 20 bp, Artificial Sequence
  Synthetic oligonucleotide; TGG chr11 5333704 5333723 5333720 +
atagagacctacaggtgtca

SEQ ID NO: 21087 - DNA, 20 bp, Artificial Sequence
  Synthetic oligonucleotide; CAG chr11 5333732 5333751 5333748 +
ccaccctgcacattcactcc

SEQ ID NO: 21088 - DNA, 20 bp, Artificial Sequence
  Synthetic oligonucleotide; GAG chr11 5333734 5333753 5333750 +
accctgcacattcactccca

SEQ ID NO: 21089 - DNA, 20 bp, Artificial Sequence
  Synthetic oligonucleotide; CAG chr11 5333738 5333757 5333754 +
tgcacattcactcccagagt

SEQ ID NO: 21090 - DNA, 20 bp, Artificial Sequence
  Synthetic oligonucleotide; AAG chr11 5333766 5333785 5333782 +
ttcctctcctgcctcttcca

SEQ ID NO: 21091 - DNA, 20 bp, Artificial Sequence
  Synthetic oligonucleotide; TAG chr11 5333782 5333801 5333798 +
tccaaagaaaatttctattg

SEQ ID NO: 21092 - DNA, 20 bp, Artificial Sequence
  Synthetic oligonucleotide; AGG chr11 5333783 5333802 5333799 +
ccaaagaaaatttctattgt

SEQ ID NO: 21093 - DNA, 20 bp, Artificial Sequence
  Synthetic oligonucleotide; AAG chr11 5333788 5333807 5333804 +
gaaaatttctattgtaggaa

SEQ ID NO: 21094 - DNA, 20 bp, Artificial Sequence
  Synthetic oligonucleotide; TAG chr11 5333800 5333819 5333816 +
tgtaggaaaagtgttcttaa

SEQ ID NO: 21095 - DNA, 20 bp, Artificial Sequence
  Synthetic oligonucleotide; GAG chr11 5333807 5333826 5333823 +
aaagtgttcttaatagcgct

SEQ ID NO: 21096 - DNA, 20 bp, Artificial Sequence
  Synthetic oligonucleotide; AAG chr11 5333815 5333834 5333831 +
cttaatagcgctgagctaac

SEQ ID NO: 21097 - DNA, 20 bp, Artificial Sequence
  Synthetic oligonucleotide; TAG chr11 5333824 5333843 5333840 +
gctgagctaacaagaacttc

SEQ ID NO: 21098 - DNA, 20 bp, Artificial Sequence
  Synthetic oligonucleotide; CAG chr11 5333836 5333855 5333852 +
agaacttctagatatcaact

SEQ ID NO: 21099 - DNA, 20 bp, Artificial Sequence
  Synthetic oligonucleotide; AAG chr11 5333858 5333877 5333874 +
gaactcttaattattcatgt

SEQ ID NO: 21100 - DNA, 20 bp, Artificial Sequence
  Synthetic oligonucleotide; CAG chr11 5333892 5333911 5333908 +
taaaactactgtttttattt

SEQ ID NO: 21101 - DNA, 20 bp, Artificial Sequence
  Synthetic oligonucleotide; GAG chr11 5333894 5333913 5333910 +
aaactactgtttttatttca

SEQ ID NO: 21102 - DNA, 20 bp, Artificial Sequence
  Synthetic oligonucleotide; TAG chr11 5333908 5333927 5333924 +
atttcagagttaacatttgc

SEQ ID NO: 21103 - DNA, 20 bp, Artificial Sequence
  Synthetic oligonucleotide; AGG chr11 5333909 5333928 5333925 +
tttcagagttaacatttgct

SEQ ID NO: 21104 - DNA, 20 bp, Artificial Sequence
  Synthetic oligonucleotide; AAG chr11 5333912 5333931 5333928 +
cagagttaacatttgctagg

SEQ ID NO: 21105 - DNA, 20 bp, Artificial Sequence
  Synthetic oligonucleotide; TGG chr11 5333929 5333948 5333945 +
aggaagttgaacttttatgt

SEQ ID NO: 21106 - DNA, 20 bp, Artificial Sequence
  Synthetic oligonucleotide; GAG chr11 5333931 5333950 5333947 +
gaagttgaacttttatgttg

SEQ ID NO: 21107 - DNA, 20 bp, Artificial Sequence
  Synthetic oligonucleotide; AGG chr11 5333932 5333951 5333948 +
aagttgaacttttatgttgg

SEQ ID NO: 21108 - DNA, 20 bp, Artificial Sequence
  Synthetic oligonucleotide; CGG chr11 5333945 5333964 5333961 +
atgttggaggttgatacacc

SEQ ID NO: 21109 - DNA, 20 bp, Artificial Sequence
  Synthetic oligonucleotide; CAG chr11 5333948 5333967 5333964 +
ttggaggttgatacacccgg

SEQ ID NO: 21110 - DNA, 20 bp, Artificial Sequence
  Synthetic oligonucleotide; TAG chr11 5333957 5333976 5333973 +
gatacacccggcagaatctg

SEQ ID NO: 21111 - DNA, 20 bp, Artificial Sequence
  Synthetic oligonucleotide; CAG chr11 5333963 5333982 5333979 +
cccggcagaatctgtagata

SEQ ID NO: 21112 - DNA, 20 bp, Artificial Sequence
  Synthetic oligonucleotide; TGG chr11 5334010 5334029 5334026 +
accctcttgcaacaactatg

SEQ ID NO: 21113 - DNA, 20 bp, Artificial Sequence
  Synthetic oligonucleotide; TGG chr11 5334013 5334032 5334029 +
ctcttgcaacaactatgtgg

SEQ ID NO: 21114 - DNA, 20 bp, Artificial Sequence
  Synthetic oligonucleotide; AAG chr11 5334016 5334035 5334032 +
ttgcaacaactatgtggtgg

SEQ ID NO: 21115 - DNA, 20 bp, Artificial Sequence
  Synthetic oligonucleotide; GAG chr11 5334018 5334037 5334034 +
gcaacaactatgtggtggaa

SEQ ID NO: 21116 - DNA, 20 bp, Artificial Sequence
  Synthetic oligonucleotide; AAG chr11 5334026 5334045 5334042 +
tatgtggtggaagagaatcc

SEQ ID NO: 21117 - DNA, 20 bp, Artificial Sequence
  Synthetic oligonucleotide; AAG chr11 5334029 5334048 5334045 +
gtggtggaagagaatccaag

SEQ ID NO: 21118 - DNA, 20 bp, Artificial Sequence
  Synthetic oligonucleotide; TAG chr11 5334034 5334053 5334050 +
ggaagagaatccaagaagat

SEQ ID NO: 21119 - DNA, 20 bp, Artificial Sequence
  Synthetic oligonucleotide; TAG chr11 5334077 5334096 5334093 +
accttcattccattctccca

SEQ ID NO: 21120 - DNA, 20 bp, Artificial Sequence
  Synthetic oligonucleotide; TAG chr11 5334084 5334103 5334100 +
ttccattctcccatagtcac

SEQ ID NO: 21121 - DNA, 20 bp, Artificial Sequence
  Synthetic oligonucleotide; GAG chr11 5334086 5334105 5334102 +
ccattctcccatagtcacta

SEQ ID NO: 21122 - DNA, 20 bp, Artificial Sequence
  Synthetic oligonucleotide; TGG chr11 5334096 5334115 5334112 +
atagtcactagagcctgacc

SEQ ID NO: 21123 - DNA, 20 bp, Artificial Sequence
  Synthetic oligonucleotide; GGG chr11 5334097 5334116 5334113 +
tagtcactagagcctgacct

SEQ ID NO: 21124 - DNA, 20 bp, Artificial Sequence
  Synthetic oligonucleotide; GGG chr11 5334098 5334117 5334114 +
agtcactagagcctgacctg

SEQ ID NO: 21125 - DNA, 20 bp, Artificial Sequence
  Synthetic oligonucleotide; CAG chr11 5334104 5334123 5334120 +
tagagcctgacctggggtat

SEQ ID NO: 21126 - DNA, 20 bp, Artificial Sequence
  Synthetic oligonucleotide; AAG chr11 5334112 5334131 5334128 +
gacctggggtatcagaaatt

SEQ ID NO: 21127 - DNA, 20 bp, Artificial Sequence
  Synthetic oligonucleotide; AGG chr11 5334113 5334132 5334129 +
acctggggtatcagaaatta

SEQ ID NO: 21128 - DNA, 20 bp, Artificial Sequence
  Synthetic oligonucleotide; GGG chr11 5334114 5334133 5334130 +
cctggggtatcagaaattaa

SEQ ID NO: 21129 - DNA, 20 bp, Artificial Sequence
  Synthetic oligonucleotide; GGG chr11 5334115 5334134 5334131 +
ctggggtatcagaaattaag

SEQ ID NO: 21130 - DNA, 20 bp, Artificial Sequence
  Synthetic oligonucleotide; GAG chr11 5334117 5334136 5334133 +
ggggtatcagaaattaaggg

SEQ ID NO: 21131 - DNA, 20 bp, Artificial Sequence
  Synthetic oligonucleotide; GAG chr11 5334119 5334138 5334135 +
ggtatcagaaattaagggga

SEQ ID NO: 21132 - DNA, 20 bp, Artificial Sequence
  Synthetic oligonucleotide; AGG chr11 5334120 5334139 5334136 +
gtatcagaaattaaggggag

SEQ ID NO: 21133 - DNA, 20 bp, Artificial Sequence
  Synthetic oligonucleotide; GAG chr11 5334131 5334150 5334147 +
taaggggagaggtaattgct

SEQ ID NO: 21134 - DNA, 20 bp, Artificial Sequence
  Synthetic oligonucleotide; TGG chr11 5334137 5334156 5334153 +
gagaggtaattgctgagtcc

SEQ ID NO: 21135 - DNA, 20 bp, Artificial Sequence
  Synthetic oligonucleotide; TAG chr11 5334142 5334161 5334158 +
gtaattgctgagtcctggtg

SEQ ID NO: 21136 - DNA, 20 bp, Artificial Sequence
  Synthetic oligonucleotide; TGG chr11 5334149 5334168 5334165 +
ctgagtcctggtgtagaaat

SEQ ID NO: 21137 - DNA, 20 bp, Artificial Sequence
  Synthetic oligonucleotide; TGG chr11 5334158 5334177 5334174 +
ggtgtagaaattggtttaaa

SEQ ID NO: 21138 - DNA, 20 bp, Artificial Sequence
  Synthetic oligonucleotide; AAG chr11 5334169 5334188 5334185 +
tggtttaaatggtatctctg

SEQ ID NO: 21139 - DNA, 20 bp, Artificial Sequence
  Synthetic oligonucleotide; CAG chr11 5334180 5334199 5334196 +
gtatctctgaagactgctaa

SEQ ID NO: 21140 - DNA, 20 bp, Artificial Sequence
  Synthetic oligonucleotide; AGG chr11 5334181 5334200 5334197 +
tatctctgaagactgctaac

SEQ ID NO: 21141 - DNA, 20 bp, Artificial Sequence
  Synthetic oligonucleotide; GGG chr11 5334182 5334201 5334198 +
atctctgaagactgctaaca

SEQ ID NO: 21142 - DNA, 20 bp, Artificial Sequence
  Synthetic oligonucleotide; GAG chr11 5334194 5334213 5334210 +
tgctaacagggttaatttgt

SEQ ID NO: 21143 - DNA, 20 bp, Artificial Sequence
  Synthetic oligonucleotide; AGG chr11 5334195 5334214 5334211 +
gctaacagggttaatttgtg

SEQ ID NO: 21144 - DNA, 20 bp, Artificial Sequence
  Synthetic oligonucleotide; CAG chr11 5334222 5334241 5334238 +
ttgtattcaaaattgttccc

SEQ ID NO: 21145 - DNA, 20 bp, Artificial Sequence
  Synthetic oligonucleotide; TGG chr11 5334240 5334259 5334256 +
cccagtatctgtcttgatgc

SEQ ID NO: 21146 - DNA, 20 bp, Artificial Sequence
  Synthetic oligonucleotide; TAG chr11 5334248 5334267 5334264 +
ctgtcttgatgctggataat

SEQ ID NO: 21147 - DNA, 20 bp, Artificial Sequence
  Synthetic oligonucleotide; AGG chr11 5334249 5334268 5334265 +
tgtcttgatgctggataatt

SEQ ID NO: 21148 - DNA, 20 bp, Artificial Sequence
  Synthetic oligonucleotide; TGG chr11 5334256 5334275 5334272 +
atgctggataattaggctac

SEQ ID NO: 21149 - DNA, 20 bp, Artificial Sequence
  Synthetic oligonucleotide; GGG chr11 5334257 5334276 5334273 +
tgctggataattaggctact

SEQ ID NO: 21150 - DNA, 20 bp, Artificial Sequence
  Synthetic oligonucleotide; AAG chr11 5334272 5334291 5334288 +
ctactgggatattttttttc

SEQ ID NO: 21151 - DNA, 20 bp, Artificial Sequence
  Synthetic oligonucleotide; TGG chr11 5334282 5334301 5334298 +
attttttttcaagcctcctt

SEQ ID NO: 21152 - DNA, 20 bp, Artificial Sequence
  Synthetic oligonucleotide; GAG chr11 5334284 5334303 5334300 +
tttttttcaagcctcctttg

SEQ ID NO: 21153 - DNA, 20 bp, Artificial Sequence
  Synthetic oligonucleotide; AAG chr11 5334287 5334306 5334303 +
ttttcaagcctcctttggag

SEQ ID NO: 21154 - DNA, 20 bp, Artificial Sequence
  Synthetic oligonucleotide; AGG chr11 5334288 5334307 5334304 +
tttcaagcctcctttggaga

SEQ ID NO: 21155 - DNA, 20 bp, Artificial Sequence
  Synthetic oligonucleotide; AAG chr11 5334291 5334310 5334307 +
caagcctcctttggagaagg

SEQ ID NO: 21156 - DNA, 20 bp, Artificial Sequence
  Synthetic oligonucleotide; TGG chr11 5334294 5334313 5334310 +
gcctcctttggagaaggaag

SEQ ID NO: 21157 - DNA, 20 bp, Artificial Sequence
  Synthetic oligonucleotide; GGG chr11 5334295 5334314 5334311 +
cctcctttggagaaggaagt

SEQ ID NO: 21158 - DNA, 20 bp, Artificial Sequence
  Synthetic oligonucleotide; CAG chr11 5334301 5334320 5334317 +
ttggagaaggaagtgggctc

SEQ ID NO: 21159 - DNA, 20 bp, Artificial Sequence
  Synthetic oligonucleotide; AAG chr11 5334317 5334336 5334333 +
gctccagaactgtgttctta

SEQ ID NO: 21160 - DNA, 20 bp, Artificial Sequence
  Synthetic oligonucleotide; AAG chr11 5334340 5334359 5334356 +
ccccatattttctttgcaaa

SEQ ID NO: 21161 - DNA, 20 bp, Artificial Sequence
  Synthetic oligonucleotide; CAG chr11 5334347 5334366 5334363 +
ttttctttgcaaaaagaaaa

SEQ ID NO: 21162 - DNA, 20 bp, Artificial Sequence
  Synthetic oligonucleotide; TAG chr11 5334355 5334374 5334371 +
gcaaaaagaaaacagaattg

SEQ ID NO: 21163 - DNA, 20 bp, Artificial Sequence
  Synthetic oligonucleotide; CAG chr11 5334365 5334384 5334381 +
aacagaattgtagcttcatc

SEQ ID NO: 21164 - DNA, 20 bp, Artificial Sequence
  Synthetic oligonucleotide; TGG chr11 5334372 5334391 5334388 +
ttgtagcttcatccagcaca

SEQ ID NO: 21165 - DNA, 20 bp, Artificial Sequence
  Synthetic oligonucleotide; AAG chr11 5334375 5334394 5334391 +
tagcttcatccagcacatgg

SEQ ID NO: 21166 - DNA, 20 bp, Artificial Sequence
  Synthetic oligonucleotide; AAG chr11 5334424 5334443 5334440 +
gtatgattccccacctcaaa

SEQ ID NO: 21167 - DNA, 20 bp, Artificial Sequence
  Synthetic oligonucleotide; AAG chr11 5334427 5334446 5334443 +
tgattccccacctcaaaaag

SEQ ID NO: 21168 - DNA, 20 bp, Artificial Sequence
  Synthetic oligonucleotide; AAG chr11 5334438 5334457 5334454 +
ctcaaaaagaagataccgtg

SEQ ID NO: 21169 - DNA, 20 bp, Artificial Sequence
  Synthetic oligonucleotide; TAG chr11 5334467 5334486 5334483 +
tttgttattccttaaccctg

SEQ ID NO: 21170 - DNA, 20 bp, Artificial Sequence
  Synthetic oligonucleotide; AAG chr11 5334475 5334494 5334491 +
tccttaaccctgtagccaat

SEQ ID NO: 21171 - DNA, 20 bp, Artificial Sequence
  Synthetic oligonucleotide; TAG chr11 5334489 5334508 5334505 +
gccaataagctcactcaact

SEQ ID NO: 21172 - DNA, 20 bp, Artificial Sequence
  Synthetic oligonucleotide; AAG chr11 5334495 5334514 5334511 +
aagctcactcaacttagaca

SEQ ID NO: 21173 - DNA, 20 bp, Artificial Sequence
  Synthetic oligonucleotide; TGG chr11 5334528 5334547 5334544 +
cctcacacttaatcttttct

SEQ ID NO: 21174 - DNA, 20 bp, Artificial Sequence
  Synthetic oligonucleotide; AAG chr11 5334539 5334558 5334555 +
atcttttcttggtttcaaat

SEQ ID NO: 21175 - DNA, 20 bp, Artificial Sequence
  Synthetic oligonucleotide; GAG chr11 5334568 5334587 5334584 +
tgttatatatactcacaaat

SEQ ID NO: 21176 - DNA, 20 bp, Artificial Sequence
  Synthetic oligonucleotide; AAG chr11 5334581 5334600 5334597 +
cacaaatgagtgctgctgat

SEQ ID NO: 21177 - DNA, 20 bp, Artificial Sequence
  Synthetic oligonucleotide; CAG chr11 5334594 5334613 5334610 +
tgctgataagttctttcaaa

SEQ ID NO: 21178 - DNA, 20 bp, Artificial Sequence
  Synthetic oligonucleotide; AAG chr11 5334598 5334617 5334614 +
gataagttctttcaaacagt

SEQ ID NO: 21179 - DNA, 20 bp, Artificial Sequence
  Synthetic oligonucleotide; TGG chr11 5334617 5334636 5334633 +
taagcttgttttctgtctct

SEQ ID NO: 21180 - DNA, 20 bp, Artificial Sequence
  Synthetic oligonucleotide; AAG chr11 5334621 5334640 5334637 +
cttgttttctgtctcttggt

SEQ ID NO: 21181 - DNA, 20 bp, Artificial Sequence
  Synthetic oligonucleotide; AAG chr11 5334632 5334651 5334648 +
tctcttggtaagtcttgccc

SEQ ID NO: 21182 - DNA, 20 bp, Artificial Sequence
  Synthetic oligonucleotide; CAG chr11 5334638 5334657 5334654 +
ggtaagtcttgcccaagaat

SEQ ID NO: 21183 - DNA, 20 bp, Artificial Sequence
  Synthetic oligonucleotide; GAG chr11 5334640 5334659 5334656 +
taagtcttgcccaagaatca

SEQ ID NO: 21184 - DNA, 20 bp, Artificial Sequence
  Synthetic oligonucleotide; TGG chr11 5334653 5334672 5334669 +
agaatcagagttactgcttc

SEQ ID NO: 21185 - DNA, 20 bp, Artificial Sequence
  Synthetic oligonucleotide; GAG chr11 5334655 5334674 5334671 +
aatcagagttactgcttctg

SEQ ID NO: 21186 - DNA, 20 bp, Artificial Sequence
  Synthetic oligonucleotide; AAG chr11 5334669 5334688 5334685 +
cttctggagcaatataaatc

SEQ ID NO: 21187 - DNA, 20 bp, Artificial Sequence
  Synthetic oligonucleotide; AAG chr11 5334689 5334708 5334705 +
aagtttaaaaaattttattt

SEQ ID NO: 21188 - DNA, 20 bp, Artificial Sequence
  Synthetic oligonucleotide; TAG chr11 5334699 5334718 5334715 +
aattttatttaagtgtcctg

SEQ ID NO: 21189 - DNA, 20 bp, Artificial Sequence
  Synthetic oligonucleotide; AAG chr11 5334712 5334731 5334728 +
tgtcctgtagtaatgttaaa

SEQ ID NO: 21190 - DNA, 20 bp, Artificial Sequence
  Synthetic oligonucleotide; AGG chr11 5334713 5334732 5334729 +
gtcctgtagtaatgttaaaa

SEQ ID NO: 21191 - DNA, 20 bp, Artificial Sequence
  Synthetic oligonucleotide; GGG chr11 5334714 5334733 5334730 +
tcctgtagtaatgttaaaaa

SEQ ID NO: 21192 - DNA, 20 bp, Artificial Sequence
  Synthetic oligonucleotide; GGG chr11 5334715 5334734 5334731 +
cctgtagtaatgttaaaaag

SEQ ID NO: 21193 - DNA, 20 bp, Artificial Sequence
  Synthetic oligonucleotide; TGG chr11 5334721 5334740 5334737 +
gtaatgttaaaaaggggaca

SEQ ID NO: 21194 - DNA, 20 bp, Artificial Sequence
  Synthetic oligonucleotide; TGG chr11 5334724 5334743 5334740 +
atgttaaaaaggggacatgg

SEQ ID NO: 21195 - DNA, 20 bp, Artificial Sequence
  Synthetic oligonucleotide; GAG chr11 5334726 5334745 5334742 +
gttaaaaaggggacatggtg

SEQ ID NO: 21196 - DNA, 20 bp, Artificial Sequence
  Synthetic oligonucleotide; AGG chr11 5334727 5334746 5334743 +
ttaaaaaggggacatggtgg

SEQ ID NO: 21197 - DNA, 20 bp, Artificial Sequence
  Synthetic oligonucleotide; TGG chr11 5334744 5334763 5334760 +
tggaggtattctttaatccc

SEQ ID NO: 21198 - DNA, 20 bp, Artificial Sequence
  Synthetic oligonucleotide; TAG chr11 5334785 5334804 5334801 +
acttgaatacaatcatctca

SEQ ID NO: 21199 - DNA, 20 bp, Artificial Sequence
  Synthetic oligonucleotide; CAG chr11 5334793 5334812 5334809 +
acaatcatctcatagtctgt

SEQ ID NO: 21200 - DNA, 20 bp, Artificial Sequence
  Synthetic oligonucleotide; GAG chr11 5334795 5334814 5334811 +
aatcatctcatagtctgtca

SEQ ID NO: 21201 - DNA, 20 bp, Artificial Sequence
  Synthetic oligonucleotide; AAG chr11 5334802 5334821 5334818 +
tcatagtctgtcagagaaat

SEQ ID NO: 21202 - DNA, 20 bp, Artificial Sequence
  Synthetic oligonucleotide; AGG chr11 5334803 5334822 5334819 +
catagtctgtcagagaaata

SEQ ID NO: 21203 - DNA, 20 bp, Artificial Sequence
  Synthetic oligonucleotide; GAG chr11 5334810 5334829 5334826 +
tgtcagagaaataaggatct

SEQ ID NO: 21204 - DNA, 20 bp, Artificial Sequence
  Synthetic oligonucleotide; CAG chr11 5334830 5334849 5334846 +
gagaatttctattgtctcat

SEQ ID NO: 21205 - DNA, 20 bp, Artificial Sequence
  Synthetic oligonucleotide; TGG chr11 5334854 5334873 5334870 +
cttaaatcctaaatttatcc

SEQ ID NO: 21206 - DNA, 20 bp, Artificial Sequence
  Synthetic oligonucleotide; TAG chr11 5334861 5334880 5334877 +
cctaaatttatcctggaact

SEQ ID NO: 21207 - DNA, 20 bp, Artificial Sequence
  Synthetic oligonucleotide; GAG chr11 5334873 5334892 5334889 +
ctggaacttagcccaactat

SEQ ID NO: 21208 - DNA, 20 bp, Artificial Sequence
  Synthetic oligonucleotide; GAG chr11 5334886 5334905 5334902 +
caactatgagattttaaaat

SEQ ID NO: 21209 - DNA, 20 bp, Artificial Sequence
  Synthetic oligonucleotide; TGG chr11 5334891 5334910 5334907 +
atgagattttaaaatgagta

SEQ ID NO: 21210 - DNA, 20 bp, Artificial Sequence
  Synthetic oligonucleotide; GGG chr11 5334892 5334911 5334908 +
tgagattttaaaatgagtat

SEQ ID NO: 21211 - DNA, 20 bp, Artificial Sequence
  Synthetic oligonucleotide; TGG chr11 5334902 5334921 5334918 +
aaatgagtatgggtgcaatg

SEQ ID NO: 21212 - DNA, 20 bp, Artificial Sequence
  Synthetic oligonucleotide; GAG chr11 5334913 5334932 5334929 +
ggtgcaatgtggtgaaccat

SEQ ID NO: 21213 - DNA, 20 bp, Artificial Sequence
  Synthetic oligonucleotide; AGG chr11 5334914 5334933 5334930 +
gtgcaatgtggtgaaccatg

SEQ ID NO: 21214 - DNA, 20 bp, Artificial Sequence
  Synthetic oligonucleotide; GGG chr11 5334915 5334934 5334931 +
tgcaatgtggtgaaccatga

SEQ ID NO: 21215 - DNA, 20 bp, Artificial Sequence
  Synthetic oligonucleotide; TGG chr11 5334926 5334945 5334942 +
gaaccatgagggtcacattt

SEQ ID NO: 21216 - DNA, 20 bp, Artificial Sequence
  Synthetic oligonucleotide; CAG chr11 5334946 5334965 5334962 +
tggtgcctgacatttcacat

SEQ ID NO: 21217 - DNA, 20 bp, Artificial Sequence
  Synthetic oligonucleotide; AAG chr11 5334951 5334970 5334967 +
cctgacatttcacatcagtt

SEQ ID NO: 21218 - DNA, 20 bp, Artificial Sequence
  Synthetic oligonucleotide; TAG chr11 5334979 5334998 5334995 +
cctgaactgcattctgctca

SEQ ID NO: 21219 - DNA, 20 bp, Artificial Sequence
  Synthetic oligonucleotide; AGG chr11 5334980 5334999 5334996 +
ctgaactgcattctgctcat

SEQ ID NO: 21220 - DNA, 20 bp, Artificial Sequence
  Synthetic oligonucleotide; AAG chr11 5334996 5335015 5335012 +
tcataggtcttcctaaatgt

SEQ ID NO: 21221 - DNA, 20 bp, Artificial Sequence
  Synthetic oligonucleotide; CAG chr11 5334999 5335018 5335015 +
taggtcttcctaaatgtaag

SEQ ID NO: 21222 - DNA, 20 bp, Artificial Sequence
  Synthetic oligonucleotide; TAG chr11 5335004 5335023 5335020 +
cttcctaaatgtaagcagaa

SEQ ID NO: 21223 - DNA, 20 bp, Artificial Sequence
  Synthetic oligonucleotide; TAG chr11 5335007 5335026 5335023 +
cctaaatgtaagcagaatag

SEQ ID NO: 21224 - DNA, 20 bp, Artificial Sequence
  Synthetic oligonucleotide; TAG chr11 5335010 5335029 5335026 +
aaatgtaagcagaatagtag

SEQ ID NO: 21225 - DNA, 20 bp, Artificial Sequence
  Synthetic oligonucleotide; AGG chr11 5335011 5335030 5335027 +
aatgtaagcagaatagtagt

SEQ ID NO: 21226 - DNA, 20 bp, Artificial Sequence
  Synthetic oligonucleotide; AAG chr11 5335027 5335046 5335043 +
tagtaggaaatcatgattaa

SEQ ID NO: 21227 - DNA, 20 bp, Artificial Sequence
  Synthetic oligonucleotide; CAG chr11 5335031 5335050 5335047 +
aggaaatcatgattaaaagt

SEQ ID NO: 21228 - DNA, 20 bp, Artificial Sequence
  Synthetic oligonucleotide; TGG chr11 5335038 5335057 5335054 +
catgattaaaagtcagtctc

SEQ ID NO: 21229 - DNA, 20 bp, Artificial Sequence
  Synthetic oligonucleotide; TGG chr11 5335044 5335063 5335060 +
taaaagtcagtctctggaaa

SEQ ID NO: 21230 - DNA, 20 bp, Artificial Sequence
  Synthetic oligonucleotide; AAG chr11 5335050 5335069 5335066 +
tcagtctctggaaatggctt

SEQ ID NO: 21231 - DNA, 20 bp, Artificial Sequence
  Synthetic oligonucleotide; AAG chr11 5335082 5335101 5335098 +
ttgtgtgtcctctttgtact

SEQ ID NO: 21232 - DNA, 20 bp, Artificial Sequence
  Synthetic oligonucleotide; TAG chr11 5335093 5335112 5335109 +
ctttgtactaagttaaaatt

SEQ ID NO: 21233 - DNA, 20 bp, Artificial Sequence
  Synthetic oligonucleotide; AGG chr11 5335094 5335113 5335110 +
tttgtactaagttaaaattt

SEQ ID NO: 21234 - DNA, 20 bp, Artificial Sequence
  Synthetic oligonucleotide; TGG chr11 5335099 5335118 5335115 +
actaagttaaaatttaggtc

SEQ ID NO: 21235 - DNA, 20 bp, Artificial Sequence
  Synthetic oligonucleotide; TAG chr11 5335109 5335128 5335125 +
aatttaggtctggattgatt

SEQ ID NO: 21236 - DNA, 20 bp, Artificial Sequence
  Synthetic oligonucleotide; AGG chr11 5335110 5335129 5335126 +
atttaggtctggattgattt

SEQ ID NO: 21237 - DNA, 20 bp, Artificial Sequence
  Synthetic oligonucleotide; GGG chr11 5335111 5335130 5335127 +
tttaggtctggattgattta

SEQ ID NO: 21238 - DNA, 20 bp, Artificial Sequence
  Synthetic oligonucleotide; GGG chr11 5335112 5335131 5335128 +
ttaggtctggattgatttag

SEQ ID NO: 21239 - DNA, 20 bp, Artificial Sequence
  Synthetic oligonucleotide; GAG chr11 5335114 5335133 5335130 +
aggtctggattgatttaggg

SEQ ID NO: 21240 - DNA, 20 bp, Artificial Sequence
  Synthetic oligonucleotide; GAG chr11 5335137 5335156 5335153 +
ccatgctttgaacttaaaat

SEQ ID NO: 21241 - DNA, 20 bp, Artificial Sequence
  Synthetic oligonucleotide; AGG chr11 5335138 5335157 5335154 +
catgctttgaacttaaaatg

SEQ ID NO: 21242 - DNA, 20 bp, Artificial Sequence
  Synthetic oligonucleotide; GAG chr11 5335142 5335161 5335158 +
ctttgaacttaaaatgaggt

SEQ ID NO: 21243 - DNA, 20 bp, Artificial Sequence
  Synthetic oligonucleotide; AGG chr11 5335143 5335162 5335159 +
tttgaacttaaaatgaggtg

SEQ ID NO: 21244 - DNA, 20 bp, Artificial Sequence
  Synthetic oligonucleotide; TAG chr11 5335146 5335165 5335162 +
gaacttaaaatgaggtgagg

SEQ ID NO: 21245 - DNA, 20 bp, Artificial Sequence
  Synthetic oligonucleotide; AAG chr11 5335150 5335169 5335166 +
ttaaaatgaggtgaggtagt

SEQ ID NO: 21246 - DNA, 20 bp, Artificial Sequence
  Synthetic oligonucleotide; GAG chr11 5335158 5335177 5335174 +
aggtgaggtagtaagaccct

SEQ ID NO: 21247 - DNA, 20 bp, Artificial Sequence
  Synthetic oligonucleotide; CAG chr11 5335177 5335196 5335193 +
tgagataactgatttaattt

SEQ ID NO: 21248 - DNA, 20 bp, Artificial Sequence
  Synthetic oligonucleotide; AGG chr11 5335178 5335197 5335194 +
gagataactgatttaatttc

SEQ ID NO: 21249 - DNA, 20 bp, Artificial Sequence
  Synthetic oligonucleotide; TAG chr11 5335198 5335217 5335214 +
aggctgccctcccatttcat

SEQ ID NO: 21250 - DNA, 20 bp, Artificial Sequence
  Synthetic oligonucleotide; TAG chr11 5335201 5335220 5335217 +
ctgccctcccatttcattag

SEQ ID NO: 21251 - DNA, 20 bp, Artificial Sequence
  Synthetic oligonucleotide; AGG chr11 5335202 5335221 5335218 +
tgccctcccatttcattagt

SEQ ID NO: 21252 - DNA, 20 bp, Artificial Sequence
  Synthetic oligonucleotide; TGG chr11 5335222 5335241 5335238 +
aggtatattgaccctctcac

SEQ ID NO: 21253 - DNA, 20 bp, Artificial Sequence
  Synthetic oligonucleotide; CAG chr11 5335225 5335244 5335241 +
tatattgaccctctcactgg

SEQ ID NO: 21254 - DNA, 20 bp, Artificial Sequence
  Synthetic oligonucleotide; TGG chr11 5335266 5335285 5335282 +
cataaatatgactctattcc

SEQ ID NO: 21255 - DNA, 20 bp, Artificial Sequence
  Synthetic oligonucleotide; TAG chr11 5335284 5335303 5335300 +
cctggaaacatcacttatct

SEQ ID NO: 21256 - DNA, 20 bp, Artificial Sequence
  Synthetic oligonucleotide; CAG chr11 5335289 5335308 5335305 +
aaacatcacttatcttagaa

SEQ ID NO: 21257 - DNA, 20 bp, Artificial Sequence
  Synthetic oligonucleotide; AAG chr11 5335297 5335316 5335313 +
cttatcttagaacagatata

SEQ ID NO: 21258 - DNA, 20 bp, Artificial Sequence
  Synthetic oligonucleotide; CAG chr11 5335310 5335329 5335326 +
agatataaagtaatttcctg

SEQ ID NO: 21259 - DNA, 20 bp, Artificial Sequence
  Synthetic oligonucleotide; CAG chr11 5335320 5335339 5335336 +
taatttcctgcagactgccc

SEQ ID NO: 21260 - DNA, 20 bp, Artificial Sequence
  Synthetic oligonucleotide; GAG chr11 5335322 5335341 5335338 +
atttcctgcagactgcccca

SEQ ID NO: 21261 - DNA, 20 bp, Artificial Sequence
  Synthetic oligonucleotide; TGG chr11 5335326 5335345 5335342 +
cctgcagactgccccagagt

SEQ ID NO: 21262 - DNA, 20 bp, Artificial Sequence
  Synthetic oligonucleotide; GGG chr11 5335327 5335346 5335343 +
ctgcagactgccccagagtt

SEQ ID NO: 21263 - DNA, 20 bp, Artificial Sequence
  Synthetic oligonucleotide; AAG chr11 5335345 5335364 5335361 +
ttgggataaaatctcatgtg

SEQ ID NO: 21264 - DNA, 20 bp, Artificial Sequence
  Synthetic oligonucleotide; TGG chr11 5335357 5335376 5335373 +
ctcatgtgaagtgacactgt

SEQ ID NO: 21265 - DNA, 20 bp, Artificial Sequence
  Synthetic oligonucleotide; TGG chr11 5335360 5335379 5335376 +
atgtgaagtgacactgttgg

SEQ ID NO: 21266 - DNA, 20 bp, Artificial Sequence
  Synthetic oligonucleotide; GAG chr11 5335362 5335381 5335378 +
gtgaagtgacactgttggtg

SEQ ID NO: 21267 - DNA, 20 bp, Artificial Sequence
  Synthetic oligonucleotide; AGG chr11 5335363 5335382 5335379 +
tgaagtgacactgttggtgg

SEQ ID NO: 21268 - DNA, 20 bp, Artificial Sequence
  Synthetic oligonucleotide; AAG chr11 5335368 5335387 5335384 +
tgacactgttggtggaggat

SEQ ID NO: 21269 - DNA, 20 bp, Artificial Sequence
  Synthetic oligonucleotide; CAG chr11 5335375 5335394 5335391 +
gttggtggaggataagcctc

SEQ ID NO: 21270 - DNA, 20 bp, Artificial Sequence
  Synthetic oligonucleotide; GAG chr11 5335377 5335396 5335393 +
tggtggaggataagcctcca

SEQ ID NO: 21271 - DNA, 20 bp, Artificial Sequence
  Synthetic oligonucleotide; TGG chr11 5335382 5335401 5335398 +
gaggataagcctccagagaa

SEQ ID NO: 21272 - DNA, 20 bp, Artificial Sequence
  Synthetic oligonucleotide; GGG chr11 5335383 5335402 5335399 +
aggataagcctccagagaat

SEQ ID NO: 21273 - DNA, 20 bp, Artificial Sequence
  Synthetic oligonucleotide; CAG chr11 5335398 5335417 5335414 +
agaatgggaacaactattat

SEQ ID NO: 21274 - DNA, 20 bp, Artificial Sequence
  Synthetic oligonucleotide; AAG chr11 5335411 5335430 5335427 +
ctattatcagccaacactca

SEQ ID NO: 21275 - DNA, 20 bp, Artificial Sequence
  Synthetic oligonucleotide; AAG chr11 5335419 5335438 5335435 +
agccaacactcaaagtcacc

SEQ ID NO: 21276 - DNA, 20 bp, Artificial Sequence
  Synthetic oligonucleotide; TAG chr11 5335424 5335443 5335440 +
acactcaaagtcaccaagct

SEQ ID NO: 21277 - DNA, 20 bp, Artificial Sequence
  Synthetic oligonucleotide; AGG chr11 5335425 5335444 5335441 +
cactcaaagtcaccaagctt

SEQ ID NO: 21278 - DNA, 20 bp, Artificial Sequence
  Synthetic oligonucleotide; GGG chr11 5335426 5335445 5335442 +
actcaaagtcaccaagctta

SEQ ID NO: 21279 - DNA, 20 bp, Artificial Sequence
  Synthetic oligonucleotide; GGG chr11 5335427 5335446 5335443 +
ctcaaagtcaccaagcttag

SEQ ID NO: 21280 - DNA, 20 bp, Artificial Sequence
  Synthetic oligonucleotide; TGG chr11 5335433 5335452 5335449 +
gtcaccaagcttaggggcac

SEQ ID NO: 21281 - DNA, 20 bp, Artificial Sequence
  Synthetic oligonucleotide; GGG chr11 5335434 5335453 5335450 +
tcaccaagcttaggggcact

SEQ ID NO: 21282 - DNA, 20 bp, Artificial Sequence
  Synthetic oligonucleotide; GAG chr11 5335436 5335455 5335452 +
accaagcttaggggcactgg

SEQ ID NO: 21283 - DNA, 20 bp, Artificial Sequence
  Synthetic oligonucleotide; AGG chr11 5335437 5335456 5335453 +
ccaagcttaggggcactggg

SEQ ID NO: 21284 - DNA, 20 bp, Artificial Sequence
  Synthetic oligonucleotide; AAG chr11 5335440 5335459 5335456 +
agcttaggggcactgggagg

SEQ ID NO: 21285 - DNA, 20 bp, Artificial Sequence
  Synthetic oligonucleotide; TAG chr11 5335443 5335462 5335459 +
ttaggggcactgggaggaag

SEQ ID NO: 21286 - DNA, 20 bp, Artificial Sequence
  Synthetic oligonucleotide; AGG chr11 5335444 5335463 5335460 +
taggggcactgggaggaagt

SEQ ID NO: 21287 - DNA, 20 bp, Artificial Sequence
  Synthetic oligonucleotide; CAG chr11 5335447 5335466 5335463 +
gggcactgggaggaagtagg

SEQ ID NO: 21288 - DNA, 20 bp, Artificial Sequence
  Synthetic oligonucleotide; AGG chr11 5335448 5335467 5335464 +
ggcactgggaggaagtaggc

SEQ ID NO: 21289 - DNA, 20 bp, Artificial Sequence
  Synthetic oligonucleotide; GGG chr11 5335449 5335468 5335465 +
gcactgggaggaagtaggca

SEQ ID NO: 21290 - DNA, 20 bp, Artificial Sequence
  Synthetic oligonucleotide; TAG chr11 5335480 5335499 5335496 +
atatcttctatttccttaaa

SEQ ID NO: 21291 - DNA, 20 bp, Artificial Sequence
  Synthetic oligonucleotide; AAG chr11 5335515 5335534 5335531 +
ctctcattcatgtattttct

SEQ ID NO: 21292 - DNA, 20 bp, Artificial Sequence
  Synthetic oligonucleotide; AAG chr11 5335560 5335579 5335576 +
ttcctgctgtattgcctgtg

SEQ ID NO: 21293 - DNA, 20 bp, Artificial Sequence
  Synthetic oligonucleotide; AAG chr11 5335565 5335584 5335581 +
gctgtattgcctgtgaagta

SEQ ID NO: 21294 - DNA, 20 bp, Artificial Sequence
  Synthetic oligonucleotide; CAG chr11 5335578 5335597 5335594 +
tgaagtaaagtatcatgtca

SEQ ID NO: 21295 - DNA, 20 bp, Artificial Sequence
  Synthetic oligonucleotide; CAG chr11 5335581 5335600 5335597 +
agtaaagtatcatgtcacag

SEQ ID NO: 21296 - DNA, 20 bp, Artificial Sequence
  Synthetic oligonucleotide; CAG chr11 5335592 5335611 5335608 +
atgtcacagcagcataatct

SEQ ID NO: 21297 - DNA, 20 bp, Artificial Sequence
  Synthetic oligonucleotide; TGG chr11 5335597 5335616 5335613 +
acagcagcataatctcagat

SEQ ID NO: 21298 - DNA, 20 bp, Artificial Sequence
  Synthetic oligonucleotide; GGG chr11 5335598 5335617 5335614 +
cagcagcataatctcagatt

SEQ ID NO: 21299 - DNA, 20 bp, Artificial Sequence
  Synthetic oligonucleotide; AAG chr11 5335601 5335620 5335617 +
cagcataatctcagattggg

SEQ ID NO: 21300 - DNA, 20 bp, Artificial Sequence
  Synthetic oligonucleotide; AGG chr11 5335602 5335621 5335618 +
agcataatctcagattggga

SEQ ID NO: 21301 - DNA, 20 bp, Artificial Sequence
  Synthetic oligonucleotide; AAG chr11 5335625 5335644 5335641 +
acctccatctcctgtaataa

SEQ ID NO: 21302 - DNA, 20 bp, Artificial Sequence
  Synthetic oligonucleotide; CAG chr11 5335640 5335659 5335656 +
aataaaagccttctttgatg

SEQ ID NO: 21303 - DNA, 20 bp, Artificial Sequence
  Synthetic oligonucleotide; AAG chr11 5335654 5335673 5335670 +
ttgatgcagtgtttcctgac

SEQ ID NO: 21304 - DNA, 20 bp, Artificial Sequence
  Synthetic oligonucleotide; AGG chr11 5335655 5335674 5335671 +
tgatgcagtgtttcctgaca

SEQ ID NO: 21305 - DNA, 20 bp, Artificial Sequence
  Synthetic oligonucleotide; GGG chr11 5335656 5335675 5335672 +
gatgcagtgtttcctgacaa

SEQ ID NO: 21306 - DNA, 20 bp, Artificial Sequence
  Synthetic oligonucleotide; GAG chr11 5335668 5335687 5335684 +
cctgacaagggtcatccgct

SEQ ID NO: 21307 - DNA, 20 bp, Artificial Sequence
  Synthetic oligonucleotide; TAG chr11 5335709 5335728 5335725 +
tcacataacacaatatttat

SEQ ID NO: 21308 - DNA, 20 bp, Artificial Sequence
  Synthetic oligonucleotide; CAG chr11 5335733 5335752 5335749 +
atatctgtgctgaaaatact

SEQ ID NO: 21309 - DNA, 20 bp, Artificial Sequence
  Synthetic oligonucleotide; AGG chr11 5335734 5335753 5335750 +
tatctgtgctgaaaatactc

SEQ ID NO: 21310 - DNA, 20 bp, Artificial Sequence
  Synthetic oligonucleotide; CAG chr11 5335737 5335756 5335753 +
ctgtgctgaaaatactcagg

SEQ ID NO: 21311 - DNA, 20 bp, Artificial Sequence
  Synthetic oligonucleotide; TAG chr11 5335749 5335768 5335765 +
tactcaggcagccacattat

SEQ ID NO: 21312 - DNA, 20 bp, Artificial Sequence
  Synthetic oligonucleotide; TGG chr11 5335787 5335806 5335803 +
ttaaaatgaaaatatttttc

SEQ ID NO: 21313 - DNA, 20 bp, Artificial Sequence
  Synthetic oligonucleotide; TGG chr11 5335803 5335822 5335819 +
tttctggtcttcctattcct

SEQ ID NO: 21314 - DNA, 20 bp, Artificial Sequence
  Synthetic oligonucleotide; TGG chr11 5335810 5335829 5335826 +
tcttcctattccttggctct

SEQ ID NO: 21315 - DNA, 20 bp, Artificial Sequence
  Synthetic oligonucleotide; GAG chr11 5335816 5335835 5335832 +
tattccttggctcttggtct

SEQ ID NO: 21316 - DNA, 20 bp, Artificial Sequence
  Synthetic oligonucleotide; TGG chr11 5335822 5335841 5335838 +
ttggctcttggtctgagctc

SEQ ID NO: 21317 - DNA, 20 bp, Artificial Sequence
  Synthetic oligonucleotide; CAG chr11 5335830 5335849 5335846 +
tggtctgagctctggcatca

SEQ ID NO: 21318 - DNA, 20 bp, Artificial Sequence
  Synthetic oligonucleotide; TGG chr11 5335864 5335883 5335880 +
ctgctgccttatattacata

SEQ ID NO: 21319 - DNA, 20 bp, Artificial Sequence
  Synthetic oligonucleotide; TAG chr11 5335871 5335890 5335887 +
cttatattacatatggcata

SEQ ID NO: 21320 - DNA, 20 bp, Artificial Sequence
  Synthetic oligonucleotide; AGG chr11 5335872 5335891 5335888 +
ttatattacatatggcatat

SEQ ID NO: 21321 - DNA, 20 bp, Artificial Sequence
  Synthetic oligonucleotide; AAG chr11 5335875 5335894 5335891 +
tattacatatggcatatagg

SEQ ID NO: 21322 - DNA, 20 bp, Artificial Sequence
  Synthetic oligonucleotide; AGG chr11 5335876 5335895 5335892 +
attacatatggcatatagga

SEQ ID NO: 21323 - DNA, 20 bp, Artificial Sequence
  Synthetic oligonucleotide; AAG chr11 5335887 5335906 5335903 +
catataggaaggcaacattc

SEQ ID NO: 21324 - DNA, 20 bp, Artificial Sequence
  Synthetic oligonucleotide; AAG chr11 5335896 5335915 5335912 +
aggcaacattcaagtataat

SEQ ID NO: 21325 - DNA, 20 bp, Artificial Sequence
  Synthetic oligonucleotide; CAG chr11 5335917 5335936 5335933 +
agcttatatcgctaacgatt

SEQ ID NO: 21326 - DNA, 20 bp, Artificial Sequence
  Synthetic oligonucleotide; AGG chr11 5335918 5335937 5335934 +
gcttatatcgctaacgattc

SEQ ID NO: 21327 - DNA, 20 bp, Artificial Sequence
  Synthetic oligonucleotide; AAG chr11 5335921 5335940 5335937 +
tatatcgctaacgattcagg

SEQ ID NO: 21328 - DNA, 20 bp, Artificial Sequence
  Synthetic oligonucleotide; AGG chr11 5335922 5335941 5335938 +
atatcgctaacgattcagga

SEQ ID NO: 21329 - DNA, 20 bp, Artificial Sequence
  Synthetic oligonucleotide; TAG chr11 5335934 5335953 5335950 +
attcaggaaggtctctatcc

SEQ ID NO: 21330 - DNA, 20 bp, Artificial Sequence
  Synthetic oligonucleotide; AGG chr11 5335935 5335954 5335951 +
ttcaggaaggtctctatcct

SEQ ID NO: 21331 - DNA, 20 bp, Artificial Sequence
  Synthetic oligonucleotide; GAG chr11 5335954 5335973 5335970 +
taggatttttgctgtttgtt

SEQ ID NO: 21332 - DNA, 20 bp, Artificial Sequence
  Synthetic oligonucleotide; AAG chr11 5335958 5335977 5335974 +
atttttgctgtttgttgagt

SEQ ID NO: 21333 - DNA, 20 bp, Artificial Sequence
  Synthetic oligonucleotide; CAG chr11 5335977 5335996 5335993 +
taagtctgtgctgacaatac

SEQ ID NO: 21334 - DNA, 20 bp, Artificial Sequence
  Synthetic oligonucleotide; TAG chr11 5336003 5336022 5336019 +
cttttttttttttttctgtg

SEQ ID NO: 21335 - DNA, 20 bp, Artificial Sequence
  Synthetic oligonucleotide; CAG chr11 5336024 5336043 5336040 +
agtttgattctattatctgt

SEQ ID NO: 21336 - DNA, 20 bp, Artificial Sequence
  Synthetic oligonucleotide; TGG chr11 5336032 5336051 5336048 +
tctattatctgtcagccttc

SEQ ID NO: 21337 - DNA, 20 bp, Artificial Sequence
  Synthetic oligonucleotide; AAG chr11 5336053 5336072 5336069 +
ggattccacaattatctccg

SEQ ID NO: 21338 - DNA, 20 bp, Artificial Sequence
  Synthetic oligonucleotide; CAG chr11 5336081 5336100 5336097 +
atcctttaactcatcctcta

SEQ ID NO: 21339 - DNA, 20 bp, Artificial Sequence
  Synthetic oligonucleotide; AGG chr11 5336082 5336101 5336098 +
tcctttaactcatcctctac

SEQ ID NO: 21340 - DNA, 20 bp, Artificial Sequence
  Synthetic oligonucleotide; TGG chr11 5336091 5336110 5336107 +
tcatcctctacaggctctga

SEQ ID NO: 21341 - DNA, 20 bp, Artificial Sequence
  Synthetic oligonucleotide; TGG chr11 5336117 5336136 5336133 +
attttatatgccaatttgac

SEQ ID NO: 21342 - DNA, 20 bp, Artificial Sequence
  Synthetic oligonucleotide; GGG chr11 5336118 5336137 5336134 +
ttttatatgccaatttgact

SEQ ID NO: 21343 - DNA, 20 bp, Artificial Sequence
  Synthetic oligonucleotide; TGG chr11 5336124 5336143 5336140 +
atgccaatttgactgggcca

SEQ ID NO: 21344 - DNA, 20 bp, Artificial Sequence
  Synthetic oligonucleotide; GGG chr11 5336125 5336144 5336141 +
tgccaatttgactgggccat

SEQ ID NO: 21345 - DNA, 20 bp, Artificial Sequence
  Synthetic oligonucleotide; GGG chr11 5336126 5336145 5336142 +
gccaatttgactgggccatg

SEQ ID NO: 21346 - DNA, 20 bp, Artificial Sequence
  Synthetic oligonucleotide; TAG chr11 5336156 5336175 5336172 +
atatttgtcaaacattattc

SEQ ID NO: 21347 - DNA, 20 bp, Artificial Sequence
  Synthetic oligonucleotide; GAG chr11 5336169 5336188 5336185 +
attattctagatgtttttgt

SEQ ID NO: 21348 - DNA, 20 bp, Artificial Sequence
  Synthetic oligonucleotide; AGG chr11 5336170 5336189 5336186 +
ttattctagatgtttttgtg

SEQ ID NO: 21349 - DNA, 20 bp, Artificial Sequence
  Synthetic oligonucleotide; GGG chr11 5336171 5336190 5336187 +
tattctagatgtttttgtga

SEQ ID NO: 21350 - DNA, 20 bp, Artificial Sequence
  Synthetic oligonucleotide; TAG chr11 5336180 5336199 5336196 +
tgtttttgtgagggtgtttt

SEQ ID NO: 21351 - DNA, 20 bp, Artificial Sequence
  Synthetic oligonucleotide; AGG chr11 5336181 5336200 5336197 +
gtttttgtgagggtgttttt

SEQ ID NO: 21352 - DNA, 20 bp, Artificial Sequence
  Synthetic oligonucleotide; AAG chr11 5336185 5336204 5336201 +
ttgtgagggtgtttttaggc

SEQ ID NO: 21353 - DNA, 20 bp, Artificial Sequence
  Synthetic oligonucleotide; CGG chr11 5336202 5336221 5336218 +
ggcaagattaacatttaaat

SEQ ID NO: 21354 - DNA, 20 bp, Artificial Sequence
  Synthetic oligonucleotide; TAG chr11 5336205 5336224 5336221 +
aagattaacatttaaatcgg

SEQ ID NO: 21355 - DNA, 20 bp, Artificial Sequence
  Synthetic oligonucleotide; AAG chr11 5336211 5336230 5336227 +
aacatttaaatcggtagacc

SEQ ID NO: 21356 - DNA, 20 bp, Artificial Sequence
  Synthetic oligonucleotide; TAG chr11 5336214 5336233 5336230 +
atttaaatcggtagaccaag

SEQ ID NO: 21357 - DNA, 20 bp, Artificial Sequence
  Synthetic oligonucleotide; GAG chr11 5336216 5336235 5336232 +
ttaaatcggtagaccaagta

SEQ ID NO: 21358 - DNA, 20 bp, Artificial Sequence
  Synthetic oligonucleotide; CAG chr11 5336219 5336238 5336235 +
aatcggtagaccaagtagag

SEQ ID NO: 21359 - DNA, 20 bp, Artificial Sequence
  Synthetic oligonucleotide; TGG chr11 5336223 5336242 5336239 +
ggtagaccaagtagagcaga

SEQ ID NO: 21360 - DNA, 20 bp, Artificial Sequence
  Synthetic oligonucleotide; CAG chr11 5336238 5336257 5336254 +
gcagatggtccttcctattg

SEQ ID NO: 21361 - DNA, 20 bp, Artificial Sequence
  Synthetic oligonucleotide; AGG chr11 5336239 5336258 5336255 +
cagatggtccttcctattgc

SEQ ID NO: 21362 - DNA, 20 bp, Artificial Sequence
  Synthetic oligonucleotide; CGG chr11 5336242 5336261 5336258 +
atggtccttcctattgcagg

SEQ ID NO: 21363 - DNA, 20 bp, Artificial Sequence
  Synthetic oligonucleotide; CAG chr11 5336256 5336275 5336272 +
tgcaggcggcttcctccaat

SEQ ID NO: 21364 - DNA, 20 bp, Artificial Sequence
  Synthetic oligonucleotide; TAG chr11 5336272 5336291 5336288 +
caatcagttgaaaacctgaa

SEQ ID NO: 21365 - DNA, 20 bp, Artificial Sequence
  Synthetic oligonucleotide; AAG chr11 5336281 5336300 5336297 +
gaaaacctgaatagaacaaa

SEQ ID NO: 21366 - DNA, 20 bp, Artificial Sequence
  Synthetic oligonucleotide; CAG chr11 5336302 5336321 5336318 +
agtctgacccttccccaaat

SEQ ID NO: 21367 - DNA, 20 bp, Artificial Sequence
  Synthetic oligonucleotide; GAG chr11 5336304 5336323 5336320 +
tctgacccttccccaaatca

SEQ ID NO: 21368 - DNA, 20 bp, Artificial Sequence
  Synthetic oligonucleotide; GAG chr11 5336306 5336325 5336322 +
tgacccttccccaaatcaga

SEQ ID NO: 21369 - DNA, 20 bp, Artificial Sequence
  Synthetic oligonucleotide; TGG chr11 5336325 5336344 5336341 +
agagaattattccttattga

SEQ ID NO: 21370 - DNA, 20 bp, Artificial Sequence
  Synthetic oligonucleotide; TGG chr11 5336337 5336356 5336353 +
cttattgatggccttcaaac

SEQ ID NO: 21371 - DNA, 20 bp, Artificial Sequence
  Synthetic oligonucleotide; TAG chr11 5336344 5336363 5336360 +
atggccttcaaactggaatc

SEQ ID NO: 21372 - DNA, 20 bp, Artificial Sequence
  Synthetic oligonucleotide; TAG chr11 5336364 5336383 5336380 +
tagacctttttttctgcctt

SEQ ID NO: 21373 - DNA, 20 bp, Artificial Sequence
  Synthetic oligonucleotide; TGG chr11 5336392 5336411 5336408 +
actgaaacatcaaaacttcc

SEQ ID NO: 21374 - DNA, 20 bp, Artificial Sequence
  Synthetic oligonucleotide; GGG chr11 5336393 5336412 5336409 +
ctgaaacatcaaaacttcct

SEQ ID NO: 21375 - DNA, 20 bp, Artificial Sequence
  Synthetic oligonucleotide; AAG chr11 5336400 5336419 5336416 +
atcaaaacttcctgggtctg

SEQ ID NO: 21376 - DNA, 20 bp, Artificial Sequence
  Synthetic oligonucleotide; TGG chr11 5336408 5336427 5336424 +
ttcctgggtctgaagcctga

SEQ ID NO: 21377 - DNA, 20 bp, Artificial Sequence
  Synthetic oligonucleotide; TGG chr11 5336415 5336434 5336431 +
gtctgaagcctgatggcttt

SEQ ID NO: 21378 - DNA, 20 bp, Artificial Sequence
  Synthetic oligonucleotide; GGG chr11 5336416 5336435 5336432 +
tctgaagcctgatggctttt

SEQ ID NO: 21379 - DNA, 20 bp, Artificial Sequence
  Synthetic oligonucleotide; AAG chr11 5336423 5336442 5336439 +
cctgatggcttttgggttgc

SEQ ID NO: 21380 - DNA, 20 bp, Artificial Sequence
  Synthetic oligonucleotide; CAG chr11 5336450 5336469 5336466 +
ccatcaatcctcctgtttcc

SEQ ID NO: 21381 - DNA, 20 bp, Artificial Sequence
  Synthetic oligonucleotide; AGG chr11 5336451 5336470 5336467 +
catcaatcctcctgtttccc

SEQ ID NO: 21382 - DNA, 20 bp, Artificial Sequence
  Synthetic oligonucleotide; CAG chr11 5336458 5336477 5336474 +
cctcctgtttcccaggcctt

SEQ ID NO: 21383 - DNA, 20 bp, Artificial Sequence
  Synthetic oligonucleotide; TGG chr11 5336464 5336483 5336480 +
gtttcccaggccttcagact

SEQ ID NO: 21384 - DNA, 20 bp, Artificial Sequence
  Synthetic oligonucleotide; TGG chr11 5336469 5336488 5336485 +
ccaggccttcagacttggac

SEQ ID NO: 21385 - DNA, 20 bp, Artificial Sequence
  Synthetic oligonucleotide; GGG chr11 5336470 5336489 5336486 +
caggccttcagacttggact

SEQ ID NO: 21386 - DNA, 20 bp, Artificial Sequence
  Synthetic oligonucleotide; CAG chr11 5336483 5336502 5336499 +
ttggactgggactaaactac

SEQ ID NO: 21387 - DNA, 20 bp, Artificial Sequence
  Synthetic oligonucleotide; AGG chr11 5336484 5336503 5336500 +
tggactgggactaaactacc

SEQ ID NO: 21388 - DNA, 20 bp, Artificial Sequence
  Synthetic oligonucleotide; GAG chr11 5336494 5336513 5336510 +
ctaaactaccaggctctctt

SEQ ID NO: 21389 - DNA, 20 bp, Artificial Sequence
  Synthetic oligonucleotide; TGG chr11 5336528 5336547 5336544 +
atgactcactctgcatatct

SEQ ID NO: 21390 - DNA, 20 bp, Artificial Sequence
  Synthetic oligonucleotide; GGG chr11 5336529 5336548 5336545 +
tgactcactctgcatatctt

SEQ ID NO: 21391 - DNA, 20 bp, Artificial Sequence
  Synthetic oligonucleotide; TAG chr11 5336573 5336592 5336589 +
catctgctatttccttatat

SEQ ID NO: 21392 - DNA, 20 bp, Artificial Sequence
  Synthetic oligonucleotide; AGG chr11 5336574 5336593 5336590 +
atctgctatttccttatatt

SEQ ID NO: 21393 - DNA, 20 bp, Artificial Sequence
  Synthetic oligonucleotide; TGG chr11 5336578 5336597 5336594 +
gctatttccttatattaggt

SEQ ID NO: 21394 - DNA, 20 bp, Artificial Sequence
  Synthetic oligonucleotide; CAG chr11 5336586 5336605 5336602 +
cttatattaggttggtgcaa

SEQ ID NO: 21395 - DNA, 20 bp, Artificial Sequence
  Synthetic oligonucleotide; CAG chr11 5336595 5336614 5336611 +
ggttggtgcaacagtaattg

SEQ ID NO: 21396 - DNA, 20 bp, Artificial Sequence
  Synthetic oligonucleotide; CAG chr11 5336623 5336642 5336639 +
gccattatttttttttaatg

SEQ ID NO: 21397 - DNA, 20 bp, Artificial Sequence
  Synthetic oligonucleotide; AAG chr11 5336682 5336701 5336698 +
attcaatttttttaattttt

SEQ ID NO: 21398 - DNA, 20 bp, Artificial Sequence
  Synthetic oligonucleotide; GAG chr11 5336689 5336708 5336705 +
ttttttaatttttaagttct

SEQ ID NO: 21399 - DNA, 20 bp, Artificial Sequence
  Synthetic oligonucleotide; AGG chr11 5336690 5336709 5336706 +
tttttaatttttaagttctg

SEQ ID NO: 21400 - DNA, 20 bp, Artificial Sequence
  Synthetic oligonucleotide; CAG chr11 5336701 5336720 5336717 +
taagttctgaggtacatgtg

SEQ ID NO: 21401 - DNA, 20 bp, Artificial Sequence
  Synthetic oligonucleotide; AGG chr11 5336702 5336721 5336718 +
aagttctgaggtacatgtgc

SEQ ID NO: 21402 - DNA, 20 bp, Artificial Sequence
  Synthetic oligonucleotide; CAG chr11 5336710 5336729 5336726 +
aggtacatgtgcaggatgtg

SEQ ID NO: 21403 - DNA, 20 bp, Artificial Sequence
  Synthetic oligonucleotide; AGG chr11 5336711 5336730 5336727 +
ggtacatgtgcaggatgtgc

SEQ ID NO: 21404 - DNA, 20 bp, Artificial Sequence
  Synthetic oligonucleotide; TGG chr11 5336740 5336759 5336756 +
acatacgtaaatgtgtgcaa

SEQ ID NO: 21405 - DNA, 20 bp, Artificial Sequence
  Synthetic oligonucleotide; TGG chr11 5336743 5336762 5336759 +
tacgtaaatgtgtgcaatgg

SEQ ID NO: 21406 - DNA, 20 bp, Artificial Sequence
  Synthetic oligonucleotide; TAG chr11 5336772 5336791 5336788 +
gtacctatcaacccatcacc

SEQ ID NO: 21407 - DNA, 20 bp, Artificial Sequence
  Synthetic oligonucleotide; AGG chr11 5336773 5336792 5336789 +
tacctatcaacccatcacct

SEQ ID NO: 21408 - DNA, 20 bp, Artificial Sequence
  Synthetic oligonucleotide; AAG chr11 5336780 5336799 5336796 +
caacccatcacctaggtgtt

SEQ ID NO: 21409 - DNA, 20 bp, Artificial Sequence
  Synthetic oligonucleotide; CAG chr11 5336785 5336804 5336801 +
catcacctaggtgttaagcc

SEQ ID NO: 21410 - DNA, 20 bp, Artificial Sequence
  Synthetic oligonucleotide; TAG chr11 5336795 5336814 5336811 +
gtgttaagcccagcatgcat

SEQ ID NO: 21411 - DNA, 20 bp, Artificial Sequence
  Synthetic oligonucleotide; CAG chr11 5336841 5336860 5336857 +
caccacaccccatgccctga

SEQ ID NO: 21412 - DNA, 20 bp, Artificial Sequence
  Synthetic oligonucleotide; AGG chr11 5336842 5336861 5336858 +
accacaccccatgccctgac

SEQ ID NO: 21413 - DNA, 20 bp, Artificial Sequence
  Synthetic oligonucleotide; CAG chr11 5336848 5336867 5336864 +
ccccatgccctgacaggctc

SEQ ID NO: 21414 - DNA, 20 bp, Artificial Sequence
  Synthetic oligonucleotide; CAG chr11 5336899 5336918 5336915 +
gtgttctcattctcattgtt

SEQ ID NO: 21415 - DNA, 20 bp, Artificial Sequence
  Synthetic oligonucleotide; AAG chr11 5336913 5336932 5336929 +
attgttcagctcccacttct

SEQ ID NO: 21416 - DNA, 20 bp, Artificial Sequence
  Synthetic oligonucleotide; GAG chr11 5336917 5336936 5336933 +
ttcagctcccacttctaagt

SEQ ID NO: 21417 - DNA, 20 bp, Artificial Sequence
  Synthetic oligonucleotide; TGG chr11 5336926 5336945 5336942 +
cacttctaagtgagaacatg

SEQ ID NO: 21418 - DNA, 20 bp, Artificial Sequence
  Synthetic oligonucleotide; TGG chr11 5336933 5336952 5336949 +
aagtgagaacatgtggtgtt

SEQ ID NO: 21419 - DNA, 20 bp, Artificial Sequence
  Synthetic oligonucleotide; TAG chr11 5336952 5336971 5336968 +
ttggttttctgttcctgcat

SEQ ID NO: 21420 - DNA, 20 bp, Artificial Sequence
  Synthetic oligonucleotide; AAG chr11 5336962 5336981 5336978 +
gttcctgcattagtttactg

SEQ ID NO: 21421 - DNA, 20 bp, Artificial Sequence
  Synthetic oligonucleotide; TGG chr11 5336969 5336988 5336985 +
cattagtttactgaagataa

SEQ ID NO: 21422 - DNA, 20 bp, Artificial Sequence
  Synthetic oligonucleotide; CGG chr11 5336976 5336995 5336992 +
ttactgaagataatggcttt

SEQ ID NO: 21423 - DNA, 20 bp, Artificial Sequence
  Synthetic oligonucleotide; CAG chr11 5336993 5337012 5337009 +
tttcggctccatccatgtcc

SEQ ID NO: 21424 - DNA, 20 bp, Artificial Sequence
  Synthetic oligonucleotide; AAG chr11 5336998 5337017 5337014 +
gctccatccatgtcccagca

SEQ ID NO: 21425 - DNA, 20 bp, Artificial Sequence
  Synthetic oligonucleotide; AGG chr11 5336999 5337018 5337015 +
ctccatccatgtcccagcaa

SEQ ID NO: 21426 - DNA, 20 bp, Artificial Sequence
  Synthetic oligonucleotide; GGG chr11 5337000 5337019 5337016 +
tccatccatgtcccagcaaa

SEQ ID NO: 21427 - DNA, 20 bp, Artificial Sequence
  Synthetic oligonucleotide; TGG chr11 5337023 5337042 5337039 +
catgatctcatcccttttta

SEQ ID NO: 21428 - DNA, 20 bp, Artificial Sequence
  Synthetic oligonucleotide; TAG chr11 5337027 5337046 5337043 +
atctcatccctttttatggt

SEQ ID NO: 21429 - DNA, 20 bp, Artificial Sequence
  Synthetic oligonucleotide; TAG chr11 5337031 5337050 5337047 +
catccctttttatggttaga

SEQ ID NO: 21430 - DNA, 20 bp, Artificial Sequence
  Synthetic oligonucleotide; TGG chr11 5337041 5337060 5337057 +
tatggttagatagtatttca

SEQ ID NO: 21431 - DNA, 20 bp, Artificial Sequence
  Synthetic oligonucleotide; TGG chr11 5337082 5337101 5337098 +
tttaaattgtctatcattga

SEQ ID NO: 21432 - DNA, 20 bp, Artificial Sequence
  Synthetic oligonucleotide; TGG chr11 5337090 5337109 5337106 +
gtctatcattgatggccatt

SEQ ID NO: 21433 - DNA, 20 bp, Artificial Sequence
  Synthetic oligonucleotide; GGG chr11 5337091 5337110 5337107 +
tctatcattgatggccattt

SEQ ID NO: 21434 - DNA, 20 bp, Artificial Sequence
  Synthetic oligonucleotide; TAG chr11 5337121 5337140 5337137 +
tatgtctttgctattgtgaa

SEQ ID NO: 21435 - DNA, 20 bp, Artificial Sequence
  Synthetic oligonucleotide; TAG chr11 5337155 5337174 5337171 +
acatacatgtgcatgtatct

SEQ ID NO: 21436 - DNA, 20 bp, Artificial Sequence
  Synthetic oligonucleotide; TAG chr11 5337161 5337180 5337177 +
atgtgcatgtatcttagtaa

SEQ ID NO: 21437 - DNA, 20 bp, Artificial Sequence
  Synthetic oligonucleotide; TAG chr11 5337181 5337200 5337197 +
tagaatgatttatactcctt

SEQ ID NO: 21438 - DNA, 20 bp, Artificial Sequence
  Synthetic oligonucleotide; AGG chr11 5337182 5337201 5337198 +
agaatgatttatactccttt

SEQ ID NO: 21439 - DNA, 20 bp, Artificial Sequence
  Synthetic oligonucleotide; CAG chr11 5337193 5337212 5337209 +
tactcctttaggtatatacc

SEQ ID NO: 21440 - DNA, 20 bp, Artificial Sequence
  Synthetic oligonucleotide; TGG chr11 5337199 5337218 5337215 +
tttaggtatatacccagtaa

SEQ ID NO: 21441 - DNA, 20 bp, Artificial Sequence
  Synthetic oligonucleotide; GGG chr11 5337200 5337219 5337216 +
ttaggtatatacccagtaat

SEQ ID NO: 21442 - DNA, 20 bp, Artificial Sequence
  Synthetic oligonucleotide; GAG chr11 5337208 5337227 5337224 +
atacccagtaatgggattgt

SEQ ID NO: 21443 - DNA, 20 bp, Artificial Sequence
  Synthetic oligonucleotide; AGG chr11 5337209 5337228 5337225 +
tacccagtaatgggattgtg

SEQ ID NO: 21444 - DNA, 20 bp, Artificial Sequence
  Synthetic oligonucleotide; TGG chr11 5337217 5337236 5337233 +
aatgggattgtgaggtcaaa

SEQ ID NO: 21445 - DNA, 20 bp, Artificial Sequence
  Synthetic oligonucleotide; TGG chr11 5337226 5337245 5337242 +
gtgaggtcaaatggtatttc

SEQ ID NO: 21446 - DNA, 20 bp, Artificial Sequence
  Synthetic oligonucleotide; GAG chr11 5337241 5337260 5337257 +
atttctggttctaaatcttt

SEQ ID NO: 21447 - DNA, 20 bp, Artificial Sequence
  Synthetic oligonucleotide; AGG chr11 5337242 5337261 5337258 +
tttctggttctaaatctttg

SEQ ID NO: 21448 - DNA, 20 bp, Artificial Sequence
  Synthetic oligonucleotide; TGG chr11 5337268 5337287 5337284 +
tgccacactgtcttccacaa

SEQ ID NO: 21449 - DNA, 20 bp, Artificial Sequence
  Synthetic oligonucleotide; TAG chr11 5337277 5337296 5337293 +
gtcttccacaatggttgaat

SEQ ID NO: 21450 - DNA, 20 bp, Artificial Sequence
  Synthetic oligonucleotide; CAG chr11 5337284 5337303 5337300 +
acaatggttgaattagttta

SEQ ID NO: 21451 - DNA, 20 bp, Artificial Sequence
  Synthetic oligonucleotide; CAG chr11 5337296 5337315 5337312 +
ttagtttacagtcccaccaa

SEQ ID NO: 21452 - DNA, 20 bp, Artificial Sequence
  Synthetic oligonucleotide; AAG chr11 5337304 5337323 5337320 +
cagtcccaccaacagtgtaa

SEQ ID NO: 21453 - DNA, 20 bp, Artificial Sequence
  Synthetic oligonucleotide; TAG chr11 5337332 5337351 5337348 +
ctatttctctgcaaccttgc

SEQ ID NO: 21454 - DNA, 20 bp, Artificial Sequence
  Synthetic oligonucleotide; TGG chr11 5337374 5337393 5337390 +
ttaaaaaccaccattctgac

SEQ ID NO: 21455 - DNA, 20 bp, Artificial Sequence
  Synthetic oligonucleotide; CAG chr11 5337380 5337399 5337396 +
accaccattctgactggtgt

SEQ ID NO: 21456 - DNA, 20 bp, Artificial Sequence
  Synthetic oligonucleotide; TGG chr11 5337384 5337403 5337400 +
ccattctgactggtgtcaga

SEQ ID NO: 21457 - DNA, 20 bp, Artificial Sequence
  Synthetic oligonucleotide; TGG chr11 5337397 5337416 5337413 +
tgtcagatggtatttcattg

SEQ ID NO: 21458 - DNA, 20 bp, Artificial Sequence
  Synthetic oligonucleotide; CAG chr11 5337425 5337444 5337441 +
atttgcatttctctaatgat

SEQ ID NO: 21459 - DNA, 20 bp, Artificial Sequence
  Synthetic oligonucleotide; GAG chr11 5337435 5337454 5337451 +
ctctaatgatcagtgacatt

SEQ ID NO: 21460 - DNA, 20 bp, Artificial Sequence
  Synthetic oligonucleotide; TAG chr11 5337457 5337476 5337473 +
gacttttttcgtatgtttct

SEQ ID NO: 21461 - DNA, 20 bp, Artificial Sequence
  Synthetic oligonucleotide; GAG chr11 5337480 5337499 5337496 +
ccacataaatgtcttctttt

SEQ ID NO: 21462 - DNA, 20 bp, Artificial Sequence
  Synthetic oligonucleotide; AAG chr11 5337483 5337502 5337499 +
cataaatgtcttcttttgag

SEQ ID NO: 21463 - DNA, 20 bp, Artificial Sequence
  Synthetic oligonucleotide; TGG chr11 5337517 5337536 5337533 +
gtcctttgcccactttttaa

SEQ ID NO: 21464 - DNA, 20 bp, Artificial Sequence
  Synthetic oligonucleotide; GGG chr11 5337518 5337537 5337534 +
tcctttgcccactttttaat

SEQ ID NO: 21465 - DNA, 20 bp, Artificial Sequence
  Synthetic oligonucleotide; GGG chr11 5337519 5337538 5337535 +
cctttgcccactttttaatg

SEQ ID NO: 21466 - DNA, 20 bp, Artificial Sequence
  Synthetic oligonucleotide; AAG chr11 5337553 5337572 5337569 +
tttcttttgtaaatatgtct

SEQ ID NO: 21467 - DNA, 20 bp, Artificial Sequence
  Synthetic oligonucleotide; TAG chr11 5337563 5337582 5337579 +
aaatatgtctaagttcctca

SEQ ID NO: 21468 - DNA, 20 bp, Artificial Sequence
  Synthetic oligonucleotide; TGG chr11 5337570 5337589 5337586 +
tctaagttcctcatagattc

SEQ ID NO: 21469 - DNA, 20 bp, Artificial Sequence
  Synthetic oligonucleotide; TAG chr11 5337577 5337596 5337593 +
tcctcatagattctggatat

SEQ ID NO: 21470 - DNA, 20 bp, Artificial Sequence
  Synthetic oligonucleotide; CAG chr11 5337588 5337607 5337604 +
tctggatattagacctttgt

SEQ ID NO: 21471 - DNA, 20 bp, Artificial Sequence
  Synthetic oligonucleotide; TGG chr11 5337592 5337611 5337608 +
gatattagacctttgtcaga

SEQ ID NO: 21472 - DNA, 20 bp, Artificial Sequence
  Synthetic oligonucleotide; GGG chr11 5337593 5337612 5337609 +
atattagacctttgtcagat

SEQ ID NO: 21473 - DNA, 20 bp, Artificial Sequence
  Synthetic oligonucleotide; TAG chr11 5337596 5337615 5337612 +
ttagacctttgtcagatggg

SEQ ID NO: 21474 - DNA, 20 bp, Artificial Sequence
  Synthetic oligonucleotide; CAG chr11 5337603 5337622 5337619 +
tttgtcagatgggtagattg

SEQ ID NO: 21475 - DNA, 20 bp, Artificial Sequence
  Synthetic oligonucleotide; TAG chr11 5337624 5337643 5337640 +
agaaattttctcccattctg

SEQ ID NO: 21476 - DNA, 20 bp, Artificial Sequence
  Synthetic oligonucleotide; AGG chr11 5337625 5337644 5337641 +
gaaattttctcccattctgt

SEQ ID NO: 21477 - DNA, 20 bp, Artificial Sequence
  Synthetic oligonucleotide; TAG chr11 5337648 5337667 5337664 +
ttgcctgttcgctctgatga

SEQ ID NO: 21478 - DNA, 20 bp, Artificial Sequence
  Synthetic oligonucleotide; TAG chr11 5337665 5337684 5337681 +
tgatagtttattttgctgtt

SEQ ID NO: 21479 - DNA, 20 bp, Artificial Sequence
  Synthetic oligonucleotide; AAG chr11 5337668 5337687 5337684 +
tagtttattttgctgtttag

SEQ ID NO: 21480 - DNA, 20 bp, Artificial Sequence
  Synthetic oligonucleotide; GAG chr11 5337702 5337721 5337718 +
attgtatttttctttatttt

SEQ ID NO: 21481 - DNA, 20 bp, Artificial Sequence
  Synthetic oligonucleotide; AAG chr11 5337708 5337727 5337724 +
tttttctttattttgagatg

SEQ ID NO: 21482 - DNA, 20 bp, Artificial Sequence
  Synthetic oligonucleotide; TAG chr11 5337731 5337750 5337747 +
tctcactctttcacccatgc

SEQ ID NO: 21483 - DNA, 20 bp, Artificial Sequence
  Synthetic oligonucleotide; GAG chr11 5337733 5337752 5337749 +
tcactctttcacccatgcta

SEQ ID NO: 21484 - DNA, 20 bp, Artificial Sequence
  Synthetic oligonucleotide; CAG chr11 5337738 5337757 5337754 +
ctttcacccatgctagagtg

SEQ ID NO: 21485 - DNA, 20 bp, Artificial Sequence
  Synthetic oligonucleotide; TGG chr11 5337741 5337760 5337757 +
tcacccatgctagagtgcag

SEQ ID NO: 21486 - DNA, 20 bp, Artificial Sequence
  Synthetic oligonucleotide; CAG chr11 5337752 5337771 5337768 +
agagtgcagtggtgcgatct

SEQ ID NO: 21487 - DNA, 20 bp, Artificial Sequence
  Synthetic oligonucleotide; TGG chr11 5337776 5337795 5337792 +
tcactgcaacctctgcctcc

SEQ ID NO: 21488 - DNA, 20 bp, Artificial Sequence
  Synthetic oligonucleotide; GGG chr11 5337777 5337796 5337793 +
cactgcaacctctgcctcct

SEQ ID NO: 21489 - DNA, 20 bp, Artificial Sequence
  Synthetic oligonucleotide; AAG chr11 5337783 5337802 5337799 +
aacctctgcctcctgggttc

SEQ ID NO: 21490 - DNA, 20 bp, Artificial Sequence
  Synthetic oligonucleotide; CAG chr11 5337800 5337819 5337816 +
ttcaagcaattctcctgcct

SEQ ID NO: 21491 - DNA, 20 bp, Artificial Sequence
  Synthetic oligonucleotide; GAG chr11 5337809 5337828 5337825 +
ttctcctgcctcagcctcct

SEQ ID NO: 21492 - DNA, 20 bp, Artificial Sequence
  Synthetic oligonucleotide; TAG chr11 5337812 5337831 5337828 +
tcctgcctcagcctcctgag

SEQ ID NO: 21493 - DNA, 20 bp, Artificial Sequence
  Synthetic oligonucleotide; GAG chr11 5337817 5337836 5337833 +
cctcagcctcctgagtagct

SEQ ID NO: 21494 - DNA, 20 bp, Artificial Sequence
  Synthetic oligonucleotide; CAG chr11 5337824 5337843 5337840 +
ctcctgagtagctgagatta

SEQ ID NO: 21495 - DNA, 20 bp, Artificial Sequence
  Synthetic oligonucleotide; AGG chr11 5337825 5337844 5337841 +
tcctgagtagctgagattac

SEQ ID NO: 21496 - DNA, 20 bp, Artificial Sequence
  Synthetic oligonucleotide; CAG chr11 5337844 5337863 5337860 +
caggtacgcaccaccatacc

SEQ ID NO: 21497 - DNA, 20 bp, Artificial Sequence
  Synthetic oligonucleotide; TAG chr11 5337864 5337883 5337880 +
cagcacattttttgtatttt

SEQ ID NO: 21498 - DNA, 20 bp, Artificial Sequence
  Synthetic oligonucleotide; TAG chr11 5337867 5337886 5337883 +
cacattttttgtatttttag

SEQ ID NO: 21499 - DNA, 20 bp, Artificial Sequence
  Synthetic oligonucleotide; GAG chr11 5337869 5337888 5337885 +
cattttttgtatttttagta

SEQ ID NO: 21500 - DNA, 20 bp, Artificial Sequence
  Synthetic oligonucleotide; TGG chr11 5337873 5337892 5337889 +
ttttgtatttttagtagaga

SEQ ID NO: 21501 - DNA, 20 bp, Artificial Sequence
  Synthetic oligonucleotide; GAG chr11 5337875 5337894 5337891 +
ttgtatttttagtagagatg

SEQ ID NO: 21502 - DNA, 20 bp, Artificial Sequence
  Synthetic oligonucleotide; TGG chr11 5337889 5337908 5337905 +
gagatggagtttcaccatgt

SEQ ID NO: 21503 - DNA, 20 bp, Artificial Sequence
  Synthetic oligonucleotide; CAG chr11 5337893 5337912 5337909 +
tggagtttcaccatgttggc

SEQ ID NO: 21504 - DNA, 20 bp, Artificial Sequence
  Synthetic oligonucleotide; AGG chr11 5337894 5337913 5337910 +
ggagtttcaccatgttggcc

SEQ ID NO: 21505 - DNA, 20 bp, Artificial Sequence
  Synthetic oligonucleotide; AAG chr11 5337919 5337938 5337935 +
gctcttatactccccacctc

SEQ ID NO: 21506 - DNA, 20 bp, Artificial Sequence
  Synthetic oligonucleotide; TGG chr11 5337936 5337955 5337952 +
ctcaagtgatccacccacct

SEQ ID NO: 21507 - DNA, 20 bp, Artificial Sequence
  Synthetic oligonucleotide; AAG chr11 5337946 5337965 5337962 +
ccacccaccttggcctccca

SEQ ID NO: 21508 - DNA, 20 bp, Artificial Sequence
  Synthetic oligonucleotide; TGG chr11 5337952 5337971 5337968 +
accttggcctcccaaagtgc

SEQ ID NO: 21509 - DNA, 20 bp, Artificial Sequence
  Synthetic oligonucleotide; GGG chr11 5337953 5337972 5337969 +
ccttggcctcccaaagtgct

SEQ ID NO: 21510 - DNA, 20 bp, Artificial Sequence
  Synthetic oligonucleotide; CAG chr11 5337960 5337979 5337976 +
ctcccaaagtgctgggatta

SEQ ID NO: 21511 - DNA, 20 bp, Artificial Sequence
  Synthetic oligonucleotide; AGG chr11 5337961 5337980 5337977 +
tcccaaagtgctgggattac

SEQ ID NO: 21512 - DNA, 20 bp, Artificial Sequence
  Synthetic oligonucleotide; GAG chr11 5337967 5337986 5337983 +
agtgctgggattacaggcgt

SEQ ID NO: 21513 - DNA, 20 bp, Artificial Sequence
  Synthetic oligonucleotide; TAG chr11 5337989 5338008 5338005 +
gccaccatgcccgatctctt

SEQ ID NO: 21514 - DNA, 20 bp, Artificial Sequence
  Synthetic oligonucleotide; TAG chr11 5337998 5338017 5338014 +
cccgatctctttagtttaat

SEQ ID NO: 21515 - DNA, 20 bp, Artificial Sequence
  Synthetic oligonucleotide; CAG chr11 5338012 5338031 5338028 +
tttaattagatctcatttga

SEQ ID NO: 21516 - DNA, 20 bp, Artificial Sequence
  Synthetic oligonucleotide; CGG chr11 5338079 5338098 5338095 +
tctttgcctgtgtctatgtc

SEQ ID NO: 21517 - DNA, 20 bp, Artificial Sequence
  Synthetic oligonucleotide; TGG chr11 5338084 5338103 5338100 +
gcctgtgtctatgtccggaa

SEQ ID NO: 21518 - DNA, 20 bp, Artificial Sequence
  Synthetic oligonucleotide; TAG chr11 5338094 5338113 5338110 +
atgtccggaatggtattgcc

SEQ ID NO: 21519 - DNA, 20 bp, Artificial Sequence
  Synthetic oligonucleotide; AGG chr11 5338095 5338114 5338111 +
tgtccggaatggtattgcct

SEQ ID NO: 21520 - DNA, 20 bp, Artificial Sequence
  Synthetic oligonucleotide; AAG chr11 5338108 5338127 5338124 +
attgcctaggttttcttcta

SEQ ID NO: 21521 - DNA, 20 bp, Artificial Sequence
  Synthetic oligonucleotide; TAG chr11 5338117 5338136 5338133 +
gttttcttctaaagttttta

SEQ ID NO: 21522 - DNA, 20 bp, Artificial Sequence
  Synthetic oligonucleotide; TGG chr11 5338123 5338142 5338139 +
ttctaaagtttttatagttt

SEQ ID NO: 21523 - DNA, 20 bp, Artificial Sequence
  Synthetic oligonucleotide; GGG chr11 5338124 5338143 5338140 +
tctaaagtttttatagtttt

SEQ ID NO: 21524 - DNA, 20 bp, Artificial Sequence
  Synthetic oligonucleotide; AAG chr11 5338137 5338156 5338153 +
tagttttgggttttacactt

SEQ ID NO: 21525 - DNA, 20 bp, Artificial Sequence
  Synthetic oligonucleotide; GAG chr11 5338155 5338174 5338171 +
ttaagtctttaatgcatctt

SEQ ID NO: 21526 - DNA, 20 bp, Artificial Sequence
  Synthetic oligonucleotide; AAG chr11 5338171 5338190 5338187 +
tcttgagttaatttatgtat

SEQ ID NO: 21527 - DNA, 20 bp, Artificial Sequence
  Synthetic oligonucleotide; AAG chr11 5338178 5338197 5338194 +
ttaatttatgtataagatgt

SEQ ID NO: 21528 - DNA, 20 bp, Artificial Sequence
  Synthetic oligonucleotide; AGG chr11 5338179 5338198 5338195 +
taatttatgtataagatgta

SEQ ID NO: 21529 - DNA, 20 bp, Artificial Sequence
  Synthetic oligonucleotide; AAG chr11 5338182 5338201 5338198 +
tttatgtataagatgtaagg

SEQ ID NO: 21530 - DNA, 20 bp, Artificial Sequence
  Synthetic oligonucleotide; AGG chr11 5338183 5338202 5338199 +
ttatgtataagatgtaagga

SEQ ID NO: 21531 - DNA, 20 bp, Artificial Sequence
  Synthetic oligonucleotide; GGG chr11 5338184 5338203 5338200 +
tatgtataagatgtaaggaa

SEQ ID NO: 21532 - DNA, 20 bp, Artificial Sequence
  Synthetic oligonucleotide; GGG chr11 5338185 5338204 5338201 +
atgtataagatgtaaggaag

SEQ ID NO: 21533 - DNA, 20 bp, Artificial Sequence
  Synthetic oligonucleotide; CAG chr11 5338190 5338209 5338206 +
taagatgtaaggaaggggtc

SEQ ID NO: 21534 - DNA, 20 bp, Artificial Sequence
  Synthetic oligonucleotide; TGG chr11 5338210 5338229 5338226 +
cagtttcaattttctgcata

SEQ ID NO: 21535 - DNA, 20 bp, Artificial Sequence
  Synthetic oligonucleotide; TAG chr11 5338214 5338233 5338230 +
ttcaattttctgcatatggc

SEQ ID NO: 21536 - DNA, 20 bp, Artificial Sequence
  Synthetic oligonucleotide; CAG chr11 5338218 5338237 5338234 +
attttctgcatatggctagc

SEQ ID NO: 21537 - DNA, 20 bp, Artificial Sequence
  Synthetic oligonucleotide; CAG chr11 5338227 5338246 5338243 +
atatggctagccagttctcc

SEQ ID NO: 21538 - DNA, 20 bp, Artificial Sequence
  Synthetic oligonucleotide; TAG chr11 5338244 5338263 5338260 +
tcccagcacaatttataaaa

SEQ ID NO: 21539 - DNA, 20 bp, Artificial Sequence
  Synthetic oligonucleotide; AGG chr11 5338245 5338264 5338261 +
cccagcacaatttataaaat

SEQ ID NO: 21540 - DNA, 20 bp, Artificial Sequence
  Synthetic oligonucleotide; GGG chr11 5338246 5338265 5338262 +
ccagcacaatttataaaata

SEQ ID NO: 21541 - DNA, 20 bp, Artificial Sequence
  Synthetic oligonucleotide; CAG chr11 5338276 5338295 5338292 +
tccccattacttgtttttac

SEQ ID NO: 21542 - DNA, 20 bp, Artificial Sequence
  Synthetic oligonucleotide; AGG chr11 5338277 5338296 5338293 +
ccccattacttgtttttacc

SEQ ID NO: 21543 - DNA, 20 bp, Artificial Sequence
  Synthetic oligonucleotide; AAG chr11 5338287 5338306 5338303 +
tgtttttaccaggtttgttg

SEQ ID NO: 21544 - DNA, 20 bp, Artificial Sequence
  Synthetic oligonucleotide; CAG chr11 5338292 5338311 5338308 +
ttaccaggtttgttgaagat

SEQ ID NO: 21545 - DNA, 20 bp, Artificial Sequence
  Synthetic oligonucleotide; CAG chr11 5338302 5338321 5338318 +
tgttgaagatcagattgttt

SEQ ID NO: 21546 - DNA, 20 bp, Artificial Sequence
  Synthetic oligonucleotide; CGG chr11 5338310 5338329 5338326 +
atcagattgtttcagatgcg

SEQ ID NO: 21547 - DNA, 20 bp, Artificial Sequence
  Synthetic oligonucleotide; GAG chr11 5338323 5338342 5338339 +
agatgcgcggtcttacttct

SEQ ID NO: 21548 - DNA, 20 bp, Artificial Sequence
  Synthetic oligonucleotide; TAG chr11 5338344 5338363 5338360 +
agttctccattctgttccat

SEQ ID NO: 21549 - DNA, 20 bp, Artificial Sequence
  Synthetic oligonucleotide; CAG chr11 5338348 5338367 5338364 +
ctccattctgttccattagt

SEQ ID NO: 21550 - DNA, 20 bp, Artificial Sequence
  Synthetic oligonucleotide; TGG chr11 5338361 5338380 5338377 +
cattagtcagtgtgtctgtt

SEQ ID NO: 21551 - DNA, 20 bp, Artificial Sequence
  Synthetic oligonucleotide; CAG chr11 5338367 5338386 5338383 +
tcagtgtgtctgtttggtat

SEQ ID NO: 21552 - DNA, 20 bp, Artificial Sequence
  Synthetic oligonucleotide; CAG chr11 5338383 5338402 5338399 +
gtatcagtaccatgctgttt

SEQ ID NO: 21553 - DNA, 20 bp, Artificial Sequence
  Synthetic oligonucleotide; TAG chr11 5338387 5338406 5338403 +
cagtaccatgctgtttcagt

SEQ ID NO: 21554 - DNA, 20 bp, Artificial Sequence
  Synthetic oligonucleotide; TAG chr11 5338404 5338423 5338420 +
agttagttactgtcaccttg

SEQ ID NO: 21555 - DNA, 20 bp, Artificial Sequence
  Synthetic oligonucleotide; AAG chr11 5338416 5338435 5338432 +
tcaccttgtagtataatttg

SEQ ID NO: 21556 - DNA, 20 bp, Artificial Sequence
  Synthetic oligonucleotide; TGG chr11 5338420 5338439 5338436 +
cttgtagtataatttgaagt

SEQ ID NO: 21557 - DNA, 20 bp, Artificial Sequence
  Synthetic oligonucleotide; GGG chr11 5338421 5338440 5338437 +
ttgtagtataatttgaagtt

SEQ ID NO: 21558 - DNA, 20 bp, Artificial Sequence
  Synthetic oligonucleotide; TGG chr11 5338448 5338467 5338464 +
tcctgttgattctatttttc

SEQ ID NO: 21559 - DNA, 20 bp, Artificial Sequence
  Synthetic oligonucleotide; GAG chr11 5338450 5338469 5338466 +
ctgttgattctatttttctg

SEQ ID NO: 21560 - DNA, 20 bp, Artificial Sequence
  Synthetic oligonucleotide; TAG chr11 5338467 5338486 5338483 +
ctggagaaccatgactaaca

SEQ ID NO: 21561 - DNA, 20 bp, Artificial Sequence
  Synthetic oligonucleotide; AGG chr11 5338468 5338487 5338484 +
tggagaaccatgactaacat

SEQ ID NO: 21562 - DNA, 20 bp, Artificial Sequence
  Synthetic oligonucleotide; GGG chr11 5338469 5338488 5338485 +
ggagaaccatgactaacata

SEQ ID NO: 21563 - DNA, 20 bp, Artificial Sequence
  Synthetic oligonucleotide; GAG chr11 5338484 5338503 5338500 +
acatagggccatctattttt

SEQ ID NO: 21564 - DNA, 20 bp, Artificial Sequence
  Synthetic oligonucleotide; AGG chr11 5338485 5338504 5338501 +
catagggccatctatttttg

SEQ ID NO: 21565 - DNA, 20 bp, Artificial Sequence
  Synthetic oligonucleotide; CAG chr11 5338516 5338535 5338532 +
gactaatcactgtcatctgt

SEQ ID NO: 21566 - DNA, 20 bp, Artificial Sequence
  Synthetic oligonucleotide; TGG chr11 5338521 5338540 5338537 +
atcactgtcatctgtcagtt

SEQ ID NO: 21567 - DNA, 20 bp, Artificial Sequence
  Synthetic oligonucleotide; TGG chr11 5338524 5338543 5338540 +
actgtcatctgtcagtttgg

SEQ ID NO: 21568 - DNA, 20 bp, Artificial Sequence
  Synthetic oligonucleotide; TAG chr11 5338542 5338561 5338558 +
ggtggcatgtacttgaaatc

SEQ ID NO: 21569 - DNA, 20 bp, Artificial Sequence
  Synthetic oligonucleotide; AGG chr11 5338543 5338562 5338559 +
gtggcatgtacttgaaatct

SEQ ID NO: 21570 - DNA, 20 bp, Artificial Sequence
  Synthetic oligonucleotide; GGG chr11 5338544 5338563 5338560 +
tggcatgtacttgaaatcta

SEQ ID NO: 21571 - DNA, 20 bp, Artificial Sequence
  Synthetic oligonucleotide; GAG chr11 5338588 5338607 5338604 +
ataaaataaattttgtctat

SEQ ID NO: 21572 - DNA, 20 bp, Artificial Sequence
  Synthetic oligonucleotide; AAG chr11 5338616 5338635 5338632 +
taataacaatgactgtgtct

SEQ ID NO: 21573 - DNA, 20 bp, Artificial Sequence
  Synthetic oligonucleotide; AGG chr11 5338617 5338636 5338633 +
aataacaatgactgtgtcta

SEQ ID NO: 21574 - DNA, 20 bp, Artificial Sequence
  Synthetic oligonucleotide; TAG chr11 5338623 5338642 5338639 +
aatgactgtgtctaaggatt

SEQ ID NO: 21575 - DNA, 20 bp, Artificial Sequence
  Synthetic oligonucleotide; AGG chr11 5338624 5338643 5338640 +
atgactgtgtctaaggattt

SEQ ID NO: 21576 - DNA, 20 bp, Artificial Sequence
  Synthetic oligonucleotide; CAG chr11 5338642 5338661 5338658 +
ttaggctataaaatcaaaaa

SEQ ID NO: 21577 - DNA, 20 bp, Artificial Sequence
  Synthetic oligonucleotide; TGG chr11 5338661 5338680 5338677 +
acagatttacattctttaat

SEQ ID NO: 21578 - DNA, 20 bp, Artificial Sequence
  Synthetic oligonucleotide; TGG chr11 5338667 5338686 5338683 +
ttacattctttaattggaca

SEQ ID NO: 21579 - DNA, 20 bp, Artificial Sequence
  Synthetic oligonucleotide; GAG chr11 5338669 5338688 5338685 +
acattctttaattggacatg

SEQ ID NO: 21580 - DNA, 20 bp, Artificial Sequence
  Synthetic oligonucleotide; TGG chr11 5338677 5338696 5338693 +
taattggacatggagacctc

SEQ ID NO: 21581 - DNA, 20 bp, Artificial Sequence
  Synthetic oligonucleotide; GGG chr11 5338678 5338697 5338694 +
aattggacatggagacctct

SEQ ID NO: 21582 - DNA, 20 bp, Artificial Sequence
  Synthetic oligonucleotide; TAG chr11 5338733 5338752 5338749 +
aatttaatactcatataatc

SEQ ID NO: 21583 - DNA, 20 bp, Artificial Sequence
  Synthetic oligonucleotide; AAG chr11 5338737 5338756 5338753 +
taatactcatataatctagt

SEQ ID NO: 21584 - DNA, 20 bp, Artificial Sequence
  Synthetic oligonucleotide; TGG chr11 5338789 5338808 5338805 +
cctataaaaatctgcatctc

SEQ ID NO: 21585 - DNA, 20 bp, Artificial Sequence
  Synthetic oligonucleotide; AAG chr11 5338794 5338813 5338810 +
aaaaatctgcatctctggtg

SEQ ID NO: 21586 - DNA, 20 bp, Artificial Sequence
  Synthetic oligonucleotide; AGG chr11 5338795 5338814 5338811 +
aaaatctgcatctctggtga

SEQ ID NO: 21587 - DNA, 20 bp, Artificial Sequence
  Synthetic oligonucleotide; CAG chr11 5338802 5338821 5338818 +
gcatctctggtgaaggaacc

SEQ ID NO: 21588 - DNA, 20 bp, Artificial Sequence
  Synthetic oligonucleotide; GAG chr11 5338820 5338839 5338836 +
cccagcaattatttgttaat

SEQ ID NO: 21589 - DNA, 20 bp, Artificial Sequence
  Synthetic oligonucleotide; GAG chr11 5338822 5338841 5338838 +
cagcaattatttgttaatga

SEQ ID NO: 21590 - DNA, 20 bp, Artificial Sequence
  Synthetic oligonucleotide; AGG chr11 5338823 5338842 5338839 +
agcaattatttgttaatgag

SEQ ID NO: 21591 - DNA, 20 bp, Artificial Sequence
  Synthetic oligonucleotide; AAG chr11 5338830 5338849 5338846 +
atttgttaatgagaggaata

SEQ ID NO: 21592 - DNA, 20 bp, Artificial Sequence
  Synthetic oligonucleotide; TAG chr11 5338850 5338869 5338866 +
aagttcatcttccccttatc

SEQ ID NO: 21593 - DNA, 20 bp, Artificial Sequence
  Synthetic oligonucleotide; TGG chr11 5338870 5338889 5338886 +
tagtataaattcattttata

SEQ ID NO: 21594 - DNA, 20 bp, Artificial Sequence
  Synthetic oligonucleotide; GGG chr11 5338871 5338890 5338887 +
agtataaattcattttatat

SEQ ID NO: 21595 - DNA, 20 bp, Artificial Sequence
  Synthetic oligonucleotide; GAG chr11 5338873 5338892 5338889 +
tataaattcattttatatgg

SEQ ID NO: 21596 - DNA, 20 bp, Artificial Sequence
  Synthetic oligonucleotide; AGG chr11 5338874 5338893 5338890 +
ataaattcattttatatggg

SEQ ID NO: 21597 - DNA, 20 bp, Artificial Sequence
  Synthetic oligonucleotide; AAG chr11 5338879 5338898 5338895 +
ttcattttatatgggaggaa

SEQ ID NO: 21598 - DNA, 20 bp, Artificial Sequence
  Synthetic oligonucleotide; TAG chr11 5338898 5338917 5338914 +
aaagtgatctgtaaactcat

SEQ ID NO: 21599 - DNA, 20 bp, Artificial Sequence
  Synthetic oligonucleotide; CAG chr11 5338917 5338936 5338933 +
ttagaccatacatatttttt

SEQ ID NO: 21600 - DNA, 20 bp, Artificial Sequence
  Synthetic oligonucleotide; AAG chr11 5338929 5338948 5338945 +
tattttttcagtgtgtctct

SEQ ID NO: 21601 - DNA, 20 bp, Artificial Sequence
  Synthetic oligonucleotide; AAG chr11 5338960 5338979 5338976 +
acgtcttcttaatcatttct

SEQ ID NO: 21602 - DNA, 20 bp, Artificial Sequence
  Synthetic oligonucleotide; TGG chr11 5338965 5338984 5338981 +
ttcttaatcatttctaagat

SEQ ID NO: 21603 - DNA, 20 bp, Artificial Sequence
  Synthetic oligonucleotide; TAG chr11 5338970 5338989 5338986 +
aatcatttctaagattggct

SEQ ID NO: 21604 - DNA, 20 bp, Artificial Sequence
  Synthetic oligonucleotide; CAG chr11 5338977 5338996 5338993 +
tctaagattggcttagtcta

SEQ ID NO: 21605 - DNA, 20 bp, Artificial Sequence
  Synthetic oligonucleotide; TAG chr11 5338991 5339010 5339007 +
agtctacagaaatgcacact

SEQ ID NO: 21606 - DNA, 20 bp, Artificial Sequence
  Synthetic oligonucleotide; TGG chr11 5339028 5339047 5339044 +
actcaaattaaatattctta

SEQ ID NO: 21607 - DNA, 20 bp, Artificial Sequence
  Synthetic oligonucleotide; AAG chr11 5339045 5339064 5339061 +
ttatggtatgttatcccttc

SEQ ID NO: 21608 - DNA, 20 bp, Artificial Sequence
  Synthetic oligonucleotide; AAG chr11 5339060 5339079 5339076 +
ccttcaagcccatactacac

SEQ ID NO: 21609 - DNA, 20 bp, Artificial Sequence
  Synthetic oligonucleotide; AAG chr11 5339080 5339099 5339096 +
aagtatattattatttgaaa

SEQ ID NO: 21610 - DNA, 20 bp, Artificial Sequence
  Synthetic oligonucleotide; AAG chr11 5339084 5339103 5339100 +
atattattatttgaaaaaga

SEQ ID NO: 21611 - DNA, 20 bp, Artificial Sequence
  Synthetic oligonucleotide; AGG chr11 5339085 5339104 5339101 +
tattattatttgaaaaagaa

SEQ ID NO: 21612 - DNA, 20 bp, Artificial Sequence
  Synthetic oligonucleotide; TGG chr11 5339089 5339108 5339105 +
attatttgaaaaagaaagga

SEQ ID NO: 21613 - DNA, 20 bp, Artificial Sequence
  Synthetic oligonucleotide; TGG chr11 5339096 5339115 5339112 +
gaaaaagaaaggatggtatt

SEQ ID NO: 21614 - DNA, 20 bp, Artificial Sequence
  Synthetic oligonucleotide; AAG chr11 5339100 5339119 5339116 +
aagaaaggatggtatttggc

SEQ ID NO: 21615 - DNA, 20 bp, Artificial Sequence
  Synthetic oligonucleotide; AGG chr11 5339101 5339120 5339117 +
agaaaggatggtatttggca

SEQ ID NO: 21616 - DNA, 20 bp, Artificial Sequence
  Synthetic oligonucleotide; GGG chr11 5339102 5339121 5339118 +
gaaaggatggtatttggcaa

SEQ ID NO: 21617 - DNA, 20 bp, Artificial Sequence
  Synthetic oligonucleotide; TAG chr11 5339134 5339153 5339150 +
atgtatattcttttacacct

SEQ ID NO: 21618 - DNA, 20 bp, Artificial Sequence
  Synthetic oligonucleotide; TGG chr11 5339153 5339172 5339169 +
ttagatttcccataactaca

SEQ ID NO: 21619 - DNA, 20 bp, Artificial Sequence
  Synthetic oligonucleotide; TAG chr11 5339172 5339191 5339188 +
atggtacttatttatcttaa

SEQ ID NO: 21620 - DNA, 20 bp, Artificial Sequence
  Synthetic oligonucleotide; AGG chr11 5339173 5339192 5339189 +
tggtacttatttatcttaat

SEQ ID NO: 21621 - DNA, 20 bp, Artificial Sequence
  Synthetic oligonucleotide; GAG chr11 5339198 5339217 5339214 +
ccatgaaatttattcctcat

SEQ ID NO: 21622 - DNA, 20 bp, Artificial Sequence
  Synthetic oligonucleotide; AGG chr11 5339199 5339218 5339215 +
catgaaatttattcctcatg

SEQ ID NO: 21623 - DNA, 20 bp, Artificial Sequence
  Synthetic oligonucleotide; AAG chr11 5339215 5339234 5339231 +
catgaggtccttctctatat

SEQ ID NO: 21624 - DNA, 20 bp, Artificial Sequence
  Synthetic oligonucleotide; CAG chr11 5339232 5339251 5339248 +
tataagttatattcttcttt

SEQ ID NO: 21625 - DNA, 20 bp, Artificial Sequence
  Synthetic oligonucleotide; AAG chr11 5339249 5339268 5339265 +
tttcagtcttgaatgatgaa

SEQ ID NO: 21626 - DNA, 20 bp, Artificial Sequence
  Synthetic oligonucleotide; CAG chr11 5339260 5339279 5339276 +
aatgatgaaaagctgaatta

SEQ ID NO: 21627 - DNA, 20 bp, Artificial Sequence
  Synthetic oligonucleotide; AGG chr11 5339261 5339280 5339277 +
atgatgaaaagctgaattac

SEQ ID NO: 21628 - DNA, 20 bp, Artificial Sequence
  Synthetic oligonucleotide; AAG chr11 5339277 5339296 5339293 +
ttacaggcttcacctgctgt

SEQ ID NO: 21629 - DNA, 20 bp, Artificial Sequence
  Synthetic oligonucleotide; AAG chr11 5339280 5339299 5339296 +
caggcttcacctgctgtaag

SEQ ID NO: 21630 - DNA, 20 bp, Artificial Sequence
  Synthetic oligonucleotide; AGG chr11 5339281 5339300 5339297 +
aggcttcacctgctgtaaga

SEQ ID NO: 21631 - DNA, 20 bp, Artificial Sequence
  Synthetic oligonucleotide; TGG chr11 5339284 5339303 5339300 +
cttcacctgctgtaagaagg

SEQ ID NO: 21632 - DNA, 20 bp, Artificial Sequence
  Synthetic oligonucleotide; CAG chr11 5339292 5339311 5339308 +
gctgtaagaaggtggttcac

SEQ ID NO: 21633 - DNA, 20 bp, Artificial Sequence
  Synthetic oligonucleotide; TAG chr11 5339300 5339319 5339316 +
aaggtggttcaccagtttgt

SEQ ID NO: 21634 - DNA, 20 bp, Artificial Sequence
  Synthetic oligonucleotide; TGG chr11 5339308 5339327 5339324 +
tcaccagtttgttagtccac

SEQ ID NO: 21635 - DNA, 20 bp, Artificial Sequence
  Synthetic oligonucleotide; CAG chr11 5339354 5339373 5339370 +
tatgaatacaaattcatgtg

SEQ ID NO: 21636 - DNA, 20 bp, Artificial Sequence
  Synthetic oligonucleotide; TAG chr11 5339364 5339383 5339380 +
aattcatgtgcagtgtttcc

SEQ ID NO: 21637 - DNA, 20 bp, Artificial Sequence
  Synthetic oligonucleotide; AGG chr11 5339365 5339384 5339381 +
attcatgtgcagtgtttcct

SEQ ID NO: 21638 - DNA, 20 bp, Artificial Sequence
  Synthetic oligonucleotide; GAG chr11 5339367 5339386 5339383 +
tcatgtgcagtgtttcctag

SEQ ID NO: 21639 - DNA, 20 bp, Artificial Sequence
  Synthetic oligonucleotide; TAG chr11 5339371 5339390 5339387 +
gtgcagtgtttcctaggaga

SEQ ID NO: 21640 - DNA, 20 bp, Artificial Sequence
  Synthetic oligonucleotide; TAG chr11 5339383 5339402 5339399 +
ctaggagatagtgttataaa

SEQ ID NO: 21641 - DNA, 20 bp, Artificial Sequence
  Synthetic oligonucleotide; AGG chr11 5339384 5339403 5339400 +
taggagatagtgttataaat

SEQ ID NO: 21642 - DNA, 20 bp, Artificial Sequence
  Synthetic oligonucleotide; TAG chr11 5339413 5339432 5339429 +
ttcctaactaacttttattt

SEQ ID NO: 21643 - DNA, 20 bp, Artificial Sequence
  Synthetic oligonucleotide; AGG chr11 5339414 5339433 5339430 +
tcctaactaacttttatttt

SEQ ID NO: 21644 - DNA, 20 bp, Artificial Sequence
  Synthetic oligonucleotide; CAG chr11 5339419 5339438 5339435 +
actaacttttattttaggtt

SEQ ID NO: 21645 - DNA, 20 bp, Artificial Sequence
  Synthetic oligonucleotide; AGG chr11 5339420 5339439 5339436 +
ctaacttttattttaggttc

SEQ ID NO: 21646 - DNA, 20 bp, Artificial Sequence
  Synthetic oligonucleotide; GAG chr11 5339422 5339441 5339438 +
aacttttattttaggttcag

SEQ ID NO: 21647 - DNA, 20 bp, Artificial Sequence
  Synthetic oligonucleotide; AAG chr11 5339428 5339447 5339444 +
tattttaggttcaggagtac

SEQ ID NO: 21648 - DNA, 20 bp, Artificial Sequence
  Synthetic oligonucleotide; GAG chr11 5339430 5339449 5339446 +
ttttaggttcaggagtacaa

SEQ ID NO: 21649 - DNA, 20 bp, Artificial Sequence
  Synthetic oligonucleotide; CAG chr11 5339433 5339452 5339449 +
taggttcaggagtacaagag

SEQ ID NO: 21650 - DNA, 20 bp, Artificial Sequence
  Synthetic oligonucleotide; AGG chr11 5339434 5339453 5339450 +
aggttcaggagtacaagagc

SEQ ID NO: 21651 - DNA, 20 bp, Artificial Sequence
  Synthetic oligonucleotide; GAG chr11 5339464 5339483 5339480 +
catatttaaacttgtgtcac

SEQ ID NO: 21652 - DNA, 20 bp, Artificial Sequence
  Synthetic oligonucleotide; AGG chr11 5339465 5339484 5339481 +
atatttaaacttgtgtcacg

SEQ ID NO: 21653 - DNA, 20 bp, Artificial Sequence
  Synthetic oligonucleotide; GGG chr11 5339466 5339485 5339482 +
tatttaaacttgtgtcacga

SEQ ID NO: 21654 - DNA, 20 bp, Artificial Sequence
  Synthetic oligonucleotide; CAG chr11 5339478 5339497 5339494 +
tgtcacgagggtttgttgta

SEQ ID NO: 21655 - DNA, 20 bp, Artificial Sequence
  Synthetic oligonucleotide; CAG chr11 5339499 5339518 5339515 +
agattatgtcatcactcact

SEQ ID NO: 21656 - DNA, 20 bp, Artificial Sequence
  Synthetic oligonucleotide; AGG chr11 5339500 5339519 5339516 +
gattatgtcatcactcactc

SEQ ID NO: 21657 - DNA, 20 bp, Artificial Sequence
  Synthetic oligonucleotide; AAG chr11 5339507 5339526 5339523 +
tcatcactcactcaggtatt

SEQ ID NO: 21658 - DNA, 20 bp, Artificial Sequence
  Synthetic oligonucleotide; TAG chr11 5339512 5339531 5339528 +
actcactcaggtattaagcc

SEQ ID NO: 21659 - DNA, 20 bp, Artificial Sequence
  Synthetic oligonucleotide; TAG chr11 5339570 5339589 5339586 +
tttcaccctccatcctccaa

SEQ ID NO: 21660 - DNA, 20 bp, Artificial Sequence
  Synthetic oligonucleotide; AGG chr11 5339571 5339590 5339587 +
ttcaccctccatcctccaat

SEQ ID NO: 21661 - DNA, 20 bp, Artificial Sequence
  Synthetic oligonucleotide; CAG chr11 5339577 5339596 5339593 +
ctccatcctccaataggccc

SEQ ID NO: 21662 - DNA, 20 bp, Artificial Sequence
  Synthetic oligonucleotide; TAG chr11 5339622 5339641 5339638 +
gtccatgtgttctcatcatt

SEQ ID NO: 21663 - DNA, 20 bp, Artificial Sequence
  Synthetic oligonucleotide; AAG chr11 5339636 5339655 5339652 +
atcatttagctcccactcat

SEQ ID NO: 21664 - DNA, 20 bp, Artificial Sequence
  Synthetic oligonucleotide; GAG chr11 5339640 5339659 5339656 +
tttagctcccactcataagt

SEQ ID NO: 21665 - DNA, 20 bp, Artificial Sequence
  Synthetic oligonucleotide; TGG chr11 5339649 5339668 5339665 +
cactcataagtgagaacacg

SEQ ID NO: 21666 - DNA, 20 bp, Artificial Sequence
  Synthetic oligonucleotide; TGG chr11 5339656 5339675 5339672 +
aagtgagaacacgtggtatt

SEQ ID NO: 21667 - DNA, 20 bp, Artificial Sequence
  Synthetic oligonucleotide; AAG chr11 5339684 5339703 5339700 +
tgttcctgtattaatttgct

SEQ ID NO: 21668 - DNA, 20 bp, Artificial Sequence
  Synthetic oligonucleotide; AGG chr11 5339685 5339704 5339701 +
gttcctgtattaatttgcta

SEQ ID NO: 21669 - DNA, 20 bp, Artificial Sequence
  Synthetic oligonucleotide; TAG chr11 5339695 5339714 5339711 +
taatttgctaaggcttctaa

SEQ ID NO: 21670 - DNA, 20 bp, Artificial Sequence
  Synthetic oligonucleotide; TAG chr11 5339702 5339721 5339718 +
ctaaggcttctaatagtaca

SEQ ID NO: 21671 - DNA, 20 bp, Artificial Sequence
  Synthetic oligonucleotide; CAG chr11 5339715 5339734 5339731 +
tagtacatagcattttacca

SEQ ID NO: 21672 - DNA, 20 bp, Artificial Sequence
  Synthetic oligonucleotide; AGG chr11 5339716 5339735 5339732 +
agtacatagcattttaccac

SEQ ID NO: 21673 - DNA, 20 bp, Artificial Sequence
  Synthetic oligonucleotide; AAG chr11 5339719 5339738 5339735 +
acatagcattttaccacagg

SEQ ID NO: 21674 - DNA, 20 bp, Artificial Sequence
  Synthetic oligonucleotide; TAG chr11 5339727 5339746 5339743 +
ttttaccacaggaagacttg

SEQ ID NO: 21675 - DNA, 20 bp, Artificial Sequence
  Synthetic oligonucleotide; AGG chr11 5339728 5339747 5339744 +
tttaccacaggaagacttgt

SEQ ID NO: 21676 - DNA, 20 bp, Artificial Sequence
  Synthetic oligonucleotide; GAG chr11 5339730 5339749 5339746 +
taccacaggaagacttgtag

SEQ ID NO: 21677 - DNA, 20 bp, Artificial Sequence
  Synthetic oligonucleotide; CAG chr11 5339737 5339756 5339753 +
ggaagacttgtaggagatca

SEQ ID NO: 21678 - DNA, 20 bp, Artificial Sequence
  Synthetic oligonucleotide; AAG chr11 5339741 5339760 5339757 +
gacttgtaggagatcacaga

SEQ ID NO: 21679 - DNA, 20 bp, Artificial Sequence
  Synthetic oligonucleotide; TGG chr11 5339796 5339815 5339812 +
gtttatgttgattgttacaa

SEQ ID NO: 21680 - DNA, 20 bp, Artificial Sequence
  Synthetic oligonucleotide; GGG chr11 5339797 5339816 5339813 +
tttatgttgattgttacaat

SEQ ID NO: 21681 - DNA, 20 bp, Artificial Sequence
  Synthetic oligonucleotide; TAG chr11 5339807 5339826 5339823 +
ttgttacaatgggttttgaa

SEQ ID NO: 21682 - DNA, 20 bp, Artificial Sequence
  Synthetic oligonucleotide; GAG chr11 5339822 5339841 5339838 +
ttgaatagaaaaacatgtct

SEQ ID NO: 21683 - DNA, 20 bp, Artificial Sequence
  Synthetic oligonucleotide; TGG chr11 5339825 5339844 5339841 +
aatagaaaaacatgtctgag

SEQ ID NO: 21684 - DNA, 20 bp, Artificial Sequence
  Synthetic oligonucleotide; TAG chr11 5339840 5339859 5339856 +
ctgagtggatttccaccatg

SEQ ID NO: 21685 - DNA, 20 bp, Artificial Sequence
  Synthetic oligonucleotide; AAG chr11 5339857 5339876 5339873 +
atgtagccttctgtataact

SEQ ID NO: 21686 - DNA, 20 bp, Artificial Sequence
  Synthetic oligonucleotide; GAG chr11 5339863 5339882 5339879 +
ccttctgtataactaagttt

SEQ ID NO: 21687 - DNA, 20 bp, Artificial Sequence
  Synthetic oligonucleotide; TAG chr11 5339875 5339894 5339891 +
ctaagtttgagataattatt

SEQ ID NO: 21688 - DNA, 20 bp, Artificial Sequence
  Synthetic oligonucleotide; CAG chr11 5339920 5339939 5339936 +
ctgtgtctgtattcatccta

SEQ ID NO: 21689 - DNA, 20 bp, Artificial Sequence
  Synthetic oligonucleotide; CAG chr11 5339931 5339950 5339947 +
ttcatcctacagcatcttct

SEQ ID NO: 21690 - DNA, 20 bp, Artificial Sequence
  Synthetic oligonucleotide; TAG chr11 5339940 5339959 5339956 +
cagcatcttctcagtgaatt

SEQ ID NO: 21691 - DNA, 20 bp, Artificial Sequence
  Synthetic oligonucleotide; AAG chr11 5339959 5339978 5339975 +
ttagtttcacacttactttc

SEQ ID NO: 21692 - DNA, 20 bp, Artificial Sequence
  Synthetic oligonucleotide; CAG chr11 5339963 5339982 5339979 +
tttcacacttactttcaagt

SEQ ID NO: 21693 - DNA, 20 bp, Artificial Sequence
  Synthetic oligonucleotide; AAG chr11 5339983 5340002 5339999 +
cagaaatgaacttcttaaac

SEQ ID NO: 21694 - DNA, 20 bp, Artificial Sequence
  Synthetic oligonucleotide; AGG chr11 5339984 5340003 5340000 +
agaaatgaacttcttaaaca

SEQ ID NO: 21695 - DNA, 20 bp, Artificial Sequence
  Synthetic oligonucleotide; GGG chr11 5339985 5340004 5340001 +
gaaatgaacttcttaaacaa

SEQ ID NO: 21696 - DNA, 20 bp, Artificial Sequence
  Synthetic oligonucleotide; TGG chr11 5340015 5340034 5340031 +
ttcataaatcattcaccaaa

SEQ ID NO: 21697 - DNA, 20 bp, Artificial Sequence
  Synthetic oligonucleotide; TAG chr11 5340037 5340056 5340053 +
gtcaactttcctgccatttt

SEQ ID NO: 21698 - DNA, 20 bp, Artificial Sequence
  Synthetic oligonucleotide; AGG chr11 5340038 5340057 5340054 +
tcaactttcctgccattttt

SEQ ID NO: 21699 - DNA, 20 bp, Artificial Sequence
  Synthetic oligonucleotide; TAG chr11 5340058 5340077 5340074 +
aggttccatttcctgtattt

SEQ ID NO: 21700 - DNA, 20 bp, Artificial Sequence
  Synthetic oligonucleotide; AAG chr11 5340064 5340083 5340080 +
catttcctgtattttagaaa

SEQ ID NO: 21701 - DNA, 20 bp, Artificial Sequence
  Synthetic oligonucleotide; GAG chr11 5340066 5340085 5340082 +
tttcctgtattttagaaaaa

SEQ ID NO: 21702 - DNA, 20 bp, Artificial Sequence
  Synthetic oligonucleotide; AGG chr11 5340067 5340086 5340083 +
ttcctgtattttagaaaaag

SEQ ID NO: 21703 - DNA, 20 bp, Artificial Sequence
  Synthetic oligonucleotide; CAG chr11 5340070 5340089 5340086 +
ctgtattttagaaaaagagg

SEQ ID NO: 21704 - DNA, 20 bp, Artificial Sequence
  Synthetic oligonucleotide; CAG chr11 5340086 5340105 5340102 +
gaggcagctcttctacctaa

SEQ ID NO: 21705 - DNA, 20 bp, Artificial Sequence
  Synthetic oligonucleotide; CAG chr11 5340096 5340115 5340112 +
ttctacctaacagtattttc

SEQ ID NO: 21706 - DNA, 20 bp, Artificial Sequence
  Synthetic oligonucleotide; TAG chr11 5340109 5340128 5340125 +
tattttccagttttaaatat

SEQ ID NO: 21707 - DNA, 20 bp, Artificial Sequence
  Synthetic oligonucleotide; TAG chr11 5340113 5340132 5340129 +
ttccagttttaaatattagt

SEQ ID NO: 21708 - DNA, 20 bp, Artificial Sequence
  Synthetic oligonucleotide; GAG chr11 5340115 5340134 5340131 +
ccagttttaaatattagtta

SEQ ID NO: 21709 - DNA, 20 bp, Artificial Sequence
  Synthetic oligonucleotide; AAG chr11 5340118 5340137 5340134 +
gttttaaatattagttagag

SEQ ID NO: 21710 - DNA, 20 bp, Artificial Sequence
  Synthetic oligonucleotide; GAG chr11 5340139 5340158 5340155 +
agattcacatatctataact

SEQ ID NO: 21711 - DNA, 20 bp, Artificial Sequence
  Synthetic oligonucleotide; TAG chr11 5340158 5340177 5340174 +
tgagatgatataattattaa

SEQ ID NO: 21712 - DNA, 20 bp, Artificial Sequence
  Synthetic oligonucleotide; TGG chr11 5340165 5340184 5340181 +
atataattattaatagcctt

SEQ ID NO: 21713 - DNA, 20 bp, Artificial Sequence
  Synthetic oligonucleotide; AAG chr11 5340172 5340191 5340188 +
tattaatagcctttggttat

SEQ ID NO: 21714 - DNA, 20 bp, Artificial Sequence
  Synthetic oligonucleotide; TAG chr11 5340192 5340211 5340208 +
aagtgaaactcaactgaaac

SEQ ID NO: 21715 - DNA, 20 bp, Artificial Sequence
  Synthetic oligonucleotide; AGG chr11 5340193 5340212 5340209 +
agtgaaactcaactgaaact

SEQ ID NO: 21716 - DNA, 20 bp, Artificial Sequence
  Synthetic oligonucleotide; AAG chr11 5340214 5340233 5340230 +
ggctgaacaaaacaaattac

SEQ ID NO: 21717 - DNA, 20 bp, Artificial Sequence
  Synthetic oligonucleotide; AAG chr11 5340217 5340236 5340233 +
tgaacaaaacaaattacaag

SEQ ID NO: 21718 - DNA, 20 bp, Artificial Sequence
  Synthetic oligonucleotide; GAG chr11 5340219 5340238 5340235 +
aacaaaacaaattacaagaa

SEQ ID NO: 21719 - DNA, 20 bp, Artificial Sequence
  Synthetic oligonucleotide; AGG chr11 5340220 5340239 5340236 +
acaaaacaaattacaagaag

SEQ ID NO: 21720 - DNA, 20 bp, Artificial Sequence
  Synthetic oligonucleotide; GAG chr11 5340222 5340241 5340238 +
aaaacaaattacaagaagag

SEQ ID NO: 21721 - DNA, 20 bp, Artificial Sequence
  Synthetic oligonucleotide; TAG chr11 5340230 5340249 5340246 +
ttacaagaagaggagtttat

SEQ ID NO: 21722 - DNA, 20 bp, Artificial Sequence
  Synthetic oligonucleotide; AGG chr11 5340231 5340250 5340247 +
tacaagaagaggagtttatt

SEQ ID NO: 21723 - DNA, 20 bp, Artificial Sequence
  Synthetic oligonucleotide; TGG chr11 5340237 5340256 5340253 +
aagaggagtttattaggctg

SEQ ID NO: 21724 - DNA, 20 bp, Artificial Sequence
  Synthetic oligonucleotide; AAG chr11 5340250 5340269 5340266 +
taggctgtggaatcaaaaaa

SEQ ID NO: 21725 - DNA, 20 bp, Artificial Sequence
  Synthetic oligonucleotide; GAG chr11 5340277 5340296 5340293 +
aaactgtcctccttgtcact

SEQ ID NO: 21726 - DNA, 20 bp, Artificial Sequence
  Synthetic oligonucleotide; CAG chr11 5340283 5340302 5340299 +
tcctccttgtcactgagtct

SEQ ID NO: 21727 - DNA, 20 bp, Artificial Sequence
  Synthetic oligonucleotide; AGG chr11 5340284 5340303 5340300 +
cctccttgtcactgagtctc

SEQ ID NO: 21728 - DNA, 20 bp, Artificial Sequence
  Synthetic oligonucleotide; TGG chr11 5340293 5340312 5340309 +
cactgagtctcaggaaaaca

SEQ ID NO: 21729 - DNA, 20 bp, Artificial Sequence
  Synthetic oligonucleotide; CAG chr11 5340299 5340318 5340315 +
gtctcaggaaaacatggaat

SEQ ID NO: 21730 - DNA, 20 bp, Artificial Sequence
  Synthetic oligonucleotide; GAG chr11 5340301 5340320 5340317 +
ctcaggaaaacatggaatca

SEQ ID NO: 21731 - DNA, 20 bp, Artificial Sequence
  Synthetic oligonucleotide; AAG chr11 5340309 5340328 5340325 +
aacatggaatcagagatttg

SEQ ID NO: 21732 - DNA, 20 bp, Artificial Sequence
  Synthetic oligonucleotide; TAG chr11 5340367 5340386 5340383 +
tttactctaaatatttatta

SEQ ID NO: 21733 - DNA, 20 bp, Artificial Sequence
  Synthetic oligonucleotide; AAG chr11 5340374 5340393 5340390 +
taaatatttattatagtttg

SEQ ID NO: 21734 - DNA, 20 bp, Artificial Sequence
  Synthetic oligonucleotide; AAG chr11 5340415 5340434 5340431 +
acattgtcattaacaattct

SEQ ID NO: 21735 - DNA, 20 bp, Artificial Sequence
  Synthetic oligonucleotide; TAG chr11 5340428 5340447 5340444 +
caattctaagcattgcattt

SEQ ID NO: 21736 - DNA, 20 bp, Artificial Sequence
  Synthetic oligonucleotide; AAG chr11 5340445 5340464 5340461 +
ttttagtaattctacaacaa

SEQ ID NO: 21737 - DNA, 20 bp, Artificial Sequence
  Synthetic oligonucleotide; AAG chr11 5340498 5340517 5340514 +
ttgaaaaattctttttaaaa

SEQ ID NO: 21738 - DNA, 20 bp, Artificial Sequence
  Synthetic oligonucleotide; CGG chr11 5340512 5340531 5340528 +
ttaaaaaagttcttctactg

SEQ ID NO: 21739 - DNA, 20 bp, Artificial Sequence
  Synthetic oligonucleotide; TAG chr11 5340516 5340535 5340532 +
aaaagttcttctactgcggt

SEQ ID NO: 21740 - DNA, 20 bp, Artificial Sequence
  Synthetic oligonucleotide; AGG chr11 5340517 5340536 5340533 +
aaagttcttctactgcggtt

SEQ ID NO: 21741 - DNA, 20 bp, Artificial Sequence
  Synthetic oligonucleotide; GAG chr11 5340519 5340538 5340535 +
agttcttctactgcggttag

SEQ ID NO: 21742 - DNA, 20 bp, Artificial Sequence
  Synthetic oligonucleotide; TGG chr11 5340524 5340543 5340540 +
ttctactgcggttaggagtt

SEQ ID NO: 21743 - DNA, 20 bp, Artificial Sequence
  Synthetic oligonucleotide; GAG chr11 5340526 5340545 5340542 +
ctactgcggttaggagtttg

SEQ ID NO: 21744 - DNA, 20 bp, Artificial Sequence
  Synthetic oligonucleotide; CAG chr11 5340545 5340564 5340561 +
ggagatacaatgcaaaatat

SEQ ID NO: 21745 - DNA, 20 bp, Artificial Sequence
  Synthetic oligonucleotide; TAG chr11 5340554 5340573 5340570 +
atgcaaaatatcagttttca

SEQ ID NO: 21746 - DNA, 20 bp, Artificial Sequence
  Synthetic oligonucleotide; AGG chr11 5340555 5340574 5340571 +
tgcaaaatatcagttttcat

SEQ ID NO: 21747 - DNA, 20 bp, Artificial Sequence
  Synthetic oligonucleotide; GGG chr11 5340556 5340575 5340572 +
gcaaaatatcagttttcata

SEQ ID NO: 21748 - DNA, 20 bp, Artificial Sequence
  Synthetic oligonucleotide; TGG chr11 5340570 5340589 5340586 +
ttcatagggaacaatatttt

SEQ ID NO: 21749 - DNA, 20 bp, Artificial Sequence
  Synthetic oligonucleotide; GAG chr11 5340572 5340591 5340588 +
catagggaacaatatttttg

SEQ ID NO: 21750 - DNA, 20 bp, Artificial Sequence
  Synthetic oligonucleotide; TAG chr11 5340575 5340594 5340591 +
agggaacaatatttttggag

SEQ ID NO: 21751 - DNA, 20 bp, Artificial Sequence
  Synthetic oligonucleotide; AAG chr11 5340578 5340597 5340594 +
gaacaatatttttggagtag

SEQ ID NO: 21752 - DNA, 20 bp, Artificial Sequence
  Synthetic oligonucleotide; AGG chr11 5340579 5340598 5340595 +
aacaatatttttggagtaga

SEQ ID NO: 21753 - DNA, 20 bp, Artificial Sequence
  Synthetic oligonucleotide; GAG chr11 5340581 5340600 5340597 +
caatatttttggagtagaag

SEQ ID NO: 21754 - DNA, 20 bp, Artificial Sequence
  Synthetic oligonucleotide; AGG chr11 5340582 5340601 5340598 +
aatatttttggagtagaagg

SEQ ID NO: 21755 - DNA, 20 bp, Artificial Sequence
  Synthetic oligonucleotide; GAG chr11 5340584 5340603 5340600 +
tatttttggagtagaaggag

SEQ ID NO: 21756 - DNA, 20 bp, Artificial Sequence
  Synthetic oligonucleotide; CAG chr11 5340594 5340613 5340610 +
gtagaaggaggagaaatttt

SEQ ID NO: 21757 - DNA, 20 bp, Artificial Sequence
  Synthetic oligonucleotide; AAG chr11 5340600 5340619 5340616 +
ggaggagaaattttcagaaa

SEQ ID NO: 21758 - DNA, 20 bp, Artificial Sequence
  Synthetic oligonucleotide; AAG chr11 5340604 5340623 5340620 +
gagaaattttcagaaaaaga

SEQ ID NO: 21759 - DNA, 20 bp, Artificial Sequence
  Synthetic oligonucleotide; TAG chr11 5340607 5340626 5340623 +
aaattttcagaaaaagaaag

SEQ ID NO: 21760 - DNA, 20 bp, Artificial Sequence
  Synthetic oligonucleotide; AGG chr11 5340608 5340627 5340624 +
aattttcagaaaaagaaagt

SEQ ID NO: 21761 - DNA, 20 bp, Artificial Sequence
  Synthetic oligonucleotide; AAG chr11 5340617 5340636 5340633 +
aaaaagaaagtaggtactac

SEQ ID NO: 21762 - DNA, 20 bp, Artificial Sequence
  Synthetic oligonucleotide; CGG chr11 5340625 5340644 5340641 +
agtaggtactacaagcatga

SEQ ID NO: 21763 - DNA, 20 bp, Artificial Sequence
  Synthetic oligonucleotide; AAG chr11 5340633 5340652 5340649 +
ctacaagcatgacggaatac

SEQ ID NO: 21764 - DNA, 20 bp, Artificial Sequence
  Synthetic oligonucleotide; AGG chr11 5340634 5340653 5340650 +
tacaagcatgacggaataca

SEQ ID NO: 21765 - DNA, 20 bp, Artificial Sequence
  Synthetic oligonucleotide; AAG chr11 5340641 5340660 5340657 +
atgacggaatacaaggcaaa

SEQ ID NO: 21766 - DNA, 20 bp, Artificial Sequence
  Synthetic oligonucleotide; TAG chr11 5340644 5340663 5340660 +
acggaatacaaggcaaaaag

SEQ ID NO: 21767 - DNA, 20 bp, Artificial Sequence
  Synthetic oligonucleotide; AAG chr11 5340647 5340666 5340663 +
gaatacaaggcaaaaagtag

SEQ ID NO: 21768 - DNA, 20 bp, Artificial Sequence
  Synthetic oligonucleotide; AAG chr11 5340655 5340674 5340671 +
ggcaaaaagtagaagccact

SEQ ID NO: 21769 - DNA, 20 bp, Artificial Sequence
  Synthetic oligonucleotide; AGG chr11 5340656 5340675 5340672 +
gcaaaaagtagaagccacta

SEQ ID NO: 21770 - DNA, 20 bp, Artificial Sequence
  Synthetic oligonucleotide; TAG chr11 5340660 5340679 5340676 +
aaagtagaagccactaagga

SEQ ID NO: 21771 - DNA, 20 bp, Artificial Sequence
  Synthetic oligonucleotide; TAG chr11 5340670 5340689 5340686 +
ccactaaggatagtctactg

SEQ ID NO: 21772 - DNA, 20 bp, Artificial Sequence
  Synthetic oligonucleotide; TGG chr11 5340673 5340692 5340689 +
ctaaggatagtctactgtag

SEQ ID NO: 21773 - DNA, 20 bp, Artificial Sequence
  Synthetic oligonucleotide; GAG chr11 5340675 5340694 5340691 +
aaggatagtctactgtagtg

SEQ ID NO: 21774 - DNA, 20 bp, Artificial Sequence
  Synthetic oligonucleotide; TGG chr11 5340690 5340709 5340706 +
tagtggagtaccattcacac

SEQ ID NO: 21775 - DNA, 20 bp, Artificial Sequence
  Synthetic oligonucleotide; TAG chr11 5340698 5340717 5340714 +
taccattcacactggcctta

SEQ ID NO: 21776 - DNA, 20 bp, Artificial Sequence
  Synthetic oligonucleotide; TAG chr11 5340702 5340721 5340718 +
attcacactggccttatagt

SEQ ID NO: 21777 - DNA, 20 bp, Artificial Sequence
  Synthetic oligonucleotide; AAG chr11 5340705 5340724 5340721 +
cacactggccttatagttag

SEQ ID NO: 21778 - DNA, 20 bp, Artificial Sequence
  Synthetic oligonucleotide; TGG chr11 5340754 5340773 5340770 +
aattaaaaatgttatgccct

SEQ ID NO: 21779 - DNA, 20 bp, Artificial Sequence
  Synthetic oligonucleotide; GAG chr11 5340756 5340775 5340772 +
ttaaaaatgttatgcccttg

SEQ ID NO: 21780 - DNA, 20 bp, Artificial Sequence
  Synthetic oligonucleotide; AGG chr11 5340757 5340776 5340773 +
taaaaatgttatgcccttgg

SEQ ID NO: 21781 - DNA, 20 bp, Artificial Sequence
  Synthetic oligonucleotide; GGG chr11 5340758 5340777 5340774 +
aaaaatgttatgcccttgga

SEQ ID NO: 21782 - DNA, 20 bp, Artificial Sequence
  Synthetic oligonucleotide; AAG chr11 5340795 5340814 5340811 +
ttatattaaatttccccatc

SEQ ID NO: 21783 - DNA, 20 bp, Artificial Sequence
  Synthetic oligonucleotide; CAG chr11 5340802 5340821 5340818 +
aaatttccccatcaagaaaa

SEQ ID NO: 21784 - DNA, 20 bp, Artificial Sequence
  Synthetic oligonucleotide; AAG chr11 5340843 5340862 5340859 +
aatatttttatgaataaaat

SEQ ID NO: 21785 - DNA, 20 bp, Artificial Sequence
  Synthetic oligonucleotide; TGG chr11 5340849 5340868 5340865 +
tttatgaataaaataagttg

SEQ ID NO: 21786 - DNA, 20 bp, Artificial Sequence
  Synthetic oligonucleotide; TAG chr11 5340855 5340874 5340871 +
aataaaataagttgtggatg

SEQ ID NO: 21787 - DNA, 20 bp, Artificial Sequence
  Synthetic oligonucleotide; TAG chr11 5340858 5340877 5340874 +
aaaataagttgtggatgtag

SEQ ID NO: 21788 - DNA, 20 bp, Artificial Sequence
  Synthetic oligonucleotide; GAG chr11 5340860 5340879 5340876 +
aataagttgtggatgtagta

SEQ ID NO: 21789 - DNA, 20 bp, Artificial Sequence
  Synthetic oligonucleotide; AAG chr11 5340870 5340889 5340886 +
ggatgtagtagagcataatt

SEQ ID NO: 21790 - DNA, 20 bp, Artificial Sequence
  Synthetic oligonucleotide; AGG chr11 5340871 5340890 5340887 +
gatgtagtagagcataatta

SEQ ID NO: 21791 - DNA, 20 bp, Artificial Sequence
  Synthetic oligonucleotide; GGG chr11 5340872 5340891 5340888 +
atgtagtagagcataattaa

SEQ ID NO: 21792 - DNA, 20 bp, Artificial Sequence
  Synthetic oligonucleotide; TGG chr11 5340884 5340903 5340900 +
ataattaagggacacatgtt

SEQ ID NO: 21793 - DNA, 20 bp, Artificial Sequence
  Synthetic oligonucleotide; CAG chr11 5340906 5340925 5340922 +
gttttatgaatgattgaaaa

SEQ ID NO: 21794 - DNA, 20 bp, Artificial Sequence
  Synthetic oligonucleotide; AGG chr11 5340907 5340926 5340923 +
ttttatgaatgattgaaaac

SEQ ID NO: 21795 - DNA, 20 bp, Artificial Sequence
  Synthetic oligonucleotide; TAG chr11 5340952 5340971 5340968 +
atgcactcacactcacaatt

SEQ ID NO: 21796 - DNA, 20 bp, Artificial Sequence
  Synthetic oligonucleotide; CAG chr11 5340959 5340978 5340975 +
cacactcacaatttagtatt

SEQ ID NO: 21797 - DNA, 20 bp, Artificial Sequence
  Synthetic oligonucleotide; CAG chr11 5340973 5340992 5340989 +
agtattcagactgtgttgct

SEQ ID NO: 21798 - DNA, 20 bp, Artificial Sequence
  Synthetic oligonucleotide; AGG chr11 5340974 5340993 5340990 +
gtattcagactgtgttgctc

SEQ ID NO: 21799 - DNA, 20 bp, Artificial Sequence
  Synthetic oligonucleotide; TGG chr11 5340982 5341001 5340998 +
actgtgttgctcaggtgaca

SEQ ID NO: 21800 - DNA, 20 bp, Artificial Sequence
  Synthetic oligonucleotide; AAG chr11 5340991 5341010 5341007 +
ctcaggtgacatggcgtgac

SEQ ID NO: 21801 - DNA, 20 bp, Artificial Sequence
  Synthetic oligonucleotide; AGG chr11 5340992 5341011 5341008 +
tcaggtgacatggcgtgaca

SEQ ID NO: 21802 - DNA, 20 bp, Artificial Sequence
  Synthetic oligonucleotide; AAG chr11 5341010 5341029 5341026 +
caaggataaaaaacatgata

SEQ ID NO: 21803 - DNA, 20 bp, Artificial Sequence
  Synthetic oligonucleotide; CAG chr11 5341031 5341050 5341047 +
agctgatttttttatatgtt

SEQ ID NO: 21804 - DNA, 20 bp, Artificial Sequence
  Synthetic oligonucleotide; CAG chr11 5341063 5341082 5341079 +
aattacatctcttaatgaaa

SEQ ID NO: 21805 - DNA, 20 bp, Artificial Sequence
  Synthetic oligonucleotide; AAG chr11 5341075 5341094 5341091 +
taatgaaacagaatataaat

SEQ ID NO: 21806 - DNA, 20 bp, Artificial Sequence
  Synthetic oligonucleotide; AGG chr11 5341076 5341095 5341092 +
aatgaaacagaatataaata

SEQ ID NO: 21807 - DNA, 20 bp, Artificial Sequence
  Synthetic oligonucleotide; CAG chr11 5341083 5341102 5341099 +
cagaatataaataaggattg

SEQ ID NO: 21808 - DNA, 20 bp, Artificial Sequence
  Synthetic oligonucleotide; AAG chr11 5341094 5341113 5341110 +
taaggattgcagtttttctt

SEQ ID NO: 21809 - DNA, 20 bp, Artificial Sequence
  Synthetic oligonucleotide; TGG chr11 5341098 5341117 5341114 +
gattgcagtttttcttaagt

SEQ ID NO: 21810 - DNA, 20 bp, Artificial Sequence
  Synthetic oligonucleotide; GAG chr11 5341110 5341129 5341126 +
tcttaagttggactctctat

SEQ ID NO: 21811 - DNA, 20 bp, Artificial Sequence
  Synthetic oligonucleotide; GAG chr11 5341121 5341140 5341137 +
actctctatgagcaatacct

SEQ ID NO: 21812 - DNA, 20 bp, Artificial Sequence
  Synthetic oligonucleotide; TAG chr11 5341125 5341144 5341141 +
tctatgagcaatacctgaga

SEQ ID NO: 21813 - DNA, 20 bp, Artificial Sequence
  Synthetic oligonucleotide; AGG chr11 5341126 5341145 5341142 +
ctatgagcaatacctgagat

SEQ ID NO: 21814 - DNA, 20 bp, Artificial Sequence
  Synthetic oligonucleotide; GGG chr11 5341127 5341146 5341143 +
tatgagcaatacctgagata

SEQ ID NO: 21815 - DNA, 20 bp, Artificial Sequence
  Synthetic oligonucleotide; CAG chr11 5341164 5341183 5341180 +
aatttattaatgaatgctct

SEQ ID NO: 21816 - DNA, 20 bp, Artificial Sequence
  Synthetic oligonucleotide; AGG chr11 5341165 5341184 5341181 +
atttattaatgaatgctctc

SEQ ID NO: 21817 - DNA, 20 bp, Artificial Sequence
  Synthetic oligonucleotide; GAG chr11 5341167 5341186 5341183 +
ttattaatgaatgctctcag

SEQ ID NO: 21818 - DNA, 20 bp, Artificial Sequence
  Synthetic oligonucleotide; CAG chr11 5341171 5341190 5341187 +
taatgaatgctctcaggaga

SEQ ID NO: 21819 - DNA, 20 bp, Artificial Sequence
  Synthetic oligonucleotide; AGG chr11 5341172 5341191 5341188 +
aatgaatgctctcaggagac

SEQ ID NO: 21820 - DNA, 20 bp, Artificial Sequence
  Synthetic oligonucleotide; GGG chr11 5341173 5341192 5341189 +
atgaatgctctcaggagaca

SEQ ID NO: 21821 - DNA, 20 bp, Artificial Sequence
  Synthetic oligonucleotide; GAG chr11 5341175 5341194 5341191 +
gaatgctctcaggagacagg

SEQ ID NO: 21822 - DNA, 20 bp, Artificial Sequence
  Synthetic oligonucleotide; AAG chr11 5341179 5341198 5341195 +
gctctcaggagacagggagc

SEQ ID NO: 21823 - DNA, 20 bp, Artificial Sequence
  Synthetic oligonucleotide; AAG chr11 5341185 5341204 5341201 +
aggagacagggagcaagtaa

SEQ ID NO: 21824 - DNA, 20 bp, Artificial Sequence
  Synthetic oligonucleotide; CAG chr11 5341188 5341207 5341204 +
agacagggagcaagtaaaag

SEQ ID NO: 21825 - DNA, 20 bp, Artificial Sequence
  Synthetic oligonucleotide; TGG chr11 5341193 5341212 5341209 +
gggagcaagtaaaagcagtg

SEQ ID NO: 21826 - DNA, 20 bp, Artificial Sequence
  Synthetic oligonucleotide; CAG chr11 5341197 5341216 5341213 +
gcaagtaaaagcagtgtgga

SEQ ID NO: 21827 - DNA, 20 bp, Artificial Sequence
  Synthetic oligonucleotide; AGG chr11 5341198 5341217 5341214 +
caagtaaaagcagtgtggac

SEQ ID NO: 21828 - DNA, 20 bp, Artificial Sequence
  Synthetic oligonucleotide; GGG chr11 5341199 5341218 5341215 +
aagtaaaagcagtgtggaca

SEQ ID NO: 21829 - DNA, 20 bp, Artificial Sequence
  Synthetic oligonucleotide; GGG chr11 5341200 5341219 5341216 +
agtaaaagcagtgtggacag

SEQ ID NO: 21830 - DNA, 20 bp, Artificial Sequence
  Synthetic oligonucleotide; AAG chr11 5341203 5341222 5341219 +
aaaagcagtgtggacagggg

SEQ ID NO: 21831 - DNA, 20 bp, Artificial Sequence
  Synthetic oligonucleotide; AGG chr11 5341204 5341223 5341220 +
aaagcagtgtggacagggga

SEQ ID NO: 21832 - DNA, 20 bp, Artificial Sequence
  Synthetic oligonucleotide; GAG chr11 5341206 5341225 5341222 +
agcagtgtggacaggggaag

SEQ ID NO: 21833 - DNA, 20 bp, Artificial Sequence
  Synthetic oligonucleotide; AGG chr11 5341207 5341226 5341223 +
gcagtgtggacaggggaagg

SEQ ID NO: 21834 - DNA, 20 bp, Artificial Sequence
  Synthetic oligonucleotide; AAG chr11 5341211 5341230 5341227 +
tgtggacaggggaaggaggt

SEQ ID NO: 21835 - DNA, 20 bp, Artificial Sequence
  Synthetic oligonucleotide; AAG chr11 5341215 5341234 5341231 +
gacaggggaaggaggtaagc

SEQ ID NO: 21836 - DNA, 20 bp, Artificial Sequence
  Synthetic oligonucleotide; AAG chr11 5341227 5341246 5341243 +
aggtaagcaagtgcatactg

SEQ ID NO: 21837 - DNA, 20 bp, Artificial Sequence
  Synthetic oligonucleotide; TGG chr11 5341231 5341250 5341247 +
aagcaagtgcatactgaagc

SEQ ID NO: 21838 - DNA, 20 bp, Artificial Sequence
  Synthetic oligonucleotide; GAG chr11 5341233 5341252 5341249 +
gcaagtgcatactgaagctg

SEQ ID NO: 21839 - DNA, 20 bp, Artificial Sequence
  Synthetic oligonucleotide; TAG chr11 5341238 5341257 5341254 +
tgcatactgaagctggagct

SEQ ID NO: 21840 - DNA, 20 bp, Artificial Sequence
  Synthetic oligonucleotide; CAG chr11 5341244 5341263 5341260 +
ctgaagctggagcttagctt

SEQ ID NO: 21841 - DNA, 20 bp, Artificial Sequence
  Synthetic oligonucleotide; AAG chr11 5341247 5341266 5341263 +
aagctggagcttagcttcag

SEQ ID NO: 21842 - DNA, 20 bp, Artificial Sequence
  Synthetic oligonucleotide; AGG chr11 5341248 5341267 5341264 +
agctggagcttagcttcaga

SEQ ID NO: 21843 - DNA, 20 bp, Artificial Sequence
  Synthetic oligonucleotide; AAG chr11 5341252 5341271 5341268 +
ggagcttagcttcagaaggc

SEQ ID NO: 21844 - DNA, 20 bp, Artificial Sequence
  Synthetic oligonucleotide; GAG chr11 5341254 5341273 5341270 +
agcttagcttcagaaggcaa

SEQ ID NO: 21845 - DNA, 20 bp, Artificial Sequence
  Synthetic oligonucleotide; AGG chr11 5341255 5341274 5341271 +
gcttagcttcagaaggcaag

SEQ ID NO: 21846 - DNA, 20 bp, Artificial Sequence
  Synthetic oligonucleotide; GGG chr11 5341256 5341275 5341272 +
cttagcttcagaaggcaaga

SEQ ID NO: 21847 - DNA, 20 bp, Artificial Sequence
  Synthetic oligonucleotide; CAG chr11 5341260 5341279 5341276 +
gcttcagaaggcaagagggt

SEQ ID NO: 21848 - DNA, 20 bp, Artificial Sequence
  Synthetic oligonucleotide; TGG chr11 5341273 5341292 5341289 +
agagggtcagtatttgccta

SEQ ID NO: 21849 - DNA, 20 bp, Artificial Sequence
  Synthetic oligonucleotide; AAG chr11 5341286 5341305 5341302 +
ttgcctatggcctgctacct

SEQ ID NO: 21850 - DNA, 20 bp, Artificial Sequence
  Synthetic oligonucleotide; AGG chr11 5341287 5341306 5341303 +
tgcctatggcctgctaccta

SEQ ID NO: 21851 - DNA, 20 bp, Artificial Sequence
  Synthetic oligonucleotide; GAG chr11 5341289 5341308 5341305 +
cctatggcctgctacctaag

SEQ ID NO: 21852 - DNA, 20 bp, Artificial Sequence
  Synthetic oligonucleotide; CAG chr11 5341292 5341311 5341308 +
atggcctgctacctaaggag

SEQ ID NO: 21853 - DNA, 20 bp, Artificial Sequence
  Synthetic oligonucleotide; AGG chr11 5341293 5341312 5341309 +
tggcctgctacctaaggagc

SEQ ID NO: 21854 - DNA, 20 bp, Artificial Sequence
  Synthetic oligonucleotide; GGG chr11 5341294 5341313 5341310 +
ggcctgctacctaaggagca

SEQ ID NO: 21855 - DNA, 20 bp, Artificial Sequence
  Synthetic oligonucleotide; GGG chr11 5341295 5341314 5341311 +
gcctgctacctaaggagcag

SEQ ID NO: 21856 - DNA, 20 bp, Artificial Sequence
  Synthetic oligonucleotide; AAG chr11 5341311 5341330 5341327 +
gcaggggccattttcttcat

SEQ ID NO: 21857 - DNA, 20 bp, Artificial Sequence
  Synthetic oligonucleotide; GAG chr11 5341326 5341345 5341342 +
ttcataagacatttcctgct

SEQ ID NO: 21858 - DNA, 20 bp, Artificial Sequence
  Synthetic oligonucleotide; GAG chr11 5341331 5341350 5341347 +
aagacatttcctgctgagtt

SEQ ID NO: 21859 - DNA, 20 bp, Artificial Sequence
  Synthetic oligonucleotide; CAG chr11 5341346 5341365 5341362 +
gagttgagaacaacaacctg

SEQ ID NO: 21860 - DNA, 20 bp, Artificial Sequence
  Synthetic oligonucleotide; AAG chr11 5341350 5341369 5341366 +
tgagaacaacaacctgcaga

SEQ ID NO: 21861 - DNA, 20 bp, Artificial Sequence
  Synthetic oligonucleotide; CAG chr11 5341353 5341372 5341369 +
gaacaacaacctgcagaaag

SEQ ID NO: 21862 - DNA, 20 bp, Artificial Sequence
  Synthetic oligonucleotide; GAG chr11 5341369 5341388 5341385 +
aaagcagaaacatgaacaat

SEQ ID NO: 21863 - DNA, 20 bp, Artificial Sequence
  Synthetic oligonucleotide; CAG chr11 5341372 5341391 5341388 +
gcagaaacatgaacaatgag

SEQ ID NO: 21864 - DNA, 20 bp, Artificial Sequence
  Synthetic oligonucleotide; CAG chr11 5341385 5341404 5341401 +
caatgagcagccaacattca

SEQ ID NO: 21865 - DNA, 20 bp, Artificial Sequence
  Synthetic oligonucleotide; AGG chr11 5341386 5341405 5341402 +
aatgagcagccaacattcac

SEQ ID NO: 21866 - DNA, 20 bp, Artificial Sequence
  Synthetic oligonucleotide; CGG chr11 5341410 5341429 5341426 +
gcacaattctgtaaaatgat

SEQ ID NO: 21867 - DNA, 20 bp, Artificial Sequence
  Synthetic oligonucleotide; GGG chr11 5341411 5341430 5341427 +
cacaattctgtaaaatgatc

SEQ ID NO: 21868 - DNA, 20 bp, Artificial Sequence
  Synthetic oligonucleotide; GGG chr11 5341412 5341431 5341428 +
acaattctgtaaaatgatcg

SEQ ID NO: 21869 - DNA, 20 bp, Artificial Sequence
  Synthetic oligonucleotide; AAG chr11 5341425 5341444 5341441 +
atgatcggggtaaaacacca

SEQ ID NO: 21870 - DNA, 20 bp, Artificial Sequence
  Synthetic oligonucleotide; TAG chr11 5341449 5341468 5341465 +
cataaacaatatcttctata

SEQ ID NO: 21871 - DNA, 20 bp, Artificial Sequence
  Synthetic oligonucleotide; AAG chr11 5341472 5341491 5341488 +
tcccctctcttgtctcactg

SEQ ID NO: 21872 - DNA, 20 bp, Artificial Sequence
  Synthetic oligonucleotide; AAG chr11 5341495 5341514 5341511 +
tattatttttgctctgatta

SEQ ID NO: 21873 - DNA, 20 bp, Artificial Sequence
  Synthetic oligonucleotide; AAG chr11 5341505 5341524 5341521 +
gctctgattaaagtataatt

SEQ ID NO: 21874 - DNA, 20 bp, Artificial Sequence
  Synthetic oligonucleotide; TAG chr11 5341526 5341545 5341542 +
agacataacctccctctttt

SEQ ID NO: 21875 - DNA, 20 bp, Artificial Sequence
  Synthetic oligonucleotide; AGG chr11 5341527 5341546 5341543 +
gacataacctccctcttttt

SEQ ID NO: 21876 - DNA, 20 bp, Artificial Sequence
  Synthetic oligonucleotide; GAG chr11 5341542 5341561 5341558 +
tttttaggatattttaaatt

SEQ ID NO: 21877 - DNA, 20 bp, Artificial Sequence
  Synthetic oligonucleotide; TGG chr11 5341548 5341567 5341564 +
ggatattttaaattgagtta

SEQ ID NO: 21878 - DNA, 20 bp, Artificial Sequence
  Synthetic oligonucleotide; GGG chr11 5341549 5341568 5341565 +
gatattttaaattgagttat

SEQ ID NO: 21879 - DNA, 20 bp, Artificial Sequence
  Synthetic oligonucleotide; CAG chr11 5341568 5341587 5341584 +
tgggtcccttcctaactcat

SEQ ID NO: 21880 - DNA, 20 bp, Artificial Sequence
  Synthetic oligonucleotide; GAG chr11 5341587 5341606 5341603 +
tcagacaattttaatcaaat

SEQ ID NO: 21881 - DNA, 20 bp, Artificial Sequence
  Synthetic oligonucleotide; TGG chr11 5341610 5341629 5341626 +
aatgacattgttgtattctt

SEQ ID NO: 21882 - DNA, 20 bp, Artificial Sequence
  Synthetic oligonucleotide; GGG chr11 5341611 5341630 5341627 +
atgacattgttgtattcttt

SEQ ID NO: 21883 - DNA, 20 bp, Artificial Sequence
  Synthetic oligonucleotide; TGG chr11 5341632 5341651 5341648 +
ggaaatttacacttattaca

SEQ ID NO: 21884 - DNA, 20 bp, Artificial Sequence
  Synthetic oligonucleotide; CAG chr11 5341638 5341657 5341654 +
ttacacttattacatggaat

SEQ ID NO: 21885 - DNA, 20 bp, Artificial Sequence
  Synthetic oligonucleotide; CAG chr11 5341651 5341670 5341667 +
atggaatcagaatgtatgta

SEQ ID NO: 21886 - DNA, 20 bp, Artificial Sequence
  Synthetic oligonucleotide; AAG chr11 5341655 5341674 5341671 +
aatcagaatgtatgtacaga

SEQ ID NO: 21887 - DNA, 20 bp, Artificial Sequence
  Synthetic oligonucleotide; CAG chr11 5341679 5341698 5341695 +
aatcattcttcaaaaaaatg

SEQ ID NO: 21888 - DNA, 20 bp, Artificial Sequence
  Synthetic oligonucleotide; CAG chr11 5341705 5341724 5341721 +
cctatttttttttgttcctt

SEQ ID NO: 21889 - DNA, 20 bp, Artificial Sequence
  Synthetic oligonucleotide; TAG chr11 5341718 5341737 5341734 +
gttccttcagacctttttca

SEQ ID NO: 21890 - DNA, 20 bp, Artificial Sequence
  Synthetic oligonucleotide; AAG chr11 5341724 5341743 5341740 +
tcagacctttttcatagcaa

SEQ ID NO: 21891 - DNA, 20 bp, Artificial Sequence
  Synthetic oligonucleotide; AGG chr11 5341725 5341744 5341741 +
cagacctttttcatagcaaa

SEQ ID NO: 21892 - DNA, 20 bp, Artificial Sequence
  Synthetic oligonucleotide; GAG chr11 5341727 5341746 5341743 +
gacctttttcatagcaaaag

SEQ ID NO: 21893 - DNA, 20 bp, Artificial Sequence
  Synthetic oligonucleotide; AGG chr11 5341728 5341747 5341744 +
acctttttcatagcaaaagg

SEQ ID NO: 21894 - DNA, 20 bp, Artificial Sequence
  Synthetic oligonucleotide; GGG chr11 5341729 5341748 5341745 +
cctttttcatagcaaaagga

SEQ ID NO: 21895 - DNA, 20 bp, Artificial Sequence
  Synthetic oligonucleotide; AAG chr11 5341734 5341753 5341750 +
ttcatagcaaaaggagggtg

SEQ ID NO: 21896 - DNA, 20 bp, Artificial Sequence
  Synthetic oligonucleotide; AGG chr11 5341735 5341754 5341751 +
tcatagcaaaaggagggtga

SEQ ID NO: 21897 - DNA, 20 bp, Artificial Sequence
  Synthetic oligonucleotide; TGG chr11 5341758 5341777 5341774 +
aactgtctcttccactaatt

SEQ ID NO: 21898 - DNA, 20 bp, Artificial Sequence
  Synthetic oligonucleotide; TAG chr11 5341763 5341782 5341779 +
tctcttccactaatttggac

SEQ ID NO: 21899 - DNA, 20 bp, Artificial Sequence
  Synthetic oligonucleotide; CAG chr11 5341767 5341786 5341783 +
ttccactaatttggactagt

SEQ ID NO: 21900 - DNA, 20 bp, Artificial Sequence
  Synthetic oligonucleotide; CAG chr11 5341771 5341790 5341787 +
actaatttggactagtcagc

SEQ ID NO: 21901 - DNA, 20 bp, Artificial Sequence
  Synthetic oligonucleotide; TAG chr11 5341776 5341795 5341792 +
tttggactagtcagccagcg

SEQ ID NO: 21902 - DNA, 20 bp, Artificial Sequence
  Synthetic oligonucleotide; GAG chr11 5341785 5341804 5341801 +
gtcagccagcgtagatatct

SEQ ID NO: 21903 - DNA, 20 bp, Artificial Sequence
  Synthetic oligonucleotide; AGG chr11 5341786 5341805 5341802 +
tcagccagcgtagatatctg

SEQ ID NO: 21904 - DNA, 20 bp, Artificial Sequence
  Synthetic oligonucleotide; TGG chr11 5341790 5341809 5341806 +
ccagcgtagatatctgagga

SEQ ID NO: 21905 - DNA, 20 bp, Artificial Sequence
  Synthetic oligonucleotide; TGG chr11 5341802 5341821 5341818 +
tctgaggatggcctcaacat

SEQ ID NO: 21906 - DNA, 20 bp, Artificial Sequence
  Synthetic oligonucleotide; GAG chr11 5341804 5341823 5341820 +
tgaggatggcctcaacattg

SEQ ID NO: 21907 - DNA, 20 bp, Artificial Sequence
  Synthetic oligonucleotide; TAG chr11 5341808 5341827 5341824 +
gatggcctcaacattggagc

SEQ ID NO: 21908 - DNA, 20 bp, Artificial Sequence
  Synthetic oligonucleotide; TAG chr11 5341815 5341834 5341831 +
tcaacattggagctagcaac

SEQ ID NO: 21909 - DNA, 20 bp, Artificial Sequence
  Synthetic oligonucleotide; AGG chr11 5341816 5341835 5341832 +
caacattggagctagcaact

SEQ ID NO: 21910 - DNA, 20 bp, Artificial Sequence
  Synthetic oligonucleotide; GGG chr11 5341817 5341836 5341833 +
aacattggagctagcaacta

SEQ ID NO: 21911 - DNA, 20 bp, Artificial Sequence
  Synthetic oligonucleotide; TAG chr11 5341820 5341839 5341836 +
attggagctagcaactaggg

SEQ ID NO: 21912 - DNA, 20 bp, Artificial Sequence
  Synthetic oligonucleotide; TAG chr11 5341823 5341842 5341839 +
ggagctagcaactagggtag

SEQ ID NO: 21913 - DNA, 20 bp, Artificial Sequence
  Synthetic oligonucleotide; AAG chr11 5341829 5341848 5341845 +
agcaactagggtagtagaat

SEQ ID NO: 21914 - DNA, 20 bp, Artificial Sequence
  Synthetic oligonucleotide; GAG chr11 5341835 5341854 5341851 +
tagggtagtagaataagaat

SEQ ID NO: 21915 - DNA, 20 bp, Artificial Sequence
  Synthetic oligonucleotide; GAG chr11 5341837 5341856 5341853 +
gggtagtagaataagaatga

SEQ ID NO: 21916 - DNA, 20 bp, Artificial Sequence
  Synthetic oligonucleotide; AAG chr11 5341841 5341860 5341857 +
agtagaataagaatgagagc

SEQ ID NO: 21917 - DNA, 20 bp, Artificial Sequence
  Synthetic oligonucleotide; TAG chr11 5341845 5341864 5341861 +
gaataagaatgagagcaaga

SEQ ID NO: 21918 - DNA, 20 bp, Artificial Sequence
  Synthetic oligonucleotide; AAG chr11 5341848 5341867 5341864 +
taagaatgagagcaagatag

SEQ ID NO: 21919 - DNA, 20 bp, Artificial Sequence
  Synthetic oligonucleotide; AGG chr11 5341849 5341868 5341865 +
aagaatgagagcaagataga

SEQ ID NO: 21920 - DNA, 20 bp, Artificial Sequence
  Synthetic oligonucleotide; GAG chr11 5341851 5341870 5341867 +
gaatgagagcaagatagaag

SEQ ID NO: 21921 - DNA, 20 bp, Artificial Sequence
  Synthetic oligonucleotide; AGG chr11 5341852 5341871 5341868 +
aatgagagcaagatagaagg

SEQ ID NO: 21922 - DNA, 20 bp, Artificial Sequence
  Synthetic oligonucleotide; AAG chr11 5341917 5341936 5341933 +
ttctcacatttttttgttac

SEQ ID NO: 21923 - DNA, 20 bp, Artificial Sequence
  Synthetic oligonucleotide; CAG chr11 5341925 5341944 5341941 +
tttttttgttacaagtttgt

SEQ ID NO: 21924 - DNA, 20 bp, Artificial Sequence
  Synthetic oligonucleotide; AAG chr11 5341928 5341947 5341944 +
ttttgttacaagtttgtcag

SEQ ID NO: 21925 - DNA, 20 bp, Artificial Sequence
  Synthetic oligonucleotide; AGG chr11 5341929 5341948 5341945 +
tttgttacaagtttgtcaga

SEQ ID NO: 21926 - DNA, 20 bp, Artificial Sequence
  Synthetic oligonucleotide; TGG chr11 5341940 5341959 5341956 +
tttgtcagaaggtactgcct

SEQ ID NO: 21927 - DNA, 20 bp, Artificial Sequence
  Synthetic oligonucleotide; GGG chr11 5341941 5341960 5341957 +
ttgtcagaaggtactgcctt

SEQ ID NO: 21928 - DNA, 20 bp, Artificial Sequence
  Synthetic oligonucleotide; GGG chr11 5341942 5341961 5341958 +
tgtcagaaggtactgccttg

SEQ ID NO: 21929 - DNA, 20 bp, Artificial Sequence
  Synthetic oligonucleotide; GAG chr11 5341954 5341973 5341970 +
ctgccttggggaataaatat

SEQ ID NO: 21930 - DNA, 20 bp, Artificial Sequence
  Synthetic oligonucleotide; TGG chr11 5341961 5341980 5341977 +
ggggaataaatatgagttta

SEQ ID NO: 21931 - DNA, 20 bp, Artificial Sequence
  Synthetic oligonucleotide; GAG chr11 5341969 5341988 5341985 +
aatatgagtttatggttttt

SEQ ID NO: 21932 - DNA, 20 bp, Artificial Sequence
  Synthetic oligonucleotide; TGG chr11 5341992 5342011 5342008 +
acaaattcattataatttga

SEQ ID NO: 21933 - DNA, 20 bp, Artificial Sequence
  Synthetic oligonucleotide; GAG chr11 5341994 5342013 5342010 +
aaattcattataatttgatg

SEQ ID NO: 21934 - DNA, 20 bp, Artificial Sequence
  Synthetic oligonucleotide; AGG chr11 5341995 5342014 5342011 +
aattcattataatttgatgg

SEQ ID NO: 21935 - DNA, 20 bp, Artificial Sequence
  Synthetic oligonucleotide; GGG chr11 5341996 5342015 5342012 +
attcattataatttgatgga

SEQ ID NO: 21936 - DNA, 20 bp, Artificial Sequence
  Synthetic oligonucleotide; GAG chr11 5341998 5342017 5342014 +
tcattataatttgatggagg

SEQ ID NO: 21937 - DNA, 20 bp, Artificial Sequence
  Synthetic oligonucleotide; AGG chr11 5341999 5342018 5342015 +
cattataatttgatggaggg

SEQ ID NO: 21938 - DNA, 20 bp, Artificial Sequence
  Synthetic oligonucleotide; GAG chr11 5342001 5342020 5342017 +
ttataatttgatggagggag

SEQ ID NO: 21939 - DNA, 20 bp, Artificial Sequence
  Synthetic oligonucleotide; AGG chr11 5342002 5342021 5342018 +
tataatttgatggagggagg

SEQ ID NO: 21940 - DNA, 20 bp, Artificial Sequence
  Synthetic oligonucleotide; TAG chr11 5342012 5342031 5342028 +
tggagggaggaggaaccaac

SEQ ID NO: 21941 - DNA, 20 bp, Artificial Sequence
  Synthetic oligonucleotide; GAG chr11 5342021 5342040 5342037 +
gaggaaccaactagactgtt

SEQ ID NO: 21942 - DNA, 20 bp, Artificial Sequence
  Synthetic oligonucleotide; AAG chr11 5342029 5342048 5342045 +
aactagactgttgagatgat

SEQ ID NO: 21943 - DNA, 20 bp, Artificial Sequence
  Synthetic oligonucleotide; TAG chr11 5342036 5342055 5342052 +
ctgttgagatgataagtaat

SEQ ID NO: 21944 - DNA, 20 bp, Artificial Sequence
  Synthetic oligonucleotide; AGG chr11 5342037 5342056 5342053 +
tgttgagatgataagtaatt

SEQ ID NO: 21945 - DNA, 20 bp, Artificial Sequence
  Synthetic oligonucleotide; AAG chr11 5342050 5342069 5342066 +
agtaattaggtcactgatca

SEQ ID NO: 21946 - DNA, 20 bp, Artificial Sequence
  Synthetic oligonucleotide; AAG chr11 5342053 5342072 5342069 +
aattaggtcactgatcaaag

SEQ ID NO: 21947 - DNA, 20 bp, Artificial Sequence
  Synthetic oligonucleotide; CAG chr11 5342072 5342091 5342088 +
gaagattatattcttttttg

SEQ ID NO: 21948 - DNA, 20 bp, Artificial Sequence
  Synthetic oligonucleotide; AGG chr11 5342073 5342092 5342089 +
aagattatattcttttttgc

SEQ ID NO: 21949 - DNA, 20 bp, Artificial Sequence
  Synthetic oligonucleotide; TGG chr11 5342084 5342103 5342100 +
cttttttgcaggaaaattcc

SEQ ID NO: 21950 - DNA, 20 bp, Artificial Sequence
  Synthetic oligonucleotide; CAG chr11 5342091 5342110 5342107 +
gcaggaaaattcctggactt

SEQ ID NO: 21951 - DNA, 20 bp, Artificial Sequence
  Synthetic oligonucleotide; TAG chr11 5342106 5342125 5342122 +
gacttcagtgaccaaattta

SEQ ID NO: 21952 - DNA, 20 bp, Artificial Sequence
  Synthetic oligonucleotide; AGG chr11 5342107 5342126 5342123 +
acttcagtgaccaaatttat

SEQ ID NO: 21953 - DNA, 20 bp, Artificial Sequence
  Synthetic oligonucleotide; TGG chr11 5342125 5342144 5342141 +
ataggttcccattgtttgta

SEQ ID NO: 21954 - DNA, 20 bp, Artificial Sequence
  Synthetic oligonucleotide; CAG chr11 5342135 5342154 5342151 +
attgtttgtatggacacctg

SEQ ID NO: 21955 - DNA, 20 bp, Artificial Sequence
  Synthetic oligonucleotide; GAG chr11 5342137 5342156 5342153 +
tgtttgtatggacacctgca

SEQ ID NO: 21956 - DNA, 20 bp, Artificial Sequence
  Synthetic oligonucleotide; AAG chr11 5342148 5342167 5342164 +
acacctgcagagaaattcat

SEQ ID NO: 21957 - DNA, 20 bp, Artificial Sequence
  Synthetic oligonucleotide; GAG chr11 5342150 5342169 5342166 +
acctgcagagaaattcataa

SEQ ID NO: 21958 - DNA, 20 bp, Artificial Sequence
  Synthetic oligonucleotide; TGG chr11 5342154 5342173 5342170 +
gcagagaaattcataagagt

SEQ ID NO: 21959 - DNA, 20 bp, Artificial Sequence
  Synthetic oligonucleotide; TAG chr11 5342161 5342180 5342177 +
aattcataagagttggaaat

SEQ ID NO: 21960 - DNA, 20 bp, Artificial Sequence
  Synthetic oligonucleotide; TAG chr11 5342172 5342191 5342188 +
gttggaaattagatttgaca

SEQ ID NO: 21961 - DNA, 20 bp, Artificial Sequence
  Synthetic oligonucleotide; TAG chr11 5342277 5342296 5342293 +
accatgaaataaacatatgt

SEQ ID NO: 21962 - DNA, 20 bp, Artificial Sequence
  Synthetic oligonucleotide; TAG chr11 5342288 5342307 5342304 +
aacatatgttagttacatta

SEQ ID NO: 21963 - DNA, 20 bp, Artificial Sequence
  Synthetic oligonucleotide; TAG chr11 5342300 5342319 5342316 +
ttacattatagacataccaa

SEQ ID NO: 21964 - DNA, 20 bp, Artificial Sequence
  Synthetic oligonucleotide; AAG chr11 5342309 5342328 5342325 +
agacataccaatagatgcct

SEQ ID NO: 21965 - DNA, 20 bp, Artificial Sequence
  Synthetic oligonucleotide; AGG chr11 5342310 5342329 5342326 +
gacataccaatagatgccta

SEQ ID NO: 21966 - DNA, 20 bp, Artificial Sequence
  Synthetic oligonucleotide; TAG chr11 5342332 5342351 5342348 +
gtattgttatcacaataatt

SEQ ID NO: 21967 - DNA, 20 bp, Artificial Sequence
  Synthetic oligonucleotide; TGG chr11 5342335 5342354 5342351 +
ttgttatcacaataatttag

SEQ ID NO: 21968 - DNA, 20 bp, Artificial Sequence
  Synthetic oligonucleotide; AAG chr11 5342339 5342358 5342355 +
tatcacaataatttagtgga

SEQ ID NO: 21969 - DNA, 20 bp, Artificial Sequence
  Synthetic oligonucleotide; TAG chr11 5342344 5342363 5342360 +
caataatttagtggaaagct

SEQ ID NO: 21970 - DNA, 20 bp, Artificial Sequence
  Synthetic oligonucleotide; GAG chr11 5342346 5342365 5342362 +
ataatttagtggaaagctta

SEQ ID NO: 21971 - DNA, 20 bp, Artificial Sequence
  Synthetic oligonucleotide; CAG chr11 5342363 5342382 5342379 +
ttagagaaatattccgttta

SEQ ID NO: 21972 - DNA, 20 bp, Artificial Sequence
  Synthetic oligonucleotide; AGG chr11 5342364 5342383 5342380 +
tagagaaatattccgtttac

SEQ ID NO: 21973 - DNA, 20 bp, Artificial Sequence
  Synthetic oligonucleotide; TAG chr11 5342397 5342416 5342413 +
aaatttgtacaaactacatt

SEQ ID NO: 21974 - DNA, 20 bp, Artificial Sequence
  Synthetic oligonucleotide; AAG chr11 5342403 5342422 5342419 +
gtacaaactacatttagcta

SEQ ID NO: 21975 - DNA, 20 bp, Artificial Sequence
  Synthetic oligonucleotide; GAG chr11 5342405 5342424 5342421 +
acaaactacatttagctaaa

SEQ ID NO: 21976 - DNA, 20 bp, Artificial Sequence
  Synthetic oligonucleotide; TGG chr11 5342409 5342428 5342425 +
actacatttagctaaagagt

SEQ ID NO: 21977 - DNA, 20 bp, Artificial Sequence
  Synthetic oligonucleotide; GGG chr11 5342410 5342429 5342426 +
ctacatttagctaaagagtt

SEQ ID NO: 21978 - DNA, 20 bp, Artificial Sequence
  Synthetic oligonucleotide; AAG chr11 5342417 5342436 5342433 +
tagctaaagagttgggctta

SEQ ID NO: 21979 - DNA, 20 bp, Artificial Sequence
  Synthetic oligonucleotide; GAG chr11 5342419 5342438 5342435 +
gctaaagagttgggcttaaa

SEQ ID NO: 21980 - DNA, 20 bp, Artificial Sequence
  Synthetic oligonucleotide; TAG chr11 5342428 5342447 5342444 +
ttgggcttaaagagatacct

SEQ ID NO: 21981 - DNA, 20 bp, Artificial Sequence
  Synthetic oligonucleotide; AGG chr11 5342429 5342448 5342445 +
tgggcttaaagagatacctt

SEQ ID NO: 21982 - DNA, 20 bp, Artificial Sequence
  Synthetic oligonucleotide; GGG chr11 5342430 5342449 5342446 +
gggcttaaagagatacctta

SEQ ID NO: 21983 - DNA, 20 bp, Artificial Sequence
  Synthetic oligonucleotide; AAG chr11 5342440 5342459 5342456 +
agataccttagggaaacttg

SEQ ID NO: 21984 - DNA, 20 bp, Artificial Sequence
  Synthetic oligonucleotide; AAG chr11 5342467 5342486 5342483 +
attttaacacctattttacc

SEQ ID NO: 21985 - DNA, 20 bp, Artificial Sequence
  Synthetic oligonucleotide; GAG chr11 5342476 5342495 5342492 +
cctattttaccaagtcatat

SEQ ID NO: 21986 - DNA, 20 bp, Artificial Sequence
  Synthetic oligonucleotide; TAG chr11 5342488 5342507 5342504 +
agtcatatgagcatgcatgc

SEQ ID NO: 21987 - DNA, 20 bp, Artificial Sequence
  Synthetic oligonucleotide; GAG chr11 5342495 5342514 5342511 +
tgagcatgcatgctagatat

SEQ ID NO: 21988 - DNA, 20 bp, Artificial Sequence
  Synthetic oligonucleotide; TAG chr11 5342523 5342542 5342539 +
tttgctctcctgctaaatat

SEQ ID NO: 21989 - DNA, 20 bp, Artificial Sequence
  Synthetic oligonucleotide; GAG chr11 5342525 5342544 5342541 +
tgctctcctgctaaatatta

SEQ ID NO: 21990 - DNA, 20 bp, Artificial Sequence
  Synthetic oligonucleotide; GAG chr11 5342542 5342561 5342558 +
ttagagtttttacattctgt

SEQ ID NO: 21991 - DNA, 20 bp, Artificial Sequence
  Synthetic oligonucleotide; GAG chr11 5342544 5342563 5342560 +
agagtttttacattctgtga

SEQ ID NO: 21992 - DNA, 20 bp, Artificial Sequence
  Synthetic oligonucleotide; TGG chr11 5342560 5342579 5342576 +
gtgagagtgactgtgatgat

SEQ ID NO: 21993 - DNA, 20 bp, Artificial Sequence
  Synthetic oligonucleotide; GAG chr11 5342562 5342581 5342578 +
gagagtgactgtgatgattg

SEQ ID NO: 21994 - DNA, 20 bp, Artificial Sequence
  Synthetic oligonucleotide; CAG chr11 5342567 5342586 5342583 +
tgactgtgatgattggagat

SEQ ID NO: 21995 - DNA, 20 bp, Artificial Sequence
  Synthetic oligonucleotide; AGG chr11 5342568 5342587 5342584 +
gactgtgatgattggagatc

SEQ ID NO: 21996 - DNA, 20 bp, Artificial Sequence
  Synthetic oligonucleotide; TGG chr11 5342582 5342601 5342598 +
gagatcaggttccaattcta

SEQ ID NO: 21997 - DNA, 20 bp, Artificial Sequence
  Synthetic oligonucleotide; GGG chr11 5342583 5342602 5342599 +
agatcaggttccaattctat

SEQ ID NO: 21998 - DNA, 20 bp, Artificial Sequence
  Synthetic oligonucleotide; TAG chr11 5342586 5342605 5342602 +
tcaggttccaattctatggg

SEQ ID NO: 21999 - DNA, 20 bp, Artificial Sequence
  Synthetic oligonucleotide; AAG chr11 5342593 5342612 5342609 +
ccaattctatgggtagtaaa

SEQ ID NO: 22000 - DNA, 20 bp, Artificial Sequence
  Synthetic oligonucleotide; AGG chr11 5342594 5342613 5342610 +
caattctatgggtagtaaaa

SEQ ID NO: 22001 - DNA, 20 bp, Artificial Sequence
  Synthetic oligonucleotide; AAG chr11 5342599 5342618 5342615 +
ctatgggtagtaaaaaggtg

SEQ ID NO: 22002 - DNA, 20 bp, Artificial Sequence
  Synthetic oligonucleotide; TGG chr11 5342604 5342623 5342620 +
ggtagtaaaaaggtgaagaa

SEQ ID NO: 22003 - DNA, 20 bp, Artificial Sequence
  Synthetic oligonucleotide; TGG chr11 5342622 5342641 5342638 +
aatggcattctgaatctgct

SEQ ID NO: 22004 - DNA, 20 bp, Artificial Sequence
  Synthetic oligonucleotide; TAG chr11 5342643 5342662 5342659 +
ggtcttgacactatatgtta

SEQ ID NO: 22005 - DNA, 20 bp, Artificial Sequence
  Synthetic oligonucleotide; AGG chr11 5342644 5342663 5342660 +
gtcttgacactatatgttat

SEQ ID NO: 22006 - DNA, 20 bp, Artificial Sequence
  Synthetic oligonucleotide; TAG chr11 5342653 5342672 5342669 +
ctatatgttataggattcat

SEQ ID NO: 22007 - DNA, 20 bp, Artificial Sequence
  Synthetic oligonucleotide; TGG chr11 5342656 5342675 5342672 +
tatgttataggattcattag

SEQ ID NO: 22008 - DNA, 20 bp, Artificial Sequence
  Synthetic oligonucleotide; GAG chr11 5342658 5342677 5342674 +
tgttataggattcattagtg

SEQ ID NO: 22009 - DNA, 20 bp, Artificial Sequence
  Synthetic oligonucleotide; AGG chr11 5342659 5342678 5342675 +
gttataggattcattagtgg

SEQ ID NO: 22010 - DNA, 20 bp, Artificial Sequence
  Synthetic oligonucleotide; GGG chr11 5342660 5342679 5342676 +
ttataggattcattagtgga

SEQ ID NO: 22011 - DNA, 20 bp, Artificial Sequence
  Synthetic oligonucleotide; CAG chr11 5342665 5342684 5342681 +
ggattcattagtggagggaa

SEQ ID NO: 22012 - DNA, 20 bp, Artificial Sequence
  Synthetic oligonucleotide; TAG chr11 5342672 5342691 5342688 +
ttagtggagggaacagaaaa

SEQ ID NO: 22013 - DNA, 20 bp, Artificial Sequence
  Synthetic oligonucleotide; AGG chr11 5342673 5342692 5342689 +
tagtggagggaacagaaaat

SEQ ID NO: 22014 - DNA, 20 bp, Artificial Sequence
  Synthetic oligonucleotide; TAG chr11 5342678 5342697 5342694 +
gagggaacagaaaataggca

SEQ ID NO: 22015 - DNA, 20 bp, Artificial Sequence
  Synthetic oligonucleotide; GAG chr11 5342689 5342708 5342705 +
aaataggcatagctcataat

SEQ ID NO: 22016 - DNA, 20 bp, Artificial Sequence
  Synthetic oligonucleotide; AGG chr11 5342690 5342709 5342706 +
aataggcatagctcataatg

SEQ ID NO: 22017 - DNA, 20 bp, Artificial Sequence
  Synthetic oligonucleotide; TGG chr11 5342704 5342723 5342720 +
ataatgaggtgaacaatatg

SEQ ID NO: 22018 - DNA, 20 bp, Artificial Sequence
  Synthetic oligonucleotide; CAG chr11 5342731 5342750 5342747 +
tgctttccaaaacgatgaat

SEQ ID NO: 22019 - DNA, 20 bp, Artificial Sequence
  Synthetic oligonucleotide; GAG chr11 5342733 5342752 5342749 +
ctttccaaaacgatgaatca

SEQ ID NO: 22020 - DNA, 20 bp, Artificial Sequence
  Synthetic oligonucleotide; CAG chr11 5342764 5342783 5342780 +
atcactgtgacataaaaaac

SEQ ID NO: 22021 - DNA, 20 bp, Artificial Sequence
  Synthetic oligonucleotide; AGG chr11 5342765 5342784 5342781 +
tcactgtgacataaaaaacc

SEQ ID NO: 22022 - DNA, 20 bp, Artificial Sequence
  Synthetic oligonucleotide; CAG chr11 5342771 5342790 5342787 +
tgacataaaaaaccaggaca

SEQ ID NO: 22023 - DNA, 20 bp, Artificial Sequence
  Synthetic oligonucleotide; CAG chr11 5342774 5342793 5342790 +
cataaaaaaccaggacacag

SEQ ID NO: 22024 - DNA, 20 bp, Artificial Sequence
  Synthetic oligonucleotide; TGG chr11 5342780 5342799 5342796 +
aaaccaggacacagcagata

SEQ ID NO: 22025 - DNA, 20 bp, Artificial Sequence
  Synthetic oligonucleotide; GGG chr11 5342781 5342800 5342797 +
aaccaggacacagcagatat

SEQ ID NO: 22026 - DNA, 20 bp, Artificial Sequence
  Synthetic oligonucleotide; GAG chr11 5342783 5342802 5342799 +
ccaggacacagcagatatgg

SEQ ID NO: 22027 - DNA, 20 bp, Artificial Sequence
  Synthetic oligonucleotide; CAG chr11 5342789 5342808 5342805 +
cacagcagatatgggagaca

SEQ ID NO: 22028 - DNA, 20 bp, Artificial Sequence
  Synthetic oligonucleotide; AGG chr11 5342790 5342809 5342806 +
acagcagatatgggagacac

SEQ ID NO: 22029 - DNA, 20 bp, Artificial Sequence
  Synthetic oligonucleotide; GAG chr11 5342797 5342816 5342813 +
atatgggagacacaggtaat

SEQ ID NO: 22030 - DNA, 20 bp, Artificial Sequence
  Synthetic oligonucleotide; GAG chr11 5342799 5342818 5342815 +
atgggagacacaggtaatga

SEQ ID NO: 22031 - DNA, 20 bp, Artificial Sequence
  Synthetic oligonucleotide; TGG chr11 5342805 5342824 5342821 +
gacacaggtaatgagagcct

SEQ ID NO: 22032 - DNA, 20 bp, Artificial Sequence
  Synthetic oligonucleotide; TGG chr11 5342820 5342839 5342836 +
agccttggccctctcctctc

SEQ ID NO: 22033 - DNA, 20 bp, Artificial Sequence
  Synthetic oligonucleotide; GAG chr11 5342822 5342841 5342838 +
ccttggccctctcctctctg

SEQ ID NO: 22034 - DNA, 20 bp, Artificial Sequence
  Synthetic oligonucleotide; AGG chr11 5342823 5342842 5342839 +
cttggccctctcctctctgg

SEQ ID NO: 22035 - DNA, 20 bp, Artificial Sequence
  Synthetic oligonucleotide; CAG chr11 5342833 5342852 5342849 +
tcctctctggaggcaatgct

SEQ ID NO: 22036 - DNA, 20 bp, Artificial Sequence
  Synthetic oligonucleotide; AGG chr11 5342834 5342853 5342850 +
cctctctggaggcaatgctc

SEQ ID NO: 22037 - DNA, 20 bp, Artificial Sequence
  Synthetic oligonucleotide; CAG chr11 5342838 5342857 5342854 +
tctggaggcaatgctcagga

SEQ ID NO: 22038 - DNA, 20 bp, Artificial Sequence
  Synthetic oligonucleotide; GAG chr11 5342845 5342864 5342861 +
gcaatgctcaggacagtctt

SEQ ID NO: 22039 - DNA, 20 bp, Artificial Sequence
  Synthetic oligonucleotide; TAG chr11 5342858 5342877 5342874 +
cagtcttgagtatcaacaca

SEQ ID NO: 22040 - DNA, 20 bp, Artificial Sequence
  Synthetic oligonucleotide; AGG chr11 5342859 5342878 5342875 +
agtcttgagtatcaacacat

SEQ ID NO: 22041 - DNA, 20 bp, Artificial Sequence
  Synthetic oligonucleotide; GAG chr11 5342861 5342880 5342877 +
tcttgagtatcaacacatag

SEQ ID NO: 22042 - DNA, 20 bp, Artificial Sequence
  Synthetic oligonucleotide; AAG chr11 5342867 5342886 5342883 +
gtatcaacacataggagatg

SEQ ID NO: 22043 - DNA, 20 bp, Artificial Sequence
  Synthetic oligonucleotide; CAG chr11 5342875 5342894 5342891 +
acataggagatgaagataat

SEQ ID NO: 22044 - DNA, 20 bp, Artificial Sequence
  Synthetic oligonucleotide; CAG chr11 5342884 5342903 5342900 +
atgaagataatcagataatc

SEQ ID NO: 22045 - DNA, 20 bp, Artificial Sequence
  Synthetic oligonucleotide; AAG chr11 5342897 5342916 5342913 +
gataatccagcacaaatata

SEQ ID NO: 22046 - DNA, 20 bp, Artificial Sequence
  Synthetic oligonucleotide; AAG chr11 5342905 5342924 5342921 +
agcacaaatataaagactac

SEQ ID NO: 22047 - DNA, 20 bp, Artificial Sequence
  Synthetic oligonucleotide; CAG chr11 5342910 5342929 5342926 +
aaatataaagactacaagca

SEQ ID NO: 22048 - DNA, 20 bp, Artificial Sequence
  Synthetic oligonucleotide; TGG chr11 5342914 5342933 5342930 +
ataaagactacaagcacagc

SEQ ID NO: 22049 - DNA, 20 bp, Artificial Sequence
  Synthetic oligonucleotide; GGG chr11 5342915 5342934 5342931 +
taaagactacaagcacagct

SEQ ID NO: 22050 - DNA, 20 bp, Artificial Sequence
  Synthetic oligonucleotide; CAG chr11 5342920 5342939 5342936 +
actacaagcacagctgggta

SEQ ID NO: 22051 - DNA, 20 bp, Artificial Sequence
  Synthetic oligonucleotide; CGG chr11 5342924 5342943 5342940 +
caagcacagctgggtacagt

SEQ ID NO: 22052 - DNA, 20 bp, Artificial Sequence
  Synthetic oligonucleotide; AAG chr11 5342930 5342949 5342946 +
cagctgggtacagtcggttg

SEQ ID NO: 22053 - DNA, 20 bp, Artificial Sequence
  Synthetic oligonucleotide; AGG chr11 5342931 5342950 5342947 +
agctgggtacagtcggttga

SEQ ID NO: 22054 - DNA, 20 bp, Artificial Sequence
  Synthetic oligonucleotide; TGG chr11 5342934 5342953 5342950 +
tgggtacagtcggttgaagg

SEQ ID NO: 22055 - DNA, 20 bp, Artificial Sequence
  Synthetic oligonucleotide; CAG chr11 5342940 5342959 5342956 +
cagtcggttgaaggtggtat

SEQ ID NO: 22056 - DNA, 20 bp, Artificial Sequence
  Synthetic oligonucleotide; CAG chr11 5342945 5342964 5342961 +
ggttgaaggtggtatcagca

SEQ ID NO: 22057 - DNA, 20 bp, Artificial Sequence
  Synthetic oligonucleotide; AGG chr11 5342946 5342965 5342962 +
gttgaaggtggtatcagcac

SEQ ID NO: 22058 - DNA, 20 bp, Artificial Sequence
  Synthetic oligonucleotide; GAG chr11 5342950 5342969 5342966 +
aaggtggtatcagcacaggc

SEQ ID NO: 22059 - DNA, 20 bp, Artificial Sequence
  Synthetic oligonucleotide; TGG chr11 5342966 5342985 5342982 +
aggcgagtttaatgacatcc

SEQ ID NO: 22060 - DNA, 20 bp, Artificial Sequence
  Synthetic oligonucleotide; AAG chr11 5342971 5342990 5342987 +
agtttaatgacatcctggtg

SEQ ID NO: 22061 - DNA, 20 bp, Artificial Sequence
  Synthetic oligonucleotide; AGG chr11 5342972 5342991 5342988 +
gtttaatgacatcctggtga

SEQ ID NO: 22062 - DNA, 20 bp, Artificial Sequence
  Synthetic oligonucleotide; CAG chr11 5342975 5342994 5342991 +
taatgacatcctggtgaagg

SEQ ID NO: 22063 - DNA, 20 bp, Artificial Sequence
  Synthetic oligonucleotide; AAG chr11 5342989 5343008 5343005 +
tgaaggcagaatgcatgtga

SEQ ID NO: 22064 - DNA, 20 bp, Artificial Sequence
  Synthetic oligonucleotide; TGG chr11 5342996 5343015 5343012 +
agaatgcatgtgaaagaaca

SEQ ID NO: 22065 - DNA, 20 bp, Artificial Sequence
  Synthetic oligonucleotide; GGG chr11 5342997 5343016 5343013 +
gaatgcatgtgaaagaacat

SEQ ID NO: 22066 - DNA, 20 bp, Artificial Sequence
  Synthetic oligonucleotide; GAG chr11 5342999 5343018 5343015 +
atgcatgtgaaagaacatgg

SEQ ID NO: 22067 - DNA, 20 bp, Artificial Sequence
  Synthetic oligonucleotide; CAG chr11 5343010 5343029 5343026 +
agaacatgggagtgacaata

SEQ ID NO: 22068 - DNA, 20 bp, Artificial Sequence
  Synthetic oligonucleotide; TAG chr11 5343020 5343039 5343036 +
agtgacaatacagaaaaaaa

SEQ ID NO: 22069 - DNA, 20 bp, Artificial Sequence
  Synthetic oligonucleotide; GAG chr11 5343022 5343041 5343038 +
tgacaatacagaaaaaaata

SEQ ID NO: 22070 - DNA, 20 bp, Artificial Sequence
  Synthetic oligonucleotide; AGG chr11 5343023 5343042 5343039 +
gacaatacagaaaaaaatag

SEQ ID NO: 22071 - DNA, 20 bp, Artificial Sequence
  Synthetic oligonucleotide; GGG chr11 5343024 5343043 5343040 +
acaatacagaaaaaaataga

SEQ ID NO: 22072 - DNA, 20 bp, Artificial Sequence
  Synthetic oligonucleotide; GGG chr11 5343025 5343044 5343041 +
caatacagaaaaaaatagag

SEQ ID NO: 22073 - DNA, 20 bp, Artificial Sequence
  Synthetic oligonucleotide; TGG chr11 5343034 5343053 5343050 +
aaaaaatagaggggcctgat

SEQ ID NO: 22074 - DNA, 20 bp, Artificial Sequence
  Synthetic oligonucleotide; GGG chr11 5343035 5343054 5343051 +
aaaaatagaggggcctgatt

SEQ ID NO: 22075 - DNA, 20 bp, Artificial Sequence
  Synthetic oligonucleotide; GGG chr11 5343036 5343055 5343052 +
aaaatagaggggcctgattg

SEQ ID NO: 22076 - DNA, 20 bp, Artificial Sequence
  Synthetic oligonucleotide; GGG chr11 5343037 5343056 5343053 +
aaatagaggggcctgattgg

SEQ ID NO: 22077 - DNA, 20 bp, Artificial Sequence
  Synthetic oligonucleotide; CGG chr11 5343045 5343064 5343061 +
gggcctgattgggggaacaa

SEQ ID NO: 22078 - DNA, 20 bp, Artificial Sequence
  Synthetic oligonucleotide; CAG chr11 5343064 5343083 5343080 +
acggatacaaatcccctcat

SEQ ID NO: 22079 - DNA, 20 bp, Artificial Sequence
  Synthetic oligonucleotide; CAG chr11 5343073 5343092 5343089 +
aatcccctcatcagaactcc

SEQ ID NO: 22080 - DNA, 20 bp, Artificial Sequence
  Synthetic oligonucleotide; GAG chr11 5343093 5343112 5343109 +
cagcccaatcttcactactc

SEQ ID NO: 22081 - DNA, 20 bp, Artificial Sequence
  Synthetic oligonucleotide; TAG chr11 5343099 5343118 5343115 +
aatcttcactactcgagtat

SEQ ID NO: 22082 - DNA, 20 bp, Artificial Sequence
  Synthetic oligonucleotide; AAG chr11 5343103 5343122 5343119 +
ttcactactcgagtattagt

SEQ ID NO: 22083 - DNA, 20 bp, Artificial Sequence
  Synthetic oligonucleotide; CAG chr11 5343108 5343127 5343124 +
tactcgagtattagtaagta

SEQ ID NO: 22084 - DNA, 20 bp, Artificial Sequence
  Synthetic oligonucleotide; GAG chr11 5343110 5343129 5343126 +
ctcgagtattagtaagtaca

SEQ ID NO: 22085 - DNA, 20 bp, Artificial Sequence
  Synthetic oligonucleotide; AGG chr11 5343111 5343130 5343127 +
tcgagtattagtaagtacag

SEQ ID NO: 22086 - DNA, 20 bp, Artificial Sequence
  Synthetic oligonucleotide; AAG chr11 5343121 5343140 5343137 +
gtaagtacagaggtatatct

SEQ ID NO: 22087 - DNA, 20 bp, Artificial Sequence
  Synthetic oligonucleotide; GAG chr11 5343123 5343142 5343139 +
aagtacagaggtatatctaa

SEQ ID NO: 22088 - DNA, 20 bp, Artificial Sequence
  Synthetic oligonucleotide; AGG chr11 5343124 5343143 5343140 +
agtacagaggtatatctaag

SEQ ID NO: 22089 - DNA, 20 bp, Artificial Sequence
  Synthetic oligonucleotide; GGG chr11 5343125 5343144 5343141 +
gtacagaggtatatctaaga

SEQ ID NO: 22090 - DNA, 20 bp, Artificial Sequence
  Synthetic oligonucleotide; CAG chr11 5343131 5343150 5343147 +
aggtatatctaagagggttg

SEQ ID NO: 22091 - DNA, 20 bp, Artificial Sequence
  Synthetic oligonucleotide; TGG chr11 5343135 5343154 5343151 +
atatctaagagggttgcaga

SEQ ID NO: 22092 - DNA, 20 bp, Artificial Sequence
  Synthetic oligonucleotide; CGG chr11 5343146 5343165 5343162 +
ggttgcagatggcaataaaa

SEQ ID NO: 22093 - DNA, 20 bp, Artificial Sequence
  Synthetic oligonucleotide; TAG chr11 5343152 5343171 5343168 +
agatggcaataaaacggtca

SEQ ID NO: 22094 - DNA, 20 bp, Artificial Sequence
  Synthetic oligonucleotide; AGG chr11 5343153 5343172 5343169 +
gatggcaataaaacggtcat

SEQ ID NO: 22095 - DNA, 20 bp, Artificial Sequence
  Synthetic oligonucleotide; TGG chr11 5343159 5343178 5343175 +
aataaaacggtcataggcca

SEQ ID NO: 22096 - DNA, 20 bp, Artificial Sequence
  Synthetic oligonucleotide; AAG chr11 5343163 5343182 5343179 +
aaacggtcataggccatggc

SEQ ID NO: 22097 - DNA, 20 bp, Artificial Sequence
  Synthetic oligonucleotide; CAG chr11 5343166 5343185 5343182 +
cggtcataggccatggcaag

SEQ ID NO: 22098 - DNA, 20 bp, Artificial Sequence
  Synthetic oligonucleotide; CAG chr11 5343174 5343193 5343190 +
ggccatggcaagcagaatgc

SEQ ID NO: 22099 - DNA, 20 bp, Artificial Sequence
  Synthetic oligonucleotide; GAG chr11 5343181 5343200 5343197 +
gcaagcagaatgccagactc

SEQ ID NO: 22100 - DNA, 20 bp, Artificial Sequence
  Synthetic oligonucleotide; AAG chr11 5343185 5343204 5343201 +
gcagaatgccagactcgaga

SEQ ID NO: 22101 - DNA, 20 bp, Artificial Sequence
  Synthetic oligonucleotide; AGG chr11 5343186 5343205 5343202 +
cagaatgccagactcgagaa

SEQ ID NO: 22102 - DNA, 20 bp, Artificial Sequence
  Synthetic oligonucleotide; AAG chr11 5343190 5343209 5343206 +
atgccagactcgagaaagga

SEQ ID NO: 22103 - DNA, 20 bp, Artificial Sequence
  Synthetic oligonucleotide; GAG chr11 5343194 5343213 5343210 +
cagactcgagaaaggaaagt

SEQ ID NO: 22104 - DNA, 20 bp, Artificial Sequence
  Synthetic oligonucleotide; AAG chr11 5343203 5343222 5343219 +
gaaaggaaagtgagtgtata

SEQ ID NO: 22105 - DNA, 20 bp, Artificial Sequence
  Synthetic oligonucleotide; TAG chr11 5343206 5343225 5343222 +
aggaaagtgagtgtataaag

SEQ ID NO: 22106 - DNA, 20 bp, Artificial Sequence
  Synthetic oligonucleotide; AGG chr11 5343207 5343226 5343223 +
ggaaagtgagtgtataaagt

SEQ ID NO: 22107 - DNA, 20 bp, Artificial Sequence
  Synthetic oligonucleotide; TGG chr11 5343212 5343231 5343228 +
gtgagtgtataaagtaggcc

SEQ ID NO: 22108 - DNA, 20 bp, Artificial Sequence
  Synthetic oligonucleotide; GGG chr11 5343213 5343232 5343229 +
tgagtgtataaagtaggcct

SEQ ID NO: 22109 - DNA, 20 bp, Artificial Sequence
  Synthetic oligonucleotide; AAG chr11 5343218 5343237 5343234 +
gtataaagtaggcctgggaa

SEQ ID NO: 22110 - DNA, 20 bp, Artificial Sequence
  Synthetic oligonucleotide; CAG chr11 5343221 5343240 5343237 +
taaagtaggcctgggaaaag

SEQ ID NO: 22111 - DNA, 20 bp, Artificial Sequence
  Synthetic oligonucleotide; AGG chr11 5343222 5343241 5343238 +
aaagtaggcctgggaaaagc

SEQ ID NO: 22112 - DNA, 20 bp, Artificial Sequence
  Synthetic oligonucleotide; CAG chr11 5343250 5343269 5343266 +
cttccaatctccctgtgatc

SEQ ID NO: 22113 - DNA, 20 bp, Artificial Sequence
  Synthetic oligonucleotide; CAG chr11 5343254 5343273 5343270 +
caatctccctgtgatccagc

SEQ ID NO: 22114 - DNA, 20 bp, Artificial Sequence
  Synthetic oligonucleotide; GAG chr11 5343256 5343275 5343272 +
atctccctgtgatccagcca

SEQ ID NO: 22115 - DNA, 20 bp, Artificial Sequence
  Synthetic oligonucleotide; AGG chr11 5343257 5343276 5343273 +
tctccctgtgatccagccag

SEQ ID NO: 22116 - DNA, 20 bp, Artificial Sequence
  Synthetic oligonucleotide; CAG chr11 5343265 5343284 5343281 +
tgatccagccagaggactcc

SEQ ID NO: 22117 - DNA, 20 bp, Artificial Sequence
  Synthetic oligonucleotide; TGG chr11 5343273 5343292 5343289 +
ccagaggactcccagcaccg

SEQ ID NO: 22118 - DNA, 20 bp, Artificial Sequence
  Synthetic oligonucleotide; GGG chr11 5343274 5343293 5343290 +
cagaggactcccagcaccgt

SEQ ID NO: 22119 - DNA, 20 bp, Artificial Sequence
  Synthetic oligonucleotide; TGG chr11 5343282 5343301 5343298 +
tcccagcaccgtgggcattg

SEQ ID NO: 22120 - DNA, 20 bp, Artificial Sequence
  Synthetic oligonucleotide; CAG chr11 5343286 5343305 5343302 +
agcaccgtgggcattgtggt

SEQ ID NO: 22121 - DNA, 20 bp, Artificial Sequence
  Synthetic oligonucleotide; AGG chr11 5343287 5343306 5343303 +
gcaccgtgggcattgtggtc

SEQ ID NO: 22122 - DNA, 20 bp, Artificial Sequence
  Synthetic oligonucleotide; GGG chr11 5343288 5343307 5343304 +
caccgtgggcattgtggtca

SEQ ID NO: 22123 - DNA, 20 bp, Artificial Sequence
  Synthetic oligonucleotide; CAG chr11 5343292 5343311 5343308 +
gtgggcattgtggtcagggc

SEQ ID NO: 22124 - DNA, 20 bp, Artificial Sequence
  Synthetic oligonucleotide; CAG chr11 5343298 5343317 5343314 +
attgtggtcagggccagccc

SEQ ID NO: 22125 - DNA, 20 bp, Artificial Sequence
  Synthetic oligonucleotide; AGG chr11 5343299 5343318 5343315 +
ttgtggtcagggccagcccc

SEQ ID NO: 22126 - DNA, 20 bp, Artificial Sequence
  Synthetic oligonucleotide; TGG chr11 5343306 5343325 5343322 +
cagggccagccccaggtctg

SEQ ID NO: 22127 - DNA, 20 bp, Artificial Sequence
  Synthetic oligonucleotide; CAG chr11 5343309 5343328 5343325 +
ggccagccccaggtctgtgg

SEQ ID NO: 22128 - DNA, 20 bp, Artificial Sequence
  Synthetic oligonucleotide; CAG chr11 5343313 5343332 5343329 +
agccccaggtctgtggcagc

SEQ ID NO: 22129 - DNA, 20 bp, Artificial Sequence
  Synthetic oligonucleotide; TGG chr11 5343318 5343337 5343334 +
caggtctgtggcagccagca

SEQ ID NO: 22130 - DNA, 20 bp, Artificial Sequence
  Synthetic oligonucleotide; CAG chr11 5343322 5343341 5343338 +
tctgtggcagccagcatggc

SEQ ID NO: 22131 - DNA, 20 bp, Artificial Sequence
  Synthetic oligonucleotide; AAG chr11 5343326 5343345 5343342 +
tggcagccagcatggccaga

SEQ ID NO: 22132 - DNA, 20 bp, Artificial Sequence
  Synthetic oligonucleotide; AAG chr11 5343329 5343348 5343345 +
cagccagcatggccagaaag

SEQ ID NO: 22133 - DNA, 20 bp, Artificial Sequence
  Synthetic oligonucleotide; TGG chr11 5343336 5343355 5343352 +
catggccagaaagaagtaca

SEQ ID NO: 22134 - DNA, 20 bp, Artificial Sequence
  Synthetic oligonucleotide; GGG chr11 5343337 5343356 5343353 +
atggccagaaagaagtacat

SEQ ID NO: 22135 - DNA, 20 bp, Artificial Sequence
  Synthetic oligonucleotide; AAG chr11 5343346 5343365 5343362 +
aagaagtacatgggctcatg

SEQ ID NO: 22136 - DNA, 20 bp, Artificial Sequence
  Synthetic oligonucleotide; GAG chr11 5343367 5343386 5343383 +
agattgtgatcttccttaat

SEQ ID NO: 22137 - DNA, 20 bp, Artificial Sequence
  Synthetic oligonucleotide; AAG chr11 5343370 5343389 5343386 +
ttgtgatcttccttaatgag

SEQ ID NO: 22138 - DNA, 20 bp, Artificial Sequence
  Synthetic oligonucleotide; AAG chr11 5343373 5343392 5343389 +
tgatcttccttaatgagaag

SEQ ID NO: 22139 - DNA, 20 bp, Artificial Sequence
  Synthetic oligonucleotide; AGG chr11 5343374 5343393 5343390 +
gatcttccttaatgagaaga

SEQ ID NO: 22140 - DNA, 20 bp, Artificial Sequence
  Synthetic oligonucleotide; GAG chr11 5343376 5343395 5343392 +
tcttccttaatgagaagaag

SEQ ID NO: 22141 - DNA, 20 bp, Artificial Sequence
  Synthetic oligonucleotide; AGG chr11 5343377 5343396 5343393 +
cttccttaatgagaagaagg

SEQ ID NO: 22142 - DNA, 20 bp, Artificial Sequence
  Synthetic oligonucleotide; GGG chr11 5343378 5343397 5343394 +
ttccttaatgagaagaagga

SEQ ID NO: 22143 - DNA, 20 bp, Artificial Sequence
  Synthetic oligonucleotide; AAG chr11 5343394 5343413 5343410 +
aggagggtgccattgccaaa

SEQ ID NO: 22144 - DNA, 20 bp, Artificial Sequence
  Synthetic oligonucleotide; AGG chr11 5343395 5343414 5343411 +
ggagggtgccattgccaaaa

SEQ ID NO: 22145 - DNA, 20 bp, Artificial Sequence
  Synthetic oligonucleotide; TGG chr11 5343399 5343418 5343415 +
ggtgccattgccaaaaagga

SEQ ID NO: 22146 - DNA, 20 bp, Artificial Sequence
  Synthetic oligonucleotide; AAG chr11 5343416 5343435 5343432 +
ggatggatatatacatgaac

SEQ ID NO: 22147 - DNA, 20 bp, Artificial Sequence
  Synthetic oligonucleotide; CGG chr11 5343426 5343445 5343442 +
atacatgaacaagaaaaata

SEQ ID NO: 22148 - DNA, 20 bp, Artificial Sequence
  Synthetic oligonucleotide; CAG chr11 5343434 5343453 5343450 +
acaagaaaaatacggaaatc

SEQ ID NO: 22149 - DNA, 20 bp, Artificial Sequence
  Synthetic oligonucleotide; GAG chr11 5343441 5343460 5343457 +
aaatacggaaatccagtgat

SEQ ID NO: 22150 - DNA, 20 bp, Artificial Sequence
  Synthetic oligonucleotide; AAG chr11 5343452 5343471 5343468 +
tccagtgatgagcttcctcc

SEQ ID NO: 22151 - DNA, 20 bp, Artificial Sequence
  Synthetic oligonucleotide; TGG chr11 5343457 5343476 5343473 +
tgatgagcttcctccaagcc

SEQ ID NO: 22152 - DNA, 20 bp, Artificial Sequence
  Synthetic oligonucleotide; CAG chr11 5343465 5343484 5343481 +
ttcctccaagcctggaaaac

SEQ ID NO: 22153 - DNA, 20 bp, Artificial Sequence
  Synthetic oligonucleotide; TAG chr11 5343472 5343491 5343488 +
aagcctggaaaaccagtcaa

SEQ ID NO: 22154 - DNA, 20 bp, Artificial Sequence
  Synthetic oligonucleotide; AGG chr11 5343473 5343492 5343489 +
agcctggaaaaccagtcaat

SEQ ID NO: 22155 - DNA, 20 bp, Artificial Sequence
  Synthetic oligonucleotide; AAG chr11 5343476 5343495 5343492 +
ctggaaaaccagtcaatagg

SEQ ID NO: 22156 - DNA, 20 bp, Artificial Sequence
  Synthetic oligonucleotide; AGG chr11 5343477 5343496 5343493 +
tggaaaaccagtcaatagga

SEQ ID NO: 22157 - DNA, 20 bp, Artificial Sequence
  Synthetic oligonucleotide; GGG chr11 5343478 5343497 5343494 +
ggaaaaccagtcaataggaa

SEQ ID NO: 22158 - DNA, 20 bp, Artificial Sequence
  Synthetic oligonucleotide; TGG chr11 5343482 5343501 5343498 +
aaccagtcaataggaaggga

SEQ ID NO: 22159 - DNA, 20 bp, Artificial Sequence
  Synthetic oligonucleotide; GGG chr11 5343483 5343502 5343499 +
accagtcaataggaagggat

SEQ ID NO: 22160 - DNA, 20 bp, Artificial Sequence
  Synthetic oligonucleotide; GAG chr11 5343485 5343504 5343501 +
cagtcaataggaagggatgg

SEQ ID NO: 22161 - DNA, 20 bp, Artificial Sequence
  Synthetic oligonucleotide; TGG chr11 5343495 5343514 5343511 +
gaagggatgggagctgccgc

SEQ ID NO: 22162 - DNA, 20 bp, Artificial Sequence
  Synthetic oligonucleotide; TGG chr11 5343507 5343526 5343523 +
gctgccgctggacgacatcc

SEQ ID NO: 22163 - DNA, 20 bp, Artificial Sequence
  Synthetic oligonucleotide; GGG chr11 5343508 5343527 5343524 +
ctgccgctggacgacatcct

SEQ ID NO: 22164 - DNA, 20 bp, Artificial Sequence
  Synthetic oligonucleotide; TAG chr11 5343517 5343536 5343533 +
gacgacatcctgggtttata

SEQ ID NO: 22165 - DNA, 20 bp, Artificial Sequence
  Synthetic oligonucleotide; AAG chr11 5343520 5343539 5343536 +
gacatcctgggtttatatag

SEQ ID NO: 22166 - DNA, 20 bp, Artificial Sequence
  Synthetic oligonucleotide; CAG chr11 5343551 5343570 5343567 +
ttctgtttctgttattacca

SEQ ID NO: 22167 - DNA, 20 bp, Artificial Sequence
  Synthetic oligonucleotide; CAG chr11 5343558 5343577 5343574 +
tctgttattaccacagtgca

SEQ ID NO: 22168 - DNA, 20 bp, Artificial Sequence
  Synthetic oligonucleotide; AAG chr11 5343571 5343590 5343587 +
cagtgcacagttctaccttc

SEQ ID NO: 22169 - DNA, 20 bp, Artificial Sequence
  Synthetic oligonucleotide; AGG chr11 5343572 5343591 5343588 +
agtgcacagttctaccttca

SEQ ID NO: 22170 - DNA, 20 bp, Artificial Sequence
  Synthetic oligonucleotide; CAG chr11 5343598 5343617 5343614 +
cacttcgactatatcattct

SEQ ID NO: 22171 - DNA, 20 bp, Artificial Sequence
  Synthetic oligonucleotide; AAG chr11 5343613 5343632 5343629 +
attctcagaattttttccta

SEQ ID NO: 22172 - DNA, 20 bp, Artificial Sequence
  Synthetic oligonucleotide; AAG chr11 5343635 5343654 5343651 +
gataataatgacatcaatat

SEQ ID NO: 22173 - DNA, 20 bp, Artificial Sequence
  Synthetic oligonucleotide; CAG chr11 5343662 5343681 5343678 +
tgtttctcaaaatacattct

SEQ ID NO: 22174 - DNA, 20 bp, Artificial Sequence
  Synthetic oligonucleotide; AGG chr11 5343663 5343682 5343679 +
gtttctcaaaatacattctc

SEQ ID NO: 22175 - DNA, 20 bp, Artificial Sequence
  Synthetic oligonucleotide; GGG chr11 5343664 5343683 5343680 +
tttctcaaaatacattctca

SEQ ID NO: 22176 - DNA, 20 bp, Artificial Sequence
  Synthetic oligonucleotide; CAG chr11 5343702 5343721 5343718 +
gtattcttaactgcacattc

SEQ ID NO: 22177 - DNA, 20 bp, Artificial Sequence
  Synthetic oligonucleotide; AGG chr11 5343703 5343722 5343719 +
tattcttaactgcacattcc

SEQ ID NO: 22178 - DNA, 20 bp, Artificial Sequence
  Synthetic oligonucleotide; TGG chr11 5343736 5343755 5343752 +
tacctacgtaatcaaattct

SEQ ID NO: 22179 - DNA, 20 bp, Artificial Sequence
  Synthetic oligonucleotide; GAG chr11 5343738 5343757 5343754 +
cctacgtaatcaaattcttg

SEQ ID NO: 22180 - DNA, 20 bp, Artificial Sequence
  Synthetic oligonucleotide; AAG chr11 5343763 5343782 5343779 +
tcaactgtttatatgcattt

SEQ ID NO: 22181 - DNA, 20 bp, Artificial Sequence
  Synthetic oligonucleotide; CAG chr11 5343775 5343794 5343791 +
atgcatttaagcattctctt

SEQ ID NO: 22182 - DNA, 20 bp, Artificial Sequence
  Synthetic oligonucleotide; CAG chr11 5343827 5343846 5343843 +
aactgttacccttaactatg

SEQ ID NO: 22183 - DNA, 20 bp, Artificial Sequence
  Synthetic oligonucleotide; AAG chr11 5343836 5343855 5343852 +
ccttaactatgcagatttta

SEQ ID NO: 22184 - DNA, 20 bp, Artificial Sequence
  Synthetic oligonucleotide; TGG chr11 5343852 5343871 5343868 +
tttaaagaattcgtattcta

SEQ ID NO: 22185 - DNA, 20 bp, Artificial Sequence
  Synthetic oligonucleotide; GGG chr11 5343853 5343872 5343869 +
ttaaagaattcgtattctat

SEQ ID NO: 22186 - DNA, 20 bp, Artificial Sequence
  Synthetic oligonucleotide; GGG chr11 5343854 5343873 5343870 +
taaagaattcgtattctatg

SEQ ID NO: 22187 - DNA, 20 bp, Artificial Sequence
  Synthetic oligonucleotide; AAG chr11 5343862 5343881 5343878 +
tcgtattctatggggcattc

SEQ ID NO: 22188 - DNA, 20 bp, Artificial Sequence
  Synthetic oligonucleotide; AGG chr11 5343863 5343882 5343879 +
cgtattctatggggcattca

SEQ ID NO: 22189 - DNA, 20 bp, Artificial Sequence
  Synthetic oligonucleotide; GGG chr11 5343864 5343883 5343880 +
gtattctatggggcattcaa

SEQ ID NO: 22190 - DNA, 20 bp, Artificial Sequence
  Synthetic oligonucleotide; GGG chr11 5343865 5343884 5343881 +
tattctatggggcattcaag

SEQ ID NO: 22191 - DNA, 20 bp, Artificial Sequence
  Synthetic oligonucleotide; CAG chr11 5343873 5343892 5343889 +
ggggcattcaaggggatttc

SEQ ID NO: 22192 - DNA, 20 bp, Artificial Sequence
  Synthetic oligonucleotide; AAG chr11 5343877 5343896 5343893 +
cattcaaggggatttccaga

SEQ ID NO: 22193 - DNA, 20 bp, Artificial Sequence
  Synthetic oligonucleotide; TGG chr11 5343898 5343917 5343914 +
agctaacactaatttttttc

SEQ ID NO: 22194 - DNA, 20 bp, Artificial Sequence
  Synthetic oligonucleotide; CAG chr11 5343930 5343949 5343946 +
taaacctgtaattgccttca

SEQ ID NO: 22195 - DNA, 20 bp, Artificial Sequence
  Synthetic oligonucleotide; TAG chr11 5343933 5343952 5343949 +
acctgtaattgccttcacag

SEQ ID NO: 22196 - DNA, 20 bp, Artificial Sequence
  Synthetic oligonucleotide; AAG chr11 5343966 5343985 5343982 +
tccacattttcctgcatgta

SEQ ID NO: 22197 - DNA, 20 bp, Artificial Sequence
  Synthetic oligonucleotide; CAG chr11 5343984 5344003 5344000 +
taaagacttacctgaattat

SEQ ID NO: 22198 - DNA, 20 bp, Artificial Sequence
  Synthetic oligonucleotide; AAG chr11 5343990 5344009 5344006 +
cttacctgaattatcagcta

SEQ ID NO: 22199 - DNA, 20 bp, Artificial Sequence
  Synthetic oligonucleotide; CAG chr11 5343999 5344018 5344015 +
attatcagctaaagtctcaa

SEQ ID NO: 22200 - DNA, 20 bp, Artificial Sequence
  Synthetic oligonucleotide; AAG chr11 5344005 5344024 5344021 +
agctaaagtctcaacagcct

SEQ ID NO: 22201 - DNA, 20 bp, Artificial Sequence
  Synthetic oligonucleotide; AAG chr11 5344009 5344028 5344025 +
aaagtctcaacagcctaaga

SEQ ID NO: 22202 - DNA, 20 bp, Artificial Sequence
  Synthetic oligonucleotide; AAG chr11 5344014 5344033 5344030 +
ctcaacagcctaagaaagaa

SEQ ID NO: 22203 - DNA, 20 bp, Artificial Sequence
  Synthetic oligonucleotide; TGG chr11 5344019 5344038 5344035 +
cagcctaagaaagaaaagtg

SEQ ID NO: 22204 - DNA, 20 bp, Artificial Sequence
  Synthetic oligonucleotide; GGG chr11 5344020 5344039 5344036 +
agcctaagaaagaaaagtgt

SEQ ID NO: 22205 - DNA, 20 bp, Artificial Sequence
  Synthetic oligonucleotide; AAG chr11 5344023 5344042 5344039 +
ctaagaaagaaaagtgtggg

SEQ ID NO: 22206 - DNA, 20 bp, Artificial Sequence
  Synthetic oligonucleotide; GAG chr11 5344025 5344044 5344041 +
aagaaagaaaagtgtgggaa

SEQ ID NO: 22207 - DNA, 20 bp, Artificial Sequence
  Synthetic oligonucleotide; TAG chr11 5344048 5344067 5344064 +
aaactctgccactaccactg

SEQ ID NO: 22208 - DNA, 20 bp, Artificial Sequence
  Synthetic oligonucleotide; AAG chr11 5344053 5344072 5344069 +
ctgccactaccactgtagct

SEQ ID NO: 22209 - DNA, 20 bp, Artificial Sequence
  Synthetic oligonucleotide; AGG chr11 5344054 5344073 5344070 +
tgccactaccactgtagcta

SEQ ID NO: 22210 - DNA, 20 bp, Artificial Sequence
  Synthetic oligonucleotide; GAG chr11 5344056 5344075 5344072 +
ccactaccactgtagctaag

SEQ ID NO: 22211 - DNA, 20 bp, Artificial Sequence
  Synthetic oligonucleotide; CAG chr11 5344059 5344078 5344075 +
ctaccactgtagctaaggag

SEQ ID NO: 22212 - DNA, 20 bp, Artificial Sequence
  Synthetic oligonucleotide; CAG chr11 5344063 5344082 5344079 +
cactgtagctaaggagcagt

SEQ ID NO: 22213 - DNA, 20 bp, Artificial Sequence
  Synthetic oligonucleotide; GAG chr11 5344069 5344088 5344085 +
agctaaggagcagtcagatt

SEQ ID NO: 22214 - DNA, 20 bp, Artificial Sequence
  Synthetic oligonucleotide; AAG chr11 5344073 5344092 5344089 +
aaggagcagtcagattgaga

SEQ ID NO: 22215 - DNA, 20 bp, Artificial Sequence
  Synthetic oligonucleotide; GAG chr11 5344075 5344094 5344091 +
ggagcagtcagattgagaaa

SEQ ID NO: 22216 - DNA, 20 bp, Artificial Sequence
  Synthetic oligonucleotide; TGG chr11 5344083 5344102 5344099 +
cagattgagaaagagacact

SEQ ID NO: 22217 - DNA, 20 bp, Artificial Sequence
  Synthetic oligonucleotide; CAG chr11 5344090 5344109 5344106 +
agaaagagacacttggcctc

SEQ ID NO: 22218 - DNA, 20 bp, Artificial Sequence
  Synthetic oligonucleotide; TGG chr11 5344099 5344118 5344115 +
cacttggcctccagatttca

SEQ ID NO: 22219 - DNA, 20 bp, Artificial Sequence
  Synthetic oligonucleotide; TAG chr11 5344104 5344123 5344120 +
ggcctccagatttcatggac

SEQ ID NO: 22220 - DNA, 20 bp, Artificial Sequence
  Synthetic oligonucleotide; TGG chr11 5344110 5344129 5344126 +
cagatttcatggactagtga

SEQ ID NO: 22221 - DNA, 20 bp, Artificial Sequence
  Synthetic oligonucleotide; GGG chr11 5344111 5344130 5344127 +
agatttcatggactagtgat

SEQ ID NO: 22222 - DNA, 20 bp, Artificial Sequence
  Synthetic oligonucleotide; GGG chr11 5344112 5344131 5344128 +
gatttcatggactagtgatg

SEQ ID NO: 22223 - DNA, 20 bp, Artificial Sequence
  Synthetic oligonucleotide; CAG chr11 5344117 5344136 5344133 +
catggactagtgatggggaa

SEQ ID NO: 22224 - DNA, 20 bp, Artificial Sequence
  Synthetic oligonucleotide; TAG chr11 5344131 5344150 5344147 +
ggggaacagacattcacgat

SEQ ID NO: 22225 - DNA, 20 bp, Artificial Sequence
  Synthetic oligonucleotide; TAG chr11 5344151 5344170 5344167 +
tagtgtgaattaccctcttg

SEQ ID NO: 22226 - DNA, 20 bp, Artificial Sequence
  Synthetic oligonucleotide; CAG chr11 5344161 5344180 5344177 +
taccctcttgtagaatcctt

SEQ ID NO: 22227 - DNA, 20 bp, Artificial Sequence
  Synthetic oligonucleotide; TAG chr11 5344186 5344205 5344202 +
ctactcactacttgtgacaa

SEQ ID NO: 22228 - DNA, 20 bp, Artificial Sequence
  Synthetic oligonucleotide; CAG chr11 5344191 5344210 5344207 +
cactacttgtgacaatagct

SEQ ID NO: 22229 - DNA, 20 bp, Artificial Sequence
  Synthetic oligonucleotide; AAG chr11 5344203 5344222 5344219 +
caatagctcagtctaattat

SEQ ID NO: 22230 - DNA, 20 bp, Artificial Sequence
  Synthetic oligonucleotide; TAG chr11 5344207 5344226 5344223 +
agctcagtctaattataagt

SEQ ID NO: 22231 - DNA, 20 bp, Artificial Sequence
  Synthetic oligonucleotide; TGG chr11 5344214 5344233 5344230 +
tctaattataagttagactt

SEQ ID NO: 22232 - DNA, 20 bp, Artificial Sequence
  Synthetic oligonucleotide; GGG chr11 5344215 5344234 5344231 +
ctaattataagttagacttt

SEQ ID NO: 22233 - DNA, 20 bp, Artificial Sequence
  Synthetic oligonucleotide; GGG chr11 5344216 5344235 5344232 +
taattataagttagactttg

SEQ ID NO: 22234 - DNA, 20 bp, Artificial Sequence
  Synthetic oligonucleotide; TGG chr11 5344220 5344239 5344236 +
tataagttagactttggggc

SEQ ID NO: 22235 - DNA, 20 bp, Artificial Sequence
  Synthetic oligonucleotide; TAG chr11 5344233 5344252 5344249 +
ttggggctggaataaatgat

SEQ ID NO: 22236 - DNA, 20 bp, Artificial Sequence
  Synthetic oligonucleotide; AGG chr11 5344234 5344253 5344250 +
tggggctggaataaatgatt

SEQ ID NO: 22237 - DNA, 20 bp, Artificial Sequence
  Synthetic oligonucleotide; CAG chr11 5344238 5344257 5344254 +
gctggaataaatgattaggc

SEQ ID NO: 22238 - DNA, 20 bp, Artificial Sequence
  Synthetic oligonucleotide; AAG chr11 5344244 5344263 5344260 +
ataaatgattaggccagcca

SEQ ID NO: 22239 - DNA, 20 bp, Artificial Sequence
  Synthetic oligonucleotide; TAG chr11 5344260 5344279 5344276 +
gccaaagacatcacttataa

SEQ ID NO: 22240 - DNA, 20 bp, Artificial Sequence
  Synthetic oligonucleotide; CAG chr11 5344274 5344293 5344290 +
ttataatagtgtatctcctt

SEQ ID NO: 22241 - DNA, 20 bp, Artificial Sequence
  Synthetic oligonucleotide; AAG chr11 5344305 5344324 5344321 +
tcttactgtttcttatttac

SEQ ID NO: 22242 - DNA, 20 bp, Artificial Sequence
  Synthetic oligonucleotide; TAG chr11 5344308 5344327 5344324 +
tactgtttcttatttacaag

SEQ ID NO: 22243 - DNA, 20 bp, Artificial Sequence
  Synthetic oligonucleotide; TAG chr11 5344340 5344359 5344356 +
ctttttaaattatttttcta

SEQ ID NO: 22244 - DNA, 20 bp, Artificial Sequence
  Synthetic oligonucleotide; AGG chr11 5344341 5344360 5344357 +
tttttaaattatttttctat

SEQ ID NO: 22245 - DNA, 20 bp, Artificial Sequence
  Synthetic oligonucleotide; AAG chr11 5344351 5344370 5344367 +
atttttctataggcctactg

SEQ ID NO: 22246 - DNA, 20 bp, Artificial Sequence
  Synthetic oligonucleotide; TAG chr11 5344362 5344381 5344378 +
ggcctactgaagtaattccc

SEQ ID NO: 22247 - DNA, 20 bp, Artificial Sequence
  Synthetic oligonucleotide; AAG chr11 5344385 5344404 5344401 +
aatctgacctctctcatttc

SEQ ID NO: 22248 - DNA, 20 bp, Artificial Sequence
  Synthetic oligonucleotide; TGG chr11 5344419 5344438 5344435 +
tatttaaacatccatcttcc

SEQ ID NO: 22249 - DNA, 20 bp, Artificial Sequence
  Synthetic oligonucleotide; CAG chr11 5344440 5344459 5344456 +
ggtttccttccctttatccc

SEQ ID NO: 22250 - DNA, 20 bp, Artificial Sequence
  Synthetic oligonucleotide; TAG chr11 5344446 5344465 5344462 +
cttccctttatccccagcca

SEQ ID NO: 22251 - DNA, 20 bp, Artificial Sequence
  Synthetic oligonucleotide; AGG chr11 5344447 5344466 5344463 +
ttccctttatccccagccat

SEQ ID NO: 22252 - DNA, 20 bp, Artificial Sequence
  Synthetic oligonucleotide; GAG chr11 5344476 5344495 5344492 +
aatctgttctccccaatact

SEQ ID NO: 22253 - DNA, 20 bp, Artificial Sequence
  Synthetic oligonucleotide; GAG chr11 5344480 5344499 5344496 +
tgttctccccaatactgagt

SEQ ID NO: 22254 - DNA, 20 bp, Artificial Sequence
  Synthetic oligonucleotide; GAG chr11 5344482 5344501 5344498 +
ttctccccaatactgagtga

SEQ ID NO: 22255 - DNA, 20 bp, Artificial Sequence
  Synthetic oligonucleotide; TGG chr11 5344504 5344523 5344520 +
gctatttccctgcttaaacg

SEQ ID NO: 22256 - DNA, 20 bp, Artificial Sequence
  Synthetic oligonucleotide; AAG chr11 5344522 5344541 5344538 +
cgtggtgctgtcttttactg

SEQ ID NO: 22257 - DNA, 20 bp, Artificial Sequence
  Synthetic oligonucleotide; GAG chr11 5344524 5344543 5344540 +
tggtgctgtcttttactgaa

SEQ ID NO: 22258 - DNA, 20 bp, Artificial Sequence
  Synthetic oligonucleotide; AAG chr11 5344527 5344546 5344543 +
tgctgtcttttactgaagag

SEQ ID NO: 22259 - DNA, 20 bp, Artificial Sequence
  Synthetic oligonucleotide; GAG chr11 5344529 5344548 5344545 +
ctgtcttttactgaagagaa

SEQ ID NO: 22260 - DNA, 20 bp, Artificial Sequence
  Synthetic oligonucleotide; TAG chr11 5344534 5344553 5344550 +
ttttactgaagagaagagat

SEQ ID NO: 22261 - DNA, 20 bp, Artificial Sequence
  Synthetic oligonucleotide; GAG chr11 5344543 5344562 5344559 +
agagaagagattagtccttt

SEQ ID NO: 22262 - DNA, 20 bp, Artificial Sequence
  Synthetic oligonucleotide; AAG chr11 5344546 5344565 5344562 +
gaagagattagtcctttgag

SEQ ID NO: 22263 - DNA, 20 bp, Artificial Sequence
  Synthetic oligonucleotide; AGG chr11 5344547 5344566 5344563 +
aagagattagtcctttgaga

SEQ ID NO: 22264 - DNA, 20 bp, Artificial Sequence
  Synthetic oligonucleotide; TAG chr11 5344571 5344590 5344587 +
tttaatattccttctgccac

SEQ ID NO: 22265 - DNA, 20 bp, Artificial Sequence
  Synthetic oligonucleotide; TAG chr11 5344576 5344595 5344592 +
tattccttctgccactagac

SEQ ID NO: 22266 - DNA, 20 bp, Artificial Sequence
  Synthetic oligonucleotide; AGG chr11 5344577 5344596 5344593 +
attccttctgccactagact

SEQ ID NO: 22267 - DNA, 20 bp, Artificial Sequence
  Synthetic oligonucleotide; GGG chr11 5344578 5344597 5344594 +
ttccttctgccactagacta

SEQ ID NO: 22268 - DNA, 20 bp, Artificial Sequence
  Synthetic oligonucleotide; GGG chr11 5344579 5344598 5344595 +
tccttctgccactagactag

SEQ ID NO: 22269 - DNA, 20 bp, Artificial Sequence
  Synthetic oligonucleotide; TAG chr11 5344593 5344612 5344609 +
gactaggggcttcttgcata

SEQ ID NO: 22270 - DNA, 20 bp, Artificial Sequence
  Synthetic oligonucleotide; TGG chr11 5344599 5344618 5344615 +
gggcttcttgcatatagaca

SEQ ID NO: 22271 - DNA, 20 bp, Artificial Sequence
  Synthetic oligonucleotide; AAG chr11 5344631 5344650 5344647 +
gctttgctcaacaccttgca

SEQ ID NO: 22272 - DNA, 20 bp, Artificial Sequence
  Synthetic oligonucleotide; TAG chr11 5344663 5344682 5344679 +
tgtgactgataaacatttct

SEQ ID NO: 22273 - DNA, 20 bp, Artificial Sequence
  Synthetic oligonucleotide; CAG chr11 5344699 5344718 5344715 +
tgtgaacacgcatcatgtga

SEQ ID NO: 22274 - DNA, 20 bp, Artificial Sequence
  Synthetic oligonucleotide; AAG chr11 5344714 5344733 5344730 +
tgtgacagccatgatattta

SEQ ID NO: 22275 - DNA, 20 bp, Artificial Sequence
  Synthetic oligonucleotide; TGG chr11 5344722 5344741 5344738 +
ccatgatatttaaagctctc

SEQ ID NO: 22276 - DNA, 20 bp, Artificial Sequence
  Synthetic oligonucleotide; TGG chr11 5344732 5344751 5344748 +
taaagctctctggaattaaa

SEQ ID NO: 22277 - DNA, 20 bp, Artificial Sequence
  Synthetic oligonucleotide; AAG chr11 5344739 5344758 5344755 +
ctctggaattaaatggtaat

SEQ ID NO: 22278 - DNA, 20 bp, Artificial Sequence
  Synthetic oligonucleotide; AAG chr11 5344745 5344764 5344761 +
aattaaatggtaataagaca

SEQ ID NO: 22279 - DNA, 20 bp, Artificial Sequence
  Synthetic oligonucleotide; AAG chr11 5344773 5344792 5344789 +
aatcttataaaccataaatt

SEQ ID NO: 22280 - DNA, 20 bp, Artificial Sequence
  Synthetic oligonucleotide; AAG chr11 5344789 5344808 5344805 +
aattaagttgaaaaataaat

SEQ ID NO: 22281 - DNA, 20 bp, Artificial Sequence
  Synthetic oligonucleotide; AAG chr11 5344816 5344835 5344832 +
ttttaaacaaatataaatgc

SEQ ID NO: 22282 - DNA, 20 bp, Artificial Sequence
  Synthetic oligonucleotide; CAG chr11 5344831 5344850 5344847 +
aatgcaagtttaacataaaa

SEQ ID NO: 22283 - DNA, 20 bp, Artificial Sequence
  Synthetic oligonucleotide; TAG chr11 5344846 5344865 5344862 +
taaaacagtactacttgatg

SEQ ID NO: 22284 - DNA, 20 bp, Artificial Sequence
  Synthetic oligonucleotide; TGG chr11 5344855 5344874 5344871 +
actacttgatgtagattaat

SEQ ID NO: 22285 - DNA, 20 bp, Artificial Sequence
  Synthetic oligonucleotide; TGG chr11 5344859 5344878 5344875 +
cttgatgtagattaattgga

SEQ ID NO: 22286 - DNA, 20 bp, Artificial Sequence
  Synthetic oligonucleotide; AAG chr11 5344872 5344891 5344888 +
aattggatggtattgtatac

SEQ ID NO: 22287 - DNA, 20 bp, Artificial Sequence
  Synthetic oligonucleotide; TAG chr11 5344876 5344895 5344892 +
ggatggtattgtatacaaga

SEQ ID NO: 22288 - DNA, 20 bp, Artificial Sequence
  Synthetic oligonucleotide; TAG chr11 5344881 5344900 5344897 +
gtattgtatacaagatagta

SEQ ID NO: 22289 - DNA, 20 bp, Artificial Sequence
  Synthetic oligonucleotide; CAG chr11 5344884 5344903 5344900 +
ttgtatacaagatagtatag

SEQ ID NO: 22290 - DNA, 20 bp, Artificial Sequence
  Synthetic oligonucleotide; GAG chr11 5344890 5344909 5344906 +
acaagatagtatagcagttt

SEQ ID NO: 22291 - DNA, 20 bp, Artificial Sequence
  Synthetic oligonucleotide; AGG chr11 5344891 5344910 5344907 +
caagatagtatagcagtttg

SEQ ID NO: 22292 - DNA, 20 bp, Artificial Sequence
  Synthetic oligonucleotide; GGG chr11 5344892 5344911 5344908 +
aagatagtatagcagtttga

SEQ ID NO: 22293 - DNA, 20 bp, Artificial Sequence
  Synthetic oligonucleotide; GGG chr11 5344893 5344912 5344909 +
agatagtatagcagtttgag

SEQ ID NO: 22294 - DNA, 20 bp, Artificial Sequence
  Synthetic oligonucleotide; TAG chr11 5344898 5344917 5344914 +
gtatagcagtttgaggggcc

SEQ ID NO: 22295 - DNA, 20 bp, Artificial Sequence
  Synthetic oligonucleotide; GAG chr11 5344913 5344932 5344929 +
gggcctagaactgcacctat

SEQ ID NO: 22296 - DNA, 20 bp, Artificial Sequence
  Synthetic oligonucleotide; AGG chr11 5344914 5344933 5344930 +
ggcctagaactgcacctatg

SEQ ID NO: 22297 - DNA, 20 bp, Artificial Sequence
  Synthetic oligonucleotide; GAG chr11 5344916 5344935 5344932 +
cctagaactgcacctatgag

SEQ ID NO: 22298 - DNA, 20 bp, Artificial Sequence
  Synthetic oligonucleotide; AGG chr11 5344917 5344936 5344933 +
ctagaactgcacctatgagg

SEQ ID NO: 22299 - DNA, 20 bp, Artificial Sequence
  Synthetic oligonucleotide; GAG chr11 5344933 5344952 5344949 +
gaggaggtcccatttgaact

SEQ ID NO: 22300 - DNA, 20 bp, Artificial Sequence
  Synthetic oligonucleotide; AAG chr11 5344948 5344967 5344964 +
gaactgagacctcaatacaa

SEQ ID NO: 22301 - DNA, 20 bp, Artificial Sequence
  Synthetic oligonucleotide; CAG chr11 5344967 5344986 5344983 +
aaagaaaacctgaccgtata

SEQ ID NO: 22302 - DNA, 20 bp, Artificial Sequence
  Synthetic oligonucleotide; TAG chr11 5344973 5344992 5344989 +
aacctgaccgtatacagacc

SEQ ID NO: 22303 - DNA, 20 bp, Artificial Sequence
  Synthetic oligonucleotide; GAG chr11 5344975 5344994 5344991 +
cctgaccgtatacagaccta

SEQ ID NO: 22304 - DNA, 20 bp, Artificial Sequence
  Synthetic oligonucleotide; AGG chr11 5344976 5344995 5344992 +
ctgaccgtatacagacctag

SEQ ID NO: 22305 - DNA, 20 bp, Artificial Sequence
  Synthetic oligonucleotide; CAG chr11 5344989 5345008 5345005 +
gacctagaggaaaactgttc

SEQ ID NO: 22306 - DNA, 20 bp, Artificial Sequence
  Synthetic oligonucleotide; GAG chr11 5344991 5345010 5345007 +
cctagaggaaaactgttcca

SEQ ID NO: 22307 - DNA, 20 bp, Artificial Sequence
  Synthetic oligonucleotide; AGG chr11 5344992 5345011 5345008 +
ctagaggaaaactgttccag

SEQ ID NO: 22308 - DNA, 20 bp, Artificial Sequence
  Synthetic oligonucleotide; GGG chr11 5344993 5345012 5345009 +
tagaggaaaactgttccaga

SEQ ID NO: 22309 - DNA, 20 bp, Artificial Sequence
  Synthetic oligonucleotide; CAG chr11 5345001 5345020 5345017 +
aactgttccagagggaaaat

SEQ ID NO: 22310 - DNA, 20 bp, Artificial Sequence
  Synthetic oligonucleotide; TGG chr11 5345010 5345029 5345026 +
agagggaaaatcagcatgac

SEQ ID NO: 22311 - DNA, 20 bp, Artificial Sequence
  Synthetic oligonucleotide; AAG chr11 5345021 5345040 5345037 +
cagcatgactggcatttgat

SEQ ID NO: 22312 - DNA, 20 bp, Artificial Sequence
  Synthetic oligonucleotide; CAG chr11 5345028 5345047 5345044 +
actggcatttgataagaaaa

SEQ ID NO: 22313 - DNA, 20 bp, Artificial Sequence
  Synthetic oligonucleotide; AGG chr11 5345029 5345048 5345045 +
ctggcatttgataagaaaac

SEQ ID NO: 22314 - DNA, 20 bp, Artificial Sequence
  Synthetic oligonucleotide; GAG chr11 5345031 5345050 5345047 +
ggcatttgataagaaaacag

SEQ ID NO: 22315 - DNA, 20 bp, Artificial Sequence
  Synthetic oligonucleotide; GAG chr11 5345033 5345052 5345049 +
catttgataagaaaacagga

SEQ ID NO: 22316 - DNA, 20 bp, Artificial Sequence
  Synthetic oligonucleotide; AGG chr11 5345034 5345053 5345050 +
atttgataagaaaacaggag

SEQ ID NO: 22317 - DNA, 20 bp, Artificial Sequence
  Synthetic oligonucleotide; GGG chr11 5345035 5345054 5345051 +
tttgataagaaaacaggaga

SEQ ID NO: 22318 - DNA, 20 bp, Artificial Sequence
  Synthetic oligonucleotide; TAG chr11 5345042 5345061 5345058 +
agaaaacaggagagggacaa

SEQ ID NO: 22319 - DNA, 20 bp, Artificial Sequence
  Synthetic oligonucleotide; AAG chr11 5345054 5345073 5345070 +
agggacaatagatgatgtca

SEQ ID NO: 22320 - DNA, 20 bp, Artificial Sequence
  Synthetic oligonucleotide; AAG chr11 5345057 5345076 5345073 +
gacaatagatgatgtcaaag

SEQ ID NO: 22321 - DNA, 20 bp, Artificial Sequence
  Synthetic oligonucleotide; CAG chr11 5345060 5345079 5345076 +
aatagatgatgtcaaagaag

SEQ ID NO: 22322 - DNA, 20 bp, Artificial Sequence
  Synthetic oligonucleotide; AGG chr11 5345061 5345080 5345077 +
atagatgatgtcaaagaagc

SEQ ID NO: 22323 - DNA, 20 bp, Artificial Sequence
  Synthetic oligonucleotide; TAG chr11 5345064 5345083 5345080 +
gatgatgtcaaagaagcagg

SEQ ID NO: 22324 - DNA, 20 bp, Artificial Sequence
  Synthetic oligonucleotide; AAG chr11 5345072 5345091 5345088 +
caaagaagcaggtagtaatc

SEQ ID NO: 22325 - DNA, 20 bp, Artificial Sequence
  Synthetic oligonucleotide; TAG chr11 5345080 5345099 5345096 +
caggtagtaatcaagtgtca

SEQ ID NO: 22326 - DNA, 20 bp, Artificial Sequence
  Synthetic oligonucleotide; AGG chr11 5345081 5345100 5345097 +
aggtagtaatcaagtgtcat

SEQ ID NO: 22327 - DNA, 20 bp, Artificial Sequence
  Synthetic oligonucleotide; GGG chr11 5345082 5345101 5345098 +
ggtagtaatcaagtgtcata

SEQ ID NO: 22328 - DNA, 20 bp, Artificial Sequence
  Synthetic oligonucleotide; CAG chr11 5345090 5345109 5345106 +
tcaagtgtcatagggcctta

SEQ ID NO: 22329 - DNA, 20 bp, Artificial Sequence
  Synthetic oligonucleotide; CGG chr11 5345100 5345119 5345116 +
tagggccttacagaccacca

SEQ ID NO: 22330 - DNA, 20 bp, Artificial Sequence
  Synthetic oligonucleotide; TAG chr11 5345141 5345160 5345157 +
ttttcttcttactataaatg

SEQ ID NO: 22331 - DNA, 20 bp, Artificial Sequence
  Synthetic oligonucleotide; AAG chr11 5345146 5345165 5345162 +
ttcttactataaatgtagta

SEQ ID NO: 22332 - DNA, 20 bp, Artificial Sequence
  Synthetic oligonucleotide; TAG chr11 5345153 5345172 5345169 +
tataaatgtagtaaagacat

SEQ ID NO: 22333 - DNA, 20 bp, Artificial Sequence
  Synthetic oligonucleotide; AGG chr11 5345154 5345173 5345170 +
ataaatgtagtaaagacatt

SEQ ID NO: 22334 - DNA, 20 bp, Artificial Sequence
  Synthetic oligonucleotide; TGG chr11 5345175 5345194 5345191 +
ggacactttgaaaatcacaa

SEQ ID NO: 22335 - DNA, 20 bp, Artificial Sequence
  Synthetic oligonucleotide; TAG chr11 5345182 5345201 5345198 +
ttgaaaatcacaatggaaaa

SEQ ID NO: 22336 - DNA, 20 bp, Artificial Sequence
  Synthetic oligonucleotide; TGG chr11 5345187 5345206 5345203 +
aatcacaatggaaaatagtg

SEQ ID NO: 22337 - DNA, 20 bp, Artificial Sequence
  Synthetic oligonucleotide; TAG chr11 5345226 5345245 5345242 +
gtatttttaaattactcact

SEQ ID NO: 22338 - DNA, 20 bp, Artificial Sequence
  Synthetic oligonucleotide; AAG chr11 5345240 5345259 5345256 +
ctcacttagactgctatgtg

SEQ ID NO: 22339 - DNA, 20 bp, Artificial Sequence
  Synthetic oligonucleotide; AAG chr11 5345243 5345262 5345259 +
acttagactgctatgtgaag

SEQ ID NO: 22340 - DNA, 20 bp, Artificial Sequence
  Synthetic oligonucleotide; AAG chr11 5345249 5345268 5345265 +
actgctatgtgaagaagact

SEQ ID NO: 22341 - DNA, 20 bp, Artificial Sequence
  Synthetic oligonucleotide; AAG chr11 5345253 5345272 5345269 +
ctatgtgaagaagactaagc

SEQ ID NO: 22342 - DNA, 20 bp, Artificial Sequence
  Synthetic oligonucleotide; GAG chr11 5345255 5345274 5345271 +
atgtgaagaagactaagcaa

SEQ ID NO: 22343 - DNA, 20 bp, Artificial Sequence
  Synthetic oligonucleotide; AAG chr11 5345260 5345279 5345276 +
aagaagactaagcaagagac

SEQ ID NO: 22344 - DNA, 20 bp, Artificial Sequence
  Synthetic oligonucleotide; AAG chr11 5345265 5345284 5345281 +
gactaagcaagagacaagaa

SEQ ID NO: 22345 - DNA, 20 bp, Artificial Sequence
  Synthetic oligonucleotide; GAG chr11 5345267 5345286 5345283 +
ctaagcaagagacaagaaaa

SEQ ID NO: 22346 - DNA, 20 bp, Artificial Sequence
  Synthetic oligonucleotide; GAG chr11 5345272 5345291 5345288 +
caagagacaagaaaagagat

SEQ ID NO: 22347 - DNA, 20 bp, Artificial Sequence
  Synthetic oligonucleotide; TAG chr11 5345276 5345295 5345292 +
agacaagaaaagagatgagt

SEQ ID NO: 22348 - DNA, 20 bp, Artificial Sequence
  Synthetic oligonucleotide; AAG chr11 5345280 5345299 5345296 +
aagaaaagagatgagttaga

SEQ ID NO: 22349 - DNA, 20 bp, Artificial Sequence
  Synthetic oligonucleotide; AAG chr11 5345303 5345322 5345319 +
ctattttaaaaatccatatg

SEQ ID NO: 22350 - DNA, 20 bp, Artificial Sequence
  Synthetic oligonucleotide; GAG chr11 5345305 5345324 5345321 +
attttaaaaatccatatgaa

SEQ ID NO: 22351 - DNA, 20 bp, Artificial Sequence
  Synthetic oligonucleotide; TGG chr11 5345311 5345330 5345327 +
aaaatccatatgaagagtca

SEQ ID NO: 22352 - DNA, 20 bp, Artificial Sequence
  Synthetic oligonucleotide; TAG chr11 5345324 5345343 5345340 +
agagtcatggtgaccttgac

SEQ ID NO: 22353 - DNA, 20 bp, Artificial Sequence
  Synthetic oligonucleotide; AGG chr11 5345325 5345344 5345341 +
gagtcatggtgaccttgact

SEQ ID NO: 22354 - DNA, 20 bp, Artificial Sequence
  Synthetic oligonucleotide; GAG chr11 5345327 5345346 5345343 +
gtcatggtgaccttgactag

SEQ ID NO: 22355 - DNA, 20 bp, Artificial Sequence
  Synthetic oligonucleotide; GAG chr11 5345329 5345348 5345345 +
catggtgaccttgactagga

SEQ ID NO: 22356 - DNA, 20 bp, Artificial Sequence
  Synthetic oligonucleotide; AAG chr11 5345332 5345351 5345348 +
ggtgaccttgactaggagag

SEQ ID NO: 22357 - DNA, 20 bp, Artificial Sequence
  Synthetic oligonucleotide; CAG chr11 5345335 5345354 5345351 +
gaccttgactaggagagaag

SEQ ID NO: 22358 - DNA, 20 bp, Artificial Sequence
  Synthetic oligonucleotide; AGG chr11 5345336 5345355 5345352 +
accttgactaggagagaagc

SEQ ID NO: 22359 - DNA, 20 bp, Artificial Sequence
  Synthetic oligonucleotide; GGG chr11 5345337 5345356 5345353 +
ccttgactaggagagaagca

SEQ ID NO: 22360 - DNA, 20 bp, Artificial Sequence
  Synthetic oligonucleotide; GGG chr11 5345338 5345357 5345354 +
cttgactaggagagaagcag

SEQ ID NO: 22361 - DNA, 20 bp, Artificial Sequence
  Synthetic oligonucleotide; AAG chr11 5345351 5345370 5345367 +
gaagcaggggaaatgaaaaa

SEQ ID NO: 22362 - DNA, 20 bp, Artificial Sequence
  Synthetic oligonucleotide; GAG chr11 5345353 5345372 5345369 +
agcaggggaaatgaaaaaaa

SEQ ID NO: 22363 - DNA, 20 bp, Artificial Sequence
  Synthetic oligonucleotide; TAG chr11 5345361 5345380 5345377 +
aaatgaaaaaaagagaaaaa

SEQ ID NO: 22364 - DNA, 20 bp, Artificial Sequence
  Synthetic oligonucleotide; CAG chr11 5345375 5345394 5345391 +
gaaaaatagaaaaacttaaa

SEQ ID NO: 22365 - DNA, 20 bp, Artificial Sequence
  Synthetic oligonucleotide; GAG chr11 5345377 5345396 5345393 +
aaaatagaaaaacttaaaca

SEQ ID NO: 22366 - DNA, 20 bp, Artificial Sequence
  Synthetic oligonucleotide; CAG chr11 5345381 5345400 5345397 +
tagaaaaacttaaacagaga

SEQ ID NO: 22367 - DNA, 20 bp, Artificial Sequence
  Synthetic oligonucleotide; AAG chr11 5345395 5345414 5345411 +
cagagacagatgcatttttg

SEQ ID NO: 22368 - DNA, 20 bp, Artificial Sequence
  Synthetic oligonucleotide; TAG chr11 5345398 5345417 5345414 +
agacagatgcatttttgaag

SEQ ID NO: 22369 - DNA, 20 bp, Artificial Sequence
  Synthetic oligonucleotide; AAG chr11 5345405 5345424 5345421 +
tgcatttttgaagtagtgcc

SEQ ID NO: 22370 - DNA, 20 bp, Artificial Sequence
  Synthetic oligonucleotide; TGG chr11 5345428 5345447 5345444 +
atttgctgatatattaaaaa

SEQ ID NO: 22371 - DNA, 20 bp, Artificial Sequence
  Synthetic oligonucleotide; GGG chr11 5345429 5345448 5345445 +
tttgctgatatattaaaaat

SEQ ID NO: 22372 - DNA, 20 bp, Artificial Sequence
  Synthetic oligonucleotide; GAG chr11 5345431 5345450 5345447 +
tgctgatatattaaaaatgg

SEQ ID NO: 22373 - DNA, 20 bp, Artificial Sequence
  Synthetic oligonucleotide; GAG chr11 5345435 5345454 5345451 +
gatatattaaaaatgggagt

SEQ ID NO: 22374 - DNA, 20 bp, Artificial Sequence
  Synthetic oligonucleotide; AGG chr11 5345436 5345455 5345452 +
atatattaaaaatgggagtg

SEQ ID NO: 22375 - DNA, 20 bp, Artificial Sequence
  Synthetic oligonucleotide; GGG chr11 5345437 5345456 5345453 +
tatattaaaaatgggagtga

SEQ ID NO: 22376 - DNA, 20 bp, Artificial Sequence
  Synthetic oligonucleotide; GAG chr11 5345451 5345470 5345467 +
gagtgagggaaaaatcaaat

SEQ ID NO: 22377 - DNA, 20 bp, Artificial Sequence
  Synthetic oligonucleotide; AGG chr11 5345452 5345471 5345468 +
agtgagggaaaaatcaaatg

SEQ ID NO: 22378 - DNA, 20 bp, Artificial Sequence
  Synthetic oligonucleotide; TAG chr11 5345462 5345481 5345478 +
aaatcaaatgaggtttcccc

SEQ ID NO: 22379 - DNA, 20 bp, Artificial Sequence
  Synthetic oligonucleotide; AAG chr11 5345485 5345504 5345501 +
atttctgtttgaacaaatga

SEQ ID NO: 22380 - DNA, 20 bp, Artificial Sequence
  Synthetic oligonucleotide; TGG chr11 5345490 5345509 5345506 +
tgtttgaacaaatgaaagaa

SEQ ID NO: 22381 - DNA, 20 bp, Artificial Sequence
  Synthetic oligonucleotide; AAG chr11 5345495 5345514 5345511 +
gaacaaatgaaagaatggtg

SEQ ID NO: 22382 - DNA, 20 bp, Artificial Sequence
  Synthetic oligonucleotide; TGG chr11 5345512 5345531 5345528 +
gtgaagccatttactcaaaa

SEQ ID NO: 22383 - DNA, 20 bp, Artificial Sequence
  Synthetic oligonucleotide; AAG chr11 5345515 5345534 5345531 +
aagccatttactcaaaatgg

SEQ ID NO: 22384 - DNA, 20 bp, Artificial Sequence
  Synthetic oligonucleotide; GAG chr11 5345521 5345540 5345537 +
tttactcaaaatggaagtct

SEQ ID NO: 22385 - DNA, 20 bp, Artificial Sequence
  Synthetic oligonucleotide; AGG chr11 5345522 5345541 5345538 +
ttactcaaaatggaagtctg

SEQ ID NO: 22386 - DNA, 20 bp, Artificial Sequence
  Synthetic oligonucleotide; GGG chr11 5345523 5345542 5345539 +
tactcaaaatggaagtctga

SEQ ID NO: 22387 - DNA, 20 bp, Artificial Sequence
  Synthetic oligonucleotide; GGG chr11 5345524 5345543 5345540 +
actcaaaatggaagtctgag

SEQ ID NO: 22388 - DNA, 20 bp, Artificial Sequence
  Synthetic oligonucleotide; GGG chr11 5345525 5345544 5345541 +
ctcaaaatggaagtctgagg

SEQ ID NO: 22389 - DNA, 20 bp, Artificial Sequence
  Synthetic oligonucleotide; GAG chr11 5345544 5345563 5345560 +
ggggatacatattcacttgt

SEQ ID NO: 22390 - DNA, 20 bp, Artificial Sequence
  Synthetic oligonucleotide; AGG chr11 5345545 5345564 5345561 +
gggatacatattcacttgtg

SEQ ID NO: 22391 - DNA, 20 bp, Artificial Sequence
  Synthetic oligonucleotide; AAG chr11 5345553 5345572 5345569 +
tattcacttgtgaggaaatc

SEQ ID NO: 22392 - DNA, 20 bp, Artificial Sequence
  Synthetic oligonucleotide; GAG chr11 5345555 5345574 5345571 +
ttcacttgtgaggaaatcaa

SEQ ID NO: 22393 - DNA, 20 bp, Artificial Sequence
  Synthetic oligonucleotide; TAG chr11 5345562 5345581 5345578 +
gtgaggaaatcaagagtcat

SEQ ID NO: 22394 - DNA, 20 bp, Artificial Sequence
  Synthetic oligonucleotide; TAG chr11 5345571 5345590 5345587 +
tcaagagtcattagtaaata

SEQ ID NO: 22395 - DNA, 20 bp, Artificial Sequence
  Synthetic oligonucleotide; TAG chr11 5345580 5345599 5345596 +
attagtaaatatagctgaat

SEQ ID NO: 22396 - DNA, 20 bp, Artificial Sequence
  Synthetic oligonucleotide; GAG chr11 5345582 5345601 5345598 +
tagtaaatatagctgaatta

SEQ ID NO: 22397 - DNA, 20 bp, Artificial Sequence
  Synthetic oligonucleotide; CAG chr11 5345621 5345640 5345637 +
ttttttttcttgtcacatgc

SEQ ID NO: 22398 - DNA, 20 bp, Artificial Sequence
  Synthetic oligonucleotide; AAG chr11 5345636 5345655 5345652 +
catgccagaacaacttcttg

SEQ ID NO: 22399 - DNA, 20 bp, Artificial Sequence
  Synthetic oligonucleotide; AAG chr11 5345652 5345671 5345668 +
cttgaagttgtttttatcct

SEQ ID NO: 22400 - DNA, 20 bp, Artificial Sequence
  Synthetic oligonucleotide; AAG chr11 5345660 5345679 5345676 +
tgtttttatcctaagttaaa

SEQ ID NO: 22401 - DNA, 20 bp, Artificial Sequence
  Synthetic oligonucleotide; TGG chr11 5345664 5345683 5345680 +
tttatcctaagttaaaaaga

SEQ ID NO: 22402 - DNA, 20 bp, Artificial Sequence
  Synthetic oligonucleotide; CAG chr11 5345688 5345707 5345704 +
cgtatccaaatatacccctt

SEQ ID NO: 22403 - DNA, 20 bp, Artificial Sequence
  Synthetic oligonucleotide; GAG chr11 5345690 5345709 5345706 +
tatccaaatataccccttca

SEQ ID NO: 22404 - DNA, 20 bp, Artificial Sequence
  Synthetic oligonucleotide; CAG chr11 5345702 5345721 5345718 +
ccccttcagagttactttgt

SEQ ID NO: 22405 - DNA, 20 bp, Artificial Sequence
  Synthetic oligonucleotide; AAG chr11 5345708 5345727 5345724 +
cagagttactttgtcagtgt

SEQ ID NO: 22406 - DNA, 20 bp, Artificial Sequence
  Synthetic oligonucleotide; AGG chr11 5345709 5345728 5345725 +
agagttactttgtcagtgta

SEQ ID NO: 22407 - DNA, 20 bp, Artificial Sequence
  Synthetic oligonucleotide; AAG chr11 5345722 5345741 5345738 +
cagtgtaaggcactacccta

SEQ ID NO: 22408 - DNA, 20 bp, Artificial Sequence
  Synthetic oligonucleotide; AAG chr11 5345734 5345753 5345750 +
ctaccctaaagatgccacca

SEQ ID NO: 22409 - DNA, 20 bp, Artificial Sequence
  Synthetic oligonucleotide; AGG chr11 5345735 5345754 5345751 +
taccctaaagatgccaccaa

SEQ ID NO: 22410 - DNA, 20 bp, Artificial Sequence
  Synthetic oligonucleotide; TAG chr11 5345763 5345782 5345779 +
atcctcttaccttccaccca

SEQ ID NO: 22411 - DNA, 20 bp, Artificial Sequence
  Synthetic oligonucleotide; GAG chr11 5345765 5345784 5345781 +
cctcttaccttccacccata

SEQ ID NO: 22412 - DNA, 20 bp, Artificial Sequence
  Synthetic oligonucleotide; GAG chr11 5345770 5345789 5345786 +
taccttccacccatagagat

SEQ ID NO: 22413 - DNA, 20 bp, Artificial Sequence
  Synthetic oligonucleotide; TAG chr11 5345785 5345804 5345801 +
gagatgagatctaactgtaa

SEQ ID NO: 22414 - DNA, 20 bp, Artificial Sequence
  Synthetic oligonucleotide; CAG chr11 5345791 5345810 5345807 +
agatctaactgtaatagttt

SEQ ID NO: 22415 - DNA, 20 bp, Artificial Sequence
  Synthetic oligonucleotide; AAG chr11 5345796 5345815 5345812 +
taactgtaatagtttcagtg

SEQ ID NO: 22416 - DNA, 20 bp, Artificial Sequence
  Synthetic oligonucleotide; GAG chr11 5345798 5345817 5345814 +
actgtaatagtttcagtgaa

SEQ ID NO: 22417 - DNA, 20 bp, Artificial Sequence
  Synthetic oligonucleotide; CAG chr11 5345805 5345824 5345821 +
tagtttcagtgaagagatgc

SEQ ID NO: 22418 - DNA, 20 bp, Artificial Sequence
  Synthetic oligonucleotide; TGG chr11 5345813 5345832 5345829 +
gtgaagagatgccagacaac

SEQ ID NO: 22419 - DNA, 20 bp, Artificial Sequence
  Synthetic oligonucleotide; GGG chr11 5345814 5345833 5345830 +
tgaagagatgccagacaact

SEQ ID NO: 22420 - DNA, 20 bp, Artificial Sequence
  Synthetic oligonucleotide; GAG chr11 5345820 5345839 5345836 +
gatgccagacaactgggcgt

SEQ ID NO: 22421 - DNA, 20 bp, Artificial Sequence
  Synthetic oligonucleotide; AGG chr11 5345821 5345840 5345837 +
atgccagacaactgggcgtg

SEQ ID NO: 22422 - DNA, 20 bp, Artificial Sequence
  Synthetic oligonucleotide; CAG chr11 5345832 5345851 5345848 +
ctgggcgtgaggcaacaact

SEQ ID NO: 22423 - DNA, 20 bp, Artificial Sequence
  Synthetic oligonucleotide; AAG chr11 5345843 5345862 5345859 +
gcaacaactcagcactttga

SEQ ID NO: 22424 - DNA, 20 bp, Artificial Sequence
  Synthetic oligonucleotide; CAG chr11 5345856 5345875 5345872 +
actttgaaagaatcattttt

SEQ ID NO: 22425 - DNA, 20 bp, Artificial Sequence
  Synthetic oligonucleotide; TAG chr11 5345875 5345894 5345891 +
tcagcatccatattctgtcc

SEQ ID NO: 22426 - DNA, 20 bp, Artificial Sequence
  Synthetic oligonucleotide; AGG chr11 5345876 5345895 5345892 +
cagcatccatattctgtcct

SEQ ID NO: 22427 - DNA, 20 bp, Artificial Sequence
  Synthetic oligonucleotide; GAG chr11 5345882 5345901 5345898 +
ccatattctgtcctaggact

SEQ ID NO: 22428 - DNA, 20 bp, Artificial Sequence
  Synthetic oligonucleotide; GAG chr11 5345884 5345903 5345900 +
atattctgtcctaggactga

SEQ ID NO: 22429 - DNA, 20 bp, Artificial Sequence
  Synthetic oligonucleotide; CAG chr11 5345895 5345914 5345911 +
taggactgagagacataaac

SEQ ID NO: 22430 - DNA, 20 bp, Artificial Sequence
  Synthetic oligonucleotide; CAG chr11 5345902 5345921 5345918 +
gagagacataaaccagaatt

SEQ ID NO: 22431 - DNA, 20 bp, Artificial Sequence
  Synthetic oligonucleotide; GAG chr11 5345924 5345943 5345940 +
gtgcctactgaacatacaat

SEQ ID NO: 22432 - DNA, 20 bp, Artificial Sequence
  Synthetic oligonucleotide; CAG chr11 5345941 5345960 5345957 +
aatgagtgatgtatattctt

SEQ ID NO: 22433 - DNA, 20 bp, Artificial Sequence
  Synthetic oligonucleotide; TAG chr11 5345948 5345967 5345964 +
gatgtatattcttcagttac

SEQ ID NO: 22434 - DNA, 20 bp, Artificial Sequence
  Synthetic oligonucleotide; AAG chr11 5345956 5345975 5345972 +
ttcttcagttactagacgca

SEQ ID NO: 22435 - DNA, 20 bp, Artificial Sequence
  Synthetic oligonucleotide; CAG chr11 5345965 5345984 5345981 +
tactagacgcaaagataatc

SEQ ID NO: 22436 - DNA, 20 bp, Artificial Sequence
  Synthetic oligonucleotide; TAG chr11 5345970 5345989 5345986 +
gacgcaaagataatccagct

SEQ ID NO: 22437 - DNA, 20 bp, Artificial Sequence
  Synthetic oligonucleotide; CAG chr11 5346037 5346056 5346053 +
ctcttacttctctgacgttt

SEQ ID NO: 22438 - DNA, 20 bp, Artificial Sequence
  Synthetic oligonucleotide; CAG chr11 5346102 5346121 5346118 +
tgtgaaaaattccttcttat

SEQ ID NO: 22439 - DNA, 20 bp, Artificial Sequence
  Synthetic oligonucleotide; GAG chr11 5346104 5346123 5346120 +
tgaaaaattccttcttatca

SEQ ID NO: 22440 - DNA, 20 bp, Artificial Sequence
  Synthetic oligonucleotide; CAG chr11 5346113 5346132 5346129 +
ccttcttatcagagaatatg

SEQ ID NO: 22441 - DNA, 20 bp, Artificial Sequence
  Synthetic oligonucleotide; AAG chr11 5346119 5346138 5346135 +
tatcagagaatatgcagcac

SEQ ID NO: 22442 - DNA, 20 bp, Artificial Sequence
  Synthetic oligonucleotide; CAG chr11 5346135 5346154 5346151 +
gcacaagtgatgaatcacta

SEQ ID NO: 22443 - DNA, 20 bp, Artificial Sequence
  Synthetic oligonucleotide; AGG chr11 5346136 5346155 5346152 +
cacaagtgatgaatcactac

SEQ ID NO: 22444 - DNA, 20 bp, Artificial Sequence
  Synthetic oligonucleotide; GGG chr11 5346137 5346156 5346153 +
acaagtgatgaatcactaca

SEQ ID NO: 22445 - DNA, 20 bp, Artificial Sequence
  Synthetic oligonucleotide; AAG chr11 5346141 5346160 5346157 +
gtgatgaatcactacaggga

SEQ ID NO: 22446 - DNA, 20 bp, Artificial Sequence
  Synthetic oligonucleotide; AAG chr11 5346157 5346176 5346173 +
gggaaagctaaccaaactgt

SEQ ID NO: 22447 - DNA, 20 bp, Artificial Sequence
  Synthetic oligonucleotide; AGG chr11 5346158 5346177 5346174 +
ggaaagctaaccaaactgta

SEQ ID NO: 22448 - DNA, 20 bp, Artificial Sequence
  Synthetic oligonucleotide; AAG chr11 5346198 5346217 5346214 +
caataataacctgcaactta

SEQ ID NO: 22449 - DNA, 20 bp, Artificial Sequence
  Synthetic oligonucleotide; AAG chr11 5346221 5346240 5346237 +
tttcctccttctccattccc

SEQ ID NO: 22450 - DNA, 20 bp, Artificial Sequence
  Synthetic oligonucleotide; CAG chr11 5346233 5346252 5346249 +
ccattcccaagaattccatg

SEQ ID NO: 22451 - DNA, 20 bp, Artificial Sequence
  Synthetic oligonucleotide; TGG chr11 5346243 5346262 5346259 +
gaattccatgcagacatacc

SEQ ID NO: 22452 - DNA, 20 bp, Artificial Sequence
  Synthetic oligonucleotide; CAG chr11 5346251 5346270 5346267 +
tgcagacatacctggtaatg

SEQ ID NO: 22453 - DNA, 20 bp, Artificial Sequence
  Synthetic oligonucleotide; TAG chr11 5346260 5346279 5346276 +
acctggtaatgcagctataa

SEQ ID NO: 22454 - DNA, 20 bp, Artificial Sequence
  Synthetic oligonucleotide; TGG chr11 5346270 5346289 5346286 +
gcagctataatagtgatcta

SEQ ID NO: 22455 - DNA, 20 bp, Artificial Sequence
  Synthetic oligonucleotide; CAG chr11 5346311 5346330 5346327 +
tgtgaaaattcttgtgtcct

SEQ ID NO: 22456 - DNA, 20 bp, Artificial Sequence
  Synthetic oligonucleotide; TAG chr11 5346315 5346334 5346331 +
aaaattcttgtgtcctcagc

SEQ ID NO: 22457 - DNA, 20 bp, Artificial Sequence
  Synthetic oligonucleotide; TGG chr11 5346321 5346340 5346337 +
cttgtgtcctcagctagtcg

SEQ ID NO: 22458 - DNA, 20 bp, Artificial Sequence
  Synthetic oligonucleotide; TGG chr11 5346328 5346347 5346344 +
cctcagctagtcgtggctct

SEQ ID NO: 22459 - DNA, 20 bp, Artificial Sequence
  Synthetic oligonucleotide; GAG chr11 5346336 5346355 5346352 +
agtcgtggctcttggtttct

SEQ ID NO: 22460 - DNA, 20 bp, Artificial Sequence
  Synthetic oligonucleotide; AAG chr11 5346339 5346358 5346355 +
cgtggctcttggtttctgag

SEQ ID NO: 22461 - DNA, 20 bp, Artificial Sequence
  Synthetic oligonucleotide; AAG chr11 5346343 5346362 5346359 +
gctcttggtttctgagaaga

SEQ ID NO: 22462 - DNA, 20 bp, Artificial Sequence
  Synthetic oligonucleotide; GAG chr11 5346351 5346370 5346367 +
tttctgagaagaaagacaat

SEQ ID NO: 22463 - DNA, 20 bp, Artificial Sequence
  Synthetic oligonucleotide; GAG chr11 5346353 5346372 5346369 +
tctgagaagaaagacaatga

SEQ ID NO: 22464 - DNA, 20 bp, Artificial Sequence
  Synthetic oligonucleotide; AAG chr11 5346356 5346375 5346372 +
gagaagaaagacaatgagag

SEQ ID NO: 22465 - DNA, 20 bp, Artificial Sequence
  Synthetic oligonucleotide; GAG chr11 5346358 5346377 5346374 +
gaagaaagacaatgagagaa

SEQ ID NO: 22466 - DNA, 20 bp, Artificial Sequence
  Synthetic oligonucleotide; AAG chr11 5346365 5346384 5346381 +
gacaatgagagaagagataa

SEQ ID NO: 22467 - DNA, 20 bp, Artificial Sequence
  Synthetic oligonucleotide; GAG chr11 5346370 5346389 5346386 +
tgagagaagagataaaagct

SEQ ID NO: 22468 - DNA, 20 bp, Artificial Sequence
  Synthetic oligonucleotide; AGG chr11 5346371 5346390 5346387 +
gagagaagagataaaagctg

SEQ ID NO: 22469 - DNA, 20 bp, Artificial Sequence
  Synthetic oligonucleotide; TAG chr11 5346384 5346403 5346400 +
aaagctgaggaaaaaaaata

SEQ ID NO: 22470 - DNA, 20 bp, Artificial Sequence
  Synthetic oligonucleotide; AGG chr11 5346385 5346404 5346401 +
aagctgaggaaaaaaaatat

SEQ ID NO: 22471 - DNA, 20 bp, Artificial Sequence
  Synthetic oligonucleotide; GGG chr11 5346386 5346405 5346402 +
agctgaggaaaaaaaatata

SEQ ID NO: 22472 - DNA, 20 bp, Artificial Sequence
  Synthetic oligonucleotide; AAG chr11 5346389 5346408 5346405 +
tgaggaaaaaaaatataggg

SEQ ID NO: 22473 - DNA, 20 bp, Artificial Sequence
  Synthetic oligonucleotide; AGG chr11 5346390 5346409 5346406 +
gaggaaaaaaaatataggga

SEQ ID NO: 22474 - DNA, 20 bp, Artificial Sequence
  Synthetic oligonucleotide; AAG chr11 5346394 5346413 5346410 +
aaaaaaaatatagggaagga

SEQ ID NO: 22475 - DNA, 20 bp, Artificial Sequence
  Synthetic oligonucleotide; GAG chr11 5346396 5346415 5346412 +
aaaaaatatagggaaggaaa

SEQ ID NO: 22476 - DNA, 20 bp, Artificial Sequence
  Synthetic oligonucleotide; AAG chr11 5346405 5346424 5346421 +
agggaaggaaagagatcata

SEQ ID NO: 22477 - DNA, 20 bp, Artificial Sequence
  Synthetic oligonucleotide; GAG chr11 5346411 5346430 5346427 +
ggaaagagatcataaagact

SEQ ID NO: 22478 - DNA, 20 bp, Artificial Sequence
  Synthetic oligonucleotide; AGG chr11 5346412 5346431 5346428 +
gaaagagatcataaagactg

SEQ ID NO: 22479 - DNA, 20 bp, Artificial Sequence
  Synthetic oligonucleotide; TAG chr11 5346416 5346435 5346432 +
gagatcataaagactgagga

SEQ ID NO: 22480 - DNA, 20 bp, Artificial Sequence
  Synthetic oligonucleotide; AAG chr11 5346419 5346438 5346435 +
atcataaagactgaggatag

SEQ ID NO: 22481 - DNA, 20 bp, Artificial Sequence
  Synthetic oligonucleotide; AAG chr11 5346423 5346442 5346439 +
taaagactgaggatagaagc

SEQ ID NO: 22482 - DNA, 20 bp, Artificial Sequence
  Synthetic oligonucleotide; AAG chr11 5346426 5346445 5346442 +
agactgaggatagaagcaag

SEQ ID NO: 22483 - DNA, 20 bp, Artificial Sequence
  Synthetic oligonucleotide; TGG chr11 5346438 5346457 5346454 +
gaagcaagaagattctataa

SEQ ID NO: 22484 - DNA, 20 bp, Artificial Sequence
  Synthetic oligonucleotide; TAG chr11 5346447 5346466 5346463 +
agattctataatggaacacc

SEQ ID NO: 22485 - DNA, 20 bp, Artificial Sequence
  Synthetic oligonucleotide; CAG chr11 5346455 5346474 5346471 +
taatggaacacctagaaaat

SEQ ID NO: 22486 - DNA, 20 bp, Artificial Sequence
  Synthetic oligonucleotide; CAG chr11 5346476 5346495 5346492 +
agataaacttctaacattta

SEQ ID NO: 22487 - DNA, 20 bp, Artificial Sequence
  Synthetic oligonucleotide; AAG chr11 5346506 5346525 5346522 +
ttttctctgctttgtttaaa

SEQ ID NO: 22488 - DNA, 20 bp, Artificial Sequence
  Synthetic oligonucleotide; TAG chr11 5346516 5346535 5346532 +
tttgtttaaaaagtaaaatg

SEQ ID NO: 22489 - DNA, 20 bp, Artificial Sequence
  Synthetic oligonucleotide; TAG chr11 5346519 5346538 5346535 +
gtttaaaaagtaaaatgtag

SEQ ID NO: 22490 - DNA, 20 bp, Artificial Sequence
  Synthetic oligonucleotide; AAG chr11 5346525 5346544 5346541 +
aaagtaaaatgtagtagaat

SEQ ID NO: 22491 - DNA, 20 bp, Artificial Sequence
  Synthetic oligonucleotide; GAG chr11 5346527 5346546 5346543 +
agtaaaatgtagtagaataa

SEQ ID NO: 22492 - DNA, 20 bp, Artificial Sequence
  Synthetic oligonucleotide; AGG chr11 5346528 5346547 5346544 +
gtaaaatgtagtagaataag

SEQ ID NO: 22493 - DNA, 20 bp, Artificial Sequence
  Synthetic oligonucleotide; TAG chr11 5346550 5346569 5346566 +
gtgccttcctgttcatcttt

SEQ ID NO: 22494 - DNA, 20 bp, Artificial Sequence
  Synthetic oligonucleotide; AAG chr11 5346554 5346573 5346570 +
cttcctgttcatcttttaga

SEQ ID NO: 22495 - DNA, 20 bp, Artificial Sequence
  Synthetic oligonucleotide; AGG chr11 5346555 5346574 5346571 +
ttcctgttcatcttttagaa

SEQ ID NO: 22496 - DNA, 20 bp, Artificial Sequence
  Synthetic oligonucleotide; AAG chr11 5346559 5346578 5346575 +
tgttcatcttttagaaagga

SEQ ID NO: 22497 - DNA, 20 bp, Artificial Sequence
  Synthetic oligonucleotide; AAG chr11 5346562 5346581 5346578 +
tcatcttttagaaaggaaag

SEQ ID NO: 22498 - DNA, 20 bp, Artificial Sequence
  Synthetic oligonucleotide; GAG chr11 5346571 5346590 5346587 +
agaaaggaaagaagacatat

SEQ ID NO: 22499 - DNA, 20 bp, Artificial Sequence
  Synthetic oligonucleotide; GAG chr11 5346573 5346592 5346589 +
aaaggaaagaagacatatga

SEQ ID NO: 22500 - DNA, 20 bp, Artificial Sequence
  Synthetic oligonucleotide; AGG chr11 5346574 5346593 5346590 +
aaggaaagaagacatatgag

SEQ ID NO: 22501 - DNA, 20 bp, Artificial Sequence
  Synthetic oligonucleotide; GGG chr11 5346575 5346594 5346591 +
aggaaagaagacatatgaga

SEQ ID NO: 22502 - DNA, 20 bp, Artificial Sequence
  Synthetic oligonucleotide; GAG chr11 5346598 5346617 5346614 +
tcaatcatattcacatcact

SEQ ID NO: 22503 - DNA, 20 bp, Artificial Sequence
  Synthetic oligonucleotide; CAG chr11 5346603 5346622 5346619 +
catattcacatcactgagta

SEQ ID NO: 22504 - DNA, 20 bp, Artificial Sequence
  Synthetic oligonucleotide; AAG chr11 5346606 5346625 5346622 +
attcacatcactgagtacag

SEQ ID NO: 22505 - DNA, 20 bp, Artificial Sequence
  Synthetic oligonucleotide; AGG chr11 5346607 5346626 5346623 +
ttcacatcactgagtacaga

SEQ ID NO: 22506 - DNA, 20 bp, Artificial Sequence
  Synthetic oligonucleotide; TAG chr11 5346613 5346632 5346629 +
tcactgagtacagaaggtct

SEQ ID NO: 22507 - DNA, 20 bp, Artificial Sequence
  Synthetic oligonucleotide; AGG chr11 5346614 5346633 5346630 +
cactgagtacagaaggtctt

SEQ ID NO: 22508 - DNA, 20 bp, Artificial Sequence
  Synthetic oligonucleotide; TAG chr11 5346617 5346636 5346633 +
tgagtacagaaggtcttagg

SEQ ID NO: 22509 - DNA, 20 bp, Artificial Sequence
  Synthetic oligonucleotide; TGG chr11 5346621 5346640 5346637 +
tacagaaggtcttaggtagt

SEQ ID NO: 22510 - DNA, 20 bp, Artificial Sequence
  Synthetic oligonucleotide; TGG chr11 5346625 5346644 5346641 +
gaaggtcttaggtagttggt

SEQ ID NO: 22511 - DNA, 20 bp, Artificial Sequence
  Synthetic oligonucleotide; TAG chr11 5346628 5346647 5346644 +
ggtcttaggtagttggttgg

SEQ ID NO: 22512 - DNA, 20 bp, Artificial Sequence
  Synthetic oligonucleotide; TGG chr11 5346635 5346654 5346651 +
ggtagttggttggtagcact

SEQ ID NO: 22513 - DNA, 20 bp, Artificial Sequence
  Synthetic oligonucleotide; AAG chr11 5346649 5346668 5346665 +
agcacttggaattgcttttg

SEQ ID NO: 22514 - DNA, 20 bp, Artificial Sequence
  Synthetic oligonucleotide; CAG chr11 5346664 5346683 5346680 +
ttttgaagttctatcaactt

SEQ ID NO: 22515 - DNA, 20 bp, Artificial Sequence
  Synthetic oligonucleotide; AAG chr11 5346690 5346709 5346706 +
gaaatctgtgcacacatcca

SEQ ID NO: 22516 - DNA, 20 bp, Artificial Sequence
  Synthetic oligonucleotide; TGG chr11 5346696 5346715 5346712 +
tgtgcacacatccaaagctg

SEQ ID NO: 22517 - DNA, 20 bp, Artificial Sequence
  Synthetic oligonucleotide; GAG chr11 5346705 5346724 5346721 +
atccaaagctgtggactatt

SEQ ID NO: 22518 - DNA, 20 bp, Artificial Sequence
  Synthetic oligonucleotide; TGG chr11 5346737 5346756 5346753 +
ttcttctccgtatctttctc

SEQ ID NO: 22519 - DNA, 20 bp, Artificial Sequence
  Synthetic oligonucleotide; GAG chr11 5346739 5346758 5346755 +
cttctccgtatctttctctg

SEQ ID NO: 22520 - DNA, 20 bp, Artificial Sequence
  Synthetic oligonucleotide; GAG chr11 5346741 5346760 5346757 +
tctccgtatctttctctgga

SEQ ID NO: 22521 - DNA, 20 bp, Artificial Sequence
  Synthetic oligonucleotide; TAG chr11 5346748 5346767 5346764 +
atctttctctggagagctta

SEQ ID NO: 22522 - DNA, 20 bp, Artificial Sequence
  Synthetic oligonucleotide; GAG chr11 5346750 5346769 5346766 +
ctttctctggagagcttata

SEQ ID NO: 22523 - DNA, 20 bp, Artificial Sequence
  Synthetic oligonucleotide; AGG chr11 5346751 5346770 5346767 +
tttctctggagagcttatag

SEQ ID NO: 22524 - DNA, 20 bp, Artificial Sequence
  Synthetic oligonucleotide; GAG chr11 5346753 5346772 5346769 +
tctctggagagcttatagag

SEQ ID NO: 22525 - DNA, 20 bp, Artificial Sequence
  Synthetic oligonucleotide; TAG chr11 5346761 5346780 5346777 +
gagcttatagaggagtctcc

SEQ ID NO: 22526 - DNA, 20 bp, Artificial Sequence
  Synthetic oligonucleotide; TAG chr11 5346781 5346800 5346797 +
tagtacactctttatatatc

SEQ ID NO: 22527 - DNA, 20 bp, Artificial Sequence
  Synthetic oligonucleotide; AGG chr11 5346782 5346801 5346798 +
agtacactctttatatatct

SEQ ID NO: 22528 - DNA, 20 bp, Artificial Sequence
  Synthetic oligonucleotide; GAG chr11 5346784 5346803 5346800 +
tacactctttatatatctag

SEQ ID NO: 22529 - DNA, 20 bp, Artificial Sequence
  Synthetic oligonucleotide; CAG chr11 5346803 5346822 5346819 +
ggagtatttcaccatactcc

SEQ ID NO: 22530 - DNA, 20 bp, Artificial Sequence
  Synthetic oligonucleotide; AGG chr11 5346804 5346823 5346820 +
gagtatttcaccatactccc

SEQ ID NO: 22531 - DNA, 20 bp, Artificial Sequence
  Synthetic oligonucleotide; TGG chr11 5346824 5346843 5346840 +
aggtaccataacttgtttga

SEQ ID NO: 22532 - DNA, 20 bp, Artificial Sequence
  Synthetic oligonucleotide; GAG chr11 5346828 5346847 5346844 +
accataacttgtttgatggt

SEQ ID NO: 22533 - DNA, 20 bp, Artificial Sequence
  Synthetic oligonucleotide; AGG chr11 5346829 5346848 5346845 +
ccataacttgtttgatggtg

SEQ ID NO: 22534 - DNA, 20 bp, Artificial Sequence
  Synthetic oligonucleotide; AAG chr11 5346832 5346851 5346848 +
taacttgtttgatggtgagg

SEQ ID NO: 22535 - DNA, 20 bp, Artificial Sequence
  Synthetic oligonucleotide; GAG chr11 5346834 5346853 5346850 +
acttgtttgatggtgaggaa

SEQ ID NO: 22536 - DNA, 20 bp, Artificial Sequence
  Synthetic oligonucleotide; CAG chr11 5346837 5346856 5346853 +
tgtttgatggtgaggaagag

SEQ ID NO: 22537 - DNA, 20 bp, Artificial Sequence
  Synthetic oligonucleotide; AGG chr11 5346838 5346857 5346854 +
gtttgatggtgaggaagagc

SEQ ID NO: 22538 - DNA, 20 bp, Artificial Sequence
  Synthetic oligonucleotide; GGG chr11 5346839 5346858 5346855 +
tttgatggtgaggaagagca

SEQ ID NO: 22539 - DNA, 20 bp, Artificial Sequence
  Synthetic oligonucleotide; AAG chr11 5346859 5346878 5346875 +
gggttcttgtgtcttaccta

SEQ ID NO: 22540 - DNA, 20 bp, Artificial Sequence
  Synthetic oligonucleotide; TAG chr11 5346865 5346884 5346881 +
ttgtgtcttacctaaagact

SEQ ID NO: 22541 - DNA, 20 bp, Artificial Sequence
  Synthetic oligonucleotide; AAG chr11 5346896 5346915 5346912 +
gttccttctcaacatctgtg

SEQ ID NO: 22542 - DNA, 20 bp, Artificial Sequence
  Synthetic oligonucleotide; GAG chr11 5346898 5346917 5346914 +
tccttctcaacatctgtgaa

SEQ ID NO: 22543 - DNA, 20 bp, Artificial Sequence
  Synthetic oligonucleotide; AAG chr11 5346901 5346920 5346917 +
ttctcaacatctgtgaagag

SEQ ID NO: 22544 - DNA, 20 bp, Artificial Sequence
  Synthetic oligonucleotide; CAG chr11 5346904 5346923 5346920 +
tcaacatctgtgaagagaag

SEQ ID NO: 22545 - DNA, 20 bp, Artificial Sequence
  Synthetic oligonucleotide; TGG chr11 5346913 5346932 5346929 +
gtgaagagaagcagtcactg

SEQ ID NO: 22546 - DNA, 20 bp, Artificial Sequence
  Synthetic oligonucleotide; AAG chr11 5346925 5346944 5346941 +
agtcactgtggttattaata

SEQ ID NO: 22547 - DNA, 20 bp, Artificial Sequence
  Synthetic oligonucleotide; TAG chr11 5346929 5346948 5346945 +
actgtggttattaataaaga

SEQ ID NO: 22548 - DNA, 20 bp, Artificial Sequence
  Synthetic oligonucleotide; CAG chr11 5346940 5346959 5346956 +
taataaagatagcaccttcc

SEQ ID NO: 22549 - DNA, 20 bp, Artificial Sequence
  Synthetic oligonucleotide; TAG chr11 5346957 5346976 5346973 +
tcccagatgtctccctttta

SEQ ID NO: 22550 - DNA, 20 bp, Artificial Sequence
  Synthetic oligonucleotide; TGG chr11 5346966 5346985 5346982 +
tctcccttttatagccaact

SEQ ID NO: 22551 - DNA, 20 bp, Artificial Sequence
  Synthetic oligonucleotide; AAG chr11 5346974 5346993 5346990 +
ttatagccaacttggatctt

SEQ ID NO: 22552 - DNA, 20 bp, Artificial Sequence
  Synthetic oligonucleotide; TAG chr11 5347005 5347024 5347021 +
actctgtattaactcctcct

SEQ ID NO: 22553 - DNA, 20 bp, Artificial Sequence
  Synthetic oligonucleotide; GAG chr11 5347007 5347026 5347023 +
tctgtattaactcctcctta

SEQ ID NO: 22554 - DNA, 20 bp, Artificial Sequence
  Synthetic oligonucleotide; AGG chr11 5347008 5347027 5347024 +
ctgtattaactcctccttag

SEQ ID NO: 22555 - DNA, 20 bp, Artificial Sequence
  Synthetic oligonucleotide; GGG chr11 5347009 5347028 5347025 +
tgtattaactcctccttaga

SEQ ID NO: 22556 - DNA, 20 bp, Artificial Sequence
  Synthetic oligonucleotide; GAG chr11 5347011 5347030 5347027 +
tattaactcctccttagagg

SEQ ID NO: 22557 - DNA, 20 bp, Artificial Sequence
  Synthetic oligonucleotide; TGG chr11 5347015 5347034 5347031 +
aactcctccttagagggagc

SEQ ID NO: 22558 - DNA, 20 bp, Artificial Sequence
  Synthetic oligonucleotide; TAG chr11 5347028 5347047 5347044 +
agggagctggaacacttaat

SEQ ID NO: 22559 - DNA, 20 bp, Artificial Sequence
  Synthetic oligonucleotide; AAG chr11 5347038 5347057 5347054 +
aacacttaattagtcccccc

SEQ ID NO: 22560 - DNA, 20 bp, Artificial Sequence
  Synthetic oligonucleotide; AAG chr11 5347069 5347088 5347085 +
taatctttcttttttcaaat

SEQ ID NO: 22561 - DNA, 20 bp, Artificial Sequence
  Synthetic oligonucleotide; TGG chr11 5347076 5347095 5347092 +
tcttttttcaaataagttac

SEQ ID NO: 22562 - DNA, 20 bp, Artificial Sequence
  Synthetic oligonucleotide; AAG chr11 5347086 5347105 5347102 +
aataagttactggctgaatc

SEQ ID NO: 22563 - DNA, 20 bp, Artificial Sequence
  Synthetic oligonucleotide; TGG chr11 5347093 5347112 5347109 +
tactggctgaatcaagccac

SEQ ID NO: 22564 - DNA, 20 bp, Artificial Sequence
  Synthetic oligonucleotide; TAG chr11 5347096 5347115 5347112 +
tggctgaatcaagccactgg

SEQ ID NO: 22565 - DNA, 20 bp, Artificial Sequence
  Synthetic oligonucleotide; AGG chr11 5347097 5347116 5347113 +
ggctgaatcaagccactggt

SEQ ID NO: 22566 - DNA, 20 bp, Artificial Sequence
  Synthetic oligonucleotide; TGG chr11 5347111 5347130 5347127 +
actggtaggacctttatgtg

SEQ ID NO: 22567 - DNA, 20 bp, Artificial Sequence
  Synthetic oligonucleotide; GGG chr11 5347112 5347131 5347128 +
ctggtaggacctttatgtgt

SEQ ID NO: 22568 - DNA, 20 bp, Artificial Sequence
  Synthetic oligonucleotide; GGG chr11 5347113 5347132 5347129 +
tggtaggacctttatgtgtg

SEQ ID NO: 22569 - DNA, 20 bp, Artificial Sequence
  Synthetic oligonucleotide; CAG chr11 5347119 5347138 5347135 +
gacctttatgtgtggggaat

SEQ ID NO: 22570 - DNA, 20 bp, Artificial Sequence
  Synthetic oligonucleotide; CAG chr11 5347123 5347142 5347139 +
tttatgtgtggggaatcaga

SEQ ID NO: 22571 - DNA, 20 bp, Artificial Sequence
  Synthetic oligonucleotide; TAG chr11 5347136 5347155 5347152 +
aatcagacagcctgtcttca

SEQ ID NO: 22572 - DNA, 20 bp, Artificial Sequence
  Synthetic oligonucleotide; CAG chr11 5347142 5347161 5347158 +
acagcctgtcttcatagccc

SEQ ID NO: 22573 - DNA, 20 bp, Artificial Sequence
  Synthetic oligonucleotide; CAG chr11 5347145 5347164 5347161 +
gcctgtcttcatagccccag

SEQ ID NO: 22574 - DNA, 20 bp, Artificial Sequence
  Synthetic oligonucleotide; TGG chr11 5347152 5347171 5347168 +
ttcatagccccagcagactc

SEQ ID NO: 22575 - DNA, 20 bp, Artificial Sequence
  Synthetic oligonucleotide; TGG chr11 5347164 5347183 5347180 +
gcagactctggtatcacctc

SEQ ID NO: 22576 - DNA, 20 bp, Artificial Sequence
  Synthetic oligonucleotide; GGG chr11 5347165 5347184 5347181 +
cagactctggtatcacctct

SEQ ID NO: 22577 - DNA, 20 bp, Artificial Sequence
  Synthetic oligonucleotide; GAG chr11 5347167 5347186 5347183 +
gactctggtatcacctctgg

SEQ ID NO: 22578 - DNA, 20 bp, Artificial Sequence
  Synthetic oligonucleotide; AGG chr11 5347168 5347187 5347184 +
actctggtatcacctctggg

SEQ ID NO: 22579 - DNA, 20 bp, Artificial Sequence
  Synthetic oligonucleotide; CAG chr11 5347197 5347216 5347213 +
attccctacatttacttcaa

SEQ ID NO: 22580 - DNA, 20 bp, Artificial Sequence
  Synthetic oligonucleotide; CAG chr11 5347212 5347231 5347228 +
ttcaacagtcaaatctttcc

SEQ ID NO: 22581 - DNA, 20 bp, Artificial Sequence
  Synthetic oligonucleotide; AAG chr11 5347223 5347242 5347239 +
aatctttcccagtttatctc

SEQ ID NO: 22582 - DNA, 20 bp, Artificial Sequence
  Synthetic oligonucleotide; GAG chr11 5347225 5347244 5347241 +
tctttcccagtttatctcaa

SEQ ID NO: 22583 - DNA, 20 bp, Artificial Sequence
  Synthetic oligonucleotide; AAG chr11 5347229 5347248 5347245 +
tcccagtttatctcaagaga

SEQ ID NO: 22584 - DNA, 20 bp, Artificial Sequence
  Synthetic oligonucleotide; TGG chr11 5347246 5347265 5347262 +
agaaagcctatatatcttct

SEQ ID NO: 22585 - DNA, 20 bp, Artificial Sequence
  Synthetic oligonucleotide; TGG chr11 5347284 5347303 5347300 +
tttctactatatttcctgct

SEQ ID NO: 22586 - DNA, 20 bp, Artificial Sequence
  Synthetic oligonucleotide; TAG chr11 5347289 5347308 5347305 +
actatatttcctgcttggtt

SEQ ID NO: 22587 - DNA, 20 bp, Artificial Sequence
  Synthetic oligonucleotide; CAG chr11 5347294 5347313 5347310 +
atttcctgcttggtttagat

SEQ ID NO: 22588 - DNA, 20 bp, Artificial Sequence
  Synthetic oligonucleotide; GAG chr11 5347296 5347315 5347312 +
ttcctgcttggtttagatca

SEQ ID NO: 22589 - DNA, 20 bp, Artificial Sequence
  Synthetic oligonucleotide; AAG chr11 5347300 5347319 5347316 +
tgcttggtttagatcagaga

SEQ ID NO: 22590 - DNA, 20 bp, Artificial Sequence
  Synthetic oligonucleotide; AAG chr11 5347308 5347327 5347324 +
ttagatcagagaaagcttga

SEQ ID NO: 22591 - DNA, 20 bp, Artificial Sequence
  Synthetic oligonucleotide; CAG chr11 5347311 5347330 5347327 +
gatcagagaaagcttgaaag

SEQ ID NO: 22592 - DNA, 20 bp, Artificial Sequence
  Synthetic oligonucleotide; GAG chr11 5347313 5347332 5347329 +
tcagagaaagcttgaaagca

SEQ ID NO: 22593 - DNA, 20 bp, Artificial Sequence
  Synthetic oligonucleotide; GAG chr11 5347315 5347334 5347331 +
agagaaagcttgaaagcaga

SEQ ID NO: 22594 - DNA, 20 bp, Artificial Sequence
  Synthetic oligonucleotide; TAG chr11 5347319 5347338 5347335 +
aaagcttgaaagcagagagc

SEQ ID NO: 22595 - DNA, 20 bp, Artificial Sequence
  Synthetic oligonucleotide; TAG chr11 5347323 5347342 5347339 +
cttgaaagcagagagctaga

SEQ ID NO: 22596 - DNA, 20 bp, Artificial Sequence
  Synthetic oligonucleotide; TAG chr11 5347328 5347347 5347344 +
aagcagagagctagatagac

SEQ ID NO: 22597 - DNA, 20 bp, Artificial Sequence
  Synthetic oligonucleotide; GAG chr11 5347330 5347349 5347346 +
gcagagagctagatagacta

SEQ ID NO: 22598 - DNA, 20 bp, Artificial Sequence
  Synthetic oligonucleotide; CAG chr11 5347349 5347368 5347365 +
agagtcaatataataaaatt

SEQ ID NO: 22599 - DNA, 20 bp, Artificial Sequence
  Synthetic oligonucleotide; AGG chr11 5347350 5347369 5347366 +
gagtcaatataataaaattc

SEQ ID NO: 22600 - DNA, 20 bp, Artificial Sequence
  Synthetic oligonucleotide; CAG chr11 5347353 5347372 5347369 +
tcaatataataaaattcagg

SEQ ID NO: 22601 - DNA, 20 bp, Artificial Sequence
  Synthetic oligonucleotide; TAG chr11 5347363 5347382 5347379 +
aaaattcaggcagccttctc

SEQ ID NO: 22602 - DNA, 20 bp, Artificial Sequence
  Synthetic oligonucleotide; CAG chr11 5347390 5347409 5347406 +
caacgtgaacgcacattctg

SEQ ID NO: 22603 - DNA, 20 bp, Artificial Sequence
  Synthetic oligonucleotide; GAG chr11 5347416 5347435 5347432 +
tcactaactattcccttctt

SEQ ID NO: 22604 - DNA, 20 bp, Artificial Sequence
  Synthetic oligonucleotide; TAG chr11 5347421 5347440 5347437 +
aactattcccttcttgagtt

SEQ ID NO: 22605 - DNA, 20 bp, Artificial Sequence
  Synthetic oligonucleotide; CAG chr11 5347429 5347448 5347445 +
ccttcttgagtttagcctac

SEQ ID NO: 22606 - DNA, 20 bp, Artificial Sequence
  Synthetic oligonucleotide; AAG chr11 5347432 5347451 5347448 +
tcttgagtttagcctaccag

SEQ ID NO: 22607 - DNA, 20 bp, Artificial Sequence
  Synthetic oligonucleotide; CAG chr11 5347447 5347466 5347463 +
accagaagttttctcttttc

SEQ ID NO: 22608 - DNA, 20 bp, Artificial Sequence
  Synthetic oligonucleotide; AGG chr11 5347448 5347467 5347464 +
ccagaagttttctcttttcc

SEQ ID NO: 22609 - DNA, 20 bp, Artificial Sequence
  Synthetic oligonucleotide; GGG chr11 5347449 5347468 5347465 +
cagaagttttctcttttcca

SEQ ID NO: 22610 - DNA, 20 bp, Artificial Sequence
  Synthetic oligonucleotide; GGG chr11 5347450 5347469 5347466 +
agaagttttctcttttccag

SEQ ID NO: 22611 - DNA, 20 bp, Artificial Sequence
  Synthetic oligonucleotide; CAG chr11 5347456 5347475 5347472 +
tttctcttttccaggggatg

SEQ ID NO: 22612 - DNA, 20 bp, Artificial Sequence
  Synthetic oligonucleotide; CAG chr11 5347459 5347478 5347475 +
ctcttttccaggggatgcag

SEQ ID NO: 22613 - DNA, 20 bp, Artificial Sequence
  Synthetic oligonucleotide; AGG chr11 5347460 5347479 5347476 +
tcttttccaggggatgcagc

SEQ ID NO: 22614 - DNA, 20 bp, Artificial Sequence
  Synthetic oligonucleotide; TGG chr11 5347476 5347495 5347492 +
cagcaggcatactcatcaca

SEQ ID NO: 22615 - DNA, 20 bp, Artificial Sequence
  Synthetic oligonucleotide; CAG chr11 5347484 5347503 5347500 +
atactcatcacatggtgctt

SEQ ID NO: 22616 - DNA, 20 bp, Artificial Sequence
  Synthetic oligonucleotide; AAG chr11 5347489 5347508 5347505 +
catcacatggtgcttcagcc

SEQ ID NO: 22617 - DNA, 20 bp, Artificial Sequence
  Synthetic oligonucleotide; TGG chr11 5347512 5347531 5347528 +
cacaccacatcactttgtga

SEQ ID NO: 22618 - DNA, 20 bp, Artificial Sequence
  Synthetic oligonucleotide; CAG chr11 5347535 5347554 5347551 +
caattattatatgcgtttta

SEQ ID NO: 22619 - DNA, 20 bp, Artificial Sequence
  Synthetic oligonucleotide; AAG chr11 5347539 5347558 5347555 +
tattatatgcgttttacagt

SEQ ID NO: 22620 - DNA, 20 bp, Artificial Sequence
  Synthetic oligonucleotide; AGG chr11 5347540 5347559 5347556 +
attatatgcgttttacagta

SEQ ID NO: 22621 - DNA, 20 bp, Artificial Sequence
  Synthetic oligonucleotide; GAG chr11 5347558 5347577 5347574 +
taaggactatgaaatgcaat

SEQ ID NO: 22622 - DNA, 20 bp, Artificial Sequence
  Synthetic oligonucleotide; AAG chr11 5347575 5347594 5347591 +
aatgagataaaataattcca

SEQ ID NO: 22623 - DNA, 20 bp, Artificial Sequence
  Synthetic oligonucleotide; TAG chr11 5347578 5347597 5347594 +
gagataaaataattccaaag

SEQ ID NO: 22624 - DNA, 20 bp, Artificial Sequence
  Synthetic oligonucleotide; CAG chr11 5347583 5347602 5347599 +
aaaataattccaaagtagca

SEQ ID NO: 22625 - DNA, 20 bp, Artificial Sequence
  Synthetic oligonucleotide; AAG chr11 5347587 5347606 5347603 +
taattccaaagtagcacagc

SEQ ID NO: 22626 - DNA, 20 bp, Artificial Sequence
  Synthetic oligonucleotide; GAG chr11 5347589 5347608 5347605 +
attccaaagtagcacagcaa

SEQ ID NO: 22627 - DNA, 20 bp, Artificial Sequence
  Synthetic oligonucleotide; AAG chr11 5347595 5347614 5347611 +
aagtagcacagcaagagcca

SEQ ID NO: 22628 - DNA, 20 bp, Artificial Sequence
  Synthetic oligonucleotide; TAG chr11 5347606 5347625 5347622 +
caagagccaaagccacaatg

SEQ ID NO: 22629 - DNA, 20 bp, Artificial Sequence
  Synthetic oligonucleotide; CAG chr11 5347629 5347648 5347645 +
acaaaatattcaacctccaa

SEQ ID NO: 22630 - DNA, 20 bp, Artificial Sequence
  Synthetic oligonucleotide; GAG chr11 5347631 5347650 5347647 +
aaaatattcaacctccaaca

SEQ ID NO: 22631 - DNA, 20 bp, Artificial Sequence
  Synthetic oligonucleotide; AGG chr11 5347632 5347651 5347648 +
aaatattcaacctccaacag

SEQ ID NO: 22632 - DNA, 20 bp, Artificial Sequence
  Synthetic oligonucleotide; CAG chr11 5347643 5347662 5347659 +
ctccaacagaggaaaacctc

SEQ ID NO: 22633 - DNA, 20 bp, Artificial Sequence
  Synthetic oligonucleotide; AAG chr11 5347649 5347668 5347665 +
cagaggaaaacctccagtaa

SEQ ID NO: 22634 - DNA, 20 bp, Artificial Sequence
  Synthetic oligonucleotide; CAG chr11 5347653 5347672 5347669 +
ggaaaacctccagtaaaagc

SEQ ID NO: 22635 - DNA, 20 bp, Artificial Sequence
  Synthetic oligonucleotide; AGG chr11 5347654 5347673 5347670 +
gaaaacctccagtaaaagcc

SEQ ID NO: 22636 - DNA, 20 bp, Artificial Sequence
  Synthetic oligonucleotide; CAG chr11 5347658 5347677 5347674 +
acctccagtaaaagccagga

SEQ ID NO: 22637 - DNA, 20 bp, Artificial Sequence
  Synthetic oligonucleotide; GAG chr11 5347660 5347679 5347676 +
ctccagtaaaagccaggaca

SEQ ID NO: 22638 - DNA, 20 bp, Artificial Sequence
  Synthetic oligonucleotide; CAG chr11 5347664 5347683 5347680 +
agtaaaagccaggacagaga

SEQ ID NO: 22639 - DNA, 20 bp, Artificial Sequence
  Synthetic oligonucleotide; GAG chr11 5347666 5347685 5347682 +
taaaagccaggacagagaca

SEQ ID NO: 22640 - DNA, 20 bp, Artificial Sequence
  Synthetic oligonucleotide; GAG chr11 5347674 5347693 5347690 +
aggacagagacagagatctt

SEQ ID NO: 22641 - DNA, 20 bp, Artificial Sequence
  Synthetic oligonucleotide; AAG chr11 5347689 5347708 5347705 +
atcttgagttgtgctgttca

SEQ ID NO: 22642 - DNA, 20 bp, Artificial Sequence
  Synthetic oligonucleotide; AAG chr11 5347704 5347723 5347720 +
gttcaaagcccaatacccac

SEQ ID NO: 22643 - DNA, 20 bp, Artificial Sequence
  Synthetic oligonucleotide; AGG chr11 5347705 5347724 5347721 +
ttcaaagcccaatacccaca

SEQ ID NO: 22644 - DNA, 20 bp, Artificial Sequence
  Synthetic oligonucleotide; GAG chr11 5347710 5347729 5347726 +
agcccaatacccacaaggct

SEQ ID NO: 22645 - DNA, 20 bp, Artificial Sequence
  Synthetic oligonucleotide; AGG chr11 5347711 5347730 5347727 +
gcccaatacccacaaggctg

SEQ ID NO: 22646 - DNA, 20 bp, Artificial Sequence
  Synthetic oligonucleotide; GGG chr11 5347712 5347731 5347728 +
cccaatacccacaaggctga

SEQ ID NO: 22647 - DNA, 20 bp, Artificial Sequence
  Synthetic oligonucleotide; TAG chr11 5347724 5347743 5347740 +
aaggctgagggcacaaataa

SEQ ID NO: 22648 - DNA, 20 bp, Artificial Sequence
  Synthetic oligonucleotide; GAG chr11 5347726 5347745 5347742 +
ggctgagggcacaaataata

SEQ ID NO: 22649 - DNA, 20 bp, Artificial Sequence
  Synthetic oligonucleotide; AAG chr11 5347732 5347751 5347748 +
gggcacaaataatagagaaa

SEQ ID NO: 22650 - DNA, 20 bp, Artificial Sequence
  Synthetic oligonucleotide; TGG chr11 5347736 5347755 5347752 +
acaaataatagagaaaaaga

SEQ ID NO: 22651 - DNA, 20 bp, Artificial Sequence
  Synthetic oligonucleotide; AAG chr11 5347739 5347758 5347755 +
aataatagagaaaaagatgg

SEQ ID NO: 22652 - DNA, 20 bp, Artificial Sequence
  Synthetic oligonucleotide; AGG chr11 5347740 5347759 5347756 +
ataatagagaaaaagatgga

SEQ ID NO: 22653 - DNA, 20 bp, Artificial Sequence
  Synthetic oligonucleotide; AAG chr11 5347743 5347762 5347759 +
atagagaaaaagatggaagg

SEQ ID NO: 22654 - DNA, 20 bp, Artificial Sequence
  Synthetic oligonucleotide; AGG chr11 5347744 5347763 5347760 +
tagagaaaaagatggaagga

SEQ ID NO: 22655 - DNA, 20 bp, Artificial Sequence
  Synthetic oligonucleotide; GAG chr11 5347746 5347765 5347762 +
gagaaaaagatggaaggaag

SEQ ID NO: 22656 - DNA, 20 bp, Artificial Sequence
  Synthetic oligonucleotide; AGG chr11 5347747 5347766 5347763 +
agaaaaagatggaaggaagg

SEQ ID NO: 22657 - DNA, 20 bp, Artificial Sequence
  Synthetic oligonucleotide; TAG chr11 5347750 5347769 5347766 +
aaaagatggaaggaaggagg

SEQ ID NO: 22658 - DNA, 20 bp, Artificial Sequence
  Synthetic oligonucleotide; AGG chr11 5347751 5347770 5347767 +
aaagatggaaggaaggaggt

SEQ ID NO: 22659 - DNA, 20 bp, Artificial Sequence
  Synthetic oligonucleotide; GGG chr11 5347752 5347771 5347768 +
aagatggaaggaaggaggta

SEQ ID NO: 22660 - DNA, 20 bp, Artificial Sequence
  Synthetic oligonucleotide; GAG chr11 5347754 5347773 5347770 +
gatggaaggaaggaggtagg

SEQ ID NO: 22661 - DNA, 20 bp, Artificial Sequence
  Synthetic oligonucleotide; GAG chr11 5347756 5347775 5347772 +
tggaaggaaggaggtaggga

SEQ ID NO: 22662 - DNA, 20 bp, Artificial Sequence
  Synthetic oligonucleotide; GAG chr11 5347758 5347777 5347774 +
gaaggaaggaggtagggaga

SEQ ID NO: 22663 - DNA, 20 bp, Artificial Sequence
  Synthetic oligonucleotide; AGG chr11 5347759 5347778 5347775 +
aaggaaggaggtagggagag

SEQ ID NO: 22664 - DNA, 20 bp, Artificial Sequence
  Synthetic oligonucleotide; GGG chr11 5347760 5347779 5347776 +
aggaaggaggtagggagaga

SEQ ID NO: 22665 - DNA, 20 bp, Artificial Sequence
  Synthetic oligonucleotide; AAG chr11 5347763 5347782 5347779 +
aaggaggtagggagagaggg

SEQ ID NO: 22666 - DNA, 20 bp, Artificial Sequence
  Synthetic oligonucleotide; GAG chr11 5347765 5347784 5347781 +
ggaggtagggagagagggaa

SEQ ID NO: 22667 - DNA, 20 bp, Artificial Sequence
  Synthetic oligonucleotide; GAG chr11 5347767 5347786 5347783 +
aggtagggagagagggaaga

SEQ ID NO: 22668 - DNA, 20 bp, Artificial Sequence
  Synthetic oligonucleotide; AGG chr11 5347768 5347787 5347784 +
ggtagggagagagggaagag

SEQ ID NO: 22669 - DNA, 20 bp, Artificial Sequence
  Synthetic oligonucleotide; GAG chr11 5347770 5347789 5347786 +
tagggagagagggaagagag

SEQ ID NO: 22670 - DNA, 20 bp, Artificial Sequence
  Synthetic oligonucleotide; AGG chr11 5347771 5347790 5347787 +
agggagagagggaagagagg

SEQ ID NO: 22671 - DNA, 20 bp, Artificial Sequence
  Synthetic oligonucleotide; GGG chr11 5347772 5347791 5347788 +
gggagagagggaagagagga

SEQ ID NO: 22672 - DNA, 20 bp, Artificial Sequence
  Synthetic oligonucleotide; GAG chr11 5347774 5347793 5347790 +
gagagagggaagagaggagg

SEQ ID NO: 22673 - DNA, 20 bp, Artificial Sequence
  Synthetic oligonucleotide; CAG chr11 5347777 5347796 5347793 +
agagggaagagaggagggag

SEQ ID NO: 22674 - DNA, 20 bp, Artificial Sequence
  Synthetic oligonucleotide; AAG chr11 5347780 5347799 5347796 +
gggaagagaggagggagcag

SEQ ID NO: 22675 - DNA, 20 bp, Artificial Sequence
  Synthetic oligonucleotide; GAG chr11 5347782 5347801 5347798 +
gaagagaggagggagcagaa

SEQ ID NO: 22676 - DNA, 20 bp, Artificial Sequence
  Synthetic oligonucleotide; AGG chr11 5347783 5347802 5347799 +
aagagaggagggagcagaag

SEQ ID NO: 22677 - DNA, 20 bp, Artificial Sequence
  Synthetic oligonucleotide; GGG chr11 5347784 5347803 5347800 +
agagaggagggagcagaaga

SEQ ID NO: 22678 - DNA, 20 bp, Artificial Sequence
  Synthetic oligonucleotide; GAG chr11 5347786 5347805 5347802 +
agaggagggagcagaagagg

SEQ ID NO: 22679 - DNA, 20 bp, Artificial Sequence
  Synthetic oligonucleotide; AGG chr11 5347787 5347806 5347803 +
gaggagggagcagaagaggg

SEQ ID NO: 22680 - DNA, 20 bp, Artificial Sequence
  Synthetic oligonucleotide; GGG chr11 5347788 5347807 5347804 +
aggagggagcagaagaggga

SEQ ID NO: 22681 - DNA, 20 bp, Artificial Sequence
  Synthetic oligonucleotide; GAG chr11 5347790 5347809 5347806 +
gagggagcagaagagggagg

SEQ ID NO: 22682 - DNA, 20 bp, Artificial Sequence
  Synthetic oligonucleotide; AGG chr11 5347791 5347810 5347807 +
agggagcagaagagggaggg

SEQ ID NO: 22683 - DNA, 20 bp, Artificial Sequence
  Synthetic oligonucleotide; GGG chr11 5347792 5347811 5347808 +
gggagcagaagagggaggga

SEQ ID NO: 22684 - DNA, 20 bp, Artificial Sequence
  Synthetic oligonucleotide; AAG chr11 5347795 5347814 5347811 +
agcagaagagggagggaggg

SEQ ID NO: 22685 - DNA, 20 bp, Artificial Sequence
  Synthetic oligonucleotide; CAG chr11 5347816 5347835 5347832 +
agaacaataattatctaaat

SEQ ID NO: 22686 - DNA, 20 bp, Artificial Sequence
  Synthetic oligonucleotide; AGG chr11 5347817 5347836 5347833 +
gaacaataattatctaaatc

SEQ ID NO: 22687 - DNA, 20 bp, Artificial Sequence
  Synthetic oligonucleotide; TGG chr11 5347822 5347841 5347838 +
ataattatctaaatcaggaa

SEQ ID NO: 22688 - DNA, 20 bp, Artificial Sequence
  Synthetic oligonucleotide; TGG chr11 5347829 5347848 5347845 +
tctaaatcaggaatggtctc

SEQ ID NO: 22689 - DNA, 20 bp, Artificial Sequence
  Synthetic oligonucleotide; GGG chr11 5347830 5347849 5347846 +
ctaaatcaggaatggtctct

SEQ ID NO: 22690 - DNA, 20 bp, Artificial Sequence
  Synthetic oligonucleotide; GGG chr11 5347831 5347850 5347847 +
taaatcaggaatggtctctg

SEQ ID NO: 22691 - DNA, 20 bp, Artificial Sequence
  Synthetic oligonucleotide; GAG chr11 5347833 5347852 5347849 +
aatcaggaatggtctctggg

SEQ ID NO: 22692 - DNA, 20 bp, Artificial Sequence
  Synthetic oligonucleotide; AGG chr11 5347834 5347853 5347850 +
atcaggaatggtctctgggg

SEQ ID NO: 22693 - DNA, 20 bp, Artificial Sequence
  Synthetic oligonucleotide; GAG chr11 5347836 5347855 5347852 +
caggaatggtctctggggag

SEQ ID NO: 22694 - DNA, 20 bp, Artificial Sequence
  Synthetic oligonucleotide; CAG chr11 5347861 5347880 5347877 +
tctaaaataaatgttcctac

SEQ ID NO: 22695 - DNA, 20 bp, Artificial Sequence
  Synthetic oligonucleotide; CAG chr11 5347865 5347884 5347881 +
aaataaatgttcctaccagc

SEQ ID NO: 22696 - DNA, 20 bp, Artificial Sequence
  Synthetic oligonucleotide; AGG chr11 5347866 5347885 5347882 +
aataaatgttcctaccagcc

SEQ ID NO: 22697 - DNA, 20 bp, Artificial Sequence
  Synthetic oligonucleotide; CAG chr11 5347877 5347896 5347893 +
ctaccagccaggctcatgtg

SEQ ID NO: 22698 - DNA, 20 bp, Artificial Sequence
  Synthetic oligonucleotide; AAG chr11 5347888 5347907 5347904 +
gctcatgtgcagattctgaa

SEQ ID NO: 22699 - DNA, 20 bp, Artificial Sequence
  Synthetic oligonucleotide; CGG chr11 5347912 5347931 5347928 +
tgatgcccaaatctttcata

SEQ ID NO: 22700 - DNA, 20 bp, Artificial Sequence
  Synthetic oligonucleotide; AAG chr11 5347918 5347937 5347934 +
ccaaatctttcatacggcta

SEQ ID NO: 22701 - DNA, 20 bp, Artificial Sequence
  Synthetic oligonucleotide; GAG chr11 5347925 5347944 5347941 +
tttcatacggctaaagatgt

SEQ ID NO: 22702 - DNA, 20 bp, Artificial Sequence
  Synthetic oligonucleotide; TGG chr11 5347939 5347958 5347955 +
agatgtgagatacatgacta

SEQ ID NO: 22703 - DNA, 20 bp, Artificial Sequence
  Synthetic oligonucleotide; AAG chr11 5347947 5347966 5347963 +
gatacatgactatggaactg

SEQ ID NO: 22704 - DNA, 20 bp, Artificial Sequence
  Synthetic oligonucleotide; TGG chr11 5347952 5347971 5347968 +
atgactatggaactgaagaa

SEQ ID NO: 22705 - DNA, 20 bp, Artificial Sequence
  Synthetic oligonucleotide; AAG chr11 5347955 5347974 5347971 +
actatggaactgaagaatgg

SEQ ID NO: 22706 - DNA, 20 bp, Artificial Sequence
  Synthetic oligonucleotide; AGG chr11 5347956 5347975 5347972 +
ctatggaactgaagaatgga

SEQ ID NO: 22707 - DNA, 20 bp, Artificial Sequence
  Synthetic oligonucleotide; GGG chr11 5347957 5347976 5347973 +
tatggaactgaagaatggaa

SEQ ID NO: 22708 - DNA, 20 bp, Artificial Sequence
  Synthetic oligonucleotide; AAG chr11 5347964 5347983 5347980 +
ctgaagaatggaagggaaca

SEQ ID NO: 22709 - DNA, 20 bp, Artificial Sequence
  Synthetic oligonucleotide; CAG chr11 5347970 5347989 5347986 +
aatggaagggaacaaagttt

SEQ ID NO: 22710 - DNA, 20 bp, Artificial Sequence
  Synthetic oligonucleotide; AGG chr11 5347971 5347990 5347987 +
atggaagggaacaaagtttc

SEQ ID NO: 22711 - DNA, 20 bp, Artificial Sequence
  Synthetic oligonucleotide; CAG chr11 5347975 5347994 5347991 +
aagggaacaaagtttcaggt

SEQ ID NO: 22712 - DNA, 20 bp, Artificial Sequence
  Synthetic oligonucleotide; GAG chr11 5347979 5347998 5347995 +
gaacaaagtttcaggtcagt

SEQ ID NO: 22713 - DNA, 20 bp, Artificial Sequence
  Synthetic oligonucleotide; AGG chr11 5347980 5347999 5347996 +
aacaaagtttcaggtcagtg

SEQ ID NO: 22714 - DNA, 20 bp, Artificial Sequence
  Synthetic oligonucleotide; GGG chr11 5347981 5348000 5347997 +
acaaagtttcaggtcagtga

SEQ ID NO: 22715 - DNA, 20 bp, Artificial Sequence
  Synthetic oligonucleotide; AAG chr11 5348005 5348024 5348021 +
atttaatgaatctcctctgt

SEQ ID NO: 22716 - DNA, 20 bp, Artificial Sequence
  Synthetic oligonucleotide; CAG chr11 5348017 5348036 5348033 +
tcctctgtaagatctcattg

SEQ ID NO: 22717 - DNA, 20 bp, Artificial Sequence
  Synthetic oligonucleotide; AGG chr11 5348018 5348037 5348034 +
cctctgtaagatctcattgc

SEQ ID NO: 22718 - DNA, 20 bp, Artificial Sequence
  Synthetic oligonucleotide; AAG chr11 5348025 5348044 5348041 +
aagatctcattgcaggaacc

SEQ ID NO: 22719 - DNA, 20 bp, Artificial Sequence
  Synthetic oligonucleotide; AGG chr11 5348026 5348045 5348042 +
agatctcattgcaggaacca

SEQ ID NO: 22720 - DNA, 20 bp, Artificial Sequence
  Synthetic oligonucleotide; CAG chr11 5348040 5348059 5348056 +
gaaccaaggcaaaaaaaaaa

SEQ ID NO: 22721 - DNA, 20 bp, Artificial Sequence
  Synthetic oligonucleotide; GAG chr11 5348042 5348061 5348058 +
accaaggcaaaaaaaaaaca

SEQ ID NO: 22722 - DNA, 20 bp, Artificial Sequence
  Synthetic oligonucleotide; GAG chr11 5348044 5348063 5348060 +
caaggcaaaaaaaaaacaga

SEQ ID NO: 22723 - DNA, 20 bp, Artificial Sequence
  Synthetic oligonucleotide; AAG chr11 5348051 5348070 5348067 +
aaaaaaaaacagagagatcg

SEQ ID NO: 22724 - DNA, 20 bp, Artificial Sequence
  Synthetic oligonucleotide; TAG chr11 5348063 5348082 5348079 +
agagatcgaagctgatttct

SEQ ID NO: 22725 - DNA, 20 bp, Artificial Sequence
  Synthetic oligonucleotide; AAG chr11 5348067 5348086 5348083 +
atcgaagctgatttcttagc

SEQ ID NO: 22726 - DNA, 20 bp, Artificial Sequence
  Synthetic oligonucleotide; GAG chr11 5348069 5348088 5348085 +
cgaagctgatttcttagcaa

SEQ ID NO: 22727 - DNA, 20 bp, Artificial Sequence
  Synthetic oligonucleotide; AAG chr11 5348074 5348093 5348090 +
ctgatttcttagcaagagaa

SEQ ID NO: 22728 - DNA, 20 bp, Artificial Sequence
  Synthetic oligonucleotide; TAG chr11 5348080 5348099 5348096 +
tcttagcaagagaaaagtaa

SEQ ID NO: 22729 - DNA, 20 bp, Artificial Sequence
  Synthetic oligonucleotide; AAG chr11 5348094 5348113 5348110 +
aagtaatagtgttgtctgct

SEQ ID NO: 22730 - DNA, 20 bp, Artificial Sequence
  Synthetic oligonucleotide; GAG chr11 5348096 5348115 5348112 +
gtaatagtgttgtctgctaa

SEQ ID NO: 22731 - DNA, 20 bp, Artificial Sequence
  Synthetic oligonucleotide; TAG chr11 5348099 5348118 5348115 +
atagtgttgtctgctaagag

SEQ ID NO: 22732 - DNA, 20 bp, Artificial Sequence
  Synthetic oligonucleotide; TAG chr11 5348109 5348128 5348125 +
ctgctaagagtagatatatg

SEQ ID NO: 22733 - DNA, 20 bp, Artificial Sequence
  Synthetic oligonucleotide; TAG chr11 5348112 5348131 5348128 +
ctaagagtagatatatgtag

SEQ ID NO: 22734 - DNA, 20 bp, Artificial Sequence
  Synthetic oligonucleotide; AGG chr11 5348113 5348132 5348129 +
taagagtagatatatgtagt

SEQ ID NO: 22735 - DNA, 20 bp, Artificial Sequence
  Synthetic oligonucleotide; TGG chr11 5348118 5348137 5348134 +
gtagatatatgtagtaggca

SEQ ID NO: 22736 - DNA, 20 bp, Artificial Sequence
  Synthetic oligonucleotide; GGG chr11 5348119 5348138 5348135 +
tagatatatgtagtaggcat

SEQ ID NO: 22737 - DNA, 20 bp, Artificial Sequence
  Synthetic oligonucleotide; AAG chr11 5348127 5348146 5348143 +
tgtagtaggcatgggtccta

SEQ ID NO: 22738 - DNA, 20 bp, Artificial Sequence
  Synthetic oligonucleotide; TGG chr11 5348152 5348171 5348168 +
tccctgacatctctaaaact

SEQ ID NO: 22739 - DNA, 20 bp, Artificial Sequence
  Synthetic oligonucleotide; GAG chr11 5348162 5348181 5348178 +
ctctaaaacttggtttcttt

SEQ ID NO: 22740 - DNA, 20 bp, Artificial Sequence
  Synthetic oligonucleotide; GAG chr11 5348164 5348183 5348180 +
ctaaaacttggtttctttga

SEQ ID NO: 22741 - DNA, 20 bp, Artificial Sequence
  Synthetic oligonucleotide; AAG chr11 5348187 5348206 5348203 +
ttacctcttcaaatataaaa

SEQ ID NO: 22742 - DNA, 20 bp, Artificial Sequence
  Synthetic oligonucleotide; AAG chr11 5348192 5348211 5348208 +
tcttcaaatataaaaaagtg

SEQ ID NO: 22743 - DNA, 20 bp, Artificial Sequence
  Synthetic oligonucleotide; AGG chr11 5348193 5348212 5348209 +
cttcaaatataaaaaagtga

SEQ ID NO: 22744 - DNA, 20 bp, Artificial Sequence
  Synthetic oligonucleotide; TAG chr11 5348197 5348216 5348213 +
aaatataaaaaagtgaagga

SEQ ID NO: 22745 - DNA, 20 bp, Artificial Sequence
  Synthetic oligonucleotide; TGG chr11 5348204 5348223 5348220 +
aaaaagtgaaggatagattc

SEQ ID NO: 22746 - DNA, 20 bp, Artificial Sequence
  Synthetic oligonucleotide; AAG chr11 5348214 5348233 5348230 +
ggatagattctggaacacat

SEQ ID NO: 22747 - DNA, 20 bp, Artificial Sequence
  Synthetic oligonucleotide; AGG chr11 5348215 5348234 5348231 +
gatagattctggaacacata

SEQ ID NO: 22748 - DNA, 20 bp, Artificial Sequence
  Synthetic oligonucleotide; CAG chr11 5348239 5348258 5348255 +
aaacaattctacgaacaaac

SEQ ID NO: 22749 - DNA, 20 bp, Artificial Sequence
  Synthetic oligonucleotide; GAG chr11 5348241 5348260 5348257 +
acaattctacgaacaaacca

SEQ ID NO: 22750 - DNA, 20 bp, Artificial Sequence
  Synthetic oligonucleotide; TGG chr11 5348246 5348265 5348262 +
tctacgaacaaaccagagca

SEQ ID NO: 22751 - DNA, 20 bp, Artificial Sequence
  Synthetic oligonucleotide; GGG chr11 5348247 5348266 5348263 +
ctacgaacaaaccagagcat

SEQ ID NO: 22752 - DNA, 20 bp, Artificial Sequence
  Synthetic oligonucleotide; CAG chr11 5348258 5348277 5348274 +
ccagagcatgggtgttgact

SEQ ID NO: 22753 - DNA, 20 bp, Artificial Sequence
  Synthetic oligonucleotide; AGG chr11 5348259 5348278 5348275 +
cagagcatgggtgttgactc

SEQ ID NO: 22754 - DNA, 20 bp, Artificial Sequence
  Synthetic oligonucleotide; TGG chr11 5348271 5348290 5348287 +
gttgactcaggcatgaatta

SEQ ID NO: 22755 - DNA, 20 bp, Artificial Sequence
  Synthetic oligonucleotide; GGG chr11 5348272 5348291 5348288 +
ttgactcaggcatgaattat

SEQ ID NO: 22756 - DNA, 20 bp, Artificial Sequence
  Synthetic oligonucleotide; GGG chr11 5348273 5348292 5348289 +
tgactcaggcatgaattatg

SEQ ID NO: 22757 - DNA, 20 bp, Artificial Sequence
  Synthetic oligonucleotide; TAG chr11 5348279 5348298 5348295 +
aggcatgaattatggggttg

SEQ ID NO: 22758 - DNA, 20 bp, Artificial Sequence
  Synthetic oligonucleotide; TGG chr11 5348318 5348337 5348334 +
gactgattctttaatctctc

SEQ ID NO: 22759 - DNA, 20 bp, Artificial Sequence
  Synthetic oligonucleotide; GAG chr11 5348337 5348356 5348353 +
ctggcttccattctaaccct

SEQ ID NO: 22760 - DNA, 20 bp, Artificial Sequence
  Synthetic oligonucleotide; GAG chr11 5348339 5348358 5348355 +
ggcttccattctaaccctga

SEQ ID NO: 22761 - DNA, 20 bp, Artificial Sequence
  Synthetic oligonucleotide; TAG chr11 5348374 5348393 5348390 +
caaccccatgtcttttacct

SEQ ID NO: 22762 - DNA, 20 bp, Artificial Sequence
  Synthetic oligonucleotide; AAG chr11 5348377 5348396 5348393 +
ccccatgtcttttaccttag

SEQ ID NO: 22763 - DNA, 20 bp, Artificial Sequence
  Synthetic oligonucleotide; CAG chr11 5348382 5348401 5348398 +
tgtcttttaccttagaagtc

SEQ ID NO: 22764 - DNA, 20 bp, Artificial Sequence
  Synthetic oligonucleotide; AAG chr11 5348387 5348406 5348403 +
tttaccttagaagtccagat

SEQ ID NO: 22765 - DNA, 20 bp, Artificial Sequence
  Synthetic oligonucleotide; TAG chr11 5348399 5348418 5348415 +
gtccagataagtgccaaata

SEQ ID NO: 22766 - DNA, 20 bp, Artificial Sequence
  Synthetic oligonucleotide; GAG chr11 5348423 5348442 5348439 +
atcaactcttccaaattctt

SEQ ID NO: 22767 - DNA, 20 bp, Artificial Sequence
  Synthetic oligonucleotide; AGG chr11 5348424 5348443 5348440 +
tcaactcttccaaattcttg

SEQ ID NO: 22768 - DNA, 20 bp, Artificial Sequence
  Synthetic oligonucleotide; GAG chr11 5348426 5348445 5348442 +
aactcttccaaattcttgag

SEQ ID NO: 22769 - DNA, 20 bp, Artificial Sequence
  Synthetic oligonucleotide; AGG chr11 5348427 5348446 5348443 +
actcttccaaattcttgagg

SEQ ID NO: 22770 - DNA, 20 bp, Artificial Sequence
  Synthetic oligonucleotide; CAG chr11 5348447 5348466 5348463 +
aggtatacctctgtaatcat

SEQ ID NO: 22771 - DNA, 20 bp, Artificial Sequence
  Synthetic oligonucleotide; GAG chr11 5348449 5348468 5348465 +
gtatacctctgtaatcatca

SEQ ID NO: 22772 - DNA, 20 bp, Artificial Sequence
  Synthetic oligonucleotide; AGG chr11 5348450 5348469 5348466 +
tatacctctgtaatcatcag

SEQ ID NO: 22773 - DNA, 20 bp, Artificial Sequence
  Synthetic oligonucleotide; TAG chr11 5348466 5348485 5348482 +
tcagaggttcaaatactttc

SEQ ID NO: 22774 - DNA, 20 bp, Artificial Sequence
  Synthetic oligonucleotide; AAG chr11 5348474 5348493 5348490 +
tcaaatactttctagaaaaa

SEQ ID NO: 22775 - DNA, 20 bp, Artificial Sequence
  Synthetic oligonucleotide; AAG chr11 5348517 5348536 5348533 +
taataaaccaattcaaaatt

SEQ ID NO: 22776 - DNA, 20 bp, Artificial Sequence
  Synthetic oligonucleotide; TGG chr11 5348522 5348541 5348538 +
aaccaattcaaaattaagct

SEQ ID NO: 22777 - DNA, 20 bp, Artificial Sequence
  Synthetic oligonucleotide; CGG chr11 5348526 5348545 5348542 +
aattcaaaattaagcttgga

SEQ ID NO: 22778 - DNA, 20 bp, Artificial Sequence
  Synthetic oligonucleotide; GAG chr11 5348528 5348547 5348544 +
ttcaaaattaagcttggacg

SEQ ID NO: 22779 - DNA, 20 bp, Artificial Sequence
  Synthetic oligonucleotide; TGG chr11 5348533 5348552 5348549 +
aattaagcttggacggagct

SEQ ID NO: 22780 - DNA, 20 bp, Artificial Sequence
  Synthetic oligonucleotide; GGG chr11 5348534 5348553 5348550 +
attaagcttggacggagctt

SEQ ID NO: 22781 - DNA, 20 bp, Artificial Sequence
  Synthetic oligonucleotide; TGG chr11 5348550 5348569 5348566 +
gcttgggttatgtgtgcctc

SEQ ID NO: 22782 - DNA, 20 bp, Artificial Sequence
  Synthetic oligonucleotide; CAG chr11 5348555 5348574 5348571 +
ggttatgtgtgcctctggat

SEQ ID NO: 22783 - DNA, 20 bp, Artificial Sequence
  Synthetic oligonucleotide; AGG chr11 5348556 5348575 5348572 +
gttatgtgtgcctctggatc

SEQ ID NO: 22784 - DNA, 20 bp, Artificial Sequence
  Synthetic oligonucleotide; GGG chr11 5348557 5348576 5348573 +
ttatgtgtgcctctggatca

SEQ ID NO: 22785 - DNA, 20 bp, Artificial Sequence
  Synthetic oligonucleotide; GGG chr11 5348558 5348577 5348574 +
tatgtgtgcctctggatcag

SEQ ID NO: 22786 - DNA, 20 bp, Artificial Sequence
  Synthetic oligonucleotide; CAG chr11 5348563 5348582 5348579 +
gtgcctctggatcaggggta

SEQ ID NO: 22787 - DNA, 20 bp, Artificial Sequence
  Synthetic oligonucleotide; TAG chr11 5348573 5348592 5348589 +
atcaggggtacagattcaca

SEQ ID NO: 22788 - DNA, 20 bp, Artificial Sequence
  Synthetic oligonucleotide; TAG chr11 5348588 5348607 5348604 +
tcacatagcctgtgtgactt

SEQ ID NO: 22789 - DNA, 20 bp, Artificial Sequence
  Synthetic oligonucleotide; TGG chr11 5348595 5348614 5348611 +
gcctgtgtgactttagcacc

SEQ ID NO: 22790 - DNA, 20 bp, Artificial Sequence
  Synthetic oligonucleotide; AAG chr11 5348599 5348618 5348615 +
gtgtgactttagcacctgga

SEQ ID NO: 22791 - DNA, 20 bp, Artificial Sequence
  Synthetic oligonucleotide; AGG chr11 5348600 5348619 5348616 +
tgtgactttagcacctggaa

SEQ ID NO: 22792 - DNA, 20 bp, Artificial Sequence
  Synthetic oligonucleotide; CAG chr11 5348617 5348636 5348633 +
gaaaggtttatattgtgtaa

SEQ ID NO: 22793 - DNA, 20 bp, Artificial Sequence
  Synthetic oligonucleotide; AGG chr11 5348618 5348637 5348634 +
aaaggtttatattgtgtaac

SEQ ID NO: 22794 - DNA, 20 bp, Artificial Sequence
  Synthetic oligonucleotide; TAG chr11 5348660 5348679 5348676 +
ttcttttgcctgctttcttc

SEQ ID NO: 22795 - DNA, 20 bp, Artificial Sequence
  Synthetic oligonucleotide; TGG chr11 5348669 5348688 5348685 +
ctgctttcttctagccgccc

SEQ ID NO: 22796 - DNA, 20 bp, Artificial Sequence
  Synthetic oligonucleotide; CAG chr11 5348672 5348691 5348688 +
ctttcttctagccgccctgg

SEQ ID NO: 22797 - DNA, 20 bp, Artificial Sequence
  Synthetic oligonucleotide; TAG chr11 5348680 5348699 5348696 +
tagccgccctggcagctgat

SEQ ID NO: 22798 - DNA, 20 bp, Artificial Sequence
  Synthetic oligonucleotide; TAG chr11 5348684 5348703 5348700 +
cgccctggcagctgattaga

SEQ ID NO: 22799 - DNA, 20 bp, Artificial Sequence
  Synthetic oligonucleotide; CAG chr11 5348695 5348714 5348711 +
ctgattagatagtacccacc

SEQ ID NO: 22800 - DNA, 20 bp, Artificial Sequence
  Synthetic oligonucleotide; CGG chr11 5348699 5348718 5348715 +
ttagatagtacccacccaga

SEQ ID NO: 22801 - DNA, 20 bp, Artificial Sequence
  Synthetic oligonucleotide; GAG chr11 5348701 5348720 5348717 +
agatagtacccacccagacg

SEQ ID NO: 22802 - DNA, 20 bp, Artificial Sequence
  Synthetic oligonucleotide; AGG chr11 5348702 5348721 5348718 +
gatagtacccacccagacgg

SEQ ID NO: 22803 - DNA, 20 bp, Artificial Sequence
  Synthetic oligonucleotide; GGG chr11 5348703 5348722 5348719 +
atagtacccacccagacgga

SEQ ID NO: 22804 - DNA, 20 bp, Artificial Sequence
  Synthetic oligonucleotide; TGG chr11 5348706 5348725 5348722 +
gtacccacccagacggaggg

SEQ ID NO: 22805 - DNA, 20 bp, Artificial Sequence
  Synthetic oligonucleotide; GGG chr11 5348707 5348726 5348723 +
tacccacccagacggagggt

SEQ ID NO: 22806 - DNA, 20 bp, Artificial Sequence
  Synthetic oligonucleotide; TGG chr11 5348710 5348729 5348726 +
ccacccagacggagggtggg

SEQ ID NO: 22807 - DNA, 20 bp, Artificial Sequence
  Synthetic oligonucleotide; GGG chr11 5348711 5348730 5348727 +
cacccagacggagggtgggt

SEQ ID NO: 22808 - DNA, 20 bp, Artificial Sequence
  Synthetic oligonucleotide; CAG chr11 5348725 5348744 5348741 +
gtgggtgggtctgcctctcc

SEQ ID NO: 22809 - DNA, 20 bp, Artificial Sequence
  Synthetic oligonucleotide; TGG chr11 5348755 5348774 5348771 +
actcaaatgttaatctcctt

SEQ ID NO: 22810 - DNA, 20 bp, Artificial Sequence
  Synthetic oligonucleotide; CAG chr11 5348769 5348788 5348785 +
ctcctttggcaacaccctta

SEQ ID NO: 22811 - DNA, 20 bp, Artificial Sequence
  Synthetic oligonucleotide; CAG chr11 5348778 5348797 5348794 +
caacacccttacagcacacc

SEQ ID NO: 22812 - DNA, 20 bp, Artificial Sequence
  Synthetic oligonucleotide; AGG chr11 5348779 5348798 5348795 +
aacacccttacagcacaccc

SEQ ID NO: 22813 - DNA, 20 bp, Artificial Sequence
  Synthetic oligonucleotide; AAG chr11 5348811 5348830 5348827 +
ttgcatccttcaatccaatc

SEQ ID NO: 22814 - DNA, 20 bp, Artificial Sequence
  Synthetic oligonucleotide; CAG chr11 5348837 5348856 5348853 +
gcactcaatattaaccatca

SEQ ID NO: 22815 - DNA, 20 bp, Artificial Sequence
  Synthetic oligonucleotide; AAG chr11 5348841 5348860 5348857 +
tcaatattaaccatcacaga

SEQ ID NO: 22816 - DNA, 20 bp, Artificial Sequence
  Synthetic oligonucleotide; AGG chr11 5348842 5348861 5348858 +
caatattaaccatcacagaa

SEQ ID NO: 22817 - DNA, 20 bp, Artificial Sequence
  Synthetic oligonucleotide; TAG chr11 5348849 5348868 5348865 +
aaccatcacagaaaggataa

SEQ ID NO: 22818 - DNA, 20 bp, Artificial Sequence
  Synthetic oligonucleotide; AAG chr11 5348855 5348874 5348871 +
cacagaaaggataatagcca

SEQ ID NO: 22819 - DNA, 20 bp, Artificial Sequence
  Synthetic oligonucleotide; AGG chr11 5348856 5348875 5348872 +
acagaaaggataatagccaa

SEQ ID NO: 22820 - DNA, 20 bp, Artificial Sequence
  Synthetic oligonucleotide; AAG chr11 5348860 5348879 5348876 +
aaaggataatagccaaaggt

SEQ ID NO: 22821 - DNA, 20 bp, Artificial Sequence
  Synthetic oligonucleotide; AGG chr11 5348861 5348880 5348877 +
aaggataatagccaaaggta

SEQ ID NO: 22822 - DNA, 20 bp, Artificial Sequence
  Synthetic oligonucleotide; GGG chr11 5348862 5348881 5348878 +
aggataatagccaaaggtaa

SEQ ID NO: 22823 - DNA, 20 bp, Artificial Sequence
  Synthetic oligonucleotide; GGG chr11 5348863 5348882 5348879 +
ggataatagccaaaggtaag

SEQ ID NO: 22824 - DNA, 20 bp, Artificial Sequence
  Synthetic oligonucleotide; GGG chr11 5348864 5348883 5348880 +
gataatagccaaaggtaagg

SEQ ID NO: 22825 - DNA, 20 bp, Artificial Sequence
  Synthetic oligonucleotide; AAG chr11 5348873 5348892 5348889 +
caaaggtaagggggtaaaaa

SEQ ID NO: 22826 - DNA, 20 bp, Artificial Sequence
  Synthetic oligonucleotide; AGG chr11 5348874 5348893 5348890 +
aaaggtaagggggtaaaaaa

SEQ ID NO: 22827 - DNA, 20 bp, Artificial Sequence
  Synthetic oligonucleotide; TGG chr11 5348878 5348897 5348894 +
gtaagggggtaaaaaaagga

SEQ ID NO: 22828 - DNA, 20 bp, Artificial Sequence
  Synthetic oligonucleotide; GAG chr11 5348880 5348899 5348896 +
aagggggtaaaaaaaggatg

SEQ ID NO: 22829 - DNA, 20 bp, Artificial Sequence
  Synthetic oligonucleotide; AAG chr11 5348888 5348907 5348904 +
aaaaaaaggatggagatact

SEQ ID NO: 22830 - DNA, 20 bp, Artificial Sequence
  Synthetic oligonucleotide; GAG chr11 5348896 5348915 5348912 +
gatggagatactaagtgctt

SEQ ID NO: 22831 - DNA, 20 bp, Artificial Sequence
  Synthetic oligonucleotide; CAG chr11 5348900 5348919 5348916 +
gagatactaagtgcttgaga

SEQ ID NO: 22832 - DNA, 20 bp, Artificial Sequence
  Synthetic oligonucleotide; AAG chr11 5348905 5348924 5348921 +
actaagtgcttgagacagaa

SEQ ID NO: 22833 - DNA, 20 bp, Artificial Sequence
  Synthetic oligonucleotide; GAG chr11 5348907 5348926 5348923 +
taagtgcttgagacagaaaa

SEQ ID NO: 22834 - DNA, 20 bp, Artificial Sequence
  Synthetic oligonucleotide; CAG chr11 5348913 5348932 5348929 +
cttgagacagaaaagagtgt

SEQ ID NO: 22835 - DNA, 20 bp, Artificial Sequence
  Synthetic oligonucleotide; AGG chr11 5348914 5348933 5348930 +
ttgagacagaaaagagtgtc

SEQ ID NO: 22836 - DNA, 20 bp, Artificial Sequence
  Synthetic oligonucleotide; AAG chr11 5348919 5348938 5348935 +
acagaaaagagtgtcaggaa

SEQ ID NO: 22837 - DNA, 20 bp, Artificial Sequence
  Synthetic oligonucleotide; AAG chr11 5348924 5348943 5348940 +
aaagagtgtcaggaaaagtg

SEQ ID NO: 22838 - DNA, 20 bp, Artificial Sequence
  Synthetic oligonucleotide; AGG chr11 5348925 5348944 5348941 +
aagagtgtcaggaaaagtga

SEQ ID NO: 22839 - DNA, 20 bp, Artificial Sequence
  Synthetic oligonucleotide; AAG chr11 5348932 5348951 5348948 +
tcaggaaaagtgaaggaaaa

SEQ ID NO: 22840 - DNA, 20 bp, Artificial Sequence
  Synthetic oligonucleotide; AAG chr11 5348938 5348957 5348954 +
aaagtgaaggaaaaaagcca

SEQ ID NO: 22841 - DNA, 20 bp, Artificial Sequence
  Synthetic oligonucleotide; AGG chr11 5348939 5348958 5348955 +
aagtgaaggaaaaaagccaa

SEQ ID NO: 22842 - DNA, 20 bp, Artificial Sequence
  Synthetic oligonucleotide; GGG chr11 5348940 5348959 5348956 +
agtgaaggaaaaaagccaaa

SEQ ID NO: 22843 - DNA, 20 bp, Artificial Sequence
  Synthetic oligonucleotide; AAG chr11 5348943 5348962 5348959 +
gaaggaaaaaagccaaaggg

SEQ ID NO: 22844 - DNA, 20 bp, Artificial Sequence
  Synthetic oligonucleotide; AGG chr11 5348944 5348963 5348960 +
aaggaaaaaagccaaaggga

SEQ ID NO: 22845 - DNA, 20 bp, Artificial Sequence
  Synthetic oligonucleotide; GAG chr11 5348948 5348967 5348964 +
aaaaaagccaaagggaaggt

SEQ ID NO: 22846 - DNA, 20 bp, Artificial Sequence
  Synthetic oligonucleotide; GAG chr11 5348950 5348969 5348966 +
aaaagccaaagggaaggtga

SEQ ID NO: 22847 - DNA, 20 bp, Artificial Sequence
  Synthetic oligonucleotide; AAG chr11 5348962 5348981 5348978 +
gaaggtgagagaatatatga

SEQ ID NO: 22848 - DNA, 20 bp, Artificial Sequence
  Synthetic oligonucleotide; TGG chr11 5348977 5348996 5348993 +
tatgaaagttaacatctgaa

SEQ ID NO: 22849 - DNA, 20 bp, Artificial Sequence
  Synthetic oligonucleotide; GGG chr11 5348978 5348997 5348994 +
atgaaagttaacatctgaat

SEQ ID NO: 22850 - DNA, 20 bp, Artificial Sequence
  Synthetic oligonucleotide; GAG chr11 5348989 5349008 5349005 +
catctgaatgggctcctgct

SEQ ID NO: 22851 - DNA, 20 bp, Artificial Sequence
  Synthetic oligonucleotide; AGG chr11 5348990 5349009 5349006 +
atctgaatgggctcctgctg

SEQ ID NO: 22852 - DNA, 20 bp, Artificial Sequence
  Synthetic oligonucleotide; TAG chr11 5349001 5349020 5349017 +
ctcctgctgaggtgtctgca

SEQ ID NO: 22853 - DNA, 20 bp, Artificial Sequence
  Synthetic oligonucleotide; GAG chr11 5349003 5349022 5349019 +
cctgctgaggtgtctgcata

SEQ ID NO: 22854 - DNA, 20 bp, Artificial Sequence
  Synthetic oligonucleotide; CAG chr11 5349010 5349029 5349026 +
aggtgtctgcatagagccat

SEQ ID NO: 22855 - DNA, 20 bp, Artificial Sequence
  Synthetic oligonucleotide; CGG chr11 5349019 5349038 5349035 +
catagagccatcagtttatg

SEQ ID NO: 22856 - DNA, 20 bp, Artificial Sequence
  Synthetic oligonucleotide; CAG chr11 5349022 5349041 5349038 +
agagccatcagtttatgcgg

SEQ ID NO: 22857 - DNA, 20 bp, Artificial Sequence
  Synthetic oligonucleotide; GAG chr11 5349024 5349043 5349040 +
agccatcagtttatgcggca

SEQ ID NO: 22858 - DNA, 20 bp, Artificial Sequence
  Synthetic oligonucleotide; GAG chr11 5349030 5349049 5349046 +
cagtttatgcggcagagttt

SEQ ID NO: 22859 - DNA, 20 bp, Artificial Sequence
  Synthetic oligonucleotide; GAG chr11 5349038 5349057 5349054 +
gcggcagagtttgagacttt

SEQ ID NO: 22860 - DNA, 20 bp, Artificial Sequence
  Synthetic oligonucleotide; TAG chr11 5349044 5349063 5349060 +
gagtttgagactttgagaat

SEQ ID NO: 22861 - DNA, 20 bp, Artificial Sequence
  Synthetic oligonucleotide; AAG chr11 5349067 5349086 5349083 +
tttctcattaataaaaactc

SEQ ID NO: 22862 - DNA, 20 bp, Artificial Sequence
  Synthetic oligonucleotide; CAG chr11 5349082 5349101 5349098 +
aactcaagtctattctatga

SEQ ID NO: 22863 - DNA, 20 bp, Artificial Sequence
  Synthetic oligonucleotide; GAG chr11 5349084 5349103 5349100 +
ctcaagtctattctatgaca

SEQ ID NO: 22864 - DNA, 20 bp, Artificial Sequence
  Synthetic oligonucleotide; TGG chr11 5349091 5349110 5349107 +
ctattctatgacagagaccc

SEQ ID NO: 22865 - DNA, 20 bp, Artificial Sequence
  Synthetic oligonucleotide; AAG chr11 5349094 5349113 5349110 +
ttctatgacagagaccctgg

SEQ ID NO: 22866 - DNA, 20 bp, Artificial Sequence
  Synthetic oligonucleotide; GAG chr11 5349096 5349115 5349112 +
ctatgacagagaccctggaa

SEQ ID NO: 22867 - DNA, 20 bp, Artificial Sequence
  Synthetic oligonucleotide; AGG chr11 5349097 5349116 5349113 +
tatgacagagaccctggaag

SEQ ID NO: 22868 - DNA, 20 bp, Artificial Sequence
  Synthetic oligonucleotide; GGG chr11 5349098 5349117 5349114 +
atgacagagaccctggaaga

SEQ ID NO: 22869 - DNA, 20 bp, Artificial Sequence
  Synthetic oligonucleotide; TGG chr11 5349105 5349124 5349121 +
agaccctggaagagggtgaa

SEQ ID NO: 22870 - DNA, 20 bp, Artificial Sequence
  Synthetic oligonucleotide; CAG chr11 5349111 5349130 5349127 +
tggaagagggtgaatggctg

SEQ ID NO: 22871 - DNA, 20 bp, Artificial Sequence
  Synthetic oligonucleotide; AGG chr11 5349112 5349131 5349128 +
ggaagagggtgaatggctgc

SEQ ID NO: 22872 - DNA, 20 bp, Artificial Sequence
  Synthetic oligonucleotide; GGG chr11 5349113 5349132 5349129 +
gaagagggtgaatggctgca

SEQ ID NO: 22873 - DNA, 20 bp, Artificial Sequence
  Synthetic oligonucleotide; GAG chr11 5349118 5349137 5349134 +
gggtgaatggctgcagggat

SEQ ID NO: 22874 - DNA, 20 bp, Artificial Sequence
  Synthetic oligonucleotide; AGG chr11 5349119 5349138 5349135 +
ggtgaatggctgcagggatg

SEQ ID NO: 22875 - DNA, 20 bp, Artificial Sequence
  Synthetic oligonucleotide; AAG chr11 5349124 5349143 5349140 +
atggctgcagggatgaggca

SEQ ID NO: 22876 - DNA, 20 bp, Artificial Sequence
  Synthetic oligonucleotide; AGG chr11 5349125 5349144 5349141 +
tggctgcagggatgaggcaa

SEQ ID NO: 22877 - DNA, 20 bp, Artificial Sequence
  Synthetic oligonucleotide; TAG chr11 5349131 5349150 5349147 +
cagggatgaggcaaaggttt

SEQ ID NO: 22878 - DNA, 20 bp, Artificial Sequence
  Synthetic oligonucleotide; CAG chr11 5349157 5349176 5349173 +
tttatcccctctgaaactca

SEQ ID NO: 22879 - DNA, 20 bp, Artificial Sequence
  Synthetic oligonucleotide; AAG chr11 5349179 5349198 5349195 +
gatcatctcatataccacaa

SEQ ID NO: 22880 - DNA, 20 bp, Artificial Sequence
  Synthetic oligonucleotide; GAG chr11 5349187 5349206 5349203 +
catataccacaaaagcaact

SEQ ID NO: 22881 - DNA, 20 bp, Artificial Sequence
  Synthetic oligonucleotide; AAG chr11 5349196 5349215 5349212 +
caaaagcaactgagtgaatc

SEQ ID NO: 22882 - DNA, 20 bp, Artificial Sequence
  Synthetic oligonucleotide; AAG chr11 5349202 5349221 5349218 +
caactgagtgaatcaagtga

SEQ ID NO: 22883 - DNA, 20 bp, Artificial Sequence
  Synthetic oligonucleotide; CAG chr11 5349209 5349228 5349225 +
gtgaatcaagtgaaagcact

SEQ ID NO: 22884 - DNA, 20 bp, Artificial Sequence
  Synthetic oligonucleotide; CAG chr11 5349227 5349246 5349243 +
ctcagttttcaatatgaaaa

SEQ ID NO: 22885 - DNA, 20 bp, Artificial Sequence
  Synthetic oligonucleotide; AAG chr11 5349232 5349251 5349248 +
ttttcaatatgaaaacagac

SEQ ID NO: 22886 - DNA, 20 bp, Artificial Sequence
  Synthetic oligonucleotide; CAG chr11 5349240 5349259 5349256 +
atgaaaacagacaagacaaa

SEQ ID NO: 22887 - DNA, 20 bp, Artificial Sequence
  Synthetic oligonucleotide; AAG chr11 5349250 5349269 5349266 +
acaagacaaacagctatttt

SEQ ID NO: 22888 - DNA, 20 bp, Artificial Sequence
  Synthetic oligonucleotide; AGG chr11 5349251 5349270 5349267 +
caagacaaacagctatttta

SEQ ID NO: 22889 - DNA, 20 bp, Artificial Sequence
  Synthetic oligonucleotide; GAG chr11 5349270 5349289 5349286 +
aaggattcttcccaaaaaat

SEQ ID NO: 22890 - DNA, 20 bp, Artificial Sequence
  Synthetic oligonucleotide; AGG chr11 5349271 5349290 5349287 +
aggattcttcccaaaaaatg

SEQ ID NO: 22891 - DNA, 20 bp, Artificial Sequence
  Synthetic oligonucleotide; CAG chr11 5349288 5349307 5349304 +
atgaggtgtatataatgccc

SEQ ID NO: 22892 - DNA, 20 bp, Artificial Sequence
  Synthetic oligonucleotide; CGG chr11 5349307 5349326 5349323 +
ccagtccaatacttgacaca

SEQ ID NO: 22893 - DNA, 20 bp, Artificial Sequence
  Synthetic oligonucleotide; TAG chr11 5349310 5349329 5349326 +
gtccaatacttgacacacgg

SEQ ID NO: 22894 - DNA, 20 bp, Artificial Sequence
  Synthetic oligonucleotide; CAG chr11 5349349 5349368 5349365 +
tgttccatacatttgtttct

SEQ ID NO: 22895 - DNA, 20 bp, Artificial Sequence
  Synthetic oligonucleotide; TGG chr11 5349368 5349387 5349384 +
tcagctttattttccctatc

SEQ ID NO: 22896 - DNA, 20 bp, Artificial Sequence
  Synthetic oligonucleotide; TAG chr11 5349417 5349436 5349433 +
ttatcaattatatgtttatt

SEQ ID NO: 22897 - DNA, 20 bp, Artificial Sequence
  Synthetic oligonucleotide; TAG chr11 5349420 5349439 5349436 +
tcaattatatgtttatttag

SEQ ID NO: 22898 - DNA, 20 bp, Artificial Sequence
  Synthetic oligonucleotide; TAG chr11 5349441 5349460 5349457 +
agtaatataacacaattaac

SEQ ID NO: 22899 - DNA, 20 bp, Artificial Sequence
  Synthetic oligonucleotide; CAG chr11 5349473 5349492 5349489 +
ctgtattatcttttccctcc

SEQ ID NO: 22900 - DNA, 20 bp, Artificial Sequence
  Synthetic oligonucleotide; TAG chr11 5349483 5349502 5349499 +
ttttccctcccagctttatt

SEQ ID NO: 22901 - DNA, 20 bp, Artificial Sequence
  Synthetic oligonucleotide; AGG chr11 5349484 5349503 5349500 +
tttccctcccagctttattt

SEQ ID NO: 22902 - DNA, 20 bp, Artificial Sequence
  Synthetic oligonucleotide; AAG chr11 5349504 5349523 5349520 +
aggtatatttaaaatttgct

SEQ ID NO: 22903 - DNA, 20 bp, Artificial Sequence
  Synthetic oligonucleotide; AAG chr11 5349508 5349527 5349524 +
atatttaaaatttgctaaga

SEQ ID NO: 22904 - DNA, 20 bp, Artificial Sequence
  Synthetic oligonucleotide; CAG chr11 5349511 5349530 5349527 +
tttaaaatttgctaagaaag

SEQ ID NO: 22905 - DNA, 20 bp, Artificial Sequence
  Synthetic oligonucleotide; AAG chr11 5349545 5349564 5349561 +
ttttactaccaaaaaaatta

SEQ ID NO: 22906 - DNA, 20 bp, Artificial Sequence
  Synthetic oligonucleotide; GAG chr11 5349557 5349576 5349573 +
aaaaattaaagttattatgt

SEQ ID NO: 22907 - DNA, 20 bp, Artificial Sequence
  Synthetic oligonucleotide; AGG chr11 5349558 5349577 5349574 +
aaaattaaagttattatgtg

SEQ ID NO: 22908 - DNA, 20 bp, Artificial Sequence
  Synthetic oligonucleotide; TAG chr11 5349564 5349583 5349580 +
aaagttattatgtgaggtga

SEQ ID NO: 22909 - DNA, 20 bp, Artificial Sequence
  Synthetic oligonucleotide; TAG chr11 5349577 5349596 5349593 +
gaggtgatagatatattaat

SEQ ID NO: 22910 - DNA, 20 bp, Artificial Sequence
  Synthetic oligonucleotide; TGG chr11 5349588 5349607 5349604 +
tatattaattagtttgatta

SEQ ID NO: 22911 - DNA, 20 bp, Artificial Sequence
  Synthetic oligonucleotide; AAG chr11 5349627 5349646 5349643 +
aatacctataataaaacaat

SEQ ID NO: 22912 - DNA, 20 bp, Artificial Sequence
  Synthetic oligonucleotide; AAG chr11 5349683 5349702 5349699 +
ctgcttctttaatcctgcat

SEQ ID NO: 22913 - DNA, 20 bp, Artificial Sequence
  Synthetic oligonucleotide; GAG chr11 5349688 5349707 5349704 +
tctttaatcctgcataagct

SEQ ID NO: 22914 - DNA, 20 bp, Artificial Sequence
  Synthetic oligonucleotide; TGG chr11 5349710 5349729 5349726 +
gtattgtctgaacctctcac

SEQ ID NO: 22915 - DNA, 20 bp, Artificial Sequence
  Synthetic oligonucleotide; CAG chr11 5349713 5349732 5349729 +
ttgtctgaacctctcactgg

SEQ ID NO: 22916 - DNA, 20 bp, Artificial Sequence
  Synthetic oligonucleotide; AGG chr11 5349714 5349733 5349730 +
tgtctgaacctctcactggc

SEQ ID NO: 22917 - DNA, 20 bp, Artificial Sequence
  Synthetic oligonucleotide; CAG chr11 5349717 5349736 5349733 +
ctgaacctctcactggcagg

SEQ ID NO: 22918 - DNA, 20 bp, Artificial Sequence
  Synthetic oligonucleotide; GAG chr11 5349723 5349742 5349739 +
ctctcactggcaggcagatt

SEQ ID NO: 22919 - DNA, 20 bp, Artificial Sequence
  Synthetic oligonucleotide; GAG chr11 5349753 5349772 5349769 +
acctccttttctcacttttt

SEQ ID NO: 22920 - DNA, 20 bp, Artificial Sequence
  Synthetic oligonucleotide; AGG chr11 5349754 5349773 5349770 +
cctccttttctcactttttg

SEQ ID NO: 22921 - DNA, 20 bp, Artificial Sequence
  Synthetic oligonucleotide; CAG chr11 5349758 5349777 5349774 +
cttttctcactttttgagga

SEQ ID NO: 22922 - DNA, 20 bp, Artificial Sequence
  Synthetic oligonucleotide; GAG chr11 5349760 5349779 5349776 +
tttctcactttttgaggaca

SEQ ID NO: 22923 - DNA, 20 bp, Artificial Sequence
  Synthetic oligonucleotide; CAG chr11 5349785 5349804 5349801 +
gctttcccctctacttccct

SEQ ID NO: 22924 - DNA, 20 bp, Artificial Sequence
  Synthetic oligonucleotide; CAG chr11 5349799 5349818 5349815 +
ttccctcagtcccaatgccc

SEQ ID NO: 22925 - DNA, 20 bp, Artificial Sequence
  Synthetic oligonucleotide; AGG chr11 5349800 5349819 5349816 +
tccctcagtcccaatgcccc

SEQ ID NO: 22926 - DNA, 20 bp, Artificial Sequence
  Synthetic oligonucleotide; TAG chr11 5349817 5349836 5349833 +
cccaggctcaacgttacttt

SEQ ID NO: 22927 - DNA, 20 bp, Artificial Sequence
  Synthetic oligonucleotide; CAG chr11 5349826 5349845 5349842 +
aacgttacttttagctatgt

SEQ ID NO: 22928 - DNA, 20 bp, Artificial Sequence
  Synthetic oligonucleotide; AAG chr11 5349829 5349848 5349845 +
gttacttttagctatgtcag

SEQ ID NO: 22929 - DNA, 20 bp, Artificial Sequence
  Synthetic oligonucleotide; TGG chr11 5349841 5349860 5349857 +
tatgtcagaagttcccacat

SEQ ID NO: 22930 - DNA, 20 bp, Artificial Sequence
  Synthetic oligonucleotide; CAG chr11 5349877 5349896 5349893 +
tctcctttccctttcccacc

SEQ ID NO: 22931 - DNA, 20 bp, Artificial Sequence
  Synthetic oligonucleotide; TAG chr11 5349904 5349923 5349920 +
atcacattttatctgctgat

SEQ ID NO: 22932 - DNA, 20 bp, Artificial Sequence
  Synthetic oligonucleotide; GAG chr11 5349906 5349925 5349922 +
cacattttatctgctgatta

SEQ ID NO: 22933 - DNA, 20 bp, Artificial Sequence
  Synthetic oligonucleotide; TAG chr11 5349915 5349934 5349931 +
tctgctgattagagaaacta

SEQ ID NO: 22934 - DNA, 20 bp, Artificial Sequence
  Synthetic oligonucleotide; AAG chr11 5349935 5349954 5349951 +
tagtttaatatctttattta

SEQ ID NO: 22935 - DNA, 20 bp, Artificial Sequence
  Synthetic oligonucleotide; CAG chr11 5349945 5349964 5349961 +
tctttatttaaagtcaaaca

SEQ ID NO: 22936 - DNA, 20 bp, Artificial Sequence
  Synthetic oligonucleotide; AGG chr11 5349946 5349965 5349962 +
ctttatttaaagtcaaacac

SEQ ID NO: 22937 - DNA, 20 bp, Artificial Sequence
  Synthetic oligonucleotide; AAG chr11 5349986 5350005 5350002 +
atcatcttatatctgttccc

SEQ ID NO: 22938 - DNA, 20 bp, Artificial Sequence
  Synthetic oligonucleotide; AGG chr11 5349987 5350006 5350003 +
tcatcttatatctgttccca

SEQ ID NO: 22939 - DNA, 20 bp, Artificial Sequence
  Synthetic oligonucleotide; CAG chr11 5349996 5350015 5350012 +
atctgttcccaaggcttcca

SEQ ID NO: 22940 - DNA, 20 bp, Artificial Sequence
  Synthetic oligonucleotide; AAG chr11 5350004 5350023 5350020 +
ccaaggcttccacagaaaaa

SEQ ID NO: 22941 - DNA, 20 bp, Artificial Sequence
  Synthetic oligonucleotide; AGG chr11 5350005 5350024 5350021 +
caaggcttccacagaaaaaa

SEQ ID NO: 22942 - DNA, 20 bp, Artificial Sequence
  Synthetic oligonucleotide; TGG chr11 5350027 5350046 5350043 +
gaaatcatttgacacacctc

SEQ ID NO: 22943 - DNA, 20 bp, Artificial Sequence
  Synthetic oligonucleotide; GGG chr11 5350028 5350047 5350044 +
aaatcatttgacacacctct

SEQ ID NO: 22944 - DNA, 20 bp, Artificial Sequence
  Synthetic oligonucleotide; TAG chr11 5350055 5350074 5350071 +
taatcctgacatgtactcac

SEQ ID NO: 22945 - DNA, 20 bp, Artificial Sequence
  Synthetic oligonucleotide; GAG chr11 5350057 5350076 5350073 +
atcctgacatgtactcacta

SEQ ID NO: 22946 - DNA, 20 bp, Artificial Sequence
  Synthetic oligonucleotide; AAG chr11 5350061 5350080 5350077 +
tgacatgtactcactagaga

SEQ ID NO: 22947 - DNA, 20 bp, Artificial Sequence
  Synthetic oligonucleotide; GAG chr11 5350063 5350082 5350079 +
acatgtactcactagagaaa

SEQ ID NO: 22948 - DNA, 20 bp, Artificial Sequence
  Synthetic oligonucleotide; AAG chr11 5350067 5350086 5350083 +
gtactcactagagaaagaga

SEQ ID NO: 22949 - DNA, 20 bp, Artificial Sequence
  Synthetic oligonucleotide; AGG chr11 5350068 5350087 5350084 +
tactcactagagaaagagaa

SEQ ID NO: 22950 - DNA, 20 bp, Artificial Sequence
  Synthetic oligonucleotide; GAG chr11 5350070 5350089 5350086 +
ctcactagagaaagagaaag

SEQ ID NO: 22951 - DNA, 20 bp, Artificial Sequence
  Synthetic oligonucleotide; AGG chr11 5350071 5350090 5350087 +
tcactagagaaagagaaagg

SEQ ID NO: 22952 - DNA, 20 bp, Artificial Sequence
  Synthetic oligonucleotide; AAG chr11 5350155 5350174 5350171 +
atttccccttactttgtgtc

SEQ ID NO: 22953 - DNA, 20 bp, Artificial Sequence
  Synthetic oligonucleotide; GAG chr11 5350157 5350176 5350173 +
ttccccttactttgtgtcaa

SEQ ID NO: 22954 - DNA, 20 bp, Artificial Sequence
  Synthetic oligonucleotide; GAG chr11 5350167 5350186 5350183 +
tttgtgtcaagagaatgact

SEQ ID NO: 22955 - DNA, 20 bp, Artificial Sequence
  Synthetic oligonucleotide; AAG chr11 5350170 5350189 5350186 +
gtgtcaagagaatgactgag

SEQ ID NO: 22956 - DNA, 20 bp, Artificial Sequence
  Synthetic oligonucleotide; CAG chr11 5350174 5350193 5350190 +
caagagaatgactgagaaga

SEQ ID NO: 22957 - DNA, 20 bp, Artificial Sequence
  Synthetic oligonucleotide; TAG chr11 5350184 5350203 5350200 +
actgagaagacagaaatcac

SEQ ID NO: 22958 - DNA, 20 bp, Artificial Sequence
  Synthetic oligonucleotide; TAG chr11 5350187 5350206 5350203 +
gagaagacagaaatcactag

SEQ ID NO: 22959 - DNA, 20 bp, Artificial Sequence
  Synthetic oligonucleotide; CAG chr11 5350196 5350215 5350212 +
gaaatcactagtagtcttta

SEQ ID NO: 22960 - DNA, 20 bp, Artificial Sequence
  Synthetic oligonucleotide; AGG chr11 5350197 5350216 5350213 +
aaatcactagtagtctttac

SEQ ID NO: 22961 - DNA, 20 bp, Artificial Sequence
  Synthetic oligonucleotide; AAG chr11 5350217 5350236 5350233 +
aggttatgtaaccaaatctc

SEQ ID NO: 22962 - DNA, 20 bp, Artificial Sequence
  Synthetic oligonucleotide; AAG chr11 5350236 5350255 5350252 +
caagattaaattactttccc

SEQ ID NO: 22963 - DNA, 20 bp, Artificial Sequence
  Synthetic oligonucleotide; TAG chr11 5350250 5350269 5350266 +
tttcccaagatcattattgt

SEQ ID NO: 22964 - DNA, 20 bp, Artificial Sequence
  Synthetic oligonucleotide; AAG chr11 5350254 5350273 5350270 +
ccaagatcattattgttaga

SEQ ID NO: 22965 - DNA, 20 bp, Artificial Sequence
  Synthetic oligonucleotide; GAG chr11 5350256 5350275 5350272 +
aagatcattattgttagaaa

SEQ ID NO: 22966 - DNA, 20 bp, Artificial Sequence
  Synthetic oligonucleotide; CAG chr11 5350259 5350278 5350275 +
atcattattgttagaaagag

SEQ ID NO: 22967 - DNA, 20 bp, Artificial Sequence
  Synthetic oligonucleotide; GAG chr11 5350261 5350280 5350277 +
cattattgttagaaagagca

SEQ ID NO: 22968 - DNA, 20 bp, Artificial Sequence
  Synthetic oligonucleotide; AAG chr11 5350295 5350314 5350311 +
acaaattcttctgaaaatga

SEQ ID NO: 22969 - DNA, 20 bp, Artificial Sequence
  Synthetic oligonucleotide; CAG chr11 5350300 5350319 5350316 +
ttcttctgaaaatgaaagtc

SEQ ID NO: 22970 - DNA, 20 bp, Artificial Sequence
  Synthetic oligonucleotide; TGG chr11 5350309 5350328 5350325 +
aaatgaaagtccagtaatct

SEQ ID NO: 22971 - DNA, 20 bp, Artificial Sequence
  Synthetic oligonucleotide; TGG chr11 5350326 5350345 5350342 +
tcttggatgcattcttttca

SEQ ID NO: 22972 - DNA, 20 bp, Artificial Sequence
  Synthetic oligonucleotide; CAG chr11 5350330 5350349 5350346 +
ggatgcattcttttcatgga

SEQ ID NO: 22973 - DNA, 20 bp, Artificial Sequence
  Synthetic oligonucleotide; AAG chr11 5350334 5350353 5350350 +
gcattcttttcatggacaga

SEQ ID NO: 22974 - DNA, 20 bp, Artificial Sequence
  Synthetic oligonucleotide; GAG chr11 5350336 5350355 5350352 +
attcttttcatggacagaaa

SEQ ID NO: 22975 - DNA, 20 bp, Artificial Sequence
  Synthetic oligonucleotide; AGG chr11 5350337 5350356 5350353 +
ttcttttcatggacagaaag

SEQ ID NO: 22976 - DNA, 20 bp, Artificial Sequence
  Synthetic oligonucleotide; TAG chr11 5350383 5350402 5350399 +
acatcaatatgctctttcaa

SEQ ID NO: 22977 - DNA, 20 bp, Artificial Sequence
  Synthetic oligonucleotide; GAG chr11 5350391 5350410 5350407 +
atgctctttcaatagtatat

SEQ ID NO: 22978 - DNA, 20 bp, Artificial Sequence
  Synthetic oligonucleotide; TAG chr11 5350399 5350418 5350415 +
tcaatagtatatgagatgta

SEQ ID NO: 22979 - DNA, 20 bp, Artificial Sequence
  Synthetic oligonucleotide; AAG chr11 5350416 5350435 5350432 +
gtatagtccaaaccaaccat

SEQ ID NO: 22980 - DNA, 20 bp, Artificial Sequence
  Synthetic oligonucleotide; GAG chr11 5350418 5350437 5350434 +
atagtccaaaccaaccataa

SEQ ID NO: 22981 - DNA, 20 bp, Artificial Sequence
  Synthetic oligonucleotide; AAG chr11 5350421 5350440 5350437 +
gtccaaaccaaccataagag

SEQ ID NO: 22982 - DNA, 20 bp, Artificial Sequence
  Synthetic oligonucleotide; AGG chr11 5350422 5350441 5350438 +
tccaaaccaaccataagaga

SEQ ID NO: 22983 - DNA, 20 bp, Artificial Sequence
  Synthetic oligonucleotide; TGG chr11 5350425 5350444 5350441 +
aaaccaaccataagagaagg

SEQ ID NO: 22984 - DNA, 20 bp, Artificial Sequence
  Synthetic oligonucleotide; GGG chr11 5350426 5350445 5350442 +
aaccaaccataagagaaggt

SEQ ID NO: 22985 - DNA, 20 bp, Artificial Sequence
  Synthetic oligonucleotide; TGG chr11 5350440 5350459 5350456 +
gaaggtgggcctattttctc

SEQ ID NO: 22986 - DNA, 20 bp, Artificial Sequence
  Synthetic oligonucleotide; CAG chr11 5350475 5350494 5350491 +
acacacaatttatgtattct

SEQ ID NO: 22987 - DNA, 20 bp, Artificial Sequence
  Synthetic oligonucleotide; GAG chr11 5350477 5350496 5350493 +
acacaatttatgtattctca

SEQ ID NO: 22988 - DNA, 20 bp, Artificial Sequence
  Synthetic oligonucleotide; AGG chr11 5350478 5350497 5350494 +
cacaatttatgtattctcag

SEQ ID NO: 22989 - DNA, 20 bp, Artificial Sequence
  Synthetic oligonucleotide; TGG chr11 5350482 5350501 5350498 +
atttatgtattctcagaggt

SEQ ID NO: 22990 - DNA, 20 bp, Artificial Sequence
  Synthetic oligonucleotide; CAG chr11 5350495 5350514 5350511 +
cagaggttggctgcctgcac

SEQ ID NO: 22991 - DNA, 20 bp, Artificial Sequence
  Synthetic oligonucleotide; TAG chr11 5350507 5350526 5350523 +
gcctgcaccagctgaaatct

SEQ ID NO: 22992 - DNA, 20 bp, Artificial Sequence
  Synthetic oligonucleotide; GAG chr11 5350519 5350538 5350535 +
tgaaatcttagaattctaat

SEQ ID NO: 22993 - DNA, 20 bp, Artificial Sequence
  Synthetic oligonucleotide; CAG chr11 5350525 5350544 5350541 +
cttagaattctaatgagtca

SEQ ID NO: 22994 - DNA, 20 bp, Artificial Sequence
  Synthetic oligonucleotide; GAG chr11 5350527 5350546 5350543 +
tagaattctaatgagtcaca

SEQ ID NO: 22995 - DNA, 20 bp, Artificial Sequence
  Synthetic oligonucleotide; CAG chr11 5350555 5350574 5350571 +
tcacttttgtcaaatcccat

SEQ ID NO: 22996 - DNA, 20 bp, Artificial Sequence
  Synthetic oligonucleotide; TAG chr11 5350564 5350583 5350580 +
tcaaatcccatcagattcca

SEQ ID NO: 22997 - DNA, 20 bp, Artificial Sequence
  Synthetic oligonucleotide; AAG chr11 5350628 5350647 5350644 +
atttttatttttgcatcacc

SEQ ID NO: 22998 - DNA, 20 bp, Artificial Sequence
  Synthetic oligonucleotide; TAG chr11 5350631 5350650 5350647 +
tttatttttgcatcaccaag

SEQ ID NO: 22999 - DNA, 20 bp, Artificial Sequence
  Synthetic oligonucleotide; AGG chr11 5350632 5350651 5350648 +
ttatttttgcatcaccaagt

SEQ ID NO: 23000 - DNA, 20 bp, Artificial Sequence
  Synthetic oligonucleotide; CAG chr11 5350645 5350664 5350661 +
accaagtaggtgatatgcaa

SEQ ID NO: 23001 - DNA, 20 bp, Artificial Sequence
  Synthetic oligonucleotide; TAG chr11 5350648 5350667 5350664 +
aagtaggtgatatgcaacag

SEQ ID NO: 23002 - DNA, 20 bp, Artificial Sequence
  Synthetic oligonucleotide; TGG chr11 5350653 5350672 5350669 +
ggtgatatgcaacagtagtt

SEQ ID NO: 23003 - DNA, 20 bp, Artificial Sequence
  Synthetic oligonucleotide; TAG chr11 5350669 5350688 5350685 +
agtttggtgctattatcaat

SEQ ID NO: 23004 - DNA, 20 bp, Artificial Sequence
  Synthetic oligonucleotide; AAG chr11 5350681 5350700 5350697 +
ttatcaattagtgccttcaa

SEQ ID NO: 23005 - DNA, 20 bp, Artificial Sequence
  Synthetic oligonucleotide; AAG chr11 5350750 5350769 5350766 +
atgaaaatttgaattctttg

SEQ ID NO: 23006 - DNA, 20 bp, Artificial Sequence
  Synthetic oligonucleotide; CAG chr11 5350753 5350772 5350769 +
aaaatttgaattctttgaag

SEQ ID NO: 23007 - DNA, 20 bp, Artificial Sequence
  Synthetic oligonucleotide; TAG chr11 5350768 5350787 5350784 +
tgaagcagtgtatcaataac

SEQ ID NO: 23008 - DNA, 20 bp, Artificial Sequence
  Synthetic oligonucleotide; AGG chr11 5350769 5350788 5350785 +
gaagcagtgtatcaataact

SEQ ID NO: 23009 - DNA, 20 bp, Artificial Sequence
  Synthetic oligonucleotide; GGG chr11 5350770 5350789 5350786 +
aagcagtgtatcaataacta

SEQ ID NO: 23010 - DNA, 20 bp, Artificial Sequence
  Synthetic oligonucleotide; AAG chr11 5350778 5350797 5350794 +
tatcaataactagggttata

SEQ ID NO: 23011 - DNA, 20 bp, Artificial Sequence
  Synthetic oligonucleotide; TGG chr11 5350782 5350801 5350798 +
aataactagggttataaagc

SEQ ID NO: 23012 - DNA, 20 bp, Artificial Sequence
  Synthetic oligonucleotide; GGG chr11 5350783 5350802 5350799 +
ataactagggttataaagct

SEQ ID NO: 23013 - DNA, 20 bp, Artificial Sequence
  Synthetic oligonucleotide; TAG chr11 5350791 5350810 5350807 +
ggttataaagctgggcaact

SEQ ID NO: 23014 - DNA, 20 bp, Artificial Sequence
  Synthetic oligonucleotide; GAG chr11 5350793 5350812 5350809 +
ttataaagctgggcaactta

SEQ ID NO: 23015 - DNA, 20 bp, Artificial Sequence
  Synthetic oligonucleotide; TGG chr11 5350808 5350827 5350824 +
acttagagttctatgtgctt

SEQ ID NO: 23016 - DNA, 20 bp, Artificial Sequence
  Synthetic oligonucleotide; CAG chr11 5350820 5350839 5350836 +
atgtgctttggaaacacaca

SEQ ID NO: 23017 - DNA, 20 bp, Artificial Sequence
  Synthetic oligonucleotide; AGG chr11 5350821 5350840 5350837 +
tgtgctttggaaacacacac

SEQ ID NO: 23018 - DNA, 20 bp, Artificial Sequence
  Synthetic oligonucleotide; AAG chr11 5350825 5350844 5350841 +
ctttggaaacacacacaggt

SEQ ID NO: 23019 - DNA, 20 bp, Artificial Sequence
  Synthetic oligonucleotide; AAG chr11 5350858 5350877 5350874 +
gtcattttctaactacccaa

SEQ ID NO: 23020 - DNA, 20 bp, Artificial Sequence
  Synthetic oligonucleotide; TGG chr11 5350865 5350884 5350881 +
tctaactacccaaaagtctc

SEQ ID NO: 23021 - DNA, 20 bp, Artificial Sequence
  Synthetic oligonucleotide; GAG chr11 5350867 5350886 5350883 +
taactacccaaaagtctctg

SEQ ID NO: 23022 - DNA, 20 bp, Artificial Sequence
  Synthetic oligonucleotide; CAG chr11 5350893 5350912 5350909 +
catcaattgaattttccctc

SEQ ID NO: 23023 - DNA, 20 bp, Artificial Sequence
  Synthetic oligonucleotide; AGG chr11 5350894 5350913 5350910 +
atcaattgaattttccctcc

SEQ ID NO: 23024 - DNA, 20 bp, Artificial Sequence
  Synthetic oligonucleotide; AAG chr11 5350904 5350923 5350920 +
ttttccctccaggaatattg

SEQ ID NO: 23025 - DNA, 20 bp, Artificial Sequence
  Synthetic oligonucleotide; AAG chr11 5350909 5350928 5350925 +
cctccaggaatattgaagaa

SEQ ID NO: 23026 - DNA, 20 bp, Artificial Sequence
  Synthetic oligonucleotide; TAG chr11 5351007 5351026 5351023 +
ctttatatctgcttttccaa

SEQ ID NO: 23027 - DNA, 20 bp, Artificial Sequence
  Synthetic oligonucleotide; TAG chr11 5351014 5351033 5351030 +
tctgcttttccaatagtgct

SEQ ID NO: 23028 - DNA, 20 bp, Artificial Sequence
  Synthetic oligonucleotide; TAG chr11 5351039 5351058 5351055 +
ccatttttctactgatcttt

SEQ ID NO: 23029 - DNA, 20 bp, Artificial Sequence
  Synthetic oligonucleotide; AGG chr11 5351040 5351059 5351056 +
catttttctactgatctttt

SEQ ID NO: 23030 - DNA, 20 bp, Artificial Sequence
  Synthetic oligonucleotide; TAG chr11 5351050 5351069 5351066 +
ctgatcttttaggtctcaca

SEQ ID NO: 23031 - DNA, 20 bp, Artificial Sequence
  Synthetic oligonucleotide; TGG chr11 5351055 5351074 5351071 +
cttttaggtctcacatagcc

SEQ ID NO: 23032 - DNA, 20 bp, Artificial Sequence
  Synthetic oligonucleotide; GGG chr11 5351056 5351075 5351072 +
ttttaggtctcacatagcct

SEQ ID NO: 23033 - DNA, 20 bp, Artificial Sequence
  Synthetic oligonucleotide; CAG chr11 5351088 5351107 5351104 +
catccaccctataataccac

SEQ ID NO: 23034 - DNA, 20 bp, Artificial Sequence
  Synthetic oligonucleotide; CAG chr11 5351092 5351111 5351108 +
caccctataataccaccagt

SEQ ID NO: 23035 - DNA, 20 bp, Artificial Sequence
  Synthetic oligonucleotide; AGG chr11 5351093 5351112 5351109 +
accctataataccaccagtc

SEQ ID NO: 23036 - DNA, 20 bp, Artificial Sequence
  Synthetic oligonucleotide; AAG chr11 5351099 5351118 5351115 +
taataccaccagtcaggatg

SEQ ID NO: 23037 - DNA, 20 bp, Artificial Sequence
  Synthetic oligonucleotide; GAG chr11 5351101 5351120 5351117 +
ataccaccagtcaggatgaa

SEQ ID NO: 23038 - DNA, 20 bp, Artificial Sequence
  Synthetic oligonucleotide; AAG chr11 5351113 5351132 5351129 +
aggatgaagagcaccatgaa

SEQ ID NO: 23039 - DNA, 20 bp, Artificial Sequence
  Synthetic oligonucleotide; AAG chr11 5351124 5351143 5351140 +
caccatgaaaagtgacctat

SEQ ID NO: 23040 - DNA, 20 bp, Artificial Sequence
  Synthetic oligonucleotide; CAG chr11 5351130 5351149 5351146 +
gaaaagtgacctataagttt

SEQ ID NO: 23041 - DNA, 20 bp, Artificial Sequence
  Synthetic oligonucleotide; AGG chr11 5351131 5351150 5351147 +
aaaagtgacctataagtttc

SEQ ID NO: 23042 - DNA, 20 bp, Artificial Sequence
  Synthetic oligonucleotide; CAG chr11 5351140 5351159 5351156 +
ctataagtttcaggccatta

SEQ ID NO: 23043 - DNA, 20 bp, Artificial Sequence
  Synthetic oligonucleotide; TAG chr11 5351156 5351175 5351172 +
attacagcactattcaaata

SEQ ID NO: 23044 - DNA, 20 bp, Artificial Sequence
  Synthetic oligonucleotide; TGG chr11 5351190 5351209 5351206 +
ttcattttgtttttattttc

SEQ ID NO: 23045 - DNA, 20 bp, Artificial Sequence
  Synthetic oligonucleotide; GGG chr11 5351191 5351210 5351207 +
tcattttgtttttattttct

SEQ ID NO: 23046 - DNA, 20 bp, Artificial Sequence
  Synthetic oligonucleotide; TAG chr11 5351238 5351257 5351254 +
caatgtttattctgcatgaa

SEQ ID NO: 23047 - DNA, 20 bp, Artificial Sequence
  Synthetic oligonucleotide; TAG chr11 5351255 5351274 5351271 +
gaatagctgtatccccaacg

SEQ ID NO: 23048 - DNA, 20 bp, Artificial Sequence
  Synthetic oligonucleotide; TAG chr11 5351275 5351294 5351291 +
tagtatccaataatcttaca

SEQ ID NO: 23049 - DNA, 20 bp, Artificial Sequence
  Synthetic oligonucleotide; GAG chr11 5351277 5351296 5351293 +
gtatccaataatcttacata

SEQ ID NO: 23050 - DNA, 20 bp, Artificial Sequence
  Synthetic oligonucleotide; TAG chr11 5351326 5351345 5351342 +
acattctattttcccatacc

SEQ ID NO: 23051 - DNA, 20 bp, Artificial Sequence
  Synthetic oligonucleotide; AGG chr11 5351327 5351346 5351343 +
cattctattttcccatacct

SEQ ID NO: 23052 - DNA, 20 bp, Artificial Sequence
  Synthetic oligonucleotide; CAG chr11 5351336 5351355 5351352 +
ttcccatacctaggatctcc

SEQ ID NO: 23053 - DNA, 20 bp, Artificial Sequence
  Synthetic oligonucleotide; AGG chr11 5351337 5351356 5351353 +
tcccatacctaggatctccc

SEQ ID NO: 23054 - DNA, 20 bp, Artificial Sequence
  Synthetic oligonucleotide; AAG chr11 5351372 5351391 5351388 +
atcatccttgctgtcactga

SEQ ID NO: 23055 - DNA, 20 bp, Artificial Sequence
  Synthetic oligonucleotide; CAG chr11 5351376 5351395 5351392 +
tccttgctgtcactgaaagt

SEQ ID NO: 23056 - DNA, 20 bp, Artificial Sequence
  Synthetic oligonucleotide; AGG chr11 5351377 5351396 5351393 +
ccttgctgtcactgaaagtc

SEQ ID NO: 23057 - DNA, 20 bp, Artificial Sequence
  Synthetic oligonucleotide; TGG chr11 5351382 5351401 5351398 +
ctgtcactgaaagtcaggac

SEQ ID NO: 23058 - DNA, 20 bp, Artificial Sequence
  Synthetic oligonucleotide; CAG chr11 5351400 5351419 5351416 +
actggtgaacatcttatgaa

SEQ ID NO: 23059 - DNA, 20 bp, Artificial Sequence
  Synthetic oligonucleotide; AGG chr11 5351401 5351420 5351417 +
ctggtgaacatcttatgaac

SEQ ID NO: 23060 - DNA, 20 bp, Artificial Sequence
  Synthetic oligonucleotide; TAG chr11 5351404 5351423 5351420 +
gtgaacatcttatgaacagg

SEQ ID NO: 23061 - DNA, 20 bp, Artificial Sequence
  Synthetic oligonucleotide; AAG chr11 5351414 5351433 5351430 +
tatgaacaggtagaattctc

SEQ ID NO: 23062 - DNA, 20 bp, Artificial Sequence
  Synthetic oligonucleotide; AGG chr11 5351415 5351434 5351431 +
atgaacaggtagaattctca

SEQ ID NO: 23063 - DNA, 20 bp, Artificial Sequence
  Synthetic oligonucleotide; GAG chr11 5351417 5351436 5351433 +
gaacaggtagaattctcaag

SEQ ID NO: 23064 - DNA, 20 bp, Artificial Sequence
  Synthetic oligonucleotide; TGG chr11 5351454 5351473 5351470 +
ctgattactattgctttacc

SEQ ID NO: 23065 - DNA, 20 bp, Artificial Sequence
  Synthetic oligonucleotide; GAG chr11 5351456 5351475 5351472 +
gattactattgctttacctg

SEQ ID NO: 23066 - DNA, 20 bp, Artificial Sequence
  Synthetic oligonucleotide; AAG chr11 5351479 5351498 5351495 +
taaatatttgcctctttgca

SEQ ID NO: 23067 - DNA, 20 bp, Artificial Sequence
  Synthetic oligonucleotide; TGG chr11 5351483 5351502 5351499 +
tatttgcctctttgcaaagc

SEQ ID NO: 23068 - DNA, 20 bp, Artificial Sequence
  Synthetic oligonucleotide; TGG chr11 5351489 5351508 5351505 +
cctctttgcaaagctggcaa

SEQ ID NO: 23069 - DNA, 20 bp, Artificial Sequence
  Synthetic oligonucleotide; GGG chr11 5351490 5351509 5351506 +
ctctttgcaaagctggcaat

SEQ ID NO: 23070 - DNA, 20 bp, Artificial Sequence
  Synthetic oligonucleotide; GGG chr11 5351491 5351510 5351507 +
tctttgcaaagctggcaatg

SEQ ID NO: 23071 - DNA, 20 bp, Artificial Sequence
  Synthetic oligonucleotide; AAG chr11 5351500 5351519 5351516 +
agctggcaatggggctcaat

SEQ ID NO: 23072 - DNA, 20 bp, Artificial Sequence
  Synthetic oligonucleotide; CAG chr11 5351518 5351537 5351534 +
ataagtctgcttccaccttc

SEQ ID NO: 23073 - DNA, 20 bp, Artificial Sequence
  Synthetic oligonucleotide; TGG chr11 5351526 5351545 5351542 +
gcttccaccttccagcttac

SEQ ID NO: 23074 - DNA, 20 bp, Artificial Sequence
  Synthetic oligonucleotide; CAG chr11 5351534 5351553 5351550 +
cttccagcttactggcttcc

SEQ ID NO: 23075 - DNA, 20 bp, Artificial Sequence
  Synthetic oligonucleotide; AGG chr11 5351535 5351554 5351551 +
ttccagcttactggcttccc

SEQ ID NO: 23076 - DNA, 20 bp, Artificial Sequence
  Synthetic oligonucleotide; TGG chr11 5351540 5351559 5351556 +
gcttactggcttcccaggca

SEQ ID NO: 23077 - DNA, 20 bp, Artificial Sequence
  Synthetic oligonucleotide; GAG chr11 5351542 5351561 5351558 +
ttactggcttcccaggcatg

SEQ ID NO: 23078 - DNA, 20 bp, Artificial Sequence
  Synthetic oligonucleotide; AAG chr11 5351545 5351564 5351561 +
ctggcttcccaggcatggag

SEQ ID NO: 23079 - DNA, 20 bp, Artificial Sequence
  Synthetic oligonucleotide; AGG chr11 5351546 5351565 5351562 +
tggcttcccaggcatggaga

SEQ ID NO: 23080 - DNA, 20 bp, Artificial Sequence
  Synthetic oligonucleotide; TGG chr11 5351557 5351576 5351573 +
gcatggagaaggcacatcac

SEQ ID NO: 23081 - DNA, 20 bp, Artificial Sequence
  Synthetic oligonucleotide; TGG chr11 5351576 5351595 5351592 +
ctggatattcatcccattat

SEQ ID NO: 23082 - DNA, 20 bp, Artificial Sequence
  Synthetic oligonucleotide; CAG chr11 5351579 5351598 5351595 +
gatattcatcccattattgg

SEQ ID NO: 23083 - DNA, 20 bp, Artificial Sequence
  Synthetic oligonucleotide; TGG chr11 5351601 5351620 5351617 +
gcctacatctccatacttct

SEQ ID NO: 23084 - DNA, 20 bp, Artificial Sequence
  Synthetic oligonucleotide; TGG chr11 5351607 5351626 5351623 +
atctccatacttcttggcaa

SEQ ID NO: 23085 - DNA, 20 bp, Artificial Sequence
  Synthetic oligonucleotide; CAG chr11 5351628 5351647 5351644 +
ggcactcttctctttctcat

SEQ ID NO: 23086 - DNA, 20 bp, Artificial Sequence
  Synthetic oligonucleotide; AGG chr11 5351629 5351648 5351645 +
gcactcttctctttctcatc

SEQ ID NO: 23087 - DNA, 20 bp, Artificial Sequence
  Synthetic oligonucleotide; GAG chr11 5351650 5351669 5351666 +
ggaatgatcataacctccat

SEQ ID NO: 23088 - DNA, 20 bp, Artificial Sequence
  Synthetic oligonucleotide; TAG chr11 5351669 5351688 5351685 +
tgagcccatgtactatttct

SEQ ID NO: 23089 - DNA, 20 bp, Artificial Sequence
  Synthetic oligonucleotide; TGG chr11 5351678 5351697 5351694 +
gtactatttcttagctatgt

SEQ ID NO: 23090 - DNA, 20 bp, Artificial Sequence
  Synthetic oligonucleotide; CAG chr11 5351681 5351700 5351697 +
ctatttcttagctatgttgg

SEQ ID NO: 23091 - DNA, 20 bp, Artificial Sequence
  Synthetic oligonucleotide; CAG chr11 5351687 5351706 5351703 +
cttagctatgttggcagcta

SEQ ID NO: 23092 - DNA, 20 bp, Artificial Sequence
  Synthetic oligonucleotide; CGG chr11 5351694 5351713 5351710 +
atgttggcagctacagacct

SEQ ID NO: 23093 - DNA, 20 bp, Artificial Sequence
  Synthetic oligonucleotide; GAG chr11 5351696 5351715 5351712 +
gttggcagctacagacctcg

SEQ ID NO: 23094 - DNA, 20 bp, Artificial Sequence
  Synthetic oligonucleotide; CAG chr11 5351720 5351739 5351736 +
gacattgaccacaatgccca

SEQ ID NO: 23095 - DNA, 20 bp, Artificial Sequence
  Synthetic oligonucleotide; TAG chr11 5351726 5351745 5351742 +
gaccacaatgcccacagtgc

SEQ ID NO: 23096 - DNA, 20 bp, Artificial Sequence
  Synthetic oligonucleotide; AGG chr11 5351727 5351746 5351743 +
accacaatgcccacagtgct

SEQ ID NO: 23097 - DNA, 20 bp, Artificial Sequence
  Synthetic oligonucleotide; TGG chr11 5351737 5351756 5351753 +
ccacagtgctaggtgttctg

SEQ ID NO: 23098 - DNA, 20 bp, Artificial Sequence
  Synthetic oligonucleotide; TAG chr11 5351741 5351760 5351757 +
agtgctaggtgttctgtggt

SEQ ID NO: 23099 - DNA, 20 bp, Artificial Sequence
  Synthetic oligonucleotide; CAG chr11 5351748 5351767 5351764 +
ggtgttctgtggttagatca

SEQ ID NO: 23100 - DNA, 20 bp, Artificial Sequence
  Synthetic oligonucleotide; AGG chr11 5351749 5351768 5351765 +
gtgttctgtggttagatcac

SEQ ID NO: 23101 - DNA, 20 bp, Artificial Sequence
  Synthetic oligonucleotide; GGG chr11 5351750 5351769 5351766 +
tgttctgtggttagatcaca

SEQ ID NO: 23102 - DNA, 20 bp, Artificial Sequence
  Synthetic oligonucleotide; GAG chr11 5351752 5351771 5351768 +
ttctgtggttagatcacagg

SEQ ID NO: 23103 - DNA, 20 bp, Artificial Sequence
  Synthetic oligonucleotide; TGG chr11 5351757 5351776 5351773 +
tggttagatcacagggagat

SEQ ID NO: 23104 - DNA, 20 bp, Artificial Sequence
  Synthetic oligonucleotide; TGG chr11 5351763 5351782 5351779 +
gatcacagggagattggcca

SEQ ID NO: 23105 - DNA, 20 bp, Artificial Sequence
  Synthetic oligonucleotide; GAG chr11 5351765 5351784 5351781 +
tcacagggagattggccatg

SEQ ID NO: 23106 - DNA, 20 bp, Artificial Sequence
  Synthetic oligonucleotide; CAG chr11 5351779 5351798 5351795 +
gccatggagcctgcttctct

SEQ ID NO: 23107 - DNA, 20 bp, Artificial Sequence
  Synthetic oligonucleotide; AGG chr11 5351780 5351799 5351796 +
ccatggagcctgcttctctc

SEQ ID NO: 23108 - DNA, 20 bp, Artificial Sequence
  Synthetic oligonucleotide; TGG chr11 5351810 5351829 5351826 +
tatccatactctttctgtca

SEQ ID NO: 23109 - DNA, 20 bp, Artificial Sequence
  Synthetic oligonucleotide; GAG chr11 5351812 5351831 5351828 +
tccatactctttctgtcatg

SEQ ID NO: 23110 - DNA, 20 bp, Artificial Sequence
  Synthetic oligonucleotide; CAG chr11 5351816 5351835 5351832 +
tactctttctgtcatggagt

SEQ ID NO: 23111 - DNA, 20 bp, Artificial Sequence
  Synthetic oligonucleotide; AGG chr11 5351817 5351836 5351833 +
actctttctgtcatggagtc

SEQ ID NO: 23112 - DNA, 20 bp, Artificial Sequence
  Synthetic oligonucleotide; TGG chr11 5351834 5351853 5351850 +
gtcaggtgtcttgcttgcca

SEQ ID NO: 23113 - DNA, 20 bp, Artificial Sequence
  Synthetic oligonucleotide; CAG chr11 5351862 5351881 5351878 +
gactgtttcattaccatccg

SEQ ID NO: 23114 - DNA, 20 bp, Artificial Sequence
  Synthetic oligonucleotide; AAG chr11 5351871 5351890 5351887 +
attaccatccgcagcccctt

SEQ ID NO: 23115 - DNA, 20 bp, Artificial Sequence
  Synthetic oligonucleotide; CAG chr11 5351899 5351918 5351915 +
cctctatcctgaccaacacc

SEQ ID NO: 23116 - DNA, 20 bp, Artificial Sequence
  Synthetic oligonucleotide; AGG chr11 5351900 5351919 5351916 +
ctctatcctgaccaacaccc

SEQ ID NO: 23117 - DNA, 20 bp, Artificial Sequence
  Synthetic oligonucleotide; AAG chr11 5351908 5351927 5351924 +
tgaccaacacccaggtaatg

SEQ ID NO: 23118 - DNA, 20 bp, Artificial Sequence
  Synthetic oligonucleotide; TGG chr11 5351913 5351932 5351929 +
aacacccaggtaatgaagat

SEQ ID NO: 23119 - DNA, 20 bp, Artificial Sequence
  Synthetic oligonucleotide; CGG chr11 5351920 5351939 5351936 +
aggtaatgaagattggtgtg

SEQ ID NO: 23120 - DNA, 20 bp, Artificial Sequence
  Synthetic oligonucleotide; GGG chr11 5351921 5351940 5351937 +
ggtaatgaagattggtgtgc

SEQ ID NO: 23121 - DNA, 20 bp, Artificial Sequence
  Synthetic oligonucleotide; AAG chr11 5351931 5351950 5351947 +
attggtgtgcgggtattgac

SEQ ID NO: 23122 - DNA, 20 bp, Artificial Sequence
  Synthetic oligonucleotide; AGG chr11 5351932 5351951 5351948 +
ttggtgtgcgggtattgaca

SEQ ID NO: 23123 - DNA, 20 bp, Artificial Sequence
  Synthetic oligonucleotide; GGG chr11 5351933 5351952 5351949 +
tggtgtgcgggtattgacaa

SEQ ID NO: 23124 - DNA, 20 bp, Artificial Sequence
  Synthetic oligonucleotide; TGG chr11 5351937 5351956 5351953 +
gtgcgggtattgacaagggc

SEQ ID NO: 23125 - DNA, 20 bp, Artificial Sequence
  Synthetic oligonucleotide; TAG chr11 5351957 5351976 5351973 +
tggtctgtccattatgccaa

SEQ ID NO: 23126 - DNA, 20 bp, Artificial Sequence
  Synthetic oligonucleotide; TGG chr11 5351974 5351993 5351990 +
caatagttgttcgcctacac

SEQ ID NO: 23127 - DNA, 20 bp, Artificial Sequence
  Synthetic oligonucleotide; AAG chr11 5352026 5352045 5352042 +
ccatgctttctgtctacacc

SEQ ID NO: 23128 - DNA, 20 bp, Artificial Sequence
  Synthetic oligonucleotide; AAG chr11 5352037 5352056 5352053 +
gtctacaccaagatgtcatc

SEQ ID NO: 23129 - DNA, 20 bp, Artificial Sequence
  Synthetic oligonucleotide; TAG chr11 5352041 5352060 5352057 +
acaccaagatgtcatcaagc

SEQ ID NO: 23130 - DNA, 20 bp, Artificial Sequence
  Synthetic oligonucleotide; CAG chr11 5352077 5352096 5352093 +
caccttcaaccgtctctatc

SEQ ID NO: 23131 - DNA, 20 bp, Artificial Sequence
  Synthetic oligonucleotide; TAG chr11 5352083 5352102 5352099 +
caaccgtctctatccagttg

SEQ ID NO: 23132 - DNA, 20 bp, Artificial Sequence
  Synthetic oligonucleotide; TGG chr11 5352098 5352117 5352114 +
agttgtagttttatttgcaa

SEQ ID NO: 23133 - DNA, 20 bp, Artificial Sequence
  Synthetic oligonucleotide; TGG chr11 5352107 5352126 5352123 +
tttatttgcaatggtcttgt

SEQ ID NO: 23134 - DNA, 20 bp, Artificial Sequence
  Synthetic oligonucleotide; AAG chr11 5352148 5352167 5352164 +
tctcctacattttgattctc

SEQ ID NO: 23135 - DNA, 20 bp, Artificial Sequence
  Synthetic oligonucleotide; TGG chr11 5352158 5352177 5352174 +
tttgattctcaagactgtca

SEQ ID NO: 23136 - DNA, 20 bp, Artificial Sequence
  Synthetic oligonucleotide; GGG chr11 5352159 5352178 5352175 +
ttgattctcaagactgtcat

SEQ ID NO: 23137 - DNA, 20 bp, Artificial Sequence
  Synthetic oligonucleotide; TGG chr11 5352165 5352184 5352181 +
ctcaagactgtcatgggcat

SEQ ID NO: 23138 - DNA, 20 bp, Artificial Sequence
  Synthetic oligonucleotide; TGG chr11 5352171 5352190 5352187 +
actgtcatgggcattggttc

SEQ ID NO: 23139 - DNA, 20 bp, Artificial Sequence
  Synthetic oligonucleotide; GAG chr11 5352173 5352192 5352189 +
tgtcatgggcattggttctg

SEQ ID NO: 23140 - DNA, 20 bp, Artificial Sequence
  Synthetic oligonucleotide; AGG chr11 5352174 5352193 5352190 +
gtcatgggcattggttctgg

SEQ ID NO: 23141 - DNA, 20 bp, Artificial Sequence
  Synthetic oligonucleotide; GAG chr11 5352176 5352195 5352192 +
catgggcattggttctggag

SEQ ID NO: 23142 - DNA, 20 bp, Artificial Sequence
  Synthetic oligonucleotide; AAG chr11 5352180 5352199 5352196 +
ggcattggttctggaggaga

SEQ ID NO: 23143 - DNA, 20 bp, Artificial Sequence
  Synthetic oligonucleotide; AGG chr11 5352181 5352200 5352197 +
gcattggttctggaggagaa

SEQ ID NO: 23144 - DNA, 20 bp, Artificial Sequence
  Synthetic oligonucleotide; GGG chr11 5352182 5352201 5352198 +
cattggttctggaggagaaa

SEQ ID NO: 23145 - DNA, 20 bp, Artificial Sequence
  Synthetic oligonucleotide; AAG chr11 5352187 5352206 5352203 +
gttctggaggagaaagggcc

SEQ ID NO: 23146 - DNA, 20 bp, Artificial Sequence
  Synthetic oligonucleotide; AGG chr11 5352188 5352207 5352204 +
ttctggaggagaaagggcca

SEQ ID NO: 23147 - DNA, 20 bp, Artificial Sequence
  Synthetic oligonucleotide; TGG chr11 5352227 5352246 5352243 +
ctctcatatctgctgcatcc

SEQ ID NO: 23148 - DNA, 20 bp, Artificial Sequence
  Synthetic oligonucleotide; TAG chr11 5352245 5352264 5352261 +
cctggtcttctatgtcactg

SEQ ID NO: 23149 - DNA, 20 bp, Artificial Sequence
  Synthetic oligonucleotide; TAG chr11 5352267 5352286 5352283 +
gtttgtctgacatttattca

SEQ ID NO: 23150 - DNA, 20 bp, Artificial Sequence
  Synthetic oligonucleotide; AGG chr11 5352268 5352287 5352284 +
tttgtctgacatttattcat

SEQ ID NO: 23151 - DNA, 20 bp, Artificial Sequence
  Synthetic oligonucleotide; TGG chr11 5352273 5352292 5352289 +
ctgacatttattcataggtt

SEQ ID NO: 23152 - DNA, 20 bp, Artificial Sequence
  Synthetic oligonucleotide; AAG chr11 5352277 5352296 5352293 +
catttattcataggtttgga

SEQ ID NO: 23153 - DNA, 20 bp, Artificial Sequence
  Synthetic oligonucleotide; GAG chr11 5352309 5352328 5352325 +
catgtcgttcacatcacaat

SEQ ID NO: 23154 - DNA, 20 bp, Artificial Sequence
  Synthetic oligonucleotide; TAG chr11 5352357 5352376 5352373 +
tttatgaacccatttatcta

SEQ ID NO: 23155 - DNA, 20 bp, Artificial Sequence
  Synthetic oligonucleotide; AAG chr11 5352370 5352389 5352386 +
ttatctatagcattaaaact

SEQ ID NO: 23156 - DNA, 20 bp, Artificial Sequence
  Synthetic oligonucleotide; CAG chr11 5352373 5352392 5352389 +
tctatagcattaaaactaag

SEQ ID NO: 23157 - DNA, 20 bp, Artificial Sequence
  Synthetic oligonucleotide; CAG chr11 5352379 5352398 5352395 +
gcattaaaactaagcagatt

SEQ ID NO: 23158 - DNA, 20 bp, Artificial Sequence
  Synthetic oligonucleotide; GAG chr11 5352381 5352400 5352397 +
attaaaactaagcagattca

SEQ ID NO: 23159 - DNA, 20 bp, Artificial Sequence
  Synthetic oligonucleotide; TGG chr11 5352384 5352403 5352400 +
aaaactaagcagattcagag

SEQ ID NO: 23160 - DNA, 20 bp, Artificial Sequence
  Synthetic oligonucleotide; TAG chr11 5352417 5352436 5352433 +
ttattctctctgcctcactc

SEQ ID NO: 23161 - DNA, 20 bp, Artificial Sequence
  Synthetic oligonucleotide; GAG chr11 5352419 5352438 5352435 +
attctctctgcctcactcta

SEQ ID NO: 23162 - DNA, 20 bp, Artificial Sequence
  Synthetic oligonucleotide; TGG chr11 5352438 5352457 5352454 +
agagcatgacattgtttcac

SEQ ID NO: 23163 - DNA, 20 bp, Artificial Sequence
  Synthetic oligonucleotide; GAG chr11 5352446 5352465 5352462 +
acattgtttcactggtctct

SEQ ID NO: 23164 - DNA, 20 bp, Artificial Sequence
  Synthetic oligonucleotide; AGG chr11 5352447 5352466 5352463 +
cattgtttcactggtctctg

SEQ ID NO: 23165 - DNA, 20 bp, Artificial Sequence
  Synthetic oligonucleotide; CAG chr11 5352457 5352476 5352473 +
ctggtctctgaggaataatt

SEQ ID NO: 23166 - DNA, 20 bp, Artificial Sequence
  Synthetic oligonucleotide; AGG chr11 5352458 5352477 5352474 +
tggtctctgaggaataattc

SEQ ID NO: 23167 - DNA, 20 bp, Artificial Sequence
  Synthetic oligonucleotide; GGG chr11 5352459 5352478 5352475 +
ggtctctgaggaataattca

SEQ ID NO: 23168 - DNA, 20 bp, Artificial Sequence
  Synthetic oligonucleotide; GGG chr11 5352460 5352479 5352476 +
gtctctgaggaataattcag

SEQ ID NO: 23169 - DNA, 20 bp, Artificial Sequence
  Synthetic oligonucleotide; TGG chr11 5352466 5352485 5352482 +
gaggaataattcaggggacc

SEQ ID NO: 23170 - DNA, 20 bp, Artificial Sequence
  Synthetic oligonucleotide; CAG chr11 5352470 5352489 5352486 +
aataattcaggggacctgga

SEQ ID NO: 23171 - DNA, 20 bp, Artificial Sequence
  Synthetic oligonucleotide; AGG chr11 5352471 5352490 5352487 +
ataattcaggggacctggac

SEQ ID NO: 23172 - DNA, 20 bp, Artificial Sequence
  Synthetic oligonucleotide; CAG chr11 5352487 5352506 5352503 +
ggacaggatgacaatgttgc

SEQ ID NO: 23173 - DNA, 20 bp, Artificial Sequence
  Synthetic oligonucleotide; AAG chr11 5352493 5352512 5352509 +
gatgacaatgttgccagcat

SEQ ID NO: 23174 - DNA, 20 bp, Artificial Sequence
  Synthetic oligonucleotide; TAG chr11 5352500 5352519 5352516 +
atgttgccagcataagtaac

SEQ ID NO: 23175 - DNA, 20 bp, Artificial Sequence
  Synthetic oligonucleotide; AGG chr11 5352501 5352520 5352517 +
tgttgccagcataagtaact

SEQ ID NO: 23176 - DNA, 20 bp, Artificial Sequence
  Synthetic oligonucleotide; GGG chr11 5352502 5352521 5352518 +
gttgccagcataagtaacta

SEQ ID NO: 23177 - DNA, 20 bp, Artificial Sequence
  Synthetic oligonucleotide; AAG chr11 5352506 5352525 5352522 +
ccagcataagtaactaggga

SEQ ID NO: 23178 - DNA, 20 bp, Artificial Sequence
  Synthetic oligonucleotide; GAG chr11 5352519 5352538 5352535 +
ctagggaaagtcatttcaat

SEQ ID NO: 23179 - DNA, 20 bp, Artificial Sequence
  Synthetic oligonucleotide; GAG chr11 5352537 5352556 5352553 +
atgagaactaatcaatccct

SEQ ID NO: 23180 - DNA, 20 bp, Artificial Sequence
  Synthetic oligonucleotide; CAG chr11 5352545 5352564 5352561 +
taatcaatccctgagcattt

SEQ ID NO: 23181 - DNA, 20 bp, Artificial Sequence
  Synthetic oligonucleotide; TGG chr11 5352548 5352567 5352564 +
tcaatccctgagcatttcag

SEQ ID NO: 23182 - DNA, 20 bp, Artificial Sequence
  Synthetic oligonucleotide; CAG chr11 5352555 5352574 5352571 +
ctgagcatttcagtggaaat

SEQ ID NO: 23183 - DNA, 20 bp, Artificial Sequence
  Synthetic oligonucleotide; TAG chr11 5352575 5352594 5352591 +
cagtcaatccctctgctact

SEQ ID NO: 23184 - DNA, 20 bp, Artificial Sequence
  Synthetic oligonucleotide; AAG chr11 5352617 5352636 5352633 +
tgtctattgctgatttgtat

SEQ ID NO: 23185 - DNA, 20 bp, Artificial Sequence
  Synthetic oligonucleotide; AAG chr11 5352636 5352655 5352652 +
taagatatatgtacaacact

SEQ ID NO: 23186 - DNA, 20 bp, Artificial Sequence
  Synthetic oligonucleotide; CAG chr11 5352648 5352667 5352664 +
acaacactaagtacatatct

SEQ ID NO: 23187 - DNA, 20 bp, Artificial Sequence
  Synthetic oligonucleotide; CAG chr11 5352673 5352692 5352689 +
ctcaactgatattgttttct

SEQ ID NO: 23188 - DNA, 20 bp, Artificial Sequence
  Synthetic oligonucleotide; AGG chr11 5352674 5352693 5352690 +
tcaactgatattgttttctc

SEQ ID NO: 23189 - DNA, 20 bp, Artificial Sequence
  Synthetic oligonucleotide; TAG chr11 5352700 5352719 5352716 +
tttaactcacattgtttgat

SEQ ID NO: 23190 - DNA, 20 bp, Artificial Sequence
  Synthetic oligonucleotide; TGG chr11 5352707 5352726 5352723 +
cacattgtttgattagctta

SEQ ID NO: 23191 - DNA, 20 bp, Artificial Sequence
  Synthetic oligonucleotide; TGG chr11 5352711 5352730 5352727 +
ttgtttgattagcttatggc

SEQ ID NO: 23192 - DNA, 20 bp, Artificial Sequence
  Synthetic oligonucleotide; CAG chr11 5352759 5352778 5352775 +
cacacatacatatacacaca

SEQ ID NO: 23193 - DNA, 20 bp, Artificial Sequence
  Synthetic oligonucleotide; TAG chr11 5352833 5352852 5352849 +
tatatatacttaatatataa

SEQ ID NO: 23194 - DNA, 20 bp, Artificial Sequence
  Synthetic oligonucleotide; TGG chr11 5352914 5352933 5352930 +
ccaattatatatataattct

SEQ ID NO: 23195 - DNA, 20 bp, Artificial Sequence
  Synthetic oligonucleotide; GGG chr11 5352915 5352934 5352931 +
caattatatatataattctt

SEQ ID NO: 23196 - DNA, 20 bp, Artificial Sequence
  Synthetic oligonucleotide; TGG chr11 5352927 5352946 5352943 +
taattcttgggtctatgatt

SEQ ID NO: 23197 - DNA, 20 bp, Artificial Sequence
  Synthetic oligonucleotide; GGG chr11 5352928 5352947 5352944 +
aattcttgggtctatgattt

SEQ ID NO: 23198 - DNA, 20 bp, Artificial Sequence
  Synthetic oligonucleotide; CGG chr11 5352935 5352954 5352951 +
gggtctatgatttgggtcac

SEQ ID NO: 23199 - DNA, 20 bp, Artificial Sequence
  Synthetic oligonucleotide; CAG chr11 5352943 5352962 5352959 +
gatttgggtcaccggcattt

SEQ ID NO: 23200 - DNA, 20 bp, Artificial Sequence
  Synthetic oligonucleotide; TGG chr11 5352968 5352987 5352984 +
aatgcccattgctctccata

SEQ ID NO: 23201 - DNA, 20 bp, Artificial Sequence
  Synthetic oligonucleotide; TAG chr11 5352982 5353001 5352998 +
tccatatggcttgcatatat

SEQ ID NO: 23202 - DNA, 20 bp, Artificial Sequence
  Synthetic oligonucleotide; TAG chr11 5352997 5353016 5353013 +
tatattagtcctgttataca

SEQ ID NO: 23203 - DNA, 20 bp, Artificial Sequence
  Synthetic oligonucleotide; AGG chr11 5352998 5353017 5353014 +
atattagtcctgttatacat

SEQ ID NO: 23204 - DNA, 20 bp, Artificial Sequence
  Synthetic oligonucleotide; AAG chr11 5353004 5353023 5353020 +
gtcctgttatacataggaat

SEQ ID NO: 23205 - DNA, 20 bp, Artificial Sequence
  Synthetic oligonucleotide; AGG chr11 5353005 5353024 5353021 +
tcctgttatacataggaata

SEQ ID NO: 23206 - DNA, 20 bp, Artificial Sequence
  Synthetic oligonucleotide; TGG chr11 5353014 5353033 5353030 +
acataggaataaggcatttt

SEQ ID NO: 23207 - DNA, 20 bp, Artificial Sequence
  Synthetic oligonucleotide; CAG chr11 5353020 5353039 5353036 +
gaataaggcatttttggctt

SEQ ID NO: 23208 - DNA, 20 bp, Artificial Sequence
  Synthetic oligonucleotide; CAG chr11 5353032 5353051 5353048 +
tttggcttcagacatacatc

SEQ ID NO: 23209 - DNA, 20 bp, Artificial Sequence
  Synthetic oligonucleotide; TGG chr11 5353049 5353068 5353065 +
atccagttctcttgcatata

SEQ ID NO: 23210 - DNA, 20 bp, Artificial Sequence
  Synthetic oligonucleotide; GAG chr11 5353051 5353070 5353067 +
ccagttctcttgcatatatg

SEQ ID NO: 23211 - DNA, 20 bp, Artificial Sequence
  Synthetic oligonucleotide; TGG chr11 5353055 5353074 5353071 +
ttctcttgcatatatggagc

SEQ ID NO: 23212 - DNA, 20 bp, Artificial Sequence
  Synthetic oligonucleotide; TAG chr11 5353068 5353087 5353084 +
atggagctggctgctgtttc

SEQ ID NO: 23213 - DNA, 20 bp, Artificial Sequence
  Synthetic oligonucleotide; AAG chr11 5353084 5353103 5353100 +
tttctagaaaattgcacgtg

SEQ ID NO: 23214 - DNA, 20 bp, Artificial Sequence
  Synthetic oligonucleotide; GAG chr11 5353091 5353110 5353107 +
aaaattgcacgtgaagaaat

SEQ ID NO: 23215 - DNA, 20 bp, Artificial Sequence
  Synthetic oligonucleotide; GAG chr11 5353106 5353125 5353122 +
gaaatgagactttcttcaat

SEQ ID NO: 23216 - DNA, 20 bp, Artificial Sequence
  Synthetic oligonucleotide; GAG chr11 5353108 5353127 5353124 +
aatgagactttcttcaatga

SEQ ID NO: 23217 - DNA, 20 bp, Artificial Sequence
  Synthetic oligonucleotide; AAG chr11 5353112 5353131 5353128 +
agactttcttcaatgagagt

SEQ ID NO: 23218 - DNA, 20 bp, Artificial Sequence
  Synthetic oligonucleotide; GAG chr11 5353142 5353161 5353158 +
cctcaattactttcttcaat

SEQ ID NO: 23219 - DNA, 20 bp, Artificial Sequence
  Synthetic oligonucleotide; AGG chr11 5353143 5353162 5353159 +
ctcaattactttcttcaatg

SEQ ID NO: 23220 - DNA, 20 bp, Artificial Sequence
  Synthetic oligonucleotide; GGG chr11 5353144 5353163 5353160 +
tcaattactttcttcaatga

SEQ ID NO: 23221 - DNA, 20 bp, Artificial Sequence
  Synthetic oligonucleotide; GAG chr11 5353175 5353194 5353191 +
ttccctcaattcaaaatgat

SEQ ID NO: 23222 - DNA, 20 bp, Artificial Sequence
  Synthetic oligonucleotide; TAG chr11 5353180 5353199 5353196 +
tcaattcaaaatgatgagtc

SEQ ID NO: 23223 - DNA, 20 bp, Artificial Sequence
  Synthetic oligonucleotide; AGG chr11 5353181 5353200 5353197 +
caattcaaaatgatgagtct

SEQ ID NO: 23224 - DNA, 20 bp, Artificial Sequence
  Synthetic oligonucleotide; GGG chr11 5353182 5353201 5353198 +
aattcaaaatgatgagtcta

SEQ ID NO: 23225 - DNA, 20 bp, Artificial Sequence
  Synthetic oligonucleotide; AAG chr11 5353186 5353205 5353202 +
caaaatgatgagtctaggga

SEQ ID NO: 23226 - DNA, 20 bp, Artificial Sequence
  Synthetic oligonucleotide; GAG chr11 5353198 5353217 5353214 +
tctagggaaagtatctctat

SEQ ID NO: 23227 - DNA, 20 bp, Artificial Sequence
  Synthetic oligonucleotide; CAG chr11 5353210 5353229 5353226 +
atctctatgagaaatgtgtt

SEQ ID NO: 23228 - DNA, 20 bp, Artificial Sequence
  Synthetic oligonucleotide; TGG chr11 5353222 5353241 5353238 +
aatgtgttcagttaaaactt

SEQ ID NO: 23229 - DNA, 20 bp, Artificial Sequence
  Synthetic oligonucleotide; CAG chr11 5353263 5353282 5353279 +
tattgataataatttgaaaa

SEQ ID NO: 23230 - DNA, 20 bp, Artificial Sequence
  Synthetic oligonucleotide; GAG chr11 5353265 5353284 5353281 +
ttgataataatttgaaaaca

SEQ ID NO: 23231 - DNA, 20 bp, Artificial Sequence
  Synthetic oligonucleotide; CAG chr11 5353283 5353302 5353299 +
cagagatataatttctaatt

SEQ ID NO: 23232 - DNA, 20 bp, Artificial Sequence
  Synthetic oligonucleotide; TAG chr11 5353302 5353321 5353318 +
tcagatgaccattgtcttga

SEQ ID NO: 23233 - DNA, 20 bp, Artificial Sequence
  Synthetic oligonucleotide; CAG chr11 5353312 5353331 5353328 +
attgtcttgatagttaattc

SEQ ID NO: 23234 - DNA, 20 bp, Artificial Sequence
  Synthetic oligonucleotide; CAG chr11 5353326 5353345 5353342 +
taattccagttactactgaa

SEQ ID NO: 23235 - DNA, 20 bp, Artificial Sequence
  Synthetic oligonucleotide; GAG chr11 5353328 5353347 5353344 +
attccagttactactgaaca

SEQ ID NO: 23236 - DNA, 20 bp, Artificial Sequence
  Synthetic oligonucleotide; GAG chr11 5353330 5353349 5353346 +
tccagttactactgaacaga

SEQ ID NO: 23237 - DNA, 20 bp, Artificial Sequence
  Synthetic oligonucleotide; AAG chr11 5353346 5353365 5353362 +
cagagagatgcattttcata

SEQ ID NO: 23238 - DNA, 20 bp, Artificial Sequence
  Synthetic oligonucleotide; TGG chr11 5353349 5353368 5353365 +
agagatgcattttcataaag

SEQ ID NO: 23239 - DNA, 20 bp, Artificial Sequence
  Synthetic oligonucleotide; GAG chr11 5353355 5353374 5353371 +
gcattttcataaagtggtat

SEQ ID NO: 23240 - DNA, 20 bp, Artificial Sequence
  Synthetic oligonucleotide; GAG chr11 5353357 5353376 5353373 +
attttcataaagtggtatga

SEQ ID NO: 23241 - DNA, 20 bp, Artificial Sequence
  Synthetic oligonucleotide; AGG chr11 5353358 5353377 5353374 +
ttttcataaagtggtatgag

SEQ ID NO: 23242 - DNA, 20 bp, Artificial Sequence
  Synthetic oligonucleotide; TGG chr11 5353363 5353382 5353379 +
ataaagtggtatgagaggtc

SEQ ID NO: 23243 - DNA, 20 bp, Artificial Sequence
  Synthetic oligonucleotide; TAG chr11 5353368 5353387 5353384 +
gtggtatgagaggtctggtt

SEQ ID NO: 23244 - DNA, 20 bp, Artificial Sequence
  Synthetic oligonucleotide; AGG chr11 5353369 5353388 5353385 +
tggtatgagaggtctggttt

SEQ ID NO: 23245 - DNA, 20 bp, Artificial Sequence
  Synthetic oligonucleotide; GGG chr11 5353370 5353389 5353386 +
ggtatgagaggtctggttta

SEQ ID NO: 23246 - DNA, 20 bp, Artificial Sequence
  Synthetic oligonucleotide; GGG chr11 5353371 5353390 5353387 +
gtatgagaggtctggtttag

SEQ ID NO: 23247 - DNA, 20 bp, Artificial Sequence
  Synthetic oligonucleotide; CAG chr11 5353379 5353398 5353395 +
ggtctggtttaggggaacat

SEQ ID NO: 23248 - DNA, 20 bp, Artificial Sequence
  Synthetic oligonucleotide; GAG chr11 5353381 5353400 5353397 +
tctggtttaggggaacatca

SEQ ID NO: 23249 - DNA, 20 bp, Artificial Sequence
  Synthetic oligonucleotide; AAG chr11 5353386 5353405 5353402 +
tttaggggaacatcagagat

SEQ ID NO: 23250 - DNA, 20 bp, Artificial Sequence
  Synthetic oligonucleotide; TAG chr11 5353391 5353410 5353407 +
gggaacatcagagataagac

SEQ ID NO: 23251 - DNA, 20 bp, Artificial Sequence
  Synthetic oligonucleotide; TAG chr11 5353395 5353414 5353411 +
acatcagagataagactaga

SEQ ID NO: 23252 - DNA, 20 bp, Artificial Sequence
  Synthetic oligonucleotide; AGG chr11 5353396 5353415 5353412 +
catcagagataagactagat

SEQ ID NO: 23253 - DNA, 20 bp, Artificial Sequence
  Synthetic oligonucleotide; GGG chr11 5353397 5353416 5353413 +
atcagagataagactagata

SEQ ID NO: 23254 - DNA, 20 bp, Artificial Sequence
  Synthetic oligonucleotide; GGG chr11 5353398 5353417 5353414 +
tcagagataagactagatag

SEQ ID NO: 23255 - DNA, 20 bp, Artificial Sequence
  Synthetic oligonucleotide; TGG chr11 5353405 5353424 5353421 +
taagactagataggggtgtc

SEQ ID NO: 23256 - DNA, 20 bp, Artificial Sequence
  Synthetic oligonucleotide; TAG chr11 5353419 5353438 5353435 +
ggtgtctggcatgtgcaaaa

SEQ ID NO: 23257 - DNA, 20 bp, Artificial Sequence
  Synthetic oligonucleotide; CAG chr11 5353422 5353441 5353438 +
gtctggcatgtgcaaaatag

SEQ ID NO: 23258 - DNA, 20 bp, Artificial Sequence
  Synthetic oligonucleotide; GAG chr11 5353424 5353443 5353440 +
ctggcatgtgcaaaatagca

SEQ ID NO: 23259 - DNA, 20 bp, Artificial Sequence
  Synthetic oligonucleotide; CAG chr11 5353439 5353458 5353455 +
tagcagagttgaaaaacaaa

SEQ ID NO: 23260 - DNA, 20 bp, Artificial Sequence
  Synthetic oligonucleotide; TGG chr11 5353443 5353462 5353459 +
agagttgaaaaacaaacagt

SEQ ID NO: 23261 - DNA, 20 bp, Artificial Sequence
  Synthetic oligonucleotide; TGG chr11 5353453 5353472 5353469 +
aacaaacagttggtcatatg

SEQ ID NO: 23262 - DNA, 20 bp, Artificial Sequence
  Synthetic oligonucleotide; GAG chr11 5353455 5353474 5353471 +
caaacagttggtcatatgtg

SEQ ID NO: 23263 - DNA, 20 bp, Artificial Sequence
  Synthetic oligonucleotide; GAG chr11 5353457 5353476 5353473 +
aacagttggtcatatgtgga

SEQ ID NO: 23264 - DNA, 20 bp, Artificial Sequence
  Synthetic oligonucleotide; TGG chr11 5353460 5353479 5353476 +
agttggtcatatgtggagag

SEQ ID NO: 23265 - DNA, 20 bp, Artificial Sequence
  Synthetic oligonucleotide; GGG chr11 5353461 5353480 5353477 +
gttggtcatatgtggagagt

SEQ ID NO: 23266 - DNA, 20 bp, Artificial Sequence
  Synthetic oligonucleotide; GGG chr11 5353462 5353481 5353478 +
ttggtcatatgtggagagtg

SEQ ID NO: 23267 - DNA, 20 bp, Artificial Sequence
  Synthetic oligonucleotide; GAG chr11 5353464 5353483 5353480 +
ggtcatatgtggagagtggg

SEQ ID NO: 23268 - DNA, 20 bp, Artificial Sequence
  Synthetic oligonucleotide; AGG chr11 5353465 5353484 5353481 +
gtcatatgtggagagtgggg

SEQ ID NO: 23269 - DNA, 20 bp, Artificial Sequence
  Synthetic oligonucleotide; AAG chr11 5353468 5353487 5353484 +
atatgtggagagtggggagg

SEQ ID NO: 23270 - DNA, 20 bp, Artificial Sequence
  Synthetic oligonucleotide; AGG chr11 5353469 5353488 5353485 +
tatgtggagagtggggagga

SEQ ID NO: 23271 - DNA, 20 bp, Artificial Sequence
  Synthetic oligonucleotide; GGG chr11 5353470 5353489 5353486 +
atgtggagagtggggaggaa

SEQ ID NO: 23272 - DNA, 20 bp, Artificial Sequence
  Synthetic oligonucleotide; GAG chr11 5353472 5353491 5353488 +
gtggagagtggggaggaagg

SEQ ID NO: 23273 - DNA, 20 bp, Artificial Sequence
  Synthetic oligonucleotide; GAG chr11 5353474 5353493 5353490 +
ggagagtggggaggaaggga

SEQ ID NO: 23274 - DNA, 20 bp, Artificial Sequence
  Synthetic oligonucleotide; AGG chr11 5353475 5353494 5353491 +
gagagtggggaggaagggag

SEQ ID NO: 23275 - DNA, 20 bp, Artificial Sequence
  Synthetic oligonucleotide; TGG chr11 5353479 5353498 5353495 +
gtggggaggaagggagagga

SEQ ID NO: 23276 - DNA, 20 bp, Artificial Sequence
  Synthetic oligonucleotide; GAG chr11 5353481 5353500 5353497 +
ggggaggaagggagaggatg

SEQ ID NO: 23277 - DNA, 20 bp, Artificial Sequence
  Synthetic oligonucleotide; AGG chr11 5353482 5353501 5353498 +
gggaggaagggagaggatgg

SEQ ID NO: 23278 - DNA, 20 bp, Artificial Sequence
  Synthetic oligonucleotide; TAG chr11 5353498 5353517 5353514 +
atggaggcaatgctcataac

SEQ ID NO: 23279 - DNA, 20 bp, Artificial Sequence
  Synthetic oligonucleotide; AAG chr11 5353501 5353520 5353517 +
gaggcaatgctcataactag

SEQ ID NO: 23280 - DNA, 20 bp, Artificial Sequence
  Synthetic oligonucleotide; TGG chr11 5353510 5353529 5353526 +
ctcataactagaagataaaa

SEQ ID NO: 23281 - DNA, 20 bp, Artificial Sequence
  Synthetic oligonucleotide; TGG chr11 5353520 5353539 5353536 +
gaagataaaatggccttttc

SEQ ID NO: 23282 - DNA, 20 bp, Artificial Sequence
  Synthetic oligonucleotide; CAG chr11 5353546 5353565 5353562 +
caaatacttttgattctttt

SEQ ID NO: 23283 - DNA, 20 bp, Artificial Sequence
  Synthetic oligonucleotide; GAG chr11 5353548 5353567 5353564 +
aatacttttgattcttttca

SEQ ID NO: 23284 - DNA, 20 bp, Artificial Sequence
  Synthetic oligonucleotide; TAG chr11 5353553 5353572 5353569 +
ttttgattcttttcagagtc

SEQ ID NO: 23285 - DNA, 20 bp, Artificial Sequence
  Synthetic oligonucleotide; AGG chr11 5353554 5353573 5353570 +
tttgattcttttcagagtct

SEQ ID NO: 23286 - DNA, 20 bp, Artificial Sequence
  Synthetic oligonucleotide; GAG chr11 5353560 5353579 5353576 +
tcttttcagagtctaggcat

SEQ ID NO: 23287 - DNA, 20 bp, Artificial Sequence
  Synthetic oligonucleotide; AAG chr11 5353563 5353582 5353579 +
tttcagagtctaggcatgag

SEQ ID NO: 23288 - DNA, 20 bp, Artificial Sequence
  Synthetic oligonucleotide; GAG chr11 5353565 5353584 5353581 +
tcagagtctaggcatgagaa

SEQ ID NO: 23289 - DNA, 20 bp, Artificial Sequence
  Synthetic oligonucleotide; AGG chr11 5353566 5353585 5353582 +
cagagtctaggcatgagaag

SEQ ID NO: 23290 - DNA, 20 bp, Artificial Sequence
  Synthetic oligonucleotide; GGG chr11 5353567 5353586 5353583 +
agagtctaggcatgagaaga

SEQ ID NO: 23291 - DNA, 20 bp, Artificial Sequence
  Synthetic oligonucleotide; GGG chr11 5353568 5353587 5353584 +
gagtctaggcatgagaagag

SEQ ID NO: 23292 - DNA, 20 bp, Artificial Sequence
  Synthetic oligonucleotide; GGG chr11 5353569 5353588 5353585 +
agtctaggcatgagaagagg

SEQ ID NO: 23293 - DNA, 20 bp, Artificial Sequence
  Synthetic oligonucleotide; TGG chr11 5353576 5353595 5353592 +
gcatgagaagagggggtttg

SEQ ID NO: 23294 - DNA, 20 bp, Artificial Sequence
  Synthetic oligonucleotide; TGG chr11 5353584 5353603 5353600 +
agagggggtttgtggtccta

SEQ ID NO: 23295 - DNA, 20 bp, Artificial Sequence
  Synthetic oligonucleotide; CAG chr11 5353588 5353607 5353604 +
ggggtttgtggtcctatggc

SEQ ID NO: 23296 - DNA, 20 bp, Artificial Sequence
  Synthetic oligonucleotide; AGG chr11 5353589 5353608 5353605 +
gggtttgtggtcctatggcc

SEQ ID NO: 23297 - DNA, 20 bp, Artificial Sequence
  Synthetic oligonucleotide; AAG chr11 5353594 5353613 5353610 +
tgtggtcctatggccaggtg

SEQ ID NO: 23298 - DNA, 20 bp, Artificial Sequence
  Synthetic oligonucleotide; GAG chr11 5353596 5353615 5353612 +
tggtcctatggccaggtgaa

SEQ ID NO: 23299 - DNA, 20 bp, Artificial Sequence
  Synthetic oligonucleotide; CAG chr11 5353600 5353619 5353616 +
cctatggccaggtgaagagc

SEQ ID NO: 23300 - DNA, 20 bp, Artificial Sequence
  Synthetic oligonucleotide; AAG chr11 5353622 5353641 5353638 +
gtatccatgactcaaatgat

SEQ ID NO: 23301 - DNA, 20 bp, Artificial Sequence
  Synthetic oligonucleotide; AAG chr11 5353642 5353661 5353658 +
aagttttaaattaattttaa

SEQ ID NO: 23302 - DNA, 20 bp, Artificial Sequence
  Synthetic oligonucleotide; AAG chr11 5353646 5353665 5353662 +
tttaaattaattttaaaaga

SEQ ID NO: 23303 - DNA, 20 bp, Artificial Sequence
  Synthetic oligonucleotide; CAG chr11 5353669 5353688 5353685 +
atattcttttgaccaaaata

SEQ ID NO: 23304 - DNA, 20 bp, Artificial Sequence
  Synthetic oligonucleotide; AGG chr11 5353670 5353689 5353686 +
tattcttttgaccaaaatac

SEQ ID NO: 23305 - DNA, 20 bp, Artificial Sequence
  Synthetic oligonucleotide; GGG chr11 5353671 5353690 5353687 +
attcttttgaccaaaataca

SEQ ID NO: 23306 - DNA, 20 bp, Artificial Sequence
  Synthetic oligonucleotide; TGG chr11 5353685 5353704 5353701 +
aatacagggtatgatgtgct

SEQ ID NO: 23307 - DNA, 20 bp, Artificial Sequence
  Synthetic oligonucleotide; AAG chr11 5353695 5353714 5353711 +
atgatgtgcttggactacac

SEQ ID NO: 23308 - DNA, 20 bp, Artificial Sequence
  Synthetic oligonucleotide; AGG chr11 5353696 5353715 5353712 +
tgatgtgcttggactacaca

SEQ ID NO: 23309 - DNA, 20 bp, Artificial Sequence
  Synthetic oligonucleotide; GGG chr11 5353697 5353716 5353713 +
gatgtgcttggactacacaa

SEQ ID NO: 23310 - DNA, 20 bp, Artificial Sequence
  Synthetic oligonucleotide; GGG chr11 5353698 5353717 5353714 +
atgtgcttggactacacaag

SEQ ID NO: 23311 - DNA, 20 bp, Artificial Sequence
  Synthetic oligonucleotide; CAG chr11 5353706 5353725 5353722 +
ggactacacaaggggccacc

SEQ ID NO: 23312 - DNA, 20 bp, Artificial Sequence
  Synthetic oligonucleotide; CAG chr11 5353713 5353732 5353729 +
acaaggggccacccagtgac

SEQ ID NO: 23313 - DNA, 20 bp, Artificial Sequence
  Synthetic oligonucleotide; CAG chr11 5353717 5353736 5353733 +
ggggccacccagtgaccagt

SEQ ID NO: 23314 - DNA, 20 bp, Artificial Sequence
  Synthetic oligonucleotide; TGG chr11 5353721 5353740 5353737 +
ccacccagtgaccagtcagc

SEQ ID NO: 23315 - DNA, 20 bp, Artificial Sequence
  Synthetic oligonucleotide; TGG chr11 5353738 5353757 5353754 +
agctggatgcccctcatctc

SEQ ID NO: 23316 - DNA, 20 bp, Artificial Sequence
  Synthetic oligonucleotide; CAG chr11 5353760 5353779 5353776 +
gcctctgtcatactgacact

SEQ ID NO: 23317 - DNA, 20 bp, Artificial Sequence
  Synthetic oligonucleotide; TGG chr11 5353770 5353789 5353786 +
tactgacactcagtgatcta

SEQ ID NO: 23318 - DNA, 20 bp, Artificial Sequence
  Synthetic oligonucleotide; CAG chr11 5353794 5353813 5353810 +
tgcccacctactcttcatca

SEQ ID NO: 23319 - DNA, 20 bp, Artificial Sequence
  Synthetic oligonucleotide; AAG chr11 5353798 5353817 5353814 +
cacctactcttcatcacaga

SEQ ID NO: 23320 - DNA, 20 bp, Artificial Sequence
  Synthetic oligonucleotide; AGG chr11 5353799 5353818 5353815 +
acctactcttcatcacagaa

SEQ ID NO: 23321 - DNA, 20 bp, Artificial Sequence
  Synthetic oligonucleotide; TGG chr11 5353802 5353821 5353818 +
tactcttcatcacagaaagg

SEQ ID NO: 23322 - DNA, 20 bp, Artificial Sequence
  Synthetic oligonucleotide; GGG chr11 5353803 5353822 5353819 +
actcttcatcacagaaaggt

SEQ ID NO: 23323 - DNA, 20 bp, Artificial Sequence
  Synthetic oligonucleotide; GGG chr11 5353804 5353823 5353820 +
ctcttcatcacagaaaggtg

SEQ ID NO: 23324 - DNA, 20 bp, Artificial Sequence
  Synthetic oligonucleotide; TAG chr11 5353813 5353832 5353829 +
acagaaaggtggggattttt

SEQ ID NO: 23325 - DNA, 20 bp, Artificial Sequence
  Synthetic oligonucleotide; AGG chr11 5353814 5353833 5353830 +
cagaaaggtggggatttttt

SEQ ID NO: 23326 - DNA, 20 bp, Artificial Sequence
  Synthetic oligonucleotide; TGG chr11 5353822 5353841 5353838 +
tggggattttttaggattct

SEQ ID NO: 23327 - DNA, 20 bp, Artificial Sequence
  Synthetic oligonucleotide; GGG chr11 5353823 5353842 5353839 +
ggggattttttaggattctt

SEQ ID NO: 23328 - DNA, 20 bp, Artificial Sequence
  Synthetic oligonucleotide; CAG chr11 5353840 5353859 5353856 +
cttgggatgtataaataaca

SEQ ID NO: 23329 - DNA, 20 bp, Artificial Sequence
  Synthetic oligonucleotide; GAG chr11 5353842 5353861 5353858 +
tgggatgtataaataacaca

SEQ ID NO: 23330 - DNA, 20 bp, Artificial Sequence
  Synthetic oligonucleotide; TAG chr11 5353874 5353893 5353890 +
ataaaataataccttcacaa

SEQ ID NO: 23331 - DNA, 20 bp, Artificial Sequence
  Synthetic oligonucleotide; CAG chr11 5353881 5353900 5353897 +
aataccttcacaatagtttc

SEQ ID NO: 23332 - DNA, 20 bp, Artificial Sequence
  Synthetic oligonucleotide; AGG chr11 5353882 5353901 5353898 +
ataccttcacaatagtttcc

SEQ ID NO: 23333 - DNA, 20 bp, Artificial Sequence
  Synthetic oligonucleotide; TAG chr11 5353886 5353905 5353902 +
cttcacaatagtttccaggc

SEQ ID NO: 23334 - DNA, 20 bp, Artificial Sequence
  Synthetic oligonucleotide; TAG chr11 5353908 5353927 5353924 +
gtaaatgatctttatctgat

SEQ ID NO: 23335 - DNA, 20 bp, Artificial Sequence
  Synthetic oligonucleotide; AAG chr11 5353916 5353935 5353932 +
tctttatctgattagaccaa

SEQ ID NO: 23336 - DNA, 20 bp, Artificial Sequence
  Synthetic oligonucleotide; TGG chr11 5353941 5353960 5353957 +
tttgtttgttttactcaact

SEQ ID NO: 23337 - DNA, 20 bp, Artificial Sequence
  Synthetic oligonucleotide; TAG chr11 5353973 5353992 5353989 +
aaatttgcctttctcttttg

SEQ ID NO: 23338 - DNA, 20 bp, Artificial Sequence
  Synthetic oligonucleotide; GAG chr11 5353994 5354013 5354010 +
agcttcttgactgtgtgctc

SEQ ID NO: 23339 - DNA, 20 bp, Artificial Sequence
  Synthetic oligonucleotide; AGG chr11 5353995 5354014 5354011 +
gcttcttgactgtgtgctcg

SEQ ID NO: 23340 - DNA, 20 bp, Artificial Sequence
  Synthetic oligonucleotide; TGG chr11 5353999 5354018 5354015 +
cttgactgtgtgctcgagga

SEQ ID NO: 23341 - DNA, 20 bp, Artificial Sequence
  Synthetic oligonucleotide; TAG chr11 5354013 5354032 5354029 +
cgaggatggtaaatataaca

SEQ ID NO: 23342 - DNA, 20 bp, Artificial Sequence
  Synthetic oligonucleotide; CAG chr11 5354037 5354056 5354053 +
tcttattccctactgtatta

SEQ ID NO: 23343 - DNA, 20 bp, Artificial Sequence
  Synthetic oligonucleotide; TAG chr11 5354051 5354070 5354067 +
gtattacagaacttctcaca

SEQ ID NO: 23344 - DNA, 20 bp, Artificial Sequence
  Synthetic oligonucleotide; AAG chr11 5354105 5354124 5354121 +
aaatgaataaataaaattta

SEQ ID NO: 23345 - DNA, 20 bp, Artificial Sequence
  Synthetic oligonucleotide; TAG chr11 5354134 5354153 5354150 +
atgtctttctgtgtgtctgc

SEQ ID NO: 23346 - DNA, 20 bp, Artificial Sequence
  Synthetic oligonucleotide; AAG chr11 5354173 5354192 5354189 +
tgctctctgtattgtcttcc

SEQ ID NO: 23347 - DNA, 20 bp, Artificial Sequence
  Synthetic oligonucleotide; TGG chr11 5354179 5354198 5354195 +
ctgtattgtcttccaagata

SEQ ID NO: 23348 - DNA, 20 bp, Artificial Sequence
  Synthetic oligonucleotide; GGG chr11 5354180 5354199 5354196 +
tgtattgtcttccaagatat

SEQ ID NO: 23349 - DNA, 20 bp, Artificial Sequence
  Synthetic oligonucleotide; TGG chr11 5354215 5354234 5354231 +
aatcctgttctttcttccct

SEQ ID NO: 23350 - DNA, 20 bp, Artificial Sequence
  Synthetic oligonucleotide; GGG chr11 5354216 5354235 5354232 +
atcctgttctttcttccctt

SEQ ID NO: 23351 - DNA, 20 bp, Artificial Sequence
  Synthetic oligonucleotide; TGG chr11 5354223 5354242 5354239 +
tctttcttcccttgggcttt

SEQ ID NO: 23352 - DNA, 20 bp, Artificial Sequence
  Synthetic oligonucleotide; GGG chr11 5354224 5354243 5354240 +
ctttcttcccttgggctttt

SEQ ID NO: 23353 - DNA, 20 bp, Artificial Sequence
  Synthetic oligonucleotide; CAG chr11 5354235 5354254 5354251 +
tgggcttttgggaatgaatt

SEQ ID NO: 23354 - DNA, 20 bp, Artificial Sequence
  Synthetic oligonucleotide; AGG chr11 5354236 5354255 5354252 +
gggcttttgggaatgaattc

SEQ ID NO: 23355 - DNA, 20 bp, Artificial Sequence
  Synthetic oligonucleotide; GGG chr11 5354237 5354256 5354253 +
ggcttttgggaatgaattca

SEQ ID NO: 23356 - DNA, 20 bp, Artificial Sequence
  Synthetic oligonucleotide; GGG chr11 5354238 5354257 5354254 +
gcttttgggaatgaattcag

SEQ ID NO: 23357 - DNA, 20 bp, Artificial Sequence
  Synthetic oligonucleotide; GGG chr11 5354239 5354258 5354255 +
cttttgggaatgaattcagg

SEQ ID NO: 23358 - DNA, 20 bp, Artificial Sequence
  Synthetic oligonucleotide; AAG chr11 5354246 5354265 5354262 +
gaatgaattcagggggatct

SEQ ID NO: 23359 - DNA, 20 bp, Artificial Sequence
  Synthetic oligonucleotide; AAG chr11 5354257 5354276 5354273 +
gggggatctaagccacatca

SEQ ID NO: 23360 - DNA, 20 bp, Artificial Sequence
  Synthetic oligonucleotide; TAG chr11 5354283 5354302 5354299 +
atctttcttgactcaccctc

SEQ ID NO: 23361 - DNA, 20 bp, Artificial Sequence
  Synthetic oligonucleotide; AGG chr11 5354284 5354303 5354300 +
tctttcttgactcaccctct

SEQ ID NO: 23362 - DNA, 20 bp, Artificial Sequence
  Synthetic oligonucleotide; CAG chr11 5354289 5354308 5354305 +
cttgactcaccctctaggtc

SEQ ID NO: 23363 - DNA, 20 bp, Artificial Sequence
  Synthetic oligonucleotide; TAG chr11 5354310 5354329 5354326 +
agtgatcctgaaacctgcca

SEQ ID NO: 23364 - DNA, 20 bp, Artificial Sequence
  Synthetic oligonucleotide; CAG chr11 5354313 5354332 5354329 +
gatcctgaaacctgccatag

SEQ ID NO: 23365 - DNA, 20 bp, Artificial Sequence
  Synthetic oligonucleotide; AGG chr11 5354314 5354333 5354330 +
atcctgaaacctgccatagc

SEQ ID NO: 23366 - DNA, 20 bp, Artificial Sequence
  Synthetic oligonucleotide; TAG chr11 5354318 5354337 5354334 +
tgaaacctgccatagcaggc

SEQ ID NO: 23367 - DNA, 20 bp, Artificial Sequence
  Synthetic oligonucleotide; AAG chr11 5354325 5354344 5354341 +
tgccatagcaggctagtata

SEQ ID NO: 23368 - DNA, 20 bp, Artificial Sequence
  Synthetic oligonucleotide; TAG chr11 5354333 5354352 5354349 +
caggctagtataaagataac

SEQ ID NO: 23369 - DNA, 20 bp, Artificial Sequence
  Synthetic oligonucleotide; AGG chr11 5354334 5354353 5354350 +
aggctagtataaagataact

SEQ ID NO: 23370 - DNA, 20 bp, Artificial Sequence
  Synthetic oligonucleotide; TGG chr11 5354366 5354385 5354382 +
cattttataaattctgtaaa

SEQ ID NO: 23371 - DNA, 20 bp, Artificial Sequence
  Synthetic oligonucleotide; GAG chr11 5354390 5354409 5354406 +
cacatttgactgacaaccct

SEQ ID NO: 23372 - DNA, 20 bp, Artificial Sequence
  Synthetic oligonucleotide; AAG chr11 5354427 5354446 5354443 +
ttctgttcttccttatactg

SEQ ID NO: 23373 - DNA, 20 bp, Artificial Sequence
  Synthetic oligonucleotide; GAG chr11 5354429 5354448 5354445 +
ctgttcttccttatactgaa

SEQ ID NO: 23374 - DNA, 20 bp, Artificial Sequence
  Synthetic oligonucleotide; AAG chr11 5354440 5354459 5354456 +
tatactgaagagatgtgatg

SEQ ID NO: 23375 - DNA, 20 bp, Artificial Sequence
  Synthetic oligonucleotide; GAG chr11 5354442 5354461 5354458 +
tactgaagagatgtgatgaa

SEQ ID NO: 23376 - DNA, 20 bp, Artificial Sequence
  Synthetic oligonucleotide; AAG chr11 5354447 5354466 5354463 +
aagagatgtgatgaagagac

SEQ ID NO: 23377 - DNA, 20 bp, Artificial Sequence
  Synthetic oligonucleotide; AAG chr11 5354455 5354474 5354471 +
tgatgaagagacaagataaa

SEQ ID NO: 23378 - DNA, 20 bp, Artificial Sequence
  Synthetic oligonucleotide; AAG chr11 5354461 5354480 5354477 +
agagacaagataaaaagtcc

SEQ ID NO: 23379 - DNA, 20 bp, Artificial Sequence
  Synthetic oligonucleotide; GAG chr11 5354463 5354482 5354479 +
agacaagataaaaagtccaa

SEQ ID NO: 23380 - DNA, 20 bp, Artificial Sequence
  Synthetic oligonucleotide; GAG chr11 5354465 5354484 5354481 +
acaagataaaaagtccaaga

SEQ ID NO: 23381 - DNA, 20 bp, Artificial Sequence
  Synthetic oligonucleotide; AGG chr11 5354466 5354485 5354482 +
caagataaaaagtccaagag

SEQ ID NO: 23382 - DNA, 20 bp, Artificial Sequence
  Synthetic oligonucleotide; AAG chr11 5354472 5354491 5354488 +
aaaaagtccaagagaggtga

SEQ ID NO: 23383 - DNA, 20 bp, Artificial Sequence
  Synthetic oligonucleotide; TGG chr11 5354477 5354496 5354493 +
gtccaagagaggtgaaagac

SEQ ID NO: 23384 - DNA, 20 bp, Artificial Sequence
  Synthetic oligonucleotide; GGG chr11 5354478 5354497 5354494 +
tccaagagaggtgaaagact

SEQ ID NO: 23385 - DNA, 20 bp, Artificial Sequence
  Synthetic oligonucleotide; CAG chr11 5354486 5354505 5354502 +
aggtgaaagactgggacttg

SEQ ID NO: 23386 - DNA, 20 bp, Artificial Sequence
  Synthetic oligonucleotide; TGG chr11 5354498 5354517 5354514 +
gggacttgcagttctctttg

SEQ ID NO: 23387 - DNA, 20 bp, Artificial Sequence
  Synthetic oligonucleotide; GAG chr11 5354500 5354519 5354516 +
gacttgcagttctctttgtg

SEQ ID NO: 23388 - DNA, 20 bp, Artificial Sequence
  Synthetic oligonucleotide; CAG chr11 5354513 5354532 5354529 +
ctttgtggagtcccgtgaaa

SEQ ID NO: 23389 - DNA, 20 bp, Artificial Sequence
  Synthetic oligonucleotide; GAG chr11 5354515 5354534 5354531 +
ttgtggagtcccgtgaaaca

SEQ ID NO: 23390 - DNA, 20 bp, Artificial Sequence
  Synthetic oligonucleotide; CAG chr11 5354518 5354537 5354534 +
tggagtcccgtgaaacagag

SEQ ID NO: 23391 - DNA, 20 bp, Artificial Sequence
  Synthetic oligonucleotide; GAG chr11 5354520 5354539 5354536 +
gagtcccgtgaaacagagca

SEQ ID NO: 23392 - DNA, 20 bp, Artificial Sequence
  Synthetic oligonucleotide; TGG chr11 5354526 5354545 5354542 +
cgtgaaacagagcagagctc

SEQ ID NO: 23393 - DNA, 20 bp, Artificial Sequence
  Synthetic oligonucleotide; GGG chr11 5354527 5354546 5354543 +
gtgaaacagagcagagctct

SEQ ID NO: 23394 - DNA, 20 bp, Artificial Sequence
  Synthetic oligonucleotide; TGG chr11 5354537 5354556 5354553 +
gcagagctctgggctcccga

SEQ ID NO: 23395 - DNA, 20 bp, Artificial Sequence
  Synthetic oligonucleotide; CAG chr11 5354559 5354578 5354575 +
gtccctgaacaacatatcaa

SEQ ID NO: 23396 - DNA, 20 bp, Artificial Sequence
  Synthetic oligonucleotide; TAG chr11 5354562 5354581 5354578 +
cctgaacaacatatcaacag

SEQ ID NO: 23397 - DNA, 20 bp, Artificial Sequence
  Synthetic oligonucleotide; AGG chr11 5354563 5354582 5354579 +
ctgaacaacatatcaacagt

SEQ ID NO: 23398 - DNA, 20 bp, Artificial Sequence
  Synthetic oligonucleotide; GGG chr11 5354564 5354583 5354580 +
tgaacaacatatcaacagta

SEQ ID NO: 23399 - DNA, 20 bp, Artificial Sequence
  Synthetic oligonucleotide; AAG chr11 5354570 5354589 5354586 +
acatatcaacagtagggtcg

SEQ ID NO: 23400 - DNA, 20 bp, Artificial Sequence
  Synthetic oligonucleotide; CAG chr11 5354625 5354644 5354641 +
ctcccgcccctccacgccac

SEQ ID NO: 23401 - DNA, 20 bp, Artificial Sequence
  Synthetic oligonucleotide; GAG chr11 5354635 5354654 5354651 +
tccacgccaccagccacact

SEQ ID NO: 23402 - DNA, 20 bp, Artificial Sequence
  Synthetic oligonucleotide; CAG chr11 5354642 5354661 5354658 +
caccagccacactgagcgct

SEQ ID NO: 23403 - DNA, 20 bp, Artificial Sequence
  Synthetic oligonucleotide; CAG chr11 5354652 5354671 5354668 +
actgagcgctcagctcctcc

SEQ ID NO: 23404 - DNA, 20 bp, Artificial Sequence
  Synthetic oligonucleotide; AGG chr11 5354653 5354672 5354669 +
ctgagcgctcagctcctccc

SEQ ID NO: 23405 - DNA, 20 bp, Artificial Sequence
  Synthetic oligonucleotide; TGG chr11 5354659 5354678 5354675 +
gctcagctcctcccaggtcc

SEQ ID NO: 23406 - DNA, 20 bp, Artificial Sequence
  Synthetic oligonucleotide; CAG chr11 5354667 5354686 5354683 +
cctcccaggtcctggacctg

SEQ ID NO: 23407 - DNA, 20 bp, Artificial Sequence
  Synthetic oligonucleotide; TGG chr11 5354673 5354692 5354689 +
aggtcctggacctgcagccc

SEQ ID NO: 23408 - DNA, 20 bp, Artificial Sequence
  Synthetic oligonucleotide; AAG chr11 5354684 5354703 5354700 +
ctgcagccctggccaacatc

SEQ ID NO: 23409 - DNA, 20 bp, Artificial Sequence
  Synthetic oligonucleotide; GAG chr11 5354686 5354705 5354702 +
gcagccctggccaacatcaa

SEQ ID NO: 23410 - DNA, 20 bp, Artificial Sequence
  Synthetic oligonucleotide; AGG chr11 5354687 5354706 5354703 +
cagccctggccaacatcaag

SEQ ID NO: 23411 - DNA, 20 bp, Artificial Sequence
  Synthetic oligonucleotide; GGG chr11 5354688 5354707 5354704 +
agccctggccaacatcaaga

SEQ ID NO: 23412 - DNA, 20 bp, Artificial Sequence
  Synthetic oligonucleotide; AAG chr11 5354701 5354720 5354717 +
atcaagagggcatctttgcc

SEQ ID NO: 23413 - DNA, 20 bp, Artificial Sequence
  Synthetic oligonucleotide; TGG chr11 5354710 5354729 5354726 +
gcatctttgccaagaatgcc

SEQ ID NO: 23414 - DNA, 20 bp, Artificial Sequence
  Synthetic oligonucleotide; AAG chr11 5354713 5354732 5354729 +
tctttgccaagaatgcctgg

SEQ ID NO: 23415 - DNA, 20 bp, Artificial Sequence
  Synthetic oligonucleotide; GAG chr11 5354715 5354734 5354731 +
tttgccaagaatgcctggaa

SEQ ID NO: 23416 - DNA, 20 bp, Artificial Sequence
  Synthetic oligonucleotide; CAG chr11 5354721 5354740 5354737 +
aagaatgcctggaagagact

SEQ ID NO: 23417 - DNA, 20 bp, Artificial Sequence
  Synthetic oligonucleotide; CAG chr11 5354731 5354750 5354747 +
ggaagagactcagccactca

SEQ ID NO: 23418 - DNA, 20 bp, Artificial Sequence
  Synthetic oligonucleotide; AGG chr11 5354732 5354751 5354748 +
gaagagactcagccactcac

SEQ ID NO: 23419 - DNA, 20 bp, Artificial Sequence
  Synthetic oligonucleotide; CAG chr11 5354746 5354765 5354762 +
actcacaggaaaacgtcctc

SEQ ID NO: 23420 - DNA, 20 bp, Artificial Sequence
  Synthetic oligonucleotide; AAG chr11 5354749 5354768 5354765 +
cacaggaaaacgtcctccag

SEQ ID NO: 23421 - DNA, 20 bp, Artificial Sequence
  Synthetic oligonucleotide; CAG chr11 5354753 5354772 5354769 +
ggaaaacgtcctccagaagc

SEQ ID NO: 23422 - DNA, 20 bp, Artificial Sequence
  Synthetic oligonucleotide; AGG chr11 5354754 5354773 5354770 +
gaaaacgtcctccagaagcc

SEQ ID NO: 23423 - DNA, 20 bp, Artificial Sequence
  Synthetic oligonucleotide; GGG chr11 5354755 5354774 5354771 +
aaaacgtcctccagaagcca

SEQ ID NO: 23424 - DNA, 20 bp, Artificial Sequence
  Synthetic oligonucleotide; AAG chr11 5354759 5354778 5354775 +
cgtcctccagaagccaggga

SEQ ID NO: 23425 - DNA, 20 bp, Artificial Sequence
  Synthetic oligonucleotide; GAG chr11 5354767 5354786 5354783 +
agaagccagggaaagctgct

SEQ ID NO: 23426 - DNA, 20 bp, Artificial Sequence
  Synthetic oligonucleotide; AAG chr11 5354774 5354793 5354790 +
agggaaagctgctgagacaa

SEQ ID NO: 23427 - DNA, 20 bp, Artificial Sequence
  Synthetic oligonucleotide; CAG chr11 5354782 5354801 5354798 +
ctgctgagacaaaagacaaa

SEQ ID NO: 23428 - DNA, 20 bp, Artificial Sequence
  Synthetic oligonucleotide; AAG chr11 5354789 5354808 5354805 +
gacaaaagacaaacagtttg

SEQ ID NO: 23429 - DNA, 20 bp, Artificial Sequence
  Synthetic oligonucleotide; CAG chr11 5354800 5354819 5354816 +
aacagtttgaagaatatgtc

SEQ ID NO: 23430 - DNA, 20 bp, Artificial Sequence
  Synthetic oligonucleotide; AAG chr11 5354809 5354828 5354825 +
aagaatatgtccagaacttc

SEQ ID NO: 23431 - DNA, 20 bp, Artificial Sequence
  Synthetic oligonucleotide; AAG chr11 5354816 5354835 5354832 +
tgtccagaacttcaagccac

SEQ ID NO: 23432 - DNA, 20 bp, Artificial Sequence
  Synthetic oligonucleotide; AAG chr11 5354819 5354838 5354835 +
ccagaacttcaagccacaag

SEQ ID NO: 23433 - DNA, 20 bp, Artificial Sequence
  Synthetic oligonucleotide; CAG chr11 5354822 5354841 5354838 +
gaacttcaagccacaagaag

SEQ ID NO: 23434 - DNA, 20 bp, Artificial Sequence
  Synthetic oligonucleotide; GAG chr11 5354824 5354843 5354840 +
acttcaagccacaagaagca

SEQ ID NO: 23435 - DNA, 20 bp, Artificial Sequence
  Synthetic oligonucleotide; AGG chr11 5354825 5354844 5354841 +
cttcaagccacaagaagcag

SEQ ID NO: 23436 - DNA, 20 bp, Artificial Sequence
  Synthetic oligonucleotide; GGG chr11 5354826 5354845 5354842 +
ttcaagccacaagaagcaga

SEQ ID NO: 23437 - DNA, 20 bp, Artificial Sequence
  Synthetic oligonucleotide; CAG chr11 5354832 5354851 5354848 +
ccacaagaagcagagggtac

SEQ ID NO: 23438 - DNA, 20 bp, Artificial Sequence
  Synthetic oligonucleotide; GAG chr11 5354839 5354858 5354855 +
aagcagagggtaccagacct

SEQ ID NO: 23439 - DNA, 20 bp, Artificial Sequence
  Synthetic oligonucleotide; GAG chr11 5354841 5354860 5354857 +
gcagagggtaccagacctga

SEQ ID NO: 23440 - DNA, 20 bp, Artificial Sequence
  Synthetic oligonucleotide; GAG chr11 5354850 5354869 5354866 +
accagacctgagagaactct

SEQ ID NO: 23441 - DNA, 20 bp, Artificial Sequence
  Synthetic oligonucleotide; AGG chr11 5354851 5354870 5354867 +
ccagacctgagagaactctg

SEQ ID NO: 23442 - DNA, 20 bp, Artificial Sequence
  Synthetic oligonucleotide; TAG chr11 5354859 5354878 5354875 +
gagagaactctgaggatgtt

SEQ ID NO: 23443 - DNA, 20 bp, Artificial Sequence
  Synthetic oligonucleotide; AAG chr11 5354862 5354881 5354878 +
agaactctgaggatgtttag

SEQ ID NO: 23444 - DNA, 20 bp, Artificial Sequence
  Synthetic oligonucleotide; AAG chr11 5354871 5354890 5354887 +
aggatgtttagaagcaatca

SEQ ID NO: 23445 - DNA, 20 bp, Artificial Sequence
  Synthetic oligonucleotide; AGG chr11 5354872 5354891 5354888 +
ggatgtttagaagcaatcaa

SEQ ID NO: 23446 - DNA, 20 bp, Artificial Sequence
  Synthetic oligonucleotide; AAG chr11 5354880 5354899 5354896 +
agaagcaatcaaaggcattc

SEQ ID NO: 23447 - DNA, 20 bp, Artificial Sequence
  Synthetic oligonucleotide; GAG chr11 5354882 5354901 5354898 +
aagcaatcaaaggcattcaa

SEQ ID NO: 23448 - DNA, 20 bp, Artificial Sequence
  Synthetic oligonucleotide; AAG chr11 5354894 5354913 5354910 +
gcattcaagagaccttgacg

SEQ ID NO: 23449 - DNA, 20 bp, Artificial Sequence
  Synthetic oligonucleotide; GAG chr11 5354899 5354918 5354915 +
caagagaccttgacgaagct

SEQ ID NO: 23450 - DNA, 20 bp, Artificial Sequence
  Synthetic oligonucleotide; AAG chr11 5354912 5354931 5354928 +
cgaagctgagtcactgtgtg

SEQ ID NO: 23451 - DNA, 20 bp, Artificial Sequence
  Synthetic oligonucleotide; TGG chr11 5354924 5354943 5354940 +
actgtgtgaagtctgtgcgc

SEQ ID NO: 23452 - DNA, 20 bp, Artificial Sequence
  Synthetic oligonucleotide; TGG chr11 5354929 5354948 5354945 +
gtgaagtctgtgcgctggat

SEQ ID NO: 23453 - DNA, 20 bp, Artificial Sequence
  Synthetic oligonucleotide; TGG chr11 5354934 5354953 5354950 +
gtctgtgcgctggattggtc

SEQ ID NO: 23454 - DNA, 20 bp, Artificial Sequence
  Synthetic oligonucleotide; GGG chr11 5354935 5354954 5354951 +
tctgtgcgctggattggtct

SEQ ID NO: 23455 - DNA, 20 bp, Artificial Sequence
  Synthetic oligonucleotide; CAG chr11 5354938 5354957 5354954 +
gtgcgctggattggtctggg

SEQ ID NO: 23456 - DNA, 20 bp, Artificial Sequence
  Synthetic oligonucleotide; AGG chr11 5354939 5354958 5354955 +
tgcgctggattggtctgggc

SEQ ID NO: 23457 - DNA, 20 bp, Artificial Sequence
  Synthetic oligonucleotide; AAG chr11 5354942 5354961 5354958 +
gctggattggtctgggcagg

SEQ ID NO: 23458 - DNA, 20 bp, Artificial Sequence
  Synthetic oligonucleotide; AGG chr11 5354943 5354962 5354959 +
ctggattggtctgggcagga

SEQ ID NO: 23459 - DNA, 20 bp, Artificial Sequence
  Synthetic oligonucleotide; TGG chr11 5354954 5354973 5354970 +
tgggcaggaaggtgtgaaaa

SEQ ID NO: 23460 - DNA, 20 bp, Artificial Sequence
  Synthetic oligonucleotide; TGG chr11 5354958 5354977 5354974 +
caggaaggtgtgaaaatggt

SEQ ID NO: 23461 - DNA, 20 bp, Artificial Sequence
  Synthetic oligonucleotide; GAG chr11 5354962 5354981 5354978 +
aaggtgtgaaaatggttggt

SEQ ID NO: 23462 - DNA, 20 bp, Artificial Sequence
  Synthetic oligonucleotide; AAG chr11 5354966 5354985 5354982 +
tgtgaaaatggttggtgaga

SEQ ID NO: 23463 - DNA, 20 bp, Artificial Sequence
  Synthetic oligonucleotide; AGG chr11 5354967 5354986 5354983 +
gtgaaaatggttggtgagaa

SEQ ID NO: 23464 - DNA, 20 bp, Artificial Sequence
  Synthetic oligonucleotide; TGG chr11 5354980 5354999 5354996 +
gtgagaaaggtgatgtgctc

SEQ ID NO: 23465 - DNA, 20 bp, Artificial Sequence
  Synthetic oligonucleotide; GGG chr11 5354981 5355000 5354997 +
tgagaaaggtgatgtgctct

SEQ ID NO: 23466 - DNA, 20 bp, Artificial Sequence
  Synthetic oligonucleotide; GAG chr11 5354983 5355002 5354999 +
agaaaggtgatgtgctctgg

SEQ ID NO: 23467 - DNA, 20 bp, Artificial Sequence
  Synthetic oligonucleotide; AGG chr11 5354984 5355003 5355000 +
gaaaggtgatgtgctctggg

SEQ ID NO: 23468 - DNA, 20 bp, Artificial Sequence
  Synthetic oligonucleotide; TGG chr11 5355005 5355024 5355021 +
ggatatccacaaaaaactca

SEQ ID NO: 23469 - DNA, 20 bp, Artificial Sequence
  Synthetic oligonucleotide; TGG chr11 5355026 5355045 5355042 +
ggatgcatccttgctaacac

SEQ ID NO: 23470 - DNA, 20 bp, Artificial Sequence
  Synthetic oligonucleotide; TGG chr11 5355038 5355057 5355054 +
gctaacactggaaaactacc

SEQ ID NO: 23471 - DNA, 20 bp, Artificial Sequence
  Synthetic oligonucleotide; AAG chr11 5355058 5355077 5355074 +
tggaccaatttcctgacttg

SEQ ID NO: 23472 - DNA, 20 bp, Artificial Sequence
  Synthetic oligonucleotide; AAG chr11 5355073 5355092 5355089 +
acttgaagaatcacatcacc

SEQ ID NO: 23473 - DNA, 20 bp, Artificial Sequence
  Synthetic oligonucleotide; CAG chr11 5355078 5355097 5355094 +
aagaatcacatcaccaagtg

SEQ ID NO: 23474 - DNA, 20 bp, Artificial Sequence
  Synthetic oligonucleotide; CAG chr11 5355081 5355100 5355097 +
aatcacatcaccaagtgcag

SEQ ID NO: 23475 - DNA, 20 bp, Artificial Sequence
  Synthetic oligonucleotide; AGG chr11 5355082 5355101 5355098 +
atcacatcaccaagtgcagc

SEQ ID NO: 23476 - DNA, 20 bp, Artificial Sequence
  Synthetic oligonucleotide; AAG chr11 5355085 5355104 5355101 +
acatcaccaagtgcagcagg

SEQ ID NO: 23477 - DNA, 20 bp, Artificial Sequence
  Synthetic oligonucleotide; CGG chr11 5355092 5355111 5355108 +
caagtgcagcaggaagctta

SEQ ID NO: 23478 - DNA, 20 bp, Artificial Sequence
  Synthetic oligonucleotide; CAG chr11 5355102 5355121 5355118 +
aggaagcttacggactatga

SEQ ID NO: 23479 - DNA, 20 bp, Artificial Sequence
  Synthetic oligonucleotide; CGG chr11 5355122 5355141 5355138 +
cagtgcctgcccacctccat

SEQ ID NO: 23480 - DNA, 20 bp, Artificial Sequence
  Synthetic oligonucleotide; GGG chr11 5355123 5355142 5355139 +
agtgcctgcccacctccatc

SEQ ID NO: 23481 - DNA, 20 bp, Artificial Sequence
  Synthetic oligonucleotide; CAG chr11 5355131 5355150 5355147 +
cccacctccatcgggctcaa

SEQ ID NO: 23482 - DNA, 20 bp, Artificial Sequence
  Synthetic oligonucleotide; GAG chr11 5355133 5355152 5355149 +
cacctccatcgggctcaaca

SEQ ID NO: 23483 - DNA, 20 bp, Artificial Sequence
  Synthetic oligonucleotide; CAG chr11 5355139 5355158 5355155 +
catcgggctcaacagagctt

SEQ ID NO: 23484 - DNA, 20 bp, Artificial Sequence
  Synthetic oligonucleotide; AGG chr11 5355140 5355159 5355156 +
atcgggctcaacagagcttc

SEQ ID NO: 23485 - DNA, 20 bp, Artificial Sequence
  Synthetic oligonucleotide; GAG chr11 5355142 5355161 5355158 +
cgggctcaacagagcttcag

SEQ ID NO: 23486 - DNA, 20 bp, Artificial Sequence
  Synthetic oligonucleotide; AGG chr11 5355143 5355162 5355159 +
gggctcaacagagcttcagg

SEQ ID NO: 23487 - DNA, 20 bp, Artificial Sequence
  Synthetic oligonucleotide; AAG chr11 5355146 5355165 5355162 +
ctcaacagagcttcaggagg

SEQ ID NO: 23488 - DNA, 20 bp, Artificial Sequence
  Synthetic oligonucleotide; AGG chr11 5355147 5355166 5355163 +
tcaacagagcttcaggagga

SEQ ID NO: 23489 - DNA, 20 bp, Artificial Sequence
  Synthetic oligonucleotide; TAG chr11 5355151 5355170 5355167 +
cagagcttcaggaggaagga

SEQ ID NO: 23490 - DNA, 20 bp, Artificial Sequence
  Synthetic oligonucleotide; AGG chr11 5355152 5355171 5355168 +
agagcttcaggaggaaggat

SEQ ID NO: 23491 - DNA, 20 bp, Artificial Sequence
  Synthetic oligonucleotide; GAG chr11 5355154 5355173 5355170 +
agcttcaggaggaaggatag

SEQ ID NO: 23492 - DNA, 20 bp, Artificial Sequence
  Synthetic oligonucleotide; AAG chr11 5355166 5355185 5355182 +
aaggataggagcctctgtct

SEQ ID NO: 23493 - DNA, 20 bp, Artificial Sequence
  Synthetic oligonucleotide; AGG chr11 5355167 5355186 5355183 +
aggataggagcctctgtcta

SEQ ID NO: 23494 - DNA, 20 bp, Artificial Sequence
  Synthetic oligonucleotide; CAG chr11 5355170 5355189 5355186 +
ataggagcctctgtctaagg

SEQ ID NO: 23495 - DNA, 20 bp, Artificial Sequence
  Synthetic oligonucleotide; AAG chr11 5355173 5355192 5355189 +
ggagcctctgtctaaggcag

SEQ ID NO: 23496 - DNA, 20 bp, Artificial Sequence
  Synthetic oligonucleotide; TAG chr11 5355176 5355195 5355192 +
gcctctgtctaaggcagaag

SEQ ID NO: 23497 - DNA, 20 bp, Artificial Sequence
  Synthetic oligonucleotide; CAG chr11 5355184 5355203 5355200 +
ctaaggcagaagtagaattt

SEQ ID NO: 23498 - DNA, 20 bp, Artificial Sequence
  Synthetic oligonucleotide; AAG chr11 5355188 5355207 5355204 +
ggcagaagtagaatttcaga

SEQ ID NO: 23499 - DNA, 20 bp, Artificial Sequence
  Synthetic oligonucleotide; TAG chr11 5355193 5355212 5355209 +
aagtagaatttcagaaagca

SEQ ID NO: 23500 - DNA, 20 bp, Artificial Sequence
  Synthetic oligonucleotide; GAG chr11 5355195 5355214 5355211 +
gtagaatttcagaaagcata

SEQ ID NO: 23501 - DNA, 20 bp, Artificial Sequence
  Synthetic oligonucleotide; AAG chr11 5355199 5355218 5355215 +
aatttcagaaagcatagaga

SEQ ID NO: 23502 - DNA, 20 bp, Artificial Sequence
  Synthetic oligonucleotide; AAG chr11 5355206 5355225 5355222 +
gaaagcatagagaaagtttg

SEQ ID NO: 23503 - DNA, 20 bp, Artificial Sequence
  Synthetic oligonucleotide; GAG chr11 5355208 5355227 5355224 +
aagcatagagaaagtttgaa

SEQ ID NO: 23504 - DNA, 20 bp, Artificial Sequence
  Synthetic oligonucleotide; TGG chr11 5355216 5355235 5355232 +
agaaagtttgaagagtttaa

SEQ ID NO: 23505 - DNA, 20 bp, Artificial Sequence
  Synthetic oligonucleotide; AAG chr11 5355227 5355246 5355243 +
agagtttaatggtgacttac

SEQ ID NO: 23506 - DNA, 20 bp, Artificial Sequence
  Synthetic oligonucleotide; AAG chr11 5355232 5355251 5355248 +
ttaatggtgacttacaagaa

SEQ ID NO: 23507 - DNA, 20 bp, Artificial Sequence
  Synthetic oligonucleotide; TAG chr11 5355247 5355266 5355263 +
aagaaaagttaccattatta

SEQ ID NO: 23508 - DNA, 20 bp, Artificial Sequence
  Synthetic oligonucleotide; AAG chr11 5355252 5355271 5355268 +
aagttaccattattatagtc

SEQ ID NO: 23509 - DNA, 20 bp, Artificial Sequence
  Synthetic oligonucleotide; TGG chr11 5355261 5355280 5355277 +
ttattatagtcaagacgaat

SEQ ID NO: 23510 - DNA, 20 bp, Artificial Sequence
  Synthetic oligonucleotide; CAG chr11 5355294 5355313 5355310 +
aatactttcaaaaacatctc

SEQ ID NO: 23511 - DNA, 20 bp, Artificial Sequence
  Synthetic oligonucleotide; AAG chr11 5355302 5355321 5355318 +
caaaaacatctccagccttg

SEQ ID NO: 23512 - DNA, 20 bp, Artificial Sequence
  Synthetic oligonucleotide; AAG chr11 5355307 5355326 5355323 +
acatctccagccttgaagct

SEQ ID NO: 23513 - DNA, 20 bp, Artificial Sequence
  Synthetic oligonucleotide; AAG chr11 5355316 5355335 5355332 +
gccttgaagctaagtttcat

SEQ ID NO: 23514 - DNA, 20 bp, Artificial Sequence
  Synthetic oligonucleotide; AGG chr11 5355317 5355336 5355333 +
ccttgaagctaagtttcata

SEQ ID NO: 23515 - DNA, 20 bp, Artificial Sequence
  Synthetic oligonucleotide; TGG chr11 5355326 5355345 5355342 +
taagtttcataaggaaactg

SEQ ID NO: 23516 - DNA, 20 bp, Artificial Sequence
  Synthetic oligonucleotide; TGG chr11 5355334 5355353 5355350 +
ataaggaaactgtggtgctt

SEQ ID NO: 23517 - DNA, 20 bp, Artificial Sequence
  Synthetic oligonucleotide; CAG chr11 5355343 5355362 5355359 +
ctgtggtgctttggtacaaa

SEQ ID NO: 23518 - DNA, 20 bp, Artificial Sequence
  Synthetic oligonucleotide; AAG chr11 5355350 5355369 5355366 +
gctttggtacaaacagtatg

SEQ ID NO: 23519 - DNA, 20 bp, Artificial Sequence
  Synthetic oligonucleotide; TGG chr11 5355365 5355384 5355381 +
gtatgaagtgatgatgaaac

SEQ ID NO: 23520 - DNA, 20 bp, Artificial Sequence
  Synthetic oligonucleotide; GGG chr11 5355366 5355385 5355382 +
tatgaagtgatgatgaaact

SEQ ID NO: 23521 - DNA, 20 bp, Artificial Sequence
  Synthetic oligonucleotide; CAG chr11 5355373 5355392 5355389 +
tgatgatgaaactgggtgac

SEQ ID NO: 23522 - DNA, 20 bp, Artificial Sequence
  Synthetic oligonucleotide; AAG chr11 5355385 5355404 5355401 +
tgggtgaccagtatgctgac

SEQ ID NO: 23523 - DNA, 20 bp, Artificial Sequence
  Synthetic oligonucleotide; AGG chr11 5355386 5355405 5355402 +
gggtgaccagtatgctgaca

SEQ ID NO: 23524 - DNA, 20 bp, Artificial Sequence
  Synthetic oligonucleotide; AAG chr11 5355402 5355421 5355418 +
gacaaggccttcaacattca

SEQ ID NO: 23525 - DNA, 20 bp, Artificial Sequence
  Synthetic oligonucleotide; GAG chr11 5355404 5355423 5355420 +
caaggccttcaacattcaaa

SEQ ID NO: 23526 - DNA, 20 bp, Artificial Sequence
  Synthetic oligonucleotide; TGG chr11 5355422 5355441 5355438 +
aagagcaacacccactgatt

SEQ ID NO: 23527 - DNA, 20 bp, Artificial Sequence
  Synthetic oligonucleotide; GGG chr11 5355423 5355442 5355439 +
agagcaacacccactgattt

SEQ ID NO: 23528 - DNA, 20 bp, Artificial Sequence
  Synthetic oligonucleotide; AAG chr11 5355442 5355461 5355458 +
tgggtcctctccacattgca

SEQ ID NO: 23529 - DNA, 20 bp, Artificial Sequence
  Synthetic oligonucleotide; TGG chr11 5355454 5355473 5355470 +
acattgcaaagatgtcctca

SEQ ID NO: 23530 - DNA, 20 bp, Artificial Sequence
  Synthetic oligonucleotide; TAG chr11 5355459 5355478 5355475 +
gcaaagatgtcctcatggcc

SEQ ID NO: 23531 - DNA, 20 bp, Artificial Sequence
  Synthetic oligonucleotide; AGG chr11 5355460 5355479 5355476 +
caaagatgtcctcatggcct

SEQ ID NO: 23532 - DNA, 20 bp, Artificial Sequence
  Synthetic oligonucleotide; GGG chr11 5355461 5355480 5355477 +
aaagatgtcctcatggccta

SEQ ID NO: 23533 - DNA, 20 bp, Artificial Sequence
  Synthetic oligonucleotide; GAG chr11 5355463 5355482 5355479 +
agatgtcctcatggcctagg

SEQ ID NO: 23534 - DNA, 20 bp, Artificial Sequence
  Synthetic oligonucleotide; CAG chr11 5355480 5355499 5355496 +
agggagctttcattccaccc

SEQ ID NO: 23535 - DNA, 20 bp, Artificial Sequence
  Synthetic oligonucleotide; TAG chr11 5355492 5355511 5355508 +
ttccaccccagcccaacaac

SEQ ID NO: 23536 - DNA, 20 bp, Artificial Sequence
  Synthetic oligonucleotide; AAG chr11 5355498 5355517 5355514 +
cccagcccaacaactagttc

SEQ ID NO: 23537 - DNA, 20 bp, Artificial Sequence
  Synthetic oligonucleotide; TAG chr11 5355509 5355528 5355525 +
aactagttcaagtgaaacac

SEQ ID NO: 23538 - DNA, 20 bp, Artificial Sequence
  Synthetic oligonucleotide; CAG chr11 5355530 5355549 5355546 +
agcacctgcttctcctatgc

SEQ ID NO: 23539 - DNA, 20 bp, Artificial Sequence
  Synthetic oligonucleotide; GAG chr11 5355541 5355560 5355557 +
ctcctatgccagcatgacct

SEQ ID NO: 23540 - DNA, 20 bp, Artificial Sequence
  Synthetic oligonucleotide; CAG chr11 5355553 5355572 5355569 +
catgacctgagtcactcttg

SEQ ID NO: 23541 - DNA, 20 bp, Artificial Sequence
  Synthetic oligonucleotide; AAG chr11 5355571 5355590 5355587 +
tgcagtcctgtatctgtcta

SEQ ID NO: 23542 - DNA, 20 bp, Artificial Sequence
  Synthetic oligonucleotide; AAG chr11 5355584 5355603 5355600 +
ctgtctaaagtcacttgaca

SEQ ID NO: 23543 - DNA, 20 bp, Artificial Sequence
  Synthetic oligonucleotide; AGG chr11 5355585 5355604 5355601 +
tgtctaaagtcacttgacaa

SEQ ID NO: 23544 - DNA, 20 bp, Artificial Sequence
  Synthetic oligonucleotide; CAG chr11 5355593 5355612 5355609 +
gtcacttgacaaaggaactg

SEQ ID NO: 23545 - DNA, 20 bp, Artificial Sequence
  Synthetic oligonucleotide; CAG chr11 5355596 5355615 5355612 +
acttgacaaaggaactgcag

SEQ ID NO: 23546 - DNA, 20 bp, Artificial Sequence
  Synthetic oligonucleotide; AGG chr11 5355597 5355616 5355613 +
cttgacaaaggaactgcagc

SEQ ID NO: 23547 - DNA, 20 bp, Artificial Sequence
  Synthetic oligonucleotide; CAG chr11 5355616 5355635 5355632 +
caggaaaaatatcatcttca

SEQ ID NO: 23548 - DNA, 20 bp, Artificial Sequence
  Synthetic oligonucleotide; AAG chr11 5355628 5355647 5355644 +
catcttcacagactgtccta

SEQ ID NO: 23549 - DNA, 20 bp, Artificial Sequence
  Synthetic oligonucleotide; AAG chr11 5355632 5355651 5355648 +
ttcacagactgtcctaaagt

SEQ ID NO: 23550 - DNA, 20 bp, Artificial Sequence
  Synthetic oligonucleotide; TAG chr11 5355636 5355655 5355652 +
cagactgtcctaaagtaaga

SEQ ID NO: 23551 - DNA, 20 bp, Artificial Sequence
  Synthetic oligonucleotide; AGG chr11 5355637 5355656 5355653 +
agactgtcctaaagtaagat

SEQ ID NO: 23552 - DNA, 20 bp, Artificial Sequence
  Synthetic oligonucleotide; AAG chr11 5355672 5355691 5355688 +
tatccacaaatcatctgtaa

SEQ ID NO: 23553 - DNA, 20 bp, Artificial Sequence
  Synthetic oligonucleotide; CAG chr11 5355684 5355703 5355700 +
atctgtaaaagttatgtttt

SEQ ID NO: 23554 - DNA, 20 bp, Artificial Sequence
  Synthetic oligonucleotide; TGG chr11 5355687 5355706 5355703 +
tgtaaaagttatgttttcag

SEQ ID NO: 23555 - DNA, 20 bp, Artificial Sequence
  Synthetic oligonucleotide; TGG chr11 5355711 5355730 5355727 +
gtgtcatttcaaataaacct

SEQ ID NO: 23556 - DNA, 20 bp, Artificial Sequence
  Synthetic oligonucleotide; GGG chr11 5355712 5355731 5355728 +
tgtcatttcaaataaacctt

SEQ ID NO: 23557 - DNA, 20 bp, Artificial Sequence
  Synthetic oligonucleotide; AAG chr11 5355755 5355774 5355771 +
taaaaattaaaaaaaaaaaa

SEQ ID NO: 23558 - DNA, 20 bp, Artificial Sequence
  Synthetic oligonucleotide; GAG chr11 5355757 5355776 5355773 +
aaaattaaaaaaaaaaaaaa

SEQ ID NO: 23559 - DNA, 20 bp, Artificial Sequence
  Synthetic oligonucleotide; TAG chr11 5355760 5355779 5355776 +
attaaaaaaaaaaaaaagag

SEQ ID NO: 23560 - DNA, 20 bp, Artificial Sequence
  Synthetic oligonucleotide; AGG chr11 5355761 5355780 5355777 +
ttaaaaaaaaaaaaaagagt

SEQ ID NO: 23561 - DNA, 20 bp, Artificial Sequence
  Synthetic oligonucleotide; GGG chr11 5355762 5355781 5355778 +
taaaaaaaaaaaaaagagta

SEQ ID NO: 23562 - DNA, 20 bp, Artificial Sequence
  Synthetic oligonucleotide; AAG chr11 5355767 5355786 5355783 +
aaaaaaaaaagagtagggtc

SEQ ID NO: 23563 - DNA, 20 bp, Artificial Sequence
  Synthetic oligonucleotide; AGG chr11 5355768 5355787 5355784 +
aaaaaaaaagagtagggtca

SEQ ID NO: 23564 - DNA, 20 bp, Artificial Sequence
  Synthetic oligonucleotide; GGG chr11 5355769 5355788 5355785 +
aaaaaaaagagtagggtcaa

SEQ ID NO: 23565 - DNA, 20 bp, Artificial Sequence
  Synthetic oligonucleotide; GGG chr11 5355770 5355789 5355786 +
aaaaaaagagtagggtcaag

SEQ ID NO: 23566 - DNA, 20 bp, Artificial Sequence
  Synthetic oligonucleotide; TAG chr11 5355775 5355794 5355791 +
aagagtagggtcaaggggta

SEQ ID NO: 23567 - DNA, 20 bp, Artificial Sequence
  Synthetic oligonucleotide; AGG chr11 5355776 5355795 5355792 +
agagtagggtcaaggggtat

SEQ ID NO: 23568 - DNA, 20 bp, Artificial Sequence
  Synthetic oligonucleotide; GGG chr11 5355777 5355796 5355793 +
gagtagggtcaaggggtata

SEQ ID NO: 23569 - DNA, 20 bp, Artificial Sequence
  Synthetic oligonucleotide; TAG chr11 5355780 5355799 5355796 +
tagggtcaaggggtataggg

SEQ ID NO: 23570 - DNA, 20 bp, Artificial Sequence
  Synthetic oligonucleotide; AAG chr11 5355796 5355815 5355812 +
agggtagcaaaattttctta

SEQ ID NO: 23571 - DNA, 20 bp, Artificial Sequence
  Synthetic oligonucleotide; AGG chr11 5355797 5355816 5355813 +
gggtagcaaaattttcttaa

SEQ ID NO: 23572 - DNA, 20 bp, Artificial Sequence
  Synthetic oligonucleotide; TAG chr11 5355829 5355848 5355845 +
atgccctgctctgattcctg

SEQ ID NO: 23573 - DNA, 20 bp, Artificial Sequence
  Synthetic oligonucleotide; TAG chr11 5355837 5355856 5355853 +
ctctgattcctgtagtgaca

SEQ ID NO: 23574 - DNA, 20 bp, Artificial Sequence
  Synthetic oligonucleotide; AGG chr11 5355838 5355857 5355854 +
tctgattcctgtagtgacat

SEQ ID NO: 23575 - DNA, 20 bp, Artificial Sequence
  Synthetic oligonucleotide; CAG chr11 5355851 5355870 5355867 +
gtgacataggcgtcaatata

SEQ ID NO: 23576 - DNA, 20 bp, Artificial Sequence
  Synthetic oligonucleotide; AAG chr11 5355856 5355875 5355872 +
ataggcgtcaatatacagac

SEQ ID NO: 23577 - DNA, 20 bp, Artificial Sequence
  Synthetic oligonucleotide; AGG chr11 5355857 5355876 5355873 +
taggcgtcaatatacagaca

SEQ ID NO: 23578 - DNA, 20 bp, Artificial Sequence
  Synthetic oligonucleotide; TGG chr11 5355863 5355882 5355879 +
tcaatatacagacaaggtcc

SEQ ID NO: 23579 - DNA, 20 bp, Artificial Sequence
  Synthetic oligonucleotide; AAG chr11 5355866 5355885 5355882 +
atatacagacaaggtcctgg

SEQ ID NO: 23580 - DNA, 20 bp, Artificial Sequence
  Synthetic oligonucleotide; AAG chr11 5355889 5355908 5355905 +
ttcttttaaaaatctgctgc

SEQ ID NO: 23581 - DNA, 20 bp, Artificial Sequence
  Synthetic oligonucleotide; GAG chr11 5355894 5355913 5355910 +
ttaaaaatctgctgcaagct

SEQ ID NO: 23582 - DNA, 20 bp, Artificial Sequence
  Synthetic oligonucleotide; AGG chr11 5355895 5355914 5355911 +
taaaaatctgctgcaagctg

SEQ ID NO: 23583 - DNA, 20 bp, Artificial Sequence
  Synthetic oligonucleotide; GGG chr11 5355896 5355915 5355912 +
aaaaatctgctgcaagctga

SEQ ID NO: 23584 - DNA, 20 bp, Artificial Sequence
  Synthetic oligonucleotide; TAG chr11 5355905 5355924 5355921 +
ctgcaagctgagggtcctgt

SEQ ID NO: 23585 - DNA, 20 bp, Artificial Sequence
  Synthetic oligonucleotide; AAG chr11 5355908 5355927 5355924 +
caagctgagggtcctgttag

SEQ ID NO: 23586 - DNA, 20 bp, Artificial Sequence
  Synthetic oligonucleotide; AGG chr11 5355909 5355928 5355925 +
aagctgagggtcctgttaga

SEQ ID NO: 23587 - DNA, 20 bp, Artificial Sequence
  Synthetic oligonucleotide; CAG chr11 5355924 5355943 5355940 +
ttagaaggaaaactaacaaa

SEQ ID NO: 23588 - DNA, 20 bp, Artificial Sequence
  Synthetic oligonucleotide; AAG chr11 5355928 5355947 5355944 +
aaggaaaactaacaaacaga

SEQ ID NO: 23589 - DNA, 20 bp, Artificial Sequence
  Synthetic oligonucleotide; AGG chr11 5355929 5355948 5355945 +
aggaaaactaacaaacagaa

SEQ ID NO: 23590 - DNA, 20 bp, Artificial Sequence
  Synthetic oligonucleotide; AAG chr11 5355972 5355991 5355988 +
tctgtacgtcaccatcatca

SEQ ID NO: 23591 - DNA, 20 bp, Artificial Sequence
  Synthetic oligonucleotide; AAG chr11 5355979 5355998 5355995 +
gtcaccatcatcaaagacca

SEQ ID NO: 23592 - DNA, 20 bp, Artificial Sequence
  Synthetic oligonucleotide; AGG chr11 5355980 5355999 5355996 +
tcaccatcatcaaagaccaa

SEQ ID NO: 23593 - DNA, 20 bp, Artificial Sequence
  Synthetic oligonucleotide; TAG chr11 5355983 5356002 5355999 +
ccatcatcaaagaccaaagg

SEQ ID NO: 23594 - DNA, 20 bp, Artificial Sequence
  Synthetic oligonucleotide; AAG chr11 5355997 5356016 5356013 +
caaaggtagataaaaccaca

SEQ ID NO: 23595 - DNA, 20 bp, Artificial Sequence
  Synthetic oligonucleotide; TGG chr11 5356001 5356020 5356017 +
ggtagataaaaccacaaaga

SEQ ID NO: 23596 - DNA, 20 bp, Artificial Sequence
  Synthetic oligonucleotide; GGG chr11 5356002 5356021 5356018 +
gtagataaaaccacaaagat

SEQ ID NO: 23597 - DNA, 20 bp, Artificial Sequence
  Synthetic oligonucleotide; GGG chr11 5356003 5356022 5356019 +
tagataaaaccacaaagatg

SEQ ID NO: 23598 - DNA, 20 bp, Artificial Sequence
  Synthetic oligonucleotide; CAG chr11 5356011 5356030 5356027 +
accacaaagatggggaaaaa

SEQ ID NO: 23599 - DNA, 20 bp, Artificial Sequence
  Synthetic oligonucleotide; GAG chr11 5356013 5356032 5356029 +
cacaaagatggggaaaaaca

SEQ ID NO: 23600 - DNA, 20 bp, Artificial Sequence
  Synthetic oligonucleotide; CAG chr11 5356016 5356035 5356032 +
aaagatggggaaaaacagag

SEQ ID NO: 23601 - DNA, 20 bp, Artificial Sequence
  Synthetic oligonucleotide; TGG chr11 5356025 5356044 5356041 +
gaaaaacagagcagaaaaac

SEQ ID NO: 23602 - DNA, 20 bp, Artificial Sequence
  Synthetic oligonucleotide; CAG chr11 5356041 5356060 5356057 +
aaactggaaactctaaaaat

SEQ ID NO: 23603 - DNA, 20 bp, Artificial Sequence
  Synthetic oligonucleotide; GAG chr11 5356043 5356062 5356059 +
actggaaactctaaaaatca

SEQ ID NO: 23604 - DNA, 20 bp, Artificial Sequence
  Synthetic oligonucleotide; AAG chr11 5356062 5356081 5356078 +
agagtgcctctcctcctcca

SEQ ID NO: 23605 - DNA, 20 bp, Artificial Sequence
  Synthetic oligonucleotide; AGG chr11 5356063 5356082 5356079 +
gagtgcctctcctcctccaa

SEQ ID NO: 23606 - DNA, 20 bp, Artificial Sequence
  Synthetic oligonucleotide; CAG chr11 5356070 5356089 5356086 +
tctcctcctccaaaggaatg

SEQ ID NO: 23607 - DNA, 20 bp, Artificial Sequence
  Synthetic oligonucleotide; CAG chr11 5356081 5356100 5356097 +
aaaggaatgcagctcctcac

SEQ ID NO: 23608 - DNA, 20 bp, Artificial Sequence
  Synthetic oligonucleotide; CGG chr11 5356087 5356106 5356103 +
atgcagctcctcaccagcaa

SEQ ID NO: 23609 - DNA, 20 bp, Artificial Sequence
  Synthetic oligonucleotide; AAG chr11 5356094 5356113 5356110 +
tcctcaccagcaacggtaca

SEQ ID NO: 23610 - DNA, 20 bp, Artificial Sequence
  Synthetic oligonucleotide; TGG chr11 5356098 5356117 5356114 +
caccagcaacggtacaaagc

SEQ ID NO: 23611 - DNA, 20 bp, Artificial Sequence
  Synthetic oligonucleotide; CAG chr11 5356102 5356121 5356118 +
agcaacggtacaaagctgga

SEQ ID NO: 23612 - DNA, 20 bp, Artificial Sequence
  Synthetic oligonucleotide; GAG chr11 5356104 5356123 5356120 +
caacggtacaaagctggaca

SEQ ID NO: 23613 - DNA, 20 bp, Artificial Sequence
  Synthetic oligonucleotide; AAG chr11 5356119 5356138 5356135 +
ggacagagaatgactttgac

SEQ ID NO: 23614 - DNA, 20 bp, Artificial Sequence
  Synthetic oligonucleotide; GAG chr11 5356124 5356143 5356140 +
gagaatgactttgacaagtt

SEQ ID NO: 23615 - DNA, 20 bp, Artificial Sequence
  Synthetic oligonucleotide; GAG chr11 5356126 5356145 5356142 +
gaatgactttgacaagttga

SEQ ID NO: 23616 - DNA, 20 bp, Artificial Sequence
  Synthetic oligonucleotide; AAG chr11 5356129 5356148 5356145 +
tgactttgacaagttgagag

SEQ ID NO: 23617 - DNA, 20 bp, Artificial Sequence
  Synthetic oligonucleotide; AAG chr11 5356132 5356151 5356148 +
ctttgacaagttgagagaag

SEQ ID NO: 23618 - DNA, 20 bp, Artificial Sequence
  Synthetic oligonucleotide; AGG chr11 5356133 5356152 5356149 +
tttgacaagttgagagaaga

SEQ ID NO: 23619 - DNA, 20 bp, Artificial Sequence
  Synthetic oligonucleotide; CAG chr11 5356139 5356158 5356155 +
aagttgagagaagaaggctt

SEQ ID NO: 23620 - DNA, 20 bp, Artificial Sequence
  Synthetic oligonucleotide; GAG chr11 5356158 5356177 5356174 +
tcagacgatcaaactactcc

SEQ ID NO: 23621 - DNA, 20 bp, Artificial Sequence
  Synthetic oligonucleotide; AAG chr11 5356164 5356183 5356180 +
gatcaaactactccgagcta

SEQ ID NO: 23622 - DNA, 20 bp, Artificial Sequence
  Synthetic oligonucleotide; AGG chr11 5356165 5356184 5356181 +
atcaaactactccgagctaa

SEQ ID NO: 23623 - DNA, 20 bp, Artificial Sequence
  Synthetic oligonucleotide; GAG chr11 5356167 5356186 5356183 +
caaactactccgagctaaag

SEQ ID NO: 23624 - DNA, 20 bp, Artificial Sequence
  Synthetic oligonucleotide; AGG chr11 5356168 5356187 5356184 +
aaactactccgagctaaagg

SEQ ID NO: 23625 - DNA, 20 bp, Artificial Sequence
  Synthetic oligonucleotide; AAG chr11 5356171 5356190 5356187 +
ctactccgagctaaaggagg

SEQ ID NO: 23626 - DNA, 20 bp, Artificial Sequence
  Synthetic oligonucleotide; TGG chr11 5356184 5356203 5356200 +
aaggaggaagctcgaaccca

SEQ ID NO: 23627 - DNA, 20 bp, Artificial Sequence
  Synthetic oligonucleotide; AAG chr11 5356192 5356211 5356208 +
agctcgaacccatggcaaaa

SEQ ID NO: 23628 - DNA, 20 bp, Artificial Sequence
  Synthetic oligonucleotide; TAG chr11 5356216 5356235 5356232 +
taaaaaccttgaaaataaat

SEQ ID NO: 23629 - DNA, 20 bp, Artificial Sequence
  Synthetic oligonucleotide; TGG chr11 5356224 5356243 5356240 +
ttgaaaataaattagactaa

SEQ ID NO: 23630 - DNA, 20 bp, Artificial Sequence
  Synthetic oligonucleotide; TAG chr11 5356232 5356251 5356248 +
aaattagactaatggctaac

SEQ ID NO: 23631 - DNA, 20 bp, Artificial Sequence
  Synthetic oligonucleotide; CAG chr11 5356246 5356265 5356262 +
gctaactagaataaccaata

SEQ ID NO: 23632 - DNA, 20 bp, Artificial Sequence
  Synthetic oligonucleotide; GAG chr11 5356248 5356267 5356264 +
taactagaataaccaataca

SEQ ID NO: 23633 - DNA, 20 bp, Artificial Sequence
  Synthetic oligonucleotide; AAG chr11 5356251 5356270 5356267 +
ctagaataaccaatacagag

SEQ ID NO: 23634 - DNA, 20 bp, Artificial Sequence
  Synthetic oligonucleotide; AAG chr11 5356260 5356279 5356276 +
ccaatacagagaagtcctta

SEQ ID NO: 23635 - DNA, 20 bp, Artificial Sequence
  Synthetic oligonucleotide; AGG chr11 5356261 5356280 5356277 +
caatacagagaagtccttaa

SEQ ID NO: 23636 - DNA, 20 bp, Artificial Sequence
  Synthetic oligonucleotide; TGG chr11 5356270 5356289 5356286 +
gaagtccttaaaggacctga

SEQ ID NO: 23637 - DNA, 20 bp, Artificial Sequence
  Synthetic oligonucleotide; GAG chr11 5356272 5356291 5356288 +
agtccttaaaggacctgatg

SEQ ID NO: 23638 - DNA, 20 bp, Artificial Sequence
  Synthetic oligonucleotide; AAG chr11 5356284 5356303 5356300 +
acctgatggagctgaaaacc

SEQ ID NO: 23639 - DNA, 20 bp, Artificial Sequence
  Synthetic oligonucleotide; AGG chr11 5356285 5356304 5356301 +
cctgatggagctgaaaacca

SEQ ID NO: 23640 - DNA, 20 bp, Artificial Sequence
  Synthetic oligonucleotide; GAG chr11 5356291 5356310 5356307 +
ggagctgaaaaccaaggcat

SEQ ID NO: 23641 - DNA, 20 bp, Artificial Sequence
  Synthetic oligonucleotide; AAG chr11 5356313 5356332 5356329 +
gaactacatgatgaatgcac

SEQ ID NO: 23642 - DNA, 20 bp, Artificial Sequence
  Synthetic oligonucleotide; CAG chr11 5356319 5356338 5356335 +
catgatgaatgcacaagact

SEQ ID NO: 23643 - DNA, 20 bp, Artificial Sequence
  Synthetic oligonucleotide; TAG chr11 5356322 5356341 5356338 +
gatgaatgcacaagactcag

SEQ ID NO: 23644 - DNA, 20 bp, Artificial Sequence
  Synthetic oligonucleotide; TGG chr11 5356339 5356358 5356355 +
cagtagctgattcgatcaac

SEQ ID NO: 23645 - DNA, 20 bp, Artificial Sequence
  Synthetic oligonucleotide; AAG chr11 5356342 5356361 5356358 +
tagctgattcgatcaactgg

SEQ ID NO: 23646 - DNA, 20 bp, Artificial Sequence
  Synthetic oligonucleotide; AAG chr11 5356346 5356365 5356362 +
tgattcgatcaactggaaga

SEQ ID NO: 23647 - DNA, 20 bp, Artificial Sequence
  Synthetic oligonucleotide; AGG chr11 5356347 5356366 5356363 +
gattcgatcaactggaagaa

SEQ ID NO: 23648 - DNA, 20 bp, Artificial Sequence
  Synthetic oligonucleotide; GGG chr11 5356348 5356367 5356364 +
attcgatcaactggaagaaa

SEQ ID NO: 23649 - DNA, 20 bp, Artificial Sequence
  Synthetic oligonucleotide; CAG chr11 5356354 5356373 5356370 +
tcaactggaagaaagggtat

SEQ ID NO: 23650 - DNA, 20 bp, Artificial Sequence
  Synthetic oligonucleotide; TGG chr11 5356360 5356379 5356376 +
ggaagaaagggtatcagtga

SEQ ID NO: 23651 - DNA, 20 bp, Artificial Sequence
  Synthetic oligonucleotide; AAG chr11 5356363 5356382 5356379 +
agaaagggtatcagtgatgg

SEQ ID NO: 23652 - DNA, 20 bp, Artificial Sequence
  Synthetic oligonucleotide; AAG chr11 5356383 5356402 5356399 +
aagatcaaatgaatgaaatg

SEQ ID NO: 23653 - DNA, 20 bp, Artificial Sequence
  Synthetic oligonucleotide; AAG chr11 5356387 5356406 5356403 +
tcaaatgaatgaaatgaagc

SEQ ID NO: 23654 - DNA, 20 bp, Artificial Sequence
  Synthetic oligonucleotide; AAG chr11 5356390 5356409 5356406 +
aatgaatgaaatgaagcaag

SEQ ID NO: 23655 - DNA, 20 bp, Artificial Sequence
  Synthetic oligonucleotide; GAG chr11 5356392 5356411 5356408 +
tgaatgaaatgaagcaagaa

SEQ ID NO: 23656 - DNA, 20 bp, Artificial Sequence
  Synthetic oligonucleotide; AAG chr11 5356395 5356414 5356411 +
atgaaatgaagcaagaagag

SEQ ID NO: 23657 - DNA, 20 bp, Artificial Sequence
  Synthetic oligonucleotide; TAG chr11 5356400 5356419 5356416 +
atgaagcaagaagagaagtt

SEQ ID NO: 23658 - DNA, 20 bp, Artificial Sequence
  Synthetic oligonucleotide; GAG chr11 5356402 5356421 5356418 +
gaagcaagaagagaagttta

SEQ ID NO: 23659 - DNA, 20 bp, Artificial Sequence
  Synthetic oligonucleotide; AAG chr11 5356409 5356428 5356425 +
gaagagaagtttagagaaaa

SEQ ID NO: 23660 - DNA, 20 bp, Artificial Sequence
  Synthetic oligonucleotide; AAG chr11 5356418 5356437 5356434 +
tttagagaaaaaagaataaa

SEQ ID NO: 23661 - DNA, 20 bp, Artificial Sequence
  Synthetic oligonucleotide; AAG chr11 5356430 5356449 5356446 +
agaataaaaagaaatgaaca

SEQ ID NO: 23662 - DNA, 20 bp, Artificial Sequence
  Synthetic oligonucleotide; AAG chr11 5356438 5356457 5356454 +
aagaaatgaacaaagcctcc

SEQ ID NO: 23663 - DNA, 20 bp, Artificial Sequence
  Synthetic oligonucleotide; TGG chr11 5356446 5356465 5356462 +
aacaaagcctccaagaaata

SEQ ID NO: 23664 - DNA, 20 bp, Artificial Sequence
  Synthetic oligonucleotide; GGG chr11 5356447 5356466 5356463 +
acaaagcctccaagaaatat

SEQ ID NO: 23665 - DNA, 20 bp, Artificial Sequence
  Synthetic oligonucleotide; AAG chr11 5356460 5356479 5356476 +
gaaatatgggactatgtgaa

SEQ ID NO: 23666 - DNA, 20 bp, Artificial Sequence
  Synthetic oligonucleotide; TGG chr11 5356481 5356500 5356497 +
agaccaaatctatatctgat

SEQ ID NO: 23667 - DNA, 20 bp, Artificial Sequence
  Synthetic oligonucleotide; AAG chr11 5356493 5356512 5356509 +
tatctgattggtgtacctga

SEQ ID NO: 23668 - DNA, 20 bp, Artificial Sequence
  Synthetic oligonucleotide; CGG chr11 5356499 5356518 5356515 +
attggtgtacctgaaagtga

SEQ ID NO: 23669 - DNA, 20 bp, Artificial Sequence
  Synthetic oligonucleotide; GGG chr11 5356500 5356519 5356516 +
ttggtgtacctgaaagtgac

SEQ ID NO: 23670 - DNA, 20 bp, Artificial Sequence
  Synthetic oligonucleotide; CAG chr11 5356503 5356522 5356519 +
gtgtacctgaaagtgacggg

SEQ ID NO: 23671 - DNA, 20 bp, Artificial Sequence
  Synthetic oligonucleotide; TGG chr11 5356508 5356527 5356524 +
cctgaaagtgacgggcagaa

SEQ ID NO: 23672 - DNA, 20 bp, Artificial Sequence
  Synthetic oligonucleotide; AAG chr11 5356515 5356534 5356531 +
gtgacgggcagaatggaacc

SEQ ID NO: 23673 - DNA, 20 bp, Artificial Sequence
  Synthetic oligonucleotide; TGG chr11 5356519 5356538 5356535 +
cgggcagaatggaaccaagt

SEQ ID NO: 23674 - DNA, 20 bp, Artificial Sequence
  Synthetic oligonucleotide; CAG chr11 5356533 5356552 5356549 +
ccaagttggaaaacactctg

SEQ ID NO: 23675 - DNA, 20 bp, Artificial Sequence
  Synthetic oligonucleotide; AGG chr11 5356534 5356553 5356550 +
caagttggaaaacactctgc

SEQ ID NO: 23676 - DNA, 20 bp, Artificial Sequence
  Synthetic oligonucleotide; CAG chr11 5356545 5356564 5356561 +
acactctgcaggatattatc

SEQ ID NO: 23677 - DNA, 20 bp, Artificial Sequence
  Synthetic oligonucleotide; AGG chr11 5356546 5356565 5356562 +
cactctgcaggatattatcc

SEQ ID NO: 23678 - DNA, 20 bp, Artificial Sequence
  Synthetic oligonucleotide; GAG chr11 5356548 5356567 5356564 +
ctctgcaggatattatccag

SEQ ID NO: 23679 - DNA, 20 bp, Artificial Sequence
  Synthetic oligonucleotide; TAG chr11 5356564 5356583 5356580 +
ccaggagaacttccccaatc

SEQ ID NO: 23680 - DNA, 20 bp, Artificial Sequence
  Synthetic oligonucleotide; AAG chr11 5356568 5356587 5356584 +
gagaacttccccaatctagc

SEQ ID NO: 23681 - DNA, 20 bp, Artificial Sequence
  Synthetic oligonucleotide; AGG chr11 5356569 5356588 5356585 +
agaacttccccaatctagca

SEQ ID NO: 23682 - DNA, 20 bp, Artificial Sequence
  Synthetic oligonucleotide; CAG chr11 5356572 5356591 5356588 +
acttccccaatctagcaagg

SEQ ID NO: 23683 - DNA, 20 bp, Artificial Sequence
  Synthetic oligonucleotide; AGG chr11 5356573 5356592 5356589 +
cttccccaatctagcaaggc

SEQ ID NO: 23684 - DNA, 20 bp, Artificial Sequence
  Synthetic oligonucleotide; CAG chr11 5356590 5356609 5356606 +
ggcaggtcaacattcaaatt

SEQ ID NO: 23685 - DNA, 20 bp, Artificial Sequence
  Synthetic oligonucleotide; AGG chr11 5356591 5356610 5356607 +
gcaggtcaacattcaaattc

SEQ ID NO: 23686 - DNA, 20 bp, Artificial Sequence
  Synthetic oligonucleotide; CAG chr11 5356599 5356618 5356615 +
acattcaaattcaggaaata

SEQ ID NO: 23687 - DNA, 20 bp, Artificial Sequence
  Synthetic oligonucleotide; GAG chr11 5356601 5356620 5356617 +
attcaaattcaggaaataca

SEQ ID NO: 23688 - DNA, 20 bp, Artificial Sequence
  Synthetic oligonucleotide; AAG chr11 5356613 5356632 5356629 +
gaaatacagagaacgccaca

SEQ ID NO: 23689 - DNA, 20 bp, Artificial Sequence
  Synthetic oligonucleotide; GAG chr11 5356625 5356644 5356641 +
acgccacaaagatactcctt

SEQ ID NO: 23690 - DNA, 20 bp, Artificial Sequence
  Synthetic oligonucleotide; AAG chr11 5356628 5356647 5356644 +
ccacaaagatactccttgag

SEQ ID NO: 23691 - DNA, 20 bp, Artificial Sequence
  Synthetic oligonucleotide; GAG chr11 5356630 5356649 5356646 +
acaaagatactccttgagaa

SEQ ID NO: 23692 - DNA, 20 bp, Artificial Sequence
  Synthetic oligonucleotide; AAG chr11 5356640 5356659 5356656 +
tccttgagaagagcaactac

SEQ ID NO: 23693 - DNA, 20 bp, Artificial Sequence
  Synthetic oligonucleotide; AGG chr11 5356641 5356660 5356657 +
ccttgagaagagcaactaca

SEQ ID NO: 23694 - DNA, 20 bp, Artificial Sequence
  Synthetic oligonucleotide; CAG chr11 5356655 5356674 5356671 +
actacaaggcacataattgt

SEQ ID NO: 23695 - DNA, 20 bp, Artificial Sequence
  Synthetic oligonucleotide; AAG chr11 5356666 5356685 5356682 +
cataattgtcagattcacca

SEQ ID NO: 23696 - DNA, 20 bp, Artificial Sequence
  Synthetic oligonucleotide; AAG chr11 5356677 5356696 5356693 +
gattcaccaaagttgaaatg

SEQ ID NO: 23697 - DNA, 20 bp, Artificial Sequence
  Synthetic oligonucleotide; AGG chr11 5356678 5356697 5356694 +
attcaccaaagttgaaatga

SEQ ID NO: 23698 - DNA, 20 bp, Artificial Sequence
  Synthetic oligonucleotide; GGG chr11 5356679 5356698 5356695 +
ttcaccaaagttgaaatgaa

SEQ ID NO: 23699 - DNA, 20 bp, Artificial Sequence
  Synthetic oligonucleotide; AAG chr11 5356691 5356710 5356707 +
gaaatgaagggaaaaatgtt

SEQ ID NO: 23700 - DNA, 20 bp, Artificial Sequence
  Synthetic oligonucleotide; AGG chr11 5356692 5356711 5356708 +
aaatgaagggaaaaatgtta

SEQ ID NO: 23701 - DNA, 20 bp, Artificial Sequence
  Synthetic oligonucleotide; GGG chr11 5356693 5356712 5356709 +
aatgaagggaaaaatgttaa

SEQ ID NO: 23702 - DNA, 20 bp, Artificial Sequence
  Synthetic oligonucleotide; TAG chr11 5356696 5356715 5356712 +
gaagggaaaaatgttaaggg

SEQ ID NO: 23703 - DNA, 20 bp, Artificial Sequence
  Synthetic oligonucleotide; CAG chr11 5356700 5356719 5356716 +
ggaaaaatgttaagggtagc

SEQ ID NO: 23704 - DNA, 20 bp, Artificial Sequence
  Synthetic oligonucleotide; GAG chr11 5356702 5356721 5356718 +
aaaaatgttaagggtagcca

SEQ ID NO: 23705 - DNA, 20 bp, Artificial Sequence
  Synthetic oligonucleotide; GAG chr11 5356704 5356723 5356720 +
aaatgttaagggtagccaga

SEQ ID NO: 23706 - DNA, 20 bp, Artificial Sequence
  Synthetic oligonucleotide; AAG chr11 5356708 5356727 5356724 +
gttaagggtagccagagaga

SEQ ID NO: 23707 - DNA, 20 bp, Artificial Sequence
  Synthetic oligonucleotide; AGG chr11 5356709 5356728 5356725 +
ttaagggtagccagagagaa

SEQ ID NO: 23708 - DNA, 20 bp, Artificial Sequence
  Synthetic oligonucleotide; CGG chr11 5356713 5356732 5356729 +
gggtagccagagagaaaggt

SEQ ID NO: 23709 - DNA, 20 bp, Artificial Sequence
  Synthetic oligonucleotide; GGG chr11 5356714 5356733 5356730 +
ggtagccagagagaaaggtc

SEQ ID NO: 23710 - DNA, 20 bp, Artificial Sequence
  Synthetic oligonucleotide; AAG chr11 5356726 5356745 5356742 +
gaaaggtcgggttacccaca

SEQ ID NO: 23711 - DNA, 20 bp, Artificial Sequence
  Synthetic oligonucleotide; AGG chr11 5356727 5356746 5356743 +
aaaggtcgggttacccacaa

SEQ ID NO: 23712 - DNA, 20 bp, Artificial Sequence
  Synthetic oligonucleotide; GGG chr11 5356728 5356747 5356744 +
aaggtcgggttacccacaaa

SEQ ID NO: 23713 - DNA, 20 bp, Artificial Sequence
  Synthetic oligonucleotide; AAG chr11 5356731 5356750 5356747 +
gtcgggttacccacaaaggg

SEQ ID NO: 23714 - DNA, 20 bp, Artificial Sequence
  Synthetic oligonucleotide; CAG chr11 5356739 5356758 5356755 +
acccacaaagggaagcccat

SEQ ID NO: 23715 - DNA, 20 bp, Artificial Sequence
  Synthetic oligonucleotide; CAG chr11 5356747 5356766 5356763 +
agggaagcccatcagaataa

SEQ ID NO: 23716 - DNA, 20 bp, Artificial Sequence
  Synthetic oligonucleotide; CAG chr11 5356750 5356769 5356766 +
gaagcccatcagaataacag

SEQ ID NO: 23717 - DNA, 20 bp, Artificial Sequence
  Synthetic oligonucleotide; CAG chr11 5356759 5356778 5356775 +
cagaataacagcagatctct

SEQ ID NO: 23718 - DNA, 20 bp, Artificial Sequence
  Synthetic oligonucleotide; CAG chr11 5356762 5356781 5356778 +
aataacagcagatctctcag

SEQ ID NO: 23719 - DNA, 20 bp, Artificial Sequence
  Synthetic oligonucleotide; AAG chr11 5356774 5356793 5356790 +
tctctcagcagaaactctac

SEQ ID NO: 23720 - DNA, 20 bp, Artificial Sequence
  Synthetic oligonucleotide; CAG chr11 5356778 5356797 5356794 +
tcagcagaaactctacaagc

SEQ ID NO: 23721 - DNA, 20 bp, Artificial Sequence
  Synthetic oligonucleotide; AAG chr11 5356781 5356800 5356797 +
gcagaaactctacaagccag

SEQ ID NO: 23722 - DNA, 20 bp, Artificial Sequence
  Synthetic oligonucleotide; GAG chr11 5356783 5356802 5356799 +
agaaactctacaagccagaa

SEQ ID NO: 23723 - DNA, 20 bp, Artificial Sequence
  Synthetic oligonucleotide; GAG chr11 5356785 5356804 5356801 +
aaactctacaagccagaaga

SEQ ID NO: 23724 - DNA, 20 bp, Artificial Sequence
  Synthetic oligonucleotide; TGG chr11 5356788 5356807 5356804 +
ctctacaagccagaagagag

SEQ ID NO: 23725 - DNA, 20 bp, Artificial Sequence
  Synthetic oligonucleotide; GGG chr11 5356789 5356808 5356805 +
tctacaagccagaagagagt

SEQ ID NO: 23726 - DNA, 20 bp, Artificial Sequence
  Synthetic oligonucleotide; GGG chr11 5356790 5356809 5356806 +
ctacaagccagaagagagtg

SEQ ID NO: 23727 - DNA, 20 bp, Artificial Sequence
  Synthetic oligonucleotide; GGG chr11 5356791 5356810 5356807 +
tacaagccagaagagagtgg

SEQ ID NO: 23728 - DNA, 20 bp, Artificial Sequence
  Synthetic oligonucleotide; AAG chr11 5356813 5356832 5356829 +
gccaatattcaacatcctta

SEQ ID NO: 23729 - DNA, 20 bp, Artificial Sequence
  Synthetic oligonucleotide; AGG chr11 5356814 5356833 5356830 +
ccaatattcaacatccttaa

SEQ ID NO: 23730 - DNA, 20 bp, Artificial Sequence
  Synthetic oligonucleotide; AAG chr11 5356818 5356837 5356834 +
tattcaacatccttaaagga

SEQ ID NO: 23731 - DNA, 20 bp, Artificial Sequence
  Synthetic oligonucleotide; CAG chr11 5356832 5356851 5356848 +
aaaggaaagaattttcaaca

SEQ ID NO: 23732 - DNA, 20 bp, Artificial Sequence
  Synthetic oligonucleotide; CAG chr11 5356846 5356865 5356862 +
tcaacacagaatttcatatc

SEQ ID NO: 23733 - DNA, 20 bp, Artificial Sequence
  Synthetic oligonucleotide; AAG chr11 5356856 5356875 5356872 +
atttcatatccagccaaact

SEQ ID NO: 23734 - DNA, 20 bp, Artificial Sequence
  Synthetic oligonucleotide; AAG chr11 5356865 5356884 5356881 +
ccagccaaactaagcttcat

SEQ ID NO: 23735 - DNA, 20 bp, Artificial Sequence
  Synthetic oligonucleotide; AAG chr11 5356870 5356889 5356886 +
caaactaagcttcataagtg

SEQ ID NO: 23736 - DNA, 20 bp, Artificial Sequence
  Synthetic oligonucleotide; AGG chr11 5356871 5356890 5356887 +
aaactaagcttcataagtga

SEQ ID NO: 23737 - DNA, 20 bp, Artificial Sequence
  Synthetic oligonucleotide; GAG chr11 5356873 5356892 5356889 +
actaagcttcataagtgaag

SEQ ID NO: 23738 - DNA, 20 bp, Artificial Sequence
  Synthetic oligonucleotide; CAG chr11 5356891 5356910 5356907 +
aggagaaataaaatacttta

SEQ ID NO: 23739 - DNA, 20 bp, Artificial Sequence
  Synthetic oligonucleotide; AAG chr11 5356896 5356915 5356912 +
aaataaaatactttacagac

SEQ ID NO: 23740 - DNA, 20 bp, Artificial Sequence
  Synthetic oligonucleotide; GAG chr11 5356907 5356926 5356923 +
tttacagacaagcaaatgct

SEQ ID NO: 23741 - DNA, 20 bp, Artificial Sequence
  Synthetic oligonucleotide; GAG chr11 5356909 5356928 5356925 +
tacagacaagcaaatgctga

SEQ ID NO: 23742 - DNA, 20 bp, Artificial Sequence
  Synthetic oligonucleotide; CAG chr11 5356925 5356944 5356941 +
ctgagagattttgtcatcac

SEQ ID NO: 23743 - DNA, 20 bp, Artificial Sequence
  Synthetic oligonucleotide; AGG chr11 5356926 5356945 5356942 +
tgagagattttgtcatcacc

SEQ ID NO: 23744 - DNA, 20 bp, Artificial Sequence
  Synthetic oligonucleotide; AAG chr11 5356939 5356958 5356955 +
catcaccaggcctgacctaa

SEQ ID NO: 23745 - DNA, 20 bp, Artificial Sequence
  Synthetic oligonucleotide; GAG chr11 5356941 5356960 5356957 +
tcaccaggcctgacctaaaa

SEQ ID NO: 23746 - DNA, 20 bp, Artificial Sequence
  Synthetic oligonucleotide; AAG chr11 5356950 5356969 5356966 +
ctgacctaaaagagctcctg

SEQ ID NO: 23747 - DNA, 20 bp, Artificial Sequence
  Synthetic oligonucleotide; AGG chr11 5356951 5356970 5356967 +
tgacctaaaagagctcctga

SEQ ID NO: 23748 - DNA, 20 bp, Artificial Sequence
  Synthetic oligonucleotide; AAG chr11 5356954 5356973 5356970 +
cctaaaagagctcctgaagg

SEQ ID NO: 23749 - DNA, 20 bp, Artificial Sequence
  Synthetic oligonucleotide; TGG chr11 5356966 5356985 5356982 +
cctgaaggaagcactaaata

SEQ ID NO: 23750 - DNA, 20 bp, Artificial Sequence
  Synthetic oligonucleotide; AAG chr11 5356970 5356989 5356986 +
aaggaagcactaaatatgga

SEQ ID NO: 23751 - DNA, 20 bp, Artificial Sequence
  Synthetic oligonucleotide; AGG chr11 5356971 5356990 5356987 +
aggaagcactaaatatggaa

SEQ ID NO: 23752 - DNA, 20 bp, Artificial Sequence
  Synthetic oligonucleotide; CGG chr11 5356980 5356999 5356996 +
taaatatggaaaggcacaac

SEQ ID NO: 23753 - DNA, 20 bp, Artificial Sequence
  Synthetic oligonucleotide; CAG chr11 5356986 5357005 5357002 +
tggaaaggcacaaccggtac

SEQ ID NO: 23754 - DNA, 20 bp, Artificial Sequence
  Synthetic oligonucleotide; AAG chr11 5357015 5357034 5357031 +
caaaaacatgccaaattgta

SEQ ID NO: 23755 - DNA, 20 bp, Artificial Sequence
  Synthetic oligonucleotide; GAG chr11 5357024 5357043 5357040 +
gccaaattgtaaagaccatt

SEQ ID NO: 23756 - DNA, 20 bp, Artificial Sequence
  Synthetic oligonucleotide; AGG chr11 5357025 5357044 5357041 +
ccaaattgtaaagaccattg

SEQ ID NO: 23757 - DNA, 20 bp, Artificial Sequence
  Synthetic oligonucleotide; TAG chr11 5357029 5357048 5357045 +
attgtaaagaccattgaggc

SEQ ID NO: 23758 - DNA, 20 bp, Artificial Sequence
  Synthetic oligonucleotide; AGG chr11 5357030 5357049 5357046 +
ttgtaaagaccattgaggct

SEQ ID NO: 23759 - DNA, 20 bp, Artificial Sequence
  Synthetic oligonucleotide; AAG chr11 5357033 5357052 5357049 +
taaagaccattgaggctagg

SEQ ID NO: 23760 - DNA, 20 bp, Artificial Sequence
  Synthetic oligonucleotide; GAG chr11 5357053 5357072 5357069 +
aagaaactgcatcaactaat

SEQ ID NO: 23761 - DNA, 20 bp, Artificial Sequence
  Synthetic oligonucleotide; CAG chr11 5357065 5357084 5357081 +
caactaatgagcaaaataac

SEQ ID NO: 23762 - DNA, 20 bp, Artificial Sequence
  Synthetic oligonucleotide; CAG chr11 5357083 5357102 5357099 +
accagctaacatcataatga

SEQ ID NO: 23763 - DNA, 20 bp, Artificial Sequence
  Synthetic oligonucleotide; AGG chr11 5357084 5357103 5357100 +
ccagctaacatcataatgac

SEQ ID NO: 23764 - DNA, 20 bp, Artificial Sequence
  Synthetic oligonucleotide; TGG chr11 5357125 5357144 5357141 +
aatattaaccttaatgtaaa

SEQ ID NO: 23765 - DNA, 20 bp, Artificial Sequence
  Synthetic oligonucleotide; GGG chr11 5357126 5357145 5357142 +
atattaaccttaatgtaaat

SEQ ID NO: 23766 - DNA, 20 bp, Artificial Sequence
  Synthetic oligonucleotide; CAG chr11 5357139 5357158 5357155 +
tgtaaatgggctaaatgctc

SEQ ID NO: 23767 - DNA, 20 bp, Artificial Sequence
  Synthetic oligonucleotide; AAG chr11 5357146 5357165 5357162 +
gggctaaatgctccagtaaa

SEQ ID NO: 23768 - DNA, 20 bp, Artificial Sequence
  Synthetic oligonucleotide; CAG chr11 5357152 5357171 5357168 +
aatgctccagtaaaaagaca

SEQ ID NO: 23769 - DNA, 20 bp, Artificial Sequence
  Synthetic oligonucleotide; CGG chr11 5357156 5357175 5357172 +
ctccagtaaaaagacacaga

SEQ ID NO: 23770 - DNA, 20 bp, Artificial Sequence
  Synthetic oligonucleotide; GGG chr11 5357157 5357176 5357173 +
tccagtaaaaagacacagac

SEQ ID NO: 23771 - DNA, 20 bp, Artificial Sequence
  Synthetic oligonucleotide; TAG chr11 5357165 5357184 5357181 +
aaagacacagacgggcaaat

SEQ ID NO: 23772 - DNA, 20 bp, Artificial Sequence
  Synthetic oligonucleotide; AAG chr11 5357171 5357190 5357187 +
acagacgggcaaattagata

SEQ ID NO: 23773 - DNA, 20 bp, Artificial Sequence
  Synthetic oligonucleotide; GAG chr11 5357173 5357192 5357189 +
agacgggcaaattagataaa

SEQ ID NO: 23774 - DNA, 20 bp, Artificial Sequence
  Synthetic oligonucleotide; AAG chr11 5357178 5357197 5357194 +
ggcaaattagataaagagtc

SEQ ID NO: 23775 - DNA, 20 bp, Artificial Sequence
  Synthetic oligonucleotide; CAG chr11 5357187 5357206 5357203 +
gataaagagtcaagacccat

SEQ ID NO: 23776 - DNA, 20 bp, Artificial Sequence
  Synthetic oligonucleotide; CAG chr11 5357201 5357220 5357217 +
acccatcagtgtgctgtatt

SEQ ID NO: 23777 - DNA, 20 bp, Artificial Sequence
  Synthetic oligonucleotide; AGG chr11 5357202 5357221 5357218 +
cccatcagtgtgctgtattc

SEQ ID NO: 23778 - DNA, 20 bp, Artificial Sequence
  Synthetic oligonucleotide; TAG chr11 5357233 5357252 5357249 +
ctcatgtgcacacacacaca

SEQ ID NO: 23779 - DNA, 20 bp, Artificial Sequence
  Synthetic oligonucleotide; AGG chr11 5357234 5357253 5357250 +
tcatgtgcacacacacacat

SEQ ID NO: 23780 - DNA, 20 bp, Artificial Sequence
  Synthetic oligonucleotide; AAG chr11 5357246 5357265 5357262 +
acacacataggctcaaaata

SEQ ID NO: 23781 - DNA, 20 bp, Artificial Sequence
  Synthetic oligonucleotide; AGG chr11 5357247 5357266 5357263 +
cacacataggctcaaaataa

SEQ ID NO: 23782 - DNA, 20 bp, Artificial Sequence
  Synthetic oligonucleotide; GGG chr11 5357248 5357267 5357264 +
acacataggctcaaaataaa

SEQ ID NO: 23783 - DNA, 20 bp, Artificial Sequence
  Synthetic oligonucleotide; TGG chr11 5357252 5357271 5357268 +
ataggctcaaaataaaggga

SEQ ID NO: 23784 - DNA, 20 bp, Artificial Sequence
  Synthetic oligonucleotide; GAG chr11 5357254 5357273 5357270 +
aggctcaaaataaagggatg

SEQ ID NO: 23785 - DNA, 20 bp, Artificial Sequence
  Synthetic oligonucleotide; AGG chr11 5357255 5357274 5357271 +
ggctcaaaataaagggatgg

SEQ ID NO: 23786 - DNA, 20 bp, Artificial Sequence
  Synthetic oligonucleotide; AAG chr11 5357258 5357277 5357274 +
tcaaaataaagggatggagg

SEQ ID NO: 23787 - DNA, 20 bp, Artificial Sequence
  Synthetic oligonucleotide; AAG chr11 5357268 5357287 5357284 +
gggatggaggaagatctacc

SEQ ID NO: 23788 - DNA, 20 bp, Artificial Sequence
  Synthetic oligonucleotide; TGG chr11 5357275 5357294 5357291 +
aggaagatctaccaagaaaa

SEQ ID NO: 23789 - DNA, 20 bp, Artificial Sequence
  Synthetic oligonucleotide; AAG chr11 5357288 5357307 5357304 +
aagaaaatggaaaacaaaaa

SEQ ID NO: 23790 - DNA, 20 bp, Artificial Sequence
  Synthetic oligonucleotide; AGG chr11 5357289 5357308 5357305 +
agaaaatggaaaacaaaaaa

SEQ ID NO: 23791 - DNA, 20 bp, Artificial Sequence
  Synthetic oligonucleotide; CAG chr11 5357292 5357311 5357308 +
aaatggaaaacaaaaaaagg

SEQ ID NO: 23792 - DNA, 20 bp, Artificial Sequence
  Synthetic oligonucleotide; AGG chr11 5357293 5357312 5357309 +
aatggaaaacaaaaaaaggc

SEQ ID NO: 23793 - DNA, 20 bp, Artificial Sequence
  Synthetic oligonucleotide; GGG chr11 5357294 5357313 5357310 +
atggaaaacaaaaaaaggca

SEQ ID NO: 23794 - DNA, 20 bp, Artificial Sequence
  Synthetic oligonucleotide; GGG chr11 5357295 5357314 5357311 +
tggaaaacaaaaaaaggcag

SEQ ID NO: 23795 - DNA, 20 bp, Artificial Sequence
  Synthetic oligonucleotide; CAG chr11 5357322 5357341 5357338 +
aatcctcatctctgataaaa

SEQ ID NO: 23796 - DNA, 20 bp, Artificial Sequence
  Synthetic oligonucleotide; AGG chr11 5357323 5357342 5357339 +
atcctcatctctgataaaac

SEQ ID NO: 23797 - DNA, 20 bp, Artificial Sequence
  Synthetic oligonucleotide; AAG chr11 5357339 5357358 5357355 +
aaacaggctttaaaccaaca

SEQ ID NO: 23798 - DNA, 20 bp, Artificial Sequence
  Synthetic oligonucleotide; AAG chr11 5357347 5357366 5357363 +
tttaaaccaacaaagatcaa

SEQ ID NO: 23799 - DNA, 20 bp, Artificial Sequence
  Synthetic oligonucleotide; GAG chr11 5357349 5357368 5357365 +
taaaccaacaaagatcaaaa

SEQ ID NO: 23800 - DNA, 20 bp, Artificial Sequence
  Synthetic oligonucleotide; AAG chr11 5357355 5357374 5357371 +
aacaaagatcaaaagagaca

SEQ ID NO: 23801 - DNA, 20 bp, Artificial Sequence
  Synthetic oligonucleotide; AAG chr11 5357358 5357377 5357374 +
aaagatcaaaagagacaaag

SEQ ID NO: 23802 - DNA, 20 bp, Artificial Sequence
  Synthetic oligonucleotide; AGG chr11 5357359 5357378 5357375 +
aagatcaaaagagacaaaga

SEQ ID NO: 23803 - DNA, 20 bp, Artificial Sequence
  Synthetic oligonucleotide; TGG chr11 5357373 5357392 5357389 +
caaagaaggccattacataa

SEQ ID NO: 23804 - DNA, 20 bp, Artificial Sequence
  Synthetic oligonucleotide; AAG chr11 5357378 5357397 5357394 +
aaggccattacataatggta

SEQ ID NO: 23805 - DNA, 20 bp, Artificial Sequence
  Synthetic oligonucleotide; AGG chr11 5357379 5357398 5357395 +
aggccattacataatggtaa

SEQ ID NO: 23806 - DNA, 20 bp, Artificial Sequence
  Synthetic oligonucleotide; GGG chr11 5357380 5357399 5357396 +
ggccattacataatggtaaa

SEQ ID NO: 23807 - DNA, 20 bp, Artificial Sequence
  Synthetic oligonucleotide; AAG chr11 5357394 5357413 5357410 +
ggtaaagggatcaattcaac

SEQ ID NO: 23808 - DNA, 20 bp, Artificial Sequence
  Synthetic oligonucleotide; AAG chr11 5357397 5357416 5357413 +
aaagggatcaattcaacaag

SEQ ID NO: 23809 - DNA, 20 bp, Artificial Sequence
  Synthetic oligonucleotide; GAG chr11 5357399 5357418 5357415 +
agggatcaattcaacaagaa

SEQ ID NO: 23810 - DNA, 20 bp, Artificial Sequence
  Synthetic oligonucleotide; CAG chr11 5357433 5357452 5357449 +
aaacatatatgcacccaata

SEQ ID NO: 23811 - DNA, 20 bp, Artificial Sequence
  Synthetic oligonucleotide; AGG chr11 5357434 5357453 5357450 +
aacatatatgcacccaatac

SEQ ID NO: 23812 - DNA, 20 bp, Artificial Sequence
  Synthetic oligonucleotide; CAG chr11 5357443 5357462 5357459 +
gcacccaatacaggaacacc

SEQ ID NO: 23813 - DNA, 20 bp, Artificial Sequence
  Synthetic oligonucleotide; AGG chr11 5357444 5357463 5357460 +
cacccaatacaggaacaccc

SEQ ID NO: 23814 - DNA, 20 bp, Artificial Sequence
  Synthetic oligonucleotide; AAG chr11 5357453 5357472 5357469 +
caggaacacccaggttcata

SEQ ID NO: 23815 - DNA, 20 bp, Artificial Sequence
  Synthetic oligonucleotide; AAG chr11 5357457 5357476 5357473 +
aacacccaggttcataaagc

SEQ ID NO: 23816 - DNA, 20 bp, Artificial Sequence
  Synthetic oligonucleotide; TAG chr11 5357464 5357483 5357480 +
aggttcataaagcaagtcct

SEQ ID NO: 23817 - DNA, 20 bp, Artificial Sequence
  Synthetic oligonucleotide; GAG chr11 5357466 5357485 5357482 +
gttcataaagcaagtcctta

SEQ ID NO: 23818 - DNA, 20 bp, Artificial Sequence
  Synthetic oligonucleotide; AAG chr11 5357476 5357495 5357492 +
caagtccttagagacctaca

SEQ ID NO: 23819 - DNA, 20 bp, Artificial Sequence
  Synthetic oligonucleotide; GAG chr11 5357478 5357497 5357494 +
agtccttagagacctacaaa

SEQ ID NO: 23820 - DNA, 20 bp, Artificial Sequence
  Synthetic oligonucleotide; TAG chr11 5357484 5357503 5357500 +
tagagacctacaaagagact

SEQ ID NO: 23821 - DNA, 20 bp, Artificial Sequence
  Synthetic oligonucleotide; TGG chr11 5357505 5357524 5357521 +
agactctcacacaataacaa

SEQ ID NO: 23822 - DNA, 20 bp, Artificial Sequence
  Synthetic oligonucleotide; GGG chr11 5357506 5357525 5357522 +
gactctcacacaataacaat

SEQ ID NO: 23823 - DNA, 20 bp, Artificial Sequence
  Synthetic oligonucleotide; GAG chr11 5357508 5357527 5357524 +
ctctcacacaataacaatgg

SEQ ID NO: 23824 - DNA, 20 bp, Artificial Sequence
  Synthetic oligonucleotide; TAG chr11 5357535 5357554 5357551 +
taacaccccactgtcaacat

SEQ ID NO: 23825 - DNA, 20 bp, Artificial Sequence
  Synthetic oligonucleotide; CAG chr11 5357539 5357558 5357555 +
accccactgtcaacattaga

SEQ ID NO: 23826 - DNA, 20 bp, Artificial Sequence
  Synthetic oligonucleotide; TAG chr11 5357550 5357569 5357566 +
aacattagacagatcaacat

SEQ ID NO: 23827 - DNA, 20 bp, Artificial Sequence
  Synthetic oligonucleotide; CAG chr11 5357554 5357573 5357570 +
ttagacagatcaacattaga

SEQ ID NO: 23828 - DNA, 20 bp, Artificial Sequence
  Synthetic oligonucleotide; GAG chr11 5357563 5357582 5357579 +
tcaacattagacagatcaac

SEQ ID NO: 23829 - DNA, 20 bp, Artificial Sequence
  Synthetic oligonucleotide; CAG chr11 5357567 5357586 5357583 +
cattagacagatcaacgaga

SEQ ID NO: 23830 - DNA, 20 bp, Artificial Sequence
  Synthetic oligonucleotide; AAG chr11 5357571 5357590 5357587 +
agacagatcaacgagacaga

SEQ ID NO: 23831 - DNA, 20 bp, Artificial Sequence
  Synthetic oligonucleotide; AAG chr11 5357579 5357598 5357595 +
caacgagacagaaagttaac

SEQ ID NO: 23832 - DNA, 20 bp, Artificial Sequence
  Synthetic oligonucleotide; AGG chr11 5357580 5357599 5357596 +
aacgagacagaaagttaaca

SEQ ID NO: 23833 - DNA, 20 bp, Artificial Sequence
  Synthetic oligonucleotide; CAG chr11 5357588 5357607 5357604 +
agaaagttaacaaggatatc

SEQ ID NO: 23834 - DNA, 20 bp, Artificial Sequence
  Synthetic oligonucleotide; AGG chr11 5357589 5357608 5357605 +
gaaagttaacaaggatatcc

SEQ ID NO: 23835 - DNA, 20 bp, Artificial Sequence
  Synthetic oligonucleotide; CAG chr11 5357601 5357620 5357617 +
ggatatccaggaattgaact

SEQ ID NO: 23836 - DNA, 20 bp, Artificial Sequence
  Synthetic oligonucleotide; AAG chr11 5357613 5357632 5357629 +
attgaactcagctctgcacc

SEQ ID NO: 23837 - DNA, 20 bp, Artificial Sequence
  Synthetic oligonucleotide; CGG chr11 5357616 5357635 5357632 +
gaactcagctctgcaccaag

SEQ ID NO: 23838 - DNA, 20 bp, Artificial Sequence
  Synthetic oligonucleotide; TAG chr11 5357625 5357644 5357641 +
tctgcaccaagcggacctaa

SEQ ID NO: 23839 - DNA, 20 bp, Artificial Sequence
  Synthetic oligonucleotide; CAG chr11 5357635 5357654 5357651 +
gcggacctaatagacatcta

SEQ ID NO: 23840 - DNA, 20 bp, Artificial Sequence
  Synthetic oligonucleotide; CAG chr11 5357658 5357677 5357674 +
aactctccaccccaaatcaa

SEQ ID NO: 23841 - DNA, 20 bp, Artificial Sequence
  Synthetic oligonucleotide; CAG chr11 5357676 5357695 5357692 +
aacagaatatacattctttt

SEQ ID NO: 23842 - DNA, 20 bp, Artificial Sequence
  Synthetic oligonucleotide; TAG chr11 5357712 5357731 5357728 +
ctattccaaaattgaccaca

SEQ ID NO: 23843 - DNA, 20 bp, Artificial Sequence
  Synthetic oligonucleotide; TGG chr11 5357716 5357735 5357732 +
tccaaaattgaccacatagt

SEQ ID NO: 23844 - DNA, 20 bp, Artificial Sequence
  Synthetic oligonucleotide; AAG chr11 5357719 5357738 5357735 +
aaaattgaccacatagttgg

SEQ ID NO: 23845 - DNA, 20 bp, Artificial Sequence
  Synthetic oligonucleotide; AAG chr11 5357724 5357743 5357740 +
tgaccacatagttggaagta

SEQ ID NO: 23846 - DNA, 20 bp, Artificial Sequence
  Synthetic oligonucleotide; CAG chr11 5357734 5357753 5357750 +
gttggaagtaaagcactcct

SEQ ID NO: 23847 - DNA, 20 bp, Artificial Sequence
  Synthetic oligonucleotide; AAG chr11 5357746 5357765 5357762 +
gcactcctcagcaaatgtaa

SEQ ID NO: 23848 - DNA, 20 bp, Artificial Sequence
  Synthetic oligonucleotide; CAG chr11 5357751 5357770 5357767 +
cctcagcaaatgtaaaagaa

SEQ ID NO: 23849 - DNA, 20 bp, Artificial Sequence
  Synthetic oligonucleotide; CAG chr11 5357775 5357794 5357791 +
aattataacaaactgtctct

SEQ ID NO: 23850 - DNA, 20 bp, Artificial Sequence
  Synthetic oligonucleotide; CAG chr11 5357782 5357801 5357798 +
acaaactgtctctcagacca

SEQ ID NO: 23851 - DNA, 20 bp, Artificial Sequence
  Synthetic oligonucleotide; TAG chr11 5357796 5357815 5357812 +
agaccacagtgcaatcaaac

SEQ ID NO: 23852 - DNA, 20 bp, Artificial Sequence
  Synthetic oligonucleotide; CAG chr11 5357803 5357822 5357819 +
agtgcaatcaaactagaact

SEQ ID NO: 23853 - DNA, 20 bp, Artificial Sequence
  Synthetic oligonucleotide; AGG chr11 5357804 5357823 5357820 +
gtgcaatcaaactagaactc

SEQ ID NO: 23854 - DNA, 20 bp, Artificial Sequence
  Synthetic oligonucleotide; AAG chr11 5357810 5357829 5357826 +
tcaaactagaactcaggatt

SEQ ID NO: 23855 - DNA, 20 bp, Artificial Sequence
  Synthetic oligonucleotide; TGG chr11 5357840 5357859 5357856 +
ctcaaaaccgctcaactaca

SEQ ID NO: 23856 - DNA, 20 bp, Artificial Sequence
  Synthetic oligonucleotide; TGG chr11 5357873 5357892 5357889 +
aattgctcctgaatgactac

SEQ ID NO: 23857 - DNA, 20 bp, Artificial Sequence
  Synthetic oligonucleotide; GGG chr11 5357874 5357893 5357890 +
attgctcctgaatgactact

SEQ ID NO: 23858 - DNA, 20 bp, Artificial Sequence
  Synthetic oligonucleotide; AAG chr11 5357891 5357910 5357907 +
actgggttcataacaaaatg

SEQ ID NO: 23859 - DNA, 20 bp, Artificial Sequence
  Synthetic oligonucleotide; AGG chr11 5357892 5357911 5357908 +
ctgggttcataacaaaatga

SEQ ID NO: 23860 - DNA, 20 bp, Artificial Sequence
  Synthetic oligonucleotide; CAG chr11 5357895 5357914 5357911 +
ggttcataacaaaatgaagg

SEQ ID NO: 23861 - DNA, 20 bp, Artificial Sequence
  Synthetic oligonucleotide; TGG chr11 5357914 5357933 5357930 +
gcagaaataaaaatgttctt

SEQ ID NO: 23862 - DNA, 20 bp, Artificial Sequence
  Synthetic oligonucleotide; AAG chr11 5357922 5357941 5357938 +
aaaaatgttctttggaacca

SEQ ID NO: 23863 - DNA, 20 bp, Artificial Sequence
  Synthetic oligonucleotide; GAG chr11 5357924 5357943 5357940 +
aaatgttctttggaaccaaa

SEQ ID NO: 23864 - DNA, 20 bp, Artificial Sequence
  Synthetic oligonucleotide; AAG chr11 5357931 5357950 5357947 +
ctttggaaccaaagagaaca

SEQ ID NO: 23865 - DNA, 20 bp, Artificial Sequence
  Synthetic oligonucleotide; CAG chr11 5357945 5357964 5357961 +
agaacaaagacacaacatac

SEQ ID NO: 23866 - DNA, 20 bp, Artificial Sequence
  Synthetic oligonucleotide; TGG chr11 5357954 5357973 5357970 +
acacaacataccagaatctc

SEQ ID NO: 23867 - DNA, 20 bp, Artificial Sequence
  Synthetic oligonucleotide; GGG chr11 5357955 5357974 5357971 +
cacaacataccagaatctct

SEQ ID NO: 23868 - DNA, 20 bp, Artificial Sequence
  Synthetic oligonucleotide; AAG chr11 5357967 5357986 5357983 +
gaatctctgggacacattca

SEQ ID NO: 23869 - DNA, 20 bp, Artificial Sequence
  Synthetic oligonucleotide; CAG chr11 5357970 5357989 5357986 +
tctctgggacacattcaaag

SEQ ID NO: 23870 - DNA, 20 bp, Artificial Sequence
  Synthetic oligonucleotide; TAG chr11 5357977 5357996 5357993 +
gacacattcaaagcagtgtg

SEQ ID NO: 23871 - DNA, 20 bp, Artificial Sequence
  Synthetic oligonucleotide; GAG chr11 5357979 5357998 5357995 +
cacattcaaagcagtgtgta

SEQ ID NO: 23872 - DNA, 20 bp, Artificial Sequence
  Synthetic oligonucleotide; AGG chr11 5357980 5357999 5357996 +
acattcaaagcagtgtgtag

SEQ ID NO: 23873 - DNA, 20 bp, Artificial Sequence
  Synthetic oligonucleotide; GGG chr11 5357981 5358000 5357997 +
cattcaaagcagtgtgtaga

SEQ ID NO: 23874 - DNA, 20 bp, Artificial Sequence
  Synthetic oligonucleotide; TAG chr11 5357991 5358010 5358007 +
agtgtgtagagggaaattta

SEQ ID NO: 23875 - DNA, 20 bp, Artificial Sequence
  Synthetic oligonucleotide; CAG chr11 5358005 5358024 5358021 +
aatttatagcactaaacgcc

SEQ ID NO: 23876 - DNA, 20 bp, Artificial Sequence
  Synthetic oligonucleotide; AAG chr11 5358008 5358027 5358024 +
ttatagcactaaacgcccag

SEQ ID NO: 23877 - DNA, 20 bp, Artificial Sequence
  Synthetic oligonucleotide; GAG chr11 5358010 5358029 5358026 +
atagcactaaacgcccagaa

SEQ ID NO: 23878 - DNA, 20 bp, Artificial Sequence
  Synthetic oligonucleotide; AAG chr11 5358014 5358033 5358030 +
cactaaacgcccagaagaga

SEQ ID NO: 23879 - DNA, 20 bp, Artificial Sequence
  Synthetic oligonucleotide; CAG chr11 5358017 5358036 5358033 +
taaacgcccagaagagaaag

SEQ ID NO: 23880 - DNA, 20 bp, Artificial Sequence
  Synthetic oligonucleotide; AGG chr11 5358018 5358037 5358034 +
aaacgcccagaagagaaagc

SEQ ID NO: 23881 - DNA, 20 bp, Artificial Sequence
  Synthetic oligonucleotide; AAG chr11 5358022 5358041 5358038 +
gcccagaagagaaagcagga

SEQ ID NO: 23882 - DNA, 20 bp, Artificial Sequence
  Synthetic oligonucleotide; AAG chr11 5358057 5358076 5358073 +
caccctaacatcacaattaa

SEQ ID NO: 23883 - DNA, 20 bp, Artificial Sequence
  Synthetic oligonucleotide; TAG chr11 5358063 5358082 5358079 +
aacatcacaattaaaagaac

SEQ ID NO: 23884 - DNA, 20 bp, Artificial Sequence
  Synthetic oligonucleotide; GAG chr11 5358065 5358084 5358081 +
catcacaattaaaagaacta

SEQ ID NO: 23885 - DNA, 20 bp, Artificial Sequence
  Synthetic oligonucleotide; AAG chr11 5358068 5358087 5358084 +
cacaattaaaagaactagag

SEQ ID NO: 23886 - DNA, 20 bp, Artificial Sequence
  Synthetic oligonucleotide; AAG chr11 5358072 5358091 5358088 +
attaaaagaactagagaagc

SEQ ID NO: 23887 - DNA, 20 bp, Artificial Sequence
  Synthetic oligonucleotide; GAG chr11 5358074 5358093 5358090 +
taaaagaactagagaagcaa

SEQ ID NO: 23888 - DNA, 20 bp, Artificial Sequence
  Synthetic oligonucleotide; TAG chr11 5358094 5358113 5358110 +
gagcaaacacattcaaatgc

SEQ ID NO: 23889 - DNA, 20 bp, Artificial Sequence
  Synthetic oligonucleotide; CAG chr11 5358097 5358116 5358113 +
caaacacattcaaatgctag

SEQ ID NO: 23890 - DNA, 20 bp, Artificial Sequence
  Synthetic oligonucleotide; AAG chr11 5358100 5358119 5358116 +
acacattcaaatgctagcag

SEQ ID NO: 23891 - DNA, 20 bp, Artificial Sequence
  Synthetic oligonucleotide; AGG chr11 5358101 5358120 5358117 +
cacattcaaatgctagcaga

SEQ ID NO: 23892 - DNA, 20 bp, Artificial Sequence
  Synthetic oligonucleotide; AAG chr11 5358105 5358124 5358121 +
ttcaaatgctagcagaaggc

SEQ ID NO: 23893 - DNA, 20 bp, Artificial Sequence
  Synthetic oligonucleotide; CAG chr11 5358121 5358140 5358137 +
aggcaagaaataactaaaat

SEQ ID NO: 23894 - DNA, 20 bp, Artificial Sequence
  Synthetic oligonucleotide; GAG chr11 5358123 5358142 5358139 +
gcaagaaataactaaaatca

SEQ ID NO: 23895 - DNA, 20 bp, Artificial Sequence
  Synthetic oligonucleotide; CAG chr11 5358126 5358145 5358142 +
agaaataactaaaatcagag

SEQ ID NO: 23896 - DNA, 20 bp, Artificial Sequence
  Synthetic oligonucleotide; AAG chr11 5358134 5358153 5358150 +
ctaaaatcagagcagaactg

SEQ ID NO: 23897 - DNA, 20 bp, Artificial Sequence
  Synthetic oligonucleotide; AGG chr11 5358135 5358154 5358151 +
taaaatcagagcagaactga

SEQ ID NO: 23898 - DNA, 20 bp, Artificial Sequence
  Synthetic oligonucleotide; TAG chr11 5358141 5358160 5358157 +
cagagcagaactgaaggaaa

SEQ ID NO: 23899 - DNA, 20 bp, Artificial Sequence
  Synthetic oligonucleotide; GAG chr11 5358143 5358162 5358159 +
gagcagaactgaaggaaata

SEQ ID NO: 23900 - DNA, 20 bp, Artificial Sequence
  Synthetic oligonucleotide; CAG chr11 5358179 5358198 5358195 +
cttcaaaaaatcaatgaatc

SEQ ID NO: 23901 - DNA, 20 bp, Artificial Sequence
  Synthetic oligonucleotide; AAG chr11 5358182 5358201 5358198 +
caaaaaatcaatgaatccag

SEQ ID NO: 23902 - DNA, 20 bp, Artificial Sequence
  Synthetic oligonucleotide; TGG chr11 5358186 5358205 5358202 +
aaatcaatgaatccagaagc

SEQ ID NO: 23903 - DNA, 20 bp, Artificial Sequence
  Synthetic oligonucleotide; AAG chr11 5358198 5358217 5358214 +
ccagaagctggtttttcaaa

SEQ ID NO: 23904 - DNA, 20 bp, Artificial Sequence
  Synthetic oligonucleotide; TAG chr11 5358215 5358234 5358231 +
aaaaagatcaacaaaattga

SEQ ID NO: 23905 - DNA, 20 bp, Artificial Sequence
  Synthetic oligonucleotide; TAG chr11 5358223 5358242 5358239 +
caacaaaattgatagactgc

SEQ ID NO: 23906 - DNA, 20 bp, Artificial Sequence
  Synthetic oligonucleotide; AAG chr11 5358227 5358246 5358243 +
aaaattgatagactgctagc

SEQ ID NO: 23907 - DNA, 20 bp, Artificial Sequence
  Synthetic oligonucleotide; AAG chr11 5358237 5358256 5358253 +
gactgctagcaagactaata

SEQ ID NO: 23908 - DNA, 20 bp, Artificial Sequence
  Synthetic oligonucleotide; AAG chr11 5358240 5358259 5358256 +
tgctagcaagactaataaag

SEQ ID NO: 23909 - DNA, 20 bp, Artificial Sequence
  Synthetic oligonucleotide; AAG chr11 5358245 5358264 5358261 +
gcaagactaataaagaagaa

SEQ ID NO: 23910 - DNA, 20 bp, Artificial Sequence
  Synthetic oligonucleotide; GAG chr11 5358247 5358266 5358263 +
aagactaataaagaagaaaa

SEQ ID NO: 23911 - DNA, 20 bp, Artificial Sequence
  Synthetic oligonucleotide; GAG chr11 5358249 5358268 5358265 +
gactaataaagaagaaaaga

SEQ ID NO: 23912 - DNA, 20 bp, Artificial Sequence
  Synthetic oligonucleotide; AAG chr11 5358252 5358271 5358268 +
taataaagaagaaaagagag

SEQ ID NO: 23913 - DNA, 20 bp, Artificial Sequence
  Synthetic oligonucleotide; TAG chr11 5358262 5358281 5358278 +
gaaaagagagaagaatcaaa

SEQ ID NO: 23914 - DNA, 20 bp, Artificial Sequence
  Synthetic oligonucleotide; AAG chr11 5358283 5358302 5358299 +
agatgcaataaaaaatgata

SEQ ID NO: 23915 - DNA, 20 bp, Artificial Sequence
  Synthetic oligonucleotide; AGG chr11 5358284 5358303 5358300 +
gatgcaataaaaaatgataa

SEQ ID NO: 23916 - DNA, 20 bp, Artificial Sequence
  Synthetic oligonucleotide; GGG chr11 5358285 5358304 5358301 +
atgcaataaaaaatgataaa

SEQ ID NO: 23917 - DNA, 20 bp, Artificial Sequence
  Synthetic oligonucleotide; CAG chr11 5358307 5358326 5358323 +
gtatatcaccaccgatccca

SEQ ID NO: 23918 - DNA, 20 bp, Artificial Sequence
  Synthetic oligonucleotide; CAG chr11 5358326 5358345 5358342 +
acagaaatacaaaccaccat

SEQ ID NO: 23919 - DNA, 20 bp, Artificial Sequence
  Synthetic oligonucleotide; GAG chr11 5358328 5358347 5358344 +
agaaatacaaaccaccatca

SEQ ID NO: 23920 - DNA, 20 bp, Artificial Sequence
  Synthetic oligonucleotide; TAG chr11 5358361 5358380 5358377 +
acacctctacacaaataaac

SEQ ID NO: 23921 - DNA, 20 bp, Artificial Sequence
  Synthetic oligonucleotide; TAG chr11 5358370 5358389 5358386 +
cacaaataaactagaaaatc

SEQ ID NO: 23922 - DNA, 20 bp, Artificial Sequence
  Synthetic oligonucleotide; AAG chr11 5358373 5358392 5358389 +
aaataaactagaaaatctag

SEQ ID NO: 23923 - DNA, 20 bp, Artificial Sequence
  Synthetic oligonucleotide; TGG chr11 5358379 5358398 5358395 +
actagaaaatctagaagaaa

SEQ ID NO: 23924 - DNA, 20 bp, Artificial Sequence
  Synthetic oligonucleotide; AAG chr11 5358410 5358429 5358426 +
cttgacacatacaccctccc

SEQ ID NO: 23925 - DNA, 20 bp, Artificial Sequence
  Synthetic oligonucleotide; CAG chr11 5358420 5358439 5358436 +
acaccctcccaagactaaac

SEQ ID NO: 23926 - DNA, 20 bp, Artificial Sequence
  Synthetic oligonucleotide; AGG chr11 5358421 5358440 5358437 +
caccctcccaagactaaacc

SEQ ID NO: 23927 - DNA, 20 bp, Artificial Sequence
  Synthetic oligonucleotide; AAG chr11 5358424 5358443 5358440 +
cctcccaagactaaaccagg

SEQ ID NO: 23928 - DNA, 20 bp, Artificial Sequence
  Synthetic oligonucleotide; AAG chr11 5358427 5358446 5358443 +
cccaagactaaaccaggaag

SEQ ID NO: 23929 - DNA, 20 bp, Artificial Sequence
  Synthetic oligonucleotide; TAG chr11 5358443 5358462 5358459 +
gaagaagttgaatctctgaa

SEQ ID NO: 23930 - DNA, 20 bp, Artificial Sequence
  Synthetic oligonucleotide; CAG chr11 5358454 5358473 5358470 +
atctctgaatagaccaataa

SEQ ID NO: 23931 - DNA, 20 bp, Artificial Sequence
  Synthetic oligonucleotide; AGG chr11 5358455 5358474 5358471 +
tctctgaatagaccaataac

SEQ ID NO: 23932 - DNA, 20 bp, Artificial Sequence
  Synthetic oligonucleotide; GAG chr11 5358468 5358487 5358484 +
caataacaggatctgaaatt

SEQ ID NO: 23933 - DNA, 20 bp, Artificial Sequence
  Synthetic oligonucleotide; AGG chr11 5358469 5358488 5358485 +
aataacaggatctgaaattg

SEQ ID NO: 23934 - DNA, 20 bp, Artificial Sequence
  Synthetic oligonucleotide; TAG chr11 5358482 5358501 5358498 +
gaaattgaggcaataattaa

SEQ ID NO: 23935 - DNA, 20 bp, Artificial Sequence
  Synthetic oligonucleotide; CAG chr11 5358500 5358519 5358516 +
aatagcttaccaaccaaaaa

SEQ ID NO: 23936 - DNA, 20 bp, Artificial Sequence
  Synthetic oligonucleotide; CAG chr11 5358505 5358524 5358521 +
cttaccaaccaaaaacagtc

SEQ ID NO: 23937 - DNA, 20 bp, Artificial Sequence
  Synthetic oligonucleotide; AGG chr11 5358506 5358525 5358522 +
ttaccaaccaaaaacagtcc

SEQ ID NO: 23938 - DNA, 20 bp, Artificial Sequence
  Synthetic oligonucleotide; CAG chr11 5358511 5358530 5358527 +
aaccaaaaacagtccaggac

SEQ ID NO: 23939 - DNA, 20 bp, Artificial Sequence
  Synthetic oligonucleotide; TGG chr11 5358515 5358534 5358531 +
aaaaacagtccaggaccaga

SEQ ID NO: 23940 - DNA, 20 bp, Artificial Sequence
  Synthetic oligonucleotide; GAG chr11 5358517 5358536 5358533 +
aaacagtccaggaccagatg

SEQ ID NO: 23941 - DNA, 20 bp, Artificial Sequence
  Synthetic oligonucleotide; CAG chr11 5358523 5358542 5358539 +
tccaggaccagatggagtca

SEQ ID NO: 23942 - DNA, 20 bp, Artificial Sequence
  Synthetic oligonucleotide; CAG chr11 5358537 5358556 5358553 +
gagtcacagccaaattctac

SEQ ID NO: 23943 - DNA, 20 bp, Artificial Sequence
  Synthetic oligonucleotide; GAG chr11 5358539 5358558 5358555 +
gtcacagccaaattctacca

SEQ ID NO: 23944 - DNA, 20 bp, Artificial Sequence
  Synthetic oligonucleotide; AGG chr11 5358540 5358559 5358556 +
tcacagccaaattctaccag

SEQ ID NO: 23945 - DNA, 20 bp, Artificial Sequence
  Synthetic oligonucleotide; AAG chr11 5358546 5358565 5358562 +
ccaaattctaccagaggtac

SEQ ID NO: 23946 - DNA, 20 bp, Artificial Sequence
  Synthetic oligonucleotide; AGG chr11 5358547 5358566 5358563 +
caaattctaccagaggtaca

SEQ ID NO: 23947 - DNA, 20 bp, Artificial Sequence
  Synthetic oligonucleotide; GAG chr11 5358549 5358568 5358565 +
aattctaccagaggtacaag

SEQ ID NO: 23948 - DNA, 20 bp, Artificial Sequence
  Synthetic oligonucleotide; AGG chr11 5358550 5358569 5358566 +
attctaccagaggtacaagg

SEQ ID NO: 23949 - DNA, 20 bp, Artificial Sequence
  Synthetic oligonucleotide; GAG chr11 5358552 5358571 5358568 +
tctaccagaggtacaaggag

SEQ ID NO: 23950 - DNA, 20 bp, Artificial Sequence
  Synthetic oligonucleotide; TGG chr11 5358556 5358575 5358572 +
ccagaggtacaaggaggagc

SEQ ID NO: 23951 - DNA, 20 bp, Artificial Sequence
  Synthetic oligonucleotide; TAG chr11 5358589 5358608 5358605 +
tctgaaactattcgaatcaa

SEQ ID NO: 23952 - DNA, 20 bp, Artificial Sequence
  Synthetic oligonucleotide; AAG chr11 5358595 5358614 5358611 +
actattcgaatcaatagtaa

SEQ ID NO: 23953 - DNA, 20 bp, Artificial Sequence
  Synthetic oligonucleotide; GAG chr11 5358597 5358616 5358613 +
tattcgaatcaatagtaaaa

SEQ ID NO: 23954 - DNA, 20 bp, Artificial Sequence
  Synthetic oligonucleotide; AGG chr11 5358598 5358617 5358614 +
attcgaatcaatagtaaaag

SEQ ID NO: 23955 - DNA, 20 bp, Artificial Sequence
  Synthetic oligonucleotide; GGG chr11 5358599 5358618 5358615 +
ttcgaatcaatagtaaaaga

SEQ ID NO: 23956 - DNA, 20 bp, Artificial Sequence
  Synthetic oligonucleotide; GAG chr11 5358624 5358643 5358640 +
tcctccctaactcattttat

SEQ ID NO: 23957 - DNA, 20 bp, Artificial Sequence
  Synthetic oligonucleotide; AGG chr11 5358625 5358644 5358641 +
cctccctaactcattttatg

SEQ ID NO: 23958 - DNA, 20 bp, Artificial Sequence
  Synthetic oligonucleotide; CAG chr11 5358629 5358648 5358645 +
cctaactcattttatgaggc

SEQ ID NO: 23959 - DNA, 20 bp, Artificial Sequence
  Synthetic oligonucleotide; AAG chr11 5358648 5358667 5358664 +
ccagcatcatcctgatacca

SEQ ID NO: 23960 - DNA, 20 bp, Artificial Sequence
  Synthetic oligonucleotide; CGG chr11 5358652 5358671 5358668 +
catcatcctgataccaaagc

SEQ ID NO: 23961 - DNA, 20 bp, Artificial Sequence
  Synthetic oligonucleotide; GGG chr11 5358653 5358672 5358669 +
atcatcctgataccaaagcc

SEQ ID NO: 23962 - DNA, 20 bp, Artificial Sequence
  Synthetic oligonucleotide; CAG chr11 5358656 5358675 5358672 +
atcctgataccaaagccggg

SEQ ID NO: 23963 - DNA, 20 bp, Artificial Sequence
  Synthetic oligonucleotide; GAG chr11 5358658 5358677 5358674 +
cctgataccaaagccgggca

SEQ ID NO: 23964 - DNA, 20 bp, Artificial Sequence
  Synthetic oligonucleotide; AAG chr11 5358673 5358692 5358689 +
gggcagagacacaacaaaaa

SEQ ID NO: 23965 - DNA, 20 bp, Artificial Sequence
  Synthetic oligonucleotide; GAG chr11 5358675 5358694 5358691 +
gcagagacacaacaaaaaaa

SEQ ID NO: 23966 - DNA, 20 bp, Artificial Sequence
  Synthetic oligonucleotide; TAG chr11 5358683 5358702 5358699 +
acaacaaaaaaagagaattt

SEQ ID NO: 23967 - DNA, 20 bp, Artificial Sequence
  Synthetic oligonucleotide; TGG chr11 5358700 5358719 5358716 +
ttttagaccaatatccctga

SEQ ID NO: 23968 - DNA, 20 bp, Artificial Sequence
  Synthetic oligonucleotide; TGG chr11 5358733 5358752 5358749 +
aaaaaacctcaataaaatac

SEQ ID NO: 23969 - DNA, 20 bp, Artificial Sequence
  Synthetic oligonucleotide; AAG chr11 5358738 5358757 5358754 +
acctcaataaaatactggca

SEQ ID NO: 23970 - DNA, 20 bp, Artificial Sequence
  Synthetic oligonucleotide; CAG chr11 5358747 5358766 5358763 +
aaatactggcaaagcaaatc

SEQ ID NO: 23971 - DNA, 20 bp, Artificial Sequence
  Synthetic oligonucleotide; CAG chr11 5358750 5358769 5358766 +
tactggcaaagcaaatccag

SEQ ID NO: 23972 - DNA, 20 bp, Artificial Sequence
  Synthetic oligonucleotide; AAG chr11 5358762 5358781 5358778 +
aaatccagcagcacatccaa

SEQ ID NO: 23973 - DNA, 20 bp, Artificial Sequence
  Synthetic oligonucleotide; AAG chr11 5358781 5358800 5358797 +
aaagcttatccaccatgatc

SEQ ID NO: 23974 - DNA, 20 bp, Artificial Sequence
  Synthetic oligonucleotide; TGG chr11 5358784 5358803 5358800 +
gcttatccaccatgatcaag

SEQ ID NO: 23975 - DNA, 20 bp, Artificial Sequence
  Synthetic oligonucleotide; GGG chr11 5358785 5358804 5358801 +
cttatccaccatgatcaagt

SEQ ID NO: 23976 - DNA, 20 bp, Artificial Sequence
  Synthetic oligonucleotide; TGG chr11 5358797 5358816 5358813 +
gatcaagtgggcttcatccc

SEQ ID NO: 23977 - DNA, 20 bp, Artificial Sequence
  Synthetic oligonucleotide; GGG chr11 5358798 5358817 5358814 +
atcaagtgggcttcatccct

SEQ ID NO: 23978 - DNA, 20 bp, Artificial Sequence
  Synthetic oligonucleotide; AAG chr11 5358805 5358824 5358821 +
gggcttcatccctgggatgc

SEQ ID NO: 23979 - DNA, 20 bp, Artificial Sequence
  Synthetic oligonucleotide; AGG chr11 5358806 5358825 5358822 +
ggcttcatccctgggatgca

SEQ ID NO: 23980 - DNA, 20 bp, Artificial Sequence
  Synthetic oligonucleotide; TGG chr11 5358810 5358829 5358826 +
tcatccctgggatgcaaggc

SEQ ID NO: 23981 - DNA, 20 bp, Artificial Sequence
  Synthetic oligonucleotide; CAG chr11 5358843 5358862 5358859 +
gcaaatcaataaatgtaatc

SEQ ID NO: 23982 - DNA, 20 bp, Artificial Sequence
  Synthetic oligonucleotide; CAG chr11 5358854 5358873 5358870 +
aatgtaatccagcatataaa

SEQ ID NO: 23983 - DNA, 20 bp, Artificial Sequence
  Synthetic oligonucleotide; AAG chr11 5358862 5358881 5358878 +
ccagcatataaacagaacca

SEQ ID NO: 23984 - DNA, 20 bp, Artificial Sequence
  Synthetic oligonucleotide; TAG chr11 5358889 5358908 5358905 +
aaaccacatgattatctcaa

SEQ ID NO: 23985 - DNA, 20 bp, Artificial Sequence
  Synthetic oligonucleotide; CAG chr11 5358895 5358914 5358911 +
catgattatctcaatagatg

SEQ ID NO: 23986 - DNA, 20 bp, Artificial Sequence
  Synthetic oligonucleotide; AAG chr11 5358900 5358919 5358916 +
ttatctcaatagatgcagaa

SEQ ID NO: 23987 - DNA, 20 bp, Artificial Sequence
  Synthetic oligonucleotide; AGG chr11 5358901 5358920 5358917 +
tatctcaatagatgcagaaa

SEQ ID NO: 23988 - DNA, 20 bp, Artificial Sequence
  Synthetic oligonucleotide; TAG chr11 5358952 5358971 5358968 +
gctaaaaactctcaataaat

SEQ ID NO: 23989 - DNA, 20 bp, Artificial Sequence
  Synthetic oligonucleotide; AGG chr11 5358953 5358972 5358969 +
ctaaaaactctcaataaatt

SEQ ID NO: 23990 - DNA, 20 bp, Artificial Sequence
  Synthetic oligonucleotide; TGG chr11 5358962 5358981 5358978 +
ctcaataaattaggtattga

SEQ ID NO: 23991 - DNA, 20 bp, Artificial Sequence
  Synthetic oligonucleotide; GGG chr11 5358963 5358982 5358979 +
tcaataaattaggtattgat

SEQ ID NO: 23992 - DNA, 20 bp, Artificial Sequence
  Synthetic oligonucleotide; AAG chr11 5358983 5359002 5358999 +
gggacgtatctcaaaataat

SEQ ID NO: 23993 - DNA, 20 bp, Artificial Sequence
  Synthetic oligonucleotide; GAG chr11 5358985 5359004 5359001 +
gacgtatctcaaaataataa

SEQ ID NO: 23994 - DNA, 20 bp, Artificial Sequence
  Synthetic oligonucleotide; CAG chr11 5359006 5359025 5359022 +
agccatctatgacaaaccca

SEQ ID NO: 23995 - DNA, 20 bp, Artificial Sequence
  Synthetic oligonucleotide; TGG chr11 5359025 5359044 5359041 +
acagccaatatcatactgaa

SEQ ID NO: 23996 - DNA, 20 bp, Artificial Sequence
  Synthetic oligonucleotide; TGG chr11 5359036 5359055 5359052 +
catactgaatggacaaaaac

SEQ ID NO: 23997 - DNA, 20 bp, Artificial Sequence
  Synthetic oligonucleotide; AAG chr11 5359039 5359058 5359055 +
actgaatggacaaaaactgg

SEQ ID NO: 23998 - DNA, 20 bp, Artificial Sequence
  Synthetic oligonucleotide; TGG chr11 5359058 5359077 5359074 +
gaagcattccctttgaaaac

SEQ ID NO: 23999 - DNA, 20 bp, Artificial Sequence
  Synthetic oligonucleotide; AAG chr11 5359064 5359083 5359080 +
ttccctttgaaaactggcac

SEQ ID NO: 24000 - DNA, 20 bp, Artificial Sequence
  Synthetic oligonucleotide; CAG chr11 5359068 5359087 5359084 +
ctttgaaaactggcacaaga

SEQ ID NO: 24001 - DNA, 20 bp, Artificial Sequence
  Synthetic oligonucleotide; AGG chr11 5359069 5359088 5359085 +
tttgaaaactggcacaagac

SEQ ID NO: 24002 - DNA, 20 bp, Artificial Sequence
  Synthetic oligonucleotide; GGG chr11 5359070 5359089 5359086 +
ttgaaaactggcacaagaca

SEQ ID NO: 24003 - DNA, 20 bp, Artificial Sequence
  Synthetic oligonucleotide; TAG chr11 5359102 5359121 5359118 +
ctcactactcctattcaaca

SEQ ID NO: 24004 - DNA, 20 bp, Artificial Sequence
  Synthetic oligonucleotide; TGG chr11 5359108 5359127 5359124 +
actcctattcaacatagtgt

SEQ ID NO: 24005 - DNA, 20 bp, Artificial Sequence
  Synthetic oligonucleotide; TGG chr11 5359117 5359136 5359133 +
caacatagtgttggaatttc

SEQ ID NO: 24006 - DNA, 20 bp, Artificial Sequence
  Synthetic oligonucleotide; CAG chr11 5359121 5359140 5359137 +
atagtgttggaatttctggc

SEQ ID NO: 24007 - DNA, 20 bp, Artificial Sequence
  Synthetic oligonucleotide; AGG chr11 5359122 5359141 5359138 +
tagtgttggaatttctggcc

SEQ ID NO: 24008 - DNA, 20 bp, Artificial Sequence
  Synthetic oligonucleotide; GGG chr11 5359123 5359142 5359139 +
agtgttggaatttctggcca

SEQ ID NO: 24009 - DNA, 20 bp, Artificial Sequence
  Synthetic oligonucleotide; TAG chr11 5359130 5359149 5359146 +
gaatttctggccagggcaat

SEQ ID NO: 24010 - DNA, 20 bp, Artificial Sequence
  Synthetic oligonucleotide; AGG chr11 5359131 5359150 5359147 +
aatttctggccagggcaatt

SEQ ID NO: 24011 - DNA, 20 bp, Artificial Sequence
  Synthetic oligonucleotide; CAG chr11 5359134 5359153 5359150 +
ttctggccagggcaattagg

SEQ ID NO: 24012 - DNA, 20 bp, Artificial Sequence
  Synthetic oligonucleotide; AGG chr11 5359135 5359154 5359151 +
tctggccagggcaattaggc

SEQ ID NO: 24013 - DNA, 20 bp, Artificial Sequence
  Synthetic oligonucleotide; GAG chr11 5359137 5359156 5359153 +
tggccagggcaattaggcag

SEQ ID NO: 24014 - DNA, 20 bp, Artificial Sequence
  Synthetic oligonucleotide; AAG chr11 5359140 5359159 5359156 +
ccagggcaattaggcaggag

SEQ ID NO: 24015 - DNA, 20 bp, Artificial Sequence
  Synthetic oligonucleotide; AGG chr11 5359141 5359160 5359157 +
cagggcaattaggcaggaga

SEQ ID NO: 24016 - DNA, 20 bp, Artificial Sequence
  Synthetic oligonucleotide; AAG chr11 5359149 5359168 5359165 +
ttaggcaggagaaggaaaaa

SEQ ID NO: 24017 - DNA, 20 bp, Artificial Sequence
  Synthetic oligonucleotide; AGG chr11 5359150 5359169 5359166 +
taggcaggagaaggaaaaaa

SEQ ID NO: 24018 - DNA, 20 bp, Artificial Sequence
  Synthetic oligonucleotide; TAG chr11 5359161 5359180 5359177 +
aggaaaaaaaggtattcaat

SEQ ID NO: 24019 - DNA, 20 bp, Artificial Sequence
  Synthetic oligonucleotide; AGG chr11 5359162 5359181 5359178 +
ggaaaaaaaggtattcaatt

SEQ ID NO: 24020 - DNA, 20 bp, Artificial Sequence
  Synthetic oligonucleotide; AAG chr11 5359167 5359186 5359183 +
aaaaggtattcaattaggaa

SEQ ID NO: 24021 - DNA, 20 bp, Artificial Sequence
  Synthetic oligonucleotide; GAG chr11 5359169 5359188 5359185 +
aaggtattcaattaggaaaa

SEQ ID NO: 24022 - DNA, 20 bp, Artificial Sequence
  Synthetic oligonucleotide; AGG chr11 5359170 5359189 5359186 +
aggtattcaattaggaaaag

SEQ ID NO: 24023 - DNA, 20 bp, Artificial Sequence
  Synthetic oligonucleotide; AAG chr11 5359173 5359192 5359189 +
tattcaattaggaaaagagg

SEQ ID NO: 24024 - DNA, 20 bp, Artificial Sequence
  Synthetic oligonucleotide; CAG chr11 5359194 5359213 5359210 +
agtcaaattgtccctgtttg

SEQ ID NO: 24025 - DNA, 20 bp, Artificial Sequence
  Synthetic oligonucleotide; TAG chr11 5359215 5359234 5359231 +
agatgacacgattgtatatc

SEQ ID NO: 24026 - DNA, 20 bp, Artificial Sequence
  Synthetic oligonucleotide; CAG chr11 5359233 5359252 5359249 +
tctagaaaaccccactgtct

SEQ ID NO: 24027 - DNA, 20 bp, Artificial Sequence
  Synthetic oligonucleotide; TAG chr11 5359257 5359276 5359273 +
ccaaaatgtccttaaactga

SEQ ID NO: 24028 - DNA, 20 bp, Artificial Sequence
  Synthetic oligonucleotide; AGG chr11 5359258 5359277 5359274 +
caaaatgtccttaaactgat

SEQ ID NO: 24029 - DNA, 20 bp, Artificial Sequence
  Synthetic oligonucleotide; CAG chr11 5359267 5359286 5359283 +
cttaaactgataggcaactt

SEQ ID NO: 24030 - DNA, 20 bp, Artificial Sequence
  Synthetic oligonucleotide; AAG chr11 5359272 5359291 5359288 +
actgataggcaacttcagca

SEQ ID NO: 24031 - DNA, 20 bp, Artificial Sequence
  Synthetic oligonucleotide; CAG chr11 5359278 5359297 5359294 +
aggcaacttcagcaaagtct

SEQ ID NO: 24032 - DNA, 20 bp, Artificial Sequence
  Synthetic oligonucleotide; AGG chr11 5359279 5359298 5359295 +
ggcaacttcagcaaagtctc

SEQ ID NO: 24033 - DNA, 20 bp, Artificial Sequence
  Synthetic oligonucleotide; AAG chr11 5359308 5359327 5359324 +
aatcaatgtgcaaaaatcac

SEQ ID NO: 24034 - DNA, 20 bp, Artificial Sequence
  Synthetic oligonucleotide; CAG chr11 5359330 5359349 5359346 +
gcattcttatacaccaataa

SEQ ID NO: 24035 - DNA, 20 bp, Artificial Sequence
  Synthetic oligonucleotide; CAG chr11 5359338 5359357 5359354 +
atacaccaataacagacaaa

SEQ ID NO: 24036 - DNA, 20 bp, Artificial Sequence
  Synthetic oligonucleotide; GAG chr11 5359340 5359359 5359356 +
acaccaataacagacaaaca

SEQ ID NO: 24037 - DNA, 20 bp, Artificial Sequence
  Synthetic oligonucleotide; GAG chr11 5359342 5359361 5359358 +
accaataacagacaaacaga

SEQ ID NO: 24038 - DNA, 20 bp, Artificial Sequence
  Synthetic oligonucleotide; GAG chr11 5359354 5359373 5359370 +
caaacagagagccaaatcat

SEQ ID NO: 24039 - DNA, 20 bp, Artificial Sequence
  Synthetic oligonucleotide; AGG chr11 5359355 5359374 5359371 +
aaacagagagccaaatcatg

SEQ ID NO: 24040 - DNA, 20 bp, Artificial Sequence
  Synthetic oligonucleotide; GGG chr11 5359356 5359375 5359372 +
aacagagagccaaatcatga

SEQ ID NO: 24041 - DNA, 20 bp, Artificial Sequence
  Synthetic oligonucleotide; AAG chr11 5359382 5359401 5359398 +
tcccattcacaattgcttca

SEQ ID NO: 24042 - DNA, 20 bp, Artificial Sequence
  Synthetic oligonucleotide; GAG chr11 5359384 5359403 5359400 +
ccattcacaattgcttcaaa

SEQ ID NO: 24043 - DNA, 20 bp, Artificial Sequence
  Synthetic oligonucleotide; TAG chr11 5359398 5359417 5359414 +
ttcaaagagaataaaatacc

SEQ ID NO: 24044 - DNA, 20 bp, Artificial Sequence
  Synthetic oligonucleotide; AGG chr11 5359399 5359418 5359415 +
tcaaagagaataaaatacct

SEQ ID NO: 24045 - DNA, 20 bp, Artificial Sequence
  Synthetic oligonucleotide; AAG chr11 5359414 5359433 5359430 +
tacctaggaatccaacttac

SEQ ID NO: 24046 - DNA, 20 bp, Artificial Sequence
  Synthetic oligonucleotide; GAG chr11 5359416 5359435 5359432 +
cctaggaatccaacttacaa

SEQ ID NO: 24047 - DNA, 20 bp, Artificial Sequence
  Synthetic oligonucleotide; GAG chr11 5359418 5359437 5359434 +
taggaatccaacttacaaga

SEQ ID NO: 24048 - DNA, 20 bp, Artificial Sequence
  Synthetic oligonucleotide; AGG chr11 5359419 5359438 5359435 +
aggaatccaacttacaagag

SEQ ID NO: 24049 - DNA, 20 bp, Artificial Sequence
  Synthetic oligonucleotide; AAG chr11 5359424 5359443 5359440 +
tccaacttacaagagaggtg

SEQ ID NO: 24050 - DNA, 20 bp, Artificial Sequence
  Synthetic oligonucleotide; AGG chr11 5359425 5359444 5359441 +
ccaacttacaagagaggtga

SEQ ID NO: 24051 - DNA, 20 bp, Artificial Sequence
  Synthetic oligonucleotide; AAG chr11 5359436 5359455 5359452 +
gagaggtgaaggacctcttc

SEQ ID NO: 24052 - DNA, 20 bp, Artificial Sequence
  Synthetic oligonucleotide; AGG chr11 5359437 5359456 5359453 +
agaggtgaaggacctcttca

SEQ ID NO: 24053 - DNA, 20 bp, Artificial Sequence
  Synthetic oligonucleotide; GAG chr11 5359439 5359458 5359455 +
aggtgaaggacctcttcaag

SEQ ID NO: 24054 - DNA, 20 bp, Artificial Sequence
  Synthetic oligonucleotide; AAG chr11 5359470 5359489 5359486 +
accactgctgaatgaaataa

SEQ ID NO: 24055 - DNA, 20 bp, Artificial Sequence
  Synthetic oligonucleotide; AAG chr11 5359473 5359492 5359489 +
actgctgaatgaaataaaag

SEQ ID NO: 24056 - DNA, 20 bp, Artificial Sequence
  Synthetic oligonucleotide; TGG chr11 5359487 5359506 5359503 +
taaaagaagatacaaacaaa

SEQ ID NO: 24057 - DNA, 20 bp, Artificial Sequence
  Synthetic oligonucleotide; AAG chr11 5359490 5359509 5359506 +
aagaagatacaaacaaatgg

SEQ ID NO: 24058 - DNA, 20 bp, Artificial Sequence
  Synthetic oligonucleotide; TGG chr11 5359508 5359527 5359524 +
ggaagaacattccatgctca

SEQ ID NO: 24059 - DNA, 20 bp, Artificial Sequence
  Synthetic oligonucleotide; GGG chr11 5359509 5359528 5359525 +
gaagaacattccatgctcat

SEQ ID NO: 24060 - DNA, 20 bp, Artificial Sequence
  Synthetic oligonucleotide; TAG chr11 5359512 5359531 5359528 +
gaacattccatgctcatggg

SEQ ID NO: 24061 - DNA, 20 bp, Artificial Sequence
  Synthetic oligonucleotide; AGG chr11 5359513 5359532 5359529 +
aacattccatgctcatgggt

SEQ ID NO: 24062 - DNA, 20 bp, Artificial Sequence
  Synthetic oligonucleotide; AAG chr11 5359516 5359535 5359532 +
attccatgctcatgggtagg

SEQ ID NO: 24063 - DNA, 20 bp, Artificial Sequence
  Synthetic oligonucleotide; TGG chr11 5359536 5359555 5359552 +
aagaatcaatatcatgaaaa

SEQ ID NO: 24064 - DNA, 20 bp, Artificial Sequence
  Synthetic oligonucleotide; CAG chr11 5359544 5359563 5359560 +
atatcatgaaaatggccata

SEQ ID NO: 24065 - DNA, 20 bp, Artificial Sequence
  Synthetic oligonucleotide; AAG chr11 5359550 5359569 5359566 +
tgaaaatggccatacagccc

SEQ ID NO: 24066 - DNA, 20 bp, Artificial Sequence
  Synthetic oligonucleotide; AGG chr11 5359551 5359570 5359567 +
gaaaatggccatacagccca

SEQ ID NO: 24067 - DNA, 20 bp, Artificial Sequence
  Synthetic oligonucleotide; TAG chr11 5359561 5359580 5359577 +
atacagcccaaggtaattta

SEQ ID NO: 24068 - DNA, 20 bp, Artificial Sequence
  Synthetic oligonucleotide; AAG chr11 5359583 5359602 5359599 +
gattcaatgccatccccatc

SEQ ID NO: 24069 - DNA, 20 bp, Artificial Sequence
  Synthetic oligonucleotide; CAG chr11 5359605 5359624 5359621 +
gctaccaatgactttcttca

SEQ ID NO: 24070 - DNA, 20 bp, Artificial Sequence
  Synthetic oligonucleotide; TGG chr11 5359611 5359630 5359627 +
aatgactttcttcacagaat

SEQ ID NO: 24071 - DNA, 20 bp, Artificial Sequence
  Synthetic oligonucleotide; AAG chr11 5359628 5359647 5359644 +
aattggaaaaaactacttta

SEQ ID NO: 24072 - DNA, 20 bp, Artificial Sequence
  Synthetic oligonucleotide; TGG chr11 5359637 5359656 5359653 +
aaactactttaaagttcata

SEQ ID NO: 24073 - DNA, 20 bp, Artificial Sequence
  Synthetic oligonucleotide; AAG chr11 5359648 5359667 5359664 +
aagttcatatggaaccaaaa

SEQ ID NO: 24074 - DNA, 20 bp, Artificial Sequence
  Synthetic oligonucleotide; GAG chr11 5359650 5359669 5359666 +
gttcatatggaaccaaaaaa

SEQ ID NO: 24075 - DNA, 20 bp, Artificial Sequence
  Synthetic oligonucleotide; AAG chr11 5359675 5359694 5359691 +
cacattgacatgccaatcct

SEQ ID NO: 24076 - DNA, 20 bp, Artificial Sequence
  Synthetic oligonucleotide; AAG chr11 5359682 5359701 5359698 +
acatgccaatcctaagccaa

SEQ ID NO: 24077 - DNA, 20 bp, Artificial Sequence
  Synthetic oligonucleotide; AAG chr11 5359689 5359708 5359705 +
aatcctaagccaaaagaaca

SEQ ID NO: 24078 - DNA, 20 bp, Artificial Sequence
  Synthetic oligonucleotide; TGG chr11 5359693 5359712 5359709 +
ctaagccaaaagaacaaagc

SEQ ID NO: 24079 - DNA, 20 bp, Artificial Sequence
  Synthetic oligonucleotide; GAG chr11 5359695 5359714 5359711 +
aagccaaaagaacaaagctg

SEQ ID NO: 24080 - DNA, 20 bp, Artificial Sequence
  Synthetic oligonucleotide; AGG chr11 5359696 5359715 5359712 +
agccaaaagaacaaagctgg

SEQ ID NO: 24081 - DNA, 20 bp, Artificial Sequence
  Synthetic oligonucleotide; AAG chr11 5359730 5359749 5359746 +
ctgacttcaaactatactac

SEQ ID NO: 24082 - DNA, 20 bp, Artificial Sequence
  Synthetic oligonucleotide; AGG chr11 5359731 5359750 5359747 +
tgacttcaaactatactaca

SEQ ID NO: 24083 - DNA, 20 bp, Artificial Sequence
  Synthetic oligonucleotide; CAG chr11 5359737 5359756 5359753 +
caaactatactacaaggcta

SEQ ID NO: 24084 - DNA, 20 bp, Artificial Sequence
  Synthetic oligonucleotide; CAG chr11 5359749 5359768 5359765 +
caaggctacagtaaccaaaa

SEQ ID NO: 24085 - DNA, 20 bp, Artificial Sequence
  Synthetic oligonucleotide; TGG chr11 5359754 5359773 5359770 +
ctacagtaaccaaaacagca

SEQ ID NO: 24086 - DNA, 20 bp, Artificial Sequence
  Synthetic oligonucleotide; TGG chr11 5359760 5359779 5359776 +
taaccaaaacagcatggtac

SEQ ID NO: 24087 - DNA, 20 bp, Artificial Sequence
  Synthetic oligonucleotide; CAG chr11 5359771 5359790 5359787 +
gcatggtactggtaccaaaa

SEQ ID NO: 24088 - DNA, 20 bp, Artificial Sequence
  Synthetic oligonucleotide; GAG chr11 5359773 5359792 5359789 +
atggtactggtaccaaaaca

SEQ ID NO: 24089 - DNA, 20 bp, Artificial Sequence
  Synthetic oligonucleotide; TAG chr11 5359779 5359798 5359795 +
ctggtaccaaaacagagata

SEQ ID NO: 24090 - DNA, 20 bp, Artificial Sequence
  Synthetic oligonucleotide; TGG chr11 5359787 5359806 5359803 +
aaaacagagatatagaccaa

SEQ ID NO: 24091 - DNA, 20 bp, Artificial Sequence
  Synthetic oligonucleotide; CAG chr11 5359792 5359811 5359808 +
agagatatagaccaatggaa

SEQ ID NO: 24092 - DNA, 20 bp, Artificial Sequence
  Synthetic oligonucleotide; CAG chr11 5359797 5359816 5359813 +
tatagaccaatggaacagaa

SEQ ID NO: 24093 - DNA, 20 bp, Artificial Sequence
  Synthetic oligonucleotide; GAG chr11 5359799 5359818 5359815 +
tagaccaatggaacagaaca

SEQ ID NO: 24094 - DNA, 20 bp, Artificial Sequence
  Synthetic oligonucleotide; AGG chr11 5359800 5359819 5359816 +
agaccaatggaacagaacag

SEQ ID NO: 24095 - DNA, 20 bp, Artificial Sequence
  Synthetic oligonucleotide; CAG chr11 5359806 5359825 5359822 +
atggaacagaacagaggcct

SEQ ID NO: 24096 - DNA, 20 bp, Artificial Sequence
  Synthetic oligonucleotide; TGG chr11 5359868 5359887 5359884 +
aacctgacaaaaaaaacaaa

SEQ ID NO: 24097 - DNA, 20 bp, Artificial Sequence
  Synthetic oligonucleotide; GGG chr11 5359869 5359888 5359885 +
acctgacaaaaaaaacaaat

SEQ ID NO: 24098 - DNA, 20 bp, Artificial Sequence
  Synthetic oligonucleotide; GGG chr11 5359870 5359889 5359886 +
cctgacaaaaaaaacaaatg

SEQ ID NO: 24099 - DNA, 20 bp, Artificial Sequence
  Synthetic oligonucleotide; AAG chr11 5359874 5359893 5359890 +
acaaaaaaaacaaatgggga

SEQ ID NO: 24100 - DNA, 20 bp, Artificial Sequence
  Synthetic oligonucleotide; AGG chr11 5359875 5359894 5359891 +
caaaaaaaacaaatggggaa

SEQ ID NO: 24101 - DNA, 20 bp, Artificial Sequence
  Synthetic oligonucleotide; TGG chr11 5359895 5359914 5359911 +
aggattccctatttaataaa

SEQ ID NO: 24102 - DNA, 20 bp, Artificial Sequence
  Synthetic oligonucleotide; TGG chr11 5359901 5359920 5359917 +
ccctatttaataaatggtgc

SEQ ID NO: 24103 - DNA, 20 bp, Artificial Sequence
  Synthetic oligonucleotide; GGG chr11 5359902 5359921 5359918 +
cctatttaataaatggtgct

SEQ ID NO: 24104 - DNA, 20 bp, Artificial Sequence
  Synthetic oligonucleotide; TGG chr11 5359910 5359929 5359926 +
ataaatggtgctgggaaaac

SEQ ID NO: 24105 - DNA, 20 bp, Artificial Sequence
  Synthetic oligonucleotide; CAG chr11 5359924 5359943 5359940 +
gaaaactggctaaccatacg

SEQ ID NO: 24106 - DNA, 20 bp, Artificial Sequence
  Synthetic oligonucleotide; AAG chr11 5359928 5359947 5359944 +
actggctaaccatacgcaga

SEQ ID NO: 24107 - DNA, 20 bp, Artificial Sequence
  Synthetic oligonucleotide; TGG chr11 5359938 5359957 5359954 +
catacgcagaaagctgaaac

SEQ ID NO: 24108 - DNA, 20 bp, Artificial Sequence
  Synthetic oligonucleotide; AAG chr11 5359975 5359994 5359991 +
ccttatacaaaaattaattc

SEQ ID NO: 24109 - DNA, 20 bp, Artificial Sequence
  Synthetic oligonucleotide; TGG chr11 5359979 5359998 5359995 +
atacaaaaattaattcaaga

SEQ ID NO: 24110 - DNA, 20 bp, Artificial Sequence
  Synthetic oligonucleotide; CAG chr11 5359986 5360005 5360002 +
aattaattcaagatggatta

SEQ ID NO: 24111 - DNA, 20 bp, Artificial Sequence
  Synthetic oligonucleotide; TAG chr11 5359999 5360018 5360015 +
tggattacagacttaaatgt

SEQ ID NO: 24112 - DNA, 20 bp, Artificial Sequence
  Synthetic oligonucleotide; TGG chr11 5360022 5360041 5360038 +
actgaaaaccataaaaactc

SEQ ID NO: 24113 - DNA, 20 bp, Artificial Sequence
  Synthetic oligonucleotide; AAG chr11 5360025 5360044 5360041 +
gaaaaccataaaaactctgg

SEQ ID NO: 24114 - DNA, 20 bp, Artificial Sequence
  Synthetic oligonucleotide; TAG chr11 5360034 5360053 5360050 +
aaaaactctggaagaaaacc

SEQ ID NO: 24115 - DNA, 20 bp, Artificial Sequence
  Synthetic oligonucleotide; AGG chr11 5360035 5360054 5360051 +
aaaactctggaagaaaacct

SEQ ID NO: 24116 - DNA, 20 bp, Artificial Sequence
  Synthetic oligonucleotide; CAG chr11 5360048 5360067 5360064 +
aaaacctaggcaataccatt

SEQ ID NO: 24117 - DNA, 20 bp, Artificial Sequence
  Synthetic oligonucleotide; AGG chr11 5360049 5360068 5360065 +
aaacctaggcaataccattc

SEQ ID NO: 24118 - DNA, 20 bp, Artificial Sequence
  Synthetic oligonucleotide; TAG chr11 5360055 5360074 5360071 +
aggcaataccattcaggaca

SEQ ID NO: 24119 - DNA, 20 bp, Artificial Sequence
  Synthetic oligonucleotide; AGG chr11 5360056 5360075 5360072 +
ggcaataccattcaggacat

SEQ ID NO: 24120 - DNA, 20 bp, Artificial Sequence
  Synthetic oligonucleotide; TGG chr11 5360061 5360080 5360077 +
taccattcaggacataggca

SEQ ID NO: 24121 - DNA, 20 bp, Artificial Sequence
  Synthetic oligonucleotide; GGG chr11 5360062 5360081 5360078 +
accattcaggacataggcat

SEQ ID NO: 24122 - DNA, 20 bp, Artificial Sequence
  Synthetic oligonucleotide; AAG chr11 5360066 5360085 5360082 +
ttcaggacataggcatgggc

SEQ ID NO: 24123 - DNA, 20 bp, Artificial Sequence
  Synthetic oligonucleotide; AGG chr11 5360067 5360086 5360083 +
tcaggacataggcatgggca

SEQ ID NO: 24124 - DNA, 20 bp, Artificial Sequence
  Synthetic oligonucleotide; AAG chr11 5360091 5360110 5360107 +
cttcatgtctaaaacaccaa

SEQ ID NO: 24125 - DNA, 20 bp, Artificial Sequence
  Synthetic oligonucleotide; TGG chr11 5360097 5360116 5360113 +
gtctaaaacaccaaaagcaa

SEQ ID NO: 24126 - DNA, 20 bp, Artificial Sequence
  Synthetic oligonucleotide; AAG chr11 5360106 5360125 5360122 +
accaaaagcaatggcaacaa

SEQ ID NO: 24127 - DNA, 20 bp, Artificial Sequence
  Synthetic oligonucleotide; TGG chr11 5360115 5360134 5360131 +
aatggcaacaaaagccaaaa

SEQ ID NO: 24128 - DNA, 20 bp, Artificial Sequence
  Synthetic oligonucleotide; TGG chr11 5360123 5360142 5360139 +
caaaagccaaaatggacaaa

SEQ ID NO: 24129 - DNA, 20 bp, Artificial Sequence
  Synthetic oligonucleotide; GGG chr11 5360124 5360143 5360140 +
aaaagccaaaatggacaaat

SEQ ID NO: 24130 - DNA, 20 bp, Artificial Sequence
  Synthetic oligonucleotide; AAG chr11 5360141 5360160 5360157 +
aatgggatctaattaaacta

SEQ ID NO: 24131 - DNA, 20 bp, Artificial Sequence
  Synthetic oligonucleotide; GAG chr11 5360143 5360162 5360159 +
tgggatctaattaaactaaa

SEQ ID NO: 24132 - DNA, 20 bp, Artificial Sequence
  Synthetic oligonucleotide; CAG chr11 5360154 5360173 5360170 +
taaactaaagagcttctgca

SEQ ID NO: 24133 - DNA, 20 bp, Artificial Sequence
  Synthetic oligonucleotide; AAG chr11 5360160 5360179 5360176 +
aaagagcttctgcacagcaa

SEQ ID NO: 24134 - DNA, 20 bp, Artificial Sequence
  Synthetic oligonucleotide; CAG chr11 5360173 5360192 5360189 +
acagcaaaagaaactaccat

SEQ ID NO: 24135 - DNA, 20 bp, Artificial Sequence
  Synthetic oligonucleotide; GAG chr11 5360175 5360194 5360191 +
agcaaaagaaactaccatca

SEQ ID NO: 24136 - DNA, 20 bp, Artificial Sequence
  Synthetic oligonucleotide; CAG chr11 5360182 5360201 5360198 +
gaaactaccatcagagtgaa

SEQ ID NO: 24137 - DNA, 20 bp, Artificial Sequence
  Synthetic oligonucleotide; AGG chr11 5360183 5360202 5360199 +
aaactaccatcagagtgaac

SEQ ID NO: 24138 - DNA, 20 bp, Artificial Sequence
  Synthetic oligonucleotide; CAG chr11 5360193 5360212 5360209 +
cagagtgaacaggcaacata

SEQ ID NO: 24139 - DNA, 20 bp, Artificial Sequence
  Synthetic oligonucleotide; TGG chr11 5360198 5360217 5360214 +
tgaacaggcaacatacagaa

SEQ ID NO: 24140 - DNA, 20 bp, Artificial Sequence
  Synthetic oligonucleotide; GGG chr11 5360199 5360218 5360215 +
gaacaggcaacatacagaat

SEQ ID NO: 24141 - DNA, 20 bp, Artificial Sequence
  Synthetic oligonucleotide; GAG chr11 5360201 5360220 5360217 +
acaggcaacatacagaatgg

SEQ ID NO: 24142 - DNA, 20 bp, Artificial Sequence
  Synthetic oligonucleotide; AAG chr11 5360232 5360251 5360248 +
tgcaatctactcatccgaca

SEQ ID NO: 24143 - DNA, 20 bp, Artificial Sequence
  Synthetic oligonucleotide; AGG chr11 5360233 5360252 5360249 +
gcaatctactcatccgacaa

SEQ ID NO: 24144 - DNA, 20 bp, Artificial Sequence
  Synthetic oligonucleotide; GGG chr11 5360234 5360253 5360250 +
caatctactcatccgacaaa

SEQ ID NO: 24145 - DNA, 20 bp, Artificial Sequence
  Synthetic oligonucleotide; CAG chr11 5360245 5360264 5360261 +
tccgacaaagggctaatatc

SEQ ID NO: 24146 - DNA, 20 bp, Artificial Sequence
  Synthetic oligonucleotide; AAG chr11 5360276 5360295 5360292 +
atgaactcaaacaaatttac

SEQ ID NO: 24147 - DNA, 20 bp, Artificial Sequence
  Synthetic oligonucleotide; AAG chr11 5360299 5360318 5360315 +
aaaaaaacaaccccatcaaa

SEQ ID NO: 24148 - DNA, 20 bp, Artificial Sequence
  Synthetic oligonucleotide; TGG chr11 5360302 5360321 5360318 +
aaaacaaccccatcaaaaag

SEQ ID NO: 24149 - DNA, 20 bp, Artificial Sequence
  Synthetic oligonucleotide; GGG chr11 5360303 5360322 5360319 +
aaacaaccccatcaaaaagt

SEQ ID NO: 24150 - DNA, 20 bp, Artificial Sequence
  Synthetic oligonucleotide; AAG chr11 5360308 5360327 5360324 +
accccatcaaaaagtgggca

SEQ ID NO: 24151 - DNA, 20 bp, Artificial Sequence
  Synthetic oligonucleotide; AGG chr11 5360309 5360328 5360325 +
ccccatcaaaaagtgggcaa

SEQ ID NO: 24152 - DNA, 20 bp, Artificial Sequence
  Synthetic oligonucleotide; CAG chr11 5360319 5360338 5360335 +
aagtgggcaaaggatatgaa

SEQ ID NO: 24153 - DNA, 20 bp, Artificial Sequence
  Synthetic oligonucleotide; AAG chr11 5360333 5360352 5360349 +
tatgaacagacacttctcaa

SEQ ID NO: 24154 - DNA, 20 bp, Artificial Sequence
  Synthetic oligonucleotide; AAG chr11 5360336 5360355 5360352 +
gaacagacacttctcaaaag

SEQ ID NO: 24155 - DNA, 20 bp, Artificial Sequence
  Synthetic oligonucleotide; CAG chr11 5360348 5360367 5360364 +
ctcaaaagaagacatttatg

SEQ ID NO: 24156 - DNA, 20 bp, Artificial Sequence
  Synthetic oligonucleotide; CAG chr11 5360355 5360374 5360371 +
gaagacatttatgcagtcaa

SEQ ID NO: 24157 - DNA, 20 bp, Artificial Sequence
  Synthetic oligonucleotide; TGG chr11 5360384 5360403 5360400 +
gaaaaaatgctcatcatcac

SEQ ID NO: 24158 - DNA, 20 bp, Artificial Sequence
  Synthetic oligonucleotide; CAG chr11 5360391 5360410 5360407 +
tgctcatcatcactggccat

SEQ ID NO: 24159 - DNA, 20 bp, Artificial Sequence
  Synthetic oligonucleotide; GAG chr11 5360393 5360412 5360409 +
ctcatcatcactggccatca

SEQ ID NO: 24160 - DNA, 20 bp, Artificial Sequence
  Synthetic oligonucleotide; CAG chr11 5360414 5360433 5360430 +
agaaatacaaatcaaaacca

SEQ ID NO: 24161 - DNA, 20 bp, Artificial Sequence
  Synthetic oligonucleotide; GAG chr11 5360418 5360437 5360434 +
atacaaatcaaaaccacagt

SEQ ID NO: 24162 - DNA, 20 bp, Artificial Sequence
  Synthetic oligonucleotide; CAG chr11 5360435 5360454 5360451 +
agtgagataccatctcacac

SEQ ID NO: 24163 - DNA, 20 bp, Artificial Sequence
  Synthetic oligonucleotide; TAG chr11 5360439 5360458 5360455 +
agataccatctcacaccagt

SEQ ID NO: 24164 - DNA, 20 bp, Artificial Sequence
  Synthetic oligonucleotide; TGG chr11 5360444 5360463 5360460 +
ccatctcacaccagttagaa

SEQ ID NO: 24165 - DNA, 20 bp, Artificial Sequence
  Synthetic oligonucleotide; AAG chr11 5360458 5360477 5360474 +
ttagaatggcgatcattaaa

SEQ ID NO: 24166 - DNA, 20 bp, Artificial Sequence
  Synthetic oligonucleotide; CAG chr11 5360462 5360481 5360478 +
aatggcgatcattaaaaagt

SEQ ID NO: 24167 - DNA, 20 bp, Artificial Sequence
  Synthetic oligonucleotide; AGG chr11 5360463 5360482 5360479 +
atggcgatcattaaaaagtc

SEQ ID NO: 24168 - DNA, 20 bp, Artificial Sequence
  Synthetic oligonucleotide; CAG chr11 5360472 5360491 5360488 +
attaaaaagtcaggaaacaa

SEQ ID NO: 24169 - DNA, 20 bp, Artificial Sequence
  Synthetic oligonucleotide; AGG chr11 5360473 5360492 5360489 +
ttaaaaagtcaggaaacaac

SEQ ID NO: 24170 - DNA, 20 bp, Artificial Sequence
  Synthetic oligonucleotide; TGG chr11 5360479 5360498 5360495 +
agtcaggaaacaacaggtgc

SEQ ID NO: 24171 - DNA, 20 bp, Artificial Sequence
  Synthetic oligonucleotide; GAG chr11 5360481 5360500 5360497 +
tcaggaaacaacaggtgctg

SEQ ID NO: 24172 - DNA, 20 bp, Artificial Sequence
  Synthetic oligonucleotide; GAG chr11 5360483 5360502 5360499 +
aggaaacaacaggtgctgga

SEQ ID NO: 24173 - DNA, 20 bp, Artificial Sequence
  Synthetic oligonucleotide; AGG chr11 5360484 5360503 5360500 +
ggaaacaacaggtgctggag

SEQ ID NO: 24174 - DNA, 20 bp, Artificial Sequence
  Synthetic oligonucleotide; AAG chr11 5360492 5360511 5360508 +
caggtgctggagaggatgtg

SEQ ID NO: 24175 - DNA, 20 bp, Artificial Sequence
  Synthetic oligonucleotide; AAG chr11 5360495 5360514 5360511 +
gtgctggagaggatgtgaag

SEQ ID NO: 24176 - DNA, 20 bp, Artificial Sequence
  Synthetic oligonucleotide; TAG chr11 5360498 5360517 5360514 +
ctggagaggatgtgaagaag

SEQ ID NO: 24177 - DNA, 20 bp, Artificial Sequence
  Synthetic oligonucleotide; AGG chr11 5360499 5360518 5360515 +
tggagaggatgtgaagaagt

SEQ ID NO: 24178 - DNA, 20 bp, Artificial Sequence
  Synthetic oligonucleotide; TGG chr11 5360518 5360537 5360534 +
taggaacacttttacactgt

SEQ ID NO: 24179 - DNA, 20 bp, Artificial Sequence
  Synthetic oligonucleotide; GAG chr11 5360522 5360541 5360538 +
aacacttttacactgttggt

SEQ ID NO: 24180 - DNA, 20 bp, Artificial Sequence
  Synthetic oligonucleotide; TAG chr11 5360534 5360553 5360550 +
ctgttggtgagactgtaaac

SEQ ID NO: 24181 - DNA, 20 bp, Artificial Sequence
  Synthetic oligonucleotide; TGG chr11 5360548 5360567 5360564 +
gtaaactagttcaaccattg

SEQ ID NO: 24182 - DNA, 20 bp, Artificial Sequence
  Synthetic oligonucleotide; AAG chr11 5360551 5360570 5360567 +
aactagttcaaccattgtgg

SEQ ID NO: 24183 - DNA, 20 bp, Artificial Sequence
  Synthetic oligonucleotide; CAG chr11 5360555 5360574 5360571 +
agttcaaccattgtggaagt

SEQ ID NO: 24184 - DNA, 20 bp, Artificial Sequence
  Synthetic oligonucleotide; TGG chr11 5360560 5360579 5360576 +
aaccattgtggaagtcagtg

SEQ ID NO: 24185 - DNA, 20 bp, Artificial Sequence
  Synthetic oligonucleotide; CAG chr11 5360571 5360590 5360587 +
aagtcagtgtggcgattcct

SEQ ID NO: 24186 - DNA, 20 bp, Artificial Sequence
  Synthetic oligonucleotide; AGG chr11 5360572 5360591 5360588 +
agtcagtgtggcgattcctc

SEQ ID NO: 24187 - DNA, 20 bp, Artificial Sequence
  Synthetic oligonucleotide; GGG chr11 5360573 5360592 5360589 +
gtcagtgtggcgattcctca

SEQ ID NO: 24188 - DNA, 20 bp, Artificial Sequence
  Synthetic oligonucleotide; TAG chr11 5360579 5360598 5360595 +
gtggcgattcctcagggatc

SEQ ID NO: 24189 - DNA, 20 bp, Artificial Sequence
  Synthetic oligonucleotide; TAG chr11 5360585 5360604 5360601 +
attcctcagggatctagaac

SEQ ID NO: 24190 - DNA, 20 bp, Artificial Sequence
  Synthetic oligonucleotide; CAG chr11 5360603 5360622 5360619 +
actagaaataccatttgacc

SEQ ID NO: 24191 - DNA, 20 bp, Artificial Sequence
  Synthetic oligonucleotide; TGG chr11 5360618 5360637 5360634 +
tgacccagccatcccattac

SEQ ID NO: 24192 - DNA, 20 bp, Artificial Sequence
  Synthetic oligonucleotide; GGG chr11 5360619 5360638 5360635 +
gacccagccatcccattact

SEQ ID NO: 24193 - DNA, 20 bp, Artificial Sequence
  Synthetic oligonucleotide; AAG chr11 5360632 5360651 5360648 +
cattactgggtacatactca

SEQ ID NO: 24194 - DNA, 20 bp, Artificial Sequence
  Synthetic oligonucleotide; AGG chr11 5360633 5360652 5360649 +
attactgggtacatactcaa

SEQ ID NO: 24195 - DNA, 20 bp, Artificial Sequence
  Synthetic oligonucleotide; AAG chr11 5360657 5360676 5360673 +
ttataaatcatgctgctata

SEQ ID NO: 24196 - DNA, 20 bp, Artificial Sequence
  Synthetic oligonucleotide; TGG chr11 5360684 5360703 5360700 +
atgcacatgtatgtttattg

SEQ ID NO: 24197 - DNA, 20 bp, Artificial Sequence
  Synthetic oligonucleotide; TAG chr11 5360699 5360718 5360715 +
tattgtggcactattcacaa

SEQ ID NO: 24198 - DNA, 20 bp, Artificial Sequence
  Synthetic oligonucleotide; AAG chr11 5360704 5360723 5360720 +
tggcactattcacaatagca

SEQ ID NO: 24199 - DNA, 20 bp, Artificial Sequence
  Synthetic oligonucleotide; TGG chr11 5360710 5360729 5360726 +
tattcacaatagcaaagact

SEQ ID NO: 24200 - DNA, 20 bp, Artificial Sequence
  Synthetic oligonucleotide; TAG chr11 5360738 5360757 5360754 +
acccaaatgtccaacaatga

SEQ ID NO: 24201 - DNA, 20 bp, Artificial Sequence
  Synthetic oligonucleotide; TGG chr11 5360743 5360762 5360759 +
aatgtccaacaatgatagac

SEQ ID NO: 24202 - DNA, 20 bp, Artificial Sequence
  Synthetic oligonucleotide; AAG chr11 5360749 5360768 5360765 +
caacaatgatagactggatt

SEQ ID NO: 24203 - DNA, 20 bp, Artificial Sequence
  Synthetic oligonucleotide; TGG chr11 5360758 5360777 5360774 +
tagactggattaagaaaacg

SEQ ID NO: 24204 - DNA, 20 bp, Artificial Sequence
  Synthetic oligonucleotide; TGG chr11 5360774 5360793 5360790 +
aacgtggcacatatacacca

SEQ ID NO: 24205 - DNA, 20 bp, Artificial Sequence
  Synthetic oligonucleotide; CAG chr11 5360786 5360805 5360802 +
atacaccatggaatactatg

SEQ ID NO: 24206 - DNA, 20 bp, Artificial Sequence
  Synthetic oligonucleotide; AAG chr11 5360801 5360820 5360817 +
ctatgcagccataaaaaatg

SEQ ID NO: 24207 - DNA, 20 bp, Artificial Sequence
  Synthetic oligonucleotide; GAG chr11 5360803 5360822 5360819 +
atgcagccataaaaaatgaa

SEQ ID NO: 24208 - DNA, 20 bp, Artificial Sequence
  Synthetic oligonucleotide; TAG chr11 5360819 5360838 5360835 +
tgaagagttcatgtcctttg

SEQ ID NO: 24209 - DNA, 20 bp, Artificial Sequence
  Synthetic oligonucleotide; AGG chr11 5360820 5360839 5360836 +
gaagagttcatgtcctttgt

SEQ ID NO: 24210 - DNA, 20 bp, Artificial Sequence
  Synthetic oligonucleotide; GGG chr11 5360821 5360840 5360837 +
aagagttcatgtcctttgta

SEQ ID NO: 24211 - DNA, 20 bp, Artificial Sequence
  Synthetic oligonucleotide; TGG chr11 5360827 5360846 5360843 +
tcatgtcctttgtagggaca

SEQ ID NO: 24212 - DNA, 20 bp, Artificial Sequence
  Synthetic oligonucleotide; AAG chr11 5360833 5360852 5360849 +
cctttgtagggacatggatg

SEQ ID NO: 24213 - DNA, 20 bp, Artificial Sequence
  Synthetic oligonucleotide; TGG chr11 5360837 5360856 5360853 +
tgtagggacatggatgaagc

SEQ ID NO: 24214 - DNA, 20 bp, Artificial Sequence
  Synthetic oligonucleotide; CAG chr11 5360853 5360872 5360869 +
aagctggaaaccatcattct

SEQ ID NO: 24215 - DNA, 20 bp, Artificial Sequence
  Synthetic oligonucleotide; AAG chr11 5360867 5360886 5360883 +
cattctcagcaaactatcgc

SEQ ID NO: 24216 - DNA, 20 bp, Artificial Sequence
  Synthetic oligonucleotide; AGG chr11 5360868 5360887 5360884 +
attctcagcaaactatcgca

SEQ ID NO: 24217 - DNA, 20 bp, Artificial Sequence
  Synthetic oligonucleotide; TAG chr11 5360902 5360921 5360918 +
acactgcatgttctcactca

SEQ ID NO: 24218 - DNA, 20 bp, Artificial Sequence
  Synthetic oligonucleotide; AGG chr11 5360903 5360922 5360919 +
cactgcatgttctcactcat

SEQ ID NO: 24219 - DNA, 20 bp, Artificial Sequence
  Synthetic oligonucleotide; TGG chr11 5360906 5360925 5360922 +
tgcatgttctcactcatagg

SEQ ID NO: 24220 - DNA, 20 bp, Artificial Sequence
  Synthetic oligonucleotide; GGG chr11 5360907 5360926 5360923 +
gcatgttctcactcataggt

SEQ ID NO: 24221 - DNA, 20 bp, Artificial Sequence
  Synthetic oligonucleotide; GAG chr11 5360921 5360940 5360937 +
ataggtgggaattgaacaat

SEQ ID NO: 24222 - DNA, 20 bp, Artificial Sequence
  Synthetic oligonucleotide; TGG chr11 5360930 5360949 5360946 +
aattgaacaatgagaacaca

SEQ ID NO: 24223 - DNA, 20 bp, Artificial Sequence
  Synthetic oligonucleotide; CAG chr11 5360936 5360955 5360952 +
acaatgagaacacatggaca

SEQ ID NO: 24224 - DNA, 20 bp, Artificial Sequence
  Synthetic oligonucleotide; AGG chr11 5360937 5360956 5360953 +
caatgagaacacatggacac

SEQ ID NO: 24225 - DNA, 20 bp, Artificial Sequence
  Synthetic oligonucleotide; AAG chr11 5360940 5360959 5360956 +
tgagaacacatggacacagg

SEQ ID NO: 24226 - DNA, 20 bp, Artificial Sequence
  Synthetic oligonucleotide; AGG chr11 5360941 5360960 5360957 +
gagaacacatggacacagga

SEQ ID NO: 24227 - DNA, 20 bp, Artificial Sequence
  Synthetic oligonucleotide; GGG chr11 5360942 5360961 5360958 +
agaacacatggacacaggaa

SEQ ID NO: 24228 - DNA, 20 bp, Artificial Sequence
  Synthetic oligonucleotide; GGG chr11 5360943 5360962 5360959 +
gaacacatggacacaggaag

SEQ ID NO: 24229 - DNA, 20 bp, Artificial Sequence
  Synthetic oligonucleotide; CAG chr11 5360958 5360977 5360974 +
ggaaggggaacatcacacac

SEQ ID NO: 24230 - DNA, 20 bp, Artificial Sequence
  Synthetic oligonucleotide; AGG chr11 5360959 5360978 5360975 +
gaaggggaacatcacacacc

SEQ ID NO: 24231 - DNA, 20 bp, Artificial Sequence
  Synthetic oligonucleotide; GGG chr11 5360960 5360979 5360976 +
aaggggaacatcacacacca

SEQ ID NO: 24232 - DNA, 20 bp, Artificial Sequence
  Synthetic oligonucleotide; CAG chr11 5360967 5360986 5360983 +
acatcacacaccagggcctg

SEQ ID NO: 24233 - DNA, 20 bp, Artificial Sequence
  Synthetic oligonucleotide; TGG chr11 5360970 5360989 5360986 +
tcacacaccagggcctgcag

SEQ ID NO: 24234 - DNA, 20 bp, Artificial Sequence
  Synthetic oligonucleotide; GGG chr11 5360971 5360990 5360987 +
cacacaccagggcctgcagt

SEQ ID NO: 24235 - DNA, 20 bp, Artificial Sequence
  Synthetic oligonucleotide; GGG chr11 5360972 5360991 5360988 +
acacaccagggcctgcagtg

SEQ ID NO: 24236 - DNA, 20 bp, Artificial Sequence
  Synthetic oligonucleotide; TGG chr11 5360975 5360994 5360991 +
caccagggcctgcagtgggg

SEQ ID NO: 24237 - DNA, 20 bp, Artificial Sequence
  Synthetic oligonucleotide; GGG chr11 5360976 5360995 5360992 +
accagggcctgcagtggggt

SEQ ID NO: 24238 - DNA, 20 bp, Artificial Sequence
  Synthetic oligonucleotide; GGG chr11 5360977 5360996 5360993 +
ccagggcctgcagtggggtg

SEQ ID NO: 24239 - DNA, 20 bp, Artificial Sequence
  Synthetic oligonucleotide; GGG chr11 5360978 5360997 5360994 +
cagggcctgcagtggggtgg

SEQ ID NO: 24240 - DNA, 20 bp, Artificial Sequence
  Synthetic oligonucleotide; CGG chr11 5360982 5361001 5360998 +
gcctgcagtggggtgggggt

SEQ ID NO: 24241 - DNA, 20 bp, Artificial Sequence
  Synthetic oligonucleotide; GGG chr11 5360983 5361002 5360999 +
cctgcagtggggtgggggtc

SEQ ID NO: 24242 - DNA, 20 bp, Artificial Sequence
  Synthetic oligonucleotide; GGG chr11 5360984 5361003 5361000 +
ctgcagtggggtgggggtcg

SEQ ID NO: 24243 - DNA, 20 bp, Artificial Sequence
  Synthetic oligonucleotide; GGG chr11 5360985 5361004 5361001 +
tgcagtggggtgggggtcgg

SEQ ID NO: 24244 - DNA, 20 bp, Artificial Sequence
  Synthetic oligonucleotide; GGG chr11 5360986 5361005 5361002 +
gcagtggggtgggggtcggg

SEQ ID NO: 24245 - DNA, 20 bp, Artificial Sequence
  Synthetic oligonucleotide; GAG chr11 5360988 5361007 5361004 +
agtggggtgggggtcggggg

SEQ ID NO: 24246 - DNA, 20 bp, Artificial Sequence
  Synthetic oligonucleotide; AGG chr11 5360989 5361008 5361005 +
gtggggtgggggtcgggggg

SEQ ID NO: 24247 - DNA, 20 bp, Artificial Sequence
  Synthetic oligonucleotide; GGG chr11 5360990 5361009 5361006 +
tggggtgggggtcgggggga

SEQ ID NO: 24248 - DNA, 20 bp, Artificial Sequence
  Synthetic oligonucleotide; TAG chr11 5360994 5361013 5361010 +
gtgggggtcggggggaggga

SEQ ID NO: 24249 - DNA, 20 bp, Artificial Sequence
  Synthetic oligonucleotide; TAG chr11 5361000 5361019 5361016 +
gtcggggggagggatagcat

SEQ ID NO: 24250 - DNA, 20 bp, Artificial Sequence
  Synthetic oligonucleotide; AGG chr11 5361001 5361020 5361017 +
tcggggggagggatagcatt

SEQ ID NO: 24251 - DNA, 20 bp, Artificial Sequence
  Synthetic oligonucleotide; GAG chr11 5361003 5361022 5361019 +
ggggggagggatagcattag

SEQ ID NO: 24252 - DNA, 20 bp, Artificial Sequence
  Synthetic oligonucleotide; AAG chr11 5361020 5361039 5361036 +
taggagatatacctaatgct

SEQ ID NO: 24253 - DNA, 20 bp, Artificial Sequence
  Synthetic oligonucleotide; GAG chr11 5361027 5361046 5361043 +
tatacctaatgctaagtgac

SEQ ID NO: 24254 - DNA, 20 bp, Artificial Sequence
  Synthetic oligonucleotide; TGG chr11 5361034 5361053 5361050 +
aatgctaagtgacgagttaa

SEQ ID NO: 24255 - DNA, 20 bp, Artificial Sequence
  Synthetic oligonucleotide; GGG chr11 5361035 5361054 5361051 +
atgctaagtgacgagttaat

SEQ ID NO: 24256 - DNA, 20 bp, Artificial Sequence
  Synthetic oligonucleotide; CAG chr11 5361040 5361059 5361056 +
aagtgacgagttaatgggtg

SEQ ID NO: 24257 - DNA, 20 bp, Artificial Sequence
  Synthetic oligonucleotide; TGG chr11 5361053 5361072 5361069 +
atgggtgcagcacaccaaca

SEQ ID NO: 24258 - DNA, 20 bp, Artificial Sequence
  Synthetic oligonucleotide; AAG chr11 5361112 5361131 5361128 +
caaatgtaccctaaaactta

SEQ ID NO: 24259 - DNA, 20 bp, Artificial Sequence
  Synthetic oligonucleotide; AAG chr11 5361126 5361145 5361142 +
aacttaaagtataataataa

SEQ ID NO: 24260 - DNA, 20 bp, Artificial Sequence
  Synthetic oligonucleotide; AAG chr11 5361130 5361149 5361146 +
taaagtataataataaaaga

SEQ ID NO: 24261 - DNA, 20 bp, Artificial Sequence
  Synthetic oligonucleotide; AAG chr11 5361134 5361153 5361150 +
gtataataataaaagaaaga

SEQ ID NO: 24262 - DNA, 20 bp, Artificial Sequence
  Synthetic oligonucleotide; AAG chr11 5361138 5361157 5361154 +
aataataaaagaaagaaaga

SEQ ID NO: 24263 - DNA, 20 bp, Artificial Sequence
  Synthetic oligonucleotide; AAG chr11 5361155 5361174 5361171 +
agaaagaaatctgctgcaaa

SEQ ID NO: 24264 - DNA, 20 bp, Artificial Sequence
  Synthetic oligonucleotide; AGG chr11 5361156 5361175 5361172 +
gaaagaaatctgctgcaaaa

SEQ ID NO: 24265 - DNA, 20 bp, Artificial Sequence
  Synthetic oligonucleotide; TGG chr11 5361218 5361237 5361234 +
cttaaaataaatcttatttc

SEQ ID NO: 24266 - DNA, 20 bp, Artificial Sequence
  Synthetic oligonucleotide; GAG chr11 5361220 5361239 5361236 +
taaaataaatcttatttctg

SEQ ID NO: 24267 - DNA, 20 bp, Artificial Sequence
  Synthetic oligonucleotide; TGG chr11 5361226 5361245 5361242 +
aaatcttatttctggagatg

SEQ ID NO: 24268 - DNA, 20 bp, Artificial Sequence
  Synthetic oligonucleotide; TAG chr11 5361243 5361262 5361259 +
atgtggctaattccctaacc

SEQ ID NO: 24269 - DNA, 20 bp, Artificial Sequence
  Synthetic oligonucleotide; CAG chr11 5361249 5361268 5361265 +
ctaattccctaacctagatg

SEQ ID NO: 24270 - DNA, 20 bp, Artificial Sequence
  Synthetic oligonucleotide; AGG chr11 5361250 5361269 5361266 +
taattccctaacctagatgc

SEQ ID NO: 24271 - DNA, 20 bp, Artificial Sequence
  Synthetic oligonucleotide; AAG chr11 5361253 5361272 5361269 +
ttccctaacctagatgcagg

SEQ ID NO: 24272 - DNA, 20 bp, Artificial Sequence
  Synthetic oligonucleotide; TAG chr11 5361262 5361281 5361278 +
ctagatgcaggaagaaacct

SEQ ID NO: 24273 - DNA, 20 bp, Artificial Sequence
  Synthetic oligonucleotide; AAG chr11 5361279 5361298 5361295 +
ccttagcgactcctgttcca

SEQ ID NO: 24274 - DNA, 20 bp, Artificial Sequence
  Synthetic oligonucleotide; CAG chr11 5361294 5361313 5361310 +
ttccaaagttctaaatccct

SEQ ID NO: 24275 - DNA, 20 bp, Artificial Sequence
  Synthetic oligonucleotide; AGG chr11 5361295 5361314 5361311 +
tccaaagttctaaatccctc

SEQ ID NO: 24276 - DNA, 20 bp, Artificial Sequence
  Synthetic oligonucleotide; TGG chr11 5361299 5361318 5361315 +
aagttctaaatccctcaggc

SEQ ID NO: 24277 - DNA, 20 bp, Artificial Sequence
  Synthetic oligonucleotide; GGG chr11 5361300 5361319 5361316 +
agttctaaatccctcaggct

SEQ ID NO: 24278 - DNA, 20 bp, Artificial Sequence
  Synthetic oligonucleotide; GAG chr11 5361302 5361321 5361318 +
ttctaaatccctcaggctgg

SEQ ID NO: 24279 - DNA, 20 bp, Artificial Sequence
  Synthetic oligonucleotide; AAG chr11 5361309 5361328 5361325 +
tccctcaggctgggagaata

SEQ ID NO: 24280 - DNA, 20 bp, Artificial Sequence
  Synthetic oligonucleotide; AAG chr11 5361312 5361331 5361328 +
ctcaggctgggagaataaag

SEQ ID NO: 24281 - DNA, 20 bp, Artificial Sequence
  Synthetic oligonucleotide; AGG chr11 5361313 5361332 5361329 +
tcaggctgggagaataaaga

SEQ ID NO: 24282 - DNA, 20 bp, Artificial Sequence
  Synthetic oligonucleotide; GAG chr11 5361315 5361334 5361331 +
aggctgggagaataaagaag

SEQ ID NO: 24283 - DNA, 20 bp, Artificial Sequence
  Synthetic oligonucleotide; AGG chr11 5361316 5361335 5361332 +
ggctgggagaataaagaagg

SEQ ID NO: 24284 - DNA, 20 bp, Artificial Sequence
  Synthetic oligonucleotide; GGG chr11 5361317 5361336 5361333 +
gctgggagaataaagaagga

SEQ ID NO: 24285 - DNA, 20 bp, Artificial Sequence
  Synthetic oligonucleotide; GAG chr11 5361319 5361338 5361335 +
tgggagaataaagaaggagg

SEQ ID NO: 24286 - DNA, 20 bp, Artificial Sequence
  Synthetic oligonucleotide; AGG chr11 5361320 5361339 5361336 +
gggagaataaagaaggaggg

SEQ ID NO: 24287 - DNA, 20 bp, Artificial Sequence
  Synthetic oligonucleotide; GAG chr11 5361322 5361341 5361338 +
gagaataaagaaggagggag

SEQ ID NO: 24288 - DNA, 20 bp, Artificial Sequence
  Synthetic oligonucleotide; GAG chr11 5361324 5361343 5361340 +
gaataaagaaggagggagga

SEQ ID NO: 24289 - DNA, 20 bp, Artificial Sequence
  Synthetic oligonucleotide; GAG chr11 5361326 5361345 5361342 +
ataaagaaggagggaggaga

SEQ ID NO: 24290 - DNA, 20 bp, Artificial Sequence
  Synthetic oligonucleotide; AGG chr11 5361327 5361346 5361343 +
taaagaaggagggaggagag

SEQ ID NO: 24291 - DNA, 20 bp, Artificial Sequence
  Synthetic oligonucleotide; GAG chr11 5361329 5361348 5361345 +
aagaaggagggaggagagag

SEQ ID NO: 24292 - DNA, 20 bp, Artificial Sequence
  Synthetic oligonucleotide; TGG chr11 5361332 5361351 5361348 +
aaggagggaggagagaggag

SEQ ID NO: 24293 - DNA, 20 bp, Artificial Sequence
  Synthetic oligonucleotide; GGG chr11 5361333 5361352 5361349 +
aggagggaggagagaggagt

SEQ ID NO: 24294 - DNA, 20 bp, Artificial Sequence
  Synthetic oligonucleotide; TAG chr11 5361339 5361358 5361355 +
gaggagagaggagtgggccg

SEQ ID NO: 24295 - DNA, 20 bp, Artificial Sequence
  Synthetic oligonucleotide; AGG chr11 5361340 5361359 5361356 +
aggagagaggagtgggccgt

SEQ ID NO: 24296 - DNA, 20 bp, Artificial Sequence
  Synthetic oligonucleotide; GGG chr11 5361341 5361360 5361357 +
ggagagaggagtgggccgta

SEQ ID NO: 24297 - DNA, 20 bp, Artificial Sequence
  Synthetic oligonucleotide; GAG chr11 5361343 5361362 5361359 +
agagaggagtgggccgtagg

SEQ ID NO: 24298 - DNA, 20 bp, Artificial Sequence
  Synthetic oligonucleotide; AGG chr11 5361344 5361363 5361360 +
gagaggagtgggccgtaggg

SEQ ID NO: 24299 - DNA, 20 bp, Artificial Sequence
  Synthetic oligonucleotide; GAG chr11 5361346 5361365 5361362 +
gaggagtgggccgtagggag

SEQ ID NO: 24300 - DNA, 20 bp, Artificial Sequence
  Synthetic oligonucleotide; CAG chr11 5361371 5361390 5361387 +
tctgaaactaattttctttg

SEQ ID NO: 24301 - DNA, 20 bp, Artificial Sequence
  Synthetic oligonucleotide; TGG chr11 5361376 5361395 5361392 +
aactaattttctttgcagct

SEQ ID NO: 24302 - DNA, 20 bp, Artificial Sequence
  Synthetic oligonucleotide; GAG chr11 5361384 5361403 5361400 +
ttctttgcagcttggcttct

SEQ ID NO: 24303 - DNA, 20 bp, Artificial Sequence
  Synthetic oligonucleotide; TAG chr11 5361389 5361408 5361405 +
tgcagcttggcttctgagta

SEQ ID NO: 24304 - DNA, 20 bp, Artificial Sequence
  Synthetic oligonucleotide; AAG chr11 5361398 5361417 5361414 +
gcttctgagtatagtctaaa

SEQ ID NO: 24305 - DNA, 20 bp, Artificial Sequence
  Synthetic oligonucleotide; TGG chr11 5361402 5361421 5361418 +
ctgagtatagtctaaaaagt

SEQ ID NO: 24306 - DNA, 20 bp, Artificial Sequence
  Synthetic oligonucleotide; TGG chr11 5361408 5361427 5361424 +
atagtctaaaaagttggtgt

SEQ ID NO: 24307 - DNA, 20 bp, Artificial Sequence
  Synthetic oligonucleotide; CAG chr11 5361426 5361445 5361442 +
gttggatccaatatcttgac

SEQ ID NO: 24308 - DNA, 20 bp, Artificial Sequence
  Synthetic oligonucleotide; AGG chr11 5361427 5361446 5361443 +
ttggatccaatatcttgacc

SEQ ID NO: 24309 - DNA, 20 bp, Artificial Sequence
  Synthetic oligonucleotide; TAG chr11 5361432 5361451 5361448 +
tccaatatcttgaccaggct

SEQ ID NO: 24310 - DNA, 20 bp, Artificial Sequence
  Synthetic oligonucleotide; AGG chr11 5361433 5361452 5361449 +
ccaatatcttgaccaggctt

SEQ ID NO: 24311 - DNA, 20 bp, Artificial Sequence
  Synthetic oligonucleotide; GGG chr11 5361434 5361453 5361450 +
caatatcttgaccaggctta

SEQ ID NO: 24312 - DNA, 20 bp, Artificial Sequence
  Synthetic oligonucleotide; GGG chr11 5361435 5361454 5361451 +
aatatcttgaccaggcttag

SEQ ID NO: 24313 - DNA, 20 bp, Artificial Sequence
  Synthetic oligonucleotide; TAG chr11 5361442 5361461 5361458 +
tgaccaggcttaggggttca

SEQ ID NO: 24314 - DNA, 20 bp, Artificial Sequence
  Synthetic oligonucleotide; TGG chr11 5361454 5361473 5361470 +
ggggttcatagtcacatctg

SEQ ID NO: 24315 - DNA, 20 bp, Artificial Sequence
  Synthetic oligonucleotide; CAG chr11 5361467 5361486 5361483 +
acatctgtggcaacaatgaa

SEQ ID NO: 24316 - DNA, 20 bp, Artificial Sequence
  Synthetic oligonucleotide; CAG chr11 5361479 5361498 5361495 +
acaatgaacagacttatgaa

SEQ ID NO: 24317 - DNA, 20 bp, Artificial Sequence
  Synthetic oligonucleotide; AGG chr11 5361480 5361499 5361496 +
caatgaacagacttatgaac

SEQ ID NO: 24318 - DNA, 20 bp, Artificial Sequence
  Synthetic oligonucleotide; CGG chr11 5361484 5361503 5361500 +
gaacagacttatgaacaggt

SEQ ID NO: 24319 - DNA, 20 bp, Artificial Sequence
  Synthetic oligonucleotide; AAG chr11 5361489 5361508 5361505 +
gacttatgaacaggtcggta

SEQ ID NO: 24320 - DNA, 20 bp, Artificial Sequence
  Synthetic oligonucleotide; CAG chr11 5361497 5361516 5361513 +
aacaggtcggtaaagaactc

SEQ ID NO: 24321 - DNA, 20 bp, Artificial Sequence
  Synthetic oligonucleotide; TGG chr11 5361507 5361526 5361523 +
taaagaactccagtgtgtct

SEQ ID NO: 24322 - DNA, 20 bp, Artificial Sequence
  Synthetic oligonucleotide; TAG chr11 5361512 5361531 5361528 +
aactccagtgtgtcttggcc

SEQ ID NO: 24323 - DNA, 20 bp, Artificial Sequence
  Synthetic oligonucleotide; GAG chr11 5361514 5361533 5361530 +
ctccagtgtgtcttggccta

SEQ ID NO: 24324 - DNA, 20 bp, Artificial Sequence
  Synthetic oligonucleotide; AGG chr11 5361515 5361534 5361531 +
tccagtgtgtcttggcctag

SEQ ID NO: 24325 - DNA, 20 bp, Artificial Sequence
  Synthetic oligonucleotide; TAG chr11 5361525 5361544 5361541 +
cttggcctagaggctccgca

SEQ ID NO: 24326 - DNA, 20 bp, Artificial Sequence
  Synthetic oligonucleotide; AGG chr11 5361526 5361545 5361542 +
ttggcctagaggctccgcat

SEQ ID NO: 24327 - DNA, 20 bp, Artificial Sequence
  Synthetic oligonucleotide; GAG chr11 5361532 5361551 5361548 +
tagaggctccgcataggaat

SEQ ID NO: 24328 - DNA, 20 bp, Artificial Sequence
  Synthetic oligonucleotide; CAG chr11 5361535 5361554 5361551 +
aggctccgcataggaatgag

SEQ ID NO: 24329 - DNA, 20 bp, Artificial Sequence
  Synthetic oligonucleotide; TAG chr11 5361538 5361557 5361554 +
ctccgcataggaatgagcag

SEQ ID NO: 24330 - DNA, 20 bp, Artificial Sequence
  Synthetic oligonucleotide; CGG chr11 5361542 5361561 5361558 +
gcataggaatgagcagtaga

SEQ ID NO: 24331 - DNA, 20 bp, Artificial Sequence
  Synthetic oligonucleotide; TGG chr11 5361546 5361565 5361562 +
aggaatgagcagtagacggt

SEQ ID NO: 24332 - DNA, 20 bp, Artificial Sequence
  Synthetic oligonucleotide; CAG chr11 5361554 5361573 5361570 +
gcagtagacggttggcttat

SEQ ID NO: 24333 - DNA, 20 bp, Artificial Sequence
  Synthetic oligonucleotide; GAG chr11 5361556 5361575 5361572 +
agtagacggttggcttatca

SEQ ID NO: 24334 - DNA, 20 bp, Artificial Sequence
  Synthetic oligonucleotide; CAG chr11 5361563 5361582 5361579 +
ggttggcttatcagagattg

SEQ ID NO: 24335 - DNA, 20 bp, Artificial Sequence
  Synthetic oligonucleotide; GAG chr11 5361565 5361584 5361581 +
ttggcttatcagagattgca

SEQ ID NO: 24336 - DNA, 20 bp, Artificial Sequence
  Synthetic oligonucleotide; GAG chr11 5361567 5361586 5361583 +
ggcttatcagagattgcaga

SEQ ID NO: 24337 - DNA, 20 bp, Artificial Sequence
  Synthetic oligonucleotide; AGG chr11 5361568 5361587 5361584 +
gcttatcagagattgcagag

SEQ ID NO: 24338 - DNA, 20 bp, Artificial Sequence
  Synthetic oligonucleotide; GGG chr11 5361569 5361588 5361585 +
cttatcagagattgcagaga

SEQ ID NO: 24339 - DNA, 20 bp, Artificial Sequence
  Synthetic oligonucleotide; CAG chr11 5361577 5361596 5361593 +
agattgcagagagggaaatg

SEQ ID NO: 24340 - DNA, 20 bp, Artificial Sequence
  Synthetic oligonucleotide; CAG chr11 5361588 5361607 5361604 +
agggaaatgcagtaatgtat

SEQ ID NO: 24341 - DNA, 20 bp, Artificial Sequence
  Synthetic oligonucleotide; AAG chr11 5361593 5361612 5361609 +
aatgcagtaatgtatcagtc

SEQ ID NO: 24342 - DNA, 20 bp, Artificial Sequence
  Synthetic oligonucleotide; TGG chr11 5361602 5361621 5361618 +
atgtatcagtcaagatgtga

SEQ ID NO: 24343 - DNA, 20 bp, Artificial Sequence
  Synthetic oligonucleotide; GGG chr11 5361603 5361622 5361619 +
tgtatcagtcaagatgtgat

SEQ ID NO: 24344 - DNA, 20 bp, Artificial Sequence
  Synthetic oligonucleotide; GGG chr11 5361604 5361623 5361620 +
gtatcagtcaagatgtgatg

SEQ ID NO: 24345 - DNA, 20 bp, Artificial Sequence
  Synthetic oligonucleotide; AAG chr11 5361610 5361629 5361626 +
gtcaagatgtgatggggtat

SEQ ID NO: 24346 - DNA, 20 bp, Artificial Sequence
  Synthetic oligonucleotide; AAG chr11 5361627 5361646 5361643 +
tataagaatctatcatccca

SEQ ID NO: 24347 - DNA, 20 bp, Artificial Sequence
  Synthetic oligonucleotide; TAG chr11 5361645 5361664 5361661 +
caaagactccctaaaatctt

SEQ ID NO: 24348 - DNA, 20 bp, Artificial Sequence
  Synthetic oligonucleotide; TGG chr11 5361652 5361671 5361668 +
tccctaaaatctttagaact

SEQ ID NO: 24349 - DNA, 20 bp, Artificial Sequence
  Synthetic oligonucleotide; TAG chr11 5361683 5361702 5361699 +
taatctcttttgcaaattcc

SEQ ID NO: 24350 - DNA, 20 bp, Artificial Sequence
  Synthetic oligonucleotide; AAG chr11 5361686 5361705 5361702 +
tctcttttgcaaattcctag

SEQ ID NO: 24351 - DNA, 20 bp, Artificial Sequence
  Synthetic oligonucleotide; GAG chr11 5361688 5361707 5361704 +
tcttttgcaaattcctagaa

SEQ ID NO: 24352 - DNA, 20 bp, Artificial Sequence
  Synthetic oligonucleotide; AGG chr11 5361689 5361708 5361705 +
cttttgcaaattcctagaag

SEQ ID NO: 24353 - DNA, 20 bp, Artificial Sequence
  Synthetic oligonucleotide; GGG chr11 5361690 5361709 5361706 +
ttttgcaaattcctagaaga

SEQ ID NO: 24354 - DNA, 20 bp, Artificial Sequence
  Synthetic oligonucleotide; TAG chr11 5361700 5361719 5361716 +
tcctagaagagggaaaatcc

SEQ ID NO: 24355 - DNA, 20 bp, Artificial Sequence
  Synthetic oligonucleotide; TAG chr11 5361721 5361740 5361737 +
agatctcctttttcattccc

SEQ ID NO: 24356 - DNA, 20 bp, Artificial Sequence
  Synthetic oligonucleotide; CAG chr11 5361724 5361743 5361740 +
tctcctttttcattccctag

SEQ ID NO: 24357 - DNA, 20 bp, Artificial Sequence
  Synthetic oligonucleotide; GAG chr11 5361726 5361745 5361742 +
tcctttttcattccctagca

SEQ ID NO: 24358 - DNA, 20 bp, Artificial Sequence
  Synthetic oligonucleotide; TAG chr11 5361734 5361753 5361750 +
cattccctagcagagtgatc

SEQ ID NO: 24359 - DNA, 20 bp, Artificial Sequence
  Synthetic oligonucleotide; TAG chr11 5361738 5361757 5361754 +
ccctagcagagtgatctagt

SEQ ID NO: 24360 - DNA, 20 bp, Artificial Sequence
  Synthetic oligonucleotide; AGG chr11 5361739 5361758 5361755 +
cctagcagagtgatctagtt

SEQ ID NO: 24361 - DNA, 20 bp, Artificial Sequence
  Synthetic oligonucleotide; AAG chr11 5361750 5361769 5361766 +
gatctagttaggaaaaaatc

SEQ ID NO: 24362 - DNA, 20 bp, Artificial Sequence
  Synthetic oligonucleotide; CGG chr11 5361764 5361783 5361780 +
aaaatcaagttgaaaatcca

SEQ ID NO: 24363 - DNA, 20 bp, Artificial Sequence
  Synthetic oligonucleotide; GGG chr11 5361765 5361784 5361781 +
aaatcaagttgaaaatccac

SEQ ID NO: 24364 - DNA, 20 bp, Artificial Sequence
  Synthetic oligonucleotide; CAG chr11 5361772 5361791 5361788 +
gttgaaaatccacgggaata

SEQ ID NO: 24365 - DNA, 20 bp, Artificial Sequence
  Synthetic oligonucleotide; TGG chr11 5361786 5361805 5361802 +
ggaatacagaatgatatctc

SEQ ID NO: 24366 - DNA, 20 bp, Artificial Sequence
  Synthetic oligonucleotide; TAG chr11 5361791 5361810 5361807 +
acagaatgatatctctggtg

SEQ ID NO: 24367 - DNA, 20 bp, Artificial Sequence
  Synthetic oligonucleotide; CAG chr11 5361797 5361816 5361813 +
tgatatctctggtgtagttc

SEQ ID NO: 24368 - DNA, 20 bp, Artificial Sequence
  Synthetic oligonucleotide; TGG chr11 5361804 5361823 5361820 +
tctggtgtagttccagactc

SEQ ID NO: 24369 - DNA, 20 bp, Artificial Sequence
  Synthetic oligonucleotide; TGG chr11 5361809 5361828 5361825 +
tgtagttccagactctggtt

SEQ ID NO: 24370 - DNA, 20 bp, Artificial Sequence
  Synthetic oligonucleotide; CGG chr11 5361839 5361858 5361855 +
atttcctttgttgctctctt

SEQ ID NO: 24371 - DNA, 20 bp, Artificial Sequence
  Synthetic oligonucleotide; GGG chr11 5361840 5361859 5361856 +
tttcctttgttgctctcttc

SEQ ID NO: 24372 - DNA, 20 bp, Artificial Sequence
  Synthetic oligonucleotide; CAG chr11 5361853 5361872 5361869 +
tctcttcgggctgcataaac

SEQ ID NO: 24373 - DNA, 20 bp, Artificial Sequence
  Synthetic oligonucleotide; AAG chr11 5361884 5361903 5361900 +
ttgcctctatgtgttctacc

SEQ ID NO: 24374 - DNA, 20 bp, Artificial Sequence
  Synthetic oligonucleotide; AAG chr11 5361902 5361921 5361918 +
ccaagtacttactcccaaaa

SEQ ID NO: 24375 - DNA, 20 bp, Artificial Sequence
  Synthetic oligonucleotide; AAG chr11 5361908 5361927 5361924 +
acttactcccaaaaaagatg

SEQ ID NO: 24376 - DNA, 20 bp, Artificial Sequence
  Synthetic oligonucleotide; TAG chr11 5361912 5361931 5361928 +
actcccaaaaaagatgaagt

SEQ ID NO: 24377 - DNA, 20 bp, Artificial Sequence
  Synthetic oligonucleotide; GAG chr11 5361914 5361933 5361930 +
tcccaaaaaagatgaagtta

SEQ ID NO: 24378 - DNA, 20 bp, Artificial Sequence
  Synthetic oligonucleotide; GAG chr11 5361918 5361937 5361934 +
aaaaaagatgaagttagagt

SEQ ID NO: 24379 - DNA, 20 bp, Artificial Sequence
  Synthetic oligonucleotide; AGG chr11 5361919 5361938 5361935 +
aaaaagatgaagttagagtg

SEQ ID NO: 24380 - DNA, 20 bp, Artificial Sequence
  Synthetic oligonucleotide; TAG chr11 5361923 5361942 5361939 +
agatgaagttagagtgagga

SEQ ID NO: 24381 - DNA, 20 bp, Artificial Sequence
  Synthetic oligonucleotide; AGG chr11 5361924 5361943 5361940 +
gatgaagttagagtgaggat

SEQ ID NO: 24382 - DNA, 20 bp, Artificial Sequence
  Synthetic oligonucleotide; GGG chr11 5361925 5361944 5361941 +
atgaagttagagtgaggata

SEQ ID NO: 24383 - DNA, 20 bp, Artificial Sequence
  Synthetic oligonucleotide; GGG chr11 5361926 5361945 5361942 +
tgaagttagagtgaggatag

SEQ ID NO: 24384 - DNA, 20 bp, Artificial Sequence
  Synthetic oligonucleotide; AAG chr11 5361942 5361961 5361958 +
ataggggacactgtaatgac

SEQ ID NO: 24385 - DNA, 20 bp, Artificial Sequence
  Synthetic oligonucleotide; AGG chr11 5361943 5361962 5361959 +
taggggacactgtaatgaca

SEQ ID NO: 24386 - DNA, 20 bp, Artificial Sequence
  Synthetic oligonucleotide; GGG chr11 5361944 5361963 5361960 +
aggggacactgtaatgacaa

SEQ ID NO: 24387 - DNA, 20 bp, Artificial Sequence
  Synthetic oligonucleotide; TAG chr11 5361949 5361968 5361965 +
acactgtaatgacaagggta

SEQ ID NO: 24388 - DNA, 20 bp, Artificial Sequence
  Synthetic oligonucleotide; CAG chr11 5361957 5361976 5361973 +
atgacaagggtatagactaa

SEQ ID NO: 24389 - DNA, 20 bp, Artificial Sequence
  Synthetic oligonucleotide; AAG chr11 5361961 5361980 5361977 +
caagggtatagactaacaga

SEQ ID NO: 24390 - DNA, 20 bp, Artificial Sequence
  Synthetic oligonucleotide; TAG chr11 5361978 5361997 5361994 +
agaaagaaaaacttaccaaa

SEQ ID NO: 24391 - DNA, 20 bp, Artificial Sequence
  Synthetic oligonucleotide; TAG chr11 5361983 5362002 5361999 +
gaaaaacttaccaaatagat

SEQ ID NO: 24392 - DNA, 20 bp, Artificial Sequence
  Synthetic oligonucleotide; CAG chr11 5361989 5362008 5362005 +
cttaccaaatagattagtgt

SEQ ID NO: 24393 - DNA, 20 bp, Artificial Sequence
  Synthetic oligonucleotide; GAG chr11 5361995 5362014 5362011 +
aaatagattagtgtcagatt

SEQ ID NO: 24394 - DNA, 20 bp, Artificial Sequence
  Synthetic oligonucleotide; AAG chr11 5362000 5362019 5362016 +
gattagtgtcagattgagta

SEQ ID NO: 24395 - DNA, 20 bp, Artificial Sequence
  Synthetic oligonucleotide; GAG chr11 5362016 5362035 5362032 +
agtaaagcaaactttgacat

SEQ ID NO: 24396 - DNA, 20 bp, Artificial Sequence
  Synthetic oligonucleotide; AGG chr11 5362017 5362036 5362033 +
gtaaagcaaactttgacatg

SEQ ID NO: 24397 - DNA, 20 bp, Artificial Sequence
  Synthetic oligonucleotide; CAG chr11 5362048 5362067 5362064 +
tttaaattgctgcatattcc

SEQ ID NO: 24398 - DNA, 20 bp, Artificial Sequence
  Synthetic oligonucleotide; GAG chr11 5362055 5362074 5362071 +
tgctgcatattcccagaaat

SEQ ID NO: 24399 - DNA, 20 bp, Artificial Sequence
  Synthetic oligonucleotide; TAG chr11 5362060 5362079 5362076 +
catattcccagaaatgagcc

SEQ ID NO: 24400 - DNA, 20 bp, Artificial Sequence
  Synthetic oligonucleotide; CAG chr11 5362070 5362089 5362086 +
gaaatgagcctagtatccat

SEQ ID NO: 24401 - DNA, 20 bp, Artificial Sequence
  Synthetic oligonucleotide; AAG chr11 5362100 5362119 5362116 +
atgcaaatccttataaacca

SEQ ID NO: 24402 - DNA, 20 bp, Artificial Sequence
  Synthetic oligonucleotide; CAG chr11 5362104 5362123 5362120 +
aaatccttataaaccaaagt

SEQ ID NO: 24403 - DNA, 20 bp, Artificial Sequence
  Synthetic oligonucleotide; GAG chr11 5362106 5362125 5362122 +
atccttataaaccaaagtca

SEQ ID NO: 24404 - DNA, 20 bp, Artificial Sequence
  Synthetic oligonucleotide; GAG chr11 5362108 5362127 5362124 +
ccttataaaccaaagtcaga

SEQ ID NO: 24405 - DNA, 20 bp, Artificial Sequence
  Synthetic oligonucleotide; GAG chr11 5362110 5362129 5362126 +
ttataaaccaaagtcagaga

SEQ ID NO: 24406 - DNA, 20 bp, Artificial Sequence
  Synthetic oligonucleotide; TGG chr11 5362118 5362137 5362134 +
caaagtcagagagagcttgt

SEQ ID NO: 24407 - DNA, 20 bp, Artificial Sequence
  Synthetic oligonucleotide; GAG chr11 5362139 5362158 5362155 +
ggttcacttcattccatgct

SEQ ID NO: 24408 - DNA, 20 bp, Artificial Sequence
  Synthetic oligonucleotide; CAG chr11 5362146 5362165 5362162 +
ttcattccatgctgagctat

SEQ ID NO: 24409 - DNA, 20 bp, Artificial Sequence
  Synthetic oligonucleotide; CAG chr11 5362154 5362173 5362170 +
atgctgagctatcagcactg

SEQ ID NO: 24410 - DNA, 20 bp, Artificial Sequence
  Synthetic oligonucleotide; AAG chr11 5362163 5362182 5362179 +
tatcagcactgcagattttg

SEQ ID NO: 24411 - DNA, 20 bp, Artificial Sequence
  Synthetic oligonucleotide; CAG chr11 5362180 5362199 5362196 +
ttgaagatctcaaccacacc

SEQ ID NO: 24412 - DNA, 20 bp, Artificial Sequence
  Synthetic oligonucleotide; TAG chr11 5362184 5362203 5362200 +
agatctcaaccacacccaga

SEQ ID NO: 24413 - DNA, 20 bp, Artificial Sequence
  Synthetic oligonucleotide; GAG chr11 5362186 5362205 5362202 +
atctcaaccacacccagata

SEQ ID NO: 24414 - DNA, 20 bp, Artificial Sequence
  Synthetic oligonucleotide; GAG chr11 5362188 5362207 5362204 +
ctcaaccacacccagataga

SEQ ID NO: 24415 - DNA, 20 bp, Artificial Sequence
  Synthetic oligonucleotide; TAG chr11 5362194 5362213 5362210 +
cacacccagatagagagtga

SEQ ID NO: 24416 - DNA, 20 bp, Artificial Sequence
  Synthetic oligonucleotide; TGG chr11 5362197 5362216 5362213 +
acccagatagagagtgatag

SEQ ID NO: 24417 - DNA, 20 bp, Artificial Sequence
  Synthetic oligonucleotide; CGG chr11 5362215 5362234 5362231 +
agtggatcccgtgtttctgt

SEQ ID NO: 24418 - DNA, 20 bp, Artificial Sequence
  Synthetic oligonucleotide; GGG chr11 5362216 5362235 5362232 +
gtggatcccgtgtttctgtc

SEQ ID NO: 24419 - DNA, 20 bp, Artificial Sequence
  Synthetic oligonucleotide; GGG chr11 5362217 5362236 5362233 +
tggatcccgtgtttctgtcg

SEQ ID NO: 24420 - DNA, 20 bp, Artificial Sequence
  Synthetic oligonucleotide; GGG chr11 5362218 5362237 5362234 +
ggatcccgtgtttctgtcgg

SEQ ID NO: 24421 - DNA, 20 bp, Artificial Sequence
  Synthetic oligonucleotide; TGG chr11 5362222 5362241 5362238 +
cccgtgtttctgtcggggga

SEQ ID NO: 24422 - DNA, 20 bp, Artificial Sequence
  Synthetic oligonucleotide; GGG chr11 5362223 5362242 5362239 +
ccgtgtttctgtcgggggat

SEQ ID NO: 24423 - DNA, 20 bp, Artificial Sequence
  Synthetic oligonucleotide; GAG chr11 5362225 5362244 5362241 +
gtgtttctgtcgggggatgg

SEQ ID NO: 24424 - DNA, 20 bp, Artificial Sequence
  Synthetic oligonucleotide; TAG chr11 5362228 5362247 5362244 +
tttctgtcgggggatgggag

SEQ ID NO: 24425 - DNA, 20 bp, Artificial Sequence
  Synthetic oligonucleotide; AAG chr11 5362233 5362252 5362249 +
gtcgggggatgggagtagat

SEQ ID NO: 24426 - DNA, 20 bp, Artificial Sequence
  Synthetic oligonucleotide; AGG chr11 5362234 5362253 5362250 +
tcgggggatgggagtagata

SEQ ID NO: 24427 - DNA, 20 bp, Artificial Sequence
  Synthetic oligonucleotide; AAG chr11 5362239 5362258 5362255 +
ggatgggagtagataaggaa

SEQ ID NO: 24428 - DNA, 20 bp, Artificial Sequence
  Synthetic oligonucleotide; CAG chr11 5362258 5362277 5362274 +
aaagtgtttactatttttac

SEQ ID NO: 24429 - DNA, 20 bp, Artificial Sequence
  Synthetic oligonucleotide; CAG chr11 5362261 5362280 5362277 +
gtgtttactatttttaccag

SEQ ID NO: 24430 - DNA, 20 bp, Artificial Sequence
  Synthetic oligonucleotide; AGG chr11 5362262 5362281 5362278 +
tgtttactatttttaccagc

SEQ ID NO: 24431 - DNA, 20 bp, Artificial Sequence
  Synthetic oligonucleotide; GGG chr11 5362263 5362282 5362279 +
gtttactatttttaccagca

SEQ ID NO: 24432 - DNA, 20 bp, Artificial Sequence
  Synthetic oligonucleotide; GGG chr11 5362264 5362283 5362280 +
tttactatttttaccagcag

SEQ ID NO: 24433 - DNA, 20 bp, Artificial Sequence
  Synthetic oligonucleotide; CAG chr11 5362275 5362294 5362291 +
taccagcaggggaaactacc

SEQ ID NO: 24434 - DNA, 20 bp, Artificial Sequence
  Synthetic oligonucleotide; TGG chr11 5362285 5362304 5362301 +
ggaaactacccagatgaaaa

SEQ ID NO: 24435 - DNA, 20 bp, Artificial Sequence
  Synthetic oligonucleotide; TGG chr11 5362291 5362310 5362307 +
tacccagatgaaaatggtgc

SEQ ID NO: 24436 - DNA, 20 bp, Artificial Sequence
  Synthetic oligonucleotide; TGG chr11 5362300 5362319 5362316 +
gaaaatggtgctggatgctt

SEQ ID NO: 24437 - DNA, 20 bp, Artificial Sequence
  Synthetic oligonucleotide; GGG chr11 5362301 5362320 5362317 +
aaaatggtgctggatgcttt

SEQ ID NO: 24438 - DNA, 20 bp, Artificial Sequence
  Synthetic oligonucleotide; AAG chr11 5362308 5362327 5362324 +
tgctggatgctttgggcaaa

SEQ ID NO: 24439 - DNA, 20 bp, Artificial Sequence
  Synthetic oligonucleotide; CAG chr11 5362316 5362335 5362332 +
gctttgggcaaaaagccatt

SEQ ID NO: 24440 - DNA, 20 bp, Artificial Sequence
  Synthetic oligonucleotide; GAG chr11 5362318 5362337 5362334 +
tttgggcaaaaagccattca

SEQ ID NO: 24441 - DNA, 20 bp, Artificial Sequence
  Synthetic oligonucleotide; AAG chr11 5362336 5362355 5362352 +
cagagccataatcaactacg

SEQ ID NO: 24442 - DNA, 20 bp, Artificial Sequence
  Synthetic oligonucleotide; TGG chr11 5362340 5362359 5362356 +
gccataatcaactacgaaga

SEQ ID NO: 24443 - DNA, 20 bp, Artificial Sequence
  Synthetic oligonucleotide; CAG chr11 5362344 5362363 5362360 +
taatcaactacgaagatggt

SEQ ID NO: 24444 - DNA, 20 bp, Artificial Sequence
  Synthetic oligonucleotide; AGG chr11 5362345 5362364 5362361 +
aatcaactacgaagatggtc

SEQ ID NO: 24445 - DNA, 20 bp, Artificial Sequence
  Synthetic oligonucleotide; TAG chr11 5362352 5362371 5362368 +
tacgaagatggtcaggaatt

SEQ ID NO: 24446 - DNA, 20 bp, Artificial Sequence
  Synthetic oligonucleotide; TAG chr11 5362363 5362382 5362379 +
tcaggaatttagtgtatttg

SEQ ID NO: 24447 - DNA, 20 bp, Artificial Sequence
  Synthetic oligonucleotide; CAG chr11 5362368 5362387 5362384 +
aatttagtgtatttgtagat

SEQ ID NO: 24448 - DNA, 20 bp, Artificial Sequence
  Synthetic oligonucleotide; CAG chr11 5362376 5362395 5362392 +
gtatttgtagatcagatgat

SEQ ID NO: 24449 - DNA, 20 bp, Artificial Sequence
  Synthetic oligonucleotide; TGG chr11 5362383 5362402 5362399 +
tagatcagatgatcagtcta

SEQ ID NO: 24450 - DNA, 20 bp, Artificial Sequence
  Synthetic oligonucleotide; TGG chr11 5362389 5362408 5362405 +
agatgatcagtctatggctt

SEQ ID NO: 24451 - DNA, 20 bp, Artificial Sequence
  Synthetic oligonucleotide; TAG chr11 5362406 5362425 5362422 +
ctttggaaaattgtgaacat

SEQ ID NO: 24452 - DNA, 20 bp, Artificial Sequence
  Synthetic oligonucleotide; GAG chr11 5362414 5362433 5362430 +
aattgtgaacattagttgtt

SEQ ID NO: 24453 - DNA, 20 bp, Artificial Sequence
  Synthetic oligonucleotide; GAG chr11 5362426 5362445 5362442 +
tagttgttgagccttataat

SEQ ID NO: 24454 - DNA, 20 bp, Artificial Sequence
  Synthetic oligonucleotide; CAG chr11 5362445 5362464 5362461 +
tgagaatgtgatgattaaat

SEQ ID NO: 24455 - DNA, 20 bp, Artificial Sequence
  Synthetic oligonucleotide; AGG chr11 5362446 5362465 5362462 +
gagaatgtgatgattaaatc

SEQ ID NO: 24456 - DNA, 20 bp, Artificial Sequence
  Synthetic oligonucleotide; TGG chr11 5362454 5362473 5362470 +
gatgattaaatcaggtctac

SEQ ID NO: 24457 - DNA, 20 bp, Artificial Sequence
  Synthetic oligonucleotide; CAG chr11 5362468 5362487 5362484 +
gtctactggatactatgaat

SEQ ID NO: 24458 - DNA, 20 bp, Artificial Sequence
  Synthetic oligonucleotide; TAG chr11 5362473 5362492 5362489 +
ctggatactatgaatcagaa

SEQ ID NO: 24459 - DNA, 20 bp, Artificial Sequence
  Synthetic oligonucleotide; TAG chr11 5362486 5362505 5362502 +
atcagaatagataacattgt

SEQ ID NO: 24460 - DNA, 20 bp, Artificial Sequence
  Synthetic oligonucleotide; TAG chr11 5362500 5362519 5362516 +
cattgttagatataattacc

SEQ ID NO: 24461 - DNA, 20 bp, Artificial Sequence
  Synthetic oligonucleotide; CAG chr11 5362504 5362523 5362520 +
gttagatataattacctagt

SEQ ID NO: 24462 - DNA, 20 bp, Artificial Sequence
  Synthetic oligonucleotide; GAG chr11 5362506 5362525 5362522 +
tagatataattacctagtca

SEQ ID NO: 24463 - DNA, 20 bp, Artificial Sequence
  Synthetic oligonucleotide; GAG chr11 5362508 5362527 5362524 +
gatataattacctagtcaga

SEQ ID NO: 24464 - DNA, 20 bp, Artificial Sequence
  Synthetic oligonucleotide; CAG chr11 5362511 5362530 5362527 +
ataattacctagtcagagag

SEQ ID NO: 24465 - DNA, 20 bp, Artificial Sequence
  Synthetic oligonucleotide; GAG chr11 5362513 5362532 5362529 +
aattacctagtcagagagca

SEQ ID NO: 24466 - DNA, 20 bp, Artificial Sequence
  Synthetic oligonucleotide; AAG chr11 5362519 5362538 5362535 +
ctagtcagagagcagagatg

SEQ ID NO: 24467 - DNA, 20 bp, Artificial Sequence
  Synthetic oligonucleotide; CAG chr11 5362523 5362542 5362539 +
tcagagagcagagatgaagt

SEQ ID NO: 24468 - DNA, 20 bp, Artificial Sequence
  Synthetic oligonucleotide; AGG chr11 5362524 5362543 5362540 +
cagagagcagagatgaagtc

SEQ ID NO: 24469 - DNA, 20 bp, Artificial Sequence
  Synthetic oligonucleotide; AAG chr11 5362528 5362547 5362544 +
gagcagagatgaagtcagga

SEQ ID NO: 24470 - DNA, 20 bp, Artificial Sequence
  Synthetic oligonucleotide; AAG chr11 5362534 5362553 5362550 +
agatgaagtcaggaaagcaa

SEQ ID NO: 24471 - DNA, 20 bp, Artificial Sequence
  Synthetic oligonucleotide; AAG chr11 5362539 5362558 5362555 +
aagtcaggaaagcaaaagat

SEQ ID NO: 24472 - DNA, 20 bp, Artificial Sequence
  Synthetic oligonucleotide; CAG chr11 5362548 5362567 5362564 +
aagcaaaagataagaaataa

SEQ ID NO: 24473 - DNA, 20 bp, Artificial Sequence
  Synthetic oligonucleotide; AAG chr11 5362551 5362570 5362567 +
caaaagataagaaataacag

SEQ ID NO: 24474 - DNA, 20 bp, Artificial Sequence
  Synthetic oligonucleotide; TGG chr11 5362559 5362578 5362575 +
aagaaataacagaagtcttc

SEQ ID NO: 24475 - DNA, 20 bp, Artificial Sequence
  Synthetic oligonucleotide; TGG chr11 5362562 5362581 5362578 +
aaataacagaagtcttctgg

SEQ ID NO: 24476 - DNA, 20 bp, Artificial Sequence
  Synthetic oligonucleotide; CAG chr11 5362565 5362584 5362581 +
taacagaagtcttctggtgg

SEQ ID NO: 24477 - DNA, 20 bp, Artificial Sequence
  Synthetic oligonucleotide; GAG chr11 5362567 5362586 5362583 +
acagaagtcttctggtggca

SEQ ID NO: 24478 - DNA, 20 bp, Artificial Sequence
  Synthetic oligonucleotide; TGG chr11 5362570 5362589 5362586 +
gaagtcttctggtggcagag

SEQ ID NO: 24479 - DNA, 20 bp, Artificial Sequence
  Synthetic oligonucleotide; TGG chr11 5362573 5362592 5362589 +
gtcttctggtggcagagtgg

SEQ ID NO: 24480 - DNA, 20 bp, Artificial Sequence
  Synthetic oligonucleotide; TAG chr11 5362578 5362597 5362594 +
ctggtggcagagtggtggct

SEQ ID NO: 24481 - DNA, 20 bp, Artificial Sequence
  Synthetic oligonucleotide; TGG chr11 5362586 5362605 5362602 +
agagtggtggcttagcctgc

SEQ ID NO: 24482 - DNA, 20 bp, Artificial Sequence
  Synthetic oligonucleotide; GGG chr11 5362587 5362606 5362603 +
gagtggtggcttagcctgct

SEQ ID NO: 24483 - DNA, 20 bp, Artificial Sequence
  Synthetic oligonucleotide; GGG chr11 5362588 5362607 5362604 +
agtggtggcttagcctgctg

SEQ ID NO: 24484 - DNA, 20 bp, Artificial Sequence
  Synthetic oligonucleotide; TGG chr11 5362596 5362615 5362612 +
cttagcctgctggggcaaaa

SEQ ID NO: 24485 - DNA, 20 bp, Artificial Sequence
  Synthetic oligonucleotide; GAG chr11 5362598 5362617 5362614 +
tagcctgctggggcaaaatg

SEQ ID NO: 24486 - DNA, 20 bp, Artificial Sequence
  Synthetic oligonucleotide; AAG chr11 5362604 5362623 5362620 +
gctggggcaaaatggagctc

SEQ ID NO: 24487 - DNA, 20 bp, Artificial Sequence
  Synthetic oligonucleotide; AGG chr11 5362605 5362624 5362621 +
ctggggcaaaatggagctca

SEQ ID NO: 24488 - DNA, 20 bp, Artificial Sequence
  Synthetic oligonucleotide; GAG chr11 5362612 5362631 5362628 +
aaaatggagctcaaggccat

SEQ ID NO: 24489 - DNA, 20 bp, Artificial Sequence
  Synthetic oligonucleotide; CAG chr11 5362615 5362634 5362631 +
atggagctcaaggccatgag

SEQ ID NO: 24490 - DNA, 20 bp, Artificial Sequence
  Synthetic oligonucleotide; CAG chr11 5362624 5362643 5362640 +
aaggccatgagcagatacaa

SEQ ID NO: 24491 - DNA, 20 bp, Artificial Sequence
  Synthetic oligonucleotide; CGG chr11 5362629 5362648 5362645 +
catgagcagatacaacagcc

SEQ ID NO: 24492 - DNA, 20 bp, Artificial Sequence
  Synthetic oligonucleotide; CAG chr11 5362638 5362657 5362654 +
atacaacagcccggtcaacc

SEQ ID NO: 24493 - DNA, 20 bp, Artificial Sequence
  Synthetic oligonucleotide; TAG chr11 5362662 5362681 5362678 +
tgtcttcccccatctgattg

SEQ ID NO: 24494 - DNA, 20 bp, Artificial Sequence
  Synthetic oligonucleotide; GAG chr11 5362664 5362683 5362680 +
tcttcccccatctgattgta

SEQ ID NO: 24495 - DNA, 20 bp, Artificial Sequence
  Synthetic oligonucleotide; TGG chr11 5362671 5362690 5362687 +
ccatctgattgtagagcttt

SEQ ID NO: 24496 - DNA, 20 bp, Artificial Sequence
  Synthetic oligonucleotide; TGG chr11 5362697 5362716 5362713 +
tcgacatgttcttcaccacc

SEQ ID NO: 24497 - DNA, 20 bp, Artificial Sequence
  Synthetic oligonucleotide; GAG chr11 5362712 5362731 5362728 +
ccacctggttctttgtttac

SEQ ID NO: 24498 - DNA, 20 bp, Artificial Sequence
  Synthetic oligonucleotide; AGG chr11 5362713 5362732 5362729 +
cacctggttctttgtttacg

SEQ ID NO: 24499 - DNA, 20 bp, Artificial Sequence
  Synthetic oligonucleotide; AAG chr11 5362727 5362746 5362743 +
tttacgaggtcacctctacc

SEQ ID NO: 24500 - DNA, 20 bp, Artificial Sequence
  Synthetic oligonucleotide; AAG chr11 5362749 5362768 5362765 +
gtacacttgtgatatctata

SEQ ID NO: 24501 - DNA, 20 bp, Artificial Sequence
  Synthetic oligonucleotide; GAG chr11 5362751 5362770 5362767 +
acacttgtgatatctataaa

SEQ ID NO: 24502 - DNA, 20 bp, Artificial Sequence
  Synthetic oligonucleotide; TGG chr11 5362762 5362781 5362778 +
atctataaagagtatctcct

SEQ ID NO: 24503 - DNA, 20 bp, Artificial Sequence
  Synthetic oligonucleotide; TGG chr11 5362765 5362784 5362781 +
tataaagagtatctccttgg

SEQ ID NO: 24504 - DNA, 20 bp, Artificial Sequence
  Synthetic oligonucleotide; TGG chr11 5362780 5362799 5362796 +
cttggtggcctcactcttca

SEQ ID NO: 24505 - DNA, 20 bp, Artificial Sequence
  Synthetic oligonucleotide; GGG chr11 5362781 5362800 5362797 +
ttggtggcctcactcttcat

SEQ ID NO: 24506 - DNA, 20 bp, Artificial Sequence
  Synthetic oligonucleotide; AAG chr11 5362789 5362808 5362805 +
ctcactcttcatgggctttg

SEQ ID NO: 24507 - DNA, 20 bp, Artificial Sequence
  Synthetic oligonucleotide; TGG chr11 5362809 5362828 5362825 +
aagtcctcttcctgatgctc

SEQ ID NO: 24508 - DNA, 20 bp, Artificial Sequence
  Synthetic oligonucleotide; GGG chr11 5362810 5362829 5362826 +
agtcctcttcctgatgctct

SEQ ID NO: 24509 - DNA, 20 bp, Artificial Sequence
  Synthetic oligonucleotide; TGG chr11 5362814 5362833 5362830 +
ctcttcctgatgctctgggt

SEQ ID NO: 24510 - DNA, 20 bp, Artificial Sequence
  Synthetic oligonucleotide; GAG chr11 5362828 5362847 5362844 +
ctgggttggcatctacatgt

SEQ ID NO: 24511 - DNA, 20 bp, Artificial Sequence
  Synthetic oligonucleotide; AAG chr11 5362836 5362855 5362852 +
gcatctacatgtgagtgccc

SEQ ID NO: 24512 - DNA, 20 bp, Artificial Sequence
  Synthetic oligonucleotide; GAG chr11 5362838 5362857 5362854 +
atctacatgtgagtgcccaa

SEQ ID NO: 24513 - DNA, 20 bp, Artificial Sequence
  Synthetic oligonucleotide; CAG chr11 5362848 5362867 5362864 +
gagtgcccaagagtaacaac

SEQ ID NO: 24514 - DNA, 20 bp, Artificial Sequence
  Synthetic oligonucleotide; AGG chr11 5362849 5362868 5362865 +
agtgcccaagagtaacaacc

SEQ ID NO: 24515 - DNA, 20 bp, Artificial Sequence
  Synthetic oligonucleotide; TGG chr11 5362852 5362871 5362868 +
gcccaagagtaacaaccagg

SEQ ID NO: 24516 - DNA, 20 bp, Artificial Sequence
  Synthetic oligonucleotide; AAG chr11 5362883 5362902 5362899 +
aatccctgcttttgtaaatt

SEQ ID NO: 24517 - DNA, 20 bp, Artificial Sequence
  Synthetic oligonucleotide; TGG chr11 5362901 5362920 5362917 +
ttaagttttctttctattgc

SEQ ID NO: 24518 - DNA, 20 bp, Artificial Sequence
  Synthetic oligonucleotide; AAG chr11 5362904 5362923 5362920 +
agttttctttctattgctgg

SEQ ID NO: 24519 - DNA, 20 bp, Artificial Sequence
  Synthetic oligonucleotide; CAG chr11 5362934 5362953 5362950 +
cctgttgcttataataaatg

SEQ ID NO: 24520 - DNA, 20 bp, Artificial Sequence
  Synthetic oligonucleotide; TGG chr11 5362942 5362961 5362958 +
ttataataaatgcagatgta

SEQ ID NO: 24521 - DNA, 20 bp, Artificial Sequence
  Synthetic oligonucleotide; AAG chr11 5362959 5362978 5362975 +
gtatggcattaaaaaaaaaa

SEQ ID NO: 24522 - DNA, 20 bp, Artificial Sequence
  Synthetic oligonucleotide; TAG chr11 5362968 5362987 5362984 +
taaaaaaaaaaaagaaataa

SEQ ID NO: 24523 - DNA, 20 bp, Artificial Sequence
  Synthetic oligonucleotide; AAG chr11 5362971 5362990 5362987 +
aaaaaaaaaagaaataatag

SEQ ID NO: 24524 - DNA, 20 bp, Artificial Sequence
  Synthetic oligonucleotide; TAG chr11 5362975 5362994 5362991 +
aaaaaagaaataatagaagt

SEQ ID NO: 24525 - DNA, 20 bp, Artificial Sequence
  Synthetic oligonucleotide; AGG chr11 5362976 5362995 5362992 +
aaaaagaaataatagaagtt

SEQ ID NO: 24526 - DNA, 20 bp, Artificial Sequence
  Synthetic oligonucleotide; CAG chr11 5362979 5362998 5362995 +
aagaaataatagaagttagg

SEQ ID NO: 24527 - DNA, 20 bp, Artificial Sequence
  Synthetic oligonucleotide; AGG chr11 5362980 5362999 5362996 +
agaaataatagaagttaggc

SEQ ID NO: 24528 - DNA, 20 bp, Artificial Sequence
  Synthetic oligonucleotide; GGG chr11 5362981 5363000 5362997 +
gaaataatagaagttaggca

SEQ ID NO: 24529 - DNA, 20 bp, Artificial Sequence
  Synthetic oligonucleotide; TGG chr11 5362986 5363005 5363002 +
aatagaagttaggcagggat

SEQ ID NO: 24530 - DNA, 20 bp, Artificial Sequence
  Synthetic oligonucleotide; GGG chr11 5362987 5363006 5363003 +
atagaagttaggcagggatt

SEQ ID NO: 24531 - DNA, 20 bp, Artificial Sequence
  Synthetic oligonucleotide; GGG chr11 5362988 5363007 5363004 +
tagaagttaggcagggattg

SEQ ID NO: 24532 - DNA, 20 bp, Artificial Sequence
  Synthetic oligonucleotide; AAG chr11 5362995 5363014 5363011 +
taggcagggattggggcatg

SEQ ID NO: 24533 - DNA, 20 bp, Artificial Sequence
  Synthetic oligonucleotide; AGG chr11 5362996 5363015 5363012 +
aggcagggattggggcatga

SEQ ID NO: 24534 - DNA, 20 bp, Artificial Sequence
  Synthetic oligonucleotide; AAG chr11 5363007 5363026 5363023 +
ggggcatgaaggttgaaaac

SEQ ID NO: 24535 - DNA, 20 bp, Artificial Sequence
  Synthetic oligonucleotide; AGG chr11 5363008 5363027 5363024 +
gggcatgaaggttgaaaaca

SEQ ID NO: 24536 - DNA, 20 bp, Artificial Sequence
  Synthetic oligonucleotide; AAG chr11 5363013 5363032 5363029 +
tgaaggttgaaaacaaggaa

SEQ ID NO: 24537 - DNA, 20 bp, Artificial Sequence
  Synthetic oligonucleotide; AGG chr11 5363014 5363033 5363030 +
gaaggttgaaaacaaggaaa

SEQ ID NO: 24538 - DNA, 20 bp, Artificial Sequence
  Synthetic oligonucleotide; GAG chr11 5363016 5363035 5363032 +
aggttgaaaacaaggaaaag

SEQ ID NO: 24539 - DNA, 20 bp, Artificial Sequence
  Synthetic oligonucleotide; AAG chr11 5363022 5363041 5363038 +
aaaacaaggaaaaggagccc

SEQ ID NO: 24540 - DNA, 20 bp, Artificial Sequence
  Synthetic oligonucleotide; AGG chr11 5363023 5363042 5363039 +
aaacaaggaaaaggagccca

SEQ ID NO: 24541 - DNA, 20 bp, Artificial Sequence
  Synthetic oligonucleotide; AAG chr11 5363032 5363051 5363048 +
aaaggagcccaaggaaatgc

SEQ ID NO: 24542 - DNA, 20 bp, Artificial Sequence
  Synthetic oligonucleotide; AAG chr11 5363051 5363070 5363067 +
caagtgttgtaaaatgtgct

SEQ ID NO: 24543 - DNA, 20 bp, Artificial Sequence
  Synthetic oligonucleotide; TAG chr11 5363054 5363073 5363070 +
gtgttgtaaaatgtgctaag

SEQ ID NO: 24544 - DNA, 20 bp, Artificial Sequence
  Synthetic oligonucleotide; GAG chr11 5363063 5363082 5363079 +
aatgtgctaagtagatgtct

SEQ ID NO: 24545 - DNA, 20 bp, Artificial Sequence
  Synthetic oligonucleotide; TGG chr11 5363066 5363085 5363082 +
gtgctaagtagatgtctgag

SEQ ID NO: 24546 - DNA, 20 bp, Artificial Sequence
  Synthetic oligonucleotide; GAG chr11 5363080 5363099 5363096 +
tctgagtggcattcctccat

SEQ ID NO: 24547 - DNA, 20 bp, Artificial Sequence
  Synthetic oligonucleotide; GAG chr11 5363082 5363101 5363098 +
tgagtggcattcctccatga

SEQ ID NO: 24548 - DNA, 20 bp, Artificial Sequence
  Synthetic oligonucleotide; AAG chr11 5363086 5363105 5363102 +
tggcattcctccatgagaga

SEQ ID NO: 24549 - DNA, 20 bp, Artificial Sequence
  Synthetic oligonucleotide; AAG chr11 5363092 5363111 5363108 +
tcctccatgagagaaagctt

SEQ ID NO: 24550 - DNA, 20 bp, Artificial Sequence
  Synthetic oligonucleotide; AGG chr11 5363093 5363112 5363109 +
cctccatgagagaaagctta

SEQ ID NO: 24551 - DNA, 20 bp, Artificial Sequence
  Synthetic oligonucleotide; GGG chr11 5363094 5363113 5363110 +
ctccatgagagaaagcttaa

SEQ ID NO: 24552 - DNA, 20 bp, Artificial Sequence
  Synthetic oligonucleotide; AAG chr11 5363097 5363116 5363113 +
catgagagaaagcttaaggg

SEQ ID NO: 24553 - DNA, 20 bp, Artificial Sequence
  Synthetic oligonucleotide; AAG chr11 5363101 5363120 5363117 +
agagaaagcttaagggaaga

SEQ ID NO: 24554 - DNA, 20 bp, Artificial Sequence
  Synthetic oligonucleotide; GAG chr11 5363103 5363122 5363119 +
agaaagcttaagggaagaaa

SEQ ID NO: 24555 - DNA, 20 bp, Artificial Sequence
  Synthetic oligonucleotide; GAG chr11 5363111 5363130 5363127 +
taagggaagaaagagaccct

SEQ ID NO: 24556 - DNA, 20 bp, Artificial Sequence
  Synthetic oligonucleotide; AAG chr11 5363129 5363148 5363145 +
ctgagtgtcttcaaaactca

SEQ ID NO: 24557 - DNA, 20 bp, Artificial Sequence
  Synthetic oligonucleotide; CAG chr11 5363141 5363160 5363157 +
aaaactcaaagttttacgaa

SEQ ID NO: 24558 - DNA, 20 bp, Artificial Sequence
  Synthetic oligonucleotide; TAG chr11 5363150 5363169 5363166 +
agttttacgaacagaatgat

SEQ ID NO: 24559 - DNA, 20 bp, Artificial Sequence
  Synthetic oligonucleotide; TGG chr11 5363155 5363174 5363171 +
tacgaacagaatgattagtc

SEQ ID NO: 24560 - DNA, 20 bp, Artificial Sequence
  Synthetic oligonucleotide; GAG chr11 5363157 5363176 5363173 +
cgaacagaatgattagtctg

SEQ ID NO: 24561 - DNA, 20 bp, Artificial Sequence
  Synthetic oligonucleotide; CAG chr11 5363179 5363198 5363195 +
gaaatcatttttcatcaata

SEQ ID NO: 24562 - DNA, 20 bp, Artificial Sequence
  Synthetic oligonucleotide; AGG chr11 5363180 5363199 5363196 +
aaatcatttttcatcaatac

SEQ ID NO: 24563 - DNA, 20 bp, Artificial Sequence
  Synthetic oligonucleotide; AAG chr11 5363188 5363207 5363204 +
tttcatcaatacaggatctc

SEQ ID NO: 24564 - DNA, 20 bp, Artificial Sequence
  Synthetic oligonucleotide; CGG chr11 5363267 5363286 5363283 +
acacacacacacacacacac

SEQ ID NO: 24565 - DNA, 20 bp, Artificial Sequence
  Synthetic oligonucleotide; GAG chr11 5363271 5363290 5363287 +
acacacacacacacaccggt

SEQ ID NO: 24566 - DNA, 20 bp, Artificial Sequence
  Synthetic oligonucleotide; TGG chr11 5363274 5363293 5363290 +
cacacacacacaccggtgag

SEQ ID NO: 24567 - DNA, 20 bp, Artificial Sequence
  Synthetic oligonucleotide; CAG chr11 5363278 5363297 5363294 +
cacacacaccggtgagtgga

SEQ ID NO: 24568 - DNA, 20 bp, Artificial Sequence
  Synthetic oligonucleotide; AAG chr11 5363293 5363312 5363309 +
gtggacagacatcgtttttc

SEQ ID NO: 24569 - DNA, 20 bp, Artificial Sequence
  Synthetic oligonucleotide; CAG chr11 5363304 5363323 5363320 +
tcgtttttcaagtcatgatg

SEQ ID NO: 24570 - DNA, 20 bp, Artificial Sequence
  Synthetic oligonucleotide; CAG chr11 5363307 5363326 5363323 +
tttttcaagtcatgatgcag

SEQ ID NO: 24571 - DNA, 20 bp, Artificial Sequence
  Synthetic oligonucleotide; TGG chr11 5363313 5363332 5363329 +
aagtcatgatgcagcagtat

SEQ ID NO: 24572 - DNA, 20 bp, Artificial Sequence
  Synthetic oligonucleotide; CAG chr11 5363321 5363340 5363337 +
atgcagcagtattggaatta

SEQ ID NO: 24573 - DNA, 20 bp, Artificial Sequence
  Synthetic oligonucleotide; TGG chr11 5363331 5363350 5363347 +
attggaattacagttttttt

SEQ ID NO: 24574 - DNA, 20 bp, Artificial Sequence
  Synthetic oligonucleotide; AAG chr11 5363354 5363373 5363370 +
tttttgtttttttttacttc

SEQ ID NO: 24575 - DNA, 20 bp, Artificial Sequence
  Synthetic oligonucleotide; TGG chr11 5363360 5363379 5363376 +
tttttttttacttcaagcta

SEQ ID NO: 24576 - DNA, 20 bp, Artificial Sequence
  Synthetic oligonucleotide; GAG chr11 5363367 5363386 5363383 +
ttacttcaagctatggtgtt

SEQ ID NO: 24577 - DNA, 20 bp, Artificial Sequence
  Synthetic oligonucleotide; AAG chr11 5363404 5363423 5363420 +
caccaattaattgttccttt

SEQ ID NO: 24578 - DNA, 20 bp, Artificial Sequence
  Synthetic oligonucleotide; AAG chr11 5363455 5363474 5363471 +
acactctctctctcacacaa

SEQ ID NO: 24579 - DNA, 20 bp, Artificial Sequence
  Synthetic oligonucleotide; CAG chr11 5363496 5363515 5363512 +
aaacacacatcaccaccact

SEQ ID NO: 24580 - DNA, 20 bp, Artificial Sequence
  Synthetic oligonucleotide; GAG chr11 5363505 5363524 5363521 +
tcaccaccactcagctccat

SEQ ID NO: 24581 - DNA, 20 bp, Artificial Sequence
  Synthetic oligonucleotide; AGG chr11 5363506 5363525 5363522 +
caccaccactcagctccatg

SEQ ID NO: 24582 - DNA, 20 bp, Artificial Sequence
  Synthetic oligonucleotide; AAG chr11 5363533 5363552 5363549 +
ctcactacttttattaaacc

SEQ ID NO: 24583 - DNA, 20 bp, Artificial Sequence
  Synthetic oligonucleotide; CAG chr11 5363538 5363557 5363554 +
tacttttattaaaccaagca

SEQ ID NO: 24584 - DNA, 20 bp, Artificial Sequence
  Synthetic oligonucleotide; AAG chr11 5363546 5363565 5363562 +
ttaaaccaagcacagatacc

SEQ ID NO: 24585 - DNA, 20 bp, Artificial Sequence
  Synthetic oligonucleotide; GAG chr11 5363554 5363573 5363570 +
agcacagataccaagttttt

SEQ ID NO: 24586 - DNA, 20 bp, Artificial Sequence
  Synthetic oligonucleotide; CAG chr11 5363565 5363584 5363581 +
caagtttttgagtgtgaatg

SEQ ID NO: 24587 - DNA, 20 bp, Artificial Sequence
  Synthetic oligonucleotide; AAG chr11 5363569 5363588 5363585 +
tttttgagtgtgaatgcaga

SEQ ID NO: 24588 - DNA, 20 bp, Artificial Sequence
  Synthetic oligonucleotide; AAG chr11 5363572 5363591 5363588 +
ttgagtgtgaatgcagaaag

SEQ ID NO: 24589 - DNA, 20 bp, Artificial Sequence
  Synthetic oligonucleotide; GAG chr11 5363582 5363601 5363598 +
atgcagaaagaagatatatt

SEQ ID NO: 24590 - DNA, 20 bp, Artificial Sequence
  Synthetic oligonucleotide; AGG chr11 5363583 5363602 5363599 +
tgcagaaagaagatatattg

SEQ ID NO: 24591 - DNA, 20 bp, Artificial Sequence
  Synthetic oligonucleotide; TAG chr11 5363586 5363605 5363602 +
agaaagaagatatattgagg

SEQ ID NO: 24592 - DNA, 20 bp, Artificial Sequence
  Synthetic oligonucleotide; TAG chr11 5363599 5363618 5363615 +
attgaggtagatttttctca

SEQ ID NO: 24593 - DNA, 20 bp, Artificial Sequence
  Synthetic oligonucleotide; AAG chr11 5363610 5363629 5363626 +
tttttctcatagatactact

SEQ ID NO: 24594 - DNA, 20 bp, Artificial Sequence
  Synthetic oligonucleotide; TGG chr11 5363624 5363643 5363640 +
actactaagattatattgtc

SEQ ID NO: 24595 - DNA, 20 bp, Artificial Sequence
  Synthetic oligonucleotide; CAG chr11 5363641 5363660 5363657 +
gtctggaatcttatgtgaca

SEQ ID NO: 24596 - DNA, 20 bp, Artificial Sequence
  Synthetic oligonucleotide; AAG chr11 5363647 5363666 5363663 +
aatcttatgtgacacagaaa

SEQ ID NO: 24597 - DNA, 20 bp, Artificial Sequence
  Synthetic oligonucleotide; TGG chr11 5363665 5363684 5363681 +
aaaagaacaactctgccatt

SEQ ID NO: 24598 - DNA, 20 bp, Artificial Sequence
  Synthetic oligonucleotide; TGG chr11 5363683 5363702 5363699 +
tttggccatttgcttgtgtt

SEQ ID NO: 24599 - DNA, 20 bp, Artificial Sequence
  Synthetic oligonucleotide; AAG chr11 5363693 5363712 5363709 +
tgcttgtgtttggacttgtg

SEQ ID NO: 24600 - DNA, 20 bp, Artificial Sequence
  Synthetic oligonucleotide; AGG chr11 5363694 5363713 5363710 +
gcttgtgtttggacttgtga

SEQ ID NO: 24601 - DNA, 20 bp, Artificial Sequence
  Synthetic oligonucleotide; TGG chr11 5363717 5363736 5363733 +
tctttccatcattctgttat

SEQ ID NO: 24602 - DNA, 20 bp, Artificial Sequence
  Synthetic oligonucleotide; AAG chr11 5363721 5363740 5363737 +
tccatcattctgttattgga

SEQ ID NO: 24603 - DNA, 20 bp, Artificial Sequence
  Synthetic oligonucleotide; CGG chr11 5363724 5363743 5363740 +
atcattctgttattggaaag

SEQ ID NO: 24604 - DNA, 20 bp, Artificial Sequence
  Synthetic oligonucleotide; GGG chr11 5363725 5363744 5363741 +
tcattctgttattggaaagc

SEQ ID NO: 24605 - DNA, 20 bp, Artificial Sequence
  Synthetic oligonucleotide; AAG chr11 5363729 5363748 5363745 +
tctgttattggaaagcggga

SEQ ID NO: 24606 - DNA, 20 bp, Artificial Sequence
  Synthetic oligonucleotide; TAG chr11 5363732 5363751 5363748 +
gttattggaaagcgggaaag

SEQ ID NO: 24607 - DNA, 20 bp, Artificial Sequence
  Synthetic oligonucleotide; GAG chr11 5363744 5363763 5363760 +
cgggaaagtagcattttcat

SEQ ID NO: 24608 - DNA, 20 bp, Artificial Sequence
  Synthetic oligonucleotide; AGG chr11 5363745 5363764 5363761 +
gggaaagtagcattttcatg

SEQ ID NO: 24609 - DNA, 20 bp, Artificial Sequence
  Synthetic oligonucleotide; TAG chr11 5363762 5363781 5363778 +
atgaggattctattaaaaac

SEQ ID NO: 24610 - DNA, 20 bp, Artificial Sequence
  Synthetic oligonucleotide; AGG chr11 5363763 5363782 5363779 +
tgaggattctattaaaaact

SEQ ID NO: 24611 - DNA, 20 bp, Artificial Sequence
  Synthetic oligonucleotide; GGG chr11 5363764 5363783 5363780 +
gaggattctattaaaaacta

SEQ ID NO: 24612 - DNA, 20 bp, Artificial Sequence
  Synthetic oligonucleotide; CAG chr11 5363784 5363803 5363800 +
gggaccatatgcaatacatc

SEQ ID NO: 24613 - DNA, 20 bp, Artificial Sequence
  Synthetic oligonucleotide; TAG chr11 5363795 5363814 5363811 +
caatacatccagactatatt

SEQ ID NO: 24614 - DNA, 20 bp, Artificial Sequence
  Synthetic oligonucleotide; TAG chr11 5363805 5363824 5363821 +
agactatatttagtgtacaa

SEQ ID NO: 24615 - DNA, 20 bp, Artificial Sequence
  Synthetic oligonucleotide; AAG chr11 5363809 5363828 5363825 +
tatatttagtgtacaataga

SEQ ID NO: 24616 - DNA, 20 bp, Artificial Sequence
  Synthetic oligonucleotide; TAG chr11 5363821 5363840 5363837 +
acaatagaaagcaattacca

SEQ ID NO: 24617 - DNA, 20 bp, Artificial Sequence
  Synthetic oligonucleotide; TAG chr11 5363837 5363856 5363853 +
accatagcaattatgttccc

SEQ ID NO: 24618 - DNA, 20 bp, Artificial Sequence
  Synthetic oligonucleotide; CAG chr11 5363863 5363882 5363879 +
tcttctctctttgcaaaccc

SEQ ID NO: 24619 - DNA, 20 bp, Artificial Sequence
  Synthetic oligonucleotide; CAG chr11 5363874 5363893 5363890 +
tgcaaaccccagcccccact

SEQ ID NO: 24620 - DNA, 20 bp, Artificial Sequence
  Synthetic oligonucleotide; TGG chr11 5363884 5363903 5363900 +
agcccccactcagcatgaca

SEQ ID NO: 24621 - DNA, 20 bp, Artificial Sequence
  Synthetic oligonucleotide; CAG chr11 5363887 5363906 5363903 +
ccccactcagcatgacatgg

SEQ ID NO: 24622 - DNA, 20 bp, Artificial Sequence
  Synthetic oligonucleotide; AGG chr11 5363888 5363907 5363904 +
cccactcagcatgacatggc

SEQ ID NO: 24623 - DNA, 20 bp, Artificial Sequence
  Synthetic oligonucleotide; TAG chr11 5363899 5363918 5363915 +
tgacatggcaggtataaaaa

SEQ ID NO: 24624 - DNA, 20 bp, Artificial Sequence
  Synthetic oligonucleotide; AGG chr11 5363900 5363919 5363916 +
gacatggcaggtataaaaat

SEQ ID NO: 24625 - DNA, 20 bp, Artificial Sequence
  Synthetic oligonucleotide; CAG chr11 5363908 5363927 5363924 +
aggtataaaaataggcaact

SEQ ID NO: 24626 - DNA, 20 bp, Artificial Sequence
  Synthetic oligonucleotide; AAG chr11 5363924 5363943 5363940 +
aactcagacccatttctgta

SEQ ID NO: 24627 - DNA, 20 bp, Artificial Sequence
  Synthetic oligonucleotide; AGG chr11 5363925 5363944 5363941 +
actcagacccatttctgtaa

SEQ ID NO: 24628 - DNA, 20 bp, Artificial Sequence
  Synthetic oligonucleotide; GAG chr11 5363927 5363946 5363943 +
tcagacccatttctgtaaag

SEQ ID NO: 24629 - DNA, 20 bp, Artificial Sequence
  Synthetic oligonucleotide; AGG chr11 5363928 5363947 5363944 +
cagacccatttctgtaaagg

SEQ ID NO: 24630 - DNA, 20 bp, Artificial Sequence
  Synthetic oligonucleotide; GAG chr11 5363930 5363949 5363946 +
gacccatttctgtaaaggag

SEQ ID NO: 24631 - DNA, 20 bp, Artificial Sequence
  Synthetic oligonucleotide; AAG chr11 5363933 5363952 5363949 +
ccatttctgtaaaggaggag

SEQ ID NO: 24632 - DNA, 20 bp, Artificial Sequence
  Synthetic oligonucleotide; TAG chr11 5363943 5363962 5363959 +
aaaggaggagaagcttgtgt

SEQ ID NO: 24633 - DNA, 20 bp, Artificial Sequence
  Synthetic oligonucleotide; AGG chr11 5363944 5363963 5363960 +
aaggaggagaagcttgtgtt

SEQ ID NO: 24634 - DNA, 20 bp, Artificial Sequence
  Synthetic oligonucleotide; TGG chr11 5363949 5363968 5363965 +
ggagaagcttgtgttaggaa

SEQ ID NO: 24635 - DNA, 20 bp, Artificial Sequence
  Synthetic oligonucleotide; AAG chr11 5363952 5363971 5363968 +
gaagcttgtgttaggaatgg

SEQ ID NO: 24636 - DNA, 20 bp, Artificial Sequence
  Synthetic oligonucleotide; TGG chr11 5363961 5363980 5363977 +
gttaggaatggaagaatgcc

SEQ ID NO: 24637 - DNA, 20 bp, Artificial Sequence
  Synthetic oligonucleotide; GGG chr11 5363962 5363981 5363978 +
ttaggaatggaagaatgcct

SEQ ID NO: 24638 - DNA, 20 bp, Artificial Sequence
  Synthetic oligonucleotide; TGG chr11 5363966 5363985 5363982 +
gaatggaagaatgcctgggc

SEQ ID NO: 24639 - DNA, 20 bp, Artificial Sequence
  Synthetic oligonucleotide; GAG chr11 5363968 5363987 5363984 +
atggaagaatgcctgggctg

SEQ ID NO: 24640 - DNA, 20 bp, Artificial Sequence
  Synthetic oligonucleotide; CAG chr11 5363973 5363992 5363989 +
agaatgcctgggctggagaa

SEQ ID NO: 24641 - DNA, 20 bp, Artificial Sequence
  Synthetic oligonucleotide; AGG chr11 5363974 5363993 5363990 +
gaatgcctgggctggagaac

SEQ ID NO: 24642 - DNA, 20 bp, Artificial Sequence
  Synthetic oligonucleotide; GGG chr11 5363975 5363994 5363991 +
aatgcctgggctggagaaca

SEQ ID NO: 24643 - DNA, 20 bp, Artificial Sequence
  Synthetic oligonucleotide; CAG chr11 5363986 5364005 5364002 +
tggagaacagggcttcacaa

SEQ ID NO: 24644 - DNA, 20 bp, Artificial Sequence
  Synthetic oligonucleotide; TAG chr11 5363991 5364010 5364007 +
aacagggcttcacaacagtg

SEQ ID NO: 24645 - DNA, 20 bp, Artificial Sequence
  Synthetic oligonucleotide; TAG chr11 5363997 5364016 5364013 +
gcttcacaacagtgtagtga

SEQ ID NO: 24646 - DNA, 20 bp, Artificial Sequence
  Synthetic oligonucleotide; TGG chr11 5364023 5364042 5364039 +
cacccacatattatgtgatg

SEQ ID NO: 24647 - DNA, 20 bp, Artificial Sequence
  Synthetic oligonucleotide; GAG chr11 5364032 5364051 5364048 +
attatgtgatgtggacctct

SEQ ID NO: 24648 - DNA, 20 bp, Artificial Sequence
  Synthetic oligonucleotide; CAG chr11 5364036 5364055 5364052 +
tgtgatgtggacctctgagc

SEQ ID NO: 24649 - DNA, 20 bp, Artificial Sequence
  Synthetic oligonucleotide; AGG chr11 5364037 5364056 5364053 +
gtgatgtggacctctgagcc

SEQ ID NO: 24650 - DNA, 20 bp, Artificial Sequence
  Synthetic oligonucleotide; TGG chr11 5364057 5364076 5364073 +
aggtactatctcattctcca

SEQ ID NO: 24651 - DNA, 20 bp, Artificial Sequence
  Synthetic oligonucleotide; AAG chr11 5364067 5364086 5364083 +
tcattctccatggttgcaat

SEQ ID NO: 24652 - DNA, 20 bp, Artificial Sequence
  Synthetic oligonucleotide; AGG chr11 5364068 5364087 5364084 +
cattctccatggttgcaata

SEQ ID NO: 24653 - DNA, 20 bp, Artificial Sequence
  Synthetic oligonucleotide; TAG chr11 5364078 5364097 5364094 +
ggttgcaataaggtcgatta

SEQ ID NO: 24654 - DNA, 20 bp, Artificial Sequence
  Synthetic oligonucleotide; AAG chr11 5364089 5364108 5364105 +
ggtcgattatagattcaata

SEQ ID NO: 24655 - DNA, 20 bp, Artificial Sequence
  Synthetic oligonucleotide; AGG chr11 5364090 5364109 5364106 +
gtcgattatagattcaataa

SEQ ID NO: 24656 - DNA, 20 bp, Artificial Sequence
  Synthetic oligonucleotide; AAG chr11 5364093 5364112 5364109 +
gattatagattcaataaagg

SEQ ID NO: 24657 - DNA, 20 bp, Artificial Sequence
  Synthetic oligonucleotide; GAG chr11 5364095 5364114 5364111 +
ttatagattcaataaaggaa

SEQ ID NO: 24658 - DNA, 20 bp, Artificial Sequence
  Synthetic oligonucleotide; AGG chr11 5364096 5364115 5364112 +
tatagattcaataaaggaag

SEQ ID NO: 24659 - DNA, 20 bp, Artificial Sequence
  Synthetic oligonucleotide; AAG chr11 5364112 5364131 5364128 +
gaagaggtatctcaacacta

SEQ ID NO: 24660 - DNA, 20 bp, Artificial Sequence
  Synthetic oligonucleotide; AAG chr11 5364116 5364135 5364132 +
aggtatctcaacactaaaga

SEQ ID NO: 24661 - DNA, 20 bp, Artificial Sequence
  Synthetic oligonucleotide; GAG chr11 5364118 5364137 5364134 +
gtatctcaacactaaagaaa

SEQ ID NO: 24662 - DNA, 20 bp, Artificial Sequence
  Synthetic oligonucleotide; CAG chr11 5364130 5364149 5364146 +
taaagaaagagtaaaatttt

SEQ ID NO: 24663 - DNA, 20 bp, Artificial Sequence
  Synthetic oligonucleotide; AGG chr11 5364131 5364150 5364147 +
aaagaaagagtaaaattttc

SEQ ID NO: 24664 - DNA, 20 bp, Artificial Sequence
  Synthetic oligonucleotide; GGG chr11 5364132 5364151 5364148 +
aagaaagagtaaaattttca

SEQ ID NO: 24665 - DNA, 20 bp, Artificial Sequence
  Synthetic oligonucleotide; AAG chr11 5364141 5364160 5364157 +
taaaattttcagggttcaac

SEQ ID NO: 24666 - DNA, 20 bp, Artificial Sequence
  Synthetic oligonucleotide; AAG chr11 5364153 5364172 5364169 +
ggttcaacaagcgaccacct

SEQ ID NO: 24667 - DNA, 20 bp, Artificial Sequence
  Synthetic oligonucleotide; AGG chr11 5364154 5364173 5364170 +
gttcaacaagcgaccaccta

SEQ ID NO: 24668 - DNA, 20 bp, Artificial Sequence
  Synthetic oligonucleotide; GGG chr11 5364155 5364174 5364171 +
ttcaacaagcgaccacctaa

SEQ ID NO: 24669 - DNA, 20 bp, Artificial Sequence
  Synthetic oligonucleotide; AAG chr11 5364189 5364208 5364205 +
cctaaattttgacaaacttt

SEQ ID NO: 24670 - DNA, 20 bp, Artificial Sequence
  Synthetic oligonucleotide; AAG chr11 5364198 5364217 5364214 +
tgacaaactttaagttcaaa

SEQ ID NO: 24671 - DNA, 20 bp, Artificial Sequence
  Synthetic oligonucleotide; TAG chr11 5364207 5364226 5364223 +
ttaagttcaaaaagctcatc

SEQ ID NO: 24672 - DNA, 20 bp, Artificial Sequence
  Synthetic oligonucleotide; AAG chr11 5364218 5364237 5364234 +
aagctcatctagctatgaca

SEQ ID NO: 24673 - DNA, 20 bp, Artificial Sequence
  Synthetic oligonucleotide; TAG chr11 5364228 5364247 5364244 +
agctatgacaaagtttgaca

SEQ ID NO: 24674 - DNA, 20 bp, Artificial Sequence
  Synthetic oligonucleotide; TAG chr11 5364232 5364251 5364248 +
atgacaaagtttgacatagt

SEQ ID NO: 24675 - DNA, 20 bp, Artificial Sequence
  Synthetic oligonucleotide; GAG chr11 5364237 5364256 5364253 +
aaagtttgacatagttagat

SEQ ID NO: 24676 - DNA, 20 bp, Artificial Sequence
  Synthetic oligonucleotide; TGG chr11 5364299 5364318 5364315 +
tcttgacttcacaaaaccat

SEQ ID NO: 24677 - DNA, 20 bp, Artificial Sequence
  Synthetic oligonucleotide; TGG chr11 5364306 5364325 5364322 +
ttcacaaaaccattggaatt

SEQ ID NO: 24678 - DNA, 20 bp, Artificial Sequence
  Synthetic oligonucleotide; GGG chr11 5364307 5364326 5364323 +
tcacaaaaccattggaattt

SEQ ID NO: 24679 - DNA, 20 bp, Artificial Sequence
  Synthetic oligonucleotide; GGG chr11 5364308 5364327 5364324 +
cacaaaaccattggaatttg

SEQ ID NO: 24680 - DNA, 20 bp, Artificial Sequence
  Synthetic oligonucleotide; TGG chr11 5364316 5364335 5364332 +
cattggaatttggggtgata

SEQ ID NO: 24681 - DNA, 20 bp, Artificial Sequence
  Synthetic oligonucleotide; GAG chr11 5364318 5364337 5364334 +
ttggaatttggggtgatatg

SEQ ID NO: 24682 - DNA, 20 bp, Artificial Sequence
  Synthetic oligonucleotide; AGG chr11 5364319 5364338 5364335 +
tggaatttggggtgatatgg

SEQ ID NO: 24683 - DNA, 20 bp, Artificial Sequence
  Synthetic oligonucleotide; AAG chr11 5364323 5364342 5364339 +
atttggggtgatatggaggc

SEQ ID NO: 24684 - DNA, 20 bp, Artificial Sequence
  Synthetic oligonucleotide; CAG chr11 5364333 5364352 5364349 +
atatggaggcaagccaaatg

SEQ ID NO: 24685 - DNA, 20 bp, Artificial Sequence
  Synthetic oligonucleotide; CAG chr11 5364339 5364358 5364355 +
aggcaagccaaatgcagaaa

SEQ ID NO: 24686 - DNA, 20 bp, Artificial Sequence
  Synthetic oligonucleotide; AGG chr11 5364340 5364359 5364356 +
ggcaagccaaatgcagaaac

SEQ ID NO: 24687 - DNA, 20 bp, Artificial Sequence
  Synthetic oligonucleotide; GAG chr11 5364342 5364361 5364358 +
caagccaaatgcagaaacag

SEQ ID NO: 24688 - DNA, 20 bp, Artificial Sequence
  Synthetic oligonucleotide; AGG chr11 5364343 5364362 5364359 +
aagccaaatgcagaaacagg

SEQ ID NO: 24689 - DNA, 20 bp, Artificial Sequence
  Synthetic oligonucleotide; TGG chr11 5364349 5364368 5364365 +
aatgcagaaacaggaggtca

SEQ ID NO: 24690 - DNA, 20 bp, Artificial Sequence
  Synthetic oligonucleotide; AAG chr11 5364353 5364372 5364369 +
cagaaacaggaggtcatggt

SEQ ID NO: 24691 - DNA, 20 bp, Artificial Sequence
  Synthetic oligonucleotide; AGG chr11 5364354 5364373 5364370 +
agaaacaggaggtcatggta

SEQ ID NO: 24692 - DNA, 20 bp, Artificial Sequence
  Synthetic oligonucleotide; CAG chr11 5364365 5364384 5364381 +
gtcatggtaaggctatgatg

SEQ ID NO: 24693 - DNA, 20 bp, Artificial Sequence
  Synthetic oligonucleotide; TAG chr11 5364370 5364389 5364386 +
ggtaaggctatgatgcagtt

SEQ ID NO: 24694 - DNA, 20 bp, Artificial Sequence
  Synthetic oligonucleotide; AGG chr11 5364371 5364390 5364387 +
gtaaggctatgatgcagttt

SEQ ID NO: 24695 - DNA, 20 bp, Artificial Sequence
  Synthetic oligonucleotide; GAG chr11 5364373 5364392 5364389 +
aaggctatgatgcagtttag

SEQ ID NO: 24696 - DNA, 20 bp, Artificial Sequence
  Synthetic oligonucleotide; CAG chr11 5364400 5364419 5364416 +
gtgatgtgtcatttctgtga

SEQ ID NO: 24697 - DNA, 20 bp, Artificial Sequence
  Synthetic oligonucleotide; AGG chr11 5364401 5364420 5364417 +
tgatgtgtcatttctgtgac

SEQ ID NO: 24698 - DNA, 20 bp, Artificial Sequence
  Synthetic oligonucleotide; GAG chr11 5364408 5364427 5364424 +
tcatttctgtgacaggatat

SEQ ID NO: 24699 - DNA, 20 bp, Artificial Sequence
  Synthetic oligonucleotide; GAG chr11 5364410 5364429 5364426 +
atttctgtgacaggatatga

SEQ ID NO: 24700 - DNA, 20 bp, Artificial Sequence
  Synthetic oligonucleotide; TAG chr11 5364430 5364449 5364446 +
gagctgcacatctttctgtt

SEQ ID NO: 24701 - DNA, 20 bp, Artificial Sequence
  Synthetic oligonucleotide; TGG chr11 5364461 5364480 5364477 +
gccatatttgtaattctcaa

SEQ ID NO: 24702 - DNA, 20 bp, Artificial Sequence
  Synthetic oligonucleotide; CAG chr11 5364465 5364484 5364481 +
tatttgtaattctcaatggt

SEQ ID NO: 24703 - DNA, 20 bp, Artificial Sequence
  Synthetic oligonucleotide; TGG chr11 5364477 5364496 5364493 +
tcaatggtcagtctccttgc

SEQ ID NO: 24704 - DNA, 20 bp, Artificial Sequence
  Synthetic oligonucleotide; CAG chr11 5364501 5364520 5364517 +
ctataaattcaactacatgc

SEQ ID NO: 24705 - DNA, 20 bp, Artificial Sequence
  Synthetic oligonucleotide; AAG chr11 5364508 5364527 5364524 +
ttcaactacatgccagcttt

SEQ ID NO: 24706 - DNA, 20 bp, Artificial Sequence
  Synthetic oligonucleotide; CAG chr11 5364513 5364532 5364529 +
ctacatgccagctttaagca

SEQ ID NO: 24707 - DNA, 20 bp, Artificial Sequence
  Synthetic oligonucleotide; AAG chr11 5364523 5364542 5364539 +
gctttaagcacagtgctttg

SEQ ID NO: 24708 - DNA, 20 bp, Artificial Sequence
  Synthetic oligonucleotide; GAG chr11 5364525 5364544 5364541 +
tttaagcacagtgctttgaa

SEQ ID NO: 24709 - DNA, 20 bp, Artificial Sequence
  Synthetic oligonucleotide; GAG chr11 5364527 5364546 5364543 +
taagcacagtgctttgaaga

SEQ ID NO: 24710 - DNA, 20 bp, Artificial Sequence
  Synthetic oligonucleotide; TAG chr11 5364530 5364549 5364546 +
gcacagtgctttgaagagag

SEQ ID NO: 24711 - DNA, 20 bp, Artificial Sequence
  Synthetic oligonucleotide; AGG chr11 5364531 5364550 5364547 +
cacagtgctttgaagagagt

SEQ ID NO: 24712 - DNA, 20 bp, Artificial Sequence
  Synthetic oligonucleotide; GAG chr11 5364533 5364552 5364549 +
cagtgctttgaagagagtag

SEQ ID NO: 24713 - DNA, 20 bp, Artificial Sequence
  Synthetic oligonucleotide; AAG chr11 5364573 5364592 5364589 +
attaaatgaaaaaataaact

SEQ ID NO: 24714 - DNA, 20 bp, Artificial Sequence
  Synthetic oligonucleotide; GAG chr11 5364579 5364598 5364595 +
tgaaaaaataaactaagcgt

SEQ ID NO: 24715 - DNA, 20 bp, Artificial Sequence
  Synthetic oligonucleotide; GAG chr11 5364581 5364600 5364597 +
aaaaaataaactaagcgtga

SEQ ID NO: 24716 - DNA, 20 bp, Artificial Sequence
  Synthetic oligonucleotide; AGG chr11 5364582 5364601 5364598 +
aaaaataaactaagcgtgag

SEQ ID NO: 24717 - DNA, 20 bp, Artificial Sequence
  Synthetic oligonucleotide; AAG chr11 5364662 5364681 5364678 +
tctctgattttgtgcactct

SEQ ID NO: 24718 - DNA, 20 bp, Artificial Sequence
  Synthetic oligonucleotide; AGG chr11 5364663 5364682 5364679 +
ctctgattttgtgcactcta

SEQ ID NO: 24719 - DNA, 20 bp, Artificial Sequence
  Synthetic oligonucleotide; CAG chr11 5364666 5364685 5364682 +
tgattttgtgcactctaagg

SEQ ID NO: 24720 - DNA, 20 bp, Artificial Sequence
  Synthetic oligonucleotide; AAG chr11 5364675 5364694 5364691 +
gcactctaaggcagccctct

SEQ ID NO: 24721 - DNA, 20 bp, Artificial Sequence
  Synthetic oligonucleotide; CAG chr11 5364691 5364710 5364707 +
ctctaagctgtttgcccatc

SEQ ID NO: 24722 - DNA, 20 bp, Artificial Sequence
  Synthetic oligonucleotide; CAG chr11 5364701 5364720 5364717 +
tttgcccatccagcatatga

SEQ ID NO: 24723 - DNA, 20 bp, Artificial Sequence
  Synthetic oligonucleotide; AAG chr11 5364704 5364723 5364720 +
gcccatccagcatatgacag

SEQ ID NO: 24724 - DNA, 20 bp, Artificial Sequence
  Synthetic oligonucleotide; AAG chr11 5364715 5364734 5364731 +
atatgacagaagactcttca

SEQ ID NO: 24725 - DNA, 20 bp, Artificial Sequence
  Synthetic oligonucleotide; AAG chr11 5364728 5364747 5364744 +
ctcttcaaagtgaatgatca

SEQ ID NO: 24726 - DNA, 20 bp, Artificial Sequence
  Synthetic oligonucleotide; CAG chr11 5364742 5364761 5364758 +
tgatcaaagtcccttgttta

SEQ ID NO: 24727 - DNA, 20 bp, Artificial Sequence
  Synthetic oligonucleotide; AGG chr11 5364743 5364762 5364759 +
gatcaaagtcccttgtttac

SEQ ID NO: 24728 - DNA, 20 bp, Artificial Sequence
  Synthetic oligonucleotide; GGG chr11 5364744 5364763 5364760 +
atcaaagtcccttgtttaca

SEQ ID NO: 24729 - DNA, 20 bp, Artificial Sequence
  Synthetic oligonucleotide; GAG chr11 5364769 5364788 5364785 +
cccccaccctcttccttcct

SEQ ID NO: 24730 - DNA, 20 bp, Artificial Sequence
  Synthetic oligonucleotide; TGG chr11 5364781 5364800 5364797 +
tccttcctgagcatgtgttc

SEQ ID NO: 24731 - DNA, 20 bp, Artificial Sequence
  Synthetic oligonucleotide; AAG chr11 5364792 5364811 5364808 +
catgtgttctggatatgctg

SEQ ID NO: 24732 - DNA, 20 bp, Artificial Sequence
  Synthetic oligonucleotide; CAG chr11 5364804 5364823 5364820 +
atatgctgaagccaacctca

SEQ ID NO: 24733 - DNA, 20 bp, Artificial Sequence
  Synthetic oligonucleotide; AGG chr11 5364805 5364824 5364821 +
tatgctgaagccaacctcac

SEQ ID NO: 24734 - DNA, 20 bp, Artificial Sequence
  Synthetic oligonucleotide; AAG chr11 5364825 5364844 5364841 +
aggactttgttacctttcct

SEQ ID NO: 24735 - DNA, 20 bp, Artificial Sequence
  Synthetic oligonucleotide; TGG chr11 5364835 5364854 5364851 +
tacctttcctaagtttctat

SEQ ID NO: 24736 - DNA, 20 bp, Artificial Sequence
  Synthetic oligonucleotide; TAG chr11 5364855 5364874 5364871 +
tggtgaatttccatttaata

SEQ ID NO: 24737 - DNA, 20 bp, Artificial Sequence
  Synthetic oligonucleotide; TAG chr11 5364874 5364893 5364890 +
atagttttattaaatgattt

SEQ ID NO: 24738 - DNA, 20 bp, Artificial Sequence
  Synthetic oligonucleotide; TAG chr11 5364897 5364916 5364913 +
taaataatttttaatcattg

SEQ ID NO: 24739 - DNA, 20 bp, Artificial Sequence
  Synthetic oligonucleotide; TGG chr11 5364906 5364925 5364922 +
tttaatcattgtagcttcta

SEQ ID NO: 24740 - DNA, 20 bp, Artificial Sequence
  Synthetic oligonucleotide; TGG chr11 5364909 5364928 5364925 +
aatcattgtagcttctatgg

SEQ ID NO: 24741 - DNA, 20 bp, Artificial Sequence
  Synthetic oligonucleotide; AAG chr11 5364918 5364937 5364934 +
agcttctatggtggatacac

SEQ ID NO: 24742 - DNA, 20 bp, Artificial Sequence
  Synthetic oligonucleotide; AGG chr11 5364919 5364938 5364935 +
gcttctatggtggatacaca

SEQ ID NO: 24743 - DNA, 20 bp, Artificial Sequence
  Synthetic oligonucleotide; GAG chr11 5364921 5364940 5364937 +
ttctatggtggatacacaag

SEQ ID NO: 24744 - DNA, 20 bp, Artificial Sequence
  Synthetic oligonucleotide; AAG chr11 5364924 5364943 5364940 +
tatggtggatacacaaggag

SEQ ID NO: 24745 - DNA, 20 bp, Artificial Sequence
  Synthetic oligonucleotide; CAG chr11 5364927 5364946 5364943 +
ggtggatacacaaggagaag

SEQ ID NO: 24746 - DNA, 20 bp, Artificial Sequence
  Synthetic oligonucleotide; GAG chr11 5364929 5364948 5364945 +
tggatacacaaggagaagca

SEQ ID NO: 24747 - DNA, 20 bp, Artificial Sequence
  Synthetic oligonucleotide; GAG chr11 5364931 5364950 5364947 +
gatacacaaggagaagcaga

SEQ ID NO: 24748 - DNA, 20 bp, Artificial Sequence
  Synthetic oligonucleotide; GAG chr11 5364933 5364952 5364949 +
tacacaaggagaagcagaga

SEQ ID NO: 24749 - DNA, 20 bp, Artificial Sequence
  Synthetic oligonucleotide; GAG chr11 5364935 5364954 5364951 +
cacaaggagaagcagagaga

SEQ ID NO: 24750 - DNA, 20 bp, Artificial Sequence
  Synthetic oligonucleotide; AGG chr11 5364936 5364955 5364952 +
acaaggagaagcagagagag

SEQ ID NO: 24751 - DNA, 20 bp, Artificial Sequence
  Synthetic oligonucleotide; GGG chr11 5364937 5364956 5364953 +
caaggagaagcagagagaga

SEQ ID NO: 24752 - DNA, 20 bp, Artificial Sequence
  Synthetic oligonucleotide; AAG chr11 5364949 5364968 5364965 +
gagagagagggaaaaaaatg

SEQ ID NO: 24753 - DNA, 20 bp, Artificial Sequence
  Synthetic oligonucleotide; CAG chr11 5364955 5364974 5364971 +
gagggaaaaaaatgaagtaa

SEQ ID NO: 24754 - DNA, 20 bp, Artificial Sequence
  Synthetic oligonucleotide; AAG chr11 5364958 5364977 5364974 +
ggaaaaaaatgaagtaacag

SEQ ID NO: 24755 - DNA, 20 bp, Artificial Sequence
  Synthetic oligonucleotide; AGG chr11 5364959 5364978 5364975 +
gaaaaaaatgaagtaacaga

SEQ ID NO: 24756 - DNA, 20 bp, Artificial Sequence
  Synthetic oligonucleotide; AAG chr11 5364966 5364985 5364982 +
atgaagtaacagaaggctac

SEQ ID NO: 24757 - DNA, 20 bp, Artificial Sequence
  Synthetic oligonucleotide; AGG chr11 5364967 5364986 5364983 +
tgaagtaacagaaggctaca

SEQ ID NO: 24758 - DNA, 20 bp, Artificial Sequence
  Synthetic oligonucleotide; GGG chr11 5364968 5364987 5364984 +
gaagtaacagaaggctacaa

SEQ ID NO: 24759 - DNA, 20 bp, Artificial Sequence
  Synthetic oligonucleotide; GGG chr11 5364969 5364988 5364985 +
aagtaacagaaggctacaag

SEQ ID NO: 24760 - DNA, 20 bp, Artificial Sequence
  Synthetic oligonucleotide; AAG chr11 5364979 5364998 5364995 +
aggctacaaggggatttctc

SEQ ID NO: 24761 - DNA, 20 bp, Artificial Sequence
  Synthetic oligonucleotide; CAG chr11 5365010 5365029 5365026 +
tcttcttgtcattcttgtca

SEQ ID NO: 24762 - DNA, 20 bp, Artificial Sequence
  Synthetic oligonucleotide; TGG chr11 5365023 5365042 5365039 +
cttgtcacagcaatgaatct

SEQ ID NO: 24763 - DNA, 20 bp, Artificial Sequence
  Synthetic oligonucleotide; GGG chr11 5365024 5365043 5365040 +
ttgtcacagcaatgaatctt

SEQ ID NO: 24764 - DNA, 20 bp, Artificial Sequence
  Synthetic oligonucleotide; AAG chr11 5365032 5365051 5365048 +
gcaatgaatcttgggcaaat

SEQ ID NO: 24765 - DNA, 20 bp, Artificial Sequence
  Synthetic oligonucleotide; AGG chr11 5365033 5365052 5365049 +
caatgaatcttgggcaaata

SEQ ID NO: 24766 - DNA, 20 bp, Artificial Sequence
  Synthetic oligonucleotide; GGG chr11 5365034 5365053 5365050 +
aatgaatcttgggcaaataa

SEQ ID NO: 24767 - DNA, 20 bp, Artificial Sequence
  Synthetic oligonucleotide; AAG chr11 5365091 5365110 5365107 +
cttgtaataaccttgaattc

SEQ ID NO: 24768 - DNA, 20 bp, Artificial Sequence
  Synthetic oligonucleotide; TGG chr11 5365094 5365113 5365110 +
gtaataaccttgaattcaag

SEQ ID NO: 24769 - DNA, 20 bp, Artificial Sequence
  Synthetic oligonucleotide; TAG chr11 5365097 5365116 5365113 +
ataaccttgaattcaagtgg

SEQ ID NO: 24770 - DNA, 20 bp, Artificial Sequence
  Synthetic oligonucleotide; TGG chr11 5365136 5365155 5365152 +
aataacttttcttctttgtc

SEQ ID NO: 24771 - DNA, 20 bp, Artificial Sequence
  Synthetic oligonucleotide; GAG chr11 5365140 5365159 5365156 +
acttttcttctttgtctggt

SEQ ID NO: 24772 - DNA, 20 bp, Artificial Sequence
  Synthetic oligonucleotide; TAG chr11 5365148 5365167 5365164 +
tctttgtctggtgagttctg

SEQ ID NO: 24773 - DNA, 20 bp, Artificial Sequence
  Synthetic oligonucleotide; TAG chr11 5365156 5365175 5365172 +
tggtgagttctgtagacatt

SEQ ID NO: 24774 - DNA, 20 bp, Artificial Sequence
  Synthetic oligonucleotide; GAG chr11 5365158 5365177 5365174 +
gtgagttctgtagacattta

SEQ ID NO: 24775 - DNA, 20 bp, Artificial Sequence
  Synthetic oligonucleotide; TAG chr11 5365163 5365182 5365179 +
ttctgtagacatttagagtg

SEQ ID NO: 24776 - DNA, 20 bp, Artificial Sequence
  Synthetic oligonucleotide; AGG chr11 5365164 5365183 5365180 +
tctgtagacatttagagtgt

SEQ ID NO: 24777 - DNA, 20 bp, Artificial Sequence
  Synthetic oligonucleotide; GGG chr11 5365165 5365184 5365181 +
ctgtagacatttagagtgta

SEQ ID NO: 24778 - DNA, 20 bp, Artificial Sequence
  Synthetic oligonucleotide; TGG chr11 5365169 5365188 5365185 +
agacatttagagtgtagggc

SEQ ID NO: 24779 - DNA, 20 bp, Artificial Sequence
  Synthetic oligonucleotide; AAG chr11 5365188 5365207 5365204 +
ctggcaactgtgtttaaaat

SEQ ID NO: 24780 - DNA, 20 bp, Artificial Sequence
  Synthetic oligonucleotide; CAG chr11 5365204 5365223 5365220 +
aaataagttgtctattatat

SEQ ID NO: 24781 - DNA, 20 bp, Artificial Sequence
  Synthetic oligonucleotide; AGG chr11 5365205 5365224 5365221 +
aataagttgtctattatatc

SEQ ID NO: 24782 - DNA, 20 bp, Artificial Sequence
  Synthetic oligonucleotide; TGG chr11 5365214 5365233 5365230 +
tctattatatcaggactcca

SEQ ID NO: 24783 - DNA, 20 bp, Artificial Sequence
  Synthetic oligonucleotide; TAG chr11 5365224 5365243 5365240 +
caggactccatggaaacatc

SEQ ID NO: 24784 - DNA, 20 bp, Artificial Sequence
  Synthetic oligonucleotide; CAG chr11 5365232 5365251 5365248 +
catggaaacatctagtgaac

SEQ ID NO: 24785 - DNA, 20 bp, Artificial Sequence
  Synthetic oligonucleotide; AAG chr11 5365235 5365254 5365251 +
ggaaacatctagtgaaccag

SEQ ID NO: 24786 - DNA, 20 bp, Artificial Sequence
  Synthetic oligonucleotide; AGG chr11 5365236 5365255 5365252 +
gaaacatctagtgaaccaga

SEQ ID NO: 24787 - DNA, 20 bp, Artificial Sequence
  Synthetic oligonucleotide; GGG chr11 5365237 5365256 5365253 +
aaacatctagtgaaccagaa

SEQ ID NO: 24788 - DNA, 20 bp, Artificial Sequence
  Synthetic oligonucleotide; TGG chr11 5365241 5365260 5365257 +
atctagtgaaccagaagggc

SEQ ID NO: 24789 - DNA, 20 bp, Artificial Sequence
  Synthetic oligonucleotide; TGG chr11 5365244 5365263 5365260 +
tagtgaaccagaagggctgg

SEQ ID NO: 24790 - DNA, 20 bp, Artificial Sequence
  Synthetic oligonucleotide; GAG chr11 5365248 5365267 5365264 +
gaaccagaagggctggtggt

SEQ ID NO: 24791 - DNA, 20 bp, Artificial Sequence
  Synthetic oligonucleotide; CAG chr11 5365253 5365272 5365269 +
agaagggctggtggtgagaa

SEQ ID NO: 24792 - DNA, 20 bp, Artificial Sequence
  Synthetic oligonucleotide; TAG chr11 5365262 5365281 5365278 +
ggtggtgagaacagtgttat

SEQ ID NO: 24793 - DNA, 20 bp, Artificial Sequence
  Synthetic oligonucleotide; TGG chr11 5365273 5365292 5365289 +
cagtgttattagaataccac

SEQ ID NO: 24794 - DNA, 20 bp, Artificial Sequence
  Synthetic oligonucleotide; CAG chr11 5365283 5365302 5365299 +
agaataccactggtgtttgc

SEQ ID NO: 24795 - DNA, 20 bp, Artificial Sequence
  Synthetic oligonucleotide; TGG chr11 5365289 5365308 5365305 +
ccactggtgtttgccagctg

SEQ ID NO: 24796 - DNA, 20 bp, Artificial Sequence
  Synthetic oligonucleotide; TGG chr11 5365298 5365317 5365314 +
tttgccagctgtggaaaaca

SEQ ID NO: 24797 - DNA, 20 bp, Artificial Sequence
  Synthetic oligonucleotide; GGG chr11 5365299 5365318 5365315 +
ttgccagctgtggaaaacat

SEQ ID NO: 24798 - DNA, 20 bp, Artificial Sequence
  Synthetic oligonucleotide; TAG chr11 5365304 5365323 5365320 +
agctgtggaaaacatgggta

SEQ ID NO: 24799 - DNA, 20 bp, Artificial Sequence
  Synthetic oligonucleotide; GAG chr11 5365306 5365325 5365322 +
ctgtggaaaacatgggtata

SEQ ID NO: 24800 - DNA, 20 bp, Artificial Sequence
  Synthetic oligonucleotide; AAG chr11 5365324 5365343 5365340 +
tagagcatacactgatgcca

SEQ ID NO: 24801 - DNA, 20 bp, Artificial Sequence
  Synthetic oligonucleotide; AGG chr11 5365325 5365344 5365341 +
agagcatacactgatgccaa

SEQ ID NO: 24802 - DNA, 20 bp, Artificial Sequence
  Synthetic oligonucleotide; TGG chr11 5365340 5365359 5365356 +
gccaaaggcaaaccaatgca

SEQ ID NO: 24803 - DNA, 20 bp, Artificial Sequence
  Synthetic oligonucleotide; TGG chr11 5365344 5365363 5365360 +
aaggcaaaccaatgcatggc

SEQ ID NO: 24804 - DNA, 20 bp, Artificial Sequence
  Synthetic oligonucleotide; CGG chr11 5365350 5365369 5365366 +
aaccaatgcatggctggtcc

SEQ ID NO: 24805 - DNA, 20 bp, Artificial Sequence
  Synthetic oligonucleotide; TGG chr11 5365355 5365374 5365371 +
atgcatggctggtcccggca

SEQ ID NO: 24806 - DNA, 20 bp, Artificial Sequence
  Synthetic oligonucleotide; AAG chr11 5365362 5365381 5365378 +
gctggtcccggcatggcaac

SEQ ID NO: 24807 - DNA, 20 bp, Artificial Sequence
  Synthetic oligonucleotide; TGG chr11 5365375 5365394 5365391 +
tggcaacaagtaaccaaata

SEQ ID NO: 24808 - DNA, 20 bp, Artificial Sequence
  Synthetic oligonucleotide; GGG chr11 5365376 5365395 5365392 +
ggcaacaagtaaccaaatat

SEQ ID NO: 24809 - DNA, 20 bp, Artificial Sequence
  Synthetic oligonucleotide; GAG chr11 5365381 5365400 5365397 +
caagtaaccaaatatgggat

SEQ ID NO: 24810 - DNA, 20 bp, Artificial Sequence
  Synthetic oligonucleotide; GAG chr11 5365383 5365402 5365399 +
agtaaccaaatatgggatga

SEQ ID NO: 24811 - DNA, 20 bp, Artificial Sequence
  Synthetic oligonucleotide; AAG chr11 5365388 5365407 5365404 +
ccaaatatgggatgagagac

SEQ ID NO: 24812 - DNA, 20 bp, Artificial Sequence
  Synthetic oligonucleotide; AAG chr11 5365394 5365413 5365410 +
atgggatgagagacaagatc

SEQ ID NO: 24813 - DNA, 20 bp, Artificial Sequence
  Synthetic oligonucleotide; TAG chr11 5365404 5365423 5365420 +
agacaagatcaagcatactg

SEQ ID NO: 24814 - DNA, 20 bp, Artificial Sequence
  Synthetic oligonucleotide; TGG chr11 5365416 5365435 5365432 +
gcatactgtagaaatcgctg

SEQ ID NO: 24815 - DNA, 20 bp, Artificial Sequence
  Synthetic oligonucleotide; GAG chr11 5365418 5365437 5365434 +
atactgtagaaatcgctgtg

SEQ ID NO: 24816 - DNA, 20 bp, Artificial Sequence
  Synthetic oligonucleotide; GAG chr11 5365420 5365439 5365436 +
actgtagaaatcgctgtgga

SEQ ID NO: 24817 - DNA, 20 bp, Artificial Sequence
  Synthetic oligonucleotide; TAG chr11 5365430 5365449 5365446 +
tcgctgtggagagatgcatt

SEQ ID NO: 24818 - DNA, 20 bp, Artificial Sequence
  Synthetic oligonucleotide; AAG chr11 5365438 5365457 5365454 +
gagagatgcatttagatgaa

SEQ ID NO: 24819 - DNA, 20 bp, Artificial Sequence
  Synthetic oligonucleotide; AGG chr11 5365439 5365458 5365455 +
agagatgcatttagatgaaa

SEQ ID NO: 24820 - DNA, 20 bp, Artificial Sequence
  Synthetic oligonucleotide; TGG chr11 5365453 5365472 5365469 +
atgaaaaggtaacccaattc

SEQ ID NO: 24821 - DNA, 20 bp, Artificial Sequence
  Synthetic oligonucleotide; CAG chr11 5365461 5365480 5365477 +
gtaacccaattctggtctgc

SEQ ID NO: 24822 - DNA, 20 bp, Artificial Sequence
  Synthetic oligonucleotide; CAG chr11 5365465 5365484 5365481 +
cccaattctggtctgccagt

SEQ ID NO: 24823 - DNA, 20 bp, Artificial Sequence
  Synthetic oligonucleotide; CAG chr11 5365490 5365509 5365506 +
accattttcctgtctatgca

SEQ ID NO: 24824 - DNA, 20 bp, Artificial Sequence
  Synthetic oligonucleotide; AGG chr11 5365491 5365510 5365507 +
ccattttcctgtctatgcac

SEQ ID NO: 24825 - DNA, 20 bp, Artificial Sequence
  Synthetic oligonucleotide; TAG chr11 5365495 5365514 5365511 +
tttcctgtctatgcacagga

SEQ ID NO: 24826 - DNA, 20 bp, Artificial Sequence
  Synthetic oligonucleotide; AGG chr11 5365496 5365515 5365512 +
ttcctgtctatgcacaggat

SEQ ID NO: 24827 - DNA, 20 bp, Artificial Sequence
  Synthetic oligonucleotide; TGG chr11 5365502 5365521 5365518 +
tctatgcacaggataggata

SEQ ID NO: 24828 - DNA, 20 bp, Artificial Sequence
  Synthetic oligonucleotide; AAG chr11 5365518 5365537 5365534 +
gatatggctgtactacctcg

SEQ ID NO: 24829 - DNA, 20 bp, Artificial Sequence
  Synthetic oligonucleotide; AAG chr11 5365531 5365550 5365547 +
tacctcgaagttttttcaca

SEQ ID NO: 24830 - DNA, 20 bp, Artificial Sequence
  Synthetic oligonucleotide; GAG chr11 5365559 5365578 5365575 +
tgatacacaaaaacattatc

SEQ ID NO: 24831 - DNA, 20 bp, Artificial Sequence
  Synthetic oligonucleotide; CGG chr11 5365575 5365594 5365591 +
tatcgagatgcacatgacat

SEQ ID NO: 24832 - DNA, 20 bp, Artificial Sequence
  Synthetic oligonucleotide; CAG chr11 5365588 5365607 5365604 +
atgacatcggtttgccatga

SEQ ID NO: 24833 - DNA, 20 bp, Artificial Sequence
  Synthetic oligonucleotide; AGG chr11 5365589 5365608 5365605 +
tgacatcggtttgccatgac

SEQ ID NO: 24834 - DNA, 20 bp, Artificial Sequence
  Synthetic oligonucleotide; GGG chr11 5365590 5365609 5365606 +
gacatcggtttgccatgaca

SEQ ID NO: 24835 - DNA, 20 bp, Artificial Sequence
  Synthetic oligonucleotide; TGG chr11 5365597 5365616 5365613 +
gtttgccatgacagggctct

SEQ ID NO: 24836 - DNA, 20 bp, Artificial Sequence
  Synthetic oligonucleotide; GAG chr11 5365641 5365660 5365657 +
aacacacctccaaatgtgtt

SEQ ID NO: 24837 - DNA, 20 bp, Artificial Sequence
  Synthetic oligonucleotide; AGG chr11 5365642 5365661 5365658 +
acacacctccaaatgtgttg

SEQ ID NO: 24838 - DNA, 20 bp, Artificial Sequence
  Synthetic oligonucleotide; GAG chr11 5365652 5365671 5365668 +
aaatgtgttgaggccctaat

SEQ ID NO: 24839 - DNA, 20 bp, Artificial Sequence
  Synthetic oligonucleotide; TAG chr11 5365720 5365739 5365736 +
tcctgtaattatttaaaaaa

SEQ ID NO: 24840 - DNA, 20 bp, Artificial Sequence
  Synthetic oligonucleotide; AAG chr11 5365727 5365746 5365743 +
attatttaaaaaatagatat

SEQ ID NO: 24841 - DNA, 20 bp, Artificial Sequence
  Synthetic oligonucleotide; GAG chr11 5365735 5365754 5365751 +
aaaaatagatataagctttt

SEQ ID NO: 24842 - DNA, 20 bp, Artificial Sequence
  Synthetic oligonucleotide; AGG chr11 5365736 5365755 5365752 +
aaaatagatataagcttttg

SEQ ID NO: 24843 - DNA, 20 bp, Artificial Sequence
  Synthetic oligonucleotide; GGG chr11 5365737 5365756 5365753 +
aaatagatataagcttttga

SEQ ID NO: 24844 - DNA, 20 bp, Artificial Sequence
  Synthetic oligonucleotide; CAG chr11 5365740 5365759 5365756 +
tagatataagcttttgaggg

SEQ ID NO: 24845 - DNA, 20 bp, Artificial Sequence
  Synthetic oligonucleotide; CAG chr11 5365754 5365773 5365770 +
tgagggcagatattataatc

SEQ ID NO: 24846 - DNA, 20 bp, Artificial Sequence
  Synthetic oligonucleotide; AGG chr11 5365755 5365774 5365771 +
gagggcagatattataatcc

SEQ ID NO: 24847 - DNA, 20 bp, Artificial Sequence
  Synthetic oligonucleotide; TAG chr11 5365783 5365802 5365799 +
cctccattacccacattgtc

SEQ ID NO: 24848 - DNA, 20 bp, Artificial Sequence
  Synthetic oligonucleotide; TAG chr11 5365793 5365812 5365809 +
ccacattgtctagcacatta

SEQ ID NO: 24849 - DNA, 20 bp, Artificial Sequence
  Synthetic oligonucleotide; TAG chr11 5365801 5365820 5365817 +
tctagcacattatagatgct

SEQ ID NO: 24850 - DNA, 20 bp, Artificial Sequence
  Synthetic oligonucleotide; TGG chr11 5365811 5365830 5365827 +
tatagatgcttagtatgtgc

SEQ ID NO: 24851 - DNA, 20 bp, Artificial Sequence
  Synthetic oligonucleotide; CAG chr11 5365822 5365841 5365838 +
agtatgtgctggcttgatga

SEQ ID NO: 24852 - DNA, 20 bp, Artificial Sequence
  Synthetic oligonucleotide; AGG chr11 5365823 5365842 5365839 +
gtatgtgctggcttgatgac

SEQ ID NO: 24853 - DNA, 20 bp, Artificial Sequence
  Synthetic oligonucleotide; AAG chr11 5365829 5365848 5365845 +
gctggcttgatgacaggatg

SEQ ID NO: 24854 - DNA, 20 bp, Artificial Sequence
  Synthetic oligonucleotide; AAG chr11 5365835 5365854 5365851 +
ttgatgacaggatgaagttt

SEQ ID NO: 24855 - DNA, 20 bp, Artificial Sequence
  Synthetic oligonucleotide; TAG chr11 5365852 5365871 5365868 +
tttaagttgctaaccattct

SEQ ID NO: 24856 - DNA, 20 bp, Artificial Sequence
  Synthetic oligonucleotide; GAG chr11 5365854 5365873 5365870 +
taagttgctaaccattctta

SEQ ID NO: 24857 - DNA, 20 bp, Artificial Sequence
  Synthetic oligonucleotide; AGG chr11 5365855 5365874 5365871 +
aagttgctaaccattcttag

SEQ ID NO: 24858 - DNA, 20 bp, Artificial Sequence
  Synthetic oligonucleotide; TGG chr11 5365874 5365893 5365890 +
gaggaactctgcttacctct

SEQ ID NO: 24859 - DNA, 20 bp, Artificial Sequence
  Synthetic oligonucleotide; GGG chr11 5365875 5365894 5365891 +
aggaactctgcttacctctt

SEQ ID NO: 24860 - DNA, 20 bp, Artificial Sequence
  Synthetic oligonucleotide; AAG chr11 5365883 5365902 5365899 +
tgcttacctcttgggttctg

SEQ ID NO: 24861 - DNA, 20 bp, Artificial Sequence
  Synthetic oligonucleotide; AGG chr11 5365884 5365903 5365900 +
gcttacctcttgggttctga

SEQ ID NO: 24862 - DNA, 20 bp, Artificial Sequence
  Synthetic oligonucleotide; GGG chr11 5365885 5365904 5365901 +
cttacctcttgggttctgaa

SEQ ID NO: 24863 - DNA, 20 bp, Artificial Sequence
  Synthetic oligonucleotide; CAG chr11 5365898 5365917 5365914 +
ttctgaagggtctgactgac

SEQ ID NO: 24864 - DNA, 20 bp, Artificial Sequence
  Synthetic oligonucleotide; GAG chr11 5365900 5365919 5365916 +
ctgaagggtctgactgacca

SEQ ID NO: 24865 - DNA, 20 bp, Artificial Sequence
  Synthetic oligonucleotide; GAG chr11 5365902 5365921 5365918 +
gaagggtctgactgaccaga

SEQ ID NO: 24866 - DNA, 20 bp, Artificial Sequence
  Synthetic oligonucleotide; AGG chr11 5365903 5365922 5365919 +
aagggtctgactgaccagag

SEQ ID NO: 24867 - DNA, 20 bp, Artificial Sequence
  Synthetic oligonucleotide; AAG chr11 5365910 5365929 5365926 +
tgactgaccagagaggcatg

SEQ ID NO: 24868 - DNA, 20 bp, Artificial Sequence
  Synthetic oligonucleotide; AGG chr11 5365911 5365930 5365927 +
gactgaccagagaggcatga

SEQ ID NO: 24869 - DNA, 20 bp, Artificial Sequence
  Synthetic oligonucleotide; GGG chr11 5365912 5365931 5365928 +
actgaccagagaggcatgaa

SEQ ID NO: 24870 - DNA, 20 bp, Artificial Sequence
  Synthetic oligonucleotide; GGG chr11 5365913 5365932 5365929 +
ctgaccagagaggcatgaag

SEQ ID NO: 24871 - DNA, 20 bp, Artificial Sequence
  Synthetic oligonucleotide; GGG chr11 5365914 5365933 5365930 +
tgaccagagaggcatgaagg

SEQ ID NO: 24872 - DNA, 20 bp, Artificial Sequence
  Synthetic oligonucleotide; CAG chr11 5365917 5365936 5365933 +
ccagagaggcatgaaggggg

SEQ ID NO: 24873 - DNA, 20 bp, Artificial Sequence
  Synthetic oligonucleotide; AGG chr11 5365918 5365937 5365934 +
cagagaggcatgaagggggc

SEQ ID NO: 24874 - DNA, 20 bp, Artificial Sequence
  Synthetic oligonucleotide; CAG chr11 5365923 5365942 5365939 +
aggcatgaagggggcaggct

SEQ ID NO: 24875 - DNA, 20 bp, Artificial Sequence
  Synthetic oligonucleotide; CAG chr11 5365935 5365954 5365951 +
ggcaggctcagcatgatcac

SEQ ID NO: 24876 - DNA, 20 bp, Artificial Sequence
  Synthetic oligonucleotide; GAG chr11 5365942 5365961 5365958 +
tcagcatgatcaccagcact

SEQ ID NO: 24877 - DNA, 20 bp, Artificial Sequence
  Synthetic oligonucleotide; AAG chr11 5365959 5365978 5365975 +
actgagaaccacacaaactg

SEQ ID NO: 24878 - DNA, 20 bp, Artificial Sequence
  Synthetic oligonucleotide; TAG chr11 5365968 5365987 5365984 +
cacacaaactgaagaactgc

SEQ ID NO: 24879 - DNA, 20 bp, Artificial Sequence
  Synthetic oligonucleotide; AGG chr11 5365969 5365988 5365985 +
acacaaactgaagaactgct

SEQ ID NO: 24880 - DNA, 20 bp, Artificial Sequence
  Synthetic oligonucleotide; TGG chr11 5365975 5365994 5365991 +
actgaagaactgctaggtgc

SEQ ID NO: 24881 - DNA, 20 bp, Artificial Sequence
  Synthetic oligonucleotide; TAG chr11 5365979 5365998 5365995 +
aagaactgctaggtgctggc

SEQ ID NO: 24882 - DNA, 20 bp, Artificial Sequence
  Synthetic oligonucleotide; TGG chr11 5365982 5366001 5365998 +
aactgctaggtgctggctag

SEQ ID NO: 24883 - DNA, 20 bp, Artificial Sequence
  Synthetic oligonucleotide; GGG chr11 5365983 5366002 5365999 +
actgctaggtgctggctagt

SEQ ID NO: 24884 - DNA, 20 bp, Artificial Sequence
  Synthetic oligonucleotide; GAG chr11 5365985 5366004 5366001 +
tgctaggtgctggctagtgg

SEQ ID NO: 24885 - DNA, 20 bp, Artificial Sequence
  Synthetic oligonucleotide; AAG chr11 5365992 5366011 5366008 +
tgctggctagtgggagactt

SEQ ID NO: 24886 - DNA, 20 bp, Artificial Sequence
  Synthetic oligonucleotide; TGG chr11 5366012 5366031 5366028 +
aagaccaaccaaccacccta

SEQ ID NO: 24887 - DNA, 20 bp, Artificial Sequence
  Synthetic oligonucleotide; GAG chr11 5366014 5366033 5366030 +
gaccaaccaaccaccctatg

SEQ ID NO: 24888 - DNA, 20 bp, Artificial Sequence
  Synthetic oligonucleotide; CAG chr11 5366017 5366036 5366033 +
caaccaaccaccctatggag

SEQ ID NO: 24889 - DNA, 20 bp, Artificial Sequence
  Synthetic oligonucleotide; CAG chr11 5366021 5366040 5366037 +
caaccaccctatggagcagc

SEQ ID NO: 24890 - DNA, 20 bp, Artificial Sequence
  Synthetic oligonucleotide; AGG chr11 5366022 5366041 5366038 +
aaccaccctatggagcagcc

SEQ ID NO: 24891 - DNA, 20 bp, Artificial Sequence
  Synthetic oligonucleotide; CAG chr11 5366029 5366048 5366045 +
ctatggagcagccaggtaat

SEQ ID NO: 24892 - DNA, 20 bp, Artificial Sequence
  Synthetic oligonucleotide; TGG chr11 5366038 5366057 5366054 +
agccaggtaatcagcatgtt

SEQ ID NO: 24893 - DNA, 20 bp, Artificial Sequence
  Synthetic oligonucleotide; GGG chr11 5366039 5366058 5366055 +
gccaggtaatcagcatgttt

SEQ ID NO: 24894 - DNA, 20 bp, Artificial Sequence
  Synthetic oligonucleotide; GGG chr11 5366040 5366059 5366056 +
ccaggtaatcagcatgtttg

SEQ ID NO: 24895 - DNA, 20 bp, Artificial Sequence
  Synthetic oligonucleotide; GGG chr11 5366041 5366060 5366057 +
caggtaatcagcatgtttgg

SEQ ID NO: 24896 - DNA, 20 bp, Artificial Sequence
  Synthetic oligonucleotide; TGG chr11 5366051 5366070 5366067 +
gcatgtttgggggctgttaa

SEQ ID NO: 24897 - DNA, 20 bp, Artificial Sequence
  Synthetic oligonucleotide; AAG chr11 5366054 5366073 5366070 +
tgtttgggggctgttaatgg

SEQ ID NO: 24898 - DNA, 20 bp, Artificial Sequence
  Synthetic oligonucleotide; GAG chr11 5366056 5366075 5366072 +
tttgggggctgttaatggaa

SEQ ID NO: 24899 - DNA, 20 bp, Artificial Sequence
  Synthetic oligonucleotide; GAG chr11 5366064 5366083 5366080 +
ctgttaatggaagagttgct

SEQ ID NO: 24900 - DNA, 20 bp, Artificial Sequence
  Synthetic oligonucleotide; AGG chr11 5366065 5366084 5366081 +
tgttaatggaagagttgctg

SEQ ID NO: 24901 - DNA, 20 bp, Artificial Sequence
  Synthetic oligonucleotide; GGG chr11 5366066 5366085 5366082 +
gttaatggaagagttgctga

SEQ ID NO: 24902 - DNA, 20 bp, Artificial Sequence
  Synthetic oligonucleotide; GGG chr11 5366067 5366086 5366083 +
ttaatggaagagttgctgag

SEQ ID NO: 24903 - DNA, 20 bp, Artificial Sequence
  Synthetic oligonucleotide; CAG chr11 5366084 5366103 5366100 +
gaggggtatgcttacttgtc

SEQ ID NO: 24904 - DNA, 20 bp, Artificial Sequence
  Synthetic oligonucleotide; TAG chr11 5366099 5366118 5366115 +
ttgtccagttgtgtgtgact

SEQ ID NO: 24905 - DNA, 20 bp, Artificial Sequence
  Synthetic oligonucleotide; GAG chr11 5366101 5366120 5366117 +
gtccagttgtgtgtgactta

SEQ ID NO: 24906 - DNA, 20 bp, Artificial Sequence
  Synthetic oligonucleotide; AGG chr11 5366102 5366121 5366118 +
tccagttgtgtgtgacttag

SEQ ID NO: 24907 - DNA, 20 bp, Artificial Sequence
  Synthetic oligonucleotide; CAG chr11 5366111 5366130 5366127 +
gtgtgacttagaggtgaacc

SEQ ID NO: 24908 - DNA, 20 bp, Artificial Sequence
  Synthetic oligonucleotide; TGG chr11 5366114 5366133 5366130 +
tgacttagaggtgaacccag

SEQ ID NO: 24909 - DNA, 20 bp, Artificial Sequence
  Synthetic oligonucleotide; GGG chr11 5366115 5366134 5366131 +
gacttagaggtgaacccagt

SEQ ID NO: 24910 - DNA, 20 bp, Artificial Sequence
  Synthetic oligonucleotide; AAG chr11 5366124 5366143 5366140 +
gtgaacccagtgggcaaaat

SEQ ID NO: 24911 - DNA, 20 bp, Artificial Sequence
  Synthetic oligonucleotide; CAG chr11 5366130 5366149 5366146 +
ccagtgggcaaaataagaaa

SEQ ID NO: 24912 - DNA, 20 bp, Artificial Sequence
  Synthetic oligonucleotide; AAG chr11 5366139 5366158 5366155 +
aaaataagaaacagtatgtg

SEQ ID NO: 24913 - DNA, 20 bp, Artificial Sequence
  Synthetic oligonucleotide; GAG chr11 5366141 5366160 5366157 +
aataagaaacagtatgtgaa

SEQ ID NO: 24914 - DNA, 20 bp, Artificial Sequence
  Synthetic oligonucleotide; AGG chr11 5366142 5366161 5366158 +
ataagaaacagtatgtgaag

SEQ ID NO: 24915 - DNA, 20 bp, Artificial Sequence
  Synthetic oligonucleotide; TAG chr11 5366146 5366165 5366162 +
gaaacagtatgtgaagagga

SEQ ID NO: 24916 - DNA, 20 bp, Artificial Sequence
  Synthetic oligonucleotide; GAG chr11 5366148 5366167 5366164 +
aacagtatgtgaagaggata

SEQ ID NO: 24917 - DNA, 20 bp, Artificial Sequence
  Synthetic oligonucleotide; AAG chr11 5366152 5366171 5366168 +
gtatgtgaagaggatagagc

SEQ ID NO: 24918 - DNA, 20 bp, Artificial Sequence
  Synthetic oligonucleotide; AAG chr11 5366159 5366178 5366175 +
aagaggatagagcaagcctt

SEQ ID NO: 24919 - DNA, 20 bp, Artificial Sequence
  Synthetic oligonucleotide; TAG chr11 5366162 5366181 5366178 +
aggatagagcaagccttaag

SEQ ID NO: 24920 - DNA, 20 bp, Artificial Sequence
  Synthetic oligonucleotide; AGG chr11 5366163 5366182 5366179 +
ggatagagcaagccttaagt

SEQ ID NO: 24921 - DNA, 20 bp, Artificial Sequence
  Synthetic oligonucleotide; AAG chr11 5366166 5366185 5366182 +
tagagcaagccttaagtagg

SEQ ID NO: 24922 - DNA, 20 bp, Artificial Sequence
  Synthetic oligonucleotide; AAG chr11 5366171 5366190 5366187 +
caagccttaagtaggaagtt

SEQ ID NO: 24923 - DNA, 20 bp, Artificial Sequence
  Synthetic oligonucleotide; AGG chr11 5366172 5366191 5366188 +
aagccttaagtaggaagtta

SEQ ID NO: 24924 - DNA, 20 bp, Artificial Sequence
  Synthetic oligonucleotide; GAG chr11 5366177 5366196 5366193 +
ttaagtaggaagttaaggat

SEQ ID NO: 24925 - DNA, 20 bp, Artificial Sequence
  Synthetic oligonucleotide; AGG chr11 5366178 5366197 5366194 +
taagtaggaagttaaggatg

SEQ ID NO: 24926 - DNA, 20 bp, Artificial Sequence
  Synthetic oligonucleotide; GGG chr11 5366179 5366198 5366195 +
aagtaggaagttaaggatga

SEQ ID NO: 24927 - DNA, 20 bp, Artificial Sequence
  Synthetic oligonucleotide; CAG chr11 5366185 5366204 5366201 +
gaagttaaggatgagggaaa

SEQ ID NO: 24928 - DNA, 20 bp, Artificial Sequence
  Synthetic oligonucleotide; AGG chr11 5366186 5366205 5366202 +
aagttaaggatgagggaaac

SEQ ID NO: 24929 - DNA, 20 bp, Artificial Sequence
  Synthetic oligonucleotide; AAG chr11 5366189 5366208 5366205 +
ttaaggatgagggaaacagg

SEQ ID NO: 24930 - DNA, 20 bp, Artificial Sequence
  Synthetic oligonucleotide; AGG chr11 5366190 5366209 5366206 +
taaggatgagggaaacagga

SEQ ID NO: 24931 - DNA, 20 bp, Artificial Sequence
  Synthetic oligonucleotide; CAG chr11 5366198 5366217 5366214 +
agggaaacaggaaggaaaat

SEQ ID NO: 24932 - DNA, 20 bp, Artificial Sequence
  Synthetic oligonucleotide; TAG chr11 5366201 5366220 5366217 +
gaaacaggaaggaaaatcag

SEQ ID NO: 24933 - DNA, 20 bp, Artificial Sequence
  Synthetic oligonucleotide; AGG chr11 5366202 5366221 5366218 +
aaacaggaaggaaaatcagt

SEQ ID NO: 24934 - DNA, 20 bp, Artificial Sequence
  Synthetic oligonucleotide; AAG chr11 5366206 5366225 5366222 +
aggaaggaaaatcagtagga

SEQ ID NO: 24935 - DNA, 20 bp, Artificial Sequence
  Synthetic oligonucleotide; TAG chr11 5366211 5366230 5366227 +
ggaaaatcagtaggaaagta

SEQ ID NO: 24936 - DNA, 20 bp, Artificial Sequence
  Synthetic oligonucleotide; AAG chr11 5366214 5366233 5366230 +
aaatcagtaggaaagtatag

SEQ ID NO: 24937 - DNA, 20 bp, Artificial Sequence
  Synthetic oligonucleotide; AAG chr11 5366220 5366239 5366236 +
gtaggaaagtatagaagaca

SEQ ID NO: 24938 - DNA, 20 bp, Artificial Sequence
  Synthetic oligonucleotide; AGG chr11 5366221 5366240 5366237 +
taggaaagtatagaagacaa

SEQ ID NO: 24939 - DNA, 20 bp, Artificial Sequence
  Synthetic oligonucleotide; GAG chr11 5366223 5366242 5366239 +
ggaaagtatagaagacaaag

SEQ ID NO: 24940 - DNA, 20 bp, Artificial Sequence
  Synthetic oligonucleotide; AAG chr11 5366227 5366246 5366243 +
agtatagaagacaaaggaga

SEQ ID NO: 24941 - DNA, 20 bp, Artificial Sequence
  Synthetic oligonucleotide; AGG chr11 5366228 5366247 5366244 +
gtatagaagacaaaggagaa

SEQ ID NO: 24942 - DNA, 20 bp, Artificial Sequence
  Synthetic oligonucleotide; GGG chr11 5366229 5366248 5366245 +
tatagaagacaaaggagaaa

SEQ ID NO: 24943 - DNA, 20 bp, Artificial Sequence
  Synthetic oligonucleotide; CAG chr11 5366233 5366252 5366249 +
gaagacaaaggagaaagggc

SEQ ID NO: 24944 - DNA, 20 bp, Artificial Sequence
  Synthetic oligonucleotide; GAG chr11 5366235 5366254 5366251 +
agacaaaggagaaagggcca

SEQ ID NO: 24945 - DNA, 20 bp, Artificial Sequence
  Synthetic oligonucleotide; CAG chr11 5366241 5366260 5366257 +
aggagaaagggccagagaaa

SEQ ID NO: 24946 - DNA, 20 bp, Artificial Sequence
  Synthetic oligonucleotide; AAG chr11 5366244 5366263 5366260 +
agaaagggccagagaaacag

SEQ ID NO: 24947 - DNA, 20 bp, Artificial Sequence
  Synthetic oligonucleotide; AGG chr11 5366245 5366264 5366261 +
gaaagggccagagaaacaga

SEQ ID NO: 24948 - DNA, 20 bp, Artificial Sequence
  Synthetic oligonucleotide; AAG chr11 5366248 5366267 5366264 +
agggccagagaaacagaagg

SEQ ID NO: 24949 - DNA, 20 bp, Artificial Sequence
  Synthetic oligonucleotide; AAG chr11 5366259 5366278 5366275 +
aacagaaggaagaatctgaa

SEQ ID NO: 24950 - DNA, 20 bp, Artificial Sequence
  Synthetic oligonucleotide; AGG chr11 5366260 5366279 5366276 +
acagaaggaagaatctgaaa

SEQ ID NO: 24951 - DNA, 20 bp, Artificial Sequence
  Synthetic oligonucleotide; GAG chr11 5366262 5366281 5366278 +
agaaggaagaatctgaaaag

SEQ ID NO: 24952 - DNA, 20 bp, Artificial Sequence
  Synthetic oligonucleotide; AAG chr11 5366268 5366287 5366284 +
aagaatctgaaaaggagctc

SEQ ID NO: 24953 - DNA, 20 bp, Artificial Sequence
  Synthetic oligonucleotide; AGG chr11 5366269 5366288 5366285 +
agaatctgaaaaggagctca

SEQ ID NO: 24954 - DNA, 20 bp, Artificial Sequence
  Synthetic oligonucleotide; GGG chr11 5366270 5366289 5366286 +
gaatctgaaaaggagctcaa

SEQ ID NO: 24955 - DNA, 20 bp, Artificial Sequence
  Synthetic oligonucleotide; AAG chr11 5366273 5366292 5366289 +
tctgaaaaggagctcaaggg

SEQ ID NO: 24956 - DNA, 20 bp, Artificial Sequence
  Synthetic oligonucleotide; AGG chr11 5366274 5366293 5366290 +
ctgaaaaggagctcaaggga

SEQ ID NO: 24957 - DNA, 20 bp, Artificial Sequence
  Synthetic oligonucleotide; TGG chr11 5366285 5366304 5366301 +
ctcaagggaaggttcctctg

SEQ ID NO: 24958 - DNA, 20 bp, Artificial Sequence
  Synthetic oligonucleotide; GGG chr11 5366286 5366305 5366302 +
tcaagggaaggttcctctgt

SEQ ID NO: 24959 - DNA, 20 bp, Artificial Sequence
  Synthetic oligonucleotide; TAG chr11 5366289 5366308 5366305 +
agggaaggttcctctgtggg

SEQ ID NO: 24960 - DNA, 20 bp, Artificial Sequence
  Synthetic oligonucleotide; AAG chr11 5366299 5366318 5366315 +
cctctgtgggtagcctgtta

SEQ ID NO: 24961 - DNA, 20 bp, Artificial Sequence
  Synthetic oligonucleotide; AAG chr11 5366304 5366323 5366320 +
gtgggtagcctgttaaagaa

SEQ ID NO: 24962 - DNA, 20 bp, Artificial Sequence
  Synthetic oligonucleotide; AGG chr11 5366305 5366324 5366321 +
tgggtagcctgttaaagaaa

SEQ ID NO: 24963 - DNA, 20 bp, Artificial Sequence
  Synthetic oligonucleotide; CAG chr11 5366316 5366335 5366332 +
ttaaagaaaaggctacatta

SEQ ID NO: 24964 - DNA, 20 bp, Artificial Sequence
  Synthetic oligonucleotide; CAG chr11 5366336 5366355 5366352 +
cagactcatgcctgtaatcc

SEQ ID NO: 24965 - DNA, 20 bp, Artificial Sequence
  Synthetic oligonucleotide; TGG chr11 5366344 5366363 5366360 +
tgcctgtaatcccagcactt

SEQ ID NO: 24966 - DNA, 20 bp, Artificial Sequence
  Synthetic oligonucleotide; GGG chr11 5366345 5366364 5366361 +
gcctgtaatcccagcacttt

SEQ ID NO: 24967 - DNA, 20 bp, Artificial Sequence
  Synthetic oligonucleotide; TGG chr11 5366348 5366367 5366364 +
tgtaatcccagcactttggg

SEQ ID NO: 24968 - DNA, 20 bp, Artificial Sequence
  Synthetic oligonucleotide; GAG chr11 5366353 5366372 5366369 +
tcccagcactttgggtggct

SEQ ID NO: 24969 - DNA, 20 bp, Artificial Sequence
  Synthetic oligonucleotide; AGG chr11 5366354 5366373 5366370 +
cccagcactttgggtggctg

SEQ ID NO: 24970 - DNA, 20 bp, Artificial Sequence
  Synthetic oligonucleotide; CAG chr11 5366357 5366376 5366373 +
agcactttgggtggctgagg

SEQ ID NO: 24971 - DNA, 20 bp, Artificial Sequence
  Synthetic oligonucleotide; AGG chr11 5366358 5366377 5366374 +
gcactttgggtggctgaggc

SEQ ID NO: 24972 - DNA, 20 bp, Artificial Sequence
  Synthetic oligonucleotide; GAG chr11 5366360 5366379 5366376 +
actttgggtggctgaggcag

SEQ ID NO: 24973 - DNA, 20 bp, Artificial Sequence
  Synthetic oligonucleotide; AGG chr11 5366361 5366380 5366377 +
ctttgggtggctgaggcagg

SEQ ID NO: 24974 - DNA, 20 bp, Artificial Sequence
  Synthetic oligonucleotide; GAG chr11 5366371 5366390 5366387 +
ctgaggcaggaggatcacct

SEQ ID NO: 24975 - DNA, 20 bp, Artificial Sequence
  Synthetic oligonucleotide; AGG chr11 5366372 5366391 5366388 +
tgaggcaggaggatcacctg

SEQ ID NO: 24976 - DNA, 20 bp, Artificial Sequence
  Synthetic oligonucleotide; GGG chr11 5366373 5366392 5366389 +
gaggcaggaggatcacctga

SEQ ID NO: 24977 - DNA, 20 bp, Artificial Sequence
  Synthetic oligonucleotide; AAG chr11 5366377 5366396 5366393 +
caggaggatcacctgagggc

SEQ ID NO: 24978 - DNA, 20 bp, Artificial Sequence
  Synthetic oligonucleotide; GAG chr11 5366379 5366398 5366395 +
ggaggatcacctgagggcaa

SEQ ID NO: 24979 - DNA, 20 bp, Artificial Sequence
  Synthetic oligonucleotide; GAG chr11 5366385 5366404 5366401 +
tcacctgagggcaagagttc

SEQ ID NO: 24980 - DNA, 20 bp, Artificial Sequence
  Synthetic oligonucleotide; CAG chr11 5366390 5366409 5366406 +
tgagggcaagagttcgagac

SEQ ID NO: 24981 - DNA, 20 bp, Artificial Sequence
  Synthetic oligonucleotide; TGG chr11 5366404 5366423 5366420 +
cgagaccagcctgaccaaca

SEQ ID NO: 24982 - DNA, 20 bp, Artificial Sequence
  Synthetic oligonucleotide; TAG chr11 5366441 5366460 5366457 +
taataaaaatacaaaaaaat

SEQ ID NO: 24983 - DNA, 20 bp, Artificial Sequence
  Synthetic oligonucleotide; CAG chr11 5366444 5366463 5366460 +
taaaaatacaaaaaaattag

SEQ ID NO: 24984 - DNA, 20 bp, Artificial Sequence
  Synthetic oligonucleotide; AGG chr11 5366445 5366464 5366461 +
aaaaatacaaaaaaattagc

SEQ ID NO: 24985 - DNA, 20 bp, Artificial Sequence
  Synthetic oligonucleotide; GGG chr11 5366446 5366465 5366462 +
aaaatacaaaaaaattagca

SEQ ID NO: 24986 - DNA, 20 bp, Artificial Sequence
  Synthetic oligonucleotide; TGG chr11 5366451 5366470 5366467 +
acaaaaaaattagcagggcc

SEQ ID NO: 24987 - DNA, 20 bp, Artificial Sequence
  Synthetic oligonucleotide; TGG chr11 5366454 5366473 5366470 +
aaaaaattagcagggcctgg

SEQ ID NO: 24988 - DNA, 20 bp, Artificial Sequence
  Synthetic oligonucleotide; CAG chr11 5366457 5366476 5366473 +
aaattagcagggcctggtgg

SEQ ID NO: 24989 - DNA, 20 bp, Artificial Sequence
  Synthetic oligonucleotide; CAG chr11 5366473 5366492 5366489 +
gtggcagatgcctgtaattg

SEQ ID NO: 24990 - DNA, 20 bp, Artificial Sequence
  Synthetic oligonucleotide; CAG chr11 5366481 5366500 5366497 +
tgcctgtaattgcagctaca

SEQ ID NO: 24991 - DNA, 20 bp, Artificial Sequence
  Synthetic oligonucleotide; AGG chr11 5366482 5366501 5366498 +
gcctgtaattgcagctacac

SEQ ID NO: 24992 - DNA, 20 bp, Artificial Sequence
  Synthetic oligonucleotide; GAG chr11 5366484 5366503 5366500 +
ctgtaattgcagctacacag

SEQ ID NO: 24993 - DNA, 20 bp, Artificial Sequence
  Synthetic oligonucleotide; AGG chr11 5366485 5366504 5366501 +
tgtaattgcagctacacagg

SEQ ID NO: 24994 - DNA, 20 bp, Artificial Sequence
  Synthetic oligonucleotide; GAG chr11 5366490 5366509 5366506 +
ttgcagctacacaggaggct

SEQ ID NO: 24995 - DNA, 20 bp, Artificial Sequence
  Synthetic oligonucleotide; AGG chr11 5366491 5366510 5366507 +
tgcagctacacaggaggctg

SEQ ID NO: 24996 - DNA, 20 bp, Artificial Sequence
  Synthetic oligonucleotide; TAG chr11 5366494 5366513 5366510 +
agctacacaggaggctgagg

SEQ ID NO: 24997 - DNA, 20 bp, Artificial Sequence
  Synthetic oligonucleotide; AGG chr11 5366495 5366514 5366511 +
gctacacaggaggctgaggt

SEQ ID NO: 24998 - DNA, 20 bp, Artificial Sequence
  Synthetic oligonucleotide; GAG chr11 5366497 5366516 5366513 +
tacacaggaggctgaggtag

SEQ ID NO: 24999 - DNA, 20 bp, Artificial Sequence
  Synthetic oligonucleotide; TGG chr11 5366513 5366532 5366529 +
gtaggagaatcgcttgaacc

SEQ ID NO: 25000 - DNA, 20 bp, Artificial Sequence
  Synthetic oligonucleotide; GGG chr11 5366514 5366533 5366530 +
taggagaatcgcttgaacct

SEQ ID NO: 25001 - DNA, 20 bp, Artificial Sequence
  Synthetic oligonucleotide; GAG chr11 5366516 5366535 5366532 +
ggagaatcgcttgaacctgg

SEQ ID NO: 25002 - DNA, 20 bp, Artificial Sequence
  Synthetic oligonucleotide; AGG chr11 5366517 5366536 5366533 +
gagaatcgcttgaacctggg

SEQ ID NO: 25003 - DNA, 20 bp, Artificial Sequence
  Synthetic oligonucleotide; CGG chr11 5366520 5366539 5366536 +
aatcgcttgaacctgggagg

SEQ ID NO: 25004 - DNA, 20 bp, Artificial Sequence
  Synthetic oligonucleotide; GAG chr11 5366522 5366541 5366538 +
tcgcttgaacctgggaggcg

SEQ ID NO: 25005 - DNA, 20 bp, Artificial Sequence
  Synthetic oligonucleotide; AGG chr11 5366523 5366542 5366539 +
cgcttgaacctgggaggcgg

SEQ ID NO: 25006 - DNA, 20 bp, Artificial Sequence
  Synthetic oligonucleotide; CAG chr11 5366529 5366548 5366545 +
aacctgggaggcggaggttg

SEQ ID NO: 25007 - DNA, 20 bp, Artificial Sequence
  Synthetic oligonucleotide; GAG chr11 5366533 5366552 5366549 +
tgggaggcggaggttgcagt

SEQ ID NO: 25008 - DNA, 20 bp, Artificial Sequence
  Synthetic oligonucleotide; GAG chr11 5366538 5366557 5366554 +
ggcggaggttgcagtgagcc

SEQ ID NO: 25009 - DNA, 20 bp, Artificial Sequence
  Synthetic oligonucleotide; CAG chr11 5366558 5366577 5366574 +
gagatcgcgccattgcactc

SEQ ID NO: 25010 - DNA, 20 bp, Artificial Sequence
  Synthetic oligonucleotide; CAG chr11 5366561 5366580 5366577 +
atcgcgccattgcactccag

SEQ ID NO: 25011 - DNA, 20 bp, Artificial Sequence
  Synthetic oligonucleotide; TGG chr11 5366566 5366585 5366582 +
gccattgcactccagcagcc

SEQ ID NO: 25012 - DNA, 20 bp, Artificial Sequence
  Synthetic oligonucleotide; AAG chr11 5366569 5366588 5366585 +
attgcactccagcagcctgg

SEQ ID NO: 25013 - DNA, 20 bp, Artificial Sequence
  Synthetic oligonucleotide; AGG chr11 5366570 5366589 5366586 +
ttgcactccagcagcctgga

SEQ ID NO: 25014 - DNA, 20 bp, Artificial Sequence
  Synthetic oligonucleotide; AAG chr11 5366576 5366595 5366592 +
tccagcagcctggaaggcaa

SEQ ID NO: 25015 - DNA, 20 bp, Artificial Sequence
  Synthetic oligonucleotide; AAG chr11 5366580 5366599 5366596 +
gcagcctggaaggcaaaagc

SEQ ID NO: 25016 - DNA, 20 bp, Artificial Sequence
  Synthetic oligonucleotide; GAG chr11 5366585 5366604 5366601 +
ctggaaggcaaaagcaagat

SEQ ID NO: 25017 - DNA, 20 bp, Artificial Sequence
  Synthetic oligonucleotide; AAG chr11 5366589 5366608 5366605 +
aaggcaaaagcaagatgaga

SEQ ID NO: 25018 - DNA, 20 bp, Artificial Sequence
  Synthetic oligonucleotide; TAG chr11 5366595 5366614 5366611 +
aaagcaagatgagaaagaaa

SEQ ID NO: 25019 - DNA, 20 bp, Artificial Sequence
  Synthetic oligonucleotide; GAG chr11 5366597 5366616 5366613 +
agcaagatgagaaagaaata

SEQ ID NO: 25020 - DNA, 20 bp, Artificial Sequence
  Synthetic oligonucleotide; AAG chr11 5366601 5366620 5366617 +
agatgagaaagaaatagaga

SEQ ID NO: 25021 - DNA, 20 bp, Artificial Sequence
  Synthetic oligonucleotide; GAG chr11 5366603 5366622 5366619 +
atgagaaagaaatagagaaa

SEQ ID NO: 25022 - DNA, 20 bp, Artificial Sequence
  Synthetic oligonucleotide; GAG chr11 5366605 5366624 5366621 +
gagaaagaaatagagaaaga

SEQ ID NO: 25023 - DNA, 20 bp, Artificial Sequence
  Synthetic oligonucleotide; GAG chr11 5366607 5366626 5366623 +
gaaagaaatagagaaagaga

SEQ ID NO: 25024 - DNA, 20 bp, Artificial Sequence
  Synthetic oligonucleotide; GAG chr11 5366609 5366628 5366625 +
aagaaatagagaaagagaga

SEQ ID NO: 25025 - DNA, 20 bp, Artificial Sequence
  Synthetic oligonucleotide; AGG chr11 5366610 5366629 5366626 +
agaaatagagaaagagagag

SEQ ID NO: 25026 - DNA, 20 bp, Artificial Sequence
  Synthetic oligonucleotide; TAG chr11 5366613 5366632 5366629 +
aatagagaaagagagagagg

SEQ ID NO: 25027 - DNA, 20 bp, Artificial Sequence
  Synthetic oligonucleotide; AGG chr11 5366614 5366633 5366630 +
atagagaaagagagagaggt

SEQ ID NO: 25028 - DNA, 20 bp, Artificial Sequence
  Synthetic oligonucleotide; GGG chr11 5366615 5366634 5366631 +
tagagaaagagagagaggta

SEQ ID NO: 25029 - DNA, 20 bp, Artificial Sequence
  Synthetic oligonucleotide; GAG chr11 5366617 5366636 5366633 +
gagaaagagagagaggtagg

SEQ ID NO: 25030 - DNA, 20 bp, Artificial Sequence
  Synthetic oligonucleotide; AGG chr11 5366618 5366637 5366634 +
agaaagagagagaggtaggg

SEQ ID NO: 25031 - DNA, 20 bp, Artificial Sequence
  Synthetic oligonucleotide; GGG chr11 5366619 5366638 5366635 +
gaaagagagagaggtaggga

SEQ ID NO: 25032 - DNA, 20 bp, Artificial Sequence
  Synthetic oligonucleotide; GAG chr11 5366621 5366640 5366637 +
aagagagagaggtagggagg

SEQ ID NO: 25033 - DNA, 20 bp, Artificial Sequence
  Synthetic oligonucleotide; AGG chr11 5366622 5366641 5366638 +
agagagagaggtagggaggg

SEQ ID NO: 25034 - DNA, 20 bp, Artificial Sequence
  Synthetic oligonucleotide; AAG chr11 5366625 5366644 5366641 +
gagagaggtagggagggagg

SEQ ID NO: 25035 - DNA, 20 bp, Artificial Sequence
  Synthetic oligonucleotide; AGG chr11 5366626 5366645 5366642 +
agagaggtagggagggagga

SEQ ID NO: 25036 - DNA, 20 bp, Artificial Sequence
  Synthetic oligonucleotide; AAG chr11 5366629 5366648 5366645 +
gaggtagggagggaggaagg

SEQ ID NO: 25037 - DNA, 20 bp, Artificial Sequence
  Synthetic oligonucleotide; AGG chr11 5366630 5366649 5366646 +
aggtagggagggaggaagga

SEQ ID NO: 25038 - DNA, 20 bp, Artificial Sequence
  Synthetic oligonucleotide; GGG chr11 5366631 5366650 5366647 +
ggtagggagggaggaaggaa

SEQ ID NO: 25039 - DNA, 20 bp, Artificial Sequence
  Synthetic oligonucleotide; AAG chr11 5366634 5366653 5366650 +
agggagggaggaaggaaggg

SEQ ID NO: 25040 - DNA, 20 bp, Artificial Sequence
  Synthetic oligonucleotide; AGG chr11 5366635 5366654 5366651 +
gggagggaggaaggaaggga

SEQ ID NO: 25041 - DNA, 20 bp, Artificial Sequence
  Synthetic oligonucleotide; AAG chr11 5366639 5366658 5366655 +
gggaggaaggaagggaagga

SEQ ID NO: 25042 - DNA, 20 bp, Artificial Sequence
  Synthetic oligonucleotide; AGG chr11 5366640 5366659 5366656 +
ggaggaaggaagggaaggaa

SEQ ID NO: 25043 - DNA, 20 bp, Artificial Sequence
  Synthetic oligonucleotide; AAG chr11 5366643 5366662 5366659 +
ggaaggaagggaaggaaagg

SEQ ID NO: 25044 - DNA, 20 bp, Artificial Sequence
  Synthetic oligonucleotide; AGG chr11 5366644 5366663 5366660 +
gaaggaagggaaggaaagga

SEQ ID NO: 25045 - DNA, 20 bp, Artificial Sequence
  Synthetic oligonucleotide; AAG chr11 5366647 5366666 5366663 +
ggaagggaaggaaaggaagg

SEQ ID NO: 25046 - DNA, 20 bp, Artificial Sequence
  Synthetic oligonucleotide; GAG chr11 5366649 5366668 5366665 +
aagggaaggaaaggaaggaa

SEQ ID NO: 25047 - DNA, 20 bp, Artificial Sequence
  Synthetic oligonucleotide; AAG chr11 5366652 5366671 5366668 +
ggaaggaaaggaaggaagag

SEQ ID NO: 25048 - DNA, 20 bp, Artificial Sequence
  Synthetic oligonucleotide; AAG chr11 5366655 5366674 5366671 +
aggaaaggaaggaagagaag

SEQ ID NO: 25049 - DNA, 20 bp, Artificial Sequence
  Synthetic oligonucleotide; AAG chr11 5366658 5366677 5366674 +
aaaggaaggaagagaagaag

SEQ ID NO: 25050 - DNA, 20 bp, Artificial Sequence
  Synthetic oligonucleotide; AAG chr11 5366661 5366680 5366677 +
ggaaggaagagaagaagaag

SEQ ID NO: 25051 - DNA, 20 bp, Artificial Sequence
  Synthetic oligonucleotide; AAG chr11 5366664 5366683 5366680 +
aggaagagaagaagaagaag

SEQ ID NO: 25052 - DNA, 20 bp, Artificial Sequence
  Synthetic oligonucleotide; AGG chr11 5366665 5366684 5366681 +
ggaagagaagaagaagaaga

SEQ ID NO: 25053 - DNA, 20 bp, Artificial Sequence
  Synthetic oligonucleotide; GAG chr11 5366667 5366686 5366683 +
aagagaagaagaagaagaag

SEQ ID NO: 25054 - DNA, 20 bp, Artificial Sequence
  Synthetic oligonucleotide; AAG chr11 5366670 5366689 5366686 +
agaagaagaagaagaaggag

SEQ ID NO: 25055 - DNA, 20 bp, Artificial Sequence
  Synthetic oligonucleotide; AGG chr11 5366671 5366690 5366687 +
gaagaagaagaagaaggaga

SEQ ID NO: 25056 - DNA, 20 bp, Artificial Sequence
  Synthetic oligonucleotide; GAG chr11 5366673 5366692 5366689 +
agaagaagaagaaggagaag

SEQ ID NO: 25057 - DNA, 20 bp, Artificial Sequence
  Synthetic oligonucleotide; AAG chr11 5366676 5366695 5366692 +
agaagaagaaggagaaggag

SEQ ID NO: 25058 - DNA, 20 bp, Artificial Sequence
  Synthetic oligonucleotide; AAG chr11 5366682 5366701 5366698 +
agaaggagaaggagaagaaa

SEQ ID NO: 25059 - DNA, 20 bp, Artificial Sequence
  Synthetic oligonucleotide; TAG chr11 5366685 5366704 5366701 +
aggagaaggagaagaaaaag

SEQ ID NO: 25060 - DNA, 20 bp, Artificial Sequence
  Synthetic oligonucleotide; GAG chr11 5366687 5366706 5366703 +
gagaaggagaagaaaaagta

SEQ ID NO: 25061 - DNA, 20 bp, Artificial Sequence
  Synthetic oligonucleotide; AGG chr11 5366688 5366707 5366704 +
agaaggagaagaaaaagtag

SEQ ID NO: 25062 - DNA, 20 bp, Artificial Sequence
  Synthetic oligonucleotide; GAG chr11 5366690 5366709 5366706 +
aaggagaagaaaaagtagag

SEQ ID NO: 25063 - DNA, 20 bp, Artificial Sequence
  Synthetic oligonucleotide; AGG chr11 5366691 5366710 5366707 +
aggagaagaaaaagtagagg

SEQ ID NO: 25064 - DNA, 20 bp, Artificial Sequence
  Synthetic oligonucleotide; GAG chr11 5366693 5366712 5366709 +
gagaagaaaaagtagaggag

SEQ ID NO: 25065 - DNA, 20 bp, Artificial Sequence
  Synthetic oligonucleotide; AGG chr11 5366694 5366713 5366710 +
agaagaaaaagtagaggagg

SEQ ID NO: 25066 - DNA, 20 bp, Artificial Sequence
  Synthetic oligonucleotide; AAG chr11 5366698 5366717 5366714 +
gaaaaagtagaggaggagga

SEQ ID NO: 25067 - DNA, 20 bp, Artificial Sequence
  Synthetic oligonucleotide; AGG chr11 5366699 5366718 5366715 +
aaaaagtagaggaggaggaa

SEQ ID NO: 25068 - DNA, 20 bp, Artificial Sequence
  Synthetic oligonucleotide; AAG chr11 5366703 5366722 5366719 +
agtagaggaggaggaaagga

SEQ ID NO: 25069 - DNA, 20 bp, Artificial Sequence
  Synthetic oligonucleotide; AGG chr11 5366704 5366723 5366720 +
gtagaggaggaggaaaggaa

SEQ ID NO: 25070 - DNA, 20 bp, Artificial Sequence
  Synthetic oligonucleotide; AAG chr11 5366708 5366727 5366724 +
aggaggaggaaaggaaagga

SEQ ID NO: 25071 - DNA, 20 bp, Artificial Sequence
  Synthetic oligonucleotide; AAG chr11 5366711 5366730 5366727 +
aggaggaaaggaaaggaaag

SEQ ID NO: 25072 - DNA, 20 bp, Artificial Sequence
  Synthetic oligonucleotide; AGG chr11 5366712 5366731 5366728 +
ggaggaaaggaaaggaaaga

SEQ ID NO: 25073 - DNA, 20 bp, Artificial Sequence
  Synthetic oligonucleotide; AAG chr11 5366715 5366734 5366731 +
ggaaaggaaaggaaagaagg

SEQ ID NO: 25074 - DNA, 20 bp, Artificial Sequence
  Synthetic oligonucleotide; AGG chr11 5366716 5366735 5366732 +
gaaaggaaaggaaagaagga

SEQ ID NO: 25075 - DNA, 20 bp, Artificial Sequence
  Synthetic oligonucleotide; AAG chr11 5366719 5366738 5366735 +
aggaaaggaaagaaggaagg

SEQ ID NO: 25076 - DNA, 20 bp, Artificial Sequence
  Synthetic oligonucleotide; AGG chr11 5366720 5366739 5366736 +
ggaaaggaaagaaggaagga

SEQ ID NO: 25077 - DNA, 20 bp, Artificial Sequence
  Synthetic oligonucleotide; CAG chr11 5366727 5366746 5366743 +
aaagaaggaaggaaggaaat

SEQ ID NO: 25078 - DNA, 20 bp, Artificial Sequence
  Synthetic oligonucleotide; AGG chr11 5366728 5366747 5366744 +
aagaaggaaggaaggaaatc

SEQ ID NO: 25079 - DNA, 20 bp, Artificial Sequence
  Synthetic oligonucleotide; GGG chr11 5366729 5366748 5366745 +
agaaggaaggaaggaaatca

SEQ ID NO: 25080 - DNA, 20 bp, Artificial Sequence
  Synthetic oligonucleotide; GAG chr11 5366741 5366760 5366757 +
ggaaatcagggtattcactt

SEQ ID NO: 25081 - DNA, 20 bp, Artificial Sequence
  Synthetic oligonucleotide; AAG chr11 5366749 5366768 5366765 +
gggtattcacttgagattca

SEQ ID NO: 25082 - DNA, 20 bp, Artificial Sequence
  Synthetic oligonucleotide; TAG chr11 5366756 5366775 5366772 +
cacttgagattcaaagtctt

SEQ ID NO: 25083 - DNA, 20 bp, Artificial Sequence
  Synthetic oligonucleotide; TGG chr11 5366775 5366794 5366791 +
ttagaataaaaattaaaatt

SEQ ID NO: 25084 - DNA, 20 bp, Artificial Sequence
  Synthetic oligonucleotide; GGG chr11 5366776 5366795 5366792 +
tagaataaaaattaaaattt

SEQ ID NO: 25085 - DNA, 20 bp, Artificial Sequence
  Synthetic oligonucleotide; AAG chr11 5366784 5366803 5366800 +
aaattaaaatttgggaaaat

SEQ ID NO: 25086 - DNA, 20 bp, Artificial Sequence
  Synthetic oligonucleotide; AAG chr11 5366814 5366833 5366830 +
tgatgactaattccaatccc

SEQ ID NO: 25087 - DNA, 20 bp, Artificial Sequence
  Synthetic oligonucleotide; CGG chr11 5366819 5366838 5366835 +
actaattccaatcccaagca

SEQ ID NO: 25088 - DNA, 20 bp, Artificial Sequence
  Synthetic oligonucleotide; GGG chr11 5366820 5366839 5366836 +
ctaattccaatcccaagcac

SEQ ID NO: 25089 - DNA, 20 bp, Artificial Sequence
  Synthetic oligonucleotide; CAG chr11 5366836 5366855 5366852 +
gcacgggtctctgtgcaatg

SEQ ID NO: 25090 - DNA, 20 bp, Artificial Sequence
  Synthetic oligonucleotide; AGG chr11 5366837 5366856 5366853 +
cacgggtctctgtgcaatgc

SEQ ID NO: 25091 - DNA, 20 bp, Artificial Sequence
  Synthetic oligonucleotide; TGG chr11 5366842 5366861 5366858 +
gtctctgtgcaatgcaggac

SEQ ID NO: 25092 - DNA, 20 bp, Artificial Sequence
  Synthetic oligonucleotide; GGG chr11 5366843 5366862 5366859 +
tctctgtgcaatgcaggact

SEQ ID NO: 25093 - DNA, 20 bp, Artificial Sequence
  Synthetic oligonucleotide; AAG chr11 5366846 5366865 5366862 +
ctgtgcaatgcaggactggg

SEQ ID NO: 25094 - DNA, 20 bp, Artificial Sequence
  Synthetic oligonucleotide; AGG chr11 5366847 5366866 5366863 +
tgtgcaatgcaggactggga

SEQ ID NO: 25095 - DNA, 20 bp, Artificial Sequence
  Synthetic oligonucleotide; TAG chr11 5366852 5366871 5366868 +
aatgcaggactgggaaggtt

SEQ ID NO: 25096 - DNA, 20 bp, Artificial Sequence
  Synthetic oligonucleotide; AGG chr11 5366853 5366872 5366869 +
atgcaggactgggaaggttt

SEQ ID NO: 25097 - DNA, 20 bp, Artificial Sequence
  Synthetic oligonucleotide; CAG chr11 5366856 5366875 5366872 +
caggactgggaaggtttagg

SEQ ID NO: 25098 - DNA, 20 bp, Artificial Sequence
  Synthetic oligonucleotide; AGG chr11 5366857 5366876 5366873 +
aggactgggaaggtttaggc

SEQ ID NO: 25099 - DNA, 20 bp, Artificial Sequence
  Synthetic oligonucleotide; GGG chr11 5366858 5366877 5366874 +
ggactgggaaggtttaggca

SEQ ID NO: 25100 - DNA, 20 bp, Artificial Sequence
  Synthetic oligonucleotide; GGG chr11 5366859 5366878 5366875 +
gactgggaaggtttaggcag

SEQ ID NO: 25101 - DNA, 20 bp, Artificial Sequence
  Synthetic oligonucleotide; GAG chr11 5366877 5366896 5366893 +
aggggtgctatctgattcat

SEQ ID NO: 25102 - DNA, 20 bp, Artificial Sequence
  Synthetic oligonucleotide; CAG chr11 5366884 5366903 5366900 +
ctatctgattcatgagacaa

SEQ ID NO: 25103 - DNA, 20 bp, Artificial Sequence
  Synthetic oligonucleotide; AGG chr11 5366885 5366904 5366901 +
tatctgattcatgagacaac

SEQ ID NO: 25104 - DNA, 20 bp, Artificial Sequence
  Synthetic oligonucleotide; AAG chr11 5366892 5366911 5366908 +
ttcatgagacaacaggcaca

SEQ ID NO: 25105 - DNA, 20 bp, Artificial Sequence
  Synthetic oligonucleotide; TAG chr11 5366898 5366917 5366914 +
agacaacaggcacaaagttt

SEQ ID NO: 25106 - DNA, 20 bp, Artificial Sequence
  Synthetic oligonucleotide; TGG chr11 5366909 5366928 5366925 +
acaaagttttagtccctgcc

SEQ ID NO: 25107 - DNA, 20 bp, Artificial Sequence
  Synthetic oligonucleotide; TGG chr11 5366915 5366934 5366931 +
ttttagtccctgcctggact

SEQ ID NO: 25108 - DNA, 20 bp, Artificial Sequence
  Synthetic oligonucleotide; GAG chr11 5366929 5366948 5366945 +
tggacttggtgtcatctctt

SEQ ID NO: 25109 - DNA, 20 bp, Artificial Sequence
  Synthetic oligonucleotide; TGG chr11 5366943 5366962 5366959 +
tctcttgagcacatgcctaa

SEQ ID NO: 25110 - DNA, 20 bp, Artificial Sequence
  Synthetic oligonucleotide; AAG chr11 5366967 5366986 5366983 +
ctcctaacattcccctccca

SEQ ID NO: 25111 - DNA, 20 bp, Artificial Sequence
  Synthetic oligonucleotide; CAG chr11 5366996 5367015 5367012 +
aatgcttccacctcccgctg

SEQ ID NO: 25112 - DNA, 20 bp, Artificial Sequence
  Synthetic oligonucleotide; CAG chr11 5367008 5367027 5367024 +
tcccgctgcagtccatgaac

SEQ ID NO: 25113 - DNA, 20 bp, Artificial Sequence
  Synthetic oligonucleotide; AGG chr11 5367009 5367028 5367025 +
cccgctgcagtccatgaacc

SEQ ID NO: 25114 - DNA, 20 bp, Artificial Sequence
  Synthetic oligonucleotide; TAG chr11 5367023 5367042 5367039 +
tgaaccaggataaaattctc

SEQ ID NO: 25115 - DNA, 20 bp, Artificial Sequence
  Synthetic oligonucleotide; CAG chr11 5367026 5367045 5367042 +
accaggataaaattctctag

SEQ ID NO: 25116 - DNA, 20 bp, Artificial Sequence
  Synthetic oligonucleotide; CAG chr11 5367029 5367048 5367045 +
aggataaaattctctagcag

SEQ ID NO: 25117 - DNA, 20 bp, Artificial Sequence
  Synthetic oligonucleotide; GAG chr11 5367031 5367050 5367047 +
gataaaattctctagcagca

SEQ ID NO: 25118 - DNA, 20 bp, Artificial Sequence
  Synthetic oligonucleotide; AAG chr11 5367038 5367057 5367054 +
ttctctagcagcagagacca

SEQ ID NO: 25119 - DNA, 20 bp, Artificial Sequence
  Synthetic oligonucleotide; AAG chr11 5367051 5367070 5367067 +
gagaccaaagacattctctc

SEQ ID NO: 25120 - DNA, 20 bp, Artificial Sequence
  Synthetic oligonucleotide; CAG chr11 5367057 5367076 5367073 +
aaagacattctctcaagtct

SEQ ID NO: 25121 - DNA, 20 bp, Artificial Sequence
  Synthetic oligonucleotide; AGG chr11 5367058 5367077 5367074 +
aagacattctctcaagtctc

SEQ ID NO: 25122 - DNA, 20 bp, Artificial Sequence
  Synthetic oligonucleotide; TGG chr11 5367065 5367084 5367081 +
tctctcaagtctcaggaatg

SEQ ID NO: 25123 - DNA, 20 bp, Artificial Sequence
  Synthetic oligonucleotide; AAG chr11 5367073 5367092 5367089 +
gtctcaggaatgtggttctg

SEQ ID NO: 25124 - DNA, 20 bp, Artificial Sequence
  Synthetic oligonucleotide; AGG chr11 5367074 5367093 5367090 +
tctcaggaatgtggttctga

SEQ ID NO: 25125 - DNA, 20 bp, Artificial Sequence
  Synthetic oligonucleotide; AAG chr11 5367077 5367096 5367093 +
caggaatgtggttctgaagg

SEQ ID NO: 25126 - DNA, 20 bp, Artificial Sequence
  Synthetic oligonucleotide; GAG chr11 5367079 5367098 5367095 +
ggaatgtggttctgaaggaa

SEQ ID NO: 25127 - DNA, 20 bp, Artificial Sequence
  Synthetic oligonucleotide; AAG chr11 5367082 5367101 5367098 +
atgtggttctgaaggaagag

SEQ ID NO: 25128 - DNA, 20 bp, Artificial Sequence
  Synthetic oligonucleotide; AAG chr11 5367115 5367134 5367131 +
catacacatgccaccttgca

SEQ ID NO: 25129 - DNA, 20 bp, Artificial Sequence
  Synthetic oligonucleotide; TAG chr11 5367123 5367142 5367139 +
tgccaccttgcaaagccact

SEQ ID NO: 25130 - DNA, 20 bp, Artificial Sequence
  Synthetic oligonucleotide; CAG chr11 5367131 5367150 5367147 +
tgcaaagccacttagtgaca

SEQ ID NO: 25131 - DNA, 20 bp, Artificial Sequence
  Synthetic oligonucleotide; GAG chr11 5367133 5367152 5367149 +
caaagccacttagtgacaca

SEQ ID NO: 25132 - DNA, 20 bp, Artificial Sequence
  Synthetic oligonucleotide; TAG chr11 5367139 5367158 5367155 +
cacttagtgacacagagttt

SEQ ID NO: 25133 - DNA, 20 bp, Artificial Sequence
  Synthetic oligonucleotide; TGG chr11 5367158 5367177 5367174 +
ttagttatttcattgtgaac

SEQ ID NO: 25134 - DNA, 20 bp, Artificial Sequence
  Synthetic oligonucleotide; AAG chr11 5367177 5367196 5367193 +
ctggaataaaatcattttga

SEQ ID NO: 25135 - DNA, 20 bp, Artificial Sequence
  Synthetic oligonucleotide; AGG chr11 5367178 5367197 5367194 +
tggaataaaatcattttgaa

SEQ ID NO: 25136 - DNA, 20 bp, Artificial Sequence
  Synthetic oligonucleotide; GAG chr11 5367180 5367199 5367196 +
gaataaaatcattttgaaag

SEQ ID NO: 25137 - DNA, 20 bp, Artificial Sequence
  Synthetic oligonucleotide; AAG chr11 5367190 5367209 5367206 +
attttgaaaggagatttttg

SEQ ID NO: 25138 - DNA, 20 bp, Artificial Sequence
  Synthetic oligonucleotide; AAG chr11 5367197 5367216 5367213 +
aaggagatttttgaagttaa

SEQ ID NO: 25139 - DNA, 20 bp, Artificial Sequence
  Synthetic oligonucleotide; CAG chr11 5367206 5367225 5367222 +
tttgaagttaaaagcattgc

SEQ ID NO: 25140 - DNA, 20 bp, Artificial Sequence
  Synthetic oligonucleotide; AAG chr11 5367210 5367229 5367226 +
aagttaaaagcattgccaga

SEQ ID NO: 25141 - DNA, 20 bp, Artificial Sequence
  Synthetic oligonucleotide; AGG chr11 5367211 5367230 5367227 +
agttaaaagcattgccagaa

SEQ ID NO: 25142 - DNA, 20 bp, Artificial Sequence
  Synthetic oligonucleotide; GAG chr11 5367213 5367232 5367229 +
ttaaaagcattgccagaaag

SEQ ID NO: 25143 - DNA, 20 bp, Artificial Sequence
  Synthetic oligonucleotide; CAG chr11 5367224 5367243 5367240 +
gccagaaaggagtcacaatc

SEQ ID NO: 25144 - DNA, 20 bp, Artificial Sequence
  Synthetic oligonucleotide; AAG chr11 5367232 5367251 5367248 +
ggagtcacaatccagaccct

SEQ ID NO: 25145 - DNA, 20 bp, Artificial Sequence
  Synthetic oligonucleotide; GAG chr11 5367234 5367253 5367250 +
agtcacaatccagaccctaa

SEQ ID NO: 25146 - DNA, 20 bp, Artificial Sequence
  Synthetic oligonucleotide; GAG chr11 5367236 5367255 5367252 +
tcacaatccagaccctaaga

SEQ ID NO: 25147 - DNA, 20 bp, Artificial Sequence
  Synthetic oligonucleotide; AGG chr11 5367237 5367256 5367253 +
cacaatccagaccctaagag

SEQ ID NO: 25148 - DNA, 20 bp, Artificial Sequence
  Synthetic oligonucleotide; GGG chr11 5367238 5367257 5367254 +
acaatccagaccctaagaga

SEQ ID NO: 25149 - DNA, 20 bp, Artificial Sequence
  Synthetic oligonucleotide; TGG chr11 5367245 5367264 5367261 +
agaccctaagagagggttct

SEQ ID NO: 25150 - DNA, 20 bp, Artificial Sequence
  Synthetic oligonucleotide; AAG chr11 5367259 5367278 5367275 +
ggttcttggatttcgtgccc

SEQ ID NO: 25151 - DNA, 20 bp, Artificial Sequence
  Synthetic oligonucleotide; AAG chr11 5367263 5367282 5367279 +
cttggatttcgtgcccaaga

SEQ ID NO: 25152 - DNA, 20 bp, Artificial Sequence
  Synthetic oligonucleotide; TGG chr11 5367270 5367289 5367286 +
ttcgtgcccaagaaagaatt

SEQ ID NO: 25153 - DNA, 20 bp, Artificial Sequence
  Synthetic oligonucleotide; GGG chr11 5367271 5367290 5367287 +
tcgtgcccaagaaagaattt

SEQ ID NO: 25154 - DNA, 20 bp, Artificial Sequence
  Synthetic oligonucleotide; GGG chr11 5367272 5367291 5367288 +
cgtgcccaagaaagaatttg

SEQ ID NO: 25155 - DNA, 20 bp, Artificial Sequence
  Synthetic oligonucleotide; CAG chr11 5367285 5367304 5367301 +
gaatttggggcaaatccata

SEQ ID NO: 25156 - DNA, 20 bp, Artificial Sequence
  Synthetic oligonucleotide; AAG chr11 5367290 5367309 5367306 +
tggggcaaatccatacagaa

SEQ ID NO: 25157 - DNA, 20 bp, Artificial Sequence
  Synthetic oligonucleotide; AAG chr11 5367296 5367315 5367312 +
aaatccatacagaaaagtga

SEQ ID NO: 25158 - DNA, 20 bp, Artificial Sequence
  Synthetic oligonucleotide; AAG chr11 5367300 5367319 5367316 +
ccatacagaaaagtgaaagc

SEQ ID NO: 25159 - DNA, 20 bp, Artificial Sequence
  Synthetic oligonucleotide; AAG chr11 5367309 5367328 5367325 +
aaagtgaaagcaagttaatt

SEQ ID NO: 25160 - DNA, 20 bp, Artificial Sequence
  Synthetic oligonucleotide; AAG chr11 5367313 5367332 5367329 +
tgaaagcaagttaattaaga

SEQ ID NO: 25161 - DNA, 20 bp, Artificial Sequence
  Synthetic oligonucleotide; AAG chr11 5367318 5367337 5367334 +
gcaagttaattaagaaagta

SEQ ID NO: 25162 - DNA, 20 bp, Artificial Sequence
  Synthetic oligonucleotide; AGG chr11 5367319 5367338 5367335 +
caagttaattaagaaagtaa

SEQ ID NO: 25163 - DNA, 20 bp, Artificial Sequence
  Synthetic oligonucleotide; GAG chr11 5367321 5367340 5367337 +
agttaattaagaaagtaaag

SEQ ID NO: 25164 - DNA, 20 bp, Artificial Sequence
  Synthetic oligonucleotide; TGG chr11 5367332 5367351 5367348 +
aaagtaaaggagtaaaataa

SEQ ID NO: 25165 - DNA, 20 bp, Artificial Sequence
  Synthetic oligonucleotide; TAG chr11 5367343 5367362 5367359 +
gtaaaataatggctacccta

SEQ ID NO: 25166 - DNA, 20 bp, Artificial Sequence
  Synthetic oligonucleotide; AGG chr11 5367344 5367363 5367360 +
taaaataatggctaccctat

SEQ ID NO: 25167 - DNA, 20 bp, Artificial Sequence
  Synthetic oligonucleotide; CAG chr11 5367347 5367366 5367363 +
aataatggctaccctatagg

SEQ ID NO: 25168 - DNA, 20 bp, Artificial Sequence
  Synthetic oligonucleotide; CAG chr11 5367352 5367371 5367368 +
tggctaccctataggcagaa

SEQ ID NO: 25169 - DNA, 20 bp, Artificial Sequence
  Synthetic oligonucleotide; GAG chr11 5367359 5367378 5367375 +
cctataggcagaacagtcct

SEQ ID NO: 25170 - DNA, 20 bp, Artificial Sequence
  Synthetic oligonucleotide; AGG chr11 5367360 5367379 5367376 +
ctataggcagaacagtcctg

SEQ ID NO: 25171 - DNA, 20 bp, Artificial Sequence
  Synthetic oligonucleotide; TGG chr11 5367368 5367387 5367384 +
agaacagtcctgaggactgc

SEQ ID NO: 25172 - DNA, 20 bp, Artificial Sequence
  Synthetic oligonucleotide; TGG chr11 5367384 5367403 5367400 +
ctgctggttgcccattttta

SEQ ID NO: 25173 - DNA, 20 bp, Artificial Sequence
  Synthetic oligonucleotide; AAG chr11 5367411 5367430 5367427 +
ttattgatgatatgctaaac

SEQ ID NO: 25174 - DNA, 20 bp, Artificial Sequence
  Synthetic oligonucleotide; AGG chr11 5367412 5367431 5367428 +
tattgatgatatgctaaaca

SEQ ID NO: 25175 - DNA, 20 bp, Artificial Sequence
  Synthetic oligonucleotide; GGG chr11 5367413 5367432 5367429 +
attgatgatatgctaaacaa

SEQ ID NO: 25176 - DNA, 20 bp, Artificial Sequence
  Synthetic oligonucleotide; GGG chr11 5367414 5367433 5367430 +
ttgatgatatgctaaacaag

SEQ ID NO: 25177 - DNA, 20 bp, Artificial Sequence
  Synthetic oligonucleotide; TGG chr11 5367417 5367436 5367433 +
atgatatgctaaacaagggg

SEQ ID NO: 25178 - DNA, 20 bp, Artificial Sequence
  Synthetic oligonucleotide; CAG chr11 5367441 5367460 5367457 +
ttattcatgcctcccctttt

SEQ ID NO: 25179 - DNA, 20 bp, Artificial Sequence
  Synthetic oligonucleotide; TAG chr11 5367450 5367469 5367466 +
cctccccttttcagaccgct

SEQ ID NO: 25180 - DNA, 20 bp, Artificial Sequence
  Synthetic oligonucleotide; TGG chr11 5367474 5367493 5367490 +
gtaacttcctgatgttgcca

SEQ ID NO: 25181 - DNA, 20 bp, Artificial Sequence
  Synthetic oligonucleotide; CAG chr11 5367487 5367506 5367503 +
gttgccatggcatttctaaa

SEQ ID NO: 25182 - DNA, 20 bp, Artificial Sequence
  Synthetic oligonucleotide; TAG chr11 5367493 5367512 5367509 +
atggcatttctaaacagtca

SEQ ID NO: 25183 - DNA, 20 bp, Artificial Sequence
  Synthetic oligonucleotide; TGG chr11 5367499 5367518 5367515 +
tttctaaacagtcatagtgc

SEQ ID NO: 25184 - DNA, 20 bp, Artificial Sequence
  Synthetic oligonucleotide; TGG chr11 5367502 5367521 5367518 +
ctaaacagtcatagtgctgg

SEQ ID NO: 25185 - DNA, 20 bp, Artificial Sequence
  Synthetic oligonucleotide; GGG chr11 5367503 5367522 5367519 +
taaacagtcatagtgctggt

SEQ ID NO: 25186 - DNA, 20 bp, Artificial Sequence
  Synthetic oligonucleotide; GAG chr11 5367505 5367524 5367521 +
aacagtcatagtgctggtgg

SEQ ID NO: 25187 - DNA, 20 bp, Artificial Sequence
  Synthetic oligonucleotide; GAG chr11 5367507 5367526 5367523 +
cagtcatagtgctggtggga

SEQ ID NO: 25188 - DNA, 20 bp, Artificial Sequence
  Synthetic oligonucleotide; TAG chr11 5367510 5367529 5367526 +
tcatagtgctggtgggagag

SEQ ID NO: 25189 - DNA, 20 bp, Artificial Sequence
  Synthetic oligonucleotide; CAG chr11 5367513 5367532 5367529 +
tagtgctggtgggagagtag

SEQ ID NO: 25190 - DNA, 20 bp, Artificial Sequence
  Synthetic oligonucleotide; GAG chr11 5367517 5367536 5367533 +
gctggtgggagagtagcagt

SEQ ID NO: 25191 - DNA, 20 bp, Artificial Sequence
  Synthetic oligonucleotide; AGG chr11 5367518 5367537 5367534 +
ctggtgggagagtagcagtg

SEQ ID NO: 25192 - DNA, 20 bp, Artificial Sequence
  Synthetic oligonucleotide; CAG chr11 5367526 5367545 5367542 +
agagtagcagtgaggactac

SEQ ID NO: 25193 - DNA, 20 bp, Artificial Sequence
  Synthetic oligonucleotide; GAG chr11 5367528 5367547 5367544 +
agtagcagtgaggactacca

SEQ ID NO: 25194 - DNA, 20 bp, Artificial Sequence
  Synthetic oligonucleotide; AGG chr11 5367529 5367548 5367545 +
gtagcagtgaggactaccag

SEQ ID NO: 25195 - DNA, 20 bp, Artificial Sequence
  Synthetic oligonucleotide; TGG chr11 5367550 5367569 5367566 +
ggtcactctcatcacaatct

SEQ ID NO: 25196 - DNA, 20 bp, Artificial Sequence
  Synthetic oligonucleotide; TGG chr11 5367555 5367574 5367571 +
ctctcatcacaatcttggtt

SEQ ID NO: 25197 - DNA, 20 bp, Artificial Sequence
  Synthetic oligonucleotide; TGG chr11 5367558 5367577 5367574 +
tcatcacaatcttggtttgg

SEQ ID NO: 25198 - DNA, 20 bp, Artificial Sequence
  Synthetic oligonucleotide; GGG chr11 5367559 5367578 5367575 +
catcacaatcttggtttggt

SEQ ID NO: 25199 - DNA, 20 bp, Artificial Sequence
  Synthetic oligonucleotide; CAG chr11 5367565 5367584 5367581 +
aatcttggtttggtgggttt

SEQ ID NO: 25200 - DNA, 20 bp, Artificial Sequence
  Synthetic oligonucleotide; CAG chr11 5367569 5367588 5367585 +
ttggtttggtgggtttcagc

SEQ ID NO: 25201 - DNA, 20 bp, Artificial Sequence
  Synthetic oligonucleotide; CAG chr11 5367596 5367615 5367612 +
tttactgcaaactgtttttt

SEQ ID NO: 25202 - DNA, 20 bp, Artificial Sequence
  Synthetic oligonucleotide; AAG chr11 5367600 5367619 5367616 +
ctgcaaactgttttttcagc

SEQ ID NO: 25203 - DNA, 20 bp, Artificial Sequence
  Synthetic oligonucleotide; AGG chr11 5367601 5367620 5367617 +
tgcaaactgttttttcagca

SEQ ID NO: 25204 - DNA, 20 bp, Artificial Sequence
  Synthetic oligonucleotide; GAG chr11 5367652 5367671 5367668 +
tcttatctcatcctgtgact

SEQ ID NO: 25205 - DNA, 20 bp, Artificial Sequence
  Synthetic oligonucleotide; TGG chr11 5367669 5367688 5367685 +
actgagaatgcctaactttc

SEQ ID NO: 25206 - DNA, 20 bp, Artificial Sequence
  Synthetic oligonucleotide; GGG chr11 5367670 5367689 5367686 +
ctgagaatgcctaactttct

SEQ ID NO: 25207 - DNA, 20 bp, Artificial Sequence
  Synthetic oligonucleotide; CAG chr11 5367677 5367696 5367693 +
tgcctaactttctgggaata

SEQ ID NO: 25208 - DNA, 20 bp, Artificial Sequence
  Synthetic oligonucleotide; CAG chr11 5367682 5367701 5367698 +
aactttctgggaatacagcc

SEQ ID NO: 25209 - DNA, 20 bp, Artificial Sequence
  Synthetic oligonucleotide; TAG chr11 5367685 5367704 5367701 +
tttctgggaatacagcccag

SEQ ID NO: 25210 - DNA, 20 bp, Artificial Sequence
  Synthetic oligonucleotide; AGG chr11 5367686 5367705 5367702 +
ttctgggaatacagcccagt

SEQ ID NO: 25211 - DNA, 20 bp, Artificial Sequence
  Synthetic oligonucleotide; CAG chr11 5367692 5367711 5367708 +
gaatacagcccagtaggtct

SEQ ID NO: 25212 - DNA, 20 bp, Artificial Sequence
  Synthetic oligonucleotide; CAG chr11 5367707 5367726 5367723 +
ggtctcagccttattgtacc

SEQ ID NO: 25213 - DNA, 20 bp, Artificial Sequence
  Synthetic oligonucleotide; AAG chr11 5367719 5367738 5367735 +
attgtacccagctcctattt

SEQ ID NO: 25214 - DNA, 20 bp, Artificial Sequence
  Synthetic oligonucleotide; TGG chr11 5367723 5367742 5367739 +
tacccagctcctatttaaga

SEQ ID NO: 25215 - DNA, 20 bp, Artificial Sequence
  Synthetic oligonucleotide; GAG chr11 5367725 5367744 5367741 +
cccagctcctatttaagatg

SEQ ID NO: 25216 - DNA, 20 bp, Artificial Sequence
  Synthetic oligonucleotide; TGG chr11 5367734 5367753 5367750 +
tatttaagatggagttgctc

SEQ ID NO: 25217 - DNA, 20 bp, Artificial Sequence
  Synthetic oligonucleotide; AAG chr11 5367755 5367774 5367771 +
ggttcaaatgcctctgacaa

SEQ ID NO: 25218 - DNA, 20 bp, Artificial Sequence
  Synthetic oligonucleotide; AGG chr11 5367756 5367775 5367772 +
gttcaaatgcctctgacaaa

SEQ ID NO: 25219 - DNA, 20 bp, Artificial Sequence
  Synthetic oligonucleotide; TGG chr11 5367776 5367795 5367792 +
aggaacaaaaatgttgtttc

SEQ ID NO: 25220 - DNA, 20 bp, Artificial Sequence
  Synthetic oligonucleotide; TAG chr11 5367784 5367803 5367800 +
aaatgttgtttctggtatgc

SEQ ID NO: 25221 - DNA, 20 bp, Artificial Sequence
  Synthetic oligonucleotide; CAG chr11 5367791 5367810 5367807 +
gtttctggtatgctagcacc

SEQ ID NO: 25222 - DNA, 20 bp, Artificial Sequence
  Synthetic oligonucleotide; TAG chr11 5367796 5367815 5367812 +
tggtatgctagcacccagaa

SEQ ID NO: 25223 - DNA, 20 bp, Artificial Sequence
  Synthetic oligonucleotide; GAG chr11 5367798 5367817 5367814 +
gtatgctagcacccagaata

SEQ ID NO: 25224 - DNA, 20 bp, Artificial Sequence
  Synthetic oligonucleotide; AGG chr11 5367799 5367818 5367815 +
tatgctagcacccagaatag

SEQ ID NO: 25225 - DNA, 20 bp, Artificial Sequence
  Synthetic oligonucleotide; AAG chr11 5367896 5367915 5367912 +
ctcatgcttaaatcttgacc

SEQ ID NO: 25226 - DNA, 20 bp, Artificial Sequence
  Synthetic oligonucleotide; AGG chr11 5367897 5367916 5367913 +
tcatgcttaaatcttgacca

SEQ ID NO: 25227 - DNA, 20 bp, Artificial Sequence
  Synthetic oligonucleotide; CAG chr11 5367923 5367942 5367939 +
tgcattttcctatccttact

SEQ ID NO: 25228 - DNA, 20 bp, Artificial Sequence
  Synthetic oligonucleotide; CAG chr11 5367926 5367945 5367942 +
attttcctatccttactcag

SEQ ID NO: 25229 - DNA, 20 bp, Artificial Sequence
  Synthetic oligonucleotide; GAG chr11 5367934 5367953 5367950 +
atccttactcagcagtttgt

SEQ ID NO: 25230 - DNA, 20 bp, Artificial Sequence
  Synthetic oligonucleotide; AGG chr11 5367935 5367954 5367951 +
tccttactcagcagtttgtg

SEQ ID NO: 25231 - DNA, 20 bp, Artificial Sequence
  Synthetic oligonucleotide; CAG chr11 5367941 5367960 5367957 +
ctcagcagtttgtgaggaat

SEQ ID NO: 25232 - DNA, 20 bp, Artificial Sequence
  Synthetic oligonucleotide; AAG chr11 5367954 5367973 5367970 +
gaggaatcagacattcttca

SEQ ID NO: 25233 - DNA, 20 bp, Artificial Sequence
  Synthetic oligonucleotide; CAG chr11 5367969 5367988 5367985 +
cttcaaagtttcacttctac

SEQ ID NO: 25234 - DNA, 20 bp, Artificial Sequence
  Synthetic oligonucleotide; GAG chr11 5367971 5367990 5367987 +
tcaaagtttcacttctacca

SEQ ID NO: 25235 - DNA, 20 bp, Artificial Sequence
  Synthetic oligonucleotide; TAG chr11 5367974 5367993 5367990 +
aagtttcacttctaccagag

SEQ ID NO: 25236 - DNA, 20 bp, Artificial Sequence
  Synthetic oligonucleotide; GAG chr11 5367976 5367995 5367992 +
gtttcacttctaccagagta

SEQ ID NO: 25237 - DNA, 20 bp, Artificial Sequence
  Synthetic oligonucleotide; AAG chr11 5368021 5368040 5368037 +
ttacaccccacaactaaccc

SEQ ID NO: 25238 - DNA, 20 bp, Artificial Sequence
  Synthetic oligonucleotide; TGG chr11 5368031 5368050 5368047 +
caactaacccaagcttcact

SEQ ID NO: 25239 - DNA, 20 bp, Artificial Sequence
  Synthetic oligonucleotide; TGG chr11 5368047 5368066 5368063 +
cacttggttctttgctccta

SEQ ID NO: 25240 - DNA, 20 bp, Artificial Sequence
  Synthetic oligonucleotide; GAG chr11 5368049 5368068 5368065 +
cttggttctttgctcctatg

SEQ ID NO: 25241 - DNA, 20 bp, Artificial Sequence
  Synthetic oligonucleotide; CAG chr11 5368055 5368074 5368071 +
tctttgctcctatggagacc

SEQ ID NO: 25242 - DNA, 20 bp, Artificial Sequence
  Synthetic oligonucleotide; AGG chr11 5368056 5368075 5368072 +
ctttgctcctatggagaccc

SEQ ID NO: 25243 - DNA, 20 bp, Artificial Sequence
  Synthetic oligonucleotide; CAG chr11 5368065 5368084 5368081 +
tatggagacccaggctcact

SEQ ID NO: 25244 - DNA, 20 bp, Artificial Sequence
  Synthetic oligonucleotide; CAG chr11 5368100 5368119 5368116 +
ttgttttttcctctgccatt

SEQ ID NO: 25245 - DNA, 20 bp, Artificial Sequence
  Synthetic oligonucleotide; CAG chr11 5368140 5368159 5368156 +
ccaataacttaactatgaac

SEQ ID NO: 25246 - DNA, 20 bp, Artificial Sequence
  Synthetic oligonucleotide; AAG chr11 5368159 5368178 5368175 +
ccagcatgaaaaatcctgtt

SEQ ID NO: 25247 - DNA, 20 bp, Artificial Sequence
  Synthetic oligonucleotide; TAG chr11 5368169 5368188 5368185 +
aaatcctgttaagtgttctg

SEQ ID NO: 25248 - DNA, 20 bp, Artificial Sequence
  Synthetic oligonucleotide; AGG chr11 5368170 5368189 5368186 +
aatcctgttaagtgttctgt

SEQ ID NO: 25249 - DNA, 20 bp, Artificial Sequence
  Synthetic oligonucleotide; CAG chr11 5368207 5368226 5368223 +
ttgtttcatgcttcttcata

SEQ ID NO: 25250 - DNA, 20 bp, Artificial Sequence
  Synthetic oligonucleotide; CAG chr11 5368217 5368236 5368233 +
cttcttcatacagtcttatg

SEQ ID NO: 25251 - DNA, 20 bp, Artificial Sequence
  Synthetic oligonucleotide; TAG chr11 5368220 5368239 5368236 +
cttcatacagtcttatgcag

SEQ ID NO: 25252 - DNA, 20 bp, Artificial Sequence
  Synthetic oligonucleotide; TGG chr11 5368226 5368245 5368242 +
acagtcttatgcagtagttt

SEQ ID NO: 25253 - DNA, 20 bp, Artificial Sequence
  Synthetic oligonucleotide; GGG chr11 5368227 5368246 5368243 +
cagtcttatgcagtagtttt

SEQ ID NO: 25254 - DNA, 20 bp, Artificial Sequence
  Synthetic oligonucleotide; CAG chr11 5368237 5368256 5368253 +
cagtagttttgggaattaaa

SEQ ID NO: 25255 - DNA, 20 bp, Artificial Sequence
  Synthetic oligonucleotide; TGG chr11 5368242 5368261 5368258 +
gttttgggaattaaacagtt

SEQ ID NO: 25256 - DNA, 20 bp, Artificial Sequence
  Synthetic oligonucleotide; TGG chr11 5368269 5368288 5368285 +
caatcccaccttccacttat

SEQ ID NO: 25257 - DNA, 20 bp, Artificial Sequence
  Synthetic oligonucleotide; TAG chr11 5368284 5368303 5368300 +
cttattggctgcgtacccta

SEQ ID NO: 25258 - DNA, 20 bp, Artificial Sequence
  Synthetic oligonucleotide; AAG chr11 5368289 5368308 5368305 +
tggctgcgtaccctatagca

SEQ ID NO: 25259 - DNA, 20 bp, Artificial Sequence
  Synthetic oligonucleotide; TGG chr11 5368312 5368331 5368328 +
caatttatctttctgtgttt

SEQ ID NO: 25260 - DNA, 20 bp, Artificial Sequence
  Synthetic oligonucleotide; AAG chr11 5368328 5368347 5368344 +
gttttggtccactcatcttt

SEQ ID NO: 25261 - DNA, 20 bp, Artificial Sequence
  Synthetic oligonucleotide; TGG chr11 5368331 5368350 5368347 +
ttggtccactcatctttaag

SEQ ID NO: 25262 - DNA, 20 bp, Artificial Sequence
  Synthetic oligonucleotide; GGG chr11 5368332 5368351 5368348 +
tggtccactcatctttaagt

SEQ ID NO: 25263 - DNA, 20 bp, Artificial Sequence
  Synthetic oligonucleotide; GGG chr11 5368333 5368352 5368349 +
ggtccactcatctttaagtg

SEQ ID NO: 25264 - DNA, 20 bp, Artificial Sequence
  Synthetic oligonucleotide; TAG chr11 5368343 5368362 5368359 +
tctttaagtggggataccaa

SEQ ID NO: 25265 - DNA, 20 bp, Artificial Sequence
  Synthetic oligonucleotide; TGG chr11 5368354 5368373 5368370 +
ggataccaatagtacccaca

SEQ ID NO: 25266 - DNA, 20 bp, Artificial Sequence
  Synthetic oligonucleotide; TAG chr11 5368405 5368424 5368421 +
aatatgtctaacgtgttcaa

SEQ ID NO: 25267 - DNA, 20 bp, Artificial Sequence
  Synthetic oligonucleotide; TGG chr11 5368412 5368431 5368428 +
ctaacgtgttcaatagtgcc

SEQ ID NO: 25268 - DNA, 20 bp, Artificial Sequence
  Synthetic oligonucleotide; AAG chr11 5368423 5368442 5368439 +
aatagtgcctggtccattgt

SEQ ID NO: 25269 - DNA, 20 bp, Artificial Sequence
  Synthetic oligonucleotide; TAG chr11 5368431 5368450 5368447 +
ctggtccattgtaagtatta

SEQ ID NO: 25270 - DNA, 20 bp, Artificial Sequence
  Synthetic oligonucleotide; GAG chr11 5368483 5368502 5368499 +
attgaaaattttgtgaaaat

SEQ ID NO: 25271 - DNA, 20 bp, Artificial Sequence
  Synthetic oligonucleotide; TGG chr11 5368499 5368518 5368515 +
aaatgagacaatttgacctt

SEQ ID NO: 25272 - DNA, 20 bp, Artificial Sequence
  Synthetic oligonucleotide; GGG chr11 5368500 5368519 5368516 +
aatgagacaatttgaccttt

SEQ ID NO: 25273 - DNA, 20 bp, Artificial Sequence
  Synthetic oligonucleotide; GAG chr11 5368505 5368524 5368521 +
gacaatttgacctttgggct

SEQ ID NO: 25274 - DNA, 20 bp, Artificial Sequence
  Synthetic oligonucleotide; AAG chr11 5368508 5368527 5368524 +
aatttgacctttgggctgag

SEQ ID NO: 25275 - DNA, 20 bp, Artificial Sequence
  Synthetic oligonucleotide; TAG chr11 5368521 5368540 5368537 +
ggctgagaagatactctgtc

SEQ ID NO: 25276 - DNA, 20 bp, Artificial Sequence
  Synthetic oligonucleotide; AAG chr11 5368532 5368551 5368548 +
tactctgtctagctctgaca

SEQ ID NO: 25277 - DNA, 20 bp, Artificial Sequence
  Synthetic oligonucleotide; AAG chr11 5368553 5368572 5368569 +
agaaaataaaaacctttaaa

SEQ ID NO: 25278 - DNA, 20 bp, Artificial Sequence
  Synthetic oligonucleotide; AAG chr11 5368579 5368598 5368595 +
tctcacaatcgtaatacttg

SEQ ID NO: 25279 - DNA, 20 bp, Artificial Sequence
  Synthetic oligonucleotide; AAG chr11 5368588 5368607 5368604 +
cgtaatacttgaagttacac

SEQ ID NO: 25280 - DNA, 20 bp, Artificial Sequence
  Synthetic oligonucleotide; AAG chr11 5368604 5368623 5368620 +
acacaagatattctaacata

SEQ ID NO: 25281 - DNA, 20 bp, Artificial Sequence
  Synthetic oligonucleotide; GAG chr11 5368638 5368657 5368654 +
tattctcacatgcatcctgt

SEQ ID NO: 25282 - DNA, 20 bp, Artificial Sequence
  Synthetic oligonucleotide; AAG chr11 5368642 5368661 5368658 +
ctcacatgcatcctgtgaga

SEQ ID NO: 25283 - DNA, 20 bp, Artificial Sequence
  Synthetic oligonucleotide; CAG chr11 5368645 5368664 5368661 +
acatgcatcctgtgagaaag

SEQ ID NO: 25284 - DNA, 20 bp, Artificial Sequence
  Synthetic oligonucleotide; GAG chr11 5368647 5368666 5368663 +
atgcatcctgtgagaaagca

SEQ ID NO: 25285 - DNA, 20 bp, Artificial Sequence
  Synthetic oligonucleotide; TAG chr11 5368652 5368671 5368668 +
tcctgtgagaaagcagagca

SEQ ID NO: 25286 - DNA, 20 bp, Artificial Sequence
  Synthetic oligonucleotide; TAG chr11 5368655 5368674 5368671 +
tgtgagaaagcagagcatag

SEQ ID NO: 25287 - DNA, 20 bp, Artificial Sequence
  Synthetic oligonucleotide; GAG chr11 5368657 5368676 5368673 +
tgagaaagcagagcatagta

SEQ ID NO: 25288 - DNA, 20 bp, Artificial Sequence
  Synthetic oligonucleotide; AGG chr11 5368658 5368677 5368674 +
gagaaagcagagcatagtag

SEQ ID NO: 25289 - DNA, 20 bp, Artificial Sequence
  Synthetic oligonucleotide; CAG chr11 5368664 5368683 5368680 +
gcagagcatagtagaggttt

SEQ ID NO: 25290 - DNA, 20 bp, Artificial Sequence
  Synthetic oligonucleotide; AAG chr11 5368678 5368697 5368694 +
aggtttcagttttatctgtc

SEQ ID NO: 25291 - DNA, 20 bp, Artificial Sequence
  Synthetic oligonucleotide; GAG chr11 5368680 5368699 5368696 +
gtttcagttttatctgtcaa

SEQ ID NO: 25292 - DNA, 20 bp, Artificial Sequence
  Synthetic oligonucleotide; GAG chr11 5368691 5368710 5368707 +
atctgtcaagagcaaaattt

SEQ ID NO: 25293 - DNA, 20 bp, Artificial Sequence
  Synthetic oligonucleotide; AGG chr11 5368692 5368711 5368708 +
tctgtcaagagcaaaatttg

SEQ ID NO: 25294 - DNA, 20 bp, Artificial Sequence
  Synthetic oligonucleotide; GAG chr11 5368707 5368726 5368723 +
atttgaggtttctaaacatt

SEQ ID NO: 25295 - DNA, 20 bp, Artificial Sequence
  Synthetic oligonucleotide; AAG chr11 5368738 5368757 5368754 +
aatattatgctttaaaactg

SEQ ID NO: 25296 - DNA, 20 bp, Artificial Sequence
  Synthetic oligonucleotide; AGG chr11 5368739 5368758 5368755 +
atattatgctttaaaactga

SEQ ID NO: 25297 - DNA, 20 bp, Artificial Sequence
  Synthetic oligonucleotide; AAG chr11 5368742 5368761 5368758 +
ttatgctttaaaactgaagg

SEQ ID NO: 25298 - DNA, 20 bp, Artificial Sequence
  Synthetic oligonucleotide; CAG chr11 5368753 5368772 5368769 +
aactgaaggaagcaaaacct

SEQ ID NO: 25299 - DNA, 20 bp, Artificial Sequence
  Synthetic oligonucleotide; TAG chr11 5368758 5368777 5368774 +
aaggaagcaaaacctcagca

SEQ ID NO: 25300 - DNA, 20 bp, Artificial Sequence
  Synthetic oligonucleotide; AGG chr11 5368759 5368778 5368775 +
aggaagcaaaacctcagcat

SEQ ID NO: 25301 - DNA, 20 bp, Artificial Sequence
  Synthetic oligonucleotide; AAG chr11 5368770 5368789 5368786 +
cctcagcataggccttctga

SEQ ID NO: 25302 - DNA, 20 bp, Artificial Sequence
  Synthetic oligonucleotide; TGG chr11 5368780 5368799 5368796 +
ggccttctgaaagcttacga

SEQ ID NO: 25303 - DNA, 20 bp, Artificial Sequence
  Synthetic oligonucleotide; CAG chr11 5368800 5368819 5368816 +
tggcttttctttttttcccc

SEQ ID NO: 25304 - DNA, 20 bp, Artificial Sequence
  Synthetic oligonucleotide; AGG chr11 5368801 5368820 5368817 +
ggcttttctttttttccccc

SEQ ID NO: 25305 - DNA, 20 bp, Artificial Sequence
  Synthetic oligonucleotide; GGG chr11 5368802 5368821 5368818 +
gcttttctttttttccccca

SEQ ID NO: 25306 - DNA, 20 bp, Artificial Sequence
  Synthetic oligonucleotide; AAG chr11 5368807 5368826 5368823 +
tctttttttcccccagggca

SEQ ID NO: 25307 - DNA, 20 bp, Artificial Sequence
  Synthetic oligonucleotide; TAG chr11 5368816 5368835 5368832 +
cccccagggcaaagtgttct

SEQ ID NO: 25308 - DNA, 20 bp, Artificial Sequence
  Synthetic oligonucleotide; AGG chr11 5368817 5368836 5368833 +
ccccagggcaaagtgttctt

SEQ ID NO: 25309 - DNA, 20 bp, Artificial Sequence
  Synthetic oligonucleotide; GAG chr11 5368819 5368838 5368835 +
ccagggcaaagtgttcttag

SEQ ID NO: 25310 - DNA, 20 bp, Artificial Sequence
  Synthetic oligonucleotide; AAG chr11 5368823 5368842 5368839 +
ggcaaagtgttcttaggagc

SEQ ID NO: 25311 - DNA, 20 bp, Artificial Sequence
  Synthetic oligonucleotide; TGG chr11 5368830 5368849 5368846 +
tgttcttaggagcaagatgt

SEQ ID NO: 25312 - DNA, 20 bp, Artificial Sequence
  Synthetic oligonucleotide; TGG chr11 5368852 5368871 5368868 +
gaatttacaccattcttatg

SEQ ID NO: 25313 - DNA, 20 bp, Artificial Sequence
  Synthetic oligonucleotide; AAG chr11 5368858 5368877 5368874 +
acaccattcttatgtggatt

SEQ ID NO: 25314 - DNA, 20 bp, Artificial Sequence
  Synthetic oligonucleotide; GAG chr11 5368860 5368879 5368876 +
accattcttatgtggattaa

SEQ ID NO: 25315 - DNA, 20 bp, Artificial Sequence
  Synthetic oligonucleotide; GAG chr11 5368862 5368881 5368878 +
cattcttatgtggattaaga

SEQ ID NO: 25316 - DNA, 20 bp, Artificial Sequence
  Synthetic oligonucleotide; AGG chr11 5368863 5368882 5368879 +
attcttatgtggattaagag

SEQ ID NO: 25317 - DNA, 20 bp, Artificial Sequence
  Synthetic oligonucleotide; GAG chr11 5368875 5368894 5368891 +
attaagagaggtttccttct

SEQ ID NO: 25318 - DNA, 20 bp, Artificial Sequence
  Synthetic oligonucleotide; AGG chr11 5368876 5368895 5368892 +
ttaagagaggtttccttctg

SEQ ID NO: 25319 - DNA, 20 bp, Artificial Sequence
  Synthetic oligonucleotide; TGG chr11 5368883 5368902 5368899 +
aggtttccttctgaggatgt

SEQ ID NO: 25320 - DNA, 20 bp, Artificial Sequence
  Synthetic oligonucleotide; AAG chr11 5368886 5368905 5368902 +
tttccttctgaggatgttgg

SEQ ID NO: 25321 - DNA, 20 bp, Artificial Sequence
  Synthetic oligonucleotide; CAG chr11 5368897 5368916 5368913 +
ggatgttggaagcctctgtt

SEQ ID NO: 25322 - DNA, 20 bp, Artificial Sequence
  Synthetic oligonucleotide; AGG chr11 5368898 5368917 5368914 +
gatgttggaagcctctgttc

SEQ ID NO: 25323 - DNA, 20 bp, Artificial Sequence
  Synthetic oligonucleotide; CGG chr11 5368914 5368933 5368930 +
gttcaggaactttttctttc

SEQ ID NO: 25324 - DNA, 20 bp, Artificial Sequence
  Synthetic oligonucleotide; CAG chr11 5368927 5368946 5368943 +
ttctttccggatcatgctta

SEQ ID NO: 25325 - DNA, 20 bp, Artificial Sequence
  Synthetic oligonucleotide; AAG chr11 5368944 5368963 5368960 +
ttacagatctgattacaccc

SEQ ID NO: 25326 - DNA, 20 bp, Artificial Sequence
  Synthetic oligonucleotide; AAG chr11 5368947 5368966 5368963 +
cagatctgattacacccaag

SEQ ID NO: 25327 - DNA, 20 bp, Artificial Sequence
  Synthetic oligonucleotide; CAG chr11 5368964 5368983 5368980 +
aagaagcctaaattgtgtgt

SEQ ID NO: 25328 - DNA, 20 bp, Artificial Sequence
  Synthetic oligonucleotide; TAG chr11 5368972 5368991 5368988 +
taaattgtgtgtcagccaac

SEQ ID NO: 25329 - DNA, 20 bp, Artificial Sequence
  Synthetic oligonucleotide; TGG chr11 5368978 5368997 5368994 +
gtgtgtcagccaactagatg

SEQ ID NO: 25330 - DNA, 20 bp, Artificial Sequence
  Synthetic oligonucleotide; AAG chr11 5368983 5369002 5368999 +
tcagccaactagatgtggac

SEQ ID NO: 25331 - DNA, 20 bp, Artificial Sequence
  Synthetic oligonucleotide; TAG chr11 5368987 5369006 5369003 +
ccaactagatgtggacaaga

SEQ ID NO: 25332 - DNA, 20 bp, Artificial Sequence
  Synthetic oligonucleotide; TAG chr11 5368994 5369013 5369010 +
gatgtggacaagatagtttt

SEQ ID NO: 25333 - DNA, 20 bp, Artificial Sequence
  Synthetic oligonucleotide; TGG chr11 5369005 5369024 5369021 +
gatagtttttagcctccttc

SEQ ID NO: 25334 - DNA, 20 bp, Artificial Sequence
  Synthetic oligonucleotide; GGG chr11 5369006 5369025 5369022 +
atagtttttagcctccttct

SEQ ID NO: 25335 - DNA, 20 bp, Artificial Sequence
  Synthetic oligonucleotide; TAG chr11 5369011 5369030 5369027 +
ttttagcctccttctgggac

SEQ ID NO: 25336 - DNA, 20 bp, Artificial Sequence
  Synthetic oligonucleotide; AAG chr11 5369027 5369046 5369043 +
ggactagatattcattcacc

SEQ ID NO: 25337 - DNA, 20 bp, Artificial Sequence
  Synthetic oligonucleotide; GAG chr11 5369032 5369051 5369048 +
agatattcattcaccaagat

SEQ ID NO: 25338 - DNA, 20 bp, Artificial Sequence
  Synthetic oligonucleotide; AAG chr11 5369043 5369062 5369059 +
caccaagatgagtgcctttg

SEQ ID NO: 25339 - DNA, 20 bp, Artificial Sequence
  Synthetic oligonucleotide; CAG chr11 5369046 5369065 5369062 +
caagatgagtgcctttgaag

SEQ ID NO: 25340 - DNA, 20 bp, Artificial Sequence
  Synthetic oligonucleotide; TAG chr11 5369058 5369077 5369074 +
ctttgaagcagaatctgtga

SEQ ID NO: 25341 - DNA, 20 bp, Artificial Sequence
  Synthetic oligonucleotide; AGG chr11 5369059 5369078 5369075 +
tttgaagcagaatctgtgat

SEQ ID NO: 25342 - DNA, 20 bp, Artificial Sequence
  Synthetic oligonucleotide; GGG chr11 5369060 5369079 5369076 +
ttgaagcagaatctgtgata

SEQ ID NO: 25343 - DNA, 20 bp, Artificial Sequence
  Synthetic oligonucleotide; TGG chr11 5369063 5369082 5369079 +
aagcagaatctgtgataggg

SEQ ID NO: 25344 - DNA, 20 bp, Artificial Sequence
  Synthetic oligonucleotide; TGG chr11 5369067 5369086 5369083 +
agaatctgtgatagggtggt

SEQ ID NO: 25345 - DNA, 20 bp, Artificial Sequence
  Synthetic oligonucleotide; GGG chr11 5369068 5369087 5369084 +
gaatctgtgatagggtggtt

SEQ ID NO: 25346 - DNA, 20 bp, Artificial Sequence
  Synthetic oligonucleotide; TAG chr11 5369076 5369095 5369092 +
gatagggtggttgggccacc

SEQ ID NO: 25347 - DNA, 20 bp, Artificial Sequence
  Synthetic oligonucleotide; GAG chr11 5369078 5369097 5369094 +
tagggtggttgggccaccta

SEQ ID NO: 25348 - DNA, 20 bp, Artificial Sequence
  Synthetic oligonucleotide; TGG chr11 5369086 5369105 5369102 +
ttgggccacctagagacata

SEQ ID NO: 25349 - DNA, 20 bp, Artificial Sequence
  Synthetic oligonucleotide; TAG chr11 5369096 5369115 5369112 +
tagagacatatggccatgac

SEQ ID NO: 25350 - DNA, 20 bp, Artificial Sequence
  Synthetic oligonucleotide; AAG chr11 5369104 5369123 5369120 +
tatggccatgactagaatct

SEQ ID NO: 25351 - DNA, 20 bp, Artificial Sequence
  Synthetic oligonucleotide; AGG chr11 5369105 5369124 5369121 +
atggccatgactagaatcta

SEQ ID NO: 25352 - DNA, 20 bp, Artificial Sequence
  Synthetic oligonucleotide; TAG chr11 5369109 5369128 5369125 +
ccatgactagaatctaaggt

SEQ ID NO: 25353 - DNA, 20 bp, Artificial Sequence
  Synthetic oligonucleotide; CAG chr11 5369117 5369136 5369133 +
agaatctaaggttagacata

SEQ ID NO: 25354 - DNA, 20 bp, Artificial Sequence
  Synthetic oligonucleotide; AAG chr11 5369121 5369140 5369137 +
tctaaggttagacatacaga

SEQ ID NO: 25355 - DNA, 20 bp, Artificial Sequence
  Synthetic oligonucleotide; AGG chr11 5369122 5369141 5369138 +
ctaaggttagacatacagaa

SEQ ID NO: 25356 - DNA, 20 bp, Artificial Sequence
  Synthetic oligonucleotide; AAG chr11 5369128 5369147 5369144 +
ttagacatacagaaaggatg

SEQ ID NO: 25357 - DNA, 20 bp, Artificial Sequence
  Synthetic oligonucleotide; TAG chr11 5369141 5369160 5369157 +
aaggatgaagtctttaaaaa

SEQ ID NO: 25358 - DNA, 20 bp, Artificial Sequence
  Synthetic oligonucleotide; AGG chr11 5369142 5369161 5369158 +
aggatgaagtctttaaaaat

SEQ ID NO: 25359 - DNA, 20 bp, Artificial Sequence
  Synthetic oligonucleotide; GAG chr11 5369183 5369202 5369199 +
tccattcacacatataacct

SEQ ID NO: 25360 - DNA, 20 bp, Artificial Sequence
  Synthetic oligonucleotide; TAG chr11 5369201 5369220 5369217 +
ctgagtccctactgattttc

SEQ ID NO: 25361 - DNA, 20 bp, Artificial Sequence
  Synthetic oligonucleotide; GAG chr11 5369217 5369236 5369233 +
tttctagtactgtactgaat

SEQ ID NO: 25362 - DNA, 20 bp, Artificial Sequence
  Synthetic oligonucleotide; AGG chr11 5369218 5369237 5369234 +
ttctagtactgtactgaatg

SEQ ID NO: 25363 - DNA, 20 bp, Artificial Sequence
  Synthetic oligonucleotide; TAG chr11 5369230 5369249 5369246 +
actgaatgaggccaacatga

SEQ ID NO: 25364 - DNA, 20 bp, Artificial Sequence
  Synthetic oligonucleotide; AAG chr11 5369233 5369252 5369249 +
gaatgaggccaacatgatag

SEQ ID NO: 25365 - DNA, 20 bp, Artificial Sequence
  Synthetic oligonucleotide; AAG chr11 5369236 5369255 5369252 +
tgaggccaacatgatagaag

SEQ ID NO: 25366 - DNA, 20 bp, Artificial Sequence
  Synthetic oligonucleotide; TGG chr11 5369258 5369277 5369274 +
gatatgtatgcccatgtgtg

SEQ ID NO: 25367 - DNA, 20 bp, Artificial Sequence
  Synthetic oligonucleotide; GGG chr11 5369259 5369278 5369275 +
atatgtatgcccatgtgtgt

SEQ ID NO: 25368 - DNA, 20 bp, Artificial Sequence
  Synthetic oligonucleotide; GGG chr11 5369260 5369279 5369276 +
tatgtatgcccatgtgtgtg

SEQ ID NO: 25369 - DNA, 20 bp, Artificial Sequence
  Synthetic oligonucleotide; TAG chr11 5369263 5369282 5369279 +
gtatgcccatgtgtgtgggg

SEQ ID NO: 25370 - DNA, 20 bp, Artificial Sequence
  Synthetic oligonucleotide; TAG chr11 5369266 5369285 5369282 +
tgcccatgtgtgtggggtag

SEQ ID NO: 25371 - DNA, 20 bp, Artificial Sequence
  Synthetic oligonucleotide; AAG chr11 5369274 5369293 5369290 +
tgtgtggggtagtagaaaca

SEQ ID NO: 25372 - DNA, 20 bp, Artificial Sequence
  Synthetic oligonucleotide; CGG chr11 5369280 5369299 5369296 +
gggtagtagaaacaaagtca

SEQ ID NO: 25373 - DNA, 20 bp, Artificial Sequence
  Synthetic oligonucleotide; AAG chr11 5369301 5369320 5369317 +
ggcttaacaaatattaatta

SEQ ID NO: 25374 - DNA, 20 bp, Artificial Sequence
  Synthetic oligonucleotide; TAG chr11 5369314 5369333 5369330 +
ttaattaaagttattattac

SEQ ID NO: 25375 - DNA, 20 bp, Artificial Sequence
  Synthetic oligonucleotide; TAG chr11 5369318 5369337 5369334 +
ttaaagttattattactagt

SEQ ID NO: 25376 - DNA, 20 bp, Artificial Sequence
  Synthetic oligonucleotide; TGG chr11 5369321 5369340 5369337 +
aagttattattactagttag

SEQ ID NO: 25377 - DNA, 20 bp, Artificial Sequence
  Synthetic oligonucleotide; TAG chr11 5369346 5369365 5369362 +
tactattaacaataatattt

SEQ ID NO: 25378 - DNA, 20 bp, Artificial Sequence
  Synthetic oligonucleotide; CAG chr11 5369349 5369368 5369365 +
tattaacaataatattttag

SEQ ID NO: 25379 - DNA, 20 bp, Artificial Sequence
  Synthetic oligonucleotide; TAG chr11 5369378 5369397 5369394 +
tttgcaaaatataacacttt

SEQ ID NO: 25380 - DNA, 20 bp, Artificial Sequence
  Synthetic oligonucleotide; AGG chr11 5369379 5369398 5369395 +
ttgcaaaatataacactttt

SEQ ID NO: 25381 - DNA, 20 bp, Artificial Sequence
  Synthetic oligonucleotide; GAG chr11 5369381 5369400 5369397 +
gcaaaatataacacttttag

SEQ ID NO: 25382 - DNA, 20 bp, Artificial Sequence
  Synthetic oligonucleotide; CAG chr11 5369403 5369422 5369419 +
gaattacatctattatacct

SEQ ID NO: 25383 - DNA, 20 bp, Artificial Sequence
  Synthetic oligonucleotide; CAG chr11 5369421 5369440 5369437 +
ctcagtaaaactctatgaaa

SEQ ID NO: 25384 - DNA, 20 bp, Artificial Sequence
  Synthetic oligonucleotide; TGG chr11 5369443 5369462 5369459 +
gactttttatatattttttc

SEQ ID NO: 25385 - DNA, 20 bp, Artificial Sequence
  Synthetic oligonucleotide; GAG chr11 5369470 5369489 5369486 +
aaaataaaatctgataattt

SEQ ID NO: 25386 - DNA, 20 bp, Artificial Sequence
  Synthetic oligonucleotide; AAG chr11 5369483 5369502 5369499 +
ataatttgagacatttaaaa

SEQ ID NO: 25387 - DNA, 20 bp, Artificial Sequence
  Synthetic oligonucleotide; TAG chr11 5369494 5369513 5369510 +
catttaaaaaagtatacaac

SEQ ID NO: 25388 - DNA, 20 bp, Artificial Sequence
  Synthetic oligonucleotide; AAG chr11 5369498 5369517 5369514 +
taaaaaagtatacaactagt

SEQ ID NO: 25389 - DNA, 20 bp, Artificial Sequence
  Synthetic oligonucleotide; TAG chr11 5369501 5369520 5369517 +
aaaagtatacaactagtaag

SEQ ID NO: 25390 - DNA, 20 bp, Artificial Sequence
  Synthetic oligonucleotide; AAG chr11 5369593 5369612 5369609 +
ctccatgtatattaaatata

SEQ ID NO: 25391 - DNA, 20 bp, Artificial Sequence
  Synthetic oligonucleotide; AAG chr11 5369598 5369617 5369614 +
tgtatattaaatataaagta

SEQ ID NO: 25392 - DNA, 20 bp, Artificial Sequence
  Synthetic oligonucleotide; TGG chr11 5369630 5369649 5369646 +
ccttacctttctatcctccc

SEQ ID NO: 25393 - DNA, 20 bp, Artificial Sequence
  Synthetic oligonucleotide; GAG chr11 5369632 5369651 5369648 +
ttacctttctatcctccctg

SEQ ID NO: 25394 - DNA, 20 bp, Artificial Sequence
  Synthetic oligonucleotide; TAG chr11 5369720 5369739 5369736 +
tatgaacatactcaaataaa

SEQ ID NO: 25395 - DNA, 20 bp, Artificial Sequence
  Synthetic oligonucleotide; TGG chr11 5369729 5369748 5369745 +
actcaaataaatagtcctat

SEQ ID NO: 25396 - DNA, 20 bp, Artificial Sequence
  Synthetic oligonucleotide; TGG chr11 5369733 5369752 5369749 +
aaataaatagtcctattggc

SEQ ID NO: 25397 - DNA, 20 bp, Artificial Sequence
  Synthetic oligonucleotide; TAG chr11 5369736 5369755 5369752 +
taaatagtcctattggctgg

SEQ ID NO: 25398 - DNA, 20 bp, Artificial Sequence
  Synthetic oligonucleotide; AAG chr11 5369740 5369759 5369756 +
tagtcctattggctggtagc

SEQ ID NO: 25399 - DNA, 20 bp, Artificial Sequence
  Synthetic oligonucleotide; AGG chr11 5369741 5369760 5369757 +
agtcctattggctggtagca

SEQ ID NO: 25400 - DNA, 20 bp, Artificial Sequence
  Synthetic oligonucleotide; GGG chr11 5369742 5369761 5369758 +
gtcctattggctggtagcaa

SEQ ID NO: 25401 - DNA, 20 bp, Artificial Sequence
  Synthetic oligonucleotide; TAG chr11 5369752 5369771 5369768 +
ctggtagcaagggctatgtg

SEQ ID NO: 25402 - DNA, 20 bp, Artificial Sequence
  Synthetic oligonucleotide; CAG chr11 5369786 5369805 5369802 +
ccatgatgccacactaaaat

SEQ ID NO: 25403 - DNA, 20 bp, Artificial Sequence
  Synthetic oligonucleotide; CAG chr11 5369815 5369834 5369831 +
ttgtctgcatttttgtgtta

SEQ ID NO: 25404 - DNA, 20 bp, Artificial Sequence
  Synthetic oligonucleotide; TAG chr11 5369824 5369843 5369840 +
tttttgtgttacagtgaatg

SEQ ID NO: 25405 - DNA, 20 bp, Artificial Sequence
  Synthetic oligonucleotide; AAG chr11 5369842 5369861 5369858 +
tgtagactaaaatccaaaat

SEQ ID NO: 25406 - DNA, 20 bp, Artificial Sequence
  Synthetic oligonucleotide; CAG chr11 5369849 5369868 5369865 +
taaaatccaaaataagtcaa

SEQ ID NO: 25407 - DNA, 20 bp, Artificial Sequence
  Synthetic oligonucleotide; AAG chr11 5369859 5369878 5369875 +
aataagtcaacagttgttaa

SEQ ID NO: 25408 - DNA, 20 bp, Artificial Sequence
  Synthetic oligonucleotide; TGG chr11 5369874 5369893 5369890 +
gttaaaagtgatgacctcat

SEQ ID NO: 25409 - DNA, 20 bp, Artificial Sequence
  Synthetic oligonucleotide; TAG chr11 5369891 5369910 5369907 +
cattggttttgctatcaaca

SEQ ID NO: 25410 - DNA, 20 bp, Artificial Sequence
  Synthetic oligonucleotide; AAG chr11 5369895 5369914 5369911 +
ggttttgctatcaacataga

SEQ ID NO: 25411 - DNA, 20 bp, Artificial Sequence
  Synthetic oligonucleotide; AAG chr11 5369899 5369918 5369915 +
ttgctatcaacatagaaaga

SEQ ID NO: 25412 - DNA, 20 bp, Artificial Sequence
  Synthetic oligonucleotide; AGG chr11 5369900 5369919 5369916 +
tgctatcaacatagaaagaa

SEQ ID NO: 25413 - DNA, 20 bp, Artificial Sequence
  Synthetic oligonucleotide; GGG chr11 5369901 5369920 5369917 +
gctatcaacatagaaagaaa

SEQ ID NO: 25414 - DNA, 20 bp, Artificial Sequence
  Synthetic oligonucleotide; AAG chr11 5369904 5369923 5369920 +
atcaacatagaaagaaaggg

SEQ ID NO: 25415 - DNA, 20 bp, Artificial Sequence
  Synthetic oligonucleotide; CAG chr11 5369916 5369935 5369932 +
agaaagggaagacattttct

SEQ ID NO: 25416 - DNA, 20 bp, Artificial Sequence
  Synthetic oligonucleotide; AGG chr11 5369917 5369936 5369933 +
gaaagggaagacattttctc

SEQ ID NO: 25417 - DNA, 20 bp, Artificial Sequence
  Synthetic oligonucleotide; AAG chr11 5369930 5369949 5369946 +
ttttctcaggatttttactc

SEQ ID NO: 25418 - DNA, 20 bp, Artificial Sequence
  Synthetic oligonucleotide; AGG chr11 5369931 5369950 5369947 +
tttctcaggatttttactca

SEQ ID NO: 25419 - DNA, 20 bp, Artificial Sequence
  Synthetic oligonucleotide; AAG chr11 5369935 5369954 5369951 +
tcaggatttttactcaagga

SEQ ID NO: 25420 - DNA, 20 bp, Artificial Sequence
  Synthetic oligonucleotide; AGG chr11 5369936 5369955 5369952 +
caggatttttactcaaggaa

SEQ ID NO: 25421 - DNA, 20 bp, Artificial Sequence
  Synthetic oligonucleotide; CAG chr11 5369939 5369958 5369955 +
gatttttactcaaggaaagg

SEQ ID NO: 25422 - DNA, 20 bp, Artificial Sequence
  Synthetic oligonucleotide; TGG chr11 5369942 5369961 5369958 +
ttttactcaaggaaaggcag

SEQ ID NO: 25423 - DNA, 20 bp, Artificial Sequence
  Synthetic oligonucleotide; GGG chr11 5369943 5369962 5369959 +
tttactcaaggaaaggcagt

SEQ ID NO: 25424 - DNA, 20 bp, Artificial Sequence
  Synthetic oligonucleotide; GGG chr11 5369944 5369963 5369960 +
ttactcaaggaaaggcagtg

SEQ ID NO: 25425 - DNA, 20 bp, Artificial Sequence
  Synthetic oligonucleotide; AAG chr11 5369948 5369967 5369964 +
tcaaggaaaggcagtgggga

SEQ ID NO: 25426 - DNA, 20 bp, Artificial Sequence
  Synthetic oligonucleotide; GAG chr11 5369950 5369969 5369966 +
aaggaaaggcagtggggaaa

SEQ ID NO: 25427 - DNA, 20 bp, Artificial Sequence
  Synthetic oligonucleotide; AGG chr11 5369951 5369970 5369967 +
aggaaaggcagtggggaaag

SEQ ID NO: 25428 - DNA, 20 bp, Artificial Sequence
  Synthetic oligonucleotide; TGG chr11 5369957 5369976 5369973 +
ggcagtggggaaagaggctt

SEQ ID NO: 25429 - DNA, 20 bp, Artificial Sequence
  Synthetic oligonucleotide; AAG chr11 5369984 5370003 5370000 +
ctgtgtcaatctgtatcaac

SEQ ID NO: 25430 - DNA, 20 bp, Artificial Sequence
  Synthetic oligonucleotide; TGG chr11 5370008 5370027 5370024 +
tcttcaaacctccctctgca

SEQ ID NO: 25431 - DNA, 20 bp, Artificial Sequence
  Synthetic oligonucleotide; CAG chr11 5370014 5370033 5370030 +
aacctccctctgcatggccc

SEQ ID NO: 25432 - DNA, 20 bp, Artificial Sequence
  Synthetic oligonucleotide; AGG chr11 5370015 5370034 5370031 +
acctccctctgcatggcccc

SEQ ID NO: 25433 - DNA, 20 bp, Artificial Sequence
  Synthetic oligonucleotide; GAG chr11 5370017 5370036 5370033 +
ctccctctgcatggccccag

SEQ ID NO: 25434 - DNA, 20 bp, Artificial Sequence
  Synthetic oligonucleotide; GAG chr11 5370019 5370038 5370035 +
ccctctgcatggccccagga

SEQ ID NO: 25435 - DNA, 20 bp, Artificial Sequence
  Synthetic oligonucleotide; CAG chr11 5370023 5370042 5370039 +
ctgcatggccccaggagagt

SEQ ID NO: 25436 - DNA, 20 bp, Artificial Sequence
  Synthetic oligonucleotide; TGG chr11 5370054 5370073 5370070 +
aaacctctcctgccatctta

SEQ ID NO: 25437 - DNA, 20 bp, Artificial Sequence
  Synthetic oligonucleotide; CAG chr11 5370063 5370082 5370079 +
ctgccatcttatggtttgta

SEQ ID NO: 25438 - DNA, 20 bp, Artificial Sequence
  Synthetic oligonucleotide; AAG chr11 5370073 5370092 5370089 +
atggtttgtacagcatgtgc

SEQ ID NO: 25439 - DNA, 20 bp, Artificial Sequence
  Synthetic oligonucleotide; TAG chr11 5370085 5370104 5370101 +
gcatgtgcaagctgcttcta

SEQ ID NO: 25440 - DNA, 20 bp, Artificial Sequence
  Synthetic oligonucleotide; TAG chr11 5370097 5370116 5370113 +
tgcttctatagaaatgcata

SEQ ID NO: 25441 - DNA, 20 bp, Artificial Sequence
  Synthetic oligonucleotide; CAG chr11 5370106 5370125 5370122 +
agaaatgcatatagaaaata

SEQ ID NO: 25442 - DNA, 20 bp, Artificial Sequence
  Synthetic oligonucleotide; AGG chr11 5370107 5370126 5370123 +
gaaatgcatatagaaaatac

SEQ ID NO: 25443 - DNA, 20 bp, Artificial Sequence
  Synthetic oligonucleotide; TAG chr11 5370121 5370140 5370137 +
aaatacaggtatataaatgc

SEQ ID NO: 25444 - DNA, 20 bp, Artificial Sequence
  Synthetic oligonucleotide; GAG chr11 5370123 5370142 5370139 +
atacaggtatataaatgcta

SEQ ID NO: 25445 - DNA, 20 bp, Artificial Sequence
  Synthetic oligonucleotide; AGG chr11 5370124 5370143 5370140 +
tacaggtatataaatgctag

SEQ ID NO: 25446 - DNA, 20 bp, Artificial Sequence
  Synthetic oligonucleotide; AAG chr11 5370132 5370151 5370148 +
tataaatgctagaggctacc

SEQ ID NO: 25447 - DNA, 20 bp, Artificial Sequence
  Synthetic oligonucleotide; CAG chr11 5370189 5370208 5370205 +
gtatttattattatcattaa

SEQ ID NO: 25448 - DNA, 20 bp, Artificial Sequence
  Synthetic oligonucleotide; CAG chr11 5370195 5370214 5370211 +
attattatcattaacagtca

SEQ ID NO: 25449 - DNA, 20 bp, Artificial Sequence
  Synthetic oligonucleotide; TAG chr11 5370205 5370224 5370221 +
ttaacagtcacagtctttta

SEQ ID NO: 25450 - DNA, 20 bp, Artificial Sequence
  Synthetic oligonucleotide; AAG chr11 5370217 5370236 5370233 +
gtcttttatagtaaatccta

SEQ ID NO: 25451 - DNA, 20 bp, Artificial Sequence
  Synthetic oligonucleotide; AAG chr11 5370223 5370242 5370239 +
tatagtaaatcctaaagttg

SEQ ID NO: 25452 - DNA, 20 bp, Artificial Sequence
  Synthetic oligonucleotide; AGG chr11 5370224 5370243 5370240 +
atagtaaatcctaaagttga

SEQ ID NO: 25453 - DNA, 20 bp, Artificial Sequence
  Synthetic oligonucleotide; AAG chr11 5370258 5370277 5370274 +
aatgctatgaaatattaaat

SEQ ID NO: 25454 - DNA, 20 bp, Artificial Sequence
  Synthetic oligonucleotide; TAG chr11 5370267 5370286 5370283 +
aaatattaaataagtgacga

SEQ ID NO: 25455 - DNA, 20 bp, Artificial Sequence
  Synthetic oligonucleotide; CAG chr11 5370290 5370309 5370306 +
tatcttttatgctgactgtc

SEQ ID NO: 25456 - DNA, 20 bp, Artificial Sequence
  Synthetic oligonucleotide; AGG chr11 5370291 5370310 5370307 +
atcttttatgctgactgtcc

SEQ ID NO: 25457 - DNA, 20 bp, Artificial Sequence
  Synthetic oligonucleotide; TGG chr11 5370296 5370315 5370312 +
ttatgctgactgtccaggat

SEQ ID NO: 25458 - DNA, 20 bp, Artificial Sequence
  Synthetic oligonucleotide; CAG chr11 5370307 5370326 5370323 +
gtccaggattggaaatgcta

SEQ ID NO: 25459 - DNA, 20 bp, Artificial Sequence
  Synthetic oligonucleotide; AAG chr11 5370312 5370331 5370328 +
ggattggaaatgctacagca

SEQ ID NO: 25460 - DNA, 20 bp, Artificial Sequence
  Synthetic oligonucleotide; GAG chr11 5370316 5370335 5370332 +
tggaaatgctacagcaaagt

SEQ ID NO: 25461 - DNA, 20 bp, Artificial Sequence
  Synthetic oligonucleotide; TAG chr11 5370320 5370339 5370336 +
aatgctacagcaaagtgaga

SEQ ID NO: 25462 - DNA, 20 bp, Artificial Sequence
  Synthetic oligonucleotide; AGG chr11 5370321 5370340 5370337 +
atgctacagcaaagtgagat

SEQ ID NO: 25463 - DNA, 20 bp, Artificial Sequence
  Synthetic oligonucleotide; AAG chr11 5370346 5370365 5370362 +
ttttatgtatatcatctgca

SEQ ID NO: 25464 - DNA, 20 bp, Artificial Sequence
  Synthetic oligonucleotide; TAG chr11 5370361 5370380 5370377 +
ctgcaaagactaaactaaaa

SEQ ID NO: 25465 - DNA, 20 bp, Artificial Sequence
  Synthetic oligonucleotide; TGG chr11 5370365 5370384 5370381 +
aaagactaaactaaaatagc

SEQ ID NO: 25466 - DNA, 20 bp, Artificial Sequence
  Synthetic oligonucleotide; GGG chr11 5370366 5370385 5370382 +
aagactaaactaaaatagct

SEQ ID NO: 25467 - DNA, 20 bp, Artificial Sequence
  Synthetic oligonucleotide; CAG chr11 5370373 5370392 5370389 +
aactaaaatagctgggttgt

SEQ ID NO: 25468 - DNA, 20 bp, Artificial Sequence
  Synthetic oligonucleotide; AGG chr11 5370374 5370393 5370390 +
actaaaatagctgggttgtc

SEQ ID NO: 25469 - DNA, 20 bp, Artificial Sequence
  Synthetic oligonucleotide; CAG chr11 5370378 5370397 5370394 +
aaatagctgggttgtcaggt

SEQ ID NO: 25470 - DNA, 20 bp, Artificial Sequence
  Synthetic oligonucleotide; GAG chr11 5370380 5370399 5370396 +
atagctgggttgtcaggtca

SEQ ID NO: 25471 - DNA, 20 bp, Artificial Sequence
  Synthetic oligonucleotide; CAG chr11 5370390 5370409 5370406 +
tgtcaggtcagagcaattta

SEQ ID NO: 25472 - DNA, 20 bp, Artificial Sequence
  Synthetic oligonucleotide; AGG chr11 5370391 5370410 5370407 +
gtcaggtcagagcaatttac

SEQ ID NO: 25473 - DNA, 20 bp, Artificial Sequence
  Synthetic oligonucleotide; GGG chr11 5370392 5370411 5370408 +
tcaggtcagagcaatttaca

SEQ ID NO: 25474 - DNA, 20 bp, Artificial Sequence
  Synthetic oligonucleotide; CAG chr11 5370414 5370433 5370430 +
gaaaattaaattcaaatctt

SEQ ID NO: 25475 - DNA, 20 bp, Artificial Sequence
  Synthetic oligonucleotide; GAG chr11 5370416 5370435 5370432 +
aaattaaattcaaatcttca

SEQ ID NO: 25476 - DNA, 20 bp, Artificial Sequence
  Synthetic oligonucleotide; AGG chr11 5370417 5370436 5370433 +
aattaaattcaaatcttcag

SEQ ID NO: 25477 - DNA, 20 bp, Artificial Sequence
  Synthetic oligonucleotide; TGG chr11 5370429 5370448 5370445 +
atcttcagaggatcatttgt

SEQ ID NO: 25478 - DNA, 20 bp, Artificial Sequence
  Synthetic oligonucleotide; GAG chr11 5370450 5370469 5370466 +
ggtatgtctctgtccaattt

SEQ ID NO: 25479 - DNA, 20 bp, Artificial Sequence
  Synthetic oligonucleotide; AGG chr11 5370451 5370470 5370467 +
gtatgtctctgtccaatttg

SEQ ID NO: 25480 - DNA, 20 bp, Artificial Sequence
  Synthetic oligonucleotide; GGG chr11 5370452 5370471 5370468 +
tatgtctctgtccaatttga

SEQ ID NO: 25481 - DNA, 20 bp, Artificial Sequence
  Synthetic oligonucleotide; CAG chr11 5370469 5370488 5370485 +
tgagggcaataatttaatgc

SEQ ID NO: 25482 - DNA, 20 bp, Artificial Sequence
  Synthetic oligonucleotide; TAG chr11 5370551 5370570 5370567 +
tttctcactctttctgtgtt

SEQ ID NO: 25483 - DNA, 20 bp, Artificial Sequence
  Synthetic oligonucleotide; TAG chr11 5370564 5370583 5370580 +
ctgtgtttagaaatgaataa

SEQ ID NO: 25484 - DNA, 20 bp, Artificial Sequence
  Synthetic oligonucleotide; AAG chr11 5370591 5370610 5370607 +
actaaatacatttatttaac

SEQ ID NO: 25485 - DNA, 20 bp, Artificial Sequence
  Synthetic oligonucleotide; CGG chr11 5370594 5370613 5370610 +
aaatacatttatttaacaag

SEQ ID NO: 25486 - DNA, 20 bp, Artificial Sequence
  Synthetic oligonucleotide; TAG chr11 5370605 5370624 5370621 +
tttaacaagcggtcattgtt

SEQ ID NO: 25487 - DNA, 20 bp, Artificial Sequence
  Synthetic oligonucleotide; GAG chr11 5370625 5370644 5370641 +
tagttgtttgtttatctaat

SEQ ID NO: 25488 - DNA, 20 bp, Artificial Sequence
  Synthetic oligonucleotide; GAG chr11 5370627 5370646 5370643 +
gttgtttgtttatctaatga

SEQ ID NO: 25489 - DNA, 20 bp, Artificial Sequence
  Synthetic oligonucleotide; AGG chr11 5370628 5370647 5370644 +
ttgtttgtttatctaatgag

SEQ ID NO: 25490 - DNA, 20 bp, Artificial Sequence
  Synthetic oligonucleotide; TAG chr11 5370642 5370661 5370658 +
aatgagaggcttctctattt

SEQ ID NO: 25491 - DNA, 20 bp, Artificial Sequence
  Synthetic oligonucleotide; TGG chr11 5370652 5370671 5370668 +
ttctctattttagcaactac

SEQ ID NO: 25492 - DNA, 20 bp, Artificial Sequence
  Synthetic oligonucleotide; GGG chr11 5370653 5370672 5370669 +
tctctattttagcaactact

SEQ ID NO: 25493 - DNA, 20 bp, Artificial Sequence
  Synthetic oligonucleotide; TGG chr11 5370669 5370688 5370685 +
tactgggtacaaaaatacat

SEQ ID NO: 25494 - DNA, 20 bp, Artificial Sequence
  Synthetic oligonucleotide; AAG chr11 5370695 5370714 5370711 +
atatattctctgttcctatg

SEQ ID NO: 25495 - DNA, 20 bp, Artificial Sequence
  Synthetic oligonucleotide; CGG chr11 5370710 5370729 5370726 +
ctatgaagcttgtattttaa

SEQ ID NO: 25496 - DNA, 20 bp, Artificial Sequence
  Synthetic oligonucleotide; AAG chr11 5370714 5370733 5370730 +
gaagcttgtattttaacgga

SEQ ID NO: 25497 - DNA, 20 bp, Artificial Sequence
  Synthetic oligonucleotide; AGG chr11 5370715 5370734 5370731 +
aagcttgtattttaacggaa

SEQ ID NO: 25498 - DNA, 20 bp, Artificial Sequence
  Synthetic oligonucleotide; AAG chr11 5370729 5370748 5370745 +
acggaaaggaaataataaaa

SEQ ID NO: 25499 - DNA, 20 bp, Artificial Sequence
  Synthetic oligonucleotide; TAG chr11 5370757 5370776 5370773 +
aaaataattacaacctcata

SEQ ID NO: 25500 - DNA, 20 bp, Artificial Sequence
  Synthetic oligonucleotide; AAG chr11 5370769 5370788 5370785 +
acctcatatagctgctatga

SEQ ID NO: 25501 - DNA, 20 bp, Artificial Sequence
  Synthetic oligonucleotide; AAG chr11 5370773 5370792 5370789 +
catatagctgctatgaaaga

SEQ ID NO: 25502 - DNA, 20 bp, Artificial Sequence
  Synthetic oligonucleotide; TAG chr11 5370792 5370811 5370808 +
aaagaaaaaatttgatgcaa

SEQ ID NO: 25503 - DNA, 20 bp, Artificial Sequence
  Synthetic oligonucleotide; GAG chr11 5370794 5370813 5370810 +
agaaaaaatttgatgcaata

SEQ ID NO: 25504 - DNA, 20 bp, Artificial Sequence
  Synthetic oligonucleotide; AAG chr11 5370814 5370833 5370830 +
gagaataacaaaatttatgt

SEQ ID NO: 25505 - DNA, 20 bp, Artificial Sequence
  Synthetic oligonucleotide; TAG chr11 5370818 5370837 5370834 +
ataacaaaatttatgtaagc

SEQ ID NO: 25506 - DNA, 20 bp, Artificial Sequence
  Synthetic oligonucleotide; CGG chr11 5370832 5370851 5370848 +
gtaagctagtgtgacaaatg

SEQ ID NO: 25507 - DNA, 20 bp, Artificial Sequence
  Synthetic oligonucleotide; GGG chr11 5370833 5370852 5370849 +
taagctagtgtgacaaatgc

SEQ ID NO: 25508 - DNA, 20 bp, Artificial Sequence
  Synthetic oligonucleotide; GAG chr11 5370840 5370859 5370856 +
gtgtgacaaatgcgggttct

SEQ ID NO: 25509 - DNA, 20 bp, Artificial Sequence
  Synthetic oligonucleotide; GAG chr11 5370842 5370861 5370858 +
gtgacaaatgcgggttctga

SEQ ID NO: 25510 - DNA, 20 bp, Artificial Sequence
  Synthetic oligonucleotide; AGG chr11 5370843 5370862 5370859 +
tgacaaatgcgggttctgag

SEQ ID NO: 25511 - DNA, 20 bp, Artificial Sequence
  Synthetic oligonucleotide; GAG chr11 5370845 5370864 5370861 +
acaaatgcgggttctgagag

SEQ ID NO: 25512 - DNA, 20 bp, Artificial Sequence
  Synthetic oligonucleotide; AGG chr11 5370846 5370865 5370862 +
caaatgcgggttctgagagg

SEQ ID NO: 25513 - DNA, 20 bp, Artificial Sequence
  Synthetic oligonucleotide; CAG chr11 5370857 5370876 5370873 +
tctgagaggaggtaatattt

SEQ ID NO: 25514 - DNA, 20 bp, Artificial Sequence
  Synthetic oligonucleotide; GAG chr11 5370869 5370888 5370885 +
taatatttcagctgtgacct

SEQ ID NO: 25515 - DNA, 20 bp, Artificial Sequence
  Synthetic oligonucleotide; GAG chr11 5370871 5370890 5370887 +
atatttcagctgtgacctga

SEQ ID NO: 25516 - DNA, 20 bp, Artificial Sequence
  Synthetic oligonucleotide; TAG chr11 5370877 5370896 5370893 +
cagctgtgacctgagagttg

SEQ ID NO: 25517 - DNA, 20 bp, Artificial Sequence
  Synthetic oligonucleotide; GAG chr11 5370879 5370898 5370895 +
gctgtgacctgagagttgta

SEQ ID NO: 25518 - DNA, 20 bp, Artificial Sequence
  Synthetic oligonucleotide; AGG chr11 5370880 5370899 5370896 +
ctgtgacctgagagttgtag

SEQ ID NO: 25519 - DNA, 20 bp, Artificial Sequence
  Synthetic oligonucleotide; AAG chr11 5370886 5370905 5370902 +
cctgagagttgtagaggcaa

SEQ ID NO: 25520 - DNA, 20 bp, Artificial Sequence
  Synthetic oligonucleotide; AAG chr11 5370889 5370908 5370905 +
gagagttgtagaggcaaaag

SEQ ID NO: 25521 - DNA, 20 bp, Artificial Sequence
  Synthetic oligonucleotide; TAG chr11 5370900 5370919 5370916 +
aggcaaaagaagtattgcca

SEQ ID NO: 25522 - DNA, 20 bp, Artificial Sequence
  Synthetic oligonucleotide; TGG chr11 5370903 5370922 5370919 +
caaaagaagtattgccatag

SEQ ID NO: 25523 - DNA, 20 bp, Artificial Sequence
  Synthetic oligonucleotide; TGG chr11 5370909 5370928 5370925 +
aagtattgccatagtggtat

SEQ ID NO: 25524 - DNA, 20 bp, Artificial Sequence
  Synthetic oligonucleotide; TGG chr11 5370915 5370934 5370931 +
tgccatagtggtattggtcc

SEQ ID NO: 25525 - DNA, 20 bp, Artificial Sequence
  Synthetic oligonucleotide; GAG chr11 5370917 5370936 5370933 +
ccatagtggtattggtcctg

SEQ ID NO: 25526 - DNA, 20 bp, Artificial Sequence
  Synthetic oligonucleotide; TGG chr11 5370923 5370942 5370939 +
tggtattggtcctggagctc

SEQ ID NO: 25527 - DNA, 20 bp, Artificial Sequence
  Synthetic oligonucleotide; GAG chr11 5370932 5370951 5370948 +
tcctggagctctggttcaat

SEQ ID NO: 25528 - DNA, 20 bp, Artificial Sequence
  Synthetic oligonucleotide; CAG chr11 5370935 5370954 5370951 +
tggagctctggttcaatgag

SEQ ID NO: 25529 - DNA, 20 bp, Artificial Sequence
  Synthetic oligonucleotide; CAG chr11 5370939 5370958 5370955 +
gctctggttcaatgagcaga

SEQ ID NO: 25530 - DNA, 20 bp, Artificial Sequence
  Synthetic oligonucleotide; AAG chr11 5370942 5370961 5370958 +
ctggttcaatgagcagacag

SEQ ID NO: 25531 - DNA, 20 bp, Artificial Sequence
  Synthetic oligonucleotide; AGG chr11 5370943 5370962 5370959 +
tggttcaatgagcagacaga

SEQ ID NO: 25532 - DNA, 20 bp, Artificial Sequence
  Synthetic oligonucleotide; AAG chr11 5370946 5370965 5370962 +
ttcaatgagcagacagaagg

SEQ ID NO: 25533 - DNA, 20 bp, Artificial Sequence
  Synthetic oligonucleotide; GAG chr11 5370948 5370967 5370964 +
caatgagcagacagaaggaa

SEQ ID NO: 25534 - DNA, 20 bp, Artificial Sequence
  Synthetic oligonucleotide; CAG chr11 5370969 5370988 5370985 +
agaaccatatgatcatactt

SEQ ID NO: 25535 - DNA, 20 bp, Artificial Sequence
  Synthetic oligonucleotide; AGG chr11 5370970 5370989 5370986 +
gaaccatatgatcatacttc

SEQ ID NO: 25536 - DNA, 20 bp, Artificial Sequence
  Synthetic oligonucleotide; AAG chr11 5370976 5370995 5370992 +
tatgatcatacttcaggaaa

SEQ ID NO: 25537 - DNA, 20 bp, Artificial Sequence
  Synthetic oligonucleotide; TGG chr11 5370992 5371011 5371008 +
gaaaaagacttacacatgat

SEQ ID NO: 25538 - DNA, 20 bp, Artificial Sequence
  Synthetic oligonucleotide; GGG chr11 5370993 5371012 5371009 +
aaaaagacttacacatgatt

SEQ ID NO: 25539 - DNA, 20 bp, Artificial Sequence
  Synthetic oligonucleotide; GGG chr11 5370994 5371013 5371010 +
aaaagacttacacatgattg

SEQ ID NO: 25540 - DNA, 20 bp, Artificial Sequence
  Synthetic oligonucleotide; AAG chr11 5371004 5371023 5371020 +
cacatgattggggctaccca

SEQ ID NO: 25541 - DNA, 20 bp, Artificial Sequence
  Synthetic oligonucleotide; AGG chr11 5371005 5371024 5371021 +
acatgattggggctacccaa

SEQ ID NO: 25542 - DNA, 20 bp, Artificial Sequence
  Synthetic oligonucleotide; GGG chr11 5371006 5371025 5371022 +
catgattggggctacccaaa

SEQ ID NO: 25543 - DNA, 20 bp, Artificial Sequence
  Synthetic oligonucleotide; TGG chr11 5371011 5371030 5371027 +
ttggggctacccaaagggac

SEQ ID NO: 25544 - DNA, 20 bp, Artificial Sequence
  Synthetic oligonucleotide; AAG chr11 5371021 5371040 5371037 +
ccaaagggactggtttttcc

SEQ ID NO: 25545 - DNA, 20 bp, Artificial Sequence
  Synthetic oligonucleotide; GAG chr11 5371023 5371042 5371039 +
aaagggactggtttttccaa

SEQ ID NO: 25546 - DNA, 20 bp, Artificial Sequence
  Synthetic oligonucleotide; CAG chr11 5371026 5371045 5371042 +
gggactggtttttccaagag

SEQ ID NO: 25547 - DNA, 20 bp, Artificial Sequence
  Synthetic oligonucleotide; GAG chr11 5371036 5371055 5371052 +
tttccaagagcagataattt

SEQ ID NO: 25548 - DNA, 20 bp, Artificial Sequence
  Synthetic oligonucleotide; TAG chr11 5371048 5371067 5371064 +
gataatttgagtgataaaaa

SEQ ID NO: 25549 - DNA, 20 bp, Artificial Sequence
  Synthetic oligonucleotide; TAG chr11 5371074 5371093 5371090 +
ttttgaacccttccttctgc

SEQ ID NO: 25550 - DNA, 20 bp, Artificial Sequence
  Synthetic oligonucleotide; TAG chr11 5371080 5371099 5371096 +
acccttccttctgctagccc

SEQ ID NO: 25551 - DNA, 20 bp, Artificial Sequence
  Synthetic oligonucleotide; TGG chr11 5371086 5371105 5371102 +
ccttctgctagccctagcta

SEQ ID NO: 25552 - DNA, 20 bp, Artificial Sequence
  Synthetic oligonucleotide; TGG chr11 5371096 5371115 5371112 +
gccctagctatggaccacca

SEQ ID NO: 25553 - DNA, 20 bp, Artificial Sequence
  Synthetic oligonucleotide; AAG chr11 5371105 5371124 5371121 +
atggaccaccatggatattg

SEQ ID NO: 25554 - DNA, 20 bp, Artificial Sequence
  Synthetic oligonucleotide; AAG chr11 5371109 5371128 5371125 +
accaccatggatattgaagt

SEQ ID NO: 25555 - DNA, 20 bp, Artificial Sequence
  Synthetic oligonucleotide; AGG chr11 5371110 5371129 5371126 +
ccaccatggatattgaagta

SEQ ID NO: 25556 - DNA, 20 bp, Artificial Sequence
  Synthetic oligonucleotide; GGG chr11 5371111 5371130 5371127 +
caccatggatattgaagtaa

SEQ ID NO: 25557 - DNA, 20 bp, Artificial Sequence
  Synthetic oligonucleotide; TGG chr11 5371122 5371141 5371138 +
ttgaagtaagggctttgttt

SEQ ID NO: 25558 - DNA, 20 bp, Artificial Sequence
  Synthetic oligonucleotide; GAG chr11 5371145 5371164 5371161 +
aattactctccacacattct

SEQ ID NO: 25559 - DNA, 20 bp, Artificial Sequence
  Synthetic oligonucleotide; AGG chr11 5371146 5371165 5371162 +
attactctccacacattctg

SEQ ID NO: 25560 - DNA, 20 bp, Artificial Sequence
  Synthetic oligonucleotide; AAG chr11 5371155 5371174 5371171 +
cacacattctgaggatatac

SEQ ID NO: 25561 - DNA, 20 bp, Artificial Sequence
  Synthetic oligonucleotide; AGG chr11 5371156 5371175 5371172 +
acacattctgaggatataca

SEQ ID NO: 25562 - DNA, 20 bp, Artificial Sequence
  Synthetic oligonucleotide; GGG chr11 5371157 5371176 5371173 +
cacattctgaggatatacaa

SEQ ID NO: 25563 - DNA, 20 bp, Artificial Sequence
  Synthetic oligonucleotide; TAG chr11 5371173 5371192 5371189 +
acaagggcactgaaatattc

SEQ ID NO: 25564 - DNA, 20 bp, Artificial Sequence
  Synthetic oligonucleotide; AAG chr11 5371177 5371196 5371193 +
gggcactgaaatattctaga

SEQ ID NO: 25565 - DNA, 20 bp, Artificial Sequence
  Synthetic oligonucleotide; TAG chr11 5371184 5371203 5371200 +
gaaatattctagaaagtcca

SEQ ID NO: 25566 - DNA, 20 bp, Artificial Sequence
  Synthetic oligonucleotide; AAG chr11 5371209 5371228 5371225 +
cattctgatgtttatactct

SEQ ID NO: 25567 - DNA, 20 bp, Artificial Sequence
  Synthetic oligonucleotide; CAG chr11 5371217 5371236 5371233 +
tgtttatactctaagccaca

SEQ ID NO: 25568 - DNA, 20 bp, Artificial Sequence
  Synthetic oligonucleotide; CGG chr11 5371230 5371249 5371246 +
agccacacagcacctttccc

SEQ ID NO: 25569 - DNA, 20 bp, Artificial Sequence
  Synthetic oligonucleotide; TAG chr11 5371236 5371255 5371252 +
acagcacctttccccggatc

SEQ ID NO: 25570 - DNA, 20 bp, Artificial Sequence
  Synthetic oligonucleotide; AGG chr11 5371237 5371256 5371253 +
cagcacctttccccggatct

SEQ ID NO: 25571 - DNA, 20 bp, Artificial Sequence
  Synthetic oligonucleotide; GGG chr11 5371238 5371257 5371254 +
agcacctttccccggatcta

SEQ ID NO: 25572 - DNA, 20 bp, Artificial Sequence
  Synthetic oligonucleotide; TAG chr11 5371251 5371270 5371267 +
ggatctagggtctttcacat

SEQ ID NO: 25573 - DNA, 20 bp, Artificial Sequence
  Synthetic oligonucleotide; AGG chr11 5371252 5371271 5371268 +
gatctagggtctttcacatt

SEQ ID NO: 25574 - DNA, 20 bp, Artificial Sequence
  Synthetic oligonucleotide; CAG chr11 5371278 5371297 5371294 +
atttttttaaaactcaaaca

SEQ ID NO: 25575 - DNA, 20 bp, Artificial Sequence
  Synthetic oligonucleotide; AAG chr11 5371281 5371300 5371297 +
tttttaaaactcaaacacag

SEQ ID NO: 25576 - DNA, 20 bp, Artificial Sequence
  Synthetic oligonucleotide; TGG chr11 5371319 5371338 5371335 +
catataattctcattctctg

SEQ ID NO: 25577 - DNA, 20 bp, Artificial Sequence
  Synthetic oligonucleotide; TAG chr11 5371337 5371356 5371353 +
tgtggctcataaacatttaa

SEQ ID NO: 25578 - DNA, 20 bp, Artificial Sequence
  Synthetic oligonucleotide; GAG chr11 5371339 5371358 5371355 +
tggctcataaacatttaata

SEQ ID NO: 25579 - DNA, 20 bp, Artificial Sequence
  Synthetic oligonucleotide; GAG chr11 5371366 5371385 5371382 +
tgatgaaactgtaaaaccct

SEQ ID NO: 25580 - DNA, 20 bp, Artificial Sequence
  Synthetic oligonucleotide; TAG chr11 5371372 5371391 5371388 +
aactgtaaaaccctgagttg

SEQ ID NO: 25581 - DNA, 20 bp, Artificial Sequence
  Synthetic oligonucleotide; AGG chr11 5371373 5371392 5371389 +
actgtaaaaccctgagttgt

SEQ ID NO: 25582 - DNA, 20 bp, Artificial Sequence
  Synthetic oligonucleotide; CGG chr11 5371377 5371396 5371393 +
taaaaccctgagttgtaggc

SEQ ID NO: 25583 - DNA, 20 bp, Artificial Sequence
  Synthetic oligonucleotide; GAG chr11 5371379 5371398 5371395 +
aaaccctgagttgtaggccg

SEQ ID NO: 25584 - DNA, 20 bp, Artificial Sequence
  Synthetic oligonucleotide; AAG chr11 5371400 5371419 5371416 +
agatataaaatttcaacata

SEQ ID NO: 25585 - DNA, 20 bp, Artificial Sequence
  Synthetic oligonucleotide; CAG chr11 5371418 5371437 5371434 +
taaagaatgaacaaaatgac

SEQ ID NO: 25586 - DNA, 20 bp, Artificial Sequence
  Synthetic oligonucleotide; GAG chr11 5371420 5371439 5371436 +
aagaatgaacaaaatgacca

SEQ ID NO: 25587 - DNA, 20 bp, Artificial Sequence
  Synthetic oligonucleotide; AGG chr11 5371421 5371440 5371437 +
agaatgaacaaaatgaccag

SEQ ID NO: 25588 - DNA, 20 bp, Artificial Sequence
  Synthetic oligonucleotide; CAG chr11 5371424 5371443 5371440 +
atgaacaaaatgaccagagg

SEQ ID NO: 25589 - DNA, 20 bp, Artificial Sequence
  Synthetic oligonucleotide; GAG chr11 5371426 5371445 5371442 +
gaacaaaatgaccagaggca

SEQ ID NO: 25590 - DNA, 20 bp, Artificial Sequence
  Synthetic oligonucleotide; AGG chr11 5371427 5371446 5371443 +
aacaaaatgaccagaggcag

SEQ ID NO: 25591 - DNA, 20 bp, Artificial Sequence
  Synthetic oligonucleotide; GAG chr11 5371436 5371455 5371452 +
accagaggcagaggtaccct

SEQ ID NO: 25592 - DNA, 20 bp, Artificial Sequence
  Synthetic oligonucleotide; GAG chr11 5371438 5371457 5371454 +
cagaggcagaggtaccctga

SEQ ID NO: 25593 - DNA, 20 bp, Artificial Sequence
  Synthetic oligonucleotide; CAG chr11 5371442 5371461 5371458 +
ggcagaggtaccctgagaga

SEQ ID NO: 25594 - DNA, 20 bp, Artificial Sequence
  Synthetic oligonucleotide; TAG chr11 5371448 5371467 5371464 +
ggtaccctgagagacagtga

SEQ ID NO: 25595 - DNA, 20 bp, Artificial Sequence
  Synthetic oligonucleotide; AAG chr11 5371460 5371479 5371476 +
gacagtgatagctgtatcta

SEQ ID NO: 25596 - DNA, 20 bp, Artificial Sequence
  Synthetic oligonucleotide; GAG chr11 5371462 5371481 5371478 +
cagtgatagctgtatctaaa

SEQ ID NO: 25597 - DNA, 20 bp, Artificial Sequence
  Synthetic oligonucleotide; TAG chr11 5371480 5371499 5371496 +
aagagtactgatattaaaaa

SEQ ID NO: 25598 - DNA, 20 bp, Artificial Sequence
  Synthetic oligonucleotide; GAG chr11 5371482 5371501 5371498 +
gagtactgatattaaaaata

SEQ ID NO: 25599 - DNA, 20 bp, Artificial Sequence
  Synthetic oligonucleotide; AAG chr11 5371510 5371529 5371526 +
catatatctcattatatcca

SEQ ID NO: 25600 - DNA, 20 bp, Artificial Sequence
  Synthetic oligonucleotide; AGG chr11 5371511 5371530 5371527 +
atatatctcattatatccaa

SEQ ID NO: 25601 - DNA, 20 bp, Artificial Sequence
  Synthetic oligonucleotide; GGG chr11 5371512 5371531 5371528 +
tatatctcattatatccaaa

SEQ ID NO: 25602 - DNA, 20 bp, Artificial Sequence
  Synthetic oligonucleotide; AAG chr11 5371521 5371540 5371537 +
ttatatccaaagggttacat

SEQ ID NO: 25603 - DNA, 20 bp, Artificial Sequence
  Synthetic oligonucleotide; AAG chr11 5371528 5371547 5371544 +
caaagggttacataagtttt

SEQ ID NO: 25604 - DNA, 20 bp, Artificial Sequence
  Synthetic oligonucleotide; GAG chr11 5371530 5371549 5371546 +
aagggttacataagttttaa

SEQ ID NO: 25605 - DNA, 20 bp, Artificial Sequence
  Synthetic oligonucleotide; TGG chr11 5371533 5371552 5371549 +
ggttacataagttttaagag

SEQ ID NO: 25606 - DNA, 20 bp, Artificial Sequence
  Synthetic oligonucleotide; AAG chr11 5371546 5371565 5371562 +
ttaagagtggaaataacatg

SEQ ID NO: 25607 - DNA, 20 bp, Artificial Sequence
  Synthetic oligonucleotide; AGG chr11 5371547 5371566 5371563 +
taagagtggaaataacatga

SEQ ID NO: 25608 - DNA, 20 bp, Artificial Sequence
  Synthetic oligonucleotide; TAG chr11 5371562 5371581 5371578 +
catgaaggaccctaaacaat

SEQ ID NO: 25609 - DNA, 20 bp, Artificial Sequence
  Synthetic oligonucleotide; AGG chr11 5371563 5371582 5371579 +
atgaaggaccctaaacaatt

SEQ ID NO: 25610 - DNA, 20 bp, Artificial Sequence
  Synthetic oligonucleotide; CAG chr11 5371569 5371588 5371585 +
gaccctaaacaattaggaaa

SEQ ID NO: 25611 - DNA, 20 bp, Artificial Sequence
  Synthetic oligonucleotide; CAG chr11 5371587 5371606 5371603 +
aacagaaatttgacttgctt

SEQ ID NO: 25612 - DNA, 20 bp, Artificial Sequence
  Synthetic oligonucleotide; AAG chr11 5371594 5371613 5371610 +
atttgacttgcttcagataa

SEQ ID NO: 25613 - DNA, 20 bp, Artificial Sequence
  Synthetic oligonucleotide; AAG chr11 5371621 5371640 5371637 +
taaaatattttatctgaaac

SEQ ID NO: 25614 - DNA, 20 bp, Artificial Sequence
  Synthetic oligonucleotide; AAG chr11 5371625 5371644 5371641 +
atattttatctgaaacaagt

SEQ ID NO: 25615 - DNA, 20 bp, Artificial Sequence
  Synthetic oligonucleotide; TAG chr11 5371643 5371662 5371659 +
gtaagcttgttcaaaaaata

SEQ ID NO: 25616 - DNA, 20 bp, Artificial Sequence
  Synthetic oligonucleotide; AGG chr11 5371644 5371663 5371660 +
taagcttgttcaaaaaatat

SEQ ID NO: 25617 - DNA, 20 bp, Artificial Sequence
  Synthetic oligonucleotide; TAG chr11 5371660 5371679 5371676 +
atataggatatatgtgtaca

SEQ ID NO: 25618 - DNA, 20 bp, Artificial Sequence
  Synthetic oligonucleotide; GAG chr11 5371664 5371683 5371680 +
aggatatatgtgtacatagt

SEQ ID NO: 25619 - DNA, 20 bp, Artificial Sequence
  Synthetic oligonucleotide; AAG chr11 5371682 5371701 5371698 +
gtgagatgattacttcaatc

SEQ ID NO: 25620 - DNA, 20 bp, Artificial Sequence
  Synthetic oligonucleotide; TAG chr11 5371719 5371738 5371735 +
catcaatacaacaccttcca

SEQ ID NO: 25621 - DNA, 20 bp, Artificial Sequence
  Synthetic oligonucleotide; AAG chr11 5371746 5371765 5371762 +
cttttgctttttctttgtgt

SEQ ID NO: 25622 - DNA, 20 bp, Artificial Sequence
  Synthetic oligonucleotide; AGG chr11 5371747 5371766 5371763 +
ttttgctttttctttgtgta

SEQ ID NO: 25623 - DNA, 20 bp, Artificial Sequence
  Synthetic oligonucleotide; GGG chr11 5371748 5371767 5371764 +
tttgctttttctttgtgtaa

SEQ ID NO: 25624 - DNA, 20 bp, Artificial Sequence
  Synthetic oligonucleotide; TAG chr11 5371781 5371800 5371797 +
ctactgtcataacaaatgtt

SEQ ID NO: 25625 - DNA, 20 bp, Artificial Sequence
  Synthetic oligonucleotide; CAG chr11 5371788 5371807 5371804 +
cataacaaatgtttagttta

SEQ ID NO: 25626 - DNA, 20 bp, Artificial Sequence
  Synthetic oligonucleotide; CAG chr11 5371793 5371812 5371809 +
caaatgtttagtttacagta

SEQ ID NO: 25627 - DNA, 20 bp, Artificial Sequence
  Synthetic oligonucleotide; AAG chr11 5371800 5371819 5371816 +
ttagtttacagtacagtatt

SEQ ID NO: 25628 - DNA, 20 bp, Artificial Sequence
  Synthetic oligonucleotide; TAG chr11 5371819 5371838 5371835 +
taagtcttcatgccatacac

SEQ ID NO: 25629 - DNA, 20 bp, Artificial Sequence
  Synthetic oligonucleotide; CAG chr11 5371846 5371865 5371862 +
ctaaacttatttatcctata

SEQ ID NO: 25630 - DNA, 20 bp, Artificial Sequence
  Synthetic oligonucleotide; AAG chr11 5371853 5371872 5371869 +
tatttatcctatacagctgc

SEQ ID NO: 25631 - DNA, 20 bp, Artificial Sequence
  Synthetic oligonucleotide; GAG chr11 5371946 5371965 5371962 +
tttgaccttatttttctttt

SEQ ID NO: 25632 - DNA, 20 bp, Artificial Sequence
  Synthetic oligonucleotide; AAG chr11 5371960 5371979 5371976 +
tcttttgagattccacatat

SEQ ID NO: 25633 - DNA, 20 bp, Artificial Sequence
  Synthetic oligonucleotide; TGG chr11 5371993 5372012 5372009 +
cctttatttgtttctgtgtc

SEQ ID NO: 25634 - DNA, 20 bp, Artificial Sequence
  Synthetic oligonucleotide; TAG chr11 5372007 5372026 5372023 +
tgtgtctggtttatttcact

SEQ ID NO: 25635 - DNA, 20 bp, Artificial Sequence
  Synthetic oligonucleotide; TAG chr11 5372022 5372041 5372038 +
tcacttagcaaaatgtactc

SEQ ID NO: 25636 - DNA, 20 bp, Artificial Sequence
  Synthetic oligonucleotide; AGG chr11 5372023 5372042 5372039 +
cacttagcaaaatgtactct

SEQ ID NO: 25637 - DNA, 20 bp, Artificial Sequence
  Synthetic oligonucleotide; AAG chr11 5372054 5372073 5372070 +
ttccccccatctcctttttt

SEQ ID NO: 25638 - DNA, 20 bp, Artificial Sequence
  Synthetic oligonucleotide; AGG chr11 5372055 5372074 5372071 +
tccccccatctcctttttta

SEQ ID NO: 25639 - DNA, 20 bp, Artificial Sequence
  Synthetic oligonucleotide; CAG chr11 5372113 5372132 5372129 +
atatatcacaatatcatata

SEQ ID NO: 25640 - DNA, 20 bp, Artificial Sequence
  Synthetic oligonucleotide; TAG chr11 5372151 5372170 5372167 +
tttatctgttcatctatata

SEQ ID NO: 25641 - DNA, 20 bp, Artificial Sequence
  Synthetic oligonucleotide; TAG chr11 5372162 5372181 5372178 +
atctatatatagataccact

SEQ ID NO: 25642 - DNA, 20 bp, Artificial Sequence
  Synthetic oligonucleotide; TGG chr11 5372180 5372199 5372196 +
cttagattgtttccatgtct

SEQ ID NO: 25643 - DNA, 20 bp, Artificial Sequence
  Synthetic oligonucleotide; GAG chr11 5372211 5372230 5372227 +
aataatgctgcaattaacat

SEQ ID NO: 25644 - DNA, 20 bp, Artificial Sequence
  Synthetic oligonucleotide; GAG chr11 5372213 5372232 5372229 +
taatgctgcaattaacatga

SEQ ID NO: 25645 - DNA, 20 bp, Artificial Sequence
  Synthetic oligonucleotide; CAG chr11 5372218 5372237 5372234 +
ctgcaattaacatgagagtg

SEQ ID NO: 25646 - DNA, 20 bp, Artificial Sequence
  Synthetic oligonucleotide; TAG chr11 5372222 5372241 5372238 +
aattaacatgagagtgcaga

SEQ ID NO: 25647 - DNA, 20 bp, Artificial Sequence
  Synthetic oligonucleotide; TAG chr11 5372228 5372247 5372244 +
catgagagtgcagatagctc

SEQ ID NO: 25648 - DNA, 20 bp, Artificial Sequence
  Synthetic oligonucleotide; CGG chr11 5372237 5372256 5372253 +
gcagatagctctagaaaatg

SEQ ID NO: 25649 - DNA, 20 bp, Artificial Sequence
  Synthetic oligonucleotide; TGG chr11 5372253 5372272 5372269 +
aatgcggattttatttattt

SEQ ID NO: 25650 - DNA, 20 bp, Artificial Sequence
  Synthetic oligonucleotide; CAG chr11 5372265 5372284 5372281 +
atttattttggatacatata

SEQ ID NO: 25651 - DNA, 20 bp, Artificial Sequence
  Synthetic oligonucleotide; CAG chr11 5372268 5372287 5372284 +
tattttggatacatatacag

SEQ ID NO: 25652 - DNA, 20 bp, Artificial Sequence
  Synthetic oligonucleotide; GAG chr11 5372270 5372289 5372286 +
ttttggatacatatacagca

SEQ ID NO: 25653 - DNA, 20 bp, Artificial Sequence
  Synthetic oligonucleotide; TAG chr11 5372304 5372323 5372320 +
tcatacaataactctatttt

SEQ ID NO: 25654 - DNA, 20 bp, Artificial Sequence
  Synthetic oligonucleotide; GAG chr11 5372313 5372332 5372329 +
aactctatttttagttgttt

SEQ ID NO: 25655 - DNA, 20 bp, Artificial Sequence
  Synthetic oligonucleotide; TGG chr11 5372339 5372358 5372355 +
cttccatacgttttctataa

SEQ ID NO: 25656 - DNA, 20 bp, Artificial Sequence
  Synthetic oligonucleotide; CAG chr11 5372364 5372383 5372380 +
atgttaacttacattcccac

SEQ ID NO: 25657 - DNA, 20 bp, Artificial Sequence
  Synthetic oligonucleotide; AAG chr11 5372375 5372394 5372391 +
cattcccaccagctatgcac

SEQ ID NO: 25658 - DNA, 20 bp, Artificial Sequence
  Synthetic oligonucleotide; GAG chr11 5372377 5372396 5372393 +
ttcccaccagctatgcacaa

SEQ ID NO: 25659 - DNA, 20 bp, Artificial Sequence
  Synthetic oligonucleotide; CAG chr11 5372394 5372413 5372410 +
caagagttctcctttctcca

SEQ ID NO: 25660 - DNA, 20 bp, Artificial Sequence
  Synthetic oligonucleotide; TAG chr11 5372432 5372451 5372448 +
tctcttgtcttttttgataa

SEQ ID NO: 25661 - DNA, 20 bp, Artificial Sequence
  Synthetic oligonucleotide; CAG chr11 5372444 5372463 5372460 +
tttgataatagccatctcaa

SEQ ID NO: 25662 - DNA, 20 bp, Artificial Sequence
  Synthetic oligonucleotide; AGG chr11 5372445 5372464 5372461 +
ttgataatagccatctcaac

SEQ ID NO: 25663 - DNA, 20 bp, Artificial Sequence
  Synthetic oligonucleotide; GAG chr11 5372451 5372470 5372467 +
atagccatctcaacaggtgt

SEQ ID NO: 25664 - DNA, 20 bp, Artificial Sequence
  Synthetic oligonucleotide; TGG chr11 5372463 5372482 5372479 +
acaggtgtgagtgatacttg

SEQ ID NO: 25665 - DNA, 20 bp, Artificial Sequence
  Synthetic oligonucleotide; TGG chr11 5372491 5372510 5372507 +
atttgcattttcctgatgat

SEQ ID NO: 25666 - DNA, 20 bp, Artificial Sequence
  Synthetic oligonucleotide; TAG chr11 5372499 5372518 5372515 +
tttcctgatgattggtgatg

SEQ ID NO: 25667 - DNA, 20 bp, Artificial Sequence
  Synthetic oligonucleotide; CAG chr11 5372541 5372560 5372557 +
gctgaccatttgcatgtctt

SEQ ID NO: 25668 - DNA, 20 bp, Artificial Sequence
  Synthetic oligonucleotide; GAG chr11 5372543 5372562 5372559 +
tgaccatttgcatgtcttca

SEQ ID NO: 25669 - DNA, 20 bp, Artificial Sequence
  Synthetic oligonucleotide; CAG chr11 5372557 5372576 5372573 +
tcttcagagaaatgtatatt

SEQ ID NO: 25670 - DNA, 20 bp, Artificial Sequence
  Synthetic oligonucleotide; TAG chr11 5372580 5372599 5372596 +
atcctttgcccatttttact

SEQ ID NO: 25671 - DNA, 20 bp, Artificial Sequence
  Synthetic oligonucleotide; AGG chr11 5372581 5372600 5372597 +
tcctttgcccatttttactt

SEQ ID NO: 25672 - DNA, 20 bp, Artificial Sequence
  Synthetic oligonucleotide; TAG chr11 5372607 5372626 5372623 +
ctattatattttttcatatt

SEQ ID NO: 25673 - DNA, 20 bp, Artificial Sequence
  Synthetic oligonucleotide; GAG chr11 5372616 5372635 5372632 +
tttttcatatttagttgatt

SEQ ID NO: 25674 - DNA, 20 bp, Artificial Sequence
  Synthetic oligonucleotide; TGG chr11 5372633 5372652 5372649 +
attgagttccttatatattt

SEQ ID NO: 25675 - DNA, 20 bp, Artificial Sequence
  Synthetic oligonucleotide; GGG chr11 5372634 5372653 5372650 +
ttgagttccttatatatttt

SEQ ID NO: 25676 - DNA, 20 bp, Artificial Sequence
  Synthetic oligonucleotide; TAG chr11 5372640 5372659 5372656 +
tccttatatattttgggtat

SEQ ID NO: 25677 - DNA, 20 bp, Artificial Sequence
  Synthetic oligonucleotide; CAG chr11 5372651 5372670 5372667 +
tttgggtattagacttgtat

SEQ ID NO: 25678 - DNA, 20 bp, Artificial Sequence
  Synthetic oligonucleotide; CAG chr11 5372717 5372736 5372733 +
tgattgttttctttgctgtg

SEQ ID NO: 25679 - DNA, 20 bp, Artificial Sequence
  Synthetic oligonucleotide; TAG chr11 5372728 5372747 5372744 +
tttgctgtgcagaaaatatt

SEQ ID NO: 25680 - DNA, 20 bp, Artificial Sequence
  Synthetic oligonucleotide; GAG chr11 5372772 5372791 5372788 +
tatttttgcttttgttacct

SEQ ID NO: 25681 - DNA, 20 bp, Artificial Sequence
  Synthetic oligonucleotide; TGG chr11 5372778 5372797 5372794 +
tgcttttgttacctgagctc

SEQ ID NO: 25682 - DNA, 20 bp, Artificial Sequence
  Synthetic oligonucleotide; CAG chr11 5372790 5372809 5372806 +
ctgagctctggcacatttta

SEQ ID NO: 25683 - DNA, 20 bp, Artificial Sequence
  Synthetic oligonucleotide; CAG chr11 5372822 5372841 5372838 +
tgaaaatttgtatgaaacca

SEQ ID NO: 25684 - DNA, 20 bp, Artificial Sequence
  Synthetic oligonucleotide; TGG chr11 5372837 5372856 5372853 +
aaccacagaacacccccaaa

SEQ ID NO: 25685 - DNA, 20 bp, Artificial Sequence
  Synthetic oligonucleotide; GAG chr11 5372853 5372872 5372869 +
caaatggccaaaacaatctt

SEQ ID NO: 25686 - DNA, 20 bp, Artificial Sequence
  Synthetic oligonucleotide; AAG chr11 5372857 5372876 5372873 +
tggccaaaacaatcttgaga

SEQ ID NO: 25687 - DNA, 20 bp, Artificial Sequence
  Synthetic oligonucleotide; TGG chr11 5372874 5372893 5372890 +
agaaagaaaaaccaacttga

SEQ ID NO: 25688 - DNA, 20 bp, Artificial Sequence
  Synthetic oligonucleotide; CAG chr11 5372877 5372896 5372893 +
aagaaaaaccaacttgatgg

SEQ ID NO: 25689 - DNA, 20 bp, Artificial Sequence
  Synthetic oligonucleotide; AAG chr11 5372909 5372928 5372925 +
tgatttcaaattatattaca

SEQ ID NO: 25690 - DNA, 20 bp, Artificial Sequence
  Synthetic oligonucleotide; TAG chr11 5372915 5372934 5372931 +
caaattatattacaaagcta

SEQ ID NO: 25691 - DNA, 20 bp, Artificial Sequence
  Synthetic oligonucleotide; AAG chr11 5372927 5372946 5372943 +
caaagctatagtaaccaaaa

SEQ ID NO: 25692 - DNA, 20 bp, Artificial Sequence
  Synthetic oligonucleotide; TGG chr11 5372932 5372951 5372948 +
ctatagtaaccaaaaaagta

SEQ ID NO: 25693 - DNA, 20 bp, Artificial Sequence
  Synthetic oligonucleotide; TAG chr11 5372949 5372968 5372965 +
gtatggtactatcacataaa

SEQ ID NO: 25694 - DNA, 20 bp, Artificial Sequence
  Synthetic oligonucleotide; TAG chr11 5372957 5372976 5372973 +
ctatcacataaatagacaca

SEQ ID NO: 25695 - DNA, 20 bp, Artificial Sequence
  Synthetic oligonucleotide; CAG chr11 5372971 5372990 5372987 +
gacacatagaccaaattgaa

SEQ ID NO: 25696 - DNA, 20 bp, Artificial Sequence
  Synthetic oligonucleotide; AAG chr11 5372978 5372997 5372994 +
agaccaaattgaacagaata

SEQ ID NO: 25697 - DNA, 20 bp, Artificial Sequence
  Synthetic oligonucleotide; GAG chr11 5372980 5372999 5372996 +
accaaattgaacagaataaa

SEQ ID NO: 25698 - DNA, 20 bp, Artificial Sequence
  Synthetic oligonucleotide; CAG chr11 5372985 5373004 5373001 +
attgaacagaataaagagcc

SEQ ID NO: 25699 - DNA, 20 bp, Artificial Sequence
  Synthetic oligonucleotide; CAG chr11 5373007 5373026 5373023 +
gaaataaatttacgtatata

SEQ ID NO: 25700 - DNA, 20 bp, Artificial Sequence
  Synthetic oligonucleotide; CAG chr11 5373012 5373031 5373028 +
aaatttacgtatatacagtc

SEQ ID NO: 25701 - DNA, 20 bp, Artificial Sequence
  Synthetic oligonucleotide; AAG chr11 5373026 5373045 5373042 +
acagtccagtaattctcaac

SEQ ID NO: 25702 - DNA, 20 bp, Artificial Sequence
  Synthetic oligonucleotide; AGG chr11 5373027 5373046 5373043 +
cagtccagtaattctcaaca

SEQ ID NO: 25703 - DNA, 20 bp, Artificial Sequence
  Synthetic oligonucleotide; TAG chr11 5373042 5373061 5373058 +
caacaaggccaccaacacaa

SEQ ID NO: 25704 - DNA, 20 bp, Artificial Sequence
  Synthetic oligonucleotide; AGG chr11 5373043 5373062 5373059 +
aacaaggccaccaacacaat

SEQ ID NO: 25705 - DNA, 20 bp, Artificial Sequence
  Synthetic oligonucleotide; GGG chr11 5373044 5373063 5373060 +
acaaggccaccaacacaata

SEQ ID NO: 25706 - DNA, 20 bp, Artificial Sequence
  Synthetic oligonucleotide; GGG chr11 5373045 5373064 5373061 +
caaggccaccaacacaatag

SEQ ID NO: 25707 - DNA, 20 bp, Artificial Sequence
  Synthetic oligonucleotide; AAG chr11 5373048 5373067 5373064 +
ggccaccaacacaatagggg

SEQ ID NO: 25708 - DNA, 20 bp, Artificial Sequence
  Synthetic oligonucleotide; AGG chr11 5373049 5373068 5373065 +
gccaccaacacaatagggga

SEQ ID NO: 25709 - DNA, 20 bp, Artificial Sequence
  Synthetic oligonucleotide; TAG chr11 5373053 5373072 5373069 +
ccaacacaataggggaagga

SEQ ID NO: 25710 - DNA, 20 bp, Artificial Sequence
  Synthetic oligonucleotide; TAG chr11 5373069 5373088 5373085 +
aggatagtctcctcaacaaa

SEQ ID NO: 25711 - DNA, 20 bp, Artificial Sequence
  Synthetic oligonucleotide; TGG chr11 5373075 5373094 5373091 +
gtctcctcaacaaatagtgt

SEQ ID NO: 25712 - DNA, 20 bp, Artificial Sequence
  Synthetic oligonucleotide; GGG chr11 5373076 5373095 5373092 +
tctcctcaacaaatagtgtt

SEQ ID NO: 25713 - DNA, 20 bp, Artificial Sequence
  Synthetic oligonucleotide; TGG chr11 5373084 5373103 5373100 +
acaaatagtgttgggaaaac

SEQ ID NO: 25714 - DNA, 20 bp, Artificial Sequence
  Synthetic oligonucleotide; AAG chr11 5373101 5373120 5373117 +
aactggatatccaaatgcaa

SEQ ID NO: 25715 - DNA, 20 bp, Artificial Sequence
  Synthetic oligonucleotide; TGG chr11 5373112 5373131 5373128 +
caaatgcaaaagaataaaat

SEQ ID NO: 25716 - DNA, 20 bp, Artificial Sequence
  Synthetic oligonucleotide; AAG chr11 5373126 5373145 5373142 +
taaaattggacctttacctt

SEQ ID NO: 25717 - DNA, 20 bp, Artificial Sequence
  Synthetic oligonucleotide; AAG chr11 5373133 5373152 5373149 +
ggacctttaccttaagccat

SEQ ID NO: 25718 - DNA, 20 bp, Artificial Sequence
  Synthetic oligonucleotide; TAG chr11 5373147 5373166 5373163 +
agccataagtcaactcaaaa

SEQ ID NO: 25719 - DNA, 20 bp, Artificial Sequence
  Synthetic oligonucleotide; AAG chr11 5373154 5373173 5373170 +
agtcaactcaaaatagatta

SEQ ID NO: 25720 - DNA, 20 bp, Artificial Sequence
  Synthetic oligonucleotide; AAG chr11 5373167 5373186 5373183 +
tagattaaagacataaatgt

SEQ ID NO: 25721 - DNA, 20 bp, Artificial Sequence
  Synthetic oligonucleotide; TGG chr11 5373190 5373209 5373206 +
acctgaaatcacaaaactcc

SEQ ID NO: 25722 - DNA, 20 bp, Artificial Sequence
  Synthetic oligonucleotide; AAG chr11 5373193 5373212 5373209 +
tgaaatcacaaaactcctgg

SEQ ID NO: 25723 - DNA, 20 bp, Artificial Sequence
  Synthetic oligonucleotide; TAG chr11 5373204 5373223 5373220 +
aactcctggaagaacatgta

SEQ ID NO: 25724 - DNA, 20 bp, Artificial Sequence
  Synthetic oligonucleotide; GAG chr11 5373206 5373225 5373222 +
ctcctggaagaacatgtata

SEQ ID NO: 25725 - DNA, 20 bp, Artificial Sequence
  Synthetic oligonucleotide; TAG chr11 5373210 5373229 5373226 +
tggaagaacatgtatagaga

SEQ ID NO: 25726 - DNA, 20 bp, Artificial Sequence
  Synthetic oligonucleotide; CAG chr11 5373224 5373243 5373240 +
tagagatagctgcttgatat

SEQ ID NO: 25727 - DNA, 20 bp, Artificial Sequence
  Synthetic oligonucleotide; CGG chr11 5373230 5373249 5373246 +
tagctgcttgatatcagtct

SEQ ID NO: 25728 - DNA, 20 bp, Artificial Sequence
  Synthetic oligonucleotide; TAG chr11 5373241 5373260 5373257 +
tatcagtctcggcaattttt

SEQ ID NO: 25729 - DNA, 20 bp, Artificial Sequence
  Synthetic oligonucleotide; AAG chr11 5373260 5373279 5373276 +
ttagatattgtcttgatttg

SEQ ID NO: 25730 - DNA, 20 bp, Artificial Sequence
  Synthetic oligonucleotide; TGG chr11 5373274 5373293 5373290 +
gatttgaagaaaattttcac

SEQ ID NO: 25731 - DNA, 20 bp, Artificial Sequence
  Synthetic oligonucleotide; AAG chr11 5373277 5373296 5373293 +
ttgaagaaaattttcactgg

SEQ ID NO: 25732 - DNA, 20 bp, Artificial Sequence
  Synthetic oligonucleotide; AAG chr11 5373312 5373331 5373328 +
gattttttctttcacaaata

SEQ ID NO: 25733 - DNA, 20 bp, Artificial Sequence
  Synthetic oligonucleotide; CAG chr11 5373318 5373337 5373334 +
ttctttcacaaataaagttc

SEQ ID NO: 25734 - DNA, 20 bp, Artificial Sequence
  Synthetic oligonucleotide; GAG chr11 5373326 5373345 5373342 +
caaataaagttccagttttt

SEQ ID NO: 25735 - DNA, 20 bp, Artificial Sequence
  Synthetic oligonucleotide; AAG chr11 5373331 5373350 5373347 +
aaagttccagtttttgagcc

SEQ ID NO: 25736 - DNA, 20 bp, Artificial Sequence
  Synthetic oligonucleotide; TGG chr11 5373335 5373354 5373351 +
ttccagtttttgagccaaga

SEQ ID NO: 25737 - DNA, 20 bp, Artificial Sequence
  Synthetic oligonucleotide; TAG chr11 5373343 5373362 5373359 +
tttgagccaagatggccaaa

SEQ ID NO: 25738 - DNA, 20 bp, Artificial Sequence
  Synthetic oligonucleotide; AGG chr11 5373344 5373363 5373360 +
ttgagccaagatggccaaat

SEQ ID NO: 25739 - DNA, 20 bp, Artificial Sequence
  Synthetic oligonucleotide; CAG chr11 5373349 5373368 5373365 +
ccaagatggccaaataggaa

SEQ ID NO: 25740 - DNA, 20 bp, Artificial Sequence
  Synthetic oligonucleotide; TGG chr11 5373355 5373374 5373371 +
tggccaaataggaacagctc

SEQ ID NO: 25741 - DNA, 20 bp, Artificial Sequence
  Synthetic oligonucleotide; CAG chr11 5373362 5373381 5373378 +
ataggaacagctctggtcta

SEQ ID NO: 25742 - DNA, 20 bp, Artificial Sequence
  Synthetic oligonucleotide; CAG chr11 5373369 5373388 5373385 +
cagctctggtctacagctcc

SEQ ID NO: 25743 - DNA, 20 bp, Artificial Sequence
  Synthetic oligonucleotide; CAG chr11 5373383 5373402 5373399 +
agctcccagcgtgaacaaca

SEQ ID NO: 25744 - DNA, 20 bp, Artificial Sequence
  Synthetic oligonucleotide; AAG chr11 5373386 5373405 5373402 +
tcccagcgtgaacaacacag

SEQ ID NO: 25745 - DNA, 20 bp, Artificial Sequence
  Synthetic oligonucleotide; CGG chr11 5373390 5373409 5373406 +
agcgtgaacaacacagaaga

SEQ ID NO: 25746 - DNA, 20 bp, Artificial Sequence
  Synthetic oligonucleotide; GGG chr11 5373391 5373410 5373407 +
gcgtgaacaacacagaagac

SEQ ID NO: 25747 - DNA, 20 bp, Artificial Sequence
  Synthetic oligonucleotide; GAG chr11 5373414 5373433 5373430 +
tgatttctgcatttccatct

SEQ ID NO: 25748 - DNA, 20 bp, Artificial Sequence
  Synthetic oligonucleotide; AGG chr11 5373415 5373434 5373431 +
gatttctgcatttccatctg

SEQ ID NO: 25749 - DNA, 20 bp, Artificial Sequence
  Synthetic oligonucleotide; TGG chr11 5373420 5373439 5373436 +
ctgcatttccatctgaggta

SEQ ID NO: 25750 - DNA, 20 bp, Artificial Sequence
  Synthetic oligonucleotide; GGG chr11 5373421 5373440 5373437 +
tgcatttccatctgaggtat

SEQ ID NO: 25751 - DNA, 20 bp, Artificial Sequence
  Synthetic oligonucleotide; GGG chr11 5373422 5373441 5373438 +
gcatttccatctgaggtatg

SEQ ID NO: 25752 - DNA, 20 bp, Artificial Sequence
  Synthetic oligonucleotide; TAG chr11 5373435 5373454 5373451 +
aggtatggggttcatctcgc

SEQ ID NO: 25753 - DNA, 20 bp, Artificial Sequence
  Synthetic oligonucleotide; AGG chr11 5373436 5373455 5373452 +
ggtatggggttcatctcgct

SEQ ID NO: 25754 - DNA, 20 bp, Artificial Sequence
  Synthetic oligonucleotide; GGG chr11 5373437 5373456 5373453 +
gtatggggttcatctcgcta

SEQ ID NO: 25755 - DNA, 20 bp, Artificial Sequence
  Synthetic oligonucleotide; GAG chr11 5373439 5373458 5373455 +
atggggttcatctcgctagg

SEQ ID NO: 25756 - DNA, 20 bp, Artificial Sequence
  Synthetic oligonucleotide; CAG chr11 5373445 5373464 5373461 +
ttcatctcgctagggagtgc

SEQ ID NO: 25757 - DNA, 20 bp, Artificial Sequence
  Synthetic oligonucleotide; CAG chr11 5373449 5373468 5373465 +
tctcgctagggagtgccaga

SEQ ID NO: 25758 - DNA, 20 bp, Artificial Sequence
  Synthetic oligonucleotide; TGG chr11 5373452 5373471 5373468 +
cgctagggagtgccagacag

SEQ ID NO: 25759 - DNA, 20 bp, Artificial Sequence
  Synthetic oligonucleotide; GGG chr11 5373453 5373472 5373469 +
gctagggagtgccagacagt

SEQ ID NO: 25760 - DNA, 20 bp, Artificial Sequence
  Synthetic oligonucleotide; CAG chr11 5373458 5373477 5373474 +
ggagtgccagacagtgggca

SEQ ID NO: 25761 - DNA, 20 bp, Artificial Sequence
  Synthetic oligonucleotide; AGG chr11 5373459 5373478 5373475 +
gagtgccagacagtgggcac

SEQ ID NO: 25762 - DNA, 20 bp, Artificial Sequence
  Synthetic oligonucleotide; CAG chr11 5373463 5373482 5373479 +
gccagacagtgggcacaggt

SEQ ID NO: 25763 - DNA, 20 bp, Artificial Sequence
  Synthetic oligonucleotide; TGG chr11 5373466 5373485 5373482 +
agacagtgggcacaggtcag

SEQ ID NO: 25764 - DNA, 20 bp, Artificial Sequence
  Synthetic oligonucleotide; GGG chr11 5373467 5373486 5373483 +
gacagtgggcacaggtcagt

SEQ ID NO: 25765 - DNA, 20 bp, Artificial Sequence
  Synthetic oligonucleotide; CAG chr11 5373472 5373491 5373488 +
tgggcacaggtcagtgggtg

SEQ ID NO: 25766 - DNA, 20 bp, Artificial Sequence
  Synthetic oligonucleotide; CAG chr11 5373487 5373506 5373503 +
gggtgcagcacaccatgcac

SEQ ID NO: 25767 - DNA, 20 bp, Artificial Sequence
  Synthetic oligonucleotide; AAG chr11 5373493 5373512 5373509 +
agcacaccatgcaccagccg

SEQ ID NO: 25768 - DNA, 20 bp, Artificial Sequence
  Synthetic oligonucleotide; CAG chr11 5373496 5373515 5373512 +
acaccatgcaccagccgaag

SEQ ID NO: 25769 - DNA, 20 bp, Artificial Sequence
  Synthetic oligonucleotide; AGG chr11 5373497 5373516 5373513 +
caccatgcaccagccgaagc

SEQ ID NO: 25770 - DNA, 20 bp, Artificial Sequence
  Synthetic oligonucleotide; GGG chr11 5373498 5373517 5373514 +
accatgcaccagccgaagca

SEQ ID NO: 25771 - DNA, 20 bp, Artificial Sequence
  Synthetic oligonucleotide; GAG chr11 5373502 5373521 5373518 +
tgcaccagccgaagcagggt

SEQ ID NO: 25772 - DNA, 20 bp, Artificial Sequence
  Synthetic oligonucleotide; AGG chr11 5373503 5373522 5373519 +
gcaccagccgaagcagggtg

SEQ ID NO: 25773 - DNA, 20 bp, Artificial Sequence
  Synthetic oligonucleotide; TGG chr11 5373518 5373537 5373534 +
gggtgaggcattgcctcact

SEQ ID NO: 25774 - DNA, 20 bp, Artificial Sequence
  Synthetic oligonucleotide; GGG chr11 5373519 5373538 5373535 +
ggtgaggcattgcctcactt

SEQ ID NO: 25775 - DNA, 20 bp, Artificial Sequence
  Synthetic oligonucleotide; AAG chr11 5373522 5373541 5373538 +
gaggcattgcctcacttggg

SEQ ID NO: 25776 - DNA, 20 bp, Artificial Sequence
  Synthetic oligonucleotide; AAG chr11 5373528 5373547 5373544 +
ttgcctcacttgggaagcac

SEQ ID NO: 25777 - DNA, 20 bp, Artificial Sequence
  Synthetic oligonucleotide; AGG chr11 5373529 5373548 5373545 +
tgcctcacttgggaagcaca

SEQ ID NO: 25778 - DNA, 20 bp, Artificial Sequence
  Synthetic oligonucleotide; GGG chr11 5373530 5373549 5373546 +
gcctcacttgggaagcacaa

SEQ ID NO: 25779 - DNA, 20 bp, Artificial Sequence
  Synthetic oligonucleotide; GGG chr11 5373531 5373550 5373547 +
cctcacttgggaagcacaag

SEQ ID NO: 25780 - DNA, 20 bp, Artificial Sequence
  Synthetic oligonucleotide; TGG chr11 5373537 5373556 5373553 +
ttgggaagcacaaggggtca

SEQ ID NO: 25781 - DNA, 20 bp, Artificial Sequence
  Synthetic oligonucleotide; GAG chr11 5373539 5373558 5373555 +
gggaagcacaaggggtcatg

SEQ ID NO: 25782 - DNA, 20 bp, Artificial Sequence
  Synthetic oligonucleotide; TGG chr11 5373552 5373571 5373568 +
ggtcatggagttccctttcc

SEQ ID NO: 25783 - DNA, 20 bp, Artificial Sequence
  Synthetic oligonucleotide; AAG chr11 5373557 5373576 5373573 +
tggagttccctttcctggtc

SEQ ID NO: 25784 - DNA, 20 bp, Artificial Sequence
  Synthetic oligonucleotide; AGG chr11 5373558 5373577 5373574 +
ggagttccctttcctggtca

SEQ ID NO: 25785 - DNA, 20 bp, Artificial Sequence
  Synthetic oligonucleotide; AAG chr11 5373562 5373581 5373578 +
ttccctttcctggtcaagga

SEQ ID NO: 25786 - DNA, 20 bp, Artificial Sequence
  Synthetic oligonucleotide; AGG chr11 5373563 5373582 5373579 +
tccctttcctggtcaaggaa

SEQ ID NO: 25787 - DNA, 20 bp, Artificial Sequence
  Synthetic oligonucleotide; GGG chr11 5373564 5373583 5373580 +
ccctttcctggtcaaggaaa

SEQ ID NO: 25788 - DNA, 20 bp, Artificial Sequence
  Synthetic oligonucleotide; GGG chr11 5373565 5373584 5373581 +
cctttcctggtcaaggaaag

SEQ ID NO: 25789 - DNA, 20 bp, Artificial Sequence
  Synthetic oligonucleotide; CGG chr11 5373575 5373594 5373591 +
tcaaggaaaggggtgacata

SEQ ID NO: 25790 - DNA, 20 bp, Artificial Sequence
  Synthetic oligonucleotide; TGG chr11 5373582 5373601 5373598 +
aaggggtgacatacggcacc

SEQ ID NO: 25791 - DNA, 20 bp, Artificial Sequence
  Synthetic oligonucleotide; TGG chr11 5373590 5373609 5373606 +
acatacggcacctggaaaat

SEQ ID NO: 25792 - DNA, 20 bp, Artificial Sequence
  Synthetic oligonucleotide; GGG chr11 5373591 5373610 5373607 +
catacggcacctggaaaatt

SEQ ID NO: 25793 - DNA, 20 bp, Artificial Sequence
  Synthetic oligonucleotide; CAG chr11 5373625 5373644 5373641 +
cgaatactgtgcttttctga

SEQ ID NO: 25794 - DNA, 20 bp, Artificial Sequence
  Synthetic oligonucleotide; AGG chr11 5373626 5373645 5373642 +
gaatactgtgcttttctgac

SEQ ID NO: 25795 - DNA, 20 bp, Artificial Sequence
  Synthetic oligonucleotide; TAG chr11 5373631 5373650 5373647 +
ctgtgcttttctgacaggct

SEQ ID NO: 25796 - DNA, 20 bp, Artificial Sequence
  Synthetic oligonucleotide; AGG chr11 5373632 5373651 5373648 +
tgtgcttttctgacaggctt

SEQ ID NO: 25797 - DNA, 20 bp, Artificial Sequence
  Synthetic oligonucleotide; TGG chr11 5373638 5373657 5373654 +
tttctgacaggcttaggaaa

SEQ ID NO: 25798 - DNA, 20 bp, Artificial Sequence
  Synthetic oligonucleotide; CAG chr11 5373646 5373665 5373662 +
aggcttaggaaatggcgcac

SEQ ID NO: 25799 - DNA, 20 bp, Artificial Sequence
  Synthetic oligonucleotide; AGG chr11 5373647 5373666 5373663 +
ggcttaggaaatggcgcacc

SEQ ID NO: 25800 - DNA, 20 bp, Artificial Sequence
  Synthetic oligonucleotide; GAG chr11 5373649 5373668 5373665 +
cttaggaaatggcgcaccag

SEQ ID NO: 25801 - DNA, 20 bp, Artificial Sequence
  Synthetic oligonucleotide; TGG chr11 5373667 5373686 5373683 +
aggagattatatcctgcaca

SEQ ID NO: 25802 - DNA, 20 bp, Artificial Sequence
  Synthetic oligonucleotide; GAG chr11 5373674 5373693 5373690 +
tatatcctgcacatggctcc

SEQ ID NO: 25803 - DNA, 20 bp, Artificial Sequence
  Synthetic oligonucleotide; AGG chr11 5373675 5373694 5373691 +
atatcctgcacatggctccg

SEQ ID NO: 25804 - DNA, 20 bp, Artificial Sequence
  Synthetic oligonucleotide; GGG chr11 5373676 5373695 5373692 +
tatcctgcacatggctccga

SEQ ID NO: 25805 - DNA, 20 bp, Artificial Sequence
  Synthetic oligonucleotide; CGG chr11 5373690 5373709 5373706 +
ctccgagggtcctacgccca

SEQ ID NO: 25806 - DNA, 20 bp, Artificial Sequence
  Synthetic oligonucleotide; GAG chr11 5373692 5373711 5373708 +
ccgagggtcctacgcccacg

SEQ ID NO: 25807 - DNA, 20 bp, Artificial Sequence
  Synthetic oligonucleotide; TAG chr11 5373708 5373727 5373724 +
cacggagtctccctgattgc

SEQ ID NO: 25808 - DNA, 20 bp, Artificial Sequence
  Synthetic oligonucleotide; CAG chr11 5373713 5373732 5373729 +
agtctccctgattgctagca

SEQ ID NO: 25809 - DNA, 20 bp, Artificial Sequence
  Synthetic oligonucleotide; CAG chr11 5373716 5373735 5373732 +
ctccctgattgctagcacag

SEQ ID NO: 25810 - DNA, 20 bp, Artificial Sequence
  Synthetic oligonucleotide; GAG chr11 5373722 5373741 5373738 +
gattgctagcacagcagtct

SEQ ID NO: 25811 - DNA, 20 bp, Artificial Sequence
  Synthetic oligonucleotide; AAG chr11 5373735 5373754 5373751 +
gcagtctgagatcaaactgc

SEQ ID NO: 25812 - DNA, 20 bp, Artificial Sequence
  Synthetic oligonucleotide; AGG chr11 5373736 5373755 5373752 +
cagtctgagatcaaactgca

SEQ ID NO: 25813 - DNA, 20 bp, Artificial Sequence
  Synthetic oligonucleotide; TGG chr11 5373739 5373758 5373755 +
tctgagatcaaactgcaagg

SEQ ID NO: 25814 - DNA, 20 bp, Artificial Sequence
  Synthetic oligonucleotide; CAG chr11 5373742 5373761 5373758 +
gagatcaaactgcaaggtgg

SEQ ID NO: 25815 - DNA, 20 bp, Artificial Sequence
  Synthetic oligonucleotide; GAG chr11 5373746 5373765 5373762 +
tcaaactgcaaggtggcagc

SEQ ID NO: 25816 - DNA, 20 bp, Artificial Sequence
  Synthetic oligonucleotide; AGG chr11 5373747 5373766 5373763 +
caaactgcaaggtggcagcg

SEQ ID NO: 25817 - DNA, 20 bp, Artificial Sequence
  Synthetic oligonucleotide; TGG chr11 5373751 5373770 5373767 +
ctgcaaggtggcagcgaggc

SEQ ID NO: 25818 - DNA, 20 bp, Artificial Sequence
  Synthetic oligonucleotide; GGG chr11 5373752 5373771 5373768 +
tgcaaggtggcagcgaggct

SEQ ID NO: 25819 - DNA, 20 bp, Artificial Sequence
  Synthetic oligonucleotide; GGG chr11 5373753 5373772 5373769 +
gcaaggtggcagcgaggctg

SEQ ID NO: 25820 - DNA, 20 bp, Artificial Sequence
  Synthetic oligonucleotide; GGG chr11 5373754 5373773 5373770 +
caaggtggcagcgaggctgg

SEQ ID NO: 25821 - DNA, 20 bp, Artificial Sequence
  Synthetic oligonucleotide; GAG chr11 5373756 5373775 5373772 +
aggtggcagcgaggctgggg

SEQ ID NO: 25822 - DNA, 20 bp, Artificial Sequence
  Synthetic oligonucleotide; AGG chr11 5373757 5373776 5373773 +
ggtggcagcgaggctggggg

SEQ ID NO: 25823 - DNA, 20 bp, Artificial Sequence
  Synthetic oligonucleotide; GGG chr11 5373758 5373777 5373774 +
gtggcagcgaggctggggga

SEQ ID NO: 25824 - DNA, 20 bp, Artificial Sequence
  Synthetic oligonucleotide; GGG chr11 5373759 5373778 5373775 +
tggcagcgaggctgggggag

SEQ ID NO: 25825 - DNA, 20 bp, Artificial Sequence
  Synthetic oligonucleotide; CAG chr11 5373762 5373781 5373778 +
cagcgaggctgggggagggg

SEQ ID NO: 25826 - DNA, 20 bp, Artificial Sequence
  Synthetic oligonucleotide; CAG chr11 5373776 5373795 5373792 +
gaggggcagccgccattgcc

SEQ ID NO: 25827 - DNA, 20 bp, Artificial Sequence
  Synthetic oligonucleotide; AGG chr11 5373777 5373796 5373793 +
aggggcagccgccattgccc

SEQ ID NO: 25828 - DNA, 20 bp, Artificial Sequence
  Synthetic oligonucleotide; TAG chr11 5373786 5373805 5373802 +
cgccattgcccaggcttgct

SEQ ID NO: 25829 - DNA, 20 bp, Artificial Sequence
  Synthetic oligonucleotide; AGG chr11 5373787 5373806 5373803 +
gccattgcccaggcttgctt

SEQ ID NO: 25830 - DNA, 20 bp, Artificial Sequence
  Synthetic oligonucleotide; AAG chr11 5373796 5373815 5373812 +
caggcttgcttaggtaaaca

SEQ ID NO: 25831 - DNA, 20 bp, Artificial Sequence
  Synthetic oligonucleotide; CAG chr11 5373799 5373818 5373815 +
gcttgcttaggtaaacaaag

SEQ ID NO: 25832 - DNA, 20 bp, Artificial Sequence
  Synthetic oligonucleotide; CAG chr11 5373803 5373822 5373819 +
gcttaggtaaacaaagcagc

SEQ ID NO: 25833 - DNA, 20 bp, Artificial Sequence
  Synthetic oligonucleotide; AGG chr11 5373804 5373823 5373820 +
cttaggtaaacaaagcagcc

SEQ ID NO: 25834 - DNA, 20 bp, Artificial Sequence
  Synthetic oligonucleotide; AAG chr11 5373807 5373826 5373823 +
aggtaaacaaagcagccagg

SEQ ID NO: 25835 - DNA, 20 bp, Artificial Sequence
  Synthetic oligonucleotide; TGG chr11 5373817 5373836 5373833 +
agcagccaggaagctcaaac

SEQ ID NO: 25836 - DNA, 20 bp, Artificial Sequence
  Synthetic oligonucleotide; GGG chr11 5373818 5373837 5373834 +
gcagccaggaagctcaaact

SEQ ID NO: 25837 - DNA, 20 bp, Artificial Sequence
  Synthetic oligonucleotide; TGG chr11 5373821 5373840 5373837 +
gccaggaagctcaaactggg

SEQ ID NO: 25838 - DNA, 20 bp, Artificial Sequence
  Synthetic oligonucleotide; CAG chr11 5373833 5373852 5373849 +
aaactgggtggaccccacca

SEQ ID NO: 25839 - DNA, 20 bp, Artificial Sequence
  Synthetic oligonucleotide; AAG chr11 5373839 5373858 5373855 +
ggtggaccccaccacagctc

SEQ ID NO: 25840 - DNA, 20 bp, Artificial Sequence
  Synthetic oligonucleotide; AGG chr11 5373840 5373859 5373856 +
gtggaccccaccacagctca

SEQ ID NO: 25841 - DNA, 20 bp, Artificial Sequence
  Synthetic oligonucleotide; GAG chr11 5373842 5373861 5373858 +
ggaccccaccacagctcaag

SEQ ID NO: 25842 - DNA, 20 bp, Artificial Sequence
  Synthetic oligonucleotide; AGG chr11 5373843 5373862 5373859 +
gaccccaccacagctcaagg

SEQ ID NO: 25843 - DNA, 20 bp, Artificial Sequence
  Synthetic oligonucleotide; TAG chr11 5373860 5373879 5373876 +
aggaggcctgcctgcctctg

SEQ ID NO: 25844 - DNA, 20 bp, Artificial Sequence
  Synthetic oligonucleotide; AGG chr11 5373861 5373880 5373877 +
ggaggcctgcctgcctctgt

SEQ ID NO: 25845 - DNA, 20 bp, Artificial Sequence
  Synthetic oligonucleotide; TGG chr11 5373873 5373892 5373889 +
gcctctgtaggctccacctt

SEQ ID NO: 25846 - DNA, 20 bp, Artificial Sequence
  Synthetic oligonucleotide; GGG chr11 5373874 5373893 5373890 +
cctctgtaggctccaccttt

SEQ ID NO: 25847 - DNA, 20 bp, Artificial Sequence
  Synthetic oligonucleotide; GGG chr11 5373875 5373894 5373891 +
ctctgtaggctccacctttg

SEQ ID NO: 25848 - DNA, 20 bp, Artificial Sequence
  Synthetic oligonucleotide; GGG chr11 5373876 5373895 5373892 +
tctgtaggctccacctttgg

SEQ ID NO: 25849 - DNA, 20 bp, Artificial Sequence
  Synthetic oligonucleotide; CAG chr11 5373879 5373898 5373895 +
gtaggctccacctttggggg

SEQ ID NO: 25850 - DNA, 20 bp, Artificial Sequence
  Synthetic oligonucleotide; AGG chr11 5373880 5373899 5373896 +
taggctccacctttgggggc

SEQ ID NO: 25851 - DNA, 20 bp, Artificial Sequence
  Synthetic oligonucleotide; GGG chr11 5373881 5373900 5373897 +
aggctccacctttgggggca

SEQ ID NO: 25852 - DNA, 20 bp, Artificial Sequence
  Synthetic oligonucleotide; CAG chr11 5373886 5373905 5373902 +
ccacctttgggggcagggca

SEQ ID NO: 25853 - DNA, 20 bp, Artificial Sequence
  Synthetic oligonucleotide; AAG chr11 5373898 5373917 5373914 +
gcagggcacagacaaacaaa

SEQ ID NO: 25854 - DNA, 20 bp, Artificial Sequence
  Synthetic oligonucleotide; CAG chr11 5373902 5373921 5373918 +
ggcacagacaaacaaaaaga

SEQ ID NO: 25855 - DNA, 20 bp, Artificial Sequence
  Synthetic oligonucleotide; CAG chr11 5373905 5373924 5373921 +
acagacaaacaaaaagacag

SEQ ID NO: 25856 - DNA, 20 bp, Artificial Sequence
  Synthetic oligonucleotide; CAG chr11 5373917 5373936 5373933 +
aaagacagcagtaacctctg

SEQ ID NO: 25857 - DNA, 20 bp, Artificial Sequence
  Synthetic oligonucleotide; CAG chr11 5373940 5373959 5373956 +
acttaaatgtccctgtctga

SEQ ID NO: 25858 - DNA, 20 bp, Artificial Sequence
  Synthetic oligonucleotide; GAG chr11 5373947 5373966 5373963 +
tgtccctgtctgacagcttt

SEQ ID NO: 25859 - DNA, 20 bp, Artificial Sequence
  Synthetic oligonucleotide; AGG chr11 5373948 5373967 5373964 +
gtccctgtctgacagctttg

SEQ ID NO: 25860 - DNA, 20 bp, Artificial Sequence
  Synthetic oligonucleotide; GAG chr11 5373950 5373969 5373966 +
ccctgtctgacagctttgag

SEQ ID NO: 25861 - DNA, 20 bp, Artificial Sequence
  Synthetic oligonucleotide; GAG chr11 5373952 5373971 5373968 +
ctgtctgacagctttgagga

SEQ ID NO: 25862 - DNA, 20 bp, Artificial Sequence
  Synthetic oligonucleotide; CAG chr11 5373955 5373974 5373971 +
tctgacagctttgaggagag

SEQ ID NO: 25863 - DNA, 20 bp, Artificial Sequence
  Synthetic oligonucleotide; TGG chr11 5373958 5373977 5373974 +
gacagctttgaggagagcag

SEQ ID NO: 25864 - DNA, 20 bp, Artificial Sequence
  Synthetic oligonucleotide; CAG chr11 5373967 5373986 5373983 +
gaggagagcagtggttctcc

SEQ ID NO: 25865 - DNA, 20 bp, Artificial Sequence
  Synthetic oligonucleotide; CAG chr11 5373974 5373993 5373990 +
gcagtggttctcccagcaca

SEQ ID NO: 25866 - DNA, 20 bp, Artificial Sequence
  Synthetic oligonucleotide; TGG chr11 5373978 5373997 5373994 +
tggttctcccagcacacagc

SEQ ID NO: 25867 - DNA, 20 bp, Artificial Sequence
  Synthetic oligonucleotide; GAG chr11 5373980 5373999 5373996 +
gttctcccagcacacagctg

SEQ ID NO: 25868 - DNA, 20 bp, Artificial Sequence
  Synthetic oligonucleotide; GAG chr11 5373987 5374006 5374003 +
cagcacacagctggagatct

SEQ ID NO: 25869 - DNA, 20 bp, Artificial Sequence
  Synthetic oligonucleotide; CGG chr11 5373992 5374011 5374008 +
cacagctggagatctgagaa

SEQ ID NO: 25870 - DNA, 20 bp, Artificial Sequence
  Synthetic oligonucleotide; GGG chr11 5373993 5374012 5374009 +
acagctggagatctgagaac

SEQ ID NO: 25871 - DNA, 20 bp, Artificial Sequence
  Synthetic oligonucleotide; CAG chr11 5373996 5374015 5374012 +
gctggagatctgagaacggg

SEQ ID NO: 25872 - DNA, 20 bp, Artificial Sequence
  Synthetic oligonucleotide; AAG chr11 5374010 5374029 5374026 +
aacgggcagactgcctcctc

SEQ ID NO: 25873 - DNA, 20 bp, Artificial Sequence
  Synthetic oligonucleotide; TGG chr11 5374013 5374032 5374029 +
gggcagactgcctcctcaag

SEQ ID NO: 25874 - DNA, 20 bp, Artificial Sequence
  Synthetic oligonucleotide; GGG chr11 5374014 5374033 5374030 +
ggcagactgcctcctcaagt

SEQ ID NO: 25875 - DNA, 20 bp, Artificial Sequence
  Synthetic oligonucleotide; GAG chr11 5374036 5374055 5374052 +
gtccctgacccctgaccccc

SEQ ID NO: 25876 - DNA, 20 bp, Artificial Sequence
  Synthetic oligonucleotide; CAG chr11 5374039 5374058 5374055 +
cctgacccctgacccccgag

SEQ ID NO: 25877 - DNA, 20 bp, Artificial Sequence
  Synthetic oligonucleotide; TGG chr11 5374048 5374067 5374064 +
tgacccccgagcagcctaac

SEQ ID NO: 25878 - DNA, 20 bp, Artificial Sequence
  Synthetic oligonucleotide; GGG chr11 5374049 5374068 5374065 +
gacccccgagcagcctaact

SEQ ID NO: 25879 - DNA, 20 bp, Artificial Sequence
  Synthetic oligonucleotide; GAG chr11 5374051 5374070 5374067 +
cccccgagcagcctaactgg

SEQ ID NO: 25880 - DNA, 20 bp, Artificial Sequence
  Synthetic oligonucleotide; AGG chr11 5374052 5374071 5374068 +
ccccgagcagcctaactggg

SEQ ID NO: 25881 - DNA, 20 bp, Artificial Sequence
  Synthetic oligonucleotide; AAG chr11 5374062 5374081 5374078 +
cctaactgggaggcaccccc

SEQ ID NO: 25882 - DNA, 20 bp, Artificial Sequence
  Synthetic oligonucleotide; AAG chr11 5374066 5374085 5374082 +
actgggaggcacccccaagt

SEQ ID NO: 25883 - DNA, 20 bp, Artificial Sequence
  Synthetic oligonucleotide; AGG chr11 5374067 5374086 5374083 +
ctgggaggcacccccaagta

SEQ ID NO: 25884 - DNA, 20 bp, Artificial Sequence
  Synthetic oligonucleotide; GGG chr11 5374068 5374087 5374084 +
tgggaggcacccccaagtaa

SEQ ID NO: 25885 - DNA, 20 bp, Artificial Sequence
  Synthetic oligonucleotide; CAG chr11 5374071 5374090 5374087 +
gaggcacccccaagtaaggg

SEQ ID NO: 25886 - DNA, 20 bp, Artificial Sequence
  Synthetic oligonucleotide; CGG chr11 5374088 5374107 5374104 +
gggcagactgacacctcaca

SEQ ID NO: 25887 - DNA, 20 bp, Artificial Sequence
  Synthetic oligonucleotide; CAG chr11 5374092 5374111 5374108 +
agactgacacctcacacggc

SEQ ID NO: 25888 - DNA, 20 bp, Artificial Sequence
  Synthetic oligonucleotide; AGG chr11 5374093 5374112 5374109 +
gactgacacctcacacggcc

SEQ ID NO: 25889 - DNA, 20 bp, Artificial Sequence
  Synthetic oligonucleotide; GAG chr11 5374105 5374124 5374121 +
acacggccaggtactcctct

SEQ ID NO: 25890 - DNA, 20 bp, Artificial Sequence
  Synthetic oligonucleotide; CAG chr11 5374118 5374137 5374134 +
ctcctctgagacaaaacttc

SEQ ID NO: 25891 - DNA, 20 bp, Artificial Sequence
  Synthetic oligonucleotide; GAG chr11 5374120 5374139 5374136 +
cctctgagacaaaacttcca

SEQ ID NO: 25892 - DNA, 20 bp, Artificial Sequence
  Synthetic oligonucleotide; AGG chr11 5374121 5374140 5374137 +
ctctgagacaaaacttccag

SEQ ID NO: 25893 - DNA, 20 bp, Artificial Sequence
  Synthetic oligonucleotide; CAG chr11 5374130 5374149 5374146 +
aaaacttccagaggaacgat

SEQ ID NO: 25894 - DNA, 20 bp, Artificial Sequence
  Synthetic oligonucleotide; CAG chr11 5374134 5374153 5374150 +
cttccagaggaacgatcaga

SEQ ID NO: 25895 - DNA, 20 bp, Artificial Sequence
  Synthetic oligonucleotide; CAG chr11 5374137 5374156 5374153 +
ccagaggaacgatcagacag

SEQ ID NO: 25896 - DNA, 20 bp, Artificial Sequence
  Synthetic oligonucleotide; CGG chr11 5374146 5374165 5374162 +
cgatcagacagcagcattcg

SEQ ID NO: 25897 - DNA, 20 bp, Artificial Sequence
  Synthetic oligonucleotide; CGG chr11 5374163 5374182 5374179 +
tcgcggatcacgaaaatctg

SEQ ID NO: 25898 - DNA, 20 bp, Artificial Sequence
  Synthetic oligonucleotide; CAG chr11 5374171 5374190 5374187 +
cacgaaaatctgcggttctg

SEQ ID NO: 25899 - DNA, 20 bp, Artificial Sequence
  Synthetic oligonucleotide; CAG chr11 5374191 5374210 5374207 +
cagacaccgctgctgatacc

SEQ ID NO: 25900 - DNA, 20 bp, Artificial Sequence
  Synthetic oligonucleotide; AGG chr11 5374192 5374211 5374208 +
agacaccgctgctgataccc

SEQ ID NO: 25901 - DNA, 20 bp, Artificial Sequence
  Synthetic oligonucleotide; CAG chr11 5374199 5374218 5374215 +
gctgctgatacccaggcaaa

SEQ ID NO: 25902 - DNA, 20 bp, Artificial Sequence
  Synthetic oligonucleotide; AGG chr11 5374200 5374219 5374216 +
ctgctgatacccaggcaaac

SEQ ID NO: 25903 - DNA, 20 bp, Artificial Sequence
  Synthetic oligonucleotide; GGG chr11 5374201 5374220 5374217 +
tgctgatacccaggcaaaca

SEQ ID NO: 25904 - DNA, 20 bp, Artificial Sequence
  Synthetic oligonucleotide; TGG chr11 5374206 5374225 5374222 +
atacccaggcaaacagggtc

SEQ ID NO: 25905 - DNA, 20 bp, Artificial Sequence
  Synthetic oligonucleotide; GAG chr11 5374208 5374227 5374224 +
acccaggcaaacagggtctg

SEQ ID NO: 25906 - DNA, 20 bp, Artificial Sequence
  Synthetic oligonucleotide; TGG chr11 5374211 5374230 5374227 +
caggcaaacagggtctggag

SEQ ID NO: 25907 - DNA, 20 bp, Artificial Sequence
  Synthetic oligonucleotide; TAG chr11 5374219 5374238 5374235 +
cagggtctggagtggacctc

SEQ ID NO: 25908 - DNA, 20 bp, Artificial Sequence
  Synthetic oligonucleotide; CAG chr11 5374232 5374251 5374248 +
ggacctctagcaaactccaa

SEQ ID NO: 25909 - DNA, 20 bp, Artificial Sequence
  Synthetic oligonucleotide; CAG chr11 5374240 5374259 5374256 +
agcaaactccaacagacctg

SEQ ID NO: 25910 - DNA, 20 bp, Artificial Sequence
  Synthetic oligonucleotide; GAG chr11 5374245 5374264 5374261 +
actccaacagacctgcagct

SEQ ID NO: 25911 - DNA, 20 bp, Artificial Sequence
  Synthetic oligonucleotide; AGG chr11 5374246 5374265 5374262 +
ctccaacagacctgcagctg

SEQ ID NO: 25912 - DNA, 20 bp, Artificial Sequence
  Synthetic oligonucleotide; GGG chr11 5374247 5374266 5374263 +
tccaacagacctgcagctga

SEQ ID NO: 25913 - DNA, 20 bp, Artificial Sequence
  Synthetic oligonucleotide; TAG chr11 5374260 5374279 5374276 +
cagctgagggtcctgtctgt

SEQ ID NO: 25914 - DNA, 20 bp, Artificial Sequence
  Synthetic oligonucleotide; AAG chr11 5374263 5374282 5374279 +
ctgagggtcctgtctgttag

SEQ ID NO: 25915 - DNA, 20 bp, Artificial Sequence
  Synthetic oligonucleotide; AGG chr11 5374264 5374283 5374280 +
tgagggtcctgtctgttaga

SEQ ID NO: 25916 - DNA, 20 bp, Artificial Sequence
  Synthetic oligonucleotide; CAG chr11 5374279 5374298 5374295 +
ttagaaggaaaactaacaaa

SEQ ID NO: 25917 - DNA, 20 bp, Artificial Sequence
  Synthetic oligonucleotide; AAG chr11 5374283 5374302 5374299 +
aaggaaaactaacaaacaga

SEQ ID NO: 25918 - DNA, 20 bp, Artificial Sequence
  Synthetic oligonucleotide; AGG chr11 5374284 5374303 5374300 +
aggaaaactaacaaacagaa

SEQ ID NO: 25919 - DNA, 20 bp, Artificial Sequence
  Synthetic oligonucleotide; CGG chr11 5374308 5374327 5374324 +
catccacaccaaaaacccat

SEQ ID NO: 25920 - DNA, 20 bp, Artificial Sequence
  Synthetic oligonucleotide; AAG chr11 5374327 5374346 5374343 +
tcggtacatcactatcatca

SEQ ID NO: 25921 - DNA, 20 bp, Artificial Sequence
  Synthetic oligonucleotide; AAG chr11 5374335 5374354 5374351 +
tcactatcatcaaagaccaa

SEQ ID NO: 25922 - DNA, 20 bp, Artificial Sequence
  Synthetic oligonucleotide; TAG chr11 5374338 5374357 5374354 +
ctatcatcaaagaccaaaag

SEQ ID NO: 25923 - DNA, 20 bp, Artificial Sequence
  Synthetic oligonucleotide; AAG chr11 5374352 5374371 5374368 +
caaaagtagatacaaccaca

SEQ ID NO: 25924 - DNA, 20 bp, Artificial Sequence
  Synthetic oligonucleotide; TGG chr11 5374356 5374375 5374372 +
agtagatacaaccacaaagt

SEQ ID NO: 25925 - DNA, 20 bp, Artificial Sequence
  Synthetic oligonucleotide; GGG chr11 5374357 5374376 5374373 +
gtagatacaaccacaaagtt

SEQ ID NO: 25926 - DNA, 20 bp, Artificial Sequence
  Synthetic oligonucleotide; GGG chr11 5374358 5374377 5374374 +
tagatacaaccacaaagttg

SEQ ID NO: 25927 - DNA, 20 bp, Artificial Sequence
  Synthetic oligonucleotide; CAG chr11 5374367 5374386 5374383 +
ccacaaagttggggaaaaaa

SEQ ID NO: 25928 - DNA, 20 bp, Artificial Sequence
  Synthetic oligonucleotide; GAG chr11 5374369 5374388 5374385 +
acaaagttggggaaaaaaca

SEQ ID NO: 25929 - DNA, 20 bp, Artificial Sequence
  Synthetic oligonucleotide; CAG chr11 5374372 5374391 5374388 +
aagttggggaaaaaacagag

SEQ ID NO: 25930 - DNA, 20 bp, Artificial Sequence
  Synthetic oligonucleotide; TGG chr11 5374381 5374400 5374397 +
aaaaaacagagcagaaaaac

SEQ ID NO: 25931 - DNA, 20 bp, Artificial Sequence
  Synthetic oligonucleotide; AAG chr11 5374394 5374413 5374410 +
gaaaaactggaaactctaaa

SEQ ID NO: 25932 - DNA, 20 bp, Artificial Sequence
  Synthetic oligonucleotide; CAG chr11 5374397 5374416 5374413 +
aaactggaaactctaaaaag

SEQ ID NO: 25933 - DNA, 20 bp, Artificial Sequence
  Synthetic oligonucleotide; GAG chr11 5374399 5374418 5374415 +
actggaaactctaaaaagca

SEQ ID NO: 25934 - DNA, 20 bp, Artificial Sequence
  Synthetic oligonucleotide; AAG chr11 5374418 5374437 5374434 +
agagcacctttcctcctcca

SEQ ID NO: 25935 - DNA, 20 bp, Artificial Sequence
  Synthetic oligonucleotide; AGG chr11 5374419 5374438 5374435 +
gagcacctttcctcctccaa

SEQ ID NO: 25936 - DNA, 20 bp, Artificial Sequence
  Synthetic oligonucleotide; AAG chr11 5374423 5374442 5374439 +
acctttcctcctccaaagga

SEQ ID NO: 25937 - DNA, 20 bp, Artificial Sequence
  Synthetic oligonucleotide; CAG chr11 5374426 5374445 5374442 +
tttcctcctccaaaggaaag

SEQ ID NO: 25938 - DNA, 20 bp, Artificial Sequence
  Synthetic oligonucleotide; CAG chr11 5374437 5374456 5374453 +
aaaggaaagcagttcctcac

SEQ ID NO: 25939 - DNA, 20 bp, Artificial Sequence
  Synthetic oligonucleotide; CGG chr11 5374443 5374462 5374459 +
aagcagttcctcaccagcaa

SEQ ID NO: 25940 - DNA, 20 bp, Artificial Sequence
  Synthetic oligonucleotide; AAG chr11 5374450 5374469 5374466 +
tcctcaccagcaacggaaca

SEQ ID NO: 25941 - DNA, 20 bp, Artificial Sequence
  Synthetic oligonucleotide; TGG chr11 5374454 5374473 5374470 +
caccagcaacggaacaaagc

SEQ ID NO: 25942 - DNA, 20 bp, Artificial Sequence
  Synthetic oligonucleotide; TGG chr11 5374458 5374477 5374474 +
agcaacggaacaaagctgga

SEQ ID NO: 25943 - DNA, 20 bp, Artificial Sequence
  Synthetic oligonucleotide; GAG chr11 5374460 5374479 5374476 +
caacggaacaaagctggatg

SEQ ID NO: 25944 - DNA, 20 bp, Artificial Sequence
  Synthetic oligonucleotide; GAG chr11 5374475 5374494 5374491 +
ggatggagaatgactttgac

SEQ ID NO: 25945 - DNA, 20 bp, Artificial Sequence
  Synthetic oligonucleotide; GAG chr11 5374480 5374499 5374496 +
gagaatgactttgacgagct

SEQ ID NO: 25946 - DNA, 20 bp, Artificial Sequence
  Synthetic oligonucleotide; GAG chr11 5374482 5374501 5374498 +
gaatgactttgacgagctga

SEQ ID NO: 25947 - DNA, 20 bp, Artificial Sequence
  Synthetic oligonucleotide; AAG chr11 5374485 5374504 5374501 +
tgactttgacgagctgagag

SEQ ID NO: 25948 - DNA, 20 bp, Artificial Sequence
  Synthetic oligonucleotide; AAG chr11 5374488 5374507 5374504 +
ctttgacgagctgagagaag

SEQ ID NO: 25949 - DNA, 20 bp, Artificial Sequence
  Synthetic oligonucleotide; CAG chr11 5374495 5374514 5374511 +
gagctgagagaagaagactt

SEQ ID NO: 25950 - DNA, 20 bp, Artificial Sequence
  Synthetic oligonucleotide; GAG chr11 5374514 5374533 5374530 +
tcagacgatgaaactactcc

SEQ ID NO: 25951 - DNA, 20 bp, Artificial Sequence
  Synthetic oligonucleotide; CAG chr11 5374520 5374539 5374536 +
gatgaaactactccgagcta

SEQ ID NO: 25952 - DNA, 20 bp, Artificial Sequence
  Synthetic oligonucleotide; AGG chr11 5374521 5374540 5374537 +
atgaaactactccgagctac

SEQ ID NO: 25953 - DNA, 20 bp, Artificial Sequence
  Synthetic oligonucleotide; GAG chr11 5374523 5374542 5374539 +
gaaactactccgagctacag

SEQ ID NO: 25954 - DNA, 20 bp, Artificial Sequence
  Synthetic oligonucleotide; AGG chr11 5374524 5374543 5374540 +
aaactactccgagctacagg

SEQ ID NO: 25955 - DNA, 20 bp, Artificial Sequence
  Synthetic oligonucleotide; AAG chr11 5374539 5374558 5374555 +
acaggaggaaattcaaacca

SEQ ID NO: 25956 - DNA, 20 bp, Artificial Sequence
  Synthetic oligonucleotide; AGG chr11 5374540 5374559 5374556 +
caggaggaaattcaaaccaa

SEQ ID NO: 25957 - DNA, 20 bp, Artificial Sequence
  Synthetic oligonucleotide; AAG chr11 5374545 5374564 5374561 +
ggaaattcaaaccaaaggca

SEQ ID NO: 25958 - DNA, 20 bp, Artificial Sequence
  Synthetic oligonucleotide; AAG chr11 5374548 5374567 5374564 +
aattcaaaccaaaggcaaag

SEQ ID NO: 25959 - DNA, 20 bp, Artificial Sequence
  Synthetic oligonucleotide; TAG chr11 5374573 5374592 5374589 +
aaaaactttgaaaaaaaatt

SEQ ID NO: 25960 - DNA, 20 bp, Artificial Sequence
  Synthetic oligonucleotide; TAG chr11 5374589 5374608 5374605 +
aatttagatgaatgtataac

SEQ ID NO: 25961 - DNA, 20 bp, Artificial Sequence
  Synthetic oligonucleotide; CAG chr11 5374603 5374622 5374619 +
tataactagaataaccaata

SEQ ID NO: 25962 - DNA, 20 bp, Artificial Sequence
  Synthetic oligonucleotide; GAG chr11 5374605 5374624 5374621 +
taactagaataaccaataca

SEQ ID NO: 25963 - DNA, 20 bp, Artificial Sequence
  Synthetic oligonucleotide; AAG chr11 5374608 5374627 5374624 +
ctagaataaccaatacagag

SEQ ID NO: 25964 - DNA, 20 bp, Artificial Sequence
  Synthetic oligonucleotide; AAG chr11 5374617 5374636 5374633 +
ccaatacagagaagtgctta

SEQ ID NO: 25965 - DNA, 20 bp, Artificial Sequence
  Synthetic oligonucleotide; AGG chr11 5374618 5374637 5374634 +
caatacagagaagtgcttaa

SEQ ID NO: 25966 - DNA, 20 bp, Artificial Sequence
  Synthetic oligonucleotide; GAG chr11 5374620 5374639 5374636 +
atacagagaagtgcttaaag

SEQ ID NO: 25967 - DNA, 20 bp, Artificial Sequence
  Synthetic oligonucleotide; TGG chr11 5374627 5374646 5374643 +
gaagtgcttaaaggagctga

SEQ ID NO: 25968 - DNA, 20 bp, Artificial Sequence
  Synthetic oligonucleotide; GAG chr11 5374629 5374648 5374645 +
agtgcttaaaggagctgatg

SEQ ID NO: 25969 - DNA, 20 bp, Artificial Sequence
  Synthetic oligonucleotide; AAG chr11 5374636 5374655 5374652 +
aaaggagctgatggagctga

SEQ ID NO: 25970 - DNA, 20 bp, Artificial Sequence
  Synthetic oligonucleotide; AAG chr11 5374641 5374660 5374657 +
agctgatggagctgaaagcc

SEQ ID NO: 25971 - DNA, 20 bp, Artificial Sequence
  Synthetic oligonucleotide; AGG chr11 5374642 5374661 5374658 +
gctgatggagctgaaagcca

SEQ ID NO: 25972 - DNA, 20 bp, Artificial Sequence
  Synthetic oligonucleotide; GAG chr11 5374648 5374667 5374664 +
ggagctgaaagccaaggctc

SEQ ID NO: 25973 - DNA, 20 bp, Artificial Sequence
  Synthetic oligonucleotide; AAG chr11 5374660 5374679 5374676 +
caaggctcgagaatgacgtg

SEQ ID NO: 25974 - DNA, 20 bp, Artificial Sequence
  Synthetic oligonucleotide; TGG chr11 5374665 5374684 5374681 +
ctcgagaatgacgtgaagaa

SEQ ID NO: 25975 - DNA, 20 bp, Artificial Sequence
  Synthetic oligonucleotide; GAG chr11 5374667 5374686 5374683 +
cgagaatgacgtgaagaatg

SEQ ID NO: 25976 - DNA, 20 bp, Artificial Sequence
  Synthetic oligonucleotide; AAG chr11 5374670 5374689 5374686 +
gaatgacgtgaagaatggag

SEQ ID NO: 25977 - DNA, 20 bp, Artificial Sequence
  Synthetic oligonucleotide; CAG chr11 5374676 5374695 5374692 +
cgtgaagaatggagaagcct

SEQ ID NO: 25978 - DNA, 20 bp, Artificial Sequence
  Synthetic oligonucleotide; AGG chr11 5374677 5374696 5374693 +
gtgaagaatggagaagcctc

SEQ ID NO: 25979 - DNA, 20 bp, Artificial Sequence
  Synthetic oligonucleotide; GAG chr11 5374679 5374698 5374695 +
gaagaatggagaagcctcag

SEQ ID NO: 25980 - DNA, 20 bp, Artificial Sequence
  Synthetic oligonucleotide; TGG chr11 5374696 5374715 5374712 +
caggagctgatgcgatcaac

SEQ ID NO: 25981 - DNA, 20 bp, Artificial Sequence
  Synthetic oligonucleotide; AAG chr11 5374699 5374718 5374715 +
gagctgatgcgatcaactgg

SEQ ID NO: 25982 - DNA, 20 bp, Artificial Sequence
  Synthetic oligonucleotide; AAG chr11 5374703 5374722 5374719 +
tgatgcgatcaactggaaga

SEQ ID NO: 25983 - DNA, 20 bp, Artificial Sequence
  Synthetic oligonucleotide; AGG chr11 5374704 5374723 5374720 +
gatgcgatcaactggaagaa

SEQ ID NO: 25984 - DNA, 20 bp, Artificial Sequence
  Synthetic oligonucleotide; GGG chr11 5374705 5374724 5374721 +
atgcgatcaactggaagaaa

SEQ ID NO: 25985 - DNA, 20 bp, Artificial Sequence
  Synthetic oligonucleotide; CAG chr11 5374711 5374730 5374727 +
tcaactggaagaaagggtat

SEQ ID NO: 25986 - DNA, 20 bp, Artificial Sequence
  Synthetic oligonucleotide; TGG chr11 5374717 5374736 5374733 +
ggaagaaagggtatcagtga

SEQ ID NO: 25987 - DNA, 20 bp, Artificial Sequence
  Synthetic oligonucleotide; AAG chr11 5374720 5374739 5374736 +
agaaagggtatcagtgatgg

SEQ ID NO: 25988 - DNA, 20 bp, Artificial Sequence
  Synthetic oligonucleotide; AAG chr11 5374740 5374759 5374756 +
aagatgaaataaatgaaatg

SEQ ID NO: 25989 - DNA, 20 bp, Artificial Sequence
  Synthetic oligonucleotide; GAG chr11 5374744 5374763 5374760 +
tgaaataaatgaaatgaagc

SEQ ID NO: 25990 - DNA, 20 bp, Artificial Sequence
  Synthetic oligonucleotide; AAG chr11 5374747 5374766 5374763 +
aataaatgaaatgaagcgag

SEQ ID NO: 25991 - DNA, 20 bp, Artificial Sequence
  Synthetic oligonucleotide; AGG chr11 5374748 5374767 5374764 +
ataaatgaaatgaagcgaga

SEQ ID NO: 25992 - DNA, 20 bp, Artificial Sequence
  Synthetic oligonucleotide; GGG chr11 5374749 5374768 5374765 +
taaatgaaatgaagcgagaa

SEQ ID NO: 25993 - DNA, 20 bp, Artificial Sequence
  Synthetic oligonucleotide; AAG chr11 5374752 5374771 5374768 +
atgaaatgaagcgagaaggg

SEQ ID NO: 25994 - DNA, 20 bp, Artificial Sequence
  Synthetic oligonucleotide; TAG chr11 5374757 5374776 5374773 +
atgaagcgagaagggaagtt

SEQ ID NO: 25995 - DNA, 20 bp, Artificial Sequence
  Synthetic oligonucleotide; GAG chr11 5374759 5374778 5374775 +
gaagcgagaagggaagttta

SEQ ID NO: 25996 - DNA, 20 bp, Artificial Sequence
  Synthetic oligonucleotide; AAG chr11 5374766 5374785 5374782 +
gaagggaagtttagagaaaa

SEQ ID NO: 25997 - DNA, 20 bp, Artificial Sequence
  Synthetic oligonucleotide; AAG chr11 5374775 5374794 5374791 +
tttagagaaaaaagaataaa

SEQ ID NO: 25998 - DNA, 20 bp, Artificial Sequence
  Synthetic oligonucleotide; AAG chr11 5374787 5374806 5374803 +
agaataaaaagaaatgaaca

SEQ ID NO: 25999 - DNA, 20 bp, Artificial Sequence
  Synthetic oligonucleotide; AAG chr11 5374795 5374814 5374811 +
aagaaatgaacaaagcctcc

SEQ ID NO: 26000 - DNA, 20 bp, Artificial Sequence
  Synthetic oligonucleotide; TGG chr11 5374803 5374822 5374819 +
aacaaagcctccaagaaata

SEQ ID NO: 26001 - DNA, 20 bp, Artificial Sequence
  Synthetic oligonucleotide; GGG chr11 5374804 5374823 5374820 +
acaaagcctccaagaaatat

SEQ ID NO: 26002 - DNA, 20 bp, Artificial Sequence
  Synthetic oligonucleotide; AAG chr11 5374817 5374836 5374833 +
gaaatatgggactatgtgaa

SEQ ID NO: 26003 - DNA, 20 bp, Artificial Sequence
  Synthetic oligonucleotide; TAG chr11 5374828 5374847 5374844 +
ctatgtgaaaagatcaaatc

SEQ ID NO: 26004 - DNA, 20 bp, Artificial Sequence
  Synthetic oligonucleotide; AGG chr11 5374829 5374848 5374845 +
tatgtgaaaagatcaaatct

SEQ ID NO: 26005 - DNA, 20 bp, Artificial Sequence
  Synthetic oligonucleotide; TGG chr11 5374838 5374857 5374854 +
agatcaaatctaggtctgat

SEQ ID NO: 26006 - DNA, 20 bp, Artificial Sequence
  Synthetic oligonucleotide; AAG chr11 5374850 5374869 5374866 +
ggtctgattggtgtacctga

SEQ ID NO: 26007 - DNA, 20 bp, Artificial Sequence
  Synthetic oligonucleotide; CGG chr11 5374856 5374875 5374872 +
attggtgtacctgaaagtga

SEQ ID NO: 26008 - DNA, 20 bp, Artificial Sequence
  Synthetic oligonucleotide; GGG chr11 5374857 5374876 5374873 +
ttggtgtacctgaaagtgac

SEQ ID NO: 26009 - DNA, 20 bp, Artificial Sequence
  Synthetic oligonucleotide; GGG chr11 5374858 5374877 5374874 +
tggtgtacctgaaagtgacg

SEQ ID NO: 26010 - DNA, 20 bp, Artificial Sequence
  Synthetic oligonucleotide; GAG chr11 5374860 5374879 5374876 +
gtgtacctgaaagtgacggg

SEQ ID NO: 26011 - DNA, 20 bp, Artificial Sequence
  Synthetic oligonucleotide; AAG chr11 5374872 5374891 5374888 +
gtgacggggagaatcgaacc

SEQ ID NO: 26012 - DNA, 20 bp, Artificial Sequence
  Synthetic oligonucleotide; TGG chr11 5374876 5374895 5374892 +
cggggagaatcgaaccaagt

SEQ ID NO: 26013 - DNA, 20 bp, Artificial Sequence
  Synthetic oligonucleotide; CAG chr11 5374890 5374909 5374906 +
ccaagttggaaaacactctg

SEQ ID NO: 26014 - DNA, 20 bp, Artificial Sequence
  Synthetic oligonucleotide; AGG chr11 5374891 5374910 5374907 +
caagttggaaaacactctgc

SEQ ID NO: 26015 - DNA, 20 bp, Artificial Sequence
  Synthetic oligonucleotide; CAG chr11 5374902 5374921 5374918 +
acactctgcaggatattatc

SEQ ID NO: 26016 - DNA, 20 bp, Artificial Sequence
  Synthetic oligonucleotide; AGG chr11 5374903 5374922 5374919 +
cactctgcaggatattatcc

SEQ ID NO: 26017 - DNA, 20 bp, Artificial Sequence
  Synthetic oligonucleotide; GAG chr11 5374905 5374924 5374921 +
ctctgcaggatattatccag

SEQ ID NO: 26018 - DNA, 20 bp, Artificial Sequence
  Synthetic oligonucleotide; TAG chr11 5374921 5374940 5374937 +
ccaggagaacttccccaatc

SEQ ID NO: 26019 - DNA, 20 bp, Artificial Sequence
  Synthetic oligonucleotide; AAG chr11 5374925 5374944 5374941 +
gagaacttccccaatctagc

SEQ ID NO: 26020 - DNA, 20 bp, Artificial Sequence
  Synthetic oligonucleotide; AGG chr11 5374926 5374945 5374942 +
agaacttccccaatctagca

SEQ ID NO: 26021 - DNA, 20 bp, Artificial Sequence
  Synthetic oligonucleotide; CAG chr11 5374929 5374948 5374945 +
acttccccaatctagcaagg

SEQ ID NO: 26022 - DNA, 20 bp, Artificial Sequence
  Synthetic oligonucleotide; AGG chr11 5374930 5374949 5374946 +
cttccccaatctagcaaggc

SEQ ID NO: 26023 - DNA, 20 bp, Artificial Sequence
  Synthetic oligonucleotide; CAG chr11 5374941 5374960 5374957 +
tagcaaggcaggccaacatt

SEQ ID NO: 26024 - DNA, 20 bp, Artificial Sequence
  Synthetic oligonucleotide; CAG chr11 5374947 5374966 5374963 +
ggcaggccaacattcagatt

SEQ ID NO: 26025 - DNA, 20 bp, Artificial Sequence
  Synthetic oligonucleotide; AGG chr11 5374948 5374967 5374964 +
gcaggccaacattcagattc

SEQ ID NO: 26026 - DNA, 20 bp, Artificial Sequence
  Synthetic oligonucleotide; CAG chr11 5374956 5374975 5374972 +
acattcagattcaggaaata

SEQ ID NO: 26027 - DNA, 20 bp, Artificial Sequence
  Synthetic oligonucleotide; GAG chr11 5374958 5374977 5374974 +
attcagattcaggaaataca

SEQ ID NO: 26028 - DNA, 20 bp, Artificial Sequence
  Synthetic oligonucleotide; GAG chr11 5374982 5375001 5374998 +
acgccacaaacatactcctc

SEQ ID NO: 26029 - DNA, 20 bp, Artificial Sequence
  Synthetic oligonucleotide; AAG chr11 5374985 5375004 5375001 +
ccacaaacatactcctcgag

SEQ ID NO: 26030 - DNA, 20 bp, Artificial Sequence
  Synthetic oligonucleotide; GAG chr11 5374987 5375006 5375003 +
acaaacatactcctcgagaa

SEQ ID NO: 26031 - DNA, 20 bp, Artificial Sequence
  Synthetic oligonucleotide; AAG chr11 5374997 5375016 5375013 +
tcctcgagaagagcaactcc

SEQ ID NO: 26032 - DNA, 20 bp, Artificial Sequence
  Synthetic oligonucleotide; CAG chr11 5375012 5375031 5375028 +
actccaagacacataattgt

SEQ ID NO: 26033 - DNA, 20 bp, Artificial Sequence
  Synthetic oligonucleotide; AAG chr11 5375023 5375042 5375039 +
cataattgtcagattcacca

SEQ ID NO: 26034 - DNA, 20 bp, Artificial Sequence
  Synthetic oligonucleotide; AAG chr11 5375034 5375053 5375050 +
gattcaccaaagttgaaatg

SEQ ID NO: 26035 - DNA, 20 bp, Artificial Sequence
  Synthetic oligonucleotide; AGG chr11 5375035 5375054 5375051 +
attcaccaaagttgaaatga

SEQ ID NO: 26036 - DNA, 20 bp, Artificial Sequence
  Synthetic oligonucleotide; AAG chr11 5375048 5375067 5375064 +
gaaatgaaggaaaaaatgtt

SEQ ID NO: 26037 - DNA, 20 bp, Artificial Sequence
  Synthetic oligonucleotide; AGG chr11 5375049 5375068 5375065 +
aaatgaaggaaaaaatgtta

SEQ ID NO: 26038 - DNA, 20 bp, Artificial Sequence
  Synthetic oligonucleotide; GGG chr11 5375050 5375069 5375066 +
aatgaaggaaaaaatgttaa

SEQ ID NO: 26039 - DNA, 20 bp, Artificial Sequence
  Synthetic oligonucleotide; CAG chr11 5375053 5375072 5375069 +
gaaggaaaaaatgttaaggg

SEQ ID NO: 26040 - DNA, 20 bp, Artificial Sequence
  Synthetic oligonucleotide; CAG chr11 5375057 5375076 5375073 +
gaaaaaatgttaagggcagc

SEQ ID NO: 26041 - DNA, 20 bp, Artificial Sequence
  Synthetic oligonucleotide; GAG chr11 5375059 5375078 5375075 +
aaaaatgttaagggcagcca

SEQ ID NO: 26042 - DNA, 20 bp, Artificial Sequence
  Synthetic oligonucleotide; GAG chr11 5375061 5375080 5375077 +
aaatgttaagggcagccaga

SEQ ID NO: 26043 - DNA, 20 bp, Artificial Sequence
  Synthetic oligonucleotide; AAG chr11 5375065 5375084 5375081 +
gttaagggcagccagagaga

SEQ ID NO: 26044 - DNA, 20 bp, Artificial Sequence
  Synthetic oligonucleotide; AGG chr11 5375066 5375085 5375082 +
ttaagggcagccagagagaa

SEQ ID NO: 26045 - DNA, 20 bp, Artificial Sequence
  Synthetic oligonucleotide; CGG chr11 5375070 5375089 5375086 +
gggcagccagagagaaaggt

SEQ ID NO: 26046 - DNA, 20 bp, Artificial Sequence
  Synthetic oligonucleotide; GGG chr11 5375071 5375090 5375087 +
ggcagccagagagaaaggtc

SEQ ID NO: 26047 - DNA, 20 bp, Artificial Sequence
  Synthetic oligonucleotide; AAG chr11 5375083 5375102 5375099 +
gaaaggtcgggttacccaca

SEQ ID NO: 26048 - DNA, 20 bp, Artificial Sequence
  Synthetic oligonucleotide; AGG chr11 5375084 5375103 5375100 +
aaaggtcgggttacccacaa

SEQ ID NO: 26049 - DNA, 20 bp, Artificial Sequence
  Synthetic oligonucleotide; GGG chr11 5375085 5375104 5375101 +
aaggtcgggttacccacaaa

SEQ ID NO: 26050 - DNA, 20 bp, Artificial Sequence
  Synthetic oligonucleotide; AAG chr11 5375088 5375107 5375104 +
gtcgggttacccacaaaggg

SEQ ID NO: 26051 - DNA, 20 bp, Artificial Sequence
  Synthetic oligonucleotide; CAG chr11 5375096 5375115 5375112 +
acccacaaagggaagcccat

SEQ ID NO: 26052 - DNA, 20 bp, Artificial Sequence
  Synthetic oligonucleotide; CAG chr11 5375104 5375123 5375120 +
agggaagcccatcagactaa

SEQ ID NO: 26053 - DNA, 20 bp, Artificial Sequence
  Synthetic oligonucleotide; CAG chr11 5375107 5375126 5375123 +
gaagcccatcagactaacag

SEQ ID NO: 26054 - DNA, 20 bp, Artificial Sequence
  Synthetic oligonucleotide; TGG chr11 5375116 5375135 5375132 +
cagactaacagcagctctct

SEQ ID NO: 26055 - DNA, 20 bp, Artificial Sequence
  Synthetic oligonucleotide; CAG chr11 5375119 5375138 5375135 +
actaacagcagctctcttgg

SEQ ID NO: 26056 - DNA, 20 bp, Artificial Sequence
  Synthetic oligonucleotide; AAG chr11 5375131 5375150 5375147 +
tctcttggcagaaactctac

SEQ ID NO: 26057 - DNA, 20 bp, Artificial Sequence
  Synthetic oligonucleotide; CAG chr11 5375135 5375154 5375151 +
ttggcagaaactctacaagc

SEQ ID NO: 26058 - DNA, 20 bp, Artificial Sequence
  Synthetic oligonucleotide; AAG chr11 5375138 5375157 5375154 +
gcagaaactctacaagccag

SEQ ID NO: 26059 - DNA, 20 bp, Artificial Sequence
  Synthetic oligonucleotide; GAG chr11 5375140 5375159 5375156 +
agaaactctacaagccagaa

SEQ ID NO: 26060 - DNA, 20 bp, Artificial Sequence
  Synthetic oligonucleotide; GAG chr11 5375142 5375161 5375158 +
aaactctacaagccagaaga

SEQ ID NO: 26061 - DNA, 20 bp, Artificial Sequence
  Synthetic oligonucleotide; TGG chr11 5375145 5375164 5375161 +
ctctacaagccagaagagag

SEQ ID NO: 26062 - DNA, 20 bp, Artificial Sequence
  Synthetic oligonucleotide; GGG chr11 5375146 5375165 5375162 +
tctacaagccagaagagagt

SEQ ID NO: 26063 - DNA, 20 bp, Artificial Sequence
  Synthetic oligonucleotide; GGG chr11 5375147 5375166 5375163 +
ctacaagccagaagagagtg

SEQ ID NO: 26064 - DNA, 20 bp, Artificial Sequence
  Synthetic oligonucleotide; GGG chr11 5375148 5375167 5375164 +
tacaagccagaagagagtgg

SEQ ID NO: 26065 - DNA, 20 bp, Artificial Sequence
  Synthetic oligonucleotide; AAG chr11 5375170 5375189 5375186 +
gccaatattcaacatcctta

SEQ ID NO: 26066 - DNA, 20 bp, Artificial Sequence
  Synthetic oligonucleotide; AGG chr11 5375171 5375190 5375187 +
ccaatattcaacatccttaa

SEQ ID NO: 26067 - DNA, 20 bp, Artificial Sequence
  Synthetic oligonucleotide; AAG chr11 5375175 5375194 5375191 +
tattcaacatccttaaagga

SEQ ID NO: 26068 - DNA, 20 bp, Artificial Sequence
  Synthetic oligonucleotide; CAG chr11 5375189 5375208 5375205 +
aaaggaaagaattttcaaca

SEQ ID NO: 26069 - DNA, 20 bp, Artificial Sequence
  Synthetic oligonucleotide; CAG chr11 5375203 5375222 5375219 +
tcaacacagaatttaatatc

SEQ ID NO: 26070 - DNA, 20 bp, Artificial Sequence
  Synthetic oligonucleotide; AAG chr11 5375213 5375232 5375229 +
atttaatatccagccaaact

SEQ ID NO: 26071 - DNA, 20 bp, Artificial Sequence
  Synthetic oligonucleotide; AAG chr11 5375222 5375241 5375238 +
ccagccaaactaagcttcat

SEQ ID NO: 26072 - DNA, 20 bp, Artificial Sequence
  Synthetic oligonucleotide; AAG chr11 5375227 5375246 5375243 +
caaactaagcttcataagtg

SEQ ID NO: 26073 - DNA, 20 bp, Artificial Sequence
  Synthetic oligonucleotide; AGG chr11 5375228 5375247 5375244 +
aaactaagcttcataagtga

SEQ ID NO: 26074 - DNA, 20 bp, Artificial Sequence
  Synthetic oligonucleotide; GAG chr11 5375230 5375249 5375246 +
actaagcttcataagtgaag

SEQ ID NO: 26075 - DNA, 20 bp, Artificial Sequence
  Synthetic oligonucleotide; CAG chr11 5375248 5375267 5375264 +
aggagaaataaaatacttta

SEQ ID NO: 26076 - DNA, 20 bp, Artificial Sequence
  Synthetic oligonucleotide; AAG chr11 5375253 5375272 5375269 +
aaataaaatactttacagac

SEQ ID NO: 26077 - DNA, 20 bp, Artificial Sequence
  Synthetic oligonucleotide; GAG chr11 5375264 5375283 5375280 +
tttacagacaagcaaatgct

SEQ ID NO: 26078 - DNA, 20 bp, Artificial Sequence
  Synthetic oligonucleotide; GAG chr11 5375266 5375285 5375282 +
tacagacaagcaaatgctga

SEQ ID NO: 26079 - DNA, 20 bp, Artificial Sequence
  Synthetic oligonucleotide; CAG chr11 5375282 5375301 5375298 +
ctgagagattttgtcatcac

SEQ ID NO: 26080 - DNA, 20 bp, Artificial Sequence
  Synthetic oligonucleotide; AGG chr11 5375283 5375302 5375299 +
tgagagattttgtcatcacc

SEQ ID NO: 26081 - DNA, 20 bp, Artificial Sequence
  Synthetic oligonucleotide; AAG chr11 5375296 5375315 5375312 +
catcaccaggcctgacctaa

SEQ ID NO: 26082 - DNA, 20 bp, Artificial Sequence
  Synthetic oligonucleotide; GAG chr11 5375298 5375317 5375314 +
tcaccaggcctgacctaaaa

SEQ ID NO: 26083 - DNA, 20 bp, Artificial Sequence
  Synthetic oligonucleotide; AAG chr11 5375307 5375326 5375323 +
ctgacctaaaagagctcctg

SEQ ID NO: 26084 - DNA, 20 bp, Artificial Sequence
  Synthetic oligonucleotide; AGG chr11 5375308 5375327 5375324 +
tgacctaaaagagctcctga

SEQ ID NO: 26085 - DNA, 20 bp, Artificial Sequence
  Synthetic oligonucleotide; AAG chr11 5375311 5375330 5375327 +
cctaaaagagctcctgaagg

SEQ ID NO: 26086 - DNA, 20 bp, Artificial Sequence
  Synthetic oligonucleotide; TGG chr11 5375323 5375342 5375339 +
cctgaaggaagcactaaaca

SEQ ID NO: 26087 - DNA, 20 bp, Artificial Sequence
  Synthetic oligonucleotide; AAG chr11 5375327 5375346 5375343 +
aaggaagcactaaacatgga

SEQ ID NO: 26088 - DNA, 20 bp, Artificial Sequence
  Synthetic oligonucleotide; AGG chr11 5375328 5375347 5375344 +
aggaagcactaaacatggaa

SEQ ID NO: 26089 - DNA, 20 bp, Artificial Sequence
  Synthetic oligonucleotide; CGG chr11 5375337 5375356 5375353 +
taaacatggaaaggcacaac

SEQ ID NO: 26090 - DNA, 20 bp, Artificial Sequence
  Synthetic oligonucleotide; CAG chr11 5375343 5375362 5375359 +
tggaaaggcacaaccggtac

SEQ ID NO: 26091 - DNA, 20 bp, Artificial Sequence
  Synthetic oligonucleotide; CAG chr11 5375358 5375377 5375374 +
ggtaccagccactgcaaaat

SEQ ID NO: 26092 - DNA, 20 bp, Artificial Sequence
  Synthetic oligonucleotide; AGG chr11 5375359 5375378 5375375 +
gtaccagccactgcaaaatc

SEQ ID NO: 26093 - DNA, 20 bp, Artificial Sequence
  Synthetic oligonucleotide; AAG chr11 5375372 5375391 5375388 +
caaaatcaggccaaaatgtg

SEQ ID NO: 26094 - DNA, 20 bp, Artificial Sequence
  Synthetic oligonucleotide; AAG chr11 5375381 5375400 5375397 +
gccaaaatgtgaagaccatc

SEQ ID NO: 26095 - DNA, 20 bp, Artificial Sequence
  Synthetic oligonucleotide; TAG chr11 5375386 5375405 5375402 +
aatgtgaagaccatcaagac

SEQ ID NO: 26096 - DNA, 20 bp, Artificial Sequence
  Synthetic oligonucleotide; AGG chr11 5375387 5375406 5375403 +
atgtgaagaccatcaagact

SEQ ID NO: 26097 - DNA, 20 bp, Artificial Sequence
  Synthetic oligonucleotide; AAG chr11 5375390 5375409 5375406 +
tgaagaccatcaagactagg

SEQ ID NO: 26098 - DNA, 20 bp, Artificial Sequence
  Synthetic oligonucleotide; GAG chr11 5375410 5375429 5375426 +
aagaaactgcatcaactaac

SEQ ID NO: 26099 - DNA, 20 bp, Artificial Sequence
  Synthetic oligonucleotide; CAG chr11 5375422 5375441 5375438 +
caactaacgagcaaaataac

SEQ ID NO: 26100 - DNA, 20 bp, Artificial Sequence
  Synthetic oligonucleotide; CAG chr11 5375437 5375456 5375453 +
ataaccagctatcataatga

SEQ ID NO: 26101 - DNA, 20 bp, Artificial Sequence
  Synthetic oligonucleotide; AGG chr11 5375438 5375457 5375454 +
taaccagctatcataatgac

SEQ ID NO: 26102 - DNA, 20 bp, Artificial Sequence
  Synthetic oligonucleotide; TGG chr11 5375479 5375498 5375495 +
atattaactttaaatgtaaa

SEQ ID NO: 26103 - DNA, 20 bp, Artificial Sequence
  Synthetic oligonucleotide; AAG chr11 5375485 5375504 5375501 +
actttaaatgtaaatggact

SEQ ID NO: 26104 - DNA, 20 bp, Artificial Sequence
  Synthetic oligonucleotide; AAG chr11 5375500 5375519 5375516 +
ggactaagtgctccaattga

SEQ ID NO: 26105 - DNA, 20 bp, Artificial Sequence
  Synthetic oligonucleotide; CAG chr11 5375506 5375525 5375522 +
agtgctccaattgaaagaca

SEQ ID NO: 26106 - DNA, 20 bp, Artificial Sequence
  Synthetic oligonucleotide; TGG chr11 5375511 5375530 5375527 +
tccaattgaaagacacagac

SEQ ID NO: 26107 - DNA, 20 bp, Artificial Sequence
  Synthetic oligonucleotide; TGG chr11 5375519 5375538 5375535 +
aaagacacagactggcaaat

SEQ ID NO: 26108 - DNA, 20 bp, Artificial Sequence
  Synthetic oligonucleotide; AAG chr11 5375525 5375544 5375541 +
acagactggcaaattggata

SEQ ID NO: 26109 - DNA, 20 bp, Artificial Sequence
  Synthetic oligonucleotide; GAG chr11 5375527 5375546 5375543 +
agactggcaaattggataaa

SEQ ID NO: 26110 - DNA, 20 bp, Artificial Sequence
  Synthetic oligonucleotide; CAG chr11 5375536 5375555 5375552 +
aattggataaagagtgtatt

SEQ ID NO: 26111 - DNA, 20 bp, Artificial Sequence
  Synthetic oligonucleotide; AGG chr11 5375537 5375556 5375553 +
attggataaagagtgtattc

SEQ ID NO: 26112 - DNA, 20 bp, Artificial Sequence
  Synthetic oligonucleotide; TAG chr11 5375568 5375587 5375584 +
ctcatgtgcacacacacaca

SEQ ID NO: 26113 - DNA, 20 bp, Artificial Sequence
  Synthetic oligonucleotide; AGG chr11 5375569 5375588 5375585 +
tcatgtgcacacacacacat

SEQ ID NO: 26114 - DNA, 20 bp, Artificial Sequence
  Synthetic oligonucleotide; AAG chr11 5375582 5375601 5375598 +
cacacataggctcaaaataa

SEQ ID NO: 26115 - DNA, 20 bp, Artificial Sequence
  Synthetic oligonucleotide; AGG chr11 5375583 5375602 5375599 +
acacataggctcaaaataaa

SEQ ID NO: 26116 - DNA, 20 bp, Artificial Sequence
  Synthetic oligonucleotide; TGG chr11 5375587 5375606 5375603 +
ataggctcaaaataaaagga

SEQ ID NO: 26117 - DNA, 20 bp, Artificial Sequence
  Synthetic oligonucleotide; GAG chr11 5375589 5375608 5375605 +
aggctcaaaataaaaggatg

SEQ ID NO: 26118 - DNA, 20 bp, Artificial Sequence
  Synthetic oligonucleotide; AGG chr11 5375590 5375609 5375606 +
ggctcaaaataaaaggatgg

SEQ ID NO: 26119 - DNA, 20 bp, Artificial Sequence
  Synthetic oligonucleotide; AAG chr11 5375593 5375612 5375609 +
tcaaaataaaaggatggagg

SEQ ID NO: 26120 - DNA, 20 bp, Artificial Sequence
  Synthetic oligonucleotide; AAG chr11 5375603 5375622 5375619 +
aggatggaggaagatctacc

SEQ ID NO: 26121 - DNA, 20 bp, Artificial Sequence
  Synthetic oligonucleotide; TGG chr11 5375610 5375629 5375626 +
aggaagatctaccaagcaaa

SEQ ID NO: 26122 - DNA, 20 bp, Artificial Sequence
  Synthetic oligonucleotide; AAG chr11 5375623 5375642 5375639 +
aagcaaatggaaaacaaaaa

SEQ ID NO: 26123 - DNA, 20 bp, Artificial Sequence
  Synthetic oligonucleotide; AGG chr11 5375624 5375643 5375640 +
agcaaatggaaaacaaaaaa

SEQ ID NO: 26124 - DNA, 20 bp, Artificial Sequence
  Synthetic oligonucleotide; CAG chr11 5375627 5375646 5375643 +
aaatggaaaacaaaaaaagg

SEQ ID NO: 26125 - DNA, 20 bp, Artificial Sequence
  Synthetic oligonucleotide; AGG chr11 5375628 5375647 5375644 +
aatggaaaacaaaaaaaggc

SEQ ID NO: 26126 - DNA, 20 bp, Artificial Sequence
  Synthetic oligonucleotide; GGG chr11 5375629 5375648 5375645 +
atggaaaacaaaaaaaggca

SEQ ID NO: 26127 - DNA, 20 bp, Artificial Sequence
  Synthetic oligonucleotide; GGG chr11 5375630 5375649 5375646 +
tggaaaacaaaaaaaggcag

SEQ ID NO: 26128 - DNA, 20 bp, Artificial Sequence
  Synthetic oligonucleotide; TAG chr11 5375642 5375661 5375658 +
aaaggcaggggttgcaatcc

SEQ ID NO: 26129 - DNA, 20 bp, Artificial Sequence
  Synthetic oligonucleotide; CAG chr11 5375657 5375676 5375673 +
aatcctagtctctgataaaa

SEQ ID NO: 26130 - DNA, 20 bp, Artificial Sequence
  Synthetic oligonucleotide; AGG chr11 5375658 5375677 5375674 +
atcctagtctctgataaaac

SEQ ID NO: 26131 - DNA, 20 bp, Artificial Sequence
  Synthetic oligonucleotide; AAG chr11 5375674 5375693 5375690 +
aaacaggctttaaaccaaca

SEQ ID NO: 26132 - DNA, 20 bp, Artificial Sequence
  Synthetic oligonucleotide; AAG chr11 5375682 5375701 5375698 +
tttaaaccaacaaagatcaa

SEQ ID NO: 26133 - DNA, 20 bp, Artificial Sequence
  Synthetic oligonucleotide; GAG chr11 5375684 5375703 5375700 +
taaaccaacaaagatcaaaa

SEQ ID NO: 26134 - DNA, 20 bp, Artificial Sequence
  Synthetic oligonucleotide; AAG chr11 5375690 5375709 5375706 +
aacaaagatcaaaagagaca

SEQ ID NO: 26135 - DNA, 20 bp, Artificial Sequence
  Synthetic oligonucleotide; AAG chr11 5375693 5375712 5375709 +
aaagatcaaaagagacaaag

SEQ ID NO: 26136 - DNA, 20 bp, Artificial Sequence
  Synthetic oligonucleotide; AGG chr11 5375694 5375713 5375710 +
aagatcaaaagagacaaaga

SEQ ID NO: 26137 - DNA, 20 bp, Artificial Sequence
  Synthetic oligonucleotide; TGG chr11 5375708 5375727 5375724 +
caaagaaggccattacataa

SEQ ID NO: 26138 - DNA, 20 bp, Artificial Sequence
  Synthetic oligonucleotide; AAG chr11 5375713 5375732 5375729 +
aaggccattacataatggta

SEQ ID NO: 26139 - DNA, 20 bp, Artificial Sequence
  Synthetic oligonucleotide; AGG chr11 5375714 5375733 5375730 +
aggccattacataatggtaa

SEQ ID NO: 26140 - DNA, 20 bp, Artificial Sequence
  Synthetic oligonucleotide; GGG chr11 5375715 5375734 5375731 +
ggccattacataatggtaaa

SEQ ID NO: 26141 - DNA, 20 bp, Artificial Sequence
  Synthetic oligonucleotide; AAG chr11 5375729 5375748 5375745 +
ggtaaagggatcaattcaac

SEQ ID NO: 26142 - DNA, 20 bp, Artificial Sequence
  Synthetic oligonucleotide; AAG chr11 5375732 5375751 5375748 +
aaagggatcaattcaacaag

SEQ ID NO: 26143 - DNA, 20 bp, Artificial Sequence
  Synthetic oligonucleotide; GAG chr11 5375734 5375753 5375750 +
agggatcaattcaacaagaa

SEQ ID NO: 26144 - DNA, 20 bp, Artificial Sequence
  Synthetic oligonucleotide; CAG chr11 5375768 5375787 5375784 +
aaatatatatgcacccaata

SEQ ID NO: 26145 - DNA, 20 bp, Artificial Sequence
  Synthetic oligonucleotide; AGG chr11 5375769 5375788 5375785 +
aatatatatgcacccaatac

SEQ ID NO: 26146 - DNA, 20 bp, Artificial Sequence
  Synthetic oligonucleotide; GAG chr11 5375771 5375790 5375787 +
tatatatgcacccaatacag

SEQ ID NO: 26147 - DNA, 20 bp, Artificial Sequence
  Synthetic oligonucleotide; CAG chr11 5375778 5375797 5375794 +
gcacccaatacaggagcacc

SEQ ID NO: 26148 - DNA, 20 bp, Artificial Sequence
  Synthetic oligonucleotide; AAG chr11 5375788 5375807 5375804 +
caggagcacccagattcata

SEQ ID NO: 26149 - DNA, 20 bp, Artificial Sequence
  Synthetic oligonucleotide; AAG chr11 5375792 5375811 5375808 +
agcacccagattcataaagc

SEQ ID NO: 26150 - DNA, 20 bp, Artificial Sequence
  Synthetic oligonucleotide; TAG chr11 5375799 5375818 5375815 +
agattcataaagcaagtcct

SEQ ID NO: 26151 - DNA, 20 bp, Artificial Sequence
  Synthetic oligonucleotide; GAG chr11 5375801 5375820 5375817 +
attcataaagcaagtcctta

SEQ ID NO: 26152 - DNA, 20 bp, Artificial Sequence
  Synthetic oligonucleotide; AAG chr11 5375811 5375830 5375827 +
caagtccttagagacctaca

SEQ ID NO: 26153 - DNA, 20 bp, Artificial Sequence
  Synthetic oligonucleotide; GAG chr11 5375813 5375832 5375829 +
agtccttagagacctacaaa

SEQ ID NO: 26154 - DNA, 20 bp, Artificial Sequence
  Synthetic oligonucleotide; TAG chr11 5375819 5375838 5375835 +
tagagacctacaaagagact

SEQ ID NO: 26155 - DNA, 20 bp, Artificial Sequence
  Synthetic oligonucleotide; TGG chr11 5375840 5375859 5375856 +
agactcccacactttaataa

SEQ ID NO: 26156 - DNA, 20 bp, Artificial Sequence
  Synthetic oligonucleotide; GGG chr11 5375841 5375860 5375857 +
gactcccacactttaataat

SEQ ID NO: 26157 - DNA, 20 bp, Artificial Sequence
  Synthetic oligonucleotide; GAG chr11 5375843 5375862 5375859 +
ctcccacactttaataatgg

SEQ ID NO: 26158 - DNA, 20 bp, Artificial Sequence
  Synthetic oligonucleotide; TAG chr11 5375870 5375889 5375886 +
taataccccactgtcaacat

SEQ ID NO: 26159 - DNA, 20 bp, Artificial Sequence
  Synthetic oligonucleotide; CAG chr11 5375874 5375893 5375890 +
accccactgtcaacattaga

SEQ ID NO: 26160 - DNA, 20 bp, Artificial Sequence
  Synthetic oligonucleotide; GAG chr11 5375883 5375902 5375899 +
tcaacattagacagatcaac

SEQ ID NO: 26161 - DNA, 20 bp, Artificial Sequence
  Synthetic oligonucleotide; CAG chr11 5375887 5375906 5375903 +
cattagacagatcaacgaga

SEQ ID NO: 26162 - DNA, 20 bp, Artificial Sequence
  Synthetic oligonucleotide; AAG chr11 5375891 5375910 5375907 +
agacagatcaacgagacaga

SEQ ID NO: 26163 - DNA, 20 bp, Artificial Sequence
  Synthetic oligonucleotide; AAG chr11 5375899 5375918 5375915 +
caacgagacagaaagttaac

SEQ ID NO: 26164 - DNA, 20 bp, Artificial Sequence
  Synthetic oligonucleotide; AGG chr11 5375900 5375919 5375916 +
aacgagacagaaagttaaca

SEQ ID NO: 26165 - DNA, 20 bp, Artificial Sequence
  Synthetic oligonucleotide; CAG chr11 5375908 5375927 5375924 +
agaaagttaacaaggatatc

SEQ ID NO: 26166 - DNA, 20 bp, Artificial Sequence
  Synthetic oligonucleotide; AGG chr11 5375909 5375928 5375925 +
gaaagttaacaaggatatcc

SEQ ID NO: 26167 - DNA, 20 bp, Artificial Sequence
  Synthetic oligonucleotide; CAG chr11 5375921 5375940 5375937 +
ggatatccaggaattgaaca

SEQ ID NO: 26168 - DNA, 20 bp, Artificial Sequence
  Synthetic oligonucleotide; AAG chr11 5375933 5375952 5375949 +
attgaacacagctctgcacc

SEQ ID NO: 26169 - DNA, 20 bp, Artificial Sequence
  Synthetic oligonucleotide; CAG chr11 5375936 5375955 5375952 +
gaacacagctctgcaccaag

SEQ ID NO: 26170 - DNA, 20 bp, Artificial Sequence
  Synthetic oligonucleotide; TAG chr11 5375945 5375964 5375961 +
tctgcaccaagcagacctaa

SEQ ID NO: 26171 - DNA, 20 bp, Artificial Sequence
  Synthetic oligonucleotide; CAG chr11 5375955 5375974 5375971 +
gcagacctaatagacatcta

SEQ ID NO: 26172 - DNA, 20 bp, Artificial Sequence
  Synthetic oligonucleotide; CAG chr11 5375978 5375997 5375994 +
aactctccaccccaaatcaa

SEQ ID NO: 26173 - DNA, 20 bp, Artificial Sequence
  Synthetic oligonucleotide; CAG chr11 5375997 5376016 5376013 +
acagaatatacatttttttt

SEQ ID NO: 26174 - DNA, 20 bp, Artificial Sequence
  Synthetic oligonucleotide; TGG chr11 5376037 5376056 5376053 +
tccaaaattgaccacatact

SEQ ID NO: 26175 - DNA, 20 bp, Artificial Sequence
  Synthetic oligonucleotide; AAG chr11 5376040 5376059 5376056 +
aaaattgaccacatacttgg

SEQ ID NO: 26176 - DNA, 20 bp, Artificial Sequence
  Synthetic oligonucleotide; AAG chr11 5376045 5376064 5376061 +
tgaccacatacttggaagta

SEQ ID NO: 26177 - DNA, 20 bp, Artificial Sequence
  Synthetic oligonucleotide; CAG chr11 5376055 5376074 5376071 +
cttggaagtaaagctctcct

SEQ ID NO: 26178 - DNA, 20 bp, Artificial Sequence
  Synthetic oligonucleotide; AAG chr11 5376067 5376086 5376083 +
gctctcctcagcaaatataa

SEQ ID NO: 26179 - DNA, 20 bp, Artificial Sequence
  Synthetic oligonucleotide; CAG chr11 5376072 5376091 5376088 +
cctcagcaaatataaaagaa

SEQ ID NO: 26180 - DNA, 20 bp, Artificial Sequence
  Synthetic oligonucleotide; CAG chr11 5376096 5376115 5376112 +
aattataacaaactgtctct

SEQ ID NO: 26181 - DNA, 20 bp, Artificial Sequence
  Synthetic oligonucleotide; CAG chr11 5376103 5376122 5376119 +
acaaactgtctctcagacca

SEQ ID NO: 26182 - DNA, 20 bp, Artificial Sequence
  Synthetic oligonucleotide; TAG chr11 5376117 5376136 5376133 +
agaccacagtgcaatcaaac

SEQ ID NO: 26183 - DNA, 20 bp, Artificial Sequence
  Synthetic oligonucleotide; CAG chr11 5376124 5376143 5376140 +
agtgcaatcaaactagaact

SEQ ID NO: 26184 - DNA, 20 bp, Artificial Sequence
  Synthetic oligonucleotide; AGG chr11 5376125 5376144 5376141 +
gtgcaatcaaactagaactc

SEQ ID NO: 26185 - DNA, 20 bp, Artificial Sequence
  Synthetic oligonucleotide; AAG chr11 5376131 5376150 5376147 +
tcaaactagaactcaggatt

SEQ ID NO: 26186 - DNA, 20 bp, Artificial Sequence
  Synthetic oligonucleotide; TGG chr11 5376161 5376180 5376177 +
ctcaaaaccactcaactaca

SEQ ID NO: 26187 - DNA, 20 bp, Artificial Sequence
  Synthetic oligonucleotide; TGG chr11 5376194 5376213 5376210 +
acctgctcctgaatgactac

SEQ ID NO: 26188 - DNA, 20 bp, Artificial Sequence
  Synthetic oligonucleotide; GGG chr11 5376195 5376214 5376211 +
cctgctcctgaatgactact

SEQ ID NO: 26189 - DNA, 20 bp, Artificial Sequence
  Synthetic oligonucleotide; AAG chr11 5376212 5376231 5376228 +
actgggtacataacgaaatg

SEQ ID NO: 26190 - DNA, 20 bp, Artificial Sequence
  Synthetic oligonucleotide; AGG chr11 5376213 5376232 5376229 +
ctgggtacataacgaaatga

SEQ ID NO: 26191 - DNA, 20 bp, Artificial Sequence
  Synthetic oligonucleotide; CAG chr11 5376216 5376235 5376232 +
ggtacataacgaaatgaagg

SEQ ID NO: 26192 - DNA, 20 bp, Artificial Sequence
  Synthetic oligonucleotide; AAG chr11 5376224 5376243 5376240 +
acgaaatgaaggcagaaata

SEQ ID NO: 26193 - DNA, 20 bp, Artificial Sequence
  Synthetic oligonucleotide; GAG chr11 5376245 5376264 5376261 +
agatgttctttgaaaccaat

SEQ ID NO: 26194 - DNA, 20 bp, Artificial Sequence
  Synthetic oligonucleotide; AAG chr11 5376252 5376271 5376268 +
ctttgaaaccaatgagaaca

SEQ ID NO: 26195 - DNA, 20 bp, Artificial Sequence
  Synthetic oligonucleotide; CAG chr11 5376266 5376285 5376282 +
agaacaaagacacaacatac

SEQ ID NO: 26196 - DNA, 20 bp, Artificial Sequence
  Synthetic oligonucleotide; TGG chr11 5376275 5376294 5376291 +
acacaacataccagaatctc

SEQ ID NO: 26197 - DNA, 20 bp, Artificial Sequence
  Synthetic oligonucleotide; GGG chr11 5376276 5376295 5376292 +
cacaacataccagaatctct

SEQ ID NO: 26198 - DNA, 20 bp, Artificial Sequence
  Synthetic oligonucleotide; CAG chr11 5376291 5376310 5376307 +
tctctgggacacattcgaat

SEQ ID NO: 26199 - DNA, 20 bp, Artificial Sequence
  Synthetic oligonucleotide; TAG chr11 5376298 5376317 5376314 +
gacacattcgaatcagtgtg

SEQ ID NO: 26200 - DNA, 20 bp, Artificial Sequence
  Synthetic oligonucleotide; AGG chr11 5376299 5376318 5376315 +
acacattcgaatcagtgtgt

SEQ ID NO: 26201 - DNA, 20 bp, Artificial Sequence
  Synthetic oligonucleotide; GGG chr11 5376300 5376319 5376316 +
cacattcgaatcagtgtgta

SEQ ID NO: 26202 - DNA, 20 bp, Artificial Sequence
  Synthetic oligonucleotide; GGG chr11 5376301 5376320 5376317 +
acattcgaatcagtgtgtag

SEQ ID NO: 26203 - DNA, 20 bp, Artificial Sequence
  Synthetic oligonucleotide; GGG chr11 5376302 5376321 5376318 +
cattcgaatcagtgtgtagg

SEQ ID NO: 26204 - DNA, 20 bp, Artificial Sequence
  Synthetic oligonucleotide; TAG chr11 5376312 5376331 5376328 +
agtgtgtagggggaaattta

SEQ ID NO: 26205 - DNA, 20 bp, Artificial Sequence
  Synthetic oligonucleotide; AAG chr11 5376329 5376348 5376345 +
ttatagcactaaacgcccac

SEQ ID NO: 26206 - DNA, 20 bp, Artificial Sequence
  Synthetic oligonucleotide; GAG chr11 5376331 5376350 5376347 +
atagcactaaacgcccacaa

SEQ ID NO: 26207 - DNA, 20 bp, Artificial Sequence
  Synthetic oligonucleotide; AAG chr11 5376335 5376354 5376351 +
cactaaacgcccacaagaga

SEQ ID NO: 26208 - DNA, 20 bp, Artificial Sequence
  Synthetic oligonucleotide; AAG chr11 5376339 5376358 5376355 +
aaacgcccacaagagaaagc

SEQ ID NO: 26209 - DNA, 20 bp, Artificial Sequence
  Synthetic oligonucleotide; AAG chr11 5376343 5376362 5376359 +
gcccacaagagaaagcaaga

SEQ ID NO: 26210 - DNA, 20 bp, Artificial Sequence
  Synthetic oligonucleotide; AAG chr11 5376378 5376397 5376394 +
caccctaacatcacaattaa

SEQ ID NO: 26211 - DNA, 20 bp, Artificial Sequence
  Synthetic oligonucleotide; TAG chr11 5376384 5376403 5376400 +
aacatcacaattaaaagaac

SEQ ID NO: 26212 - DNA, 20 bp, Artificial Sequence
  Synthetic oligonucleotide; AAG chr11 5376389 5376408 5376405 +
cacaattaaaagaactagat

SEQ ID NO: 26213 - DNA, 20 bp, Artificial Sequence
  Synthetic oligonucleotide; AAG chr11 5376393 5376412 5376409 +
attaaaagaactagataagc

SEQ ID NO: 26214 - DNA, 20 bp, Artificial Sequence
  Synthetic oligonucleotide; GAG chr11 5376395 5376414 5376411 +
taaaagaactagataagcaa

SEQ ID NO: 26215 - DNA, 20 bp, Artificial Sequence
  Synthetic oligonucleotide; AAG chr11 5376411 5376430 5376427 +
gcaagagcaaacacattcaa

SEQ ID NO: 26216 - DNA, 20 bp, Artificial Sequence
  Synthetic oligonucleotide; TAG chr11 5376415 5376434 5376431 +
gagcaaacacattcaaaagc

SEQ ID NO: 26217 - DNA, 20 bp, Artificial Sequence
  Synthetic oligonucleotide; CAG chr11 5376418 5376437 5376434 +
caaacacattcaaaagctag

SEQ ID NO: 26218 - DNA, 20 bp, Artificial Sequence
  Synthetic oligonucleotide; AAG chr11 5376421 5376440 5376437 +
acacattcaaaagctagcag

SEQ ID NO: 26219 - DNA, 20 bp, Artificial Sequence
  Synthetic oligonucleotide; AAG chr11 5376426 5376445 5376442 +
ttcaaaagctagcagaagtc

SEQ ID NO: 26220 - DNA, 20 bp, Artificial Sequence
  Synthetic oligonucleotide; CAG chr11 5376442 5376461 5376458 +
agtcaagaaataactaaaat

SEQ ID NO: 26221 - DNA, 20 bp, Artificial Sequence
  Synthetic oligonucleotide; GAG chr11 5376444 5376463 5376460 +
tcaagaaataactaaaatca

SEQ ID NO: 26222 - DNA, 20 bp, Artificial Sequence
  Synthetic oligonucleotide; CAG chr11 5376447 5376466 5376463 +
agaaataactaaaatcagag

SEQ ID NO: 26223 - DNA, 20 bp, Artificial Sequence
  Synthetic oligonucleotide; AAG chr11 5376455 5376474 5376471 +
ctaaaatcagagcagaactg

SEQ ID NO: 26224 - DNA, 20 bp, Artificial Sequence
  Synthetic oligonucleotide; AGG chr11 5376456 5376475 5376472 +
taaaatcagagcagaactga

SEQ ID NO: 26225 - DNA, 20 bp, Artificial Sequence
  Synthetic oligonucleotide; CAG chr11 5376462 5376481 5376478 +
cagagcagaactgaaggaaa

SEQ ID NO: 26226 - DNA, 20 bp, Artificial Sequence
  Synthetic oligonucleotide; GAG chr11 5376464 5376483 5376480 +
gagcagaactgaaggaaaca

SEQ ID NO: 26227 - DNA, 20 bp, Artificial Sequence
  Synthetic oligonucleotide; TGG chr11 5376499 5376518 5376515 +
cttcaaaaaattaatgaatc

SEQ ID NO: 26228 - DNA, 20 bp, Artificial Sequence
  Synthetic oligonucleotide; GGG chr11 5376500 5376519 5376516 +
ttcaaaaaattaatgaatct

SEQ ID NO: 26229 - DNA, 20 bp, Artificial Sequence
  Synthetic oligonucleotide; GAG chr11 5376502 5376521 5376518 +
caaaaaattaatgaatctgg

SEQ ID NO: 26230 - DNA, 20 bp, Artificial Sequence
  Synthetic oligonucleotide; TGG chr11 5376506 5376525 5376522 +
aaattaatgaatctgggagc

SEQ ID NO: 26231 - DNA, 20 bp, Artificial Sequence
  Synthetic oligonucleotide; AAG chr11 5376517 5376536 5376533 +
tctgggagctggttttttga

SEQ ID NO: 26232 - DNA, 20 bp, Artificial Sequence
  Synthetic oligonucleotide; AGG chr11 5376518 5376537 5376534 +
ctgggagctggttttttgaa

SEQ ID NO: 26233 - DNA, 20 bp, Artificial Sequence
  Synthetic oligonucleotide; TAG chr11 5376535 5376554 5376551 +
gaaaggatcaacaaaactga

SEQ ID NO: 26234 - DNA, 20 bp, Artificial Sequence
  Synthetic oligonucleotide; TAG chr11 5376543 5376562 5376559 +
caacaaaactgatagaccgc

SEQ ID NO: 26235 - DNA, 20 bp, Artificial Sequence
  Synthetic oligonucleotide; AAG chr11 5376547 5376566 5376563 +
aaaactgatagaccgctagc

SEQ ID NO: 26236 - DNA, 20 bp, Artificial Sequence
  Synthetic oligonucleotide; AAG chr11 5376556 5376575 5376572 +
agaccgctagcaagactaat

SEQ ID NO: 26237 - DNA, 20 bp, Artificial Sequence
  Synthetic oligonucleotide; AAG chr11 5376561 5376580 5376577 +
gctagcaagactaataagaa

SEQ ID NO: 26238 - DNA, 20 bp, Artificial Sequence
  Synthetic oligonucleotide; GAG chr11 5376563 5376582 5376579 +
tagcaagactaataagaaaa

SEQ ID NO: 26239 - DNA, 20 bp, Artificial Sequence
  Synthetic oligonucleotide; GAG chr11 5376565 5376584 5376581 +
gcaagactaataagaaaaga

SEQ ID NO: 26240 - DNA, 20 bp, Artificial Sequence
  Synthetic oligonucleotide; AAG chr11 5376568 5376587 5376584 +
agactaataagaaaagagag

SEQ ID NO: 26241 - DNA, 20 bp, Artificial Sequence
  Synthetic oligonucleotide; TAG chr11 5376578 5376597 5376594 +
gaaaagagagaagaatcaaa

SEQ ID NO: 26242 - DNA, 20 bp, Artificial Sequence
  Synthetic oligonucleotide; AAG chr11 5376600 5376619 5376616 +
gacacaataaaaaaatgata

SEQ ID NO: 26243 - DNA, 20 bp, Artificial Sequence
  Synthetic oligonucleotide; AGG chr11 5376601 5376620 5376617 +
acacaataaaaaaatgataa

SEQ ID NO: 26244 - DNA, 20 bp, Artificial Sequence
  Synthetic oligonucleotide; GGG chr11 5376602 5376621 5376618 +
cacaataaaaaaatgataaa

SEQ ID NO: 26245 - DNA, 20 bp, Artificial Sequence
  Synthetic oligonucleotide; GGG chr11 5376603 5376622 5376619 +
acaataaaaaaatgataaag

SEQ ID NO: 26246 - DNA, 20 bp, Artificial Sequence
  Synthetic oligonucleotide; CAG chr11 5376624 5376643 5376640 +
ggatatcaccaccgatccca

SEQ ID NO: 26247 - DNA, 20 bp, Artificial Sequence
  Synthetic oligonucleotide; CAG chr11 5376643 5376662 5376659 +
acagaaatacaaactgccat

SEQ ID NO: 26248 - DNA, 20 bp, Artificial Sequence
  Synthetic oligonucleotide; GAG chr11 5376645 5376664 5376661 +
agaaatacaaactgccatca

SEQ ID NO: 26249 - DNA, 20 bp, Artificial Sequence
  Synthetic oligonucleotide; TAG chr11 5376678 5376697 5376694 +
acacctctacgcaaataaac

SEQ ID NO: 26250 - DNA, 20 bp, Artificial Sequence
  Synthetic oligonucleotide; TAG chr11 5376687 5376706 5376703 +
cgcaaataaactagaaaatc

SEQ ID NO: 26251 - DNA, 20 bp, Artificial Sequence
  Synthetic oligonucleotide; AAG chr11 5376690 5376709 5376706 +
aaataaactagaaaatctag

SEQ ID NO: 26252 - DNA, 20 bp, Artificial Sequence
  Synthetic oligonucleotide; TGG chr11 5376696 5376715 5376712 +
actagaaaatctagaagaaa

SEQ ID NO: 26253 - DNA, 20 bp, Artificial Sequence
  Synthetic oligonucleotide; TGG chr11 5376708 5376727 5376724 +
agaagaaatggataaattcc

SEQ ID NO: 26254 - DNA, 20 bp, Artificial Sequence
  Synthetic oligonucleotide; AAG chr11 5376727 5376746 5376743 +
ctggacacatacactatccc

SEQ ID NO: 26255 - DNA, 20 bp, Artificial Sequence
  Synthetic oligonucleotide; CAG chr11 5376737 5376756 5376753 +
acactatcccaagactaaac

SEQ ID NO: 26256 - DNA, 20 bp, Artificial Sequence
  Synthetic oligonucleotide; AGG chr11 5376738 5376757 5376754 +
cactatcccaagactaaacc

SEQ ID NO: 26257 - DNA, 20 bp, Artificial Sequence
  Synthetic oligonucleotide; AAG chr11 5376741 5376760 5376757 +
tatcccaagactaaaccagg

SEQ ID NO: 26258 - DNA, 20 bp, Artificial Sequence
  Synthetic oligonucleotide; AAG chr11 5376744 5376763 5376760 +
cccaagactaaaccaggaag

SEQ ID NO: 26259 - DNA, 20 bp, Artificial Sequence
  Synthetic oligonucleotide; TAG chr11 5376760 5376779 5376776 +
gaagaagttgaatctctgaa

SEQ ID NO: 26260 - DNA, 20 bp, Artificial Sequence
  Synthetic oligonucleotide; CAG chr11 5376771 5376790 5376787 +
atctctgaatagaccaataa

SEQ ID NO: 26261 - DNA, 20 bp, Artificial Sequence
  Synthetic oligonucleotide; AGG chr11 5376772 5376791 5376788 +
tctctgaatagaccaataac

SEQ ID NO: 26262 - DNA, 20 bp, Artificial Sequence
  Synthetic oligonucleotide; TGG chr11 5376786 5376805 5376802 +
aataacaggatctgaaattg

SEQ ID NO: 26263 - DNA, 20 bp, Artificial Sequence
  Synthetic oligonucleotide; TAG chr11 5376799 5376818 5376815 +
gaaattgtggcaataatcaa

SEQ ID NO: 26264 - DNA, 20 bp, Artificial Sequence
  Synthetic oligonucleotide; AAG chr11 5376815 5376834 5376831 +
tcaatagcttaccaaccaaa

SEQ ID NO: 26265 - DNA, 20 bp, Artificial Sequence
  Synthetic oligonucleotide; GAG chr11 5376817 5376836 5376833 +
aatagcttaccaaccaaaaa

SEQ ID NO: 26266 - DNA, 20 bp, Artificial Sequence
  Synthetic oligonucleotide; CAG chr11 5376822 5376841 5376838 +
cttaccaaccaaaaagagtc

SEQ ID NO: 26267 - DNA, 20 bp, Artificial Sequence
  Synthetic oligonucleotide; AGG chr11 5376823 5376842 5376839 +
ttaccaaccaaaaagagtcc

SEQ ID NO: 26268 - DNA, 20 bp, Artificial Sequence
  Synthetic oligonucleotide; CAG chr11 5376828 5376847 5376844 +
aaccaaaaagagtccaggac

SEQ ID NO: 26269 - DNA, 20 bp, Artificial Sequence
  Synthetic oligonucleotide; TGG chr11 5376832 5376851 5376848 +
aaaaagagtccaggaccaga

SEQ ID NO: 26270 - DNA, 20 bp, Artificial Sequence
  Synthetic oligonucleotide; CAG chr11 5376840 5376859 5376856 +
tccaggaccagatggattca

SEQ ID NO: 26271 - DNA, 20 bp, Artificial Sequence
  Synthetic oligonucleotide; CAG chr11 5376854 5376873 5376870 +
gattcacagccaaattctaa

SEQ ID NO: 26272 - DNA, 20 bp, Artificial Sequence
  Synthetic oligonucleotide; GAG chr11 5376856 5376875 5376872 +
ttcacagccaaattctaaca

SEQ ID NO: 26273 - DNA, 20 bp, Artificial Sequence
  Synthetic oligonucleotide; AGG chr11 5376857 5376876 5376873 +
tcacagccaaattctaacag

SEQ ID NO: 26274 - DNA, 20 bp, Artificial Sequence
  Synthetic oligonucleotide; AAG chr11 5376863 5376882 5376879 +
ccaaattctaacagaggtac

SEQ ID NO: 26275 - DNA, 20 bp, Artificial Sequence
  Synthetic oligonucleotide; AGG chr11 5376864 5376883 5376880 +
caaattctaacagaggtaca

SEQ ID NO: 26276 - DNA, 20 bp, Artificial Sequence
  Synthetic oligonucleotide; GAG chr11 5376866 5376885 5376882 +
aattctaacagaggtacaag

SEQ ID NO: 26277 - DNA, 20 bp, Artificial Sequence
  Synthetic oligonucleotide; AGG chr11 5376867 5376886 5376883 +
attctaacagaggtacaagg

SEQ ID NO: 26278 - DNA, 20 bp, Artificial Sequence
  Synthetic oligonucleotide; TGG chr11 5376873 5376892 5376889 +
acagaggtacaaggaggaat

SEQ ID NO: 26279 - DNA, 20 bp, Artificial Sequence
  Synthetic oligonucleotide; CAG chr11 5376906 5376925 5376922 +
tctgaaactattccaatcaa

SEQ ID NO: 26280 - DNA, 20 bp, Artificial Sequence
  Synthetic oligonucleotide; AAG chr11 5376912 5376931 5376928 +
actattccaatcaacagaaa

SEQ ID NO: 26281 - DNA, 20 bp, Artificial Sequence
  Synthetic oligonucleotide; AAG chr11 5376915 5376934 5376931 +
attccaatcaacagaaaaag

SEQ ID NO: 26282 - DNA, 20 bp, Artificial Sequence
  Synthetic oligonucleotide; AGG chr11 5376916 5376935 5376932 +
ttccaatcaacagaaaaaga

SEQ ID NO: 26283 - DNA, 20 bp, Artificial Sequence
  Synthetic oligonucleotide; GAG chr11 5376941 5376960 5376957 +
tcctccctaactcattttat

SEQ ID NO: 26284 - DNA, 20 bp, Artificial Sequence
  Synthetic oligonucleotide; AGG chr11 5376942 5376961 5376958 +
cctccctaactcattttatg

SEQ ID NO: 26285 - DNA, 20 bp, Artificial Sequence
  Synthetic oligonucleotide; CAG chr11 5376946 5376965 5376962 +
cctaactcattttatgaggc

SEQ ID NO: 26286 - DNA, 20 bp, Artificial Sequence
  Synthetic oligonucleotide; AAG chr11 5376965 5376984 5376981 +
ccagcatcatcctaatacca

SEQ ID NO: 26287 - DNA, 20 bp, Artificial Sequence
  Synthetic oligonucleotide; CAG chr11 5376969 5376988 5376985 +
catcatcctaataccaaagc

SEQ ID NO: 26288 - DNA, 20 bp, Artificial Sequence
  Synthetic oligonucleotide; AAG chr11 5376973 5376992 5376989 +
atcctaataccaaagccaga

SEQ ID NO: 26289 - DNA, 20 bp, Artificial Sequence
  Synthetic oligonucleotide; GAG chr11 5376975 5376994 5376991 +
cctaataccaaagccagaaa

SEQ ID NO: 26290 - DNA, 20 bp, Artificial Sequence
  Synthetic oligonucleotide; AAG chr11 5376990 5377009 5377006 +
agaaagagacacaaccaaaa

SEQ ID NO: 26291 - DNA, 20 bp, Artificial Sequence
  Synthetic oligonucleotide; GAG chr11 5376992 5377011 5377008 +
aaagagacacaaccaaaaaa

SEQ ID NO: 26292 - DNA, 20 bp, Artificial Sequence
  Synthetic oligonucleotide; TAG chr11 5377000 5377019 5377016 +
acaaccaaaaaagagaattt

SEQ ID NO: 26293 - DNA, 20 bp, Artificial Sequence
  Synthetic oligonucleotide; TGG chr11 5377050 5377069 5377066 +
aaaaatcctcaataaaatac

SEQ ID NO: 26294 - DNA, 20 bp, Artificial Sequence
  Synthetic oligonucleotide; CAG chr11 5377064 5377083 5377080 +
aaatactggcaaaccgaatc

SEQ ID NO: 26295 - DNA, 20 bp, Artificial Sequence
  Synthetic oligonucleotide; CAG chr11 5377067 5377086 5377083 +
tactggcaaaccgaatccag

SEQ ID NO: 26296 - DNA, 20 bp, Artificial Sequence
  Synthetic oligonucleotide; AAG chr11 5377079 5377098 5377095 +
gaatccagcagcacatcaaa

SEQ ID NO: 26297 - DNA, 20 bp, Artificial Sequence
  Synthetic oligonucleotide; AAG chr11 5377098 5377117 5377114 +
aaagcttatccacgatgatc

SEQ ID NO: 26298 - DNA, 20 bp, Artificial Sequence
  Synthetic oligonucleotide; TGG chr11 5377101 5377120 5377117 +
gcttatccacgatgatcaag

SEQ ID NO: 26299 - DNA, 20 bp, Artificial Sequence
  Synthetic oligonucleotide; TGG chr11 5377114 5377133 5377130 +
gatcaagtggacttcatccc

SEQ ID NO: 26300 - DNA, 20 bp, Artificial Sequence
  Synthetic oligonucleotide; GGG chr11 5377115 5377134 5377131 +
atcaagtggacttcatccct

SEQ ID NO: 26301 - DNA, 20 bp, Artificial Sequence
  Synthetic oligonucleotide; AAG chr11 5377122 5377141 5377138 +
ggacttcatccctgggatgc

SEQ ID NO: 26302 - DNA, 20 bp, Artificial Sequence
  Synthetic oligonucleotide; AGG chr11 5377123 5377142 5377139 +
gacttcatccctgggatgca

SEQ ID NO: 26303 - DNA, 20 bp, Artificial Sequence
  Synthetic oligonucleotide; TGG chr11 5377127 5377146 5377143 +
tcatccctgggatgcaaggc

SEQ ID NO: 26304 - DNA, 20 bp, Artificial Sequence
  Synthetic oligonucleotide; CAG chr11 5377160 5377179 5377176 +
gcaaatcaataaatgtaatc

SEQ ID NO: 26305 - DNA, 20 bp, Artificial Sequence
  Synthetic oligonucleotide; CAG chr11 5377171 5377190 5377187 +
aatgtaatccagcatataaa

SEQ ID NO: 26306 - DNA, 20 bp, Artificial Sequence
  Synthetic oligonucleotide; AAG chr11 5377179 5377198 5377195 +
ccagcatataaacagaacca

SEQ ID NO: 26307 - DNA, 20 bp, Artificial Sequence
  Synthetic oligonucleotide; TAG chr11 5377206 5377225 5377222 +
aaaccacatgattatctcaa

SEQ ID NO: 26308 - DNA, 20 bp, Artificial Sequence
  Synthetic oligonucleotide; CAG chr11 5377212 5377231 5377228 +
catgattatctcaatagatg

SEQ ID NO: 26309 - DNA, 20 bp, Artificial Sequence
  Synthetic oligonucleotide; AAG chr11 5377217 5377236 5377233 +
ttatctcaatagatgcagaa

SEQ ID NO: 26310 - DNA, 20 bp, Artificial Sequence
  Synthetic oligonucleotide; AGG chr11 5377218 5377237 5377234 +
tatctcaatagatgcagaaa

SEQ ID NO: 26311 - DNA, 20 bp, Artificial Sequence
  Synthetic oligonucleotide; TAG chr11 5377269 5377288 5377285 +
gctaaaaactttcaataaat

SEQ ID NO: 26312 - DNA, 20 bp, Artificial Sequence
  Synthetic oligonucleotide; AGG chr11 5377270 5377289 5377286 +
ctaaaaactttcaataaatt

SEQ ID NO: 26313 - DNA, 20 bp, Artificial Sequence
  Synthetic oligonucleotide; TGG chr11 5377279 5377298 5377295 +
ttcaataaattaggtattga

SEQ ID NO: 26314 - DNA, 20 bp, Artificial Sequence
  Synthetic oligonucleotide; GGG chr11 5377280 5377299 5377296 +
tcaataaattaggtattgat

SEQ ID NO: 26315 - DNA, 20 bp, Artificial Sequence
  Synthetic oligonucleotide; AAG chr11 5377300 5377319 5377316 +
gggacatatctcaaaataat

SEQ ID NO: 26316 - DNA, 20 bp, Artificial Sequence
  Synthetic oligonucleotide; GAG chr11 5377302 5377321 5377318 +
gacatatctcaaaataataa

SEQ ID NO: 26317 - DNA, 20 bp, Artificial Sequence
  Synthetic oligonucleotide; CAG chr11 5377323 5377342 5377339 +
agctatctatgacaaaccca

SEQ ID NO: 26318 - DNA, 20 bp, Artificial Sequence
  Synthetic oligonucleotide; TGG chr11 5377342 5377361 5377358 +
acagccaatatcatactgaa

SEQ ID NO: 26319 - DNA, 20 bp, Artificial Sequence
  Synthetic oligonucleotide; GGG chr11 5377343 5377362 5377359 +
cagccaatatcatactgaat

SEQ ID NO: 26320 - DNA, 20 bp, Artificial Sequence
  Synthetic oligonucleotide; TGG chr11 5377353 5377372 5377369 +
catactgaatgggcaaaaac

SEQ ID NO: 26321 - DNA, 20 bp, Artificial Sequence
  Synthetic oligonucleotide; AAG chr11 5377356 5377375 5377372 +
actgaatgggcaaaaactgg

SEQ ID NO: 26322 - DNA, 20 bp, Artificial Sequence
  Synthetic oligonucleotide; TGG chr11 5377375 5377394 5377391 +
gaagcattccctttgtaaac

SEQ ID NO: 26323 - DNA, 20 bp, Artificial Sequence
  Synthetic oligonucleotide; AAG chr11 5377381 5377400 5377397 +
ttccctttgtaaactggcac

SEQ ID NO: 26324 - DNA, 20 bp, Artificial Sequence
  Synthetic oligonucleotide; CAG chr11 5377385 5377404 5377401 +
ctttgtaaactggcacaaga

SEQ ID NO: 26325 - DNA, 20 bp, Artificial Sequence
  Synthetic oligonucleotide; AGG chr11 5377386 5377405 5377402 +
tttgtaaactggcacaagac

SEQ ID NO: 26326 - DNA, 20 bp, Artificial Sequence
  Synthetic oligonucleotide; GGG chr11 5377387 5377406 5377403 +
ttgtaaactggcacaagaca

SEQ ID NO: 26327 - DNA, 20 bp, Artificial Sequence
  Synthetic oligonucleotide; TAG chr11 5377419 5377438 5377435 +
ctcactactcctattcaaca

SEQ ID NO: 26328 - DNA, 20 bp, Artificial Sequence
  Synthetic oligonucleotide; TGG chr11 5377425 5377444 5377441 +
actcctattcaacatagtgt

SEQ ID NO: 26329 - DNA, 20 bp, Artificial Sequence
  Synthetic oligonucleotide; AAG chr11 5377428 5377447 5377444 +
cctattcaacatagtgttgg

SEQ ID NO: 26330 - DNA, 20 bp, Artificial Sequence
  Synthetic oligonucleotide; TGG chr11 5377434 5377453 5377450 +
caacatagtgttggaagttc

SEQ ID NO: 26331 - DNA, 20 bp, Artificial Sequence
  Synthetic oligonucleotide; CAG chr11 5377438 5377457 5377454 +
atagtgttggaagttctggc

SEQ ID NO: 26332 - DNA, 20 bp, Artificial Sequence
  Synthetic oligonucleotide; AGG chr11 5377439 5377458 5377455 +
tagtgttggaagttctggcc

SEQ ID NO: 26333 - DNA, 20 bp, Artificial Sequence
  Synthetic oligonucleotide; GGG chr11 5377440 5377459 5377456 +
agtgttggaagttctggcca

SEQ ID NO: 26334 - DNA, 20 bp, Artificial Sequence
  Synthetic oligonucleotide; TAG chr11 5377447 5377466 5377463 +
gaagttctggccagggcaat

SEQ ID NO: 26335 - DNA, 20 bp, Artificial Sequence
  Synthetic oligonucleotide; AGG chr11 5377448 5377467 5377464 +
aagttctggccagggcaatt

SEQ ID NO: 26336 - DNA, 20 bp, Artificial Sequence
  Synthetic oligonucleotide; CAG chr11 5377451 5377470 5377467 +
ttctggccagggcaattagg

SEQ ID NO: 26337 - DNA, 20 bp, Artificial Sequence
  Synthetic oligonucleotide; AAG chr11 5377454 5377473 5377470 +
tggccagggcaattaggcag

SEQ ID NO: 26338 - DNA, 20 bp, Artificial Sequence
  Synthetic oligonucleotide; CAG chr11 5377458 5377477 5377474 +
cagggcaattaggcagaaga

SEQ ID NO: 26339 - DNA, 20 bp, Artificial Sequence
  Synthetic oligonucleotide; AGG chr11 5377459 5377478 5377475 +
agggcaattaggcagaagac

SEQ ID NO: 26340 - DNA, 20 bp, Artificial Sequence
  Synthetic oligonucleotide; AAG chr11 5377466 5377485 5377482 +
ttaggcagaagacaggaaaa

SEQ ID NO: 26341 - DNA, 20 bp, Artificial Sequence
  Synthetic oligonucleotide; AGG chr11 5377467 5377486 5377483 +
taggcagaagacaggaaaaa

SEQ ID NO: 26342 - DNA, 20 bp, Artificial Sequence
  Synthetic oligonucleotide; GGG chr11 5377468 5377487 5377484 +
aggcagaagacaggaaaaaa

SEQ ID NO: 26343 - DNA, 20 bp, Artificial Sequence
  Synthetic oligonucleotide; AAG chr11 5377480 5377499 5377496 +
ggaaaaaagggtattcaatt

SEQ ID NO: 26344 - DNA, 20 bp, Artificial Sequence
  Synthetic oligonucleotide; AAG chr11 5377485 5377504 5377501 +
aaagggtattcaattaagaa

SEQ ID NO: 26345 - DNA, 20 bp, Artificial Sequence
  Synthetic oligonucleotide; GAG chr11 5377487 5377506 5377503 +
agggtattcaattaagaaaa

SEQ ID NO: 26346 - DNA, 20 bp, Artificial Sequence
  Synthetic oligonucleotide; AGG chr11 5377488 5377507 5377504 +
gggtattcaattaagaaaag

SEQ ID NO: 26347 - DNA, 20 bp, Artificial Sequence
  Synthetic oligonucleotide; AAG chr11 5377491 5377510 5377507 +
tattcaattaagaaaagagg

SEQ ID NO: 26348 - DNA, 20 bp, Artificial Sequence
  Synthetic oligonucleotide; CAG chr11 5377512 5377531 5377528 +
agtcaaattgtccctgtttg

SEQ ID NO: 26349 - DNA, 20 bp, Artificial Sequence
  Synthetic oligonucleotide; TAG chr11 5377533 5377552 5377549 +
agacgacatgattgtatatc

SEQ ID NO: 26350 - DNA, 20 bp, Artificial Sequence
  Synthetic oligonucleotide; CAG chr11 5377551 5377570 5377567 +
tctagaaaacccccttgtct

SEQ ID NO: 26351 - DNA, 20 bp, Artificial Sequence
  Synthetic oligonucleotide; AAG chr11 5377568 5377587 5377584 +
tctcagcccaaaatctcctt

SEQ ID NO: 26352 - DNA, 20 bp, Artificial Sequence
  Synthetic oligonucleotide; AAG chr11 5377576 5377595 5377592 +
caaaatctccttaagctgat

SEQ ID NO: 26353 - DNA, 20 bp, Artificial Sequence
  Synthetic oligonucleotide; CAG chr11 5377585 5377604 5377601 +
cttaagctgataagcaactt

SEQ ID NO: 26354 - DNA, 20 bp, Artificial Sequence
  Synthetic oligonucleotide; AAG chr11 5377590 5377609 5377606 +
gctgataagcaacttcagca

SEQ ID NO: 26355 - DNA, 20 bp, Artificial Sequence
  Synthetic oligonucleotide; CAG chr11 5377596 5377615 5377612 +
aagcaacttcagcaaagcct

SEQ ID NO: 26356 - DNA, 20 bp, Artificial Sequence
  Synthetic oligonucleotide; AGG chr11 5377597 5377616 5377613 +
agcaacttcagcaaagcctc

SEQ ID NO: 26357 - DNA, 20 bp, Artificial Sequence
  Synthetic oligonucleotide; AAG chr11 5377626 5377645 5377642 +
aaccaatgtgcaaaaatcac

SEQ ID NO: 26358 - DNA, 20 bp, Artificial Sequence
  Synthetic oligonucleotide; CAG chr11 5377648 5377667 5377664 +
gcattcttatacaccaataa

SEQ ID NO: 26359 - DNA, 20 bp, Artificial Sequence
  Synthetic oligonucleotide; CAG chr11 5377656 5377675 5377672 +
atacaccaataacagacaaa

SEQ ID NO: 26360 - DNA, 20 bp, Artificial Sequence
  Synthetic oligonucleotide; GAG chr11 5377658 5377677 5377674 +
acaccaataacagacaaaca

SEQ ID NO: 26361 - DNA, 20 bp, Artificial Sequence
  Synthetic oligonucleotide; GAG chr11 5377660 5377679 5377676 +
accaataacagacaaacaga

SEQ ID NO: 26362 - DNA, 20 bp, Artificial Sequence
  Synthetic oligonucleotide; GAG chr11 5377672 5377691 5377688 +
caaacagagagccaaatcat

SEQ ID NO: 26363 - DNA, 20 bp, Artificial Sequence
  Synthetic oligonucleotide; AGG chr11 5377673 5377692 5377689 +
aaacagagagccaaatcatg

SEQ ID NO: 26364 - DNA, 20 bp, Artificial Sequence
  Synthetic oligonucleotide; GGG chr11 5377674 5377693 5377690 +
aacagagagccaaatcatga

SEQ ID NO: 26365 - DNA, 20 bp, Artificial Sequence
  Synthetic oligonucleotide; AAG chr11 5377700 5377719 5377716 +
tcccattcacaattgcttca

SEQ ID NO: 26366 - DNA, 20 bp, Artificial Sequence
  Synthetic oligonucleotide; GAG chr11 5377702 5377721 5377718 +
ccattcacaattgcttcaaa

SEQ ID NO: 26367 - DNA, 20 bp, Artificial Sequence
  Synthetic oligonucleotide; TAG chr11 5377716 5377735 5377732 +
ttcaaagagaataaaatacc

SEQ ID NO: 26368 - DNA, 20 bp, Artificial Sequence
  Synthetic oligonucleotide; AGG chr11 5377717 5377736 5377733 +
tcaaagagaataaaatacct

SEQ ID NO: 26369 - DNA, 20 bp, Artificial Sequence
  Synthetic oligonucleotide; AAG chr11 5377732 5377751 5377748 +
tacctaggaatccaacttac

SEQ ID NO: 26370 - DNA, 20 bp, Artificial Sequence
  Synthetic oligonucleotide; AGG chr11 5377733 5377752 5377749 +
acctaggaatccaacttaca

SEQ ID NO: 26371 - DNA, 20 bp, Artificial Sequence
  Synthetic oligonucleotide; GGG chr11 5377734 5377753 5377750 +
cctaggaatccaacttacaa

SEQ ID NO: 26372 - DNA, 20 bp, Artificial Sequence
  Synthetic oligonucleotide; AAG chr11 5377742 5377761 5377758 +
tccaacttacaagggatgtg

SEQ ID NO: 26373 - DNA, 20 bp, Artificial Sequence
  Synthetic oligonucleotide; AGG chr11 5377743 5377762 5377759 +
ccaacttacaagggatgtga

SEQ ID NO: 26374 - DNA, 20 bp, Artificial Sequence
  Synthetic oligonucleotide; AAG chr11 5377754 5377773 5377770 +
gggatgtgaaggacctcttc

SEQ ID NO: 26375 - DNA, 20 bp, Artificial Sequence
  Synthetic oligonucleotide; AGG chr11 5377755 5377774 5377771 +
ggatgtgaaggacctcttca

SEQ ID NO: 26376 - DNA, 20 bp, Artificial Sequence
  Synthetic oligonucleotide; GAG chr11 5377757 5377776 5377773 +
atgtgaaggacctcttcaag

SEQ ID NO: 26377 - DNA, 20 bp, Artificial Sequence
  Synthetic oligonucleotide; AAG chr11 5377788 5377807 5377804 +
accactgctcaatgaaataa

SEQ ID NO: 26378 - DNA, 20 bp, Artificial Sequence
  Synthetic oligonucleotide; AAG chr11 5377791 5377810 5377807 +
actgctcaatgaaataaaag

SEQ ID NO: 26379 - DNA, 20 bp, Artificial Sequence
  Synthetic oligonucleotide; TGG chr11 5377805 5377824 5377821 +
taaaagaagatacaaacaaa

SEQ ID NO: 26380 - DNA, 20 bp, Artificial Sequence
  Synthetic oligonucleotide; AAG chr11 5377808 5377827 5377824 +
aagaagatacaaacaaatgg

SEQ ID NO: 26381 - DNA, 20 bp, Artificial Sequence
  Synthetic oligonucleotide; TGG chr11 5377826 5377845 5377842 +
ggaagaacattccatgctta

SEQ ID NO: 26382 - DNA, 20 bp, Artificial Sequence
  Synthetic oligonucleotide; GGG chr11 5377827 5377846 5377843 +
gaagaacattccatgcttat

SEQ ID NO: 26383 - DNA, 20 bp, Artificial Sequence
  Synthetic oligonucleotide; TAG chr11 5377830 5377849 5377846 +
gaacattccatgcttatggg

SEQ ID NO: 26384 - DNA, 20 bp, Artificial Sequence
  Synthetic oligonucleotide; AGG chr11 5377831 5377850 5377847 +
aacattccatgcttatgggt

SEQ ID NO: 26385 - DNA, 20 bp, Artificial Sequence
  Synthetic oligonucleotide; AAG chr11 5377834 5377853 5377850 +
attccatgcttatgggtagg

SEQ ID NO: 26386 - DNA, 20 bp, Artificial Sequence
  Synthetic oligonucleotide; TGG chr11 5377854 5377873 5377870 +
aagaatcaatatcatcaaaa

SEQ ID NO: 26387 - DNA, 20 bp, Artificial Sequence
  Synthetic oligonucleotide; AAG chr11 5377868 5377887 5377884 +
tcaaaatggccataatgccc

SEQ ID NO: 26388 - DNA, 20 bp, Artificial Sequence
  Synthetic oligonucleotide; AGG chr11 5377869 5377888 5377885 +
caaaatggccataatgccca

SEQ ID NO: 26389 - DNA, 20 bp, Artificial Sequence
  Synthetic oligonucleotide; TAG chr11 5377879 5377898 5377895 +
ataatgcccaaggtaattta

SEQ ID NO: 26390 - DNA, 20 bp, Artificial Sequence
  Synthetic oligonucleotide; AAG chr11 5377901 5377920 5377917 +
gattcaatgccatccccatc

SEQ ID NO: 26391 - DNA, 20 bp, Artificial Sequence
  Synthetic oligonucleotide; CAG chr11 5377923 5377942 5377939 +
gctaccaatgattttcttca

SEQ ID NO: 26392 - DNA, 20 bp, Artificial Sequence
  Synthetic oligonucleotide; TGG chr11 5377929 5377948 5377945 +
aatgattttcttcacagaat

SEQ ID NO: 26393 - DNA, 20 bp, Artificial Sequence
  Synthetic oligonucleotide; AAG chr11 5377945 5377964 5377961 +
gaattggaaaaacgacttta

SEQ ID NO: 26394 - DNA, 20 bp, Artificial Sequence
  Synthetic oligonucleotide; TGG chr11 5377954 5377973 5377970 +
aaacgactttaaagttcata

SEQ ID NO: 26395 - DNA, 20 bp, Artificial Sequence
  Synthetic oligonucleotide; AAG chr11 5377965 5377984 5377981 +
aagttcatatggaaccaaaa

SEQ ID NO: 26396 - DNA, 20 bp, Artificial Sequence
  Synthetic oligonucleotide; GAG chr11 5377967 5377986 5377983 +
gttcatatggaaccaaaaaa

SEQ ID NO: 26397 - DNA, 20 bp, Artificial Sequence
  Synthetic oligonucleotide; AAG chr11 5377981 5378000 5377997 +
aaaaaagagcctgcattgcc

SEQ ID NO: 26398 - DNA, 20 bp, Artificial Sequence
  Synthetic oligonucleotide; AAG chr11 5377992 5378011 5378008 +
tgcattgccaagtcaatcct

SEQ ID NO: 26399 - DNA, 20 bp, Artificial Sequence
  Synthetic oligonucleotide; AAG chr11 5377999 5378018 5378015 +
ccaagtcaatcctaagccaa

SEQ ID NO: 26400 - DNA, 20 bp, Artificial Sequence
  Synthetic oligonucleotide; AAG chr11 5378006 5378025 5378022 +
aatcctaagccaaaagaaca

SEQ ID NO: 26401 - DNA, 20 bp, Artificial Sequence
  Synthetic oligonucleotide; TGG chr11 5378010 5378029 5378026 +
ctaagccaaaagaacaaagc

SEQ ID NO: 26402 - DNA, 20 bp, Artificial Sequence
  Synthetic oligonucleotide; GAG chr11 5378012 5378031 5378028 +
aagccaaaagaacaaagctg

SEQ ID NO: 26403 - DNA, 20 bp, Artificial Sequence
  Synthetic oligonucleotide; AGG chr11 5378013 5378032 5378029 +
agccaaaagaacaaagctgg

SEQ ID NO: 26404 - DNA, 20 bp, Artificial Sequence
  Synthetic oligonucleotide; CAG chr11 5378019 5378038 5378035 +
aagaacaaagctggaggcat

SEQ ID NO: 26405 - DNA, 20 bp, Artificial Sequence
  Synthetic oligonucleotide; AGG chr11 5378020 5378039 5378036 +
agaacaaagctggaggcatc

SEQ ID NO: 26406 - DNA, 20 bp, Artificial Sequence
  Synthetic oligonucleotide; AAG chr11 5378047 5378066 5378063 +
ctcacttcaaactatactac

SEQ ID NO: 26407 - DNA, 20 bp, Artificial Sequence
  Synthetic oligonucleotide; AGG chr11 5378048 5378067 5378064 +
tcacttcaaactatactaca

SEQ ID NO: 26408 - DNA, 20 bp, Artificial Sequence
  Synthetic oligonucleotide; CAG chr11 5378054 5378073 5378070 +
caaactatactacaaggcta

SEQ ID NO: 26409 - DNA, 20 bp, Artificial Sequence
  Synthetic oligonucleotide; CAG chr11 5378066 5378085 5378082 +
caaggctacagtaaccaaaa

SEQ ID NO: 26410 - DNA, 20 bp, Artificial Sequence
  Synthetic oligonucleotide; TGG chr11 5378077 5378096 5378093 +
taaccaaaacagcatgttac

SEQ ID NO: 26411 - DNA, 20 bp, Artificial Sequence
  Synthetic oligonucleotide; CAG chr11 5378090 5378109 5378106 +
atgttactggtaccaaaaca

SEQ ID NO: 26412 - DNA, 20 bp, Artificial Sequence
  Synthetic oligonucleotide; TAG chr11 5378096 5378115 5378112 +
ctggtaccaaaacacagata

SEQ ID NO: 26413 - DNA, 20 bp, Artificial Sequence
  Synthetic oligonucleotide; TGG chr11 5378104 5378123 5378120 +
aaaacacagatatagatcaa

SEQ ID NO: 26414 - DNA, 20 bp, Artificial Sequence
  Synthetic oligonucleotide; CAG chr11 5378109 5378128 5378125 +
acagatatagatcaatggaa

SEQ ID NO: 26415 - DNA, 20 bp, Artificial Sequence
  Synthetic oligonucleotide; CAG chr11 5378114 5378133 5378130 +
tatagatcaatggaacagaa

SEQ ID NO: 26416 - DNA, 20 bp, Artificial Sequence
  Synthetic oligonucleotide; GAG chr11 5378116 5378135 5378132 +
tagatcaatggaacagaaca

SEQ ID NO: 26417 - DNA, 20 bp, Artificial Sequence
  Synthetic oligonucleotide; CAG chr11 5378123 5378142 5378139 +
atggaacagaacagagccct

SEQ ID NO: 26418 - DNA, 20 bp, Artificial Sequence
  Synthetic oligonucleotide; GAG chr11 5378170 5378189 5378186 +
atctgatctttgaaaaacct

SEQ ID NO: 26419 - DNA, 20 bp, Artificial Sequence
  Synthetic oligonucleotide; AAG chr11 5378179 5378198 5378195 +
ttgaaaaacctgagaaaaac

SEQ ID NO: 26420 - DNA, 20 bp, Artificial Sequence
  Synthetic oligonucleotide; TGG chr11 5378185 5378204 5378201 +
aacctgagaaaaacaagaaa

SEQ ID NO: 26421 - DNA, 20 bp, Artificial Sequence
  Synthetic oligonucleotide; GGG chr11 5378186 5378205 5378202 +
acctgagaaaaacaagaaat

SEQ ID NO: 26422 - DNA, 20 bp, Artificial Sequence
  Synthetic oligonucleotide; GGG chr11 5378187 5378206 5378203 +
cctgagaaaaacaagaaatg

SEQ ID NO: 26423 - DNA, 20 bp, Artificial Sequence
  Synthetic oligonucleotide; AAG chr11 5378191 5378210 5378207 +
agaaaaacaagaaatgggga

SEQ ID NO: 26424 - DNA, 20 bp, Artificial Sequence
  Synthetic oligonucleotide; AGG chr11 5378192 5378211 5378208 +
gaaaaacaagaaatggggaa

SEQ ID NO: 26425 - DNA, 20 bp, Artificial Sequence
  Synthetic oligonucleotide; TGG chr11 5378212 5378231 5378228 +
aggattccctatttaataaa

SEQ ID NO: 26426 - DNA, 20 bp, Artificial Sequence
  Synthetic oligonucleotide; TGG chr11 5378218 5378237 5378234 +
ccctatttaataaatggtgc

SEQ ID NO: 26427 - DNA, 20 bp, Artificial Sequence
  Synthetic oligonucleotide; GGG chr11 5378219 5378238 5378235 +
cctatttaataaatggtgct

SEQ ID NO: 26428 - DNA, 20 bp, Artificial Sequence
  Synthetic oligonucleotide; GAG chr11 5378221 5378240 5378237 +
tatttaataaatggtgctgg

SEQ ID NO: 26429 - DNA, 20 bp, Artificial Sequence
  Synthetic oligonucleotide; TGG chr11 5378227 5378246 5378243 +
ataaatggtgctgggagaac

SEQ ID NO: 26430 - DNA, 20 bp, Artificial Sequence
  Synthetic oligonucleotide; TAG chr11 5378231 5378250 5378247 +
atggtgctgggagaactggc

SEQ ID NO: 26431 - DNA, 20 bp, Artificial Sequence
  Synthetic oligonucleotide; TAG chr11 5378241 5378260 5378257 +
gagaactggctagccatatg

SEQ ID NO: 26432 - DNA, 20 bp, Artificial Sequence
  Synthetic oligonucleotide; TGG chr11 5378255 5378274 5378271 +
catatgtagaatgctgaaac

SEQ ID NO: 26433 - DNA, 20 bp, Artificial Sequence
  Synthetic oligonucleotide; AAG chr11 5378292 5378311 5378308 +
ccttatacaaaaattaattc

SEQ ID NO: 26434 - DNA, 20 bp, Artificial Sequence
  Synthetic oligonucleotide; TGG chr11 5378296 5378315 5378312 +
atacaaaaattaattcaaga

SEQ ID NO: 26435 - DNA, 20 bp, Artificial Sequence
  Synthetic oligonucleotide; AAG chr11 5378303 5378322 5378319 +
aattaattcaagatggatta

SEQ ID NO: 26436 - DNA, 20 bp, Artificial Sequence
  Synthetic oligonucleotide; TAG chr11 5378316 5378335 5378332 +
tggattaaagacttaaacat

SEQ ID NO: 26437 - DNA, 20 bp, Artificial Sequence
  Synthetic oligonucleotide; TAG chr11 5378339 5378358 5378355 +
acctaaaaccataaaaaccc

SEQ ID NO: 26438 - DNA, 20 bp, Artificial Sequence
  Synthetic oligonucleotide; AAG chr11 5378342 5378361 5378358 +
taaaaccataaaaaccctag

SEQ ID NO: 26439 - DNA, 20 bp, Artificial Sequence
  Synthetic oligonucleotide; CAG chr11 5378351 5378370 5378367 +
aaaaaccctagaagaaaacg

SEQ ID NO: 26440 - DNA, 20 bp, Artificial Sequence
  Synthetic oligonucleotide; AGG chr11 5378352 5378371 5378368 +
aaaaccctagaagaaaacgc

SEQ ID NO: 26441 - DNA, 20 bp, Artificial Sequence
  Synthetic oligonucleotide; CAG chr11 5378365 5378384 5378381 +
aaaacgcaggcattaccatt

SEQ ID NO: 26442 - DNA, 20 bp, Artificial Sequence
  Synthetic oligonucleotide; AGG chr11 5378366 5378385 5378382 +
aaacgcaggcattaccattc

SEQ ID NO: 26443 - DNA, 20 bp, Artificial Sequence
  Synthetic oligonucleotide; TAG chr11 5378372 5378391 5378388 +
aggcattaccattcaggaca

SEQ ID NO: 26444 - DNA, 20 bp, Artificial Sequence
  Synthetic oligonucleotide; AGG chr11 5378373 5378392 5378389 +
ggcattaccattcaggacat

SEQ ID NO: 26445 - DNA, 20 bp, Artificial Sequence
  Synthetic oligonucleotide; TGG chr11 5378378 5378397 5378394 +
taccattcaggacataggca

SEQ ID NO: 26446 - DNA, 20 bp, Artificial Sequence
  Synthetic oligonucleotide; GGG chr11 5378379 5378398 5378395 +
accattcaggacataggcat

SEQ ID NO: 26447 - DNA, 20 bp, Artificial Sequence
  Synthetic oligonucleotide; AAG chr11 5378383 5378402 5378399 +
ttcaggacataggcatgggc

SEQ ID NO: 26448 - DNA, 20 bp, Artificial Sequence
  Synthetic oligonucleotide; AGG chr11 5378384 5378403 5378400 +
tcaggacataggcatgggca

SEQ ID NO: 26449 - DNA, 20 bp, Artificial Sequence
  Synthetic oligonucleotide; AAG chr11 5378408 5378427 5378424 +
cttcatgtctaaaacaccaa

SEQ ID NO: 26450 - DNA, 20 bp, Artificial Sequence
  Synthetic oligonucleotide; TGG chr11 5378414 5378433 5378430 +
gtctaaaacaccaaaagcga

SEQ ID NO: 26451 - DNA, 20 bp, Artificial Sequence
  Synthetic oligonucleotide; AAG chr11 5378423 5378442 5378439 +
accaaaagcgatggcaacaa

SEQ ID NO: 26452 - DNA, 20 bp, Artificial Sequence
  Synthetic oligonucleotide; TGG chr11 5378440 5378459 5378456 +
caaaagccaaaattcactaa

SEQ ID NO: 26453 - DNA, 20 bp, Artificial Sequence
  Synthetic oligonucleotide; GGG chr11 5378441 5378460 5378457 +
aaaagccaaaattcactaat

SEQ ID NO: 26454 - DNA, 20 bp, Artificial Sequence
  Synthetic oligonucleotide; AAG chr11 5378458 5378477 5378474 +
aatgggatctaatgaaacta

SEQ ID NO: 26455 - DNA, 20 bp, Artificial Sequence
  Synthetic oligonucleotide; GAG chr11 5378460 5378479 5378476 +
tgggatctaatgaaactaaa

SEQ ID NO: 26456 - DNA, 20 bp, Artificial Sequence
  Synthetic oligonucleotide; CAG chr11 5378471 5378490 5378487 +
gaaactaaagagcttctgca

SEQ ID NO: 26457 - DNA, 20 bp, Artificial Sequence
  Synthetic oligonucleotide; AAG chr11 5378477 5378496 5378493 +
aaagagcttctgcacagcta

SEQ ID NO: 26458 - DNA, 20 bp, Artificial Sequence
  Synthetic oligonucleotide; CAG chr11 5378490 5378509 5378506 +
acagctaaagaaactaccat

SEQ ID NO: 26459 - DNA, 20 bp, Artificial Sequence
  Synthetic oligonucleotide; GAG chr11 5378492 5378511 5378508 +
agctaaagaaactaccatca

SEQ ID NO: 26460 - DNA, 20 bp, Artificial Sequence
  Synthetic oligonucleotide; CAG chr11 5378499 5378518 5378515 +
gaaactaccatcagagtgaa

SEQ ID NO: 26461 - DNA, 20 bp, Artificial Sequence
  Synthetic oligonucleotide; AGG chr11 5378500 5378519 5378516 +
aaactaccatcagagtgaac

SEQ ID NO: 26462 - DNA, 20 bp, Artificial Sequence
  Synthetic oligonucleotide; TGG chr11 5378515 5378534 5378531 +
tgaacaggcaacctacacaa

SEQ ID NO: 26463 - DNA, 20 bp, Artificial Sequence
  Synthetic oligonucleotide; GGG chr11 5378516 5378535 5378532 +
gaacaggcaacctacacaat

SEQ ID NO: 26464 - DNA, 20 bp, Artificial Sequence
  Synthetic oligonucleotide; GAG chr11 5378518 5378537 5378534 +
acaggcaacctacacaatgg

SEQ ID NO: 26465 - DNA, 20 bp, Artificial Sequence
  Synthetic oligonucleotide; AAG chr11 5378549 5378568 5378565 +
cacaacctactcatctgaca

SEQ ID NO: 26466 - DNA, 20 bp, Artificial Sequence
  Synthetic oligonucleotide; AGG chr11 5378550 5378569 5378566 +
acaacctactcatctgacaa

SEQ ID NO: 26467 - DNA, 20 bp, Artificial Sequence
  Synthetic oligonucleotide; GGG chr11 5378551 5378570 5378567 +
caacctactcatctgacaaa

SEQ ID NO: 26468 - DNA, 20 bp, Artificial Sequence
  Synthetic oligonucleotide; CAG chr11 5378562 5378581 5378578 +
tctgacaaagggctaatatc

SEQ ID NO: 26469 - DNA, 20 bp, Artificial Sequence
  Synthetic oligonucleotide; AAG chr11 5378593 5378612 5378609 +
atgaactcaaacaaatttac

SEQ ID NO: 26470 - DNA, 20 bp, Artificial Sequence
  Synthetic oligonucleotide; CAG chr11 5378607 5378626 5378623 +
atttacaagaaaaaaacaaa

SEQ ID NO: 26471 - DNA, 20 bp, Artificial Sequence
  Synthetic oligonucleotide; AAG chr11 5378620 5378639 5378636 +
aaacaaacagccccatcaac

SEQ ID NO: 26472 - DNA, 20 bp, Artificial Sequence
  Synthetic oligonucleotide; TGG chr11 5378623 5378642 5378639 +
caaacagccccatcaacaag

SEQ ID NO: 26473 - DNA, 20 bp, Artificial Sequence
  Synthetic oligonucleotide; GGG chr11 5378624 5378643 5378640 +
aaacagccccatcaacaagt

SEQ ID NO: 26474 - DNA, 20 bp, Artificial Sequence
  Synthetic oligonucleotide; AAG chr11 5378629 5378648 5378645 +
gccccatcaacaagtgggca

SEQ ID NO: 26475 - DNA, 20 bp, Artificial Sequence
  Synthetic oligonucleotide; AGG chr11 5378630 5378649 5378646 +
ccccatcaacaagtgggcaa

SEQ ID NO: 26476 - DNA, 20 bp, Artificial Sequence
  Synthetic oligonucleotide; CAG chr11 5378640 5378659 5378656 +
aagtgggcaaaggatatgaa

SEQ ID NO: 26477 - DNA, 20 bp, Artificial Sequence
  Synthetic oligonucleotide; AAG chr11 5378654 5378673 5378670 +
tatgaacagacacttctcaa

SEQ ID NO: 26478 - DNA, 20 bp, Artificial Sequence
  Synthetic oligonucleotide; AAG chr11 5378676 5378695 5378692 +
gaaaacatttatgcaaccaa

SEQ ID NO: 26479 - DNA, 20 bp, Artificial Sequence
  Synthetic oligonucleotide; TGG chr11 5378705 5378724 5378721 +
gaaaaaatgctcatcatcac

SEQ ID NO: 26480 - DNA, 20 bp, Artificial Sequence
  Synthetic oligonucleotide; CAG chr11 5378712 5378731 5378728 +
tgctcatcatcactggccat

SEQ ID NO: 26481 - DNA, 20 bp, Artificial Sequence
  Synthetic oligonucleotide; GAG chr11 5378714 5378733 5378730 +
ctcatcatcactggccatca

SEQ ID NO: 26482 - DNA, 20 bp, Artificial Sequence
  Synthetic oligonucleotide; GAG chr11 5378739 5378758 5378755 +
atgcaaatcaaaaccacaat

SEQ ID NO: 26483 - DNA, 20 bp, Artificial Sequence
  Synthetic oligonucleotide; CAG chr11 5378756 5378775 5378772 +
aatgagataccatctcatac

SEQ ID NO: 26484 - DNA, 20 bp, Artificial Sequence
  Synthetic oligonucleotide; TAG chr11 5378760 5378779 5378776 +
agataccatctcataccagt

SEQ ID NO: 26485 - DNA, 20 bp, Artificial Sequence
  Synthetic oligonucleotide; TGG chr11 5378765 5378784 5378781 +
ccatctcataccagttagaa

SEQ ID NO: 26486 - DNA, 20 bp, Artificial Sequence
  Synthetic oligonucleotide; AAG chr11 5378779 5378798 5378795 +
ttagaatggcaatcattaaa

SEQ ID NO: 26487 - DNA, 20 bp, Artificial Sequence
  Synthetic oligonucleotide; CAG chr11 5378783 5378802 5378799 +
aatggcaatcattaaaaagt

SEQ ID NO: 26488 - DNA, 20 bp, Artificial Sequence
  Synthetic oligonucleotide; AGG chr11 5378784 5378803 5378800 +
atggcaatcattaaaaagtc

SEQ ID NO: 26489 - DNA, 20 bp, Artificial Sequence
  Synthetic oligonucleotide; CAG chr11 5378793 5378812 5378809 +
attaaaaagtcaggaaacaa

SEQ ID NO: 26490 - DNA, 20 bp, Artificial Sequence
  Synthetic oligonucleotide; AGG chr11 5378794 5378813 5378810 +
ttaaaaagtcaggaaacaac

SEQ ID NO: 26491 - DNA, 20 bp, Artificial Sequence
  Synthetic oligonucleotide; TGG chr11 5378800 5378819 5378816 +
agtcaggaaacaacaggtgc

SEQ ID NO: 26492 - DNA, 20 bp, Artificial Sequence
  Synthetic oligonucleotide; GAG chr11 5378802 5378821 5378818 +
tcaggaaacaacaggtgctg

SEQ ID NO: 26493 - DNA, 20 bp, Artificial Sequence
  Synthetic oligonucleotide; GAG chr11 5378804 5378823 5378820 +
aggaaacaacaggtgctgga

SEQ ID NO: 26494 - DNA, 20 bp, Artificial Sequence
  Synthetic oligonucleotide; AGG chr11 5378805 5378824 5378821 +
ggaaacaacaggtgctggag

SEQ ID NO: 26495 - DNA, 20 bp, Artificial Sequence
  Synthetic oligonucleotide; TGG chr11 5378811 5378830 5378827 +
aacaggtgctggagaggatg

SEQ ID NO: 26496 - DNA, 20 bp, Artificial Sequence
  Synthetic oligonucleotide; GAG chr11 5378813 5378832 5378829 +
caggtgctggagaggatgtg

SEQ ID NO: 26497 - DNA, 20 bp, Artificial Sequence
  Synthetic oligonucleotide; TAG chr11 5378819 5378838 5378835 +
ctggagaggatgtggagaaa

SEQ ID NO: 26498 - DNA, 20 bp, Artificial Sequence
  Synthetic oligonucleotide; AGG chr11 5378820 5378839 5378836 +
tggagaggatgtggagaaat

SEQ ID NO: 26499 - DNA, 20 bp, Artificial Sequence
  Synthetic oligonucleotide; TGG chr11 5378839 5378858 5378855 +
taggaacacttttacactct

SEQ ID NO: 26500 - DNA, 20 bp, Artificial Sequence
  Synthetic oligonucleotide; TGG chr11 5378842 5378861 5378858 +
gaacacttttacactcttgg

SEQ ID NO: 26501 - DNA, 20 bp, Artificial Sequence
  Synthetic oligonucleotide; GGG chr11 5378843 5378862 5378859 +
aacacttttacactcttggt

SEQ ID NO: 26502 - DNA, 20 bp, Artificial Sequence
  Synthetic oligonucleotide; TAG chr11 5378855 5378874 5378871 +
ctcttggtgggactgtaaac

SEQ ID NO: 26503 - DNA, 20 bp, Artificial Sequence
  Synthetic oligonucleotide; TGG chr11 5378869 5378888 5378885 +
gtaaactagttcaaccattg

SEQ ID NO: 26504 - DNA, 20 bp, Artificial Sequence
  Synthetic oligonucleotide; AAG chr11 5378872 5378891 5378888 +
aactagttcaaccattgtgg

SEQ ID NO: 26505 - DNA, 20 bp, Artificial Sequence
  Synthetic oligonucleotide; CAG chr11 5378876 5378895 5378892 +
agttcaaccattgtggaagt

SEQ ID NO: 26506 - DNA, 20 bp, Artificial Sequence
  Synthetic oligonucleotide; TGG chr11 5378881 5378900 5378897 +
aaccattgtggaagtcagtg

SEQ ID NO: 26507 - DNA, 20 bp, Artificial Sequence
  Synthetic oligonucleotide; CAG chr11 5378892 5378911 5378908 +
aagtcagtgtggcgattcct

SEQ ID NO: 26508 - DNA, 20 bp, Artificial Sequence
  Synthetic oligonucleotide; AGG chr11 5378893 5378912 5378909 +
agtcagtgtggcgattcctc

SEQ ID NO: 26509 - DNA, 20 bp, Artificial Sequence
  Synthetic oligonucleotide; GGG chr11 5378894 5378913 5378910 +
gtcagtgtggcgattcctca

SEQ ID NO: 26510 - DNA, 20 bp, Artificial Sequence
  Synthetic oligonucleotide; TAG chr11 5378900 5378919 5378916 +
gtggcgattcctcagggatc

SEQ ID NO: 26511 - DNA, 20 bp, Artificial Sequence
  Synthetic oligonucleotide; TAG chr11 5378906 5378925 5378922 +
attcctcagggatctagaac

SEQ ID NO: 26512 - DNA, 20 bp, Artificial Sequence
  Synthetic oligonucleotide; CAG chr11 5378924 5378943 5378940 +
actagaaataccatttgacc

SEQ ID NO: 26513 - DNA, 20 bp, Artificial Sequence
  Synthetic oligonucleotide; TGG chr11 5378939 5378958 5378955 +
tgacccagccatcccattac

SEQ ID NO: 26514 - DNA, 20 bp, Artificial Sequence
  Synthetic oligonucleotide; GGG chr11 5378940 5378959 5378956 +
gacccagccatcccattact

SEQ ID NO: 26515 - DNA, 20 bp, Artificial Sequence
  Synthetic oligonucleotide; AAG chr11 5378953 5378972 5378969 +
cattactgggtatataccca

SEQ ID NO: 26516 - DNA, 20 bp, Artificial Sequence
  Synthetic oligonucleotide; AGG chr11 5378954 5378973 5378970 +
attactgggtatatacccaa

SEQ ID NO: 26517 - DNA, 20 bp, Artificial Sequence
  Synthetic oligonucleotide; AAG chr11 5378978 5378997 5378994 +
atataaatcatgctgctata

SEQ ID NO: 26518 - DNA, 20 bp, Artificial Sequence
  Synthetic oligonucleotide; CGG chr11 5379005 5379024 5379021 +
atgcacacgtatgtttattg

SEQ ID NO: 26519 - DNA, 20 bp, Artificial Sequence
  Synthetic oligonucleotide; TAG chr11 5379020 5379039 5379036 +
tattgcggtactattcacaa

SEQ ID NO: 26520 - DNA, 20 bp, Artificial Sequence
  Synthetic oligonucleotide; AAG chr11 5379025 5379044 5379041 +
cggtactattcacaatagca

SEQ ID NO: 26521 - DNA, 20 bp, Artificial Sequence
  Synthetic oligonucleotide; TGG chr11 5379031 5379050 5379047 +
tattcacaatagcaaagact

SEQ ID NO: 26522 - DNA, 20 bp, Artificial Sequence
  Synthetic oligonucleotide; TAG chr11 5379059 5379078 5379075 +
acccaaatgtccaacaatga

SEQ ID NO: 26523 - DNA, 20 bp, Artificial Sequence
  Synthetic oligonucleotide; TGG chr11 5379064 5379083 5379080 +
aatgtccaacaatgatagac

SEQ ID NO: 26524 - DNA, 20 bp, Artificial Sequence
  Synthetic oligonucleotide; AAG chr11 5379070 5379089 5379086 +
caacaatgatagactggatt

SEQ ID NO: 26525 - DNA, 20 bp, Artificial Sequence
  Synthetic oligonucleotide; TGG chr11 5379079 5379098 5379095 +
tagactggattaagaaaatg

SEQ ID NO: 26526 - DNA, 20 bp, Artificial Sequence
  Synthetic oligonucleotide; TGG chr11 5379095 5379114 5379111 +
aatgtggcacatatacacca

SEQ ID NO: 26527 - DNA, 20 bp, Artificial Sequence
  Synthetic oligonucleotide; CAG chr11 5379107 5379126 5379123 +
atacaccatggaatactatg

SEQ ID NO: 26528 - DNA, 20 bp, Artificial Sequence
  Synthetic oligonucleotide; GAG chr11 5379123 5379142 5379139 +
tatgcagccataaaaatgat

SEQ ID NO: 26529 - DNA, 20 bp, Artificial Sequence
  Synthetic oligonucleotide; TAG chr11 5379139 5379158 5379155 +
tgatgagttcatgtcctttg

SEQ ID NO: 26530 - DNA, 20 bp, Artificial Sequence
  Synthetic oligonucleotide; AGG chr11 5379140 5379159 5379156 +
gatgagttcatgtcctttgt

SEQ ID NO: 26531 - DNA, 20 bp, Artificial Sequence
  Synthetic oligonucleotide; GGG chr11 5379141 5379160 5379157 +
atgagttcatgtcctttgta

SEQ ID NO: 26532 - DNA, 20 bp, Artificial Sequence
  Synthetic oligonucleotide; TGG chr11 5379147 5379166 5379163 +
tcatgtcctttgtagggaca

SEQ ID NO: 26533 - DNA, 20 bp, Artificial Sequence
  Synthetic oligonucleotide; TGG chr11 5379157 5379176 5379173 +
tgtagggacatggatgaaat

SEQ ID NO: 26534 - DNA, 20 bp, Artificial Sequence
  Synthetic oligonucleotide; CAG chr11 5379173 5379192 5379189 +
aaattggaaatcatcattct

SEQ ID NO: 26535 - DNA, 20 bp, Artificial Sequence
  Synthetic oligonucleotide; AAG chr11 5379187 5379206 5379203 +
cattctcagtaaactatcgc

SEQ ID NO: 26536 - DNA, 20 bp, Artificial Sequence
  Synthetic oligonucleotide; AGG chr11 5379188 5379207 5379204 +
attctcagtaaactatcgca

SEQ ID NO: 26537 - DNA, 20 bp, Artificial Sequence
  Synthetic oligonucleotide; TAG chr11 5379223 5379242 5379239 +
acaccacatattctcactca

SEQ ID NO: 26538 - DNA, 20 bp, Artificial Sequence
  Synthetic oligonucleotide; TGG chr11 5379227 5379246 5379243 +
cacatattctcactcataga

SEQ ID NO: 26539 - DNA, 20 bp, Artificial Sequence
  Synthetic oligonucleotide; GGG chr11 5379228 5379247 5379244 +
acatattctcactcatagat

SEQ ID NO: 26540 - DNA, 20 bp, Artificial Sequence
  Synthetic oligonucleotide; GAG chr11 5379242 5379261 5379258 +
atagatgggaactgaacaat

SEQ ID NO: 26541 - DNA, 20 bp, Artificial Sequence
  Synthetic oligonucleotide; TGG chr11 5379251 5379270 5379267 +
aactgaacaatgagaacaca

SEQ ID NO: 26542 - DNA, 20 bp, Artificial Sequence
  Synthetic oligonucleotide; CAG chr11 5379257 5379276 5379273 +
acaatgagaacacatggaca

SEQ ID NO: 26543 - DNA, 20 bp, Artificial Sequence
  Synthetic oligonucleotide; AGG chr11 5379258 5379277 5379274 +
caatgagaacacatggacac

SEQ ID NO: 26544 - DNA, 20 bp, Artificial Sequence
  Synthetic oligonucleotide; AAG chr11 5379261 5379280 5379277 +
tgagaacacatggacacagg

SEQ ID NO: 26545 - DNA, 20 bp, Artificial Sequence
  Synthetic oligonucleotide; AGG chr11 5379262 5379281 5379278 +
gagaacacatggacacagga

SEQ ID NO: 26546 - DNA, 20 bp, Artificial Sequence
  Synthetic oligonucleotide; GGG chr11 5379263 5379282 5379279 +
agaacacatggacacaggaa

SEQ ID NO: 26547 - DNA, 20 bp, Artificial Sequence
  Synthetic oligonucleotide; GGG chr11 5379264 5379283 5379280 +
gaacacatggacacaggaag

SEQ ID NO: 26548 - DNA, 20 bp, Artificial Sequence
  Synthetic oligonucleotide; TGG chr11 5379279 5379298 5379295 +
ggaaggggaacatcacactc

SEQ ID NO: 26549 - DNA, 20 bp, Artificial Sequence
  Synthetic oligonucleotide; GGG chr11 5379280 5379299 5379296 +
gaaggggaacatcacactct

SEQ ID NO: 26550 - DNA, 20 bp, Artificial Sequence
  Synthetic oligonucleotide; GGG chr11 5379281 5379300 5379297 +
aaggggaacatcacactctg

SEQ ID NO: 26551 - DNA, 20 bp, Artificial Sequence
  Synthetic oligonucleotide; TGG chr11 5379291 5379310 5379307 +
tcacactctggggactgttg

SEQ ID NO: 26552 - DNA, 20 bp, Artificial Sequence
  Synthetic oligonucleotide; GGG chr11 5379292 5379311 5379308 +
cacactctggggactgttgt

SEQ ID NO: 26553 - DNA, 20 bp, Artificial Sequence
  Synthetic oligonucleotide; GGG chr11 5379293 5379312 5379309 +
acactctggggactgttgtg

SEQ ID NO: 26554 - DNA, 20 bp, Artificial Sequence
  Synthetic oligonucleotide; TGG chr11 5379296 5379315 5379312 +
ctctggggactgttgtgggg

SEQ ID NO: 26555 - DNA, 20 bp, Artificial Sequence
  Synthetic oligonucleotide; GGG chr11 5379297 5379316 5379313 +
tctggggactgttgtggggt

SEQ ID NO: 26556 - DNA, 20 bp, Artificial Sequence
  Synthetic oligonucleotide; GGG chr11 5379298 5379317 5379314 +
ctggggactgttgtggggtg

SEQ ID NO: 26557 - DNA, 20 bp, Artificial Sequence
  Synthetic oligonucleotide; GGG chr11 5379299 5379318 5379315 +
tggggactgttgtggggtgg

SEQ ID NO: 26558 - DNA, 20 bp, Artificial Sequence
  Synthetic oligonucleotide; CAG chr11 5379304 5379323 5379320 +
actgttgtggggtgggggtg

SEQ ID NO: 26559 - DNA, 20 bp, Artificial Sequence
  Synthetic oligonucleotide; AGG chr11 5379305 5379324 5379321 +
ctgttgtggggtgggggtgc

SEQ ID NO: 26560 - DNA, 20 bp, Artificial Sequence
  Synthetic oligonucleotide; GGG chr11 5379306 5379325 5379322 +
tgttgtggggtgggggtgca

SEQ ID NO: 26561 - DNA, 20 bp, Artificial Sequence
  Synthetic oligonucleotide; GAG chr11 5379308 5379327 5379324 +
ttgtggggtgggggtgcagg

SEQ ID NO: 26562 - DNA, 20 bp, Artificial Sequence
  Synthetic oligonucleotide; AGG chr11 5379309 5379328 5379325 +
tgtggggtgggggtgcaggg

SEQ ID NO: 26563 - DNA, 20 bp, Artificial Sequence
  Synthetic oligonucleotide; GGG chr11 5379310 5379329 5379326 +
gtggggtgggggtgcaggga

SEQ ID NO: 26564 - DNA, 20 bp, Artificial Sequence
  Synthetic oligonucleotide; TGG chr11 5379314 5379333 5379330 +
ggtgggggtgcagggaggga

SEQ ID NO: 26565 - DNA, 20 bp, Artificial Sequence
  Synthetic oligonucleotide; TAG chr11 5379320 5379339 5379336 +
ggtgcagggagggatggcat

SEQ ID NO: 26566 - DNA, 20 bp, Artificial Sequence
  Synthetic oligonucleotide; AGG chr11 5379321 5379340 5379337 +
gtgcagggagggatggcatt

SEQ ID NO: 26567 - DNA, 20 bp, Artificial Sequence
  Synthetic oligonucleotide; GAG chr11 5379323 5379342 5379339 +
gcagggagggatggcattag

SEQ ID NO: 26568 - DNA, 20 bp, Artificial Sequence
  Synthetic oligonucleotide; GAG chr11 5379347 5379366 5379363 +
tatacctaatgctaaattac

SEQ ID NO: 26569 - DNA, 20 bp, Artificial Sequence
  Synthetic oligonucleotide; TGG chr11 5379354 5379373 5379370 +
aatgctaaattacgagttaa

SEQ ID NO: 26570 - DNA, 20 bp, Artificial Sequence
  Synthetic oligonucleotide; GGG chr11 5379355 5379374 5379371 +
atgctaaattacgagttaat

SEQ ID NO: 26571 - DNA, 20 bp, Artificial Sequence
  Synthetic oligonucleotide; CAG chr11 5379360 5379379 5379376 +
aaattacgagttaatgggtg

SEQ ID NO: 26572 - DNA, 20 bp, Artificial Sequence
  Synthetic oligonucleotide; TGG chr11 5379373 5379392 5379389 +
atgggtgcagcacaccaaca

SEQ ID NO: 26573 - DNA, 20 bp, Artificial Sequence
  Synthetic oligonucleotide; CGG chr11 5379400 5379419 5379416 +
tgtatacatatgtaactaac

SEQ ID NO: 26574 - DNA, 20 bp, Artificial Sequence
  Synthetic oligonucleotide; AAG chr11 5379432 5379451 5379448 +
cacatgtaccctaaatctta

SEQ ID NO: 26575 - DNA, 20 bp, Artificial Sequence
  Synthetic oligonucleotide; AAG chr11 5379479 5379498 5379495 +
aaataaaaaaataaaaaata

SEQ ID NO: 26576 - DNA, 20 bp, Artificial Sequence
  Synthetic oligonucleotide; CAG chr11 5379485 5379504 5379501 +
aaaaataaaaaataaagttc

SEQ ID NO: 26577 - DNA, 20 bp, Artificial Sequence
  Synthetic oligonucleotide; CAG chr11 5379498 5379517 5379514 +
aaagttccagtttatttttt

SEQ ID NO: 26578 - DNA, 20 bp, Artificial Sequence
  Synthetic oligonucleotide; AGG chr11 5379499 5379518 5379515 +
aagttccagtttattttttc

SEQ ID NO: 26579 - DNA, 20 bp, Artificial Sequence
  Synthetic oligonucleotide; AAG chr11 5379564 5379583 5379580 +
ctttttctatgtctgctttt

SEQ ID NO: 26580 - DNA, 20 bp, Artificial Sequence
  Synthetic oligonucleotide; TGG chr11 5379569 5379588 5379585 +
tctatgtctgcttttaagat

SEQ ID NO: 26581 - DNA, 20 bp, Artificial Sequence
  Synthetic oligonucleotide; AAG chr11 5379599 5379618 5379615 +
ttgttgtttatgccatttgt

SEQ ID NO: 26582 - DNA, 20 bp, Artificial Sequence
  Synthetic oligonucleotide; TAG chr11 5379611 5379630 5379627 +
ccatttgtaagatatgcatt

SEQ ID NO: 26583 - DNA, 20 bp, Artificial Sequence
  Synthetic oligonucleotide; AAG chr11 5379644 5379663 5379660 +
ttttttaattgacattgctc

SEQ ID NO: 26584 - DNA, 20 bp, Artificial Sequence
  Synthetic oligonucleotide; AGG chr11 5379645 5379664 5379661 +
tttttaattgacattgctca

SEQ ID NO: 26585 - DNA, 20 bp, Artificial Sequence
  Synthetic oligonucleotide; TAG chr11 5379649 5379668 5379665 +
taattgacattgctcaaggt

SEQ ID NO: 26586 - DNA, 20 bp, Artificial Sequence
  Synthetic oligonucleotide; AAG chr11 5379655 5379674 5379671 +
acattgctcaaggttagcta

SEQ ID NO: 26587 - DNA, 20 bp, Artificial Sequence
  Synthetic oligonucleotide; TAG chr11 5379669 5379688 5379685 +
tagctaaagatatgaattaa

SEQ ID NO: 26588 - DNA, 20 bp, Artificial Sequence
  Synthetic oligonucleotide; CAG chr11 5379682 5379701 5379698 +
gaattaatagattttatgtc

SEQ ID NO: 26589 - DNA, 20 bp, Artificial Sequence
  Synthetic oligonucleotide; CAG chr11 5379698 5379717 5379714 +
tgtccagatgttgaaacatt

SEQ ID NO: 26590 - DNA, 20 bp, Artificial Sequence
  Synthetic oligonucleotide; TAG chr11 5379746 5379765 5379762 +
atccattttttgtttccttt

SEQ ID NO: 26591 - DNA, 20 bp, Artificial Sequence
  Synthetic oligonucleotide; TGG chr11 5379766 5379785 5379782 +
tagaattctaatttcacata

SEQ ID NO: 26592 - DNA, 20 bp, Artificial Sequence
  Synthetic oligonucleotide; TGG chr11 5379769 5379788 5379785 +
aattctaatttcacatatgg

SEQ ID NO: 26593 - DNA, 20 bp, Artificial Sequence
  Synthetic oligonucleotide; CAG chr11 5379773 5379792 5379789 +
ctaatttcacatatggtgga

SEQ ID NO: 26594 - DNA, 20 bp, Artificial Sequence
  Synthetic oligonucleotide; GAG chr11 5379792 5379811 5379808 +
acagcttgatactttcccat

SEQ ID NO: 26595 - DNA, 20 bp, Artificial Sequence
  Synthetic oligonucleotide; TGG chr11 5379797 5379816 5379813 +
ttgatactttcccatgagtc

SEQ ID NO: 26596 - DNA, 20 bp, Artificial Sequence
  Synthetic oligonucleotide; TGG chr11 5379805 5379824 5379821 +
ttcccatgagtctggctttc

SEQ ID NO: 26597 - DNA, 20 bp, Artificial Sequence
  Synthetic oligonucleotide; GGG chr11 5379806 5379825 5379822 +
tcccatgagtctggctttct

SEQ ID NO: 26598 - DNA, 20 bp, Artificial Sequence
  Synthetic oligonucleotide; TGG chr11 5379819 5379838 5379835 +
gctttctgggtttctctccc

SEQ ID NO: 26599 - DNA, 20 bp, Artificial Sequence
  Synthetic oligonucleotide; TGG chr11 5379885 5379904 5379901 +
tgtctgctttctgccatgtt

SEQ ID NO: 26600 - DNA, 20 bp, Artificial Sequence
  Synthetic oligonucleotide; CAG chr11 5379891 5379910 5379907 +
ctttctgccatgtttggaac

SEQ ID NO: 26601 - DNA, 20 bp, Artificial Sequence
  Synthetic oligonucleotide; GAG chr11 5379897 5379916 5379913 +
gccatgtttggaaccagcat

SEQ ID NO: 26602 - DNA, 20 bp, Artificial Sequence
  Synthetic oligonucleotide; CAG chr11 5379908 5379927 5379924 +
aaccagcatgagacctttat

SEQ ID NO: 26603 - DNA, 20 bp, Artificial Sequence
  Synthetic oligonucleotide; TGG chr11 5379928 5379947 5379944 +
cagatgcaaccgcccgatct

SEQ ID NO: 26604 - DNA, 20 bp, Artificial Sequence
  Synthetic oligonucleotide; AAG chr11 5379937 5379956 5379953 +
ccgcccgatcttggactttt

SEQ ID NO: 26605 - DNA, 20 bp, Artificial Sequence
  Synthetic oligonucleotide; CAG chr11 5379944 5379963 5379960 +
atcttggacttttaagtcac

SEQ ID NO: 26606 - DNA, 20 bp, Artificial Sequence
  Synthetic oligonucleotide; AAG chr11 5379983 5380002 5379999 +
aaactttaaaaaaaaaaaat

SEQ ID NO: 26607 - DNA, 20 bp, Artificial Sequence
  Synthetic oligonucleotide; CAG chr11 5379991 5380010 5380007 +
aaaaaaaaaaataagctacc

SEQ ID NO: 26608 - DNA, 20 bp, Artificial Sequence
  Synthetic oligonucleotide; CAG chr11 5379997 5380016 5380013 +
aaaaataagctacccagact

SEQ ID NO: 26609 - DNA, 20 bp, Artificial Sequence
  Synthetic oligonucleotide; AGG chr11 5379998 5380017 5380014 +
aaaataagctacccagactc

SEQ ID NO: 26610 - DNA, 20 bp, Artificial Sequence
  Synthetic oligonucleotide; TAG chr11 5380011 5380030 5380027 +
cagactcaggtactctgtta

SEQ ID NO: 26611 - DNA, 20 bp, Artificial Sequence
  Synthetic oligonucleotide; TAG chr11 5380046 5380065 5380062 +
tgcaaaatacactaaaactt

SEQ ID NO: 26612 - DNA, 20 bp, Artificial Sequence
  Synthetic oligonucleotide; TGG chr11 5380056 5380075 5380072 +
actaaaactttagcccaact

SEQ ID NO: 26613 - DNA, 20 bp, Artificial Sequence
  Synthetic oligonucleotide; GAG chr11 5380058 5380077 5380074 +
taaaactttagcccaacttg

SEQ ID NO: 26614 - DNA, 20 bp, Artificial Sequence
  Synthetic oligonucleotide; TGG chr11 5380061 5380080 5380077 +
aactttagcccaacttggag

SEQ ID NO: 26615 - DNA, 20 bp, Artificial Sequence
  Synthetic oligonucleotide; GGG chr11 5380062 5380081 5380078 +
actttagcccaacttggagt

SEQ ID NO: 26616 - DNA, 20 bp, Artificial Sequence
  Synthetic oligonucleotide; GGG chr11 5380063 5380082 5380079 +
ctttagcccaacttggagtg

SEQ ID NO: 26617 - DNA, 20 bp, Artificial Sequence
  Synthetic oligonucleotide; GAG chr11 5380065 5380084 5380081 +
ttagcccaacttggagtggg

SEQ ID NO: 26618 - DNA, 20 bp, Artificial Sequence
  Synthetic oligonucleotide; AAG chr11 5380068 5380087 5380084 +
gcccaacttggagtggggag

SEQ ID NO: 26619 - DNA, 20 bp, Artificial Sequence
  Synthetic oligonucleotide; GAG chr11 5380070 5380089 5380086 +
ccaacttggagtggggagaa

SEQ ID NO: 26620 - DNA, 20 bp, Artificial Sequence
  Synthetic oligonucleotide; TGG chr11 5380074 5380093 5380090 +
cttggagtggggagaagaga

SEQ ID NO: 26621 - DNA, 20 bp, Artificial Sequence
  Synthetic oligonucleotide; AAG chr11 5380085 5380104 5380101 +
gagaagagatggtttcccaa

SEQ ID NO: 26622 - DNA, 20 bp, Artificial Sequence
  Synthetic oligonucleotide; AGG chr11 5380086 5380105 5380102 +
agaagagatggtttcccaaa

SEQ ID NO: 26623 - DNA, 20 bp, Artificial Sequence
  Synthetic oligonucleotide; GGG chr11 5380087 5380106 5380103 +
gaagagatggtttcccaaaa

SEQ ID NO: 26624 - DNA, 20 bp, Artificial Sequence
  Synthetic oligonucleotide; GGG chr11 5380088 5380107 5380104 +
aagagatggtttcccaaaag

SEQ ID NO: 26625 - DNA, 20 bp, Artificial Sequence
  Synthetic oligonucleotide; AAG chr11 5380101 5380120 5380117 +
ccaaaaggggtctctctgaa

SEQ ID NO: 26626 - DNA, 20 bp, Artificial Sequence
  Synthetic oligonucleotide; CGG chr11 5380126 5380145 5380142 +
ttcacaatgaaaatgaaaat

SEQ ID NO: 26627 - DNA, 20 bp, Artificial Sequence
  Synthetic oligonucleotide; AAG chr11 5380148 5380167 5380164 +
gttccctttcataatgactg

SEQ ID NO: 26628 - DNA, 20 bp, Artificial Sequence
  Synthetic oligonucleotide; GAG chr11 5380150 5380169 5380166 +
tccctttcataatgactgaa

SEQ ID NO: 26629 - DNA, 20 bp, Artificial Sequence
  Synthetic oligonucleotide; GAG chr11 5380152 5380171 5380168 +
cctttcataatgactgaaga

SEQ ID NO: 26630 - DNA, 20 bp, Artificial Sequence
  Synthetic oligonucleotide; AGG chr11 5380153 5380172 5380169 +
ctttcataatgactgaagag

SEQ ID NO: 26631 - DNA, 20 bp, Artificial Sequence
  Synthetic oligonucleotide; TAG chr11 5380156 5380175 5380172 +
tcataatgactgaagagagg

SEQ ID NO: 26632 - DNA, 20 bp, Artificial Sequence
  Synthetic oligonucleotide; AGG chr11 5380157 5380176 5380173 +
cataatgactgaagagaggt

SEQ ID NO: 26633 - DNA, 20 bp, Artificial Sequence
  Synthetic oligonucleotide; AAG chr11 5380169 5380188 5380185 +
agagaggtaggatgttacga

SEQ ID NO: 26634 - DNA, 20 bp, Artificial Sequence
  Synthetic oligonucleotide; AAG chr11 5380172 5380191 5380188 +
gaggtaggatgttacgaaag

SEQ ID NO: 26635 - DNA, 20 bp, Artificial Sequence
  Synthetic oligonucleotide; AGG chr11 5380173 5380192 5380189 +
aggtaggatgttacgaaaga

SEQ ID NO: 26636 - DNA, 20 bp, Artificial Sequence
  Synthetic oligonucleotide; AAG chr11 5380185 5380204 5380201 +
acgaaagaaggcgtttctga

SEQ ID NO: 26637 - DNA, 20 bp, Artificial Sequence
  Synthetic oligonucleotide; GAG chr11 5380187 5380206 5380203 +
gaaagaaggcgtttctgaaa

SEQ ID NO: 26638 - DNA, 20 bp, Artificial Sequence
  Synthetic oligonucleotide; TGG chr11 5380196 5380215 5380212 +
cgtttctgaaagagttgctg

SEQ ID NO: 26639 - DNA, 20 bp, Artificial Sequence
  Synthetic oligonucleotide; GGG chr11 5380197 5380216 5380213 +
gtttctgaaagagttgctgt

SEQ ID NO: 26640 - DNA, 20 bp, Artificial Sequence
  Synthetic oligonucleotide; AAG chr11 5380200 5380219 5380216 +
tctgaaagagttgctgtggg

SEQ ID NO: 26641 - DNA, 20 bp, Artificial Sequence
  Synthetic oligonucleotide; TGG chr11 5380206 5380225 5380222 +
agagttgctgtgggaagatg

SEQ ID NO: 26642 - DNA, 20 bp, Artificial Sequence
  Synthetic oligonucleotide; GAG chr11 5380208 5380227 5380224 +
agttgctgtgggaagatgtg

SEQ ID NO: 26643 - DNA, 20 bp, Artificial Sequence
  Synthetic oligonucleotide; CAG chr11 5380229 5380248 5380245 +
agacttctctgtaaaccttc

SEQ ID NO: 26644 - DNA, 20 bp, Artificial Sequence
  Synthetic oligonucleotide; CAG chr11 5380248 5380267 5380264 +
ccagactctctgtgcacaca

SEQ ID NO: 26645 - DNA, 20 bp, Artificial Sequence
  Synthetic oligonucleotide; CAG chr11 5380254 5380273 5380270 +
tctctgtgcacacacagatg

SEQ ID NO: 26646 - DNA, 20 bp, Artificial Sequence
  Synthetic oligonucleotide; AGG chr11 5380255 5380274 5380271 +
ctctgtgcacacacagatgc

SEQ ID NO: 26647 - DNA, 20 bp, Artificial Sequence
  Synthetic oligonucleotide; CAG chr11 5380262 5380281 5380278 +
cacacacagatgcaggtgtc

SEQ ID NO: 26648 - DNA, 20 bp, Artificial Sequence
  Synthetic oligonucleotide; AGG chr11 5380263 5380282 5380279 +
acacacagatgcaggtgtcc

SEQ ID NO: 26649 - DNA, 20 bp, Artificial Sequence
  Synthetic oligonucleotide; GGG chr11 5380264 5380283 5380280 +
cacacagatgcaggtgtcca

SEQ ID NO: 26650 - DNA, 20 bp, Artificial Sequence
  Synthetic oligonucleotide; GAG chr11 5380266 5380285 5380282 +
cacagatgcaggtgtccagg

SEQ ID NO: 26651 - DNA, 20 bp, Artificial Sequence
  Synthetic oligonucleotide; AGG chr11 5380267 5380286 5380283 +
acagatgcaggtgtccaggg

SEQ ID NO: 26652 - DNA, 20 bp, Artificial Sequence
  Synthetic oligonucleotide; CAG chr11 5380270 5380289 5380286 +
gatgcaggtgtccagggagg

SEQ ID NO: 26653 - DNA, 20 bp, Artificial Sequence
  Synthetic oligonucleotide; AGG chr11 5380271 5380290 5380287 +
atgcaggtgtccagggaggc

SEQ ID NO: 26654 - DNA, 20 bp, Artificial Sequence
  Synthetic oligonucleotide; GGG chr11 5380272 5380291 5380288 +
tgcaggtgtccagggaggca

SEQ ID NO: 26655 - DNA, 20 bp, Artificial Sequence
  Synthetic oligonucleotide; GGG chr11 5380273 5380292 5380289 +
gcaggtgtccagggaggcag

SEQ ID NO: 26656 - DNA, 20 bp, Artificial Sequence
  Synthetic oligonucleotide; GGG chr11 5380274 5380293 5380290 +
caggtgtccagggaggcagg

SEQ ID NO: 26657 - DNA, 20 bp, Artificial Sequence
  Synthetic oligonucleotide; TGG chr11 5380278 5380297 5380294 +
tgtccagggaggcaggggga

SEQ ID NO: 26658 - DNA, 20 bp, Artificial Sequence
  Synthetic oligonucleotide; TAG chr11 5380310 5380329 5380326 +
attgcaacatgaaaatttct

SEQ ID NO: 26659 - DNA, 20 bp, Artificial Sequence
  Synthetic oligonucleotide; AGG chr11 5380311 5380330 5380327 +
ttgcaacatgaaaatttctt

SEQ ID NO: 26660 - DNA, 20 bp, Artificial Sequence
  Synthetic oligonucleotide; GGG chr11 5380312 5380331 5380328 +
tgcaacatgaaaatttctta

SEQ ID NO: 26661 - DNA, 20 bp, Artificial Sequence
  Synthetic oligonucleotide; GGG chr11 5380313 5380332 5380329 +
gcaacatgaaaatttcttag

SEQ ID NO: 26662 - DNA, 20 bp, Artificial Sequence
  Synthetic oligonucleotide; TGG chr11 5380319 5380338 5380335 +
tgaaaatttcttaggggctg

SEQ ID NO: 26663 - DNA, 20 bp, Artificial Sequence
  Synthetic oligonucleotide; CAG chr11 5380324 5380343 5380340 +
atttcttaggggctgtggac

SEQ ID NO: 26664 - DNA, 20 bp, Artificial Sequence
  Synthetic oligonucleotide; CAG chr11 5380329 5380348 5380345 +
ttaggggctgtggaccagtc

SEQ ID NO: 26665 - DNA, 20 bp, Artificial Sequence
  Synthetic oligonucleotide; AAG chr11 5380332 5380351 5380348 +
ggggctgtggaccagtccag

SEQ ID NO: 26666 - DNA, 20 bp, Artificial Sequence
  Synthetic oligonucleotide; TGG chr11 5380342 5380361 5380358 +
accagtccagaagacccttt

SEQ ID NO: 26667 - DNA, 20 bp, Artificial Sequence
  Synthetic oligonucleotide; TGG chr11 5380360 5380379 5380376 +
tttggcaatcctaacttctg

SEQ ID NO: 26668 - DNA, 20 bp, Artificial Sequence
  Synthetic oligonucleotide; GGG chr11 5380361 5380380 5380377 +
ttggcaatcctaacttctgt

SEQ ID NO: 26669 - DNA, 20 bp, Artificial Sequence
  Synthetic oligonucleotide; CAG chr11 5380370 5380389 5380386 +
ctaacttctgtgggtctctc

SEQ ID NO: 26670 - DNA, 20 bp, Artificial Sequence
  Synthetic oligonucleotide; AAG chr11 5380378 5380397 5380394 +
tgtgggtctctccagtctga

SEQ ID NO: 26671 - DNA, 20 bp, Artificial Sequence
  Synthetic oligonucleotide; TGG chr11 5380407 5380426 5380423 +
atcgatctcacaccacaaaa

SEQ ID NO: 26672 - DNA, 20 bp, Artificial Sequence
  Synthetic oligonucleotide; GAG chr11 5380409 5380428 5380425 +
cgatctcacaccacaaaatg

SEQ ID NO: 26673 - DNA, 20 bp, Artificial Sequence
  Synthetic oligonucleotide; TGG chr11 5380418 5380437 5380434 +
accacaaaatggagttcttc

SEQ ID NO: 26674 - DNA, 20 bp, Artificial Sequence
  Synthetic oligonucleotide; GGG chr11 5380419 5380438 5380435 +
ccacaaaatggagttcttct

SEQ ID NO: 26675 - DNA, 20 bp, Artificial Sequence
  Synthetic oligonucleotide; AAG chr11 5380422 5380441 5380438 +
caaaatggagttcttctggg

SEQ ID NO: 26676 - DNA, 20 bp, Artificial Sequence
  Synthetic oligonucleotide; AGG chr11 5380423 5380442 5380439 +
aaaatggagttcttctggga

SEQ ID NO: 26677 - DNA, 20 bp, Artificial Sequence
  Synthetic oligonucleotide; CAG chr11 5380437 5380456 5380453 +
ctgggaaggacttgttctaa

SEQ ID NO: 26678 - DNA, 20 bp, Artificial Sequence
  Synthetic oligonucleotide; AGG chr11 5380438 5380457 5380454 +
tgggaaggacttgttctaac

SEQ ID NO: 26679 - DNA, 20 bp, Artificial Sequence
  Synthetic oligonucleotide; GAG chr11 5380444 5380463 5380460 +
ggacttgttctaacaggcct

SEQ ID NO: 26680 - DNA, 20 bp, Artificial Sequence
  Synthetic oligonucleotide; GAG chr11 5380446 5380465 5380462 +
acttgttctaacaggcctga

SEQ ID NO: 26681 - DNA, 20 bp, Artificial Sequence
  Synthetic oligonucleotide; GAG chr11 5380450 5380469 5380466 +
gttctaacaggcctgagagt

SEQ ID NO: 26682 - DNA, 20 bp, Artificial Sequence
  Synthetic oligonucleotide; AGG chr11 5380451 5380470 5380467 +
ttctaacaggcctgagagtg

SEQ ID NO: 26683 - DNA, 20 bp, Artificial Sequence
  Synthetic oligonucleotide; TGG chr11 5380462 5380481 5380478 +
ctgagagtgaggtgaccttg

SEQ ID NO: 26684 - DNA, 20 bp, Artificial Sequence
  Synthetic oligonucleotide; CAG chr11 5380478 5380497 5380494 +
cttgtggccattttctgtga

SEQ ID NO: 26685 - DNA, 20 bp, Artificial Sequence
  Synthetic oligonucleotide; GAG chr11 5380480 5380499 5380496 +
tgtggccattttctgtgaca

SEQ ID NO: 26686 - DNA, 20 bp, Artificial Sequence
  Synthetic oligonucleotide; AAG chr11 5380492 5380511 5380508 +
ctgtgacagagacacctaaa

SEQ ID NO: 26687 - DNA, 20 bp, Artificial Sequence
  Synthetic oligonucleotide; GAG chr11 5380494 5380513 5380510 +
gtgacagagacacctaaaaa

SEQ ID NO: 26688 - DNA, 20 bp, Artificial Sequence
  Synthetic oligonucleotide; GAG chr11 5380505 5380524 5380521 +
acctaaaaagagtctgttgt

SEQ ID NO: 26689 - DNA, 20 bp, Artificial Sequence
  Synthetic oligonucleotide; TGG chr11 5380510 5380529 5380526 +
aaaagagtctgttgtgagtc

SEQ ID NO: 26690 - DNA, 20 bp, Artificial Sequence
  Synthetic oligonucleotide; GAG chr11 5380512 5380531 5380528 +
aagagtctgttgtgagtctg

SEQ ID NO: 26691 - DNA, 20 bp, Artificial Sequence
  Synthetic oligonucleotide; GAG chr11 5380520 5380539 5380536 +
gttgtgagtctggagacatt

SEQ ID NO: 26692 - DNA, 20 bp, Artificial Sequence
  Synthetic oligonucleotide; GAG chr11 5380531 5380550 5380547 +
ggagacattgagaaccctgt

SEQ ID NO: 26693 - DNA, 20 bp, Artificial Sequence
  Synthetic oligonucleotide; AAG chr11 5380535 5380554 5380551 +
acattgagaaccctgtgagt

SEQ ID NO: 26694 - DNA, 20 bp, Artificial Sequence
  Synthetic oligonucleotide; AGG chr11 5380536 5380555 5380552 +
cattgagaaccctgtgagta

SEQ ID NO: 26695 - DNA, 20 bp, Artificial Sequence
  Synthetic oligonucleotide; TAG chr11 5380547 5380566 5380563 +
ctgtgagtaaggattttatt

SEQ ID NO: 26696 - DNA, 20 bp, Artificial Sequence
  Synthetic oligonucleotide; AGG chr11 5380548 5380567 5380564 +
tgtgagtaaggattttattt

SEQ ID NO: 26697 - DNA, 20 bp, Artificial Sequence
  Synthetic oligonucleotide; TGG chr11 5380559 5380578 5380575 +
attttatttaggtctgtttc

SEQ ID NO: 26698 - DNA, 20 bp, Artificial Sequence
  Synthetic oligonucleotide; CAG chr11 5380563 5380582 5380579 +
tatttaggtctgtttctggt

SEQ ID NO: 26699 - DNA, 20 bp, Artificial Sequence
  Synthetic oligonucleotide; GAG chr11 5380565 5380584 5380581 +
tttaggtctgtttctggtca

SEQ ID NO: 26700 - DNA, 20 bp, Artificial Sequence
  Synthetic oligonucleotide; TGG chr11 5380568 5380587 5380584 +
aggtctgtttctggtcagag

SEQ ID NO: 26701 - DNA, 20 bp, Artificial Sequence
  Synthetic oligonucleotide; GGG chr11 5380569 5380588 5380585 +
ggtctgtttctggtcagagt

SEQ ID NO: 26702 - DNA, 20 bp, Artificial Sequence
  Synthetic oligonucleotide; GGG chr11 5380570 5380589 5380586 +
gtctgtttctggtcagagtg

SEQ ID NO: 26703 - DNA, 20 bp, Artificial Sequence
  Synthetic oligonucleotide; AAG chr11 5380577 5380596 5380593 +
tctggtcagagtggggattt

SEQ ID NO: 26704 - DNA, 20 bp, Artificial Sequence
  Synthetic oligonucleotide; AGG chr11 5380578 5380597 5380594 +
ctggtcagagtggggattta

SEQ ID NO: 26705 - DNA, 20 bp, Artificial Sequence
  Synthetic oligonucleotide; TGG chr11 5380583 5380602 5380599 +
cagagtggggatttaaggct

SEQ ID NO: 26706 - DNA, 20 bp, Artificial Sequence
  Synthetic oligonucleotide; AAG chr11 5380597 5380616 5380613 +
aaggcttggtcaatatgatt

SEQ ID NO: 26707 - DNA, 20 bp, Artificial Sequence
  Synthetic oligonucleotide; AAG chr11 5380604 5380623 5380620 +
ggtcaatatgattaagacta

SEQ ID NO: 26708 - DNA, 20 bp, Artificial Sequence
  Synthetic oligonucleotide; AGG chr11 5380605 5380624 5380621 +
gtcaatatgattaagactaa

SEQ ID NO: 26709 - DNA, 20 bp, Artificial Sequence
  Synthetic oligonucleotide; TAG chr11 5380617 5380636 5380633 +
aagactaaaggccacacaca

SEQ ID NO: 26710 - DNA, 20 bp, Artificial Sequence
  Synthetic oligonucleotide; GAG chr11 5380628 5380647 5380644 +
ccacacacatagatttgtgt

SEQ ID NO: 26711 - DNA, 20 bp, Artificial Sequence
  Synthetic oligonucleotide; AAG chr11 5380655 5380674 5380671 +
ccatctgtaaaaatctgaaa

SEQ ID NO: 26712 - DNA, 20 bp, Artificial Sequence
  Synthetic oligonucleotide; AAG chr11 5380660 5380679 5380676 +
tgtaaaaatctgaaaaagct

SEQ ID NO: 26713 - DNA, 20 bp, Artificial Sequence
  Synthetic oligonucleotide; TAG chr11 5380688 5380707 5380704 +
ctatctctctccatcaattt

SEQ ID NO: 26714 - DNA, 20 bp, Artificial Sequence
  Synthetic oligonucleotide; AAG chr11 5380706 5380725 5380722 +
tttagtttttatgtgtttgt

SEQ ID NO: 26715 - DNA, 20 bp, Artificial Sequence
  Synthetic oligonucleotide; TAG chr11 5380712 5380731 5380728 +
ttttatgtgtttgtaagatg

SEQ ID NO: 26716 - DNA, 20 bp, Artificial Sequence
  Synthetic oligonucleotide; GAG chr11 5380734 5380753 5380750 +
gatatgtctattttgtgcat

SEQ ID NO: 26717 - DNA, 20 bp, Artificial Sequence
  Synthetic oligonucleotide; GAG chr11 5380736 5380755 5380752 +
tatgtctattttgtgcatga

SEQ ID NO: 26718 - DNA, 20 bp, Artificial Sequence
  Synthetic oligonucleotide; GAG chr11 5380738 5380757 5380754 +
tgtctattttgtgcatgaga

SEQ ID NO: 26719 - DNA, 20 bp, Artificial Sequence
  Synthetic oligonucleotide; GAG chr11 5380740 5380759 5380756 +
tctattttgtgcatgagaga

SEQ ID NO: 26720 - DNA, 20 bp, Artificial Sequence
  Synthetic oligonucleotide; AGG chr11 5380741 5380760 5380757 +
ctattttgtgcatgagagag

SEQ ID NO: 26721 - DNA, 20 bp, Artificial Sequence
  Synthetic oligonucleotide; AAG chr11 5380744 5380763 5380760 +
ttttgtgcatgagagagagg

SEQ ID NO: 26722 - DNA, 20 bp, Artificial Sequence
  Synthetic oligonucleotide; AAG chr11 5380757 5380776 5380773 +
agagaggaagatcatcctca

SEQ ID NO: 26723 - DNA, 20 bp, Artificial Sequence
  Synthetic oligonucleotide; AGG chr11 5380758 5380777 5380774 +
gagaggaagatcatcctcaa

SEQ ID NO: 26724 - DNA, 20 bp, Artificial Sequence
  Synthetic oligonucleotide; AAG chr11 5380761 5380780 5380777 +
aggaagatcatcctcaaagg

SEQ ID NO: 26725 - DNA, 20 bp, Artificial Sequence
  Synthetic oligonucleotide; TGG chr11 5380771 5380790 5380787 +
tcctcaaaggaagaatgaac

SEQ ID NO: 26726 - DNA, 20 bp, Artificial Sequence
  Synthetic oligonucleotide; TGG chr11 5380775 5380794 5380791 +
caaaggaagaatgaactggt

SEQ ID NO: 26727 - DNA, 20 bp, Artificial Sequence
  Synthetic oligonucleotide; CAG chr11 5380778 5380797 5380794 +
aggaagaatgaactggttgg

SEQ ID NO: 26728 - DNA, 20 bp, Artificial Sequence
  Synthetic oligonucleotide; CAG chr11 5380785 5380804 5380801 +
atgaactggttggcagcttt

SEQ ID NO: 26729 - DNA, 20 bp, Artificial Sequence
  Synthetic oligonucleotide; TAG chr11 5380793 5380812 5380809 +
gttggcagctttcagctgtg

SEQ ID NO: 26730 - DNA, 20 bp, Artificial Sequence
  Synthetic oligonucleotide; TGG chr11 5380796 5380815 5380812 +
ggcagctttcagctgtgtag

SEQ ID NO: 26731 - DNA, 20 bp, Artificial Sequence
  Synthetic oligonucleotide; GGG chr11 5380797 5380816 5380813 +
gcagctttcagctgtgtagt

SEQ ID NO: 26732 - DNA, 20 bp, Artificial Sequence
  Synthetic oligonucleotide; GAG chr11 5380804 5380823 5380820 +
tcagctgtgtagtgggtatt

SEQ ID NO: 26733 - DNA, 20 bp, Artificial Sequence
  Synthetic oligonucleotide; AGG chr11 5380805 5380824 5380821 +
cagctgtgtagtgggtattg

SEQ ID NO: 26734 - DNA, 20 bp, Artificial Sequence
  Synthetic oligonucleotide; CGG chr11 5380811 5380830 5380827 +
tgtagtgggtattgaggaca

SEQ ID NO: 26735 - DNA, 20 bp, Artificial Sequence
  Synthetic oligonucleotide; GGG chr11 5380812 5380831 5380828 +
gtagtgggtattgaggacac

SEQ ID NO: 26736 - DNA, 20 bp, Artificial Sequence
  Synthetic oligonucleotide; AAG chr11 5380815 5380834 5380831 +
gtgggtattgaggacacggg

SEQ ID NO: 26737 - DNA, 20 bp, Artificial Sequence
  Synthetic oligonucleotide; AGG chr11 5380816 5380835 5380832 +
tgggtattgaggacacggga

SEQ ID NO: 26738 - DNA, 20 bp, Artificial Sequence
  Synthetic oligonucleotide; TGG chr11 5380819 5380838 5380835 +
gtattgaggacacgggaagg

SEQ ID NO: 26739 - DNA, 20 bp, Artificial Sequence
  Synthetic oligonucleotide; TGG chr11 5380825 5380844 5380841 +
aggacacgggaaggtggtgc

SEQ ID NO: 26740 - DNA, 20 bp, Artificial Sequence
  Synthetic oligonucleotide; AAG chr11 5380828 5380847 5380844 +
acacgggaaggtggtgctgg

SEQ ID NO: 26741 - DNA, 20 bp, Artificial Sequence
  Synthetic oligonucleotide; AAG chr11 5380833 5380852 5380849 +
ggaaggtggtgctggaagaa

SEQ ID NO: 26742 - DNA, 20 bp, Artificial Sequence
  Synthetic oligonucleotide; TGG chr11 5380854 5380873 5380870 +
agccacattttcttgtgccc

SEQ ID NO: 26743 - DNA, 20 bp, Artificial Sequence
  Synthetic oligonucleotide; GGG chr11 5380855 5380874 5380871 +
gccacattttcttgtgccct

SEQ ID NO: 26744 - DNA, 20 bp, Artificial Sequence
  Synthetic oligonucleotide; GGG chr11 5380856 5380875 5380872 +
ccacattttcttgtgccctg

SEQ ID NO: 26745 - DNA, 20 bp, Artificial Sequence
  Synthetic oligonucleotide; TAG chr11 5380860 5380879 5380876 +
attttcttgtgccctgggga

SEQ ID NO: 26746 - DNA, 20 bp, Artificial Sequence
  Synthetic oligonucleotide; TAG chr11 5380863 5380882 5380879 +
ttcttgtgccctggggatag

SEQ ID NO: 26747 - DNA, 20 bp, Artificial Sequence
  Synthetic oligonucleotide; AGG chr11 5380864 5380883 5380880 +
tcttgtgccctggggatagt

SEQ ID NO: 26748 - DNA, 20 bp, Artificial Sequence
  Synthetic oligonucleotide; GGG chr11 5380865 5380884 5380881 +
cttgtgccctggggatagta

SEQ ID NO: 26749 - DNA, 20 bp, Artificial Sequence
  Synthetic oligonucleotide; TGG chr11 5380871 5380890 5380887 +
ccctggggatagtagggcct

SEQ ID NO: 26750 - DNA, 20 bp, Artificial Sequence
  Synthetic oligonucleotide; TGG chr11 5380877 5380896 5380893 +
ggatagtagggccttggtgc

SEQ ID NO: 26751 - DNA, 20 bp, Artificial Sequence
  Synthetic oligonucleotide; CAG chr11 5380881 5380900 5380897 +
agtagggccttggtgctggt

SEQ ID NO: 26752 - DNA, 20 bp, Artificial Sequence
  Synthetic oligonucleotide; AAG chr11 5380889 5380908 5380905 +
cttggtgctggtcagaattt

SEQ ID NO: 26753 - DNA, 20 bp, Artificial Sequence
  Synthetic oligonucleotide; TGG chr11 5380900 5380919 5380916 +
tcagaatttaagcctatcct

SEQ ID NO: 26754 - DNA, 20 bp, Artificial Sequence
  Synthetic oligonucleotide; GGG chr11 5380901 5380920 5380917 +
cagaatttaagcctatcctt

SEQ ID NO: 26755 - DNA, 20 bp, Artificial Sequence
  Synthetic oligonucleotide; TGG chr11 5380918 5380937 5380934 +
cttgggctgaatgctccccc

SEQ ID NO: 26756 - DNA, 20 bp, Artificial Sequence
  Synthetic oligonucleotide; TGG chr11 5380921 5380940 5380937 +
gggctgaatgctccccctgg

SEQ ID NO: 26757 - DNA, 20 bp, Artificial Sequence
  Synthetic oligonucleotide; TGG chr11 5380930 5380949 5380946 +
gctccccctggtggctacat

SEQ ID NO: 26758 - DNA, 20 bp, Artificial Sequence
  Synthetic oligonucleotide; CAG chr11 5380940 5380959 5380956 +
gtggctacattggaaaacca

SEQ ID NO: 26759 - DNA, 20 bp, Artificial Sequence
  Synthetic oligonucleotide; CAG chr11 5380951 5380970 5380967 +
ggaaaaccacagcatgtgta

SEQ ID NO: 26760 - DNA, 20 bp, Artificial Sequence
  Synthetic oligonucleotide; TGG chr11 5380958 5380977 5380974 +
cacagcatgtgtacagacct

SEQ ID NO: 26761 - DNA, 20 bp, Artificial Sequence
  Synthetic oligonucleotide; GGG chr11 5380959 5380978 5380975 +
acagcatgtgtacagacctt

SEQ ID NO: 26762 - DNA, 20 bp, Artificial Sequence
  Synthetic oligonucleotide; GGG chr11 5380960 5380979 5380976 +
cagcatgtgtacagaccttg

SEQ ID NO: 26763 - DNA, 20 bp, Artificial Sequence
  Synthetic oligonucleotide; CAG chr11 5380966 5380985 5380982 +
gtgtacagaccttggggatt

SEQ ID NO: 26764 - DNA, 20 bp, Artificial Sequence
  Synthetic oligonucleotide; AAG chr11 5380977 5380996 5380993 +
ttggggattcagttctcctg

SEQ ID NO: 26765 - DNA, 20 bp, Artificial Sequence
  Synthetic oligonucleotide; AGG chr11 5380978 5380997 5380994 +
tggggattcagttctcctga

SEQ ID NO: 26766 - DNA, 20 bp, Artificial Sequence
  Synthetic oligonucleotide; AAG chr11 5380997 5381016 5381013 +
aaggaatctcctacttcacc

SEQ ID NO: 26767 - DNA, 20 bp, Artificial Sequence
  Synthetic oligonucleotide; TGG chr11 5381002 5381021 5381018 +
atctcctacttcaccaagcc

SEQ ID NO: 26768 - DNA, 20 bp, Artificial Sequence
  Synthetic oligonucleotide; CAG chr11 5381007 5381026 5381023 +
ctacttcaccaagcctggct

SEQ ID NO: 26769 - DNA, 20 bp, Artificial Sequence
  Synthetic oligonucleotide; TGG chr11 5381010 5381029 5381026 +
cttcaccaagcctggctcag

SEQ ID NO: 26770 - DNA, 20 bp, Artificial Sequence
  Synthetic oligonucleotide; GGG chr11 5381011 5381030 5381027 +
ttcaccaagcctggctcagt

SEQ ID NO: 26771 - DNA, 20 bp, Artificial Sequence
  Synthetic oligonucleotide; TGG chr11 5381015 5381034 5381031 +
ccaagcctggctcagtgggc

SEQ ID NO: 26772 - DNA, 20 bp, Artificial Sequence
  Synthetic oligonucleotide; TAG chr11 5381019 5381038 5381035 +
gcctggctcagtgggctggc

SEQ ID NO: 26773 - DNA, 20 bp, Artificial Sequence
  Synthetic oligonucleotide; AGG chr11 5381020 5381039 5381036 +
cctggctcagtgggctggct

SEQ ID NO: 26774 - DNA, 20 bp, Artificial Sequence
  Synthetic oligonucleotide; TGG chr11 5381032 5381051 5381048 +
ggctggctaggtatcaattc

SEQ ID NO: 26775 - DNA, 20 bp, Artificial Sequence
  Synthetic oligonucleotide; TAG chr11 5381036 5381055 5381052 +
ggctaggtatcaattctgga

SEQ ID NO: 26776 - DNA, 20 bp, Artificial Sequence
  Synthetic oligonucleotide; GAG chr11 5381038 5381057 5381054 +
ctaggtatcaattctggata

SEQ ID NO: 26777 - DNA, 20 bp, Artificial Sequence
  Synthetic oligonucleotide; AGG chr11 5381039 5381058 5381055 +
taggtatcaattctggatag

SEQ ID NO: 26778 - DNA, 20 bp, Artificial Sequence
  Synthetic oligonucleotide; TGG chr11 5381063 5381082 5381079 +
tccttaaataaaacttatac

SEQ ID NO: 26779 - DNA, 20 bp, Artificial Sequence
  Synthetic oligonucleotide; AAG chr11 5381074 5381093 5381090 +
aacttatactggccccttga

SEQ ID NO: 26780 - DNA, 20 bp, Artificial Sequence
  Synthetic oligonucleotide; CAG chr11 5381078 5381097 5381094 +
tatactggccccttgaaagc

SEQ ID NO: 26781 - DNA, 20 bp, Artificial Sequence
  Synthetic oligonucleotide; AGG chr11 5381079 5381098 5381095 +
atactggccccttgaaagcc

SEQ ID NO: 26782 - DNA, 20 bp, Artificial Sequence
  Synthetic oligonucleotide; TAG chr11 5381209 5381228 5381225 +
accatttgcacattaacaaa

SEQ ID NO: 26783 - DNA, 20 bp, Artificial Sequence
  Synthetic oligonucleotide; AGG chr11 5381210 5381229 5381226 +
ccatttgcacattaacaaat

SEQ ID NO: 26784 - DNA, 20 bp, Artificial Sequence
  Synthetic oligonucleotide; CAG chr11 5381223 5381242 5381239 +
aacaaataggtacactgtta

SEQ ID NO: 26785 - DNA, 20 bp, Artificial Sequence
  Synthetic oligonucleotide; TAG chr11 5381242 5381261 5381258 +
acagtgacacttttcacttt

SEQ ID NO: 26786 - DNA, 20 bp, Artificial Sequence
  Synthetic oligonucleotide; TGG chr11 5381248 5381267 5381264 +
acacttttcacttttagtaa

SEQ ID NO: 26787 - DNA, 20 bp, Artificial Sequence
  Synthetic oligonucleotide; TAG chr11 5381254 5381273 5381270 +
ttcacttttagtaatggatt

SEQ ID NO: 26788 - DNA, 20 bp, Artificial Sequence
  Synthetic oligonucleotide; AAG chr11 5381286 5381305 5381302 +
taatgaattctaatacctta

SEQ ID NO: 26789 - DNA, 20 bp, Artificial Sequence
  Synthetic oligonucleotide; AGG chr11 5381287 5381306 5381303 +
aatgaattctaataccttaa

SEQ ID NO: 26790 - DNA, 20 bp, Artificial Sequence
  Synthetic oligonucleotide; AAG chr11 5381292 5381311 5381308 +
attctaataccttaaaggtt

SEQ ID NO: 26791 - DNA, 20 bp, Artificial Sequence
  Synthetic oligonucleotide; AGG chr11 5381293 5381312 5381309 +
ttctaataccttaaaggtta

SEQ ID NO: 26792 - DNA, 20 bp, Artificial Sequence
  Synthetic oligonucleotide; CAG chr11 5381388 5381407 5381404 +
aatattcgcatgattaccca

SEQ ID NO: 26793 - DNA, 20 bp, Artificial Sequence
  Synthetic oligonucleotide; TAG chr11 5381394 5381413 5381410 +
cgcatgattacccacagtga

SEQ ID NO: 26794 - DNA, 20 bp, Artificial Sequence
  Synthetic oligonucleotide; GAG chr11 5381396 5381415 5381412 +
catgattacccacagtgata

SEQ ID NO: 26795 - DNA, 20 bp, Artificial Sequence
  Synthetic oligonucleotide; TAG chr11 5381400 5381419 5381416 +
attacccacagtgatagaga

SEQ ID NO: 26796 - DNA, 20 bp, Artificial Sequence
  Synthetic oligonucleotide; AGG chr11 5381401 5381420 5381417 +
ttacccacagtgatagagat

SEQ ID NO: 26797 - DNA, 20 bp, Artificial Sequence
  Synthetic oligonucleotide; GAG chr11 5381407 5381426 5381423 +
acagtgatagagataggtcc

SEQ ID NO: 26798 - DNA, 20 bp, Artificial Sequence
  Synthetic oligonucleotide; AGG chr11 5381408 5381427 5381424 +
cagtgatagagataggtccg

SEQ ID NO: 26799 - DNA, 20 bp, Artificial Sequence
  Synthetic oligonucleotide; TGG chr11 5381445 5381464 5381461 +
tgtccccatcatcctcctct

SEQ ID NO: 26800 - DNA, 20 bp, Artificial Sequence
  Synthetic oligonucleotide; CAG chr11 5381452 5381471 5381468 +
atcatcctcctcttggcctc

SEQ ID NO: 26801 - DNA, 20 bp, Artificial Sequence
  Synthetic oligonucleotide; AGG chr11 5381453 5381472 5381469 +
tcatcctcctcttggcctcc

SEQ ID NO: 26802 - DNA, 20 bp, Artificial Sequence
  Synthetic oligonucleotide; CAG chr11 5381459 5381478 5381475 +
tcctcttggcctccaggctt

SEQ ID NO: 26803 - DNA, 20 bp, Artificial Sequence
  Synthetic oligonucleotide; TAG chr11 5381480 5381499 5381496 +
agaaactacctctgccttcc

SEQ ID NO: 26804 - DNA, 20 bp, Artificial Sequence
  Synthetic oligonucleotide; TGG chr11 5381485 5381504 5381501 +
ctacctctgccttcctagcc

SEQ ID NO: 26805 - DNA, 20 bp, Artificial Sequence
  Synthetic oligonucleotide; GGG chr11 5381486 5381505 5381502 +
tacctctgccttcctagcct

SEQ ID NO: 26806 - DNA, 20 bp, Artificial Sequence
  Synthetic oligonucleotide; TAG chr11 5381490 5381509 5381506 +
tctgccttcctagcctgggc

SEQ ID NO: 26807 - DNA, 20 bp, Artificial Sequence
  Synthetic oligonucleotide; TGG chr11 5381504 5381523 5381520 +
ctgggctagtgaccctattt

SEQ ID NO: 26808 - DNA, 20 bp, Artificial Sequence
  Synthetic oligonucleotide; GAG chr11 5381544 5381563 5381560 +
ctaacatctttactcaatgt

SEQ ID NO: 26809 - DNA, 20 bp, Artificial Sequence
  Synthetic oligonucleotide; AAG chr11 5381554 5381573 5381570 +
tactcaatgtgagcttcata

SEQ ID NO: 26810 - DNA, 20 bp, Artificial Sequence
  Synthetic oligonucleotide; AGG chr11 5381555 5381574 5381571 +
actcaatgtgagcttcataa

SEQ ID NO: 26811 - DNA, 20 bp, Artificial Sequence
  Synthetic oligonucleotide; AAG chr11 5381559 5381578 5381575 +
aatgtgagcttcataaaggc

SEQ ID NO: 26812 - DNA, 20 bp, Artificial Sequence
  Synthetic oligonucleotide; AAG chr11 5381590 5381609 5381606 +
atgttaatctgtctatcttc

SEQ ID NO: 26813 - DNA, 20 bp, Artificial Sequence
  Synthetic oligonucleotide; CAG chr11 5381601 5381620 5381617 +
tctatcttcaagttcttgat

SEQ ID NO: 26814 - DNA, 20 bp, Artificial Sequence
  Synthetic oligonucleotide; GAG chr11 5381603 5381622 5381619 +
tatcttcaagttcttgatca

SEQ ID NO: 26815 - DNA, 20 bp, Artificial Sequence
  Synthetic oligonucleotide; CAG chr11 5381613 5381632 5381629 +
ttcttgatcagagtttctca

SEQ ID NO: 26816 - DNA, 20 bp, Artificial Sequence
  Synthetic oligonucleotide; AGG chr11 5381614 5381633 5381630 +
tcttgatcagagtttctcac

SEQ ID NO: 26817 - DNA, 20 bp, Artificial Sequence
  Synthetic oligonucleotide; GAG chr11 5381648 5381667 5381664 +
gcacgtcaatgaaaattgat

SEQ ID NO: 26818 - DNA, 20 bp, Artificial Sequence
  Synthetic oligonucleotide; CAG chr11 5381668 5381687 5381684 +
gagaatgtttaatgtaattt

SEQ ID NO: 26819 - DNA, 20 bp, Artificial Sequence
  Synthetic oligonucleotide; AAG chr11 5381681 5381700 5381697 +
gtaatttcagtcacacttca

SEQ ID NO: 26820 - DNA, 20 bp, Artificial Sequence
  Synthetic oligonucleotide; GAG chr11 5381683 5381702 5381699 +
aatttcagtcacacttcaaa

SEQ ID NO: 26821 - DNA, 20 bp, Artificial Sequence
  Synthetic oligonucleotide; AGG chr11 5381684 5381703 5381700 +
atttcagtcacacttcaaag

SEQ ID NO: 26822 - DNA, 20 bp, Artificial Sequence
  Synthetic oligonucleotide; AAG chr11 5381717 5381736 5381733 +
gatatgataaaacaaatcta

SEQ ID NO: 26823 - DNA, 20 bp, Artificial Sequence
  Synthetic oligonucleotide; AGG chr11 5381718 5381737 5381734 +
atatgataaaacaaatctaa

SEQ ID NO: 26824 - DNA, 20 bp, Artificial Sequence
  Synthetic oligonucleotide; TAG chr11 5381726 5381745 5381742 +
aaacaaatctaaaggtcatt

SEQ ID NO: 26825 - DNA, 20 bp, Artificial Sequence
  Synthetic oligonucleotide; GAG chr11 5381728 5381747 5381744 +
acaaatctaaaggtcattta

SEQ ID NO: 26826 - DNA, 20 bp, Artificial Sequence
  Synthetic oligonucleotide; AAG chr11 5381736 5381755 5381752 +
aaaggtcatttagagcaata

SEQ ID NO: 26827 - DNA, 20 bp, Artificial Sequence
  Synthetic oligonucleotide; GAG chr11 5381752 5381771 5381768 +
aataaagaatcaaaaatgct

SEQ ID NO: 26828 - DNA, 20 bp, Artificial Sequence
  Synthetic oligonucleotide; TGG chr11 5381765 5381784 5381781 +
aaatgctgagttctttcatt

SEQ ID NO: 26829 - DNA, 20 bp, Artificial Sequence
  Synthetic oligonucleotide; TGG chr11 5381789 5381808 5381805 +
tttcaaataaatctattgct

SEQ ID NO: 26830 - DNA, 20 bp, Artificial Sequence
  Synthetic oligonucleotide; TGG chr11 5381796 5381815 5381812 +
taaatctattgcttggaaac

SEQ ID NO: 26831 - DNA, 20 bp, Artificial Sequence
  Synthetic oligonucleotide; CAG chr11 5381817 5381836 5381833 +
ggtccttcaattatataatt

SEQ ID NO: 26832 - DNA, 20 bp, Artificial Sequence
  Synthetic oligonucleotide; GAG chr11 5381819 5381838 5381835 +
tccttcaattatataattca

SEQ ID NO: 26833 - DNA, 20 bp, Artificial Sequence
  Synthetic oligonucleotide; TAG chr11 5381825 5381844 5381841 +
aattatataattcagagaaa

SEQ ID NO: 26834 - DNA, 20 bp, Artificial Sequence
  Synthetic oligonucleotide; AAG chr11 5381834 5381853 5381850 +
attcagagaaatagaatata

SEQ ID NO: 26835 - DNA, 20 bp, Artificial Sequence
  Synthetic oligonucleotide; CAG chr11 5381845 5381864 5381861 +
tagaatataaagctattata

SEQ ID NO: 26836 - DNA, 20 bp, Artificial Sequence
  Synthetic oligonucleotide; TAG chr11 5381852 5381871 5381868 +
taaagctattatacagatgt

SEQ ID NO: 26837 - DNA, 20 bp, Artificial Sequence
  Synthetic oligonucleotide; AAG chr11 5381862 5381881 5381878 +
atacagatgttagtttaaaa

SEQ ID NO: 26838 - DNA, 20 bp, Artificial Sequence
  Synthetic oligonucleotide; AAG chr11 5381866 5381885 5381882 +
agatgttagtttaaaaaagt

SEQ ID NO: 26839 - DNA, 20 bp, Artificial Sequence
  Synthetic oligonucleotide; TAG chr11 5381876 5381895 5381892 +
ttaaaaaagtaagcaaatat

SEQ ID NO: 26840 - DNA, 20 bp, Artificial Sequence
  Synthetic oligonucleotide; GAG chr11 5381878 5381897 5381894 +
aaaaaagtaagcaaatatta

SEQ ID NO: 26841 - DNA, 20 bp, Artificial Sequence
  Synthetic oligonucleotide; TGG chr11 5381890 5381909 5381906 +
aaatattagagatctctaaa

SEQ ID NO: 26842 - DNA, 20 bp, Artificial Sequence
  Synthetic oligonucleotide; TAG chr11 5381893 5381912 5381909 +
tattagagatctctaaatgg

SEQ ID NO: 26843 - DNA, 20 bp, Artificial Sequence
  Synthetic oligonucleotide; AGG chr11 5381894 5381913 5381910 +
attagagatctctaaatggt

SEQ ID NO: 26844 - DNA, 20 bp, Artificial Sequence
  Synthetic oligonucleotide; CAG chr11 5381909 5381928 5381925 +
atggtaggttatccactaaa

SEQ ID NO: 26845 - DNA, 20 bp, Artificial Sequence
  Synthetic oligonucleotide; AAG chr11 5381931 5381950 5381947 +
gtattgtttatctacgtaaa

SEQ ID NO: 26846 - DNA, 20 bp, Artificial Sequence
  Synthetic oligonucleotide; CAG chr11 5381956 5381975 5381972 +
gtcaattacatatctgcatc

SEQ ID NO: 26847 - DNA, 20 bp, Artificial Sequence
  Synthetic oligonucleotide; CAG chr11 5381987 5382006 5382003 +
accaaaataacatctgtttc

SEQ ID NO: 26848 - DNA, 20 bp, Artificial Sequence
  Synthetic oligonucleotide; CAG chr11 5381992 5382011 5382008 +
aataacatctgtttccagtg

SEQ ID NO: 26849 - DNA, 20 bp, Artificial Sequence
  Synthetic oligonucleotide; TGG chr11 5382033 5382052 5382049 +
atattgttaacaatgtactc

SEQ ID NO: 26850 - DNA, 20 bp, Artificial Sequence
  Synthetic oligonucleotide; CAG chr11 5382117 5382136 5382133 +
acatgtcatataaactcatt

SEQ ID NO: 26851 - DNA, 20 bp, Artificial Sequence
  Synthetic oligonucleotide; AGG chr11 5382118 5382137 5382134 +
catgtcatataaactcattc

SEQ ID NO: 26852 - DNA, 20 bp, Artificial Sequence
  Synthetic oligonucleotide; GGG chr11 5382119 5382138 5382135 +
atgtcatataaactcattca

SEQ ID NO: 26853 - DNA, 20 bp, Artificial Sequence
  Synthetic oligonucleotide; AAG chr11 5382155 5382174 5382171 +
tacctctactgttttattcc

SEQ ID NO: 26854 - DNA, 20 bp, Artificial Sequence
  Synthetic oligonucleotide; AGG chr11 5382156 5382175 5382172 +
acctctactgttttattcca

SEQ ID NO: 26855 - DNA, 20 bp, Artificial Sequence
  Synthetic oligonucleotide; CGG chr11 5382191 5382210 5382207 +
taaatgttatatttgatcac

SEQ ID NO: 26856 - DNA, 20 bp, Artificial Sequence
  Synthetic oligonucleotide; TAG chr11 5382203 5382222 5382219 +
ttgatcaccggaaaatctta

SEQ ID NO: 26857 - DNA, 20 bp, Artificial Sequence
  Synthetic oligonucleotide; TGG chr11 5382270 5382289 5382286 +
cttacactacccctcctttt

SEQ ID NO: 26858 - DNA, 20 bp, Artificial Sequence
  Synthetic oligonucleotide; AAG chr11 5382288 5382307 5382304 +
tttggaaatacctttctata

SEQ ID NO: 26859 - DNA, 20 bp, Artificial Sequence
  Synthetic oligonucleotide; TGG chr11 5382300 5382319 5382316 +
tttctataaagccctatctg

SEQ ID NO: 26860 - DNA, 20 bp, Artificial Sequence
  Synthetic oligonucleotide; TAG chr11 5382315 5382334 5382331 +
atctgtggttgattcttaat

SEQ ID NO: 26861 - DNA, 20 bp, Artificial Sequence
  Synthetic oligonucleotide; TAG chr11 5382324 5382343 5382340 +
tgattcttaattagtcttca

SEQ ID NO: 26862 - DNA, 20 bp, Artificial Sequence
  Synthetic oligonucleotide; CAG chr11 5382329 5382348 5382345 +
cttaattagtcttcatagct

SEQ ID NO: 26863 - DNA, 20 bp, Artificial Sequence
  Synthetic oligonucleotide; AGG chr11 5382330 5382349 5382346 +
ttaattagtcttcatagctc

SEQ ID NO: 26864 - DNA, 20 bp, Artificial Sequence
  Synthetic oligonucleotide; TGG chr11 5382334 5382353 5382350 +
ttagtcttcatagctcaggt

SEQ ID NO: 26865 - DNA, 20 bp, Artificial Sequence
  Synthetic oligonucleotide; GGG chr11 5382335 5382354 5382351 +
tagtcttcatagctcaggtt

SEQ ID NO: 26866 - DNA, 20 bp, Artificial Sequence
  Synthetic oligonucleotide; GGG chr11 5382336 5382355 5382352 +
agtcttcatagctcaggttg

SEQ ID NO: 26867 - DNA, 20 bp, Artificial Sequence
  Synthetic oligonucleotide; TGG chr11 5382346 5382365 5382362 +
gctcaggttggggccttccc

SEQ ID NO: 26868 - DNA, 20 bp, Artificial Sequence
  Synthetic oligonucleotide; TGG chr11 5382359 5382378 5382375 +
ccttccctggccctcacctg

SEQ ID NO: 26869 - DNA, 20 bp, Artificial Sequence
  Synthetic oligonucleotide; GGG chr11 5382360 5382379 5382376 +
cttccctggccctcacctgt

SEQ ID NO: 26870 - DNA, 20 bp, Artificial Sequence
  Synthetic oligonucleotide; CAG chr11 5382364 5382383 5382380 +
cctggccctcacctgtgggc

SEQ ID NO: 26871 - DNA, 20 bp, Artificial Sequence
  Synthetic oligonucleotide; AGG chr11 5382365 5382384 5382381 +
ctggccctcacctgtgggcc

SEQ ID NO: 26872 - DNA, 20 bp, Artificial Sequence
  Synthetic oligonucleotide; AAG chr11 5382420 5382439 5382436 +
tccatctcttacattgcgct

SEQ ID NO: 26873 - DNA, 20 bp, Artificial Sequence
  Synthetic oligonucleotide; TAG chr11 5382424 5382443 5382440 +
tctcttacattgcgctaaga

SEQ ID NO: 26874 - DNA, 20 bp, Artificial Sequence
  Synthetic oligonucleotide; TAG chr11 5382450 5382469 5382466 +
ttttcctatcttatgtgtga

SEQ ID NO: 26875 - DNA, 20 bp, Artificial Sequence
  Synthetic oligonucleotide; TAG chr11 5382467 5382486 5382483 +
tgatagatgcccctgaataa

SEQ ID NO: 26876 - DNA, 20 bp, Artificial Sequence
  Synthetic oligonucleotide; TGG chr11 5382486 5382505 5382502 +
atagcaatatttgctgttgc

SEQ ID NO: 26877 - DNA, 20 bp, Artificial Sequence
  Synthetic oligonucleotide; TAG chr11 5382495 5382514 5382511 +
tttgctgttgctggtaataa

SEQ ID NO: 26878 - DNA, 20 bp, Artificial Sequence
  Synthetic oligonucleotide; CAG chr11 5382498 5382517 5382514 +
gctgttgctggtaataatag

SEQ ID NO: 26879 - DNA, 20 bp, Artificial Sequence
  Synthetic oligonucleotide; TGG chr11 5382524 5382543 5382540 +
tgttgctgttatactgtcct

SEQ ID NO: 26880 - DNA, 20 bp, Artificial Sequence
  Synthetic oligonucleotide; TAG chr11 5382528 5382547 5382544 +
gctgttatactgtccttggc

SEQ ID NO: 26881 - DNA, 20 bp, Artificial Sequence
  Synthetic oligonucleotide; AGG chr11 5382529 5382548 5382545 +
ctgttatactgtccttggct

SEQ ID NO: 26882 - DNA, 20 bp, Artificial Sequence
  Synthetic oligonucleotide; CAG chr11 5382536 5382555 5382552 +
actgtccttggctaggatcc

SEQ ID NO: 26883 - DNA, 20 bp, Artificial Sequence
  Synthetic oligonucleotide; TAG chr11 5382544 5382563 5382560 +
tggctaggatcccagtgaaa

SEQ ID NO: 26884 - DNA, 20 bp, Artificial Sequence
  Synthetic oligonucleotide; AGG chr11 5382545 5382564 5382561 +
ggctaggatcccagtgaaat

SEQ ID NO: 26885 - DNA, 20 bp, Artificial Sequence
  Synthetic oligonucleotide; CAG chr11 5382572 5382591 5382588 +
aatcatgttcttaataaatg

SEQ ID NO: 26886 - DNA, 20 bp, Artificial Sequence
  Synthetic oligonucleotide; AGG chr11 5382573 5382592 5382589 +
atcatgttcttaataaatgc

SEQ ID NO: 26887 - DNA, 20 bp, Artificial Sequence
  Synthetic oligonucleotide; TGG chr11 5382593 5382612 5382609 +
aggattttctgaaatttttc

SEQ ID NO: 26888 - DNA, 20 bp, Artificial Sequence
  Synthetic oligonucleotide; TAG chr11 5382596 5382615 5382612 +
attttctgaaatttttctgg

SEQ ID NO: 26889 - DNA, 20 bp, Artificial Sequence
  Synthetic oligonucleotide; TGG chr11 5382599 5382618 5382615 +
ttctgaaatttttctggtag

SEQ ID NO: 26890 - DNA, 20 bp, Artificial Sequence
  Synthetic oligonucleotide; AAG chr11 5382615 5382634 5382631 +
gtagtggtgccctctcctac

SEQ ID NO: 26891 - DNA, 20 bp, Artificial Sequence
  Synthetic oligonucleotide; AAG chr11 5382626 5382645 5382642 +
ctctcctacaagcctaaatg

SEQ ID NO: 26892 - DNA, 20 bp, Artificial Sequence
  Synthetic oligonucleotide; CAG chr11 5382634 5382653 5382650 +
caagcctaaatgaagatgct

SEQ ID NO: 26893 - DNA, 20 bp, Artificial Sequence
  Synthetic oligonucleotide; AAG chr11 5382655 5382674 5382671 +
agctccttcctattgtaccg

SEQ ID NO: 26894 - DNA, 20 bp, Artificial Sequence
  Synthetic oligonucleotide; CAG chr11 5382659 5382678 5382675 +
ccttcctattgtaccgaagc

SEQ ID NO: 26895 - DNA, 20 bp, Artificial Sequence
  Synthetic oligonucleotide; AAG chr11 5382688 5382707 5382704 +
cctcataactacaatttaat

SEQ ID NO: 26896 - DNA, 20 bp, Artificial Sequence
  Synthetic oligonucleotide; TGG chr11 5382740 5382759 5382756 +
accctgactctcctacactc

SEQ ID NO: 26897 - DNA, 20 bp, Artificial Sequence
  Synthetic oligonucleotide; CAG chr11 5382753 5382772 5382769 +
tacactctggccctaacaac

SEQ ID NO: 26898 - DNA, 20 bp, Artificial Sequence
  Synthetic oligonucleotide; CGG chr11 5382765 5382784 5382781 +
ctaacaaccagttacttacc

SEQ ID NO: 26899 - DNA, 20 bp, Artificial Sequence
  Synthetic oligonucleotide; AAG chr11 5382771 5382790 5382787 +
accagttacttacccggtgt

SEQ ID NO: 26900 - DNA, 20 bp, Artificial Sequence
  Synthetic oligonucleotide; AGG chr11 5382772 5382791 5382788 +
ccagttacttacccggtgta

SEQ ID NO: 26901 - DNA, 20 bp, Artificial Sequence
  Synthetic oligonucleotide; TGG chr11 5382775 5382794 5382791 +
gttacttacccggtgtaagg

SEQ ID NO: 26902 - DNA, 20 bp, Artificial Sequence
  Synthetic oligonucleotide; TGG chr11 5382791 5382810 5382807 +
aaggtggtgccacttctgtc

SEQ ID NO: 26903 - DNA, 20 bp, Artificial Sequence
  Synthetic oligonucleotide; GGG chr11 5382792 5382811 5382808 +
aggtggtgccacttctgtct

SEQ ID NO: 26904 - DNA, 20 bp, Artificial Sequence
  Synthetic oligonucleotide; TGG chr11 5382797 5382816 5382813 +
gtgccacttctgtctgggtg

SEQ ID NO: 26905 - DNA, 20 bp, Artificial Sequence
  Synthetic oligonucleotide; TGG chr11 5382811 5382830 5382827 +
tgggtgtggtctgatcacaa

SEQ ID NO: 26906 - DNA, 20 bp, Artificial Sequence
  Synthetic oligonucleotide; TGG chr11 5382830 5382849 5382846 +
atggcatgtcataaacttca

SEQ ID NO: 26907 - DNA, 20 bp, Artificial Sequence
  Synthetic oligonucleotide; GGG chr11 5382831 5382850 5382847 +
tggcatgtcataaacttcat

SEQ ID NO: 26908 - DNA, 20 bp, Artificial Sequence
  Synthetic oligonucleotide; TGG chr11 5382843 5382862 5382859 +
aacttcatgggtctctgtcc

SEQ ID NO: 26909 - DNA, 20 bp, Artificial Sequence
  Synthetic oligonucleotide; TAG chr11 5382849 5382868 5382865 +
atgggtctctgtcctggttt

SEQ ID NO: 26910 - DNA, 20 bp, Artificial Sequence
  Synthetic oligonucleotide; TGG chr11 5382869 5382888 5382885 +
tagatctgtatgccccgttt

SEQ ID NO: 26911 - DNA, 20 bp, Artificial Sequence
  Synthetic oligonucleotide; GAG chr11 5382871 5382890 5382887 +
gatctgtatgccccgttttg

SEQ ID NO: 26912 - DNA, 20 bp, Artificial Sequence
  Synthetic oligonucleotide; AAG chr11 5382913 5382932 5382929 +
aatcaaccatgccctattta

SEQ ID NO: 26913 - DNA, 20 bp, Artificial Sequence
  Synthetic oligonucleotide; AGG chr11 5382914 5382933 5382930 +
atcaaccatgccctatttaa

SEQ ID NO: 26914 - DNA, 20 bp, Artificial Sequence
  Synthetic oligonucleotide; CAG chr11 5382938 5382957 5382954 +
tgtaataccttgcttcatgc

SEQ ID NO: 26915 - DNA, 20 bp, Artificial Sequence
  Synthetic oligonucleotide; AAG chr11 5382946 5382965 5382962 +
cttgcttcatgccagtctcc

SEQ ID NO: 26916 - DNA, 20 bp, Artificial Sequence
  Synthetic oligonucleotide; GAG chr11 5382948 5382967 5382964 +
tgcttcatgccagtctccaa

SEQ ID NO: 26917 - DNA, 20 bp, Artificial Sequence
  Synthetic oligonucleotide; TGG chr11 5382965 5382984 5382981 +
caagagtgtgtgtgtgtttg

SEQ ID NO: 26918 - DNA, 20 bp, Artificial Sequence
  Synthetic oligonucleotide; TGG chr11 5382968 5382987 5382984 +
gagtgtgtgtgtgtttgtgg

SEQ ID NO: 26919 - DNA, 20 bp, Artificial Sequence
  Synthetic oligonucleotide; GAG chr11 5382970 5382989 5382986 +
gtgtgtgtgtgtttgtggtg

SEQ ID NO: 26920 - DNA, 20 bp, Artificial Sequence
  Synthetic oligonucleotide; GAG chr11 5382972 5382991 5382988 +
gtgtgtgtgtttgtggtgga

SEQ ID NO: 26921 - DNA, 20 bp, Artificial Sequence
  Synthetic oligonucleotide; AGG chr11 5382973 5382992 5382989 +
tgtgtgtgtttgtggtggag

SEQ ID NO: 26922 - DNA, 20 bp, Artificial Sequence
  Synthetic oligonucleotide; GAG chr11 5382984 5383003 5383000 +
gtggtggagaggttgtgtgt

SEQ ID NO: 26923 - DNA, 20 bp, Artificial Sequence
  Synthetic oligonucleotide; AAG chr11 5382993 5383012 5383009 +
aggttgtgtgtgagttttga

SEQ ID NO: 26924 - DNA, 20 bp, Artificial Sequence
  Synthetic oligonucleotide; AAG chr11 5382998 5383017 5383014 +
gtgtgtgagttttgaaagaa

SEQ ID NO: 26925 - DNA, 20 bp, Artificial Sequence
  Synthetic oligonucleotide; GAG chr11 5383000 5383019 5383016 +
gtgtgagttttgaaagaaaa

SEQ ID NO: 26926 - DNA, 20 bp, Artificial Sequence
  Synthetic oligonucleotide; CAG chr11 5383033 5383052 5383049 +
atgacctgatcacattaact

SEQ ID NO: 26927 - DNA, 20 bp, Artificial Sequence
  Synthetic oligonucleotide; AGG chr11 5383034 5383053 5383050 +
tgacctgatcacattaactc

SEQ ID NO: 26928 - DNA, 20 bp, Artificial Sequence
  Synthetic oligonucleotide; TAG chr11 5383042 5383061 5383058 +
tcacattaactcaggttctg

SEQ ID NO: 26929 - DNA, 20 bp, Artificial Sequence
  Synthetic oligonucleotide; TAG chr11 5383047 5383066 5383063 +
ttaactcaggttctgtagca

SEQ ID NO: 26930 - DNA, 20 bp, Artificial Sequence
  Synthetic oligonucleotide; TGG chr11 5383052 5383071 5383068 +
tcaggttctgtagcatagtc

SEQ ID NO: 26931 - DNA, 20 bp, Artificial Sequence
  Synthetic oligonucleotide; GGG chr11 5383053 5383072 5383069 +
caggttctgtagcatagtct

SEQ ID NO: 26932 - DNA, 20 bp, Artificial Sequence
  Synthetic oligonucleotide; GGG chr11 5383054 5383073 5383070 +
aggttctgtagcatagtctg

SEQ ID NO: 26933 - DNA, 20 bp, Artificial Sequence
  Synthetic oligonucleotide; AAG chr11 5383057 5383076 5383073 +
ttctgtagcatagtctgggg

SEQ ID NO: 26934 - DNA, 20 bp, Artificial Sequence
  Synthetic oligonucleotide; AAG chr11 5383060 5383079 5383076 +
tgtagcatagtctggggaag

SEQ ID NO: 26935 - DNA, 20 bp, Artificial Sequence
  Synthetic oligonucleotide; AAG chr11 5383066 5383085 5383082 +
atagtctggggaagaagtac

SEQ ID NO: 26936 - DNA, 20 bp, Artificial Sequence
  Synthetic oligonucleotide; TGG chr11 5383095 5383114 5383111 +
tttttttttctaaatgttga

SEQ ID NO: 26937 - DNA, 20 bp, Artificial Sequence
  Synthetic oligonucleotide; CAG chr11 5383108 5383127 5383124 +
atgttgatggcatttgctac

SEQ ID NO: 26938 - DNA, 20 bp, Artificial Sequence
  Synthetic oligonucleotide; AAG chr11 5383113 5383132 5383129 +
gatggcatttgctaccagaa

SEQ ID NO: 26939 - DNA, 20 bp, Artificial Sequence
  Synthetic oligonucleotide; AAG chr11 5383116 5383135 5383132 +
ggcatttgctaccagaaaag

SEQ ID NO: 26940 - DNA, 20 bp, Artificial Sequence
  Synthetic oligonucleotide; AGG chr11 5383117 5383136 5383133 +
gcatttgctaccagaaaaga

SEQ ID NO: 26941 - DNA, 20 bp, Artificial Sequence
  Synthetic oligonucleotide; AAG chr11 5383124 5383143 5383140 +
ctaccagaaaagaaggaaaa

SEQ ID NO: 26942 - DNA, 20 bp, Artificial Sequence
  Synthetic oligonucleotide; AAG chr11 5383134 5383153 5383150 +
agaaggaaaaaagttttgta

SEQ ID NO: 26943 - DNA, 20 bp, Artificial Sequence
  Synthetic oligonucleotide; AGG chr11 5383135 5383154 5383151 +
gaaggaaaaaagttttgtaa

SEQ ID NO: 26944 - DNA, 20 bp, Artificial Sequence
  Synthetic oligonucleotide; TAG chr11 5383148 5383167 5383164 +
tttgtaaaggctacttgttg

SEQ ID NO: 26945 - DNA, 20 bp, Artificial Sequence
  Synthetic oligonucleotide; AGG chr11 5383149 5383168 5383165 +
ttgtaaaggctacttgttgt

SEQ ID NO: 26946 - DNA, 20 bp, Artificial Sequence
  Synthetic oligonucleotide; GGG chr11 5383150 5383169 5383166 +
tgtaaaggctacttgttgta

SEQ ID NO: 26947 - DNA, 20 bp, Artificial Sequence
  Synthetic oligonucleotide; AAG chr11 5383160 5383179 5383176 +
acttgttgtagggctcattg

SEQ ID NO: 26948 - DNA, 20 bp, Artificial Sequence
  Synthetic oligonucleotide; AGG chr11 5383161 5383180 5383177 +
cttgttgtagggctcattga

SEQ ID NO: 26949 - DNA, 20 bp, Artificial Sequence
  Synthetic oligonucleotide; AAG chr11 5383165 5383184 5383181 +
ttgtagggctcattgaagga

SEQ ID NO: 26950 - DNA, 20 bp, Artificial Sequence
  Synthetic oligonucleotide; CAG chr11 5383170 5383189 5383186 +
gggctcattgaaggaaagtc

SEQ ID NO: 26951 - DNA, 20 bp, Artificial Sequence
  Synthetic oligonucleotide; AAG chr11 5383181 5383200 5383197 +
aggaaagtccagtgcattca

SEQ ID NO: 26952 - DNA, 20 bp, Artificial Sequence
  Synthetic oligonucleotide; AAG chr11 5383187 5383206 5383203 +
gtccagtgcattcaaagatg

SEQ ID NO: 26953 - DNA, 20 bp, Artificial Sequence
  Synthetic oligonucleotide; TAG chr11 5383190 5383209 5383206 +
cagtgcattcaaagatgaag

SEQ ID NO: 26954 - DNA, 20 bp, Artificial Sequence
  Synthetic oligonucleotide; GAG chr11 5383192 5383211 5383208 +
gtgcattcaaagatgaagta

SEQ ID NO: 26955 - DNA, 20 bp, Artificial Sequence
  Synthetic oligonucleotide; GAG chr11 5383194 5383213 5383210 +
gcattcaaagatgaagtaga

SEQ ID NO: 26956 - DNA, 20 bp, Artificial Sequence
  Synthetic oligonucleotide; TGG chr11 5383200 5383219 5383216 +
aaagatgaagtagagagctt

SEQ ID NO: 26957 - DNA, 20 bp, Artificial Sequence
  Synthetic oligonucleotide; GGG chr11 5383201 5383220 5383217 +
aagatgaagtagagagcttt

SEQ ID NO: 26958 - DNA, 20 bp, Artificial Sequence
  Synthetic oligonucleotide; AAG chr11 5383205 5383224 5383221 +
tgaagtagagagctttggga

SEQ ID NO: 26959 - DNA, 20 bp, Artificial Sequence
  Synthetic oligonucleotide; GAG chr11 5383211 5383230 5383227 +
agagagctttgggaaagcct

SEQ ID NO: 26960 - DNA, 20 bp, Artificial Sequence
  Synthetic oligonucleotide; TGG chr11 5383223 5383242 5383239 +
gaaagcctgagacactgacc

SEQ ID NO: 26961 - DNA, 20 bp, Artificial Sequence
  Synthetic oligonucleotide; TGG chr11 5383235 5383254 5383251 +
cactgacctggacatttgtt

SEQ ID NO: 26962 - DNA, 20 bp, Artificial Sequence
  Synthetic oligonucleotide; GGG chr11 5383236 5383255 5383252 +
actgacctggacatttgttt

SEQ ID NO: 26963 - DNA, 20 bp, Artificial Sequence
  Synthetic oligonucleotide; GGG chr11 5383237 5383256 5383253 +
ctgacctggacatttgtttg

SEQ ID NO: 26964 - DNA, 20 bp, Artificial Sequence
  Synthetic oligonucleotide; TAG chr11 5383240 5383259 5383256 +
acctggacatttgtttgggg

SEQ ID NO: 26965 - DNA, 20 bp, Artificial Sequence
  Synthetic oligonucleotide; AGG chr11 5383241 5383260 5383257 +
cctggacatttgtttggggt

SEQ ID NO: 26966 - DNA, 20 bp, Artificial Sequence
  Synthetic oligonucleotide; AAG chr11 5383255 5383274 5383271 +
tggggtaggattgaatatgc

SEQ ID NO: 26967 - DNA, 20 bp, Artificial Sequence
  Synthetic oligonucleotide; TAG chr11 5383267 5383286 5383283 +
gaatatgcaagattgacttc

SEQ ID NO: 26968 - DNA, 20 bp, Artificial Sequence
  Synthetic oligonucleotide; AGG chr11 5383268 5383287 5383284 +
aatatgcaagattgacttct

SEQ ID NO: 26969 - DNA, 20 bp, Artificial Sequence
  Synthetic oligonucleotide; AAG chr11 5383275 5383294 5383291 +
aagattgacttctaggtcca

SEQ ID NO: 26970 - DNA, 20 bp, Artificial Sequence
  Synthetic oligonucleotide; TAG chr11 5383281 5383300 5383297 +
gacttctaggtccaaagata

SEQ ID NO: 26971 - DNA, 20 bp, Artificial Sequence
  Synthetic oligonucleotide; GAG chr11 5383283 5383302 5383299 +
cttctaggtccaaagatata

SEQ ID NO: 26972 - DNA, 20 bp, Artificial Sequence
  Synthetic oligonucleotide; AGG chr11 5383284 5383303 5383300 +
ttctaggtccaaagatatag

SEQ ID NO: 26973 - DNA, 20 bp, Artificial Sequence
  Synthetic oligonucleotide; TGG chr11 5383288 5383307 5383304 +
aggtccaaagatatagaggc

SEQ ID NO: 26974 - DNA, 20 bp, Artificial Sequence
  Synthetic oligonucleotide; CAG chr11 5383291 5383310 5383307 +
tccaaagatatagaggctgg

SEQ ID NO: 26975 - DNA, 20 bp, Artificial Sequence
  Synthetic oligonucleotide; GAG chr11 5383293 5383312 5383309 +
caaagatatagaggctggca

SEQ ID NO: 26976 - DNA, 20 bp, Artificial Sequence
  Synthetic oligonucleotide; TGG chr11 5383297 5383316 5383313 +
gatatagaggctggcagaga

SEQ ID NO: 26977 - DNA, 20 bp, Artificial Sequence
  Synthetic oligonucleotide; GAG chr11 5383299 5383318 5383315 +
tatagaggctggcagagatg

SEQ ID NO: 26978 - DNA, 20 bp, Artificial Sequence
  Synthetic oligonucleotide; AGG chr11 5383300 5383319 5383316 +
atagaggctggcagagatgg

SEQ ID NO: 26979 - DNA, 20 bp, Artificial Sequence
  Synthetic oligonucleotide; GGG chr11 5383301 5383320 5383317 +
tagaggctggcagagatgga

SEQ ID NO: 26980 - DNA, 20 bp, Artificial Sequence
  Synthetic oligonucleotide; CAG chr11 5383319 5383338 5383335 +
gagggcaatttaattatctg

SEQ ID NO: 26981 - DNA, 20 bp, Artificial Sequence
  Synthetic oligonucleotide; TGG chr11 5383326 5383345 5383342 +
atttaattatctgcagtaaa

SEQ ID NO: 26982 - DNA, 20 bp, Artificial Sequence
  Synthetic oligonucleotide; TAG chr11 5383340 5383359 5383356 +
agtaaatggaaatataaaaa

SEQ ID NO: 26983 - DNA, 20 bp, Artificial Sequence
  Synthetic oligonucleotide; CAG chr11 5383344 5383363 5383360 +
aatggaaatataaaaataga

SEQ ID NO: 26984 - DNA, 20 bp, Artificial Sequence
  Synthetic oligonucleotide; AGG chr11 5383345 5383364 5383361 +
atggaaatataaaaatagac

SEQ ID NO: 26985 - DNA, 20 bp, Artificial Sequence
  Synthetic oligonucleotide; GAG chr11 5383353 5383372 5383369 +
ataaaaatagacaggaaaat

SEQ ID NO: 26986 - DNA, 20 bp, Artificial Sequence
  Synthetic oligonucleotide; CAG chr11 5383358 5383377 5383374 +
aatagacaggaaaatgagtg

SEQ ID NO: 26987 - DNA, 20 bp, Artificial Sequence
  Synthetic oligonucleotide; AGG chr11 5383359 5383378 5383375 +
atagacaggaaaatgagtgc

SEQ ID NO: 26988 - DNA, 20 bp, Artificial Sequence
  Synthetic oligonucleotide; GAG chr11 5383361 5383380 5383377 +
agacaggaaaatgagtgcag

SEQ ID NO: 26989 - DNA, 20 bp, Artificial Sequence
  Synthetic oligonucleotide; GAG chr11 5383365 5383384 5383381 +
aggaaaatgagtgcaggagt

SEQ ID NO: 26990 - DNA, 20 bp, Artificial Sequence
  Synthetic oligonucleotide; GAG chr11 5383367 5383386 5383383 +
gaaaatgagtgcaggagtga

SEQ ID NO: 26991 - DNA, 20 bp, Artificial Sequence
  Synthetic oligonucleotide; AAG chr11 5383377 5383396 5383393 +
gcaggagtgagagaatcttg

SEQ ID NO: 26992 - DNA, 20 bp, Artificial Sequence
  Synthetic oligonucleotide; TAG chr11 5383380 5383399 5383396 +
ggagtgagagaatcttgaag

SEQ ID NO: 26993 - DNA, 20 bp, Artificial Sequence
  Synthetic oligonucleotide; TGG chr11 5383383 5383402 5383399 +
gtgagagaatcttgaagtag

SEQ ID NO: 26994 - DNA, 20 bp, Artificial Sequence
  Synthetic oligonucleotide; TGG chr11 5383392 5383411 5383408 +
tcttgaagtagtggtgattg

SEQ ID NO: 26995 - DNA, 20 bp, Artificial Sequence
  Synthetic oligonucleotide; AAG chr11 5383401 5383420 5383417 +
agtggtgattgtggtgcttc

SEQ ID NO: 26996 - DNA, 20 bp, Artificial Sequence
  Synthetic oligonucleotide; AGG chr11 5383402 5383421 5383418 +
gtggtgattgtggtgcttca

SEQ ID NO: 26997 - DNA, 20 bp, Artificial Sequence
  Synthetic oligonucleotide; CAG chr11 5383405 5383424 5383421 +
gtgattgtggtgcttcaagg

SEQ ID NO: 26998 - DNA, 20 bp, Artificial Sequence
  Synthetic oligonucleotide; AAG chr11 5383421 5383440 5383437 +
aaggcagatgtgcaatttaa

SEQ ID NO: 26999 - DNA, 20 bp, Artificial Sequence
  Synthetic oligonucleotide; TGG chr11 5383441 5383460 5383457 +
aagccactgtgaacatcaca

SEQ ID NO: 27000 - DNA, 20 bp, Artificial Sequence
  Synthetic oligonucleotide; TGG chr11 5383477 5383496 5383493 +
tatactacatccgacctctc

SEQ ID NO: 27001 - DNA, 20 bp, Artificial Sequence
  Synthetic oligonucleotide; CGG chr11 5383487 5383506 5383503 +
ccgacctctctggaaaacga

SEQ ID NO: 27002 - DNA, 20 bp, Artificial Sequence
  Synthetic oligonucleotide; GGG chr11 5383488 5383507 5383504 +
cgacctctctggaaaacgac

SEQ ID NO: 27003 - DNA, 20 bp, Artificial Sequence
  Synthetic oligonucleotide; TAG chr11 5383499 5383518 5383515 +
gaaaacgacgggtccattac

SEQ ID NO: 27004 - DNA, 20 bp, Artificial Sequence
  Synthetic oligonucleotide; TGG chr11 5383502 5383521 5383518 +
aacgacgggtccattactag

SEQ ID NO: 27005 - DNA, 20 bp, Artificial Sequence
  Synthetic oligonucleotide; CAG chr11 5383509 5383528 5383525 +
ggtccattactagtggataa

SEQ ID NO: 27006 - DNA, 20 bp, Artificial Sequence
  Synthetic oligonucleotide; AAG chr11 5383512 5383531 5383528 +
ccattactagtggataacag

SEQ ID NO: 27007 - DNA, 20 bp, Artificial Sequence
  Synthetic oligonucleotide; CAG chr11 5383516 5383535 5383532 +
tactagtggataacagaaga

SEQ ID NO: 27008 - DNA, 20 bp, Artificial Sequence
  Synthetic oligonucleotide; AAG chr11 5383532 5383551 5383548 +
aagacagtaaataaaatgat

SEQ ID NO: 27009 - DNA, 20 bp, Artificial Sequence
  Synthetic oligonucleotide; CAG chr11 5383572 5383591 5383588 +
tttatgaaattaaaaataaa

SEQ ID NO: 27010 - DNA, 20 bp, Artificial Sequence
  Synthetic oligonucleotide; AAG chr11 5383577 5383596 5383593 +
gaaattaaaaataaacagat

SEQ ID NO: 27011 - DNA, 20 bp, Artificial Sequence
  Synthetic oligonucleotide; AGG chr11 5383578 5383597 5383594 +
aaattaaaaataaacagata

SEQ ID NO: 27012 - DNA, 20 bp, Artificial Sequence
  Synthetic oligonucleotide; CAG chr11 5383581 5383600 5383597 +
ttaaaaataaacagataagg

SEQ ID NO: 27013 - DNA, 20 bp, Artificial Sequence
  Synthetic oligonucleotide; TAG chr11 5383584 5383603 5383600 +
aaaataaacagataaggcag

SEQ ID NO: 27014 - DNA, 20 bp, Artificial Sequence
  Synthetic oligonucleotide; CAG chr11 5383598 5383617 5383614 +
aggcagtagtacttttgttg

SEQ ID NO: 27015 - DNA, 20 bp, Artificial Sequence
  Synthetic oligonucleotide; CAG chr11 5383601 5383620 5383617 +
cagtagtacttttgttgcag

SEQ ID NO: 27016 - DNA, 20 bp, Artificial Sequence
  Synthetic oligonucleotide; TAG chr11 5383613 5383632 5383629 +
tgttgcagcagatgtctgtg

SEQ ID NO: 27017 - DNA, 20 bp, Artificial Sequence
  Synthetic oligonucleotide; TGG chr11 5383624 5383643 5383640 +
atgtctgtgtagccaaaacc

SEQ ID NO: 27018 - DNA, 20 bp, Artificial Sequence
  Synthetic oligonucleotide; GGG chr11 5383625 5383644 5383641 +
tgtctgtgtagccaaaacct

SEQ ID NO: 27019 - DNA, 20 bp, Artificial Sequence
  Synthetic oligonucleotide; GGG chr11 5383626 5383645 5383642 +
gtctgtgtagccaaaacctg

SEQ ID NO: 27020 - DNA, 20 bp, Artificial Sequence
  Synthetic oligonucleotide; AAG chr11 5383642 5383661 5383658 +
cctggggactgaatgctaaa

SEQ ID NO: 27021 - DNA, 20 bp, Artificial Sequence
  Synthetic oligonucleotide; TAG chr11 5383646 5383665 5383662 +
gggactgaatgctaaaaagt

SEQ ID NO: 27022 - DNA, 20 bp, Artificial Sequence
  Synthetic oligonucleotide; AGG chr11 5383647 5383666 5383663 +
ggactgaatgctaaaaagtt

SEQ ID NO: 27023 - DNA, 20 bp, Artificial Sequence
  Synthetic oligonucleotide; GGG chr11 5383648 5383667 5383664 +
gactgaatgctaaaaagtta

SEQ ID NO: 27024 - DNA, 20 bp, Artificial Sequence
  Synthetic oligonucleotide; CAG chr11 5383656 5383675 5383672 +
gctaaaaagttagggctctt

SEQ ID NO: 27025 - DNA, 20 bp, Artificial Sequence
  Synthetic oligonucleotide; CAG chr11 5383662 5383681 5383678 +
aagttagggctcttcagctt

SEQ ID NO: 27026 - DNA, 20 bp, Artificial Sequence
  Synthetic oligonucleotide; AGG chr11 5383663 5383682 5383679 +
agttagggctcttcagcttc

SEQ ID NO: 27027 - DNA, 20 bp, Artificial Sequence
  Synthetic oligonucleotide; GAG chr11 5383665 5383684 5383681 +
ttagggctcttcagcttcag

SEQ ID NO: 27028 - DNA, 20 bp, Artificial Sequence
  Synthetic oligonucleotide; CAG chr11 5383669 5383688 5383685 +
ggctcttcagcttcaggaga

SEQ ID NO: 27029 - DNA, 20 bp, Artificial Sequence
  Synthetic oligonucleotide; AGG chr11 5383670 5383689 5383686 +
gctcttcagcttcaggagac

SEQ ID NO: 27030 - DNA, 20 bp, Artificial Sequence
  Synthetic oligonucleotide; GGG chr11 5383671 5383690 5383687 +
ctcttcagcttcaggagaca

SEQ ID NO: 27031 - DNA, 20 bp, Artificial Sequence
  Synthetic oligonucleotide; GGG chr11 5383672 5383691 5383688 +
tcttcagcttcaggagacag

SEQ ID NO: 27032 - DNA, 20 bp, Artificial Sequence
  Synthetic oligonucleotide; TGG chr11 5383675 5383694 5383691 +
tcagcttcaggagacagggg

SEQ ID NO: 27033 - DNA, 20 bp, Artificial Sequence
  Synthetic oligonucleotide; GAG chr11 5383677 5383696 5383693 +
agcttcaggagacaggggtg

SEQ ID NO: 27034 - DNA, 20 bp, Artificial Sequence
  Synthetic oligonucleotide; AAG chr11 5383683 5383702 5383699 +
aggagacaggggtggagata

SEQ ID NO: 27035 - DNA, 20 bp, Artificial Sequence
  Synthetic oligonucleotide; AAG chr11 5383687 5383706 5383703 +
gacaggggtggagataaaga

SEQ ID NO: 27036 - DNA, 20 bp, Artificial Sequence
  Synthetic oligonucleotide; TAG chr11 5383701 5383720 5383717 +
taaagaaagtttcctgccca

SEQ ID NO: 27037 - DNA, 20 bp, Artificial Sequence
  Synthetic oligonucleotide; AGG chr11 5383702 5383721 5383718 +
aaagaaagtttcctgcccat

SEQ ID NO: 27038 - DNA, 20 bp, Artificial Sequence
  Synthetic oligonucleotide; CAG chr11 5383710 5383729 5383726 +
tttcctgcccataggattcc

SEQ ID NO: 27039 - DNA, 20 bp, Artificial Sequence
  Synthetic oligonucleotide; TGG chr11 5383716 5383735 5383732 +
gcccataggattcccagccc

SEQ ID NO: 27040 - DNA, 20 bp, Artificial Sequence
  Synthetic oligonucleotide; GGG chr11 5383717 5383736 5383733 +
cccataggattcccagccct

SEQ ID NO: 27041 - DNA, 20 bp, Artificial Sequence
  Synthetic oligonucleotide; GGG chr11 5383718 5383737 5383734 +
ccataggattcccagccctg

SEQ ID NO: 27042 - DNA, 20 bp, Artificial Sequence
  Synthetic oligonucleotide; AAG chr11 5383738 5383757 5383754 +
gggaccctttgtttaccatt

SEQ ID NO: 27043 - DNA, 20 bp, Artificial Sequence
  Synthetic oligonucleotide; CAG chr11 5383747 5383766 5383763 +
tgtttaccattaagttctcc

SEQ ID NO: 27044 - DNA, 20 bp, Artificial Sequence
  Synthetic oligonucleotide; TGG chr11 5383751 5383770 5383767 +
taccattaagttctcccagc

SEQ ID NO: 27045 - DNA, 20 bp, Artificial Sequence
  Synthetic oligonucleotide; GAG chr11 5383753 5383772 5383769 +
ccattaagttctcccagctg

SEQ ID NO: 27046 - DNA, 20 bp, Artificial Sequence
  Synthetic oligonucleotide; TGG chr11 5383759 5383778 5383775 +
agttctcccagctggagcca

SEQ ID NO: 27047 - DNA, 20 bp, Artificial Sequence
  Synthetic oligonucleotide; TAG chr11 5383766 5383785 5383782 +
ccagctggagccatggtctt

SEQ ID NO: 27048 - DNA, 20 bp, Artificial Sequence
  Synthetic oligonucleotide; AGG chr11 5383767 5383786 5383783 +
cagctggagccatggtcttt

SEQ ID NO: 27049 - DNA, 20 bp, Artificial Sequence
  Synthetic oligonucleotide; GAG chr11 5383769 5383788 5383785 +
gctggagccatggtctttag

SEQ ID NO: 27050 - DNA, 20 bp, Artificial Sequence
  Synthetic oligonucleotide; AGG chr11 5383770 5383789 5383786 +
ctggagccatggtctttagg

SEQ ID NO: 27051 - DNA, 20 bp, Artificial Sequence
  Synthetic oligonucleotide; CAG chr11 5383789 5383808 5383805 +
gaggataaatccttctgtga

SEQ ID NO: 27052 - DNA, 20 bp, Artificial Sequence
  Synthetic oligonucleotide; CAG chr11 5383795 5383814 5383811 +
aaatccttctgtgacagcca

SEQ ID NO: 27053 - DNA, 20 bp, Artificial Sequence
  Synthetic oligonucleotide; CAG chr11 5383810 5383829 5383826 +
agccacagccttgtgcctct

SEQ ID NO: 27054 - DNA, 20 bp, Artificial Sequence
  Synthetic oligonucleotide; TGG chr11 5383855 5383874 5383871 +
tatactcttctttcttcctt

SEQ ID NO: 27055 - DNA, 20 bp, Artificial Sequence
  Synthetic oligonucleotide; TGG chr11 5383869 5383888 5383885 +
ttcctttggaacctactcat

SEQ ID NO: 27056 - DNA, 20 bp, Artificial Sequence
  Synthetic oligonucleotide; TGG chr11 5383896 5383915 5383912 +
acatttttgttattacctgc

SEQ ID NO: 27057 - DNA, 20 bp, Artificial Sequence
  Synthetic oligonucleotide; GAG chr11 5383900 5383919 5383916 +
ttttgttattacctgctggt

SEQ ID NO: 27058 - DNA, 20 bp, Artificial Sequence
  Synthetic oligonucleotide; CGG chr11 5383922 5383941 5383938 +
gtctcactactgtcttgtgc

SEQ ID NO: 27059 - DNA, 20 bp, Artificial Sequence
  Synthetic oligonucleotide; GGG chr11 5383923 5383942 5383939 +
tctcactactgtcttgtgcc

SEQ ID NO: 27060 - DNA, 20 bp, Artificial Sequence
  Synthetic oligonucleotide; GGG chr11 5383924 5383943 5383940 +
ctcactactgtcttgtgccg

SEQ ID NO: 27061 - DNA, 20 bp, Artificial Sequence
  Synthetic oligonucleotide; CAG chr11 5383930 5383949 5383946 +
actgtcttgtgccggggttt

SEQ ID NO: 27062 - DNA, 20 bp, Artificial Sequence
  Synthetic oligonucleotide; AGG chr11 5383931 5383950 5383947 +
ctgtcttgtgccggggtttc

SEQ ID NO: 27063 - DNA, 20 bp, Artificial Sequence
  Synthetic oligonucleotide; GAG chr11 5383933 5383952 5383949 +
gtcttgtgccggggtttcag

SEQ ID NO: 27064 - DNA, 20 bp, Artificial Sequence
  Synthetic oligonucleotide; TGG chr11 5383936 5383955 5383952 +
ttgtgccggggtttcaggag

SEQ ID NO: 27065 - DNA, 20 bp, Artificial Sequence
  Synthetic oligonucleotide; GGG chr11 5383937 5383956 5383953 +
tgtgccggggtttcaggagt

SEQ ID NO: 27066 - DNA, 20 bp, Artificial Sequence
  Synthetic oligonucleotide; TAG chr11 5383944 5383963 5383960 +
gggtttcaggagtgggtaat

SEQ ID NO: 27067 - DNA, 20 bp, Artificial Sequence
  Synthetic oligonucleotide; AGG chr11 5383945 5383964 5383961 +
ggtttcaggagtgggtaatt

SEQ ID NO: 27068 - DNA, 20 bp, Artificial Sequence
  Synthetic oligonucleotide; GGG chr11 5383946 5383965 5383962 +
gtttcaggagtgggtaatta

SEQ ID NO: 27069 - DNA, 20 bp, Artificial Sequence
  Synthetic oligonucleotide; GGG chr11 5383947 5383966 5383963 +
tttcaggagtgggtaattag

SEQ ID NO: 27070 - DNA, 20 bp, Artificial Sequence
  Synthetic oligonucleotide; GGG chr11 5383948 5383967 5383964 +
ttcaggagtgggtaattagg

SEQ ID NO: 27071 - DNA, 20 bp, Artificial Sequence
  Synthetic oligonucleotide; TGG chr11 5383954 5383973 5383970 +
agtgggtaattagggggaca

SEQ ID NO: 27072 - DNA, 20 bp, Artificial Sequence
  Synthetic oligonucleotide; GGG chr11 5383955 5383974 5383971 +
gtgggtaattagggggacat

SEQ ID NO: 27073 - DNA, 20 bp, Artificial Sequence
  Synthetic oligonucleotide; GAG chr11 5383957 5383976 5383973 +
gggtaattagggggacatgg

SEQ ID NO: 27074 - DNA, 20 bp, Artificial Sequence
  Synthetic oligonucleotide; GAG chr11 5383959 5383978 5383975 +
gtaattagggggacatggga

SEQ ID NO: 27075 - DNA, 20 bp, Artificial Sequence
  Synthetic oligonucleotide; GAG chr11 5383961 5383980 5383977 +
aattagggggacatgggaga

SEQ ID NO: 27076 - DNA, 20 bp, Artificial Sequence
  Synthetic oligonucleotide; AGG chr11 5383962 5383981 5383978 +
attagggggacatgggagag

SEQ ID NO: 27077 - DNA, 20 bp, Artificial Sequence
  Synthetic oligonucleotide; GAG chr11 5383964 5383983 5383980 +
tagggggacatgggagagag

SEQ ID NO: 27078 - DNA, 20 bp, Artificial Sequence
  Synthetic oligonucleotide; AGG chr11 5383965 5383984 5383981 +
agggggacatgggagagagg

SEQ ID NO: 27079 - DNA, 20 bp, Artificial Sequence
  Synthetic oligonucleotide; GGG chr11 5383966 5383985 5383982 +
gggggacatgggagagagga

SEQ ID NO: 27080 - DNA, 20 bp, Artificial Sequence
  Synthetic oligonucleotide; GAG chr11 5383968 5383987 5383984 +
gggacatgggagagaggagg

SEQ ID NO: 27081 - DNA, 20 bp, Artificial Sequence
  Synthetic oligonucleotide; GAG chr11 5383976 5383995 5383992 +
ggagagaggagggagaaaat

SEQ ID NO: 27082 - DNA, 20 bp, Artificial Sequence
  Synthetic oligonucleotide; AGG chr11 5383977 5383996 5383993 +
gagagaggagggagaaaatg

SEQ ID NO: 27083 - DNA, 20 bp, Artificial Sequence
  Synthetic oligonucleotide; GGG chr11 5383978 5383997 5383994 +
agagaggagggagaaaatga

SEQ ID NO: 27084 - DNA, 20 bp, Artificial Sequence
  Synthetic oligonucleotide; TGG chr11 5383985 5384004 5384001 +
agggagaaaatgagggaaaa

SEQ ID NO: 27085 - DNA, 20 bp, Artificial Sequence
  Synthetic oligonucleotide; GGG chr11 5383986 5384005 5384002 +
gggagaaaatgagggaaaat

SEQ ID NO: 27086 - DNA, 20 bp, Artificial Sequence
  Synthetic oligonucleotide; TAG chr11 5383995 5384014 5384011 +
tgagggaaaatgggaatgca

SEQ ID NO: 27087 - DNA, 20 bp, Artificial Sequence
  Synthetic oligonucleotide; AGG chr11 5383996 5384015 5384012 +
gagggaaaatgggaatgcat

SEQ ID NO: 27088 - DNA, 20 bp, Artificial Sequence
  Synthetic oligonucleotide; AAG chr11 5384007 5384026 5384023 +
ggaatgcataggtatcacaa

SEQ ID NO: 27089 - DNA, 20 bp, Artificial Sequence
  Synthetic oligonucleotide; CAG chr11 5384010 5384029 5384026 +
atgcataggtatcacaaaag

SEQ ID NO: 27090 - DNA, 20 bp, Artificial Sequence
  Synthetic oligonucleotide; GAG chr11 5384014 5384033 5384030 +
ataggtatcacaaaagcagt

SEQ ID NO: 27091 - DNA, 20 bp, Artificial Sequence
  Synthetic oligonucleotide; AAG chr11 5384023 5384042 5384039 +
acaaaagcagtgagcccaaa

SEQ ID NO: 27092 - DNA, 20 bp, Artificial Sequence
  Synthetic oligonucleotide; TGG chr11 5384029 5384048 5384045 +
gcagtgagcccaaaaagaca

SEQ ID NO: 27093 - DNA, 20 bp, Artificial Sequence
  Synthetic oligonucleotide; CAG chr11 5384035 5384054 5384051 +
agcccaaaaagacatggtct

SEQ ID NO: 27094 - DNA, 20 bp, Artificial Sequence
  Synthetic oligonucleotide; AAG chr11 5384046 5384065 5384062 +
acatggtctcagttacaatt

SEQ ID NO: 27095 - DNA, 20 bp, Artificial Sequence
  Synthetic oligonucleotide; AGG chr11 5384047 5384066 5384063 +
catggtctcagttacaatta

SEQ ID NO: 27096 - DNA, 20 bp, Artificial Sequence
  Synthetic oligonucleotide; TAG chr11 5384077 5384096 5384093 +
cccaaatgtttgaatgtcct

SEQ ID NO: 27097 - DNA, 20 bp, Artificial Sequence
  Synthetic oligonucleotide; TGG chr11 5384085 5384104 5384101 +
tttgaatgtccttagccaaa

SEQ ID NO: 27098 - DNA, 20 bp, Artificial Sequence
  Synthetic oligonucleotide; AAG chr11 5384109 5384128 5384125 +
ttccccacattccctgcact

SEQ ID NO: 27099 - DNA, 20 bp, Artificial Sequence
  Synthetic oligonucleotide; TGG chr11 5384117 5384136 5384133 +
attccctgcactaagcctaa

SEQ ID NO: 27100 - DNA, 20 bp, Artificial Sequence
  Synthetic oligonucleotide; GGG chr11 5384118 5384137 5384134 +
ttccctgcactaagcctaat

SEQ ID NO: 27101 - DNA, 20 bp, Artificial Sequence
  Synthetic oligonucleotide; TAG chr11 5384171 5384190 5384187 +
gtttctttgtttgttgtttt

SEQ ID NO: 27102 - DNA, 20 bp, Artificial Sequence
  Synthetic oligonucleotide; GAG chr11 5384178 5384197 5384194 +
tgtttgttgtttttagaaat

SEQ ID NO: 27103 - DNA, 20 bp, Artificial Sequence
  Synthetic oligonucleotide; AGG chr11 5384179 5384198 5384195 +
gtttgttgtttttagaaatg

SEQ ID NO: 27104 - DNA, 20 bp, Artificial Sequence
  Synthetic oligonucleotide; TAG chr11 5384184 5384203 5384200 +
ttgtttttagaaatgaggtc

SEQ ID NO: 27105 - DNA, 20 bp, Artificial Sequence
  Synthetic oligonucleotide; CAG chr11 5384197 5384216 5384213 +
tgaggtctagctctgttacc

SEQ ID NO: 27106 - DNA, 20 bp, Artificial Sequence
  Synthetic oligonucleotide; AGG chr11 5384198 5384217 5384214 +
gaggtctagctctgttaccc

SEQ ID NO: 27107 - DNA, 20 bp, Artificial Sequence
  Synthetic oligonucleotide; CAG chr11 5384204 5384223 5384220 +
tagctctgttacccaggcta

SEQ ID NO: 27108 - DNA, 20 bp, Artificial Sequence
  Synthetic oligonucleotide; CAG chr11 5384209 5384228 5384225 +
ctgttacccaggctacagtg

SEQ ID NO: 27109 - DNA, 20 bp, Artificial Sequence
  Synthetic oligonucleotide; TGG chr11 5384212 5384231 5384228 +
ttacccaggctacagtgcag

SEQ ID NO: 27110 - DNA, 20 bp, Artificial Sequence
  Synthetic oligonucleotide; TAG chr11 5384223 5384242 5384239 +
acagtgcagtggtgtaatca

SEQ ID NO: 27111 - DNA, 20 bp, Artificial Sequence
  Synthetic oligonucleotide; CGG chr11 5384244 5384263 5384260 +
agctcactgtaaactcaaac

SEQ ID NO: 27112 - DNA, 20 bp, Artificial Sequence
  Synthetic oligonucleotide; AAG chr11 5384251 5384270 5384267 +
tgtaaactcaaaccggattc

SEQ ID NO: 27113 - DNA, 20 bp, Artificial Sequence
  Synthetic oligonucleotide; AAG chr11 5384277 5384296 5384293 +
tcctcccaccttattcttcc

SEQ ID NO: 27114 - DNA, 20 bp, Artificial Sequence
  Synthetic oligonucleotide; CAG chr11 5384284 5384303 5384300 +
accttattcttccaagttgc

SEQ ID NO: 27115 - DNA, 20 bp, Artificial Sequence
  Synthetic oligonucleotide; AGG chr11 5384285 5384304 5384301 +
ccttattcttccaagttgcc

SEQ ID NO: 27116 - DNA, 20 bp, Artificial Sequence
  Synthetic oligonucleotide; AAG chr11 5384293 5384312 5384309 +
ttccaagttgccaggattat

SEQ ID NO: 27117 - DNA, 20 bp, Artificial Sequence
  Synthetic oligonucleotide; CAG chr11 5384312 5384331 5384328 +
taagtgtgaaccaccatata

SEQ ID NO: 27118 - DNA, 20 bp, Artificial Sequence
  Synthetic oligonucleotide; CAG chr11 5384315 5384334 5384331 +
gtgtgaaccaccatatacag

SEQ ID NO: 27119 - DNA, 20 bp, Artificial Sequence
  Synthetic oligonucleotide; TGG chr11 5384320 5384339 5384336 +
aaccaccatatacagcagtc

SEQ ID NO: 27120 - DNA, 20 bp, Artificial Sequence
  Synthetic oligonucleotide; GGG chr11 5384321 5384340 5384337 +
accaccatatacagcagtct

SEQ ID NO: 27121 - DNA, 20 bp, Artificial Sequence
  Synthetic oligonucleotide; TAG chr11 5384327 5384346 5384343 +
atatacagcagtctgggcct

SEQ ID NO: 27122 - DNA, 20 bp, Artificial Sequence
  Synthetic oligonucleotide; TGG chr11 5384340 5384359 5384356 +
tgggccttagatttttcact

SEQ ID NO: 27123 - DNA, 20 bp, Artificial Sequence
  Synthetic oligonucleotide; AAG chr11 5384349 5384368 5384365 +
gatttttcacttggaaaatg

SEQ ID NO: 27124 - DNA, 20 bp, Artificial Sequence
  Synthetic oligonucleotide; TAG chr11 5384355 5384374 5384371 +
tcacttggaaaatgaagtct

SEQ ID NO: 27125 - DNA, 20 bp, Artificial Sequence
  Synthetic oligonucleotide; CAG chr11 5384362 5384381 5384378 +
gaaaatgaagtcttagaaac

SEQ ID NO: 27126 - DNA, 20 bp, Artificial Sequence
  Synthetic oligonucleotide; AGG chr11 5384363 5384382 5384379 +
aaaatgaagtcttagaaacc

SEQ ID NO: 27127 - DNA, 20 bp, Artificial Sequence
  Synthetic oligonucleotide; GGG chr11 5384364 5384383 5384380 +
aaatgaagtcttagaaacca

SEQ ID NO: 27128 - DNA, 20 bp, Artificial Sequence
  Synthetic oligonucleotide; CAG chr11 5384373 5384392 5384389 +
cttagaaaccagggttctca

SEQ ID NO: 27129 - DNA, 20 bp, Artificial Sequence
  Synthetic oligonucleotide; CAG chr11 5384394 5384413 5384410 +
agaatctcttctgatattct

SEQ ID NO: 27130 - DNA, 20 bp, Artificial Sequence
  Synthetic oligonucleotide; GAG chr11 5384396 5384415 5384412 +
aatctcttctgatattctca

SEQ ID NO: 27131 - DNA, 20 bp, Artificial Sequence
  Synthetic oligonucleotide; CAG chr11 5384407 5384426 5384423 +
atattctcagagtctatgca

SEQ ID NO: 27132 - DNA, 20 bp, Artificial Sequence
  Synthetic oligonucleotide; CAG chr11 5384413 5384432 5384429 +
tcagagtctatgcacagaac

SEQ ID NO: 27133 - DNA, 20 bp, Artificial Sequence
  Synthetic oligonucleotide; GAG chr11 5384415 5384434 5384431 +
agagtctatgcacagaacca

SEQ ID NO: 27134 - DNA, 20 bp, Artificial Sequence
  Synthetic oligonucleotide; CAG chr11 5384419 5384438 5384435 +
tctatgcacagaaccagagc

SEQ ID NO: 27135 - DNA, 20 bp, Artificial Sequence
  Synthetic oligonucleotide; GAG chr11 5384421 5384440 5384437 +
tatgcacagaaccagagcca

SEQ ID NO: 27136 - DNA, 20 bp, Artificial Sequence
  Synthetic oligonucleotide; AAG chr11 5384425 5384444 5384441 +
cacagaaccagagccagaga

SEQ ID NO: 27137 - DNA, 20 bp, Artificial Sequence
  Synthetic oligonucleotide; CAG chr11 5384430 5384449 5384446 +
aaccagagccagagaaagaa

SEQ ID NO: 27138 - DNA, 20 bp, Artificial Sequence
  Synthetic oligonucleotide; CAG chr11 5384437 5384456 5384453 +
gccagagaaagaacagaaaa

SEQ ID NO: 27139 - DNA, 20 bp, Artificial Sequence
  Synthetic oligonucleotide; AGG chr11 5384438 5384457 5384454 +
ccagagaaagaacagaaaac

SEQ ID NO: 27140 - DNA, 20 bp, Artificial Sequence
  Synthetic oligonucleotide; TGG chr11 5384453 5384472 5384469 +
aaaacaggaccttctcttgc

SEQ ID NO: 27141 - DNA, 20 bp, Artificial Sequence
  Synthetic oligonucleotide; AAG chr11 5384458 5384477 5384474 +
aggaccttctcttgctggaa

SEQ ID NO: 27142 - DNA, 20 bp, Artificial Sequence
  Synthetic oligonucleotide; GAG chr11 5384460 5384479 5384476 +
gaccttctcttgctggaaaa

SEQ ID NO: 27143 - DNA, 20 bp, Artificial Sequence
  Synthetic oligonucleotide; AGG chr11 5384461 5384480 5384477 +
accttctcttgctggaaaag

SEQ ID NO: 27144 - DNA, 20 bp, Artificial Sequence
  Synthetic oligonucleotide; GAG chr11 5384465 5384484 5384481 +
tctcttgctggaaaagaggc

SEQ ID NO: 27145 - DNA, 20 bp, Artificial Sequence
  Synthetic oligonucleotide; CAG chr11 5384476 5384495 5384492 +
aaaagaggcgagctcatctg

SEQ ID NO: 27146 - DNA, 20 bp, Artificial Sequence
  Synthetic oligonucleotide; TAG chr11 5384487 5384506 5384503 +
gctcatctgcagtattctgt

SEQ ID NO: 27147 - DNA, 20 bp, Artificial Sequence
  Synthetic oligonucleotide; AGG chr11 5384488 5384507 5384504 +
ctcatctgcagtattctgtt

SEQ ID NO: 27148 - DNA, 20 bp, Artificial Sequence
  Synthetic oligonucleotide; AAG chr11 5384491 5384510 5384507 +
atctgcagtattctgttagg

SEQ ID NO: 27149 - DNA, 20 bp, Artificial Sequence
  Synthetic oligonucleotide; AGG chr11 5384492 5384511 5384508 +
tctgcagtattctgttagga

SEQ ID NO: 27150 - DNA, 20 bp, Artificial Sequence
  Synthetic oligonucleotide; CAG chr11 5384496 5384515 5384512 +
cagtattctgttaggaaggc

SEQ ID NO: 27151 - DNA, 20 bp, Artificial Sequence
  Synthetic oligonucleotide; AGG chr11 5384497 5384516 5384513 +
agtattctgttaggaaggcc

SEQ ID NO: 27152 - DNA, 20 bp, Artificial Sequence
  Synthetic oligonucleotide; GAG chr11 5384499 5384518 5384515 +
tattctgttaggaaggccag

SEQ ID NO: 27153 - DNA, 20 bp, Artificial Sequence
  Synthetic oligonucleotide; AGG chr11 5384500 5384519 5384516 +
attctgttaggaaggccagg

SEQ ID NO: 27154 - DNA, 20 bp, Artificial Sequence
  Synthetic oligonucleotide; CAG chr11 5384503 5384522 5384519 +
ctgttaggaaggccaggagg

SEQ ID NO: 27155 - DNA, 20 bp, Artificial Sequence
  Synthetic oligonucleotide; AGG chr11 5384504 5384523 5384520 +
tgttaggaaggccaggaggc

SEQ ID NO: 27156 - DNA, 20 bp, Artificial Sequence
  Synthetic oligonucleotide; GGG chr11 5384505 5384524 5384521 +
gttaggaaggccaggaggca

SEQ ID NO: 27157 - DNA, 20 bp, Artificial Sequence
  Synthetic oligonucleotide; GAG chr11 5384526 5384545 5384542 +
ggctgcctcactcccctgat

SEQ ID NO: 27158 - DNA, 20 bp, Artificial Sequence
  Synthetic oligonucleotide; TGG chr11 5384537 5384556 5384553 +
tcccctgatgagtgcctgca

SEQ ID NO: 27159 - DNA, 20 bp, Artificial Sequence
  Synthetic oligonucleotide; CAG chr11 5384541 5384560 5384557 +
ctgatgagtgcctgcatggc

SEQ ID NO: 27160 - DNA, 20 bp, Artificial Sequence
  Synthetic oligonucleotide; AGG chr11 5384542 5384561 5384558 +
tgatgagtgcctgcatggcc

SEQ ID NO: 27161 - DNA, 20 bp, Artificial Sequence
  Synthetic oligonucleotide; CAG chr11 5384546 5384565 5384562 +
gagtgcctgcatggccaggc

SEQ ID NO: 27162 - DNA, 20 bp, Artificial Sequence
  Synthetic oligonucleotide; TGG chr11 5384557 5384576 5384573 +
tggccaggccagcccctccc

SEQ ID NO: 27163 - DNA, 20 bp, Artificial Sequence
  Synthetic oligonucleotide; TAG chr11 5384568 5384587 5384584 +
gcccctccctggatcatgtc

SEQ ID NO: 27164 - DNA, 20 bp, Artificial Sequence
  Synthetic oligonucleotide; AAG chr11 5384571 5384590 5384587 +
cctccctggatcatgtctag

SEQ ID NO: 27165 - DNA, 20 bp, Artificial Sequence
  Synthetic oligonucleotide; CAG chr11 5384575 5384594 5384591 +
cctggatcatgtctagaagt

SEQ ID NO: 27166 - DNA, 20 bp, Artificial Sequence
  Synthetic oligonucleotide; AGG chr11 5384576 5384595 5384592 +
ctggatcatgtctagaagtc

SEQ ID NO: 27167 - DNA, 20 bp, Artificial Sequence
  Synthetic oligonucleotide; TGG chr11 5384580 5384599 5384596 +
atcatgtctagaagtcagga

SEQ ID NO: 27168 - DNA, 20 bp, Artificial Sequence
  Synthetic oligonucleotide; CAG chr11 5384583 5384602 5384599 +
atgtctagaagtcaggatgg

SEQ ID NO: 27169 - DNA, 20 bp, Artificial Sequence
  Synthetic oligonucleotide; AAG chr11 5384586 5384605 5384602 +
tctagaagtcaggatggcag

SEQ ID NO: 27170 - DNA, 20 bp, Artificial Sequence
  Synthetic oligonucleotide; TGG chr11 5384594 5384613 5384610 +
tcaggatggcagaagccctc

SEQ ID NO: 27171 - DNA, 20 bp, Artificial Sequence
  Synthetic oligonucleotide; GAG chr11 5384617 5384636 5384633 +
tctctatactctttcctgcc

SEQ ID NO: 27172 - DNA, 20 bp, Artificial Sequence
  Synthetic oligonucleotide; TGG chr11 5384625 5384644 5384641 +
ctctttcctgccgagccatc

SEQ ID NO: 27173 - DNA, 20 bp, Artificial Sequence
  Synthetic oligonucleotide; CAG chr11 5384654 5384673 5384670 +
caccctctccttactctcat

SEQ ID NO: 27174 - DNA, 20 bp, Artificial Sequence
  Synthetic oligonucleotide; CAG chr11 5384662 5384681 5384678 +
ccttactctcatcagaaaaa

SEQ ID NO: 27175 - DNA, 20 bp, Artificial Sequence
  Synthetic oligonucleotide; TGG chr11 5384707 5384726 5384723 +
attaaatgcattttatatgc

SEQ ID NO: 27176 - DNA, 20 bp, Artificial Sequence
  Synthetic oligonucleotide; CAG chr11 5384712 5384731 5384728 +
atgcattttatatgctggtc

SEQ ID NO: 27177 - DNA, 20 bp, Artificial Sequence
  Synthetic oligonucleotide; TAG chr11 5384721 5384740 5384737 +
atatgctggtccagttaaca

SEQ ID NO: 27178 - DNA, 20 bp, Artificial Sequence
  Synthetic oligonucleotide; AAG chr11 5384726 5384745 5384742 +
ctggtccagttaacatagaa

SEQ ID NO: 27179 - DNA, 20 bp, Artificial Sequence
  Synthetic oligonucleotide; CAG chr11 5384781 5384800 5384797 +
acaacaccttgtaacttccc

SEQ ID NO: 27180 - DNA, 20 bp, Artificial Sequence
  Synthetic oligonucleotide; CAG chr11 5384788 5384807 5384804 +
cttgtaacttccccagtatc

SEQ ID NO: 27181 - DNA, 20 bp, Artificial Sequence
  Synthetic oligonucleotide; AGG chr11 5384789 5384808 5384805 +
ttgtaacttccccagtatcc

SEQ ID NO: 27182 - DNA, 20 bp, Artificial Sequence
  Synthetic oligonucleotide; TGG chr11 5384795 5384814 5384811 +
cttccccagtatccaggata

SEQ ID NO: 27183 - DNA, 20 bp, Artificial Sequence
  Synthetic oligonucleotide; CAG chr11 5384836 5384855 5384852 +
ctcctctatcctactaaaaa

SEQ ID NO: 27184 - DNA, 20 bp, Artificial Sequence
  Synthetic oligonucleotide; AGG chr11 5384837 5384856 5384853 +
tcctctatcctactaaaaac

SEQ ID NO: 27185 - DNA, 20 bp, Artificial Sequence
  Synthetic oligonucleotide; CAG chr11 5384848 5384867 5384864 +
actaaaaacaggcatgttta

SEQ ID NO: 27186 - DNA, 20 bp, Artificial Sequence
  Synthetic oligonucleotide; GAG chr11 5384853 5384872 5384869 +
aaacaggcatgtttacagat

SEQ ID NO: 27187 - DNA, 20 bp, Artificial Sequence
  Synthetic oligonucleotide; TGG chr11 5384867 5384886 5384883 +
acagatgagtttgaccactg

SEQ ID NO: 27188 - DNA, 20 bp, Artificial Sequence
  Synthetic oligonucleotide; TAG chr11 5384880 5384899 5384896 +
accactgtggaaatgttctc

SEQ ID NO: 27189 - DNA, 20 bp, Artificial Sequence
  Synthetic oligonucleotide; AGG chr11 5384881 5384900 5384897 +
ccactgtggaaatgttctct

SEQ ID NO: 27190 - DNA, 20 bp, Artificial Sequence
  Synthetic oligonucleotide; GGG chr11 5384882 5384901 5384898 +
cactgtggaaatgttctcta

SEQ ID NO: 27191 - DNA, 20 bp, Artificial Sequence
  Synthetic oligonucleotide; GGG chr11 5384883 5384902 5384899 +
actgtggaaatgttctctag

SEQ ID NO: 27192 - DNA, 20 bp, Artificial Sequence
  Synthetic oligonucleotide; TGG chr11 5384903 5384922 5384919 +
gggttcaaaaatgaataatc

SEQ ID NO: 27193 - DNA, 20 bp, Artificial Sequence
  Synthetic oligonucleotide; AAG chr11 5384909 5384928 5384925 +
aaaaatgaataatctggttc

SEQ ID NO: 27194 - DNA, 20 bp, Artificial Sequence
  Synthetic oligonucleotide; TAG chr11 5384922 5384941 5384938 +
ctggttcaagtccttgtgtt

SEQ ID NO: 27195 - DNA, 20 bp, Artificial Sequence
  Synthetic oligonucleotide; AGG chr11 5384923 5384942 5384939 +
tggttcaagtccttgtgttt

SEQ ID NO: 27196 - DNA, 20 bp, Artificial Sequence
  Synthetic oligonucleotide; CAG chr11 5384928 5384947 5384944 +
caagtccttgtgtttaggtg

SEQ ID NO: 27197 - DNA, 20 bp, Artificial Sequence
  Synthetic oligonucleotide; AAG chr11 5384957 5384976 5384973 +
ttgcatattctcctatttac

SEQ ID NO: 27198 - DNA, 20 bp, Artificial Sequence
  Synthetic oligonucleotide; CAG chr11 5384963 5384982 5384979 +
attctcctatttacaagaaa

SEQ ID NO: 27199 - DNA, 20 bp, Artificial Sequence
  Synthetic oligonucleotide; TAG chr11 5384981 5385000 5384997 +
aacagtatcctccaccaatg

SEQ ID NO: 27200 - DNA, 20 bp, Artificial Sequence
  Synthetic oligonucleotide; AAG chr11 5385019 5385038 5385035 +
ctaatattaaattcaaacaa

SEQ ID NO: 27201 - DNA, 20 bp, Artificial Sequence
  Synthetic oligonucleotide; TAG chr11 5385028 5385047 5385044 +
aattcaaacaaaagaatatt

SEQ ID NO: 27202 - DNA, 20 bp, Artificial Sequence
  Synthetic oligonucleotide; CAG chr11 5385034 5385053 5385050 +
aacaaaagaatatttagaca

SEQ ID NO: 27203 - DNA, 20 bp, Artificial Sequence
  Synthetic oligonucleotide; AGG chr11 5385035 5385054 5385051 +
acaaaagaatatttagacac

SEQ ID NO: 27204 - DNA, 20 bp, Artificial Sequence
  Synthetic oligonucleotide; GAG chr11 5385039 5385058 5385055 +
aagaatatttagacacaggt

SEQ ID NO: 27205 - DNA, 20 bp, Artificial Sequence
  Synthetic oligonucleotide; AGG chr11 5385040 5385059 5385056 +
agaatatttagacacaggtg

SEQ ID NO: 27206 - DNA, 20 bp, Artificial Sequence
  Synthetic oligonucleotide; TAG chr11 5385043 5385062 5385059 +
atatttagacacaggtgagg

SEQ ID NO: 27207 - DNA, 20 bp, Artificial Sequence
  Synthetic oligonucleotide; GAG chr11 5385045 5385064 5385061 +
atttagacacaggtgaggta

SEQ ID NO: 27208 - DNA, 20 bp, Artificial Sequence
  Synthetic oligonucleotide; GAG chr11 5385047 5385066 5385063 +
ttagacacaggtgaggtaga

SEQ ID NO: 27209 - DNA, 20 bp, Artificial Sequence
  Synthetic oligonucleotide; CAG chr11 5385083 5385102 5385099 +
gtatactgaaaatctctttt

SEQ ID NO: 27210 - DNA, 20 bp, Artificial Sequence
  Synthetic oligonucleotide; AGG chr11 5385084 5385103 5385100 +
tatactgaaaatctcttttc

SEQ ID NO: 27211 - DNA, 20 bp, Artificial Sequence
  Synthetic oligonucleotide; AAG chr11 5385105 5385124 5385121 +
ggaattttctcctgtgatct

SEQ ID NO: 27212 - DNA, 20 bp, Artificial Sequence
  Synthetic oligonucleotide; TAG chr11 5385149 5385168 5385165 +
tattttaattatgttgtaat

SEQ ID NO: 27213 - DNA, 20 bp, Artificial Sequence
  Synthetic oligonucleotide; GAG chr11 5385169 5385188 5385185 +
tagatgtaactgactgctct

SEQ ID NO: 27214 - DNA, 20 bp, Artificial Sequence
  Synthetic oligonucleotide; TGG chr11 5385172 5385191 5385188 +
atgtaactgactgctctgag

SEQ ID NO: 27215 - DNA, 20 bp, Artificial Sequence
  Synthetic oligonucleotide; TAG chr11 5385189 5385208 5385205 +
gagtggactcctccattgct

SEQ ID NO: 27216 - DNA, 20 bp, Artificial Sequence
  Synthetic oligonucleotide; TAG chr11 5385192 5385211 5385208 +
tggactcctccattgcttag

SEQ ID NO: 27217 - DNA, 20 bp, Artificial Sequence
  Synthetic oligonucleotide; TGG chr11 5385226 5385245 5385242 +
tgactgttgctctcctatca

SEQ ID NO: 27218 - DNA, 20 bp, Artificial Sequence
  Synthetic oligonucleotide; TAG chr11 5385246 5385265 5385262 +
tggataattatctctcttgc

SEQ ID NO: 27219 - DNA, 20 bp, Artificial Sequence
  Synthetic oligonucleotide; AGG chr11 5385247 5385266 5385263 +
ggataattatctctcttgct

SEQ ID NO: 27220 - DNA, 20 bp, Artificial Sequence
  Synthetic oligonucleotide; GAG chr11 5385249 5385268 5385265 +
ataattatctctcttgctag

SEQ ID NO: 27221 - DNA, 20 bp, Artificial Sequence
  Synthetic oligonucleotide; AAG chr11 5385262 5385281 5385278 +
ttgctaggagaaatccccta

SEQ ID NO: 27222 - DNA, 20 bp, Artificial Sequence
  Synthetic oligonucleotide; AAG chr11 5385275 5385294 5385291 +
tcccctaaagctttcttccc

SEQ ID NO: 27223 - DNA, 20 bp, Artificial Sequence
  Synthetic oligonucleotide; GAG chr11 5385277 5385296 5385293 +
ccctaaagctttcttcccaa

SEQ ID NO: 27224 - DNA, 20 bp, Artificial Sequence
  Synthetic oligonucleotide; AGG chr11 5385278 5385297 5385294 +
cctaaagctttcttcccaag

SEQ ID NO: 27225 - DNA, 20 bp, Artificial Sequence
  Synthetic oligonucleotide; AAG chr11 5385281 5385300 5385297 +
aaagctttcttcccaagagg

SEQ ID NO: 27226 - DNA, 20 bp, Artificial Sequence
  Synthetic oligonucleotide; AAG chr11 5385294 5385313 5385310 +
caagaggaagtatactttcc

SEQ ID NO: 27227 - DNA, 20 bp, Artificial Sequence
  Synthetic oligonucleotide; GAG chr11 5385296 5385315 5385312 +
agaggaagtatactttccaa

SEQ ID NO: 27228 - DNA, 20 bp, Artificial Sequence
  Synthetic oligonucleotide; CAG chr11 5385308 5385327 5385324 +
ctttccaagagaaataatcc

SEQ ID NO: 27229 - DNA, 20 bp, Artificial Sequence
  Synthetic oligonucleotide; TAG chr11 5385330 5385349 5385346 +
gccctgtcattgtctctgta

SEQ ID NO: 27230 - DNA, 20 bp, Artificial Sequence
  Synthetic oligonucleotide; CAG chr11 5385348 5385367 5385364 +
tatagacatcttgtttctac

SEQ ID NO: 27231 - DNA, 20 bp, Artificial Sequence
  Synthetic oligonucleotide; AAG chr11 5385381 5385400 5385397 +
ctgtccatctcatcactctg

SEQ ID NO: 27232 - DNA, 20 bp, Artificial Sequence
  Synthetic oligonucleotide; TGG chr11 5385385 5385404 5385401 +
ccatctcatcactctgaagt

SEQ ID NO: 27233 - DNA, 20 bp, Artificial Sequence
  Synthetic oligonucleotide; CAG chr11 5385394 5385413 5385410 +
cactctgaagttggtgaaca

SEQ ID NO: 27234 - DNA, 20 bp, Artificial Sequence
  Synthetic oligonucleotide; GAG chr11 5385396 5385415 5385412 +
ctctgaagttggtgaacaca

SEQ ID NO: 27235 - DNA, 20 bp, Artificial Sequence
  Synthetic oligonucleotide; CAG chr11 5385406 5385425 5385422 +
ggtgaacacagagctgacaa

SEQ ID NO: 27236 - DNA, 20 bp, Artificial Sequence
  Synthetic oligonucleotide; CAG chr11 5385414 5385433 5385430 +
cagagctgacaacagaaccc

SEQ ID NO: 27237 - DNA, 20 bp, Artificial Sequence
  Synthetic oligonucleotide; AGG chr11 5385415 5385434 5385431 +
agagctgacaacagaacccc

SEQ ID NO: 27238 - DNA, 20 bp, Artificial Sequence
  Synthetic oligonucleotide; AAG chr11 5385422 5385441 5385438 +
acaacagaaccccaggcaca

SEQ ID NO: 27239 - DNA, 20 bp, Artificial Sequence
  Synthetic oligonucleotide; CAG chr11 5385428 5385447 5385444 +
gaaccccaggcacaaagaat

SEQ ID NO: 27240 - DNA, 20 bp, Artificial Sequence
  Synthetic oligonucleotide; AGG chr11 5385429 5385448 5385445 +
aaccccaggcacaaagaatc

SEQ ID NO: 27241 - DNA, 20 bp, Artificial Sequence
  Synthetic oligonucleotide; AAG chr11 5385434 5385453 5385450 +
caggcacaaagaatcaggat

SEQ ID NO: 27242 - DNA, 20 bp, Artificial Sequence
  Synthetic oligonucleotide; GAG chr11 5385436 5385455 5385452 +
ggcacaaagaatcaggataa

SEQ ID NO: 27243 - DNA, 20 bp, Artificial Sequence
  Synthetic oligonucleotide; AGG chr11 5385437 5385456 5385453 +
gcacaaagaatcaggataag

SEQ ID NO: 27244 - DNA, 20 bp, Artificial Sequence
  Synthetic oligonucleotide; GAG chr11 5385441 5385460 5385457 +
aaagaatcaggataagaggt

SEQ ID NO: 27245 - DNA, 20 bp, Artificial Sequence
  Synthetic oligonucleotide; TAG chr11 5385465 5385484 5385481 +
actttatttattcacccatt

SEQ ID NO: 27246 - DNA, 20 bp, Artificial Sequence
  Synthetic oligonucleotide; TAG chr11 5385493 5385512 5385509 +
catgcaaaaaaatatatata

SEQ ID NO: 27247 - DNA, 20 bp, Artificial Sequence
  Synthetic oligonucleotide; TGG chr11 5385496 5385515 5385512 +
gcaaaaaaatatatatatag

SEQ ID NO: 27248 - DNA, 20 bp, Artificial Sequence
  Synthetic oligonucleotide; TAG chr11 5385513 5385532 5385529 +
tagtggtacctaccacatct

SEQ ID NO: 27249 - DNA, 20 bp, Artificial Sequence
  Synthetic oligonucleotide; CAG chr11 5385523 5385542 5385539 +
taccacatcttagacactgt

SEQ ID NO: 27250 - DNA, 20 bp, Artificial Sequence
  Synthetic oligonucleotide; AGG chr11 5385524 5385543 5385540 +
accacatcttagacactgtc

SEQ ID NO: 27251 - DNA, 20 bp, Artificial Sequence
  Synthetic oligonucleotide; CAG chr11 5385530 5385549 5385546 +
tcttagacactgtcaggctc

SEQ ID NO: 27252 - DNA, 20 bp, Artificial Sequence
  Synthetic oligonucleotide; AGG chr11 5385531 5385550 5385547 +
cttagacactgtcaggctcc

SEQ ID NO: 27253 - DNA, 20 bp, Artificial Sequence
  Synthetic oligonucleotide; GGG chr11 5385532 5385551 5385548 +
ttagacactgtcaggctcca

SEQ ID NO: 27254 - DNA, 20 bp, Artificial Sequence
  Synthetic oligonucleotide; GGG chr11 5385533 5385552 5385549 +
tagacactgtcaggctccag

SEQ ID NO: 27255 - DNA, 20 bp, Artificial Sequence
  Synthetic oligonucleotide; TAG chr11 5385540 5385559 5385556 +
tgtcaggctccaggggcctt

SEQ ID NO: 27256 - DNA, 20 bp, Artificial Sequence
  Synthetic oligonucleotide; GAG chr11 5385542 5385561 5385558 +
tcaggctccaggggccttta

SEQ ID NO: 27257 - DNA, 20 bp, Artificial Sequence
  Synthetic oligonucleotide; CAG chr11 5385550 5385569 5385566 +
caggggcctttagagaattc

SEQ ID NO: 27258 - DNA, 20 bp, Artificial Sequence
  Synthetic oligonucleotide; TAG chr11 5385579 5385598 5385595 +
caacttaaaaaatgaattat

SEQ ID NO: 27259 - DNA, 20 bp, Artificial Sequence
  Synthetic oligonucleotide; AGG chr11 5385580 5385599 5385596 +
aacttaaaaaatgaattatt

SEQ ID NO: 27260 - DNA, 20 bp, Artificial Sequence
  Synthetic oligonucleotide; TGG chr11 5385584 5385603 5385600 +
taaaaaatgaattattaggt

SEQ ID NO: 27261 - DNA, 20 bp, Artificial Sequence
  Synthetic oligonucleotide; TGG chr11 5385598 5385617 5385614 +
ttaggttggtgaaaaattaa

SEQ ID NO: 27262 - DNA, 20 bp, Artificial Sequence
  Synthetic oligonucleotide; CAG chr11 5385601 5385620 5385617 +
ggttggtgaaaaattaatgg

SEQ ID NO: 27263 - DNA, 20 bp, Artificial Sequence
  Synthetic oligonucleotide; AAG chr11 5385644 5385663 5385660 +
tgttctaaacatgtataata

SEQ ID NO: 27264 - DNA, 20 bp, Artificial Sequence
  Synthetic oligonucleotide; AAG chr11 5385686 5385705 5385702 +
tataatatatatgttgtaca

SEQ ID NO: 27265 - DNA, 20 bp, Artificial Sequence
  Synthetic oligonucleotide; CAG chr11 5385748 5385767 5385764 +
tgtttacatatataaatata

SEQ ID NO: 27266 - DNA, 20 bp, Artificial Sequence
  Synthetic oligonucleotide; AAG chr11 5385794 5385813 5385810 +
ttatatataaaaaatctata

SEQ ID NO: 27267 - DNA, 20 bp, Artificial Sequence
  Synthetic oligonucleotide; AAG chr11 5385803 5385822 5385819 +
aaaaatctataaagtatata

SEQ ID NO: 27268 - DNA, 20 bp, Artificial Sequence
  Synthetic oligonucleotide; AAG chr11 5385842 5385861 5385858 +
actaaaatgtatattctata

SEQ ID NO: 27269 - DNA, 20 bp, Artificial Sequence
  Synthetic oligonucleotide; GAG chr11 5385852 5385871 5385868 +
atattctataaagtatttat

SEQ ID NO: 27270 - DNA, 20 bp, Artificial Sequence
  Synthetic oligonucleotide; TGG chr11 5385906 5385925 5385922 +
tatacatatgtgtacttata

SEQ ID NO: 27271 - DNA, 20 bp, Artificial Sequence
  Synthetic oligonucleotide; AAG chr11 5385915 5385934 5385931 +
gtgtacttatatggatgtat

SEQ ID NO: 27272 - DNA, 20 bp, Artificial Sequence
  Synthetic oligonucleotide; AAG chr11 5385940 5385959 5385956 +
tgttctatatatatatcaat

SEQ ID NO: 27273 - DNA, 20 bp, Artificial Sequence
  Synthetic oligonucleotide; AAG chr11 5385965 5385984 5385981 +
tatataaatataaaaatata

SEQ ID NO: 27274 - DNA, 20 bp, Artificial Sequence
  Synthetic oligonucleotide; TAG chr11 5385994 5386013 5386010 +
tgtgtgtatttacaccttaa

SEQ ID NO: 27275 - DNA, 20 bp, Artificial Sequence
  Synthetic oligonucleotide; CAG chr11 5386004 5386023 5386020 +
tacaccttaatagtacatta

SEQ ID NO: 27276 - DNA, 20 bp, Artificial Sequence
  Synthetic oligonucleotide; AGG chr11 5386005 5386024 5386021 +
acaccttaatagtacattac

SEQ ID NO: 27277 - DNA, 20 bp, Artificial Sequence
  Synthetic oligonucleotide; GAG chr11 5386016 5386035 5386032 +
gtacattacaggtactacgt

SEQ ID NO: 27278 - DNA, 20 bp, Artificial Sequence
  Synthetic oligonucleotide; CAG chr11 5386021 5386040 5386037 +
ttacaggtactacgtgagaa

SEQ ID NO: 27279 - DNA, 20 bp, Artificial Sequence
  Synthetic oligonucleotide; GAG chr11 5386023 5386042 5386039 +
acaggtactacgtgagaaca

SEQ ID NO: 27280 - DNA, 20 bp, Artificial Sequence
  Synthetic oligonucleotide; AAG chr11 5386027 5386046 5386043 +
gtactacgtgagaacagaga

SEQ ID NO: 27281 - DNA, 20 bp, Artificial Sequence
  Synthetic oligonucleotide; CAG chr11 5386045 5386064 5386061 +
gaaagatgtacctaatgcta

SEQ ID NO: 27282 - DNA, 20 bp, Artificial Sequence
  Synthetic oligonucleotide; AAG chr11 5386048 5386067 5386064 +
agatgtacctaatgctacag

SEQ ID NO: 27283 - DNA, 20 bp, Artificial Sequence
  Synthetic oligonucleotide; AGG chr11 5386049 5386068 5386065 +
gatgtacctaatgctacaga

SEQ ID NO: 27284 - DNA, 20 bp, Artificial Sequence
  Synthetic oligonucleotide; AAG chr11 5386052 5386071 5386068 +
gtacctaatgctacagaagg

SEQ ID NO: 27285 - DNA, 20 bp, Artificial Sequence
  Synthetic oligonucleotide; CAG chr11 5386056 5386075 5386072 +
ctaatgctacagaaggaagt

SEQ ID NO: 27286 - DNA, 20 bp, Artificial Sequence
  Synthetic oligonucleotide; AGG chr11 5386057 5386076 5386073 +
taatgctacagaaggaagtc

SEQ ID NO: 27287 - DNA, 20 bp, Artificial Sequence
  Synthetic oligonucleotide; GAG chr11 5386059 5386078 5386075 +
atgctacagaaggaagtcag

SEQ ID NO: 27288 - DNA, 20 bp, Artificial Sequence
  Synthetic oligonucleotide; GAG chr11 5386061 5386080 5386077 +
gctacagaaggaagtcagga

SEQ ID NO: 27289 - DNA, 20 bp, Artificial Sequence
  Synthetic oligonucleotide; CAG chr11 5386070 5386089 5386086 +
ggaagtcaggagagatttga

SEQ ID NO: 27290 - DNA, 20 bp, Artificial Sequence
  Synthetic oligonucleotide; AAG chr11 5386073 5386092 5386089 +
agtcaggagagatttgacag

SEQ ID NO: 27291 - DNA, 20 bp, Artificial Sequence
  Synthetic oligonucleotide; AAG chr11 5386076 5386095 5386092 +
caggagagatttgacagaag

SEQ ID NO: 27292 - DNA, 20 bp, Artificial Sequence
  Synthetic oligonucleotide; AAG chr11 5386092 5386111 5386108 +
gaagaagtgatatttgtact

SEQ ID NO: 27293 - DNA, 20 bp, Artificial Sequence
  Synthetic oligonucleotide; AAG chr11 5386100 5386119 5386116 +
gatatttgtactaagtctta

SEQ ID NO: 27294 - DNA, 20 bp, Artificial Sequence
  Synthetic oligonucleotide; AGG chr11 5386101 5386120 5386117 +
atatttgtactaagtcttaa

SEQ ID NO: 27295 - DNA, 20 bp, Artificial Sequence
  Synthetic oligonucleotide; AAG chr11 5386110 5386129 5386126 +
ctaagtcttaaaggatccgc

SEQ ID NO: 27296 - DNA, 20 bp, Artificial Sequence
  Synthetic oligonucleotide; TGG chr11 5386120 5386139 5386136 +
aaggatccgcaagtgtttac

SEQ ID NO: 27297 - DNA, 20 bp, Artificial Sequence
  Synthetic oligonucleotide; TGG chr11 5386124 5386143 5386140 +
atccgcaagtgtttactggt

SEQ ID NO: 27298 - DNA, 20 bp, Artificial Sequence
  Synthetic oligonucleotide; CAG chr11 5386132 5386151 5386148 +
gtgtttactggttggaaaaa

SEQ ID NO: 27299 - DNA, 20 bp, Artificial Sequence
  Synthetic oligonucleotide; AGG chr11 5386133 5386152 5386149 +
tgtttactggttggaaaaac

SEQ ID NO: 27300 - DNA, 20 bp, Artificial Sequence
  Synthetic oligonucleotide; GGG chr11 5386134 5386153 5386150 +
gtttactggttggaaaaaca

SEQ ID NO: 27301 - DNA, 20 bp, Artificial Sequence
  Synthetic oligonucleotide; GGG chr11 5386135 5386154 5386151 +
tttactggttggaaaaacag

SEQ ID NO: 27302 - DNA, 20 bp, Artificial Sequence
  Synthetic oligonucleotide; TGG chr11 5386138 5386157 5386154 +
actggttggaaaaacagggg

SEQ ID NO: 27303 - DNA, 20 bp, Artificial Sequence
  Synthetic oligonucleotide; AAG chr11 5386149 5386168 5386165 +
aaacaggggtggtttttgcc

SEQ ID NO: 27304 - DNA, 20 bp, Artificial Sequence
  Synthetic oligonucleotide; AAG chr11 5386153 5386172 5386169 +
aggggtggtttttgccaaga

SEQ ID NO: 27305 - DNA, 20 bp, Artificial Sequence
  Synthetic oligonucleotide; TAG chr11 5386165 5386184 5386181 +
tgccaagaaagcaataaata

SEQ ID NO: 27306 - DNA, 20 bp, Artificial Sequence
  Synthetic oligonucleotide; AAG chr11 5386168 5386187 5386184 +
caagaaagcaataaatatag

SEQ ID NO: 27307 - DNA, 20 bp, Artificial Sequence
  Synthetic oligonucleotide; AAG chr11 5386180 5386199 5386196 +
aaatatagaagaataaaaac

SEQ ID NO: 27308 - DNA, 20 bp, Artificial Sequence
  Synthetic oligonucleotide; AAG chr11 5386185 5386204 5386201 +
tagaagaataaaaacaagaa

SEQ ID NO: 27309 - DNA, 20 bp, Artificial Sequence
  Synthetic oligonucleotide; TAG chr11 5386194 5386213 5386210 +
aaaaacaagaaaagtatgtg

SEQ ID NO: 27310 - DNA, 20 bp, Artificial Sequence
  Synthetic oligonucleotide; AGG chr11 5386195 5386214 5386211 +
aaaacaagaaaagtatgtgt

SEQ ID NO: 27311 - DNA, 20 bp, Artificial Sequence
  Synthetic oligonucleotide; GGG chr11 5386196 5386215 5386212 +
aaacaagaaaagtatgtgta

SEQ ID NO: 27312 - DNA, 20 bp, Artificial Sequence
  Synthetic oligonucleotide; AAG chr11 5386204 5386223 5386220 +
aaagtatgtgtagggaattg

SEQ ID NO: 27313 - DNA, 20 bp, Artificial Sequence
  Synthetic oligonucleotide; TGG chr11 5386219 5386238 5386235 +
aattgaagaaaaaaatgata

SEQ ID NO: 27314 - DNA, 20 bp, Artificial Sequence
  Synthetic oligonucleotide; GGG chr11 5386220 5386239 5386236 +
attgaagaaaaaaatgatat

SEQ ID NO: 27315 - DNA, 20 bp, Artificial Sequence
  Synthetic oligonucleotide; TGG chr11 5386232 5386251 5386248 +
aatgatatgggtgtgttgac

SEQ ID NO: 27316 - DNA, 20 bp, Artificial Sequence
  Synthetic oligonucleotide; GGG chr11 5386233 5386252 5386249 +
atgatatgggtgtgttgact

SEQ ID NO: 27317 - DNA, 20 bp, Artificial Sequence
  Synthetic oligonucleotide; AAG chr11 5386238 5386257 5386254 +
atgggtgtgttgactgggaa

SEQ ID NO: 27318 - DNA, 20 bp, Artificial Sequence
  Synthetic oligonucleotide; TGG chr11 5386242 5386261 5386258 +
gtgtgttgactgggaaaaga

SEQ ID NO: 27319 - DNA, 20 bp, Artificial Sequence
  Synthetic oligonucleotide; GGG chr11 5386243 5386262 5386259 +
tgtgttgactgggaaaagat

SEQ ID NO: 27320 - DNA, 20 bp, Artificial Sequence
  Synthetic oligonucleotide; TGG chr11 5386248 5386267 5386264 +
tgactgggaaaagatgggtt

SEQ ID NO: 27321 - DNA, 20 bp, Artificial Sequence
  Synthetic oligonucleotide; AAG chr11 5386252 5386271 5386268 +
tgggaaaagatgggtttgga

SEQ ID NO: 27322 - DNA, 20 bp, Artificial Sequence
  Synthetic oligonucleotide; AGG chr11 5386253 5386272 5386269 +
gggaaaagatgggtttggaa

SEQ ID NO: 27323 - DNA, 20 bp, Artificial Sequence
  Synthetic oligonucleotide; AAG chr11 5386265 5386284 5386281 +
gtttggaaaggtgccaaaac

SEQ ID NO: 27324 - DNA, 20 bp, Artificial Sequence
  Synthetic oligonucleotide; AAG chr11 5386268 5386287 5386284 +
tggaaaggtgccaaaacaag

SEQ ID NO: 27325 - DNA, 20 bp, Artificial Sequence
  Synthetic oligonucleotide; AGG chr11 5386269 5386288 5386285 +
ggaaaggtgccaaaacaaga

SEQ ID NO: 27326 - DNA, 20 bp, Artificial Sequence
  Synthetic oligonucleotide; CGG chr11 5386274 5386293 5386290 +
ggtgccaaaacaagaaggac

SEQ ID NO: 27327 - DNA, 20 bp, Artificial Sequence
  Synthetic oligonucleotide; GGG chr11 5386275 5386294 5386291 +
gtgccaaaacaagaaggacc

SEQ ID NO: 27328 - DNA, 20 bp, Artificial Sequence
  Synthetic oligonucleotide; AAG chr11 5386281 5386300 5386297 +
aaacaagaaggaccgggcta

SEQ ID NO: 27329 - DNA, 20 bp, Artificial Sequence
  Synthetic oligonucleotide; TGG chr11 5386285 5386304 5386301 +
aagaaggaccgggctaaaga

SEQ ID NO: 27330 - DNA, 20 bp, Artificial Sequence
  Synthetic oligonucleotide; CAG chr11 5386293 5386312 5386309 +
ccgggctaaagatggtgtta

SEQ ID NO: 27331 - DNA, 20 bp, Artificial Sequence
  Synthetic oligonucleotide; AGG chr11 5386294 5386313 5386310 +
cgggctaaagatggtgttac

SEQ ID NO: 27332 - DNA, 20 bp, Artificial Sequence
  Synthetic oligonucleotide; GGG chr11 5386295 5386314 5386311 +
gggctaaagatggtgttaca

SEQ ID NO: 27333 - DNA, 20 bp, Artificial Sequence
  Synthetic oligonucleotide; GAG chr11 5386303 5386322 5386319 +
gatggtgttacagggtgttt

SEQ ID NO: 27334 - DNA, 20 bp, Artificial Sequence
  Synthetic oligonucleotide; AGG chr11 5386304 5386323 5386320 +
atggtgttacagggtgtttg

SEQ ID NO: 27335 - DNA, 20 bp, Artificial Sequence
  Synthetic oligonucleotide; CAG chr11 5386311 5386330 5386327 +
tacagggtgtttgaggctac

SEQ ID NO: 27336 - DNA, 20 bp, Artificial Sequence
  Synthetic oligonucleotide; AGG chr11 5386312 5386331 5386328 +
acagggtgtttgaggctacc

SEQ ID NO: 27337 - DNA, 20 bp, Artificial Sequence
  Synthetic oligonucleotide; GGG chr11 5386313 5386332 5386329 +
cagggtgtttgaggctacca

SEQ ID NO: 27338 - DNA, 20 bp, Artificial Sequence
  Synthetic oligonucleotide; TAG chr11 5386323 5386342 5386339 +
gaggctaccagggccatgca

SEQ ID NO: 27339 - DNA, 20 bp, Artificial Sequence
  Synthetic oligonucleotide; GAG chr11 5386325 5386344 5386341 +
ggctaccagggccatgcata

SEQ ID NO: 27340 - DNA, 20 bp, Artificial Sequence
  Synthetic oligonucleotide; GAG chr11 5386327 5386346 5386343 +
ctaccagggccatgcataga

SEQ ID NO: 27341 - DNA, 20 bp, Artificial Sequence
  Synthetic oligonucleotide; AAG chr11 5386333 5386352 5386349 +
gggccatgcatagagagaca

SEQ ID NO: 27342 - DNA, 20 bp, Artificial Sequence
  Synthetic oligonucleotide; AGG chr11 5386334 5386353 5386350 +
ggccatgcatagagagacaa

SEQ ID NO: 27343 - DNA, 20 bp, Artificial Sequence
  Synthetic oligonucleotide; CAG chr11 5386368 5386387 5386384 +
tcctgattttcgctcactac

SEQ ID NO: 27344 - DNA, 20 bp, Artificial Sequence
  Synthetic oligonucleotide; AGG chr11 5386369 5386388 5386385 +
cctgattttcgctcactacc

SEQ ID NO: 27345 - DNA, 20 bp, Artificial Sequence
  Synthetic oligonucleotide; TGG chr11 5386375 5386394 5386391 +
tttcgctcactaccaggcct

SEQ ID NO: 27346 - DNA, 20 bp, Artificial Sequence
  Synthetic oligonucleotide; GGG chr11 5386376 5386395 5386392 +
ttcgctcactaccaggcctt

SEQ ID NO: 27347 - DNA, 20 bp, Artificial Sequence
  Synthetic oligonucleotide; TAG chr11 5386398 5386417 5386414 +
gatgattgtttacctttttg

SEQ ID NO: 27348 - DNA, 20 bp, Artificial Sequence
  Synthetic oligonucleotide; AAG chr11 5386414 5386433 5386430 +
tttgtagttttctccttgtg

SEQ ID NO: 27349 - DNA, 20 bp, Artificial Sequence
  Synthetic oligonucleotide; TAG chr11 5386417 5386436 5386433 +
gtagttttctccttgtgaag

SEQ ID NO: 27350 - DNA, 20 bp, Artificial Sequence
  Synthetic oligonucleotide; TAG chr11 5386435 5386454 5386451 +
agtagtaataaaatgtttca

SEQ ID NO: 27351 - DNA, 20 bp, Artificial Sequence
  Synthetic oligonucleotide; AAG chr11 5386464 5386483 5386480 +
gaaatattcatgattatgtc

SEQ ID NO: 27352 - DNA, 20 bp, Artificial Sequence
  Synthetic oligonucleotide; CAG chr11 5386474 5386493 5386490 +
tgattatgtcaagcttttca

SEQ ID NO: 27353 - DNA, 20 bp, Artificial Sequence
  Synthetic oligonucleotide; TGG chr11 5386492 5386511 5386508 +
cacagcatctaaatcatgta

SEQ ID NO: 27354 - DNA, 20 bp, Artificial Sequence
  Synthetic oligonucleotide; TGG chr11 5386506 5386525 5386522 +
catgtatggcctcaataaat

SEQ ID NO: 27355 - DNA, 20 bp, Artificial Sequence
  Synthetic oligonucleotide; CAG chr11 5386519 5386538 5386535 +
aataaattggactatcacca

SEQ ID NO: 27356 - DNA, 20 bp, Artificial Sequence
  Synthetic oligonucleotide; AAG chr11 5386531 5386550 5386547 +
tatcaccacagatcttttac

SEQ ID NO: 27357 - DNA, 20 bp, Artificial Sequence
  Synthetic oligonucleotide; TAG chr11 5386554 5386573 5386570 +
tttgaactttattctaatga

SEQ ID NO: 27358 - DNA, 20 bp, Artificial Sequence
  Synthetic oligonucleotide; AGG chr11 5386555 5386574 5386571 +
ttgaactttattctaatgat

SEQ ID NO: 27359 - DNA, 20 bp, Artificial Sequence
  Synthetic oligonucleotide; GAG chr11 5386557 5386576 5386573 +
gaactttattctaatgatag

SEQ ID NO: 27360 - DNA, 20 bp, Artificial Sequence
  Synthetic oligonucleotide; AAG chr11 5386566 5386585 5386582 +
tctaatgataggagctactg

SEQ ID NO: 27361 - DNA, 20 bp, Artificial Sequence
  Synthetic oligonucleotide; CAG chr11 5386578 5386597 5386594 +
agctactgaagtactgaaaa

SEQ ID NO: 27362 - DNA, 20 bp, Artificial Sequence
  Synthetic oligonucleotide; CAG chr11 5386583 5386602 5386599 +
ctgaagtactgaaaacagtg

SEQ ID NO: 27363 - DNA, 20 bp, Artificial Sequence
  Synthetic oligonucleotide; TAG chr11 5386593 5386612 5386609 +
gaaaacagtgcagtgattca

SEQ ID NO: 27364 - DNA, 20 bp, Artificial Sequence
  Synthetic oligonucleotide; GAG chr11 5386595 5386614 5386611 +
aaacagtgcagtgattcata

SEQ ID NO: 27365 - DNA, 20 bp, Artificial Sequence
  Synthetic oligonucleotide; TAG chr11 5386599 5386618 5386615 +
agtgcagtgattcatagagt

SEQ ID NO: 27366 - DNA, 20 bp, Artificial Sequence
  Synthetic oligonucleotide; CGG chr11 5386619 5386638 5386635 +
tagtactttctgcataatct

SEQ ID NO: 27367 - DNA, 20 bp, Artificial Sequence
  Synthetic oligonucleotide; TGG chr11 5386622 5386641 5386638 +
tactttctgcataatctcgg

SEQ ID NO: 27368 - DNA, 20 bp, Artificial Sequence
  Synthetic oligonucleotide; CAG chr11 5386628 5386647 5386644 +
ctgcataatctcggtggctg

SEQ ID NO: 27369 - DNA, 20 bp, Artificial Sequence
  Synthetic oligonucleotide; TAG chr11 5386631 5386650 5386647 +
cataatctcggtggctgcag

SEQ ID NO: 27370 - DNA, 20 bp, Artificial Sequence
  Synthetic oligonucleotide; GAG chr11 5386633 5386652 5386649 +
taatctcggtggctgcagta

SEQ ID NO: 27371 - DNA, 20 bp, Artificial Sequence
  Synthetic oligonucleotide; AGG chr11 5386634 5386653 5386650 +
aatctcggtggctgcagtag

SEQ ID NO: 27372 - DNA, 20 bp, Artificial Sequence
  Synthetic oligonucleotide; TGG chr11 5386638 5386657 5386654 +
tcggtggctgcagtagagga

SEQ ID NO: 27373 - DNA, 20 bp, Artificial Sequence
  Synthetic oligonucleotide; AAG chr11 5386644 5386663 5386660 +
gctgcagtagaggatggacc

SEQ ID NO: 27374 - DNA, 20 bp, Artificial Sequence
  Synthetic oligonucleotide; AGG chr11 5386645 5386664 5386661 +
ctgcagtagaggatggacca

SEQ ID NO: 27375 - DNA, 20 bp, Artificial Sequence
  Synthetic oligonucleotide; GGG chr11 5386646 5386665 5386662 +
tgcagtagaggatggaccaa

SEQ ID NO: 27376 - DNA, 20 bp, Artificial Sequence
  Synthetic oligonucleotide; AAG chr11 5386649 5386668 5386665 +
agtagaggatggaccaaggg

SEQ ID NO: 27377 - DNA, 20 bp, Artificial Sequence
  Synthetic oligonucleotide; AGG chr11 5386650 5386669 5386666 +
gtagaggatggaccaaggga

SEQ ID NO: 27378 - DNA, 20 bp, Artificial Sequence
  Synthetic oligonucleotide; GAG chr11 5386652 5386671 5386668 +
agaggatggaccaagggaag

SEQ ID NO: 27379 - DNA, 20 bp, Artificial Sequence
  Synthetic oligonucleotide; AGG chr11 5386653 5386672 5386669 +
gaggatggaccaagggaagg

SEQ ID NO: 27380 - DNA, 20 bp, Artificial Sequence
  Synthetic oligonucleotide; GAG chr11 5386655 5386674 5386671 +
ggatggaccaagggaaggag

SEQ ID NO: 27381 - DNA, 20 bp, Artificial Sequence
  Synthetic oligonucleotide; TGG chr11 5386660 5386679 5386676 +
gaccaagggaaggaggagcc

SEQ ID NO: 27382 - DNA, 20 bp, Artificial Sequence
  Synthetic oligonucleotide; CAG chr11 5386680 5386699 5386696 +
tggctttgcatgttgaatga

SEQ ID NO: 27383 - DNA, 20 bp, Artificial Sequence
  Synthetic oligonucleotide; AGG chr11 5386681 5386700 5386697 +
ggctttgcatgttgaatgac

SEQ ID NO: 27384 - DNA, 20 bp, Artificial Sequence
  Synthetic oligonucleotide; CAG chr11 5386685 5386704 5386701 +
ttgcatgttgaatgacaggt

SEQ ID NO: 27385 - DNA, 20 bp, Artificial Sequence
  Synthetic oligonucleotide; AGG chr11 5386686 5386705 5386702 +
tgcatgttgaatgacaggtc

SEQ ID NO: 27386 - DNA, 20 bp, Artificial Sequence
  Synthetic oligonucleotide; AAG chr11 5386690 5386709 5386706 +
tgttgaatgacaggtcaggc

SEQ ID NO: 27387 - DNA, 20 bp, Artificial Sequence
  Synthetic oligonucleotide; CAG chr11 5386693 5386712 5386709 +
tgaatgacaggtcaggcaag

SEQ ID NO: 27388 - DNA, 20 bp, Artificial Sequence
  Synthetic oligonucleotide; AGG chr11 5386694 5386713 5386710 +
gaatgacaggtcaggcaagc

SEQ ID NO: 27389 - DNA, 20 bp, Artificial Sequence
  Synthetic oligonucleotide; TGG chr11 5386699 5386718 5386715 +
acaggtcaggcaagcaggtg

SEQ ID NO: 27390 - DNA, 20 bp, Artificial Sequence
  Synthetic oligonucleotide; AAG chr11 5386704 5386723 5386720 +
tcaggcaagcaggtgtggaa

SEQ ID NO: 27391 - DNA, 20 bp, Artificial Sequence
  Synthetic oligonucleotide; AAG chr11 5386709 5386728 5386725 +
caagcaggtgtggaaaagct

SEQ ID NO: 27392 - DNA, 20 bp, Artificial Sequence
  Synthetic oligonucleotide; AAG chr11 5386715 5386734 5386731 +
ggtgtggaaaagctaagaac

SEQ ID NO: 27393 - DNA, 20 bp, Artificial Sequence
  Synthetic oligonucleotide; AGG chr11 5386716 5386735 5386732 +
gtgtggaaaagctaagaaca

SEQ ID NO: 27394 - DNA, 20 bp, Artificial Sequence
  Synthetic oligonucleotide; TGG chr11 5386723 5386742 5386739 +
aaagctaagaacaaggacat

SEQ ID NO: 27395 - DNA, 20 bp, Artificial Sequence
  Synthetic oligonucleotide; CAG chr11 5386729 5386748 5386745 +
aagaacaaggacattggcta

SEQ ID NO: 27396 - DNA, 20 bp, Artificial Sequence
  Synthetic oligonucleotide; GAG chr11 5386731 5386750 5386747 +
gaacaaggacattggctaca

SEQ ID NO: 27397 - DNA, 20 bp, Artificial Sequence
  Synthetic oligonucleotide; AAG chr11 5386737 5386756 5386753 +
ggacattggctacagagatg

SEQ ID NO: 27398 - DNA, 20 bp, Artificial Sequence
  Synthetic oligonucleotide; TAG chr11 5386745 5386764 5386761 +
gctacagagatgaagatgaa

SEQ ID NO: 27399 - DNA, 20 bp, Artificial Sequence
  Synthetic oligonucleotide; CAG chr11 5386752 5386771 5386768 +
agatgaagatgaatagatta

SEQ ID NO: 27400 - DNA, 20 bp, Artificial Sequence
  Synthetic oligonucleotide; AGG chr11 5386753 5386772 5386769 +
gatgaagatgaatagattac

SEQ ID NO: 27401 - DNA, 20 bp, Artificial Sequence
  Synthetic oligonucleotide; GGG chr11 5386754 5386773 5386770 +
atgaagatgaatagattaca

SEQ ID NO: 27402 - DNA, 20 bp, Artificial Sequence
  Synthetic oligonucleotide; TAG chr11 5386758 5386777 5386774 +
agatgaatagattacaggga

SEQ ID NO: 27403 - DNA, 20 bp, Artificial Sequence
  Synthetic oligonucleotide; AAG chr11 5386766 5386785 5386782 +
agattacagggatagattaa

SEQ ID NO: 27404 - DNA, 20 bp, Artificial Sequence
  Synthetic oligonucleotide; TAG chr11 5386773 5386792 5386789 +
agggatagattaaaagaact

SEQ ID NO: 27405 - DNA, 20 bp, Artificial Sequence
  Synthetic oligonucleotide; TAG chr11 5386784 5386803 5386800 +
aaaagaacttagttaaaaat

SEQ ID NO: 27406 - DNA, 20 bp, Artificial Sequence
  Synthetic oligonucleotide; CAG chr11 5386790 5386809 5386806 +
acttagttaaaaattagata

SEQ ID NO: 27407 - DNA, 20 bp, Artificial Sequence
  Synthetic oligonucleotide; AAG chr11 5386794 5386813 5386810 +
agttaaaaattagatacaga

SEQ ID NO: 27408 - DNA, 20 bp, Artificial Sequence
  Synthetic oligonucleotide; GAG chr11 5386796 5386815 5386812 +
ttaaaaattagatacagaaa

SEQ ID NO: 27409 - DNA, 20 bp, Artificial Sequence
  Synthetic oligonucleotide; AGG chr11 5386797 5386816 5386813 +
taaaaattagatacagaaag

SEQ ID NO: 27410 - DNA, 20 bp, Artificial Sequence
  Synthetic oligonucleotide; GGG chr11 5386798 5386817 5386814 +
aaaaattagatacagaaaga

SEQ ID NO: 27411 - DNA, 20 bp, Artificial Sequence
  Synthetic oligonucleotide; GAG chr11 5386800 5386819 5386816 +
aaattagatacagaaagagg

SEQ ID NO: 27412 - DNA, 20 bp, Artificial Sequence
  Synthetic oligonucleotide; GAG chr11 5386802 5386821 5386818 +
attagatacagaaagaggga

SEQ ID NO: 27413 - DNA, 20 bp, Artificial Sequence
  Synthetic oligonucleotide; AGG chr11 5386803 5386822 5386819 +
ttagatacagaaagagggag

SEQ ID NO: 27414 - DNA, 20 bp, Artificial Sequence
  Synthetic oligonucleotide; GGG chr11 5386804 5386823 5386820 +
tagatacagaaagagggaga

SEQ ID NO: 27415 - DNA, 20 bp, Artificial Sequence
  Synthetic oligonucleotide; GAG chr11 5386809 5386828 5386825 +
acagaaagagggagagggtt

SEQ ID NO: 27416 - DNA, 20 bp, Artificial Sequence
  Synthetic oligonucleotide; TAG chr11 5386812 5386831 5386828 +
gaaagagggagagggttgag

SEQ ID NO: 27417 - DNA, 20 bp, Artificial Sequence
  Synthetic oligonucleotide; GAG chr11 5386814 5386833 5386830 +
aagagggagagggttgagta

SEQ ID NO: 27418 - DNA, 20 bp, Artificial Sequence
  Synthetic oligonucleotide; CAG chr11 5386820 5386839 5386836 +
gagagggttgagtagagcat

SEQ ID NO: 27419 - DNA, 20 bp, Artificial Sequence
  Synthetic oligonucleotide; TGG chr11 5386843 5386862 5386859 +
ctcaaaaatgttgtcttgaa

SEQ ID NO: 27420 - DNA, 20 bp, Artificial Sequence
  Synthetic oligonucleotide; CAG chr11 5386846 5386865 5386862 +
aaaaatgttgtcttgaatgg

SEQ ID NO: 27421 - DNA, 20 bp, Artificial Sequence
  Synthetic oligonucleotide; AGG chr11 5386847 5386866 5386863 +
aaaatgttgtcttgaatggc

SEQ ID NO: 27422 - DNA, 20 bp, Artificial Sequence
  Synthetic oligonucleotide; TGG chr11 5386853 5386872 5386869 +
ttgtcttgaatggcaggaaa

SEQ ID NO: 27423 - DNA, 20 bp, Artificial Sequence
  Synthetic oligonucleotide; GAG chr11 5386886 5386905 5386902 +
tataaaaaatgcataaatat

SEQ ID NO: 27424 - DNA, 20 bp, Artificial Sequence
  Synthetic oligonucleotide; AAG chr11 5386889 5386908 5386905 +
aaaaaatgcataaatatgag

SEQ ID NO: 27425 - DNA, 20 bp, Artificial Sequence
  Synthetic oligonucleotide; CAG chr11 5386895 5386914 5386911 +
tgcataaatatgagaagaat

SEQ ID NO: 27426 - DNA, 20 bp, Artificial Sequence
  Synthetic oligonucleotide; AGG chr11 5386896 5386915 5386912 +
gcataaatatgagaagaatc

SEQ ID NO: 27427 - DNA, 20 bp, Artificial Sequence
  Synthetic oligonucleotide; AAG chr11 5386905 5386924 5386921 +
tgagaagaatcaggtgtgaa

SEQ ID NO: 27428 - DNA, 20 bp, Artificial Sequence
  Synthetic oligonucleotide; TGG chr11 5386909 5386928 5386925 +
aagaatcaggtgtgaaaaga

SEQ ID NO: 27429 - DNA, 20 bp, Artificial Sequence
  Synthetic oligonucleotide; TGG chr11 5386916 5386935 5386932 +
aggtgtgaaaagatggatgc

SEQ ID NO: 27430 - DNA, 20 bp, Artificial Sequence
  Synthetic oligonucleotide; GGG chr11 5386917 5386936 5386933 +
ggtgtgaaaagatggatgct

SEQ ID NO: 27431 - DNA, 20 bp, Artificial Sequence
  Synthetic oligonucleotide; TAG chr11 5386928 5386947 5386944 +
atggatgctgggctcaatat

SEQ ID NO: 27432 - DNA, 20 bp, Artificial Sequence
  Synthetic oligonucleotide; GAG chr11 5386938 5386957 5386954 +
ggctcaatattagacgtgtt

SEQ ID NO: 27433 - DNA, 20 bp, Artificial Sequence
  Synthetic oligonucleotide; CAG chr11 5386947 5386966 5386963 +
ttagacgtgttgagtttcat

SEQ ID NO: 27434 - DNA, 20 bp, Artificial Sequence
  Synthetic oligonucleotide; TGG chr11 5386958 5386977 5386974 +
gagtttcatcagtatccttt

SEQ ID NO: 27435 - DNA, 20 bp, Artificial Sequence
  Synthetic oligonucleotide; TAG chr11 5386968 5386987 5386984 +
agtatccttttggaaacacc

SEQ ID NO: 27436 - DNA, 20 bp, Artificial Sequence
  Synthetic oligonucleotide; GAG chr11 5386972 5386991 5386988 +
tccttttggaaacacctagt

SEQ ID NO: 27437 - DNA, 20 bp, Artificial Sequence
  Synthetic oligonucleotide; AAG chr11 5386975 5386994 5386991 +
ttttggaaacacctagtgag

SEQ ID NO: 27438 - DNA, 20 bp, Artificial Sequence
  Synthetic oligonucleotide; AGG chr11 5386976 5386995 5386992 +
tttggaaacacctagtgaga

SEQ ID NO: 27439 - DNA, 20 bp, Artificial Sequence
  Synthetic oligonucleotide; CAG chr11 5386979 5386998 5386995 +
ggaaacacctagtgagaagg

SEQ ID NO: 27440 - DNA, 20 bp, Artificial Sequence
  Synthetic oligonucleotide; CAG chr11 5386987 5387006 5387003 +
ctagtgagaaggcagaaact

SEQ ID NO: 27441 - DNA, 20 bp, Artificial Sequence
  Synthetic oligonucleotide; AGG chr11 5386988 5387007 5387004 +
tagtgagaaggcagaaactc

SEQ ID NO: 27442 - DNA, 20 bp, Artificial Sequence
  Synthetic oligonucleotide; CGG chr11 5387003 5387022 5387019 +
aactcaggcctgatatgtaa

SEQ ID NO: 27443 - DNA, 20 bp, Artificial Sequence
  Synthetic oligonucleotide; GAG chr11 5387005 5387024 5387021 +
ctcaggcctgatatgtaacg

SEQ ID NO: 27444 - DNA, 20 bp, Artificial Sequence
  Synthetic oligonucleotide; TGG chr11 5387013 5387032 5387029 +
tgatatgtaacggagttatc

SEQ ID NO: 27445 - DNA, 20 bp, Artificial Sequence
  Synthetic oligonucleotide; TAG chr11 5387018 5387037 5387034 +
tgtaacggagttatctggac

SEQ ID NO: 27446 - DNA, 20 bp, Artificial Sequence
  Synthetic oligonucleotide; GAG chr11 5387020 5387039 5387036 +
taacggagttatctggacta

SEQ ID NO: 27447 - DNA, 20 bp, Artificial Sequence
  Synthetic oligonucleotide; AAG chr11 5387033 5387052 5387049 +
tggactagagattaatgtct

SEQ ID NO: 27448 - DNA, 20 bp, Artificial Sequence
  Synthetic oligonucleotide; GAG chr11 5387035 5387054 5387051 +
gactagagattaatgtctaa

SEQ ID NO: 27449 - DNA, 20 bp, Artificial Sequence
  Synthetic oligonucleotide; AAG chr11 5387050 5387069 5387066 +
tctaagagccaccactgtat

SEQ ID NO: 27450 - DNA, 20 bp, Artificial Sequence
  Synthetic oligonucleotide; TAG chr11 5387065 5387084 5387081 +
tgtataagtaataataataa

SEQ ID NO: 27451 - DNA, 20 bp, Artificial Sequence
  Synthetic oligonucleotide; GAG chr11 5387082 5387101 5387098 +
taatagataatataatgaat

SEQ ID NO: 27452 - DNA, 20 bp, Artificial Sequence
  Synthetic oligonucleotide; AAG chr11 5387085 5387104 5387101 +
tagataatataatgaatgag

SEQ ID NO: 27453 - DNA, 20 bp, Artificial Sequence
  Synthetic oligonucleotide; AAG chr11 5387090 5387109 5387106 +
aatataatgaatgagaagtt

SEQ ID NO: 27454 - DNA, 20 bp, Artificial Sequence
  Synthetic oligonucleotide; AGG chr11 5387091 5387110 5387107 +
atataatgaatgagaagtta

SEQ ID NO: 27455 - DNA, 20 bp, Artificial Sequence
  Synthetic oligonucleotide; AAG chr11 5387099 5387118 5387115 +
aatgagaagttaaggtgttc

SEQ ID NO: 27456 - DNA, 20 bp, Artificial Sequence
  Synthetic oligonucleotide; AGG chr11 5387100 5387119 5387116 +
atgagaagttaaggtgttca

SEQ ID NO: 27457 - DNA, 20 bp, Artificial Sequence
  Synthetic oligonucleotide; CAG chr11 5387104 5387123 5387120 +
gaagttaaggtgttcaagga

SEQ ID NO: 27458 - DNA, 20 bp, Artificial Sequence
  Synthetic oligonucleotide; GAG chr11 5387130 5387149 5387146 +
actgaataacataaatattt

SEQ ID NO: 27459 - DNA, 20 bp, Artificial Sequence
  Synthetic oligonucleotide; TGG chr11 5387136 5387155 5387152 +
taacataaatatttgagcaa

SEQ ID NO: 27460 - DNA, 20 bp, Artificial Sequence
  Synthetic oligonucleotide; AAG chr11 5387143 5387162 5387159 +
aatatttgagcaatggaaat

SEQ ID NO: 27461 - DNA, 20 bp, Artificial Sequence
  Synthetic oligonucleotide; GAG chr11 5387145 5387164 5387161 +
tatttgagcaatggaaataa

SEQ ID NO: 27462 - DNA, 20 bp, Artificial Sequence
  Synthetic oligonucleotide; GAG chr11 5387147 5387166 5387163 +
tttgagcaatggaaataaga

SEQ ID NO: 27463 - DNA, 20 bp, Artificial Sequence
  Synthetic oligonucleotide; TAG chr11 5387154 5387173 5387170 +
aatggaaataagagagtgca

SEQ ID NO: 27464 - DNA, 20 bp, Artificial Sequence
  Synthetic oligonucleotide; AAG chr11 5387157 5387176 5387173 +
ggaaataagagagtgcatag

SEQ ID NO: 27465 - DNA, 20 bp, Artificial Sequence
  Synthetic oligonucleotide; CAG chr11 5387173 5387192 5387189 +
atagaagctatcacaaaaat

SEQ ID NO: 27466 - DNA, 20 bp, Artificial Sequence
  Synthetic oligonucleotide; AAG chr11 5387176 5387195 5387192 +
gaagctatcacaaaaatcag

SEQ ID NO: 27467 - DNA, 20 bp, Artificial Sequence
  Synthetic oligonucleotide; GAG chr11 5387178 5387197 5387194 +
agctatcacaaaaatcagaa

SEQ ID NO: 27468 - DNA, 20 bp, Artificial Sequence
  Synthetic oligonucleotide; CAG chr11 5387184 5387203 5387200 +
cacaaaaatcagaagagaac

SEQ ID NO: 27469 - DNA, 20 bp, Artificial Sequence
  Synthetic oligonucleotide; CAG chr11 5387187 5387206 5387203 +
aaaaatcagaagagaaccag

SEQ ID NO: 27470 - DNA, 20 bp, Artificial Sequence
  Synthetic oligonucleotide; TGG chr11 5387194 5387213 5387210 +
agaagagaaccagcagatct

SEQ ID NO: 27471 - DNA, 20 bp, Artificial Sequence
  Synthetic oligonucleotide; AAG chr11 5387201 5387220 5387217 +
aaccagcagatcttggcatt

SEQ ID NO: 27472 - DNA, 20 bp, Artificial Sequence
  Synthetic oligonucleotide; TAG chr11 5387210 5387229 5387226 +
atcttggcattaagaatttc

SEQ ID NO: 27473 - DNA, 20 bp, Artificial Sequence
  Synthetic oligonucleotide; GAG chr11 5387212 5387231 5387228 +
cttggcattaagaatttcta

SEQ ID NO: 27474 - DNA, 20 bp, Artificial Sequence
  Synthetic oligonucleotide; GAG chr11 5387214 5387233 5387230 +
tggcattaagaatttctaga

SEQ ID NO: 27475 - DNA, 20 bp, Artificial Sequence
  Synthetic oligonucleotide; GAG chr11 5387216 5387235 5387232 +
gcattaagaatttctagaga

SEQ ID NO: 27476 - DNA, 20 bp, Artificial Sequence
  Synthetic oligonucleotide; AAG chr11 5387226 5387245 5387242 +
tttctagagagagctctaaa

SEQ ID NO: 27477 - DNA, 20 bp, Artificial Sequence
  Synthetic oligonucleotide; AGG chr11 5387227 5387246 5387243 +
ttctagagagagctctaaaa

SEQ ID NO: 27478 - DNA, 20 bp, Artificial Sequence
  Synthetic oligonucleotide; AAG chr11 5387230 5387249 5387246 +
tagagagagctctaaaaagg

SEQ ID NO: 27479 - DNA, 20 bp, Artificial Sequence
  Synthetic oligonucleotide; AGG chr11 5387231 5387250 5387247 +
agagagagctctaaaaagga

SEQ ID NO: 27480 - DNA, 20 bp, Artificial Sequence
  Synthetic oligonucleotide; TGG chr11 5387236 5387255 5387252 +
gagctctaaaaaggaaggca

SEQ ID NO: 27481 - DNA, 20 bp, Artificial Sequence
  Synthetic oligonucleotide; CAG chr11 5387240 5387259 5387256 +
tctaaaaaggaaggcatggc

SEQ ID NO: 27482 - DNA, 20 bp, Artificial Sequence
  Synthetic oligonucleotide; GAG chr11 5387242 5387261 5387258 +
taaaaaggaaggcatggcca

SEQ ID NO: 27483 - DNA, 20 bp, Artificial Sequence
  Synthetic oligonucleotide; AAG chr11 5387275 5387294 5387291 +
ttgcacaaaaaaatcaataa

SEQ ID NO: 27484 - DNA, 20 bp, Artificial Sequence
  Synthetic oligonucleotide; CAG chr11 5387278 5387297 5387294 +
cacaaaaaaatcaataaaag

SEQ ID NO: 27485 - DNA, 20 bp, Artificial Sequence
  Synthetic oligonucleotide; AGG chr11 5387279 5387298 5387295 +
acaaaaaaatcaataaaagc

SEQ ID NO: 27486 - DNA, 20 bp, Artificial Sequence
  Synthetic oligonucleotide; AAG chr11 5387289 5387308 5387305 +
caataaaagcaggtatgatt

SEQ ID NO: 27487 - DNA, 20 bp, Artificial Sequence
  Synthetic oligonucleotide; TGG chr11 5387307 5387326 5387323 +
ttaagactctccattgcatt

SEQ ID NO: 27488 - DNA, 20 bp, Artificial Sequence
  Synthetic oligonucleotide; TAG chr11 5387314 5387333 5387330 +
tctccattgcatttggcccc

SEQ ID NO: 27489 - DNA, 20 bp, Artificial Sequence
  Synthetic oligonucleotide; AAG chr11 5387317 5387336 5387333 +
ccattgcatttggcccctag

SEQ ID NO: 27490 - DNA, 20 bp, Artificial Sequence
  Synthetic oligonucleotide; TGG chr11 5387324 5387343 5387340 +
atttggcccctagaagtcac

SEQ ID NO: 27491 - DNA, 20 bp, Artificial Sequence
  Synthetic oligonucleotide; AAG chr11 5387334 5387353 5387350 +
tagaagtcactggtgaattt

SEQ ID NO: 27492 - DNA, 20 bp, Artificial Sequence
  Synthetic oligonucleotide; AGG chr11 5387335 5387354 5387351 +
agaagtcactggtgaattta

SEQ ID NO: 27493 - DNA, 20 bp, Artificial Sequence
  Synthetic oligonucleotide; GAG chr11 5387337 5387356 5387353 +
aagtcactggtgaatttaag

SEQ ID NO: 27494 - DNA, 20 bp, Artificial Sequence
  Synthetic oligonucleotide; TAG chr11 5387348 5387367 5387364 +
gaatttaaggagcattgctt

SEQ ID NO: 27495 - DNA, 20 bp, Artificial Sequence
  Synthetic oligonucleotide; AAG chr11 5387353 5387372 5387369 +
taaggagcattgctttagct

SEQ ID NO: 27496 - DNA, 20 bp, Artificial Sequence
  Synthetic oligonucleotide; TGG chr11 5387356 5387375 5387372 +
ggagcattgctttagctaag

SEQ ID NO: 27497 - DNA, 20 bp, Artificial Sequence
  Synthetic oligonucleotide; GGG chr11 5387357 5387376 5387373 +
gagcattgctttagctaagt

SEQ ID NO: 27498 - DNA, 20 bp, Artificial Sequence
  Synthetic oligonucleotide; TAG chr11 5387377 5387396 5387393 +
gggttttaaaaaaaacatta

SEQ ID NO: 27499 - DNA, 20 bp, Artificial Sequence
  Synthetic oligonucleotide; AGG chr11 5387378 5387397 5387394 +
ggttttaaaaaaaacattat

SEQ ID NO: 27500 - DNA, 20 bp, Artificial Sequence
  Synthetic oligonucleotide; GGG chr11 5387379 5387398 5387395 +
gttttaaaaaaaacattata

SEQ ID NO: 27501 - DNA, 20 bp, Artificial Sequence
  Synthetic oligonucleotide; TGG chr11 5387382 5387401 5387398 +
ttaaaaaaaacattataggg

SEQ ID NO: 27502 - DNA, 20 bp, Artificial Sequence
  Synthetic oligonucleotide; TGG chr11 5387386 5387405 5387402 +
aaaaaacattatagggtggt

SEQ ID NO: 27503 - DNA, 20 bp, Artificial Sequence
  Synthetic oligonucleotide; GAG chr11 5387391 5387410 5387407 +
acattatagggtggttggtt

SEQ ID NO: 27504 - DNA, 20 bp, Artificial Sequence
  Synthetic oligonucleotide; TAG chr11 5387394 5387413 5387410 +
ttatagggtggttggttgag

SEQ ID NO: 27505 - DNA, 20 bp, Artificial Sequence
  Synthetic oligonucleotide; GAG chr11 5387403 5387422 5387419 +
ggttggttgagtagtaaact

SEQ ID NO: 27506 - DNA, 20 bp, Artificial Sequence
  Synthetic oligonucleotide; AAG chr11 5387406 5387425 5387422 +
tggttgagtagtaaactgag

SEQ ID NO: 27507 - DNA, 20 bp, Artificial Sequence
  Synthetic oligonucleotide; AAG chr11 5387411 5387430 5387427 +
gagtagtaaactgagaagta

SEQ ID NO: 27508 - DNA, 20 bp, Artificial Sequence
  Synthetic oligonucleotide; TGG chr11 5387417 5387436 5387433 +
taaactgagaagtaaagaaa

SEQ ID NO: 27509 - DNA, 20 bp, Artificial Sequence
  Synthetic oligonucleotide; AAG chr11 5387422 5387441 5387438 +
tgagaagtaaagaaatggaa

SEQ ID NO: 27510 - DNA, 20 bp, Artificial Sequence
  Synthetic oligonucleotide; TGG chr11 5387432 5387451 5387448 +
agaaatggaaaagataaatg

SEQ ID NO: 27511 - DNA, 20 bp, Artificial Sequence
  Synthetic oligonucleotide; AAG chr11 5387456 5387475 5387472 +
ctattttttaccccttgcca

SEQ ID NO: 27512 - DNA, 20 bp, Artificial Sequence
  Synthetic oligonucleotide; AAG chr11 5387465 5387484 5387481 +
accccttgccaaagtgatgt

SEQ ID NO: 27513 - DNA, 20 bp, Artificial Sequence
  Synthetic oligonucleotide; CAG chr11 5387481 5387500 5387497 +
atgtaagccttatatccatg

SEQ ID NO: 27514 - DNA, 20 bp, Artificial Sequence
  Synthetic oligonucleotide; AAG chr11 5387503 5387522 5387519 +
gcacctctgctctcaactcg

SEQ ID NO: 27515 - DNA, 20 bp, Artificial Sequence
  Synthetic oligonucleotide; AAG chr11 5387511 5387530 5387527 +
gctctcaactcgaagctcac

SEQ ID NO: 27516 - DNA, 20 bp, Artificial Sequence
  Synthetic oligonucleotide; AAG chr11 5387528 5387547 5387544 +
cacaagtataataaaattca

SEQ ID NO: 27517 - DNA, 20 bp, Artificial Sequence
  Synthetic oligonucleotide; TAG chr11 5387531 5387550 5387547 +
aagtataataaaattcaaag

SEQ ID NO: 27518 - DNA, 20 bp, Artificial Sequence
  Synthetic oligonucleotide; AAG chr11 5387548 5387567 5387564 +
aagtagcttgcgtgacctgc

SEQ ID NO: 27519 - DNA, 20 bp, Artificial Sequence
  Synthetic oligonucleotide; TAG chr11 5387564 5387583 5387580 +
ctgcaagatcatacatgacg

SEQ ID NO: 27520 - DNA, 20 bp, Artificial Sequence
  Synthetic oligonucleotide; TAG chr11 5387571 5387590 5387587 +
atcatacatgacgtagcatt

SEQ ID NO: 27521 - DNA, 20 bp, Artificial Sequence
  Synthetic oligonucleotide; AAG chr11 5387584 5387603 5387600 +
tagcatttagctgctacttc

SEQ ID NO: 27522 - DNA, 20 bp, Artificial Sequence
  Synthetic oligonucleotide; TGG chr11 5387587 5387606 5387603 +
catttagctgctacttcaag

SEQ ID NO: 27523 - DNA, 20 bp, Artificial Sequence
  Synthetic oligonucleotide; TGG chr11 5387634 5387653 5387650 +
ttcctccattgaatatacat

SEQ ID NO: 27524 - DNA, 20 bp, Artificial Sequence
  Synthetic oligonucleotide; AAG chr11 5387662 5387681 5387678 +
ttttgtcttttaaacttgtc

SEQ ID NO: 27525 - DNA, 20 bp, Artificial Sequence
  Synthetic oligonucleotide; CAG chr11 5387678 5387697 5387694 +
tgtcaagctgctctctgctt

SEQ ID NO: 27526 - DNA, 20 bp, Artificial Sequence
  Synthetic oligonucleotide; AGG chr11 5387679 5387698 5387695 +
gtcaagctgctctctgcttc

SEQ ID NO: 27527 - DNA, 20 bp, Artificial Sequence
  Synthetic oligonucleotide; AAG chr11 5387724 5387743 5387740 +
ttccttgaatgtttttccct

SEQ ID NO: 27528 - DNA, 20 bp, Artificial Sequence
  Synthetic oligonucleotide; TAG chr11 5387728 5387747 5387744 +
ttgaatgtttttccctaaga

SEQ ID NO: 27529 - DNA, 20 bp, Artificial Sequence
  Synthetic oligonucleotide; CAG chr11 5387779 5387798 5387795 +
cttctctaaaattacctact

SEQ ID NO: 27530 - DNA, 20 bp, Artificial Sequence
  Synthetic oligonucleotide; GAG chr11 5387781 5387800 5387797 +
tctctaaaattacctactca

SEQ ID NO: 27531 - DNA, 20 bp, Artificial Sequence
  Synthetic oligonucleotide; GAG chr11 5387783 5387802 5387799 +
tctaaaattacctactcaga

SEQ ID NO: 27532 - DNA, 20 bp, Artificial Sequence
  Synthetic oligonucleotide; AGG chr11 5387784 5387803 5387800 +
ctaaaattacctactcagag

SEQ ID NO: 27533 - DNA, 20 bp, Artificial Sequence
  Synthetic oligonucleotide; CAG chr11 5387876 5387895 5387892 +
cattacattaccttgcattg

SEQ ID NO: 27534 - DNA, 20 bp, Artificial Sequence
  Synthetic oligonucleotide; CAG chr11 5387933 5387952 5387949 +
gtttctgttcattgtatttt

SEQ ID NO: 27535 - DNA, 20 bp, Artificial Sequence
  Synthetic oligonucleotide; TAG chr11 5387940 5387959 5387956 +
ttcattgtattttcagtacc

SEQ ID NO: 27536 - DNA, 20 bp, Artificial Sequence
  Synthetic oligonucleotide; AGG chr11 5387941 5387960 5387957 +
tcattgtattttcagtacct

SEQ ID NO: 27537 - DNA, 20 bp, Artificial Sequence
  Synthetic oligonucleotide; AAG chr11 5387949 5387968 5387965 +
ttttcagtacctaggtgtaa

SEQ ID NO: 27538 - DNA, 20 bp, Artificial Sequence
  Synthetic oligonucleotide; CAG chr11 5387958 5387977 5387974 +
cctaggtgtaaaagtaattg

SEQ ID NO: 27539 - DNA, 20 bp, Artificial Sequence
  Synthetic oligonucleotide; AAG chr11 5387974 5387993 5387990 +
attgcagttcttgccattga

SEQ ID NO: 27540 - DNA, 20 bp, Artificial Sequence
  Synthetic oligonucleotide; TGG chr11 5387980 5387999 5387996 +
gttcttgccattgaaagtaa

SEQ ID NO: 27541 - DNA, 20 bp, Artificial Sequence
  Synthetic oligonucleotide; TAG chr11 5388015 5388034 5388031 +
ttacttttgcaccaacctaa

SEQ ID NO: 27542 - DNA, 20 bp, Artificial Sequence
  Synthetic oligonucleotide; AAG chr11 5388116 5388135 5388132 +
attgaaataattattgaaat

SEQ ID NO: 27543 - DNA, 20 bp, Artificial Sequence
  Synthetic oligonucleotide; TGG chr11 5388124 5388143 5388140 +
aattattgaaataagattaa

SEQ ID NO: 27544 - DNA, 20 bp, Artificial Sequence
  Synthetic oligonucleotide; AAG chr11 5388166 5388185 5388182 +
atttattcaaataatattta

SEQ ID NO: 27545 - DNA, 20 bp, Artificial Sequence
  Synthetic oligonucleotide; AGG chr11 5388167 5388186 5388183 +
tttattcaaataatatttaa

SEQ ID NO: 27546 - DNA, 20 bp, Artificial Sequence
  Synthetic oligonucleotide; TGG chr11 5388182 5388201 5388198 +
tttaaaggattccaatgata

SEQ ID NO: 27547 - DNA, 20 bp, Artificial Sequence
  Synthetic oligonucleotide; TGG chr11 5388185 5388204 5388201 +
aaaggattccaatgatatgg

SEQ ID NO: 27548 - DNA, 20 bp, Artificial Sequence
  Synthetic oligonucleotide; AAG chr11 5388194 5388213 5388210 +
caatgatatggtggctaaaa

SEQ ID NO: 27549 - DNA, 20 bp, Artificial Sequence
  Synthetic oligonucleotide; TAG chr11 5388205 5388224 5388221 +
tggctaaaaaagtcaatccc

SEQ ID NO: 27550 - DNA, 20 bp, Artificial Sequence
  Synthetic oligonucleotide; GAG chr11 5388207 5388226 5388223 +
gctaaaaaagtcaatcccta

SEQ ID NO: 27551 - DNA, 20 bp, Artificial Sequence
  Synthetic oligonucleotide; AAG chr11 5388228 5388247 5388244 +
agctaatattaaaattaaaa

SEQ ID NO: 27552 - DNA, 20 bp, Artificial Sequence
  Synthetic oligonucleotide; GAG chr11 5388230 5388249 5388246 +
ctaatattaaaattaaaaaa

SEQ ID NO: 27553 - DNA, 20 bp, Artificial Sequence
  Synthetic oligonucleotide; CAG chr11 5388234 5388253 5388250 +
tattaaaattaaaaaagaga

SEQ ID NO: 27554 - DNA, 20 bp, Artificial Sequence
  Synthetic oligonucleotide; TGG chr11 5388240 5388259 5388256 +
aattaaaaaagagacagtca

SEQ ID NO: 27555 - DNA, 20 bp, Artificial Sequence
  Synthetic oligonucleotide; AAG chr11 5388254 5388273 5388270 +
cagtcatggtttatgtccac

SEQ ID NO: 27556 - DNA, 20 bp, Artificial Sequence
  Synthetic oligonucleotide; AGG chr11 5388255 5388274 5388271 +
agtcatggtttatgtccaca

SEQ ID NO: 27557 - DNA, 20 bp, Artificial Sequence
  Synthetic oligonucleotide; TAG chr11 5388269 5388288 5388285 +
tccacaaggaattcacatta

SEQ ID NO: 27558 - DNA, 20 bp, Artificial Sequence
  Synthetic oligonucleotide; AAG chr11 5388272 5388291 5388288 +
acaaggaattcacattatag

SEQ ID NO: 27559 - DNA, 20 bp, Artificial Sequence
  Synthetic oligonucleotide; CAG chr11 5388280 5388299 5388296 +
ttcacattatagaagcaata

SEQ ID NO: 27560 - DNA, 20 bp, Artificial Sequence
  Synthetic oligonucleotide; CAG chr11 5388298 5388317 5388314 +
tacagaaattgacaatgctg

SEQ ID NO: 27561 - DNA, 20 bp, Artificial Sequence
  Synthetic oligonucleotide; AGG chr11 5388299 5388318 5388315 +
acagaaattgacaatgctgc

SEQ ID NO: 27562 - DNA, 20 bp, Artificial Sequence
  Synthetic oligonucleotide; GGG chr11 5388300 5388319 5388316 +
cagaaattgacaatgctgca

SEQ ID NO: 27563 - DNA, 20 bp, Artificial Sequence
  Synthetic oligonucleotide; TGG chr11 5388312 5388331 5388328 +
atgctgcagggaaaatatca

SEQ ID NO: 27564 - DNA, 20 bp, Artificial Sequence
  Synthetic oligonucleotide; TAG chr11 5388319 5388338 5388335 +
agggaaaatatcatggtaat

SEQ ID NO: 27565 - DNA, 20 bp, Artificial Sequence
  Synthetic oligonucleotide; TAG chr11 5388326 5388345 5388342 +
atatcatggtaattagtgca

SEQ ID NO: 27566 - DNA, 20 bp, Artificial Sequence
  Synthetic oligonucleotide; CAG chr11 5388336 5388355 5388352 +
aattagtgcatagtgaacta

SEQ ID NO: 27567 - DNA, 20 bp, Artificial Sequence
  Synthetic oligonucleotide; AGG chr11 5388337 5388356 5388353 +
attagtgcatagtgaactac

SEQ ID NO: 27568 - DNA, 20 bp, Artificial Sequence
  Synthetic oligonucleotide; TAG chr11 5388346 5388365 5388362 +
tagtgaactacaggaacaca

SEQ ID NO: 27569 - DNA, 20 bp, Artificial Sequence
  Synthetic oligonucleotide; AGG chr11 5388347 5388366 5388363 +
agtgaactacaggaacacat

SEQ ID NO: 27570 - DNA, 20 bp, Artificial Sequence
  Synthetic oligonucleotide; GAG chr11 5388349 5388368 5388365 +
tgaactacaggaacacatag

SEQ ID NO: 27571 - DNA, 20 bp, Artificial Sequence
  Synthetic oligonucleotide; GAG chr11 5388351 5388370 5388367 +
aactacaggaacacatagga

SEQ ID NO: 27572 - DNA, 20 bp, Artificial Sequence
  Synthetic oligonucleotide; AGG chr11 5388352 5388371 5388368 +
actacaggaacacataggag

SEQ ID NO: 27573 - DNA, 20 bp, Artificial Sequence
  Synthetic oligonucleotide; GGG chr11 5388353 5388372 5388369 +
ctacaggaacacataggaga

SEQ ID NO: 27574 - DNA, 20 bp, Artificial Sequence
  Synthetic oligonucleotide; TGG chr11 5388371 5388390 5388387 +
gagggtattcaaactaaact

SEQ ID NO: 27575 - DNA, 20 bp, Artificial Sequence
  Synthetic oligonucleotide; GGG chr11 5388372 5388391 5388388 +
agggtattcaaactaaactt

SEQ ID NO: 27576 - DNA, 20 bp, Artificial Sequence
  Synthetic oligonucleotide; GGG chr11 5388373 5388392 5388389 +
gggtattcaaactaaacttg

SEQ ID NO: 27577 - DNA, 20 bp, Artificial Sequence
  Synthetic oligonucleotide; AAG chr11 5388381 5388400 5388397 +
aaactaaacttggggaattt

SEQ ID NO: 27578 - DNA, 20 bp, Artificial Sequence
  Synthetic oligonucleotide; AAG chr11 5388384 5388403 5388400 +
ctaaacttggggaatttaag

SEQ ID NO: 27579 - DNA, 20 bp, Artificial Sequence
  Synthetic oligonucleotide; AGG chr11 5388385 5388404 5388401 +
taaacttggggaatttaaga

SEQ ID NO: 27580 - DNA, 20 bp, Artificial Sequence
  Synthetic oligonucleotide; AAG chr11 5388395 5388414 5388411 +
gaatttaagaaggccttctg

SEQ ID NO: 27581 - DNA, 20 bp, Artificial Sequence
  Synthetic oligonucleotide; AGG chr11 5388396 5388415 5388412 +
aatttaagaaggccttctga

SEQ ID NO: 27582 - DNA, 20 bp, Artificial Sequence
  Synthetic oligonucleotide; AAG chr11 5388410 5388429 5388426 +
ttctgaaggacatcatatct

SEQ ID NO: 27583 - DNA, 20 bp, Artificial Sequence
  Synthetic oligonucleotide; AAG chr11 5388415 5388434 5388431 +
aaggacatcatatctaagct

SEQ ID NO: 27584 - DNA, 20 bp, Artificial Sequence
  Synthetic oligonucleotide; AGG chr11 5388416 5388435 5388432 +
aggacatcatatctaagcta

SEQ ID NO: 27585 - DNA, 20 bp, Artificial Sequence
  Synthetic oligonucleotide; TGG chr11 5388419 5388438 5388435 +
acatcatatctaagctaagg

SEQ ID NO: 27586 - DNA, 20 bp, Artificial Sequence
  Synthetic oligonucleotide; GGG chr11 5388420 5388439 5388436 +
catcatatctaagctaaggt

SEQ ID NO: 27587 - DNA, 20 bp, Artificial Sequence
  Synthetic oligonucleotide; TAG chr11 5388429 5388448 5388445 +
taagctaaggtgggttatat

SEQ ID NO: 27588 - DNA, 20 bp, Artificial Sequence
  Synthetic oligonucleotide; TAG chr11 5388432 5388451 5388448 +
gctaaggtgggttatattag

SEQ ID NO: 27589 - DNA, 20 bp, Artificial Sequence
  Synthetic oligonucleotide; AAG chr11 5388435 5388454 5388451 +
aaggtgggttatattagtag

SEQ ID NO: 27590 - DNA, 20 bp, Artificial Sequence
  Synthetic oligonucleotide; TAG chr11 5388443 5388462 5388459 +
ttatattagtagaagttaac

SEQ ID NO: 27591 - DNA, 20 bp, Artificial Sequence
  Synthetic oligonucleotide; AAG chr11 5388449 5388468 5388465 +
tagtagaagttaactagaca

SEQ ID NO: 27592 - DNA, 20 bp, Artificial Sequence
  Synthetic oligonucleotide; AAG chr11 5388455 5388474 5388471 +
aagttaactagacaaagatt

SEQ ID NO: 27593 - DNA, 20 bp, Artificial Sequence
  Synthetic oligonucleotide; AGG chr11 5388456 5388475 5388472 +
agttaactagacaaagatta

SEQ ID NO: 27594 - DNA, 20 bp, Artificial Sequence
  Synthetic oligonucleotide; GGG chr11 5388457 5388476 5388473 +
gttaactagacaaagattaa

SEQ ID NO: 27595 - DNA, 20 bp, Artificial Sequence
  Synthetic oligonucleotide; AAG chr11 5388461 5388480 5388477 +
actagacaaagattaaggga

SEQ ID NO: 27596 - DNA, 20 bp, Artificial Sequence
  Synthetic oligonucleotide; CAG chr11 5388470 5388489 5388486 +
agattaagggaaagctattt

SEQ ID NO: 27597 - DNA, 20 bp, Artificial Sequence
  Synthetic oligonucleotide; AGG chr11 5388471 5388490 5388487 +
gattaagggaaagctatttc

SEQ ID NO: 27598 - DNA, 20 bp, Artificial Sequence
  Synthetic oligonucleotide; CAG chr11 5388491 5388510 5388507 +
aggaaaaaatgtttttattc

SEQ ID NO: 27599 - DNA, 20 bp, Artificial Sequence
  Synthetic oligonucleotide; AGG chr11 5388492 5388511 5388508 +
ggaaaaaatgtttttattcc

SEQ ID NO: 27600 - DNA, 20 bp, Artificial Sequence
  Synthetic oligonucleotide; AAG chr11 5388495 5388514 5388511 +
aaaaatgtttttattccagg

SEQ ID NO: 27601 - DNA, 20 bp, Artificial Sequence
  Synthetic oligonucleotide; GAG chr11 5388523 5388542 5388539 +
aaatacaaatgtttacctat

SEQ ID NO: 27602 - DNA, 20 bp, Artificial Sequence
  Synthetic oligonucleotide; AAG chr11 5388527 5388546 5388543 +
acaaatgtttacctatgagc

SEQ ID NO: 27603 - DNA, 20 bp, Artificial Sequence
  Synthetic oligonucleotide; TAG chr11 5388535 5388554 5388551 +
ttacctatgagcaagcatac

SEQ ID NO: 27604 - DNA, 20 bp, Artificial Sequence
  Synthetic oligonucleotide; TGG chr11 5388544 5388563 5388560 +
agcaagcatactagataaac

SEQ ID NO: 27605 - DNA, 20 bp, Artificial Sequence
  Synthetic oligonucleotide; AAG chr11 5388547 5388566 5388563 +
aagcatactagataaactgg

SEQ ID NO: 27606 - DNA, 20 bp, Artificial Sequence
  Synthetic oligonucleotide; TAG chr11 5388557 5388576 5388573 +
gataaactggaagaattgtt

SEQ ID NO: 27607 - DNA, 20 bp, Artificial Sequence
  Synthetic oligonucleotide; CAG chr11 5388582 5388601 5388598 +
tcattaacaccgtgaatata

SEQ ID NO: 27608 - DNA, 20 bp, Artificial Sequence
  Synthetic oligonucleotide; GAG chr11 5388584 5388603 5388600 +
attaacaccgtgaatataca

SEQ ID NO: 27609 - DNA, 20 bp, Artificial Sequence
  Synthetic oligonucleotide; AGG chr11 5388585 5388604 5388601 +
ttaacaccgtgaatatacag

SEQ ID NO: 27610 - DNA, 20 bp, Artificial Sequence
  Synthetic oligonucleotide; TAG chr11 5388592 5388611 5388608 +
cgtgaatatacagaggaaat

SEQ ID NO: 27611 - DNA, 20 bp, Artificial Sequence
  Synthetic oligonucleotide; AGG chr11 5388593 5388612 5388609 +
gtgaatatacagaggaaatt

SEQ ID NO: 27612 - DNA, 20 bp, Artificial Sequence
  Synthetic oligonucleotide; TAG chr11 5388597 5388616 5388613 +
atatacagaggaaattagga

SEQ ID NO: 27613 - DNA, 20 bp, Artificial Sequence
  Synthetic oligonucleotide; AAG chr11 5388602 5388621 5388618 +
cagaggaaattaggatagat

SEQ ID NO: 27614 - DNA, 20 bp, Artificial Sequence
  Synthetic oligonucleotide; TAG chr11 5388609 5388628 5388625 +
aattaggatagataagaaaa

SEQ ID NO: 27615 - DNA, 20 bp, Artificial Sequence
  Synthetic oligonucleotide; AGG chr11 5388610 5388629 5388626 +
attaggatagataagaaaat

SEQ ID NO: 27616 - DNA, 20 bp, Artificial Sequence
  Synthetic oligonucleotide; CGG chr11 5388620 5388639 5388636 +
ataagaaaataggatataca

SEQ ID NO: 27617 - DNA, 20 bp, Artificial Sequence
  Synthetic oligonucleotide; GAG chr11 5388622 5388641 5388638 +
aagaaaataggatatacacg

SEQ ID NO: 27618 - DNA, 20 bp, Artificial Sequence
  Synthetic oligonucleotide; GAG chr11 5388624 5388643 5388640 +
gaaaataggatatacacgga

SEQ ID NO: 27619 - DNA, 20 bp, Artificial Sequence
  Synthetic oligonucleotide; AAG chr11 5388632 5388651 5388648 +
gatatacacggagagaaaat

SEQ ID NO: 27620 - DNA, 20 bp, Artificial Sequence
  Synthetic oligonucleotide; AGG chr11 5388633 5388652 5388649 +
atatacacggagagaaaata

SEQ ID NO: 27621 - DNA, 20 bp, Artificial Sequence
  Synthetic oligonucleotide; TAG chr11 5388636 5388655 5388652 +
tacacggagagaaaataagg

SEQ ID NO: 27622 - DNA, 20 bp, Artificial Sequence
  Synthetic oligonucleotide; AGG chr11 5388637 5388656 5388653 +
acacggagagaaaataaggt

SEQ ID NO: 27623 - DNA, 20 bp, Artificial Sequence
  Synthetic oligonucleotide; GGG chr11 5388638 5388657 5388654 +
cacggagagaaaataaggta

SEQ ID NO: 27624 - DNA, 20 bp, Artificial Sequence
  Synthetic oligonucleotide; TAG chr11 5388711 5388730 5388727 +
tatacgtctctcttgctata

SEQ ID NO: 27625 - DNA, 20 bp, Artificial Sequence
  Synthetic oligonucleotide; TAG chr11 5388714 5388733 5388730 +
acgtctctcttgctatatag

SEQ ID NO: 27626 - DNA, 20 bp, Artificial Sequence
  Synthetic oligonucleotide; CAG chr11 5388728 5388747 5388744 +
atatagtagtcaactgaata

SEQ ID NO: 27627 - DNA, 20 bp, Artificial Sequence
  Synthetic oligonucleotide; TAG chr11 5388731 5388750 5388747 +
tagtagtcaactgaatacag

SEQ ID NO: 27628 - DNA, 20 bp, Artificial Sequence
  Synthetic oligonucleotide; AAG chr11 5388739 5388758 5388755 +
aactgaatacagtagtacaa

SEQ ID NO: 27629 - DNA, 20 bp, Artificial Sequence
  Synthetic oligonucleotide; GAG chr11 5388744 5388763 5388760 +
aatacagtagtacaaaagat

SEQ ID NO: 27630 - DNA, 20 bp, Artificial Sequence
  Synthetic oligonucleotide; TGG chr11 5388751 5388770 5388767 +
tagtacaaaagatgagtcac

SEQ ID NO: 27631 - DNA, 20 bp, Artificial Sequence
  Synthetic oligonucleotide; TAG chr11 5388756 5388775 5388772 +
caaaagatgagtcactggaa

SEQ ID NO: 27632 - DNA, 20 bp, Artificial Sequence
  Synthetic oligonucleotide; AAG chr11 5388765 5388784 5388781 +
agtcactggaatagtcctga

SEQ ID NO: 27633 - DNA, 20 bp, Artificial Sequence
  Synthetic oligonucleotide; GAG chr11 5388767 5388786 5388783 +
tcactggaatagtcctgaaa

SEQ ID NO: 27634 - DNA, 20 bp, Artificial Sequence
  Synthetic oligonucleotide; TAG chr11 5388780 5388799 5388796 +
cctgaaagagtgatctgaat

SEQ ID NO: 27635 - DNA, 20 bp, Artificial Sequence
  Synthetic oligonucleotide; TAG chr11 5388785 5388804 5388801 +
aagagtgatctgaattagaa

SEQ ID NO: 27636 - DNA, 20 bp, Artificial Sequence
  Synthetic oligonucleotide; AAG chr11 5388796 5388815 5388812 +
gaattagaatagcatcaatg

SEQ ID NO: 27637 - DNA, 20 bp, Artificial Sequence
  Synthetic oligonucleotide; AGG chr11 5388797 5388816 5388813 +
aattagaatagcatcaatga

SEQ ID NO: 27638 - DNA, 20 bp, Artificial Sequence
  Synthetic oligonucleotide; CGG chr11 5388803 5388822 5388819 +
aatagcatcaatgaaggtga

SEQ ID NO: 27639 - DNA, 20 bp, Artificial Sequence
  Synthetic oligonucleotide; GAG chr11 5388807 5388826 5388823 +
gcatcaatgaaggtgacggt

SEQ ID NO: 27640 - DNA, 20 bp, Artificial Sequence
  Synthetic oligonucleotide; CAG chr11 5388814 5388833 5388830 +
tgaaggtgacggtgagtaaa

SEQ ID NO: 27641 - DNA, 20 bp, Artificial Sequence
  Synthetic oligonucleotide; GAG chr11 5388821 5388840 5388837 +
gacggtgagtaaacagactt

SEQ ID NO: 27642 - DNA, 20 bp, Artificial Sequence
  Synthetic oligonucleotide; AGG chr11 5388822 5388841 5388838 +
acggtgagtaaacagacttg

SEQ ID NO: 27643 - DNA, 20 bp, Artificial Sequence
  Synthetic oligonucleotide; CAG chr11 5388829 5388848 5388845 +
gtaaacagacttgaggtatt

SEQ ID NO: 27644 - DNA, 20 bp, Artificial Sequence
  Synthetic oligonucleotide; CAG chr11 5388836 5388855 5388852 +
gacttgaggtattcagtaaa

SEQ ID NO: 27645 - DNA, 20 bp, Artificial Sequence
  Synthetic oligonucleotide; TAG chr11 5388845 5388864 5388861 +
tattcagtaaacagaaaccc

SEQ ID NO: 27646 - DNA, 20 bp, Artificial Sequence
  Synthetic oligonucleotide; AGG chr11 5388846 5388865 5388862 +
attcagtaaacagaaaccct

SEQ ID NO: 27647 - DNA, 20 bp, Artificial Sequence
  Synthetic oligonucleotide; TGG chr11 5388852 5388871 5388868 +
taaacagaaaccctaggact

SEQ ID NO: 27648 - DNA, 20 bp, Artificial Sequence
  Synthetic oligonucleotide; TGG chr11 5388859 5388878 5388875 +
aaaccctaggacttggtgat

SEQ ID NO: 27649 - DNA, 20 bp, Artificial Sequence
  Synthetic oligonucleotide; TAG chr11 5388867 5388886 5388883 +
ggacttggtgattggttgat

SEQ ID NO: 27650 - DNA, 20 bp, Artificial Sequence
  Synthetic oligonucleotide; TGG chr11 5388876 5388895 5388892 +
gattggttgattagatacta

SEQ ID NO: 27651 - DNA, 20 bp, Artificial Sequence
  Synthetic oligonucleotide; GAG chr11 5388878 5388897 5388894 +
ttggttgattagatactatg

SEQ ID NO: 27652 - DNA, 20 bp, Artificial Sequence
  Synthetic oligonucleotide; GAG chr11 5388880 5388899 5388896 +
ggttgattagatactatgga

SEQ ID NO: 27653 - DNA, 20 bp, Artificial Sequence
  Synthetic oligonucleotide; TGG chr11 5388891 5388910 5388907 +
tactatggagagatgtgata

SEQ ID NO: 27654 - DNA, 20 bp, Artificial Sequence
  Synthetic oligonucleotide; GAG chr11 5388893 5388912 5388909 +
ctatggagagatgtgatatg

SEQ ID NO: 27655 - DNA, 20 bp, Artificial Sequence
  Synthetic oligonucleotide; AAG chr11 5388896 5388915 5388912 +
tggagagatgtgatatggag

SEQ ID NO: 27656 - DNA, 20 bp, Artificial Sequence
  Synthetic oligonucleotide; GAG chr11 5388926 5388945 5388942 +
taaaacatgacatttgactt

SEQ ID NO: 27657 - DNA, 20 bp, Artificial Sequence
  Synthetic oligonucleotide; GAG chr11 5388934 5388953 5388950 +
gacatttgacttgagccact

SEQ ID NO: 27658 - DNA, 20 bp, Artificial Sequence
  Synthetic oligonucleotide; AAG chr11 5388945 5388964 5388961 +
tgagccactgagataatgaa

SEQ ID NO: 27659 - DNA, 20 bp, Artificial Sequence
  Synthetic oligonucleotide; CAG chr11 5388950 5388969 5388966 +
cactgagataatgaaaagta

SEQ ID NO: 27660 - DNA, 20 bp, Artificial Sequence
  Synthetic oligonucleotide; TAG chr11 5388960 5388979 5388976 +
atgaaaagtacagatgttgc

SEQ ID NO: 27661 - DNA, 20 bp, Artificial Sequence
  Synthetic oligonucleotide; GAG chr11 5388962 5388981 5388978 +
gaaaagtacagatgttgcta

SEQ ID NO: 27662 - DNA, 20 bp, Artificial Sequence
  Synthetic oligonucleotide; TGG chr11 5388967 5388986 5388983 +
gtacagatgttgctagagtc

SEQ ID NO: 27663 - DNA, 20 bp, Artificial Sequence
  Synthetic oligonucleotide; AAG chr11 5388977 5388996 5388993 +
tgctagagtctggaaatcaa

SEQ ID NO: 27664 - DNA, 20 bp, Artificial Sequence
  Synthetic oligonucleotide; GAG chr11 5388979 5388998 5388995 +
ctagagtctggaaatcaaaa

SEQ ID NO: 27665 - DNA, 20 bp, Artificial Sequence
  Synthetic oligonucleotide; GAG chr11 5388981 5389000 5388997 +
agagtctggaaatcaaaaga

SEQ ID NO: 27666 - DNA, 20 bp, Artificial Sequence
  Synthetic oligonucleotide; AAG chr11 5388985 5389004 5389001 +
tctggaaatcaaaagagaga

SEQ ID NO: 27667 - DNA, 20 bp, Artificial Sequence
  Synthetic oligonucleotide; AAG chr11 5388990 5389009 5389006 +
aaatcaaaagagagaaagac

SEQ ID NO: 27668 - DNA, 20 bp, Artificial Sequence
  Synthetic oligonucleotide; TGG chr11 5388996 5389015 5389012 +
aaagagagaaagacaagttc

SEQ ID NO: 27669 - DNA, 20 bp, Artificial Sequence
  Synthetic oligonucleotide; TGG chr11 5389027 5389046 5389043 +
atttgttatttatcaatata

SEQ ID NO: 27670 - DNA, 20 bp, Artificial Sequence
  Synthetic oligonucleotide; TGG chr11 5389031 5389050 5389047 +
gttatttatcaatatatgga

SEQ ID NO: 27671 - DNA, 20 bp, Artificial Sequence
  Synthetic oligonucleotide; TGG chr11 5389046 5389065 5389062 +
atggatggtaaatgaaatca

SEQ ID NO: 27672 - DNA, 20 bp, Artificial Sequence
  Synthetic oligonucleotide; TAG chr11 5389049 5389068 5389065 +
gatggtaaatgaaatcatgg

SEQ ID NO: 27673 - DNA, 20 bp, Artificial Sequence
  Synthetic oligonucleotide; TGG chr11 5389052 5389071 5389068 +
ggtaaatgaaatcatggtag

SEQ ID NO: 27674 - DNA, 20 bp, Artificial Sequence
  Synthetic oligonucleotide; AAG chr11 5389063 5389082 5389079 +
tcatggtagtggatgacatt

SEQ ID NO: 27675 - DNA, 20 bp, Artificial Sequence
  Synthetic oligonucleotide; AAG chr11 5389066 5389085 5389082 +
tggtagtggatgacattaag

SEQ ID NO: 27676 - DNA, 20 bp, Artificial Sequence
  Synthetic oligonucleotide; TAG chr11 5389075 5389094 5389091 +
atgacattaagaagaaataa

SEQ ID NO: 27677 - DNA, 20 bp, Artificial Sequence
  Synthetic oligonucleotide; TGG chr11 5389082 5389101 5389098 +
taagaagaaataatagaata

SEQ ID NO: 27678 - DNA, 20 bp, Artificial Sequence
  Synthetic oligonucleotide; CAG chr11 5389086 5389105 5389102 +
aagaaataatagaatatggc

SEQ ID NO: 27679 - DNA, 20 bp, Artificial Sequence
  Synthetic oligonucleotide; AGG chr11 5389087 5389106 5389103 +
agaaataatagaatatggcc

SEQ ID NO: 27680 - DNA, 20 bp, Artificial Sequence
  Synthetic oligonucleotide; AAG chr11 5389098 5389117 5389114 +
aatatggccaggaaattgcc

SEQ ID NO: 27681 - DNA, 20 bp, Artificial Sequence
  Synthetic oligonucleotide; AGG chr11 5389099 5389118 5389115 +
atatggccaggaaattgcca

SEQ ID NO: 27682 - DNA, 20 bp, Artificial Sequence
  Synthetic oligonucleotide; TGG chr11 5389103 5389122 5389119 +
ggccaggaaattgccaagga

SEQ ID NO: 27683 - DNA, 20 bp, Artificial Sequence
  Synthetic oligonucleotide; GGG chr11 5389104 5389123 5389120 +
gccaggaaattgccaaggat

SEQ ID NO: 27684 - DNA, 20 bp, Artificial Sequence
  Synthetic oligonucleotide; AAG chr11 5389107 5389126 5389123 +
aggaaattgccaaggatggg

SEQ ID NO: 27685 - DNA, 20 bp, Artificial Sequence
  Synthetic oligonucleotide; AAG chr11 5389120 5389139 5389136 +
ggatgggaagaactatactt

SEQ ID NO: 27686 - DNA, 20 bp, Artificial Sequence
  Synthetic oligonucleotide; AGG chr11 5389121 5389140 5389137 +
gatgggaagaactatactta

SEQ ID NO: 27687 - DNA, 20 bp, Artificial Sequence
  Synthetic oligonucleotide; GGG chr11 5389122 5389141 5389138 +
atgggaagaactatacttaa

SEQ ID NO: 27688 - DNA, 20 bp, Artificial Sequence
  Synthetic oligonucleotide; GAG chr11 5389127 5389146 5389143 +
aagaactatacttaagggtt

SEQ ID NO: 27689 - DNA, 20 bp, Artificial Sequence
  Synthetic oligonucleotide; AAG chr11 5389135 5389154 5389151 +
tacttaagggttgagcaata

SEQ ID NO: 27690 - DNA, 20 bp, Artificial Sequence
  Synthetic oligonucleotide; AGG chr11 5389136 5389155 5389152 +
acttaagggttgagcaataa

SEQ ID NO: 27691 - DNA, 20 bp, Artificial Sequence
  Synthetic oligonucleotide; CAG chr11 5389144 5389163 5389160 +
gttgagcaataaaggcacac

SEQ ID NO: 27692 - DNA, 20 bp, Artificial Sequence
  Synthetic oligonucleotide; AAG chr11 5389149 5389168 5389165 +
gcaataaaggcacaccagca

SEQ ID NO: 27693 - DNA, 20 bp, Artificial Sequence
  Synthetic oligonucleotide; GAG chr11 5389151 5389170 5389167 +
aataaaggcacaccagcaaa

SEQ ID NO: 27694 - DNA, 20 bp, Artificial Sequence
  Synthetic oligonucleotide; AGG chr11 5389152 5389171 5389168 +
ataaaggcacaccagcaaag

SEQ ID NO: 27695 - DNA, 20 bp, Artificial Sequence
  Synthetic oligonucleotide; CAG chr11 5389155 5389174 5389171 +
aaggcacaccagcaaagagg

SEQ ID NO: 27696 - DNA, 20 bp, Artificial Sequence
  Synthetic oligonucleotide; GAG chr11 5389157 5389176 5389173 +
ggcacaccagcaaagaggca

SEQ ID NO: 27697 - DNA, 20 bp, Artificial Sequence
  Synthetic oligonucleotide; GAG chr11 5389159 5389178 5389175 +
cacaccagcaaagaggcaga

SEQ ID NO: 27698 - DNA, 20 bp, Artificial Sequence
  Synthetic oligonucleotide; AGG chr11 5389160 5389179 5389176 +
acaccagcaaagaggcagag

SEQ ID NO: 27699 - DNA, 20 bp, Artificial Sequence
  Synthetic oligonucleotide; CAG chr11 5389182 5389201 5389198 +
gaactgaaataattgaaata

SEQ ID NO: 27700 - DNA, 20 bp, Artificial Sequence
  Synthetic oligonucleotide; GAG chr11 5389184 5389203 5389200 +
actgaaataattgaaataca

SEQ ID NO: 27701 - DNA, 20 bp, Artificial Sequence
  Synthetic oligonucleotide; AGG chr11 5389185 5389204 5389201 +
ctgaaataattgaaatacag

SEQ ID NO: 27702 - DNA, 20 bp, Artificial Sequence
  Synthetic oligonucleotide; TGG chr11 5389193 5389212 5389209 +
attgaaatacagaggaaaac

SEQ ID NO: 27703 - DNA, 20 bp, Artificial Sequence
  Synthetic oligonucleotide; GAG chr11 5389197 5389216 5389213 +
aaatacagaggaaaactggt

SEQ ID NO: 27704 - DNA, 20 bp, Artificial Sequence
  Synthetic oligonucleotide; AGG chr11 5389198 5389217 5389214 +
aatacagaggaaaactggtg

SEQ ID NO: 27705 - DNA, 20 bp, Artificial Sequence
  Synthetic oligonucleotide; GGG chr11 5389199 5389218 5389215 +
atacagaggaaaactggtga

SEQ ID NO: 27706 - DNA, 20 bp, Artificial Sequence
  Synthetic oligonucleotide; GAG chr11 5389203 5389222 5389219 +
agaggaaaactggtgagggc

SEQ ID NO: 27707 - DNA, 20 bp, Artificial Sequence
  Synthetic oligonucleotide; AGG chr11 5389204 5389223 5389220 +
gaggaaaactggtgagggcg

SEQ ID NO: 27708 - DNA, 20 bp, Artificial Sequence
  Synthetic oligonucleotide; AAG chr11 5389213 5389232 5389229 +
tggtgagggcgaggttatca

SEQ ID NO: 27709 - DNA, 20 bp, Artificial Sequence
  Synthetic oligonucleotide; AAG chr11 5389217 5389236 5389233 +
gagggcgaggttatcaaaga

SEQ ID NO: 27710 - DNA, 20 bp, Artificial Sequence
  Synthetic oligonucleotide; AAG chr11 5389227 5389246 5389243 +
ttatcaaagaaagttcaata

SEQ ID NO: 27711 - DNA, 20 bp, Artificial Sequence
  Synthetic oligonucleotide; TAG chr11 5389230 5389249 5389246 +
tcaaagaaagttcaataaag

SEQ ID NO: 27712 - DNA, 20 bp, Artificial Sequence
  Synthetic oligonucleotide; GAG chr11 5389234 5389253 5389250 +
agaaagttcaataaagtagt

SEQ ID NO: 27713 - DNA, 20 bp, Artificial Sequence
  Synthetic oligonucleotide; TGG chr11 5389239 5389258 5389255 +
gttcaataaagtagtgagat

SEQ ID NO: 27714 - DNA, 20 bp, Artificial Sequence
  Synthetic oligonucleotide; CAG chr11 5389242 5389261 5389258 +
caataaagtagtgagattgg

SEQ ID NO: 27715 - DNA, 20 bp, Artificial Sequence
  Synthetic oligonucleotide; AAG chr11 5389252 5389271 5389268 +
gtgagattggcagaattcat

SEQ ID NO: 27716 - DNA, 20 bp, Artificial Sequence
  Synthetic oligonucleotide; AGG chr11 5389253 5389272 5389269 +
tgagattggcagaattcata

SEQ ID NO: 27717 - DNA, 20 bp, Artificial Sequence
  Synthetic oligonucleotide; GGG chr11 5389254 5389273 5389270 +
gagattggcagaattcataa

SEQ ID NO: 27718 - DNA, 20 bp, Artificial Sequence
  Synthetic oligonucleotide; TGG chr11 5389257 5389276 5389273 +
attggcagaattcataaggg

SEQ ID NO: 27719 - DNA, 20 bp, Artificial Sequence
  Synthetic oligonucleotide; GAG chr11 5389259 5389278 5389275 +
tggcagaattcataagggtg

SEQ ID NO: 27720 - DNA, 20 bp, Artificial Sequence
  Synthetic oligonucleotide; TAG chr11 5389262 5389281 5389278 +
cagaattcataagggtggag

SEQ ID NO: 27721 - DNA, 20 bp, Artificial Sequence
  Synthetic oligonucleotide; AAG chr11 5389274 5389293 5389290 +
gggtggagtagataatacta

SEQ ID NO: 27722 - DNA, 20 bp, Artificial Sequence
  Synthetic oligonucleotide; AGG chr11 5389275 5389294 5389291 +
ggtggagtagataatactaa

SEQ ID NO: 27723 - DNA, 20 bp, Artificial Sequence
  Synthetic oligonucleotide; TGG chr11 5389290 5389309 5389306 +
actaaaggtgatgatgacca

SEQ ID NO: 27724 - DNA, 20 bp, Artificial Sequence
  Synthetic oligonucleotide; TAG chr11 5389317 5389336 5389333 +
gcttgtgatgttgtgaatgt

SEQ ID NO: 27725 - DNA, 20 bp, Artificial Sequence
  Synthetic oligonucleotide; AAG chr11 5389322 5389341 5389338 +
tgatgttgtgaatgttagtg

SEQ ID NO: 27726 - DNA, 20 bp, Artificial Sequence
  Synthetic oligonucleotide; AAG chr11 5389328 5389347 5389344 +
tgtgaatgttagtgaagctg

SEQ ID NO: 27727 - DNA, 20 bp, Artificial Sequence
  Synthetic oligonucleotide; CAG chr11 5389341 5389360 5389357 +
gaagctgaagaattaataac

SEQ ID NO: 27728 - DNA, 20 bp, Artificial Sequence
  Synthetic oligonucleotide; CAG chr11 5389361 5389380 5389377 +
cagaaatatccatttatttt

SEQ ID NO: 27729 - DNA, 20 bp, Artificial Sequence
  Synthetic oligonucleotide; GAG chr11 5389374 5389393 5389390 +
ttattttcagctcaatcccc

SEQ ID NO: 27730 - DNA, 20 bp, Artificial Sequence
  Synthetic oligonucleotide; AGG chr11 5389375 5389394 5389391 +
tattttcagctcaatccccg

SEQ ID NO: 27731 - DNA, 20 bp, Artificial Sequence
  Synthetic oligonucleotide; CAG chr11 5389383 5389402 5389399 +
gctcaatccccgaggaatgt

SEQ ID NO: 27732 - DNA, 20 bp, Artificial Sequence
  Synthetic oligonucleotide; CAG chr11 5389399 5389418 5389415 +
atgtcagtccaatattcgct

SEQ ID NO: 27733 - DNA, 20 bp, Artificial Sequence
  Synthetic oligonucleotide; CAG chr11 5389433 5389452 5389449 +
tgctgctatccaacattact

SEQ ID NO: 27734 - DNA, 20 bp, Artificial Sequence
  Synthetic oligonucleotide; TAG chr11 5389438 5389457 5389454 +
ctatccaacattactcagtt

SEQ ID NO: 27735 - DNA, 20 bp, Artificial Sequence
  Synthetic oligonucleotide; CAG chr11 5389459 5389478 5389475 +
agccccatattctatctcac

SEQ ID NO: 27736 - DNA, 20 bp, Artificial Sequence
  Synthetic oligonucleotide; TGG chr11 5389468 5389487 5389484 +
ttctatctcaccagctttcc

SEQ ID NO: 27737 - DNA, 20 bp, Artificial Sequence
  Synthetic oligonucleotide; TGG chr11 5389473 5389492 5389489 +
tctcaccagctttcctggat

SEQ ID NO: 27738 - DNA, 20 bp, Artificial Sequence
  Synthetic oligonucleotide; AAG chr11 5389476 5389495 5389492 +
caccagctttcctggattgg

SEQ ID NO: 27739 - DNA, 20 bp, Artificial Sequence
  Synthetic oligonucleotide; AGG chr11 5389477 5389496 5389493 +
accagctttcctggattgga

SEQ ID NO: 27740 - DNA, 20 bp, Artificial Sequence
  Synthetic oligonucleotide; TGG chr11 5389490 5389509 5389506 +
gattggaaggcatcaaacac

SEQ ID NO: 27741 - DNA, 20 bp, Artificial Sequence
  Synthetic oligonucleotide; TGG chr11 5389521 5389540 5389537 +
cccctttttctttatgtaca

SEQ ID NO: 27742 - DNA, 20 bp, Artificial Sequence
  Synthetic oligonucleotide; CAG chr11 5389533 5389552 5389549 +
tatgtacatggttgccatct

SEQ ID NO: 27743 - DNA, 20 bp, Artificial Sequence
  Synthetic oligonucleotide; AGG chr11 5389534 5389553 5389550 +
atgtacatggttgccatctc

SEQ ID NO: 27744 - DNA, 20 bp, Artificial Sequence
  Synthetic oligonucleotide; AAG chr11 5389562 5389581 5389578 +
gtttcattctgatcattatt

SEQ ID NO: 27745 - DNA, 20 bp, Artificial Sequence
  Synthetic oligonucleotide; TGG chr11 5389611 5389630 5389627 +
gtactatctactatccttgc

SEQ ID NO: 27746 - DNA, 20 bp, Artificial Sequence
  Synthetic oligonucleotide; TGG chr11 5389626 5389645 5389642 +
cttgctggccctcactgacc

SEQ ID NO: 27747 - DNA, 20 bp, Artificial Sequence
  Synthetic oligonucleotide; GGG chr11 5389627 5389646 5389643 +
ttgctggccctcactgacct

SEQ ID NO: 27748 - DNA, 20 bp, Artificial Sequence
  Synthetic oligonucleotide; GGG chr11 5389628 5389647 5389644 +
tgctggccctcactgacctg

SEQ ID NO: 27749 - DNA, 20 bp, Artificial Sequence
  Synthetic oligonucleotide; TGG chr11 5389659 5389678 5389675 +
gtccacgttgcccaccacta

SEQ ID NO: 27750 - DNA, 20 bp, Artificial Sequence
  Synthetic oligonucleotide; GGG chr11 5389660 5389679 5389676 +
tccacgttgcccaccactat

SEQ ID NO: 27751 - DNA, 20 bp, Artificial Sequence
  Synthetic oligonucleotide; GGG chr11 5389661 5389680 5389677 +
ccacgttgcccaccactatg

SEQ ID NO: 27752 - DNA, 20 bp, Artificial Sequence
  Synthetic oligonucleotide; TGG chr11 5389670 5389689 5389686 +
ccaccactatggggatcttc

SEQ ID NO: 27753 - DNA, 20 bp, Artificial Sequence
  Synthetic oligonucleotide; TAG chr11 5389684 5389703 5389700 +
atcttctggtttaactccca

SEQ ID NO: 27754 - DNA, 20 bp, Artificial Sequence
  Synthetic oligonucleotide; TGG chr11 5389696 5389715 5389712 +
aactcccatagtatctactt

SEQ ID NO: 27755 - DNA, 20 bp, Artificial Sequence
  Synthetic oligonucleotide; GAG chr11 5389698 5389717 5389714 +
ctcccatagtatctactttg

SEQ ID NO: 27756 - DNA, 20 bp, Artificial Sequence
  Synthetic oligonucleotide; CAG chr11 5389712 5389731 5389728 +
actttggagcgtgtcaaatc

SEQ ID NO: 27757 - DNA, 20 bp, Artificial Sequence
  Synthetic oligonucleotide; TGG chr11 5389743 5389762 5389759 +
catccactctttttccttca

SEQ ID NO: 27758 - DNA, 20 bp, Artificial Sequence
  Synthetic oligonucleotide; GAG chr11 5389745 5389764 5389761 +
tccactctttttccttcatg

SEQ ID NO: 27759 - DNA, 20 bp, Artificial Sequence
  Synthetic oligonucleotide; CAG chr11 5389752 5389771 5389768 +
tttttccttcatggagtcct

SEQ ID NO: 27760 - DNA, 20 bp, Artificial Sequence
  Synthetic oligonucleotide; TGG chr11 5389785 5389804 5389801 +
gatgtcctttgaccgccttg

SEQ ID NO: 27761 - DNA, 20 bp, Artificial Sequence
  Synthetic oligonucleotide; GAG chr11 5389804 5389823 5389820 +
gtggccatctgccaccctct

SEQ ID NO: 27762 - DNA, 20 bp, Artificial Sequence
  Synthetic oligonucleotide; AGG chr11 5389805 5389824 5389821 +
tggccatctgccaccctctg

SEQ ID NO: 27763 - DNA, 20 bp, Artificial Sequence
  Synthetic oligonucleotide; CGG chr11 5389812 5389831 5389828 +
ctgccaccctctgaggtatt

SEQ ID NO: 27764 - DNA, 20 bp, Artificial Sequence
  Synthetic oligonucleotide; TGG chr11 5389825 5389844 5389841 +
aggtattcggtcattatcac

SEQ ID NO: 27765 - DNA, 20 bp, Artificial Sequence
  Synthetic oligonucleotide; CAG chr11 5389829 5389848 5389845 +
attcggtcattatcactggc

SEQ ID NO: 27766 - DNA, 20 bp, Artificial Sequence
  Synthetic oligonucleotide; AAG chr11 5389833 5389852 5389849 +
ggtcattatcactggccagc

SEQ ID NO: 27767 - DNA, 20 bp, Artificial Sequence
  Synthetic oligonucleotide; TGG chr11 5389836 5389855 5389852 +
cattatcactggccagcaag

SEQ ID NO: 27768 - DNA, 20 bp, Artificial Sequence
  Synthetic oligonucleotide; CAG chr11 5389840 5389859 5389856 +
atcactggccagcaagtggt

SEQ ID NO: 27769 - DNA, 20 bp, Artificial Sequence
  Synthetic oligonucleotide; GAG chr11 5389842 5389861 5389858 +
cactggccagcaagtggtca

SEQ ID NO: 27770 - DNA, 20 bp, Artificial Sequence
  Synthetic oligonucleotide; CAG chr11 5389845 5389864 5389861 +
tggccagcaagtggtcagag

SEQ ID NO: 27771 - DNA, 20 bp, Artificial Sequence
  Synthetic oligonucleotide; AGG chr11 5389846 5389865 5389862 +
ggccagcaagtggtcagagc

SEQ ID NO: 27772 - DNA, 20 bp, Artificial Sequence
  Synthetic oligonucleotide; CGG chr11 5389865 5389884 5389881 +
caggcctaattgtcatcttc

SEQ ID NO: 27773 - DNA, 20 bp, Artificial Sequence
  Synthetic oligonucleotide; GGG chr11 5389866 5389885 5389882 +
aggcctaattgtcatcttcc

SEQ ID NO: 27774 - DNA, 20 bp, Artificial Sequence
  Synthetic oligonucleotide; GGG chr11 5389867 5389886 5389883 +
ggcctaattgtcatcttccg

SEQ ID NO: 27775 - DNA, 20 bp, Artificial Sequence
  Synthetic oligonucleotide; TGG chr11 5389875 5389894 5389891 +
tgtcatcttccggggacctg

SEQ ID NO: 27776 - DNA, 20 bp, Artificial Sequence
  Synthetic oligonucleotide; AAG chr11 5389904 5389923 5389920 +
tccctattgtcctcctcctg

SEQ ID NO: 27777 - DNA, 20 bp, Artificial Sequence
  Synthetic oligonucleotide; AGG chr11 5389905 5389924 5389921 +
ccctattgtcctcctcctga

SEQ ID NO: 27778 - DNA, 20 bp, Artificial Sequence
  Synthetic oligonucleotide; TGG chr11 5389921 5389940 5389937 +
ctgaaggcttttccctactg

SEQ ID NO: 27779 - DNA, 20 bp, Artificial Sequence
  Synthetic oligonucleotide; TGG chr11 5389929 5389948 5389945 +
ttttccctactgtggatctg

SEQ ID NO: 27780 - DNA, 20 bp, Artificial Sequence
  Synthetic oligonucleotide; CAG chr11 5389958 5389977 5389974 +
cccactcattttgcctgcac

SEQ ID NO: 27781 - DNA, 20 bp, Artificial Sequence
  Synthetic oligonucleotide; AGG chr11 5389959 5389978 5389975 +
ccactcattttgcctgcacc

SEQ ID NO: 27782 - DNA, 20 bp, Artificial Sequence
  Synthetic oligonucleotide; AAG chr11 5389962 5389981 5389978 +
ctcattttgcctgcaccagg

SEQ ID NO: 27783 - DNA, 20 bp, Artificial Sequence
  Synthetic oligonucleotide; CAG chr11 5389970 5389989 5389986 +
gcctgcaccaggaagtgata

SEQ ID NO: 27784 - DNA, 20 bp, Artificial Sequence
  Synthetic oligonucleotide; TGG chr11 5389974 5389993 5389990 +
gcaccaggaagtgatacagc

SEQ ID NO: 27785 - DNA, 20 bp, Artificial Sequence
  Synthetic oligonucleotide; CAG chr11 5389983 5390002 5389999 +
agtgatacagctggcctgca

SEQ ID NO: 27786 - DNA, 20 bp, Artificial Sequence
  Synthetic oligonucleotide; TGG chr11 5390008 5390027 5390024 +
atcaccttcaataatctgta

SEQ ID NO: 27787 - DNA, 20 bp, Artificial Sequence
  Synthetic oligonucleotide; TGG chr11 5390016 5390035 5390032 +
caataatctgtatggactga

SEQ ID NO: 27788 - DNA, 20 bp, Artificial Sequence
  Synthetic oligonucleotide; TGG chr11 5390019 5390038 5390035 +
taatctgtatggactgatgg

SEQ ID NO: 27789 - DNA, 20 bp, Artificial Sequence
  Synthetic oligonucleotide; TAG chr11 5390022 5390041 5390038 +
tctgtatggactgatggtgg

SEQ ID NO: 27790 - DNA, 20 bp, Artificial Sequence
  Synthetic oligonucleotide; TGG chr11 5390040 5390059 5390056 +
ggtagttttcactgtgatgc

SEQ ID NO: 27791 - DNA, 20 bp, Artificial Sequence
  Synthetic oligonucleotide; TGG chr11 5390046 5390065 5390062 +
tttcactgtgatgctggacc

SEQ ID NO: 27792 - DNA, 20 bp, Artificial Sequence
  Synthetic oligonucleotide; TGG chr11 5390068 5390087 5390084 +
gtgctcatcgcactgtccta

SEQ ID NO: 27793 - DNA, 20 bp, Artificial Sequence
  Synthetic oligonucleotide; CAG chr11 5390085 5390104 5390101 +
ctatggactcatcctgcaca

SEQ ID NO: 27794 - DNA, 20 bp, Artificial Sequence
  Synthetic oligonucleotide; TAG chr11 5390088 5390107 5390104 +
tggactcatcctgcacacag

SEQ ID NO: 27795 - DNA, 20 bp, Artificial Sequence
  Synthetic oligonucleotide; CAG chr11 5390091 5390110 5390107 +
actcatcctgcacacagtag

SEQ ID NO: 27796 - DNA, 20 bp, Artificial Sequence
  Synthetic oligonucleotide; AGG chr11 5390092 5390111 5390108 +
ctcatcctgcacacagtagc

SEQ ID NO: 27797 - DNA, 20 bp, Artificial Sequence
  Synthetic oligonucleotide; TGG chr11 5390097 5390116 5390113 +
cctgcacacagtagcaggcc

SEQ ID NO: 27798 - DNA, 20 bp, Artificial Sequence
  Synthetic oligonucleotide; AAG chr11 5390106 5390125 5390122 +
agtagcaggcctggcctccc

SEQ ID NO: 27799 - DNA, 20 bp, Artificial Sequence
  Synthetic oligonucleotide; GAG chr11 5390108 5390127 5390124 +
tagcaggcctggcctcccaa

SEQ ID NO: 27800 - DNA, 20 bp, Artificial Sequence
  Synthetic oligonucleotide; AGG chr11 5390109 5390128 5390125 +
agcaggcctggcctcccaag

SEQ ID NO: 27801 - DNA, 20 bp, Artificial Sequence
  Synthetic oligonucleotide; GAG chr11 5390111 5390130 5390127 +
caggcctggcctcccaagag

SEQ ID NO: 27802 - DNA, 20 bp, Artificial Sequence
  Synthetic oligonucleotide; CAG chr11 5390114 5390133 5390130 +
gcctggcctcccaagaggag

SEQ ID NO: 27803 - DNA, 20 bp, Artificial Sequence
  Synthetic oligonucleotide; CAG chr11 5390129 5390148 5390145 +
aggagcagcgccgtgccttt

SEQ ID NO: 27804 - DNA, 20 bp, Artificial Sequence
  Synthetic oligonucleotide; TAG chr11 5390160 5390179 5390176 +
cgctcctctctgtgctgtgc

SEQ ID NO: 27805 - DNA, 20 bp, Artificial Sequence
  Synthetic oligonucleotide; TGG chr11 5390181 5390200 5390197 +
agtattctttgtgcccatga

SEQ ID NO: 27806 - DNA, 20 bp, Artificial Sequence
  Synthetic oligonucleotide; GGG chr11 5390182 5390201 5390198 +
gtattctttgtgcccatgat

SEQ ID NO: 27807 - DNA, 20 bp, Artificial Sequence
  Synthetic oligonucleotide; GGG chr11 5390183 5390202 5390199 +
tattctttgtgcccatgatg

SEQ ID NO: 27808 - DNA, 20 bp, Artificial Sequence
  Synthetic oligonucleotide; TGG chr11 5390193 5390212 5390209 +
gcccatgatggggctgtccc

SEQ ID NO: 27809 - DNA, 20 bp, Artificial Sequence
  Synthetic oligonucleotide; TGG chr11 5390206 5390225 5390222 +
ctgtccctggtgcaccgttt

SEQ ID NO: 27810 - DNA, 20 bp, Artificial Sequence
  Synthetic oligonucleotide; GGG chr11 5390207 5390226 5390223 +
tgtccctggtgcaccgtttt

SEQ ID NO: 27811 - DNA, 20 bp, Artificial Sequence
  Synthetic oligonucleotide; AAG chr11 5390210 5390229 5390226 +
ccctggtgcaccgttttggg

SEQ ID NO: 27812 - DNA, 20 bp, Artificial Sequence
  Synthetic oligonucleotide; TGG chr11 5390241 5390260 5390257 +
acctgctattcatcttctta

SEQ ID NO: 27813 - DNA, 20 bp, Artificial Sequence
  Synthetic oligonucleotide; CAG chr11 5390290 5390309 5390306 +
atgcttaacccaatcatata

SEQ ID NO: 27814 - DNA, 20 bp, Artificial Sequence
  Synthetic oligonucleotide; AAG chr11 5390297 5390316 5390313 +
acccaatcatatacagcatt

SEQ ID NO: 27815 - DNA, 20 bp, Artificial Sequence
  Synthetic oligonucleotide; AAG chr11 5390303 5390322 5390319 +
tcatatacagcattaagacc

SEQ ID NO: 27816 - DNA, 20 bp, Artificial Sequence
  Synthetic oligonucleotide; AGG chr11 5390304 5390323 5390320 +
catatacagcattaagacca

SEQ ID NO: 27817 - DNA, 20 bp, Artificial Sequence
  Synthetic oligonucleotide; GAG chr11 5390306 5390325 5390322 +
tatacagcattaagaccaag

SEQ ID NO: 27818 - DNA, 20 bp, Artificial Sequence
  Synthetic oligonucleotide; AAG chr11 5390327 5390346 5390343 +
agatccaccgtgccattatc

SEQ ID NO: 27819 - DNA, 20 bp, Artificial Sequence
  Synthetic oligonucleotide; TAG chr11 5390334 5390353 5390350 +
ccgtgccattatcaagttcc

SEQ ID NO: 27820 - DNA, 20 bp, Artificial Sequence
  Synthetic oligonucleotide; AGG chr11 5390335 5390354 5390351 +
cgtgccattatcaagttcct

SEQ ID NO: 27821 - DNA, 20 bp, Artificial Sequence
  Synthetic oligonucleotide; AAG chr11 5390345 5390364 5390361 +
tcaagttcctaggtcttaaa

SEQ ID NO: 27822 - DNA, 20 bp, Artificial Sequence
  Synthetic oligonucleotide; AGG chr11 5390346 5390365 5390362 +
caagttcctaggtcttaaaa

SEQ ID NO: 27823 - DNA, 20 bp, Artificial Sequence
  Synthetic oligonucleotide; CAG chr11 5390350 5390369 5390366 +
ttcctaggtcttaaaaaggc

SEQ ID NO: 27824 - DNA, 20 bp, Artificial Sequence
  Synthetic oligonucleotide; GAG chr11 5390358 5390377 5390374 +
tcttaaaaaggccagtaaat

SEQ ID NO: 27825 - DNA, 20 bp, Artificial Sequence
  Synthetic oligonucleotide; TGG chr11 5390364 5390383 5390380 +
aaaggccagtaaatgagtcc

SEQ ID NO: 27826 - DNA, 20 bp, Artificial Sequence
  Synthetic oligonucleotide; GGG chr11 5390365 5390384 5390381 +
aaggccagtaaatgagtcct

SEQ ID NO: 27827 - DNA, 20 bp, Artificial Sequence
  Synthetic oligonucleotide; GGG chr11 5390366 5390385 5390382 +
aggccagtaaatgagtcctg

SEQ ID NO: 27828 - DNA, 20 bp, Artificial Sequence
  Synthetic oligonucleotide; TAG chr11 5390382 5390401 5390398 +
cctggggctaaaactccccc

SEQ ID NO: 27829 - DNA, 20 bp, Artificial Sequence
  Synthetic oligonucleotide; GAG chr11 5390384 5390403 5390400 +
tggggctaaaactcccccta

SEQ ID NO: 27830 - DNA, 20 bp, Artificial Sequence
  Synthetic oligonucleotide; AGG chr11 5390385 5390404 5390401 +
ggggctaaaactccccctag

SEQ ID NO: 27831 - DNA, 20 bp, Artificial Sequence
  Synthetic oligonucleotide; AAG chr11 5390393 5390412 5390409 +
aactccccctagaggcctat

SEQ ID NO: 27832 - DNA, 20 bp, Artificial Sequence
  Synthetic oligonucleotide; AAG chr11 5390396 5390415 5390412 +
tccccctagaggcctataag

SEQ ID NO: 27833 - DNA, 20 bp, Artificial Sequence
  Synthetic oligonucleotide; AGG chr11 5390397 5390416 5390413 +
ccccctagaggcctataaga

SEQ ID NO: 27834 - DNA, 20 bp, Artificial Sequence
  Synthetic oligonucleotide; TGG chr11 5390408 5390427 5390424 +
cctataagaaggccccaaat

SEQ ID NO: 27835 - DNA, 20 bp, Artificial Sequence
  Synthetic oligonucleotide; TGG chr11 5390421 5390440 5390437 +
cccaaattggactgaaaatt

SEQ ID NO: 27836 - DNA, 20 bp, Artificial Sequence
  Synthetic oligonucleotide; GAG chr11 5390423 5390442 5390439 +
caaattggactgaaaatttg

SEQ ID NO: 27837 - DNA, 20 bp, Artificial Sequence
  Synthetic oligonucleotide; GAG chr11 5390430 5390449 5390446 +
gactgaaaatttggagtatt

SEQ ID NO: 27838 - DNA, 20 bp, Artificial Sequence
  Synthetic oligonucleotide; TAG chr11 5390437 5390456 5390453 +
aatttggagtattgagtata

SEQ ID NO: 27839 - DNA, 20 bp, Artificial Sequence
  Synthetic oligonucleotide; AAG chr11 5390450 5390469 5390466 +
gagtatatagcatgctctta

SEQ ID NO: 27840 - DNA, 20 bp, Artificial Sequence
  Synthetic oligonucleotide; TGG chr11 5390481 5390500 5390497 +
cccctgtcctaaataaaata

SEQ ID NO: 27841 - DNA, 20 bp, Artificial Sequence
  Synthetic oligonucleotide; GGG chr11 5390482 5390501 5390498 +
ccctgtcctaaataaaatat

SEQ ID NO: 27842 - DNA, 20 bp, Artificial Sequence
  Synthetic oligonucleotide; TGG chr11 5390497 5390516 5390513 +
aatatgggcaaatttatgtc

SEQ ID NO: 27843 - DNA, 20 bp, Artificial Sequence
  Synthetic oligonucleotide; GAG chr11 5390499 5390518 5390515 +
tatgggcaaatttatgtctg

SEQ ID NO: 27844 - DNA, 20 bp, Artificial Sequence
  Synthetic oligonucleotide; TGG chr11 5390505 5390524 5390521 +
caaatttatgtctggagttg

SEQ ID NO: 27845 - DNA, 20 bp, Artificial Sequence
  Synthetic oligonucleotide; TAG chr11 5390534 5390553 5390550 +
aaaactgaacttctcttgct

SEQ ID NO: 27846 - DNA, 20 bp, Artificial Sequence
  Synthetic oligonucleotide; TGG chr11 5390544 5390563 5390560 +
ttctcttgcttagattttaa

SEQ ID NO: 27847 - DNA, 20 bp, Artificial Sequence
  Synthetic oligonucleotide; CAG chr11 5390556 5390575 5390572 +
gattttaatggctcctccta

SEQ ID NO: 27848 - DNA, 20 bp, Artificial Sequence
  Synthetic oligonucleotide; GAG chr11 5390561 5390580 5390577 +
taatggctcctcctacagct

SEQ ID NO: 27849 - DNA, 20 bp, Artificial Sequence
  Synthetic oligonucleotide; TGG chr11 5390567 5390586 5390583 +
ctcctcctacagctgagaac

SEQ ID NO: 27850 - DNA, 20 bp, Artificial Sequence
  Synthetic oligonucleotide; TGG chr11 5390576 5390595 5390592 +
cagctgagaactggcatttt

SEQ ID NO: 27851 - DNA, 20 bp, Artificial Sequence
  Synthetic oligonucleotide; TAG chr11 5390579 5390598 5390595 +
ctgagaactggcatttttgg

SEQ ID NO: 27852 - DNA, 20 bp, Artificial Sequence
  Synthetic oligonucleotide; AAG chr11 5390587 5390606 5390603 +
tggcatttttggtagcatca

SEQ ID NO: 27853 - DNA, 20 bp, Artificial Sequence
  Synthetic oligonucleotide; CAG chr11 5390595 5390614 5390611 +
ttggtagcatcaaagctatc

SEQ ID NO: 27854 - DNA, 20 bp, Artificial Sequence
  Synthetic oligonucleotide; AAG chr11 5390598 5390617 5390614 +
gtagcatcaaagctatccag

SEQ ID NO: 27855 - DNA, 20 bp, Artificial Sequence
  Synthetic oligonucleotide; AGG chr11 5390599 5390618 5390615 +
tagcatcaaagctatccaga

SEQ ID NO: 27856 - DNA, 20 bp, Artificial Sequence
  Synthetic oligonucleotide; AAG chr11 5390613 5390632 5390629 +
tccagaaggcaactttattg

SEQ ID NO: 27857 - DNA, 20 bp, Artificial Sequence
  Synthetic oligonucleotide; AGG chr11 5390614 5390633 5390630 +
ccagaaggcaactttattga

SEQ ID NO: 27858 - DNA, 20 bp, Artificial Sequence
  Synthetic oligonucleotide; AAG chr11 5390665 5390684 5390681 +
gaaactaaataaaaactaaa

SEQ ID NO: 27859 - DNA, 20 bp, Artificial Sequence
  Synthetic oligonucleotide; CAG chr11 5390680 5390699 5390696 +
ctaaaaagaacaataaatac

SEQ ID NO: 27860 - DNA, 20 bp, Artificial Sequence
  Synthetic oligonucleotide; GAG chr11 5390682 5390701 5390698 +
aaaaagaacaataaatacca

SEQ ID NO: 27861 - DNA, 20 bp, Artificial Sequence
  Synthetic oligonucleotide; CAG chr11 5390689 5390708 5390705 +
acaataaataccagagcacc

SEQ ID NO: 27862 - DNA, 20 bp, Artificial Sequence
  Synthetic oligonucleotide; GAG chr11 5390691 5390710 5390707 +
aataaataccagagcaccca

SEQ ID NO: 27863 - DNA, 20 bp, Artificial Sequence
  Synthetic oligonucleotide; AGG chr11 5390692 5390711 5390708 +
ataaataccagagcacccag

SEQ ID NO: 27864 - DNA, 20 bp, Artificial Sequence
  Synthetic oligonucleotide; GAG chr11 5390694 5390713 5390710 +
aaataccagagcacccagag

SEQ ID NO: 27865 - DNA, 20 bp, Artificial Sequence
  Synthetic oligonucleotide; GAG chr11 5390696 5390715 5390712 +
ataccagagcacccagagga

SEQ ID NO: 27866 - DNA, 20 bp, Artificial Sequence
  Synthetic oligonucleotide; TGG chr11 5390701 5390720 5390717 +
agagcacccagaggagagcc

SEQ ID NO: 27867 - DNA, 20 bp, Artificial Sequence
  Synthetic oligonucleotide; CAG chr11 5390704 5390723 5390720 +
gcacccagaggagagcctgg

SEQ ID NO: 27868 - DNA, 20 bp, Artificial Sequence
  Synthetic oligonucleotide; GAG chr11 5390706 5390725 5390722 +
acccagaggagagcctggca

SEQ ID NO: 27869 - DNA, 20 bp, Artificial Sequence
  Synthetic oligonucleotide; CAG chr11 5390711 5390730 5390727 +
gaggagagcctggcagagac

SEQ ID NO: 27870 - DNA, 20 bp, Artificial Sequence
  Synthetic oligonucleotide; AGG chr11 5390712 5390731 5390728 +
aggagagcctggcagagacc

SEQ ID NO: 27871 - DNA, 20 bp, Artificial Sequence
  Synthetic oligonucleotide; CGG chr11 5390742 5390761 5390758 +
catttgctctaactcacctc

SEQ ID NO: 27872 - DNA, 20 bp, Artificial Sequence
  Synthetic oligonucleotide; TGG chr11 5390762 5390781 5390778 +
cggaaatacacctccttcca

SEQ ID NO: 27873 - DNA, 20 bp, Artificial Sequence
  Synthetic oligonucleotide; TGG chr11 5390770 5390789 5390786 +
cacctccttccatggttcct

SEQ ID NO: 27874 - DNA, 20 bp, Artificial Sequence
  Synthetic oligonucleotide; GGG chr11 5390771 5390790 5390787 +
acctccttccatggttcctt

SEQ ID NO: 27875 - DNA, 20 bp, Artificial Sequence
  Synthetic oligonucleotide; TGG chr11 5390795 5390814 5390811 +
ctgcttccatcttatctacc

SEQ ID NO: 27876 - DNA, 20 bp, Artificial Sequence
  Synthetic oligonucleotide; AAG chr11 5390800 5390819 5390816 +
tccatcttatctacctggcc

SEQ ID NO: 27877 - DNA, 20 bp, Artificial Sequence
  Synthetic oligonucleotide; TGG chr11 5390826 5390845 5390842 +
cttctcatctttttctatcc

SEQ ID NO: 27878 - DNA, 20 bp, Artificial Sequence
  Synthetic oligonucleotide; CAG chr11 5390830 5390849 5390846 +
tcatctttttctatcctggt

SEQ ID NO: 27879 - DNA, 20 bp, Artificial Sequence
  Synthetic oligonucleotide; CAG chr11 5390833 5390852 5390849 +
tctttttctatcctggtcag

SEQ ID NO: 27880 - DNA, 20 bp, Artificial Sequence
  Synthetic oligonucleotide; CAG chr11 5390843 5390862 5390859 +
tcctggtcagcagtaacttt

SEQ ID NO: 27881 - DNA, 20 bp, Artificial Sequence
  Synthetic oligonucleotide; AAG chr11 5390852 5390871 5390868 +
gcagtaactttcagaccccc

SEQ ID NO: 27882 - DNA, 20 bp, Artificial Sequence
  Synthetic oligonucleotide; CAG chr11 5390861 5390880 5390877 +
ttcagacccccaagtcacat

SEQ ID NO: 27883 - DNA, 20 bp, Artificial Sequence
  Synthetic oligonucleotide; CAG chr11 5390870 5390889 5390886 +
ccaagtcacatcagaaacct

SEQ ID NO: 27884 - DNA, 20 bp, Artificial Sequence
  Synthetic oligonucleotide; AAG chr11 5390904 5390923 5390920 +
tcttcctcaacacctgtttc

SEQ ID NO: 27885 - DNA, 20 bp, Artificial Sequence
  Synthetic oligonucleotide; AAG chr11 5390927 5390946 5390943 +
caacacccccccaaatttct

SEQ ID NO: 27886 - DNA, 20 bp, Artificial Sequence
  Synthetic oligonucleotide; AGG chr11 5390928 5390947 5390944 +
aacacccccccaaatttcta

SEQ ID NO: 27887 - DNA, 20 bp, Artificial Sequence
  Synthetic oligonucleotide; TAG chr11 5390958 5390977 5390974 +
ctctcctgaccatattcctc

SEQ ID NO: 27888 - DNA, 20 bp, Artificial Sequence
  Synthetic oligonucleotide; AAG chr11 5390961 5390980 5390977 +
tcctgaccatattcctctag

SEQ ID NO: 27889 - DNA, 20 bp, Artificial Sequence
  Synthetic oligonucleotide; AAG chr11 5390964 5390983 5390980 +
tgaccatattcctctagaag

SEQ ID NO: 27890 - DNA, 20 bp, Artificial Sequence
  Synthetic oligonucleotide; GAG chr11 5390966 5390985 5390982 +
accatattcctctagaagaa

SEQ ID NO: 27891 - DNA, 20 bp, Artificial Sequence
  Synthetic oligonucleotide; AAG chr11 5391021 5391040 5391037 +
tgattttaccttacaacctc

SEQ ID NO: 27892 - DNA, 20 bp, Artificial Sequence
  Synthetic oligonucleotide; AAG chr11 5391033 5391052 5391049 +
acaacctcaagtctgacatt

SEQ ID NO: 27893 - DNA, 20 bp, Artificial Sequence
  Synthetic oligonucleotide; CAG chr11 5391039 5391058 5391055 +
tcaagtctgacattaagcta

SEQ ID NO: 27894 - DNA, 20 bp, Artificial Sequence
  Synthetic oligonucleotide; CAG chr11 5391043 5391062 5391059 +
gtctgacattaagctacagt

SEQ ID NO: 27895 - DNA, 20 bp, Artificial Sequence
  Synthetic oligonucleotide; TAG chr11 5391056 5391075 5391072 +
ctacagtcagtatttacttg

SEQ ID NO: 27896 - DNA, 20 bp, Artificial Sequence
  Synthetic oligonucleotide; AGG chr11 5391057 5391076 5391073 +
tacagtcagtatttacttgt

SEQ ID NO: 27897 - DNA, 20 bp, Artificial Sequence
  Synthetic oligonucleotide; TAG chr11 5391065 5391084 5391081 +
gtatttacttgtaggtgttt

SEQ ID NO: 27898 - DNA, 20 bp, Artificial Sequence
  Synthetic oligonucleotide; GAG chr11 5391099 5391118 5391115 +
tgaacaatgacatgtaacgt

SEQ ID NO: 27899 - DNA, 20 bp, Artificial Sequence
  Synthetic oligonucleotide; AAG chr11 5391103 5391122 5391119 +
caatgacatgtaacgtgaga

SEQ ID NO: 27900 - DNA, 20 bp, Artificial Sequence
  Synthetic oligonucleotide; CAG chr11 5391109 5391128 5391125 +
catgtaacgtgagaaagctt

SEQ ID NO: 27901 - DNA, 20 bp, Artificial Sequence
  Synthetic oligonucleotide; AAG chr11 5391114 5391133 5391130 +
aacgtgagaaagcttcagcc

SEQ ID NO: 27902 - DNA, 20 bp, Artificial Sequence
  Synthetic oligonucleotide; AGG chr11 5391115 5391134 5391131 +
acgtgagaaagcttcagcca

SEQ ID NO: 27903 - DNA, 20 bp, Artificial Sequence
  Synthetic oligonucleotide; AAG chr11 5391138 5391157 5391154 +
aaactcacacaaacatattg

SEQ ID NO: 27904 - DNA, 20 bp, Artificial Sequence
  Synthetic oligonucleotide; CAG chr11 5391157 5391176 5391173 +
gaagtcacaatcccattgct

SEQ ID NO: 27905 - DNA, 20 bp, Artificial Sequence
  Synthetic oligonucleotide; AGG chr11 5391158 5391177 5391174 +
aagtcacaatcccattgctc

SEQ ID NO: 27906 - DNA, 20 bp, Artificial Sequence
  Synthetic oligonucleotide; GAG chr11 5391160 5391179 5391176 +
gtcacaatcccattgctcag

SEQ ID NO: 27907 - DNA, 20 bp, Artificial Sequence
  Synthetic oligonucleotide; AGG chr11 5391161 5391180 5391177 +
tcacaatcccattgctcagg

SEQ ID NO: 27908 - DNA, 20 bp, Artificial Sequence
  Synthetic oligonucleotide; TGG chr11 5391179 5391198 5391195 +
ggaggaaataaactttacat

SEQ ID NO: 27909 - DNA, 20 bp, Artificial Sequence
  Synthetic oligonucleotide; CAG chr11 5391187 5391206 5391203 +
taaactttacattggctgat

SEQ ID NO: 27910 - DNA, 20 bp, Artificial Sequence
  Synthetic oligonucleotide; GAG chr11 5391201 5391220 5391217 +
gctgatcagcctgtccctac

SEQ ID NO: 27911 - DNA, 20 bp, Artificial Sequence
  Synthetic oligonucleotide; CAG chr11 5391223 5391242 5391239 +
gtgactaaatgcaatccttg

SEQ ID NO: 27912 - DNA, 20 bp, Artificial Sequence
  Synthetic oligonucleotide; AGG chr11 5391224 5391243 5391240 +
tgactaaatgcaatccttgc

SEQ ID NO: 27913 - DNA, 20 bp, Artificial Sequence
  Synthetic oligonucleotide; GGG chr11 5391225 5391244 5391241 +
gactaaatgcaatccttgca

SEQ ID NO: 27914 - DNA, 20 bp, Artificial Sequence
  Synthetic oligonucleotide; GGG chr11 5391226 5391245 5391242 +
actaaatgcaatccttgcag

SEQ ID NO: 27915 - DNA, 20 bp, Artificial Sequence
  Synthetic oligonucleotide; CAG chr11 5391232 5391251 5391248 +
tgcaatccttgcaggggtct

SEQ ID NO: 27916 - DNA, 20 bp, Artificial Sequence
  Synthetic oligonucleotide; AAG chr11 5391253 5391272 5391269 +
agctttgaaattgcttcctc

SEQ ID NO: 27917 - DNA, 20 bp, Artificial Sequence
  Synthetic oligonucleotide; AGG chr11 5391254 5391273 5391270 +
gctttgaaattgcttcctca

SEQ ID NO: 27918 - DNA, 20 bp, Artificial Sequence
  Synthetic oligonucleotide; CAG chr11 5391266 5391285 5391282 +
cttcctcaaggacattttca

SEQ ID NO: 27919 - DNA, 20 bp, Artificial Sequence
  Synthetic oligonucleotide; TAG chr11 5391270 5391289 5391286 +
ctcaaggacattttcacaga

SEQ ID NO: 27920 - DNA, 20 bp, Artificial Sequence
  Synthetic oligonucleotide; TGG chr11 5391288 5391307 5391304 +
gatagctcctccctttccaa

SEQ ID NO: 27921 - DNA, 20 bp, Artificial Sequence
  Synthetic oligonucleotide; AAG chr11 5391293 5391312 5391309 +
ctcctccctttccaatggta

SEQ ID NO: 27922 - DNA, 20 bp, Artificial Sequence
  Synthetic oligonucleotide; CGG chr11 5391311 5391330 5391327 +
taaagcaccaaatgctccat

SEQ ID NO: 27923 - DNA, 20 bp, Artificial Sequence
  Synthetic oligonucleotide; CAG chr11 5391324 5391343 5391340 +
gctccatcggtttccttcca

SEQ ID NO: 27924 - DNA, 20 bp, Artificial Sequence
  Synthetic oligonucleotide; CAG chr11 5391360 5391379 5391376 +
ccgttgtaacatttgtcaca

SEQ ID NO: 27925 - DNA, 20 bp, Artificial Sequence
  Synthetic oligonucleotide; AAG chr11 5391379 5391398 5391395 +
acagtaatgtcctgtttatg

SEQ ID NO: 27926 - DNA, 20 bp, Artificial Sequence
  Synthetic oligonucleotide; AGG chr11 5391380 5391399 5391396 +
cagtaatgtcctgtttatga

SEQ ID NO: 27927 - DNA, 20 bp, Artificial Sequence
  Synthetic oligonucleotide; TAG chr11 5391400 5391419 5391416 +
aggtgtgtgcatgtgtccat

SEQ ID NO: 27928 - DNA, 20 bp, Artificial Sequence
  Synthetic oligonucleotide; AAG chr11 5391415 5391434 5391431 +
tccattagaatgactaaatc

SEQ ID NO: 27929 - DNA, 20 bp, Artificial Sequence
  Synthetic oligonucleotide; TGG chr11 5391423 5391442 5391439 +
aatgactaaatcaagatccc

SEQ ID NO: 27930 - DNA, 20 bp, Artificial Sequence
  Synthetic oligonucleotide; GAG chr11 5391425 5391444 5391441 +
tgactaaatcaagatccctg

SEQ ID NO: 27931 - DNA, 20 bp, Artificial Sequence
  Synthetic oligonucleotide; AGG chr11 5391426 5391445 5391442 +
gactaaatcaagatccctgg

SEQ ID NO: 27932 - DNA, 20 bp, Artificial Sequence
  Synthetic oligonucleotide; TAG chr11 5391432 5391451 5391448 +
atcaagatccctggaggaat

SEQ ID NO: 27933 - DNA, 20 bp, Artificial Sequence
  Synthetic oligonucleotide; AGG chr11 5391433 5391452 5391449 +
tcaagatccctggaggaatt

SEQ ID NO: 27934 - DNA, 20 bp, Artificial Sequence
  Synthetic oligonucleotide; CAG chr11 5391450 5391469 5391466 +
attaggcatgtcttgctcgc

SEQ ID NO: 27935 - DNA, 20 bp, Artificial Sequence
  Synthetic oligonucleotide; TAG chr11 5391476 5391495 5391492 +
atgtatataaatacaatgcc

SEQ ID NO: 27936 - DNA, 20 bp, Artificial Sequence
  Synthetic oligonucleotide; TGG chr11 5391516 5391535 5391532 +
ataaatattaaatgtatgcg

SEQ ID NO: 27937 - DNA, 20 bp, Artificial Sequence
  Synthetic oligonucleotide; TAG chr11 5391524 5391543 5391540 +
taaatgtatgcgtggacata

SEQ ID NO: 27938 - DNA, 20 bp, Artificial Sequence
  Synthetic oligonucleotide; AAG chr11 5391534 5391553 5391550 +
cgtggacatatagatacata

SEQ ID NO: 27939 - DNA, 20 bp, Artificial Sequence
  Synthetic oligonucleotide; GAG chr11 5391536 5391555 5391552 +
tggacatatagatacataaa

SEQ ID NO: 27940 - DNA, 20 bp, Artificial Sequence
  Synthetic oligonucleotide; AGG chr11 5391537 5391556 5391553 +
ggacatatagatacataaag

SEQ ID NO: 27941 - DNA, 20 bp, Artificial Sequence
  Synthetic oligonucleotide; GGG chr11 5391538 5391557 5391554 +
gacatatagatacataaaga

SEQ ID NO: 27942 - DNA, 20 bp, Artificial Sequence
  Synthetic oligonucleotide; CAG chr11 5391544 5391563 5391560 +
tagatacataaagagggatc

SEQ ID NO: 27943 - DNA, 20 bp, Artificial Sequence
  Synthetic oligonucleotide; GAG chr11 5391546 5391565 5391562 +
gatacataaagagggatcca

SEQ ID NO: 27944 - DNA, 20 bp, Artificial Sequence
  Synthetic oligonucleotide; CAG chr11 5391553 5391572 5391569 +
aaagagggatccagagctaa

SEQ ID NO: 27945 - DNA, 20 bp, Artificial Sequence
  Synthetic oligonucleotide; AAG chr11 5391556 5391575 5391572 +
gagggatccagagctaacag

SEQ ID NO: 27946 - DNA, 20 bp, Artificial Sequence
  Synthetic oligonucleotide; GAG chr11 5391574 5391593 5391590 +
agaagttctcttcttgtctc

SEQ ID NO: 27947 - DNA, 20 bp, Artificial Sequence
  Synthetic oligonucleotide; AGG chr11 5391575 5391594 5391591 +
gaagttctcttcttgtctcg

SEQ ID NO: 27948 - DNA, 20 bp, Artificial Sequence
  Synthetic oligonucleotide; CAG chr11 5391597 5391616 5391613 +
gaactcctcctcttcacatt

SEQ ID NO: 27949 - DNA, 20 bp, Artificial Sequence
  Synthetic oligonucleotide; AAG chr11 5391600 5391619 5391616 +
ctcctcctcttcacattcag

SEQ ID NO: 27950 - DNA, 20 bp, Artificial Sequence
  Synthetic oligonucleotide; AAG chr11 5391606 5391625 5391622 +
ctcttcacattcagaagccc

SEQ ID NO: 27951 - DNA, 20 bp, Artificial Sequence
  Synthetic oligonucleotide; AAG chr11 5391609 5391628 5391625 +
ttcacattcagaagcccaag

SEQ ID NO: 27952 - DNA, 20 bp, Artificial Sequence
  Synthetic oligonucleotide; TGG chr11 5391624 5391643 5391640 +
ccaagaagacacctttctgc

SEQ ID NO: 27953 - DNA, 20 bp, Artificial Sequence
  Synthetic oligonucleotide; AAG chr11 5391635 5391654 5391651 +
cctttctgctggcatccatc

SEQ ID NO: 27954 - DNA, 20 bp, Artificial Sequence
  Synthetic oligonucleotide; AGG chr11 5391636 5391655 5391652 +
ctttctgctggcatccatca

SEQ ID NO: 27955 - DNA, 20 bp, Artificial Sequence
  Synthetic oligonucleotide; TGG chr11 5391639 5391658 5391655 +
tctgctggcatccatcaagg

SEQ ID NO: 27956 - DNA, 20 bp, Artificial Sequence
  Synthetic oligonucleotide; CAG chr11 5391658 5391677 5391674 +
gtggtatatcttcattgtcc

SEQ ID NO: 27957 - DNA, 20 bp, Artificial Sequence
  Synthetic oligonucleotide; CAG chr11 5391673 5391692 5391689 +
tgtcccagttctactttact

SEQ ID NO: 27958 - DNA, 20 bp, Artificial Sequence
  Synthetic oligonucleotide; AGG chr11 5391674 5391693 5391690 +
gtcccagttctactttactc

SEQ ID NO: 27959 - DNA, 20 bp, Artificial Sequence
  Synthetic oligonucleotide; TGG chr11 5391682 5391701 5391698 +
tctactttactcaggccctc

SEQ ID NO: 27960 - DNA, 20 bp, Artificial Sequence
  Synthetic oligonucleotide; CAG chr11 5391706 5391725 5391722 +
tcctcccacccattctccta

SEQ ID NO: 27961 - DNA, 20 bp, Artificial Sequence
  Synthetic oligonucleotide; AGG chr11 5391707 5391726 5391723 +
cctcccacccattctcctac

SEQ ID NO: 27962 - DNA, 20 bp, Artificial Sequence
  Synthetic oligonucleotide; GAG chr11 5391723 5391742 5391739 +
ctacaggttaaaattaccat

SEQ ID NO: 27963 - DNA, 20 bp, Artificial Sequence
  Synthetic oligonucleotide; AGG chr11 5391724 5391743 5391740 +
tacaggttaaaattaccatg

SEQ ID NO: 27964 - DNA, 20 bp, Artificial Sequence
  Synthetic oligonucleotide; CAG chr11 5391728 5391747 5391744 +
ggttaaaattaccatgaggc

SEQ ID NO: 27965 - DNA, 20 bp, Artificial Sequence
  Synthetic oligonucleotide; AGG chr11 5391729 5391748 5391745 +
gttaaaattaccatgaggcc

SEQ ID NO: 27966 - DNA, 20 bp, Artificial Sequence
  Synthetic oligonucleotide; CGG chr11 5391734 5391753 5391750 +
aattaccatgaggccaggca

SEQ ID NO: 27967 - DNA, 20 bp, Artificial Sequence
  Synthetic oligonucleotide; TGG chr11 5391737 5391756 5391753 +
taccatgaggccaggcacgg

SEQ ID NO: 27968 - DNA, 20 bp, Artificial Sequence
  Synthetic oligonucleotide; CAG chr11 5391755 5391774 5391771 +
ggtggcttatgctataatcc

SEQ ID NO: 27969 - DNA, 20 bp, Artificial Sequence
  Synthetic oligonucleotide; TGG chr11 5391763 5391782 5391779 +
atgctataatcccagcactt

SEQ ID NO: 27970 - DNA, 20 bp, Artificial Sequence
  Synthetic oligonucleotide; GGG chr11 5391764 5391783 5391780 +
tgctataatcccagcacttt

SEQ ID NO: 27971 - DNA, 20 bp, Artificial Sequence
  Synthetic oligonucleotide; GAG chr11 5391766 5391785 5391782 +
ctataatcccagcactttgg

SEQ ID NO: 27972 - DNA, 20 bp, Artificial Sequence
  Synthetic oligonucleotide; AAG chr11 5391772 5391791 5391788 +
tcccagcactttgggagacc

SEQ ID NO: 27973 - DNA, 20 bp, Artificial Sequence
  Synthetic oligonucleotide; AGG chr11 5391773 5391792 5391789 +
cccagcactttgggagacca

SEQ ID NO: 27974 - DNA, 20 bp, Artificial Sequence
  Synthetic oligonucleotide; TGG chr11 5391776 5391795 5391792 +
agcactttgggagaccaagg

SEQ ID NO: 27975 - DNA, 20 bp, Artificial Sequence
  Synthetic oligonucleotide; GGG chr11 5391777 5391796 5391793 +
gcactttgggagaccaaggt

SEQ ID NO: 27976 - DNA, 20 bp, Artificial Sequence
  Synthetic oligonucleotide; GAG chr11 5391779 5391798 5391795 +
actttgggagaccaaggtgg

SEQ ID NO: 27977 - DNA, 20 bp, Artificial Sequence
  Synthetic oligonucleotide; AGG chr11 5391780 5391799 5391796 +
ctttgggagaccaaggtggg

SEQ ID NO: 27978 - DNA, 20 bp, Artificial Sequence
  Synthetic oligonucleotide; AAG chr11 5391790 5391809 5391806 +
ccaaggtgggaggattgctg

SEQ ID NO: 27979 - DNA, 20 bp, Artificial Sequence
  Synthetic oligonucleotide; AGG chr11 5391791 5391810 5391807 +
caaggtgggaggattgctga

SEQ ID NO: 27980 - DNA, 20 bp, Artificial Sequence
  Synthetic oligonucleotide; CAG chr11 5391795 5391814 5391811 +
gtgggaggattgctgaaggc

SEQ ID NO: 27981 - DNA, 20 bp, Artificial Sequence
  Synthetic oligonucleotide; AGG chr11 5391796 5391815 5391812 +
tgggaggattgctgaaggcc

SEQ ID NO: 27982 - DNA, 20 bp, Artificial Sequence
  Synthetic oligonucleotide; GAG chr11 5391798 5391817 5391814 +
ggaggattgctgaaggccag

SEQ ID NO: 27983 - DNA, 20 bp, Artificial Sequence
  Synthetic oligonucleotide; GAG chr11 5391804 5391823 5391820 +
ttgctgaaggccaggagttt

SEQ ID NO: 27984 - DNA, 20 bp, Artificial Sequence
  Synthetic oligonucleotide; CAG chr11 5391815 5391834 5391831 +
caggagtttgagaccaactt

SEQ ID NO: 27985 - DNA, 20 bp, Artificial Sequence
  Synthetic oligonucleotide; AGG chr11 5391816 5391835 5391832 +
aggagtttgagaccaacttc

SEQ ID NO: 27986 - DNA, 20 bp, Artificial Sequence
  Synthetic oligonucleotide; AAG chr11 5391820 5391839 5391836 +
gtttgagaccaacttcaggc

SEQ ID NO: 27987 - DNA, 20 bp, Artificial Sequence
  Synthetic oligonucleotide; AAG chr11 5391823 5391842 5391839 +
tgagaccaacttcaggcaag

SEQ ID NO: 27988 - DNA, 20 bp, Artificial Sequence
  Synthetic oligonucleotide; GAG chr11 5391833 5391852 5391849 +
ttcaggcaagaagattactt

SEQ ID NO: 27989 - DNA, 20 bp, Artificial Sequence
  Synthetic oligonucleotide; CAG chr11 5391838 5391857 5391854 +
gcaagaagattacttgagtc

SEQ ID NO: 27990 - DNA, 20 bp, Artificial Sequence
  Synthetic oligonucleotide; AGG chr11 5391839 5391858 5391855 +
caagaagattacttgagtcc

SEQ ID NO: 27991 - DNA, 20 bp, Artificial Sequence
  Synthetic oligonucleotide; GAG chr11 5391841 5391860 5391857 +
agaagattacttgagtccag

SEQ ID NO: 27992 - DNA, 20 bp, Artificial Sequence
  Synthetic oligonucleotide; GAG chr11 5391847 5391866 5391863 +
ttacttgagtccaggagttt

SEQ ID NO: 27993 - DNA, 20 bp, Artificial Sequence
  Synthetic oligonucleotide; CAG chr11 5391852 5391871 5391868 +
tgagtccaggagtttgagac

SEQ ID NO: 27994 - DNA, 20 bp, Artificial Sequence
  Synthetic oligonucleotide; CAG chr11 5391866 5391885 5391882 +
tgagaccagcctgaacaata

SEQ ID NO: 27995 - DNA, 20 bp, Artificial Sequence
  Synthetic oligonucleotide; AAG chr11 5391870 5391889 5391886 +
accagcctgaacaatacagc

SEQ ID NO: 27996 - DNA, 20 bp, Artificial Sequence
  Synthetic oligonucleotide; TAG chr11 5391901 5391920 5391917 +
tctacaaaaaaaattaaaat

SEQ ID NO: 27997 - DNA, 20 bp, Artificial Sequence
  Synthetic oligonucleotide; TGG chr11 5391911 5391930 5391927 +
aaattaaaattagccatgtg

SEQ ID NO: 27998 - DNA, 20 bp, Artificial Sequence
  Synthetic oligonucleotide; CGG chr11 5391914 5391933 5391930 +
ttaaaattagccatgtgtgg

SEQ ID NO: 27999 - DNA, 20 bp, Artificial Sequence
  Synthetic oligonucleotide; TAG chr11 5391927 5391946 5391943 +
tgtgtggcggtgcacgtctg

SEQ ID NO: 28000 - DNA, 20 bp, Artificial Sequence
  Synthetic oligonucleotide; CAG chr11 5391933 5391952 5391949 +
gcggtgcacgtctgtagtct

SEQ ID NO: 28001 - DNA, 20 bp, Artificial Sequence
  Synthetic oligonucleotide; TGG chr11 5391941 5391960 5391957 +
cgtctgtagtctcagctacc

SEQ ID NO: 28002 - DNA, 20 bp, Artificial Sequence
  Synthetic oligonucleotide; GGG chr11 5391942 5391961 5391958 +
gtctgtagtctcagctacct

SEQ ID NO: 28003 - DNA, 20 bp, Artificial Sequence
  Synthetic oligonucleotide; GAG chr11 5391944 5391963 5391960 +
ctgtagtctcagctacctgg

SEQ ID NO: 28004 - DNA, 20 bp, Artificial Sequence
  Synthetic oligonucleotide; AGG chr11 5391945 5391964 5391961 +
tgtagtctcagctacctggg

SEQ ID NO: 28005 - DNA, 20 bp, Artificial Sequence
  Synthetic oligonucleotide; GAG chr11 5391950 5391969 5391966 +
tctcagctacctgggaggct

SEQ ID NO: 28006 - DNA, 20 bp, Artificial Sequence
  Synthetic oligonucleotide; AGG chr11 5391951 5391970 5391967 +
ctcagctacctgggaggctg

SEQ ID NO: 28007 - DNA, 20 bp, Artificial Sequence
  Synthetic oligonucleotide; TGG chr11 5391954 5391973 5391970 +
agctacctgggaggctgagg

SEQ ID NO: 28008 - DNA, 20 bp, Artificial Sequence
  Synthetic oligonucleotide; GGG chr11 5391955 5391974 5391971 +
gctacctgggaggctgaggt

SEQ ID NO: 28009 - DNA, 20 bp, Artificial Sequence
  Synthetic oligonucleotide; AAG chr11 5391958 5391977 5391974 +
acctgggaggctgaggtggg

SEQ ID NO: 28010 - DNA, 20 bp, Artificial Sequence
  Synthetic oligonucleotide; GAG chr11 5391968 5391987 5391984 +
ctgaggtgggaagaatgctt

SEQ ID NO: 28011 - DNA, 20 bp, Artificial Sequence
  Synthetic oligonucleotide; CAG chr11 5391973 5391992 5391989 +
gtgggaagaatgcttgagcc

SEQ ID NO: 28012 - DNA, 20 bp, Artificial Sequence
  Synthetic oligonucleotide; AGG chr11 5391974 5391993 5391990 +
tgggaagaatgcttgagccc

SEQ ID NO: 28013 - DNA, 20 bp, Artificial Sequence
  Synthetic oligonucleotide; GAG chr11 5391976 5391995 5391992 +
ggaagaatgcttgagcccag

SEQ ID NO: 28014 - DNA, 20 bp, Artificial Sequence
  Synthetic oligonucleotide; AGG chr11 5391977 5391996 5391993 +
gaagaatgcttgagcccagg

SEQ ID NO: 28015 - DNA, 20 bp, Artificial Sequence
  Synthetic oligonucleotide; GAG chr11 5391982 5392001 5391998 +
atgcttgagcccaggaggtt

SEQ ID NO: 28016 - DNA, 20 bp, Artificial Sequence
  Synthetic oligonucleotide; AGG chr11 5391983 5392002 5391999 +
tgcttgagcccaggaggttg

SEQ ID NO: 28017 - DNA, 20 bp, Artificial Sequence
  Synthetic oligonucleotide; CAG chr11 5391989 5392008 5392005 +
agcccaggaggttgaggctg

SEQ ID NO: 28018 - DNA, 20 bp, Artificial Sequence
  Synthetic oligonucleotide; GAG chr11 5391993 5392012 5392009 +
caggaggttgaggctgcagt

SEQ ID NO: 28019 - DNA, 20 bp, Artificial Sequence
  Synthetic oligonucleotide; TGG chr11 5392015 5392034 5392031 +
gccataatcacactactgcc

SEQ ID NO: 28020 - DNA, 20 bp, Artificial Sequence
  Synthetic oligonucleotide; GGG chr11 5392016 5392035 5392032 +
ccataatcacactactgcct

SEQ ID NO: 28021 - DNA, 20 bp, Artificial Sequence
  Synthetic oligonucleotide; AAG chr11 5392024 5392043 5392040 +
acactactgcctgggtgacc

SEQ ID NO: 28022 - DNA, 20 bp, Artificial Sequence
  Synthetic oligonucleotide; GAG chr11 5392028 5392047 5392044 +
tactgcctgggtgaccaagt

SEQ ID NO: 28023 - DNA, 20 bp, Artificial Sequence
  Synthetic oligonucleotide; AAG chr11 5392050 5392069 5392066 +
gaccccgattcaaaaataaa

SEQ ID NO: 28024 - DNA, 20 bp, Artificial Sequence
  Synthetic oligonucleotide; AGG chr11 5392051 5392070 5392067 +
accccgattcaaaaataaaa

SEQ ID NO: 28025 - DNA, 20 bp, Artificial Sequence
  Synthetic oligonucleotide; AAG chr11 5392072 5392091 5392088 +
ggaaaacaaacaaaattaca

SEQ ID NO: 28026 - DNA, 20 bp, Artificial Sequence
  Synthetic oligonucleotide; AAG chr11 5392087 5392106 5392103 +
ttacaaagcgaaatttaaaa

SEQ ID NO: 28027 - DNA, 20 bp, Artificial Sequence
  Synthetic oligonucleotide; CGG chr11 5392124 5392143 5392140 +
aatatgtatgtatgtttgtg

SEQ ID NO: 28028 - DNA, 20 bp, Artificial Sequence
  Synthetic oligonucleotide; TGG chr11 5392146 5392165 5392162 +
gtttcttgtgtatgtttgtg

SEQ ID NO: 28029 - DNA, 20 bp, Artificial Sequence
  Synthetic oligonucleotide; TGG chr11 5392168 5392187 5392184 +
gtatctcatgtttgtatgtg

SEQ ID NO: 28030 - DNA, 20 bp, Artificial Sequence
  Synthetic oligonucleotide; GGG chr11 5392169 5392188 5392185 +
tatctcatgtttgtatgtgt

SEQ ID NO: 28031 - DNA, 20 bp, Artificial Sequence
  Synthetic oligonucleotide; CAG chr11 5392178 5392197 5392194 +
tttgtatgtgtgggtgttat

SEQ ID NO: 28032 - DNA, 20 bp, Artificial Sequence
  Synthetic oligonucleotide; CAG chr11 5392186 5392205 5392202 +
tgtgggtgttatcagactct

SEQ ID NO: 28033 - DNA, 20 bp, Artificial Sequence
  Synthetic oligonucleotide; AGG chr11 5392187 5392206 5392203 +
gtgggtgttatcagactctc

SEQ ID NO: 28034 - DNA, 20 bp, Artificial Sequence
  Synthetic oligonucleotide; TGG chr11 5392192 5392211 5392208 +
tgttatcagactctcaggct

SEQ ID NO: 28035 - DNA, 20 bp, Artificial Sequence
  Synthetic oligonucleotide; GGG chr11 5392193 5392212 5392209 +
gttatcagactctcaggctt

SEQ ID NO: 28036 - DNA, 20 bp, Artificial Sequence
  Synthetic oligonucleotide; GAG chr11 5392195 5392214 5392211 +
tatcagactctcaggcttgg

SEQ ID NO: 28037 - DNA, 20 bp, Artificial Sequence
  Synthetic oligonucleotide; TGG chr11 5392204 5392223 5392220 +
ctcaggcttgggagcccctc

SEQ ID NO: 28038 - DNA, 20 bp, Artificial Sequence
  Synthetic oligonucleotide; CAG chr11 5392211 5392230 5392227 +
ttgggagcccctctggaacc

SEQ ID NO: 28039 - DNA, 20 bp, Artificial Sequence
  Synthetic oligonucleotide; CAG chr11 5392214 5392233 5392230 +
ggagcccctctggaacccag

SEQ ID NO: 28040 - DNA, 20 bp, Artificial Sequence
  Synthetic oligonucleotide; CAG chr11 5392223 5392242 5392239 +
ctggaacccagcagtttctg

SEQ ID NO: 28041 - DNA, 20 bp, Artificial Sequence
  Synthetic oligonucleotide; CAG chr11 5392231 5392250 5392247 +
cagcagtttctgcagcctta

SEQ ID NO: 28042 - DNA, 20 bp, Artificial Sequence
  Synthetic oligonucleotide; AGG chr11 5392232 5392251 5392248 +
agcagtttctgcagccttac

SEQ ID NO: 28043 - DNA, 20 bp, Artificial Sequence
  Synthetic oligonucleotide; TGG chr11 5392236 5392255 5392252 +
gtttctgcagccttacaggc

SEQ ID NO: 28044 - DNA, 20 bp, Artificial Sequence
  Synthetic oligonucleotide; TAG chr11 5392252 5392271 5392268 +
aggctggcactccttaaaca

SEQ ID NO: 28045 - DNA, 20 bp, Artificial Sequence
  Synthetic oligonucleotide; AGG chr11 5392253 5392272 5392269 +
ggctggcactccttaaacat

SEQ ID NO: 28046 - DNA, 20 bp, Artificial Sequence
  Synthetic oligonucleotide; TAG chr11 5392286 5392305 5392302 +
aactttaatttacatccaca

SEQ ID NO: 28047 - DNA, 20 bp, Artificial Sequence
  Synthetic oligonucleotide; TAG chr11 5392289 5392308 5392305 +
tttaatttacatccacatag

SEQ ID NO: 28048 - DNA, 20 bp, Artificial Sequence
  Synthetic oligonucleotide; AGG chr11 5392290 5392309 5392306 +
ttaatttacatccacatagt

SEQ ID NO: 28049 - DNA, 20 bp, Artificial Sequence
  Synthetic oligonucleotide; TAG chr11 5392306 5392325 5392322 +
tagtaggccacattactcaa

SEQ ID NO: 28050 - DNA, 20 bp, Artificial Sequence
  Synthetic oligonucleotide; CAG chr11 5392309 5392328 5392325 +
taggccacattactcaatag

SEQ ID NO: 28051 - DNA, 20 bp, Artificial Sequence
  Synthetic oligonucleotide; GAG chr11 5392316 5392335 5392332 +
cattactcaatagcagttcc

SEQ ID NO: 28052 - DNA, 20 bp, Artificial Sequence
  Synthetic oligonucleotide; TAG chr11 5392322 5392341 5392338 +
tcaatagcagttccgagact

SEQ ID NO: 28053 - DNA, 20 bp, Artificial Sequence
  Synthetic oligonucleotide; GAG chr11 5392343 5392362 5392359 +
agaatattcttctccatgtt

SEQ ID NO: 28054 - DNA, 20 bp, Artificial Sequence
  Synthetic oligonucleotide; GAG chr11 5392345 5392364 5392361 +
aatattcttctccatgttga

SEQ ID NO: 28055 - DNA, 20 bp, Artificial Sequence
  Synthetic oligonucleotide; AGG chr11 5392346 5392365 5392362 +
atattcttctccatgttgag

SEQ ID NO: 28056 - DNA, 20 bp, Artificial Sequence
  Synthetic oligonucleotide; TAG chr11 5392363 5392382 5392379 +
gagaggaaattcctattcta

SEQ ID NO: 28057 - DNA, 20 bp, Artificial Sequence
  Synthetic oligonucleotide; TGG chr11 5392374 5392393 5392390 +
cctattctatagatctcatt

SEQ ID NO: 28058 - DNA, 20 bp, Artificial Sequence
  Synthetic oligonucleotide; TAG chr11 5392377 5392396 5392393 +
attctatagatctcatttgg

SEQ ID NO: 28059 - DNA, 20 bp, Artificial Sequence
  Synthetic oligonucleotide; TGG chr11 5392382 5392401 5392398 +
atagatctcatttggtagaa

SEQ ID NO: 28060 - DNA, 20 bp, Artificial Sequence
  Synthetic oligonucleotide; GGG chr11 5392383 5392402 5392399 +
tagatctcatttggtagaat

SEQ ID NO: 28061 - DNA, 20 bp, Artificial Sequence
  Synthetic oligonucleotide; GGG chr11 5392384 5392403 5392400 +
agatctcatttggtagaatg

SEQ ID NO: 28062 - DNA, 20 bp, Artificial Sequence
  Synthetic oligonucleotide; TAG chr11 5392398 5392417 5392414 +
agaatggggtacaaaaaatt

SEQ ID NO: 28063 - DNA, 20 bp, Artificial Sequence
  Synthetic oligonucleotide; AGG chr11 5392399 5392418 5392415 +
gaatggggtacaaaaaattt

SEQ ID NO: 28064 - DNA, 20 bp, Artificial Sequence
  Synthetic oligonucleotide; TGG chr11 5392405 5392424 5392421 +
ggtacaaaaaatttaggatt

SEQ ID NO: 28065 - DNA, 20 bp, Artificial Sequence
  Synthetic oligonucleotide; TAG chr11 5392411 5392430 5392427 +
aaaaatttaggatttggatt

SEQ ID NO: 28066 - DNA, 20 bp, Artificial Sequence
  Synthetic oligonucleotide; TAG chr11 5392416 5392435 5392432 +
tttaggatttggatttagat

SEQ ID NO: 28067 - DNA, 20 bp, Artificial Sequence
  Synthetic oligonucleotide; AAG chr11 5392424 5392443 5392440 +
ttggatttagattagcactg

SEQ ID NO: 28068 - DNA, 20 bp, Artificial Sequence
  Synthetic oligonucleotide; TAG chr11 5392452 5392471 5392468 +
ttttgcctcttattaacaaa

SEQ ID NO: 28069 - DNA, 20 bp, Artificial Sequence
  Synthetic oligonucleotide; TAG chr11 5392485 5392504 5392501 +
tctaaatttcattttcaaat

SEQ ID NO: 28070 - DNA, 20 bp, Artificial Sequence
  Synthetic oligonucleotide; AGG chr11 5392486 5392505 5392502 +
ctaaatttcattttcaaatt

SEQ ID NO: 28071 - DNA, 20 bp, Artificial Sequence
  Synthetic oligonucleotide; CAG chr11 5392498 5392517 5392514 +
ttcaaattaggaaatacgta

SEQ ID NO: 28072 - DNA, 20 bp, Artificial Sequence
  Synthetic oligonucleotide; AGG chr11 5392499 5392518 5392515 +
tcaaattaggaaatacgtac

SEQ ID NO: 28073 - DNA, 20 bp, Artificial Sequence
  Synthetic oligonucleotide; AAG chr11 5392585 5392604 5392601 +
ttgttactaaacgaatattg

SEQ ID NO: 28074 - DNA, 20 bp, Artificial Sequence
  Synthetic oligonucleotide; TAG chr11 5392590 5392609 5392606 +
actaaacgaatattgaagaa

SEQ ID NO: 28075 - DNA, 20 bp, Artificial Sequence
  Synthetic oligonucleotide; GAG chr11 5392592 5392611 5392608 +
taaacgaatattgaagaata

SEQ ID NO: 28076 - DNA, 20 bp, Artificial Sequence
  Synthetic oligonucleotide; TGG chr11 5392610 5392629 5392626 +
tagagttaacaatcaatatc

SEQ ID NO: 28077 - DNA, 20 bp, Artificial Sequence
  Synthetic oligonucleotide; TGG chr11 5392614 5392633 5392630 +
gttaacaatcaatatctggc

SEQ ID NO: 28078 - DNA, 20 bp, Artificial Sequence
  Synthetic oligonucleotide; GGG chr11 5392615 5392634 5392631 +
ttaacaatcaatatctggct

SEQ ID NO: 28079 - DNA, 20 bp, Artificial Sequence
  Synthetic oligonucleotide; CGG chr11 5392620 5392639 5392636 +
aatcaatatctggctgggcg

SEQ ID NO: 28080 - DNA, 20 bp, Artificial Sequence
  Synthetic oligonucleotide; TGG chr11 5392623 5392642 5392639 +
caatatctggctgggcgcgg

SEQ ID NO: 28081 - DNA, 20 bp, Artificial Sequence
  Synthetic oligonucleotide; CAG chr11 5392642 5392661 5392658 +
gtggctcacgcctgtaatcc

SEQ ID NO: 28082 - DNA, 20 bp, Artificial Sequence
  Synthetic oligonucleotide; TGG chr11 5392650 5392669 5392666 +
cgcctgtaatcccagcactc

SEQ ID NO: 28083 - DNA, 20 bp, Artificial Sequence
  Synthetic oligonucleotide; GGG chr11 5392651 5392670 5392667 +
gcctgtaatcccagcactct

SEQ ID NO: 28084 - DNA, 20 bp, Artificial Sequence
  Synthetic oligonucleotide; GAG chr11 5392653 5392672 5392669 +
ctgtaatcccagcactctgg

SEQ ID NO: 28085 - DNA, 20 bp, Artificial Sequence
  Synthetic oligonucleotide; AGG chr11 5392654 5392673 5392670 +
tgtaatcccagcactctggg

SEQ ID NO: 28086 - DNA, 20 bp, Artificial Sequence
  Synthetic oligonucleotide; GAG chr11 5392659 5392678 5392675 +
tcccagcactctgggaggcc

SEQ ID NO: 28087 - DNA, 20 bp, Artificial Sequence
  Synthetic oligonucleotide; AGG chr11 5392660 5392679 5392676 +
cccagcactctgggaggccg

SEQ ID NO: 28088 - DNA, 20 bp, Artificial Sequence
  Synthetic oligonucleotide; CGG chr11 5392663 5392682 5392679 +
agcactctgggaggccgagg

SEQ ID NO: 28089 - DNA, 20 bp, Artificial Sequence
  Synthetic oligonucleotide; GGG chr11 5392664 5392683 5392680 +
gcactctgggaggccgaggc

SEQ ID NO: 28090 - DNA, 20 bp, Artificial Sequence
  Synthetic oligonucleotide; TGG chr11 5392667 5392686 5392683 +
ctctgggaggccgaggcggg

SEQ ID NO: 28091 - DNA, 20 bp, Artificial Sequence
  Synthetic oligonucleotide; GAG chr11 5392675 5392694 5392691 +
ggccgaggcgggtggatcac

SEQ ID NO: 28092 - DNA, 20 bp, Artificial Sequence
  Synthetic oligonucleotide; AGG chr11 5392676 5392695 5392692 +
gccgaggcgggtggatcacg

SEQ ID NO: 28093 - DNA, 20 bp, Artificial Sequence
  Synthetic oligonucleotide; CAG chr11 5392680 5392699 5392696 +
aggcgggtggatcacgaggt

SEQ ID NO: 28094 - DNA, 20 bp, Artificial Sequence
  Synthetic oligonucleotide; AGG chr11 5392681 5392700 5392697 +
ggcgggtggatcacgaggtc

SEQ ID NO: 28095 - DNA, 20 bp, Artificial Sequence
  Synthetic oligonucleotide; GAG chr11 5392683 5392702 5392699 +
cgggtggatcacgaggtcag

SEQ ID NO: 28096 - DNA, 20 bp, Artificial Sequence
  Synthetic oligonucleotide; GAG chr11 5392689 5392708 5392705 +
gatcacgaggtcaggagatc

SEQ ID NO: 28097 - DNA, 20 bp, Artificial Sequence
  Synthetic oligonucleotide; TGG chr11 5392699 5392718 5392715 +
tcaggagatcgagaccatcc

SEQ ID NO: 28098 - DNA, 20 bp, Artificial Sequence
  Synthetic oligonucleotide; CGG chr11 5392708 5392727 5392724 +
cgagaccatcctggctaaca

SEQ ID NO: 28099 - DNA, 20 bp, Artificial Sequence
  Synthetic oligonucleotide; TGG chr11 5392711 5392730 5392727 +
gaccatcctggctaacacgg

SEQ ID NO: 28100 - DNA, 20 bp, Artificial Sequence
  Synthetic oligonucleotide; CAG chr11 5392718 5392737 5392734 +
ctggctaacacggtggaacc

SEQ ID NO: 28101 - DNA, 20 bp, Artificial Sequence
  Synthetic oligonucleotide; AAG chr11 5392740 5392759 5392756 +
gtctctactaaaaatacaaa

SEQ ID NO: 28102 - DNA, 20 bp, Artificial Sequence
  Synthetic oligonucleotide; TAG chr11 5392744 5392763 5392760 +
ctactaaaaatacaaaaagt

SEQ ID NO: 28103 - DNA, 20 bp, Artificial Sequence
  Synthetic oligonucleotide; CGG chr11 5392748 5392767 5392764 +
taaaaatacaaaaagttagc

SEQ ID NO: 28104 - DNA, 20 bp, Artificial Sequence
  Synthetic oligonucleotide; GGG chr11 5392749 5392768 5392765 +
aaaaatacaaaaagttagcc

SEQ ID NO: 28105 - DNA, 20 bp, Artificial Sequence
  Synthetic oligonucleotide; TGG chr11 5392754 5392773 5392770 +
tacaaaaagttagccgggca

SEQ ID NO: 28106 - DNA, 20 bp, Artificial Sequence
  Synthetic oligonucleotide; TGG chr11 5392757 5392776 5392773 +
aaaaagttagccgggcatgg

SEQ ID NO: 28107 - DNA, 20 bp, Artificial Sequence
  Synthetic oligonucleotide; TGG chr11 5392760 5392779 5392776 +
aagttagccgggcatggtgg

SEQ ID NO: 28108 - DNA, 20 bp, Artificial Sequence
  Synthetic oligonucleotide; GGG chr11 5392761 5392780 5392777 +
agttagccgggcatggtggt

SEQ ID NO: 28109 - DNA, 20 bp, Artificial Sequence
  Synthetic oligonucleotide; TAG chr11 5392770 5392789 5392786 +
ggcatggtggtgggcacctg

SEQ ID NO: 28110 - DNA, 20 bp, Artificial Sequence
  Synthetic oligonucleotide; CAG chr11 5392776 5392795 5392792 +
gtggtgggcacctgtagtcc

SEQ ID NO: 28111 - DNA, 20 bp, Artificial Sequence
  Synthetic oligonucleotide; CAG chr11 5392784 5392803 5392800 +
cacctgtagtcccagctact

SEQ ID NO: 28112 - DNA, 20 bp, Artificial Sequence
  Synthetic oligonucleotide; AGG chr11 5392785 5392804 5392801 +
acctgtagtcccagctactc

SEQ ID NO: 28113 - DNA, 20 bp, Artificial Sequence
  Synthetic oligonucleotide; GAG chr11 5392787 5392806 5392803 +
ctgtagtcccagctactcag

SEQ ID NO: 28114 - DNA, 20 bp, Artificial Sequence
  Synthetic oligonucleotide; AGG chr11 5392788 5392807 5392804 +
tgtagtcccagctactcagg

SEQ ID NO: 28115 - DNA, 20 bp, Artificial Sequence
  Synthetic oligonucleotide; TGG chr11 5392792 5392811 5392808 +
gtcccagctactcaggaggc

SEQ ID NO: 28116 - DNA, 20 bp, Artificial Sequence
  Synthetic oligonucleotide; GGG chr11 5392793 5392812 5392809 +
tcccagctactcaggaggct

SEQ ID NO: 28117 - DNA, 20 bp, Artificial Sequence
  Synthetic oligonucleotide; GGG chr11 5392794 5392813 5392810 +
cccagctactcaggaggctg

SEQ ID NO: 28118 - DNA, 20 bp, Artificial Sequence
  Synthetic oligonucleotide; CAG chr11 5392797 5392816 5392813 +
agctactcaggaggctgggg

SEQ ID NO: 28119 - DNA, 20 bp, Artificial Sequence
  Synthetic oligonucleotide; CAG chr11 5392800 5392819 5392816 +
tactcaggaggctggggcag

SEQ ID NO: 28120 - DNA, 20 bp, Artificial Sequence
  Synthetic oligonucleotide; TGG chr11 5392805 5392824 5392821 +
aggaggctggggcagcagaa

SEQ ID NO: 28121 - DNA, 20 bp, Artificial Sequence
  Synthetic oligonucleotide; CAG chr11 5392816 5392835 5392832 +
gcagcagaatggcgtgaacc

SEQ ID NO: 28122 - DNA, 20 bp, Artificial Sequence
  Synthetic oligonucleotide; AGG chr11 5392817 5392836 5392833 +
cagcagaatggcgtgaaccc

SEQ ID NO: 28123 - DNA, 20 bp, Artificial Sequence
  Synthetic oligonucleotide; GAG chr11 5392819 5392838 5392835 +
gcagaatggcgtgaacccag

SEQ ID NO: 28124 - DNA, 20 bp, Artificial Sequence
  Synthetic oligonucleotide; AGG chr11 5392820 5392839 5392836 +
cagaatggcgtgaacccagg

SEQ ID NO: 28125 - DNA, 20 bp, Artificial Sequence
  Synthetic oligonucleotide; TGG chr11 5392823 5392842 5392839 +
aatggcgtgaacccaggagg

SEQ ID NO: 28126 - DNA, 20 bp, Artificial Sequence
  Synthetic oligonucleotide; GAG chr11 5392825 5392844 5392841 +
tggcgtgaacccaggaggtg

SEQ ID NO: 28127 - DNA, 20 bp, Artificial Sequence
  Synthetic oligonucleotide; CAG chr11 5392832 5392851 5392848 +
aacccaggaggtggagcttg

SEQ ID NO: 28128 - DNA, 20 bp, Artificial Sequence
  Synthetic oligonucleotide; GAG chr11 5392836 5392855 5392852 +
caggaggtggagcttgcagt

SEQ ID NO: 28129 - DNA, 20 bp, Artificial Sequence
  Synthetic oligonucleotide; GAG chr11 5392841 5392860 5392857 +
ggtggagcttgcagtgagcc

SEQ ID NO: 28130 - DNA, 20 bp, Artificial Sequence
  Synthetic oligonucleotide; CAG chr11 5392861 5392880 5392877 +
gagatcgtgccactgcactc

SEQ ID NO: 28131 - DNA, 20 bp, Artificial Sequence
  Synthetic oligonucleotide; TGG chr11 5392866 5392885 5392882 +
cgtgccactgcactccagcc

SEQ ID NO: 28132 - DNA, 20 bp, Artificial Sequence
  Synthetic oligonucleotide; GGG chr11 5392867 5392886 5392883 +
gtgccactgcactccagcct

SEQ ID NO: 28133 - DNA, 20 bp, Artificial Sequence
  Synthetic oligonucleotide; CAG chr11 5392873 5392892 5392889 +
ctgcactccagcctgggcaa

SEQ ID NO: 28134 - DNA, 20 bp, Artificial Sequence
  Synthetic oligonucleotide; GAG chr11 5392875 5392894 5392891 +
gcactccagcctgggcaaca

SEQ ID NO: 28135 - DNA, 20 bp, Artificial Sequence
  Synthetic oligonucleotide; AAG chr11 5392879 5392898 5392895 +
tccagcctgggcaacagagc

SEQ ID NO: 28136 - DNA, 20 bp, Artificial Sequence
  Synthetic oligonucleotide; AAG chr11 5392905 5392924 5392921 +
ccttctcaaaaacaaaaaaa

SEQ ID NO: 28137 - DNA, 20 bp, Artificial Sequence
  Synthetic oligonucleotide; AAG chr11 5392934 5392953 5392950 +
aaataaatatctgtgctgtt

SEQ ID NO: 28138 - DNA, 20 bp, Artificial Sequence
  Synthetic oligonucleotide; TGG chr11 5392941 5392960 5392957 +
tatctgtgctgttaagtatg

SEQ ID NO: 28139 - DNA, 20 bp, Artificial Sequence
  Synthetic oligonucleotide; AAG chr11 5392947 5392966 5392963 +
tgctgttaagtatgtggtaa

SEQ ID NO: 28140 - DNA, 20 bp, Artificial Sequence
  Synthetic oligonucleotide; GAG chr11 5392949 5392968 5392965 +
ctgttaagtatgtggtaaaa

SEQ ID NO: 28141 - DNA, 20 bp, Artificial Sequence
  Synthetic oligonucleotide; AGG chr11 5392950 5392969 5392966 +
tgttaagtatgtggtaaaag

SEQ ID NO: 28142 - DNA, 20 bp, Artificial Sequence
  Synthetic oligonucleotide; CAG chr11 5392966 5392985 5392982 +
aaagaggtattttcacatac

SEQ ID NO: 28143 - DNA, 20 bp, Artificial Sequence
  Synthetic oligonucleotide; AAG chr11 5393018 5393037 5393034 +
taaaaaacaaaatacatcaa

SEQ ID NO: 28144 - DNA, 20 bp, Artificial Sequence
  Synthetic oligonucleotide; CAG chr11 5393048 5393067 5393064 +
aatattcatgctctgtgtct

SEQ ID NO: 28145 - DNA, 20 bp, Artificial Sequence
  Synthetic oligonucleotide; TAG chr11 5393100 5393119 5393116 +
taaatgataaattaaaaatt

SEQ ID NO: 28146 - DNA, 20 bp, Artificial Sequence
  Synthetic oligonucleotide; AGG chr11 5393101 5393120 5393117 +
aaatgataaattaaaaattt

SEQ ID NO: 28147 - DNA, 20 bp, Artificial Sequence
  Synthetic oligonucleotide; AAG chr11 5393108 5393127 5393124 +
aaattaaaaatttaggatgt

SEQ ID NO: 28148 - DNA, 20 bp, Artificial Sequence
  Synthetic oligonucleotide; TGG chr11 5393118 5393137 5393134 +
tttaggatgtaagctgtttg

SEQ ID NO: 28149 - DNA, 20 bp, Artificial Sequence
  Synthetic oligonucleotide; CAG chr11 5393145 5393164 5393161 +
atttttttcctgtttgctca

SEQ ID NO: 28150 - DNA, 20 bp, Artificial Sequence
  Synthetic oligonucleotide; TAG chr11 5393164 5393183 5393180 +
acagttctaaatccatctcc

SEQ ID NO: 28151 - DNA, 20 bp, Artificial Sequence
  Synthetic oligonucleotide; AGG chr11 5393165 5393184 5393181 +
cagttctaaatccatctcct

SEQ ID NO: 28152 - DNA, 20 bp, Artificial Sequence
  Synthetic oligonucleotide; CAG chr11 5393169 5393188 5393185 +
tctaaatccatctcctaggt

SEQ ID NO: 28153 - DNA, 20 bp, Artificial Sequence
  Synthetic oligonucleotide; AAG chr11 5393203 5393222 5393219 +
tatgtgttgaactatttaat

SEQ ID NO: 28154 - DNA, 20 bp, Artificial Sequence
  Synthetic oligonucleotide; AAG chr11 5393241 5393260 5393257 +
gtgttattgttcataatttt

SEQ ID NO: 28155 - DNA, 20 bp, Artificial Sequence
  Synthetic oligonucleotide; AAG chr11 5393249 5393268 5393265 +
gttcataattttaagaatgt

SEQ ID NO: 28156 - DNA, 20 bp, Artificial Sequence
  Synthetic oligonucleotide; TAG chr11 5393265 5393284 5393281 +
atgtaagcatacaaaatgtc

SEQ ID NO: 28157 - DNA, 20 bp, Artificial Sequence
  Synthetic oligonucleotide; AAG chr11 5393290 5393309 5393306 +
taaaaatattacataaatca

SEQ ID NO: 28158 - DNA, 20 bp, Artificial Sequence
  Synthetic oligonucleotide; TAG chr11 5393337 5393356 5393353 +
taaaatgacatttaaatgct

SEQ ID NO: 28159 - DNA, 20 bp, Artificial Sequence
  Synthetic oligonucleotide; AGG chr11 5393338 5393357 5393354 +
aaaatgacatttaaatgctt

SEQ ID NO: 28160 - DNA, 20 bp, Artificial Sequence
  Synthetic oligonucleotide; TGG chr11 5393348 5393367 5393364 +
ttaaatgcttaggaaactgt

SEQ ID NO: 28161 - DNA, 20 bp, Artificial Sequence
  Synthetic oligonucleotide; AAG chr11 5393370 5393389 5393386 +
gcaaaatattaaataaaaat

SEQ ID NO: 28162 - DNA, 20 bp, Artificial Sequence
  Synthetic oligonucleotide; TAG chr11 5393379 5393398 5393395 +
taaataaaaataagcaaaat

SEQ ID NO: 28163 - DNA, 20 bp, Artificial Sequence
  Synthetic oligonucleotide; AGG chr11 5393380 5393399 5393396 +
aaataaaaataagcaaaatt

SEQ ID NO: 28164 - DNA, 20 bp, Artificial Sequence
  Synthetic oligonucleotide; CAG chr11 5393385 5393404 5393401 +
aaaataagcaaaattaggta

SEQ ID NO: 28165 - DNA, 20 bp, Artificial Sequence
  Synthetic oligonucleotide; AAG chr11 5393404 5393423 5393420 +
acagaacaatcactatgtaa

SEQ ID NO: 28166 - DNA, 20 bp, Artificial Sequence
  Synthetic oligonucleotide; AGG chr11 5393405 5393424 5393421 +
cagaacaatcactatgtaaa

SEQ ID NO: 28167 - DNA, 20 bp, Artificial Sequence
  Synthetic oligonucleotide; AAG chr11 5393427 5393446 5393443 +
gctataaatatttgtatcaa

SEQ ID NO: 28168 - DNA, 20 bp, Artificial Sequence
  Synthetic oligonucleotide; CAG chr11 5393435 5393454 5393451 +
tatttgtatcaaaagaaaaa

SEQ ID NO: 28169 - DNA, 20 bp, Artificial Sequence
  Synthetic oligonucleotide; TAG chr11 5393465 5393484 5393481 +
atataatcttattttctata

SEQ ID NO: 28170 - DNA, 20 bp, Artificial Sequence
  Synthetic oligonucleotide; AAG chr11 5393501 5393520 5393517 +
tgccgtatacaaattttctg

SEQ ID NO: 28171 - DNA, 20 bp, Artificial Sequence
  Synthetic oligonucleotide; AAG chr11 5393504 5393523 5393520 +
cgtatacaaattttctgaag

SEQ ID NO: 28172 - DNA, 20 bp, Artificial Sequence
  Synthetic oligonucleotide; CGG chr11 5393513 5393532 5393529 +
attttctgaagaagacattt

SEQ ID NO: 28173 - DNA, 20 bp, Artificial Sequence
  Synthetic oligonucleotide; AAG chr11 5393530 5393549 5393546 +
tttcggttttataatctaaa

SEQ ID NO: 28174 - DNA, 20 bp, Artificial Sequence
  Synthetic oligonucleotide; GAG chr11 5393532 5393551 5393548 +
tcggttttataatctaaaaa

SEQ ID NO: 28175 - DNA, 20 bp, Artificial Sequence
  Synthetic oligonucleotide; AAG chr11 5393555 5393574 5393571 +
cattttacaatgactataaa

SEQ ID NO: 28176 - DNA, 20 bp, Artificial Sequence
  Synthetic oligonucleotide; AAG chr11 5393576 5393595 5393592 +
agttatatacgattatgctg

SEQ ID NO: 28177 - DNA, 20 bp, Artificial Sequence
  Synthetic oligonucleotide; AAG chr11 5393588 5393607 5393604 +
ttatgctgaagatgacaatg

SEQ ID NO: 28178 - DNA, 20 bp, Artificial Sequence
  Synthetic oligonucleotide; AAG chr11 5393628 5393647 5393644 +
gataaatgctaatgtttatt

SEQ ID NO: 28179 - DNA, 20 bp, Artificial Sequence
  Synthetic oligonucleotide; CGG chr11 5393642 5393661 5393658 +
tttattaagcatttaactca

SEQ ID NO: 28180 - DNA, 20 bp, Artificial Sequence
  Synthetic oligonucleotide; TAG chr11 5393645 5393664 5393661 +
attaagcatttaactcacgg

SEQ ID NO: 28181 - DNA, 20 bp, Artificial Sequence
  Synthetic oligonucleotide; GAG chr11 5393647 5393666 5393663 +
taagcatttaactcacggta

SEQ ID NO: 28182 - DNA, 20 bp, Artificial Sequence
  Synthetic oligonucleotide; GAG chr11 5393649 5393668 5393665 +
agcatttaactcacggtaga

SEQ ID NO: 28183 - DNA, 20 bp, Artificial Sequence
  Synthetic oligonucleotide; AGG chr11 5393650 5393669 5393666 +
gcatttaactcacggtagag

SEQ ID NO: 28184 - DNA, 20 bp, Artificial Sequence
  Synthetic oligonucleotide; GGG chr11 5393651 5393670 5393667 +
catttaactcacggtagaga

SEQ ID NO: 28185 - DNA, 20 bp, Artificial Sequence
  Synthetic oligonucleotide; GAG chr11 5393656 5393675 5393672 +
aactcacggtagagagggct

SEQ ID NO: 28186 - DNA, 20 bp, Artificial Sequence
  Synthetic oligonucleotide; AAG chr11 5393716 5393735 5393732 +
attttctcaccaaacctgtg

SEQ ID NO: 28187 - DNA, 20 bp, Artificial Sequence
  Synthetic oligonucleotide; TAG chr11 5393719 5393738 5393735 +
ttctcaccaaacctgtgaag

SEQ ID NO: 28188 - DNA, 20 bp, Artificial Sequence
  Synthetic oligonucleotide; AGG chr11 5393720 5393739 5393736 +
tctcaccaaacctgtgaagt

SEQ ID NO: 28189 - DNA, 20 bp, Artificial Sequence
  Synthetic oligonucleotide; GGG chr11 5393721 5393740 5393737 +
ctcaccaaacctgtgaagta

SEQ ID NO: 28190 - DNA, 20 bp, Artificial Sequence
  Synthetic oligonucleotide; GAG chr11 5393723 5393742 5393739 +
caccaaacctgtgaagtagg

SEQ ID NO: 28191 - DNA, 20 bp, Artificial Sequence
  Synthetic oligonucleotide; AGG chr11 5393724 5393743 5393740 +
accaaacctgtgaagtaggg

SEQ ID NO: 28192 - DNA, 20 bp, Artificial Sequence
  Synthetic oligonucleotide; TAG chr11 5393753 5393772 5393769 +
tattttcaatgttttaaaat

SEQ ID NO: 28193 - DNA, 20 bp, Artificial Sequence
  Synthetic oligonucleotide; AGG chr11 5393754 5393773 5393770 +
attttcaatgttttaaaatt

SEQ ID NO: 28194 - DNA, 20 bp, Artificial Sequence
  Synthetic oligonucleotide; GAG chr11 5393762 5393781 5393778 +
tgttttaaaattaggaaact

SEQ ID NO: 28195 - DNA, 20 bp, Artificial Sequence
  Synthetic oligonucleotide; AGG chr11 5393763 5393782 5393779 +
gttttaaaattaggaaactg

SEQ ID NO: 28196 - DNA, 20 bp, Artificial Sequence
  Synthetic oligonucleotide; CAG chr11 5393770 5393789 5393786 +
aattaggaaactgaggctca

SEQ ID NO: 28197 - DNA, 20 bp, Artificial Sequence
  Synthetic oligonucleotide; GAG chr11 5393772 5393791 5393788 +
ttaggaaactgaggctcaca

SEQ ID NO: 28198 - DNA, 20 bp, Artificial Sequence
  Synthetic oligonucleotide; AGG chr11 5393773 5393792 5393789 +
taggaaactgaggctcacag

SEQ ID NO: 28199 - DNA, 20 bp, Artificial Sequence
  Synthetic oligonucleotide; AAG chr11 5393777 5393796 5393793 +
aaactgaggctcacagagga

SEQ ID NO: 28200 - DNA, 20 bp, Artificial Sequence
  Synthetic oligonucleotide; TAG chr11 5393790 5393809 5393806 +
cagaggaaagcaactttcct

SEQ ID NO: 28201 - DNA, 20 bp, Artificial Sequence
  Synthetic oligonucleotide; AAG chr11 5393808 5393827 5393824 +
cttagttaaatcattaatgt

SEQ ID NO: 28202 - DNA, 20 bp, Artificial Sequence
  Synthetic oligonucleotide; CAG chr11 5393812 5393831 5393828 +
gttaaatcattaatgtaagt

SEQ ID NO: 28203 - DNA, 20 bp, Artificial Sequence
  Synthetic oligonucleotide; AAG chr11 5393832 5393851 5393848 +
cagaactgaaattcaatatc

SEQ ID NO: 28204 - DNA, 20 bp, Artificial Sequence
  Synthetic oligonucleotide; TGG chr11 5393863 5393882 5393879 +
attttcttaaaccattatgc

SEQ ID NO: 28205 - DNA, 20 bp, Artificial Sequence
  Synthetic oligonucleotide; CAG chr11 5393879 5393898 5393895 +
atgctggactcctctccaaa

SEQ ID NO: 28206 - DNA, 20 bp, Artificial Sequence
  Synthetic oligonucleotide; AGG chr11 5393880 5393899 5393896 +
tgctggactcctctccaaac

SEQ ID NO: 28207 - DNA, 20 bp, Artificial Sequence
  Synthetic oligonucleotide; CAG chr11 5393894 5393913 5393910 +
ccaaacaggaccactcgttt

SEQ ID NO: 28208 - DNA, 20 bp, Artificial Sequence
  Synthetic oligonucleotide; AGG chr11 5393895 5393914 5393911 +
caaacaggaccactcgtttc

SEQ ID NO: 28209 - DNA, 20 bp, Artificial Sequence
  Synthetic oligonucleotide; GGG chr11 5393896 5393915 5393912 +
aaacaggaccactcgtttca

SEQ ID NO: 28210 - DNA, 20 bp, Artificial Sequence
  Synthetic oligonucleotide; AAG chr11 5393921 5393940 5393937 +
atgttttccatgttatactg

SEQ ID NO: 28211 - DNA, 20 bp, Artificial Sequence
  Synthetic oligonucleotide; AGG chr11 5393922 5393941 5393938 +
tgttttccatgttatactga

SEQ ID NO: 28212 - DNA, 20 bp, Artificial Sequence
  Synthetic oligonucleotide; AAG chr11 5393925 5393944 5393941 +
tttccatgttatactgaagg

SEQ ID NO: 28213 - DNA, 20 bp, Artificial Sequence
  Synthetic oligonucleotide; TGG chr11 5393937 5393956 5393953 +
actgaaggaagtcccatcat

SEQ ID NO: 28214 - DNA, 20 bp, Artificial Sequence
  Synthetic oligonucleotide; TAG chr11 5393968 5393987 5393984 +
taactttttgttccctttcc

SEQ ID NO: 28215 - DNA, 20 bp, Artificial Sequence
  Synthetic oligonucleotide; TAG chr11 5393994 5394013 5394010 +
atgttatctatttttccatt

SEQ ID NO: 28216 - DNA, 20 bp, Artificial Sequence
  Synthetic oligonucleotide; CAG chr11 5394000 5394019 5394016 +
tctatttttccatttagtat

SEQ ID NO: 28217 - DNA, 20 bp, Artificial Sequence
  Synthetic oligonucleotide; AGG chr11 5394001 5394020 5394017 +
ctatttttccatttagtatc

SEQ ID NO: 28218 - DNA, 20 bp, Artificial Sequence
  Synthetic oligonucleotide; AAG chr11 5394006 5394025 5394022 +
tttccatttagtatcaggaa

SEQ ID NO: 28219 - DNA, 20 bp, Artificial Sequence
  Synthetic oligonucleotide; TAG chr11 5394010 5394029 5394026 +
catttagtatcaggaaaaga

SEQ ID NO: 28220 - DNA, 20 bp, Artificial Sequence
  Synthetic oligonucleotide; CAG chr11 5394016 5394035 5394032 +
gtatcaggaaaagatagcaa

SEQ ID NO: 28221 - DNA, 20 bp, Artificial Sequence
  Synthetic oligonucleotide; CAG chr11 5394023 5394042 5394039 +
gaaaagatagcaacagaaaa

SEQ ID NO: 28222 - DNA, 20 bp, Artificial Sequence
  Synthetic oligonucleotide; TAG chr11 5394059 5394078 5394075 +
ttgtattaaatactttttaa

SEQ ID NO: 28223 - DNA, 20 bp, Artificial Sequence
  Synthetic oligonucleotide; AAG chr11 5394072 5394091 5394088 +
tttttaatagacttgatttt

SEQ ID NO: 28224 - DNA, 20 bp, Artificial Sequence
  Synthetic oligonucleotide; GAG chr11 5394074 5394093 5394090 +
tttaatagacttgattttaa

SEQ ID NO: 28225 - DNA, 20 bp, Artificial Sequence
  Synthetic oligonucleotide; TAG chr11 5394080 5394099 5394096 +
agacttgattttaagagtta

SEQ ID NO: 28226 - DNA, 20 bp, Artificial Sequence
  Synthetic oligonucleotide; CAG chr11 5394088 5394107 5394104 +
ttttaagagttatagattca

SEQ ID NO: 28227 - DNA, 20 bp, Artificial Sequence
  Synthetic oligonucleotide; CAG chr11 5394098 5394117 5394114 +
tatagattcacagaaaaact

SEQ ID NO: 28228 - DNA, 20 bp, Artificial Sequence
  Synthetic oligonucleotide; TAG chr11 5394101 5394120 5394117 +
agattcacagaaaaactcag

SEQ ID NO: 28229 - DNA, 20 bp, Artificial Sequence
  Synthetic oligonucleotide; AAG chr11 5394104 5394123 5394120 +
ttcacagaaaaactcagtag

SEQ ID NO: 28230 - DNA, 20 bp, Artificial Sequence
  Synthetic oligonucleotide; AGG chr11 5394105 5394124 5394121 +
tcacagaaaaactcagtaga

SEQ ID NO: 28231 - DNA, 20 bp, Artificial Sequence
  Synthetic oligonucleotide; GAG chr11 5394112 5394131 5394128 +
aaaactcagtagaaggtact

SEQ ID NO: 28232 - DNA, 20 bp, Artificial Sequence
  Synthetic oligonucleotide; TGG chr11 5394136 5394155 5394152 +
accttctattttgcatatca

SEQ ID NO: 28233 - DNA, 20 bp, Artificial Sequence
  Synthetic oligonucleotide; AAG chr11 5394145 5394164 5394161 +
tttgcatatcatggtttttt

SEQ ID NO: 28234 - DNA, 20 bp, Artificial Sequence
  Synthetic oligonucleotide; TAG chr11 5394162 5394181 5394178 +
tttaagcacatattataacc

SEQ ID NO: 28235 - DNA, 20 bp, Artificial Sequence
  Synthetic oligonucleotide; AGG chr11 5394163 5394182 5394179 +
ttaagcacatattataacct

SEQ ID NO: 28236 - DNA, 20 bp, Artificial Sequence
  Synthetic oligonucleotide; AAG chr11 5394175 5394194 5394191 +
tataacctaggtattattct

SEQ ID NO: 28237 - DNA, 20 bp, Artificial Sequence
  Synthetic oligonucleotide; AGG chr11 5394176 5394195 5394192 +
ataacctaggtattattcta

SEQ ID NO: 28238 - DNA, 20 bp, Artificial Sequence
  Synthetic oligonucleotide; GGG chr11 5394177 5394196 5394193 +
taacctaggtattattctaa

SEQ ID NO: 28239 - DNA, 20 bp, Artificial Sequence
  Synthetic oligonucleotide; AAG chr11 5394193 5394212 5394209 +
ctaagggcataatacactat

SEQ ID NO: 28240 - DNA, 20 bp, Artificial Sequence
  Synthetic oligonucleotide; GAG chr11 5394222 5394241 5394238 +
tatcttgacaataaccttat

SEQ ID NO: 28241 - DNA, 20 bp, Artificial Sequence
  Synthetic oligonucleotide; TGG chr11 5394226 5394245 5394242 +
ttgacaataaccttatgaga

SEQ ID NO: 28242 - DNA, 20 bp, Artificial Sequence
  Synthetic oligonucleotide; TAG chr11 5394236 5394255 5394252 +
ccttatgagatggatactac

SEQ ID NO: 28243 - DNA, 20 bp, Artificial Sequence
  Synthetic oligonucleotide; CAG chr11 5394252 5394271 5394268 +
ctactagattacccatttta

SEQ ID NO: 28244 - DNA, 20 bp, Artificial Sequence
  Synthetic oligonucleotide; AAG chr11 5394257 5394276 5394273 +
agattacccattttacagat

SEQ ID NO: 28245 - DNA, 20 bp, Artificial Sequence
  Synthetic oligonucleotide; GAG chr11 5394266 5394285 5394282 +
attttacagataagtacact

SEQ ID NO: 28246 - DNA, 20 bp, Artificial Sequence
  Synthetic oligonucleotide; AGG chr11 5394267 5394286 5394283 +
ttttacagataagtacactg

SEQ ID NO: 28247 - DNA, 20 bp, Artificial Sequence
  Synthetic oligonucleotide; CAG chr11 5394272 5394291 5394288 +
cagataagtacactgaggct

SEQ ID NO: 28248 - DNA, 20 bp, Artificial Sequence
  Synthetic oligonucleotide; GAG chr11 5394274 5394293 5394290 +
gataagtacactgaggctca

SEQ ID NO: 28249 - DNA, 20 bp, Artificial Sequence
  Synthetic oligonucleotide; AAG chr11 5394304 5394323 5394320 +
atcttgcccaatattatacc

SEQ ID NO: 28250 - DNA, 20 bp, Artificial Sequence
  Synthetic oligonucleotide; CAG chr11 5394312 5394331 5394328 +
caatattataccaagtttga

SEQ ID NO: 28251 - DNA, 20 bp, Artificial Sequence
  Synthetic oligonucleotide; TGG chr11 5394324 5394343 5394340 +
aagtttgacagttctgactg

SEQ ID NO: 28252 - DNA, 20 bp, Artificial Sequence
  Synthetic oligonucleotide; TAG chr11 5394333 5394352 5394349 +
agttctgactgtggtgcttg

SEQ ID NO: 28253 - DNA, 20 bp, Artificial Sequence
  Synthetic oligonucleotide; CAG chr11 5394392 5394411 5394408 +
aaccaaaaaaaacataaaat

SEQ ID NO: 28254 - DNA, 20 bp, Artificial Sequence
  Synthetic oligonucleotide; AAG chr11 5394398 5394417 5394414 +
aaaaaacataaaatcagcca

SEQ ID NO: 28255 - DNA, 20 bp, Artificial Sequence
  Synthetic oligonucleotide; CAG chr11 5394423 5394442 5394439 +
gtacatattcctgctaatga

SEQ ID NO: 28256 - DNA, 20 bp, Artificial Sequence
  Synthetic oligonucleotide; TGG chr11 5394444 5394463 5394460 +
agtatctgctttaaatcatc

SEQ ID NO: 28257 - DNA, 20 bp, Artificial Sequence
  Synthetic oligonucleotide; CAG chr11 5394456 5394475 5394472 +
aaatcatctggcccattcct

SEQ ID NO: 28258 - DNA, 20 bp, Artificial Sequence
  Synthetic oligonucleotide; AAG chr11 5394462 5394481 5394478 +
tctggcccattcctcagcac

SEQ ID NO: 28259 - DNA, 20 bp, Artificial Sequence
  Synthetic oligonucleotide; CAG chr11 5394477 5394496 5394493 +
agcacaagcctatattcctg

SEQ ID NO: 28260 - DNA, 20 bp, Artificial Sequence
  Synthetic oligonucleotide; AGG chr11 5394478 5394497 5394494 +
gcacaagcctatattcctgc

SEQ ID NO: 28261 - DNA, 20 bp, Artificial Sequence
  Synthetic oligonucleotide; AAG chr11 5394519 5394538 5394535 +
tcccgttatttaatatccac

SEQ ID NO: 28262 - DNA, 20 bp, Artificial Sequence
  Synthetic oligonucleotide; AAG chr11 5394529 5394548 5394545 +
taatatccacaagcctctct

SEQ ID NO: 28263 - DNA, 20 bp, Artificial Sequence
  Synthetic oligonucleotide; CAG chr11 5394563 5394582 5394579 +
gatactgtatttgtaaaaca

SEQ ID NO: 28264 - DNA, 20 bp, Artificial Sequence
  Synthetic oligonucleotide; TGG chr11 5394567 5394586 5394583 +
ctgtatttgtaaaacacaga

SEQ ID NO: 28265 - DNA, 20 bp, Artificial Sequence
  Synthetic oligonucleotide; AAG chr11 5394582 5394601 5394598 +
acagatggctcatgtaattg

SEQ ID NO: 28266 - DNA, 20 bp, Artificial Sequence
  Synthetic oligonucleotide; CAG chr11 5394589 5394608 5394605 +
gctcatgtaattgaagttca

SEQ ID NO: 28267 - DNA, 20 bp, Artificial Sequence
  Synthetic oligonucleotide; GAG chr11 5394621 5394640 5394637 +
ttttgctttgtgacaactct

SEQ ID NO: 28268 - DNA, 20 bp, Artificial Sequence
  Synthetic oligonucleotide; TAG chr11 5394674 5394693 5394690 +
atgttacctattttgaatga

SEQ ID NO: 28269 - DNA, 20 bp, Artificial Sequence
  Synthetic oligonucleotide; CAG chr11 5394679 5394698 5394695 +
acctattttgaatgatagtg

SEQ ID NO: 28270 - DNA, 20 bp, Artificial Sequence
  Synthetic oligonucleotide; TAG chr11 5394686 5394705 5394702 +
ttgaatgatagtgcagacat

SEQ ID NO: 28271 - DNA, 20 bp, Artificial Sequence
  Synthetic oligonucleotide; AAG chr11 5394690 5394709 5394706 +
atgatagtgcagacattagt

SEQ ID NO: 28272 - DNA, 20 bp, Artificial Sequence
  Synthetic oligonucleotide; AGG chr11 5394691 5394710 5394707 +
tgatagtgcagacattagta

SEQ ID NO: 28273 - DNA, 20 bp, Artificial Sequence
  Synthetic oligonucleotide; AAG chr11 5394695 5394714 5394711 +
agtgcagacattagtaagga

SEQ ID NO: 28274 - DNA, 20 bp, Artificial Sequence
  Synthetic oligonucleotide; TGG chr11 5394720 5394739 5394736 +
tgctaaatatttgtatcacc

SEQ ID NO: 28275 - DNA, 20 bp, Artificial Sequence
  Synthetic oligonucleotide; GGG chr11 5394721 5394740 5394737 +
gctaaatatttgtatcacct

SEQ ID NO: 28276 - DNA, 20 bp, Artificial Sequence
  Synthetic oligonucleotide; AAG chr11 5394724 5394743 5394740 +
aaatatttgtatcacctggg

SEQ ID NO: 28277 - DNA, 20 bp, Artificial Sequence
  Synthetic oligonucleotide; CAG chr11 5394743 5394762 5394759 +
gaagcctgtttttgcttcat

SEQ ID NO: 28278 - DNA, 20 bp, Artificial Sequence
  Synthetic oligonucleotide; AGG chr11 5394744 5394763 5394760 +
aagcctgtttttgcttcatc

SEQ ID NO: 28279 - DNA, 20 bp, Artificial Sequence
  Synthetic oligonucleotide; GGG chr11 5394745 5394764 5394761 +
agcctgtttttgcttcatca

SEQ ID NO: 28280 - DNA, 20 bp, Artificial Sequence
  Synthetic oligonucleotide; GGG chr11 5394746 5394765 5394762 +
gcctgtttttgcttcatcag

SEQ ID NO: 28281 - DNA, 20 bp, Artificial Sequence
  Synthetic oligonucleotide; TAG chr11 5394753 5394772 5394769 +
tttgcttcatcaggggacgt

SEQ ID NO: 28282 - DNA, 20 bp, Artificial Sequence
  Synthetic oligonucleotide; CAG chr11 5394778 5394797 5394794 +
tttttcacatcaacctcctg

SEQ ID NO: 28283 - DNA, 20 bp, Artificial Sequence
  Synthetic oligonucleotide; AAG chr11 5394781 5394800 5394797 +
ttcacatcaacctcctgcag

SEQ ID NO: 28284 - DNA, 20 bp, Artificial Sequence
  Synthetic oligonucleotide; AAG chr11 5394798 5394817 5394814 +
cagaagacaatgctttctga

SEQ ID NO: 28285 - DNA, 20 bp, Artificial Sequence
  Synthetic oligonucleotide; CAG chr11 5394802 5394821 5394818 +
agacaatgctttctgaaaga

SEQ ID NO: 28286 - DNA, 20 bp, Artificial Sequence
  Synthetic oligonucleotide; GAG chr11 5394804 5394823 5394820 +
acaatgctttctgaaagaca

SEQ ID NO: 28287 - DNA, 20 bp, Artificial Sequence
  Synthetic oligonucleotide; AAG chr11 5394847 5394866 5394863 +
gcattcaaatatctgaccca

SEQ ID NO: 28288 - DNA, 20 bp, Artificial Sequence
  Synthetic oligonucleotide; CAG chr11 5394873 5394892 5394889 +
gtgatctttacatacttgct

SEQ ID NO: 28289 - DNA, 20 bp, Artificial Sequence
  Synthetic oligonucleotide; CAG chr11 5394883 5394902 5394899 +
catacttgctcagtgaatga

SEQ ID NO: 28290 - DNA, 20 bp, Artificial Sequence
  Synthetic oligonucleotide; TGG chr11 5394898 5394917 5394914 +
aatgacagtgaataactacc

SEQ ID NO: 28291 - DNA, 20 bp, Artificial Sequence
  Synthetic oligonucleotide; AAG chr11 5394906 5394925 5394922 +
tgaataactacctggttgta

SEQ ID NO: 28292 - DNA, 20 bp, Artificial Sequence
  Synthetic oligonucleotide; AAG chr11 5394917 5394936 5394933 +
ctggttgtaaagactgtctc

SEQ ID NO: 28293 - DNA, 20 bp, Artificial Sequence
  Synthetic oligonucleotide; AGG chr11 5394918 5394937 5394934 +
tggttgtaaagactgtctca

SEQ ID NO: 28294 - DNA, 20 bp, Artificial Sequence
  Synthetic oligonucleotide; GGG chr11 5394919 5394938 5394935 +
ggttgtaaagactgtctcaa

SEQ ID NO: 28295 - DNA, 20 bp, Artificial Sequence
  Synthetic oligonucleotide; GGG chr11 5394920 5394939 5394936 +
gttgtaaagactgtctcaag

SEQ ID NO: 28296 - DNA, 20 bp, Artificial Sequence
  Synthetic oligonucleotide; TGG chr11 5394932 5394951 5394948 +
gtctcaaggggacttttgtc

SEQ ID NO: 28297 - DNA, 20 bp, Artificial Sequence
  Synthetic oligonucleotide; GGG chr11 5394933 5394952 5394949 +
tctcaaggggacttttgtct

SEQ ID NO: 28298 - DNA, 20 bp, Artificial Sequence
  Synthetic oligonucleotide; AAG chr11 5394938 5394957 5394954 +
aggggacttttgtctgggaa

SEQ ID NO: 28299 - DNA, 20 bp, Artificial Sequence
  Synthetic oligonucleotide; AAG chr11 5394943 5394962 5394959 +
acttttgtctgggaaaagaa

SEQ ID NO: 28300 - DNA, 20 bp, Artificial Sequence
  Synthetic oligonucleotide; AAG chr11 5394947 5394966 5394963 +
ttgtctgggaaaagaaaaga

SEQ ID NO: 28301 - DNA, 20 bp, Artificial Sequence
  Synthetic oligonucleotide; AAG chr11 5394956 5394975 5394972 +
aaaagaaaagaaagacaaaa

SEQ ID NO: 28302 - DNA, 20 bp, Artificial Sequence
  Synthetic oligonucleotide; GAG chr11 5394958 5394977 5394974 +
aagaaaagaaagacaaaaaa

SEQ ID NO: 28303 - DNA, 20 bp, Artificial Sequence
  Synthetic oligonucleotide; AGG chr11 5394959 5394978 5394975 +
agaaaagaaagacaaaaaag

SEQ ID NO: 28304 - DNA, 20 bp, Artificial Sequence
  Synthetic oligonucleotide; GAG chr11 5394965 5394984 5394981 +
gaaagacaaaaaagaggatt

SEQ ID NO: 28305 - DNA, 20 bp, Artificial Sequence
  Synthetic oligonucleotide; AAG chr11 5394968 5394987 5394984 +
agacaaaaaagaggattgag

SEQ ID NO: 28306 - DNA, 20 bp, Artificial Sequence
  Synthetic oligonucleotide; AAG chr11 5394992 5395011 5395008 +
acccaataaattttcttatg

SEQ ID NO: 28307 - DNA, 20 bp, Artificial Sequence
  Synthetic oligonucleotide; TGG chr11 5394996 5395015 5395012 +
aataaattttcttatgaagt

SEQ ID NO: 28308 - DNA, 20 bp, Artificial Sequence
  Synthetic oligonucleotide; CAG chr11 5394999 5395018 5395015 +
aaattttcttatgaagttgg

SEQ ID NO: 28309 - DNA, 20 bp, Artificial Sequence
  Synthetic oligonucleotide; TGG chr11 5395003 5395022 5395019 +
tttcttatgaagttggcagc

SEQ ID NO: 28310 - DNA, 20 bp, Artificial Sequence
  Synthetic oligonucleotide; GGG chr11 5395004 5395023 5395020 +
ttcttatgaagttggcagct

SEQ ID NO: 28311 - DNA, 20 bp, Artificial Sequence
  Synthetic oligonucleotide; GGG chr11 5395005 5395024 5395021 +
tcttatgaagttggcagctg

SEQ ID NO: 28312 - DNA, 20 bp, Artificial Sequence
  Synthetic oligonucleotide; GAG chr11 5395007 5395026 5395023 +
ttatgaagttggcagctggg

SEQ ID NO: 28313 - DNA, 20 bp, Artificial Sequence
  Synthetic oligonucleotide; GAG chr11 5395009 5395028 5395025 +
atgaagttggcagctgggga

SEQ ID NO: 28314 - DNA, 20 bp, Artificial Sequence
  Synthetic oligonucleotide; AAG chr11 5395012 5395031 5395028 +
aagttggcagctggggagag

SEQ ID NO: 28315 - DNA, 20 bp, Artificial Sequence
  Synthetic oligonucleotide; CAG chr11 5395016 5395035 5395032 +
tggcagctggggagagaaga

SEQ ID NO: 28316 - DNA, 20 bp, Artificial Sequence
  Synthetic oligonucleotide; AAG chr11 5395021 5395040 5395037 +
gctggggagagaagacagtc

SEQ ID NO: 28317 - DNA, 20 bp, Artificial Sequence
  Synthetic oligonucleotide; AGG chr11 5395022 5395041 5395038 +
ctggggagagaagacagtca

SEQ ID NO: 28318 - DNA, 20 bp, Artificial Sequence
  Synthetic oligonucleotide; TGG chr11 5395031 5395050 5395047 +
gaagacagtcaaggatcctc

SEQ ID NO: 28319 - DNA, 20 bp, Artificial Sequence
  Synthetic oligonucleotide; TAG chr11 5395051 5395070 5395067 +
tggctcactgaaatacctcc

SEQ ID NO: 28320 - DNA, 20 bp, Artificial Sequence
  Synthetic oligonucleotide; GAG chr11 5395053 5395072 5395069 +
gctcactgaaatacctccta

SEQ ID NO: 28321 - DNA, 20 bp, Artificial Sequence
  Synthetic oligonucleotide; AGG chr11 5395054 5395073 5395070 +
ctcactgaaatacctcctag

SEQ ID NO: 28322 - DNA, 20 bp, Artificial Sequence
  Synthetic oligonucleotide; TGG chr11 5395063 5395082 5395079 +
atacctcctagaggtactca

SEQ ID NO: 28323 - DNA, 20 bp, Artificial Sequence
  Synthetic oligonucleotide; AAG chr11 5395084 5395103 5395100 +
ggttcactaaatttccattt

SEQ ID NO: 28324 - DNA, 20 bp, Artificial Sequence
  Synthetic oligonucleotide; TGG chr11 5395092 5395111 5395108 +
aaatttccatttaagataac

SEQ ID NO: 28325 - DNA, 20 bp, Artificial Sequence
  Synthetic oligonucleotide; GGG chr11 5395093 5395112 5395109 +
aatttccatttaagataact

SEQ ID NO: 28326 - DNA, 20 bp, Artificial Sequence
  Synthetic oligonucleotide; TGG chr11 5395110 5395129 5395126 +
actgggcatctcaaatgctt

SEQ ID NO: 28327 - DNA, 20 bp, Artificial Sequence
  Synthetic oligonucleotide; TAG chr11 5395115 5395134 5395131 +
gcatctcaaatgctttggtc

SEQ ID NO: 28328 - DNA, 20 bp, Artificial Sequence
  Synthetic oligonucleotide; AGG chr11 5395116 5395135 5395132 +
catctcaaatgctttggtct

SEQ ID NO: 28329 - DNA, 20 bp, Artificial Sequence
  Synthetic oligonucleotide; GAG chr11 5395118 5395137 5395134 +
tctcaaatgctttggtctag

SEQ ID NO: 28330 - DNA, 20 bp, Artificial Sequence
  Synthetic oligonucleotide; AGG chr11 5395119 5395138 5395135 +
ctcaaatgctttggtctagg

SEQ ID NO: 28331 - DNA, 20 bp, Artificial Sequence
  Synthetic oligonucleotide; AAG chr11 5395148 5395167 5395164 +
atccctctttgacattcatc

SEQ ID NO: 28332 - DNA, 20 bp, Artificial Sequence
  Synthetic oligonucleotide; TAG chr11 5395163 5395182 5395179 +
tcatcaagtctgcgtccatc

SEQ ID NO: 28333 - DNA, 20 bp, Artificial Sequence
  Synthetic oligonucleotide; AGG chr11 5395164 5395183 5395180 +
catcaagtctgcgtccatct

SEQ ID NO: 28334 - DNA, 20 bp, Artificial Sequence
  Synthetic oligonucleotide; GGG chr11 5395165 5395184 5395181 +
atcaagtctgcgtccatcta

SEQ ID NO: 28335 - DNA, 20 bp, Artificial Sequence
  Synthetic oligonucleotide; GAG chr11 5395167 5395186 5395183 +
caagtctgcgtccatctagg

SEQ ID NO: 28336 - DNA, 20 bp, Artificial Sequence
  Synthetic oligonucleotide; GAG chr11 5395178 5395197 5395194 +
ccatctagggagattccttt

SEQ ID NO: 28337 - DNA, 20 bp, Artificial Sequence
  Synthetic oligonucleotide; AGG chr11 5395179 5395198 5395195 +
catctagggagattcctttg

SEQ ID NO: 28338 - DNA, 20 bp, Artificial Sequence
  Synthetic oligonucleotide; GGG chr11 5395180 5395199 5395196 +
atctagggagattcctttga

SEQ ID NO: 28339 - DNA, 20 bp, Artificial Sequence
  Synthetic oligonucleotide; AAG chr11 5395186 5395205 5395202 +
ggagattcctttgagggcca

SEQ ID NO: 28340 - DNA, 20 bp, Artificial Sequence
  Synthetic oligonucleotide; AAG chr11 5395193 5395212 5395209 +
cctttgagggccaaagaccc

SEQ ID NO: 28341 - DNA, 20 bp, Artificial Sequence
  Synthetic oligonucleotide; AGG chr11 5395194 5395213 5395210 +
ctttgagggccaaagaccca

SEQ ID NO: 28342 - DNA, 20 bp, Artificial Sequence
  Synthetic oligonucleotide; AAG chr11 5395197 5395216 5395213 +
tgagggccaaagacccaagg

SEQ ID NO: 28343 - DNA, 20 bp, Artificial Sequence
  Synthetic oligonucleotide; GAG chr11 5395199 5395218 5395215 +
agggccaaagacccaaggaa

SEQ ID NO: 28344 - DNA, 20 bp, Artificial Sequence
  Synthetic oligonucleotide; GAG chr11 5395201 5395220 5395217 +
ggccaaagacccaaggaaga

SEQ ID NO: 28345 - DNA, 20 bp, Artificial Sequence
  Synthetic oligonucleotide; CAG chr11 5395205 5395224 5395221 +
aaagacccaaggaagagaga

SEQ ID NO: 28346 - DNA, 20 bp, Artificial Sequence
  Synthetic oligonucleotide; AAG chr11 5395214 5395233 5395230 +
aggaagagagacagctttat

SEQ ID NO: 28347 - DNA, 20 bp, Artificial Sequence
  Synthetic oligonucleotide; CAG chr11 5395220 5395239 5395236 +
agagacagctttataagtgc

SEQ ID NO: 28348 - DNA, 20 bp, Artificial Sequence
  Synthetic oligonucleotide; CAG chr11 5395225 5395244 5395241 +
cagctttataagtgccagtg

SEQ ID NO: 28349 - DNA, 20 bp, Artificial Sequence
  Synthetic oligonucleotide; TAG chr11 5395234 5395253 5395250 +
aagtgccagtgcagcccacg

SEQ ID NO: 28350 - DNA, 20 bp, Artificial Sequence
  Synthetic oligonucleotide; CAG chr11 5395239 5395258 5395255 +
ccagtgcagcccacgtagaa

SEQ ID NO: 28351 - DNA, 20 bp, Artificial Sequence
  Synthetic oligonucleotide; GAG chr11 5395248 5395267 5395264 +
cccacgtagaacagcatcct

SEQ ID NO: 28352 - DNA, 20 bp, Artificial Sequence
  Synthetic oligonucleotide; TGG chr11 5395256 5395275 5395272 +
gaacagcatcctgagtcaaa

SEQ ID NO: 28353 - DNA, 20 bp, Artificial Sequence
  Synthetic oligonucleotide; AAG chr11 5395259 5395278 5395275 +
cagcatcctgagtcaaatgg

SEQ ID NO: 28354 - DNA, 20 bp, Artificial Sequence
  Synthetic oligonucleotide; TGG chr11 5395266 5395285 5395282 +
ctgagtcaaatggaagatgc

SEQ ID NO: 28355 - DNA, 20 bp, Artificial Sequence
  Synthetic oligonucleotide; TGG chr11 5395271 5395290 5395287 +
tcaaatggaagatgctggca

SEQ ID NO: 28356 - DNA, 20 bp, Artificial Sequence
  Synthetic oligonucleotide; GAG chr11 5395273 5395292 5395289 +
aaatggaagatgctggcatg

SEQ ID NO: 28357 - DNA, 20 bp, Artificial Sequence
  Synthetic oligonucleotide; TGG chr11 5395276 5395295 5395292 +
tggaagatgctggcatggag

SEQ ID NO: 28358 - DNA, 20 bp, Artificial Sequence
  Synthetic oligonucleotide; AAG chr11 5395279 5395298 5395295 +
aagatgctggcatggagtgg

SEQ ID NO: 28359 - DNA, 20 bp, Artificial Sequence
  Synthetic oligonucleotide; AGG chr11 5395280 5395299 5395296 +
agatgctggcatggagtgga

SEQ ID NO: 28360 - DNA, 20 bp, Artificial Sequence
  Synthetic oligonucleotide; GGG chr11 5395281 5395300 5395297 +
gatgctggcatggagtggaa

SEQ ID NO: 28361 - DNA, 20 bp, Artificial Sequence
  Synthetic oligonucleotide; GAG chr11 5395290 5395309 5395306 +
atggagtggaagggctgcat

SEQ ID NO: 28362 - DNA, 20 bp, Artificial Sequence
  Synthetic oligonucleotide; AAG chr11 5395294 5395313 5395310 +
agtggaagggctgcatgaga

SEQ ID NO: 28363 - DNA, 20 bp, Artificial Sequence
  Synthetic oligonucleotide; AAG chr11 5395297 5395316 5395313 +
ggaagggctgcatgagaaag

SEQ ID NO: 28364 - DNA, 20 bp, Artificial Sequence
  Synthetic oligonucleotide; CAG chr11 5395303 5395322 5395319 +
gctgcatgagaaagaagcta

SEQ ID NO: 28365 - DNA, 20 bp, Artificial Sequence
  Synthetic oligonucleotide; GAG chr11 5395305 5395324 5395321 +
tgcatgagaaagaagctaca

SEQ ID NO: 28366 - DNA, 20 bp, Artificial Sequence
  Synthetic oligonucleotide; AAG chr11 5395308 5395327 5395324 +
atgagaaagaagctacagag

SEQ ID NO: 28367 - DNA, 20 bp, Artificial Sequence
  Synthetic oligonucleotide; AAG chr11 5395312 5395331 5395328 +
gaaagaagctacagagaaga

SEQ ID NO: 28368 - DNA, 20 bp, Artificial Sequence
  Synthetic oligonucleotide; AGG chr11 5395313 5395332 5395329 +
aaagaagctacagagaagaa

SEQ ID NO: 28369 - DNA, 20 bp, Artificial Sequence
  Synthetic oligonucleotide; CAG chr11 5395318 5395337 5395334 +
agctacagagaagaaaggac

SEQ ID NO: 28370 - DNA, 20 bp, Artificial Sequence
  Synthetic oligonucleotide; AAG chr11 5395322 5395341 5395338 +
acagagaagaaaggaccagt

SEQ ID NO: 28371 - DNA, 20 bp, Artificial Sequence
  Synthetic oligonucleotide; AAG chr11 5395331 5395350 5395347 +
aaaggaccagtaagttgctg

SEQ ID NO: 28372 - DNA, 20 bp, Artificial Sequence
  Synthetic oligonucleotide; AGG chr11 5395332 5395351 5395348 +
aaggaccagtaagttgctga

SEQ ID NO: 28373 - DNA, 20 bp, Artificial Sequence
  Synthetic oligonucleotide; TGG chr11 5395347 5395366 5395363 +
gctgaaggtcctttgttttg

SEQ ID NO: 28374 - DNA, 20 bp, Artificial Sequence
  Synthetic oligonucleotide; AAG chr11 5395353 5395372 5395369 +
ggtcctttgttttgtggata

SEQ ID NO: 28375 - DNA, 20 bp, Artificial Sequence
  Synthetic oligonucleotide; AGG chr11 5395354 5395373 5395370 +
gtcctttgttttgtggataa

SEQ ID NO: 28376 - DNA, 20 bp, Artificial Sequence
  Synthetic oligonucleotide; AAG chr11 5395357 5395376 5395373 +
ctttgttttgtggataaagg

SEQ ID NO: 28377 - DNA, 20 bp, Artificial Sequence
  Synthetic oligonucleotide; TGG chr11 5395364 5395383 5395380 +
ttgtggataaaggaagtcat

SEQ ID NO: 28378 - DNA, 20 bp, Artificial Sequence
  Synthetic oligonucleotide; GAG chr11 5395366 5395385 5395382 +
gtggataaaggaagtcattg

SEQ ID NO: 28379 - DNA, 20 bp, Artificial Sequence
  Synthetic oligonucleotide; TAG chr11 5395392 5395411 5395408 +
cctctctaatatcccttatc

SEQ ID NO: 28380 - DNA, 20 bp, Artificial Sequence
  Synthetic oligonucleotide; CAG chr11 5395407 5395426 5395423 +
ttatctagcatgactatatg

SEQ ID NO: 28381 - DNA, 20 bp, Artificial Sequence
  Synthetic oligonucleotide; AGG chr11 5395408 5395427 5395424 +
tatctagcatgactatatgc

SEQ ID NO: 28382 - DNA, 20 bp, Artificial Sequence
  Synthetic oligonucleotide; GGG chr11 5395409 5395428 5395425 +
atctagcatgactatatgca

SEQ ID NO: 28383 - DNA, 20 bp, Artificial Sequence
  Synthetic oligonucleotide; TGG chr11 5395415 5395434 5395431 +
catgactatatgcagggtta

SEQ ID NO: 28384 - DNA, 20 bp, Artificial Sequence
  Synthetic oligonucleotide; TAG chr11 5395420 5395439 5395436 +
ctatatgcagggttatggaa

SEQ ID NO: 28385 - DNA, 20 bp, Artificial Sequence
  Synthetic oligonucleotide; AGG chr11 5395421 5395440 5395437 +
tatatgcagggttatggaat

SEQ ID NO: 28386 - DNA, 20 bp, Artificial Sequence
  Synthetic oligonucleotide; GGG chr11 5395422 5395441 5395438 +
atatgcagggttatggaata

SEQ ID NO: 28387 - DNA, 20 bp, Artificial Sequence
  Synthetic oligonucleotide; CAG chr11 5395425 5395444 5395441 +
tgcagggttatggaataggg

SEQ ID NO: 28388 - DNA, 20 bp, Artificial Sequence
  Synthetic oligonucleotide; CAG chr11 5395432 5395451 5395448 +
ttatggaatagggcagcttc

SEQ ID NO: 28389 - DNA, 20 bp, Artificial Sequence
  Synthetic oligonucleotide; AGG chr11 5395433 5395452 5395449 +
tatggaatagggcagcttcc

SEQ ID NO: 28390 - DNA, 20 bp, Artificial Sequence
  Synthetic oligonucleotide; AAG chr11 5395436 5395455 5395452 +
ggaatagggcagcttccagg

SEQ ID NO: 28391 - DNA, 20 bp, Artificial Sequence
  Synthetic oligonucleotide; TGG chr11 5395440 5395459 5395456 +
tagggcagcttccaggaaga

SEQ ID NO: 28392 - DNA, 20 bp, Artificial Sequence
  Synthetic oligonucleotide; TAG chr11 5395455 5395474 5395471 +
gaagatggccaatctgttgt

SEQ ID NO: 28393 - DNA, 20 bp, Artificial Sequence
  Synthetic oligonucleotide; AGG chr11 5395456 5395475 5395472 +
aagatggccaatctgttgtt

SEQ ID NO: 28394 - DNA, 20 bp, Artificial Sequence
  Synthetic oligonucleotide; GGG chr11 5395457 5395476 5395473 +
agatggccaatctgttgtta

SEQ ID NO: 28395 - DNA, 20 bp, Artificial Sequence
  Synthetic oligonucleotide; TGG chr11 5395495 5395514 5395511 +
atctcccgtgatgtttttga

SEQ ID NO: 28396 - DNA, 20 bp, Artificial Sequence
  Synthetic oligonucleotide; GGG chr11 5395496 5395515 5395512 +
tctcccgtgatgtttttgat

SEQ ID NO: 28397 - DNA, 20 bp, Artificial Sequence
  Synthetic oligonucleotide; GGG chr11 5395497 5395516 5395513 +
ctcccgtgatgtttttgatg

SEQ ID NO: 28398 - DNA, 20 bp, Artificial Sequence
  Synthetic oligonucleotide; AAG chr11 5395500 5395519 5395516 +
ccgtgatgtttttgatgggg

SEQ ID NO: 28399 - DNA, 20 bp, Artificial Sequence
  Synthetic oligonucleotide; CAG chr11 5395504 5395523 5395520 +
gatgtttttgatggggaaga

SEQ ID NO: 28400 - DNA, 20 bp, Artificial Sequence
  Synthetic oligonucleotide; TGG chr11 5395510 5395529 5395526 +
tttgatggggaagacagatc

SEQ ID NO: 28401 - DNA, 20 bp, Artificial Sequence
  Synthetic oligonucleotide; TGG chr11 5395522 5395541 5395538 +
gacagatctggacttgttac

SEQ ID NO: 28402 - DNA, 20 bp, Artificial Sequence
  Synthetic oligonucleotide; GGG chr11 5395523 5395542 5395539 +
acagatctggacttgttact

SEQ ID NO: 28403 - DNA, 20 bp, Artificial Sequence
  Synthetic oligonucleotide; TAG chr11 5395536 5395555 5395552 +
tgttactgggctatgccttg

SEQ ID NO: 28404 - DNA, 20 bp, Artificial Sequence
  Synthetic oligonucleotide; GAG chr11 5395538 5395557 5395554 +
ttactgggctatgccttgta

SEQ ID NO: 28405 - DNA, 20 bp, Artificial Sequence
  Synthetic oligonucleotide; CAG chr11 5395548 5395567 5395564 +
atgccttgtagagaatgata

SEQ ID NO: 28406 - DNA, 20 bp, Artificial Sequence
  Synthetic oligonucleotide; AGG chr11 5395549 5395568 5395565 +
tgccttgtagagaatgatac

SEQ ID NO: 28407 - DNA, 20 bp, Artificial Sequence
  Synthetic oligonucleotide; GGG chr11 5395550 5395569 5395566 +
gccttgtagagaatgataca

SEQ ID NO: 28408 - DNA, 20 bp, Artificial Sequence
  Synthetic oligonucleotide; TGG chr11 5395556 5395575 5395572 +
tagagaatgatacagggttg

SEQ ID NO: 28409 - DNA, 20 bp, Artificial Sequence
  Synthetic oligonucleotide; CAG chr11 5395559 5395578 5395575 +
agaatgatacagggttgtgg

SEQ ID NO: 28410 - DNA, 20 bp, Artificial Sequence
  Synthetic oligonucleotide; AGG chr11 5395560 5395579 5395576 +
gaatgatacagggttgtggc

SEQ ID NO: 28411 - DNA, 20 bp, Artificial Sequence
  Synthetic oligonucleotide; AAG chr11 5395564 5395583 5395580 +
gatacagggttgtggcaggc

SEQ ID NO: 28412 - DNA, 20 bp, Artificial Sequence
  Synthetic oligonucleotide; AGG chr11 5395565 5395584 5395581 +
atacagggttgtggcaggca

SEQ ID NO: 28413 - DNA, 20 bp, Artificial Sequence
  Synthetic oligonucleotide; CAG chr11 5395579 5395598 5395595 +
caggcaaggaaacataatct

SEQ ID NO: 28414 - DNA, 20 bp, Artificial Sequence
  Synthetic oligonucleotide; AAG chr11 5395600 5395619 5395616 +
agcaattgctccaattgatg

SEQ ID NO: 28415 - DNA, 20 bp, Artificial Sequence
  Synthetic oligonucleotide; CAG chr11 5395615 5395634 5395631 +
tgatgaagcttctaacattt

SEQ ID NO: 28416 - DNA, 20 bp, Artificial Sequence
  Synthetic oligonucleotide; GAG chr11 5395617 5395636 5395633 +
atgaagcttctaacatttca

SEQ ID NO: 28417 - DNA, 20 bp, Artificial Sequence
  Synthetic oligonucleotide; CAG chr11 5395632 5395651 5395648 +
tttcagagtgctttcctcca

SEQ ID NO: 28418 - DNA, 20 bp, Artificial Sequence
  Synthetic oligonucleotide; AAG chr11 5395664 5395683 5395680 +
acctaatcatttctctcgaa

SEQ ID NO: 28419 - DNA, 20 bp, Artificial Sequence
  Synthetic oligonucleotide; GAG chr11 5395666 5395685 5395682 +
ctaatcatttctctcgaaaa

SEQ ID NO: 28420 - DNA, 20 bp, Artificial Sequence
  Synthetic oligonucleotide; AGG chr11 5395667 5395686 5395683 +
taatcatttctctcgaaaag

SEQ ID NO: 28421 - DNA, 20 bp, Artificial Sequence
  Synthetic oligonucleotide; CAG chr11 5395670 5395689 5395686 +
tcatttctctcgaaaagagg

SEQ ID NO: 28422 - DNA, 20 bp, Artificial Sequence
  Synthetic oligonucleotide; AGG chr11 5395671 5395690 5395687 +
catttctctcgaaaagaggc

SEQ ID NO: 28423 - DNA, 20 bp, Artificial Sequence
  Synthetic oligonucleotide; GGG chr11 5395672 5395691 5395688 +
atttctctcgaaaagaggca

SEQ ID NO: 28424 - DNA, 20 bp, Artificial Sequence
  Synthetic oligonucleotide; TGG chr11 5395681 5395700 5395697 +
gaaaagaggcagggcccatg

SEQ ID NO: 28425 - DNA, 20 bp, Artificial Sequence
  Synthetic oligonucleotide; TAG chr11 5395697 5395716 5395713 +
catgtggaaatctttcaaca

SEQ ID NO: 28426 - DNA, 20 bp, Artificial Sequence
  Synthetic oligonucleotide; AAG chr11 5395705 5395724 5395721 +
aatctttcaacatagtaaaa

SEQ ID NO: 28427 - DNA, 20 bp, Artificial Sequence
  Synthetic oligonucleotide; AAG chr11 5395710 5395729 5395726 +
ttcaacatagtaaaaaagct

SEQ ID NO: 28428 - DNA, 20 bp, Artificial Sequence
  Synthetic oligonucleotide; AGG chr11 5395711 5395730 5395727 +
tcaacatagtaaaaaagcta

SEQ ID NO: 28429 - DNA, 20 bp, Artificial Sequence
  Synthetic oligonucleotide; TAG chr11 5395716 5395735 5395732 +
atagtaaaaaagctaaggtt

SEQ ID NO: 28430 - DNA, 20 bp, Artificial Sequence
  Synthetic oligonucleotide; AAG chr11 5395720 5395739 5395736 +
taaaaaagctaaggtttaga

SEQ ID NO: 28431 - DNA, 20 bp, Artificial Sequence
  Synthetic oligonucleotide; CAG chr11 5395726 5395745 5395742 +
agctaaggtttagaaagatt

SEQ ID NO: 28432 - DNA, 20 bp, Artificial Sequence
  Synthetic oligonucleotide; AAG chr11 5395740 5395759 5395756 +
aagattcagtaactttgcca

SEQ ID NO: 28433 - DNA, 20 bp, Artificial Sequence
  Synthetic oligonucleotide; TGG chr11 5395748 5395767 5395764 +
gtaactttgccaaagccata

SEQ ID NO: 28434 - DNA, 20 bp, Artificial Sequence
  Synthetic oligonucleotide; AAG chr11 5395751 5395770 5395767 +
actttgccaaagccatatgg

SEQ ID NO: 28435 - DNA, 20 bp, Artificial Sequence
  Synthetic oligonucleotide; AGG chr11 5395752 5395771 5395768 +
ctttgccaaagccatatgga

SEQ ID NO: 28436 - DNA, 20 bp, Artificial Sequence
  Synthetic oligonucleotide; AAG chr11 5395774 5395793 5395790 +
gattgtccaaaaacctgtgc

SEQ ID NO: 28437 - DNA, 20 bp, Artificial Sequence
  Synthetic oligonucleotide; GAG chr11 5395776 5395795 5395792 +
ttgtccaaaaacctgtgcaa

SEQ ID NO: 28438 - DNA, 20 bp, Artificial Sequence
  Synthetic oligonucleotide; TGG chr11 5395783 5395802 5395799 +
aaaacctgtgcaagagctca

SEQ ID NO: 28439 - DNA, 20 bp, Artificial Sequence
  Synthetic oligonucleotide; CAG chr11 5395821 5395840 5395837 +
accttacgcttcattgttgt

SEQ ID NO: 28440 - DNA, 20 bp, Artificial Sequence
  Synthetic oligonucleotide; TAG chr11 5395844 5395863 5395860 +
attatttttcaatcttttct

SEQ ID NO: 28441 - DNA, 20 bp, Artificial Sequence
  Synthetic oligonucleotide; GAG chr11 5395846 5395865 5395862 +
tatttttcaatcttttctta

SEQ ID NO: 28442 - DNA, 20 bp, Artificial Sequence
  Synthetic oligonucleotide; TGG chr11 5395869 5395888 5395885 +
ctcactgcaacattgctcac

SEQ ID NO: 28443 - DNA, 20 bp, Artificial Sequence
  Synthetic oligonucleotide; TGG chr11 5395877 5395896 5395893 +
aacattgctcactggaatgc

SEQ ID NO: 28444 - DNA, 20 bp, Artificial Sequence
  Synthetic oligonucleotide; AAG chr11 5395881 5395900 5395897 +
ttgctcactggaatgctgga

SEQ ID NO: 28445 - DNA, 20 bp, Artificial Sequence
  Synthetic oligonucleotide; GAG chr11 5395908 5395927 5395924 +
actaataaaatgtgtctatt

SEQ ID NO: 28446 - DNA, 20 bp, Artificial Sequence
  Synthetic oligonucleotide; TGG chr11 5395952 5395971 5395968 +
catttaaaattgcatatgaa

SEQ ID NO: 28447 - DNA, 20 bp, Artificial Sequence
  Synthetic oligonucleotide; TGG chr11 5395967 5395986 5395983 +
atgaatggctctctaatcta

SEQ ID NO: 28448 - DNA, 20 bp, Artificial Sequence
  Synthetic oligonucleotide; GAG chr11 5395969 5395988 5395985 +
gaatggctctctaatctatg

SEQ ID NO: 28449 - DNA, 20 bp, Artificial Sequence
  Synthetic oligonucleotide; TAG chr11 5395972 5395991 5395988 +
tggctctctaatctatggag

SEQ ID NO: 28450 - DNA, 20 bp, Artificial Sequence
  Synthetic oligonucleotide; AGG chr11 5395973 5395992 5395989 +
ggctctctaatctatggagt

SEQ ID NO: 28451 - DNA, 20 bp, Artificial Sequence
  Synthetic oligonucleotide; TAG chr11 5395976 5395995 5395992 +
tctctaatctatggagtagg

SEQ ID NO: 28452 - DNA, 20 bp, Artificial Sequence
  Synthetic oligonucleotide; CAG chr11 5395995 5396014 5396011 +
gtagaattgtctcaattttt

SEQ ID NO: 28453 - DNA, 20 bp, Artificial Sequence
  Synthetic oligonucleotide; AAG chr11 5396001 5396020 5396017 +
ttgtctcaatttttcagatg

SEQ ID NO: 28454 - DNA, 20 bp, Artificial Sequence
  Synthetic oligonucleotide; AAG chr11 5396009 5396028 5396025 +
atttttcagatgaagaaact

SEQ ID NO: 28455 - DNA, 20 bp, Artificial Sequence
  Synthetic oligonucleotide; CAG chr11 5396018 5396037 5396034 +
atgaagaaactaagattaat

SEQ ID NO: 28456 - DNA, 20 bp, Artificial Sequence
  Synthetic oligonucleotide; TAG chr11 5396037 5396056 5396053 +
tcagatactttgcacaatca

SEQ ID NO: 28457 - DNA, 20 bp, Artificial Sequence
  Synthetic oligonucleotide; GAG chr11 5396039 5396058 5396055 +
agatactttgcacaatcata

SEQ ID NO: 28458 - DNA, 20 bp, Artificial Sequence
  Synthetic oligonucleotide; AAG chr11 5396044 5396063 5396060 +
ctttgcacaatcatagagtg

SEQ ID NO: 28459 - DNA, 20 bp, Artificial Sequence
  Synthetic oligonucleotide; GAG chr11 5396046 5396065 5396062 +
ttgcacaatcatagagtgaa

SEQ ID NO: 28460 - DNA, 20 bp, Artificial Sequence
  Synthetic oligonucleotide; AAG chr11 5396055 5396074 5396071 +
catagagtgaagagctattg

SEQ ID NO: 28461 - DNA, 20 bp, Artificial Sequence
  Synthetic oligonucleotide; CAG chr11 5396072 5396091 5396088 +
ttgaagttatgattgtaata

SEQ ID NO: 28462 - DNA, 20 bp, Artificial Sequence
  Synthetic oligonucleotide; TGG chr11 5396078 5396097 5396094 +
ttatgattgtaatacagatc

SEQ ID NO: 28463 - DNA, 20 bp, Artificial Sequence
  Synthetic oligonucleotide; CAG chr11 5396084 5396103 5396100 +
ttgtaatacagatctggtcc

SEQ ID NO: 28464 - DNA, 20 bp, Artificial Sequence
  Synthetic oligonucleotide; GAG chr11 5396086 5396105 5396102 +
gtaatacagatctggtccca

SEQ ID NO: 28465 - DNA, 20 bp, Artificial Sequence
  Synthetic oligonucleotide; TAG chr11 5396132 5396151 5396148 +
ctgcctaatgaaaatgtgcc

SEQ ID NO: 28466 - DNA, 20 bp, Artificial Sequence
  Synthetic oligonucleotide; AGG chr11 5396133 5396152 5396149 +
tgcctaatgaaaatgtgcct

SEQ ID NO: 28467 - DNA, 20 bp, Artificial Sequence
  Synthetic oligonucleotide; AAG chr11 5396140 5396159 5396156 +
tgaaaatgtgcctaggctgc

SEQ ID NO: 28468 - DNA, 20 bp, Artificial Sequence
  Synthetic oligonucleotide; CAG chr11 5396144 5396163 5396160 +
aatgtgcctaggctgcaaga

SEQ ID NO: 28469 - DNA, 20 bp, Artificial Sequence
  Synthetic oligonucleotide; AGG chr11 5396145 5396164 5396161 +
atgtgcctaggctgcaagac

SEQ ID NO: 28470 - DNA, 20 bp, Artificial Sequence
  Synthetic oligonucleotide; GGG chr11 5396146 5396165 5396162 +
tgtgcctaggctgcaagaca

SEQ ID NO: 28471 - DNA, 20 bp, Artificial Sequence
  Synthetic oligonucleotide; TAG chr11 5396178 5396197 5396194 +
ctcaccactcctattcaaca

SEQ ID NO: 28472 - DNA, 20 bp, Artificial Sequence
  Synthetic oligonucleotide; TGG chr11 5396184 5396203 5396200 +
actcctattcaacatagtgt

SEQ ID NO: 28473 - DNA, 20 bp, Artificial Sequence
  Synthetic oligonucleotide; AAG chr11 5396187 5396206 5396203 +
cctattcaacatagtgttgg

SEQ ID NO: 28474 - DNA, 20 bp, Artificial Sequence
  Synthetic oligonucleotide; TGG chr11 5396193 5396212 5396209 +
caacatagtgttggaagttc

SEQ ID NO: 28475 - DNA, 20 bp, Artificial Sequence
  Synthetic oligonucleotide; CGG chr11 5396198 5396217 5396214 +
tagtgttggaagttctggcc

SEQ ID NO: 28476 - DNA, 20 bp, Artificial Sequence
  Synthetic oligonucleotide; GGG chr11 5396199 5396218 5396215 +
agtgttggaagttctggccc

SEQ ID NO: 28477 - DNA, 20 bp, Artificial Sequence
  Synthetic oligonucleotide; CGG chr11 5396206 5396225 5396222 +
gaagttctggcccgggcaat

SEQ ID NO: 28478 - DNA, 20 bp, Artificial Sequence
  Synthetic oligonucleotide; GGG chr11 5396207 5396226 5396223 +
aagttctggcccgggcaatc

SEQ ID NO: 28479 - DNA, 20 bp, Artificial Sequence
  Synthetic oligonucleotide; CAG chr11 5396210 5396229 5396226 +
ttctggcccgggcaatcggg

SEQ ID NO: 28480 - DNA, 20 bp, Artificial Sequence
  Synthetic oligonucleotide; AGG chr11 5396211 5396230 5396227 +
tctggcccgggcaatcgggc

SEQ ID NO: 28481 - DNA, 20 bp, Artificial Sequence
  Synthetic oligonucleotide; GAG chr11 5396213 5396232 5396229 +
tggcccgggcaatcgggcag

SEQ ID NO: 28482 - DNA, 20 bp, Artificial Sequence
  Synthetic oligonucleotide; AAG chr11 5396216 5396235 5396232 +
cccgggcaatcgggcaggag

SEQ ID NO: 28483 - DNA, 20 bp, Artificial Sequence
  Synthetic oligonucleotide; AGG chr11 5396217 5396236 5396233 +
ccgggcaatcgggcaggaga

SEQ ID NO: 28484 - DNA, 20 bp, Artificial Sequence
  Synthetic oligonucleotide; AAG chr11 5396226 5396245 5396242 +
cgggcaggagaaggaaataa

SEQ ID NO: 28485 - DNA, 20 bp, Artificial Sequence
  Synthetic oligonucleotide; AGG chr11 5396227 5396246 5396243 +
gggcaggagaaggaaataaa

SEQ ID NO: 28486 - DNA, 20 bp, Artificial Sequence
  Synthetic oligonucleotide; AAG chr11 5396244 5396263 5396260 +
aaaaggcattcaattatgta

SEQ ID NO: 28487 - DNA, 20 bp, Artificial Sequence
  Synthetic oligonucleotide; GAG chr11 5396246 5396265 5396262 +
aaggcattcaattatgtaaa

SEQ ID NO: 28488 - DNA, 20 bp, Artificial Sequence
  Synthetic oligonucleotide; AAG chr11 5396250 5396269 5396266 +
cattcaattatgtaaagaga

SEQ ID NO: 28489 - DNA, 20 bp, Artificial Sequence
  Synthetic oligonucleotide; CAG chr11 5396271 5396290 5396287 +
agtcaaattgtccctgtttg

SEQ ID NO: 28490 - DNA, 20 bp, Artificial Sequence
  Synthetic oligonucleotide; TAG chr11 5396292 5396311 5396308 +
agatgacgtgattgcatatc

SEQ ID NO: 28491 - DNA, 20 bp, Artificial Sequence
  Synthetic oligonucleotide; CAG chr11 5396310 5396329 5396326 +
tctagaaaaccccattgtct

SEQ ID NO: 28492 - DNA, 20 bp, Artificial Sequence
  Synthetic oligonucleotide; AAG chr11 5396327 5396346 5396343 +
tctcagcccaaaatcccctt

SEQ ID NO: 28493 - DNA, 20 bp, Artificial Sequence
  Synthetic oligonucleotide; AAG chr11 5396335 5396354 5396351 +
caaaatccccttaagctgat

SEQ ID NO: 28494 - DNA, 20 bp, Artificial Sequence
  Synthetic oligonucleotide; CAG chr11 5396344 5396363 5396360 +
cttaagctgataagcaactt

SEQ ID NO: 28495 - DNA, 20 bp, Artificial Sequence
  Synthetic oligonucleotide; AAG chr11 5396349 5396368 5396365 +
gctgataagcaacttcagca

SEQ ID NO: 28496 - DNA, 20 bp, Artificial Sequence
  Synthetic oligonucleotide; CAG chr11 5396355 5396374 5396371 +
aagcaacttcagcaaagtct

SEQ ID NO: 28497 - DNA, 20 bp, Artificial Sequence
  Synthetic oligonucleotide; AGG chr11 5396356 5396375 5396372 +
agcaacttcagcaaagtctc

SEQ ID NO: 28498 - DNA, 20 bp, Artificial Sequence
  Synthetic oligonucleotide; AAG chr11 5396385 5396404 5396401 +
aatcaatgtgcaaaaatcac

SEQ ID NO: 28499 - DNA, 20 bp, Artificial Sequence
  Synthetic oligonucleotide; CAG chr11 5396407 5396426 5396423 +
gcattcttatacaccaataa

SEQ ID NO: 28500 - DNA, 20 bp, Artificial Sequence
  Synthetic oligonucleotide; CAG chr11 5396415 5396434 5396431 +
atacaccaataacagacaaa

SEQ ID NO: 28501 - DNA, 20 bp, Artificial Sequence
  Synthetic oligonucleotide; GAG chr11 5396419 5396438 5396435 +
accaataacagacaaacagt

SEQ ID NO: 28502 - DNA, 20 bp, Artificial Sequence
  Synthetic oligonucleotide; CAG chr11 5396445 5396464 5396461 +
actcccattcacaattgctt

SEQ ID NO: 28503 - DNA, 20 bp, Artificial Sequence
  Synthetic oligonucleotide; GAG chr11 5396447 5396466 5396463 +
tcccattcacaattgcttca

SEQ ID NO: 28504 - DNA, 20 bp, Artificial Sequence
  Synthetic oligonucleotide; GAG chr11 5396449 5396468 5396465 +
ccattcacaattgcttcaga

SEQ ID NO: 28505 - DNA, 20 bp, Artificial Sequence
  Synthetic oligonucleotide; TAG chr11 5396463 5396482 5396479 +
ttcagagagaatataatacc

SEQ ID NO: 28506 - DNA, 20 bp, Artificial Sequence
  Synthetic oligonucleotide; AGG chr11 5396464 5396483 5396480 +
tcagagagaatataatacct

SEQ ID NO: 28507 - DNA, 20 bp, Artificial Sequence
  Synthetic oligonucleotide; AAG chr11 5396479 5396498 5396495 +
tacctaggaatccaacttac

SEQ ID NO: 28508 - DNA, 20 bp, Artificial Sequence
  Synthetic oligonucleotide; AGG chr11 5396480 5396499 5396496 +
acctaggaatccaacttaca

SEQ ID NO: 28509 - DNA, 20 bp, Artificial Sequence
  Synthetic oligonucleotide; GGG chr11 5396481 5396500 5396497 +
cctaggaatccaacttacaa

SEQ ID NO: 28510 - DNA, 20 bp, Artificial Sequence
  Synthetic oligonucleotide; AAG chr11 5396489 5396508 5396505 +
tccaacttacaagggatgtg

SEQ ID NO: 28511 - DNA, 20 bp, Artificial Sequence
  Synthetic oligonucleotide; AGG chr11 5396490 5396509 5396506 +
ccaacttacaagggatgtga

SEQ ID NO: 28512 - DNA, 20 bp, Artificial Sequence
  Synthetic oligonucleotide; AAG chr11 5396501 5396520 5396517 +
gggatgtgaaggacctcttc

SEQ ID NO: 28513 - DNA, 20 bp, Artificial Sequence
  Synthetic oligonucleotide; AGG chr11 5396502 5396521 5396518 +
ggatgtgaaggacctcttca

SEQ ID NO: 28514 - DNA, 20 bp, Artificial Sequence
  Synthetic oligonucleotide; GAG chr11 5396504 5396523 5396520 +
atgtgaaggacctcttcaag

SEQ ID NO: 28515 - DNA, 20 bp, Artificial Sequence
  Synthetic oligonucleotide; AAG chr11 5396525 5396544 5396541 +
agaactacaaaccactgctc

SEQ ID NO: 28516 - DNA, 20 bp, Artificial Sequence
  Synthetic oligonucleotide; AGG chr11 5396526 5396545 5396542 +
gaactacaaaccactgctca

SEQ ID NO: 28517 - DNA, 20 bp, Artificial Sequence
  Synthetic oligonucleotide; AAG chr11 5396533 5396552 5396549 +
aaaccactgctcaaggaaat

SEQ ID NO: 28518 - DNA, 20 bp, Artificial Sequence
  Synthetic oligonucleotide; TGG chr11 5396547 5396566 5396563 +
ggaaataagatacaaacaaa

SEQ ID NO: 28519 - DNA, 20 bp, Artificial Sequence
  Synthetic oligonucleotide; AAG chr11 5396550 5396569 5396566 +
aataagatacaaacaaatgg

SEQ ID NO: 28520 - DNA, 20 bp, Artificial Sequence
  Synthetic oligonucleotide; TGG chr11 5396568 5396587 5396584 +
ggaagaacattccatgctca

SEQ ID NO: 28521 - DNA, 20 bp, Artificial Sequence
  Synthetic oligonucleotide; TAG chr11 5396572 5396591 5396588 +
gaacattccatgctcatgga

SEQ ID NO: 28522 - DNA, 20 bp, Artificial Sequence
  Synthetic oligonucleotide; AGG chr11 5396573 5396592 5396589 +
aacattccatgctcatggat

SEQ ID NO: 28523 - DNA, 20 bp, Artificial Sequence
  Synthetic oligonucleotide; AAG chr11 5396576 5396595 5396592 +
attccatgctcatggatagg

SEQ ID NO: 28524 - DNA, 20 bp, Artificial Sequence
  Synthetic oligonucleotide; TGG chr11 5396596 5396615 5396612 +
aagaaacaatatcgtgaaaa

SEQ ID NO: 28525 - DNA, 20 bp, Artificial Sequence
  Synthetic oligonucleotide; AAG chr11 5396610 5396629 5396626 +
tgaaaatggccatactgccc

SEQ ID NO: 28526 - DNA, 20 bp, Artificial Sequence
  Synthetic oligonucleotide; AGG chr11 5396611 5396630 5396627 +
gaaaatggccatactgccca

SEQ ID NO: 28527 - DNA, 20 bp, Artificial Sequence
  Synthetic oligonucleotide; TAG chr11 5396621 5396640 5396637 +
atactgcccaaggtaattta

SEQ ID NO: 28528 - DNA, 20 bp, Artificial Sequence
  Synthetic oligonucleotide; AAG chr11 5396643 5396662 5396659 +
gattcaatgccatccccatc

SEQ ID NO: 28529 - DNA, 20 bp, Artificial Sequence
  Synthetic oligonucleotide; CAG chr11 5396665 5396684 5396681 +
gctaccaatgactttcttca

SEQ ID NO: 28530 - DNA, 20 bp, Artificial Sequence
  Synthetic oligonucleotide; TGG chr11 5396671 5396690 5396687 +
aatgactttcttcacagaat

SEQ ID NO: 28531 - DNA, 20 bp, Artificial Sequence
  Synthetic oligonucleotide; AAG chr11 5396688 5396707 5396704 +
aattggaaaaaactacttta

SEQ ID NO: 28532 - DNA, 20 bp, Artificial Sequence
  Synthetic oligonucleotide; TGG chr11 5396697 5396716 5396713 +
aaactactttaaagttcata

SEQ ID NO: 28533 - DNA, 20 bp, Artificial Sequence
  Synthetic oligonucleotide; AAG chr11 5396708 5396727 5396724 +
aagttcatatggaaccaaaa

SEQ ID NO: 28534 - DNA, 20 bp, Artificial Sequence
  Synthetic oligonucleotide; GAG chr11 5396710 5396729 5396726 +
gttcatatggaaccaaaaaa

SEQ ID NO: 28535 - DNA, 20 bp, Artificial Sequence
  Synthetic oligonucleotide; AAG chr11 5396724 5396743 5396740 +
aaaaaagagcccgcatcgcc

SEQ ID NO: 28536 - DNA, 20 bp, Artificial Sequence
  Synthetic oligonucleotide; AAG chr11 5396735 5396754 5396751 +
cgcatcgccaagtcaatcct

SEQ ID NO: 28537 - DNA, 20 bp, Artificial Sequence
  Synthetic oligonucleotide; AAG chr11 5396742 5396761 5396758 +
ccaagtcaatcctaagccaa

SEQ ID NO: 28538 - DNA, 20 bp, Artificial Sequence
  Synthetic oligonucleotide; AAG chr11 5396749 5396768 5396765 +
aatcctaagccaaaagaaca

SEQ ID NO: 28539 - DNA, 20 bp, Artificial Sequence
  Synthetic oligonucleotide; TGG chr11 5396753 5396772 5396769 +
ctaagccaaaagaacaaagc

SEQ ID NO: 28540 - DNA, 20 bp, Artificial Sequence
  Synthetic oligonucleotide; GAG chr11 5396755 5396774 5396771 +
aagccaaaagaacaaagctg

SEQ ID NO: 28541 - DNA, 20 bp, Artificial Sequence
  Synthetic oligonucleotide; AGG chr11 5396756 5396775 5396772 +
agccaaaagaacaaagctgg

SEQ ID NO: 28542 - DNA, 20 bp, Artificial Sequence
  Synthetic oligonucleotide; AAG chr11 5396790 5396809 5396806 +
ctgatttcaaactatactac

SEQ ID NO: 28543 - DNA, 20 bp, Artificial Sequence
  Synthetic oligonucleotide; AGG chr11 5396791 5396810 5396807 +
tgatttcaaactatactaca

SEQ ID NO: 28544 - DNA, 20 bp, Artificial Sequence
  Synthetic oligonucleotide; CAG chr11 5396797 5396816 5396813 +
caaactatactacaaggcta

SEQ ID NO: 28545 - DNA, 20 bp, Artificial Sequence
  Synthetic oligonucleotide; CAG chr11 5396809 5396828 5396825 +
caaggctacagtaaccaaaa

SEQ ID NO: 28546 - DNA, 20 bp, Artificial Sequence
  Synthetic oligonucleotide; TAG chr11 5396814 5396833 5396830 +
ctacagtaaccaaaacagca

SEQ ID NO: 28547 - DNA, 20 bp, Artificial Sequence
  Synthetic oligonucleotide; TGG chr11 5396820 5396839 5396836 +
taaccaaaacagcatagtac

SEQ ID NO: 28548 - DNA, 20 bp, Artificial Sequence
  Synthetic oligonucleotide; CAG chr11 5396831 5396850 5396847 +
gcatagtactggtaccaaaa

SEQ ID NO: 28549 - DNA, 20 bp, Artificial Sequence
  Synthetic oligonucleotide; GAG chr11 5396833 5396852 5396849 +
atagtactggtaccaaaaca

SEQ ID NO: 28550 - DNA, 20 bp, Artificial Sequence
  Synthetic oligonucleotide; TAG chr11 5396839 5396858 5396855 +
ctggtaccaaaacagagata

SEQ ID NO: 28551 - DNA, 20 bp, Artificial Sequence
  Synthetic oligonucleotide; TGG chr11 5396847 5396866 5396863 +
aaaacagagatatagaccaa

SEQ ID NO: 28552 - DNA, 20 bp, Artificial Sequence
  Synthetic oligonucleotide; CAG chr11 5396857 5396876 5396873 +
tatagaccaatggaacaaaa

SEQ ID NO: 28553 - DNA, 20 bp, Artificial Sequence
  Synthetic oligonucleotide; GAG chr11 5396859 5396878 5396875 +
tagaccaatggaacaaaaca

SEQ ID NO: 28554 - DNA, 20 bp, Artificial Sequence
  Synthetic oligonucleotide; CAG chr11 5396866 5396885 5396882 +
atggaacaaaacagagccct

SEQ ID NO: 28555 - DNA, 20 bp, Artificial Sequence
  Synthetic oligonucleotide; GAG chr11 5396913 5396932 5396929 +
atctgatctttgacaaacct

SEQ ID NO: 28556 - DNA, 20 bp, Artificial Sequence
  Synthetic oligonucleotide; AAG chr11 5396922 5396941 5396938 +
ttgacaaacctgagaaaaac

SEQ ID NO: 28557 - DNA, 20 bp, Artificial Sequence
  Synthetic oligonucleotide; TGG chr11 5396928 5396947 5396944 +
aacctgagaaaaacaagaaa

SEQ ID NO: 28558 - DNA, 20 bp, Artificial Sequence
  Synthetic oligonucleotide; GGG chr11 5396929 5396948 5396945 +
acctgagaaaaacaagaaat

SEQ ID NO: 28559 - DNA, 20 bp, Artificial Sequence
  Synthetic oligonucleotide; GGG chr11 5396930 5396949 5396946 +
cctgagaaaaacaagaaatg

SEQ ID NO: 28560 - DNA, 20 bp, Artificial Sequence
  Synthetic oligonucleotide; AAG chr11 5396934 5396953 5396950 +
agaaaaacaagaaatgggga

SEQ ID NO: 28561 - DNA, 20 bp, Artificial Sequence
  Synthetic oligonucleotide; AGG chr11 5396935 5396954 5396951 +
gaaaaacaagaaatggggaa

SEQ ID NO: 28562 - DNA, 20 bp, Artificial Sequence
  Synthetic oligonucleotide; TGG chr11 5396955 5396974 5396971 +
aggattccctgtttaataaa

SEQ ID NO: 28563 - DNA, 20 bp, Artificial Sequence
  Synthetic oligonucleotide; TGG chr11 5396961 5396980 5396977 +
ccctgtttaataaatggtgc

SEQ ID NO: 28564 - DNA, 20 bp, Artificial Sequence
  Synthetic oligonucleotide; GGG chr11 5396962 5396981 5396978 +
cctgtttaataaatggtgct

SEQ ID NO: 28565 - DNA, 20 bp, Artificial Sequence
  Synthetic oligonucleotide; TGG chr11 5396970 5396989 5396986 +
ataaatggtgctgggaaaac

SEQ ID NO: 28566 - DNA, 20 bp, Artificial Sequence
  Synthetic oligonucleotide; TAG chr11 5396974 5396993 5396990 +
atggtgctgggaaaactggc

SEQ ID NO: 28567 - DNA, 20 bp, Artificial Sequence
  Synthetic oligonucleotide; TAG chr11 5396984 5397003 5397000 +
gaaaactggctagccaaatg

SEQ ID NO: 28568 - DNA, 20 bp, Artificial Sequence
  Synthetic oligonucleotide; AGG chr11 5396985 5397004 5397001 +
aaaactggctagccaaatgt

SEQ ID NO: 28569 - DNA, 20 bp, Artificial Sequence
  Synthetic oligonucleotide; AAG chr11 5396988 5397007 5397004 +
actggctagccaaatgtagg

SEQ ID NO: 28570 - DNA, 20 bp, Artificial Sequence
  Synthetic oligonucleotide; TGG chr11 5396998 5397017 5397014 +
caaatgtaggaagctgaaac

SEQ ID NO: 28571 - DNA, 20 bp, Artificial Sequence
  Synthetic oligonucleotide; AAG chr11 5397035 5397054 5397051 +
ccttatacaaaaattaactc

SEQ ID NO: 28572 - DNA, 20 bp, Artificial Sequence
  Synthetic oligonucleotide; TGG chr11 5397039 5397058 5397055 +
atacaaaaattaactcaaga

SEQ ID NO: 28573 - DNA, 20 bp, Artificial Sequence
  Synthetic oligonucleotide; AAG chr11 5397046 5397065 5397062 +
aattaactcaagatggatta

SEQ ID NO: 28574 - DNA, 20 bp, Artificial Sequence
  Synthetic oligonucleotide; TAG chr11 5397059 5397078 5397075 +
tggattaaagacttaaatgt

SEQ ID NO: 28575 - DNA, 20 bp, Artificial Sequence
  Synthetic oligonucleotide; TAG chr11 5397082 5397101 5397098 +
acctaaaaccataaaaactc

SEQ ID NO: 28576 - DNA, 20 bp, Artificial Sequence
  Synthetic oligonucleotide; AAG chr11 5397085 5397104 5397101 +
taaaaccataaaaactctag

SEQ ID NO: 28577 - DNA, 20 bp, Artificial Sequence
  Synthetic oligonucleotide; AAG chr11 5397095 5397114 5397111 +
aaaactctagaagaaaacct

SEQ ID NO: 28578 - DNA, 20 bp, Artificial Sequence
  Synthetic oligonucleotide; CAG chr11 5397108 5397127 5397124 +
aaaacctaagcaataccatt

SEQ ID NO: 28579 - DNA, 20 bp, Artificial Sequence
  Synthetic oligonucleotide; AGG chr11 5397109 5397128 5397125 +
aaacctaagcaataccattc

SEQ ID NO: 28580 - DNA, 20 bp, Artificial Sequence
  Synthetic oligonucleotide; TAG chr11 5397115 5397134 5397131 +
aagcaataccattcaggaca

SEQ ID NO: 28581 - DNA, 20 bp, Artificial Sequence
  Synthetic oligonucleotide; AGG chr11 5397116 5397135 5397132 +
agcaataccattcaggacat

SEQ ID NO: 28582 - DNA, 20 bp, Artificial Sequence
  Synthetic oligonucleotide; TGG chr11 5397121 5397140 5397137 +
taccattcaggacataggca

SEQ ID NO: 28583 - DNA, 20 bp, Artificial Sequence
  Synthetic oligonucleotide; GGG chr11 5397122 5397141 5397138 +
accattcaggacataggcat

SEQ ID NO: 28584 - DNA, 20 bp, Artificial Sequence
  Synthetic oligonucleotide; TGG chr11 5397127 5397146 5397143 +
tcaggacataggcatgggca

SEQ ID NO: 28585 - DNA, 20 bp, Artificial Sequence
  Synthetic oligonucleotide; AAG chr11 5397151 5397170 5397167 +
cttcatgtctaaaacaccaa

SEQ ID NO: 28586 - DNA, 20 bp, Artificial Sequence
  Synthetic oligonucleotide; TGG chr11 5397157 5397176 5397173 +
gtctaaaacaccaaaagcaa

SEQ ID NO: 28587 - DNA, 20 bp, Artificial Sequence
  Synthetic oligonucleotide; AAG chr11 5397166 5397185 5397182 +
accaaaagcaatggcaacaa

SEQ ID NO: 28588 - DNA, 20 bp, Artificial Sequence
  Synthetic oligonucleotide; TGG chr11 5397183 5397202 5397199 +
caaaagccaaaattcactaa

SEQ ID NO: 28589 - DNA, 20 bp, Artificial Sequence
  Synthetic oligonucleotide; GGG chr11 5397184 5397203 5397200 +
aaaagccaaaattcactaat

SEQ ID NO: 28590 - DNA, 20 bp, Artificial Sequence
  Synthetic oligonucleotide; AAG chr11 5397201 5397220 5397217 +
aatgggatctaattaaacta

SEQ ID NO: 28591 - DNA, 20 bp, Artificial Sequence
  Synthetic oligonucleotide; CAG chr11 5397214 5397233 5397230 +
taaactaaagatcttctgca

SEQ ID NO: 28592 - DNA, 20 bp, Artificial Sequence
  Synthetic oligonucleotide; AAG chr11 5397220 5397239 5397236 +
aaagatcttctgcacagcaa

SEQ ID NO: 28593 - DNA, 20 bp, Artificial Sequence
  Synthetic oligonucleotide; CAG chr11 5397233 5397252 5397249 +
acagcaaaagaaactaccat

SEQ ID NO: 28594 - DNA, 20 bp, Artificial Sequence
  Synthetic oligonucleotide; GAG chr11 5397235 5397254 5397251 +
agcaaaagaaactaccatca

SEQ ID NO: 28595 - DNA, 20 bp, Artificial Sequence
  Synthetic oligonucleotide; CAG chr11 5397242 5397261 5397258 +
gaaactaccatcagagtgaa

SEQ ID NO: 28596 - DNA, 20 bp, Artificial Sequence
  Synthetic oligonucleotide; AGG chr11 5397243 5397262 5397259 +
aaactaccatcagagtgaac

SEQ ID NO: 28597 - DNA, 20 bp, Artificial Sequence
  Synthetic oligonucleotide; TGG chr11 5397258 5397277 5397274 +
tgaacaggcaacctacacaa

SEQ ID NO: 28598 - DNA, 20 bp, Artificial Sequence
  Synthetic oligonucleotide; GGG chr11 5397259 5397278 5397275 +
gaacaggcaacctacacaat

SEQ ID NO: 28599 - DNA, 20 bp, Artificial Sequence
  Synthetic oligonucleotide; GAG chr11 5397261 5397280 5397277 +
acaggcaacctacacaatgg

SEQ ID NO: 28600 - DNA, 20 bp, Artificial Sequence
  Synthetic oligonucleotide; AAG chr11 5397292 5397311 5397308 +
tgcaatctactcatctgaca

SEQ ID NO: 28601 - DNA, 20 bp, Artificial Sequence
  Synthetic oligonucleotide; AGG chr11 5397293 5397312 5397309 +
gcaatctactcatctgacaa

SEQ ID NO: 28602 - DNA, 20 bp, Artificial Sequence
  Synthetic oligonucleotide; GGG chr11 5397294 5397313 5397310 +
caatctactcatctgacaaa

SEQ ID NO: 28603 - DNA, 20 bp, Artificial Sequence
  Synthetic oligonucleotide; CAG chr11 5397305 5397324 5397321 +
tctgacaaagggctaatatc

SEQ ID NO: 28604 - DNA, 20 bp, Artificial Sequence
  Synthetic oligonucleotide; AAG chr11 5397336 5397355 5397352 +
atgaactcaaacaaatttac

SEQ ID NO: 28605 - DNA, 20 bp, Artificial Sequence
  Synthetic oligonucleotide; GAG chr11 5397338 5397357 5397354 +
gaactcaaacaaatttacaa

SEQ ID NO: 28606 - DNA, 20 bp, Artificial Sequence
  Synthetic oligonucleotide; AAG chr11 5397359 5397378 5397375 +
agaaaaaaaaccccatcaaa

SEQ ID NO: 28607 - DNA, 20 bp, Artificial Sequence
  Synthetic oligonucleotide; TGG chr11 5397362 5397381 5397378 +
aaaaaaaccccatcaaaaag

SEQ ID NO: 28608 - DNA, 20 bp, Artificial Sequence
  Synthetic oligonucleotide; GGG chr11 5397363 5397382 5397379 +
aaaaaaccccatcaaaaagt

SEQ ID NO: 28609 - DNA, 20 bp, Artificial Sequence
  Synthetic oligonucleotide; AAG chr11 5397368 5397387 5397384 +
accccatcaaaaagtgggca

SEQ ID NO: 28610 - DNA, 20 bp, Artificial Sequence
  Synthetic oligonucleotide; AGG chr11 5397369 5397388 5397385 +
ccccatcaaaaagtgggcaa

SEQ ID NO: 28611 - DNA, 20 bp, Artificial Sequence
  Synthetic oligonucleotide; CAG chr11 5397379 5397398 5397395 +
aagtgggcaaaggatatgaa

SEQ ID NO: 28612 - DNA, 20 bp, Artificial Sequence
  Synthetic oligonucleotide; AAG chr11 5397393 5397412 5397409 +
tatgaacagacacttctcaa

SEQ ID NO: 28613 - DNA, 20 bp, Artificial Sequence
  Synthetic oligonucleotide; AAG chr11 5397396 5397415 5397412 +
gaacagacacttctcaaaag

SEQ ID NO: 28614 - DNA, 20 bp, Artificial Sequence
  Synthetic oligonucleotide; CAG chr11 5397408 5397427 5397424 +
ctcaaaagaagacatttatg

SEQ ID NO: 28615 - DNA, 20 bp, Artificial Sequence
  Synthetic oligonucleotide; AAG chr11 5397415 5397434 5397431 +
gaagacatttatgcagccaa

SEQ ID NO: 28616 - DNA, 20 bp, Artificial Sequence
  Synthetic oligonucleotide; TGG chr11 5397444 5397463 5397460 +
gaaaaaatgctcatcatcac

SEQ ID NO: 28617 - DNA, 20 bp, Artificial Sequence
  Synthetic oligonucleotide; CAG chr11 5397451 5397470 5397467 +
tgctcatcatcactggccat

SEQ ID NO: 28618 - DNA, 20 bp, Artificial Sequence
  Synthetic oligonucleotide; GAG chr11 5397453 5397472 5397469 +
ctcatcatcactggccatca

SEQ ID NO: 28619 - DNA, 20 bp, Artificial Sequence
  Synthetic oligonucleotide; GAG chr11 5397478 5397497 5397494 +
atgcaaatcaaaaccacaat

SEQ ID NO: 28620 - DNA, 20 bp, Artificial Sequence
  Synthetic oligonucleotide; CAG chr11 5397495 5397514 5397511 +
aatgagataccatctcacac

SEQ ID NO: 28621 - DNA, 20 bp, Artificial Sequence
  Synthetic oligonucleotide; TAG chr11 5397499 5397518 5397515 +
agataccatctcacaccagt

SEQ ID NO: 28622 - DNA, 20 bp, Artificial Sequence
  Synthetic oligonucleotide; TGG chr11 5397504 5397523 5397520 +
ccatctcacaccagttagaa

SEQ ID NO: 28623 - DNA, 20 bp, Artificial Sequence
  Synthetic oligonucleotide; AAG chr11 5397518 5397537 5397534 +
ttagaatggcaatcattaaa

SEQ ID NO: 28624 - DNA, 20 bp, Artificial Sequence
  Synthetic oligonucleotide; CAG chr11 5397522 5397541 5397538 +
aatggcaatcattaaaaagt

SEQ ID NO: 28625 - DNA, 20 bp, Artificial Sequence
  Synthetic oligonucleotide; AGG chr11 5397523 5397542 5397539 +
atggcaatcattaaaaagtc

SEQ ID NO: 28626 - DNA, 20 bp, Artificial Sequence
  Synthetic oligonucleotide; CAG chr11 5397532 5397551 5397548 +
attaaaaagtcaggaaacaa

SEQ ID NO: 28627 - DNA, 20 bp, Artificial Sequence
  Synthetic oligonucleotide; AGG chr11 5397533 5397552 5397549 +
ttaaaaagtcaggaaacaac

SEQ ID NO: 28628 - DNA, 20 bp, Artificial Sequence
  Synthetic oligonucleotide; TGG chr11 5397539 5397558 5397555 +
agtcaggaaacaacaggtgc

SEQ ID NO: 28629 - DNA, 20 bp, Artificial Sequence
  Synthetic oligonucleotide; GAG chr11 5397541 5397560 5397557 +
tcaggaaacaacaggtgctg

SEQ ID NO: 28630 - DNA, 20 bp, Artificial Sequence
  Synthetic oligonucleotide; GAG chr11 5397543 5397562 5397559 +
aggaaacaacaggtgctgga

SEQ ID NO: 28631 - DNA, 20 bp, Artificial Sequence
  Synthetic oligonucleotide; AGG chr11 5397544 5397563 5397560 +
ggaaacaacaggtgctggag

SEQ ID NO: 28632 - DNA, 20 bp, Artificial Sequence
  Synthetic oligonucleotide; TGG chr11 5397550 5397569 5397566 +
aacaggtgctggagaggatg

SEQ ID NO: 28633 - DNA, 20 bp, Artificial Sequence
  Synthetic oligonucleotide; GAG chr11 5397552 5397571 5397568 +
caggtgctggagaggatgtg

SEQ ID NO: 28634 - DNA, 20 bp, Artificial Sequence
  Synthetic oligonucleotide; TAG chr11 5397558 5397577 5397574 +
ctggagaggatgtggagaaa

SEQ ID NO: 28635 - DNA, 20 bp, Artificial Sequence
  Synthetic oligonucleotide; AGG chr11 5397559 5397578 5397575 +
tggagaggatgtggagaaat

SEQ ID NO: 28636 - DNA, 20 bp, Artificial Sequence
  Synthetic oligonucleotide; TGG chr11 5397578 5397597 5397594 +
taggaacacttttacactgt

SEQ ID NO: 28637 - DNA, 20 bp, Artificial Sequence
  Synthetic oligonucleotide; TGG chr11 5397581 5397600 5397597 +
gaacacttttacactgttgg

SEQ ID NO: 28638 - DNA, 20 bp, Artificial Sequence
  Synthetic oligonucleotide; GGG chr11 5397582 5397601 5397598 +
aacacttttacactgttggt

SEQ ID NO: 28639 - DNA, 20 bp, Artificial Sequence
  Synthetic oligonucleotide; TAG chr11 5397594 5397613 5397610 +
ctgttggtgggactgtaaac

SEQ ID NO: 28640 - DNA, 20 bp, Artificial Sequence
  Synthetic oligonucleotide; TGG chr11 5397608 5397627 5397624 +
gtaaactagttcaaacattg

SEQ ID NO: 28641 - DNA, 20 bp, Artificial Sequence
  Synthetic oligonucleotide; AAG chr11 5397611 5397630 5397627 +
aactagttcaaacattgtgg

SEQ ID NO: 28642 - DNA, 20 bp, Artificial Sequence
  Synthetic oligonucleotide; CAG chr11 5397615 5397634 5397631 +
agttcaaacattgtggaagt

SEQ ID NO: 28643 - DNA, 20 bp, Artificial Sequence
  Synthetic oligonucleotide; TGG chr11 5397620 5397639 5397636 +
aaacattgtggaagtcagtg

SEQ ID NO: 28644 - DNA, 20 bp, Artificial Sequence
  Synthetic oligonucleotide; CAG chr11 5397631 5397650 5397647 +
aagtcagtgtggtgattcct

SEQ ID NO: 28645 - DNA, 20 bp, Artificial Sequence
  Synthetic oligonucleotide; AGG chr11 5397632 5397651 5397648 +
agtcagtgtggtgattcctc

SEQ ID NO: 28646 - DNA, 20 bp, Artificial Sequence
  Synthetic oligonucleotide; GGG chr11 5397633 5397652 5397649 +
gtcagtgtggtgattcctca

SEQ ID NO: 28647 - DNA, 20 bp, Artificial Sequence
  Synthetic oligonucleotide; TAG chr11 5397639 5397658 5397655 +
gtggtgattcctcagggatc

SEQ ID NO: 28648 - DNA, 20 bp, Artificial Sequence
  Synthetic oligonucleotide; TAG chr11 5397645 5397664 5397661 +
attcctcagggatctagaac

SEQ ID NO: 28649 - DNA, 20 bp, Artificial Sequence
  Synthetic oligonucleotide; CAG chr11 5397663 5397682 5397679 +
actagaaataccatttgacc

SEQ ID NO: 28650 - DNA, 20 bp, Artificial Sequence
  Synthetic oligonucleotide; TGG chr11 5397678 5397697 5397694 +
tgacccagccatcccattac

SEQ ID NO: 28651 - DNA, 20 bp, Artificial Sequence
  Synthetic oligonucleotide; GGG chr11 5397679 5397698 5397695 +
gacccagccatcccattact

SEQ ID NO: 28652 - DNA, 20 bp, Artificial Sequence
  Synthetic oligonucleotide; AAG chr11 5397692 5397711 5397708 +
cattactgggtatacaccca

SEQ ID NO: 28653 - DNA, 20 bp, Artificial Sequence
  Synthetic oligonucleotide; AGG chr11 5397693 5397712 5397709 +
attactgggtatacacccaa

SEQ ID NO: 28654 - DNA, 20 bp, Artificial Sequence
  Synthetic oligonucleotide; AAG chr11 5397717 5397736 5397733 +
ttataaatcatgctgctata

SEQ ID NO: 28655 - DNA, 20 bp, Artificial Sequence
  Synthetic oligonucleotide; CGG chr11 5397744 5397763 5397760 +
atgcacacgtatgtttattg

SEQ ID NO: 28656 - DNA, 20 bp, Artificial Sequence
  Synthetic oligonucleotide; TAG chr11 5397759 5397778 5397775 +
tattgcggcactattcacaa

SEQ ID NO: 28657 - DNA, 20 bp, Artificial Sequence
  Synthetic oligonucleotide; AAG chr11 5397764 5397783 5397780 +
cggcactattcacaatagca

SEQ ID NO: 28658 - DNA, 20 bp, Artificial Sequence
  Synthetic oligonucleotide; TGG chr11 5397770 5397789 5397786 +
tattcacaatagcaaagact

SEQ ID NO: 28659 - DNA, 20 bp, Artificial Sequence
  Synthetic oligonucleotide; TAG chr11 5397798 5397817 5397814 +
acccaaatgtccaacaatga

SEQ ID NO: 28660 - DNA, 20 bp, Artificial Sequence
  Synthetic oligonucleotide; TGG chr11 5397803 5397822 5397819 +
aatgtccaacaatgatagac

SEQ ID NO: 28661 - DNA, 20 bp, Artificial Sequence
  Synthetic oligonucleotide; AAG chr11 5397809 5397828 5397825 +
caacaatgatagactggatt

SEQ ID NO: 28662 - DNA, 20 bp, Artificial Sequence
  Synthetic oligonucleotide; TGG chr11 5397818 5397837 5397834 +
tagactggattaagaaaatg

SEQ ID NO: 28663 - DNA, 20 bp, Artificial Sequence
  Synthetic oligonucleotide; TGG chr11 5397834 5397853 5397850 +
aatgtggcacatatacacca

SEQ ID NO: 28664 - DNA, 20 bp, Artificial Sequence
  Synthetic oligonucleotide; CAG chr11 5397846 5397865 5397862 +
atacaccatggaatactatg

SEQ ID NO: 28665 - DNA, 20 bp, Artificial Sequence
  Synthetic oligonucleotide; GAG chr11 5397863 5397882 5397879 +
atgcagccataaaaaatgat

SEQ ID NO: 28666 - DNA, 20 bp, Artificial Sequence
  Synthetic oligonucleotide; TAG chr11 5397879 5397898 5397895 +
tgatgagttcatgtcctttg

SEQ ID NO: 28667 - DNA, 20 bp, Artificial Sequence
  Synthetic oligonucleotide; AGG chr11 5397880 5397899 5397896 +
gatgagttcatgtcctttgt

SEQ ID NO: 28668 - DNA, 20 bp, Artificial Sequence
  Synthetic oligonucleotide; GGG chr11 5397881 5397900 5397897 +
atgagttcatgtcctttgta

SEQ ID NO: 28669 - DNA, 20 bp, Artificial Sequence
  Synthetic oligonucleotide; TGG chr11 5397887 5397906 5397903 +
tcatgtcctttgtagggaca

SEQ ID NO: 28670 - DNA, 20 bp, Artificial Sequence
  Synthetic oligonucleotide; AAG chr11 5397893 5397912 5397909 +
cctttgtagggacatggatg

SEQ ID NO: 28671 - DNA, 20 bp, Artificial Sequence
  Synthetic oligonucleotide; TGG chr11 5397897 5397916 5397913 +
tgtagggacatggatgaagc

SEQ ID NO: 28672 - DNA, 20 bp, Artificial Sequence
  Synthetic oligonucleotide; CAG chr11 5397913 5397932 5397929 +
aagctggaaaccatcattct

SEQ ID NO: 28673 - DNA, 20 bp, Artificial Sequence
  Synthetic oligonucleotide; AAG chr11 5397927 5397946 5397943 +
cattctcagcaaactatcac

SEQ ID NO: 28674 - DNA, 20 bp, Artificial Sequence
  Synthetic oligonucleotide; AGG chr11 5397928 5397947 5397944 +
attctcagcaaactatcaca

SEQ ID NO: 28675 - DNA, 20 bp, Artificial Sequence
  Synthetic oligonucleotide; AAG chr11 5397936 5397955 5397952 +
caaactatcacaaggacaaa

SEQ ID NO: 28676 - DNA, 20 bp, Artificial Sequence
  Synthetic oligonucleotide; TAG chr11 5397963 5397982 5397979 +
acaccacatgttctcactca

SEQ ID NO: 28677 - DNA, 20 bp, Artificial Sequence
  Synthetic oligonucleotide; AGG chr11 5397964 5397983 5397980 +
caccacatgttctcactcat

SEQ ID NO: 28678 - DNA, 20 bp, Artificial Sequence
  Synthetic oligonucleotide; TGG chr11 5397967 5397986 5397983 +
cacatgttctcactcatagg

SEQ ID NO: 28679 - DNA, 20 bp, Artificial Sequence
  Synthetic oligonucleotide; GGG chr11 5397968 5397987 5397984 +
acatgttctcactcataggt

SEQ ID NO: 28680 - DNA, 20 bp, Artificial Sequence
  Synthetic oligonucleotide; GAG chr11 5397982 5398001 5397998 +
ataggtgggaactgaacaat

SEQ ID NO: 28681 - DNA, 20 bp, Artificial Sequence
  Synthetic oligonucleotide; TGG chr11 5397991 5398010 5398007 +
aactgaacaatgagaacaca

SEQ ID NO: 28682 - DNA, 20 bp, Artificial Sequence
  Synthetic oligonucleotide; CAG chr11 5397997 5398016 5398013 +
acaatgagaacacatggaca

SEQ ID NO: 28683 - DNA, 20 bp, Artificial Sequence
  Synthetic oligonucleotide; AGG chr11 5397998 5398017 5398014 +
caatgagaacacatggacac

SEQ ID NO: 28684 - DNA, 20 bp, Artificial Sequence
  Synthetic oligonucleotide; AAG chr11 5398001 5398020 5398017 +
tgagaacacatggacacagg

SEQ ID NO: 28685 - DNA, 20 bp, Artificial Sequence
  Synthetic oligonucleotide; AGG chr11 5398002 5398021 5398018 +
gagaacacatggacacagga

SEQ ID NO: 28686 - DNA, 20 bp, Artificial Sequence
  Synthetic oligonucleotide; GGG chr11 5398003 5398022 5398019 +
agaacacatggacacaggaa

SEQ ID NO: 28687 - DNA, 20 bp, Artificial Sequence
  Synthetic oligonucleotide; GGG chr11 5398004 5398023 5398020 +
gaacacatggacacaggaag

SEQ ID NO: 28688 - DNA, 20 bp, Artificial Sequence
  Synthetic oligonucleotide; CGG chr11 5398019 5398038 5398035 +
ggaaggggaacatcacacac

SEQ ID NO: 28689 - DNA, 20 bp, Artificial Sequence
  Synthetic oligonucleotide; GGG chr11 5398020 5398039 5398036 +
gaaggggaacatcacacacc

SEQ ID NO: 28690 - DNA, 20 bp, Artificial Sequence
  Synthetic oligonucleotide; GGG chr11 5398021 5398040 5398037 +
aaggggaacatcacacaccg

SEQ ID NO: 28691 - DNA, 20 bp, Artificial Sequence
  Synthetic oligonucleotide; TGG chr11 5398031 5398050 5398047 +
tcacacaccggggcctgttg

SEQ ID NO: 28692 - DNA, 20 bp, Artificial Sequence
  Synthetic oligonucleotide; GGG chr11 5398032 5398051 5398048 +
cacacaccggggcctgttgt

SEQ ID NO: 28693 - DNA, 20 bp, Artificial Sequence
  Synthetic oligonucleotide; GGG chr11 5398033 5398052 5398049 +
acacaccggggcctgttgtg

SEQ ID NO: 28694 - DNA, 20 bp, Artificial Sequence
  Synthetic oligonucleotide; TGG chr11 5398036 5398055 5398052 +
caccggggcctgttgtgggg

SEQ ID NO: 28695 - DNA, 20 bp, Artificial Sequence
  Synthetic oligonucleotide; GGG chr11 5398037 5398056 5398053 +
accggggcctgttgtggggt

SEQ ID NO: 28696 - DNA, 20 bp, Artificial Sequence
  Synthetic oligonucleotide; GAG chr11 5398039 5398058 5398055 +
cggggcctgttgtggggtgg

SEQ ID NO: 28697 - DNA, 20 bp, Artificial Sequence
  Synthetic oligonucleotide; AGG chr11 5398040 5398059 5398056 +
ggggcctgttgtggggtggg

SEQ ID NO: 28698 - DNA, 20 bp, Artificial Sequence
  Synthetic oligonucleotide; GAG chr11 5398042 5398061 5398058 +
ggcctgttgtggggtgggag

SEQ ID NO: 28699 - DNA, 20 bp, Artificial Sequence
  Synthetic oligonucleotide; AGG chr11 5398043 5398062 5398059 +
gcctgttgtggggtgggagg

SEQ ID NO: 28700 - DNA, 20 bp, Artificial Sequence
  Synthetic oligonucleotide; GGG chr11 5398044 5398063 5398060 +
cctgttgtggggtgggagga

SEQ ID NO: 28701 - DNA, 20 bp, Artificial Sequence
  Synthetic oligonucleotide; GGG chr11 5398045 5398064 5398061 +
ctgttgtggggtgggaggag

SEQ ID NO: 28702 - DNA, 20 bp, Artificial Sequence
  Synthetic oligonucleotide; GGG chr11 5398046 5398065 5398062 +
tgttgtggggtgggaggagg

SEQ ID NO: 28703 - DNA, 20 bp, Artificial Sequence
  Synthetic oligonucleotide; CAG chr11 5398049 5398068 5398065 +
tgtggggtgggaggaggggg

SEQ ID NO: 28704 - DNA, 20 bp, Artificial Sequence
  Synthetic oligonucleotide; AGG chr11 5398050 5398069 5398066 +
gtggggtgggaggagggggc

SEQ ID NO: 28705 - DNA, 20 bp, Artificial Sequence
  Synthetic oligonucleotide; GGG chr11 5398051 5398070 5398067 +
tggggtgggaggagggggca

SEQ ID NO: 28706 - DNA, 20 bp, Artificial Sequence
  Synthetic oligonucleotide; TAG chr11 5398055 5398074 5398071 +
gtgggaggagggggcaggga

SEQ ID NO: 28707 - DNA, 20 bp, Artificial Sequence
  Synthetic oligonucleotide; TAG chr11 5398061 5398080 5398077 +
ggagggggcagggatagcat

SEQ ID NO: 28708 - DNA, 20 bp, Artificial Sequence
  Synthetic oligonucleotide; AGG chr11 5398062 5398081 5398078 +
gagggggcagggatagcatt

SEQ ID NO: 28709 - DNA, 20 bp, Artificial Sequence
  Synthetic oligonucleotide; GAG chr11 5398064 5398083 5398080 +
gggggcagggatagcattag

SEQ ID NO: 28710 - DNA, 20 bp, Artificial Sequence
  Synthetic oligonucleotide; TGG chr11 5398084 5398103 5398100 +
gagatatacctaatgttaaa

SEQ ID NO: 28711 - DNA, 20 bp, Artificial Sequence
  Synthetic oligonucleotide; GAG chr11 5398088 5398107 5398104 +
tatacctaatgttaaatggt

SEQ ID NO: 28712 - DNA, 20 bp, Artificial Sequence
  Synthetic oligonucleotide; TGG chr11 5398095 5398114 5398111 +
aatgttaaatggtgagttaa

SEQ ID NO: 28713 - DNA, 20 bp, Artificial Sequence
  Synthetic oligonucleotide; GGG chr11 5398096 5398115 5398112 +
atgttaaatggtgagttaat

SEQ ID NO: 28714 - DNA, 20 bp, Artificial Sequence
  Synthetic oligonucleotide; CAG chr11 5398101 5398120 5398117 +
aaatggtgagttaatgggtg

SEQ ID NO: 28715 - DNA, 20 bp, Artificial Sequence
  Synthetic oligonucleotide; TGG chr11 5398114 5398133 5398130 +
atgggtgcagcacaccaaca

SEQ ID NO: 28716 - DNA, 20 bp, Artificial Sequence
  Synthetic oligonucleotide; AAG chr11 5398174 5398193 5398190 +
acatgtaccctaaaacttaa

SEQ ID NO: 28717 - DNA, 20 bp, Artificial Sequence
  Synthetic oligonucleotide; AAG chr11 5398190 5398209 5398206 +
ttaaaagtataacaaaaaat

SEQ ID NO: 28718 - DNA, 20 bp, Artificial Sequence
  Synthetic oligonucleotide; TAG chr11 5398194 5398213 5398210 +
aagtataacaaaaaataagt

SEQ ID NO: 28719 - DNA, 20 bp, Artificial Sequence
  Synthetic oligonucleotide; AAG chr11 5398201 5398220 5398217 +
acaaaaaataagttagaaaa

SEQ ID NO: 28720 - DNA, 20 bp, Artificial Sequence
  Synthetic oligonucleotide; TAG chr11 5398218 5398237 5398234 +
aaaaagaaatttacatatat

SEQ ID NO: 28721 - DNA, 20 bp, Artificial Sequence
  Synthetic oligonucleotide; TGG chr11 5398235 5398254 5398251 +
tattagttatttaaatatgc

SEQ ID NO: 28722 - DNA, 20 bp, Artificial Sequence
  Synthetic oligonucleotide; AAG chr11 5398264 5398283 5398280 +
actattacactcatttcaca

SEQ ID NO: 28723 - DNA, 20 bp, Artificial Sequence
  Synthetic oligonucleotide; TAG chr11 5398298 5398317 5398314 +
atatctttgcttgtttccct

SEQ ID NO: 28724 - DNA, 20 bp, Artificial Sequence
  Synthetic oligonucleotide; AGG chr11 5398299 5398318 5398315 +
tatctttgcttgtttccctt

SEQ ID NO: 28725 - DNA, 20 bp, Artificial Sequence
  Synthetic oligonucleotide; TGG chr11 5398307 5398326 5398323 +
cttgtttcccttaggttctc

SEQ ID NO: 28726 - DNA, 20 bp, Artificial Sequence
  Synthetic oligonucleotide; GAG chr11 5398315 5398334 5398331 +
ccttaggttctctggatatt

SEQ ID NO: 28727 - DNA, 20 bp, Artificial Sequence
  Synthetic oligonucleotide; GAG chr11 5398317 5398336 5398333 +
ttaggttctctggatattga

SEQ ID NO: 28728 - DNA, 20 bp, Artificial Sequence
  Synthetic oligonucleotide; GAG chr11 5398319 5398338 5398335 +
aggttctctggatattgaga

SEQ ID NO: 28729 - DNA, 20 bp, Artificial Sequence
  Synthetic oligonucleotide; AGG chr11 5398320 5398339 5398336 +
ggttctctggatattgagag

SEQ ID NO: 28730 - DNA, 20 bp, Artificial Sequence
  Synthetic oligonucleotide; TGG chr11 5398337 5398356 5398353 +
gagaggctaatgtaattacc

SEQ ID NO: 28731 - DNA, 20 bp, Artificial Sequence
  Synthetic oligonucleotide; GGG chr11 5398338 5398357 5398354 +
agaggctaatgtaattacct

SEQ ID NO: 28732 - DNA, 20 bp, Artificial Sequence
  Synthetic oligonucleotide; CAG chr11 5398352 5398371 5398368 +
ttacctgggtaattgctcct

SEQ ID NO: 28733 - DNA, 20 bp, Artificial Sequence
  Synthetic oligonucleotide; AGG chr11 5398353 5398372 5398369 +
tacctgggtaattgctcctc

SEQ ID NO: 28734 - DNA, 20 bp, Artificial Sequence
  Synthetic oligonucleotide; GGG chr11 5398354 5398373 5398370 +
acctgggtaattgctcctca

SEQ ID NO: 28735 - DNA, 20 bp, Artificial Sequence
  Synthetic oligonucleotide; TAG chr11 5398387 5398406 5398403 +
tctccccattactctactcc

SEQ ID NO: 28736 - DNA, 20 bp, Artificial Sequence
  Synthetic oligonucleotide; GAG chr11 5398389 5398408 5398405 +
tccccattactctactccta

SEQ ID NO: 28737 - DNA, 20 bp, Artificial Sequence
  Synthetic oligonucleotide; CAG chr11 5398400 5398419 5398416 +
ctactcctagagactctgat

SEQ ID NO: 28738 - DNA, 20 bp, Artificial Sequence
  Synthetic oligonucleotide; TGG chr11 5398416 5398435 5398432 +
tgatcagctttttcaaaaaa

SEQ ID NO: 28739 - DNA, 20 bp, Artificial Sequence
  Synthetic oligonucleotide; GGG chr11 5398417 5398436 5398433 +
gatcagctttttcaaaaaat

SEQ ID NO: 28740 - DNA, 20 bp, Artificial Sequence
  Synthetic oligonucleotide; CAG chr11 5398420 5398439 5398436 +
cagctttttcaaaaaatggg

SEQ ID NO: 28741 - DNA, 20 bp, Artificial Sequence
  Synthetic oligonucleotide; CAG chr11 5398428 5398447 5398444 +
tcaaaaaatgggcagcattc

SEQ ID NO: 28742 - DNA, 20 bp, Artificial Sequence
  Synthetic oligonucleotide; CAG chr11 5398434 5398453 5398450 +
aatgggcagcattccagccc

SEQ ID NO: 28743 - DNA, 20 bp, Artificial Sequence
  Synthetic oligonucleotide; AGG chr11 5398435 5398454 5398451 +
atgggcagcattccagcccc

SEQ ID NO: 28744 - DNA, 20 bp, Artificial Sequence
  Synthetic oligonucleotide; AAG chr11 5398441 5398460 5398457 +
agcattccagccccaggact

SEQ ID NO: 28745 - DNA, 20 bp, Artificial Sequence
  Synthetic oligonucleotide; AAG chr11 5398444 5398463 5398460 +
attccagccccaggactaag

SEQ ID NO: 28746 - DNA, 20 bp, Artificial Sequence
  Synthetic oligonucleotide; CAG chr11 5398459 5398478 5398475 +
ctaagaagatatgaatgcca

SEQ ID NO: 28747 - DNA, 20 bp, Artificial Sequence
  Synthetic oligonucleotide; TGG chr11 5398462 5398481 5398478 +
agaagatatgaatgccacag

SEQ ID NO: 28748 - DNA, 20 bp, Artificial Sequence
  Synthetic oligonucleotide; CAG chr11 5398465 5398484 5398481 +
agatatgaatgccacagtgg

SEQ ID NO: 28749 - DNA, 20 bp, Artificial Sequence
  Synthetic oligonucleotide; AGG chr11 5398466 5398485 5398482 +
gatatgaatgccacagtggc

SEQ ID NO: 28750 - DNA, 20 bp, Artificial Sequence
  Synthetic oligonucleotide; GGG chr11 5398467 5398486 5398483 +
atatgaatgccacagtggca

SEQ ID NO: 28751 - DNA, 20 bp, Artificial Sequence
  Synthetic oligonucleotide; AAG chr11 5398478 5398497 5398494 +
acagtggcagggacttgctg

SEQ ID NO: 28752 - DNA, 20 bp, Artificial Sequence
  Synthetic oligonucleotide; GAG chr11 5398482 5398501 5398498 +
tggcagggacttgctgaagt

SEQ ID NO: 28753 - DNA, 20 bp, Artificial Sequence
  Synthetic oligonucleotide; GAG chr11 5398501 5398520 5398517 +
tgagcttccccatcccacct

SEQ ID NO: 28754 - DNA, 20 bp, Artificial Sequence
  Synthetic oligonucleotide; AGG chr11 5398502 5398521 5398518 +
gagcttccccatcccacctg

SEQ ID NO: 28755 - DNA, 20 bp, Artificial Sequence
  Synthetic oligonucleotide; CAG chr11 5398507 5398526 5398523 +
tccccatcccacctgaggct

SEQ ID NO: 28756 - DNA, 20 bp, Artificial Sequence
  Synthetic oligonucleotide; GAG chr11 5398509 5398528 5398525 +
cccatcccacctgaggctca

SEQ ID NO: 28757 - DNA, 20 bp, Artificial Sequence
  Synthetic oligonucleotide; AGG chr11 5398510 5398529 5398526 +
ccatcccacctgaggctcag

SEQ ID NO: 28758 - DNA, 20 bp, Artificial Sequence
  Synthetic oligonucleotide; CAG chr11 5398514 5398533 5398530 +
cccacctgaggctcagaggc

SEQ ID NO: 28759 - DNA, 20 bp, Artificial Sequence
  Synthetic oligonucleotide; TGG chr11 5398526 5398545 5398542 +
tcagaggccagtttcacttg

SEQ ID NO: 28760 - DNA, 20 bp, Artificial Sequence
  Synthetic oligonucleotide; GAG chr11 5398530 5398549 5398546 +
aggccagtttcacttgtggt

SEQ ID NO: 28761 - DNA, 20 bp, Artificial Sequence
  Synthetic oligonucleotide; AAG chr11 5398538 5398557 5398554 +
ttcacttgtggtgagtgcac

SEQ ID NO: 28762 - DNA, 20 bp, Artificial Sequence
  Synthetic oligonucleotide; TGG chr11 5398557 5398576 5398573 +
caagcccatgatccctgata

SEQ ID NO: 28763 - DNA, 20 bp, Artificial Sequence
  Synthetic oligonucleotide; TGG chr11 5398562 5398581 5398578 +
ccatgatccctgatatggct

SEQ ID NO: 28764 - DNA, 20 bp, Artificial Sequence
  Synthetic oligonucleotide; CGG chr11 5398622 5398641 5398638 +
tccccataatccctatatgt

SEQ ID NO: 28765 - DNA, 20 bp, Artificial Sequence
  Synthetic oligonucleotide; GGG chr11 5398623 5398642 5398639 +
ccccataatccctatatgtc

SEQ ID NO: 28766 - DNA, 20 bp, Artificial Sequence
  Synthetic oligonucleotide; GGG chr11 5398624 5398643 5398640 +
cccataatccctatatgtcg

SEQ ID NO: 28767 - DNA, 20 bp, Artificial Sequence
  Synthetic oligonucleotide; GGG chr11 5398625 5398644 5398641 +
ccataatccctatatgtcgg

SEQ ID NO: 28768 - DNA, 20 bp, Artificial Sequence
  Synthetic oligonucleotide; GAG chr11 5398627 5398646 5398643 +
ataatccctatatgtcgggg

SEQ ID NO: 28769 - DNA, 20 bp, Artificial Sequence
  Synthetic oligonucleotide; AGG chr11 5398628 5398647 5398644 +
taatccctatatgtcggggg

SEQ ID NO: 28770 - DNA, 20 bp, Artificial Sequence
  Synthetic oligonucleotide; GGG chr11 5398629 5398648 5398645 +
aatccctatatgtcggggga

SEQ ID NO: 28771 - DNA, 20 bp, Artificial Sequence
  Synthetic oligonucleotide; CAG chr11 5398634 5398653 5398650 +
ctatatgtcgggggagggac

SEQ ID NO: 28772 - DNA, 20 bp, Artificial Sequence
  Synthetic oligonucleotide; AGG chr11 5398635 5398654 5398651 +
tatatgtcgggggagggacc

SEQ ID NO: 28773 - DNA, 20 bp, Artificial Sequence
  Synthetic oligonucleotide; TGG chr11 5398638 5398657 5398654 +
atgtcgggggagggaccagg

SEQ ID NO: 28774 - DNA, 20 bp, Artificial Sequence
  Synthetic oligonucleotide; GGG chr11 5398639 5398658 5398655 +
tgtcgggggagggaccaggt

SEQ ID NO: 28775 - DNA, 20 bp, Artificial Sequence
  Synthetic oligonucleotide; GAG chr11 5398641 5398660 5398657 +
tcgggggagggaccaggtgg

SEQ ID NO: 28776 - DNA, 20 bp, Artificial Sequence
  Synthetic oligonucleotide; TGG chr11 5398649 5398668 5398665 +
gggaccaggtgggagattat

SEQ ID NO: 28777 - DNA, 20 bp, Artificial Sequence
  Synthetic oligonucleotide; TGG chr11 5398656 5398675 5398672 +
ggtgggagattattggatca

SEQ ID NO: 28778 - DNA, 20 bp, Artificial Sequence
  Synthetic oligonucleotide; GGG chr11 5398657 5398676 5398673 +
gtgggagattattggatcat

SEQ ID NO: 28779 - DNA, 20 bp, Artificial Sequence
  Synthetic oligonucleotide; GAG chr11 5398659 5398678 5398675 +
gggagattattggatcatgg

SEQ ID NO: 28780 - DNA, 20 bp, Artificial Sequence
  Synthetic oligonucleotide; CAG chr11 5398662 5398681 5398678 +
agattattggatcatgggag

SEQ ID NO: 28781 - DNA, 20 bp, Artificial Sequence
  Synthetic oligonucleotide; CAG chr11 5398676 5398695 5398692 +
tgggagcagtttcccccatg

SEQ ID NO: 28782 - DNA, 20 bp, Artificial Sequence
  Synthetic oligonucleotide; GAG chr11 5398692 5398711 5398708 +
catgcagttctcgtgatact

SEQ ID NO: 28783 - DNA, 20 bp, Artificial Sequence
  Synthetic oligonucleotide; GAG chr11 5398696 5398715 5398712 +
cagttctcgtgatactgagt

SEQ ID NO: 28784 - DNA, 20 bp, Artificial Sequence
  Synthetic oligonucleotide; GAG chr11 5398706 5398725 5398722 +
gatactgagtgagttttcat

SEQ ID NO: 28785 - DNA, 20 bp, Artificial Sequence
  Synthetic oligonucleotide; TGG chr11 5398715 5398734 5398731 +
tgagttttcatgagatctga

SEQ ID NO: 28786 - DNA, 20 bp, Artificial Sequence
  Synthetic oligonucleotide; AAG chr11 5398724 5398743 5398740 +
atgagatctgatggttttat

SEQ ID NO: 28787 - DNA, 20 bp, Artificial Sequence
  Synthetic oligonucleotide; AGG chr11 5398725 5398744 5398741 +
tgagatctgatggttttata

SEQ ID NO: 28788 - DNA, 20 bp, Artificial Sequence
  Synthetic oligonucleotide; CAG chr11 5398728 5398747 5398744 +
gatctgatggttttataagg

SEQ ID NO: 28789 - DNA, 20 bp, Artificial Sequence
  Synthetic oligonucleotide; AAG chr11 5398769 5398788 5398785 +
actctctcttgcctgccacc

SEQ ID NO: 28790 - DNA, 20 bp, Artificial Sequence
  Synthetic oligonucleotide; AAG chr11 5398773 5398792 5398789 +
tctcttgcctgccaccaagt

SEQ ID NO: 28791 - DNA, 20 bp, Artificial Sequence
  Synthetic oligonucleotide; AAG chr11 5398807 5398826 5398823 +
tctccttctgccataattgt

SEQ ID NO: 28792 - DNA, 20 bp, Artificial Sequence
  Synthetic oligonucleotide; GAG chr11 5398816 5398835 5398832 +
gccataattgtaagtttcct

SEQ ID NO: 28793 - DNA, 20 bp, Artificial Sequence
  Synthetic oligonucleotide; AGG chr11 5398817 5398836 5398833 +
ccataattgtaagtttcctg

SEQ ID NO: 28794 - DNA, 20 bp, Artificial Sequence
  Synthetic oligonucleotide; CAG chr11 5398826 5398845 5398842 +
taagtttcctgaggcctccc

SEQ ID NO: 28795 - DNA, 20 bp, Artificial Sequence
  Synthetic oligonucleotide; TGG chr11 5398834 5398853 5398850 +
ctgaggcctccccagctatg

SEQ ID NO: 28796 - DNA, 20 bp, Artificial Sequence
  Synthetic oligonucleotide; GAG chr11 5398843 5398862 5398859 +
ccccagctatgtggaaatgt

SEQ ID NO: 28797 - DNA, 20 bp, Artificial Sequence
  Synthetic oligonucleotide; CAG chr11 5398877 5398896 5398893 +
tcctttgttaataaattacc

SEQ ID NO: 28798 - DNA, 20 bp, Artificial Sequence
  Synthetic oligonucleotide; CAG chr11 5398883 5398902 5398899 +
gttaataaattacccagtct

SEQ ID NO: 28799 - DNA, 20 bp, Artificial Sequence
  Synthetic oligonucleotide; AGG chr11 5398884 5398903 5398900 +
ttaataaattacccagtctc

SEQ ID NO: 28800 - DNA, 20 bp, Artificial Sequence
  Synthetic oligonucleotide; TAG chr11 5398887 5398906 5398903 +
ataaattacccagtctcagg

SEQ ID NO: 28801 - DNA, 20 bp, Artificial Sequence
  Synthetic oligonucleotide; TAG chr11 5398896 5398915 5398912 +
ccagtctcaggtagtatctt

SEQ ID NO: 28802 - DNA, 20 bp, Artificial Sequence
  Synthetic oligonucleotide; GAG chr11 5398898 5398917 5398914 +
agtctcaggtagtatcttta

SEQ ID NO: 28803 - DNA, 20 bp, Artificial Sequence
  Synthetic oligonucleotide; CAG chr11 5398901 5398920 5398917 +
ctcaggtagtatctttagag

SEQ ID NO: 28804 - DNA, 20 bp, Artificial Sequence
  Synthetic oligonucleotide; GAG chr11 5398907 5398926 5398923 +
tagtatctttagagcagtgt

SEQ ID NO: 28805 - DNA, 20 bp, Artificial Sequence
  Synthetic oligonucleotide; AAG chr11 5398930 5398949 5398946 +
aatgaactaatacaatcccc

SEQ ID NO: 28806 - DNA, 20 bp, Artificial Sequence
  Synthetic oligonucleotide; AAG chr11 5398945 5398964 5398961 +
tccccaagccctgccttctg

SEQ ID NO: 28807 - DNA, 20 bp, Artificial Sequence
  Synthetic oligonucleotide; CAG chr11 5398948 5398967 5398964 +
ccaagccctgccttctgaag

SEQ ID NO: 28808 - DNA, 20 bp, Artificial Sequence
  Synthetic oligonucleotide; CAG chr11 5398955 5398974 5398971 +
ctgccttctgaagcagcatt

SEQ ID NO: 28809 - DNA, 20 bp, Artificial Sequence
  Synthetic oligonucleotide; AGG chr11 5398956 5398975 5398972 +
tgccttctgaagcagcattc

SEQ ID NO: 28810 - DNA, 20 bp, Artificial Sequence
  Synthetic oligonucleotide; CAG chr11 5398977 5398996 5398993 +
ggactcccaaccccatgtca

SEQ ID NO: 28811 - DNA, 20 bp, Artificial Sequence
  Synthetic oligonucleotide; AAG chr11 5398984 5399003 5399000 +
caaccccatgtcacagtgtg

SEQ ID NO: 28812 - DNA, 20 bp, Artificial Sequence
  Synthetic oligonucleotide; TAG chr11 5398991 5399010 5399007 +
atgtcacagtgtgaagccct

SEQ ID NO: 28813 - DNA, 20 bp, Artificial Sequence
  Synthetic oligonucleotide; AAG chr11 5399004 5399023 5399020 +
aagcccttagcatttttcct

SEQ ID NO: 28814 - DNA, 20 bp, Artificial Sequence
  Synthetic oligonucleotide; CAG chr11 5399008 5399027 5399024 +
ccttagcatttttcctaaga

SEQ ID NO: 28815 - DNA, 20 bp, Artificial Sequence
  Synthetic oligonucleotide; TAG chr11 5399011 5399030 5399027 +
tagcatttttcctaagacag

SEQ ID NO: 28816 - DNA, 20 bp, Artificial Sequence
  Synthetic oligonucleotide; TAG chr11 5399023 5399042 5399039 +
taagacagtagtcacctccc

SEQ ID NO: 28817 - DNA, 20 bp, Artificial Sequence
  Synthetic oligonucleotide; TGG chr11 5399041 5399060 5399057 +
cctagcttcttgaacctgtc

SEQ ID NO: 28818 - DNA, 20 bp, Artificial Sequence
  Synthetic oligonucleotide; CAG chr11 5399044 5399063 5399060 +
agcttcttgaacctgtctgg

SEQ ID NO: 28819 - DNA, 20 bp, Artificial Sequence
  Synthetic oligonucleotide; AAG chr11 5399047 5399066 5399063 +
ttcttgaacctgtctggcag

SEQ ID NO: 28820 - DNA, 20 bp, Artificial Sequence
  Synthetic oligonucleotide; AGG chr11 5399048 5399067 5399064 +
tcttgaacctgtctggcaga

SEQ ID NO: 28821 - DNA, 20 bp, Artificial Sequence
  Synthetic oligonucleotide; GAG chr11 5399050 5399069 5399066 +
ttgaacctgtctggcagaag

SEQ ID NO: 28822 - DNA, 20 bp, Artificial Sequence
  Synthetic oligonucleotide; GAG chr11 5399052 5399071 5399068 +
gaacctgtctggcagaagga

SEQ ID NO: 28823 - DNA, 20 bp, Artificial Sequence
  Synthetic oligonucleotide; AGG chr11 5399053 5399072 5399069 +
aacctgtctggcagaaggag

SEQ ID NO: 28824 - DNA, 20 bp, Artificial Sequence
  Synthetic oligonucleotide; TGG chr11 5399071 5399090 5399087 +
agaggaatcacatcctaaat

SEQ ID NO: 28825 - DNA, 20 bp, Artificial Sequence
  Synthetic oligonucleotide; TGG chr11 5399074 5399093 5399090 +
ggaatcacatcctaaattgg

SEQ ID NO: 28826 - DNA, 20 bp, Artificial Sequence
  Synthetic oligonucleotide; CAG chr11 5399077 5399096 5399093 +
atcacatcctaaattggtgg

SEQ ID NO: 28827 - DNA, 20 bp, Artificial Sequence
  Synthetic oligonucleotide; TGG chr11 5399081 5399100 5399097 +
catcctaaattggtggcaga

SEQ ID NO: 28828 - DNA, 20 bp, Artificial Sequence
  Synthetic oligonucleotide; CAG chr11 5399102 5399121 5399118 +
ggaaaacaaaacaaaaacac

SEQ ID NO: 28829 - DNA, 20 bp, Artificial Sequence
  Synthetic oligonucleotide; GAG chr11 5399104 5399123 5399120 +
aaaacaaaacaaaaacacca

SEQ ID NO: 28830 - DNA, 20 bp, Artificial Sequence
  Synthetic oligonucleotide; TAG chr11 5399127 5399146 5399143 +
cacatcatgaattcttgaaa

SEQ ID NO: 28831 - DNA, 20 bp, Artificial Sequence
  Synthetic oligonucleotide; TGG chr11 5399149 5399168 5399165 +
gttttgccatcatattatct

SEQ ID NO: 28832 - DNA, 20 bp, Artificial Sequence
  Synthetic oligonucleotide; GGG chr11 5399150 5399169 5399166 +
ttttgccatcatattatctt

SEQ ID NO: 28833 - DNA, 20 bp, Artificial Sequence
  Synthetic oligonucleotide; TGG chr11 5399175 5399194 5399191 +
actcacaaaatgcttatgtc

SEQ ID NO: 28834 - DNA, 20 bp, Artificial Sequence
  Synthetic oligonucleotide; AAG chr11 5399196 5399215 5399212 +
ggtttatatgctcatctatt

SEQ ID NO: 28835 - DNA, 20 bp, Artificial Sequence
  Synthetic oligonucleotide; TGG chr11 5399199 5399218 5399215 +
ttatatgctcatctattaag

SEQ ID NO: 28836 - DNA, 20 bp, Artificial Sequence
  Synthetic oligonucleotide; GGG chr11 5399200 5399219 5399216 +
tatatgctcatctattaagt

SEQ ID NO: 28837 - DNA, 20 bp, Artificial Sequence
  Synthetic oligonucleotide; CAG chr11 5399229 5399248 5399245 +
ttgtctccttgtttacctca

SEQ ID NO: 28838 - DNA, 20 bp, Artificial Sequence
  Synthetic oligonucleotide; TGG chr11 5399235 5399254 5399251 +
ccttgtttacctcacagatg

SEQ ID NO: 28839 - DNA, 20 bp, Artificial Sequence
  Synthetic oligonucleotide; GAG chr11 5399241 5399260 5399257 +
ttacctcacagatgtggtct

SEQ ID NO: 28840 - DNA, 20 bp, Artificial Sequence
  Synthetic oligonucleotide; CAG chr11 5399247 5399266 5399263 +
cacagatgtggtctgagtat

SEQ ID NO: 28841 - DNA, 20 bp, Artificial Sequence
  Synthetic oligonucleotide; GAG chr11 5399251 5399270 5399267 +
gatgtggtctgagtatcagt

SEQ ID NO: 28842 - DNA, 20 bp, Artificial Sequence
  Synthetic oligonucleotide; AAG chr11 5399262 5399281 5399278 +
agtatcagtgagccaataac

SEQ ID NO: 28843 - DNA, 20 bp, Artificial Sequence
  Synthetic oligonucleotide; AGG chr11 5399263 5399282 5399279 +
gtatcagtgagccaataaca

SEQ ID NO: 28844 - DNA, 20 bp, Artificial Sequence
  Synthetic oligonucleotide; AAG chr11 5399267 5399286 5399283 +
cagtgagccaataacaagga

SEQ ID NO: 28845 - DNA, 20 bp, Artificial Sequence
  Synthetic oligonucleotide; AAG chr11 5399285 5399304 5399301 +
gaaagacaattattaataaa

SEQ ID NO: 28846 - DNA, 20 bp, Artificial Sequence
  Synthetic oligonucleotide; TGG chr11 5399289 5399308 5399305 +
gacaattattaataaaaagt

SEQ ID NO: 28847 - DNA, 20 bp, Artificial Sequence
  Synthetic oligonucleotide; AAG chr11 5399296 5399315 5399312 +
attaataaaaagttggaaat

SEQ ID NO: 28848 - DNA, 20 bp, Artificial Sequence
  Synthetic oligonucleotide; GAG chr11 5399318 5399337 5399334 +
gctgactgtgattgactcct

SEQ ID NO: 28849 - DNA, 20 bp, Artificial Sequence
  Synthetic oligonucleotide; AAG chr11 5399330 5399349 5399346 +
tgactcctgagaattcctga

SEQ ID NO: 28850 - DNA, 20 bp, Artificial Sequence
  Synthetic oligonucleotide; GAG chr11 5399332 5399351 5399348 +
actcctgagaattcctgaaa

SEQ ID NO: 28851 - DNA, 20 bp, Artificial Sequence
  Synthetic oligonucleotide; TAG chr11 5399338 5399357 5399354 +
gagaattcctgaaagagata

SEQ ID NO: 28852 - DNA, 20 bp, Artificial Sequence
  Synthetic oligonucleotide; GAG chr11 5399340 5399359 5399356 +
gaattcctgaaagagatata

SEQ ID NO: 28853 - DNA, 20 bp, Artificial Sequence
  Synthetic oligonucleotide; TGG chr11 5399343 5399362 5399359 +
ttcctgaaagagatatagag

SEQ ID NO: 28854 - DNA, 20 bp, Artificial Sequence
  Synthetic oligonucleotide; GAG chr11 5399345 5399364 5399361 +
cctgaaagagatatagagtg

SEQ ID NO: 28855 - DNA, 20 bp, Artificial Sequence
  Synthetic oligonucleotide; GAG chr11 5399347 5399366 5399363 +
tgaaagagatatagagtgga

SEQ ID NO: 28856 - DNA, 20 bp, Artificial Sequence
  Synthetic oligonucleotide; TGG chr11 5399365 5399384 5399381 +
gagagaatattaacattcac

SEQ ID NO: 28857 - DNA, 20 bp, Artificial Sequence
  Synthetic oligonucleotide; AAG chr11 5399374 5399393 5399390 +
ttaacattcactggttgcta

SEQ ID NO: 28858 - DNA, 20 bp, Artificial Sequence
  Synthetic oligonucleotide; AGG chr11 5399375 5399394 5399391 +
taacattcactggttgctaa

SEQ ID NO: 28859 - DNA, 20 bp, Artificial Sequence
  Synthetic oligonucleotide; TAG chr11 5399393 5399412 5399409 +
aaaggctcacattaaatatt

SEQ ID NO: 28860 - DNA, 20 bp, Artificial Sequence
  Synthetic oligonucleotide; GAG chr11 5399395 5399414 5399411 +
aggctcacattaaatattta

SEQ ID NO: 28861 - DNA, 20 bp, Artificial Sequence
  Synthetic oligonucleotide; CAG chr11 5399399 5399418 5399415 +
tcacattaaatatttagagc

SEQ ID NO: 28862 - DNA, 20 bp, Artificial Sequence
  Synthetic oligonucleotide; GAG chr11 5399407 5399426 5399423 +
aatatttagagccagtccct

SEQ ID NO: 28863 - DNA, 20 bp, Artificial Sequence
  Synthetic oligonucleotide; AGG chr11 5399408 5399427 5399424 +
atatttagagccagtccctg

SEQ ID NO: 28864 - DNA, 20 bp, Artificial Sequence
  Synthetic oligonucleotide; AAG chr11 5399412 5399431 5399428 +
ttagagccagtccctgaggt

SEQ ID NO: 28865 - DNA, 20 bp, Artificial Sequence
  Synthetic oligonucleotide; AAG chr11 5399441 5399460 5399457 +
catctttatctttaaaaaca

SEQ ID NO: 28866 - DNA, 20 bp, Artificial Sequence
  Synthetic oligonucleotide; AAG chr11 5399459 5399478 5399475 +
caaagatactaatgtgcaca

SEQ ID NO: 28867 - DNA, 20 bp, Artificial Sequence
  Synthetic oligonucleotide; AGG chr11 5399460 5399479 5399476 +
aaagatactaatgtgcacaa

SEQ ID NO: 28868 - DNA, 20 bp, Artificial Sequence
  Synthetic oligonucleotide; AAG chr11 5399465 5399484 5399481 +
tactaatgtgcacaaaggta

SEQ ID NO: 28869 - DNA, 20 bp, Artificial Sequence
  Synthetic oligonucleotide; AAG chr11 5399474 5399493 5399490 +
gcacaaaggtaaagtacgta

SEQ ID NO: 28870 - DNA, 20 bp, Artificial Sequence
  Synthetic oligonucleotide; AAG chr11 5399490 5399509 5399506 +
cgtaaagttataccgaacat

SEQ ID NO: 28871 - DNA, 20 bp, Artificial Sequence
  Synthetic oligonucleotide; CAG chr11 5399512 5399531 5399528 +
gattcacctccaattctgtc

SEQ ID NO: 28872 - DNA, 20 bp, Artificial Sequence
  Synthetic oligonucleotide; CAG chr11 5399518 5399537 5399534 +
cctccaattctgtccagctc

SEQ ID NO: 28873 - DNA, 20 bp, Artificial Sequence
  Synthetic oligonucleotide; AGG chr11 5399519 5399538 5399535 +
ctccaattctgtccagctcc

SEQ ID NO: 28874 - DNA, 20 bp, Artificial Sequence
  Synthetic oligonucleotide; GGG chr11 5399520 5399539 5399536 +
tccaattctgtccagctcca

SEQ ID NO: 28875 - DNA, 20 bp, Artificial Sequence
  Synthetic oligonucleotide; GGG chr11 5399521 5399540 5399537 +
ccaattctgtccagctccag

SEQ ID NO: 28876 - DNA, 20 bp, Artificial Sequence
  Synthetic oligonucleotide; CAG chr11 5399526 5399545 5399542 +
tctgtccagctccaggggta

SEQ ID NO: 28877 - DNA, 20 bp, Artificial Sequence
  Synthetic oligonucleotide; TGG chr11 5399582 5399601 5399598 +
tttgttgtgtcctattatac

SEQ ID NO: 28878 - DNA, 20 bp, Artificial Sequence
  Synthetic oligonucleotide; GGG chr11 5399583 5399602 5399599 +
ttgttgtgtcctattatact

SEQ ID NO: 28879 - DNA, 20 bp, Artificial Sequence
  Synthetic oligonucleotide; TAG chr11 5399589 5399608 5399605 +
tgtcctattatactgggcta

SEQ ID NO: 28880 - DNA, 20 bp, Artificial Sequence
  Synthetic oligonucleotide; AAG chr11 5399619 5399638 5399635 +
gatcccttttgtaacctttc

SEQ ID NO: 28881 - DNA, 20 bp, Artificial Sequence
  Synthetic oligonucleotide; CAG chr11 5399654 5399673 5399670 +
tgtcaaacaaatcctaaact

SEQ ID NO: 28882 - DNA, 20 bp, Artificial Sequence
  Synthetic oligonucleotide; AGG chr11 5399655 5399674 5399671 +
gtcaaacaaatcctaaactc

SEQ ID NO: 28883 - DNA, 20 bp, Artificial Sequence
  Synthetic oligonucleotide; GAG chr11 5399657 5399676 5399673 +
caaacaaatcctaaactcag

SEQ ID NO: 28884 - DNA, 20 bp, Artificial Sequence
  Synthetic oligonucleotide; AAG chr11 5399674 5399693 5399690 +
caggagaatgattgtgtttt

SEQ ID NO: 28885 - DNA, 20 bp, Artificial Sequence
  Synthetic oligonucleotide; AAG chr11 5399686 5399705 5399702 +
tgtgttttaagatctctttc

SEQ ID NO: 28886 - DNA, 20 bp, Artificial Sequence
  Synthetic oligonucleotide; AGG chr11 5399687 5399706 5399703 +
gtgttttaagatctctttca

SEQ ID NO: 28887 - DNA, 20 bp, Artificial Sequence
  Synthetic oligonucleotide; GAG chr11 5399689 5399708 5399705 +
gttttaagatctctttcaag

SEQ ID NO: 28888 - DNA, 20 bp, Artificial Sequence
  Synthetic oligonucleotide; TGG chr11 5399706 5399725 5399722 +
aaggagatctgacccttatc

SEQ ID NO: 28889 - DNA, 20 bp, Artificial Sequence
  Synthetic oligonucleotide; CGG chr11 5399709 5399728 5399725 +
gagatctgacccttatctgg

SEQ ID NO: 28890 - DNA, 20 bp, Artificial Sequence
  Synthetic oligonucleotide; TAG chr11 5399712 5399731 5399728 +
atctgacccttatctggcgg

SEQ ID NO: 28891 - DNA, 20 bp, Artificial Sequence
  Synthetic oligonucleotide; GAG chr11 5399714 5399733 5399730 +
ctgacccttatctggcggta

SEQ ID NO: 28892 - DNA, 20 bp, Artificial Sequence
  Synthetic oligonucleotide; TGG chr11 5399721 5399740 5399737 +
ttatctggcggtagagactc

SEQ ID NO: 28893 - DNA, 20 bp, Artificial Sequence
  Synthetic oligonucleotide; GAG chr11 5399723 5399742 5399739 +
atctggcggtagagactctg

SEQ ID NO: 28894 - DNA, 20 bp, Artificial Sequence
  Synthetic oligonucleotide; TGG chr11 5399727 5399746 5399743 +
ggcggtagagactctggaga

SEQ ID NO: 28895 - DNA, 20 bp, Artificial Sequence
  Synthetic oligonucleotide; GAG chr11 5399735 5399754 5399751 +
agactctggagatggaaact

SEQ ID NO: 28896 - DNA, 20 bp, Artificial Sequence
  Synthetic oligonucleotide; AAG chr11 5399738 5399757 5399754 +
ctctggagatggaaactgag

SEQ ID NO: 28897 - DNA, 20 bp, Artificial Sequence
  Synthetic oligonucleotide; AGG chr11 5399739 5399758 5399755 +
tctggagatggaaactgaga

SEQ ID NO: 28898 - DNA, 20 bp, Artificial Sequence
  Synthetic oligonucleotide; AAG chr11 5399762 5399781 5399778 +
atgcaaaaaaaaaaaaatgc

SEQ ID NO: 28899 - DNA, 20 bp, Artificial Sequence
  Synthetic oligonucleotide; AAG chr11 5399766 5399785 5399782 +
aaaaaaaaaaaaatgcaaga

SEQ ID NO: 28900 - DNA, 20 bp, Artificial Sequence
  Synthetic oligonucleotide; AAG chr11 5399776 5399795 5399792 +
aaatgcaagaaagaaaaaaa

SEQ ID NO: 28901 - DNA, 20 bp, Artificial Sequence
  Synthetic oligonucleotide; AGG chr11 5399777 5399796 5399793 +
aatgcaagaaagaaaaaaaa

SEQ ID NO: 28902 - DNA, 20 bp, Artificial Sequence
  Synthetic oligonucleotide; AAG chr11 5399780 5399799 5399796 +
gcaagaaagaaaaaaaaagg

SEQ ID NO: 28903 - DNA, 20 bp, Artificial Sequence
  Synthetic oligonucleotide; AAG chr11 5399790 5399809 5399806 +
aaaaaaaaggaagaaaacaa

SEQ ID NO: 28904 - DNA, 20 bp, Artificial Sequence
  Synthetic oligonucleotide; GAG chr11 5399792 5399811 5399808 +
aaaaaaggaagaaaacaaaa

SEQ ID NO: 28905 - DNA, 20 bp, Artificial Sequence
  Synthetic oligonucleotide; CAG chr11 5399799 5399818 5399815 +
gaagaaaacaaaagagacca

SEQ ID NO: 28906 - DNA, 20 bp, Artificial Sequence
  Synthetic oligonucleotide; CAG chr11 5399803 5399822 5399819 +
aaaacaaaagagaccacaga

SEQ ID NO: 28907 - DNA, 20 bp, Artificial Sequence
  Synthetic oligonucleotide; AGG chr11 5399804 5399823 5399820 +
aaacaaaagagaccacagac

SEQ ID NO: 28908 - DNA, 20 bp, Artificial Sequence
  Synthetic oligonucleotide; CAG chr11 5399807 5399826 5399823 +
caaaagagaccacagacagg

SEQ ID NO: 28909 - DNA, 20 bp, Artificial Sequence
  Synthetic oligonucleotide; GAG chr11 5399809 5399828 5399825 +
aaagagaccacagacaggca

SEQ ID NO: 28910 - DNA, 20 bp, Artificial Sequence
  Synthetic oligonucleotide; AAG chr11 5399812 5399831 5399828 +
gagaccacagacaggcagag

SEQ ID NO: 28911 - DNA, 20 bp, Artificial Sequence
  Synthetic oligonucleotide; AGG chr11 5399813 5399832 5399829 +
agaccacagacaggcagaga

SEQ ID NO: 28912 - DNA, 20 bp, Artificial Sequence
  Synthetic oligonucleotide; CAG chr11 5399816 5399835 5399832 +
ccacagacaggcagagaagg

SEQ ID NO: 28913 - DNA, 20 bp, Artificial Sequence
  Synthetic oligonucleotide; GAG chr11 5399818 5399837 5399834 +
acagacaggcagagaaggca

SEQ ID NO: 28914 - DNA, 20 bp, Artificial Sequence
  Synthetic oligonucleotide; AGG chr11 5399819 5399838 5399835 +
cagacaggcagagaaggcag

SEQ ID NO: 28915 - DNA, 20 bp, Artificial Sequence
  Synthetic oligonucleotide; GAG chr11 5399821 5399840 5399837 +
gacaggcagagaaggcagag

SEQ ID NO: 28916 - DNA, 20 bp, Artificial Sequence
  Synthetic oligonucleotide; AGG chr11 5399822 5399841 5399838 +
acaggcagagaaggcagagg

SEQ ID NO: 28917 - DNA, 20 bp, Artificial Sequence
  Synthetic oligonucleotide; GAG chr11 5399824 5399843 5399840 +
aggcagagaaggcagaggag

SEQ ID NO: 28918 - DNA, 20 bp, Artificial Sequence
  Synthetic oligonucleotide; GAG chr11 5399826 5399845 5399842 +
gcagagaaggcagaggagga

SEQ ID NO: 28919 - DNA, 20 bp, Artificial Sequence
  Synthetic oligonucleotide; TAG chr11 5399833 5399852 5399849 +
aggcagaggaggagagactc

SEQ ID NO: 28920 - DNA, 20 bp, Artificial Sequence
  Synthetic oligonucleotide; AAG chr11 5399840 5399859 5399856 +
ggaggagagactctagtttc

SEQ ID NO: 28921 - DNA, 20 bp, Artificial Sequence
  Synthetic oligonucleotide; CAG chr11 5399846 5399865 5399862 +
gagactctagtttcaagtat

SEQ ID NO: 28922 - DNA, 20 bp, Artificial Sequence
  Synthetic oligonucleotide; AAG chr11 5399851 5399870 5399867 +
tctagtttcaagtatcagtc

SEQ ID NO: 28923 - DNA, 20 bp, Artificial Sequence
  Synthetic oligonucleotide; CGG chr11 5399873 5399892 5399889 +
gatttgtttcttccaatatc

SEQ ID NO: 28924 - DNA, 20 bp, Artificial Sequence
  Synthetic oligonucleotide; GAG chr11 5399882 5399901 5399898 +
cttccaatatccggttattt

SEQ ID NO: 28925 - DNA, 20 bp, Artificial Sequence
  Synthetic oligonucleotide; AGG chr11 5399883 5399902 5399899 +
ttccaatatccggttatttg

SEQ ID NO: 28926 - DNA, 20 bp, Artificial Sequence
  Synthetic oligonucleotide; TGG chr11 5399888 5399907 5399904 +
atatccggttatttgaggtg

SEQ ID NO: 28927 - DNA, 20 bp, Artificial Sequence
  Synthetic oligonucleotide; CAG chr11 5399891 5399910 5399907 +
tccggttatttgaggtgtgg

SEQ ID NO: 28928 - DNA, 20 bp, Artificial Sequence
  Synthetic oligonucleotide; AGG chr11 5399892 5399911 5399908 +
ccggttatttgaggtgtggc

SEQ ID NO: 28929 - DNA, 20 bp, Artificial Sequence
  Synthetic oligonucleotide; AAG chr11 5399896 5399915 5399912 +
ttatttgaggtgtggcaggc

SEQ ID NO: 28930 - DNA, 20 bp, Artificial Sequence
  Synthetic oligonucleotide; CAG chr11 5399902 5399921 5399918 +
gaggtgtggcaggcaagata

SEQ ID NO: 28931 - DNA, 20 bp, Artificial Sequence
  Synthetic oligonucleotide; AGG chr11 5399903 5399922 5399919 +
aggtgtggcaggcaagatac

SEQ ID NO: 28932 - DNA, 20 bp, Artificial Sequence
  Synthetic oligonucleotide; GGG chr11 5399904 5399923 5399920 +
ggtgtggcaggcaagataca

SEQ ID NO: 28933 - DNA, 20 bp, Artificial Sequence
  Synthetic oligonucleotide; CAG chr11 5399909 5399928 5399925 +
ggcaggcaagatacagggtg

SEQ ID NO: 28934 - DNA, 20 bp, Artificial Sequence
  Synthetic oligonucleotide; TGG chr11 5399912 5399931 5399928 +
aggcaagatacagggtgcag

SEQ ID NO: 28935 - DNA, 20 bp, Artificial Sequence
  Synthetic oligonucleotide; GGG chr11 5399913 5399932 5399929 +
ggcaagatacagggtgcagt

SEQ ID NO: 28936 - DNA, 20 bp, Artificial Sequence
  Synthetic oligonucleotide; AAG chr11 5399919 5399938 5399935 +
atacagggtgcagtgggatc

SEQ ID NO: 28937 - DNA, 20 bp, Artificial Sequence
  Synthetic oligonucleotide; AGG chr11 5399920 5399939 5399936 +
tacagggtgcagtgggatca

SEQ ID NO: 28938 - DNA, 20 bp, Artificial Sequence
  Synthetic oligonucleotide; CAG chr11 5399926 5399945 5399942 +
gtgcagtgggatcaaggatt

SEQ ID NO: 28939 - DNA, 20 bp, Artificial Sequence
  Synthetic oligonucleotide; AAG chr11 5399930 5399949 5399946 +
agtgggatcaaggattcagt

SEQ ID NO: 28940 - DNA, 20 bp, Artificial Sequence
  Synthetic oligonucleotide; AGG chr11 5399931 5399950 5399947 +
gtgggatcaaggattcagta

SEQ ID NO: 28941 - DNA, 20 bp, Artificial Sequence
  Synthetic oligonucleotide; CAG chr11 5399934 5399953 5399950 +
ggatcaaggattcagtaagg

SEQ ID NO: 28942 - DNA, 20 bp, Artificial Sequence
  Synthetic oligonucleotide; CGG chr11 5399941 5399960 5399957 +
ggattcagtaaggcagcaca

SEQ ID NO: 28943 - DNA, 20 bp, Artificial Sequence
  Synthetic oligonucleotide; GGG chr11 5399942 5399961 5399958 +
gattcagtaaggcagcacac

SEQ ID NO: 28944 - DNA, 20 bp, Artificial Sequence
  Synthetic oligonucleotide; AAG chr11 5399945 5399964 5399961 +
tcagtaaggcagcacacggg

SEQ ID NO: 28945 - DNA, 20 bp, Artificial Sequence
  Synthetic oligonucleotide; CAG chr11 5399950 5399969 5399966 +
aaggcagcacacgggaagaa

SEQ ID NO: 28946 - DNA, 20 bp, Artificial Sequence
  Synthetic oligonucleotide; CAG chr11 5399963 5399982 5399979 +
ggaagaacagctgctcaatc

SEQ ID NO: 28947 - DNA, 20 bp, Artificial Sequence
  Synthetic oligonucleotide; GAG chr11 5399965 5399984 5399981 +
aagaacagctgctcaatcca

SEQ ID NO: 28948 - DNA, 20 bp, Artificial Sequence
  Synthetic oligonucleotide; AGG chr11 5399966 5399985 5399982 +
agaacagctgctcaatccag

SEQ ID NO: 28949 - DNA, 20 bp, Artificial Sequence
  Synthetic oligonucleotide; CAG chr11 5399969 5399988 5399985 +
acagctgctcaatccagagg

SEQ ID NO: 28950 - DNA, 20 bp, Artificial Sequence
  Synthetic oligonucleotide; GAG chr11 5399979 5399998 5399982 -
tattgatctgcctctggatt

SEQ ID NO: 28951 - DNA, 20 bp, Artificial Sequence
  Synthetic oligonucleotide; CAG chr11 5399976 5399995 5399979 -
tgatctgcctctggattgag

SEQ ID NO: 28952 - DNA, 20 bp, Artificial Sequence
  Synthetic oligonucleotide; CGG chr11 5399895 5399914 5399898 -
cctgccacacctcaaataac

SEQ ID NO: 28953 - DNA, 20 bp, Artificial Sequence
  Synthetic oligonucleotide; TGG chr11 5399888 5399907 5399891 -
cacctcaaataaccggatat

SEQ ID NO: 28954 - DNA, 20 bp, Artificial Sequence
  Synthetic oligonucleotide; AAG chr11 5399885 5399904 5399888 -
ctcaaataaccggatattgg

SEQ ID NO: 28955 - DNA, 20 bp, Artificial Sequence
  Synthetic oligonucleotide; TAG chr11 5399855 5399874 5399858 -
tcttgactgatacttgaaac

SEQ ID NO: 28956 - DNA, 20 bp, Artificial Sequence
  Synthetic oligonucleotide; GAG chr11 5399853 5399872 5399856 -
ttgactgatacttgaaacta

SEQ ID NO: 28957 - DNA, 20 bp, Artificial Sequence
  Synthetic oligonucleotide; TGG chr11 5399819 5399838 5399822 -
ctgccttctctgcctgtctg

SEQ ID NO: 28958 - DNA, 20 bp, Artificial Sequence
  Synthetic oligonucleotide; CAG chr11 5399756 5399775 5399759 -
ttttttttttgcatccttct

SEQ ID NO: 28959 - DNA, 20 bp, Artificial Sequence
  Synthetic oligonucleotide; CAG chr11 5399743 5399762 5399746 -
tccttctcagtttccatctc

SEQ ID NO: 28960 - DNA, 20 bp, Artificial Sequence
  Synthetic oligonucleotide; GAG chr11 5399741 5399760 5399744 -
cttctcagtttccatctcca

SEQ ID NO: 28961 - DNA, 20 bp, Artificial Sequence
  Synthetic oligonucleotide; CAG chr11 5399728 5399747 5399731 -
atctccagagtctctaccgc

SEQ ID NO: 28962 - DNA, 20 bp, Artificial Sequence
  Synthetic oligonucleotide; AAG chr11 5399723 5399742 5399726 -
cagagtctctaccgccagat

SEQ ID NO: 28963 - DNA, 20 bp, Artificial Sequence
  Synthetic oligonucleotide; AGG chr11 5399722 5399741 5399725 -
agagtctctaccgccagata

SEQ ID NO: 28964 - DNA, 20 bp, Artificial Sequence
  Synthetic oligonucleotide; GGG chr11 5399721 5399740 5399724 -
gagtctctaccgccagataa

SEQ ID NO: 28965 - DNA, 20 bp, Artificial Sequence
  Synthetic oligonucleotide; CAG chr11 5399717 5399736 5399720 -
ctctaccgccagataagggt

SEQ ID NO: 28966 - DNA, 20 bp, Artificial Sequence
  Synthetic oligonucleotide; AAG chr11 5399704 5399723 5399707 -
taagggtcagatctccttga

SEQ ID NO: 28967 - DNA, 20 bp, Artificial Sequence
  Synthetic oligonucleotide; GAG chr11 5399702 5399721 5399705 -
agggtcagatctccttgaaa

SEQ ID NO: 28968 - DNA, 20 bp, Artificial Sequence
  Synthetic oligonucleotide; GAG chr11 5399675 5399694 5399678 -
taaaacacaatcattctcct

SEQ ID NO: 28969 - DNA, 20 bp, Artificial Sequence
  Synthetic oligonucleotide; TAG chr11 5399670 5399689 5399673 -
cacaatcattctcctgagtt

SEQ ID NO: 28970 - DNA, 20 bp, Artificial Sequence
  Synthetic oligonucleotide; AGG chr11 5399669 5399688 5399672 -
acaatcattctcctgagttt

SEQ ID NO: 28971 - DNA, 20 bp, Artificial Sequence
  Synthetic oligonucleotide; AAG chr11 5399655 5399674 5399658 -
gagtttaggatttgtttgac

SEQ ID NO: 28972 - DNA, 20 bp, Artificial Sequence
  Synthetic oligonucleotide; GAG chr11 5399653 5399672 5399656 -
gtttaggatttgtttgacaa

SEQ ID NO: 28973 - DNA, 20 bp, Artificial Sequence
  Synthetic oligonucleotide; TAG chr11 5399645 5399664 5399648 -
tttgtttgacaagagcattt

SEQ ID NO: 28974 - DNA, 20 bp, Artificial Sequence
  Synthetic oligonucleotide; AAG chr11 5399637 5399656 5399640 -
acaagagcattttagcttga

SEQ ID NO: 28975 - DNA, 20 bp, Artificial Sequence
  Synthetic oligonucleotide; AGG chr11 5399636 5399655 5399639 -
caagagcattttagcttgaa

SEQ ID NO: 28976 - DNA, 20 bp, Artificial Sequence
  Synthetic oligonucleotide; AAG chr11 5399627 5399646 5399630 -
tttagcttgaaaggttacaa

SEQ ID NO: 28977 - DNA, 20 bp, Artificial Sequence
  Synthetic oligonucleotide; AGG chr11 5399626 5399645 5399629 -
ttagcttgaaaggttacaaa

SEQ ID NO: 28978 - DNA, 20 bp, Artificial Sequence
  Synthetic oligonucleotide; GGG chr11 5399625 5399644 5399628 -
tagcttgaaaggttacaaaa

SEQ ID NO: 28979 - DNA, 20 bp, Artificial Sequence
  Synthetic oligonucleotide; TAG chr11 5399616 5399635 5399619 -
aggttacaaaagggatcatg

SEQ ID NO: 28980 - DNA, 20 bp, Artificial Sequence
  Synthetic oligonucleotide; TAG chr11 5399609 5399628 5399612 -
aaaagggatcatgtagtcta

SEQ ID NO: 28981 - DNA, 20 bp, Artificial Sequence
  Synthetic oligonucleotide; CAG chr11 5399604 5399623 5399607 -
ggatcatgtagtctatagcc

SEQ ID NO: 28982 - DNA, 20 bp, Artificial Sequence
  Synthetic oligonucleotide; TAG chr11 5399596 5399615 5399599 -
tagtctatagcccagtataa

SEQ ID NO: 28983 - DNA, 20 bp, Artificial Sequence
  Synthetic oligonucleotide; AGG chr11 5399595 5399614 5399598 -
agtctatagcccagtataat

SEQ ID NO: 28984 - DNA, 20 bp, Artificial Sequence
  Synthetic oligonucleotide; CAG chr11 5399581 5399600 5399584 -
tataataggacacaacaaat

SEQ ID NO: 28985 - DNA, 20 bp, Artificial Sequence
  Synthetic oligonucleotide; AAG chr11 5399573 5399592 5399576 -
gacacaacaaatcagaaaaa

SEQ ID NO: 28986 - DNA, 20 bp, Artificial Sequence
  Synthetic oligonucleotide; TAG chr11 5399570 5399589 5399573 -
acaacaaatcagaaaaaaag

SEQ ID NO: 28987 - DNA, 20 bp, Artificial Sequence
  Synthetic oligonucleotide; TGG chr11 5399563 5399582 5399566 -
atcagaaaaaaagtagaatg

SEQ ID NO: 28988 - DNA, 20 bp, Artificial Sequence
  Synthetic oligonucleotide; GGG chr11 5399562 5399581 5399565 -
tcagaaaaaaagtagaatgt

SEQ ID NO: 28989 - DNA, 20 bp, Artificial Sequence
  Synthetic oligonucleotide; CAG chr11 5399558 5399577 5399561 -
aaaaaaagtagaatgtggga

SEQ ID NO: 28990 - DNA, 20 bp, Artificial Sequence
  Synthetic oligonucleotide; TGG chr11 5399540 5399559 5399543 -
gacagtgatgactgtacccc

SEQ ID NO: 28991 - DNA, 20 bp, Artificial Sequence
  Synthetic oligonucleotide; GAG chr11 5399538 5399557 5399541 -
cagtgatgactgtacccctg

SEQ ID NO: 28992 - DNA, 20 bp, Artificial Sequence
  Synthetic oligonucleotide; TGG chr11 5399534 5399553 5399537 -
gatgactgtacccctggagc

SEQ ID NO: 28993 - DNA, 20 bp, Artificial Sequence
  Synthetic oligonucleotide; CAG chr11 5399530 5399549 5399533 -
actgtacccctggagctgga

SEQ ID NO: 28994 - DNA, 20 bp, Artificial Sequence
  Synthetic oligonucleotide; TGG chr11 5399524 5399543 5399527 -
cccctggagctggacagaat

SEQ ID NO: 28995 - DNA, 20 bp, Artificial Sequence
  Synthetic oligonucleotide; GAG chr11 5399522 5399541 5399525 -
cctggagctggacagaattg

SEQ ID NO: 28996 - DNA, 20 bp, Artificial Sequence
  Synthetic oligonucleotide; AGG chr11 5399521 5399540 5399524 -
ctggagctggacagaattgg

SEQ ID NO: 28997 - DNA, 20 bp, Artificial Sequence
  Synthetic oligonucleotide; CGG chr11 5399505 5399524 5399508 -
ttggaggtgaatcttatgtt

SEQ ID NO: 28998 - DNA, 20 bp, Artificial Sequence
  Synthetic oligonucleotide; TAG chr11 5399470 5399489 5399473 -
tactttacctttgtgcacat

SEQ ID NO: 28999 - DNA, 20 bp, Artificial Sequence
  Synthetic oligonucleotide; AAG chr11 5399453 5399472 5399456 -
cattagtatctttgttttta

SEQ ID NO: 29000 - DNA, 20 bp, Artificial Sequence
  Synthetic oligonucleotide; AAG chr11 5399447 5399466 5399450 -
tatctttgtttttaaagata

SEQ ID NO: 29001 - DNA, 20 bp, Artificial Sequence
  Synthetic oligonucleotide; CAG chr11 5399428 5399447 5399431 -
aaagatgttaatacttacct

SEQ ID NO: 29002 - DNA, 20 bp, Artificial Sequence
  Synthetic oligonucleotide; AGG chr11 5399427 5399446 5399430 -
aagatgttaatacttacctc

SEQ ID NO: 29003 - DNA, 20 bp, Artificial Sequence
  Synthetic oligonucleotide; GGG chr11 5399426 5399445 5399429 -
agatgttaatacttacctca

SEQ ID NO: 29004 - DNA, 20 bp, Artificial Sequence
  Synthetic oligonucleotide; TGG chr11 5399421 5399440 5399424 -
ttaatacttacctcagggac

SEQ ID NO: 29005 - DNA, 20 bp, Artificial Sequence
  Synthetic oligonucleotide; GAG chr11 5399401 5399420 5399404 -
tggctctaaatatttaatgt

SEQ ID NO: 29006 - DNA, 20 bp, Artificial Sequence
  Synthetic oligonucleotide; TAG chr11 5399394 5399413 5399397 -
aaatatttaatgtgagcctt

SEQ ID NO: 29007 - DNA, 20 bp, Artificial Sequence
  Synthetic oligonucleotide; CAG chr11 5399387 5399406 5399390 -
taatgtgagcctttagcaac

SEQ ID NO: 29008 - DNA, 20 bp, Artificial Sequence
  Synthetic oligonucleotide; CAG chr11 5399349 5399368 5399352 -
tctccactctatatctcttt

SEQ ID NO: 29009 - DNA, 20 bp, Artificial Sequence
  Synthetic oligonucleotide; AGG chr11 5399348 5399367 5399351 -
ctccactctatatctctttc

SEQ ID NO: 29010 - DNA, 20 bp, Artificial Sequence
  Synthetic oligonucleotide; CAG chr11 5399339 5399358 5399342 -
atatctctttcaggaattct

SEQ ID NO: 29011 - DNA, 20 bp, Artificial Sequence
  Synthetic oligonucleotide; AGG chr11 5399338 5399357 5399341 -
tatctctttcaggaattctc

SEQ ID NO: 29012 - DNA, 20 bp, Artificial Sequence
  Synthetic oligonucleotide; GAG chr11 5399336 5399355 5399339 -
tctctttcaggaattctcag

SEQ ID NO: 29013 - DNA, 20 bp, Artificial Sequence
  Synthetic oligonucleotide; CAG chr11 5399326 5399345 5399329 -
gaattctcaggagtcaatca

SEQ ID NO: 29014 - DNA, 20 bp, Artificial Sequence
  Synthetic oligonucleotide; CAG chr11 5399322 5399341 5399325 -
tctcaggagtcaatcacagt

SEQ ID NO: 29015 - DNA, 20 bp, Artificial Sequence
  Synthetic oligonucleotide; TGG chr11 5399277 5399296 5399280 -
taattgtctttccttgttat

SEQ ID NO: 29016 - DNA, 20 bp, Artificial Sequence
  Synthetic oligonucleotide; CAG chr11 5399262 5399281 5399265 -
gttattggctcactgatact

SEQ ID NO: 29017 - DNA, 20 bp, Artificial Sequence
  Synthetic oligonucleotide; GAG chr11 5399248 5399267 5399251 -
gatactcagaccacatctgt

SEQ ID NO: 29018 - DNA, 20 bp, Artificial Sequence
  Synthetic oligonucleotide; AGG chr11 5399247 5399266 5399250 -
atactcagaccacatctgtg

SEQ ID NO: 29019 - DNA, 20 bp, Artificial Sequence
  Synthetic oligonucleotide; AAG chr11 5399239 5399258 5399242 -
accacatctgtgaggtaaac

SEQ ID NO: 29020 - DNA, 20 bp, Artificial Sequence
  Synthetic oligonucleotide; AGG chr11 5399238 5399257 5399241 -
ccacatctgtgaggtaaaca

SEQ ID NO: 29021 - DNA, 20 bp, Artificial Sequence
  Synthetic oligonucleotide; GAG chr11 5399236 5399255 5399239 -
acatctgtgaggtaaacaag

SEQ ID NO: 29022 - DNA, 20 bp, Artificial Sequence
  Synthetic oligonucleotide; AAG chr11 5399231 5399250 5399234 -
tgtgaggtaaacaaggagac

SEQ ID NO: 29023 - DNA, 20 bp, Artificial Sequence
  Synthetic oligonucleotide; TAG chr11 5399214 5399233 5399217 -
gacaagaatttcccacttaa

SEQ ID NO: 29024 - DNA, 20 bp, Artificial Sequence
  Synthetic oligonucleotide; GAG chr11 5399209 5399228 5399212 -
gaatttcccacttaatagat

SEQ ID NO: 29025 - DNA, 20 bp, Artificial Sequence
  Synthetic oligonucleotide; CAG chr11 5399197 5399216 5399200 -
taatagatgagcatataaac

SEQ ID NO: 29026 - DNA, 20 bp, Artificial Sequence
  Synthetic oligonucleotide; AAG chr11 5399190 5399209 5399193 -
tgagcatataaaccagacat

SEQ ID NO: 29027 - DNA, 20 bp, Artificial Sequence
  Synthetic oligonucleotide; GAG chr11 5399179 5399198 5399182 -
accagacataagcattttgt

SEQ ID NO: 29028 - DNA, 20 bp, Artificial Sequence
  Synthetic oligonucleotide; AAG chr11 5399170 5399189 5399173 -
aagcattttgtgagtaaccc

SEQ ID NO: 29029 - DNA, 20 bp, Artificial Sequence
  Synthetic oligonucleotide; TGG chr11 5399158 5399177 5399161 -
agtaacccaagataatatga

SEQ ID NO: 29030 - DNA, 20 bp, Artificial Sequence
  Synthetic oligonucleotide; AAG chr11 5399143 5399162 5399146 -
tatgatggcaaaactatttc

SEQ ID NO: 29031 - DNA, 20 bp, Artificial Sequence
  Synthetic oligonucleotide; TGG chr11 5399124 5399143 5399127 -
caagaattcatgatgtgctc

SEQ ID NO: 29032 - DNA, 20 bp, Artificial Sequence
  Synthetic oligonucleotide; TAG chr11 5399088 5399107 5399091 -
ttttccatctgccaccaatt

SEQ ID NO: 29033 - DNA, 20 bp, Artificial Sequence
  Synthetic oligonucleotide; AGG chr11 5399087 5399106 5399090 -
tttccatctgccaccaattt

SEQ ID NO: 29034 - DNA, 20 bp, Artificial Sequence
  Synthetic oligonucleotide; CAG chr11 5399063 5399082 5399066 -
tgtgattcctctccttctgc

SEQ ID NO: 29035 - DNA, 20 bp, Artificial Sequence
  Synthetic oligonucleotide; CAG chr11 5399059 5399078 5399062 -
attcctctccttctgccaga

SEQ ID NO: 29036 - DNA, 20 bp, Artificial Sequence
  Synthetic oligonucleotide; AGG chr11 5399058 5399077 5399061 -
ttcctctccttctgccagac

SEQ ID NO: 29037 - DNA, 20 bp, Artificial Sequence
  Synthetic oligonucleotide; AAG chr11 5399052 5399071 5399055 -
tccttctgccagacaggttc

SEQ ID NO: 29038 - DNA, 20 bp, Artificial Sequence
  Synthetic oligonucleotide; AAG chr11 5399049 5399068 5399052 -
ttctgccagacaggttcaag

SEQ ID NO: 29039 - DNA, 20 bp, Artificial Sequence
  Synthetic oligonucleotide; TAG chr11 5399045 5399064 5399048 -
gccagacaggttcaagaagc

SEQ ID NO: 29040 - DNA, 20 bp, Artificial Sequence
  Synthetic oligonucleotide; AGG chr11 5399044 5399063 5399047 -
ccagacaggttcaagaagct

SEQ ID NO: 29041 - DNA, 20 bp, Artificial Sequence
  Synthetic oligonucleotide; GGG chr11 5399043 5399062 5399046 -
cagacaggttcaagaagcta

SEQ ID NO: 29042 - DNA, 20 bp, Artificial Sequence
  Synthetic oligonucleotide; GAG chr11 5399041 5399060 5399044 -
gacaggttcaagaagctagg

SEQ ID NO: 29043 - DNA, 20 bp, Artificial Sequence
  Synthetic oligonucleotide; AGG chr11 5399040 5399059 5399043 -
acaggttcaagaagctaggg

SEQ ID NO: 29044 - DNA, 20 bp, Artificial Sequence
  Synthetic oligonucleotide; TAG chr11 5399025 5399044 5399028 -
tagggaggtgactactgtct

SEQ ID NO: 29045 - DNA, 20 bp, Artificial Sequence
  Synthetic oligonucleotide; AGG chr11 5399024 5399043 5399027 -
agggaggtgactactgtctt

SEQ ID NO: 29046 - DNA, 20 bp, Artificial Sequence
  Synthetic oligonucleotide; AAG chr11 5399012 5399031 5399015 -
actgtcttaggaaaaatgct

SEQ ID NO: 29047 - DNA, 20 bp, Artificial Sequence
  Synthetic oligonucleotide; AGG chr11 5399011 5399030 5399014 -
ctgtcttaggaaaaatgcta

SEQ ID NO: 29048 - DNA, 20 bp, Artificial Sequence
  Synthetic oligonucleotide; GGG chr11 5399010 5399029 5399013 -
tgtcttaggaaaaatgctaa

SEQ ID NO: 29049 - DNA, 20 bp, Artificial Sequence
  Synthetic oligonucleotide; TGG chr11 5398992 5399011 5398995 -
aagggcttcacactgtgaca

SEQ ID NO: 29050 - DNA, 20 bp, Artificial Sequence
  Synthetic oligonucleotide; GGG chr11 5398991 5399010 5398994 -
agggcttcacactgtgacat

SEQ ID NO: 29051 - DNA, 20 bp, Artificial Sequence
  Synthetic oligonucleotide; GGG chr11 5398990 5399009 5398993 -
gggcttcacactgtgacatg

SEQ ID NO: 29052 - DNA, 20 bp, Artificial Sequence
  Synthetic oligonucleotide; TGG chr11 5398986 5399005 5398989 -
ttcacactgtgacatggggt

SEQ ID NO: 29053 - DNA, 20 bp, Artificial Sequence
  Synthetic oligonucleotide; GGG chr11 5398985 5399004 5398988 -
tcacactgtgacatggggtt

SEQ ID NO: 29054 - DNA, 20 bp, Artificial Sequence
  Synthetic oligonucleotide; GAG chr11 5398983 5399002 5398986 -
acactgtgacatggggttgg

SEQ ID NO: 29055 - DNA, 20 bp, Artificial Sequence
  Synthetic oligonucleotide; CAG chr11 5398965 5398984 5398968 -
gggagtcctgaatgctgctt

SEQ ID NO: 29056 - DNA, 20 bp, Artificial Sequence
  Synthetic oligonucleotide; AAG chr11 5398962 5398981 5398965 -
agtcctgaatgctgcttcag

SEQ ID NO: 29057 - DNA, 20 bp, Artificial Sequence
  Synthetic oligonucleotide; AGG chr11 5398961 5398980 5398964 -
gtcctgaatgctgcttcaga

SEQ ID NO: 29058 - DNA, 20 bp, Artificial Sequence
  Synthetic oligonucleotide; CAG chr11 5398958 5398977 5398961 -
ctgaatgctgcttcagaagg

SEQ ID NO: 29059 - DNA, 20 bp, Artificial Sequence
  Synthetic oligonucleotide; AGG chr11 5398957 5398976 5398960 -
tgaatgctgcttcagaaggc

SEQ ID NO: 29060 - DNA, 20 bp, Artificial Sequence
  Synthetic oligonucleotide; GGG chr11 5398956 5398975 5398959 -
gaatgctgcttcagaaggca

SEQ ID NO: 29061 - DNA, 20 bp, Artificial Sequence
  Synthetic oligonucleotide; TGG chr11 5398951 5398970 5398954 -
ctgcttcagaaggcagggct

SEQ ID NO: 29062 - DNA, 20 bp, Artificial Sequence
  Synthetic oligonucleotide; GGG chr11 5398950 5398969 5398953 -
tgcttcagaaggcagggctt

SEQ ID NO: 29063 - DNA, 20 bp, Artificial Sequence
  Synthetic oligonucleotide; GGG chr11 5398949 5398968 5398952 -
gcttcagaaggcagggcttg

SEQ ID NO: 29064 - DNA, 20 bp, Artificial Sequence
  Synthetic oligonucleotide; TAG chr11 5398939 5398958 5398942 -
gcagggcttggggattgtat

SEQ ID NO: 29065 - DNA, 20 bp, Artificial Sequence
  Synthetic oligonucleotide; AAG chr11 5398916 5398935 5398919 -
ttcattctcacactgctcta

SEQ ID NO: 29066 - DNA, 20 bp, Artificial Sequence
  Synthetic oligonucleotide; GAG chr11 5398904 5398923 5398907 -
ctgctctaaagatactacct

SEQ ID NO: 29067 - DNA, 20 bp, Artificial Sequence
  Synthetic oligonucleotide; TGG chr11 5398899 5398918 5398902 -
ctaaagatactacctgagac

SEQ ID NO: 29068 - DNA, 20 bp, Artificial Sequence
  Synthetic oligonucleotide; GGG chr11 5398898 5398917 5398901 -
taaagatactacctgagact

SEQ ID NO: 29069 - DNA, 20 bp, Artificial Sequence
  Synthetic oligonucleotide; AAG chr11 5398882 5398901 5398885 -
gactgggtaatttattaaca

SEQ ID NO: 29070 - DNA, 20 bp, Artificial Sequence
  Synthetic oligonucleotide; AGG chr11 5398881 5398900 5398884 -
actgggtaatttattaacaa

SEQ ID NO: 29071 - DNA, 20 bp, Artificial Sequence
  Synthetic oligonucleotide; GAG chr11 5398879 5398898 5398882 -
tgggtaatttattaacaaag

SEQ ID NO: 29072 - DNA, 20 bp, Artificial Sequence
  Synthetic oligonucleotide; AGG chr11 5398878 5398897 5398881 -
gggtaatttattaacaaagg

SEQ ID NO: 29073 - DNA, 20 bp, Artificial Sequence
  Synthetic oligonucleotide; TAG chr11 5398852 5398871 5398855 -
aattgactcacatttccaca

SEQ ID NO: 29074 - DNA, 20 bp, Artificial Sequence
  Synthetic oligonucleotide; TGG chr11 5398848 5398867 5398851 -
gactcacatttccacatagc

SEQ ID NO: 29075 - DNA, 20 bp, Artificial Sequence
  Synthetic oligonucleotide; GGG chr11 5398847 5398866 5398850 -
actcacatttccacatagct

SEQ ID NO: 29076 - DNA, 20 bp, Artificial Sequence
  Synthetic oligonucleotide; GGG chr11 5398846 5398865 5398849 -
ctcacatttccacatagctg

SEQ ID NO: 29077 - DNA, 20 bp, Artificial Sequence
  Synthetic oligonucleotide; GAG chr11 5398844 5398863 5398847 -
cacatttccacatagctggg

SEQ ID NO: 29078 - DNA, 20 bp, Artificial Sequence
  Synthetic oligonucleotide; AGG chr11 5398843 5398862 5398846 -
acatttccacatagctgggg

SEQ ID NO: 29079 - DNA, 20 bp, Artificial Sequence
  Synthetic oligonucleotide; CAG chr11 5398837 5398856 5398840 -
ccacatagctggggaggcct

SEQ ID NO: 29080 - DNA, 20 bp, Artificial Sequence
  Synthetic oligonucleotide; AGG chr11 5398836 5398855 5398839 -
cacatagctggggaggcctc

SEQ ID NO: 29081 - DNA, 20 bp, Artificial Sequence
  Synthetic oligonucleotide; TGG chr11 5398820 5398839 5398823 -
cctcaggaaacttacaatta

SEQ ID NO: 29082 - DNA, 20 bp, Artificial Sequence
  Synthetic oligonucleotide; CAG chr11 5398817 5398836 5398820 -
caggaaacttacaattatgg

SEQ ID NO: 29083 - DNA, 20 bp, Artificial Sequence
  Synthetic oligonucleotide; AAG chr11 5398814 5398833 5398817 -
gaaacttacaattatggcag

SEQ ID NO: 29084 - DNA, 20 bp, Artificial Sequence
  Synthetic oligonucleotide; AGG chr11 5398813 5398832 5398816 -
aaacttacaattatggcaga

SEQ ID NO: 29085 - DNA, 20 bp, Artificial Sequence
  Synthetic oligonucleotide; GAG chr11 5398811 5398830 5398814 -
acttacaattatggcagaag

SEQ ID NO: 29086 - DNA, 20 bp, Artificial Sequence
  Synthetic oligonucleotide; AAG chr11 5398808 5398827 5398811 -
tacaattatggcagaaggag

SEQ ID NO: 29087 - DNA, 20 bp, Artificial Sequence
  Synthetic oligonucleotide; CAG chr11 5398805 5398824 5398808 -
aattatggcagaaggagaag

SEQ ID NO: 29088 - DNA, 20 bp, Artificial Sequence
  Synthetic oligonucleotide; AGG chr11 5398804 5398823 5398807 -
attatggcagaaggagaagc

SEQ ID NO: 29089 - DNA, 20 bp, Artificial Sequence
  Synthetic oligonucleotide; TGG chr11 5398790 5398809 5398793 -
agaagcaggcacatcttact

SEQ ID NO: 29090 - DNA, 20 bp, Artificial Sequence
  Synthetic oligonucleotide; TGG chr11 5398787 5398806 5398790 -
agcaggcacatcttacttgg

SEQ ID NO: 29091 - DNA, 20 bp, Artificial Sequence
  Synthetic oligonucleotide; CAG chr11 5398784 5398803 5398787 -
aggcacatcttacttggtgg

SEQ ID NO: 29092 - DNA, 20 bp, Artificial Sequence
  Synthetic oligonucleotide; AGG chr11 5398783 5398802 5398786 -
ggcacatcttacttggtggc

SEQ ID NO: 29093 - DNA, 20 bp, Artificial Sequence
  Synthetic oligonucleotide; AAG chr11 5398779 5398798 5398782 -
catcttacttggtggcaggc

SEQ ID NO: 29094 - DNA, 20 bp, Artificial Sequence
  Synthetic oligonucleotide; GAG chr11 5398777 5398796 5398780 -
tcttacttggtggcaggcaa

SEQ ID NO: 29095 - DNA, 20 bp, Artificial Sequence
  Synthetic oligonucleotide; GAG chr11 5398775 5398794 5398778 -
ttacttggtggcaggcaaga

SEQ ID NO: 29096 - DNA, 20 bp, Artificial Sequence
  Synthetic oligonucleotide; GAG chr11 5398773 5398792 5398776 -
acttggtggcaggcaagaga

SEQ ID NO: 29097 - DNA, 20 bp, Artificial Sequence
  Synthetic oligonucleotide; GAG chr11 5398769 5398788 5398772 -
ggtggcaggcaagagagagt

SEQ ID NO: 29098 - DNA, 20 bp, Artificial Sequence
  Synthetic oligonucleotide; AAG chr11 5398765 5398784 5398768 -
gcaggcaagagagagtgagc

SEQ ID NO: 29099 - DNA, 20 bp, Artificial Sequence
  Synthetic oligonucleotide; AAG chr11 5398762 5398781 5398765 -
ggcaagagagagtgagcaag

SEQ ID NO: 29100 - DNA, 20 bp, Artificial Sequence
  Synthetic oligonucleotide; GAG chr11 5398760 5398779 5398763 -
caagagagagtgagcaagaa

SEQ ID NO: 29101 - DNA, 20 bp, Artificial Sequence
  Synthetic oligonucleotide; AGG chr11 5398759 5398778 5398762 -
aagagagagtgagcaagaag

SEQ ID NO: 29102 - DNA, 20 bp, Artificial Sequence
  Synthetic oligonucleotide; GGG chr11 5398758 5398777 5398761 -
agagagagtgagcaagaaga

SEQ ID NO: 29103 - DNA, 20 bp, Artificial Sequence
  Synthetic oligonucleotide; CAG chr11 5398734 5398753 5398737 -
aaactgccttataaaaccat

SEQ ID NO: 29104 - DNA, 20 bp, Artificial Sequence
  Synthetic oligonucleotide; CAG chr11 5398713 5398732 5398716 -
agatctcatgaaaactcact

SEQ ID NO: 29105 - DNA, 20 bp, Artificial Sequence
  Synthetic oligonucleotide; GAG chr11 5398704 5398723 5398707 -
gaaaactcactcagtatcac

SEQ ID NO: 29106 - DNA, 20 bp, Artificial Sequence
  Synthetic oligonucleotide; TGG chr11 5398694 5398713 5398697 -
tcagtatcacgagaactgca

SEQ ID NO: 29107 - DNA, 20 bp, Artificial Sequence
  Synthetic oligonucleotide; GGG chr11 5398693 5398712 5398696 -
cagtatcacgagaactgcat

SEQ ID NO: 29108 - DNA, 20 bp, Artificial Sequence
  Synthetic oligonucleotide; GGG chr11 5398692 5398711 5398695 -
agtatcacgagaactgcatg

SEQ ID NO: 29109 - DNA, 20 bp, Artificial Sequence
  Synthetic oligonucleotide; GGG chr11 5398691 5398710 5398694 -
gtatcacgagaactgcatgg

SEQ ID NO: 29110 - DNA, 20 bp, Artificial Sequence
  Synthetic oligonucleotide; TGG chr11 5398656 5398675 5398659 -
tgatccaataatctcccacc

SEQ ID NO: 29111 - DNA, 20 bp, Artificial Sequence
  Synthetic oligonucleotide; TAG chr11 5398637 5398656 5398640 -
ctggtccctcccccgacata

SEQ ID NO: 29112 - DNA, 20 bp, Artificial Sequence
  Synthetic oligonucleotide; AGG chr11 5398636 5398655 5398639 -
tggtccctcccccgacatat

SEQ ID NO: 29113 - DNA, 20 bp, Artificial Sequence
  Synthetic oligonucleotide; GGG chr11 5398635 5398654 5398638 -
ggtccctcccccgacatata

SEQ ID NO: 29114 - DNA, 20 bp, Artificial Sequence
  Synthetic oligonucleotide; TGG chr11 5398628 5398647 5398631 -
cccccgacatatagggatta

SEQ ID NO: 29115 - DNA, 20 bp, Artificial Sequence
  Synthetic oligonucleotide; GGG chr11 5398627 5398646 5398630 -
ccccgacatatagggattat

SEQ ID NO: 29116 - DNA, 20 bp, Artificial Sequence
  Synthetic oligonucleotide; GGG chr11 5398626 5398645 5398629 -
cccgacatatagggattatg

SEQ ID NO: 29117 - DNA, 20 bp, Artificial Sequence
  Synthetic oligonucleotide; TGG chr11 5398602 5398621 5398605 -
ttacaattcaatatgaaatt

SEQ ID NO: 29118 - DNA, 20 bp, Artificial Sequence
  Synthetic oligonucleotide; GGG chr11 5398601 5398620 5398604 -
tacaattcaatatgaaattt

SEQ ID NO: 29119 - DNA, 20 bp, Artificial Sequence
  Synthetic oligonucleotide; TGG chr11 5398598 5398617 5398601 -
aattcaatatgaaatttggg

SEQ ID NO: 29120 - DNA, 20 bp, Artificial Sequence
  Synthetic oligonucleotide; GAG chr11 5398596 5398615 5398599 -
ttcaatatgaaatttgggtg

SEQ ID NO: 29121 - DNA, 20 bp, Artificial Sequence
  Synthetic oligonucleotide; CAG chr11 5398590 5398609 5398593 -
atgaaatttgggtggagaca

SEQ ID NO: 29122 - DNA, 20 bp, Artificial Sequence
  Synthetic oligonucleotide; GAG chr11 5398588 5398607 5398591 -
gaaatttgggtggagacaca

SEQ ID NO: 29123 - DNA, 20 bp, Artificial Sequence
  Synthetic oligonucleotide; AAG chr11 5398583 5398602 5398586 -
ttgggtggagacacagagcc

SEQ ID NO: 29124 - DNA, 20 bp, Artificial Sequence
  Synthetic oligonucleotide; CAG chr11 5398574 5398593 5398577 -
gacacagagccaagccatat

SEQ ID NO: 29125 - DNA, 20 bp, Artificial Sequence
  Synthetic oligonucleotide; AGG chr11 5398573 5398592 5398576 -
acacagagccaagccatatc

SEQ ID NO: 29126 - DNA, 20 bp, Artificial Sequence
  Synthetic oligonucleotide; GGG chr11 5398572 5398591 5398575 -
cacagagccaagccatatca

SEQ ID NO: 29127 - DNA, 20 bp, Artificial Sequence
  Synthetic oligonucleotide; TGG chr11 5398565 5398584 5398568 -
ccaagccatatcagggatca

SEQ ID NO: 29128 - DNA, 20 bp, Artificial Sequence
  Synthetic oligonucleotide; GGG chr11 5398564 5398583 5398567 -
caagccatatcagggatcat

SEQ ID NO: 29129 - DNA, 20 bp, Artificial Sequence
  Synthetic oligonucleotide; AAG chr11 5398545 5398564 5398548 -
tgggcttgtgcactcaccac

SEQ ID NO: 29130 - DNA, 20 bp, Artificial Sequence
  Synthetic oligonucleotide; TGG chr11 5398536 5398555 5398539 -
gcactcaccacaagtgaaac

SEQ ID NO: 29131 - DNA, 20 bp, Artificial Sequence
  Synthetic oligonucleotide; GAG chr11 5398528 5398547 5398531 -
cacaagtgaaactggcctct

SEQ ID NO: 29132 - DNA, 20 bp, Artificial Sequence
  Synthetic oligonucleotide; CAG chr11 5398522 5398541 5398525 -
tgaaactggcctctgagcct

SEQ ID NO: 29133 - DNA, 20 bp, Artificial Sequence
  Synthetic oligonucleotide; AGG chr11 5398521 5398540 5398524 -
gaaactggcctctgagcctc

SEQ ID NO: 29134 - DNA, 20 bp, Artificial Sequence
  Synthetic oligonucleotide; TGG chr11 5398518 5398537 5398521 -
actggcctctgagcctcagg

SEQ ID NO: 29135 - DNA, 20 bp, Artificial Sequence
  Synthetic oligonucleotide; GGG chr11 5398517 5398536 5398520 -
ctggcctctgagcctcaggt

SEQ ID NO: 29136 - DNA, 20 bp, Artificial Sequence
  Synthetic oligonucleotide; TGG chr11 5398513 5398532 5398516 -
cctctgagcctcaggtggga

SEQ ID NO: 29137 - DNA, 20 bp, Artificial Sequence
  Synthetic oligonucleotide; GGG chr11 5398512 5398531 5398515 -
ctctgagcctcaggtgggat

SEQ ID NO: 29138 - DNA, 20 bp, Artificial Sequence
  Synthetic oligonucleotide; GGG chr11 5398511 5398530 5398514 -
tctgagcctcaggtgggatg

SEQ ID NO: 29139 - DNA, 20 bp, Artificial Sequence
  Synthetic oligonucleotide; AAG chr11 5398508 5398527 5398511 -
gagcctcaggtgggatgggg

SEQ ID NO: 29140 - DNA, 20 bp, Artificial Sequence
  Synthetic oligonucleotide; CAG chr11 5398498 5398517 5398501 -
tgggatggggaagctcactt

SEQ ID NO: 29141 - DNA, 20 bp, Artificial Sequence
  Synthetic oligonucleotide; AAG chr11 5398494 5398513 5398497 -
atggggaagctcacttcagc

SEQ ID NO: 29142 - DNA, 20 bp, Artificial Sequence
  Synthetic oligonucleotide; TGG chr11 5398479 5398498 5398482 -
tcagcaagtccctgccactg

SEQ ID NO: 29143 - DNA, 20 bp, Artificial Sequence
  Synthetic oligonucleotide; TAG chr11 5398462 5398481 5398465 -
ctgtggcattcatatcttct

SEQ ID NO: 29144 - DNA, 20 bp, Artificial Sequence
  Synthetic oligonucleotide; TGG chr11 5398456 5398475 5398459 -
cattcatatcttcttagtcc

SEQ ID NO: 29145 - DNA, 20 bp, Artificial Sequence
  Synthetic oligonucleotide; GGG chr11 5398455 5398474 5398458 -
attcatatcttcttagtcct

SEQ ID NO: 29146 - DNA, 20 bp, Artificial Sequence
  Synthetic oligonucleotide; GGG chr11 5398454 5398473 5398457 -
ttcatatcttcttagtcctg

SEQ ID NO: 29147 - DNA, 20 bp, Artificial Sequence
  Synthetic oligonucleotide; TGG chr11 5398450 5398469 5398453 -
tatcttcttagtcctggggc

SEQ ID NO: 29148 - DNA, 20 bp, Artificial Sequence
  Synthetic oligonucleotide; AAG chr11 5398426 5398445 5398429 -
atgctgcccattttttgaaa

SEQ ID NO: 29149 - DNA, 20 bp, Artificial Sequence
  Synthetic oligonucleotide; CAG chr11 5398418 5398437 5398421 -
cattttttgaaaaagctgat

SEQ ID NO: 29150 - DNA, 20 bp, Artificial Sequence
  Synthetic oligonucleotide; GAG chr11 5398416 5398435 5398419 -
ttttttgaaaaagctgatca

SEQ ID NO: 29151 - DNA, 20 bp, Artificial Sequence
  Synthetic oligonucleotide; TAG chr11 5398409 5398428 5398412 -
aaaaagctgatcagagtctc

SEQ ID NO: 29152 - DNA, 20 bp, Artificial Sequence
  Synthetic oligonucleotide; AGG chr11 5398408 5398427 5398411 -
aaaagctgatcagagtctct

SEQ ID NO: 29153 - DNA, 20 bp, Artificial Sequence
  Synthetic oligonucleotide; GAG chr11 5398406 5398425 5398409 -
aagctgatcagagtctctag

SEQ ID NO: 29154 - DNA, 20 bp, Artificial Sequence
  Synthetic oligonucleotide; TAG chr11 5398403 5398422 5398406 -
ctgatcagagtctctaggag

SEQ ID NO: 29155 - DNA, 20 bp, Artificial Sequence
  Synthetic oligonucleotide; GAG chr11 5398401 5398420 5398404 -
gatcagagtctctaggagta

SEQ ID NO: 29156 - DNA, 20 bp, Artificial Sequence
  Synthetic oligonucleotide; TGG chr11 5398395 5398414 5398398 -
agtctctaggagtagagtaa

SEQ ID NO: 29157 - DNA, 20 bp, Artificial Sequence
  Synthetic oligonucleotide; GGG chr11 5398394 5398413 5398397 -
gtctctaggagtagagtaat

SEQ ID NO: 29158 - DNA, 20 bp, Artificial Sequence
  Synthetic oligonucleotide; GGG chr11 5398393 5398412 5398396 -
tctctaggagtagagtaatg

SEQ ID NO: 29159 - DNA, 20 bp, Artificial Sequence
  Synthetic oligonucleotide; GAG chr11 5398391 5398410 5398394 -
tctaggagtagagtaatggg

SEQ ID NO: 29160 - DNA, 20 bp, Artificial Sequence
  Synthetic oligonucleotide; AAG chr11 5398387 5398406 5398390 -
ggagtagagtaatggggaga

SEQ ID NO: 29161 - DNA, 20 bp, Artificial Sequence
  Synthetic oligonucleotide; TAG chr11 5398383 5398402 5398386 -
tagagtaatggggagaaagt

SEQ ID NO: 29162 - DNA, 20 bp, Artificial Sequence
  Synthetic oligonucleotide; AGG chr11 5398382 5398401 5398385 -
agagtaatggggagaaagtt

SEQ ID NO: 29163 - DNA, 20 bp, Artificial Sequence
  Synthetic oligonucleotide; GAG chr11 5398373 5398392 5398376 -
gggagaaagttaggttccct

SEQ ID NO: 29164 - DNA, 20 bp, Artificial Sequence
  Synthetic oligonucleotide; AGG chr11 5398372 5398391 5398375 -
ggagaaagttaggttccctg

SEQ ID NO: 29165 - DNA, 20 bp, Artificial Sequence
  Synthetic oligonucleotide; GAG chr11 5398370 5398389 5398373 -
agaaagttaggttccctgag

SEQ ID NO: 29166 - DNA, 20 bp, Artificial Sequence
  Synthetic oligonucleotide; CAG chr11 5398359 5398378 5398362 -
ttccctgaggagcaattacc

SEQ ID NO: 29167 - DNA, 20 bp, Artificial Sequence
  Synthetic oligonucleotide; AGG chr11 5398358 5398377 5398361 -
tccctgaggagcaattaccc

SEQ ID NO: 29168 - DNA, 20 bp, Artificial Sequence
  Synthetic oligonucleotide; TAG chr11 5398346 5398365 5398349 -
aattacccaggtaattacat

SEQ ID NO: 29169 - DNA, 20 bp, Artificial Sequence
  Synthetic oligonucleotide; CAG chr11 5398329 5398348 5398332 -
cattagcctctctcaatatc

SEQ ID NO: 29170 - DNA, 20 bp, Artificial Sequence
  Synthetic oligonucleotide; GAG chr11 5398327 5398346 5398330 -
ttagcctctctcaatatcca

SEQ ID NO: 29171 - DNA, 20 bp, Artificial Sequence
  Synthetic oligonucleotide; AAG chr11 5398319 5398338 5398322 -
tctcaatatccagagaacct

SEQ ID NO: 29172 - DNA, 20 bp, Artificial Sequence
  Synthetic oligonucleotide; AGG chr11 5398318 5398337 5398321 -
ctcaatatccagagaaccta

SEQ ID NO: 29173 - DNA, 20 bp, Artificial Sequence
  Synthetic oligonucleotide; GGG chr11 5398317 5398336 5398320 -
tcaatatccagagaacctaa

SEQ ID NO: 29174 - DNA, 20 bp, Artificial Sequence
  Synthetic oligonucleotide; AAG chr11 5398310 5398329 5398313 -
ccagagaacctaagggaaac

SEQ ID NO: 29175 - DNA, 20 bp, Artificial Sequence
  Synthetic oligonucleotide; AAG chr11 5398305 5398324 5398308 -
gaacctaagggaaacaagca

SEQ ID NO: 29176 - DNA, 20 bp, Artificial Sequence
  Synthetic oligonucleotide; TAG chr11 5398299 5398318 5398302 -
aagggaaacaagcaaagata

SEQ ID NO: 29177 - DNA, 20 bp, Artificial Sequence
  Synthetic oligonucleotide; GAG chr11 5398297 5398316 5398300 -
gggaaacaagcaaagatata

SEQ ID NO: 29178 - DNA, 20 bp, Artificial Sequence
  Synthetic oligonucleotide; CAG chr11 5398293 5398312 5398296 -
aacaagcaaagatatagagt

SEQ ID NO: 29179 - DNA, 20 bp, Artificial Sequence
  Synthetic oligonucleotide; GAG chr11 5398276 5398295 5398279 -
agtcagtatctttgtgaaat

SEQ ID NO: 29180 - DNA, 20 bp, Artificial Sequence
  Synthetic oligonucleotide; TAG chr11 5398268 5398287 5398271 -
tctttgtgaaatgagtgtaa

SEQ ID NO: 29181 - DNA, 20 bp, Artificial Sequence
  Synthetic oligonucleotide; CAG chr11 5398257 5398276 5398260 -
tgagtgtaatagtatttatc

SEQ ID NO: 29182 - DNA, 20 bp, Artificial Sequence
  Synthetic oligonucleotide; AAG chr11 5398192 5398211 5398195 -
ttattttttgttatactttt

SEQ ID NO: 29183 - DNA, 20 bp, Artificial Sequence
  Synthetic oligonucleotide; TAG chr11 5398186 5398205 5398189 -
tttgttatacttttaagttt

SEQ ID NO: 29184 - DNA, 20 bp, Artificial Sequence
  Synthetic oligonucleotide; AGG chr11 5398185 5398204 5398188 -
ttgttatacttttaagtttt

SEQ ID NO: 29185 - DNA, 20 bp, Artificial Sequence
  Synthetic oligonucleotide; GGG chr11 5398184 5398203 5398187 -
tgttatacttttaagtttta

SEQ ID NO: 29186 - DNA, 20 bp, Artificial Sequence
  Synthetic oligonucleotide; AAG chr11 5398170 5398189 5398173 -
gttttagggtacatgtgcac

SEQ ID NO: 29187 - DNA, 20 bp, Artificial Sequence
  Synthetic oligonucleotide; AGG chr11 5398169 5398188 5398172 -
ttttagggtacatgtgcaca

SEQ ID NO: 29188 - DNA, 20 bp, Artificial Sequence
  Synthetic oligonucleotide; CAG chr11 5398164 5398183 5398167 -
gggtacatgtgcacaaggtg

SEQ ID NO: 29189 - DNA, 20 bp, Artificial Sequence
  Synthetic oligonucleotide; AGG chr11 5398163 5398182 5398166 -
ggtacatgtgcacaaggtgc

SEQ ID NO: 29190 - DNA, 20 bp, Artificial Sequence
  Synthetic oligonucleotide; TAG chr11 5398159 5398178 5398162 -
catgtgcacaaggtgcaggt

SEQ ID NO: 29191 - DNA, 20 bp, Artificial Sequence
  Synthetic oligonucleotide; TGG chr11 5398131 5398150 5398134 -
tatgtatacatgtgccatgt

SEQ ID NO: 29192 - DNA, 20 bp, Artificial Sequence
  Synthetic oligonucleotide; TAG chr11 5398096 5398115 5398099 -
attaactcaccatttaacat

SEQ ID NO: 29193 - DNA, 20 bp, Artificial Sequence
  Synthetic oligonucleotide; AGG chr11 5398095 5398114 5398098 -
ttaactcaccatttaacatt

SEQ ID NO: 29194 - DNA, 20 bp, Artificial Sequence
  Synthetic oligonucleotide; CAG chr11 5398048 5398067 5398051 -
cccctcctcccaccccacaa

SEQ ID NO: 29195 - DNA, 20 bp, Artificial Sequence
  Synthetic oligonucleotide; AGG chr11 5398047 5398066 5398050 -
ccctcctcccaccccacaac

SEQ ID NO: 29196 - DNA, 20 bp, Artificial Sequence
  Synthetic oligonucleotide; CGG chr11 5398041 5398060 5398044 -
tcccaccccacaacaggccc

SEQ ID NO: 29197 - DNA, 20 bp, Artificial Sequence
  Synthetic oligonucleotide; CAG chr11 5397996 5398015 5397999 -
gtccatgtgttctcattgtt

SEQ ID NO: 29198 - DNA, 20 bp, Artificial Sequence
  Synthetic oligonucleotide; GAG chr11 5397982 5398001 5397985 -
attgttcagttcccacctat

SEQ ID NO: 29199 - DNA, 20 bp, Artificial Sequence
  Synthetic oligonucleotide; GAG chr11 5397978 5397997 5397981 -
ttcagttcccacctatgagt

SEQ ID NO: 29200 - DNA, 20 bp, Artificial Sequence
  Synthetic oligonucleotide; TGG chr11 5397969 5397988 5397972 -
cacctatgagtgagaacatg

SEQ ID NO: 29201 - DNA, 20 bp, Artificial Sequence
  Synthetic oligonucleotide; TGG chr11 5397962 5397981 5397965 -
gagtgagaacatgtggtgtt

SEQ ID NO: 29202 - DNA, 20 bp, Artificial Sequence
  Synthetic oligonucleotide; TAG chr11 5397943 5397962 5397946 -
ttggctttttgtccttgtga

SEQ ID NO: 29203 - DNA, 20 bp, Artificial Sequence
  Synthetic oligonucleotide; GAG chr11 5397934 5397953 5397937 -
tgtccttgtgatagtttgct

SEQ ID NO: 29204 - DNA, 20 bp, Artificial Sequence
  Synthetic oligonucleotide; TGG chr11 5397926 5397945 5397929 -
tgatagtttgctgagaatga

SEQ ID NO: 29205 - DNA, 20 bp, Artificial Sequence
  Synthetic oligonucleotide; CAG chr11 5397919 5397938 5397922 -
ttgctgagaatgatggtttc

SEQ ID NO: 29206 - DNA, 20 bp, Artificial Sequence
  Synthetic oligonucleotide; AAG chr11 5397897 5397916 5397900 -
gcttcatccatgtccctaca

SEQ ID NO: 29207 - DNA, 20 bp, Artificial Sequence
  Synthetic oligonucleotide; AGG chr11 5397896 5397915 5397899 -
cttcatccatgtccctacaa

SEQ ID NO: 29208 - DNA, 20 bp, Artificial Sequence
  Synthetic oligonucleotide; TGG chr11 5397872 5397891 5397875 -
catgaactcatcatttttta

SEQ ID NO: 29209 - DNA, 20 bp, Artificial Sequence
  Synthetic oligonucleotide; TAG chr11 5397864 5397883 5397867 -
catcattttttatggctgca

SEQ ID NO: 29210 - DNA, 20 bp, Artificial Sequence
  Synthetic oligonucleotide; TGG chr11 5397854 5397873 5397857 -
tatggctgcatagtattcca

SEQ ID NO: 29211 - DNA, 20 bp, Artificial Sequence
  Synthetic oligonucleotide; CAG chr11 5397825 5397844 5397828 -
tgtgccacattttcttaatc

SEQ ID NO: 29212 - DNA, 20 bp, Artificial Sequence
  Synthetic oligonucleotide; TGG chr11 5397811 5397830 5397814 -
ttaatccagtctatcattgt

SEQ ID NO: 29213 - DNA, 20 bp, Artificial Sequence
  Synthetic oligonucleotide; TGG chr11 5397803 5397822 5397806 -
gtctatcattgttggacatt

SEQ ID NO: 29214 - DNA, 20 bp, Artificial Sequence
  Synthetic oligonucleotide; GGG chr11 5397802 5397821 5397805 -
tctatcattgttggacattt

SEQ ID NO: 29215 - DNA, 20 bp, Artificial Sequence
  Synthetic oligonucleotide; TGG chr11 5397798 5397817 5397801 -
tcattgttggacatttgggt

SEQ ID NO: 29216 - DNA, 20 bp, Artificial Sequence
  Synthetic oligonucleotide; AAG chr11 5397791 5397810 5397794 -
tggacatttgggttggttcc

SEQ ID NO: 29217 - DNA, 20 bp, Artificial Sequence
  Synthetic oligonucleotide; TAG chr11 5397772 5397791 5397775 -
caagtctttgctattgtgaa

SEQ ID NO: 29218 - DNA, 20 bp, Artificial Sequence
  Synthetic oligonucleotide; TAG chr11 5397735 5397754 5397738 -
tacgtgtgcatgtgtcttta

SEQ ID NO: 29219 - DNA, 20 bp, Artificial Sequence
  Synthetic oligonucleotide; CAG chr11 5397732 5397751 5397735 -
gtgtgcatgtgtctttatag

SEQ ID NO: 29220 - DNA, 20 bp, Artificial Sequence
  Synthetic oligonucleotide; TGG chr11 5397712 5397731 5397715 -
cagcatgatttataatcctt

SEQ ID NO: 29221 - DNA, 20 bp, Artificial Sequence
  Synthetic oligonucleotide; GGG chr11 5397711 5397730 5397714 -
agcatgatttataatccttt

SEQ ID NO: 29222 - DNA, 20 bp, Artificial Sequence
  Synthetic oligonucleotide; CAG chr11 5397700 5397719 5397703 -
taatcctttgggtgtatacc

SEQ ID NO: 29223 - DNA, 20 bp, Artificial Sequence
  Synthetic oligonucleotide; TGG chr11 5397694 5397713 5397697 -
tttgggtgtatacccagtaa

SEQ ID NO: 29224 - DNA, 20 bp, Artificial Sequence
  Synthetic oligonucleotide; GGG chr11 5397693 5397712 5397696 -
ttgggtgtatacccagtaat

SEQ ID NO: 29225 - DNA, 20 bp, Artificial Sequence
  Synthetic oligonucleotide; TGG chr11 5397689 5397708 5397692 -
gtgtatacccagtaatggga

SEQ ID NO: 29226 - DNA, 20 bp, Artificial Sequence
  Synthetic oligonucleotide; TGG chr11 5397685 5397704 5397688 -
atacccagtaatgggatggc

SEQ ID NO: 29227 - DNA, 20 bp, Artificial Sequence
  Synthetic oligonucleotide; GGG chr11 5397684 5397703 5397687 -
tacccagtaatgggatggct

SEQ ID NO: 29228 - DNA, 20 bp, Artificial Sequence
  Synthetic oligonucleotide; TGG chr11 5397676 5397695 5397679 -
aatgggatggctgggtcaaa

SEQ ID NO: 29229 - DNA, 20 bp, Artificial Sequence
  Synthetic oligonucleotide; TAG chr11 5397667 5397686 5397670 -
gctgggtcaaatggtatttc

SEQ ID NO: 29230 - DNA, 20 bp, Artificial Sequence
  Synthetic oligonucleotide; TAG chr11 5397661 5397680 5397664 -
tcaaatggtatttctagttc

SEQ ID NO: 29231 - DNA, 20 bp, Artificial Sequence
  Synthetic oligonucleotide; GAG chr11 5397652 5397671 5397655 -
atttctagttctagatccct

SEQ ID NO: 29232 - DNA, 20 bp, Artificial Sequence
  Synthetic oligonucleotide; AGG chr11 5397651 5397670 5397654 -
tttctagttctagatccctg

SEQ ID NO: 29233 - DNA, 20 bp, Artificial Sequence
  Synthetic oligonucleotide; TAG chr11 5397616 5397635 5397619 -
gacttccacaatgtttgaac

SEQ ID NO: 29234 - DNA, 20 bp, Artificial Sequence
  Synthetic oligonucleotide; CAG chr11 5397609 5397628 5397612 -
acaatgtttgaactagttta

SEQ ID NO: 29235 - DNA, 20 bp, Artificial Sequence
  Synthetic oligonucleotide; CAG chr11 5397597 5397616 5397600 -
ctagtttacagtcccaccaa

SEQ ID NO: 29236 - DNA, 20 bp, Artificial Sequence
  Synthetic oligonucleotide; AAG chr11 5397589 5397608 5397592 -
cagtcccaccaacagtgtaa

SEQ ID NO: 29237 - DNA, 20 bp, Artificial Sequence
  Synthetic oligonucleotide; CAG chr11 5397561 5397580 5397564 -
ctatttctccacatcctctc

SEQ ID NO: 29238 - DNA, 20 bp, Artificial Sequence
  Synthetic oligonucleotide; TGG chr11 5397517 5397536 5397520 -
ttaatgattgccattctaac

SEQ ID NO: 29239 - DNA, 20 bp, Artificial Sequence
  Synthetic oligonucleotide; GAG chr11 5397511 5397530 5397514 -
attgccattctaactggtgt

SEQ ID NO: 29240 - DNA, 20 bp, Artificial Sequence
  Synthetic oligonucleotide; TGG chr11 5397507 5397526 5397510 -
ccattctaactggtgtgaga

SEQ ID NO: 29241 - DNA, 20 bp, Artificial Sequence
  Synthetic oligonucleotide; TGG chr11 5397494 5397513 5397497 -
tgtgagatggtatctcattg

SEQ ID NO: 29242 - DNA, 20 bp, Artificial Sequence
  Synthetic oligonucleotide; TGG chr11 5397470 5397489 5397473 -
tttgatttgcatttctctga

SEQ ID NO: 29243 - DNA, 20 bp, Artificial Sequence
  Synthetic oligonucleotide; CAG chr11 5397466 5397485 5397469 -
atttgcatttctctgatggc

SEQ ID NO: 29244 - DNA, 20 bp, Artificial Sequence
  Synthetic oligonucleotide; GAG chr11 5397456 5397475 5397459 -
ctctgatggccagtgatgat

SEQ ID NO: 29245 - DNA, 20 bp, Artificial Sequence
  Synthetic oligonucleotide; TGG chr11 5397434 5397453 5397437 -
gcattttttcatgtgtcttt

SEQ ID NO: 29246 - DNA, 20 bp, Artificial Sequence
  Synthetic oligonucleotide; GAG chr11 5397411 5397430 5397414 -
ctgcataaatgtcttctttt

SEQ ID NO: 29247 - DNA, 20 bp, Artificial Sequence
  Synthetic oligonucleotide; AAG chr11 5397408 5397427 5397411 -
cataaatgtcttcttttgag

SEQ ID NO: 29248 - DNA, 20 bp, Artificial Sequence
  Synthetic oligonucleotide; TGG chr11 5397374 5397393 5397377 -
atcctttgcccactttttga

SEQ ID NO: 29249 - DNA, 20 bp, Artificial Sequence
  Synthetic oligonucleotide; GGG chr11 5397373 5397392 5397376 -
tcctttgcccactttttgat

SEQ ID NO: 29250 - DNA, 20 bp, Artificial Sequence
  Synthetic oligonucleotide; GGG chr11 5397372 5397391 5397375 -
cctttgcccactttttgatg

SEQ ID NO: 29251 - DNA, 20 bp, Artificial Sequence
  Synthetic oligonucleotide; GAG chr11 5397344 5397363 5397347 -
tttctcttgtaaatttgttt

SEQ ID NO: 29252 - DNA, 20 bp, Artificial Sequence
  Synthetic oligonucleotide; TAG chr11 5397334 5397353 5397337 -
aaatttgtttgagttcattg

SEQ ID NO: 29253 - DNA, 20 bp, Artificial Sequence
  Synthetic oligonucleotide; TGG chr11 5397327 5397346 5397330 -
tttgagttcattgtagattc

SEQ ID NO: 29254 - DNA, 20 bp, Artificial Sequence
  Synthetic oligonucleotide; TAG chr11 5397320 5397339 5397323 -
tcattgtagattctggatat

SEQ ID NO: 29255 - DNA, 20 bp, Artificial Sequence
  Synthetic oligonucleotide; CAG chr11 5397309 5397328 5397312 -
tctggatattagccctttgt

SEQ ID NO: 29256 - DNA, 20 bp, Artificial Sequence
  Synthetic oligonucleotide; GAG chr11 5397304 5397323 5397307 -
atattagccctttgtcagat

SEQ ID NO: 29257 - DNA, 20 bp, Artificial Sequence
  Synthetic oligonucleotide; TAG chr11 5397301 5397320 5397304 -
ttagccctttgtcagatgag

SEQ ID NO: 29258 - DNA, 20 bp, Artificial Sequence
  Synthetic oligonucleotide; TAG chr11 5397273 5397292 5397276 -
aaaaattttctcccattgtg

SEQ ID NO: 29259 - DNA, 20 bp, Artificial Sequence
  Synthetic oligonucleotide; AGG chr11 5397272 5397291 5397275 -
aaaattttctcccattgtgt

SEQ ID NO: 29260 - DNA, 20 bp, Artificial Sequence
  Synthetic oligonucleotide; TGG chr11 5397252 5397271 5397255 -
aggttgcctgttcactctga

SEQ ID NO: 29261 - DNA, 20 bp, Artificial Sequence
  Synthetic oligonucleotide; TAG chr11 5397249 5397268 5397252 -
ttgcctgttcactctgatgg

SEQ ID NO: 29262 - DNA, 20 bp, Artificial Sequence
  Synthetic oligonucleotide; CAG chr11 5397232 5397251 5397235 -
tggtagtttcttttgctgtg

SEQ ID NO: 29263 - DNA, 20 bp, Artificial Sequence
  Synthetic oligonucleotide; AAG chr11 5397229 5397248 5397232 -
tagtttcttttgctgtgcag

SEQ ID NO: 29264 - DNA, 20 bp, Artificial Sequence
  Synthetic oligonucleotide; TAG chr11 5397221 5397240 5397224 -
tttgctgtgcagaagatctt

SEQ ID NO: 29265 - DNA, 20 bp, Artificial Sequence
  Synthetic oligonucleotide; TAG chr11 5397212 5397231 5397215 -
cagaagatctttagtttaat

SEQ ID NO: 29266 - DNA, 20 bp, Artificial Sequence
  Synthetic oligonucleotide; TAG chr11 5397202 5397221 5397205 -
ttagtttaattagatcccat

SEQ ID NO: 29267 - DNA, 20 bp, Artificial Sequence
  Synthetic oligonucleotide; TGG chr11 5397192 5397211 5397195 -
tagatcccattagtgaattt

SEQ ID NO: 29268 - DNA, 20 bp, Artificial Sequence
  Synthetic oligonucleotide; TGG chr11 5397170 5397189 5397173 -
gcttttgttgccattgcttt

SEQ ID NO: 29269 - DNA, 20 bp, Artificial Sequence
  Synthetic oligonucleotide; TAG chr11 5397162 5397181 5397165 -
tgccattgcttttggtgttt

SEQ ID NO: 29270 - DNA, 20 bp, Artificial Sequence
  Synthetic oligonucleotide; AAG chr11 5397154 5397173 5397157 -
cttttggtgttttagacatg

SEQ ID NO: 29271 - DNA, 20 bp, Artificial Sequence
  Synthetic oligonucleotide; TGG chr11 5397126 5397145 5397129 -
gcccatgcctatgtcctgaa

SEQ ID NO: 29272 - DNA, 20 bp, Artificial Sequence
  Synthetic oligonucleotide; TAG chr11 5397116 5397135 5397119 -
atgtcctgaatggtattgct

SEQ ID NO: 29273 - DNA, 20 bp, Artificial Sequence
  Synthetic oligonucleotide; AGG chr11 5397115 5397134 5397118 -
tgtcctgaatggtattgctt

SEQ ID NO: 29274 - DNA, 20 bp, Artificial Sequence
  Synthetic oligonucleotide; TAG chr11 5397104 5397123 5397107 -
gtattgcttaggttttcttc

SEQ ID NO: 29275 - DNA, 20 bp, Artificial Sequence
  Synthetic oligonucleotide; GAG chr11 5397102 5397121 5397105 -
attgcttaggttttcttcta

SEQ ID NO: 29276 - DNA, 20 bp, Artificial Sequence
  Synthetic oligonucleotide; TGG chr11 5397093 5397112 5397096 -
gttttcttctagagttttta

SEQ ID NO: 29277 - DNA, 20 bp, Artificial Sequence
  Synthetic oligonucleotide; TAG chr11 5397087 5397106 5397090 -
ttctagagtttttatggttt

SEQ ID NO: 29278 - DNA, 20 bp, Artificial Sequence
  Synthetic oligonucleotide; AGG chr11 5397086 5397105 5397089 -
tctagagtttttatggtttt

SEQ ID NO: 29279 - DNA, 20 bp, Artificial Sequence
  Synthetic oligonucleotide; AAG chr11 5397073 5397092 5397076 -
tggttttaggtctaacattt

SEQ ID NO: 29280 - DNA, 20 bp, Artificial Sequence
  Synthetic oligonucleotide; GAG chr11 5397055 5397074 5397058 -
ttaagtctttaatccatctt

SEQ ID NO: 29281 - DNA, 20 bp, Artificial Sequence
  Synthetic oligonucleotide; AAG chr11 5397039 5397058 5397042 -
tcttgagttaatttttgtat

SEQ ID NO: 29282 - DNA, 20 bp, Artificial Sequence
  Synthetic oligonucleotide; AGG chr11 5397038 5397057 5397041 -
cttgagttaatttttgtata

SEQ ID NO: 29283 - DNA, 20 bp, Artificial Sequence
  Synthetic oligonucleotide; AAG chr11 5397032 5397051 5397035 -
ttaatttttgtataaggtgt

SEQ ID NO: 29284 - DNA, 20 bp, Artificial Sequence
  Synthetic oligonucleotide; AGG chr11 5397031 5397050 5397034 -
taatttttgtataaggtgta

SEQ ID NO: 29285 - DNA, 20 bp, Artificial Sequence
  Synthetic oligonucleotide; AAG chr11 5397028 5397047 5397031 -
tttttgtataaggtgtaagg

SEQ ID NO: 29286 - DNA, 20 bp, Artificial Sequence
  Synthetic oligonucleotide; AGG chr11 5397027 5397046 5397030 -
ttttgtataaggtgtaagga

SEQ ID NO: 29287 - DNA, 20 bp, Artificial Sequence
  Synthetic oligonucleotide; GGG chr11 5397026 5397045 5397029 -
tttgtataaggtgtaaggaa

SEQ ID NO: 29288 - DNA, 20 bp, Artificial Sequence
  Synthetic oligonucleotide; CAG chr11 5397020 5397039 5397023 -
taaggtgtaaggaagggatc

SEQ ID NO: 29289 - DNA, 20 bp, Artificial Sequence
  Synthetic oligonucleotide; CAG chr11 5397014 5397033 5397017 -
gtaaggaagggatccagttt

SEQ ID NO: 29290 - DNA, 20 bp, Artificial Sequence
  Synthetic oligonucleotide; TGG chr11 5397000 5397019 5397003 -
cagtttcagcttcctacatt

SEQ ID NO: 29291 - DNA, 20 bp, Artificial Sequence
  Synthetic oligonucleotide; TAG chr11 5396996 5397015 5396999 -
ttcagcttcctacatttggc

SEQ ID NO: 29292 - DNA, 20 bp, Artificial Sequence
  Synthetic oligonucleotide; CAG chr11 5396992 5397011 5396995 -
gcttcctacatttggctagc

SEQ ID NO: 29293 - DNA, 20 bp, Artificial Sequence
  Synthetic oligonucleotide; CAG chr11 5396983 5397002 5396986 -
atttggctagccagttttcc

SEQ ID NO: 29294 - DNA, 20 bp, Artificial Sequence
  Synthetic oligonucleotide; CAG chr11 5396966 5396985 5396969 -
tcccagcaccatttattaaa

SEQ ID NO: 29295 - DNA, 20 bp, Artificial Sequence
  Synthetic oligonucleotide; AGG chr11 5396965 5396984 5396968 -
cccagcaccatttattaaac

SEQ ID NO: 29296 - DNA, 20 bp, Artificial Sequence
  Synthetic oligonucleotide; GGG chr11 5396964 5396983 5396967 -
ccagcaccatttattaaaca

SEQ ID NO: 29297 - DNA, 20 bp, Artificial Sequence
  Synthetic oligonucleotide; CAG chr11 5396934 5396953 5396937 -
tccccatttcttgtttttct

SEQ ID NO: 29298 - DNA, 20 bp, Artificial Sequence
  Synthetic oligonucleotide; AGG chr11 5396933 5396952 5396936 -
ccccatttcttgtttttctc

SEQ ID NO: 29299 - DNA, 20 bp, Artificial Sequence
  Synthetic oligonucleotide; AAG chr11 5396923 5396942 5396926 -
tgtttttctcaggtttgtca

SEQ ID NO: 29300 - DNA, 20 bp, Artificial Sequence
  Synthetic oligonucleotide; CAG chr11 5396918 5396937 5396921 -
ttctcaggtttgtcaaagat

SEQ ID NO: 29301 - DNA, 20 bp, Artificial Sequence
  Synthetic oligonucleotide; TAG chr11 5396914 5396933 5396917 -
caggtttgtcaaagatcaga

SEQ ID NO: 29302 - DNA, 20 bp, Artificial Sequence
  Synthetic oligonucleotide; TAG chr11 5396908 5396927 5396911 -
tgtcaaagatcagatagttg

SEQ ID NO: 29303 - DNA, 20 bp, Artificial Sequence
  Synthetic oligonucleotide; TAG chr11 5396904 5396923 5396907 -
aaagatcagatagttgtaga

SEQ ID NO: 29304 - DNA, 20 bp, Artificial Sequence
  Synthetic oligonucleotide; CAG chr11 5396900 5396919 5396903 -
atcagatagttgtagataga

SEQ ID NO: 29305 - DNA, 20 bp, Artificial Sequence
  Synthetic oligonucleotide; GAG chr11 5396887 5396906 5396890 -
agatagacagcattatttct

SEQ ID NO: 29306 - DNA, 20 bp, Artificial Sequence
  Synthetic oligonucleotide; AGG chr11 5396886 5396905 5396889 -
gatagacagcattatttctg

SEQ ID NO: 29307 - DNA, 20 bp, Artificial Sequence
  Synthetic oligonucleotide; GGG chr11 5396885 5396904 5396888 -
atagacagcattatttctga

SEQ ID NO: 29308 - DNA, 20 bp, Artificial Sequence
  Synthetic oligonucleotide; TGG chr11 5396866 5396885 5396869 -
agggctctgttttgttccat

SEQ ID NO: 29309 - DNA, 20 bp, Artificial Sequence
  Synthetic oligonucleotide; TGG chr11 5396848 5396867 5396851 -
attggtctatatctctgttt

SEQ ID NO: 29310 - DNA, 20 bp, Artificial Sequence
  Synthetic oligonucleotide; CAG chr11 5396842 5396861 5396845 -
ctatatctctgttttggtac

SEQ ID NO: 29311 - DNA, 20 bp, Artificial Sequence
  Synthetic oligonucleotide; TGG chr11 5396826 5396845 5396829 -
gtaccagtactatgctgttt

SEQ ID NO: 29312 - DNA, 20 bp, Artificial Sequence
  Synthetic oligonucleotide; TAG chr11 5396817 5396836 5396820 -
ctatgctgttttggttactg

SEQ ID NO: 29313 - DNA, 20 bp, Artificial Sequence
  Synthetic oligonucleotide; TAG chr11 5396809 5396828 5396812 -
ttttggttactgtagccttg

SEQ ID NO: 29314 - DNA, 20 bp, Artificial Sequence
  Synthetic oligonucleotide; TAG chr11 5396804 5396823 5396807 -
gttactgtagccttgtagta

SEQ ID NO: 29315 - DNA, 20 bp, Artificial Sequence
  Synthetic oligonucleotide; CAG chr11 5396793 5396812 5396796 -
cttgtagtatagtttgaaat

SEQ ID NO: 29316 - DNA, 20 bp, Artificial Sequence
  Synthetic oligonucleotide; AGG chr11 5396792 5396811 5396795 -
ttgtagtatagtttgaaatc

SEQ ID NO: 29317 - DNA, 20 bp, Artificial Sequence
  Synthetic oligonucleotide; TAG chr11 5396789 5396808 5396792 -
tagtatagtttgaaatcagg

SEQ ID NO: 29318 - DNA, 20 bp, Artificial Sequence
  Synthetic oligonucleotide; CAG chr11 5396775 5396794 5396778 -
atcaggtagtgtgatgcctc

SEQ ID NO: 29319 - DNA, 20 bp, Artificial Sequence
  Synthetic oligonucleotide; TGG chr11 5396761 5396780 5396764 -
tgcctccagctttgttcttt

SEQ ID NO: 29320 - DNA, 20 bp, Artificial Sequence
  Synthetic oligonucleotide; TAG chr11 5396756 5396775 5396759 -
ccagctttgttcttttggct

SEQ ID NO: 29321 - DNA, 20 bp, Artificial Sequence
  Synthetic oligonucleotide; AGG chr11 5396755 5396774 5396758 -
cagctttgttcttttggctt

SEQ ID NO: 29322 - DNA, 20 bp, Artificial Sequence
  Synthetic oligonucleotide; TGG chr11 5396745 5396764 5396748 -
cttttggcttaggattgact

SEQ ID NO: 29323 - DNA, 20 bp, Artificial Sequence
  Synthetic oligonucleotide; CGG chr11 5396737 5396756 5396740 -
ttaggattgacttggcgatg

SEQ ID NO: 29324 - DNA, 20 bp, Artificial Sequence
  Synthetic oligonucleotide; GGG chr11 5396736 5396755 5396739 -
taggattgacttggcgatgc

SEQ ID NO: 29325 - DNA, 20 bp, Artificial Sequence
  Synthetic oligonucleotide; TGG chr11 5396725 5396744 5396728 -
tggcgatgcgggctcttttt

SEQ ID NO: 29326 - DNA, 20 bp, Artificial Sequence
  Synthetic oligonucleotide; AAG chr11 5396706 5396725 5396709 -
ttggttccatatgaacttta

SEQ ID NO: 29327 - DNA, 20 bp, Artificial Sequence
  Synthetic oligonucleotide; TAG chr11 5396703 5396722 5396706 -
gttccatatgaactttaaag

SEQ ID NO: 29328 - DNA, 20 bp, Artificial Sequence
  Synthetic oligonucleotide; AAG chr11 5396683 5396702 5396686 -
tagttttttccaattctgtg

SEQ ID NO: 29329 - DNA, 20 bp, Artificial Sequence
  Synthetic oligonucleotide; AAG chr11 5396679 5396698 5396682 -
tttttccaattctgtgaaga

SEQ ID NO: 29330 - DNA, 20 bp, Artificial Sequence
  Synthetic oligonucleotide; TGG chr11 5396672 5396691 5396675 -
aattctgtgaagaaagtcat

SEQ ID NO: 29331 - DNA, 20 bp, Artificial Sequence
  Synthetic oligonucleotide; TAG chr11 5396669 5396688 5396672 -
tctgtgaagaaagtcattgg

SEQ ID NO: 29332 - DNA, 20 bp, Artificial Sequence
  Synthetic oligonucleotide; TGG chr11 5396661 5396680 5396664 -
gaaagtcattggtagcttga

SEQ ID NO: 29333 - DNA, 20 bp, Artificial Sequence
  Synthetic oligonucleotide; GGG chr11 5396660 5396679 5396663 -
aaagtcattggtagcttgat

SEQ ID NO: 29334 - DNA, 20 bp, Artificial Sequence
  Synthetic oligonucleotide; GGG chr11 5396659 5396678 5396662 -
aagtcattggtagcttgatg

SEQ ID NO: 29335 - DNA, 20 bp, Artificial Sequence
  Synthetic oligonucleotide; TGG chr11 5396655 5396674 5396658 -
cattggtagcttgatgggga

SEQ ID NO: 29336 - DNA, 20 bp, Artificial Sequence
  Synthetic oligonucleotide; TGG chr11 5396631 5396650 5396634 -
attgaatctataaattacct

SEQ ID NO: 29337 - DNA, 20 bp, Artificial Sequence
  Synthetic oligonucleotide; GGG chr11 5396630 5396649 5396633 -
ttgaatctataaattacctt

SEQ ID NO: 29338 - DNA, 20 bp, Artificial Sequence
  Synthetic oligonucleotide; CAG chr11 5396627 5396646 5396630 -
aatctataaattaccttggg

SEQ ID NO: 29339 - DNA, 20 bp, Artificial Sequence
  Synthetic oligonucleotide; TGG chr11 5396622 5396641 5396625 -
ataaattaccttgggcagta

SEQ ID NO: 29340 - DNA, 20 bp, Artificial Sequence
  Synthetic oligonucleotide; GAG chr11 5396587 5396606 5396590 -
tattgtttcttcctatccat

SEQ ID NO: 29341 - DNA, 20 bp, Artificial Sequence
  Synthetic oligonucleotide; TGG chr11 5396582 5396601 5396585 -
tttcttcctatccatgagca

SEQ ID NO: 29342 - DNA, 20 bp, Artificial Sequence
  Synthetic oligonucleotide; GAG chr11 5396545 5396564 5396548 -
tgtttgtatcttatttcctt

SEQ ID NO: 29343 - DNA, 20 bp, Artificial Sequence
  Synthetic oligonucleotide; CAG chr11 5396542 5396561 5396545 -
ttgtatcttatttccttgag

SEQ ID NO: 29344 - DNA, 20 bp, Artificial Sequence
  Synthetic oligonucleotide; TGG chr11 5396539 5396558 5396542 -
tatcttatttccttgagcag

SEQ ID NO: 29345 - DNA, 20 bp, Artificial Sequence
  Synthetic oligonucleotide; TAG chr11 5396532 5396551 5396535 -
tttccttgagcagtggtttg

SEQ ID NO: 29346 - DNA, 20 bp, Artificial Sequence
  Synthetic oligonucleotide; AAG chr11 5396520 5396539 5396523 -
gtggtttgtagttctccttg

SEQ ID NO: 29347 - DNA, 20 bp, Artificial Sequence
  Synthetic oligonucleotide; GAG chr11 5396518 5396537 5396521 -
ggtttgtagttctccttgaa

SEQ ID NO: 29348 - DNA, 20 bp, Artificial Sequence
  Synthetic oligonucleotide; AGG chr11 5396517 5396536 5396520 -
gtttgtagttctccttgaag

SEQ ID NO: 29349 - DNA, 20 bp, Artificial Sequence
  Synthetic oligonucleotide; AAG chr11 5396497 5396516 5396500 -
aggtccttcacatcccttgt

SEQ ID NO: 29350 - DNA, 20 bp, Artificial Sequence
  Synthetic oligonucleotide; TGG chr11 5396493 5396512 5396496 -
ccttcacatcccttgtaagt

SEQ ID NO: 29351 - DNA, 20 bp, Artificial Sequence
  Synthetic oligonucleotide; TAG chr11 5396485 5396504 5396488 -
tcccttgtaagttggattcc

SEQ ID NO: 29352 - DNA, 20 bp, Artificial Sequence
  Synthetic oligonucleotide; AGG chr11 5396484 5396503 5396487 -
cccttgtaagttggattcct

SEQ ID NO: 29353 - DNA, 20 bp, Artificial Sequence
  Synthetic oligonucleotide; AAG chr11 5396465 5396484 5396468 -
taggtattatattctctctg

SEQ ID NO: 29354 - DNA, 20 bp, Artificial Sequence
  Synthetic oligonucleotide; TGG chr11 5396452 5396471 5396455 -
ctctctgaagcaattgtgaa

SEQ ID NO: 29355 - DNA, 20 bp, Artificial Sequence
  Synthetic oligonucleotide; GGG chr11 5396451 5396470 5396454 -
tctctgaagcaattgtgaat

SEQ ID NO: 29356 - DNA, 20 bp, Artificial Sequence
  Synthetic oligonucleotide; GAG chr11 5396449 5396468 5396452 -
tctgaagcaattgtgaatgg

SEQ ID NO: 29357 - DNA, 20 bp, Artificial Sequence
  Synthetic oligonucleotide; TGG chr11 5396423 5396442 5396426 -
actcactgtttgtctgttat

SEQ ID NO: 29358 - DNA, 20 bp, Artificial Sequence
  Synthetic oligonucleotide; AAG chr11 5396415 5396434 5396418 -
tttgtctgttattggtgtat

SEQ ID NO: 29359 - DNA, 20 bp, Artificial Sequence
  Synthetic oligonucleotide; GAG chr11 5396376 5396395 5396379 -
gcacattgattttgtatcct

SEQ ID NO: 29360 - DNA, 20 bp, Artificial Sequence
  Synthetic oligonucleotide; AAG chr11 5396364 5396383 5396367 -
tgtatcctgagactttgctg

SEQ ID NO: 29361 - DNA, 20 bp, Artificial Sequence
  Synthetic oligonucleotide; CAG chr11 5396353 5396372 5396356 -
actttgctgaagttgcttat

SEQ ID NO: 29362 - DNA, 20 bp, Artificial Sequence
  Synthetic oligonucleotide; AAG chr11 5396347 5396366 5396350 -
ctgaagttgcttatcagctt

SEQ ID NO: 29363 - DNA, 20 bp, Artificial Sequence
  Synthetic oligonucleotide; AGG chr11 5396346 5396365 5396349 -
tgaagttgcttatcagctta

SEQ ID NO: 29364 - DNA, 20 bp, Artificial Sequence
  Synthetic oligonucleotide; GGG chr11 5396345 5396364 5396348 -
gaagttgcttatcagcttaa

SEQ ID NO: 29365 - DNA, 20 bp, Artificial Sequence
  Synthetic oligonucleotide; GGG chr11 5396344 5396363 5396347 -
aagttgcttatcagcttaag

SEQ ID NO: 29366 - DNA, 20 bp, Artificial Sequence
  Synthetic oligonucleotide; TGG chr11 5396337 5396356 5396340 -
ttatcagcttaaggggattt

SEQ ID NO: 29367 - DNA, 20 bp, Artificial Sequence
  Synthetic oligonucleotide; GGG chr11 5396336 5396355 5396339 -
tatcagcttaaggggatttt

SEQ ID NO: 29368 - DNA, 20 bp, Artificial Sequence
  Synthetic oligonucleotide; GAG chr11 5396331 5396350 5396334 -
gcttaaggggattttgggct

SEQ ID NO: 29369 - DNA, 20 bp, Artificial Sequence
  Synthetic oligonucleotide; TGG chr11 5396324 5396343 5396327 -
gggattttgggctgagacaa

SEQ ID NO: 29370 - DNA, 20 bp, Artificial Sequence
  Synthetic oligonucleotide; GGG chr11 5396323 5396342 5396326 -
ggattttgggctgagacaat

SEQ ID NO: 29371 - DNA, 20 bp, Artificial Sequence
  Synthetic oligonucleotide; GGG chr11 5396322 5396341 5396325 -
gattttgggctgagacaatg

SEQ ID NO: 29372 - DNA, 20 bp, Artificial Sequence
  Synthetic oligonucleotide; TAG chr11 5396314 5396333 5396317 -
gctgagacaatggggttttc

SEQ ID NO: 29373 - DNA, 20 bp, Artificial Sequence
  Synthetic oligonucleotide; CAG chr11 5396287 5396306 5396290 -
gcaatcacgtcatctgcaaa

SEQ ID NO: 29374 - DNA, 20 bp, Artificial Sequence
  Synthetic oligonucleotide; AGG chr11 5396286 5396305 5396289 -
caatcacgtcatctgcaaac

SEQ ID NO: 29375 - DNA, 20 bp, Artificial Sequence
  Synthetic oligonucleotide; GGG chr11 5396285 5396304 5396288 -
aatcacgtcatctgcaaaca

SEQ ID NO: 29376 - DNA, 20 bp, Artificial Sequence
  Synthetic oligonucleotide; CGG chr11 5396220 5396239 5396223 -
ccttctcctgcccgattgcc

SEQ ID NO: 29377 - DNA, 20 bp, Artificial Sequence
  Synthetic oligonucleotide; GGG chr11 5396219 5396238 5396222 -
cttctcctgcccgattgccc

SEQ ID NO: 29378 - DNA, 20 bp, Artificial Sequence
  Synthetic oligonucleotide; CAG chr11 5396215 5396234 5396218 -
tcctgcccgattgcccgggc

SEQ ID NO: 29379 - DNA, 20 bp, Artificial Sequence
  Synthetic oligonucleotide; TAG chr11 5396191 5396210 5396194 -
acttccaacactatgttgaa

SEQ ID NO: 29380 - DNA, 20 bp, Artificial Sequence
  Synthetic oligonucleotide; AGG chr11 5396190 5396209 5396193 -
cttccaacactatgttgaat

SEQ ID NO: 29381 - DNA, 20 bp, Artificial Sequence
  Synthetic oligonucleotide; GAG chr11 5396188 5396207 5396191 -
tccaacactatgttgaatag

SEQ ID NO: 29382 - DNA, 20 bp, Artificial Sequence
  Synthetic oligonucleotide; TGG chr11 5396185 5396204 5396188 -
aacactatgttgaataggag

SEQ ID NO: 29383 - DNA, 20 bp, Artificial Sequence
  Synthetic oligonucleotide; GAG chr11 5396181 5396200 5396184 -
ctatgttgaataggagtggt

SEQ ID NO: 29384 - DNA, 20 bp, Artificial Sequence
  Synthetic oligonucleotide; GAG chr11 5396179 5396198 5396182 -
atgttgaataggagtggtga

SEQ ID NO: 29385 - DNA, 20 bp, Artificial Sequence
  Synthetic oligonucleotide; GAG chr11 5396177 5396196 5396180 -
gttgaataggagtggtgaga

SEQ ID NO: 29386 - DNA, 20 bp, Artificial Sequence
  Synthetic oligonucleotide; AGG chr11 5396176 5396195 5396179 -
ttgaataggagtggtgagag

SEQ ID NO: 29387 - DNA, 20 bp, Artificial Sequence
  Synthetic oligonucleotide; GGG chr11 5396175 5396194 5396178 -
tgaataggagtggtgagaga

SEQ ID NO: 29388 - DNA, 20 bp, Artificial Sequence
  Synthetic oligonucleotide; CAG chr11 5396159 5396178 5396162 -
gagagggcatccctgtcttg

SEQ ID NO: 29389 - DNA, 20 bp, Artificial Sequence
  Synthetic oligonucleotide; TAG chr11 5396154 5396173 5396157 -
ggcatccctgtcttgcagcc

SEQ ID NO: 29390 - DNA, 20 bp, Artificial Sequence
  Synthetic oligonucleotide; AGG chr11 5396153 5396172 5396156 -
gcatccctgtcttgcagcct

SEQ ID NO: 29391 - DNA, 20 bp, Artificial Sequence
  Synthetic oligonucleotide; TAG chr11 5396139 5396158 5396142 -
cagcctaggcacattttcat

SEQ ID NO: 29392 - DNA, 20 bp, Artificial Sequence
  Synthetic oligonucleotide; AGG chr11 5396138 5396157 5396141 -
agcctaggcacattttcatt

SEQ ID NO: 29393 - DNA, 20 bp, Artificial Sequence
  Synthetic oligonucleotide; CAG chr11 5396135 5396154 5396138 -
ctaggcacattttcattagg

SEQ ID NO: 29394 - DNA, 20 bp, Artificial Sequence
  Synthetic oligonucleotide; CAG chr11 5396130 5396149 5396133 -
cacattttcattaggcagtg

SEQ ID NO: 29395 - DNA, 20 bp, Artificial Sequence
  Synthetic oligonucleotide; TGG chr11 5396125 5396144 5396128 -
tttcattaggcagtgcagtg

SEQ ID NO: 29396 - DNA, 20 bp, Artificial Sequence
  Synthetic oligonucleotide; AAG chr11 5396120 5396139 5396123 -
ttaggcagtgcagtgtggtt

SEQ ID NO: 29397 - DNA, 20 bp, Artificial Sequence
  Synthetic oligonucleotide; GAG chr11 5396118 5396137 5396121 -
aggcagtgcagtgtggttaa

SEQ ID NO: 29398 - DNA, 20 bp, Artificial Sequence
  Synthetic oligonucleotide; CAG chr11 5396115 5396134 5396118 -
cagtgcagtgtggttaagag

SEQ ID NO: 29399 - DNA, 20 bp, Artificial Sequence
  Synthetic oligonucleotide; TGG chr11 5396106 5396125 5396109 -
gtggttaagagcagtgtctc

SEQ ID NO: 29400 - DNA, 20 bp, Artificial Sequence
  Synthetic oligonucleotide; GGG chr11 5396105 5396124 5396108 -
tggttaagagcagtgtctct

SEQ ID NO: 29401 - DNA, 20 bp, Artificial Sequence
  Synthetic oligonucleotide; CAG chr11 5396100 5396119 5396103 -
aagagcagtgtctctgggac

SEQ ID NO: 29402 - DNA, 20 bp, Artificial Sequence
  Synthetic oligonucleotide; TAG chr11 5396072 5396091 5396075 -
tattacaatcataacttcaa

SEQ ID NO: 29403 - DNA, 20 bp, Artificial Sequence
  Synthetic oligonucleotide; AAG chr11 5396047 5396066 5396050 -
cttcactctatgattgtgca

SEQ ID NO: 29404 - DNA, 20 bp, Artificial Sequence
  Synthetic oligonucleotide; TAG chr11 5396030 5396049 5396033 -
gcaaagtatctgattaatct

SEQ ID NO: 29405 - DNA, 20 bp, Artificial Sequence
  Synthetic oligonucleotide; GAG chr11 5396008 5396027 5396011 -
gtttcttcatctgaaaaatt

SEQ ID NO: 29406 - DNA, 20 bp, Artificial Sequence
  Synthetic oligonucleotide; TAG chr11 5395987 5396006 5395990 -
agacaattctacctactcca

SEQ ID NO: 29407 - DNA, 20 bp, Artificial Sequence
  Synthetic oligonucleotide; TAG chr11 5395982 5396001 5395985 -
attctacctactccatagat

SEQ ID NO: 29408 - DNA, 20 bp, Artificial Sequence
  Synthetic oligonucleotide; GAG chr11 5395980 5395999 5395983 -
tctacctactccatagatta

SEQ ID NO: 29409 - DNA, 20 bp, Artificial Sequence
  Synthetic oligonucleotide; GAG chr11 5395978 5395997 5395981 -
tacctactccatagattaga

SEQ ID NO: 29410 - DNA, 20 bp, Artificial Sequence
  Synthetic oligonucleotide; TGG chr11 5395954 5395973 5395957 -
cattcatatgcaattttaaa

SEQ ID NO: 29411 - DNA, 20 bp, Artificial Sequence
  Synthetic oligonucleotide; GAG chr11 5395952 5395971 5395955 -
ttcatatgcaattttaaatg

SEQ ID NO: 29412 - DNA, 20 bp, Artificial Sequence
  Synthetic oligonucleotide; CAG chr11 5395947 5395966 5395950 -
atgcaattttaaatggagta

SEQ ID NO: 29413 - DNA, 20 bp, Artificial Sequence
  Synthetic oligonucleotide; TAG chr11 5395943 5395962 5395946 -
aattttaaatggagtacagt

SEQ ID NO: 29414 - DNA, 20 bp, Artificial Sequence
  Synthetic oligonucleotide; AAG chr11 5395940 5395959 5395943 -
tttaaatggagtacagttag

SEQ ID NO: 29415 - DNA, 20 bp, Artificial Sequence
  Synthetic oligonucleotide; TAG chr11 5395926 5395945 5395929 -
agttagaagcaaatactcaa

SEQ ID NO: 29416 - DNA, 20 bp, Artificial Sequence
  Synthetic oligonucleotide; TAG chr11 5395912 5395931 5395915 -
actcaatagacacattttat

SEQ ID NO: 29417 - DNA, 20 bp, Artificial Sequence
  Synthetic oligonucleotide; CAG chr11 5395899 5395918 5395902 -
attttattagttgtactttc

SEQ ID NO: 29418 - DNA, 20 bp, Artificial Sequence
  Synthetic oligonucleotide; CAG chr11 5395891 5395910 5395894 -
agttgtactttccagcattc

SEQ ID NO: 29419 - DNA, 20 bp, Artificial Sequence
  Synthetic oligonucleotide; GAG chr11 5395887 5395906 5395890 -
gtactttccagcattccagt

SEQ ID NO: 29420 - DNA, 20 bp, Artificial Sequence
  Synthetic oligonucleotide; CAG chr11 5395876 5395895 5395879 -
cattccagtgagcaatgttg

SEQ ID NO: 29421 - DNA, 20 bp, Artificial Sequence
  Synthetic oligonucleotide; GAG chr11 5395872 5395891 5395875 -
ccagtgagcaatgttgcagt

SEQ ID NO: 29422 - DNA, 20 bp, Artificial Sequence
  Synthetic oligonucleotide; AAG chr11 5395865 5395884 5395868 -
gcaatgttgcagtgagctct

SEQ ID NO: 29423 - DNA, 20 bp, Artificial Sequence
  Synthetic oligonucleotide; AAG chr11 5395860 5395879 5395863 -
gttgcagtgagctctaagaa

SEQ ID NO: 29424 - DNA, 20 bp, Artificial Sequence
  Synthetic oligonucleotide; AAG chr11 5395832 5395851 5395835 -
aaaataatctgacaacaatg

SEQ ID NO: 29425 - DNA, 20 bp, Artificial Sequence
  Synthetic oligonucleotide; AAG chr11 5395826 5395845 5395829 -
atctgacaacaatgaagcgt

SEQ ID NO: 29426 - DNA, 20 bp, Artificial Sequence
  Synthetic oligonucleotide; AGG chr11 5395825 5395844 5395828 -
tctgacaacaatgaagcgta

SEQ ID NO: 29427 - DNA, 20 bp, Artificial Sequence
  Synthetic oligonucleotide; TGG chr11 5395818 5395837 5395821 -
acaatgaagcgtaaggtatt

SEQ ID NO: 29428 - DNA, 20 bp, Artificial Sequence
  Synthetic oligonucleotide; GAG chr11 5395816 5395835 5395819 -
aatgaagcgtaaggtatttg

SEQ ID NO: 29429 - DNA, 20 bp, Artificial Sequence
  Synthetic oligonucleotide; TGG chr11 5395813 5395832 5395816 -
gaagcgtaaggtatttggag

SEQ ID NO: 29430 - DNA, 20 bp, Artificial Sequence
  Synthetic oligonucleotide; GGG chr11 5395812 5395831 5395815 -
aagcgtaaggtatttggagt

SEQ ID NO: 29431 - DNA, 20 bp, Artificial Sequence
  Synthetic oligonucleotide; AAG chr11 5395809 5395828 5395812 -
cgtaaggtatttggagtggg

SEQ ID NO: 29432 - DNA, 20 bp, Artificial Sequence
  Synthetic oligonucleotide; GAG chr11 5395802 5395821 5395805 -
tatttggagtgggaagccat

SEQ ID NO: 29433 - DNA, 20 bp, Artificial Sequence
  Synthetic oligonucleotide; CAG chr11 5395791 5395810 5395794 -
ggaagccatgagctcttgca

SEQ ID NO: 29434 - DNA, 20 bp, Artificial Sequence
  Synthetic oligonucleotide; AGG chr11 5395790 5395809 5395793 -
gaagccatgagctcttgcac

SEQ ID NO: 29435 - DNA, 20 bp, Artificial Sequence
  Synthetic oligonucleotide; TGG chr11 5395783 5395802 5395786 -
tgagctcttgcacaggtttt

SEQ ID NO: 29436 - DNA, 20 bp, Artificial Sequence
  Synthetic oligonucleotide; TGG chr11 5395766 5395785 5395769 -
ttttggacaatccttccata

SEQ ID NO: 29437 - DNA, 20 bp, Artificial Sequence
  Synthetic oligonucleotide; TGG chr11 5395760 5395779 5395763 -
acaatccttccatatggctt

SEQ ID NO: 29438 - DNA, 20 bp, Artificial Sequence
  Synthetic oligonucleotide; AAG chr11 5395755 5395774 5395758 -
ccttccatatggctttggca

SEQ ID NO: 29439 - DNA, 20 bp, Artificial Sequence
  Synthetic oligonucleotide; TAG chr11 5395731 5395750 5395734 -
tactgaatctttctaaacct

SEQ ID NO: 29440 - DNA, 20 bp, Artificial Sequence
  Synthetic oligonucleotide; AAG chr11 5395711 5395730 5395714 -
tagcttttttactatgttga

SEQ ID NO: 29441 - DNA, 20 bp, Artificial Sequence
  Synthetic oligonucleotide; TGG chr11 5395699 5395718 5395702 -
tatgttgaaagatttccaca

SEQ ID NO: 29442 - DNA, 20 bp, Artificial Sequence
  Synthetic oligonucleotide; GGG chr11 5395698 5395717 5395701 -
atgttgaaagatttccacat

SEQ ID NO: 29443 - DNA, 20 bp, Artificial Sequence
  Synthetic oligonucleotide; GAG chr11 5395681 5395700 5395684 -
catgggccctgcctcttttc

SEQ ID NO: 29444 - DNA, 20 bp, Artificial Sequence
  Synthetic oligonucleotide; GAG chr11 5395679 5395698 5395682 -
tgggccctgcctcttttcga

SEQ ID NO: 29445 - DNA, 20 bp, Artificial Sequence
  Synthetic oligonucleotide; TAG chr11 5395669 5395688 5395672 -
ctcttttcgagagaaatgat

SEQ ID NO: 29446 - DNA, 20 bp, Artificial Sequence
  Synthetic oligonucleotide; AGG chr11 5395668 5395687 5395671 -
tcttttcgagagaaatgatt

SEQ ID NO: 29447 - DNA, 20 bp, Artificial Sequence
  Synthetic oligonucleotide; TGG chr11 5395660 5395679 5395663 -
agagaaatgattaggtttaa

SEQ ID NO: 29448 - DNA, 20 bp, Artificial Sequence
  Synthetic oligonucleotide; GGG chr11 5395659 5395678 5395662 -
gagaaatgattaggtttaat

SEQ ID NO: 29449 - DNA, 20 bp, Artificial Sequence
  Synthetic oligonucleotide; GGG chr11 5395658 5395677 5395661 -
agaaatgattaggtttaatg

SEQ ID NO: 29450 - DNA, 20 bp, Artificial Sequence
  Synthetic oligonucleotide; TGG chr11 5395652 5395671 5395655 -
gattaggtttaatggggctg

SEQ ID NO: 29451 - DNA, 20 bp, Artificial Sequence
  Synthetic oligonucleotide; GAG chr11 5395650 5395669 5395653 -
ttaggtttaatggggctgtg

SEQ ID NO: 29452 - DNA, 20 bp, Artificial Sequence
  Synthetic oligonucleotide; AGG chr11 5395649 5395668 5395652 -
taggtttaatggggctgtgg

SEQ ID NO: 29453 - DNA, 20 bp, Artificial Sequence
  Synthetic oligonucleotide; AAG chr11 5395645 5395664 5395648 -
tttaatggggctgtggagga

SEQ ID NO: 29454 - DNA, 20 bp, Artificial Sequence
  Synthetic oligonucleotide; TAG chr11 5395629 5395648 5395632 -
aggaaagcactctgaaatgt

SEQ ID NO: 29455 - DNA, 20 bp, Artificial Sequence
  Synthetic oligonucleotide; AAG chr11 5395626 5395645 5395629 -
aaagcactctgaaatgttag

SEQ ID NO: 29456 - DNA, 20 bp, Artificial Sequence
  Synthetic oligonucleotide; TGG chr11 5395613 5395632 5395616 -
atgttagaagcttcatcaat

SEQ ID NO: 29457 - DNA, 20 bp, Artificial Sequence
  Synthetic oligonucleotide; GAG chr11 5395611 5395630 5395614 -
gttagaagcttcatcaattg

SEQ ID NO: 29458 - DNA, 20 bp, Artificial Sequence
  Synthetic oligonucleotide; GAG chr11 5395600 5395619 5395603 -
catcaattggagcaattgct

SEQ ID NO: 29459 - DNA, 20 bp, Artificial Sequence
  Synthetic oligonucleotide; AAG chr11 5395555 5395574 5395558 -
aaccctgtatcattctctac

SEQ ID NO: 29460 - DNA, 20 bp, Artificial Sequence
  Synthetic oligonucleotide; AGG chr11 5395554 5395573 5395557 -
accctgtatcattctctaca

SEQ ID NO: 29461 - DNA, 20 bp, Artificial Sequence
  Synthetic oligonucleotide; TAG chr11 5395549 5395568 5395552 -
gtatcattctctacaaggca

SEQ ID NO: 29462 - DNA, 20 bp, Artificial Sequence
  Synthetic oligonucleotide; CAG chr11 5395544 5395563 5395547 -
attctctacaaggcatagcc

SEQ ID NO: 29463 - DNA, 20 bp, Artificial Sequence
  Synthetic oligonucleotide; AAG chr11 5395537 5395556 5395540 -
acaaggcatagcccagtaac

SEQ ID NO: 29464 - DNA, 20 bp, Artificial Sequence
  Synthetic oligonucleotide; CAG chr11 5395532 5395551 5395535 -
gcatagcccagtaacaagtc

SEQ ID NO: 29465 - DNA, 20 bp, Artificial Sequence
  Synthetic oligonucleotide; CGG chr11 5395503 5395522 5395506 -
cttccccatcaaaaacatca

SEQ ID NO: 29466 - DNA, 20 bp, Artificial Sequence
  Synthetic oligonucleotide; GGG chr11 5395502 5395521 5395505 -
ttccccatcaaaaacatcac

SEQ ID NO: 29467 - DNA, 20 bp, Artificial Sequence
  Synthetic oligonucleotide; GAG chr11 5395500 5395519 5395503 -
ccccatcaaaaacatcacgg

SEQ ID NO: 29468 - DNA, 20 bp, Artificial Sequence
  Synthetic oligonucleotide; TAG chr11 5395491 5395510 5395494 -
aaacatcacgggagatatga

SEQ ID NO: 29469 - DNA, 20 bp, Artificial Sequence
  Synthetic oligonucleotide; CAG chr11 5395486 5395505 5395489 -
tcacgggagatatgatagaa

SEQ ID NO: 29470 - DNA, 20 bp, Artificial Sequence
  Synthetic oligonucleotide; CAG chr11 5395483 5395502 5395486 -
cgggagatatgatagaacag

SEQ ID NO: 29471 - DNA, 20 bp, Artificial Sequence
  Synthetic oligonucleotide; CAG chr11 5395471 5395490 5395474 -
tagaacagcagccctaacaa

SEQ ID NO: 29472 - DNA, 20 bp, Artificial Sequence
  Synthetic oligonucleotide; TGG chr11 5395466 5395485 5395469 -
cagcagccctaacaacagat

SEQ ID NO: 29473 - DNA, 20 bp, Artificial Sequence
  Synthetic oligonucleotide; TGG chr11 5395454 5395473 5395457 -
caacagattggccatcttcc

SEQ ID NO: 29474 - DNA, 20 bp, Artificial Sequence
  Synthetic oligonucleotide; AAG chr11 5395451 5395470 5395454 -
cagattggccatcttcctgg

SEQ ID NO: 29475 - DNA, 20 bp, Artificial Sequence
  Synthetic oligonucleotide; TAG chr11 5395423 5395442 5395426 -
ctattccataaccctgcata

SEQ ID NO: 29476 - DNA, 20 bp, Artificial Sequence
  Synthetic oligonucleotide; TAG chr11 5395414 5395433 5395417 -
aaccctgcatatagtcatgc

SEQ ID NO: 29477 - DNA, 20 bp, Artificial Sequence
  Synthetic oligonucleotide; AAG chr11 5395409 5395428 5395412 -
tgcatatagtcatgctagat

SEQ ID NO: 29478 - DNA, 20 bp, Artificial Sequence
  Synthetic oligonucleotide; AGG chr11 5395408 5395427 5395411 -
gcatatagtcatgctagata

SEQ ID NO: 29479 - DNA, 20 bp, Artificial Sequence
  Synthetic oligonucleotide; GGG chr11 5395407 5395426 5395410 -
catatagtcatgctagataa

SEQ ID NO: 29480 - DNA, 20 bp, Artificial Sequence
  Synthetic oligonucleotide; TAG chr11 5395400 5395419 5395403 -
tcatgctagataagggatat

SEQ ID NO: 29481 - DNA, 20 bp, Artificial Sequence
  Synthetic oligonucleotide; GAG chr11 5395398 5395417 5395401 -
atgctagataagggatatta

SEQ ID NO: 29482 - DNA, 20 bp, Artificial Sequence
  Synthetic oligonucleotide; GAG chr11 5395396 5395415 5395399 -
gctagataagggatattaga

SEQ ID NO: 29483 - DNA, 20 bp, Artificial Sequence
  Synthetic oligonucleotide; AGG chr11 5395395 5395414 5395398 -
ctagataagggatattagag

SEQ ID NO: 29484 - DNA, 20 bp, Artificial Sequence
  Synthetic oligonucleotide; AAG chr11 5395360 5395379 5395363 -
cttcctttatccacaaaaca

SEQ ID NO: 29485 - DNA, 20 bp, Artificial Sequence
  Synthetic oligonucleotide; AGG chr11 5395359 5395378 5395362 -
ttcctttatccacaaaacaa

SEQ ID NO: 29486 - DNA, 20 bp, Artificial Sequence
  Synthetic oligonucleotide; CAG chr11 5395351 5395370 5395354 -
tccacaaaacaaaggacctt

SEQ ID NO: 29487 - DNA, 20 bp, Artificial Sequence
  Synthetic oligonucleotide; TGG chr11 5395340 5395359 5395343 -
aaggaccttcagcaacttac

SEQ ID NO: 29488 - DNA, 20 bp, Artificial Sequence
  Synthetic oligonucleotide; TAG chr11 5395323 5395342 5395326 -
tactggtcctttcttctctg

SEQ ID NO: 29489 - DNA, 20 bp, Artificial Sequence
  Synthetic oligonucleotide; CAG chr11 5395307 5395326 5395310 -
tctgtagcttctttctcatg

SEQ ID NO: 29490 - DNA, 20 bp, Artificial Sequence
  Synthetic oligonucleotide; CAG chr11 5395288 5395307 5395291 -
gcagcccttccactccatgc

SEQ ID NO: 29491 - DNA, 20 bp, Artificial Sequence
  Synthetic oligonucleotide; CAG chr11 5395269 5395288 5395272 -
ccagcatcttccatttgact

SEQ ID NO: 29492 - DNA, 20 bp, Artificial Sequence
  Synthetic oligonucleotide; AGG chr11 5395268 5395287 5395271 -
cagcatcttccatttgactc

SEQ ID NO: 29493 - DNA, 20 bp, Artificial Sequence
  Synthetic oligonucleotide; TGG chr11 5395252 5395271 5395255 -
actcaggatgctgttctacg

SEQ ID NO: 29494 - DNA, 20 bp, Artificial Sequence
  Synthetic oligonucleotide; GGG chr11 5395251 5395270 5395254 -
ctcaggatgctgttctacgt

SEQ ID NO: 29495 - DNA, 20 bp, Artificial Sequence
  Synthetic oligonucleotide; TGG chr11 5395242 5395261 5395245 -
ctgttctacgtgggctgcac

SEQ ID NO: 29496 - DNA, 20 bp, Artificial Sequence
  Synthetic oligonucleotide; AAG chr11 5395231 5395250 5395234 -
gggctgcactggcacttata

SEQ ID NO: 29497 - DNA, 20 bp, Artificial Sequence
  Synthetic oligonucleotide; TGG chr11 5395214 5395233 5395217 -
ataaagctgtctctcttcct

SEQ ID NO: 29498 - DNA, 20 bp, Artificial Sequence
  Synthetic oligonucleotide; GGG chr11 5395213 5395232 5395216 -
taaagctgtctctcttcctt

SEQ ID NO: 29499 - DNA, 20 bp, Artificial Sequence
  Synthetic oligonucleotide; TGG chr11 5395206 5395225 5395209 -
gtctctcttccttgggtctt

SEQ ID NO: 29500 - DNA, 20 bp, Artificial Sequence
  Synthetic oligonucleotide; AAG chr11 5395197 5395216 5395200 -
ccttgggtctttggccctca

SEQ ID NO: 29501 - DNA, 20 bp, Artificial Sequence
  Synthetic oligonucleotide; AGG chr11 5395196 5395215 5395199 -
cttgggtctttggccctcaa

SEQ ID NO: 29502 - DNA, 20 bp, Artificial Sequence
  Synthetic oligonucleotide; TAG chr11 5395185 5395204 5395188 -
ggccctcaaaggaatctccc

SEQ ID NO: 29503 - DNA, 20 bp, Artificial Sequence
  Synthetic oligonucleotide; TGG chr11 5395181 5395200 5395184 -
ctcaaaggaatctccctaga

SEQ ID NO: 29504 - DNA, 20 bp, Artificial Sequence
  Synthetic oligonucleotide; CAG chr11 5395175 5395194 5395178 -
ggaatctccctagatggacg

SEQ ID NO: 29505 - DNA, 20 bp, Artificial Sequence
  Synthetic oligonucleotide; AAG chr11 5395157 5395176 5395160 -
cgcagacttgatgaatgtca

SEQ ID NO: 29506 - DNA, 20 bp, Artificial Sequence
  Synthetic oligonucleotide; GAG chr11 5395155 5395174 5395158 -
cagacttgatgaatgtcaaa

SEQ ID NO: 29507 - DNA, 20 bp, Artificial Sequence
  Synthetic oligonucleotide; AGG chr11 5395154 5395173 5395157 -
agacttgatgaatgtcaaag

SEQ ID NO: 29508 - DNA, 20 bp, Artificial Sequence
  Synthetic oligonucleotide; GGG chr11 5395153 5395172 5395156 -
gacttgatgaatgtcaaaga

SEQ ID NO: 29509 - DNA, 20 bp, Artificial Sequence
  Synthetic oligonucleotide; TAG chr11 5395148 5395167 5395151 -
gatgaatgtcaaagagggat

SEQ ID NO: 29510 - DNA, 20 bp, Artificial Sequence
  Synthetic oligonucleotide; TAG chr11 5395137 5395156 5395140 -
aagagggattagcatcctcc

SEQ ID NO: 29511 - DNA, 20 bp, Artificial Sequence
  Synthetic oligonucleotide; AAG chr11 5395130 5395149 5395133 -
attagcatcctcctagacca

SEQ ID NO: 29512 - DNA, 20 bp, Artificial Sequence
  Synthetic oligonucleotide; GAG chr11 5395122 5395141 5395125 -
cctcctagaccaaagcattt

SEQ ID NO: 29513 - DNA, 20 bp, Artificial Sequence
  Synthetic oligonucleotide; CAG chr11 5395114 5395133 5395117 -
accaaagcatttgagatgcc

SEQ ID NO: 29514 - DNA, 20 bp, Artificial Sequence
  Synthetic oligonucleotide; TGG chr11 5395101 5395120 5395104 -
agatgcccagttatcttaaa

SEQ ID NO: 29515 - DNA, 20 bp, Artificial Sequence
  Synthetic oligonucleotide; TAG chr11 5395093 5395112 5395096 -
agttatcttaaatggaaatt

SEQ ID NO: 29516 - DNA, 20 bp, Artificial Sequence
  Synthetic oligonucleotide; GAG chr11 5395082 5395101 5395085 -
atggaaatttagtgaaccat

SEQ ID NO: 29517 - DNA, 20 bp, Artificial Sequence
  Synthetic oligonucleotide; TAG chr11 5395073 5395092 5395076 -
tagtgaaccatgagtacctc

SEQ ID NO: 29518 - DNA, 20 bp, Artificial Sequence
  Synthetic oligonucleotide; AGG chr11 5395072 5395091 5395075 -
agtgaaccatgagtacctct

SEQ ID NO: 29519 - DNA, 20 bp, Artificial Sequence
  Synthetic oligonucleotide; GAG chr11 5395070 5395089 5395073 -
tgaaccatgagtacctctag

SEQ ID NO: 29520 - DNA, 20 bp, Artificial Sequence
  Synthetic oligonucleotide; AGG chr11 5395069 5395088 5395072 -
gaaccatgagtacctctagg

SEQ ID NO: 29521 - DNA, 20 bp, Artificial Sequence
  Synthetic oligonucleotide; CAG chr11 5395061 5395080 5395064 -
agtacctctaggaggtattt

SEQ ID NO: 29522 - DNA, 20 bp, Artificial Sequence
  Synthetic oligonucleotide; GAG chr11 5395057 5395076 5395060 -
cctctaggaggtatttcagt

SEQ ID NO: 29523 - DNA, 20 bp, Artificial Sequence
  Synthetic oligonucleotide; CAG chr11 5395053 5395072 5395056 -
taggaggtatttcagtgagc

SEQ ID NO: 29524 - DNA, 20 bp, Artificial Sequence
  Synthetic oligonucleotide; GAG chr11 5395051 5395070 5395054 -
ggaggtatttcagtgagcca

SEQ ID NO: 29525 - DNA, 20 bp, Artificial Sequence
  Synthetic oligonucleotide; AGG chr11 5395050 5395069 5395053 -
gaggtatttcagtgagccag

SEQ ID NO: 29526 - DNA, 20 bp, Artificial Sequence
  Synthetic oligonucleotide; CAG chr11 5395025 5395044 5395028 -
ccttgactgtcttctctccc

SEQ ID NO: 29527 - DNA, 20 bp, Artificial Sequence
  Synthetic oligonucleotide; AAG chr11 5395009 5395028 5395012 -
tccccagctgccaacttcat

SEQ ID NO: 29528 - DNA, 20 bp, Artificial Sequence
  Synthetic oligonucleotide; TGG chr11 5394997 5395016 5395000 -
aacttcataagaaaatttat

SEQ ID NO: 29529 - DNA, 20 bp, Artificial Sequence
  Synthetic oligonucleotide; GGG chr11 5394996 5395015 5394999 -
acttcataagaaaatttatt

SEQ ID NO: 29530 - DNA, 20 bp, Artificial Sequence
  Synthetic oligonucleotide; CAG chr11 5394954 5394973 5394957 -
ttgtctttcttttcttttcc

SEQ ID NO: 29531 - DNA, 20 bp, Artificial Sequence
  Synthetic oligonucleotide; AAG chr11 5394947 5394966 5394950 -
tcttttcttttcccagacaa

SEQ ID NO: 29532 - DNA, 20 bp, Artificial Sequence
  Synthetic oligonucleotide; GAG chr11 5394937 5394956 5394940 -
tcccagacaaaagtcccctt

SEQ ID NO: 29533 - DNA, 20 bp, Artificial Sequence
  Synthetic oligonucleotide; CAG chr11 5394933 5394952 5394936 -
agacaaaagtccccttgaga

SEQ ID NO: 29534 - DNA, 20 bp, Artificial Sequence
  Synthetic oligonucleotide; CAG chr11 5394920 5394939 5394923 -
cttgagacagtctttacaac

SEQ ID NO: 29535 - DNA, 20 bp, Artificial Sequence
  Synthetic oligonucleotide; AGG chr11 5394919 5394938 5394922 -
ttgagacagtctttacaacc

SEQ ID NO: 29536 - DNA, 20 bp, Artificial Sequence
  Synthetic oligonucleotide; TAG chr11 5394916 5394935 5394919 -
agacagtctttacaaccagg

SEQ ID NO: 29537 - DNA, 20 bp, Artificial Sequence
  Synthetic oligonucleotide; GAG chr11 5394894 5394913 5394897 -
gttattcactgtcattcact

SEQ ID NO: 29538 - DNA, 20 bp, Artificial Sequence
  Synthetic oligonucleotide; AAG chr11 5394890 5394909 5394893 -
ttcactgtcattcactgagc

SEQ ID NO: 29539 - DNA, 20 bp, Artificial Sequence
  Synthetic oligonucleotide; AAG chr11 5394881 5394900 5394884 -
attcactgagcaagtatgta

SEQ ID NO: 29540 - DNA, 20 bp, Artificial Sequence
  Synthetic oligonucleotide; AAG chr11 5394873 5394892 5394876 -
agcaagtatgtaaagatcac

SEQ ID NO: 29541 - DNA, 20 bp, Artificial Sequence
  Synthetic oligonucleotide; TGG chr11 5394867 5394886 5394870 -
tatgtaaagatcacaagctt

SEQ ID NO: 29542 - DNA, 20 bp, Artificial Sequence
  Synthetic oligonucleotide; GGG chr11 5394866 5394885 5394869 -
atgtaaagatcacaagcttt

SEQ ID NO: 29543 - DNA, 20 bp, Artificial Sequence
  Synthetic oligonucleotide; CAG chr11 5394862 5394881 5394865 -
aaagatcacaagctttgggt

SEQ ID NO: 29544 - DNA, 20 bp, Artificial Sequence
  Synthetic oligonucleotide; AAG chr11 5394847 5394866 5394850 -
tgggtcagatatttgaatgc

SEQ ID NO: 29545 - DNA, 20 bp, Artificial Sequence
  Synthetic oligonucleotide; AAG chr11 5394837 5394856 5394840 -
atttgaatgcaagcattaat

SEQ ID NO: 29546 - DNA, 20 bp, Artificial Sequence
  Synthetic oligonucleotide; CAG chr11 5394817 5394836 5394820 -
aagacacaaactctgtcttt

SEQ ID NO: 29547 - DNA, 20 bp, Artificial Sequence
  Synthetic oligonucleotide; AAG chr11 5394813 5394832 5394816 -
cacaaactctgtctttcaga

SEQ ID NO: 29548 - DNA, 20 bp, Artificial Sequence
  Synthetic oligonucleotide; CAG chr11 5394798 5394817 5394801 -
tcagaaagcattgtcttctg

SEQ ID NO: 29549 - DNA, 20 bp, Artificial Sequence
  Synthetic oligonucleotide; AGG chr11 5394797 5394816 5394800 -
cagaaagcattgtcttctgc

SEQ ID NO: 29550 - DNA, 20 bp, Artificial Sequence
  Synthetic oligonucleotide; GAG chr11 5394795 5394814 5394798 -
gaaagcattgtcttctgcag

SEQ ID NO: 29551 - DNA, 20 bp, Artificial Sequence
  Synthetic oligonucleotide; AGG chr11 5394794 5394813 5394797 -
aaagcattgtcttctgcagg

SEQ ID NO: 29552 - DNA, 20 bp, Artificial Sequence
  Synthetic oligonucleotide; AAG chr11 5394760 5394779 5394763 -
aaaactaacgtcccctgatg

SEQ ID NO: 29553 - DNA, 20 bp, Artificial Sequence
  Synthetic oligonucleotide; CAG chr11 5394751 5394770 5394754 -
gtcccctgatgaagcaaaaa

SEQ ID NO: 29554 - DNA, 20 bp, Artificial Sequence
  Synthetic oligonucleotide; AGG chr11 5394750 5394769 5394753 -
tcccctgatgaagcaaaaac

SEQ ID NO: 29555 - DNA, 20 bp, Artificial Sequence
  Synthetic oligonucleotide; CAG chr11 5394742 5394761 5394745 -
tgaagcaaaaacaggcttcc

SEQ ID NO: 29556 - DNA, 20 bp, Artificial Sequence
  Synthetic oligonucleotide; AGG chr11 5394741 5394760 5394744 -
gaagcaaaaacaggcttccc

SEQ ID NO: 29557 - DNA, 20 bp, Artificial Sequence
  Synthetic oligonucleotide; TAG chr11 5394725 5394744 5394728 -
tcccaggtgatacaaatatt

SEQ ID NO: 29558 - DNA, 20 bp, Artificial Sequence
  Synthetic oligonucleotide; AAG chr11 5394721 5394740 5394724 -
aggtgatacaaatatttagc

SEQ ID NO: 29559 - DNA, 20 bp, Artificial Sequence
  Synthetic oligonucleotide; TAG chr11 5394684 5394703 5394687 -
gtctgcactatcattcaaaa

SEQ ID NO: 29560 - DNA, 20 bp, Artificial Sequence
  Synthetic oligonucleotide; AGG chr11 5394683 5394702 5394686 -
tctgcactatcattcaaaat

SEQ ID NO: 29561 - DNA, 20 bp, Artificial Sequence
  Synthetic oligonucleotide; TAG chr11 5394672 5394691 5394675 -
attcaaaataggtaacattt

SEQ ID NO: 29562 - DNA, 20 bp, Artificial Sequence
  Synthetic oligonucleotide; TAG chr11 5394668 5394687 5394671 -
aaaataggtaacattttaga

SEQ ID NO: 29563 - DNA, 20 bp, Artificial Sequence
  Synthetic oligonucleotide; GAG chr11 5394666 5394685 5394669 -
aataggtaacattttagata

SEQ ID NO: 29564 - DNA, 20 bp, Artificial Sequence
  Synthetic oligonucleotide; AGG chr11 5394665 5394684 5394668 -
ataggtaacattttagatag

SEQ ID NO: 29565 - DNA, 20 bp, Artificial Sequence
  Synthetic oligonucleotide; GGG chr11 5394664 5394683 5394667 -
taggtaacattttagataga

SEQ ID NO: 29566 - DNA, 20 bp, Artificial Sequence
  Synthetic oligonucleotide; GGG chr11 5394663 5394682 5394666 -
aggtaacattttagatagag

SEQ ID NO: 29567 - DNA, 20 bp, Artificial Sequence
  Synthetic oligonucleotide; AAG chr11 5394648 5394667 5394651 -
tagaggggaaaacatgtaca

SEQ ID NO: 29568 - DNA, 20 bp, Artificial Sequence
  Synthetic oligonucleotide; AGG chr11 5394647 5394666 5394650 -
agaggggaaaacatgtacaa

SEQ ID NO: 29569 - DNA, 20 bp, Artificial Sequence
  Synthetic oligonucleotide; CAG chr11 5394642 5394661 5394645 -
ggaaaacatgtacaaaggct

SEQ ID NO: 29570 - DNA, 20 bp, Artificial Sequence
  Synthetic oligonucleotide; GAG chr11 5394640 5394659 5394643 -
aaaacatgtacaaaggctca

SEQ ID NO: 29571 - DNA, 20 bp, Artificial Sequence
  Synthetic oligonucleotide; AAG chr11 5394629 5394648 5394632 -
aaaggctcagagttgtcaca

SEQ ID NO: 29572 - DNA, 20 bp, Artificial Sequence
  Synthetic oligonucleotide; GAG chr11 5394593 5394612 5394596 -
tctgtgaacttcaattacat

SEQ ID NO: 29573 - DNA, 20 bp, Artificial Sequence
  Synthetic oligonucleotide; CAG chr11 5394570 5394589 5394573 -
ccatctgtgttttacaaata

SEQ ID NO: 29574 - DNA, 20 bp, Artificial Sequence
  Synthetic oligonucleotide; AAG chr11 5394556 5394575 5394559 -
caaatacagtatcaatttca

SEQ ID NO: 29575 - DNA, 20 bp, Artificial Sequence
  Synthetic oligonucleotide; AGG chr11 5394555 5394574 5394558 -
aaatacagtatcaatttcaa

SEQ ID NO: 29576 - DNA, 20 bp, Artificial Sequence
  Synthetic oligonucleotide; TAG chr11 5394550 5394569 5394553 -
cagtatcaatttcaaaggct

SEQ ID NO: 29577 - DNA, 20 bp, Artificial Sequence
  Synthetic oligonucleotide; GAG chr11 5394548 5394567 5394551 -
gtatcaatttcaaaggctta

SEQ ID NO: 29578 - DNA, 20 bp, Artificial Sequence
  Synthetic oligonucleotide; GAG chr11 5394546 5394565 5394549 -
atcaatttcaaaggcttaga

SEQ ID NO: 29579 - DNA, 20 bp, Artificial Sequence
  Synthetic oligonucleotide; AGG chr11 5394545 5394564 5394548 -
tcaatttcaaaggcttagag

SEQ ID NO: 29580 - DNA, 20 bp, Artificial Sequence
  Synthetic oligonucleotide; TGG chr11 5394538 5394557 5394541 -
caaaggcttagagaggcttg

SEQ ID NO: 29581 - DNA, 20 bp, Artificial Sequence
  Synthetic oligonucleotide; CGG chr11 5394524 5394543 5394527 -
ggcttgtggatattaaataa

SEQ ID NO: 29582 - DNA, 20 bp, Artificial Sequence
  Synthetic oligonucleotide; GGG chr11 5394523 5394542 5394526 -
gcttgtggatattaaataac

SEQ ID NO: 29583 - DNA, 20 bp, Artificial Sequence
  Synthetic oligonucleotide; TAG chr11 5394519 5394538 5394522 -
gtggatattaaataacggga

SEQ ID NO: 29584 - DNA, 20 bp, Artificial Sequence
  Synthetic oligonucleotide; AAG chr11 5394511 5394530 5394514 -
taaataacgggatagttgta

SEQ ID NO: 29585 - DNA, 20 bp, Artificial Sequence
  Synthetic oligonucleotide; CAG chr11 5394497 5394516 5394500 -
gttgtaaagatttttgcctg

SEQ ID NO: 29586 - DNA, 20 bp, Artificial Sequence
  Synthetic oligonucleotide; AGG chr11 5394496 5394515 5394499 -
ttgtaaagatttttgcctgc

SEQ ID NO: 29587 - DNA, 20 bp, Artificial Sequence
  Synthetic oligonucleotide; TAG chr11 5394489 5394508 5394492 -
gatttttgcctgcaggaata

SEQ ID NO: 29588 - DNA, 20 bp, Artificial Sequence
  Synthetic oligonucleotide; AGG chr11 5394488 5394507 5394491 -
atttttgcctgcaggaatat

SEQ ID NO: 29589 - DNA, 20 bp, Artificial Sequence
  Synthetic oligonucleotide; GAG chr11 5394477 5394496 5394480 -
caggaatataggcttgtgct

SEQ ID NO: 29590 - DNA, 20 bp, Artificial Sequence
  Synthetic oligonucleotide; AGG chr11 5394476 5394495 5394479 -
aggaatataggcttgtgctg

SEQ ID NO: 29591 - DNA, 20 bp, Artificial Sequence
  Synthetic oligonucleotide; TGG chr11 5394471 5394490 5394474 -
tataggcttgtgctgaggaa

SEQ ID NO: 29592 - DNA, 20 bp, Artificial Sequence
  Synthetic oligonucleotide; GGG chr11 5394470 5394489 5394473 -
ataggcttgtgctgaggaat

SEQ ID NO: 29593 - DNA, 20 bp, Artificial Sequence
  Synthetic oligonucleotide; CAG chr11 5394466 5394485 5394469 -
gcttgtgctgaggaatgggc

SEQ ID NO: 29594 - DNA, 20 bp, Artificial Sequence
  Synthetic oligonucleotide; AAG chr11 5394455 5394474 5394458 -
ggaatgggccagatgattta

SEQ ID NO: 29595 - DNA, 20 bp, Artificial Sequence
  Synthetic oligonucleotide; CAG chr11 5394452 5394471 5394455 -
atgggccagatgatttaaag

SEQ ID NO: 29596 - DNA, 20 bp, Artificial Sequence
  Synthetic oligonucleotide; TAG chr11 5394439 5394458 5394442 -
tttaaagcagatactgtcat

SEQ ID NO: 29597 - DNA, 20 bp, Artificial Sequence
  Synthetic oligonucleotide; CAG chr11 5394436 5394455 5394439 -
aaagcagatactgtcattag

SEQ ID NO: 29598 - DNA, 20 bp, Artificial Sequence
  Synthetic oligonucleotide; AGG chr11 5394435 5394454 5394438 -
aagcagatactgtcattagc

SEQ ID NO: 29599 - DNA, 20 bp, Artificial Sequence
  Synthetic oligonucleotide; CAG chr11 5394424 5394443 5394427 -
gtcattagcaggaatatgta

SEQ ID NO: 29600 - DNA, 20 bp, Artificial Sequence
  Synthetic oligonucleotide; TGG chr11 5394418 5394437 5394421 -
agcaggaatatgtacagctt

SEQ ID NO: 29601 - DNA, 20 bp, Artificial Sequence
  Synthetic oligonucleotide; TGG chr11 5394397 5394416 5394400 -
ggctgattttatgttttttt

SEQ ID NO: 29602 - DNA, 20 bp, Artificial Sequence
  Synthetic oligonucleotide; CAG chr11 5394375 5394394 5394378 -
gtttgttgttgttgttgaat

SEQ ID NO: 29603 - DNA, 20 bp, Artificial Sequence
  Synthetic oligonucleotide; TGG chr11 5394372 5394391 5394375 -
tgttgttgttgttgaatcag

SEQ ID NO: 29604 - DNA, 20 bp, Artificial Sequence
  Synthetic oligonucleotide; GAG chr11 5394370 5394389 5394373 -
ttgttgttgttgaatcagtg

SEQ ID NO: 29605 - DNA, 20 bp, Artificial Sequence
  Synthetic oligonucleotide; TAG chr11 5394365 5394384 5394368 -
gttgttgaatcagtggagca

SEQ ID NO: 29606 - DNA, 20 bp, Artificial Sequence
  Synthetic oligonucleotide; AAG chr11 5394352 5394371 5394355 -
tggagcatagttaaaactac

SEQ ID NO: 29607 - DNA, 20 bp, Artificial Sequence
  Synthetic oligonucleotide; CAG chr11 5394344 5394363 5394347 -
agttaaaactacaagcacca

SEQ ID NO: 29608 - DNA, 20 bp, Artificial Sequence
  Synthetic oligonucleotide; CAG chr11 5394340 5394359 5394343 -
aaaactacaagcaccacagt

SEQ ID NO: 29609 - DNA, 20 bp, Artificial Sequence
  Synthetic oligonucleotide; TGG chr11 5394325 5394344 5394328 -
acagtcagaactgtcaaact

SEQ ID NO: 29610 - DNA, 20 bp, Artificial Sequence
  Synthetic oligonucleotide; TGG chr11 5394314 5394333 5394317 -
tgtcaaacttggtataatat

SEQ ID NO: 29611 - DNA, 20 bp, Artificial Sequence
  Synthetic oligonucleotide; GGG chr11 5394313 5394332 5394316 -
gtcaaacttggtataatatt

SEQ ID NO: 29612 - DNA, 20 bp, Artificial Sequence
  Synthetic oligonucleotide; AAG chr11 5394309 5394328 5394312 -
aacttggtataatattgggc

SEQ ID NO: 29613 - DNA, 20 bp, Artificial Sequence
  Synthetic oligonucleotide; GAG chr11 5394293 5394312 5394296 -
gggcaagatattttgtctct

SEQ ID NO: 29614 - DNA, 20 bp, Artificial Sequence
  Synthetic oligonucleotide; CAG chr11 5394287 5394306 5394290 -
gatattttgtctctgagcct

SEQ ID NO: 29615 - DNA, 20 bp, Artificial Sequence
  Synthetic oligonucleotide; TGG chr11 5394267 5394286 5394270 -
cagtgtacttatctgtaaaa

SEQ ID NO: 29616 - DNA, 20 bp, Artificial Sequence
  Synthetic oligonucleotide; GGG chr11 5394266 5394285 5394269 -
agtgtacttatctgtaaaat

SEQ ID NO: 29617 - DNA, 20 bp, Artificial Sequence
  Synthetic oligonucleotide; TAG chr11 5394258 5394277 5394261 -
tatctgtaaaatgggtaatc

SEQ ID NO: 29618 - DNA, 20 bp, Artificial Sequence
  Synthetic oligonucleotide; TAG chr11 5394255 5394274 5394258 -
ctgtaaaatgggtaatctag

SEQ ID NO: 29619 - DNA, 20 bp, Artificial Sequence
  Synthetic oligonucleotide; AAG chr11 5394240 5394259 5394243 -
tctagtagtatccatctcat

SEQ ID NO: 29620 - DNA, 20 bp, Artificial Sequence
  Synthetic oligonucleotide; AGG chr11 5394239 5394258 5394242 -
ctagtagtatccatctcata

SEQ ID NO: 29621 - DNA, 20 bp, Artificial Sequence
  Synthetic oligonucleotide; AAG chr11 5394228 5394247 5394231 -
catctcataaggttattgtc

SEQ ID NO: 29622 - DNA, 20 bp, Artificial Sequence
  Synthetic oligonucleotide; AAG chr11 5394222 5394241 5394225 -
ataaggttattgtcaagata

SEQ ID NO: 29623 - DNA, 20 bp, Artificial Sequence
  Synthetic oligonucleotide; TAG chr11 5394212 5394231 5394215 -
tgtcaagataaagtgactta

SEQ ID NO: 29624 - DNA, 20 bp, Artificial Sequence
  Synthetic oligonucleotide; TAG chr11 5394196 5394215 5394199 -
cttatagtgtattatgccct

SEQ ID NO: 29625 - DNA, 20 bp, Artificial Sequence
  Synthetic oligonucleotide; TAG chr11 5394184 5394203 5394187 -
tatgcccttagaataatacc

SEQ ID NO: 29626 - DNA, 20 bp, Artificial Sequence
  Synthetic oligonucleotide; AGG chr11 5394183 5394202 5394186 -
atgcccttagaataatacct

SEQ ID NO: 29627 - DNA, 20 bp, Artificial Sequence
  Synthetic oligonucleotide; TAG chr11 5394144 5394163 5394147 -
aaaaaccatgatatgcaaaa

SEQ ID NO: 29628 - DNA, 20 bp, Artificial Sequence
  Synthetic oligonucleotide; AAG chr11 5394141 5394160 5394144 -
aaccatgatatgcaaaatag

SEQ ID NO: 29629 - DNA, 20 bp, Artificial Sequence
  Synthetic oligonucleotide; AGG chr11 5394140 5394159 5394143 -
accatgatatgcaaaataga

SEQ ID NO: 29630 - DNA, 20 bp, Artificial Sequence
  Synthetic oligonucleotide; CAG chr11 5394133 5394152 5394136 -
tatgcaaaatagaaggtact

SEQ ID NO: 29631 - DNA, 20 bp, Artificial Sequence
  Synthetic oligonucleotide; GAG chr11 5394119 5394138 5394122 -
ggtactcagtaccttctact

SEQ ID NO: 29632 - DNA, 20 bp, Artificial Sequence
  Synthetic oligonucleotide; AAG chr11 5394086 5394105 5394089 -
aatctataactcttaaaatc

SEQ ID NO: 29633 - DNA, 20 bp, Artificial Sequence
  Synthetic oligonucleotide; AAG chr11 5394074 5394093 5394077 -
ttaaaatcaagtctattaaa

SEQ ID NO: 29634 - DNA, 20 bp, Artificial Sequence
  Synthetic oligonucleotide; TGG chr11 5394012 5394031 5394015 -
tatcttttcctgatactaaa

SEQ ID NO: 29635 - DNA, 20 bp, Artificial Sequence
  Synthetic oligonucleotide; TAG chr11 5394004 5394023 5394007 -
cctgatactaaatggaaaaa

SEQ ID NO: 29636 - DNA, 20 bp, Artificial Sequence
  Synthetic oligonucleotide; TAG chr11 5393990 5394009 5393993 -
gaaaaatagataacatattc

SEQ ID NO: 29637 - DNA, 20 bp, Artificial Sequence
  Synthetic oligonucleotide; AGG chr11 5393989 5394008 5393992 -
aaaaatagataacatattct

SEQ ID NO: 29638 - DNA, 20 bp, Artificial Sequence
  Synthetic oligonucleotide; AAG chr11 5393985 5394004 5393988 -
atagataacatattctagga

SEQ ID NO: 29639 - DNA, 20 bp, Artificial Sequence
  Synthetic oligonucleotide; AGG chr11 5393984 5394003 5393987 -
tagataacatattctaggaa

SEQ ID NO: 29640 - DNA, 20 bp, Artificial Sequence
  Synthetic oligonucleotide; GGG chr11 5393983 5394002 5393986 -
agataacatattctaggaaa

SEQ ID NO: 29641 - DNA, 20 bp, Artificial Sequence
  Synthetic oligonucleotide; AAG chr11 5393974 5393993 5393977 -
attctaggaaagggaacaaa

SEQ ID NO: 29642 - DNA, 20 bp, Artificial Sequence
  Synthetic oligonucleotide; TAG chr11 5393970 5393989 5393973 -
taggaaagggaacaaaaagt

SEQ ID NO: 29643 - DNA, 20 bp, Artificial Sequence
  Synthetic oligonucleotide; AGG chr11 5393969 5393988 5393972 -
aggaaagggaacaaaaagtt

SEQ ID NO: 29644 - DNA, 20 bp, Artificial Sequence
  Synthetic oligonucleotide; GGG chr11 5393968 5393987 5393971 -
ggaaagggaacaaaaagtta

SEQ ID NO: 29645 - DNA, 20 bp, Artificial Sequence
  Synthetic oligonucleotide; GAG chr11 5393966 5393985 5393969 -
aaagggaacaaaaagttagg

SEQ ID NO: 29646 - DNA, 20 bp, Artificial Sequence
  Synthetic oligonucleotide; AAG chr11 5393963 5393982 5393966 -
gggaacaaaaagttagggag

SEQ ID NO: 29647 - DNA, 20 bp, Artificial Sequence
  Synthetic oligonucleotide; TGG chr11 5393953 5393972 5393956 -
agttagggagaagccaatga

SEQ ID NO: 29648 - DNA, 20 bp, Artificial Sequence
  Synthetic oligonucleotide; GGG chr11 5393952 5393971 5393955 -
gttagggagaagccaatgat

SEQ ID NO: 29649 - DNA, 20 bp, Artificial Sequence
  Synthetic oligonucleotide; CAG chr11 5393941 5393960 5393944 -
gccaatgatgggacttcctt

SEQ ID NO: 29650 - DNA, 20 bp, Artificial Sequence
  Synthetic oligonucleotide; TGG chr11 5393931 5393950 5393934 -
ggacttccttcagtataaca

SEQ ID NO: 29651 - DNA, 20 bp, Artificial Sequence
  Synthetic oligonucleotide; TGG chr11 5393922 5393941 5393925 -
tcagtataacatggaaaaca

SEQ ID NO: 29652 - DNA, 20 bp, Artificial Sequence
  Synthetic oligonucleotide; GAG chr11 5393910 5393929 5393913 -
ggaaaacatggccctgaaac

SEQ ID NO: 29653 - DNA, 20 bp, Artificial Sequence
  Synthetic oligonucleotide; TGG chr11 5393907 5393926 5393910 -
aaacatggccctgaaacgag

SEQ ID NO: 29654 - DNA, 20 bp, Artificial Sequence
  Synthetic oligonucleotide; TGG chr11 5393897 5393916 5393900 -
ctgaaacgagtggtcctgtt

SEQ ID NO: 29655 - DNA, 20 bp, Artificial Sequence
  Synthetic oligonucleotide; GAG chr11 5393895 5393914 5393898 -
gaaacgagtggtcctgtttg

SEQ ID NO: 29656 - DNA, 20 bp, Artificial Sequence
  Synthetic oligonucleotide; GAG chr11 5393893 5393912 5393896 -
aacgagtggtcctgtttgga

SEQ ID NO: 29657 - DNA, 20 bp, Artificial Sequence
  Synthetic oligonucleotide; AGG chr11 5393892 5393911 5393895 -
acgagtggtcctgtttggag

SEQ ID NO: 29658 - DNA, 20 bp, Artificial Sequence
  Synthetic oligonucleotide; GAG chr11 5393890 5393909 5393893 -
gagtggtcctgtttggagag

SEQ ID NO: 29659 - DNA, 20 bp, Artificial Sequence
  Synthetic oligonucleotide; CAG chr11 5393885 5393904 5393888 -
gtcctgtttggagaggagtc

SEQ ID NO: 29660 - DNA, 20 bp, Artificial Sequence
  Synthetic oligonucleotide; TGG chr11 5393877 5393896 5393880 -
tggagaggagtccagcataa

SEQ ID NO: 29661 - DNA, 20 bp, Artificial Sequence
  Synthetic oligonucleotide; AAG chr11 5393871 5393890 5393874 -
ggagtccagcataatggttt

SEQ ID NO: 29662 - DNA, 20 bp, Artificial Sequence
  Synthetic oligonucleotide; CAG chr11 5393863 5393882 5393866 -
gcataatggtttaagaaaat

SEQ ID NO: 29663 - DNA, 20 bp, Artificial Sequence
  Synthetic oligonucleotide; CAG chr11 5393840 5393859 5393843 -
atgcgcttgatattgaattt

SEQ ID NO: 29664 - DNA, 20 bp, Artificial Sequence
  Synthetic oligonucleotide; AAG chr11 5393811 5393830 5393814 -
cttacattaatgatttaact

SEQ ID NO: 29665 - DNA, 20 bp, Artificial Sequence
  Synthetic oligonucleotide; AGG chr11 5393810 5393829 5393813 -
ttacattaatgatttaacta

SEQ ID NO: 29666 - DNA, 20 bp, Artificial Sequence
  Synthetic oligonucleotide; AAG chr11 5393806 5393825 5393809 -
attaatgatttaactaagga

SEQ ID NO: 29667 - DNA, 20 bp, Artificial Sequence
  Synthetic oligonucleotide; GAG chr11 5393789 5393808 5393792 -
ggaaagttgctttcctctgt

SEQ ID NO: 29668 - DNA, 20 bp, Artificial Sequence
  Synthetic oligonucleotide; CAG chr11 5393783 5393802 5393786 -
ttgctttcctctgtgagcct

SEQ ID NO: 29669 - DNA, 20 bp, Artificial Sequence
  Synthetic oligonucleotide; CAG chr11 5393734 5393753 5393737 -
aataatacctccctacttca

SEQ ID NO: 29670 - DNA, 20 bp, Artificial Sequence
  Synthetic oligonucleotide; AGG chr11 5393733 5393752 5393736 -
ataatacctccctacttcac

SEQ ID NO: 29671 - DNA, 20 bp, Artificial Sequence
  Synthetic oligonucleotide; TGG chr11 5393728 5393747 5393731 -
acctccctacttcacaggtt

SEQ ID NO: 29672 - DNA, 20 bp, Artificial Sequence
  Synthetic oligonucleotide; GAG chr11 5393724 5393743 5393727 -
ccctacttcacaggtttggt

SEQ ID NO: 29673 - DNA, 20 bp, Artificial Sequence
  Synthetic oligonucleotide; AAG chr11 5393684 5393703 5393687 -
tgtaaaataatgaaaataaa

SEQ ID NO: 29674 - DNA, 20 bp, Artificial Sequence
  Synthetic oligonucleotide; CAG chr11 5393677 5393696 5393680 -
taatgaaaataaaaagtact

SEQ ID NO: 29675 - DNA, 20 bp, Artificial Sequence
  Synthetic oligonucleotide; GAG chr11 5393661 5393680 5393664 -
tactcagccctctctaccgt

SEQ ID NO: 29676 - DNA, 20 bp, Artificial Sequence
  Synthetic oligonucleotide; TAG chr11 5393639 5393658 5393642 -
gttaaatgcttaataaacat

SEQ ID NO: 29677 - DNA, 20 bp, Artificial Sequence
  Synthetic oligonucleotide; CAG chr11 5393596 5393615 5393599 -
atcatcttcattgtcatctt

SEQ ID NO: 29678 - DNA, 20 bp, Artificial Sequence
  Synthetic oligonucleotide; TAG chr11 5393571 5393590 5393574 -
taatcgtatataacttttta

SEQ ID NO: 29679 - DNA, 20 bp, Artificial Sequence
  Synthetic oligonucleotide; TAG chr11 5393548 5393567 5393551 -
tcattgtaaaatgctctttt

SEQ ID NO: 29680 - DNA, 20 bp, Artificial Sequence
  Synthetic oligonucleotide; CAG chr11 5393521 5393540 5393524 -
taaaaccgaaatgtcttctt

SEQ ID NO: 29681 - DNA, 20 bp, Artificial Sequence
  Synthetic oligonucleotide; CGG chr11 5393506 5393525 5393509 -
ttcttcagaaaatttgtata

SEQ ID NO: 29682 - DNA, 20 bp, Artificial Sequence
  Synthetic oligonucleotide; AAG chr11 5393501 5393520 5393504 -
cagaaaatttgtatacggca

SEQ ID NO: 29683 - DNA, 20 bp, Artificial Sequence
  Synthetic oligonucleotide; TAG chr11 5393497 5393516 5393500 -
aaatttgtatacggcaaaga

SEQ ID NO: 29684 - DNA, 20 bp, Artificial Sequence
  Synthetic oligonucleotide; GAG chr11 5393495 5393514 5393498 -
atttgtatacggcaaagata

SEQ ID NO: 29685 - DNA, 20 bp, Artificial Sequence
  Synthetic oligonucleotide; TAG chr11 5393483 5393502 5393486 -
caaagatagagaaatctata

SEQ ID NO: 29686 - DNA, 20 bp, Artificial Sequence
  Synthetic oligonucleotide; AAG chr11 5393475 5393494 5393478 -
gagaaatctatatagaaaat

SEQ ID NO: 29687 - DNA, 20 bp, Artificial Sequence
  Synthetic oligonucleotide; CAG chr11 5393461 5393480 5393464 -
gaaaataagattatatataa

SEQ ID NO: 29688 - DNA, 20 bp, Artificial Sequence
  Synthetic oligonucleotide; TAG chr11 5393431 5393450 5393434 -
tcttttgatacaaatattta

SEQ ID NO: 29689 - DNA, 20 bp, Artificial Sequence
  Synthetic oligonucleotide; TAG chr11 5393419 5393438 5393422 -
aatatttatagccttttaca

SEQ ID NO: 29690 - DNA, 20 bp, Artificial Sequence
  Synthetic oligonucleotide; CAG chr11 5393367 5393386 5393370 -
tttatttaatattttgccaa

SEQ ID NO: 29691 - DNA, 20 bp, Artificial Sequence
  Synthetic oligonucleotide; AAG chr11 5393358 5393377 5393361 -
tattttgccaacagtttcct

SEQ ID NO: 29692 - DNA, 20 bp, Artificial Sequence
  Synthetic oligonucleotide; TAG chr11 5393333 5393352 5393336 -
tttaaatgtcattttaataa

SEQ ID NO: 29693 - DNA, 20 bp, Artificial Sequence
  Synthetic oligonucleotide; TAG chr11 5393287 5393306 5393290 -
tttatgtaatatttttattc

SEQ ID NO: 29694 - DNA, 20 bp, Artificial Sequence
  Synthetic oligonucleotide; TAG chr11 5393217 5393236 5393220 -
tataatattcacttattaaa

SEQ ID NO: 29695 - DNA, 20 bp, Artificial Sequence
  Synthetic oligonucleotide; TAG chr11 5393186 5393205 5393189 -
atatttattgatcactgacc

SEQ ID NO: 29696 - DNA, 20 bp, Artificial Sequence
  Synthetic oligonucleotide; AGG chr11 5393185 5393204 5393188 -
tatttattgatcactgacct

SEQ ID NO: 29697 - DNA, 20 bp, Artificial Sequence
  Synthetic oligonucleotide; GAG chr11 5393183 5393202 5393186 -
tttattgatcactgacctag

SEQ ID NO: 29698 - DNA, 20 bp, Artificial Sequence
  Synthetic oligonucleotide; TGG chr11 5393179 5393198 5393182 -
ttgatcactgacctaggaga

SEQ ID NO: 29699 - DNA, 20 bp, Artificial Sequence
  Synthetic oligonucleotide; TAG chr11 5393173 5393192 5393176 -
actgacctaggagatggatt

SEQ ID NO: 29700 - DNA, 20 bp, Artificial Sequence
  Synthetic oligonucleotide; GAG chr11 5393164 5393183 5393167 -
ggagatggatttagaactgt

SEQ ID NO: 29701 - DNA, 20 bp, Artificial Sequence
  Synthetic oligonucleotide; CAG chr11 5393157 5393176 5393160 -
gatttagaactgtgagcaaa

SEQ ID NO: 29702 - DNA, 20 bp, Artificial Sequence
  Synthetic oligonucleotide; AGG chr11 5393156 5393175 5393159 -
atttagaactgtgagcaaac

SEQ ID NO: 29703 - DNA, 20 bp, Artificial Sequence
  Synthetic oligonucleotide; CAG chr11 5393134 5393153 5393137 -
gaaaaaaattttgccacaaa

SEQ ID NO: 29704 - DNA, 20 bp, Artificial Sequence
  Synthetic oligonucleotide; TAG chr11 5393098 5393117 5393101 -
tttttaatttatcatttatt

SEQ ID NO: 29705 - DNA, 20 bp, Artificial Sequence
  Synthetic oligonucleotide; AGG chr11 5393097 5393116 5393100 -
ttttaatttatcatttattt

SEQ ID NO: 29706 - DNA, 20 bp, Artificial Sequence
  Synthetic oligonucleotide; CAG chr11 5393093 5393112 5393096 -
aatttatcatttatttagga

SEQ ID NO: 29707 - DNA, 20 bp, Artificial Sequence
  Synthetic oligonucleotide; TAG chr11 5393085 5393104 5393088 -
atttatttaggacagatttt

SEQ ID NO: 29708 - DNA, 20 bp, Artificial Sequence
  Synthetic oligonucleotide; AAG chr11 5393082 5393101 5393085 -
tatttaggacagatttttag

SEQ ID NO: 29709 - DNA, 20 bp, Artificial Sequence
  Synthetic oligonucleotide; TGG chr11 5393079 5393098 5393082 -
ttaggacagatttttagaag

SEQ ID NO: 29710 - DNA, 20 bp, Artificial Sequence
  Synthetic oligonucleotide; GAG chr11 5393069 5393088 5393072 -
tttttagaagtggcatttct

SEQ ID NO: 29711 - DNA, 20 bp, Artificial Sequence
  Synthetic oligonucleotide; CAG chr11 5393063 5393082 5393066 -
gaagtggcatttctgagaca

SEQ ID NO: 29712 - DNA, 20 bp, Artificial Sequence
  Synthetic oligonucleotide; GAG chr11 5393061 5393080 5393064 -
agtggcatttctgagacaca

SEQ ID NO: 29713 - DNA, 20 bp, Artificial Sequence
  Synthetic oligonucleotide; AAG chr11 5393045 5393064 5393048 -
cacagagcatgaatattttc

SEQ ID NO: 29714 - DNA, 20 bp, Artificial Sequence
  Synthetic oligonucleotide; AAG chr11 5393015 5393034 5393018 -
atgtattttgttttttataa

SEQ ID NO: 29715 - DNA, 20 bp, Artificial Sequence
  Synthetic oligonucleotide; AGG chr11 5393014 5393033 5393017 -
tgtattttgttttttataaa

SEQ ID NO: 29716 - DNA, 20 bp, Artificial Sequence
  Synthetic oligonucleotide; TGG chr11 5392988 5393007 5392991 -
attaaattatgttttcattc

SEQ ID NO: 29717 - DNA, 20 bp, Artificial Sequence
  Synthetic oligonucleotide; CAG chr11 5392952 5392971 5392955 -
ctcttttaccacatacttaa

SEQ ID NO: 29718 - DNA, 20 bp, Artificial Sequence
  Synthetic oligonucleotide; CAG chr11 5392947 5392966 5392950 -
ttaccacatacttaacagca

SEQ ID NO: 29719 - DNA, 20 bp, Artificial Sequence
  Synthetic oligonucleotide; GAG chr11 5392912 5392931 5392915 -
ttttctttttttttgttttt

SEQ ID NO: 29720 - DNA, 20 bp, Artificial Sequence
  Synthetic oligonucleotide; AAG chr11 5392909 5392928 5392912 -
tctttttttttgtttttgag

SEQ ID NO: 29721 - DNA, 20 bp, Artificial Sequence
  Synthetic oligonucleotide; AGG chr11 5392908 5392927 5392911 -
ctttttttttgtttttgaga

SEQ ID NO: 29722 - DNA, 20 bp, Artificial Sequence
  Synthetic oligonucleotide; GAG chr11 5392906 5392925 5392909 -
ttttttttgtttttgagaag

SEQ ID NO: 29723 - DNA, 20 bp, Artificial Sequence
  Synthetic oligonucleotide; CAG chr11 5392888 5392907 5392891 -
aggagtcttgctctgttgcc

SEQ ID NO: 29724 - DNA, 20 bp, Artificial Sequence
  Synthetic oligonucleotide; AGG chr11 5392887 5392906 5392890 -
ggagtcttgctctgttgccc

SEQ ID NO: 29725 - DNA, 20 bp, Artificial Sequence
  Synthetic oligonucleotide; TGG chr11 5392883 5392902 5392886 -
tcttgctctgttgcccaggc

SEQ ID NO: 29726 - DNA, 20 bp, Artificial Sequence
  Synthetic oligonucleotide; GAG chr11 5392881 5392900 5392884 -
ttgctctgttgcccaggctg

SEQ ID NO: 29727 - DNA, 20 bp, Artificial Sequence
  Synthetic oligonucleotide; CAG chr11 5392876 5392895 5392879 -
ctgttgcccaggctggagtg

SEQ ID NO: 29728 - DNA, 20 bp, Artificial Sequence
  Synthetic oligonucleotide; TGG chr11 5392873 5392892 5392876 -
ttgcccaggctggagtgcag

SEQ ID NO: 29729 - DNA, 20 bp, Artificial Sequence
  Synthetic oligonucleotide; CGG chr11 5392862 5392881 5392865 -
ggagtgcagtggcacgatct

SEQ ID NO: 29730 - DNA, 20 bp, Artificial Sequence
  Synthetic oligonucleotide; AAG chr11 5392851 5392870 5392854 -
gcacgatctcggctcactgc

SEQ ID NO: 29731 - DNA, 20 bp, Artificial Sequence
  Synthetic oligonucleotide; TGG chr11 5392838 5392857 5392841 -
tcactgcaagctccacctcc

SEQ ID NO: 29732 - DNA, 20 bp, Artificial Sequence
  Synthetic oligonucleotide; GGG chr11 5392837 5392856 5392840 -
cactgcaagctccacctcct

SEQ ID NO: 29733 - DNA, 20 bp, Artificial Sequence
  Synthetic oligonucleotide; CAG chr11 5392814 5392833 5392817 -
ttcacgccattctgctgccc

SEQ ID NO: 29734 - DNA, 20 bp, Artificial Sequence
  Synthetic oligonucleotide; GAG chr11 5392805 5392824 5392808 -
ttctgctgccccagcctcct

SEQ ID NO: 29735 - DNA, 20 bp, Artificial Sequence
  Synthetic oligonucleotide; TAG chr11 5392802 5392821 5392805 -
tgctgccccagcctcctgag

SEQ ID NO: 29736 - DNA, 20 bp, Artificial Sequence
  Synthetic oligonucleotide; TGG chr11 5392798 5392817 5392801 -
gccccagcctcctgagtagc

SEQ ID NO: 29737 - DNA, 20 bp, Artificial Sequence
  Synthetic oligonucleotide; GGG chr11 5392797 5392816 5392800 -
ccccagcctcctgagtagct

SEQ ID NO: 29738 - DNA, 20 bp, Artificial Sequence
  Synthetic oligonucleotide; CAG chr11 5392790 5392809 5392793 -
ctcctgagtagctgggacta

SEQ ID NO: 29739 - DNA, 20 bp, Artificial Sequence
  Synthetic oligonucleotide; AGG chr11 5392789 5392808 5392792 -
tcctgagtagctgggactac

SEQ ID NO: 29740 - DNA, 20 bp, Artificial Sequence
  Synthetic oligonucleotide; CGG chr11 5392770 5392789 5392773 -
caggtgcccaccaccatgcc

SEQ ID NO: 29741 - DNA, 20 bp, Artificial Sequence
  Synthetic oligonucleotide; TAG chr11 5392750 5392769 5392753 -
cggctaactttttgtatttt

SEQ ID NO: 29742 - DNA, 20 bp, Artificial Sequence
  Synthetic oligonucleotide; TAG chr11 5392747 5392766 5392750 -
ctaactttttgtatttttag

SEQ ID NO: 29743 - DNA, 20 bp, Artificial Sequence
  Synthetic oligonucleotide; GAG chr11 5392745 5392764 5392748 -
aactttttgtatttttagta

SEQ ID NO: 29744 - DNA, 20 bp, Artificial Sequence
  Synthetic oligonucleotide; TGG chr11 5392740 5392759 5392743 -
tttgtatttttagtagagac

SEQ ID NO: 29745 - DNA, 20 bp, Artificial Sequence
  Synthetic oligonucleotide; GGG chr11 5392739 5392758 5392742 -
ttgtatttttagtagagact

SEQ ID NO: 29746 - DNA, 20 bp, Artificial Sequence
  Synthetic oligonucleotide; TAG chr11 5392725 5392744 5392728 -
gagactgggttccaccgtgt

SEQ ID NO: 29747 - DNA, 20 bp, Artificial Sequence
  Synthetic oligonucleotide; CAG chr11 5392721 5392740 5392724 -
ctgggttccaccgtgttagc

SEQ ID NO: 29748 - DNA, 20 bp, Artificial Sequence
  Synthetic oligonucleotide; AGG chr11 5392720 5392739 5392723 -
tgggttccaccgtgttagcc

SEQ ID NO: 29749 - DNA, 20 bp, Artificial Sequence
  Synthetic oligonucleotide; TGG chr11 5392716 5392735 5392719 -
ttccaccgtgttagccagga

SEQ ID NO: 29750 - DNA, 20 bp, Artificial Sequence
  Synthetic oligonucleotide; CGG chr11 5392680 5392699 5392683 -
acctcgtgatccacccgcct

SEQ ID NO: 29751 - DNA, 20 bp, Artificial Sequence
  Synthetic oligonucleotide; CAG chr11 5392672 5392691 5392675 -
atccacccgcctcggcctcc

SEQ ID NO: 29752 - DNA, 20 bp, Artificial Sequence
  Synthetic oligonucleotide; GAG chr11 5392670 5392689 5392673 -
ccacccgcctcggcctccca

SEQ ID NO: 29753 - DNA, 20 bp, Artificial Sequence
  Synthetic oligonucleotide; TGG chr11 5392664 5392683 5392667 -
gcctcggcctcccagagtgc

SEQ ID NO: 29754 - DNA, 20 bp, Artificial Sequence
  Synthetic oligonucleotide; GGG chr11 5392663 5392682 5392666 -
cctcggcctcccagagtgct

SEQ ID NO: 29755 - DNA, 20 bp, Artificial Sequence
  Synthetic oligonucleotide; CAG chr11 5392656 5392675 5392659 -
ctcccagagtgctgggatta

SEQ ID NO: 29756 - DNA, 20 bp, Artificial Sequence
  Synthetic oligonucleotide; AGG chr11 5392655 5392674 5392658 -
tcccagagtgctgggattac

SEQ ID NO: 29757 - DNA, 20 bp, Artificial Sequence
  Synthetic oligonucleotide; GAG chr11 5392649 5392668 5392652 -
agtgctgggattacaggcgt

SEQ ID NO: 29758 - DNA, 20 bp, Artificial Sequence
  Synthetic oligonucleotide; CAG chr11 5392636 5392655 5392639 -
caggcgtgagccaccgcgcc

SEQ ID NO: 29759 - DNA, 20 bp, Artificial Sequence
  Synthetic oligonucleotide; CAG chr11 5392632 5392651 5392635 -
cgtgagccaccgcgcccagc

SEQ ID NO: 29760 - DNA, 20 bp, Artificial Sequence
  Synthetic oligonucleotide; TAG chr11 5392594 5392613 5392597 -
tctattcttcaatattcgtt

SEQ ID NO: 29761 - DNA, 20 bp, Artificial Sequence
  Synthetic oligonucleotide; AAG chr11 5392582 5392601 5392585 -
tattcgtttagtaacaaatt

SEQ ID NO: 29762 - DNA, 20 bp, Artificial Sequence
  Synthetic oligonucleotide; GAG chr11 5392554 5392573 5392557 -
ttaatttgcattttaaattt

SEQ ID NO: 29763 - DNA, 20 bp, Artificial Sequence
  Synthetic oligonucleotide; AAG chr11 5392550 5392569 5392553 -
tttgcattttaaatttgagt

SEQ ID NO: 29764 - DNA, 20 bp, Artificial Sequence
  Synthetic oligonucleotide; AGG chr11 5392549 5392568 5392552 -
ttgcattttaaatttgagta

SEQ ID NO: 29765 - DNA, 20 bp, Artificial Sequence
  Synthetic oligonucleotide; TAG chr11 5392546 5392565 5392549 -
cattttaaatttgagtaagg

SEQ ID NO: 29766 - DNA, 20 bp, Artificial Sequence
  Synthetic oligonucleotide; AAG chr11 5392543 5392562 5392546 -
tttaaatttgagtaaggtag

SEQ ID NO: 29767 - DNA, 20 bp, Artificial Sequence
  Synthetic oligonucleotide; TAG chr11 5392489 5392508 5392492 -
cctaatttgaaaatgaaatt

SEQ ID NO: 29768 - DNA, 20 bp, Artificial Sequence
  Synthetic oligonucleotide; CAG chr11 5392482 5392501 5392485 -
tgaaaatgaaatttagatgt

SEQ ID NO: 29769 - DNA, 20 bp, Artificial Sequence
  Synthetic oligonucleotide; TGG chr11 5392479 5392498 5392482 -
aaatgaaatttagatgtcag

SEQ ID NO: 29770 - DNA, 20 bp, Artificial Sequence
  Synthetic oligonucleotide; AAG chr11 5392463 5392482 5392466 -
tcagtggtctatttgttaat

SEQ ID NO: 29771 - DNA, 20 bp, Artificial Sequence
  Synthetic oligonucleotide; GAG chr11 5392461 5392480 5392464 -
agtggtctatttgttaataa

SEQ ID NO: 29772 - DNA, 20 bp, Artificial Sequence
  Synthetic oligonucleotide; AGG chr11 5392460 5392479 5392463 -
gtggtctatttgttaataag

SEQ ID NO: 29773 - DNA, 20 bp, Artificial Sequence
  Synthetic oligonucleotide; TGG chr11 5392452 5392471 5392455 -
tttgttaataagaggcaaaa

SEQ ID NO: 29774 - DNA, 20 bp, Artificial Sequence
  Synthetic oligonucleotide; GGG chr11 5392451 5392470 5392454 -
ttgttaataagaggcaaaat

SEQ ID NO: 29775 - DNA, 20 bp, Artificial Sequence
  Synthetic oligonucleotide; CAG chr11 5392444 5392463 5392447 -
taagaggcaaaatgggactt

SEQ ID NO: 29776 - DNA, 20 bp, Artificial Sequence
  Synthetic oligonucleotide; GAG chr11 5392391 5392410 5392394 -
tgtaccccattctaccaaat

SEQ ID NO: 29777 - DNA, 20 bp, Artificial Sequence
  Synthetic oligonucleotide; TAG chr11 5392383 5392402 5392386 -
attctaccaaatgagatcta

SEQ ID NO: 29778 - DNA, 20 bp, Artificial Sequence
  Synthetic oligonucleotide; TAG chr11 5392378 5392397 5392381 -
accaaatgagatctatagaa

SEQ ID NO: 29779 - DNA, 20 bp, Artificial Sequence
  Synthetic oligonucleotide; AGG chr11 5392377 5392396 5392380 -
ccaaatgagatctatagaat

SEQ ID NO: 29780 - DNA, 20 bp, Artificial Sequence
  Synthetic oligonucleotide; TGG chr11 5392359 5392378 5392362 -
ataggaatttcctctcaaca

SEQ ID NO: 29781 - DNA, 20 bp, Artificial Sequence
  Synthetic oligonucleotide; GAG chr11 5392357 5392376 5392360 -
aggaatttcctctcaacatg

SEQ ID NO: 29782 - DNA, 20 bp, Artificial Sequence
  Synthetic oligonucleotide; AAG chr11 5392354 5392373 5392357 -
aatttcctctcaacatggag

SEQ ID NO: 29783 - DNA, 20 bp, Artificial Sequence
  Synthetic oligonucleotide; AAG chr11 5392343 5392362 5392346 -
aacatggagaagaatattct

SEQ ID NO: 29784 - DNA, 20 bp, Artificial Sequence
  Synthetic oligonucleotide; CGG chr11 5392337 5392356 5392340 -
gagaagaatattctaagtct

SEQ ID NO: 29785 - DNA, 20 bp, Artificial Sequence
  Synthetic oligonucleotide; GAG chr11 5392324 5392343 5392327 -
taagtctcggaactgctatt

SEQ ID NO: 29786 - DNA, 20 bp, Artificial Sequence
  Synthetic oligonucleotide; TGG chr11 5392316 5392335 5392319 -
ggaactgctattgagtaatg

SEQ ID NO: 29787 - DNA, 20 bp, Artificial Sequence
  Synthetic oligonucleotide; TGG chr11 5392304 5392323 5392307 -
gagtaatgtggcctactatg

SEQ ID NO: 29788 - DNA, 20 bp, Artificial Sequence
  Synthetic oligonucleotide; AAG chr11 5392291 5392310 5392294 -
tactatgtggatgtaaatta

SEQ ID NO: 29789 - DNA, 20 bp, Artificial Sequence
  Synthetic oligonucleotide; TAG chr11 5392286 5392305 5392289 -
tgtggatgtaaattaaagtt

SEQ ID NO: 29790 - DNA, 20 bp, Artificial Sequence
  Synthetic oligonucleotide; TGG chr11 5392281 5392300 5392284 -
atgtaaattaaagtttagaa

SEQ ID NO: 29791 - DNA, 20 bp, Artificial Sequence
  Synthetic oligonucleotide; AAG chr11 5392267 5392286 5392270 -
ttagaatggaacctatgttt

SEQ ID NO: 29792 - DNA, 20 bp, Artificial Sequence
  Synthetic oligonucleotide; AGG chr11 5392266 5392285 5392269 -
tagaatggaacctatgttta

SEQ ID NO: 29793 - DNA, 20 bp, Artificial Sequence
  Synthetic oligonucleotide; GAG chr11 5392264 5392283 5392267 -
gaatggaacctatgtttaag

SEQ ID NO: 29794 - DNA, 20 bp, Artificial Sequence
  Synthetic oligonucleotide; CAG chr11 5392258 5392277 5392261 -
aacctatgtttaaggagtgc

SEQ ID NO: 29795 - DNA, 20 bp, Artificial Sequence
  Synthetic oligonucleotide; AAG chr11 5392250 5392269 5392253 -
tttaaggagtgccagcctgt

SEQ ID NO: 29796 - DNA, 20 bp, Artificial Sequence
  Synthetic oligonucleotide; AGG chr11 5392249 5392268 5392252 -
ttaaggagtgccagcctgta

SEQ ID NO: 29797 - DNA, 20 bp, Artificial Sequence
  Synthetic oligonucleotide; CAG chr11 5392243 5392262 5392246 -
agtgccagcctgtaaggctg

SEQ ID NO: 29798 - DNA, 20 bp, Artificial Sequence
  Synthetic oligonucleotide; TGG chr11 5392233 5392252 5392236 -
tgtaaggctgcagaaactgc

SEQ ID NO: 29799 - DNA, 20 bp, Artificial Sequence
  Synthetic oligonucleotide; GGG chr11 5392232 5392251 5392235 -
gtaaggctgcagaaactgct

SEQ ID NO: 29800 - DNA, 20 bp, Artificial Sequence
  Synthetic oligonucleotide; CAG chr11 5392226 5392245 5392229 -
ctgcagaaactgctgggttc

SEQ ID NO: 29801 - DNA, 20 bp, Artificial Sequence
  Synthetic oligonucleotide; GAG chr11 5392224 5392243 5392227 -
gcagaaactgctgggttcca

SEQ ID NO: 29802 - DNA, 20 bp, Artificial Sequence
  Synthetic oligonucleotide; AGG chr11 5392223 5392242 5392226 -
cagaaactgctgggttccag

SEQ ID NO: 29803 - DNA, 20 bp, Artificial Sequence
  Synthetic oligonucleotide; GGG chr11 5392222 5392241 5392225 -
agaaactgctgggttccaga

SEQ ID NO: 29804 - DNA, 20 bp, Artificial Sequence
  Synthetic oligonucleotide; GGG chr11 5392221 5392240 5392224 -
gaaactgctgggttccagag

SEQ ID NO: 29805 - DNA, 20 bp, Artificial Sequence
  Synthetic oligonucleotide; AAG chr11 5392213 5392232 5392216 -
tgggttccagaggggctccc

SEQ ID NO: 29806 - DNA, 20 bp, Artificial Sequence
  Synthetic oligonucleotide; GAG chr11 5392207 5392226 5392210 -
ccagaggggctcccaagcct

SEQ ID NO: 29807 - DNA, 20 bp, Artificial Sequence
  Synthetic oligonucleotide; GAG chr11 5392205 5392224 5392208 -
agaggggctcccaagcctga

SEQ ID NO: 29808 - DNA, 20 bp, Artificial Sequence
  Synthetic oligonucleotide; GAG chr11 5392175 5392194 5392178 -
acacccacacatacaaacat

SEQ ID NO: 29809 - DNA, 20 bp, Artificial Sequence
  Synthetic oligonucleotide; AAG chr11 5392153 5392172 5392156 -
gataccacacaaacatacac

SEQ ID NO: 29810 - DNA, 20 bp, Artificial Sequence
  Synthetic oligonucleotide; TAG chr11 5392122 5392141 5392125 -
caaacatacatacatatttt

SEQ ID NO: 29811 - DNA, 20 bp, Artificial Sequence
  Synthetic oligonucleotide; GAG chr11 5392120 5392139 5392123 -
aacatacatacatattttta

SEQ ID NO: 29812 - DNA, 20 bp, Artificial Sequence
  Synthetic oligonucleotide; TGG chr11 5392115 5392134 5392118 -
acatacatatttttagagtt

SEQ ID NO: 29813 - DNA, 20 bp, Artificial Sequence
  Synthetic oligonucleotide; CGG chr11 5392057 5392076 5392060 -
tttcctttttatttttgaat

SEQ ID NO: 29814 - DNA, 20 bp, Artificial Sequence
  Synthetic oligonucleotide; GGG chr11 5392056 5392075 5392059 -
ttcctttttatttttgaatc

SEQ ID NO: 29815 - DNA, 20 bp, Artificial Sequence
  Synthetic oligonucleotide; GGG chr11 5392055 5392074 5392058 -
tcctttttatttttgaatcg

SEQ ID NO: 29816 - DNA, 20 bp, Artificial Sequence
  Synthetic oligonucleotide; TGG chr11 5392045 5392064 5392048 -
ttttgaatcggggtctcact

SEQ ID NO: 29817 - DNA, 20 bp, Artificial Sequence
  Synthetic oligonucleotide; CAG chr11 5392037 5392056 5392040 -
cggggtctcacttggtcacc

SEQ ID NO: 29818 - DNA, 20 bp, Artificial Sequence
  Synthetic oligonucleotide; AGG chr11 5392036 5392055 5392039 -
ggggtctcacttggtcaccc

SEQ ID NO: 29819 - DNA, 20 bp, Artificial Sequence
  Synthetic oligonucleotide; CAG chr11 5392033 5392052 5392036 -
gtctcacttggtcacccagg

SEQ ID NO: 29820 - DNA, 20 bp, Artificial Sequence
  Synthetic oligonucleotide; TAG chr11 5392030 5392049 5392033 -
tcacttggtcacccaggcag

SEQ ID NO: 29821 - DNA, 20 bp, Artificial Sequence
  Synthetic oligonucleotide; TGG chr11 5392019 5392038 5392022 -
cccaggcagtagtgtgatta

SEQ ID NO: 29822 - DNA, 20 bp, Artificial Sequence
  Synthetic oligonucleotide; CAG chr11 5392009 5392028 5392012 -
agtgtgattatggctcactg

SEQ ID NO: 29823 - DNA, 20 bp, Artificial Sequence
  Synthetic oligonucleotide; TGG chr11 5391995 5392014 5391998 -
tcactgcagcctcaacctcc

SEQ ID NO: 29824 - DNA, 20 bp, Artificial Sequence
  Synthetic oligonucleotide; GGG chr11 5391994 5392013 5391997 -
cactgcagcctcaacctcct

SEQ ID NO: 29825 - DNA, 20 bp, Artificial Sequence
  Synthetic oligonucleotide; AAG chr11 5391988 5392007 5391991 -
agcctcaacctcctgggctc

SEQ ID NO: 29826 - DNA, 20 bp, Artificial Sequence
  Synthetic oligonucleotide; CAG chr11 5391971 5391990 5391974 -
ctcaagcattcttcccacct

SEQ ID NO: 29827 - DNA, 20 bp, Artificial Sequence
  Synthetic oligonucleotide; CAG chr11 5391963 5391982 5391966 -
ttcttcccacctcagcctcc

SEQ ID NO: 29828 - DNA, 20 bp, Artificial Sequence
  Synthetic oligonucleotide; AGG chr11 5391962 5391981 5391965 -
tcttcccacctcagcctccc

SEQ ID NO: 29829 - DNA, 20 bp, Artificial Sequence
  Synthetic oligonucleotide; TAG chr11 5391959 5391978 5391962 -
tcccacctcagcctcccagg

SEQ ID NO: 29830 - DNA, 20 bp, Artificial Sequence
  Synthetic oligonucleotide; GAG chr11 5391954 5391973 5391957 -
cctcagcctcccaggtagct

SEQ ID NO: 29831 - DNA, 20 bp, Artificial Sequence
  Synthetic oligonucleotide; CAG chr11 5391947 5391966 5391950 -
ctcccaggtagctgagacta

SEQ ID NO: 29832 - DNA, 20 bp, Artificial Sequence
  Synthetic oligonucleotide; TGG chr11 5391927 5391946 5391930 -
cagacgtgcaccgccacaca

SEQ ID NO: 29833 - DNA, 20 bp, Artificial Sequence
  Synthetic oligonucleotide; TAG chr11 5391905 5391924 5391908 -
gctaattttaattttttttg

SEQ ID NO: 29834 - DNA, 20 bp, Artificial Sequence
  Synthetic oligonucleotide; GAG chr11 5391903 5391922 5391906 -
taattttaattttttttgta

SEQ ID NO: 29835 - DNA, 20 bp, Artificial Sequence
  Synthetic oligonucleotide; TAG chr11 5391899 5391918 5391902 -
tttaattttttttgtagaga

SEQ ID NO: 29836 - DNA, 20 bp, Artificial Sequence
  Synthetic oligonucleotide; AGG chr11 5391898 5391917 5391901 -
ttaattttttttgtagagat

SEQ ID NO: 29837 - DNA, 20 bp, Artificial Sequence
  Synthetic oligonucleotide; GGG chr11 5391897 5391916 5391900 -
taattttttttgtagagata

SEQ ID NO: 29838 - DNA, 20 bp, Artificial Sequence
  Synthetic oligonucleotide; CAG chr11 5391879 5391898 5391882 -
tagggtcttgctgtattgtt

SEQ ID NO: 29839 - DNA, 20 bp, Artificial Sequence
  Synthetic oligonucleotide; AGG chr11 5391878 5391897 5391881 -
agggtcttgctgtattgttc

SEQ ID NO: 29840 - DNA, 20 bp, Artificial Sequence
  Synthetic oligonucleotide; TGG chr11 5391874 5391893 5391877 -
tcttgctgtattgttcaggc

SEQ ID NO: 29841 - DNA, 20 bp, Artificial Sequence
  Synthetic oligonucleotide; TGG chr11 5391860 5391879 5391863 -
tcaggctggtctcaaactcc

SEQ ID NO: 29842 - DNA, 20 bp, Artificial Sequence
  Synthetic oligonucleotide; AAG chr11 5391853 5391872 5391856 -
ggtctcaaactcctggactc

SEQ ID NO: 29843 - DNA, 20 bp, Artificial Sequence
  Synthetic oligonucleotide; AAG chr11 5391835 5391854 5391838 -
tcaagtaatcttcttgcctg

SEQ ID NO: 29844 - DNA, 20 bp, Artificial Sequence
  Synthetic oligonucleotide; TGG chr11 5391831 5391850 5391834 -
gtaatcttcttgcctgaagt

SEQ ID NO: 29845 - DNA, 20 bp, Artificial Sequence
  Synthetic oligonucleotide; TGG chr11 5391817 5391836 5391820 -
tgaagttggtctcaaactcc

SEQ ID NO: 29846 - DNA, 20 bp, Artificial Sequence
  Synthetic oligonucleotide; CAG chr11 5391810 5391829 5391813 -
ggtctcaaactcctggcctt

SEQ ID NO: 29847 - DNA, 20 bp, Artificial Sequence
  Synthetic oligonucleotide; TGG chr11 5391793 5391812 5391796 -
cttcagcaatcctcccacct

SEQ ID NO: 29848 - DNA, 20 bp, Artificial Sequence
  Synthetic oligonucleotide; AAG chr11 5391783 5391802 5391786 -
cctcccaccttggtctccca

SEQ ID NO: 29849 - DNA, 20 bp, Artificial Sequence
  Synthetic oligonucleotide; TGG chr11 5391777 5391796 5391780 -
accttggtctcccaaagtgc

SEQ ID NO: 29850 - DNA, 20 bp, Artificial Sequence
  Synthetic oligonucleotide; GGG chr11 5391776 5391795 5391779 -
ccttggtctcccaaagtgct

SEQ ID NO: 29851 - DNA, 20 bp, Artificial Sequence
  Synthetic oligonucleotide; TAG chr11 5391769 5391788 5391772 -
ctcccaaagtgctgggatta

SEQ ID NO: 29852 - DNA, 20 bp, Artificial Sequence
  Synthetic oligonucleotide; AAG chr11 5391763 5391782 5391766 -
aagtgctgggattatagcat

SEQ ID NO: 29853 - DNA, 20 bp, Artificial Sequence
  Synthetic oligonucleotide; TGG chr11 5391750 5391769 5391753 -
atagcataagccaccgtgcc

SEQ ID NO: 29854 - DNA, 20 bp, Artificial Sequence
  Synthetic oligonucleotide; TGG chr11 5391742 5391761 5391745 -
agccaccgtgcctggcctca

SEQ ID NO: 29855 - DNA, 20 bp, Artificial Sequence
  Synthetic oligonucleotide; TAG chr11 5391726 5391745 5391729 -
ctcatggtaattttaacctg

SEQ ID NO: 29856 - DNA, 20 bp, Artificial Sequence
  Synthetic oligonucleotide; AGG chr11 5391725 5391744 5391728 -
tcatggtaattttaacctgt

SEQ ID NO: 29857 - DNA, 20 bp, Artificial Sequence
  Synthetic oligonucleotide; GAG chr11 5391723 5391742 5391726 -
atggtaattttaacctgtag

SEQ ID NO: 29858 - DNA, 20 bp, Artificial Sequence
  Synthetic oligonucleotide; TGG chr11 5391718 5391737 5391721 -
aattttaacctgtaggagaa

SEQ ID NO: 29859 - DNA, 20 bp, Artificial Sequence
  Synthetic oligonucleotide; GGG chr11 5391717 5391736 5391720 -
attttaacctgtaggagaat

SEQ ID NO: 29860 - DNA, 20 bp, Artificial Sequence
  Synthetic oligonucleotide; TGG chr11 5391714 5391733 5391717 -
ttaacctgtaggagaatggg

SEQ ID NO: 29861 - DNA, 20 bp, Artificial Sequence
  Synthetic oligonucleotide; GGG chr11 5391713 5391732 5391716 -
taacctgtaggagaatgggt

SEQ ID NO: 29862 - DNA, 20 bp, Artificial Sequence
  Synthetic oligonucleotide; GAG chr11 5391711 5391730 5391714 -
acctgtaggagaatgggtgg

SEQ ID NO: 29863 - DNA, 20 bp, Artificial Sequence
  Synthetic oligonucleotide; AGG chr11 5391710 5391729 5391713 -
cctgtaggagaatgggtggg

SEQ ID NO: 29864 - DNA, 20 bp, Artificial Sequence
  Synthetic oligonucleotide; CAG chr11 5391704 5391723 5391707 -
ggagaatgggtgggaggatc

SEQ ID NO: 29865 - DNA, 20 bp, Artificial Sequence
  Synthetic oligonucleotide; GAG chr11 5391702 5391721 5391705 -
agaatgggtgggaggatcca

SEQ ID NO: 29866 - DNA, 20 bp, Artificial Sequence
  Synthetic oligonucleotide; AGG chr11 5391701 5391720 5391704 -
gaatgggtgggaggatccag

SEQ ID NO: 29867 - DNA, 20 bp, Artificial Sequence
  Synthetic oligonucleotide; GGG chr11 5391700 5391719 5391703 -
aatgggtgggaggatccaga

SEQ ID NO: 29868 - DNA, 20 bp, Artificial Sequence
  Synthetic oligonucleotide; GAG chr11 5391694 5391713 5391697 -
tgggaggatccagagggcct

SEQ ID NO: 29869 - DNA, 20 bp, Artificial Sequence
  Synthetic oligonucleotide; AAG chr11 5391689 5391708 5391692 -
ggatccagagggcctgagta

SEQ ID NO: 29870 - DNA, 20 bp, Artificial Sequence
  Synthetic oligonucleotide; TAG chr11 5391686 5391705 5391689 -
tccagagggcctgagtaaag

SEQ ID NO: 29871 - DNA, 20 bp, Artificial Sequence
  Synthetic oligonucleotide; TGG chr11 5391680 5391699 5391683 -
gggcctgagtaaagtagaac

SEQ ID NO: 29872 - DNA, 20 bp, Artificial Sequence
  Synthetic oligonucleotide; GGG chr11 5391679 5391698 5391682 -
ggcctgagtaaagtagaact

SEQ ID NO: 29873 - DNA, 20 bp, Artificial Sequence
  Synthetic oligonucleotide; AAG chr11 5391670 5391689 5391673 -
aaagtagaactgggacaatg

SEQ ID NO: 29874 - DNA, 20 bp, Artificial Sequence
  Synthetic oligonucleotide; TGG chr11 5391653 5391672 5391656 -
atgaagatataccaccttga

SEQ ID NO: 29875 - DNA, 20 bp, Artificial Sequence
  Synthetic oligonucleotide; CAG chr11 5391646 5391665 5391649 -
tataccaccttgatggatgc

SEQ ID NO: 29876 - DNA, 20 bp, Artificial Sequence
  Synthetic oligonucleotide; CAG chr11 5391643 5391662 5391646 -
accaccttgatggatgccag

SEQ ID NO: 29877 - DNA, 20 bp, Artificial Sequence
  Synthetic oligonucleotide; AAG chr11 5391639 5391658 5391642 -
ccttgatggatgccagcaga

SEQ ID NO: 29878 - DNA, 20 bp, Artificial Sequence
  Synthetic oligonucleotide; AGG chr11 5391638 5391657 5391641 -
cttgatggatgccagcagaa

SEQ ID NO: 29879 - DNA, 20 bp, Artificial Sequence
  Synthetic oligonucleotide; TGG chr11 5391627 5391646 5391630 -
ccagcagaaaggtgtcttct

SEQ ID NO: 29880 - DNA, 20 bp, Artificial Sequence
  Synthetic oligonucleotide; GGG chr11 5391626 5391645 5391629 -
cagcagaaaggtgtcttctt

SEQ ID NO: 29881 - DNA, 20 bp, Artificial Sequence
  Synthetic oligonucleotide; AAG chr11 5391611 5391630 5391614 -
ttcttgggcttctgaatgtg

SEQ ID NO: 29882 - DNA, 20 bp, Artificial Sequence
  Synthetic oligonucleotide; GAG chr11 5391609 5391628 5391612 -
cttgggcttctgaatgtgaa

SEQ ID NO: 29883 - DNA, 20 bp, Artificial Sequence
  Synthetic oligonucleotide; AGG chr11 5391608 5391627 5391611 -
ttgggcttctgaatgtgaag

SEQ ID NO: 29884 - DNA, 20 bp, Artificial Sequence
  Synthetic oligonucleotide; GAG chr11 5391606 5391625 5391609 -
gggcttctgaatgtgaagag

SEQ ID NO: 29885 - DNA, 20 bp, Artificial Sequence
  Synthetic oligonucleotide; AGG chr11 5391605 5391624 5391608 -
ggcttctgaatgtgaagagg

SEQ ID NO: 29886 - DNA, 20 bp, Artificial Sequence
  Synthetic oligonucleotide; GAG chr11 5391603 5391622 5391606 -
cttctgaatgtgaagaggag

SEQ ID NO: 29887 - DNA, 20 bp, Artificial Sequence
  Synthetic oligonucleotide; GAG chr11 5391594 5391613 5391597 -
gtgaagaggaggagttcctc

SEQ ID NO: 29888 - DNA, 20 bp, Artificial Sequence
  Synthetic oligonucleotide; AAG chr11 5391589 5391608 5391592 -
gaggaggagttcctcgagac

SEQ ID NO: 29889 - DNA, 20 bp, Artificial Sequence
  Synthetic oligonucleotide; AAG chr11 5391586 5391605 5391589 -
gaggagttcctcgagacaag

SEQ ID NO: 29890 - DNA, 20 bp, Artificial Sequence
  Synthetic oligonucleotide; GAG chr11 5391584 5391603 5391587 -
ggagttcctcgagacaagaa

SEQ ID NO: 29891 - DNA, 20 bp, Artificial Sequence
  Synthetic oligonucleotide; TAG chr11 5391572 5391591 5391575 -
gacaagaagagaacttctgt

SEQ ID NO: 29892 - DNA, 20 bp, Artificial Sequence
  Synthetic oligonucleotide; TGG chr11 5391566 5391585 5391569 -
aagagaacttctgttagctc

SEQ ID NO: 29893 - DNA, 20 bp, Artificial Sequence
  Synthetic oligonucleotide; GAG chr11 5391515 5391534 5391518 -
gcatacatttaatatttatt

SEQ ID NO: 29894 - DNA, 20 bp, Artificial Sequence
  Synthetic oligonucleotide; TGG chr11 5391508 5391527 5391511 -
tttaatatttattgagtata

SEQ ID NO: 29895 - DNA, 20 bp, Artificial Sequence
  Synthetic oligonucleotide; TAG chr11 5391498 5391517 5391501 -
attgagtatatggcatgtgc

SEQ ID NO: 29896 - DNA, 20 bp, Artificial Sequence
  Synthetic oligonucleotide; AGG chr11 5391497 5391516 5391500 -
ttgagtatatggcatgtgct

SEQ ID NO: 29897 - DNA, 20 bp, Artificial Sequence
  Synthetic oligonucleotide; TGG chr11 5391472 5391491 5391475 -
ttgtatttatatacatttac

SEQ ID NO: 29898 - DNA, 20 bp, Artificial Sequence
  Synthetic oligonucleotide; GAG chr11 5391468 5391487 5391471 -
atttatatacatttactggc

SEQ ID NO: 29899 - DNA, 20 bp, Artificial Sequence
  Synthetic oligonucleotide; AAG chr11 5391464 5391483 5391467 -
atatacatttactggcgagc

SEQ ID NO: 29900 - DNA, 20 bp, Artificial Sequence
  Synthetic oligonucleotide; CAG chr11 5391445 5391464 5391448 -
caagacatgcctaattcctc

SEQ ID NO: 29901 - DNA, 20 bp, Artificial Sequence
  Synthetic oligonucleotide; AGG chr11 5391444 5391463 5391447 -
aagacatgcctaattcctcc

SEQ ID NO: 29902 - DNA, 20 bp, Artificial Sequence
  Synthetic oligonucleotide; GGG chr11 5391443 5391462 5391446 -
agacatgcctaattcctcca

SEQ ID NO: 29903 - DNA, 20 bp, Artificial Sequence
  Synthetic oligonucleotide; TAG chr11 5391431 5391450 5391434 -
ttcctccagggatcttgatt

SEQ ID NO: 29904 - DNA, 20 bp, Artificial Sequence
  Synthetic oligonucleotide; TGG chr11 5391419 5391438 5391422 -
tcttgatttagtcattctaa

SEQ ID NO: 29905 - DNA, 20 bp, Artificial Sequence
  Synthetic oligonucleotide; CAG chr11 5391393 5391412 5391396 -
catgcacacaccttcataaa

SEQ ID NO: 29906 - DNA, 20 bp, Artificial Sequence
  Synthetic oligonucleotide; AGG chr11 5391392 5391411 5391395 -
atgcacacaccttcataaac

SEQ ID NO: 29907 - DNA, 20 bp, Artificial Sequence
  Synthetic oligonucleotide; CGG chr11 5391363 5391382 5391366 -
ctgtgtgacaaatgttacaa

SEQ ID NO: 29908 - DNA, 20 bp, Artificial Sequence
  Synthetic oligonucleotide; GGG chr11 5391362 5391381 5391365 -
tgtgtgacaaatgttacaac

SEQ ID NO: 29909 - DNA, 20 bp, Artificial Sequence
  Synthetic oligonucleotide; CAG chr11 5391354 5391373 5391357 -
aaatgttacaacgggaaatg

SEQ ID NO: 29910 - DNA, 20 bp, Artificial Sequence
  Synthetic oligonucleotide; AGG chr11 5391353 5391372 5391356 -
aatgttacaacgggaaatgc

SEQ ID NO: 29911 - DNA, 20 bp, Artificial Sequence
  Synthetic oligonucleotide; GGG chr11 5391352 5391371 5391355 -
atgttacaacgggaaatgca

SEQ ID NO: 29912 - DNA, 20 bp, Artificial Sequence
  Synthetic oligonucleotide; TGG chr11 5391344 5391363 5391347 -
acgggaaatgcagggcactg

SEQ ID NO: 29913 - DNA, 20 bp, Artificial Sequence
  Synthetic oligonucleotide; AAG chr11 5391341 5391360 5391344 -
ggaaatgcagggcactgtgg

SEQ ID NO: 29914 - DNA, 20 bp, Artificial Sequence
  Synthetic oligonucleotide; AGG chr11 5391340 5391359 5391343 -
gaaatgcagggcactgtgga

SEQ ID NO: 29915 - DNA, 20 bp, Artificial Sequence
  Synthetic oligonucleotide; TGG chr11 5391330 5391349 5391333 -
gcactgtggaaggaaaccga

SEQ ID NO: 29916 - DNA, 20 bp, Artificial Sequence
  Synthetic oligonucleotide; GAG chr11 5391328 5391347 5391331 -
actgtggaaggaaaccgatg

SEQ ID NO: 29917 - DNA, 20 bp, Artificial Sequence
  Synthetic oligonucleotide; TGG chr11 5391321 5391340 5391324 -
aaggaaaccgatggagcatt

SEQ ID NO: 29918 - DNA, 20 bp, Artificial Sequence
  Synthetic oligonucleotide; TGG chr11 5391307 5391326 5391310 -
agcatttggtgctttaccat

SEQ ID NO: 29919 - DNA, 20 bp, Artificial Sequence
  Synthetic oligonucleotide; AAG chr11 5391303 5391322 5391306 -
tttggtgctttaccattgga

SEQ ID NO: 29920 - DNA, 20 bp, Artificial Sequence
  Synthetic oligonucleotide; AGG chr11 5391302 5391321 5391305 -
ttggtgctttaccattggaa

SEQ ID NO: 29921 - DNA, 20 bp, Artificial Sequence
  Synthetic oligonucleotide; GGG chr11 5391301 5391320 5391304 -
tggtgctttaccattggaaa

SEQ ID NO: 29922 - DNA, 20 bp, Artificial Sequence
  Synthetic oligonucleotide; GAG chr11 5391299 5391318 5391302 -
gtgctttaccattggaaagg

SEQ ID NO: 29923 - DNA, 20 bp, Artificial Sequence
  Synthetic oligonucleotide; AGG chr11 5391298 5391317 5391301 -
tgctttaccattggaaaggg

SEQ ID NO: 29924 - DNA, 20 bp, Artificial Sequence
  Synthetic oligonucleotide; GAG chr11 5391296 5391315 5391299 -
ctttaccattggaaagggag

SEQ ID NO: 29925 - DNA, 20 bp, Artificial Sequence
  Synthetic oligonucleotide; GAG chr11 5391273 5391292 5391276 -
ctatctgtgaaaatgtcctt

SEQ ID NO: 29926 - DNA, 20 bp, Artificial Sequence
  Synthetic oligonucleotide; AGG chr11 5391272 5391291 5391275 -
tatctgtgaaaatgtccttg

SEQ ID NO: 29927 - DNA, 20 bp, Artificial Sequence
  Synthetic oligonucleotide; AAG chr11 5391269 5391288 5391272 -
ctgtgaaaatgtccttgagg

SEQ ID NO: 29928 - DNA, 20 bp, Artificial Sequence
  Synthetic oligonucleotide; AAG chr11 5391258 5391277 5391261 -
tccttgaggaagcaatttca

SEQ ID NO: 29929 - DNA, 20 bp, Artificial Sequence
  Synthetic oligonucleotide; GAG chr11 5391253 5391272 5391256 -
gaggaagcaatttcaaagct

SEQ ID NO: 29930 - DNA, 20 bp, Artificial Sequence
  Synthetic oligonucleotide; AAG chr11 5391242 5391261 5391245 -
ttcaaagctgagacccctgc

SEQ ID NO: 29931 - DNA, 20 bp, Artificial Sequence
  Synthetic oligonucleotide; AGG chr11 5391241 5391260 5391244 -
tcaaagctgagacccctgca

SEQ ID NO: 29932 - DNA, 20 bp, Artificial Sequence
  Synthetic oligonucleotide; TAG chr11 5391230 5391249 5391233 -
acccctgcaaggattgcatt

SEQ ID NO: 29933 - DNA, 20 bp, Artificial Sequence
  Synthetic oligonucleotide; TAG chr11 5391220 5391239 5391223 -
ggattgcatttagtcactcg

SEQ ID NO: 29934 - DNA, 20 bp, Artificial Sequence
  Synthetic oligonucleotide; AGG chr11 5391219 5391238 5391222 -
gattgcatttagtcactcgt

SEQ ID NO: 29935 - DNA, 20 bp, Artificial Sequence
  Synthetic oligonucleotide; GGG chr11 5391218 5391237 5391221 -
attgcatttagtcactcgta

SEQ ID NO: 29936 - DNA, 20 bp, Artificial Sequence
  Synthetic oligonucleotide; CAG chr11 5391214 5391233 5391217 -
catttagtcactcgtaggga

SEQ ID NO: 29937 - DNA, 20 bp, Artificial Sequence
  Synthetic oligonucleotide; AGG chr11 5391213 5391232 5391216 -
atttagtcactcgtagggac

SEQ ID NO: 29938 - DNA, 20 bp, Artificial Sequence
  Synthetic oligonucleotide; CAG chr11 5391205 5391224 5391208 -
actcgtagggacaggctgat

SEQ ID NO: 29939 - DNA, 20 bp, Artificial Sequence
  Synthetic oligonucleotide; AAG chr11 5391194 5391213 5391197 -
caggctgatcagccaatgta

SEQ ID NO: 29940 - DNA, 20 bp, Artificial Sequence
  Synthetic oligonucleotide; GAG chr11 5391178 5391197 5391181 -
tgtaaagtttatttcctcct

SEQ ID NO: 29941 - DNA, 20 bp, Artificial Sequence
  Synthetic oligonucleotide; TGG chr11 5391172 5391191 5391175 -
gtttatttcctcctgagcaa

SEQ ID NO: 29942 - DNA, 20 bp, Artificial Sequence
  Synthetic oligonucleotide; GGG chr11 5391171 5391190 5391174 -
tttatttcctcctgagcaat

SEQ ID NO: 29943 - DNA, 20 bp, Artificial Sequence
  Synthetic oligonucleotide; GAG chr11 5391144 5391163 5391147 -
tgacttcaatatgtttgtgt

SEQ ID NO: 29944 - DNA, 20 bp, Artificial Sequence
  Synthetic oligonucleotide; TGG chr11 5391135 5391154 5391138 -
tatgtttgtgtgagtttcct

SEQ ID NO: 29945 - DNA, 20 bp, Artificial Sequence
  Synthetic oligonucleotide; AAG chr11 5391129 5391148 5391132 -
tgtgtgagtttccttggctg

SEQ ID NO: 29946 - DNA, 20 bp, Artificial Sequence
  Synthetic oligonucleotide; AAG chr11 5391075 5391094 5391078 -
cacacaactaaaacacctac

SEQ ID NO: 29947 - DNA, 20 bp, Artificial Sequence
  Synthetic oligonucleotide; TAG chr11 5391059 5391078 5391062 -
ctacaagtaaatactgactg

SEQ ID NO: 29948 - DNA, 20 bp, Artificial Sequence
  Synthetic oligonucleotide; CAG chr11 5391048 5391067 5391051 -
tactgactgtagcttaatgt

SEQ ID NO: 29949 - DNA, 20 bp, Artificial Sequence
  Synthetic oligonucleotide; GAG chr11 5391041 5391060 5391044 -
tgtagcttaatgtcagactt

SEQ ID NO: 29950 - DNA, 20 bp, Artificial Sequence
  Synthetic oligonucleotide; AGG chr11 5391040 5391059 5391043 -
gtagcttaatgtcagacttg

SEQ ID NO: 29951 - DNA, 20 bp, Artificial Sequence
  Synthetic oligonucleotide; AAG chr11 5391033 5391052 5391036 -
aatgtcagacttgaggttgt

SEQ ID NO: 29952 - DNA, 20 bp, Artificial Sequence
  Synthetic oligonucleotide; AGG chr11 5391032 5391051 5391035 -
atgtcagacttgaggttgta

SEQ ID NO: 29953 - DNA, 20 bp, Artificial Sequence
  Synthetic oligonucleotide; CAG chr11 5391023 5391042 5391026 -
ttgaggttgtaaggtaaaat

SEQ ID NO: 29954 - DNA, 20 bp, Artificial Sequence
  Synthetic oligonucleotide; GAG chr11 5391021 5391040 5391024 -
gaggttgtaaggtaaaatca

SEQ ID NO: 29955 - DNA, 20 bp, Artificial Sequence
  Synthetic oligonucleotide; GAG chr11 5391016 5391035 5391019 -
tgtaaggtaaaatcagagat

SEQ ID NO: 29956 - DNA, 20 bp, Artificial Sequence
  Synthetic oligonucleotide; GAG chr11 5391014 5391033 5391017 -
taaggtaaaatcagagatga

SEQ ID NO: 29957 - DNA, 20 bp, Artificial Sequence
  Synthetic oligonucleotide; AGG chr11 5391013 5391032 5391016 -
aaggtaaaatcagagatgag

SEQ ID NO: 29958 - DNA, 20 bp, Artificial Sequence
  Synthetic oligonucleotide; GAG chr11 5391011 5391030 5391014 -
ggtaaaatcagagatgagag

SEQ ID NO: 29959 - DNA, 20 bp, Artificial Sequence
  Synthetic oligonucleotide; AAG chr11 5391006 5391025 5391009 -
aatcagagatgagaggagtc

SEQ ID NO: 29960 - DNA, 20 bp, Artificial Sequence
  Synthetic oligonucleotide; AGG chr11 5391005 5391024 5391008 -
atcagagatgagaggagtca

SEQ ID NO: 29961 - DNA, 20 bp, Artificial Sequence
  Synthetic oligonucleotide; TAG chr11 5391001 5391020 5391004 -
gagatgagaggagtcaagga

SEQ ID NO: 29962 - DNA, 20 bp, Artificial Sequence
  Synthetic oligonucleotide; AGG chr11 5391000 5391019 5391003 -
agatgagaggagtcaaggat

SEQ ID NO: 29963 - DNA, 20 bp, Artificial Sequence
  Synthetic oligonucleotide; AAG chr11 5390993 5391012 5390996 -
aggagtcaaggataggatca

SEQ ID NO: 29964 - DNA, 20 bp, Artificial Sequence
  Synthetic oligonucleotide; TAG chr11 5390980 5390999 5390983 -
aggatcaaagtctcttcttc

SEQ ID NO: 29965 - DNA, 20 bp, Artificial Sequence
  Synthetic oligonucleotide; GAG chr11 5390978 5390997 5390981 -
gatcaaagtctcttcttcta

SEQ ID NO: 29966 - DNA, 20 bp, Artificial Sequence
  Synthetic oligonucleotide; AGG chr11 5390977 5390996 5390980 -
atcaaagtctcttcttctag

SEQ ID NO: 29967 - DNA, 20 bp, Artificial Sequence
  Synthetic oligonucleotide; TGG chr11 5390970 5390989 5390973 -
tctcttcttctagaggaata

SEQ ID NO: 29968 - DNA, 20 bp, Artificial Sequence
  Synthetic oligonucleotide; CAG chr11 5390966 5390985 5390969 -
ttcttctagaggaatatggt

SEQ ID NO: 29969 - DNA, 20 bp, Artificial Sequence
  Synthetic oligonucleotide; AGG chr11 5390965 5390984 5390968 -
tcttctagaggaatatggtc

SEQ ID NO: 29970 - DNA, 20 bp, Artificial Sequence
  Synthetic oligonucleotide; GAG chr11 5390963 5390982 5390966 -
ttctagaggaatatggtcag

SEQ ID NO: 29971 - DNA, 20 bp, Artificial Sequence
  Synthetic oligonucleotide; GAG chr11 5390961 5390980 5390964 -
ctagaggaatatggtcagga

SEQ ID NO: 29972 - DNA, 20 bp, Artificial Sequence
  Synthetic oligonucleotide; GAG chr11 5390959 5390978 5390962 -
agaggaatatggtcaggaga

SEQ ID NO: 29973 - DNA, 20 bp, Artificial Sequence
  Synthetic oligonucleotide; TAG chr11 5390948 5390967 5390951 -
gtcaggagagagcacaacct

SEQ ID NO: 29974 - DNA, 20 bp, Artificial Sequence
  Synthetic oligonucleotide; TGG chr11 5390940 5390959 5390943 -
agagcacaaccttagaaatt

SEQ ID NO: 29975 - DNA, 20 bp, Artificial Sequence
  Synthetic oligonucleotide; GGG chr11 5390939 5390958 5390942 -
gagcacaaccttagaaattt

SEQ ID NO: 29976 - DNA, 20 bp, Artificial Sequence
  Synthetic oligonucleotide; GGG chr11 5390938 5390957 5390941 -
agcacaaccttagaaatttg

SEQ ID NO: 29977 - DNA, 20 bp, Artificial Sequence
  Synthetic oligonucleotide; GGG chr11 5390937 5390956 5390940 -
gcacaaccttagaaatttgg

SEQ ID NO: 29978 - DNA, 20 bp, Artificial Sequence
  Synthetic oligonucleotide; GGG chr11 5390936 5390955 5390939 -
cacaaccttagaaatttggg

SEQ ID NO: 29979 - DNA, 20 bp, Artificial Sequence
  Synthetic oligonucleotide; GGG chr11 5390935 5390954 5390938 -
acaaccttagaaatttgggg

SEQ ID NO: 29980 - DNA, 20 bp, Artificial Sequence
  Synthetic oligonucleotide; CAG chr11 5390920 5390939 5390923 -
tgggggggtgttgcttgaaa

SEQ ID NO: 29981 - DNA, 20 bp, Artificial Sequence
  Synthetic oligonucleotide; AGG chr11 5390919 5390938 5390922 -
gggggggtgttgcttgaaac

SEQ ID NO: 29982 - DNA, 20 bp, Artificial Sequence
  Synthetic oligonucleotide; GAG chr11 5390912 5390931 5390915 -
tgttgcttgaaacaggtgtt

SEQ ID NO: 29983 - DNA, 20 bp, Artificial Sequence
  Synthetic oligonucleotide; AGG chr11 5390911 5390930 5390914 -
gttgcttgaaacaggtgttg

SEQ ID NO: 29984 - DNA, 20 bp, Artificial Sequence
  Synthetic oligonucleotide; AAG chr11 5390908 5390927 5390911 -
gcttgaaacaggtgttgagg

SEQ ID NO: 29985 - DNA, 20 bp, Artificial Sequence
  Synthetic oligonucleotide; CAG chr11 5390901 5390920 5390904 -
acaggtgttgaggaagaatg

SEQ ID NO: 29986 - DNA, 20 bp, Artificial Sequence
  Synthetic oligonucleotide; AGG chr11 5390900 5390919 5390903 -
caggtgttgaggaagaatgc

SEQ ID NO: 29987 - DNA, 20 bp, Artificial Sequence
  Synthetic oligonucleotide; GAG chr11 5390898 5390917 5390901 -
ggtgttgaggaagaatgcag

SEQ ID NO: 29988 - DNA, 20 bp, Artificial Sequence
  Synthetic oligonucleotide; GAG chr11 5390891 5390910 5390894 -
aggaagaatgcaggagttct

SEQ ID NO: 29989 - DNA, 20 bp, Artificial Sequence
  Synthetic oligonucleotide; AGG chr11 5390890 5390909 5390893 -
ggaagaatgcaggagttctg

SEQ ID NO: 29990 - DNA, 20 bp, Artificial Sequence
  Synthetic oligonucleotide; TGG chr11 5390873 5390892 5390876 -
ctgaggtttctgatgtgact

SEQ ID NO: 29991 - DNA, 20 bp, Artificial Sequence
  Synthetic oligonucleotide; GGG chr11 5390872 5390891 5390875 -
tgaggtttctgatgtgactt

SEQ ID NO: 29992 - DNA, 20 bp, Artificial Sequence
  Synthetic oligonucleotide; GGG chr11 5390871 5390890 5390874 -
gaggtttctgatgtgacttg

SEQ ID NO: 29993 - DNA, 20 bp, Artificial Sequence
  Synthetic oligonucleotide; GGG chr11 5390870 5390889 5390873 -
aggtttctgatgtgacttgg

SEQ ID NO: 29994 - DNA, 20 bp, Artificial Sequence
  Synthetic oligonucleotide; AAG chr11 5390862 5390881 5390865 -
gatgtgacttgggggtctga

SEQ ID NO: 29995 - DNA, 20 bp, Artificial Sequence
  Synthetic oligonucleotide; CAG chr11 5390848 5390867 5390851 -
gtctgaaagttactgctgac

SEQ ID NO: 29996 - DNA, 20 bp, Artificial Sequence
  Synthetic oligonucleotide; AGG chr11 5390847 5390866 5390850 -
tctgaaagttactgctgacc

SEQ ID NO: 29997 - DNA, 20 bp, Artificial Sequence
  Synthetic oligonucleotide; TAG chr11 5390843 5390862 5390846 -
aaagttactgctgaccagga

SEQ ID NO: 29998 - DNA, 20 bp, Artificial Sequence
  Synthetic oligonucleotide; AAG chr11 5390837 5390856 5390840 -
actgctgaccaggatagaaa

SEQ ID NO: 29999 - DNA, 20 bp, Artificial Sequence
  Synthetic oligonucleotide; GAG chr11 5390832 5390851 5390835 -
tgaccaggatagaaaaagat

SEQ ID NO: 30000 - DNA, 20 bp, Artificial Sequence
  Synthetic oligonucleotide; AAG chr11 5390829 5390848 5390832 -
ccaggatagaaaaagatgag

SEQ ID NO: 30001 - DNA, 20 bp, Artificial Sequence
  Synthetic oligonucleotide; TGG chr11 5390821 5390840 5390824 -
gaaaaagatgagaagaaact

SEQ ID NO: 30002 - DNA, 20 bp, Artificial Sequence
  Synthetic oligonucleotide; CAG chr11 5390817 5390836 5390820 -
aagatgagaagaaacttggc

SEQ ID NO: 30003 - DNA, 20 bp, Artificial Sequence
  Synthetic oligonucleotide; AGG chr11 5390816 5390835 5390819 -
agatgagaagaaacttggcc

SEQ ID NO: 30004 - DNA, 20 bp, Artificial Sequence
  Synthetic oligonucleotide; TAG chr11 5390813 5390832 5390816 -
tgagaagaaacttggccagg

SEQ ID NO: 30005 - DNA, 20 bp, Artificial Sequence
  Synthetic oligonucleotide; AAG chr11 5390808 5390827 5390811 -
agaaacttggccaggtagat

SEQ ID NO: 30006 - DNA, 20 bp, Artificial Sequence
  Synthetic oligonucleotide; TGG chr11 5390804 5390823 5390807 -
acttggccaggtagataaga

SEQ ID NO: 30007 - DNA, 20 bp, Artificial Sequence
  Synthetic oligonucleotide; AAG chr11 5390801 5390820 5390804 -
tggccaggtagataagatgg

SEQ ID NO: 30008 - DNA, 20 bp, Artificial Sequence
  Synthetic oligonucleotide; CAG chr11 5390798 5390817 5390801 -
ccaggtagataagatggaag

SEQ ID NO: 30009 - DNA, 20 bp, Artificial Sequence
  Synthetic oligonucleotide; AAG chr11 5390791 5390810 5390794 -
gataagatggaagcagtccc

SEQ ID NO: 30010 - DNA, 20 bp, Artificial Sequence
  Synthetic oligonucleotide; AGG chr11 5390790 5390809 5390793 -
ataagatggaagcagtccca

SEQ ID NO: 30011 - DNA, 20 bp, Artificial Sequence
  Synthetic oligonucleotide; TGG chr11 5390782 5390801 5390785 -
gaagcagtcccaaggaacca

SEQ ID NO: 30012 - DNA, 20 bp, Artificial Sequence
  Synthetic oligonucleotide; AAG chr11 5390779 5390798 5390782 -
gcagtcccaaggaaccatgg

SEQ ID NO: 30013 - DNA, 20 bp, Artificial Sequence
  Synthetic oligonucleotide; AGG chr11 5390778 5390797 5390781 -
cagtcccaaggaaccatgga

SEQ ID NO: 30014 - DNA, 20 bp, Artificial Sequence
  Synthetic oligonucleotide; GAG chr11 5390776 5390795 5390779 -
gtcccaaggaaccatggaag

SEQ ID NO: 30015 - DNA, 20 bp, Artificial Sequence
  Synthetic oligonucleotide; AGG chr11 5390775 5390794 5390778 -
tcccaaggaaccatggaagg

SEQ ID NO: 30016 - DNA, 20 bp, Artificial Sequence
  Synthetic oligonucleotide; CGG chr11 5390764 5390783 5390767 -
catggaaggaggtgtatttc

SEQ ID NO: 30017 - DNA, 20 bp, Artificial Sequence
  Synthetic oligonucleotide; GAG chr11 5390762 5390781 5390765 -
tggaaggaggtgtatttccg

SEQ ID NO: 30018 - DNA, 20 bp, Artificial Sequence
  Synthetic oligonucleotide; AGG chr11 5390761 5390780 5390764 -
ggaaggaggtgtatttccgg

SEQ ID NO: 30019 - DNA, 20 bp, Artificial Sequence
  Synthetic oligonucleotide; GAG chr11 5390757 5390776 5390760 -
ggaggtgtatttccggaggt

SEQ ID NO: 30020 - DNA, 20 bp, Artificial Sequence
  Synthetic oligonucleotide; TAG chr11 5390753 5390772 5390756 -
gtgtatttccggaggtgagt

SEQ ID NO: 30021 - DNA, 20 bp, Artificial Sequence
  Synthetic oligonucleotide; GAG chr11 5390751 5390770 5390754 -
gtatttccggaggtgagtta

SEQ ID NO: 30022 - DNA, 20 bp, Artificial Sequence
  Synthetic oligonucleotide; TGG chr11 5390744 5390763 5390747 -
cggaggtgagttagagcaaa

SEQ ID NO: 30023 - DNA, 20 bp, Artificial Sequence
  Synthetic oligonucleotide; TGG chr11 5390733 5390752 5390736 -
tagagcaaatggcatttacc

SEQ ID NO: 30024 - DNA, 20 bp, Artificial Sequence
  Synthetic oligonucleotide; CAG chr11 5390723 5390742 5390726 -
ggcatttacctggtctctgc

SEQ ID NO: 30025 - DNA, 20 bp, Artificial Sequence
  Synthetic oligonucleotide; AGG chr11 5390722 5390741 5390725 -
gcatttacctggtctctgcc

SEQ ID NO: 30026 - DNA, 20 bp, Artificial Sequence
  Synthetic oligonucleotide; TGG chr11 5390711 5390730 5390714 -
gtctctgccaggctctcctc

SEQ ID NO: 30027 - DNA, 20 bp, Artificial Sequence
  Synthetic oligonucleotide; GGG chr11 5390710 5390729 5390713 -
tctctgccaggctctcctct

SEQ ID NO: 30028 - DNA, 20 bp, Artificial Sequence
  Synthetic oligonucleotide; TGG chr11 5390702 5390721 5390705 -
aggctctcctctgggtgctc

SEQ ID NO: 30029 - DNA, 20 bp, Artificial Sequence
  Synthetic oligonucleotide; TAG chr11 5390683 5390702 5390686 -
ctggtatttattgttctttt

SEQ ID NO: 30030 - DNA, 20 bp, Artificial Sequence
  Synthetic oligonucleotide; TAG chr11 5390672 5390691 5390675 -
tgttctttttagtttttatt

SEQ ID NO: 30031 - DNA, 20 bp, Artificial Sequence
  Synthetic oligonucleotide; TAG chr11 5390661 5390680 5390664 -
gtttttatttagtttcattt

SEQ ID NO: 30032 - DNA, 20 bp, Artificial Sequence
  Synthetic oligonucleotide; TAG chr11 5390655 5390674 5390658 -
atttagtttcattttagttt

SEQ ID NO: 30033 - DNA, 20 bp, Artificial Sequence
  Synthetic oligonucleotide; AAG chr11 5390628 5390647 5390631 -
attgatgatgaccttcaata

SEQ ID NO: 30034 - DNA, 20 bp, Artificial Sequence
  Synthetic oligonucleotide; TGG chr11 5390617 5390636 5390620 -
ccttcaataaagttgccttc

SEQ ID NO: 30035 - DNA, 20 bp, Artificial Sequence
  Synthetic oligonucleotide; TAG chr11 5390613 5390632 5390616 -
caataaagttgccttctgga

SEQ ID NO: 30036 - DNA, 20 bp, Artificial Sequence
  Synthetic oligonucleotide; CAG chr11 5390589 5390608 5390592 -
tttgatgctaccaaaaatgc

SEQ ID NO: 30037 - DNA, 20 bp, Artificial Sequence
  Synthetic oligonucleotide; CAG chr11 5390582 5390601 5390585 -
ctaccaaaaatgccagttct

SEQ ID NO: 30038 - DNA, 20 bp, Artificial Sequence
  Synthetic oligonucleotide; TAG chr11 5390576 5390595 5390579 -
aaaatgccagttctcagctg

SEQ ID NO: 30039 - DNA, 20 bp, Artificial Sequence
  Synthetic oligonucleotide; AGG chr11 5390575 5390594 5390578 -
aaatgccagttctcagctgt

SEQ ID NO: 30040 - DNA, 20 bp, Artificial Sequence
  Synthetic oligonucleotide; GAG chr11 5390573 5390592 5390576 -
atgccagttctcagctgtag

SEQ ID NO: 30041 - DNA, 20 bp, Artificial Sequence
  Synthetic oligonucleotide; AGG chr11 5390572 5390591 5390575 -
tgccagttctcagctgtagg

SEQ ID NO: 30042 - DNA, 20 bp, Artificial Sequence
  Synthetic oligonucleotide; GAG chr11 5390570 5390589 5390573 -
ccagttctcagctgtaggag

SEQ ID NO: 30043 - DNA, 20 bp, Artificial Sequence
  Synthetic oligonucleotide; AAG chr11 5390555 5390574 5390558 -
aggaggagccattaaaatct

SEQ ID NO: 30044 - DNA, 20 bp, Artificial Sequence
  Synthetic oligonucleotide; AAG chr11 5390551 5390570 5390554 -
ggagccattaaaatctaagc

SEQ ID NO: 30045 - DNA, 20 bp, Artificial Sequence
  Synthetic oligonucleotide; GAG chr11 5390549 5390568 5390552 -
agccattaaaatctaagcaa

SEQ ID NO: 30046 - DNA, 20 bp, Artificial Sequence
  Synthetic oligonucleotide; AAG chr11 5390546 5390565 5390549 -
cattaaaatctaagcaagag

SEQ ID NO: 30047 - DNA, 20 bp, Artificial Sequence
  Synthetic oligonucleotide; CAG chr11 5390541 5390560 5390544 -
aaatctaagcaagagaagtt

SEQ ID NO: 30048 - DNA, 20 bp, Artificial Sequence
  Synthetic oligonucleotide; AAG chr11 5390531 5390550 5390534 -
aagagaagttcagtttttta

SEQ ID NO: 30049 - DNA, 20 bp, Artificial Sequence
  Synthetic oligonucleotide; CAG chr11 5390519 5390538 5390522 -
gttttttaaagccacaactc

SEQ ID NO: 30050 - DNA, 20 bp, Artificial Sequence
  Synthetic oligonucleotide; TAG chr11 5390492 5390511 5390495 -
aaatttgcccatattttatt

SEQ ID NO: 30051 - DNA, 20 bp, Artificial Sequence
  Synthetic oligonucleotide; AGG chr11 5390491 5390510 5390494 -
aatttgcccatattttattt

SEQ ID NO: 30052 - DNA, 20 bp, Artificial Sequence
  Synthetic oligonucleotide; CAG chr11 5390487 5390506 5390490 -
tgcccatattttatttagga

SEQ ID NO: 30053 - DNA, 20 bp, Artificial Sequence
  Synthetic oligonucleotide; AGG chr11 5390486 5390505 5390489 -
gcccatattttatttaggac

SEQ ID NO: 30054 - DNA, 20 bp, Artificial Sequence
  Synthetic oligonucleotide; GGG chr11 5390485 5390504 5390488 -
cccatattttatttaggaca

SEQ ID NO: 30055 - DNA, 20 bp, Artificial Sequence
  Synthetic oligonucleotide; GGG chr11 5390484 5390503 5390487 -
ccatattttatttaggacag

SEQ ID NO: 30056 - DNA, 20 bp, Artificial Sequence
  Synthetic oligonucleotide; AAG chr11 5390469 5390488 5390472 -
gacaggggcaaaaaatcttt

SEQ ID NO: 30057 - DNA, 20 bp, Artificial Sequence
  Synthetic oligonucleotide; GAG chr11 5390467 5390486 5390470 -
caggggcaaaaaatctttaa

SEQ ID NO: 30058 - DNA, 20 bp, Artificial Sequence
  Synthetic oligonucleotide; CAG chr11 5390435 5390454 5390438 -
tactcaatactccaaatttt

SEQ ID NO: 30059 - DNA, 20 bp, Artificial Sequence
  Synthetic oligonucleotide; TGG chr11 5390425 5390444 5390428 -
tccaaattttcagtccaatt

SEQ ID NO: 30060 - DNA, 20 bp, Artificial Sequence
  Synthetic oligonucleotide; GGG chr11 5390424 5390443 5390427 -
ccaaattttcagtccaattt

SEQ ID NO: 30061 - DNA, 20 bp, Artificial Sequence
  Synthetic oligonucleotide; GGG chr11 5390423 5390442 5390426 -
caaattttcagtccaatttg

SEQ ID NO: 30062 - DNA, 20 bp, Artificial Sequence
  Synthetic oligonucleotide; TAG chr11 5390412 5390431 5390415 -
tccaatttggggccttctta

SEQ ID NO: 30063 - DNA, 20 bp, Artificial Sequence
  Synthetic oligonucleotide; AGG chr11 5390411 5390430 5390414 -
ccaatttggggccttcttat

SEQ ID NO: 30064 - DNA, 20 bp, Artificial Sequence
  Synthetic oligonucleotide; TAG chr11 5390404 5390423 5390407 -
ggggccttcttataggcctc

SEQ ID NO: 30065 - DNA, 20 bp, Artificial Sequence
  Synthetic oligonucleotide; AGG chr11 5390403 5390422 5390406 -
gggccttcttataggcctct

SEQ ID NO: 30066 - DNA, 20 bp, Artificial Sequence
  Synthetic oligonucleotide; GGG chr11 5390402 5390421 5390405 -
ggccttcttataggcctcta

SEQ ID NO: 30067 - DNA, 20 bp, Artificial Sequence
  Synthetic oligonucleotide; GGG chr11 5390401 5390420 5390404 -
gccttcttataggcctctag

SEQ ID NO: 30068 - DNA, 20 bp, Artificial Sequence
  Synthetic oligonucleotide; GGG chr11 5390400 5390419 5390403 -
ccttcttataggcctctagg

SEQ ID NO: 30069 - DNA, 20 bp, Artificial Sequence
  Synthetic oligonucleotide; GAG chr11 5390398 5390417 5390401 -
ttcttataggcctctagggg

SEQ ID NO: 30070 - DNA, 20 bp, Artificial Sequence
  Synthetic oligonucleotide; TAG chr11 5390392 5390411 5390395 -
taggcctctagggggagttt

SEQ ID NO: 30071 - DNA, 20 bp, Artificial Sequence
  Synthetic oligonucleotide; CAG chr11 5390386 5390405 5390389 -
tctagggggagttttagccc

SEQ ID NO: 30072 - DNA, 20 bp, Artificial Sequence
  Synthetic oligonucleotide; AGG chr11 5390385 5390404 5390388 -
ctagggggagttttagcccc

SEQ ID NO: 30073 - DNA, 20 bp, Artificial Sequence
  Synthetic oligonucleotide; TGG chr11 5390372 5390391 5390375 -
tagccccaggactcatttac

SEQ ID NO: 30074 - DNA, 20 bp, Artificial Sequence
  Synthetic oligonucleotide; AAG chr11 5390362 5390381 5390365 -
actcatttactggccttttt

SEQ ID NO: 30075 - DNA, 20 bp, Artificial Sequence
  Synthetic oligonucleotide; TAG chr11 5390356 5390375 5390359 -
ttactggcctttttaagacc

SEQ ID NO: 30076 - DNA, 20 bp, Artificial Sequence
  Synthetic oligonucleotide; AGG chr11 5390355 5390374 5390358 -
tactggcctttttaagacct

SEQ ID NO: 30077 - DNA, 20 bp, Artificial Sequence
  Synthetic oligonucleotide; TGG chr11 5390342 5390361 5390345 -
aagacctaggaacttgataa

SEQ ID NO: 30078 - DNA, 20 bp, Artificial Sequence
  Synthetic oligonucleotide; CGG chr11 5390337 5390356 5390340 -
ctaggaacttgataatggca

SEQ ID NO: 30079 - DNA, 20 bp, Artificial Sequence
  Synthetic oligonucleotide; TGG chr11 5390334 5390353 5390337 -
ggaacttgataatggcacgg

SEQ ID NO: 30080 - DNA, 20 bp, Artificial Sequence
  Synthetic oligonucleotide; TGG chr11 5390324 5390343 5390327 -
aatggcacggtggatctcct

SEQ ID NO: 30081 - DNA, 20 bp, Artificial Sequence
  Synthetic oligonucleotide; TGG chr11 5390302 5390321 5390305 -
gtcttaatgctgtatatgat

SEQ ID NO: 30082 - DNA, 20 bp, Artificial Sequence
  Synthetic oligonucleotide; GGG chr11 5390301 5390320 5390304 -
tcttaatgctgtatatgatt

SEQ ID NO: 30083 - DNA, 20 bp, Artificial Sequence
  Synthetic oligonucleotide; AAG chr11 5390296 5390315 5390299 -
atgctgtatatgattgggtt

SEQ ID NO: 30084 - DNA, 20 bp, Artificial Sequence
  Synthetic oligonucleotide; TGG chr11 5390291 5390310 5390294 -
gtatatgattgggttaagca

SEQ ID NO: 30085 - DNA, 20 bp, Artificial Sequence
  Synthetic oligonucleotide; GGG chr11 5390290 5390309 5390293 -
tatatgattgggttaagcat

SEQ ID NO: 30086 - DNA, 20 bp, Artificial Sequence
  Synthetic oligonucleotide; GAG chr11 5390288 5390307 5390291 -
tatgattgggttaagcatgg

SEQ ID NO: 30087 - DNA, 20 bp, Artificial Sequence
  Synthetic oligonucleotide; AGG chr11 5390287 5390306 5390290 -
atgattgggttaagcatggg

SEQ ID NO: 30088 - DNA, 20 bp, Artificial Sequence
  Synthetic oligonucleotide; AAG chr11 5390278 5390297 5390281 -
ttaagcatgggaggcacaaa

SEQ ID NO: 30089 - DNA, 20 bp, Artificial Sequence
  Synthetic oligonucleotide; AGG chr11 5390277 5390296 5390280 -
taagcatgggaggcacaaaa

SEQ ID NO: 30090 - DNA, 20 bp, Artificial Sequence
  Synthetic oligonucleotide; TAG chr11 5390274 5390293 5390277 -
gcatgggaggcacaaaaagg

SEQ ID NO: 30091 - DNA, 20 bp, Artificial Sequence
  Synthetic oligonucleotide; TGG chr11 5390267 5390286 5390270 -
aggcacaaaaaggtagacat

SEQ ID NO: 30092 - DNA, 20 bp, Artificial Sequence
  Synthetic oligonucleotide; AAG chr11 5390260 5390279 5390263 -
aaaaggtagacattggccat

SEQ ID NO: 30093 - DNA, 20 bp, Artificial Sequence
  Synthetic oligonucleotide; AAG chr11 5390257 5390276 5390260 -
aggtagacattggccataag

SEQ ID NO: 30094 - DNA, 20 bp, Artificial Sequence
  Synthetic oligonucleotide; TAG chr11 5390249 5390268 5390252 -
attggccataagaagatgaa

SEQ ID NO: 30095 - DNA, 20 bp, Artificial Sequence
  Synthetic oligonucleotide; CAG chr11 5390246 5390265 5390249 -
ggccataagaagatgaatag

SEQ ID NO: 30096 - DNA, 20 bp, Artificial Sequence
  Synthetic oligonucleotide; AGG chr11 5390245 5390264 5390248 -
gccataagaagatgaatagc

SEQ ID NO: 30097 - DNA, 20 bp, Artificial Sequence
  Synthetic oligonucleotide; TGG chr11 5390242 5390261 5390245 -
ataagaagatgaatagcagg

SEQ ID NO: 30098 - DNA, 20 bp, Artificial Sequence
  Synthetic oligonucleotide; GGG chr11 5390241 5390260 5390244 -
taagaagatgaatagcaggt

SEQ ID NO: 30099 - DNA, 20 bp, Artificial Sequence
  Synthetic oligonucleotide; GGG chr11 5390240 5390259 5390243 -
aagaagatgaatagcaggtg

SEQ ID NO: 30100 - DNA, 20 bp, Artificial Sequence
  Synthetic oligonucleotide; CGG chr11 5390223 5390242 5390226 -
gtggggcatgcttcccaaaa

SEQ ID NO: 30101 - DNA, 20 bp, Artificial Sequence
  Synthetic oligonucleotide; CAG chr11 5390215 5390234 5390218 -
tgcttcccaaaacggtgcac

SEQ ID NO: 30102 - DNA, 20 bp, Artificial Sequence
  Synthetic oligonucleotide; AGG chr11 5390214 5390233 5390217 -
gcttcccaaaacggtgcacc

SEQ ID NO: 30103 - DNA, 20 bp, Artificial Sequence
  Synthetic oligonucleotide; GGG chr11 5390213 5390232 5390216 -
cttcccaaaacggtgcacca

SEQ ID NO: 30104 - DNA, 20 bp, Artificial Sequence
  Synthetic oligonucleotide; CAG chr11 5390209 5390228 5390212 -
ccaaaacggtgcaccaggga

SEQ ID NO: 30105 - DNA, 20 bp, Artificial Sequence
  Synthetic oligonucleotide; TGG chr11 5390198 5390217 5390201 -
caccagggacagccccatca

SEQ ID NO: 30106 - DNA, 20 bp, Artificial Sequence
  Synthetic oligonucleotide; GGG chr11 5390197 5390216 5390200 -
accagggacagccccatcat

SEQ ID NO: 30107 - DNA, 20 bp, Artificial Sequence
  Synthetic oligonucleotide; AAG chr11 5390190 5390209 5390193 -
acagccccatcatgggcaca

SEQ ID NO: 30108 - DNA, 20 bp, Artificial Sequence
  Synthetic oligonucleotide; TAG chr11 5390182 5390201 5390185 -
atcatgggcacaaagaatac

SEQ ID NO: 30109 - DNA, 20 bp, Artificial Sequence
  Synthetic oligonucleotide; CAG chr11 5390177 5390196 5390180 -
gggcacaaagaatactagca

SEQ ID NO: 30110 - DNA, 20 bp, Artificial Sequence
  Synthetic oligonucleotide; CAG chr11 5390172 5390191 5390175 -
caaagaatactagcacagca

SEQ ID NO: 30111 - DNA, 20 bp, Artificial Sequence
  Synthetic oligonucleotide; GAG chr11 5390170 5390189 5390173 -
aagaatactagcacagcaca

SEQ ID NO: 30112 - DNA, 20 bp, Artificial Sequence
  Synthetic oligonucleotide; GAG chr11 5390168 5390187 5390171 -
gaatactagcacagcacaga

SEQ ID NO: 30113 - DNA, 20 bp, Artificial Sequence
  Synthetic oligonucleotide; AGG chr11 5390167 5390186 5390170 -
aatactagcacagcacagag

SEQ ID NO: 30114 - DNA, 20 bp, Artificial Sequence
  Synthetic oligonucleotide; GAG chr11 5390165 5390184 5390168 -
tactagcacagcacagagag

SEQ ID NO: 30115 - DNA, 20 bp, Artificial Sequence
  Synthetic oligonucleotide; CGG chr11 5390162 5390181 5390165 -
tagcacagcacagagaggag

SEQ ID NO: 30116 - DNA, 20 bp, Artificial Sequence
  Synthetic oligonucleotide; AAG chr11 5390148 5390167 5390151 -
gaggagcggtgcatgtctga

SEQ ID NO: 30117 - DNA, 20 bp, Artificial Sequence
  Synthetic oligonucleotide; AGG chr11 5390147 5390166 5390150 -
aggagcggtgcatgtctgaa

SEQ ID NO: 30118 - DNA, 20 bp, Artificial Sequence
  Synthetic oligonucleotide; CGG chr11 5390142 5390161 5390145 -
cggtgcatgtctgaaaggca

SEQ ID NO: 30119 - DNA, 20 bp, Artificial Sequence
  Synthetic oligonucleotide; TGG chr11 5390127 5390146 5390130 -
aggcacggcgctgctcctct

SEQ ID NO: 30120 - DNA, 20 bp, Artificial Sequence
  Synthetic oligonucleotide; GGG chr11 5390126 5390145 5390129 -
ggcacggcgctgctcctctt

SEQ ID NO: 30121 - DNA, 20 bp, Artificial Sequence
  Synthetic oligonucleotide; GAG chr11 5390124 5390143 5390127 -
cacggcgctgctcctcttgg

SEQ ID NO: 30122 - DNA, 20 bp, Artificial Sequence
  Synthetic oligonucleotide; AGG chr11 5390123 5390142 5390126 -
acggcgctgctcctcttggg

SEQ ID NO: 30123 - DNA, 20 bp, Artificial Sequence
  Synthetic oligonucleotide; CAG chr11 5390119 5390138 5390122 -
cgctgctcctcttgggaggc

SEQ ID NO: 30124 - DNA, 20 bp, Artificial Sequence
  Synthetic oligonucleotide; AGG chr11 5390118 5390137 5390121 -
gctgctcctcttgggaggcc

SEQ ID NO: 30125 - DNA, 20 bp, Artificial Sequence
  Synthetic oligonucleotide; CAG chr11 5390101 5390120 5390104 -
gccaggcctgctactgtgtg

SEQ ID NO: 30126 - DNA, 20 bp, Artificial Sequence
  Synthetic oligonucleotide; AGG chr11 5390100 5390119 5390103 -
ccaggcctgctactgtgtgc

SEQ ID NO: 30127 - DNA, 20 bp, Artificial Sequence
  Synthetic oligonucleotide; GAG chr11 5390095 5390114 5390098 -
cctgctactgtgtgcaggat

SEQ ID NO: 30128 - DNA, 20 bp, Artificial Sequence
  Synthetic oligonucleotide; TAG chr11 5390088 5390107 5390091 -
ctgtgtgcaggatgagtcca

SEQ ID NO: 30129 - DNA, 20 bp, Artificial Sequence
  Synthetic oligonucleotide; AGG chr11 5390087 5390106 5390090 -
tgtgtgcaggatgagtccat

SEQ ID NO: 30130 - DNA, 20 bp, Artificial Sequence
  Synthetic oligonucleotide; CAG chr11 5390083 5390102 5390086 -
tgcaggatgagtccatagga

SEQ ID NO: 30131 - DNA, 20 bp, Artificial Sequence
  Synthetic oligonucleotide; GAG chr11 5390074 5390093 5390077 -
agtccataggacagtgcgat

SEQ ID NO: 30132 - DNA, 20 bp, Artificial Sequence
  Synthetic oligonucleotide; CAG chr11 5390068 5390087 5390071 -
taggacagtgcgatgagcac

SEQ ID NO: 30133 - DNA, 20 bp, Artificial Sequence
  Synthetic oligonucleotide; AGG chr11 5390067 5390086 5390070 -
aggacagtgcgatgagcacc

SEQ ID NO: 30134 - DNA, 20 bp, Artificial Sequence
  Synthetic oligonucleotide; CAG chr11 5390062 5390081 5390065 -
agtgcgatgagcaccaggtc

SEQ ID NO: 30135 - DNA, 20 bp, Artificial Sequence
  Synthetic oligonucleotide; CAG chr11 5390054 5390073 5390057 -
gagcaccaggtccagcatca

SEQ ID NO: 30136 - DNA, 20 bp, Artificial Sequence
  Synthetic oligonucleotide; CAG chr11 5390035 5390054 5390038 -
acagtgaaaactaccaccat

SEQ ID NO: 30137 - DNA, 20 bp, Artificial Sequence
  Synthetic oligonucleotide; CAG chr11 5390026 5390045 5390029 -
actaccaccatcagtccata

SEQ ID NO: 30138 - DNA, 20 bp, Artificial Sequence
  Synthetic oligonucleotide; AAG chr11 5390016 5390035 5390019 -
tcagtccatacagattattg

SEQ ID NO: 30139 - DNA, 20 bp, Artificial Sequence
  Synthetic oligonucleotide; AGG chr11 5390015 5390034 5390018 -
cagtccatacagattattga

SEQ ID NO: 30140 - DNA, 20 bp, Artificial Sequence
  Synthetic oligonucleotide; CAG chr11 5390001 5390020 5390004 -
tattgaaggtgatatctgtg

SEQ ID NO: 30141 - DNA, 20 bp, Artificial Sequence
  Synthetic oligonucleotide; AGG chr11 5390000 5390019 5390003 -
attgaaggtgatatctgtgc

SEQ ID NO: 30142 - DNA, 20 bp, Artificial Sequence
  Synthetic oligonucleotide; CAG chr11 5389996 5390015 5389999 -
aaggtgatatctgtgcaggc

SEQ ID NO: 30143 - DNA, 20 bp, Artificial Sequence
  Synthetic oligonucleotide; TGG chr11 5389980 5389999 5389983 -
aggccagctgtatcacttcc

SEQ ID NO: 30144 - DNA, 20 bp, Artificial Sequence
  Synthetic oligonucleotide; CAG chr11 5389975 5389994 5389978 -
agctgtatcacttcctggtg

SEQ ID NO: 30145 - DNA, 20 bp, Artificial Sequence
  Synthetic oligonucleotide; AGG chr11 5389974 5389993 5389977 -
gctgtatcacttcctggtgc

SEQ ID NO: 30146 - DNA, 20 bp, Artificial Sequence
  Synthetic oligonucleotide; GAG chr11 5389965 5389984 5389968 -
cttcctggtgcaggcaaaat

SEQ ID NO: 30147 - DNA, 20 bp, Artificial Sequence
  Synthetic oligonucleotide; TGG chr11 5389962 5389981 5389965 -
cctggtgcaggcaaaatgag

SEQ ID NO: 30148 - DNA, 20 bp, Artificial Sequence
  Synthetic oligonucleotide; GGG chr11 5389961 5389980 5389964 -
ctggtgcaggcaaaatgagt

SEQ ID NO: 30149 - DNA, 20 bp, Artificial Sequence
  Synthetic oligonucleotide; GAG chr11 5389959 5389978 5389962 -
ggtgcaggcaaaatgagtgg

SEQ ID NO: 30150 - DNA, 20 bp, Artificial Sequence
  Synthetic oligonucleotide; GAG chr11 5389957 5389976 5389960 -
tgcaggcaaaatgagtggga

SEQ ID NO: 30151 - DNA, 20 bp, Artificial Sequence
  Synthetic oligonucleotide; AGG chr11 5389956 5389975 5389959 -
gcaggcaaaatgagtgggag

SEQ ID NO: 30152 - DNA, 20 bp, Artificial Sequence
  Synthetic oligonucleotide; CAG chr11 5389949 5389968 5389952 -
aaatgagtgggagaggacca

SEQ ID NO: 30153 - DNA, 20 bp, Artificial Sequence
  Synthetic oligonucleotide; CAG chr11 5389941 5389960 5389944 -
gggagaggaccacagatcca

SEQ ID NO: 30154 - DNA, 20 bp, Artificial Sequence
  Synthetic oligonucleotide; TAG chr11 5389938 5389957 5389941 -
agaggaccacagatccacag

SEQ ID NO: 30155 - DNA, 20 bp, Artificial Sequence
  Synthetic oligonucleotide; AGG chr11 5389937 5389956 5389940 -
gaggaccacagatccacagt

SEQ ID NO: 30156 - DNA, 20 bp, Artificial Sequence
  Synthetic oligonucleotide; GGG chr11 5389936 5389955 5389939 -
aggaccacagatccacagta

SEQ ID NO: 30157 - DNA, 20 bp, Artificial Sequence
  Synthetic oligonucleotide; AAG chr11 5389931 5389950 5389934 -
cacagatccacagtagggaa

SEQ ID NO: 30158 - DNA, 20 bp, Artificial Sequence
  Synthetic oligonucleotide; CAG chr11 5389924 5389943 5389927 -
ccacagtagggaaaagcctt

SEQ ID NO: 30159 - DNA, 20 bp, Artificial Sequence
  Synthetic oligonucleotide; AGG chr11 5389923 5389942 5389926 -
cacagtagggaaaagccttc

SEQ ID NO: 30160 - DNA, 20 bp, Artificial Sequence
  Synthetic oligonucleotide; GAG chr11 5389921 5389940 5389924 -
cagtagggaaaagccttcag

SEQ ID NO: 30161 - DNA, 20 bp, Artificial Sequence
  Synthetic oligonucleotide; AGG chr11 5389920 5389939 5389923 -
agtagggaaaagccttcagg

SEQ ID NO: 30162 - DNA, 20 bp, Artificial Sequence
  Synthetic oligonucleotide; GAG chr11 5389918 5389937 5389921 -
tagggaaaagccttcaggag

SEQ ID NO: 30163 - DNA, 20 bp, Artificial Sequence
  Synthetic oligonucleotide; AGG chr11 5389917 5389936 5389920 -
agggaaaagccttcaggagg

SEQ ID NO: 30164 - DNA, 20 bp, Artificial Sequence
  Synthetic oligonucleotide; TAG chr11 5389910 5389929 5389913 -
agccttcaggaggaggacaa

SEQ ID NO: 30165 - DNA, 20 bp, Artificial Sequence
  Synthetic oligonucleotide; AGG chr11 5389909 5389928 5389912 -
gccttcaggaggaggacaat

SEQ ID NO: 30166 - DNA, 20 bp, Artificial Sequence
  Synthetic oligonucleotide; GGG chr11 5389908 5389927 5389911 -
ccttcaggaggaggacaata

SEQ ID NO: 30167 - DNA, 20 bp, Artificial Sequence
  Synthetic oligonucleotide; TAG chr11 5389904 5389923 5389907 -
caggaggaggacaataggga

SEQ ID NO: 30168 - DNA, 20 bp, Artificial Sequence
  Synthetic oligonucleotide; TGG chr11 5389901 5389920 5389904 -
gaggaggacaatagggatag

SEQ ID NO: 30169 - DNA, 20 bp, Artificial Sequence
  Synthetic oligonucleotide; CAG chr11 5389895 5389914 5389898 -
gacaatagggatagtggcca

SEQ ID NO: 30170 - DNA, 20 bp, Artificial Sequence
  Synthetic oligonucleotide; AGG chr11 5389894 5389913 5389897 -
acaatagggatagtggccac

SEQ ID NO: 30171 - DNA, 20 bp, Artificial Sequence
  Synthetic oligonucleotide; CGG chr11 5389887 5389906 5389890 -
ggatagtggccacaggtccc

SEQ ID NO: 30172 - DNA, 20 bp, Artificial Sequence
  Synthetic oligonucleotide; AAG chr11 5389884 5389903 5389887 -
tagtggccacaggtccccgg

SEQ ID NO: 30173 - DNA, 20 bp, Artificial Sequence
  Synthetic oligonucleotide; TAG chr11 5389873 5389892 5389876 -
ggtccccggaagatgacaat

SEQ ID NO: 30174 - DNA, 20 bp, Artificial Sequence
  Synthetic oligonucleotide; AGG chr11 5389872 5389891 5389875 -
gtccccggaagatgacaatt

SEQ ID NO: 30175 - DNA, 20 bp, Artificial Sequence
  Synthetic oligonucleotide; TGG chr11 5389851 5389870 5389854 -
ggcctgctctgaccacttgc

SEQ ID NO: 30176 - DNA, 20 bp, Artificial Sequence
  Synthetic oligonucleotide; CAG chr11 5389847 5389866 5389850 -
tgctctgaccacttgctggc

SEQ ID NO: 30177 - DNA, 20 bp, Artificial Sequence
  Synthetic oligonucleotide; CAG chr11 5389825 5389844 5389828 -
gtgataatgaccgaatacct

SEQ ID NO: 30178 - DNA, 20 bp, Artificial Sequence
  Synthetic oligonucleotide; GAG chr11 5389823 5389842 5389826 -
gataatgaccgaatacctca

SEQ ID NO: 30179 - DNA, 20 bp, Artificial Sequence
  Synthetic oligonucleotide; AGG chr11 5389822 5389841 5389825 -
ataatgaccgaatacctcag

SEQ ID NO: 30180 - DNA, 20 bp, Artificial Sequence
  Synthetic oligonucleotide; GGG chr11 5389821 5389840 5389824 -
taatgaccgaatacctcaga

SEQ ID NO: 30181 - DNA, 20 bp, Artificial Sequence
  Synthetic oligonucleotide; TGG chr11 5389818 5389837 5389821 -
tgaccgaatacctcagaggg

SEQ ID NO: 30182 - DNA, 20 bp, Artificial Sequence
  Synthetic oligonucleotide; CAG chr11 5389815 5389834 5389818 -
ccgaatacctcagagggtgg

SEQ ID NO: 30183 - DNA, 20 bp, Artificial Sequence
  Synthetic oligonucleotide; TGG chr11 5389811 5389830 5389814 -
atacctcagagggtggcaga

SEQ ID NO: 30184 - DNA, 20 bp, Artificial Sequence
  Synthetic oligonucleotide; AAG chr11 5389804 5389823 5389807 -
agagggtggcagatggccac

SEQ ID NO: 30185 - DNA, 20 bp, Artificial Sequence
  Synthetic oligonucleotide; AGG chr11 5389803 5389822 5389806 -
gagggtggcagatggccaca

SEQ ID NO: 30186 - DNA, 20 bp, Artificial Sequence
  Synthetic oligonucleotide; CGG chr11 5389800 5389819 5389803 -
ggtggcagatggccacaagg

SEQ ID NO: 30187 - DNA, 20 bp, Artificial Sequence
  Synthetic oligonucleotide; AAG chr11 5389794 5389813 5389797 -
agatggccacaaggcggtca

SEQ ID NO: 30188 - DNA, 20 bp, Artificial Sequence
  Synthetic oligonucleotide; AGG chr11 5389793 5389812 5389796 -
gatggccacaaggcggtcaa

SEQ ID NO: 30189 - DNA, 20 bp, Artificial Sequence
  Synthetic oligonucleotide; GAG chr11 5389783 5389802 5389786 -
aggcggtcaaaggacatcat

SEQ ID NO: 30190 - DNA, 20 bp, Artificial Sequence
  Synthetic oligonucleotide; AGG chr11 5389782 5389801 5389785 -
ggcggtcaaaggacatcatg

SEQ ID NO: 30191 - DNA, 20 bp, Artificial Sequence
  Synthetic oligonucleotide; GAG chr11 5389780 5389799 5389783 -
cggtcaaaggacatcatgag

SEQ ID NO: 30192 - DNA, 20 bp, Artificial Sequence
  Synthetic oligonucleotide; GAG chr11 5389773 5389792 5389776 -
aggacatcatgaggagcact

SEQ ID NO: 30193 - DNA, 20 bp, Artificial Sequence
  Synthetic oligonucleotide; AGG chr11 5389772 5389791 5389775 -
ggacatcatgaggagcactg

SEQ ID NO: 30194 - DNA, 20 bp, Artificial Sequence
  Synthetic oligonucleotide; AAG chr11 5389761 5389780 5389764 -
ggagcactgaggactccatg

SEQ ID NO: 30195 - DNA, 20 bp, Artificial Sequence
  Synthetic oligonucleotide; AGG chr11 5389760 5389779 5389763 -
gagcactgaggactccatga

SEQ ID NO: 30196 - DNA, 20 bp, Artificial Sequence
  Synthetic oligonucleotide; AAG chr11 5389754 5389773 5389757 -
tgaggactccatgaaggaaa

SEQ ID NO: 30197 - DNA, 20 bp, Artificial Sequence
  Synthetic oligonucleotide; GAG chr11 5389752 5389771 5389755 -
aggactccatgaaggaaaaa

SEQ ID NO: 30198 - DNA, 20 bp, Artificial Sequence
  Synthetic oligonucleotide; TGG chr11 5389749 5389768 5389752 -
actccatgaaggaaaaagag

SEQ ID NO: 30199 - DNA, 20 bp, Artificial Sequence
  Synthetic oligonucleotide; CAG chr11 5389743 5389762 5389746 -
tgaaggaaaaagagtggatg

SEQ ID NO: 30200 - DNA, 20 bp, Artificial Sequence
  Synthetic oligonucleotide; TGG chr11 5389734 5389753 5389737 -
aagagtggatgcagaacatc

SEQ ID NO: 30201 - DNA, 20 bp, Artificial Sequence
  Synthetic oligonucleotide; AAG chr11 5389716 5389735 5389719 -
tctggatttgacacgctcca

SEQ ID NO: 30202 - DNA, 20 bp, Artificial Sequence
  Synthetic oligonucleotide; TAG chr11 5389713 5389732 5389716 -
ggatttgacacgctccaaag

SEQ ID NO: 30203 - DNA, 20 bp, Artificial Sequence
  Synthetic oligonucleotide; TGG chr11 5389704 5389723 5389707 -
acgctccaaagtagatacta

SEQ ID NO: 30204 - DNA, 20 bp, Artificial Sequence
  Synthetic oligonucleotide; GGG chr11 5389703 5389722 5389706 -
cgctccaaagtagatactat

SEQ ID NO: 30205 - DNA, 20 bp, Artificial Sequence
  Synthetic oligonucleotide; GAG chr11 5389701 5389720 5389704 -
ctccaaagtagatactatgg

SEQ ID NO: 30206 - DNA, 20 bp, Artificial Sequence
  Synthetic oligonucleotide; CAG chr11 5389692 5389711 5389695 -
agatactatgggagttaaac

SEQ ID NO: 30207 - DNA, 20 bp, Artificial Sequence
  Synthetic oligonucleotide; AAG chr11 5389689 5389708 5389692 -
tactatgggagttaaaccag

SEQ ID NO: 30208 - DNA, 20 bp, Artificial Sequence
  Synthetic oligonucleotide; TAG chr11 5389679 5389698 5389682 -
gttaaaccagaagatcccca

SEQ ID NO: 30209 - DNA, 20 bp, Artificial Sequence
  Synthetic oligonucleotide; TGG chr11 5389676 5389695 5389679 -
aaaccagaagatccccatag

SEQ ID NO: 30210 - DNA, 20 bp, Artificial Sequence
  Synthetic oligonucleotide; TGG chr11 5389673 5389692 5389676 -
ccagaagatccccatagtgg

SEQ ID NO: 30211 - DNA, 20 bp, Artificial Sequence
  Synthetic oligonucleotide; GGG chr11 5389672 5389691 5389675 -
cagaagatccccatagtggt

SEQ ID NO: 30212 - DNA, 20 bp, Artificial Sequence
  Synthetic oligonucleotide; TGG chr11 5389664 5389683 5389667 -
ccccatagtggtgggcaacg

SEQ ID NO: 30213 - DNA, 20 bp, Artificial Sequence
  Synthetic oligonucleotide; CAG chr11 5389654 5389673 5389657 -
gtgggcaacgtggacacaca

SEQ ID NO: 30214 - DNA, 20 bp, Artificial Sequence
  Synthetic oligonucleotide; CAG chr11 5389648 5389667 5389651 -
aacgtggacacacacagccc

SEQ ID NO: 30215 - DNA, 20 bp, Artificial Sequence
  Synthetic oligonucleotide; AGG chr11 5389647 5389666 5389650 -
acgtggacacacacagcccc

SEQ ID NO: 30216 - DNA, 20 bp, Artificial Sequence
  Synthetic oligonucleotide; CAG chr11 5389643 5389662 5389646 -
ggacacacacagccccaggt

SEQ ID NO: 30217 - DNA, 20 bp, Artificial Sequence
  Synthetic oligonucleotide; GAG chr11 5389639 5389658 5389642 -
acacacagccccaggtcagt

SEQ ID NO: 30218 - DNA, 20 bp, Artificial Sequence
  Synthetic oligonucleotide; AGG chr11 5389638 5389657 5389641 -
cacacagccccaggtcagtg

SEQ ID NO: 30219 - DNA, 20 bp, Artificial Sequence
  Synthetic oligonucleotide; GGG chr11 5389637 5389656 5389640 -
acacagccccaggtcagtga

SEQ ID NO: 30220 - DNA, 20 bp, Artificial Sequence
  Synthetic oligonucleotide; CAG chr11 5389633 5389652 5389636 -
agccccaggtcagtgagggc

SEQ ID NO: 30221 - DNA, 20 bp, Artificial Sequence
  Synthetic oligonucleotide; AAG chr11 5389629 5389648 5389632 -
ccaggtcagtgagggccagc

SEQ ID NO: 30222 - DNA, 20 bp, Artificial Sequence
  Synthetic oligonucleotide; AGG chr11 5389628 5389647 5389631 -
caggtcagtgagggccagca

SEQ ID NO: 30223 - DNA, 20 bp, Artificial Sequence
  Synthetic oligonucleotide; TAG chr11 5389624 5389643 5389627 -
tcagtgagggccagcaagga

SEQ ID NO: 30224 - DNA, 20 bp, Artificial Sequence
  Synthetic oligonucleotide; TAG chr11 5389621 5389640 5389624 -
gtgagggccagcaaggatag

SEQ ID NO: 30225 - DNA, 20 bp, Artificial Sequence
  Synthetic oligonucleotide; TAG chr11 5389617 5389636 5389620 -
gggccagcaaggatagtaga

SEQ ID NO: 30226 - DNA, 20 bp, Artificial Sequence
  Synthetic oligonucleotide; TGG chr11 5389610 5389629 5389613 -
caaggatagtagatagtaca

SEQ ID NO: 30227 - DNA, 20 bp, Artificial Sequence
  Synthetic oligonucleotide; GGG chr11 5389609 5389628 5389612 -
aaggatagtagatagtacat

SEQ ID NO: 30228 - DNA, 20 bp, Artificial Sequence
  Synthetic oligonucleotide; CAG chr11 5389600 5389619 5389603 -
agatagtacatgggtgtgtg

SEQ ID NO: 30229 - DNA, 20 bp, Artificial Sequence
  Synthetic oligonucleotide; GAG chr11 5389595 5389614 5389598 -
gtacatgggtgtgtgcagac

SEQ ID NO: 30230 - DNA, 20 bp, Artificial Sequence
  Synthetic oligonucleotide; AGG chr11 5389594 5389613 5389597 -
tacatgggtgtgtgcagacg

SEQ ID NO: 30231 - DNA, 20 bp, Artificial Sequence
  Synthetic oligonucleotide; GGG chr11 5389593 5389612 5389596 -
acatgggtgtgtgcagacga

SEQ ID NO: 30232 - DNA, 20 bp, Artificial Sequence
  Synthetic oligonucleotide; TGG chr11 5389589 5389608 5389592 -
gggtgtgtgcagacgagggt

SEQ ID NO: 30233 - DNA, 20 bp, Artificial Sequence
  Synthetic oligonucleotide; CAG chr11 5389573 5389592 5389576 -
gggttggtcttaataatgat

SEQ ID NO: 30234 - DNA, 20 bp, Artificial Sequence
  Synthetic oligonucleotide; GAG chr11 5389554 5389573 5389557 -
tcagaatgaaacaattgcct

SEQ ID NO: 30235 - DNA, 20 bp, Artificial Sequence
  Synthetic oligonucleotide; TGG chr11 5389550 5389569 5389553 -
aatgaaacaattgcctgaga

SEQ ID NO: 30236 - DNA, 20 bp, Artificial Sequence
  Synthetic oligonucleotide; AAG chr11 5389533 5389552 5389536 -
agatggcaaccatgtacata

SEQ ID NO: 30237 - DNA, 20 bp, Artificial Sequence
  Synthetic oligonucleotide; AAG chr11 5389527 5389546 5389530 -
caaccatgtacataaagaaa

SEQ ID NO: 30238 - DNA, 20 bp, Artificial Sequence
  Synthetic oligonucleotide; AGG chr11 5389526 5389545 5389529 -
aaccatgtacataaagaaaa

SEQ ID NO: 30239 - DNA, 20 bp, Artificial Sequence
  Synthetic oligonucleotide; GGG chr11 5389525 5389544 5389528 -
accatgtacataaagaaaaa

SEQ ID NO: 30240 - DNA, 20 bp, Artificial Sequence
  Synthetic oligonucleotide; GGG chr11 5389524 5389543 5389527 -
ccatgtacataaagaaaaag

SEQ ID NO: 30241 - DNA, 20 bp, Artificial Sequence
  Synthetic oligonucleotide; CAG chr11 5389512 5389531 5389515 -
agaaaaaggggatgaaaatc

SEQ ID NO: 30242 - DNA, 20 bp, Artificial Sequence
  Synthetic oligonucleotide; CAG chr11 5389490 5389509 5389493 -
gtgtttgatgccttccaatc

SEQ ID NO: 30243 - DNA, 20 bp, Artificial Sequence
  Synthetic oligonucleotide; AGG chr11 5389489 5389508 5389492 -
tgtttgatgccttccaatcc

SEQ ID NO: 30244 - DNA, 20 bp, Artificial Sequence
  Synthetic oligonucleotide; AAG chr11 5389485 5389504 5389488 -
tgatgccttccaatccagga

SEQ ID NO: 30245 - DNA, 20 bp, Artificial Sequence
  Synthetic oligonucleotide; TGG chr11 5389481 5389500 5389484 -
gccttccaatccaggaaagc

SEQ ID NO: 30246 - DNA, 20 bp, Artificial Sequence
  Synthetic oligonucleotide; GAG chr11 5389477 5389496 5389480 -
tccaatccaggaaagctggt

SEQ ID NO: 30247 - DNA, 20 bp, Artificial Sequence
  Synthetic oligonucleotide; TAG chr11 5389473 5389492 5389476 -
atccaggaaagctggtgaga

SEQ ID NO: 30248 - DNA, 20 bp, Artificial Sequence
  Synthetic oligonucleotide; TGG chr11 5389466 5389485 5389469 -
aaagctggtgagatagaata

SEQ ID NO: 30249 - DNA, 20 bp, Artificial Sequence
  Synthetic oligonucleotide; GGG chr11 5389465 5389484 5389468 -
aagctggtgagatagaatat

SEQ ID NO: 30250 - DNA, 20 bp, Artificial Sequence
  Synthetic oligonucleotide; GGG chr11 5389464 5389483 5389467 -
agctggtgagatagaatatg

SEQ ID NO: 30251 - DNA, 20 bp, Artificial Sequence
  Synthetic oligonucleotide; GAG chr11 5389454 5389473 5389457 -
atagaatatggggctaaact

SEQ ID NO: 30252 - DNA, 20 bp, Artificial Sequence
  Synthetic oligonucleotide; TGG chr11 5389445 5389464 5389448 -
ggggctaaactgagtaatgt

SEQ ID NO: 30253 - DNA, 20 bp, Artificial Sequence
  Synthetic oligonucleotide; TAG chr11 5389441 5389460 5389444 -
ctaaactgagtaatgttgga

SEQ ID NO: 30254 - DNA, 20 bp, Artificial Sequence
  Synthetic oligonucleotide; CAG chr11 5389438 5389457 5389441 -
aactgagtaatgttggatag

SEQ ID NO: 30255 - DNA, 20 bp, Artificial Sequence
  Synthetic oligonucleotide; GAG chr11 5389427 5389446 5389430 -
gttggatagcagcatgaatt

SEQ ID NO: 30256 - DNA, 20 bp, Artificial Sequence
  Synthetic oligonucleotide; AGG chr11 5389426 5389445 5389429 -
ttggatagcagcatgaattg

SEQ ID NO: 30257 - DNA, 20 bp, Artificial Sequence
  Synthetic oligonucleotide; GAG chr11 5389420 5389439 5389423 -
agcagcatgaattgaggact

SEQ ID NO: 30258 - DNA, 20 bp, Artificial Sequence
  Synthetic oligonucleotide; TGG chr11 5389410 5389429 5389413 -
attgaggactgagcgaatat

SEQ ID NO: 30259 - DNA, 20 bp, Artificial Sequence
  Synthetic oligonucleotide; CGG chr11 5389395 5389414 5389398 -
aatattggactgacattcct

SEQ ID NO: 30260 - DNA, 20 bp, Artificial Sequence
  Synthetic oligonucleotide; GGG chr11 5389394 5389413 5389397 -
atattggactgacattcctc

SEQ ID NO: 30261 - DNA, 20 bp, Artificial Sequence
  Synthetic oligonucleotide; GGG chr11 5389393 5389412 5389396 -
tattggactgacattcctcg

SEQ ID NO: 30262 - DNA, 20 bp, Artificial Sequence
  Synthetic oligonucleotide; GAG chr11 5389387 5389406 5389390 -
actgacattcctcggggatt

SEQ ID NO: 30263 - DNA, 20 bp, Artificial Sequence
  Synthetic oligonucleotide; TGG chr11 5389373 5389392 5389376 -
gggattgagctgaaaataaa

SEQ ID NO: 30264 - DNA, 20 bp, Artificial Sequence
  Synthetic oligonucleotide; TGG chr11 5389363 5389382 5389366 -
tgaaaataaatggatatttc

SEQ ID NO: 30265 - DNA, 20 bp, Artificial Sequence
  Synthetic oligonucleotide; CAG chr11 5389348 5389367 5389351 -
atttctggttattaattctt

SEQ ID NO: 30266 - DNA, 20 bp, Artificial Sequence
  Synthetic oligonucleotide; AAG chr11 5389321 5389340 5389324 -
actaacattcacaacatcac

SEQ ID NO: 30267 - DNA, 20 bp, Artificial Sequence
  Synthetic oligonucleotide; CAG chr11 5389318 5389337 5389321 -
aacattcacaacatcacaag

SEQ ID NO: 30268 - DNA, 20 bp, Artificial Sequence
  Synthetic oligonucleotide; TGG chr11 5389310 5389329 5389313 -
caacatcacaagcagtacca

SEQ ID NO: 30269 - DNA, 20 bp, Artificial Sequence
  Synthetic oligonucleotide; TAG chr11 5389294 5389313 5389297 -
accatggtcatcatcacctt

SEQ ID NO: 30270 - DNA, 20 bp, Artificial Sequence
  Synthetic oligonucleotide; CAG chr11 5389215 5389234 5389218 -
tttgataacctcgccctcac

SEQ ID NO: 30271 - DNA, 20 bp, Artificial Sequence
  Synthetic oligonucleotide; CAG chr11 5389188 5389207 5389191 -
cctctgtatttcaattattt

SEQ ID NO: 30272 - DNA, 20 bp, Artificial Sequence
  Synthetic oligonucleotide; TGG chr11 5389166 5389185 5389169 -
gttcctctctgcctctttgc

SEQ ID NO: 30273 - DNA, 20 bp, Artificial Sequence
  Synthetic oligonucleotide; AAG chr11 5389140 5389159 5389143 -
gcctttattgctcaaccctt

SEQ ID NO: 30274 - DNA, 20 bp, Artificial Sequence
  Synthetic oligonucleotide; TAG chr11 5389135 5389154 5389138 -
tattgctcaacccttaagta

SEQ ID NO: 30275 - DNA, 20 bp, Artificial Sequence
  Synthetic oligonucleotide; TGG chr11 5389119 5389138 5389122 -
agtatagttcttcccatcct

SEQ ID NO: 30276 - DNA, 20 bp, Artificial Sequence
  Synthetic oligonucleotide; TGG chr11 5389108 5389127 5389111 -
tcccatccttggcaatttcc

SEQ ID NO: 30277 - DNA, 20 bp, Artificial Sequence
  Synthetic oligonucleotide; CAG chr11 5389018 5389037 5389021 -
aaataacaaatatataattc

SEQ ID NO: 30278 - DNA, 20 bp, Artificial Sequence
  Synthetic oligonucleotide; CAG chr11 5388989 5389008 5388992 -
tctttctctcttttgatttc

SEQ ID NO: 30279 - DNA, 20 bp, Artificial Sequence
  Synthetic oligonucleotide; TAG chr11 5388982 5389001 5388985 -
ctcttttgatttccagactc

SEQ ID NO: 30280 - DNA, 20 bp, Artificial Sequence
  Synthetic oligonucleotide; CAG chr11 5388955 5388974 5388958 -
atctgtacttttcattatct

SEQ ID NO: 30281 - DNA, 20 bp, Artificial Sequence
  Synthetic oligonucleotide; TGG chr11 5388952 5388971 5388955 -
tgtacttttcattatctcag

SEQ ID NO: 30282 - DNA, 20 bp, Artificial Sequence
  Synthetic oligonucleotide; AAG chr11 5388946 5388965 5388949 -
tttcattatctcagtggctc

SEQ ID NO: 30283 - DNA, 20 bp, Artificial Sequence
  Synthetic oligonucleotide; TAG chr11 5388923 5388942 5388926 -
tcaaatgtcatgttttatgt

SEQ ID NO: 30284 - DNA, 20 bp, Artificial Sequence
  Synthetic oligonucleotide; TAG chr11 5388896 5388915 5388899 -
ctccatatcacatctctcca

SEQ ID NO: 30285 - DNA, 20 bp, Artificial Sequence
  Synthetic oligonucleotide; AAG chr11 5388873 5388892 5388876 -
tatctaatcaaccaatcacc

SEQ ID NO: 30286 - DNA, 20 bp, Artificial Sequence
  Synthetic oligonucleotide; TAG chr11 5388867 5388886 5388870 -
atcaaccaatcaccaagtcc

SEQ ID NO: 30287 - DNA, 20 bp, Artificial Sequence
  Synthetic oligonucleotide; AGG chr11 5388866 5388885 5388869 -
tcaaccaatcaccaagtcct

SEQ ID NO: 30288 - DNA, 20 bp, Artificial Sequence
  Synthetic oligonucleotide; GGG chr11 5388865 5388884 5388868 -
caaccaatcaccaagtccta

SEQ ID NO: 30289 - DNA, 20 bp, Artificial Sequence
  Synthetic oligonucleotide; AAG chr11 5388841 5388860 5388844 -
ttctgtttactgaatacctc

SEQ ID NO: 30290 - DNA, 20 bp, Artificial Sequence
  Synthetic oligonucleotide; CAG chr11 5388797 5388816 5388800 -
tcattgatgctattctaatt

SEQ ID NO: 30291 - DNA, 20 bp, Artificial Sequence
  Synthetic oligonucleotide; CAG chr11 5388784 5388803 5388787 -
tctaattcagatcactcttt

SEQ ID NO: 30292 - DNA, 20 bp, Artificial Sequence
  Synthetic oligonucleotide; AGG chr11 5388783 5388802 5388786 -
ctaattcagatcactctttc

SEQ ID NO: 30293 - DNA, 20 bp, Artificial Sequence
  Synthetic oligonucleotide; CAG chr11 5388773 5388792 5388776 -
tcactctttcaggactattc

SEQ ID NO: 30294 - DNA, 20 bp, Artificial Sequence
  Synthetic oligonucleotide; CAG chr11 5388744 5388763 5388747 -
atcttttgtactactgtatt

SEQ ID NO: 30295 - DNA, 20 bp, Artificial Sequence
  Synthetic oligonucleotide; TAG chr11 5388729 5388748 5388732 -
gtattcagttgactactata

SEQ ID NO: 30296 - DNA, 20 bp, Artificial Sequence
  Synthetic oligonucleotide; AAG chr11 5388725 5388744 5388728 -
tcagttgactactatatagc

SEQ ID NO: 30297 - DNA, 20 bp, Artificial Sequence
  Synthetic oligonucleotide; GAG chr11 5388723 5388742 5388726 -
agttgactactatatagcaa

SEQ ID NO: 30298 - DNA, 20 bp, Artificial Sequence
  Synthetic oligonucleotide; GAG chr11 5388721 5388740 5388724 -
ttgactactatatagcaaga

SEQ ID NO: 30299 - DNA, 20 bp, Artificial Sequence
  Synthetic oligonucleotide; AAG chr11 5388704 5388723 5388707 -
agagagacgtatacataaac

SEQ ID NO: 30300 - DNA, 20 bp, Artificial Sequence
  Synthetic oligonucleotide; AAG chr11 5388692 5388711 5388695 -
acataaacaagtttttaatg

SEQ ID NO: 30301 - DNA, 20 bp, Artificial Sequence
  Synthetic oligonucleotide; AAG chr11 5388684 5388703 5388687 -
aagtttttaatgaagtaaaa

SEQ ID NO: 30302 - DNA, 20 bp, Artificial Sequence
  Synthetic oligonucleotide; AGG chr11 5388683 5388702 5388686 -
agtttttaatgaagtaaaaa

SEQ ID NO: 30303 - DNA, 20 bp, Artificial Sequence
  Synthetic oligonucleotide; AAG chr11 5388665 5388684 5388668 -
aaaggtttaaaatgacattc

SEQ ID NO: 30304 - DNA, 20 bp, Artificial Sequence
  Synthetic oligonucleotide; CGG chr11 5388594 5388613 5388597 -
taatttcctctgtatattca

SEQ ID NO: 30305 - DNA, 20 bp, Artificial Sequence
  Synthetic oligonucleotide; CAG chr11 5388566 5388585 5388569 -
atgacactaaacaattcttc

SEQ ID NO: 30306 - DNA, 20 bp, Artificial Sequence
  Synthetic oligonucleotide; TAG chr11 5388557 5388576 5388560 -
aacaattcttccagtttatc

SEQ ID NO: 30307 - DNA, 20 bp, Artificial Sequence
  Synthetic oligonucleotide; TAG chr11 5388542 5388561 5388545 -
ttatctagtatgcttgctca

SEQ ID NO: 30308 - DNA, 20 bp, Artificial Sequence
  Synthetic oligonucleotide; AGG chr11 5388541 5388560 5388544 -
tatctagtatgcttgctcat

SEQ ID NO: 30309 - DNA, 20 bp, Artificial Sequence
  Synthetic oligonucleotide; TGG chr11 5388513 5388532 5388516 -
atttgtattttcattcttcc

SEQ ID NO: 30310 - DNA, 20 bp, Artificial Sequence
  Synthetic oligonucleotide; TAG chr11 5388487 5388506 5388490 -
aaaaacattttttcctgaaa

SEQ ID NO: 30311 - DNA, 20 bp, Artificial Sequence
  Synthetic oligonucleotide; TAG chr11 5388465 5388484 5388468 -
gctttcccttaatctttgtc

SEQ ID NO: 30312 - DNA, 20 bp, Artificial Sequence
  Synthetic oligonucleotide; TAG chr11 5388436 5388455 5388439 -
tctactaatataacccacct

SEQ ID NO: 30313 - DNA, 20 bp, Artificial Sequence
  Synthetic oligonucleotide; TAG chr11 5388431 5388450 5388434 -
taatataacccaccttagct

SEQ ID NO: 30314 - DNA, 20 bp, Artificial Sequence
  Synthetic oligonucleotide; CAG chr11 5388415 5388434 5388418 -
agcttagatatgatgtcctt

SEQ ID NO: 30315 - DNA, 20 bp, Artificial Sequence
  Synthetic oligonucleotide; AAG chr11 5388412 5388431 5388415 -
ttagatatgatgtccttcag

SEQ ID NO: 30316 - DNA, 20 bp, Artificial Sequence
  Synthetic oligonucleotide; AGG chr11 5388411 5388430 5388414 -
tagatatgatgtccttcaga

SEQ ID NO: 30317 - DNA, 20 bp, Artificial Sequence
  Synthetic oligonucleotide; AAG chr11 5388392 5388411 5388395 -
aaggccttcttaaattcccc

SEQ ID NO: 30318 - DNA, 20 bp, Artificial Sequence
  Synthetic oligonucleotide; TAG chr11 5388387 5388406 5388390 -
cttcttaaattccccaagtt

SEQ ID NO: 30319 - DNA, 20 bp, Artificial Sequence
  Synthetic oligonucleotide; TAG chr11 5388356 5388375 5388359 -
ccctctcctatgtgttcctg

SEQ ID NO: 30320 - DNA, 20 bp, Artificial Sequence
  Synthetic oligonucleotide; CAG chr11 5388318 5388337 5388321 -
ttaccatgatattttccctg

SEQ ID NO: 30321 - DNA, 20 bp, Artificial Sequence
  Synthetic oligonucleotide; TGG chr11 5388273 5388292 5388276 -
tctataatgtgaattccttg

SEQ ID NO: 30322 - DNA, 20 bp, Artificial Sequence
  Synthetic oligonucleotide; TAG chr11 5388233 5388252 5388236 -
ctcttttttaattttaatat

SEQ ID NO: 30323 - DNA, 20 bp, Artificial Sequence
  Synthetic oligonucleotide; TAG chr11 5388227 5388246 5388230 -
tttaattttaatattagctc

SEQ ID NO: 30324 - DNA, 20 bp, Artificial Sequence
  Synthetic oligonucleotide; AGG chr11 5388226 5388245 5388229 -
ttaattttaatattagctct

SEQ ID NO: 30325 - DNA, 20 bp, Artificial Sequence
  Synthetic oligonucleotide; GGG chr11 5388225 5388244 5388228 -
taattttaatattagctcta

SEQ ID NO: 30326 - DNA, 20 bp, Artificial Sequence
  Synthetic oligonucleotide; TAG chr11 5388211 5388230 5388214 -
gctctagggattgacttttt

SEQ ID NO: 30327 - DNA, 20 bp, Artificial Sequence
  Synthetic oligonucleotide; TGG chr11 5388196 5388215 5388199 -
ttttttagccaccatatcat

SEQ ID NO: 30328 - DNA, 20 bp, Artificial Sequence
  Synthetic oligonucleotide; TGG chr11 5388052 5388071 5388055 -
catattgaaattgtattaca

SEQ ID NO: 30329 - DNA, 20 bp, Artificial Sequence
  Synthetic oligonucleotide; CAG chr11 5388049 5388068 5388052 -
attgaaattgtattacatgg

SEQ ID NO: 30330 - DNA, 20 bp, Artificial Sequence
  Synthetic oligonucleotide; TAG chr11 5388034 5388053 5388037 -
catggcagacataattctat

SEQ ID NO: 30331 - DNA, 20 bp, Artificial Sequence
  Synthetic oligonucleotide; AGG chr11 5388033 5388052 5388036 -
atggcagacataattctatt

SEQ ID NO: 30332 - DNA, 20 bp, Artificial Sequence
  Synthetic oligonucleotide; TGG chr11 5388029 5388048 5388032 -
cagacataattctattaggt

SEQ ID NO: 30333 - DNA, 20 bp, Artificial Sequence
  Synthetic oligonucleotide; AAG chr11 5388021 5388040 5388024 -
attctattaggttggtgcaa

SEQ ID NO: 30334 - DNA, 20 bp, Artificial Sequence
  Synthetic oligonucleotide; TGG chr11 5388012 5388031 5388015 -
ggttggtgcaaaagtaattg

SEQ ID NO: 30335 - DNA, 20 bp, Artificial Sequence
  Synthetic oligonucleotide; TGG chr11 5387990 5388009 5387993 -
gtttttaccattactttcaa

SEQ ID NO: 30336 - DNA, 20 bp, Artificial Sequence
  Synthetic oligonucleotide; AAG chr11 5387986 5388005 5387989 -
ttaccattactttcaatggc

SEQ ID NO: 30337 - DNA, 20 bp, Artificial Sequence
  Synthetic oligonucleotide; TAG chr11 5387962 5387981 5387965 -
actgcaattacttttacacc

SEQ ID NO: 30338 - DNA, 20 bp, Artificial Sequence
  Synthetic oligonucleotide; AGG chr11 5387961 5387980 5387964 -
ctgcaattacttttacacct

SEQ ID NO: 30339 - DNA, 20 bp, Artificial Sequence
  Synthetic oligonucleotide; CAG chr11 5387940 5387959 5387943 -
ggtactgaaaatacaatgaa

SEQ ID NO: 30340 - DNA, 20 bp, Artificial Sequence
  Synthetic oligonucleotide; CAG chr11 5387934 5387953 5387937 -
gaaaatacaatgaacagaaa

SEQ ID NO: 30341 - DNA, 20 bp, Artificial Sequence
  Synthetic oligonucleotide; CAG chr11 5387929 5387948 5387932 -
tacaatgaacagaaacagaa

SEQ ID NO: 30342 - DNA, 20 bp, Artificial Sequence
  Synthetic oligonucleotide; GAG chr11 5387927 5387946 5387930 -
caatgaacagaaacagaaca

SEQ ID NO: 30343 - DNA, 20 bp, Artificial Sequence
  Synthetic oligonucleotide; AAG chr11 5387890 5387909 5387893 -
atacatacatactgcaatgc

SEQ ID NO: 30344 - DNA, 20 bp, Artificial Sequence
  Synthetic oligonucleotide; AGG chr11 5387889 5387908 5387892 -
tacatacatactgcaatgca

SEQ ID NO: 30345 - DNA, 20 bp, Artificial Sequence
  Synthetic oligonucleotide; AAG chr11 5387871 5387890 5387874 -
caaggtaatgtaatgcaata

SEQ ID NO: 30346 - DNA, 20 bp, Artificial Sequence
  Synthetic oligonucleotide; AAG chr11 5387868 5387887 5387871 -
ggtaatgtaatgcaataaag

SEQ ID NO: 30347 - DNA, 20 bp, Artificial Sequence
  Synthetic oligonucleotide; TAG chr11 5387865 5387884 5387868 -
aatgtaatgcaataaagaag

SEQ ID NO: 30348 - DNA, 20 bp, Artificial Sequence
  Synthetic oligonucleotide; AGG chr11 5387864 5387883 5387867 -
atgtaatgcaataaagaagt

SEQ ID NO: 30349 - DNA, 20 bp, Artificial Sequence
  Synthetic oligonucleotide; GGG chr11 5387863 5387882 5387866 -
tgtaatgcaataaagaagta

SEQ ID NO: 30350 - DNA, 20 bp, Artificial Sequence
  Synthetic oligonucleotide; GAG chr11 5387861 5387880 5387864 -
taatgcaataaagaagtagg

SEQ ID NO: 30351 - DNA, 20 bp, Artificial Sequence
  Synthetic oligonucleotide; AAG chr11 5387856 5387875 5387859 -
caataaagaagtagggagca

SEQ ID NO: 30352 - DNA, 20 bp, Artificial Sequence
  Synthetic oligonucleotide; AGG chr11 5387855 5387874 5387858 -
aataaagaagtagggagcaa

SEQ ID NO: 30353 - DNA, 20 bp, Artificial Sequence
  Synthetic oligonucleotide; GAG chr11 5387853 5387872 5387856 -
taaagaagtagggagcaaag

SEQ ID NO: 30354 - DNA, 20 bp, Artificial Sequence
  Synthetic oligonucleotide; AGG chr11 5387852 5387871 5387855 -
aaagaagtagggagcaaagg

SEQ ID NO: 30355 - DNA, 20 bp, Artificial Sequence
  Synthetic oligonucleotide; AAG chr11 5387849 5387868 5387852 -
gaagtagggagcaaaggagg

SEQ ID NO: 30356 - DNA, 20 bp, Artificial Sequence
  Synthetic oligonucleotide; AGG chr11 5387848 5387867 5387851 -
aagtagggagcaaaggagga

SEQ ID NO: 30357 - DNA, 20 bp, Artificial Sequence
  Synthetic oligonucleotide; AAG chr11 5387844 5387863 5387847 -
agggagcaaaggaggaaggt

SEQ ID NO: 30358 - DNA, 20 bp, Artificial Sequence
  Synthetic oligonucleotide; GAG chr11 5387842 5387861 5387845 -
ggagcaaaggaggaaggtaa

SEQ ID NO: 30359 - DNA, 20 bp, Artificial Sequence
  Synthetic oligonucleotide; TAG chr11 5387825 5387844 5387828 -
taagagtgatgcattttata

SEQ ID NO: 30360 - DNA, 20 bp, Artificial Sequence
  Synthetic oligonucleotide; AGG chr11 5387824 5387843 5387827 -
aagagtgatgcattttatat

SEQ ID NO: 30361 - DNA, 20 bp, Artificial Sequence
  Synthetic oligonucleotide; GGG chr11 5387823 5387842 5387826 -
agagtgatgcattttatata

SEQ ID NO: 30362 - DNA, 20 bp, Artificial Sequence
  Synthetic oligonucleotide; TAG chr11 5387820 5387839 5387823 -
gtgatgcattttatataggg

SEQ ID NO: 30363 - DNA, 20 bp, Artificial Sequence
  Synthetic oligonucleotide; CAG chr11 5387816 5387835 5387819 -
tgcattttatatagggtagt

SEQ ID NO: 30364 - DNA, 20 bp, Artificial Sequence
  Synthetic oligonucleotide; GAG chr11 5387814 5387833 5387817 -
cattttatatagggtagtca

SEQ ID NO: 30365 - DNA, 20 bp, Artificial Sequence
  Synthetic oligonucleotide; AAG chr11 5387811 5387830 5387814 -
tttatatagggtagtcagag

SEQ ID NO: 30366 - DNA, 20 bp, Artificial Sequence
  Synthetic oligonucleotide; GAG chr11 5387800 5387819 5387803 -
tagtcagagaagacctctct

SEQ ID NO: 30367 - DNA, 20 bp, Artificial Sequence
  Synthetic oligonucleotide; TAG chr11 5387797 5387816 5387800 -
tcagagaagacctctctgag

SEQ ID NO: 30368 - DNA, 20 bp, Artificial Sequence
  Synthetic oligonucleotide; AGG chr11 5387796 5387815 5387799 -
cagagaagacctctctgagt

SEQ ID NO: 30369 - DNA, 20 bp, Artificial Sequence
  Synthetic oligonucleotide; TAG chr11 5387787 5387806 5387790 -
cctctctgagtaggtaattt

SEQ ID NO: 30370 - DNA, 20 bp, Artificial Sequence
  Synthetic oligonucleotide; GAG chr11 5387785 5387804 5387788 -
tctctgagtaggtaatttta

SEQ ID NO: 30371 - DNA, 20 bp, Artificial Sequence
  Synthetic oligonucleotide; AAG chr11 5387782 5387801 5387785 -
ctgagtaggtaattttagag

SEQ ID NO: 30372 - DNA, 20 bp, Artificial Sequence
  Synthetic oligonucleotide; CAG chr11 5387769 5387788 5387772 -
tttagagaagaaatcaaaat

SEQ ID NO: 30373 - DNA, 20 bp, Artificial Sequence
  Synthetic oligonucleotide; GAG chr11 5387767 5387786 5387770 -
tagagaagaaatcaaaatca

SEQ ID NO: 30374 - DNA, 20 bp, Artificial Sequence
  Synthetic oligonucleotide; AGG chr11 5387766 5387785 5387769 -
agagaagaaatcaaaatcag

SEQ ID NO: 30375 - DNA, 20 bp, Artificial Sequence
  Synthetic oligonucleotide; GGG chr11 5387765 5387784 5387768 -
gagaagaaatcaaaatcaga

SEQ ID NO: 30376 - DNA, 20 bp, Artificial Sequence
  Synthetic oligonucleotide; AAG chr11 5387761 5387780 5387764 -
agaaatcaaaatcagagggc

SEQ ID NO: 30377 - DNA, 20 bp, Artificial Sequence
  Synthetic oligonucleotide; TGG chr11 5387754 5387773 5387757 -
aaaatcagagggcaagtgtg

SEQ ID NO: 30378 - DNA, 20 bp, Artificial Sequence
  Synthetic oligonucleotide; TAG chr11 5387745 5387764 5387748 -
gggcaagtgtgtggctatct

SEQ ID NO: 30379 - DNA, 20 bp, Artificial Sequence
  Synthetic oligonucleotide; AGG chr11 5387744 5387763 5387747 -
ggcaagtgtgtggctatctt

SEQ ID NO: 30380 - DNA, 20 bp, Artificial Sequence
  Synthetic oligonucleotide; GGG chr11 5387743 5387762 5387746 -
gcaagtgtgtggctatctta

SEQ ID NO: 30381 - DNA, 20 bp, Artificial Sequence
  Synthetic oligonucleotide; AAG chr11 5387730 5387749 5387733 -
tatcttagggaaaaacattc

SEQ ID NO: 30382 - DNA, 20 bp, Artificial Sequence
  Synthetic oligonucleotide; AGG chr11 5387729 5387748 5387732 -
atcttagggaaaaacattca

SEQ ID NO: 30383 - DNA, 20 bp, Artificial Sequence
  Synthetic oligonucleotide; AAG chr11 5387726 5387745 5387729 -
ttagggaaaaacattcaagg

SEQ ID NO: 30384 - DNA, 20 bp, Artificial Sequence
  Synthetic oligonucleotide; AGG chr11 5387725 5387744 5387728 -
tagggaaaaacattcaagga

SEQ ID NO: 30385 - DNA, 20 bp, Artificial Sequence
  Synthetic oligonucleotide; GAG chr11 5387723 5387742 5387726 -
gggaaaaacattcaaggaag

SEQ ID NO: 30386 - DNA, 20 bp, Artificial Sequence
  Synthetic oligonucleotide; AGG chr11 5387722 5387741 5387725 -
ggaaaaacattcaaggaagg

SEQ ID NO: 30387 - DNA, 20 bp, Artificial Sequence
  Synthetic oligonucleotide; AAG chr11 5387719 5387738 5387722 -
aaaacattcaaggaaggagg

SEQ ID NO: 30388 - DNA, 20 bp, Artificial Sequence
  Synthetic oligonucleotide; AAG chr11 5387713 5387732 5387716 -
ttcaaggaaggaggaagaac

SEQ ID NO: 30389 - DNA, 20 bp, Artificial Sequence
  Synthetic oligonucleotide; AAG chr11 5387707 5387726 5387710 -
gaaggaggaagaacaagtga

SEQ ID NO: 30390 - DNA, 20 bp, Artificial Sequence
  Synthetic oligonucleotide; AAG chr11 5387698 5387717 5387701 -
agaacaagtgaaagttcctg

SEQ ID NO: 30391 - DNA, 20 bp, Artificial Sequence
  Synthetic oligonucleotide; CAG chr11 5387695 5387714 5387698 -
acaagtgaaagttcctgaag

SEQ ID NO: 30392 - DNA, 20 bp, Artificial Sequence
  Synthetic oligonucleotide; GAG chr11 5387693 5387712 5387696 -
aagtgaaagttcctgaagca

SEQ ID NO: 30393 - DNA, 20 bp, Artificial Sequence
  Synthetic oligonucleotide; GAG chr11 5387691 5387710 5387694 -
gtgaaagttcctgaagcaga

SEQ ID NO: 30394 - DNA, 20 bp, Artificial Sequence
  Synthetic oligonucleotide; CAG chr11 5387688 5387707 5387691 -
aaagttcctgaagcagagag

SEQ ID NO: 30395 - DNA, 20 bp, Artificial Sequence
  Synthetic oligonucleotide; AAG chr11 5387679 5387698 5387682 -
gaagcagagagcagcttgac

SEQ ID NO: 30396 - DNA, 20 bp, Artificial Sequence
  Synthetic oligonucleotide; AAG chr11 5387671 5387690 5387674 -
gagcagcttgacaagtttaa

SEQ ID NO: 30397 - DNA, 20 bp, Artificial Sequence
  Synthetic oligonucleotide; AAG chr11 5387664 5387683 5387667 -
ttgacaagtttaaaagacaa

SEQ ID NO: 30398 - DNA, 20 bp, Artificial Sequence
  Synthetic oligonucleotide; AAG chr11 5387661 5387680 5387664 -
acaagtttaaaagacaaaag

SEQ ID NO: 30399 - DNA, 20 bp, Artificial Sequence
  Synthetic oligonucleotide; AGG chr11 5387660 5387679 5387663 -
caagtttaaaagacaaaaga

SEQ ID NO: 30400 - DNA, 20 bp, Artificial Sequence
  Synthetic oligonucleotide; TGG chr11 5387642 5387661 5387645 -
gaaggccaatgtatattcaa

SEQ ID NO: 30401 - DNA, 20 bp, Artificial Sequence
  Synthetic oligonucleotide; GAG chr11 5387640 5387659 5387643 -
aggccaatgtatattcaatg

SEQ ID NO: 30402 - DNA, 20 bp, Artificial Sequence
  Synthetic oligonucleotide; AGG chr11 5387639 5387658 5387642 -
ggccaatgtatattcaatgg

SEQ ID NO: 30403 - DNA, 20 bp, Artificial Sequence
  Synthetic oligonucleotide; AAG chr11 5387636 5387655 5387639 -
caatgtatattcaatggagg

SEQ ID NO: 30404 - DNA, 20 bp, Artificial Sequence
  Synthetic oligonucleotide; AAG chr11 5387632 5387651 5387635 -
gtatattcaatggaggaagc

SEQ ID NO: 30405 - DNA, 20 bp, Artificial Sequence
  Synthetic oligonucleotide; AGG chr11 5387631 5387650 5387634 -
tatattcaatggaggaagca

SEQ ID NO: 30406 - DNA, 20 bp, Artificial Sequence
  Synthetic oligonucleotide; TGG chr11 5387628 5387647 5387631 -
attcaatggaggaagcaagg

SEQ ID NO: 30407 - DNA, 20 bp, Artificial Sequence
  Synthetic oligonucleotide; GGG chr11 5387627 5387646 5387630 -
ttcaatggaggaagcaaggt

SEQ ID NO: 30408 - DNA, 20 bp, Artificial Sequence
  Synthetic oligonucleotide; GGG chr11 5387626 5387645 5387629 -
tcaatggaggaagcaaggtg

SEQ ID NO: 30409 - DNA, 20 bp, Artificial Sequence
  Synthetic oligonucleotide; TGG chr11 5387621 5387640 5387624 -
ggaggaagcaaggtggggaa

SEQ ID NO: 30410 - DNA, 20 bp, Artificial Sequence
  Synthetic oligonucleotide; TGG chr11 5387618 5387637 5387621 -
ggaagcaaggtggggaatgg

SEQ ID NO: 30411 - DNA, 20 bp, Artificial Sequence
  Synthetic oligonucleotide; AAG chr11 5387603 5387622 5387606 -
aatggtggcaaatccacttg

SEQ ID NO: 30412 - DNA, 20 bp, Artificial Sequence
  Synthetic oligonucleotide; TAG chr11 5387600 5387619 5387603 -
ggtggcaaatccacttgaag

SEQ ID NO: 30413 - DNA, 20 bp, Artificial Sequence
  Synthetic oligonucleotide; CAG chr11 5387597 5387616 5387600 -
ggcaaatccacttgaagtag

SEQ ID NO: 30414 - DNA, 20 bp, Artificial Sequence
  Synthetic oligonucleotide; CAG chr11 5387567 5387586 5387570 -
ctacgtcatgtatgatcttg

SEQ ID NO: 30415 - DNA, 20 bp, Artificial Sequence
  Synthetic oligonucleotide; AGG chr11 5387566 5387585 5387569 -
tacgtcatgtatgatcttgc

SEQ ID NO: 30416 - DNA, 20 bp, Artificial Sequence
  Synthetic oligonucleotide; AAG chr11 5387557 5387576 5387560 -
tatgatcttgcaggtcacgc

SEQ ID NO: 30417 - DNA, 20 bp, Artificial Sequence
  Synthetic oligonucleotide; GAG chr11 5387529 5387548 5387532 -
ttgaattttattatacttgt

SEQ ID NO: 30418 - DNA, 20 bp, Artificial Sequence
  Synthetic oligonucleotide; GAG chr11 5387522 5387541 5387525 -
ttattatacttgtgagcttc

SEQ ID NO: 30419 - DNA, 20 bp, Artificial Sequence
  Synthetic oligonucleotide; GAG chr11 5387517 5387536 5387520 -
atacttgtgagcttcgagtt

SEQ ID NO: 30420 - DNA, 20 bp, Artificial Sequence
  Synthetic oligonucleotide; GAG chr11 5387515 5387534 5387518 -
acttgtgagcttcgagttga

SEQ ID NO: 30421 - DNA, 20 bp, Artificial Sequence
  Synthetic oligonucleotide; CAG chr11 5387512 5387531 5387515 -
tgtgagcttcgagttgagag

SEQ ID NO: 30422 - DNA, 20 bp, Artificial Sequence
  Synthetic oligonucleotide; GAG chr11 5387510 5387529 5387513 -
tgagcttcgagttgagagca

SEQ ID NO: 30423 - DNA, 20 bp, Artificial Sequence
  Synthetic oligonucleotide; AGG chr11 5387509 5387528 5387512 -
gagcttcgagttgagagcag

SEQ ID NO: 30424 - DNA, 20 bp, Artificial Sequence
  Synthetic oligonucleotide; TGG chr11 5387499 5387518 5387502 -
ttgagagcagaggtgctgca

SEQ ID NO: 30425 - DNA, 20 bp, Artificial Sequence
  Synthetic oligonucleotide; AAG chr11 5387492 5387511 5387495 -
cagaggtgctgcatggatat

SEQ ID NO: 30426 - DNA, 20 bp, Artificial Sequence
  Synthetic oligonucleotide; AGG chr11 5387491 5387510 5387494 -
agaggtgctgcatggatata

SEQ ID NO: 30427 - DNA, 20 bp, Artificial Sequence
  Synthetic oligonucleotide; TGG chr11 5387476 5387495 5387479 -
atataaggcttacatcactt

SEQ ID NO: 30428 - DNA, 20 bp, Artificial Sequence
  Synthetic oligonucleotide; AAG chr11 5387472 5387491 5387475 -
aaggcttacatcactttggc

SEQ ID NO: 30429 - DNA, 20 bp, Artificial Sequence
  Synthetic oligonucleotide; AGG chr11 5387471 5387490 5387474 -
aggcttacatcactttggca

SEQ ID NO: 30430 - DNA, 20 bp, Artificial Sequence
  Synthetic oligonucleotide; GGG chr11 5387470 5387489 5387473 -
ggcttacatcactttggcaa

SEQ ID NO: 30431 - DNA, 20 bp, Artificial Sequence
  Synthetic oligonucleotide; GGG chr11 5387469 5387488 5387472 -
gcttacatcactttggcaag

SEQ ID NO: 30432 - DNA, 20 bp, Artificial Sequence
  Synthetic oligonucleotide; TAG chr11 5387459 5387478 5387462 -
ctttggcaaggggtaaaaaa

SEQ ID NO: 30433 - DNA, 20 bp, Artificial Sequence
  Synthetic oligonucleotide; CAG chr11 5387424 5387443 5387427 -
ttttccatttctttacttct

SEQ ID NO: 30434 - DNA, 20 bp, Artificial Sequence
  Synthetic oligonucleotide; TAG chr11 5387374 5387393 5387377 -
tgttttttttaaaacccact

SEQ ID NO: 30435 - DNA, 20 bp, Artificial Sequence
  Synthetic oligonucleotide; AAG chr11 5387368 5387387 5387371 -
ttttaaaacccacttagcta

SEQ ID NO: 30436 - DNA, 20 bp, Artificial Sequence
  Synthetic oligonucleotide; CAG chr11 5387346 5387365 5387349 -
gcaatgctccttaaattcac

SEQ ID NO: 30437 - DNA, 20 bp, Artificial Sequence
  Synthetic oligonucleotide; TAG chr11 5387336 5387355 5387339 -
ttaaattcaccagtgacttc

SEQ ID NO: 30438 - DNA, 20 bp, Artificial Sequence
  Synthetic oligonucleotide; AGG chr11 5387335 5387354 5387338 -
taaattcaccagtgacttct

SEQ ID NO: 30439 - DNA, 20 bp, Artificial Sequence
  Synthetic oligonucleotide; GGG chr11 5387334 5387353 5387337 -
aaattcaccagtgacttcta

SEQ ID NO: 30440 - DNA, 20 bp, Artificial Sequence
  Synthetic oligonucleotide; GGG chr11 5387333 5387352 5387336 -
aattcaccagtgacttctag

SEQ ID NO: 30441 - DNA, 20 bp, Artificial Sequence
  Synthetic oligonucleotide; TGG chr11 5387320 5387339 5387323 -
cttctaggggccaaatgcaa

SEQ ID NO: 30442 - DNA, 20 bp, Artificial Sequence
  Synthetic oligonucleotide; GAG chr11 5387318 5387337 5387321 -
tctaggggccaaatgcaatg

SEQ ID NO: 30443 - DNA, 20 bp, Artificial Sequence
  Synthetic oligonucleotide; GAG chr11 5387316 5387335 5387319 -
taggggccaaatgcaatgga

SEQ ID NO: 30444 - DNA, 20 bp, Artificial Sequence
  Synthetic oligonucleotide; TAG chr11 5387275 5387294 5387278 -
ttattgatttttttgtgcaa

SEQ ID NO: 30445 - DNA, 20 bp, Artificial Sequence
  Synthetic oligonucleotide; TGG chr11 5387262 5387281 5387265 -
tgtgcaatagttgtgtgctc

SEQ ID NO: 30446 - DNA, 20 bp, Artificial Sequence
  Synthetic oligonucleotide; TAG chr11 5387244 5387263 5387247 -
tctggccatgccttcctttt

SEQ ID NO: 30447 - DNA, 20 bp, Artificial Sequence
  Synthetic oligonucleotide; GAG chr11 5387242 5387261 5387245 -
tggccatgccttccttttta

SEQ ID NO: 30448 - DNA, 20 bp, Artificial Sequence
  Synthetic oligonucleotide; TAG chr11 5387232 5387251 5387235 -
ttcctttttagagctctctc

SEQ ID NO: 30449 - DNA, 20 bp, Artificial Sequence
  Synthetic oligonucleotide; AAG chr11 5387215 5387234 5387218 -
ctctagaaattcttaatgcc

SEQ ID NO: 30450 - DNA, 20 bp, Artificial Sequence
  Synthetic oligonucleotide; TGG chr11 5387206 5387225 5387209 -
ttcttaatgccaagatctgc

SEQ ID NO: 30451 - DNA, 20 bp, Artificial Sequence
  Synthetic oligonucleotide; TAG chr11 5387183 5387202 5387186 -
ttctcttctgatttttgtga

SEQ ID NO: 30452 - DNA, 20 bp, Artificial Sequence
  Synthetic oligonucleotide; CAG chr11 5387134 5387153 5387137 -
gctcaaatatttatgttatt

SEQ ID NO: 30453 - DNA, 20 bp, Artificial Sequence
  Synthetic oligonucleotide; CAG chr11 5387067 5387086 5387070 -
tattattattattacttata

SEQ ID NO: 30454 - DNA, 20 bp, Artificial Sequence
  Synthetic oligonucleotide; TGG chr11 5387064 5387083 5387067 -
tattattattacttatacag

SEQ ID NO: 30455 - DNA, 20 bp, Artificial Sequence
  Synthetic oligonucleotide; TGG chr11 5387061 5387080 5387064 -
tattattacttatacagtgg

SEQ ID NO: 30456 - DNA, 20 bp, Artificial Sequence
  Synthetic oligonucleotide; TAG chr11 5387054 5387073 5387057 -
acttatacagtggtggctct

SEQ ID NO: 30457 - DNA, 20 bp, Artificial Sequence
  Synthetic oligonucleotide; TAG chr11 5387040 5387059 5387043 -
ggctcttagacattaatctc

SEQ ID NO: 30458 - DNA, 20 bp, Artificial Sequence
  Synthetic oligonucleotide; CAG chr11 5387035 5387054 5387038 -
ttagacattaatctctagtc

SEQ ID NO: 30459 - DNA, 20 bp, Artificial Sequence
  Synthetic oligonucleotide; CAG chr11 5387015 5387034 5387018 -
cagataactccgttacatat

SEQ ID NO: 30460 - DNA, 20 bp, Artificial Sequence
  Synthetic oligonucleotide; AGG chr11 5387014 5387033 5387017 -
agataactccgttacatatc

SEQ ID NO: 30461 - DNA, 20 bp, Artificial Sequence
  Synthetic oligonucleotide; GAG chr11 5387008 5387027 5387011 -
ctccgttacatatcaggcct

SEQ ID NO: 30462 - DNA, 20 bp, Artificial Sequence
  Synthetic oligonucleotide; TAG chr11 5386990 5387009 5386993 -
ctgagtttctgccttctcac

SEQ ID NO: 30463 - DNA, 20 bp, Artificial Sequence
  Synthetic oligonucleotide; AGG chr11 5386989 5387008 5386992 -
tgagtttctgccttctcact

SEQ ID NO: 30464 - DNA, 20 bp, Artificial Sequence
  Synthetic oligonucleotide; AAG chr11 5386977 5386996 5386980 -
ttctcactaggtgtttccaa

SEQ ID NO: 30465 - DNA, 20 bp, Artificial Sequence
  Synthetic oligonucleotide; AGG chr11 5386976 5386995 5386979 -
tctcactaggtgtttccaaa

SEQ ID NO: 30466 - DNA, 20 bp, Artificial Sequence
  Synthetic oligonucleotide; GAG chr11 5386943 5386962 5386946 -
aactcaacacgtctaatatt

SEQ ID NO: 30467 - DNA, 20 bp, Artificial Sequence
  Synthetic oligonucleotide; CAG chr11 5386938 5386957 5386941 -
aacacgtctaatattgagcc

SEQ ID NO: 30468 - DNA, 20 bp, Artificial Sequence
  Synthetic oligonucleotide; AAG chr11 5386860 5386879 5386863 -
ttcaccatttcctgccattc

SEQ ID NO: 30469 - DNA, 20 bp, Artificial Sequence
  Synthetic oligonucleotide; GAG chr11 5386846 5386865 5386849 -
ccattcaagacaacattttt

SEQ ID NO: 30470 - DNA, 20 bp, Artificial Sequence
  Synthetic oligonucleotide; AAG chr11 5386794 5386813 5386797 -
tctgtatctaatttttaact

SEQ ID NO: 30471 - DNA, 20 bp, Artificial Sequence
  Synthetic oligonucleotide; TAG chr11 5386749 5386768 5386752 -
tctattcatcttcatctctg

SEQ ID NO: 30472 - DNA, 20 bp, Artificial Sequence
  Synthetic oligonucleotide; TAG chr11 5386730 5386749 5386733 -
gtagccaatgtccttgttct

SEQ ID NO: 30473 - DNA, 20 bp, Artificial Sequence
  Synthetic oligonucleotide; AAG chr11 5386686 5386705 5386689 -
gacctgtcattcaacatgca

SEQ ID NO: 30474 - DNA, 20 bp, Artificial Sequence
  Synthetic oligonucleotide; CAG chr11 5386682 5386701 5386685 -
tgtcattcaacatgcaaagc

SEQ ID NO: 30475 - DNA, 20 bp, Artificial Sequence
  Synthetic oligonucleotide; AGG chr11 5386681 5386700 5386684 -
gtcattcaacatgcaaagcc

SEQ ID NO: 30476 - DNA, 20 bp, Artificial Sequence
  Synthetic oligonucleotide; TGG chr11 5386665 5386684 5386668 -
agccaggctcctccttccct

SEQ ID NO: 30477 - DNA, 20 bp, Artificial Sequence
  Synthetic oligonucleotide; CAG chr11 5386648 5386667 5386651 -
ccttggtccatcctctactg

SEQ ID NO: 30478 - DNA, 20 bp, Artificial Sequence
  Synthetic oligonucleotide; GAG chr11 5386640 5386659 5386643 -
catcctctactgcagccacc

SEQ ID NO: 30479 - DNA, 20 bp, Artificial Sequence
  Synthetic oligonucleotide; CAG chr11 5386631 5386650 5386634 -
ctgcagccaccgagattatg

SEQ ID NO: 30480 - DNA, 20 bp, Artificial Sequence
  Synthetic oligonucleotide; AAG chr11 5386627 5386646 5386630 -
agccaccgagattatgcaga

SEQ ID NO: 30481 - DNA, 20 bp, Artificial Sequence
  Synthetic oligonucleotide; CAG chr11 5386594 5386613 5386597 -
atgaatcactgcactgtttt

SEQ ID NO: 30482 - DNA, 20 bp, Artificial Sequence
  Synthetic oligonucleotide; CAG chr11 5386586 5386605 5386589 -
ctgcactgttttcagtactt

SEQ ID NO: 30483 - DNA, 20 bp, Artificial Sequence
  Synthetic oligonucleotide; TAG chr11 5386583 5386602 5386586 -
cactgttttcagtacttcag

SEQ ID NO: 30484 - DNA, 20 bp, Artificial Sequence
  Synthetic oligonucleotide; TAG chr11 5386570 5386589 5386573 -
acttcagtagctcctatcat

SEQ ID NO: 30485 - DNA, 20 bp, Artificial Sequence
  Synthetic oligonucleotide; AAG chr11 5386563 5386582 5386566 -
tagctcctatcattagaata

SEQ ID NO: 30486 - DNA, 20 bp, Artificial Sequence
  Synthetic oligonucleotide; AAG chr11 5386547 5386566 5386550 -
aataaagttcaaacttgtaa

SEQ ID NO: 30487 - DNA, 20 bp, Artificial Sequence
  Synthetic oligonucleotide; TGG chr11 5386539 5386558 5386542 -
tcaaacttgtaaaagatctg

SEQ ID NO: 30488 - DNA, 20 bp, Artificial Sequence
  Synthetic oligonucleotide; TAG chr11 5386533 5386552 5386536 -
ttgtaaaagatctgtggtga

SEQ ID NO: 30489 - DNA, 20 bp, Artificial Sequence
  Synthetic oligonucleotide; GAG chr11 5386519 5386538 5386522 -
tggtgatagtccaatttatt

SEQ ID NO: 30490 - DNA, 20 bp, Artificial Sequence
  Synthetic oligonucleotide; AGG chr11 5386518 5386537 5386521 -
ggtgatagtccaatttattg

SEQ ID NO: 30491 - DNA, 20 bp, Artificial Sequence
  Synthetic oligonucleotide; TAG chr11 5386503 5386522 5386506 -
tattgaggccatacatgatt

SEQ ID NO: 30492 - DNA, 20 bp, Artificial Sequence
  Synthetic oligonucleotide; AAG chr11 5386490 5386509 5386493 -
catgatttagatgctgtgaa

SEQ ID NO: 30493 - DNA, 20 bp, Artificial Sequence
  Synthetic oligonucleotide; AAG chr11 5386431 5386450 5386434 -
acattttattactacttcac

SEQ ID NO: 30494 - DNA, 20 bp, Artificial Sequence
  Synthetic oligonucleotide; AGG chr11 5386430 5386449 5386433 -
cattttattactacttcaca

SEQ ID NO: 30495 - DNA, 20 bp, Artificial Sequence
  Synthetic oligonucleotide; GAG chr11 5386428 5386447 5386431 -
ttttattactacttcacaag

SEQ ID NO: 30496 - DNA, 20 bp, Artificial Sequence
  Synthetic oligonucleotide; AAG chr11 5386414 5386433 5386417 -
cacaaggagaaaactacaaa

SEQ ID NO: 30497 - DNA, 20 bp, Artificial Sequence
  Synthetic oligonucleotide; AGG chr11 5386413 5386432 5386416 -
acaaggagaaaactacaaaa

SEQ ID NO: 30498 - DNA, 20 bp, Artificial Sequence
  Synthetic oligonucleotide; AAG chr11 5386396 5386415 5386399 -
aaaaggtaaacaatcatccc

SEQ ID NO: 30499 - DNA, 20 bp, Artificial Sequence
  Synthetic oligonucleotide; AGG chr11 5386395 5386414 5386398 -
aaaggtaaacaatcatccca

SEQ ID NO: 30500 - DNA, 20 bp, Artificial Sequence
  Synthetic oligonucleotide; TGG chr11 5386390 5386409 5386393 -
taaacaatcatcccaaggcc

SEQ ID NO: 30501 - DNA, 20 bp, Artificial Sequence
  Synthetic oligonucleotide; TAG chr11 5386387 5386406 5386390 -
acaatcatcccaaggcctgg

SEQ ID NO: 30502 - DNA, 20 bp, Artificial Sequence
  Synthetic oligonucleotide; GAG chr11 5386383 5386402 5386386 -
tcatcccaaggcctggtagt

SEQ ID NO: 30503 - DNA, 20 bp, Artificial Sequence
  Synthetic oligonucleotide; CAG chr11 5386373 5386392 5386376 -
gcctggtagtgagcgaaaat

SEQ ID NO: 30504 - DNA, 20 bp, Artificial Sequence
  Synthetic oligonucleotide; AGG chr11 5386372 5386391 5386375 -
cctggtagtgagcgaaaatc

SEQ ID NO: 30505 - DNA, 20 bp, Artificial Sequence
  Synthetic oligonucleotide; AAG chr11 5386367 5386386 5386370 -
tagtgagcgaaaatcaggat

SEQ ID NO: 30506 - DNA, 20 bp, Artificial Sequence
  Synthetic oligonucleotide; TGG chr11 5386339 5386358 5386342 -
aacctttgtctctctatgca

SEQ ID NO: 30507 - DNA, 20 bp, Artificial Sequence
  Synthetic oligonucleotide; TGG chr11 5386333 5386352 5386336 -
tgtctctctatgcatggccc

SEQ ID NO: 30508 - DNA, 20 bp, Artificial Sequence
  Synthetic oligonucleotide; TAG chr11 5386330 5386349 5386333 -
ctctctatgcatggccctgg

SEQ ID NO: 30509 - DNA, 20 bp, Artificial Sequence
  Synthetic oligonucleotide; TAG chr11 5386301 5386320 5386304 -
acaccctgtaacaccatctt

SEQ ID NO: 30510 - DNA, 20 bp, Artificial Sequence
  Synthetic oligonucleotide; CGG chr11 5386296 5386315 5386299 -
ctgtaacaccatctttagcc

SEQ ID NO: 30511 - DNA, 20 bp, Artificial Sequence
  Synthetic oligonucleotide; TGG chr11 5386281 5386300 5386284 -
tagcccggtccttcttgttt

SEQ ID NO: 30512 - DNA, 20 bp, Artificial Sequence
  Synthetic oligonucleotide; CAG chr11 5386254 5386273 5386257 -
tttccaaacccatcttttcc

SEQ ID NO: 30513 - DNA, 20 bp, Artificial Sequence
  Synthetic oligonucleotide; TGG chr11 5386170 5386189 5386173 -
ttctatatttattgctttct

SEQ ID NO: 30514 - DNA, 20 bp, Artificial Sequence
  Synthetic oligonucleotide; CAG chr11 5386142 5386161 5386145 -
accacccctgtttttccaac

SEQ ID NO: 30515 - DNA, 20 bp, Artificial Sequence
  Synthetic oligonucleotide; CGG chr11 5386129 5386148 5386132 -
ttccaaccagtaaacacttg

SEQ ID NO: 30516 - DNA, 20 bp, Artificial Sequence
  Synthetic oligonucleotide; AAG chr11 5386119 5386138 5386122 -
taaacacttgcggatccttt

SEQ ID NO: 30517 - DNA, 20 bp, Artificial Sequence
  Synthetic oligonucleotide; TAG chr11 5386113 5386132 5386116 -
cttgcggatcctttaagact

SEQ ID NO: 30518 - DNA, 20 bp, Artificial Sequence
  Synthetic oligonucleotide; TAG chr11 5386065 5386084 5386068 -
tctctcctgacttccttctg

SEQ ID NO: 30519 - DNA, 20 bp, Artificial Sequence
  Synthetic oligonucleotide; TAG chr11 5386059 5386078 5386062 -
ctgacttccttctgtagcat

SEQ ID NO: 30520 - DNA, 20 bp, Artificial Sequence
  Synthetic oligonucleotide; AGG chr11 5386058 5386077 5386061 -
tgacttccttctgtagcatt

SEQ ID NO: 30521 - DNA, 20 bp, Artificial Sequence
  Synthetic oligonucleotide; TAG chr11 5386033 5386052 5386036 -
catctttctctgttctcacg

SEQ ID NO: 30522 - DNA, 20 bp, Artificial Sequence
  Synthetic oligonucleotide; AAG chr11 5386012 5386031 5386015 -
agtacctgtaatgtactatt

SEQ ID NO: 30523 - DNA, 20 bp, Artificial Sequence
  Synthetic oligonucleotide; AGG chr11 5386011 5386030 5386014 -
gtacctgtaatgtactatta

SEQ ID NO: 30524 - DNA, 20 bp, Artificial Sequence
  Synthetic oligonucleotide; TAG chr11 5385947 5385966 5385950 -
tatacttattgatatatata

SEQ ID NO: 30525 - DNA, 20 bp, Artificial Sequence
  Synthetic oligonucleotide; AAG chr11 5385923 5385942 5385926 -
acatacttatacatccatat

SEQ ID NO: 30526 - DNA, 20 bp, Artificial Sequence
  Synthetic oligonucleotide; AAG chr11 5385907 5385926 5385910 -
atataagtacacatatgtat

SEQ ID NO: 30527 - DNA, 20 bp, Artificial Sequence
  Synthetic oligonucleotide; AAG chr11 5385890 5385909 5385893 -
tataagtttaaataacatat

SEQ ID NO: 30528 - DNA, 20 bp, Artificial Sequence
  Synthetic oligonucleotide; TAG chr11 5385883 5385902 5385886 -
ttaaataacatataagtgta

SEQ ID NO: 30529 - DNA, 20 bp, Artificial Sequence
  Synthetic oligonucleotide; TAG chr11 5385860 5385879 5385863 -
atttactcataaatacttta

SEQ ID NO: 30530 - DNA, 20 bp, Artificial Sequence
  Synthetic oligonucleotide; TAG chr11 5385846 5385865 5385849 -
actttatagaatatacattt

SEQ ID NO: 30531 - DNA, 20 bp, Artificial Sequence
  Synthetic oligonucleotide; TAG chr11 5385812 5385831 5385815 -
tatattctttatatacttta

SEQ ID NO: 30532 - DNA, 20 bp, Artificial Sequence
  Synthetic oligonucleotide; AAG chr11 5385796 5385815 5385799 -
tttatagattttttatatat

SEQ ID NO: 30533 - DNA, 20 bp, Artificial Sequence
  Synthetic oligonucleotide; TAG chr11 5385791 5385810 5385794 -
agattttttatatataagta

SEQ ID NO: 30534 - DNA, 20 bp, Artificial Sequence
  Synthetic oligonucleotide; AGG chr11 5385790 5385809 5385793 -
gattttttatatataagtat

SEQ ID NO: 30535 - DNA, 20 bp, Artificial Sequence
  Synthetic oligonucleotide; GGG chr11 5385789 5385808 5385792 -
attttttatatataagtata

SEQ ID NO: 30536 - DNA, 20 bp, Artificial Sequence
  Synthetic oligonucleotide; TAG chr11 5385733 5385752 5385736 -
aaacaaatatacaaaaatat

SEQ ID NO: 30537 - DNA, 20 bp, Artificial Sequence
  Synthetic oligonucleotide; TAG chr11 5385688 5385707 5385691 -
tttgtacaacatatatatta

SEQ ID NO: 30538 - DNA, 20 bp, Artificial Sequence
  Synthetic oligonucleotide; AGG chr11 5385687 5385706 5385690 -
ttgtacaacatatatattat

SEQ ID NO: 30539 - DNA, 20 bp, Artificial Sequence
  Synthetic oligonucleotide; TAG chr11 5385684 5385703 5385687 -
tacaacatatatattatagg

SEQ ID NO: 30540 - DNA, 20 bp, Artificial Sequence
  Synthetic oligonucleotide; TAG chr11 5385651 5385670 5385654 -
tattctttattatacatgtt

SEQ ID NO: 30541 - DNA, 20 bp, Artificial Sequence
  Synthetic oligonucleotide; TGG chr11 5385633 5385652 5385636 -
tttagaacataaatttatat

SEQ ID NO: 30542 - DNA, 20 bp, Artificial Sequence
  Synthetic oligonucleotide; AAG chr11 5385585 5385604 5385588 -
aacctaataattcatttttt

SEQ ID NO: 30543 - DNA, 20 bp, Artificial Sequence
  Synthetic oligonucleotide; TAG chr11 5385577 5385596 5385580 -
aattcattttttaagttgat

SEQ ID NO: 30544 - DNA, 20 bp, Artificial Sequence
  Synthetic oligonucleotide; TGG chr11 5385572 5385591 5385575 -
attttttaagttgattagac

SEQ ID NO: 30545 - DNA, 20 bp, Artificial Sequence
  Synthetic oligonucleotide; AAG chr11 5385560 5385579 5385563 -
gattagactggaattctcta

SEQ ID NO: 30546 - DNA, 20 bp, Artificial Sequence
  Synthetic oligonucleotide; AGG chr11 5385559 5385578 5385562 -
attagactggaattctctaa

SEQ ID NO: 30547 - DNA, 20 bp, Artificial Sequence
  Synthetic oligonucleotide; TGG chr11 5385552 5385571 5385555 -
tggaattctctaaaggcccc

SEQ ID NO: 30548 - DNA, 20 bp, Artificial Sequence
  Synthetic oligonucleotide; GAG chr11 5385550 5385569 5385553 -
gaattctctaaaggcccctg

SEQ ID NO: 30549 - DNA, 20 bp, Artificial Sequence
  Synthetic oligonucleotide; CAG chr11 5385542 5385561 5385545 -
taaaggcccctggagcctga

SEQ ID NO: 30550 - DNA, 20 bp, Artificial Sequence
  Synthetic oligonucleotide; AAG chr11 5385534 5385553 5385537 -
cctggagcctgacagtgtct

SEQ ID NO: 30551 - DNA, 20 bp, Artificial Sequence
  Synthetic oligonucleotide; TGG chr11 5385528 5385547 5385531 -
gcctgacagtgtctaagatg

SEQ ID NO: 30552 - DNA, 20 bp, Artificial Sequence
  Synthetic oligonucleotide; TAG chr11 5385525 5385544 5385528 -
tgacagtgtctaagatgtgg

SEQ ID NO: 30553 - DNA, 20 bp, Artificial Sequence
  Synthetic oligonucleotide; AGG chr11 5385524 5385543 5385527 -
gacagtgtctaagatgtggt

SEQ ID NO: 30554 - DNA, 20 bp, Artificial Sequence
  Synthetic oligonucleotide; TGG chr11 5385483 5385502 5385486 -
tttttgcatgaaaaactaaa

SEQ ID NO: 30555 - DNA, 20 bp, Artificial Sequence
  Synthetic oligonucleotide; GGG chr11 5385482 5385501 5385485 -
ttttgcatgaaaaactaaat

SEQ ID NO: 30556 - DNA, 20 bp, Artificial Sequence
  Synthetic oligonucleotide; AAG chr11 5385469 5385488 5385472 -
actaaatgggtgaataaata

SEQ ID NO: 30557 - DNA, 20 bp, Artificial Sequence
  Synthetic oligonucleotide; TGG chr11 5385436 5385455 5385439 -
ttatcctgattctttgtgcc

SEQ ID NO: 30558 - DNA, 20 bp, Artificial Sequence
  Synthetic oligonucleotide; GGG chr11 5385435 5385454 5385438 -
tatcctgattctttgtgcct

SEQ ID NO: 30559 - DNA, 20 bp, Artificial Sequence
  Synthetic oligonucleotide; GGG chr11 5385434 5385453 5385437 -
atcctgattctttgtgcctg

SEQ ID NO: 30560 - DNA, 20 bp, Artificial Sequence
  Synthetic oligonucleotide; CAG chr11 5385422 5385441 5385425 -
tgtgcctggggttctgttgt

SEQ ID NO: 30561 - DNA, 20 bp, Artificial Sequence
  Synthetic oligonucleotide; CAG chr11 5385401 5385420 5385404 -
agctctgtgttcaccaactt

SEQ ID NO: 30562 - DNA, 20 bp, Artificial Sequence
  Synthetic oligonucleotide; GAG chr11 5385399 5385418 5385402 -
ctctgtgttcaccaacttca

SEQ ID NO: 30563 - DNA, 20 bp, Artificial Sequence
  Synthetic oligonucleotide; GAG chr11 5385392 5385411 5385395 -
ttcaccaacttcagagtgat

SEQ ID NO: 30564 - DNA, 20 bp, Artificial Sequence
  Synthetic oligonucleotide; TGG chr11 5385388 5385407 5385391 -
ccaacttcagagtgatgaga

SEQ ID NO: 30565 - DNA, 20 bp, Artificial Sequence
  Synthetic oligonucleotide; CAG chr11 5385384 5385403 5385387 -
cttcagagtgatgagatgga

SEQ ID NO: 30566 - DNA, 20 bp, Artificial Sequence
  Synthetic oligonucleotide; AGG chr11 5385383 5385402 5385386 -
ttcagagtgatgagatggac

SEQ ID NO: 30567 - DNA, 20 bp, Artificial Sequence
  Synthetic oligonucleotide; GGG chr11 5385382 5385401 5385385 -
tcagagtgatgagatggaca

SEQ ID NO: 30568 - DNA, 20 bp, Artificial Sequence
  Synthetic oligonucleotide; GAG chr11 5385380 5385399 5385383 -
agagtgatgagatggacagg

SEQ ID NO: 30569 - DNA, 20 bp, Artificial Sequence
  Synthetic oligonucleotide; AAG chr11 5385377 5385396 5385380 -
gtgatgagatggacagggag

SEQ ID NO: 30570 - DNA, 20 bp, Artificial Sequence
  Synthetic oligonucleotide; AGG chr11 5385376 5385395 5385379 -
tgatgagatggacagggaga

SEQ ID NO: 30571 - DNA, 20 bp, Artificial Sequence
  Synthetic oligonucleotide; TGG chr11 5385370 5385389 5385373 -
gatggacagggagaaggatc

SEQ ID NO: 30572 - DNA, 20 bp, Artificial Sequence
  Synthetic oligonucleotide; TAG chr11 5385367 5385386 5385370 -
ggacagggagaaggatctgg

SEQ ID NO: 30573 - DNA, 20 bp, Artificial Sequence
  Synthetic oligonucleotide; AAG chr11 5385360 5385379 5385363 -
gagaaggatctggtagaaac

SEQ ID NO: 30574 - DNA, 20 bp, Artificial Sequence
  Synthetic oligonucleotide; CAG chr11 5385348 5385367 5385351 -
gtagaaacaagatgtctata

SEQ ID NO: 30575 - DNA, 20 bp, Artificial Sequence
  Synthetic oligonucleotide; GAG chr11 5385346 5385365 5385349 -
agaaacaagatgtctataca

SEQ ID NO: 30576 - DNA, 20 bp, Artificial Sequence
  Synthetic oligonucleotide; CAG chr11 5385336 5385355 5385339 -
tgtctatacagagacaatga

SEQ ID NO: 30577 - DNA, 20 bp, Artificial Sequence
  Synthetic oligonucleotide; AGG chr11 5385335 5385354 5385338 -
gtctatacagagacaatgac

SEQ ID NO: 30578 - DNA, 20 bp, Artificial Sequence
  Synthetic oligonucleotide; GGG chr11 5385334 5385353 5385337 -
tctatacagagacaatgaca

SEQ ID NO: 30579 - DNA, 20 bp, Artificial Sequence
  Synthetic oligonucleotide; TGG chr11 5385330 5385349 5385333 -
tacagagacaatgacagggc

SEQ ID NO: 30580 - DNA, 20 bp, Artificial Sequence
  Synthetic oligonucleotide; GGG chr11 5385329 5385348 5385332 -
acagagacaatgacagggct

SEQ ID NO: 30581 - DNA, 20 bp, Artificial Sequence
  Synthetic oligonucleotide; TGG chr11 5385315 5385334 5385318 -
agggctgggattatttctct

SEQ ID NO: 30582 - DNA, 20 bp, Artificial Sequence
  Synthetic oligonucleotide; AAG chr11 5385311 5385330 5385314 -
ctgggattatttctcttgga

SEQ ID NO: 30583 - DNA, 20 bp, Artificial Sequence
  Synthetic oligonucleotide; TGG chr11 5385296 5385315 5385299 -
ttggaaagtatacttcctct

SEQ ID NO: 30584 - DNA, 20 bp, Artificial Sequence
  Synthetic oligonucleotide; GGG chr11 5385295 5385314 5385298 -
tggaaagtatacttcctctt

SEQ ID NO: 30585 - DNA, 20 bp, Artificial Sequence
  Synthetic oligonucleotide; AAG chr11 5385292 5385311 5385295 -
aaagtatacttcctcttggg

SEQ ID NO: 30586 - DNA, 20 bp, Artificial Sequence
  Synthetic oligonucleotide; AAG chr11 5385288 5385307 5385291 -
tatacttcctcttgggaaga

SEQ ID NO: 30587 - DNA, 20 bp, Artificial Sequence
  Synthetic oligonucleotide; TAG chr11 5385282 5385301 5385285 -
tcctcttgggaagaaagctt

SEQ ID NO: 30588 - DNA, 20 bp, Artificial Sequence
  Synthetic oligonucleotide; AGG chr11 5385281 5385300 5385284 -
cctcttgggaagaaagcttt

SEQ ID NO: 30589 - DNA, 20 bp, Artificial Sequence
  Synthetic oligonucleotide; GGG chr11 5385280 5385299 5385283 -
ctcttgggaagaaagcttta

SEQ ID NO: 30590 - DNA, 20 bp, Artificial Sequence
  Synthetic oligonucleotide; GGG chr11 5385279 5385298 5385282 -
tcttgggaagaaagctttag

SEQ ID NO: 30591 - DNA, 20 bp, Artificial Sequence
  Synthetic oligonucleotide; TAG chr11 5385268 5385287 5385271 -
aagctttaggggatttctcc

SEQ ID NO: 30592 - DNA, 20 bp, Artificial Sequence
  Synthetic oligonucleotide; AAG chr11 5385264 5385283 5385267 -
tttaggggatttctcctagc

SEQ ID NO: 30593 - DNA, 20 bp, Artificial Sequence
  Synthetic oligonucleotide; GAG chr11 5385262 5385281 5385265 -
taggggatttctcctagcaa

SEQ ID NO: 30594 - DNA, 20 bp, Artificial Sequence
  Synthetic oligonucleotide; GAG chr11 5385260 5385279 5385263 -
ggggatttctcctagcaaga

SEQ ID NO: 30595 - DNA, 20 bp, Artificial Sequence
  Synthetic oligonucleotide; TAG chr11 5385243 5385262 5385246 -
agagagataattatccatga

SEQ ID NO: 30596 - DNA, 20 bp, Artificial Sequence
  Synthetic oligonucleotide; AGG chr11 5385242 5385261 5385245 -
gagagataattatccatgat

SEQ ID NO: 30597 - DNA, 20 bp, Artificial Sequence
  Synthetic oligonucleotide; GAG chr11 5385240 5385259 5385243 -
gagataattatccatgatag

SEQ ID NO: 30598 - DNA, 20 bp, Artificial Sequence
  Synthetic oligonucleotide; GAG chr11 5385238 5385257 5385241 -
gataattatccatgatagga

SEQ ID NO: 30599 - DNA, 20 bp, Artificial Sequence
  Synthetic oligonucleotide; CAG chr11 5385232 5385251 5385235 -
tatccatgataggagagcaa

SEQ ID NO: 30600 - DNA, 20 bp, Artificial Sequence
  Synthetic oligonucleotide; AAG chr11 5385210 5385229 5385213 -
gtcattttttcatgtctact

SEQ ID NO: 30601 - DNA, 20 bp, Artificial Sequence
  Synthetic oligonucleotide; TGG chr11 5385204 5385223 5385207 -
ttttcatgtctactaagcaa

SEQ ID NO: 30602 - DNA, 20 bp, Artificial Sequence
  Synthetic oligonucleotide; GAG chr11 5385202 5385221 5385205 -
ttcatgtctactaagcaatg

SEQ ID NO: 30603 - DNA, 20 bp, Artificial Sequence
  Synthetic oligonucleotide; AGG chr11 5385201 5385220 5385204 -
tcatgtctactaagcaatgg

SEQ ID NO: 30604 - DNA, 20 bp, Artificial Sequence
  Synthetic oligonucleotide; GAG chr11 5385199 5385218 5385202 -
atgtctactaagcaatggag

SEQ ID NO: 30605 - DNA, 20 bp, Artificial Sequence
  Synthetic oligonucleotide; CAG chr11 5385190 5385209 5385193 -
aagcaatggaggagtccact

SEQ ID NO: 30606 - DNA, 20 bp, Artificial Sequence
  Synthetic oligonucleotide; GAG chr11 5385188 5385207 5385191 -
gcaatggaggagtccactca

SEQ ID NO: 30607 - DNA, 20 bp, Artificial Sequence
  Synthetic oligonucleotide; CAG chr11 5385185 5385204 5385188 -
atggaggagtccactcagag

SEQ ID NO: 30608 - DNA, 20 bp, Artificial Sequence
  Synthetic oligonucleotide; CAG chr11 5385181 5385200 5385184 -
aggagtccactcagagcagt

SEQ ID NO: 30609 - DNA, 20 bp, Artificial Sequence
  Synthetic oligonucleotide; AAG chr11 5385146 5385165 5385149 -
acaacataattaaaatattc

SEQ ID NO: 30610 - DNA, 20 bp, Artificial Sequence
  Synthetic oligonucleotide; AGG chr11 5385145 5385164 5385148 -
caacataattaaaatattca

SEQ ID NO: 30611 - DNA, 20 bp, Artificial Sequence
  Synthetic oligonucleotide; CAG chr11 5385142 5385161 5385145 -
cataattaaaatattcaagg

SEQ ID NO: 30612 - DNA, 20 bp, Artificial Sequence
  Synthetic oligonucleotide; GAG chr11 5385140 5385159 5385143 -
taattaaaatattcaaggca

SEQ ID NO: 30613 - DNA, 20 bp, Artificial Sequence
  Synthetic oligonucleotide; TAG chr11 5385137 5385156 5385140 -
ttaaaatattcaaggcagag

SEQ ID NO: 30614 - DNA, 20 bp, Artificial Sequence
  Synthetic oligonucleotide; TAG chr11 5385126 5385145 5385129 -
aaggcagagtagattcatct

SEQ ID NO: 30615 - DNA, 20 bp, Artificial Sequence
  Synthetic oligonucleotide; CAG chr11 5385119 5385138 5385122 -
agtagattcatcttagatca

SEQ ID NO: 30616 - DNA, 20 bp, Artificial Sequence
  Synthetic oligonucleotide; AGG chr11 5385118 5385137 5385121 -
gtagattcatcttagatcac

SEQ ID NO: 30617 - DNA, 20 bp, Artificial Sequence
  Synthetic oligonucleotide; GAG chr11 5385116 5385135 5385119 -
agattcatcttagatcacag

SEQ ID NO: 30618 - DNA, 20 bp, Artificial Sequence
  Synthetic oligonucleotide; AAG chr11 5385101 5385120 5385104 -
cacaggagaaaattcctgaa

SEQ ID NO: 30619 - DNA, 20 bp, Artificial Sequence
  Synthetic oligonucleotide; GAG chr11 5385099 5385118 5385102 -
caggagaaaattcctgaaaa

SEQ ID NO: 30620 - DNA, 20 bp, Artificial Sequence
  Synthetic oligonucleotide; CAG chr11 5385091 5385110 5385094 -
aattcctgaaaagagatttt

SEQ ID NO: 30621 - DNA, 20 bp, Artificial Sequence
  Synthetic oligonucleotide; GAG chr11 5385080 5385099 5385083 -
agagattttcagtatacaat

SEQ ID NO: 30622 - DNA, 20 bp, Artificial Sequence
  Synthetic oligonucleotide; TGG chr11 5385073 5385092 5385076 -
ttcagtatacaatgagtaat

SEQ ID NO: 30623 - DNA, 20 bp, Artificial Sequence
  Synthetic oligonucleotide; TAG chr11 5385022 5385041 5385025 -
cttttgtttgaatttaatat

SEQ ID NO: 30624 - DNA, 20 bp, Artificial Sequence
  Synthetic oligonucleotide; TGG chr11 5384998 5385017 5385001 -
tattttttaatgaactacat

SEQ ID NO: 30625 - DNA, 20 bp, Artificial Sequence
  Synthetic oligonucleotide; TGG chr11 5384995 5385014 5384998 -
tttttaatgaactacattgg

SEQ ID NO: 30626 - DNA, 20 bp, Artificial Sequence
  Synthetic oligonucleotide; GAG chr11 5384993 5385012 5384996 -
tttaatgaactacattggtg

SEQ ID NO: 30627 - DNA, 20 bp, Artificial Sequence
  Synthetic oligonucleotide; AGG chr11 5384992 5385011 5384995 -
ttaatgaactacattggtgg

SEQ ID NO: 30628 - DNA, 20 bp, Artificial Sequence
  Synthetic oligonucleotide; TAG chr11 5384972 5384991 5384975 -
aggatactgtttcttgtaaa

SEQ ID NO: 30629 - DNA, 20 bp, Artificial Sequence
  Synthetic oligonucleotide; AGG chr11 5384971 5384990 5384974 -
ggatactgtttcttgtaaat

SEQ ID NO: 30630 - DNA, 20 bp, Artificial Sequence
  Synthetic oligonucleotide; GAG chr11 5384969 5384988 5384972 -
atactgtttcttgtaaatag

SEQ ID NO: 30631 - DNA, 20 bp, Artificial Sequence
  Synthetic oligonucleotide; AAG chr11 5384957 5384976 5384960 -
gtaaataggagaatatgcaa

SEQ ID NO: 30632 - DNA, 20 bp, Artificial Sequence
  Synthetic oligonucleotide; AAG chr11 5384937 5384956 5384940 -
aagacgctgcacctaaacac

SEQ ID NO: 30633 - DNA, 20 bp, Artificial Sequence
  Synthetic oligonucleotide; AGG chr11 5384936 5384955 5384939 -
agacgctgcacctaaacaca

SEQ ID NO: 30634 - DNA, 20 bp, Artificial Sequence
  Synthetic oligonucleotide; CAG chr11 5384925 5384944 5384928 -
ctaaacacaaggacttgaac

SEQ ID NO: 30635 - DNA, 20 bp, Artificial Sequence
  Synthetic oligonucleotide; TAG chr11 5384902 5384921 5384905 -
attattcatttttgaacccc

SEQ ID NO: 30636 - DNA, 20 bp, Artificial Sequence
  Synthetic oligonucleotide; GAG chr11 5384900 5384919 5384903 -
tattcatttttgaaccccta

SEQ ID NO: 30637 - DNA, 20 bp, Artificial Sequence
  Synthetic oligonucleotide; CAG chr11 5384887 5384906 5384890 -
acccctagagaacatttcca

SEQ ID NO: 30638 - DNA, 20 bp, Artificial Sequence
  Synthetic oligonucleotide; TGG chr11 5384884 5384903 5384887 -
cctagagaacatttccacag

SEQ ID NO: 30639 - DNA, 20 bp, Artificial Sequence
  Synthetic oligonucleotide; TAG chr11 5384852 5384871 5384855 -
tctgtaaacatgcctgtttt

SEQ ID NO: 30640 - DNA, 20 bp, Artificial Sequence
  Synthetic oligonucleotide; TAG chr11 5384849 5384868 5384852 -
gtaaacatgcctgtttttag

SEQ ID NO: 30641 - DNA, 20 bp, Artificial Sequence
  Synthetic oligonucleotide; AGG chr11 5384848 5384867 5384851 -
taaacatgcctgtttttagt

SEQ ID NO: 30642 - DNA, 20 bp, Artificial Sequence
  Synthetic oligonucleotide; TAG chr11 5384844 5384863 5384847 -
catgcctgtttttagtagga

SEQ ID NO: 30643 - DNA, 20 bp, Artificial Sequence
  Synthetic oligonucleotide; GAG chr11 5384842 5384861 5384845 -
tgcctgtttttagtaggata

SEQ ID NO: 30644 - DNA, 20 bp, Artificial Sequence
  Synthetic oligonucleotide; AGG chr11 5384841 5384860 5384844 -
gcctgtttttagtaggatag

SEQ ID NO: 30645 - DNA, 20 bp, Artificial Sequence
  Synthetic oligonucleotide; GAG chr11 5384839 5384858 5384842 -
ctgtttttagtaggatagag

SEQ ID NO: 30646 - DNA, 20 bp, Artificial Sequence
  Synthetic oligonucleotide; AGG chr11 5384838 5384857 5384841 -
tgtttttagtaggatagagg

SEQ ID NO: 30647 - DNA, 20 bp, Artificial Sequence
  Synthetic oligonucleotide; TGG chr11 5384831 5384850 5384834 -
agtaggatagaggaggattt

SEQ ID NO: 30648 - DNA, 20 bp, Artificial Sequence
  Synthetic oligonucleotide; AAG chr11 5384828 5384847 5384831 -
aggatagaggaggattttgg

SEQ ID NO: 30649 - DNA, 20 bp, Artificial Sequence
  Synthetic oligonucleotide; AGG chr11 5384827 5384846 5384830 -
ggatagaggaggattttgga

SEQ ID NO: 30650 - DNA, 20 bp, Artificial Sequence
  Synthetic oligonucleotide; AAG chr11 5384822 5384841 5384825 -
gaggaggattttggaaggcg

SEQ ID NO: 30651 - DNA, 20 bp, Artificial Sequence
  Synthetic oligonucleotide; AGG chr11 5384821 5384840 5384824 -
aggaggattttggaaggcga

SEQ ID NO: 30652 - DNA, 20 bp, Artificial Sequence
  Synthetic oligonucleotide; TGG chr11 5384810 5384829 5384813 -
ggaaggcgaaggccatatcc

SEQ ID NO: 30653 - DNA, 20 bp, Artificial Sequence
  Synthetic oligonucleotide; TGG chr11 5384803 5384822 5384806 -
gaaggccatatcctggatac

SEQ ID NO: 30654 - DNA, 20 bp, Artificial Sequence
  Synthetic oligonucleotide; GGG chr11 5384802 5384821 5384805 -
aaggccatatcctggatact

SEQ ID NO: 30655 - DNA, 20 bp, Artificial Sequence
  Synthetic oligonucleotide; GGG chr11 5384801 5384820 5384804 -
aggccatatcctggatactg

SEQ ID NO: 30656 - DNA, 20 bp, Artificial Sequence
  Synthetic oligonucleotide; AAG chr11 5384798 5384817 5384801 -
ccatatcctggatactgggg

SEQ ID NO: 30657 - DNA, 20 bp, Artificial Sequence
  Synthetic oligonucleotide; AAG chr11 5384791 5384810 5384794 -
ctggatactggggaagttac

SEQ ID NO: 30658 - DNA, 20 bp, Artificial Sequence
  Synthetic oligonucleotide; AGG chr11 5384790 5384809 5384793 -
tggatactggggaagttaca

SEQ ID NO: 30659 - DNA, 20 bp, Artificial Sequence
  Synthetic oligonucleotide; TGG chr11 5384780 5384799 5384783 -
ggaagttacaaggtgttgtt

SEQ ID NO: 30660 - DNA, 20 bp, Artificial Sequence
  Synthetic oligonucleotide; AAG chr11 5384769 5384788 5384772 -
ggtgttgtttggattaaaat

SEQ ID NO: 30661 - DNA, 20 bp, Artificial Sequence
  Synthetic oligonucleotide; CAG chr11 5384766 5384785 5384769 -
gttgtttggattaaaataag

SEQ ID NO: 30662 - DNA, 20 bp, Artificial Sequence
  Synthetic oligonucleotide; GAG chr11 5384760 5384779 5384763 -
tggattaaaataagcagatt

SEQ ID NO: 30663 - DNA, 20 bp, Artificial Sequence
  Synthetic oligonucleotide; AGG chr11 5384759 5384778 5384762 -
ggattaaaataagcagattg

SEQ ID NO: 30664 - DNA, 20 bp, Artificial Sequence
  Synthetic oligonucleotide; TGG chr11 5384755 5384774 5384758 -
taaaataagcagattgagga

SEQ ID NO: 30665 - DNA, 20 bp, Artificial Sequence
  Synthetic oligonucleotide; GGG chr11 5384754 5384773 5384757 -
aaaataagcagattgaggat

SEQ ID NO: 30666 - DNA, 20 bp, Artificial Sequence
  Synthetic oligonucleotide; GGG chr11 5384753 5384772 5384756 -
aaataagcagattgaggatg

SEQ ID NO: 30667 - DNA, 20 bp, Artificial Sequence
  Synthetic oligonucleotide; TGG chr11 5384734 5384753 5384737 -
ggggtcttttctatgttaac

SEQ ID NO: 30668 - DNA, 20 bp, Artificial Sequence
  Synthetic oligonucleotide; CAG chr11 5384729 5384748 5384732 -
cttttctatgttaactggac

SEQ ID NO: 30669 - DNA, 20 bp, Artificial Sequence
  Synthetic oligonucleotide; AAG chr11 5384695 5384714 5384698 -
catttaataatttgttgaat

SEQ ID NO: 30670 - DNA, 20 bp, Artificial Sequence
  Synthetic oligonucleotide; GAG chr11 5384672 5384691 5384675 -
tgaatgactgtttttctgat

SEQ ID NO: 30671 - DNA, 20 bp, Artificial Sequence
  Synthetic oligonucleotide; GAG chr11 5384670 5384689 5384673 -
aatgactgtttttctgatga

SEQ ID NO: 30672 - DNA, 20 bp, Artificial Sequence
  Synthetic oligonucleotide; AAG chr11 5384666 5384685 5384669 -
actgtttttctgatgagagt

SEQ ID NO: 30673 - DNA, 20 bp, Artificial Sequence
  Synthetic oligonucleotide; AGG chr11 5384665 5384684 5384668 -
ctgtttttctgatgagagta

SEQ ID NO: 30674 - DNA, 20 bp, Artificial Sequence
  Synthetic oligonucleotide; GAG chr11 5384663 5384682 5384666 -
gtttttctgatgagagtaag

SEQ ID NO: 30675 - DNA, 20 bp, Artificial Sequence
  Synthetic oligonucleotide; GAG chr11 5384661 5384680 5384664 -
ttttctgatgagagtaagga

SEQ ID NO: 30676 - DNA, 20 bp, Artificial Sequence
  Synthetic oligonucleotide; AGG chr11 5384660 5384679 5384663 -
tttctgatgagagtaaggag

SEQ ID NO: 30677 - DNA, 20 bp, Artificial Sequence
  Synthetic oligonucleotide; GGG chr11 5384659 5384678 5384662 -
ttctgatgagagtaaggaga

SEQ ID NO: 30678 - DNA, 20 bp, Artificial Sequence
  Synthetic oligonucleotide; CAG chr11 5384647 5384666 5384650 -
taaggagagggtgtgtatac

SEQ ID NO: 30679 - DNA, 20 bp, Artificial Sequence
  Synthetic oligonucleotide; TGG chr11 5384643 5384662 5384646 -
gagagggtgtgtataccaga

SEQ ID NO: 30680 - DNA, 20 bp, Artificial Sequence
  Synthetic oligonucleotide; CGG chr11 5384638 5384657 5384641 -
ggtgtgtataccagatggct

SEQ ID NO: 30681 - DNA, 20 bp, Artificial Sequence
  Synthetic oligonucleotide; CAG chr11 5384635 5384654 5384638 -
gtgtataccagatggctcgg

SEQ ID NO: 30682 - DNA, 20 bp, Artificial Sequence
  Synthetic oligonucleotide; AGG chr11 5384634 5384653 5384637 -
tgtataccagatggctcggc

SEQ ID NO: 30683 - DNA, 20 bp, Artificial Sequence
  Synthetic oligonucleotide; AAG chr11 5384630 5384649 5384633 -
taccagatggctcggcagga

SEQ ID NO: 30684 - DNA, 20 bp, Artificial Sequence
  Synthetic oligonucleotide; GAG chr11 5384628 5384647 5384631 -
ccagatggctcggcaggaaa

SEQ ID NO: 30685 - DNA, 20 bp, Artificial Sequence
  Synthetic oligonucleotide; TAG chr11 5384623 5384642 5384626 -
tggctcggcaggaaagagta

SEQ ID NO: 30686 - DNA, 20 bp, Artificial Sequence
  Synthetic oligonucleotide; GAG chr11 5384621 5384640 5384624 -
gctcggcaggaaagagtata

SEQ ID NO: 30687 - DNA, 20 bp, Artificial Sequence
  Synthetic oligonucleotide; CAG chr11 5384616 5384635 5384619 -
gcaggaaagagtatagagac

SEQ ID NO: 30688 - DNA, 20 bp, Artificial Sequence
  Synthetic oligonucleotide; GAG chr11 5384614 5384633 5384617 -
aggaaagagtatagagacca

SEQ ID NO: 30689 - DNA, 20 bp, Artificial Sequence
  Synthetic oligonucleotide; AGG chr11 5384613 5384632 5384616 -
ggaaagagtatagagaccag

SEQ ID NO: 30690 - DNA, 20 bp, Artificial Sequence
  Synthetic oligonucleotide; GGG chr11 5384612 5384631 5384615 -
gaaagagtatagagaccaga

SEQ ID NO: 30691 - DNA, 20 bp, Artificial Sequence
  Synthetic oligonucleotide; TAG chr11 5384590 5384609 5384593 -
gcttctgccatcctgacttc

SEQ ID NO: 30692 - DNA, 20 bp, Artificial Sequence
  Synthetic oligonucleotide; CAG chr11 5384579 5384598 5384582 -
cctgacttctagacatgatc

SEQ ID NO: 30693 - DNA, 20 bp, Artificial Sequence
  Synthetic oligonucleotide; AGG chr11 5384578 5384597 5384581 -
ctgacttctagacatgatcc

SEQ ID NO: 30694 - DNA, 20 bp, Artificial Sequence
  Synthetic oligonucleotide; GGG chr11 5384577 5384596 5384580 -
tgacttctagacatgatcca

SEQ ID NO: 30695 - DNA, 20 bp, Artificial Sequence
  Synthetic oligonucleotide; GAG chr11 5384575 5384594 5384578 -
acttctagacatgatccagg

SEQ ID NO: 30696 - DNA, 20 bp, Artificial Sequence
  Synthetic oligonucleotide; AGG chr11 5384574 5384593 5384577 -
cttctagacatgatccaggg

SEQ ID NO: 30697 - DNA, 20 bp, Artificial Sequence
  Synthetic oligonucleotide; GGG chr11 5384573 5384592 5384576 -
ttctagacatgatccaggga

SEQ ID NO: 30698 - DNA, 20 bp, Artificial Sequence
  Synthetic oligonucleotide; GGG chr11 5384572 5384591 5384575 -
tctagacatgatccagggag

SEQ ID NO: 30699 - DNA, 20 bp, Artificial Sequence
  Synthetic oligonucleotide; TGG chr11 5384568 5384587 5384571 -
gacatgatccagggaggggc

SEQ ID NO: 30700 - DNA, 20 bp, Artificial Sequence
  Synthetic oligonucleotide; TGG chr11 5384563 5384582 5384566 -
gatccagggaggggctggcc

SEQ ID NO: 30701 - DNA, 20 bp, Artificial Sequence
  Synthetic oligonucleotide; CAG chr11 5384555 5384574 5384558 -
gaggggctggcctggccatg

SEQ ID NO: 30702 - DNA, 20 bp, Artificial Sequence
  Synthetic oligonucleotide; AGG chr11 5384554 5384573 5384557 -
aggggctggcctggccatgc

SEQ ID NO: 30703 - DNA, 20 bp, Artificial Sequence
  Synthetic oligonucleotide; CAG chr11 5384544 5384563 5384547 -
ctggccatgcaggcactcat

SEQ ID NO: 30704 - DNA, 20 bp, Artificial Sequence
  Synthetic oligonucleotide; AGG chr11 5384543 5384562 5384546 -
tggccatgcaggcactcatc

SEQ ID NO: 30705 - DNA, 20 bp, Artificial Sequence
  Synthetic oligonucleotide; GGG chr11 5384542 5384561 5384545 -
ggccatgcaggcactcatca

SEQ ID NO: 30706 - DNA, 20 bp, Artificial Sequence
  Synthetic oligonucleotide; GGG chr11 5384541 5384560 5384544 -
gccatgcaggcactcatcag

SEQ ID NO: 30707 - DNA, 20 bp, Artificial Sequence
  Synthetic oligonucleotide; GAG chr11 5384539 5384558 5384542 -
catgcaggcactcatcaggg

SEQ ID NO: 30708 - DNA, 20 bp, Artificial Sequence
  Synthetic oligonucleotide; GAG chr11 5384535 5384554 5384538 -
caggcactcatcaggggagt

SEQ ID NO: 30709 - DNA, 20 bp, Artificial Sequence
  Synthetic oligonucleotide; AGG chr11 5384534 5384553 5384537 -
aggcactcatcaggggagtg

SEQ ID NO: 30710 - DNA, 20 bp, Artificial Sequence
  Synthetic oligonucleotide; CAG chr11 5384531 5384550 5384534 -
cactcatcaggggagtgagg

SEQ ID NO: 30711 - DNA, 20 bp, Artificial Sequence
  Synthetic oligonucleotide; TGG chr11 5384518 5384537 5384521 -
agtgaggcagccctgcctcc

SEQ ID NO: 30712 - DNA, 20 bp, Artificial Sequence
  Synthetic oligonucleotide; CAG chr11 5384506 5384525 5384509 -
ctgcctcctggccttcctaa

SEQ ID NO: 30713 - DNA, 20 bp, Artificial Sequence
  Synthetic oligonucleotide; CAG chr11 5384496 5384515 5384499 -
gccttcctaacagaatactg

SEQ ID NO: 30714 - DNA, 20 bp, Artificial Sequence
  Synthetic oligonucleotide; GAG chr11 5384491 5384510 5384494 -
cctaacagaatactgcagat

SEQ ID NO: 30715 - DNA, 20 bp, Artificial Sequence
  Synthetic oligonucleotide; CAG chr11 5384475 5384494 5384478 -
agatgagctcgcctcttttc

SEQ ID NO: 30716 - DNA, 20 bp, Artificial Sequence
  Synthetic oligonucleotide; AAG chr11 5384471 5384490 5384474 -
gagctcgcctcttttccagc

SEQ ID NO: 30717 - DNA, 20 bp, Artificial Sequence
  Synthetic oligonucleotide; GAG chr11 5384469 5384488 5384472 -
gctcgcctcttttccagcaa

SEQ ID NO: 30718 - DNA, 20 bp, Artificial Sequence
  Synthetic oligonucleotide; AAG chr11 5384466 5384485 5384469 -
cgcctcttttccagcaagag

SEQ ID NO: 30719 - DNA, 20 bp, Artificial Sequence
  Synthetic oligonucleotide; AGG chr11 5384465 5384484 5384468 -
gcctcttttccagcaagaga

SEQ ID NO: 30720 - DNA, 20 bp, Artificial Sequence
  Synthetic oligonucleotide; TGG chr11 5384441 5384460 5384444 -
cctgttttctgttctttctc

SEQ ID NO: 30721 - DNA, 20 bp, Artificial Sequence
  Synthetic oligonucleotide; TGG chr11 5384435 5384454 5384438 -
ttctgttctttctctggctc

SEQ ID NO: 30722 - DNA, 20 bp, Artificial Sequence
  Synthetic oligonucleotide; TAG chr11 5384423 5384442 5384426 -
tctggctctggttctgtgca

SEQ ID NO: 30723 - DNA, 20 bp, Artificial Sequence
  Synthetic oligonucleotide; GAG chr11 5384415 5384434 5384418 -
tggttctgtgcatagactct

SEQ ID NO: 30724 - DNA, 20 bp, Artificial Sequence
  Synthetic oligonucleotide; CAG chr11 5384407 5384426 5384410 -
tgcatagactctgagaatat

SEQ ID NO: 30725 - DNA, 20 bp, Artificial Sequence
  Synthetic oligonucleotide; AAG chr11 5384404 5384423 5384407 -
atagactctgagaatatcag

SEQ ID NO: 30726 - DNA, 20 bp, Artificial Sequence
  Synthetic oligonucleotide; GAG chr11 5384402 5384421 5384405 -
agactctgagaatatcagaa

SEQ ID NO: 30727 - DNA, 20 bp, Artificial Sequence
  Synthetic oligonucleotide; GAG chr11 5384392 5384411 5384395 -
aatatcagaagagattctgt

SEQ ID NO: 30728 - DNA, 20 bp, Artificial Sequence
  Synthetic oligonucleotide; TGG chr11 5384384 5384403 5384387 -
aagagattctgtgagaaccc

SEQ ID NO: 30729 - DNA, 20 bp, Artificial Sequence
  Synthetic oligonucleotide; AAG chr11 5384376 5384395 5384379 -
ctgtgagaaccctggtttct

SEQ ID NO: 30730 - DNA, 20 bp, Artificial Sequence
  Synthetic oligonucleotide; AAG chr11 5384361 5384380 5384364 -
tttctaagacttcattttcc

SEQ ID NO: 30731 - DNA, 20 bp, Artificial Sequence
  Synthetic oligonucleotide; AAG chr11 5384348 5384367 5384351 -
attttccaagtgaaaaatct

SEQ ID NO: 30732 - DNA, 20 bp, Artificial Sequence
  Synthetic oligonucleotide; AGG chr11 5384347 5384366 5384350 -
ttttccaagtgaaaaatcta

SEQ ID NO: 30733 - DNA, 20 bp, Artificial Sequence
  Synthetic oligonucleotide; CAG chr11 5384342 5384361 5384345 -
caagtgaaaaatctaaggcc

SEQ ID NO: 30734 - DNA, 20 bp, Artificial Sequence
  Synthetic oligonucleotide; TGG chr11 5384328 5384347 5384331 -
aaggcccagactgctgtata

SEQ ID NO: 30735 - DNA, 20 bp, Artificial Sequence
  Synthetic oligonucleotide; TGG chr11 5384325 5384344 5384328 -
gcccagactgctgtatatgg

SEQ ID NO: 30736 - DNA, 20 bp, Artificial Sequence
  Synthetic oligonucleotide; TGG chr11 5384306 5384325 5384309 -
gtggttcacacttataatcc

SEQ ID NO: 30737 - DNA, 20 bp, Artificial Sequence
  Synthetic oligonucleotide; TGG chr11 5384298 5384317 5384301 -
cacttataatcctggcaact

SEQ ID NO: 30738 - DNA, 20 bp, Artificial Sequence
  Synthetic oligonucleotide; AAG chr11 5384295 5384314 5384298 -
ttataatcctggcaacttgg

SEQ ID NO: 30739 - DNA, 20 bp, Artificial Sequence
  Synthetic oligonucleotide; AAG chr11 5384289 5384308 5384292 -
tcctggcaacttggaagaat

SEQ ID NO: 30740 - DNA, 20 bp, Artificial Sequence
  Synthetic oligonucleotide; AGG chr11 5384288 5384307 5384291 -
cctggcaacttggaagaata

SEQ ID NO: 30741 - DNA, 20 bp, Artificial Sequence
  Synthetic oligonucleotide; TGG chr11 5384285 5384304 5384288 -
ggcaacttggaagaataagg

SEQ ID NO: 30742 - DNA, 20 bp, Artificial Sequence
  Synthetic oligonucleotide; GGG chr11 5384284 5384303 5384287 -
gcaacttggaagaataaggt

SEQ ID NO: 30743 - DNA, 20 bp, Artificial Sequence
  Synthetic oligonucleotide; GAG chr11 5384282 5384301 5384285 -
aacttggaagaataaggtgg

SEQ ID NO: 30744 - DNA, 20 bp, Artificial Sequence
  Synthetic oligonucleotide; AGG chr11 5384281 5384300 5384284 -
acttggaagaataaggtggg

SEQ ID NO: 30745 - DNA, 20 bp, Artificial Sequence
  Synthetic oligonucleotide; CGG chr11 5384266 5384285 5384269 -
gtgggaggattgcttgaatc

SEQ ID NO: 30746 - DNA, 20 bp, Artificial Sequence
  Synthetic oligonucleotide; GAG chr11 5384260 5384279 5384263 -
ggattgcttgaatccggttt

SEQ ID NO: 30747 - DNA, 20 bp, Artificial Sequence
  Synthetic oligonucleotide; CAG chr11 5384253 5384272 5384256 -
ttgaatccggtttgagttta

SEQ ID NO: 30748 - DNA, 20 bp, Artificial Sequence
  Synthetic oligonucleotide; GAG chr11 5384249 5384268 5384252 -
atccggtttgagtttacagt

SEQ ID NO: 30749 - DNA, 20 bp, Artificial Sequence
  Synthetic oligonucleotide; TAG chr11 5384224 5384243 5384227 -
atgattacaccactgcactg

SEQ ID NO: 30750 - DNA, 20 bp, Artificial Sequence
  Synthetic oligonucleotide; TGG chr11 5384219 5384238 5384222 -
tacaccactgcactgtagcc

SEQ ID NO: 30751 - DNA, 20 bp, Artificial Sequence
  Synthetic oligonucleotide; GGG chr11 5384218 5384237 5384221 -
acaccactgcactgtagcct

SEQ ID NO: 30752 - DNA, 20 bp, Artificial Sequence
  Synthetic oligonucleotide; CAG chr11 5384212 5384231 5384215 -
ctgcactgtagcctgggtaa

SEQ ID NO: 30753 - DNA, 20 bp, Artificial Sequence
  Synthetic oligonucleotide; GAG chr11 5384210 5384229 5384213 -
gcactgtagcctgggtaaca

SEQ ID NO: 30754 - DNA, 20 bp, Artificial Sequence
  Synthetic oligonucleotide; TAG chr11 5384206 5384225 5384209 -
tgtagcctgggtaacagagc

SEQ ID NO: 30755 - DNA, 20 bp, Artificial Sequence
  Synthetic oligonucleotide; AAG chr11 5384178 5384197 5384181 -
atttctaaaaacaacaaaca

SEQ ID NO: 30756 - DNA, 20 bp, Artificial Sequence
  Synthetic oligonucleotide; AAG chr11 5384163 5384182 5384166 -
aaacaaagaaacaacaacaa

SEQ ID NO: 30757 - DNA, 20 bp, Artificial Sequence
  Synthetic oligonucleotide; AAG chr11 5384154 5384173 5384157 -
aacaacaacaaaagaaaaca

SEQ ID NO: 30758 - DNA, 20 bp, Artificial Sequence
  Synthetic oligonucleotide; TAG chr11 5384136 5384155 5384139 -
caaagaaaaaaaaatcccat

SEQ ID NO: 30759 - DNA, 20 bp, Artificial Sequence
  Synthetic oligonucleotide; AGG chr11 5384135 5384154 5384138 -
aaagaaaaaaaaatcccatt

SEQ ID NO: 30760 - DNA, 20 bp, Artificial Sequence
  Synthetic oligonucleotide; TAG chr11 5384130 5384149 5384133 -
aaaaaaaatcccattaggct

SEQ ID NO: 30761 - DNA, 20 bp, Artificial Sequence
  Synthetic oligonucleotide; CAG chr11 5384125 5384144 5384128 -
aaatcccattaggcttagtg

SEQ ID NO: 30762 - DNA, 20 bp, Artificial Sequence
  Synthetic oligonucleotide; AGG chr11 5384124 5384143 5384127 -
aatcccattaggcttagtgc

SEQ ID NO: 30763 - DNA, 20 bp, Artificial Sequence
  Synthetic oligonucleotide; GGG chr11 5384123 5384142 5384126 -
atcccattaggcttagtgca

SEQ ID NO: 30764 - DNA, 20 bp, Artificial Sequence
  Synthetic oligonucleotide; TGG chr11 5384116 5384135 5384119 -
taggcttagtgcagggaatg

SEQ ID NO: 30765 - DNA, 20 bp, Artificial Sequence
  Synthetic oligonucleotide; GGG chr11 5384115 5384134 5384118 -
aggcttagtgcagggaatgt

SEQ ID NO: 30766 - DNA, 20 bp, Artificial Sequence
  Synthetic oligonucleotide; GGG chr11 5384114 5384133 5384117 -
ggcttagtgcagggaatgtg

SEQ ID NO: 30767 - DNA, 20 bp, Artificial Sequence
  Synthetic oligonucleotide; TGG chr11 5384103 5384122 5384106 -
gggaatgtggggaatccatt

SEQ ID NO: 30768 - DNA, 20 bp, Artificial Sequence
  Synthetic oligonucleotide; AAG chr11 5384098 5384117 5384101 -
tgtggggaatccatttggct

SEQ ID NO: 30769 - DNA, 20 bp, Artificial Sequence
  Synthetic oligonucleotide; AGG chr11 5384097 5384116 5384100 -
gtggggaatccatttggcta

SEQ ID NO: 30770 - DNA, 20 bp, Artificial Sequence
  Synthetic oligonucleotide; TGG chr11 5384081 5384100 5384084 -
gctaaggacattcaaacatt

SEQ ID NO: 30771 - DNA, 20 bp, Artificial Sequence
  Synthetic oligonucleotide; GGG chr11 5384080 5384099 5384083 -
ctaaggacattcaaacattt

SEQ ID NO: 30772 - DNA, 20 bp, Artificial Sequence
  Synthetic oligonucleotide; GGG chr11 5384079 5384098 5384082 -
taaggacattcaaacatttg

SEQ ID NO: 30773 - DNA, 20 bp, Artificial Sequence
  Synthetic oligonucleotide; GGG chr11 5384078 5384097 5384081 -
aaggacattcaaacatttgg

SEQ ID NO: 30774 - DNA, 20 bp, Artificial Sequence
  Synthetic oligonucleotide; AAG chr11 5384073 5384092 5384076 -
cattcaaacatttgggggaa

SEQ ID NO: 30775 - DNA, 20 bp, Artificial Sequence
  Synthetic oligonucleotide; GAG chr11 5384056 5384075 5384059 -
gaaaagccttaattgtaact

SEQ ID NO: 30776 - DNA, 20 bp, Artificial Sequence
  Synthetic oligonucleotide; TGG chr11 5384041 5384060 5384044 -
taactgagaccatgtctttt

SEQ ID NO: 30777 - DNA, 20 bp, Artificial Sequence
  Synthetic oligonucleotide; GGG chr11 5384040 5384059 5384043 -
aactgagaccatgtcttttt

SEQ ID NO: 30778 - DNA, 20 bp, Artificial Sequence
  Synthetic oligonucleotide; CGG chr11 5383944 5383963 5383947 -
attacccactcctgaaaccc

SEQ ID NO: 30779 - DNA, 20 bp, Artificial Sequence
  Synthetic oligonucleotide; AAG chr11 5383938 5383957 5383941 -
cactcctgaaaccccggcac

SEQ ID NO: 30780 - DNA, 20 bp, Artificial Sequence
  Synthetic oligonucleotide; CAG chr11 5383934 5383953 5383937 -
cctgaaaccccggcacaaga

SEQ ID NO: 30781 - DNA, 20 bp, Artificial Sequence
  Synthetic oligonucleotide; TAG chr11 5383931 5383950 5383934 -
gaaaccccggcacaagacag

SEQ ID NO: 30782 - DNA, 20 bp, Artificial Sequence
  Synthetic oligonucleotide; GAG chr11 5383927 5383946 5383930 -
ccccggcacaagacagtagt

SEQ ID NO: 30783 - DNA, 20 bp, Artificial Sequence
  Synthetic oligonucleotide; CAG chr11 5383918 5383937 5383921 -
aagacagtagtgagactcac

SEQ ID NO: 30784 - DNA, 20 bp, Artificial Sequence
  Synthetic oligonucleotide; CAG chr11 5383915 5383934 5383918 -
acagtagtgagactcaccag

SEQ ID NO: 30785 - DNA, 20 bp, Artificial Sequence
  Synthetic oligonucleotide; AGG chr11 5383914 5383933 5383917 -
cagtagtgagactcaccagc

SEQ ID NO: 30786 - DNA, 20 bp, Artificial Sequence
  Synthetic oligonucleotide; AAG chr11 5383895 5383914 5383898 -
caggtaataacaaaaatgtg

SEQ ID NO: 30787 - DNA, 20 bp, Artificial Sequence
  Synthetic oligonucleotide; GAG chr11 5383887 5383906 5383890 -
aacaaaaatgtgaagccaat

SEQ ID NO: 30788 - DNA, 20 bp, Artificial Sequence
  Synthetic oligonucleotide; TAG chr11 5383884 5383903 5383887 -
aaaaatgtgaagccaatgag

SEQ ID NO: 30789 - DNA, 20 bp, Artificial Sequence
  Synthetic oligonucleotide; AGG chr11 5383883 5383902 5383886 -
aaaatgtgaagccaatgagt

SEQ ID NO: 30790 - DNA, 20 bp, Artificial Sequence
  Synthetic oligonucleotide; AAG chr11 5383875 5383894 5383878 -
aagccaatgagtaggttcca

SEQ ID NO: 30791 - DNA, 20 bp, Artificial Sequence
  Synthetic oligonucleotide; AGG chr11 5383874 5383893 5383877 -
agccaatgagtaggttccaa

SEQ ID NO: 30792 - DNA, 20 bp, Artificial Sequence
  Synthetic oligonucleotide; AAG chr11 5383871 5383890 5383874 -
caatgagtaggttccaaagg

SEQ ID NO: 30793 - DNA, 20 bp, Artificial Sequence
  Synthetic oligonucleotide; AAG chr11 5383867 5383886 5383870 -
gagtaggttccaaaggaaga

SEQ ID NO: 30794 - DNA, 20 bp, Artificial Sequence
  Synthetic oligonucleotide; AAG chr11 5383864 5383883 5383867 -
taggttccaaaggaagaaag

SEQ ID NO: 30795 - DNA, 20 bp, Artificial Sequence
  Synthetic oligonucleotide; GAG chr11 5383862 5383881 5383865 -
ggttccaaaggaagaaagaa

SEQ ID NO: 30796 - DNA, 20 bp, Artificial Sequence
  Synthetic oligonucleotide; TAG chr11 5383857 5383876 5383860 -
caaaggaagaaagaagagta

SEQ ID NO: 30797 - DNA, 20 bp, Artificial Sequence
  Synthetic oligonucleotide; AAG chr11 5383852 5383871 5383855 -
gaagaaagaagagtatagat

SEQ ID NO: 30798 - DNA, 20 bp, Artificial Sequence
  Synthetic oligonucleotide; AGG chr11 5383851 5383870 5383854 -
aagaaagaagagtatagata

SEQ ID NO: 30799 - DNA, 20 bp, Artificial Sequence
  Synthetic oligonucleotide; AAG chr11 5383841 5383860 5383844 -
agtatagataaggatgacac

SEQ ID NO: 30800 - DNA, 20 bp, Artificial Sequence
  Synthetic oligonucleotide; AGG chr11 5383840 5383859 5383843 -
gtatagataaggatgacaca

SEQ ID NO: 30801 - DNA, 20 bp, Artificial Sequence
  Synthetic oligonucleotide; GGG chr11 5383839 5383858 5383842 -
tatagataaggatgacacaa

SEQ ID NO: 30802 - DNA, 20 bp, Artificial Sequence
  Synthetic oligonucleotide; GAG chr11 5383831 5383850 5383834 -
aggatgacacaagggtcact

SEQ ID NO: 30803 - DNA, 20 bp, Artificial Sequence
  Synthetic oligonucleotide; GAG chr11 5383829 5383848 5383832 -
gatgacacaagggtcactga

SEQ ID NO: 30804 - DNA, 20 bp, Artificial Sequence
  Synthetic oligonucleotide; AGG chr11 5383828 5383847 5383831 -
atgacacaagggtcactgag

SEQ ID NO: 30805 - DNA, 20 bp, Artificial Sequence
  Synthetic oligonucleotide; AAG chr11 5383822 5383841 5383825 -
caagggtcactgagaggcac

SEQ ID NO: 30806 - DNA, 20 bp, Artificial Sequence
  Synthetic oligonucleotide; AGG chr11 5383821 5383840 5383824 -
aagggtcactgagaggcaca

SEQ ID NO: 30807 - DNA, 20 bp, Artificial Sequence
  Synthetic oligonucleotide; TGG chr11 5383815 5383834 5383818 -
cactgagaggcacaaggctg

SEQ ID NO: 30808 - DNA, 20 bp, Artificial Sequence
  Synthetic oligonucleotide; CAG chr11 5383806 5383825 5383809 -
gcacaaggctgtggctgtca

SEQ ID NO: 30809 - DNA, 20 bp, Artificial Sequence
  Synthetic oligonucleotide; AAG chr11 5383803 5383822 5383806 -
caaggctgtggctgtcacag

SEQ ID NO: 30810 - DNA, 20 bp, Artificial Sequence
  Synthetic oligonucleotide; AGG chr11 5383802 5383821 5383805 -
aaggctgtggctgtcacaga

SEQ ID NO: 30811 - DNA, 20 bp, Artificial Sequence
  Synthetic oligonucleotide; AAG chr11 5383786 5383805 5383789 -
cagaaggatttatcctccta

SEQ ID NO: 30812 - DNA, 20 bp, Artificial Sequence
  Synthetic oligonucleotide; TGG chr11 5383779 5383798 5383782 -
atttatcctcctaaagacca

SEQ ID NO: 30813 - DNA, 20 bp, Artificial Sequence
  Synthetic oligonucleotide; CAG chr11 5383773 5383792 5383776 -
cctcctaaagaccatggctc

SEQ ID NO: 30814 - DNA, 20 bp, Artificial Sequence
  Synthetic oligonucleotide; TGG chr11 5383769 5383788 5383772 -
ctaaagaccatggctccagc

SEQ ID NO: 30815 - DNA, 20 bp, Artificial Sequence
  Synthetic oligonucleotide; GGG chr11 5383768 5383787 5383771 -
taaagaccatggctccagct

SEQ ID NO: 30816 - DNA, 20 bp, Artificial Sequence
  Synthetic oligonucleotide; GAG chr11 5383766 5383785 5383769 -
aagaccatggctccagctgg

SEQ ID NO: 30817 - DNA, 20 bp, Artificial Sequence
  Synthetic oligonucleotide; TGG chr11 5383756 5383775 5383759 -
ctccagctgggagaacttaa

SEQ ID NO: 30818 - DNA, 20 bp, Artificial Sequence
  Synthetic oligonucleotide; AAG chr11 5383747 5383766 5383750 -
ggagaacttaatggtaaaca

SEQ ID NO: 30819 - DNA, 20 bp, Artificial Sequence
  Synthetic oligonucleotide; AGG chr11 5383746 5383765 5383749 -
gagaacttaatggtaaacaa

SEQ ID NO: 30820 - DNA, 20 bp, Artificial Sequence
  Synthetic oligonucleotide; GGG chr11 5383745 5383764 5383748 -
agaacttaatggtaaacaaa

SEQ ID NO: 30821 - DNA, 20 bp, Artificial Sequence
  Synthetic oligonucleotide; CAG chr11 5383738 5383757 5383741 -
aatggtaaacaaagggtccc

SEQ ID NO: 30822 - DNA, 20 bp, Artificial Sequence
  Synthetic oligonucleotide; AGG chr11 5383737 5383756 5383740 -
atggtaaacaaagggtcccc

SEQ ID NO: 30823 - DNA, 20 bp, Artificial Sequence
  Synthetic oligonucleotide; GGG chr11 5383736 5383755 5383739 -
tggtaaacaaagggtcccca

SEQ ID NO: 30824 - DNA, 20 bp, Artificial Sequence
  Synthetic oligonucleotide; TGG chr11 5383732 5383751 5383735 -
aaacaaagggtccccagggc

SEQ ID NO: 30825 - DNA, 20 bp, Artificial Sequence
  Synthetic oligonucleotide; GGG chr11 5383731 5383750 5383734 -
aacaaagggtccccagggct

SEQ ID NO: 30826 - DNA, 20 bp, Artificial Sequence
  Synthetic oligonucleotide; TGG chr11 5383721 5383740 5383724 -
ccccagggctgggaatccta

SEQ ID NO: 30827 - DNA, 20 bp, Artificial Sequence
  Synthetic oligonucleotide; GGG chr11 5383720 5383739 5383723 -
cccagggctgggaatcctat

SEQ ID NO: 30828 - DNA, 20 bp, Artificial Sequence
  Synthetic oligonucleotide; CAG chr11 5383717 5383736 5383720 -
agggctgggaatcctatggg

SEQ ID NO: 30829 - DNA, 20 bp, Artificial Sequence
  Synthetic oligonucleotide; AGG chr11 5383716 5383735 5383719 -
gggctgggaatcctatgggc

SEQ ID NO: 30830 - DNA, 20 bp, Artificial Sequence
  Synthetic oligonucleotide; AAG chr11 5383682 5383701 5383685 -
atctccacccctgtctcctg

SEQ ID NO: 30831 - DNA, 20 bp, Artificial Sequence
  Synthetic oligonucleotide; AAG chr11 5383676 5383695 5383679 -
acccctgtctcctgaagctg

SEQ ID NO: 30832 - DNA, 20 bp, Artificial Sequence
  Synthetic oligonucleotide; GAG chr11 5383674 5383693 5383677 -
ccctgtctcctgaagctgaa

SEQ ID NO: 30833 - DNA, 20 bp, Artificial Sequence
  Synthetic oligonucleotide; TAG chr11 5383660 5383679 5383663 -
gctgaagagccctaactttt

SEQ ID NO: 30834 - DNA, 20 bp, Artificial Sequence
  Synthetic oligonucleotide; CAG chr11 5383653 5383672 5383656 -
agccctaactttttagcatt

SEQ ID NO: 30835 - DNA, 20 bp, Artificial Sequence
  Synthetic oligonucleotide; CAG chr11 5383646 5383665 5383649 -
actttttagcattcagtccc

SEQ ID NO: 30836 - DNA, 20 bp, Artificial Sequence
  Synthetic oligonucleotide; AGG chr11 5383645 5383664 5383648 -
ctttttagcattcagtcccc

SEQ ID NO: 30837 - DNA, 20 bp, Artificial Sequence
  Synthetic oligonucleotide; TGG chr11 5383639 5383658 5383642 -
agcattcagtccccaggttt

SEQ ID NO: 30838 - DNA, 20 bp, Artificial Sequence
  Synthetic oligonucleotide; CAG chr11 5383631 5383650 5383634 -
gtccccaggttttggctaca

SEQ ID NO: 30839 - DNA, 20 bp, Artificial Sequence
  Synthetic oligonucleotide; AAG chr11 5383612 5383631 5383615 -
acagacatctgctgcaacaa

SEQ ID NO: 30840 - DNA, 20 bp, Artificial Sequence
  Synthetic oligonucleotide; AAG chr11 5383574 5383593 5383577 -
tgtttatttttaatttcata

SEQ ID NO: 30841 - DNA, 20 bp, Artificial Sequence
  Synthetic oligonucleotide; AAG chr11 5383571 5383590 5383574 -
ttatttttaatttcataaag

SEQ ID NO: 30842 - DNA, 20 bp, Artificial Sequence
  Synthetic oligonucleotide; TAG chr11 5383521 5383540 5383524 -
tactgtcttctgttatccac

SEQ ID NO: 30843 - DNA, 20 bp, Artificial Sequence
  Synthetic oligonucleotide; TGG chr11 5383515 5383534 5383518 -
cttctgttatccactagtaa

SEQ ID NO: 30844 - DNA, 20 bp, Artificial Sequence
  Synthetic oligonucleotide; CAG chr11 5383499 5383518 5383502 -
gtaatggacccgtcgttttc

SEQ ID NO: 30845 - DNA, 20 bp, Artificial Sequence
  Synthetic oligonucleotide; GAG chr11 5383497 5383516 5383500 -
aatggacccgtcgttttcca

SEQ ID NO: 30846 - DNA, 20 bp, Artificial Sequence
  Synthetic oligonucleotide; GAG chr11 5383495 5383514 5383498 -
tggacccgtcgttttccaga

SEQ ID NO: 30847 - DNA, 20 bp, Artificial Sequence
  Synthetic oligonucleotide; AGG chr11 5383494 5383513 5383497 -
ggacccgtcgttttccagag

SEQ ID NO: 30848 - DNA, 20 bp, Artificial Sequence
  Synthetic oligonucleotide; CGG chr11 5383490 5383509 5383493 -
ccgtcgttttccagagaggt

SEQ ID NO: 30849 - DNA, 20 bp, Artificial Sequence
  Synthetic oligonucleotide; TAG chr11 5383484 5383503 5383487 -
ttttccagagaggtcggatg

SEQ ID NO: 30850 - DNA, 20 bp, Artificial Sequence
  Synthetic oligonucleotide; AAG chr11 5383475 5383494 5383478 -
gaggtcggatgtagtatatg

SEQ ID NO: 30851 - DNA, 20 bp, Artificial Sequence
  Synthetic oligonucleotide; GAG chr11 5383473 5383492 5383476 -
ggtcggatgtagtatatgaa

SEQ ID NO: 30852 - DNA, 20 bp, Artificial Sequence
  Synthetic oligonucleotide; AGG chr11 5383472 5383491 5383475 -
gtcggatgtagtatatgaag

SEQ ID NO: 30853 - DNA, 20 bp, Artificial Sequence
  Synthetic oligonucleotide; CAG chr11 5383450 5383469 5383453 -
gattatccatgtgatgttca

SEQ ID NO: 30854 - DNA, 20 bp, Artificial Sequence
  Synthetic oligonucleotide; TGG chr11 5383447 5383466 5383450 -
tatccatgtgatgttcacag

SEQ ID NO: 30855 - DNA, 20 bp, Artificial Sequence
  Synthetic oligonucleotide; AAG chr11 5383420 5383439 5383423 -
taaattgcacatctgccttg

SEQ ID NO: 30856 - DNA, 20 bp, Artificial Sequence
  Synthetic oligonucleotide; AAG chr11 5383396 5383415 5383399 -
accacaatcaccactacttc

SEQ ID NO: 30857 - DNA, 20 bp, Artificial Sequence
  Synthetic oligonucleotide; CAG chr11 5383339 5383358 5383342 -
ttttatatttccatttactg

SEQ ID NO: 30858 - DNA, 20 bp, Artificial Sequence
  Synthetic oligonucleotide; CAG chr11 5383310 5383329 5383313 -
aaattgccctccatctctgc

SEQ ID NO: 30859 - DNA, 20 bp, Artificial Sequence
  Synthetic oligonucleotide; TGG chr11 5383295 5383314 5383298 -
tctgccagcctctatatctt

SEQ ID NO: 30860 - DNA, 20 bp, Artificial Sequence
  Synthetic oligonucleotide; TAG chr11 5383289 5383308 5383292 -
agcctctatatctttggacc

SEQ ID NO: 30861 - DNA, 20 bp, Artificial Sequence
  Synthetic oligonucleotide; AAG chr11 5383286 5383305 5383289 -
ctctatatctttggacctag

SEQ ID NO: 30862 - DNA, 20 bp, Artificial Sequence
  Synthetic oligonucleotide; CAG chr11 5383245 5383264 5383248 -
tcctaccccaaacaaatgtc

SEQ ID NO: 30863 - DNA, 20 bp, Artificial Sequence
  Synthetic oligonucleotide; AGG chr11 5383244 5383263 5383247 -
cctaccccaaacaaatgtcc

SEQ ID NO: 30864 - DNA, 20 bp, Artificial Sequence
  Synthetic oligonucleotide; CAG chr11 5383240 5383259 5383243 -
ccccaaacaaatgtccaggt

SEQ ID NO: 30865 - DNA, 20 bp, Artificial Sequence
  Synthetic oligonucleotide; CAG chr11 5383232 5383251 5383235 -
aaatgtccaggtcagtgtct

SEQ ID NO: 30866 - DNA, 20 bp, Artificial Sequence
  Synthetic oligonucleotide; AGG chr11 5383231 5383250 5383234 -
aatgtccaggtcagtgtctc

SEQ ID NO: 30867 - DNA, 20 bp, Artificial Sequence
  Synthetic oligonucleotide; AAG chr11 5383220 5383239 5383223 -
cagtgtctcaggctttccca

SEQ ID NO: 30868 - DNA, 20 bp, Artificial Sequence
  Synthetic oligonucleotide; TGG chr11 5383192 5383211 5383195 -
tacttcatctttgaatgcac

SEQ ID NO: 30869 - DNA, 20 bp, Artificial Sequence
  Synthetic oligonucleotide; GAG chr11 5383176 5383195 5383179 -
gcactggactttccttcaat

SEQ ID NO: 30870 - DNA, 20 bp, Artificial Sequence
  Synthetic oligonucleotide; AAG chr11 5383164 5383183 5383167 -
ccttcaatgagccctacaac

SEQ ID NO: 30871 - DNA, 20 bp, Artificial Sequence
  Synthetic oligonucleotide; TAG chr11 5383161 5383180 5383164 -
tcaatgagccctacaacaag

SEQ ID NO: 30872 - DNA, 20 bp, Artificial Sequence
  Synthetic oligonucleotide; TGG chr11 5383130 5383149 5383133 -
aaacttttttccttcttttc

SEQ ID NO: 30873 - DNA, 20 bp, Artificial Sequence
  Synthetic oligonucleotide; TAG chr11 5383127 5383146 5383130 -
cttttttccttcttttctgg

SEQ ID NO: 30874 - DNA, 20 bp, Artificial Sequence
  Synthetic oligonucleotide; TAG chr11 5383107 5383126 5383110 -
tagcaaatgccatcaacatt

SEQ ID NO: 30875 - DNA, 20 bp, Artificial Sequence
  Synthetic oligonucleotide; TAG chr11 5383093 5383112 5383096 -
aacatttagaaaaaaaaaaa

SEQ ID NO: 30876 - DNA, 20 bp, Artificial Sequence
  Synthetic oligonucleotide; CAG chr11 5383074 5383093 5383077 -
atagtcttgtacttcttccc

SEQ ID NO: 30877 - DNA, 20 bp, Artificial Sequence
  Synthetic oligonucleotide; CAG chr11 5383062 5383081 5383065 -
ttcttccccagactatgcta

SEQ ID NO: 30878 - DNA, 20 bp, Artificial Sequence
  Synthetic oligonucleotide; GAG chr11 5383054 5383073 5383057 -
cagactatgctacagaacct

SEQ ID NO: 30879 - DNA, 20 bp, Artificial Sequence
  Synthetic oligonucleotide; CAG chr11 5383041 5383060 5383044 -
agaacctgagttaatgtgat

SEQ ID NO: 30880 - DNA, 20 bp, Artificial Sequence
  Synthetic oligonucleotide; AGG chr11 5383040 5383059 5383043 -
gaacctgagttaatgtgatc

SEQ ID NO: 30881 - DNA, 20 bp, Artificial Sequence
  Synthetic oligonucleotide; TGG chr11 5382967 5382986 5382970 -
cacaaacacacacacactct

SEQ ID NO: 30882 - DNA, 20 bp, Artificial Sequence
  Synthetic oligonucleotide; GAG chr11 5382965 5382984 5382968 -
caaacacacacacactcttg

SEQ ID NO: 30883 - DNA, 20 bp, Artificial Sequence
  Synthetic oligonucleotide; TGG chr11 5382960 5382979 5382963 -
acacacacactcttggagac

SEQ ID NO: 30884 - DNA, 20 bp, Artificial Sequence
  Synthetic oligonucleotide; AAG chr11 5382953 5382972 5382956 -
cactcttggagactggcatg

SEQ ID NO: 30885 - DNA, 20 bp, Artificial Sequence
  Synthetic oligonucleotide; AAG chr11 5382949 5382968 5382952 -
cttggagactggcatgaagc

SEQ ID NO: 30886 - DNA, 20 bp, Artificial Sequence
  Synthetic oligonucleotide; AGG chr11 5382948 5382967 5382951 -
ttggagactggcatgaagca

SEQ ID NO: 30887 - DNA, 20 bp, Artificial Sequence
  Synthetic oligonucleotide; TAG chr11 5382929 5382948 5382932 -
aaggtattacatcctttaaa

SEQ ID NO: 30888 - DNA, 20 bp, Artificial Sequence
  Synthetic oligonucleotide; AGG chr11 5382928 5382947 5382931 -
aggtattacatcctttaaat

SEQ ID NO: 30889 - DNA, 20 bp, Artificial Sequence
  Synthetic oligonucleotide; GGG chr11 5382927 5382946 5382930 -
ggtattacatcctttaaata

SEQ ID NO: 30890 - DNA, 20 bp, Artificial Sequence
  Synthetic oligonucleotide; TGG chr11 5382922 5382941 5382925 -
tacatcctttaaatagggca

SEQ ID NO: 30891 - DNA, 20 bp, Artificial Sequence
  Synthetic oligonucleotide; TAG chr11 5382914 5382933 5382917 -
ttaaatagggcatggttgat

SEQ ID NO: 30892 - DNA, 20 bp, Artificial Sequence
  Synthetic oligonucleotide; GAG chr11 5382912 5382931 5382915 -
aaatagggcatggttgatta

SEQ ID NO: 30893 - DNA, 20 bp, Artificial Sequence
  Synthetic oligonucleotide; TGG chr11 5382904 5382923 5382907 -
catggttgattagagttgtg

SEQ ID NO: 30894 - DNA, 20 bp, Artificial Sequence
  Synthetic oligonucleotide; GGG chr11 5382903 5382922 5382906 -
atggttgattagagttgtgt

SEQ ID NO: 30895 - DNA, 20 bp, Artificial Sequence
  Synthetic oligonucleotide; GGG chr11 5382902 5382921 5382905 -
tggttgattagagttgtgtg

SEQ ID NO: 30896 - DNA, 20 bp, Artificial Sequence
  Synthetic oligonucleotide; GAG chr11 5382897 5382916 5382900 -
gattagagttgtgtggggat

SEQ ID NO: 30897 - DNA, 20 bp, Artificial Sequence
  Synthetic oligonucleotide; CGG chr11 5382886 5382905 5382889 -
tgtggggatgagctccaaaa

SEQ ID NO: 30898 - DNA, 20 bp, Artificial Sequence
  Synthetic oligonucleotide; GGG chr11 5382885 5382904 5382888 -
gtggggatgagctccaaaac

SEQ ID NO: 30899 - DNA, 20 bp, Artificial Sequence
  Synthetic oligonucleotide; GGG chr11 5382884 5382903 5382887 -
tggggatgagctccaaaacg

SEQ ID NO: 30900 - DNA, 20 bp, Artificial Sequence
  Synthetic oligonucleotide; CAG chr11 5382877 5382896 5382880 -
gagctccaaaacggggcata

SEQ ID NO: 30901 - DNA, 20 bp, Artificial Sequence
  Synthetic oligonucleotide; CAG chr11 5382865 5382884 5382868 -
ggggcatacagatctaaaac

SEQ ID NO: 30902 - DNA, 20 bp, Artificial Sequence
  Synthetic oligonucleotide; AGG chr11 5382864 5382883 5382867 -
gggcatacagatctaaaacc

SEQ ID NO: 30903 - DNA, 20 bp, Artificial Sequence
  Synthetic oligonucleotide; CAG chr11 5382860 5382879 5382863 -
atacagatctaaaaccagga

SEQ ID NO: 30904 - DNA, 20 bp, Artificial Sequence
  Synthetic oligonucleotide; GAG chr11 5382858 5382877 5382861 -
acagatctaaaaccaggaca

SEQ ID NO: 30905 - DNA, 20 bp, Artificial Sequence
  Synthetic oligonucleotide; AAG chr11 5382848 5382867 5382851 -
aaccaggacagagacccatg

SEQ ID NO: 30906 - DNA, 20 bp, Artificial Sequence
  Synthetic oligonucleotide; CAG chr11 5382824 5382843 5382827 -
ttatgacatgccattgtgat

SEQ ID NO: 30907 - DNA, 20 bp, Artificial Sequence
  Synthetic oligonucleotide; CAG chr11 5382813 5382832 5382816 -
cattgtgatcagaccacacc

SEQ ID NO: 30908 - DNA, 20 bp, Artificial Sequence
  Synthetic oligonucleotide; CAG chr11 5382809 5382828 5382812 -
gtgatcagaccacacccaga

SEQ ID NO: 30909 - DNA, 20 bp, Artificial Sequence
  Synthetic oligonucleotide; AAG chr11 5382806 5382825 5382809 -
atcagaccacacccagacag

SEQ ID NO: 30910 - DNA, 20 bp, Artificial Sequence
  Synthetic oligonucleotide; TGG chr11 5382803 5382822 5382806 -
agaccacacccagacagaag

SEQ ID NO: 30911 - DNA, 20 bp, Artificial Sequence
  Synthetic oligonucleotide; CGG chr11 5382787 5382806 5382790 -
gaagtggcaccaccttacac

SEQ ID NO: 30912 - DNA, 20 bp, Artificial Sequence
  Synthetic oligonucleotide; GGG chr11 5382786 5382805 5382789 -
aagtggcaccaccttacacc

SEQ ID NO: 30913 - DNA, 20 bp, Artificial Sequence
  Synthetic oligonucleotide; AAG chr11 5382782 5382801 5382785 -
ggcaccaccttacaccgggt

SEQ ID NO: 30914 - DNA, 20 bp, Artificial Sequence
  Synthetic oligonucleotide; TGG chr11 5382775 5382794 5382778 -
ccttacaccgggtaagtaac

SEQ ID NO: 30915 - DNA, 20 bp, Artificial Sequence
  Synthetic oligonucleotide; TAG chr11 5382768 5382787 5382771 -
ccgggtaagtaactggttgt

SEQ ID NO: 30916 - DNA, 20 bp, Artificial Sequence
  Synthetic oligonucleotide; AGG chr11 5382767 5382786 5382770 -
cgggtaagtaactggttgtt

SEQ ID NO: 30917 - DNA, 20 bp, Artificial Sequence
  Synthetic oligonucleotide; GGG chr11 5382766 5382785 5382769 -
gggtaagtaactggttgtta

SEQ ID NO: 30918 - DNA, 20 bp, Artificial Sequence
  Synthetic oligonucleotide; CAG chr11 5382762 5382781 5382765 -
aagtaactggttgttagggc

SEQ ID NO: 30919 - DNA, 20 bp, Artificial Sequence
  Synthetic oligonucleotide; GAG chr11 5382760 5382779 5382763 -
gtaactggttgttagggcca

SEQ ID NO: 30920 - DNA, 20 bp, Artificial Sequence
  Synthetic oligonucleotide; TAG chr11 5382755 5382774 5382758 -
tggttgttagggccagagtg

SEQ ID NO: 30921 - DNA, 20 bp, Artificial Sequence
  Synthetic oligonucleotide; AGG chr11 5382754 5382773 5382757 -
ggttgttagggccagagtgt

SEQ ID NO: 30922 - DNA, 20 bp, Artificial Sequence
  Synthetic oligonucleotide; GAG chr11 5382752 5382771 5382755 -
ttgttagggccagagtgtag

SEQ ID NO: 30923 - DNA, 20 bp, Artificial Sequence
  Synthetic oligonucleotide; GAG chr11 5382750 5382769 5382753 -
gttagggccagagtgtagga

SEQ ID NO: 30924 - DNA, 20 bp, Artificial Sequence
  Synthetic oligonucleotide; CAG chr11 5382746 5382765 5382749 -
gggccagagtgtaggagagt

SEQ ID NO: 30925 - DNA, 20 bp, Artificial Sequence
  Synthetic oligonucleotide; AGG chr11 5382745 5382764 5382748 -
ggccagagtgtaggagagtc

SEQ ID NO: 30926 - DNA, 20 bp, Artificial Sequence
  Synthetic oligonucleotide; GGG chr11 5382744 5382763 5382747 -
gccagagtgtaggagagtca

SEQ ID NO: 30927 - DNA, 20 bp, Artificial Sequence
  Synthetic oligonucleotide; TAG chr11 5382738 5382757 5382741 -
gtgtaggagagtcagggtga

SEQ ID NO: 30928 - DNA, 20 bp, Artificial Sequence
  Synthetic oligonucleotide; AGG chr11 5382737 5382756 5382740 -
tgtaggagagtcagggtgat

SEQ ID NO: 30929 - DNA, 20 bp, Artificial Sequence
  Synthetic oligonucleotide; AAG chr11 5382732 5382751 5382735 -
gagagtcagggtgataggac

SEQ ID NO: 30930 - DNA, 20 bp, Artificial Sequence
  Synthetic oligonucleotide; CAG chr11 5382726 5382745 5382729 -
cagggtgataggacaagatg

SEQ ID NO: 30931 - DNA, 20 bp, Artificial Sequence
  Synthetic oligonucleotide; GAG chr11 5382724 5382743 5382727 -
gggtgataggacaagatgca

SEQ ID NO: 30932 - DNA, 20 bp, Artificial Sequence
  Synthetic oligonucleotide; GAG chr11 5382722 5382741 5382725 -
gtgataggacaagatgcaga

SEQ ID NO: 30933 - DNA, 20 bp, Artificial Sequence
  Synthetic oligonucleotide; CAG chr11 5382719 5382738 5382722 -
ataggacaagatgcagagag

SEQ ID NO: 30934 - DNA, 20 bp, Artificial Sequence
  Synthetic oligonucleotide; AGG chr11 5382718 5382737 5382721 -
taggacaagatgcagagagc

SEQ ID NO: 30935 - DNA, 20 bp, Artificial Sequence
  Synthetic oligonucleotide; TAG chr11 5382699 5382718 5382702 -
caggatgtcttattaaattg

SEQ ID NO: 30936 - DNA, 20 bp, Artificial Sequence
  Synthetic oligonucleotide; GAG chr11 5382692 5382711 5382695 -
tcttattaaattgtagttat

SEQ ID NO: 30937 - DNA, 20 bp, Artificial Sequence
  Synthetic oligonucleotide; AGG chr11 5382691 5382710 5382694 -
cttattaaattgtagttatg

SEQ ID NO: 30938 - DNA, 20 bp, Artificial Sequence
  Synthetic oligonucleotide; AAG chr11 5382688 5382707 5382691 -
attaaattgtagttatgagg

SEQ ID NO: 30939 - DNA, 20 bp, Artificial Sequence
  Synthetic oligonucleotide; AGG chr11 5382687 5382706 5382690 -
ttaaattgtagttatgagga

SEQ ID NO: 30940 - DNA, 20 bp, Artificial Sequence
  Synthetic oligonucleotide; TGG chr11 5382681 5382700 5382684 -
tgtagttatgaggaaggttc

SEQ ID NO: 30941 - DNA, 20 bp, Artificial Sequence
  Synthetic oligonucleotide; CGG chr11 5382675 5382694 5382678 -
tatgaggaaggttctggctt

SEQ ID NO: 30942 - DNA, 20 bp, Artificial Sequence
  Synthetic oligonucleotide; TAG chr11 5382667 5382686 5382670 -
aggttctggcttcggtacaa

SEQ ID NO: 30943 - DNA, 20 bp, Artificial Sequence
  Synthetic oligonucleotide; AGG chr11 5382666 5382685 5382669 -
ggttctggcttcggtacaat

SEQ ID NO: 30944 - DNA, 20 bp, Artificial Sequence
  Synthetic oligonucleotide; AAG chr11 5382663 5382682 5382666 -
tctggcttcggtacaatagg

SEQ ID NO: 30945 - DNA, 20 bp, Artificial Sequence
  Synthetic oligonucleotide; AGG chr11 5382662 5382681 5382665 -
ctggcttcggtacaatagga

SEQ ID NO: 30946 - DNA, 20 bp, Artificial Sequence
  Synthetic oligonucleotide; GAG chr11 5382660 5382679 5382663 -
ggcttcggtacaataggaag

SEQ ID NO: 30947 - DNA, 20 bp, Artificial Sequence
  Synthetic oligonucleotide; GAG chr11 5382655 5382674 5382658 -
cggtacaataggaaggagct

SEQ ID NO: 30948 - DNA, 20 bp, Artificial Sequence
  Synthetic oligonucleotide; TAG chr11 5382642 5382661 5382645 -
aggagctgagcatcttcatt

SEQ ID NO: 30949 - DNA, 20 bp, Artificial Sequence
  Synthetic oligonucleotide; AGG chr11 5382641 5382660 5382644 -
ggagctgagcatcttcattt

SEQ ID NO: 30950 - DNA, 20 bp, Artificial Sequence
  Synthetic oligonucleotide; TAG chr11 5382634 5382653 5382637 -
agcatcttcatttaggcttg

SEQ ID NO: 30951 - DNA, 20 bp, Artificial Sequence
  Synthetic oligonucleotide; AGG chr11 5382633 5382652 5382636 -
gcatcttcatttaggcttgt

SEQ ID NO: 30952 - DNA, 20 bp, Artificial Sequence
  Synthetic oligonucleotide; GAG chr11 5382631 5382650 5382634 -
atcttcatttaggcttgtag

SEQ ID NO: 30953 - DNA, 20 bp, Artificial Sequence
  Synthetic oligonucleotide; GAG chr11 5382629 5382648 5382632 -
cttcatttaggcttgtagga

SEQ ID NO: 30954 - DNA, 20 bp, Artificial Sequence
  Synthetic oligonucleotide; AGG chr11 5382628 5382647 5382631 -
ttcatttaggcttgtaggag

SEQ ID NO: 30955 - DNA, 20 bp, Artificial Sequence
  Synthetic oligonucleotide; GGG chr11 5382627 5382646 5382630 -
tcatttaggcttgtaggaga

SEQ ID NO: 30956 - DNA, 20 bp, Artificial Sequence
  Synthetic oligonucleotide; CAG chr11 5382615 5382634 5382618 -
gtaggagagggcaccactac

SEQ ID NO: 30957 - DNA, 20 bp, Artificial Sequence
  Synthetic oligonucleotide; CAG chr11 5382604 5382623 5382607 -
caccactaccagaaaaattt

SEQ ID NO: 30958 - DNA, 20 bp, Artificial Sequence
  Synthetic oligonucleotide; AAG chr11 5382584 5382603 5382587 -
cagaaaatcctgcatttatt

SEQ ID NO: 30959 - DNA, 20 bp, Artificial Sequence
  Synthetic oligonucleotide; TAG chr11 5382571 5382590 5382574 -
atttattaagaacatgattt

SEQ ID NO: 30960 - DNA, 20 bp, Artificial Sequence
  Synthetic oligonucleotide; TGG chr11 5382558 5382577 5382561 -
atgattttagcctatttcac

SEQ ID NO: 30961 - DNA, 20 bp, Artificial Sequence
  Synthetic oligonucleotide; GGG chr11 5382557 5382576 5382560 -
tgattttagcctatttcact

SEQ ID NO: 30962 - DNA, 20 bp, Artificial Sequence
  Synthetic oligonucleotide; TAG chr11 5382550 5382569 5382553 -
agcctatttcactgggatcc

SEQ ID NO: 30963 - DNA, 20 bp, Artificial Sequence
  Synthetic oligonucleotide; AAG chr11 5382545 5382564 5382548 -
atttcactgggatcctagcc

SEQ ID NO: 30964 - DNA, 20 bp, Artificial Sequence
  Synthetic oligonucleotide; AGG chr11 5382544 5382563 5382547 -
tttcactgggatcctagcca

SEQ ID NO: 30965 - DNA, 20 bp, Artificial Sequence
  Synthetic oligonucleotide; CAG chr11 5382540 5382559 5382543 -
actgggatcctagccaagga

SEQ ID NO: 30966 - DNA, 20 bp, Artificial Sequence
  Synthetic oligonucleotide; CAG chr11 5382532 5382551 5382535 -
cctagccaaggacagtataa

SEQ ID NO: 30967 - DNA, 20 bp, Artificial Sequence
  Synthetic oligonucleotide; CAG chr11 5382508 5382527 5382511 -
aacaatgctgctattattac

SEQ ID NO: 30968 - DNA, 20 bp, Artificial Sequence
  Synthetic oligonucleotide; CAG chr11 5382502 5382521 5382505 -
gctgctattattaccagcaa

SEQ ID NO: 30969 - DNA, 20 bp, Artificial Sequence
  Synthetic oligonucleotide; CAG chr11 5382482 5382501 5382485 -
cagcaaatattgctattatt

SEQ ID NO: 30970 - DNA, 20 bp, Artificial Sequence
  Synthetic oligonucleotide; AGG chr11 5382481 5382500 5382484 -
agcaaatattgctattattc

SEQ ID NO: 30971 - DNA, 20 bp, Artificial Sequence
  Synthetic oligonucleotide; GGG chr11 5382480 5382499 5382483 -
gcaaatattgctattattca

SEQ ID NO: 30972 - DNA, 20 bp, Artificial Sequence
  Synthetic oligonucleotide; GGG chr11 5382479 5382498 5382482 -
caaatattgctattattcag

SEQ ID NO: 30973 - DNA, 20 bp, Artificial Sequence
  Synthetic oligonucleotide; AAG chr11 5382462 5382481 5382465 -
caggggcatctatcacacat

SEQ ID NO: 30974 - DNA, 20 bp, Artificial Sequence
  Synthetic oligonucleotide; TAG chr11 5382458 5382477 5382461 -
ggcatctatcacacataaga

SEQ ID NO: 30975 - DNA, 20 bp, Artificial Sequence
  Synthetic oligonucleotide; AGG chr11 5382457 5382476 5382460 -
gcatctatcacacataagat

SEQ ID NO: 30976 - DNA, 20 bp, Artificial Sequence
  Synthetic oligonucleotide; TAG chr11 5382441 5382460 5382444 -
agataggaaaacaactatct

SEQ ID NO: 30977 - DNA, 20 bp, Artificial Sequence
  Synthetic oligonucleotide; AAG chr11 5382430 5382449 5382433 -
caactatcttagcgcaatgt

SEQ ID NO: 30978 - DNA, 20 bp, Artificial Sequence
  Synthetic oligonucleotide; GAG chr11 5382428 5382447 5382431 -
actatcttagcgcaatgtaa

SEQ ID NO: 30979 - DNA, 20 bp, Artificial Sequence
  Synthetic oligonucleotide; TGG chr11 5382424 5382443 5382427 -
tcttagcgcaatgtaagaga

SEQ ID NO: 30980 - DNA, 20 bp, Artificial Sequence
  Synthetic oligonucleotide; TGG chr11 5382418 5382437 5382421 -
cgcaatgtaagagatggaca

SEQ ID NO: 30981 - DNA, 20 bp, Artificial Sequence
  Synthetic oligonucleotide; TGG chr11 5382397 5382416 5382400 -
ggcaattatattaatatttg

SEQ ID NO: 30982 - DNA, 20 bp, Artificial Sequence
  Synthetic oligonucleotide; GGG chr11 5382396 5382415 5382399 -
gcaattatattaatatttgt

SEQ ID NO: 30983 - DNA, 20 bp, Artificial Sequence
  Synthetic oligonucleotide; TAG chr11 5382393 5382412 5382396 -
attatattaatatttgtggg

SEQ ID NO: 30984 - DNA, 20 bp, Artificial Sequence
  Synthetic oligonucleotide; TGG chr11 5382386 5382405 5382389 -
taatatttgtgggtagcacc

SEQ ID NO: 30985 - DNA, 20 bp, Artificial Sequence
  Synthetic oligonucleotide; CAG chr11 5382379 5382398 5382382 -
tgtgggtagcacctggccca

SEQ ID NO: 30986 - DNA, 20 bp, Artificial Sequence
  Synthetic oligonucleotide; AGG chr11 5382378 5382397 5382381 -
gtgggtagcacctggcccac

SEQ ID NO: 30987 - DNA, 20 bp, Artificial Sequence
  Synthetic oligonucleotide; GAG chr11 5382374 5382393 5382377 -
gtagcacctggcccacaggt

SEQ ID NO: 30988 - DNA, 20 bp, Artificial Sequence
  Synthetic oligonucleotide; AGG chr11 5382373 5382392 5382376 -
tagcacctggcccacaggtg

SEQ ID NO: 30989 - DNA, 20 bp, Artificial Sequence
  Synthetic oligonucleotide; GGG chr11 5382372 5382391 5382375 -
agcacctggcccacaggtga

SEQ ID NO: 30990 - DNA, 20 bp, Artificial Sequence
  Synthetic oligonucleotide; CAG chr11 5382368 5382387 5382371 -
cctggcccacaggtgagggc

SEQ ID NO: 30991 - DNA, 20 bp, Artificial Sequence
  Synthetic oligonucleotide; AGG chr11 5382367 5382386 5382370 -
ctggcccacaggtgagggcc

SEQ ID NO: 30992 - DNA, 20 bp, Artificial Sequence
  Synthetic oligonucleotide; GGG chr11 5382366 5382385 5382369 -
tggcccacaggtgagggcca

SEQ ID NO: 30993 - DNA, 20 bp, Artificial Sequence
  Synthetic oligonucleotide; AAG chr11 5382363 5382382 5382366 -
cccacaggtgagggccaggg

SEQ ID NO: 30994 - DNA, 20 bp, Artificial Sequence
  Synthetic oligonucleotide; AGG chr11 5382362 5382381 5382365 -
ccacaggtgagggccaggga

SEQ ID NO: 30995 - DNA, 20 bp, Artificial Sequence
  Synthetic oligonucleotide; GAG chr11 5382350 5382369 5382353 -
gccagggaaggccccaacct

SEQ ID NO: 30996 - DNA, 20 bp, Artificial Sequence
  Synthetic oligonucleotide; AAG chr11 5382342 5382361 5382345 -
aggccccaacctgagctatg

SEQ ID NO: 30997 - DNA, 20 bp, Artificial Sequence
  Synthetic oligonucleotide; AAG chr11 5382332 5382351 5382335 -
ctgagctatgaagactaatt

SEQ ID NO: 30998 - DNA, 20 bp, Artificial Sequence
  Synthetic oligonucleotide; CAG chr11 5382320 5382339 5382323 -
gactaattaagaatcaacca

SEQ ID NO: 30999 - DNA, 20 bp, Artificial Sequence
  Synthetic oligonucleotide; TAG chr11 5382316 5382335 5382319 -
aattaagaatcaaccacaga

SEQ ID NO: 31000 - DNA, 20 bp, Artificial Sequence
  Synthetic oligonucleotide; AGG chr11 5382315 5382334 5382318 -
attaagaatcaaccacagat

SEQ ID NO: 31001 - DNA, 20 bp, Artificial Sequence
  Synthetic oligonucleotide; GGG chr11 5382314 5382333 5382317 -
ttaagaatcaaccacagata

SEQ ID NO: 31002 - DNA, 20 bp, Artificial Sequence
  Synthetic oligonucleotide; TAG chr11 5382306 5382325 5382309 -
caaccacagatagggcttta

SEQ ID NO: 31003 - DNA, 20 bp, Artificial Sequence
  Synthetic oligonucleotide; AAG chr11 5382302 5382321 5382305 -
cacagatagggctttataga

SEQ ID NO: 31004 - DNA, 20 bp, Artificial Sequence
  Synthetic oligonucleotide; AGG chr11 5382301 5382320 5382304 -
acagatagggctttatagaa

SEQ ID NO: 31005 - DNA, 20 bp, Artificial Sequence
  Synthetic oligonucleotide; AAG chr11 5382288 5382307 5382291 -
tatagaaaggtatttccaaa

SEQ ID NO: 31006 - DNA, 20 bp, Artificial Sequence
  Synthetic oligonucleotide; AGG chr11 5382287 5382306 5382290 -
atagaaaggtatttccaaaa

SEQ ID NO: 31007 - DNA, 20 bp, Artificial Sequence
  Synthetic oligonucleotide; GAG chr11 5382285 5382304 5382288 -
agaaaggtatttccaaaaag

SEQ ID NO: 31008 - DNA, 20 bp, Artificial Sequence
  Synthetic oligonucleotide; AGG chr11 5382284 5382303 5382287 -
gaaaggtatttccaaaaagg

SEQ ID NO: 31009 - DNA, 20 bp, Artificial Sequence
  Synthetic oligonucleotide; GGG chr11 5382283 5382302 5382286 -
aaaggtatttccaaaaagga

SEQ ID NO: 31010 - DNA, 20 bp, Artificial Sequence
  Synthetic oligonucleotide; GGG chr11 5382282 5382301 5382285 -
aaggtatttccaaaaaggag

SEQ ID NO: 31011 - DNA, 20 bp, Artificial Sequence
  Synthetic oligonucleotide; TAG chr11 5382279 5382298 5382282 -
gtatttccaaaaaggagggg

SEQ ID NO: 31012 - DNA, 20 bp, Artificial Sequence
  Synthetic oligonucleotide; AAG chr11 5382273 5382292 5382276 -
ccaaaaaggaggggtagtgt

SEQ ID NO: 31013 - DNA, 20 bp, Artificial Sequence
  Synthetic oligonucleotide; AAG chr11 5382269 5382288 5382272 -
aaaggaggggtagtgtaagc

SEQ ID NO: 31014 - DNA, 20 bp, Artificial Sequence
  Synthetic oligonucleotide; AGG chr11 5382268 5382287 5382271 -
aaggaggggtagtgtaagca

SEQ ID NO: 31015 - DNA, 20 bp, Artificial Sequence
  Synthetic oligonucleotide; GGG chr11 5382267 5382286 5382270 -
aggaggggtagtgtaagcaa

SEQ ID NO: 31016 - DNA, 20 bp, Artificial Sequence
  Synthetic oligonucleotide; TGG chr11 5382262 5382281 5382265 -
gggtagtgtaagcaagggca

SEQ ID NO: 31017 - DNA, 20 bp, Artificial Sequence
  Synthetic oligonucleotide; GAG chr11 5382260 5382279 5382263 -
gtagtgtaagcaagggcatg

SEQ ID NO: 31018 - DNA, 20 bp, Artificial Sequence
  Synthetic oligonucleotide; AGG chr11 5382259 5382278 5382262 -
tagtgtaagcaagggcatgg

SEQ ID NO: 31019 - DNA, 20 bp, Artificial Sequence
  Synthetic oligonucleotide; GAG chr11 5382255 5382274 5382258 -
gtaagcaagggcatggaggt

SEQ ID NO: 31020 - DNA, 20 bp, Artificial Sequence
  Synthetic oligonucleotide; AGG chr11 5382254 5382273 5382257 -
taagcaagggcatggaggtg

SEQ ID NO: 31021 - DNA, 20 bp, Artificial Sequence
  Synthetic oligonucleotide; AAG chr11 5382249 5382268 5382252 -
aagggcatggaggtgaggaa

SEQ ID NO: 31022 - DNA, 20 bp, Artificial Sequence
  Synthetic oligonucleotide; GAG chr11 5382231 5382250 5382234 -
aaaagttgtttatgtgtttt

SEQ ID NO: 31023 - DNA, 20 bp, Artificial Sequence
  Synthetic oligonucleotide; AAG chr11 5382222 5382241 5382225 -
ttatgtgttttgagaactat

SEQ ID NO: 31024 - DNA, 20 bp, Artificial Sequence
  Synthetic oligonucleotide; CGG chr11 5382213 5382232 5382216 -
ttgagaactataagattttc

SEQ ID NO: 31025 - DNA, 20 bp, Artificial Sequence
  Synthetic oligonucleotide; AAG chr11 5382192 5382211 5382195 -
ggtgatcaaatataacattt

SEQ ID NO: 31026 - DNA, 20 bp, Artificial Sequence
  Synthetic oligonucleotide; GAG chr11 5382190 5382209 5382193 -
tgatcaaatataacatttaa

SEQ ID NO: 31027 - DNA, 20 bp, Artificial Sequence
  Synthetic oligonucleotide; GAG chr11 5382188 5382207 5382191 -
atcaaatataacatttaaga

SEQ ID NO: 31028 - DNA, 20 bp, Artificial Sequence
  Synthetic oligonucleotide; TGG chr11 5382176 5382195 5382179 -
atttaagagagttaatacct

SEQ ID NO: 31029 - DNA, 20 bp, Artificial Sequence
  Synthetic oligonucleotide; CAG chr11 5382166 5382185 5382169 -
gttaataccttggaataaaa

SEQ ID NO: 31030 - DNA, 20 bp, Artificial Sequence
  Synthetic oligonucleotide; TAG chr11 5382163 5382182 5382166 -
aataccttggaataaaacag

SEQ ID NO: 31031 - DNA, 20 bp, Artificial Sequence
  Synthetic oligonucleotide; GAG chr11 5382161 5382180 5382164 -
taccttggaataaaacagta

SEQ ID NO: 31032 - DNA, 20 bp, Artificial Sequence
  Synthetic oligonucleotide; AGG chr11 5382160 5382179 5382163 -
accttggaataaaacagtag

SEQ ID NO: 31033 - DNA, 20 bp, Artificial Sequence
  Synthetic oligonucleotide; TAG chr11 5382157 5382176 5382160 -
ttggaataaaacagtagagg

SEQ ID NO: 31034 - DNA, 20 bp, Artificial Sequence
  Synthetic oligonucleotide; AGG chr11 5382156 5382175 5382159 -
tggaataaaacagtagaggt

SEQ ID NO: 31035 - DNA, 20 bp, Artificial Sequence
  Synthetic oligonucleotide; CAG chr11 5382153 5382172 5382156 -
aataaaacagtagaggtagg

SEQ ID NO: 31036 - DNA, 20 bp, Artificial Sequence
  Synthetic oligonucleotide; AGG chr11 5382152 5382171 5382155 -
ataaaacagtagaggtaggc

SEQ ID NO: 31037 - DNA, 20 bp, Artificial Sequence
  Synthetic oligonucleotide; GGG chr11 5382151 5382170 5382154 -
taaaacagtagaggtaggca

SEQ ID NO: 31038 - DNA, 20 bp, Artificial Sequence
  Synthetic oligonucleotide; GGG chr11 5382150 5382169 5382153 -
aaaacagtagaggtaggcag

SEQ ID NO: 31039 - DNA, 20 bp, Artificial Sequence
  Synthetic oligonucleotide; AAG chr11 5382146 5382165 5382149 -
cagtagaggtaggcaggggc

SEQ ID NO: 31040 - DNA, 20 bp, Artificial Sequence
  Synthetic oligonucleotide; GAG chr11 5382134 5382153 5382137 -
gcaggggcaagaccctgaat

SEQ ID NO: 31041 - DNA, 20 bp, Artificial Sequence
  Synthetic oligonucleotide; TGG chr11 5382111 5382130 5382114 -
tttatatgacatgtcaaaca

SEQ ID NO: 31042 - DNA, 20 bp, Artificial Sequence
  Synthetic oligonucleotide; TGG chr11 5382096 5382115 5382099 -
aaacatggtacacattttga

SEQ ID NO: 31043 - DNA, 20 bp, Artificial Sequence
  Synthetic oligonucleotide; TGG chr11 5382092 5382111 5382095 -
atggtacacattttgatggt

SEQ ID NO: 31044 - DNA, 20 bp, Artificial Sequence
  Synthetic oligonucleotide; GGG chr11 5382091 5382110 5382094 -
tggtacacattttgatggtt

SEQ ID NO: 31045 - DNA, 20 bp, Artificial Sequence
  Synthetic oligonucleotide; AAG chr11 5382082 5382101 5382085 -
ttttgatggttgggtttaaa

SEQ ID NO: 31046 - DNA, 20 bp, Artificial Sequence
  Synthetic oligonucleotide; AGG chr11 5382081 5382100 5382084 -
tttgatggttgggtttaaaa

SEQ ID NO: 31047 - DNA, 20 bp, Artificial Sequence
  Synthetic oligonucleotide; CAG chr11 5382078 5382097 5382081 -
gatggttgggtttaaaaagg

SEQ ID NO: 31048 - DNA, 20 bp, Artificial Sequence
  Synthetic oligonucleotide; AGG chr11 5382077 5382096 5382080 -
atggttgggtttaaaaaggc

SEQ ID NO: 31049 - DNA, 20 bp, Artificial Sequence
  Synthetic oligonucleotide; GAG chr11 5382075 5382094 5382078 -
ggttgggtttaaaaaggcag

SEQ ID NO: 31050 - DNA, 20 bp, Artificial Sequence
  Synthetic oligonucleotide; CAG chr11 5382055 5382074 5382058 -
gagataacaatcatattttc

SEQ ID NO: 31051 - DNA, 20 bp, Artificial Sequence
  Synthetic oligonucleotide; GAG chr11 5382053 5382072 5382056 -
gataacaatcatattttcca

SEQ ID NO: 31052 - DNA, 20 bp, Artificial Sequence
  Synthetic oligonucleotide; CAG chr11 5382032 5382051 5382035 -
agtacattgttaacaatatg

SEQ ID NO: 31053 - DNA, 20 bp, Artificial Sequence
  Synthetic oligonucleotide; AGG chr11 5382031 5382050 5382034 -
gtacattgttaacaatatgc

SEQ ID NO: 31054 - DNA, 20 bp, Artificial Sequence
  Synthetic oligonucleotide; AAG chr11 5382028 5382047 5382031 -
cattgttaacaatatgcagg

SEQ ID NO: 31055 - DNA, 20 bp, Artificial Sequence
  Synthetic oligonucleotide; AGG chr11 5382027 5382046 5382030 -
attgttaacaatatgcagga

SEQ ID NO: 31056 - DNA, 20 bp, Artificial Sequence
  Synthetic oligonucleotide; AAG chr11 5382019 5382038 5382022 -
caatatgcaggaaggattta

SEQ ID NO: 31057 - DNA, 20 bp, Artificial Sequence
  Synthetic oligonucleotide; TGG chr11 5382009 5382028 5382012 -
gaaggatttaaagtctgcac

SEQ ID NO: 31058 - DNA, 20 bp, Artificial Sequence
  Synthetic oligonucleotide; CAG chr11 5382003 5382022 5382006 -
tttaaagtctgcactggaaa

SEQ ID NO: 31059 - DNA, 20 bp, Artificial Sequence
  Synthetic oligonucleotide; TGG chr11 5381991 5382010 5381994 -
actggaaacagatgttattt

SEQ ID NO: 31060 - DNA, 20 bp, Artificial Sequence
  Synthetic oligonucleotide; TGG chr11 5381984 5382003 5381987 -
acagatgttattttggtgta

SEQ ID NO: 31061 - DNA, 20 bp, Artificial Sequence
  Synthetic oligonucleotide; GAG chr11 5381982 5382001 5381985 -
agatgttattttggtgtatg

SEQ ID NO: 31062 - DNA, 20 bp, Artificial Sequence
  Synthetic oligonucleotide; TGG chr11 5381978 5381997 5381981 -
gttattttggtgtatggagc

SEQ ID NO: 31063 - DNA, 20 bp, Artificial Sequence
  Synthetic oligonucleotide; CAG chr11 5381972 5381991 5381975 -
ttggtgtatggagctggatg

SEQ ID NO: 31064 - DNA, 20 bp, Artificial Sequence
  Synthetic oligonucleotide; CAG chr11 5381957 5381976 5381960 -
ggatgcagatatgtaattga

SEQ ID NO: 31065 - DNA, 20 bp, Artificial Sequence
  Synthetic oligonucleotide; TAG chr11 5381945 5381964 5381948 -
gtaattgacagctttttacg

SEQ ID NO: 31066 - DNA, 20 bp, Artificial Sequence
  Synthetic oligonucleotide; TAG chr11 5381927 5381946 5381930 -
cgtagataaacaatactgtt

SEQ ID NO: 31067 - DNA, 20 bp, Artificial Sequence
  Synthetic oligonucleotide; TGG chr11 5381924 5381943 5381927 -
agataaacaatactgtttag

SEQ ID NO: 31068 - DNA, 20 bp, Artificial Sequence
  Synthetic oligonucleotide; TAG chr11 5381908 5381927 5381911 -
ttagtggataacctaccatt

SEQ ID NO: 31069 - DNA, 20 bp, Artificial Sequence
  Synthetic oligonucleotide; GAG chr11 5381906 5381925 5381909 -
agtggataacctaccattta

SEQ ID NO: 31070 - DNA, 20 bp, Artificial Sequence
  Synthetic oligonucleotide; TAG chr11 5381860 5381879 5381863 -
ttaaactaacatctgtataa

SEQ ID NO: 31071 - DNA, 20 bp, Artificial Sequence
  Synthetic oligonucleotide; AAG chr11 5381824 5381843 5381827 -
ttctctgaattatataattg

SEQ ID NO: 31072 - DNA, 20 bp, Artificial Sequence
  Synthetic oligonucleotide; AGG chr11 5381823 5381842 5381826 -
tctctgaattatataattga

SEQ ID NO: 31073 - DNA, 20 bp, Artificial Sequence
  Synthetic oligonucleotide; CAG chr11 5381818 5381837 5381821 -
gaattatataattgaaggac

SEQ ID NO: 31074 - DNA, 20 bp, Artificial Sequence
  Synthetic oligonucleotide; AAG chr11 5381810 5381829 5381813 -
taattgaaggaccagtttcc

SEQ ID NO: 31075 - DNA, 20 bp, Artificial Sequence
  Synthetic oligonucleotide; TAG chr11 5381804 5381823 5381807 -
aaggaccagtttccaagcaa

SEQ ID NO: 31076 - DNA, 20 bp, Artificial Sequence
  Synthetic oligonucleotide; AAG chr11 5381780 5381799 5381783 -
tttatttgaaaaccaaatga

SEQ ID NO: 31077 - DNA, 20 bp, Artificial Sequence
  Synthetic oligonucleotide; CAG chr11 5381773 5381792 5381776 -
gaaaaccaaatgaaagaact

SEQ ID NO: 31078 - DNA, 20 bp, Artificial Sequence
  Synthetic oligonucleotide; TAG chr11 5381737 5381756 5381740 -
ttattgctctaaatgacctt

SEQ ID NO: 31079 - DNA, 20 bp, Artificial Sequence
  Synthetic oligonucleotide; TAG chr11 5381711 5381730 5381714 -
tgttttatcatatcacaaaa

SEQ ID NO: 31080 - DNA, 20 bp, Artificial Sequence
  Synthetic oligonucleotide; AAG chr11 5381699 5381718 5381702 -
tcacaaaatagtcctctttg

SEQ ID NO: 31081 - DNA, 20 bp, Artificial Sequence
  Synthetic oligonucleotide; AAG chr11 5381645 5381664 5381648 -
aattttcattgacgtgcatt

SEQ ID NO: 31082 - DNA, 20 bp, Artificial Sequence
  Synthetic oligonucleotide; GAG chr11 5381632 5381651 5381635 -
gtgcattaagtgcgtcctgt

SEQ ID NO: 31083 - DNA, 20 bp, Artificial Sequence
  Synthetic oligonucleotide; AAG chr11 5381618 5381637 5381621 -
tcctgtgagaaactctgatc

SEQ ID NO: 31084 - DNA, 20 bp, Artificial Sequence
  Synthetic oligonucleotide; AAG chr11 5381609 5381628 5381612 -
aaactctgatcaagaacttg

SEQ ID NO: 31085 - DNA, 20 bp, Artificial Sequence
  Synthetic oligonucleotide; TAG chr11 5381605 5381624 5381608 -
tctgatcaagaacttgaaga

SEQ ID NO: 31086 - DNA, 20 bp, Artificial Sequence
  Synthetic oligonucleotide; CAG chr11 5381601 5381620 5381604 -
atcaagaacttgaagataga

SEQ ID NO: 31087 - DNA, 20 bp, Artificial Sequence
  Synthetic oligonucleotide; TGG chr11 5381586 5381605 5381589 -
atagacagattaacatgtca

SEQ ID NO: 31088 - DNA, 20 bp, Artificial Sequence
  Synthetic oligonucleotide; AAG chr11 5381570 5381589 5381573 -
gtcatggtcttgcctttatg

SEQ ID NO: 31089 - DNA, 20 bp, Artificial Sequence
  Synthetic oligonucleotide; GAG chr11 5381559 5381578 5381562 -
gcctttatgaagctcacatt

SEQ ID NO: 31090 - DNA, 20 bp, Artificial Sequence
  Synthetic oligonucleotide; AAG chr11 5381554 5381573 5381557 -
tatgaagctcacattgagta

SEQ ID NO: 31091 - DNA, 20 bp, Artificial Sequence
  Synthetic oligonucleotide; TAG chr11 5381547 5381566 5381550 -
ctcacattgagtaaagatgt

SEQ ID NO: 31092 - DNA, 20 bp, Artificial Sequence
  Synthetic oligonucleotide; AAG chr11 5381533 5381552 5381536 -
agatgttagattgttcaacg

SEQ ID NO: 31093 - DNA, 20 bp, Artificial Sequence
  Synthetic oligonucleotide; TAG chr11 5381521 5381540 5381524 -
gttcaacgaagtttccaaaa

SEQ ID NO: 31094 - DNA, 20 bp, Artificial Sequence
  Synthetic oligonucleotide; AGG chr11 5381520 5381539 5381523 -
ttcaacgaagtttccaaaat

SEQ ID NO: 31095 - DNA, 20 bp, Artificial Sequence
  Synthetic oligonucleotide; GGG chr11 5381519 5381538 5381522 -
tcaacgaagtttccaaaata

SEQ ID NO: 31096 - DNA, 20 bp, Artificial Sequence
  Synthetic oligonucleotide; TAG chr11 5381512 5381531 5381515 -
agtttccaaaatagggtcac

SEQ ID NO: 31097 - DNA, 20 bp, Artificial Sequence
  Synthetic oligonucleotide; CAG chr11 5381507 5381526 5381510 -
ccaaaatagggtcactagcc

SEQ ID NO: 31098 - DNA, 20 bp, Artificial Sequence
  Synthetic oligonucleotide; AGG chr11 5381506 5381525 5381509 -
caaaatagggtcactagccc

SEQ ID NO: 31099 - DNA, 20 bp, Artificial Sequence
  Synthetic oligonucleotide; TAG chr11 5381502 5381521 5381505 -
atagggtcactagcccaggc

SEQ ID NO: 31100 - DNA, 20 bp, Artificial Sequence
  Synthetic oligonucleotide; AGG chr11 5381501 5381520 5381504 -
tagggtcactagcccaggct

SEQ ID NO: 31101 - DNA, 20 bp, Artificial Sequence
  Synthetic oligonucleotide; AAG chr11 5381498 5381517 5381501 -
ggtcactagcccaggctagg

SEQ ID NO: 31102 - DNA, 20 bp, Artificial Sequence
  Synthetic oligonucleotide; AGG chr11 5381497 5381516 5381500 -
gtcactagcccaggctagga

SEQ ID NO: 31103 - DNA, 20 bp, Artificial Sequence
  Synthetic oligonucleotide; CAG chr11 5381494 5381513 5381497 -
actagcccaggctaggaagg

SEQ ID NO: 31104 - DNA, 20 bp, Artificial Sequence
  Synthetic oligonucleotide; GAG chr11 5381492 5381511 5381495 -
tagcccaggctaggaaggca

SEQ ID NO: 31105 - DNA, 20 bp, Artificial Sequence
  Synthetic oligonucleotide; AGG chr11 5381491 5381510 5381494 -
agcccaggctaggaaggcag

SEQ ID NO: 31106 - DNA, 20 bp, Artificial Sequence
  Synthetic oligonucleotide; TAG chr11 5381488 5381507 5381491 -
ccaggctaggaaggcagagg

SEQ ID NO: 31107 - DNA, 20 bp, Artificial Sequence
  Synthetic oligonucleotide; AAG chr11 5381479 5381498 5381482 -
gaaggcagaggtagtttctg

SEQ ID NO: 31108 - DNA, 20 bp, Artificial Sequence
  Synthetic oligonucleotide; TGG chr11 5381474 5381493 5381477 -
cagaggtagtttctgaagcc

SEQ ID NO: 31109 - DNA, 20 bp, Artificial Sequence
  Synthetic oligonucleotide; GAG chr11 5381472 5381491 5381475 -
gaggtagtttctgaagcctg

SEQ ID NO: 31110 - DNA, 20 bp, Artificial Sequence
  Synthetic oligonucleotide; AGG chr11 5381471 5381490 5381474 -
aggtagtttctgaagcctgg

SEQ ID NO: 31111 - DNA, 20 bp, Artificial Sequence
  Synthetic oligonucleotide; AAG chr11 5381466 5381485 5381469 -
gtttctgaagcctggaggcc

SEQ ID NO: 31112 - DNA, 20 bp, Artificial Sequence
  Synthetic oligonucleotide; GAG chr11 5381464 5381483 5381467 -
ttctgaagcctggaggccaa

SEQ ID NO: 31113 - DNA, 20 bp, Artificial Sequence
  Synthetic oligonucleotide; AGG chr11 5381463 5381482 5381466 -
tctgaagcctggaggccaag

SEQ ID NO: 31114 - DNA, 20 bp, Artificial Sequence
  Synthetic oligonucleotide; GAG chr11 5381461 5381480 5381464 -
tgaagcctggaggccaagag

SEQ ID NO: 31115 - DNA, 20 bp, Artificial Sequence
  Synthetic oligonucleotide; AGG chr11 5381460 5381479 5381463 -
gaagcctggaggccaagagg

SEQ ID NO: 31116 - DNA, 20 bp, Artificial Sequence
  Synthetic oligonucleotide; TGG chr11 5381453 5381472 5381456 -
ggaggccaagaggaggatga

SEQ ID NO: 31117 - DNA, 20 bp, Artificial Sequence
  Synthetic oligonucleotide; GGG chr11 5381452 5381471 5381455 -
gaggccaagaggaggatgat

SEQ ID NO: 31118 - DNA, 20 bp, Artificial Sequence
  Synthetic oligonucleotide; GGG chr11 5381451 5381470 5381454 -
aggccaagaggaggatgatg

SEQ ID NO: 31119 - DNA, 20 bp, Artificial Sequence
  Synthetic oligonucleotide; AAG chr11 5381442 5381461 5381445 -
ggaggatgatggggacaatg

SEQ ID NO: 31120 - DNA, 20 bp, Artificial Sequence
  Synthetic oligonucleotide; AGG chr11 5381441 5381460 5381444 -
gaggatgatggggacaatga

SEQ ID NO: 31121 - DNA, 20 bp, Artificial Sequence
  Synthetic oligonucleotide; GAG chr11 5381439 5381458 5381442 -
ggatgatggggacaatgaag

SEQ ID NO: 31122 - DNA, 20 bp, Artificial Sequence
  Synthetic oligonucleotide; AAG chr11 5381435 5381454 5381438 -
gatggggacaatgaaggagc

SEQ ID NO: 31123 - DNA, 20 bp, Artificial Sequence
  Synthetic oligonucleotide; CGG chr11 5381428 5381447 5381431 -
acaatgaaggagcaagtcct

SEQ ID NO: 31124 - DNA, 20 bp, Artificial Sequence
  Synthetic oligonucleotide; TGG chr11 5381408 5381427 5381411 -
cggacctatctctatcactg

SEQ ID NO: 31125 - DNA, 20 bp, Artificial Sequence
  Synthetic oligonucleotide; GGG chr11 5381407 5381426 5381410 -
ggacctatctctatcactgt

SEQ ID NO: 31126 - DNA, 20 bp, Artificial Sequence
  Synthetic oligonucleotide; TAG chr11 5381389 5381408 5381392 -
gtgggtaatcatgcgaatat

SEQ ID NO: 31127 - DNA, 20 bp, Artificial Sequence
  Synthetic oligonucleotide; AGG chr11 5381388 5381407 5381391 -
tgggtaatcatgcgaatatt

SEQ ID NO: 31128 - DNA, 20 bp, Artificial Sequence
  Synthetic oligonucleotide; AAG chr11 5381383 5381402 5381386 -
aatcatgcgaatattaggtg

SEQ ID NO: 31129 - DNA, 20 bp, Artificial Sequence
  Synthetic oligonucleotide; TGG chr11 5381374 5381393 5381377 -
aatattaggtgaagtgaatg

SEQ ID NO: 31130 - DNA, 20 bp, Artificial Sequence
  Synthetic oligonucleotide; GGG chr11 5381373 5381392 5381376 -
atattaggtgaagtgaatgt

SEQ ID NO: 31131 - DNA, 20 bp, Artificial Sequence
  Synthetic oligonucleotide; TGG chr11 5381363 5381382 5381366 -
aagtgaatgtgggtgcatga

SEQ ID NO: 31132 - DNA, 20 bp, Artificial Sequence
  Synthetic oligonucleotide; TGG chr11 5381359 5381378 5381362 -
gaatgtgggtgcatgatggt

SEQ ID NO: 31133 - DNA, 20 bp, Artificial Sequence
  Synthetic oligonucleotide; GGG chr11 5381358 5381377 5381361 -
aatgtgggtgcatgatggtt

SEQ ID NO: 31134 - DNA, 20 bp, Artificial Sequence
  Synthetic oligonucleotide; GGG chr11 5381357 5381376 5381360 -
atgtgggtgcatgatggttg

SEQ ID NO: 31135 - DNA, 20 bp, Artificial Sequence
  Synthetic oligonucleotide; AAG chr11 5381354 5381373 5381357 -
tgggtgcatgatggttgggg

SEQ ID NO: 31136 - DNA, 20 bp, Artificial Sequence
  Synthetic oligonucleotide; AGG chr11 5381353 5381372 5381356 -
gggtgcatgatggttgggga

SEQ ID NO: 31137 - DNA, 20 bp, Artificial Sequence
  Synthetic oligonucleotide; AAG chr11 5381348 5381367 5381351 -
catgatggttggggaaggtg

SEQ ID NO: 31138 - DNA, 20 bp, Artificial Sequence
  Synthetic oligonucleotide; TAG chr11 5381334 5381353 5381337 -
aaggtgaagtatcaacacat

SEQ ID NO: 31139 - DNA, 20 bp, Artificial Sequence
  Synthetic oligonucleotide; GAG chr11 5381328 5381347 5381331 -
aagtatcaacacattagtgt

SEQ ID NO: 31140 - DNA, 20 bp, Artificial Sequence
  Synthetic oligonucleotide; AGG chr11 5381327 5381346 5381330 -
agtatcaacacattagtgtg

SEQ ID NO: 31141 - DNA, 20 bp, Artificial Sequence
  Synthetic oligonucleotide; CAG chr11 5381320 5381339 5381323 -
acacattagtgtgaggcatt

SEQ ID NO: 31142 - DNA, 20 bp, Artificial Sequence
  Synthetic oligonucleotide; AGG chr11 5381319 5381338 5381322 -
cacattagtgtgaggcattc

SEQ ID NO: 31143 - DNA, 20 bp, Artificial Sequence
  Synthetic oligonucleotide; AAG chr11 5381305 5381324 5381308 -
gcattcaggccttaaccttt

SEQ ID NO: 31144 - DNA, 20 bp, Artificial Sequence
  Synthetic oligonucleotide; AGG chr11 5381304 5381323 5381307 -
cattcaggccttaaccttta

SEQ ID NO: 31145 - DNA, 20 bp, Artificial Sequence
  Synthetic oligonucleotide; TAG chr11 5381298 5381317 5381301 -
ggccttaacctttaaggtat

SEQ ID NO: 31146 - DNA, 20 bp, Artificial Sequence
  Synthetic oligonucleotide; AAG chr11 5381283 5381302 5381286 -
ggtattagaattcattatta

SEQ ID NO: 31147 - DNA, 20 bp, Artificial Sequence
  Synthetic oligonucleotide; AAG chr11 5381261 5381280 5381264 -
gaatctaaatccattactaa

SEQ ID NO: 31148 - DNA, 20 bp, Artificial Sequence
  Synthetic oligonucleotide; AAG chr11 5381254 5381273 5381257 -
aatccattactaaaagtgaa

SEQ ID NO: 31149 - DNA, 20 bp, Artificial Sequence
  Synthetic oligonucleotide; CAG chr11 5381240 5381259 5381243 -
agtgaaaagtgtcactgtaa

SEQ ID NO: 31150 - DNA, 20 bp, Artificial Sequence
  Synthetic oligonucleotide; TGG chr11 5381213 5381232 5381216 -
cctatttgttaatgtgcaaa

SEQ ID NO: 31151 - DNA, 20 bp, Artificial Sequence
  Synthetic oligonucleotide; GAG chr11 5381176 5381195 5381179 -
aatattgtttgtgtgtgtgt

SEQ ID NO: 31152 - DNA, 20 bp, Artificial Sequence
  Synthetic oligonucleotide; GAG chr11 5381174 5381193 5381177 -
tattgtttgtgtgtgtgtga

SEQ ID NO: 31153 - DNA, 20 bp, Artificial Sequence
  Synthetic oligonucleotide; GAG chr11 5381172 5381191 5381175 -
ttgtttgtgtgtgtgtgaga

SEQ ID NO: 31154 - DNA, 20 bp, Artificial Sequence
  Synthetic oligonucleotide; GAG chr11 5381170 5381189 5381173 -
gtttgtgtgtgtgtgagaga

SEQ ID NO: 31155 - DNA, 20 bp, Artificial Sequence
  Synthetic oligonucleotide; GAG chr11 5381168 5381187 5381171 -
ttgtgtgtgtgtgagagaga

SEQ ID NO: 31156 - DNA, 20 bp, Artificial Sequence
  Synthetic oligonucleotide; GAG chr11 5381166 5381185 5381169 -
gtgtgtgtgtgagagagaga

SEQ ID NO: 31157 - DNA, 20 bp, Artificial Sequence
  Synthetic oligonucleotide; GAG chr11 5381164 5381183 5381167 -
gtgtgtgtgagagagagaga

SEQ ID NO: 31158 - DNA, 20 bp, Artificial Sequence
  Synthetic oligonucleotide; CAG chr11 5381158 5381177 5381161 -
gtgagagagagagagagaaa

SEQ ID NO: 31159 - DNA, 20 bp, Artificial Sequence
  Synthetic oligonucleotide; GAG chr11 5381154 5381173 5381157 -
gagagagagagagaaacagc

SEQ ID NO: 31160 - DNA, 20 bp, Artificial Sequence
  Synthetic oligonucleotide; GAG chr11 5381150 5381169 5381153 -
gagagagagaaacagcgagc

SEQ ID NO: 31161 - DNA, 20 bp, Artificial Sequence
  Synthetic oligonucleotide; CAG chr11 5381144 5381163 5381147 -
gagaaacagcgagcgagcga

SEQ ID NO: 31162 - DNA, 20 bp, Artificial Sequence
  Synthetic oligonucleotide; GAG chr11 5381142 5381161 5381145 -
gaaacagcgagcgagcgaca

SEQ ID NO: 31163 - DNA, 20 bp, Artificial Sequence
  Synthetic oligonucleotide; GAG chr11 5381140 5381159 5381143 -
aacagcgagcgagcgacaga

SEQ ID NO: 31164 - DNA, 20 bp, Artificial Sequence
  Synthetic oligonucleotide; GAG chr11 5381138 5381157 5381141 -
cagcgagcgagcgacagaga

SEQ ID NO: 31165 - DNA, 20 bp, Artificial Sequence
  Synthetic oligonucleotide; GAG chr11 5381136 5381155 5381139 -
gcgagcgagcgacagagaga

SEQ ID NO: 31166 - DNA, 20 bp, Artificial Sequence
  Synthetic oligonucleotide; GAG chr11 5381134 5381153 5381137 -
gagcgagcgacagagagaga

SEQ ID NO: 31167 - DNA, 20 bp, Artificial Sequence
  Synthetic oligonucleotide; AGG chr11 5381133 5381152 5381136 -
agcgagcgacagagagagag

SEQ ID NO: 31168 - DNA, 20 bp, Artificial Sequence
  Synthetic oligonucleotide; TGG chr11 5381130 5381149 5381133 -
gagcgacagagagagagagg

SEQ ID NO: 31169 - DNA, 20 bp, Artificial Sequence
  Synthetic oligonucleotide; GGG chr11 5381129 5381148 5381132 -
agcgacagagagagagaggt

SEQ ID NO: 31170 - DNA, 20 bp, Artificial Sequence
  Synthetic oligonucleotide; GGG chr11 5381128 5381147 5381131 -
gcgacagagagagagaggtg

SEQ ID NO: 31171 - DNA, 20 bp, Artificial Sequence
  Synthetic oligonucleotide; TGG chr11 5381125 5381144 5381128 -
acagagagagagaggtgggg

SEQ ID NO: 31172 - DNA, 20 bp, Artificial Sequence
  Synthetic oligonucleotide; GGG chr11 5381124 5381143 5381127 -
cagagagagagaggtggggt

SEQ ID NO: 31173 - DNA, 20 bp, Artificial Sequence
  Synthetic oligonucleotide; GGG chr11 5381123 5381142 5381126 -
agagagagagaggtggggtg

SEQ ID NO: 31174 - DNA, 20 bp, Artificial Sequence
  Synthetic oligonucleotide; GGG chr11 5381122 5381141 5381125 -
gagagagagaggtggggtgg

SEQ ID NO: 31175 - DNA, 20 bp, Artificial Sequence
  Synthetic oligonucleotide; TGG chr11 5381117 5381136 5381120 -
agagaggtggggtgggggta

SEQ ID NO: 31176 - DNA, 20 bp, Artificial Sequence
  Synthetic oligonucleotide; TGG chr11 5381114 5381133 5381117 -
gaggtggggtgggggtatgg

SEQ ID NO: 31177 - DNA, 20 bp, Artificial Sequence
  Synthetic oligonucleotide; GGG chr11 5381113 5381132 5381116 -
aggtggggtgggggtatggt

SEQ ID NO: 31178 - DNA, 20 bp, Artificial Sequence
  Synthetic oligonucleotide; GGG chr11 5381112 5381131 5381115 -
ggtggggtgggggtatggtg

SEQ ID NO: 31179 - DNA, 20 bp, Artificial Sequence
  Synthetic oligonucleotide; TGG chr11 5381109 5381128 5381112 -
ggggtgggggtatggtgggg

SEQ ID NO: 31180 - DNA, 20 bp, Artificial Sequence
  Synthetic oligonucleotide; AAG chr11 5381105 5381124 5381108 -
tgggggtatggtggggtgga

SEQ ID NO: 31181 - DNA, 20 bp, Artificial Sequence
  Synthetic oligonucleotide; TGG chr11 5381100 5381119 5381103 -
gtatggtggggtggaaagcc

SEQ ID NO: 31182 - DNA, 20 bp, Artificial Sequence
  Synthetic oligonucleotide; AAG chr11 5381092 5381111 5381095 -
gggtggaaagcctggctttc

SEQ ID NO: 31183 - DNA, 20 bp, Artificial Sequence
  Synthetic oligonucleotide; AGG chr11 5381091 5381110 5381094 -
ggtggaaagcctggctttca

SEQ ID NO: 31184 - DNA, 20 bp, Artificial Sequence
  Synthetic oligonucleotide; GGG chr11 5381090 5381109 5381093 -
gtggaaagcctggctttcaa

SEQ ID NO: 31185 - DNA, 20 bp, Artificial Sequence
  Synthetic oligonucleotide; GGG chr11 5381089 5381108 5381092 -
tggaaagcctggctttcaag

SEQ ID NO: 31186 - DNA, 20 bp, Artificial Sequence
  Synthetic oligonucleotide; CAG chr11 5381085 5381104 5381088 -
aagcctggctttcaaggggc

SEQ ID NO: 31187 - DNA, 20 bp, Artificial Sequence
  Synthetic oligonucleotide; AAG chr11 5381079 5381098 5381082 -
ggctttcaaggggccagtat

SEQ ID NO: 31188 - DNA, 20 bp, Artificial Sequence
  Synthetic oligonucleotide; AAG chr11 5381068 5381087 5381071 -
ggccagtataagttttattt

SEQ ID NO: 31189 - DNA, 20 bp, Artificial Sequence
  Synthetic oligonucleotide; AGG chr11 5381067 5381086 5381070 -
gccagtataagttttattta

SEQ ID NO: 31190 - DNA, 20 bp, Artificial Sequence
  Synthetic oligonucleotide; CAG chr11 5381054 5381073 5381057 -
ttatttaaggaacctctatc

SEQ ID NO: 31191 - DNA, 20 bp, Artificial Sequence
  Synthetic oligonucleotide; TAG chr11 5381041 5381060 5381044 -
ctctatccagaattgatacc

SEQ ID NO: 31192 - DNA, 20 bp, Artificial Sequence
  Synthetic oligonucleotide; CAG chr11 5381037 5381056 5381040 -
atccagaattgatacctagc

SEQ ID NO: 31193 - DNA, 20 bp, Artificial Sequence
  Synthetic oligonucleotide; GAG chr11 5381028 5381047 5381031 -
tgatacctagccagcccact

SEQ ID NO: 31194 - DNA, 20 bp, Artificial Sequence
  Synthetic oligonucleotide; CAG chr11 5381024 5381043 5381027 -
acctagccagcccactgagc

SEQ ID NO: 31195 - DNA, 20 bp, Artificial Sequence
  Synthetic oligonucleotide; AGG chr11 5381023 5381042 5381026 -
cctagccagcccactgagcc

SEQ ID NO: 31196 - DNA, 20 bp, Artificial Sequence
  Synthetic oligonucleotide; TGG chr11 5381018 5381037 5381021 -
ccagcccactgagccaggct

SEQ ID NO: 31197 - DNA, 20 bp, Artificial Sequence
  Synthetic oligonucleotide; AAG chr11 5381013 5381032 5381016 -
ccactgagccaggcttggtg

SEQ ID NO: 31198 - DNA, 20 bp, Artificial Sequence
  Synthetic oligonucleotide; TAG chr11 5381010 5381029 5381013 -
ctgagccaggcttggtgaag

SEQ ID NO: 31199 - DNA, 20 bp, Artificial Sequence
  Synthetic oligonucleotide; AGG chr11 5381009 5381028 5381012 -
tgagccaggcttggtgaagt

SEQ ID NO: 31200 - DNA, 20 bp, Artificial Sequence
  Synthetic oligonucleotide; GAG chr11 5381007 5381026 5381010 -
agccaggcttggtgaagtag

SEQ ID NO: 31201 - DNA, 20 bp, Artificial Sequence
  Synthetic oligonucleotide; CAG chr11 5380997 5381016 5381000 -
ggtgaagtaggagattcctt

SEQ ID NO: 31202 - DNA, 20 bp, Artificial Sequence
  Synthetic oligonucleotide; AGG chr11 5380996 5381015 5380999 -
gtgaagtaggagattccttc

SEQ ID NO: 31203 - DNA, 20 bp, Artificial Sequence
  Synthetic oligonucleotide; GAG chr11 5380994 5381013 5380997 -
gaagtaggagattccttcag

SEQ ID NO: 31204 - DNA, 20 bp, Artificial Sequence
  Synthetic oligonucleotide; AAG chr11 5380979 5380998 5380982 -
ttcaggagaactgaatcccc

SEQ ID NO: 31205 - DNA, 20 bp, Artificial Sequence
  Synthetic oligonucleotide; AGG chr11 5380978 5380997 5380981 -
tcaggagaactgaatcccca

SEQ ID NO: 31206 - DNA, 20 bp, Artificial Sequence
  Synthetic oligonucleotide; TGG chr11 5380960 5380979 5380963 -
caaggtctgtacacatgctg

SEQ ID NO: 31207 - DNA, 20 bp, Artificial Sequence
  Synthetic oligonucleotide; TAG chr11 5380947 5380966 5380950 -
catgctgtggttttccaatg

SEQ ID NO: 31208 - DNA, 20 bp, Artificial Sequence
  Synthetic oligonucleotide; CAG chr11 5380940 5380959 5380943 -
tggttttccaatgtagccac

SEQ ID NO: 31209 - DNA, 20 bp, Artificial Sequence
  Synthetic oligonucleotide; AGG chr11 5380939 5380958 5380942 -
ggttttccaatgtagccacc

SEQ ID NO: 31210 - DNA, 20 bp, Artificial Sequence
  Synthetic oligonucleotide; GGG chr11 5380938 5380957 5380941 -
gttttccaatgtagccacca

SEQ ID NO: 31211 - DNA, 20 bp, Artificial Sequence
  Synthetic oligonucleotide; GGG chr11 5380937 5380956 5380940 -
ttttccaatgtagccaccag

SEQ ID NO: 31212 - DNA, 20 bp, Artificial Sequence
  Synthetic oligonucleotide; GGG chr11 5380936 5380955 5380939 -
tttccaatgtagccaccagg

SEQ ID NO: 31213 - DNA, 20 bp, Artificial Sequence
  Synthetic oligonucleotide; GAG chr11 5380934 5380953 5380937 -
tccaatgtagccaccagggg

SEQ ID NO: 31214 - DNA, 20 bp, Artificial Sequence
  Synthetic oligonucleotide; CAG chr11 5380927 5380946 5380930 -
tagccaccagggggagcatt

SEQ ID NO: 31215 - DNA, 20 bp, Artificial Sequence
  Synthetic oligonucleotide; AAG chr11 5380921 5380940 5380924 -
ccagggggagcattcagccc

SEQ ID NO: 31216 - DNA, 20 bp, Artificial Sequence
  Synthetic oligonucleotide; AGG chr11 5380920 5380939 5380923 -
cagggggagcattcagccca

SEQ ID NO: 31217 - DNA, 20 bp, Artificial Sequence
  Synthetic oligonucleotide; TAG chr11 5380916 5380935 5380919 -
gggagcattcagcccaagga

SEQ ID NO: 31218 - DNA, 20 bp, Artificial Sequence
  Synthetic oligonucleotide; AGG chr11 5380915 5380934 5380918 -
ggagcattcagcccaaggat

SEQ ID NO: 31219 - DNA, 20 bp, Artificial Sequence
  Synthetic oligonucleotide; CAG chr11 5380899 5380918 5380902 -
ggataggcttaaattctgac

SEQ ID NO: 31220 - DNA, 20 bp, Artificial Sequence
  Synthetic oligonucleotide; AAG chr11 5380892 5380911 5380895 -
cttaaattctgaccagcacc

SEQ ID NO: 31221 - DNA, 20 bp, Artificial Sequence
  Synthetic oligonucleotide; AGG chr11 5380891 5380910 5380894 -
ttaaattctgaccagcacca

SEQ ID NO: 31222 - DNA, 20 bp, Artificial Sequence
  Synthetic oligonucleotide; CAG chr11 5380876 5380895 5380879 -
caccaaggccctactatccc

SEQ ID NO: 31223 - DNA, 20 bp, Artificial Sequence
  Synthetic oligonucleotide; AGG chr11 5380875 5380894 5380878 -
accaaggccctactatcccc

SEQ ID NO: 31224 - DNA, 20 bp, Artificial Sequence
  Synthetic oligonucleotide; GGG chr11 5380874 5380893 5380877 -
ccaaggccctactatcccca

SEQ ID NO: 31225 - DNA, 20 bp, Artificial Sequence
  Synthetic oligonucleotide; AAG chr11 5380868 5380887 5380871 -
ccctactatccccagggcac

SEQ ID NO: 31226 - DNA, 20 bp, Artificial Sequence
  Synthetic oligonucleotide; TGG chr11 5380859 5380878 5380862 -
ccccagggcacaagaaaatg

SEQ ID NO: 31227 - DNA, 20 bp, Artificial Sequence
  Synthetic oligonucleotide; CAG chr11 5380847 5380866 5380850 -
agaaaatgtggcttttcttc

SEQ ID NO: 31228 - DNA, 20 bp, Artificial Sequence
  Synthetic oligonucleotide; CAG chr11 5380811 5380830 5380814 -
tgtcctcaatacccactaca

SEQ ID NO: 31229 - DNA, 20 bp, Artificial Sequence
  Synthetic oligonucleotide; AAG chr11 5380804 5380823 5380807 -
aatacccactacacagctga

SEQ ID NO: 31230 - DNA, 20 bp, Artificial Sequence
  Synthetic oligonucleotide; CAG chr11 5380793 5380812 5380796 -
cacagctgaaagctgccaac

SEQ ID NO: 31231 - DNA, 20 bp, Artificial Sequence
  Synthetic oligonucleotide; GAG chr11 5380776 5380795 5380779 -
aaccagttcattcttccttt

SEQ ID NO: 31232 - DNA, 20 bp, Artificial Sequence
  Synthetic oligonucleotide; AGG chr11 5380775 5380794 5380778 -
accagttcattcttcctttg

SEQ ID NO: 31233 - DNA, 20 bp, Artificial Sequence
  Synthetic oligonucleotide; TAG chr11 5380744 5380763 5380747 -
cctctctctcatgcacaaaa

SEQ ID NO: 31234 - DNA, 20 bp, Artificial Sequence
  Synthetic oligonucleotide; TGG chr11 5380701 5380720 5380704 -
cacataaaaactaaaattga

SEQ ID NO: 31235 - DNA, 20 bp, Artificial Sequence
  Synthetic oligonucleotide; GAG chr11 5380699 5380718 5380702 -
cataaaaactaaaattgatg

SEQ ID NO: 31236 - DNA, 20 bp, Artificial Sequence
  Synthetic oligonucleotide; GAG chr11 5380697 5380716 5380700 -
taaaaactaaaattgatgga

SEQ ID NO: 31237 - DNA, 20 bp, Artificial Sequence
  Synthetic oligonucleotide; GAG chr11 5380695 5380714 5380698 -
aaaactaaaattgatggaga

SEQ ID NO: 31238 - DNA, 20 bp, Artificial Sequence
  Synthetic oligonucleotide; TAG chr11 5380691 5380710 5380694 -
ctaaaattgatggagagaga

SEQ ID NO: 31239 - DNA, 20 bp, Artificial Sequence
  Synthetic oligonucleotide; AGG chr11 5380690 5380709 5380693 -
taaaattgatggagagagat

SEQ ID NO: 31240 - DNA, 20 bp, Artificial Sequence
  Synthetic oligonucleotide; TAG chr11 5380681 5380700 5380684 -
tggagagagataggttttct

SEQ ID NO: 31241 - DNA, 20 bp, Artificial Sequence
  Synthetic oligonucleotide; CAG chr11 5380672 5380691 5380675 -
ataggttttcttagcttttt

SEQ ID NO: 31242 - DNA, 20 bp, Artificial Sequence
  Synthetic oligonucleotide; CAG chr11 5380662 5380681 5380665 -
ttagctttttcagattttta

SEQ ID NO: 31243 - DNA, 20 bp, Artificial Sequence
  Synthetic oligonucleotide; TGG chr11 5380658 5380677 5380661 -
ctttttcagatttttacaga

SEQ ID NO: 31244 - DNA, 20 bp, Artificial Sequence
  Synthetic oligonucleotide; TGG chr11 5380631 5380650 5380634 -
ctcacacaaatctatgtgtg

SEQ ID NO: 31245 - DNA, 20 bp, Artificial Sequence
  Synthetic oligonucleotide; TAG chr11 5380624 5380643 5380627 -
aaatctatgtgtgtggcctt

SEQ ID NO: 31246 - DNA, 20 bp, Artificial Sequence
  Synthetic oligonucleotide; AAG chr11 5380604 5380623 5380607 -
tagtcttaatcatattgacc

SEQ ID NO: 31247 - DNA, 20 bp, Artificial Sequence
  Synthetic oligonucleotide; CAG chr11 5380581 5380600 5380584 -
ccttaaatccccactctgac

SEQ ID NO: 31248 - DNA, 20 bp, Artificial Sequence
  Synthetic oligonucleotide; CAG chr11 5380575 5380594 5380578 -
atccccactctgaccagaaa

SEQ ID NO: 31249 - DNA, 20 bp, Artificial Sequence
  Synthetic oligonucleotide; CAG chr11 5380550 5380569 5380553 -
ctaaataaaatccttactca

SEQ ID NO: 31250 - DNA, 20 bp, Artificial Sequence
  Synthetic oligonucleotide; AGG chr11 5380549 5380568 5380552 -
taaataaaatccttactcac

SEQ ID NO: 31251 - DNA, 20 bp, Artificial Sequence
  Synthetic oligonucleotide; GGG chr11 5380548 5380567 5380551 -
aaataaaatccttactcaca

SEQ ID NO: 31252 - DNA, 20 bp, Artificial Sequence
  Synthetic oligonucleotide; CAG chr11 5380532 5380551 5380535 -
cacagggttctcaatgtctc

SEQ ID NO: 31253 - DNA, 20 bp, Artificial Sequence
  Synthetic oligonucleotide; CAG chr11 5380521 5380540 5380524 -
caatgtctccagactcacaa

SEQ ID NO: 31254 - DNA, 20 bp, Artificial Sequence
  Synthetic oligonucleotide; TAG chr11 5380510 5380529 5380513 -
gactcacaacagactctttt

SEQ ID NO: 31255 - DNA, 20 bp, Artificial Sequence
  Synthetic oligonucleotide; AGG chr11 5380509 5380528 5380512 -
actcacaacagactcttttt

SEQ ID NO: 31256 - DNA, 20 bp, Artificial Sequence
  Synthetic oligonucleotide; CAG chr11 5380495 5380514 5380498 -
ctttttaggtgtctctgtca

SEQ ID NO: 31257 - DNA, 20 bp, Artificial Sequence
  Synthetic oligonucleotide; TGG chr11 5380488 5380507 5380491 -
ggtgtctctgtcacagaaaa

SEQ ID NO: 31258 - DNA, 20 bp, Artificial Sequence
  Synthetic oligonucleotide; AAG chr11 5380481 5380500 5380484 -
ctgtcacagaaaatggccac

SEQ ID NO: 31259 - DNA, 20 bp, Artificial Sequence
  Synthetic oligonucleotide; AGG chr11 5380480 5380499 5380483 -
tgtcacagaaaatggccaca

SEQ ID NO: 31260 - DNA, 20 bp, Artificial Sequence
  Synthetic oligonucleotide; CAG chr11 5380465 5380484 5380468 -
ccacaaggtcacctcactct

SEQ ID NO: 31261 - DNA, 20 bp, Artificial Sequence
  Synthetic oligonucleotide; AGG chr11 5380464 5380483 5380467 -
cacaaggtcacctcactctc

SEQ ID NO: 31262 - DNA, 20 bp, Artificial Sequence
  Synthetic oligonucleotide; TAG chr11 5380456 5380475 5380459 -
cacctcactctcaggcctgt

SEQ ID NO: 31263 - DNA, 20 bp, Artificial Sequence
  Synthetic oligonucleotide; AAG chr11 5380450 5380469 5380453 -
actctcaggcctgttagaac

SEQ ID NO: 31264 - DNA, 20 bp, Artificial Sequence
  Synthetic oligonucleotide; CAG chr11 5380440 5380459 5380443 -
ctgttagaacaagtccttcc

SEQ ID NO: 31265 - DNA, 20 bp, Artificial Sequence
  Synthetic oligonucleotide; AAG chr11 5380437 5380456 5380440 -
ttagaacaagtccttcccag

SEQ ID NO: 31266 - DNA, 20 bp, Artificial Sequence
  Synthetic oligonucleotide; TGG chr11 5380422 5380441 5380425 -
cccagaagaactccattttg

SEQ ID NO: 31267 - DNA, 20 bp, Artificial Sequence
  Synthetic oligonucleotide; GAG chr11 5380416 5380435 5380419 -
agaactccattttgtggtgt

SEQ ID NO: 31268 - DNA, 20 bp, Artificial Sequence
  Synthetic oligonucleotide; CGG chr11 5380406 5380425 5380409 -
tttgtggtgtgagatcgatg

SEQ ID NO: 31269 - DNA, 20 bp, Artificial Sequence
  Synthetic oligonucleotide; GGG chr11 5380405 5380424 5380408 -
ttgtggtgtgagatcgatgc

SEQ ID NO: 31270 - DNA, 20 bp, Artificial Sequence
  Synthetic oligonucleotide; CAG chr11 5380397 5380416 5380400 -
tgagatcgatgcgggtcttt

SEQ ID NO: 31271 - DNA, 20 bp, Artificial Sequence
  Synthetic oligonucleotide; TGG chr11 5380392 5380411 5380395 -
tcgatgcgggtctttcagac

SEQ ID NO: 31272 - DNA, 20 bp, Artificial Sequence
  Synthetic oligonucleotide; GAG chr11 5380390 5380409 5380393 -
gatgcgggtctttcagactg

SEQ ID NO: 31273 - DNA, 20 bp, Artificial Sequence
  Synthetic oligonucleotide; GAG chr11 5380388 5380407 5380391 -
tgcgggtctttcagactgga

SEQ ID NO: 31274 - DNA, 20 bp, Artificial Sequence
  Synthetic oligonucleotide; CAG chr11 5380380 5380399 5380383 -
tttcagactggagagaccca

SEQ ID NO: 31275 - DNA, 20 bp, Artificial Sequence
  Synthetic oligonucleotide; AAG chr11 5380377 5380396 5380380 -
cagactggagagacccacag

SEQ ID NO: 31276 - DNA, 20 bp, Artificial Sequence
  Synthetic oligonucleotide; TAG chr11 5380373 5380392 5380376 -
ctggagagacccacagaagt

SEQ ID NO: 31277 - DNA, 20 bp, Artificial Sequence
  Synthetic oligonucleotide; AGG chr11 5380372 5380391 5380375 -
tggagagacccacagaagtt

SEQ ID NO: 31278 - DNA, 20 bp, Artificial Sequence
  Synthetic oligonucleotide; AAG chr11 5380361 5380380 5380364 -
acagaagttaggattgccaa

SEQ ID NO: 31279 - DNA, 20 bp, Artificial Sequence
  Synthetic oligonucleotide; AGG chr11 5380360 5380379 5380363 -
cagaagttaggattgccaaa

SEQ ID NO: 31280 - DNA, 20 bp, Artificial Sequence
  Synthetic oligonucleotide; GGG chr11 5380359 5380378 5380362 -
agaagttaggattgccaaaa

SEQ ID NO: 31281 - DNA, 20 bp, Artificial Sequence
  Synthetic oligonucleotide; TGG chr11 5380351 5380370 5380354 -
ggattgccaaaagggtcttc

SEQ ID NO: 31282 - DNA, 20 bp, Artificial Sequence
  Synthetic oligonucleotide; TGG chr11 5380346 5380365 5380349 -
gccaaaagggtcttctggac

SEQ ID NO: 31283 - DNA, 20 bp, Artificial Sequence
  Synthetic oligonucleotide; CAG chr11 5380339 5380358 5380342 -
gggtcttctggactggtcca

SEQ ID NO: 31284 - DNA, 20 bp, Artificial Sequence
  Synthetic oligonucleotide; AAG chr11 5380331 5380350 5380334 -
tggactggtccacagcccct

SEQ ID NO: 31285 - DNA, 20 bp, Artificial Sequence
  Synthetic oligonucleotide; TGG chr11 5380284 5380303 5380287 -
tgtccatccccctgcctccc

SEQ ID NO: 31286 - DNA, 20 bp, Artificial Sequence
  Synthetic oligonucleotide; CAG chr11 5380260 5380279 5380263 -
cacctgcatctgtgtgtgca

SEQ ID NO: 31287 - DNA, 20 bp, Artificial Sequence
  Synthetic oligonucleotide; GAG chr11 5380258 5380277 5380261 -
cctgcatctgtgtgtgcaca

SEQ ID NO: 31288 - DNA, 20 bp, Artificial Sequence
  Synthetic oligonucleotide; GAG chr11 5380256 5380275 5380259 -
tgcatctgtgtgtgcacaga

SEQ ID NO: 31289 - DNA, 20 bp, Artificial Sequence
  Synthetic oligonucleotide; TGG chr11 5380251 5380270 5380254 -
ctgtgtgtgcacagagagtc

SEQ ID NO: 31290 - DNA, 20 bp, Artificial Sequence
  Synthetic oligonucleotide; AAG chr11 5380248 5380267 5380251 -
tgtgtgcacagagagtctgg

SEQ ID NO: 31291 - DNA, 20 bp, Artificial Sequence
  Synthetic oligonucleotide; AGG chr11 5380247 5380266 5380250 -
gtgtgcacagagagtctgga

SEQ ID NO: 31292 - DNA, 20 bp, Artificial Sequence
  Synthetic oligonucleotide; CAG chr11 5380240 5380259 5380243 -
cagagagtctggaaggttta

SEQ ID NO: 31293 - DNA, 20 bp, Artificial Sequence
  Synthetic oligonucleotide; GAG chr11 5380238 5380257 5380241 -
gagagtctggaaggtttaca

SEQ ID NO: 31294 - DNA, 20 bp, Artificial Sequence
  Synthetic oligonucleotide; AAG chr11 5380235 5380254 5380238 -
agtctggaaggtttacagag

SEQ ID NO: 31295 - DNA, 20 bp, Artificial Sequence
  Synthetic oligonucleotide; CAG chr11 5380216 5380235 5380219 -
gaagtctccacatcttccca

SEQ ID NO: 31296 - DNA, 20 bp, Artificial Sequence
  Synthetic oligonucleotide; CAG chr11 5380204 5380223 5380207 -
tcttcccacagcaactcttt

SEQ ID NO: 31297 - DNA, 20 bp, Artificial Sequence
  Synthetic oligonucleotide; CAG chr11 5380168 5380187 5380171 -
cgtaacatcctacctctctt

SEQ ID NO: 31298 - DNA, 20 bp, Artificial Sequence
  Synthetic oligonucleotide; AAG chr11 5380156 5380175 5380159 -
cctctcttcagtcattatga

SEQ ID NO: 31299 - DNA, 20 bp, Artificial Sequence
  Synthetic oligonucleotide; AGG chr11 5380155 5380174 5380158 -
ctctcttcagtcattatgaa

SEQ ID NO: 31300 - DNA, 20 bp, Artificial Sequence
  Synthetic oligonucleotide; GGG chr11 5380154 5380173 5380157 -
tctcttcagtcattatgaaa

SEQ ID NO: 31301 - DNA, 20 bp, Artificial Sequence
  Synthetic oligonucleotide; CAG chr11 5380119 5380138 5380122 -
ttttcattgtgaaaactttt

SEQ ID NO: 31302 - DNA, 20 bp, Artificial Sequence
  Synthetic oligonucleotide; GAG chr11 5380117 5380136 5380120 -
ttcattgtgaaaacttttca

SEQ ID NO: 31303 - DNA, 20 bp, Artificial Sequence
  Synthetic oligonucleotide; GAG chr11 5380115 5380134 5380118 -
cattgtgaaaacttttcaga

SEQ ID NO: 31304 - DNA, 20 bp, Artificial Sequence
  Synthetic oligonucleotide; TGG chr11 5380104 5380123 5380107 -
cttttcagagagaccccttt

SEQ ID NO: 31305 - DNA, 20 bp, Artificial Sequence
  Synthetic oligonucleotide; GGG chr11 5380103 5380122 5380106 -
ttttcagagagacccctttt

SEQ ID NO: 31306 - DNA, 20 bp, Artificial Sequence
  Synthetic oligonucleotide; AAG chr11 5380077 5380096 5380080 -
ccatctcttctccccactcc

SEQ ID NO: 31307 - DNA, 20 bp, Artificial Sequence
  Synthetic oligonucleotide; TGG chr11 5380073 5380092 5380076 -
ctcttctccccactccaagt

SEQ ID NO: 31308 - DNA, 20 bp, Artificial Sequence
  Synthetic oligonucleotide; GGG chr11 5380072 5380091 5380075 -
tcttctccccactccaagtt

SEQ ID NO: 31309 - DNA, 20 bp, Artificial Sequence
  Synthetic oligonucleotide; AAG chr11 5380066 5380085 5380069 -
ccccactccaagttgggcta

SEQ ID NO: 31310 - DNA, 20 bp, Artificial Sequence
  Synthetic oligonucleotide; TAG chr11 5380060 5380079 5380063 -
tccaagttgggctaaagttt

SEQ ID NO: 31311 - DNA, 20 bp, Artificial Sequence
  Synthetic oligonucleotide; CAG chr11 5380028 5380047 5380031 -
catattttgatttgctataa

SEQ ID NO: 31312 - DNA, 20 bp, Artificial Sequence
  Synthetic oligonucleotide; GAG chr11 5380026 5380045 5380029 -
tattttgatttgctataaca

SEQ ID NO: 31313 - DNA, 20 bp, Artificial Sequence
  Synthetic oligonucleotide; GAG chr11 5380018 5380037 5380021 -
tttgctataacagagtacct

SEQ ID NO: 31314 - DNA, 20 bp, Artificial Sequence
  Synthetic oligonucleotide; TGG chr11 5380013 5380032 5380016 -
tataacagagtacctgagtc

SEQ ID NO: 31315 - DNA, 20 bp, Artificial Sequence
  Synthetic oligonucleotide; GGG chr11 5380012 5380031 5380015 -
ataacagagtacctgagtct

SEQ ID NO: 31316 - DNA, 20 bp, Artificial Sequence
  Synthetic oligonucleotide; TAG chr11 5380009 5380028 5380012 -
acagagtacctgagtctggg

SEQ ID NO: 31317 - DNA, 20 bp, Artificial Sequence
  Synthetic oligonucleotide; AAG chr11 5379989 5380008 5379992 -
tagcttatttttttttttta

SEQ ID NO: 31318 - DNA, 20 bp, Artificial Sequence
  Synthetic oligonucleotide; TGG chr11 5379979 5379998 5379982 -
tttttttttaaagttttgtt

SEQ ID NO: 31319 - DNA, 20 bp, Artificial Sequence
  Synthetic oligonucleotide; TGG chr11 5379966 5379985 5379969 -
ttttgtttggttcatgattc

SEQ ID NO: 31320 - DNA, 20 bp, Artificial Sequence
  Synthetic oligonucleotide; AAG chr11 5379955 5379974 5379958 -
tcatgattctggtgacttaa

SEQ ID NO: 31321 - DNA, 20 bp, Artificial Sequence
  Synthetic oligonucleotide; AAG chr11 5379949 5379968 5379952 -
ttctggtgacttaaaagtcc

SEQ ID NO: 31322 - DNA, 20 bp, Artificial Sequence
  Synthetic oligonucleotide; CGG chr11 5379944 5379963 5379947 -
gtgacttaaaagtccaagat

SEQ ID NO: 31323 - DNA, 20 bp, Artificial Sequence
  Synthetic oligonucleotide; GGG chr11 5379943 5379962 5379946 -
tgacttaaaagtccaagatc

SEQ ID NO: 31324 - DNA, 20 bp, Artificial Sequence
  Synthetic oligonucleotide; CGG chr11 5379940 5379959 5379943 -
cttaaaagtccaagatcggg

SEQ ID NO: 31325 - DNA, 20 bp, Artificial Sequence
  Synthetic oligonucleotide; AAG chr11 5379925 5379944 5379928 -
tcgggcggttgcatctgata

SEQ ID NO: 31326 - DNA, 20 bp, Artificial Sequence
  Synthetic oligonucleotide; AGG chr11 5379924 5379943 5379927 -
cgggcggttgcatctgataa

SEQ ID NO: 31327 - DNA, 20 bp, Artificial Sequence
  Synthetic oligonucleotide; TGG chr11 5379913 5379932 5379916 -
atctgataaaggtctcatgc

SEQ ID NO: 31328 - DNA, 20 bp, Artificial Sequence
  Synthetic oligonucleotide; TGG chr11 5379901 5379920 5379904 -
tctcatgctggttccaaaca

SEQ ID NO: 31329 - DNA, 20 bp, Artificial Sequence
  Synthetic oligonucleotide; CAG chr11 5379898 5379917 5379901 -
catgctggttccaaacatgg

SEQ ID NO: 31330 - DNA, 20 bp, Artificial Sequence
  Synthetic oligonucleotide; AAG chr11 5379894 5379913 5379897 -
ctggttccaaacatggcaga

SEQ ID NO: 31331 - DNA, 20 bp, Artificial Sequence
  Synthetic oligonucleotide; CAG chr11 5379891 5379910 5379894 -
gttccaaacatggcagaaag

SEQ ID NO: 31332 - DNA, 20 bp, Artificial Sequence
  Synthetic oligonucleotide; AAG chr11 5379885 5379904 5379888 -
aacatggcagaaagcagaca

SEQ ID NO: 31333 - DNA, 20 bp, Artificial Sequence
  Synthetic oligonucleotide; GAG chr11 5379883 5379902 5379886 -
catggcagaaagcagacaaa

SEQ ID NO: 31334 - DNA, 20 bp, Artificial Sequence
  Synthetic oligonucleotide; AAG chr11 5379879 5379898 5379882 -
gcagaaagcagacaaagagc

SEQ ID NO: 31335 - DNA, 20 bp, Artificial Sequence
  Synthetic oligonucleotide; AAG chr11 5379869 5379888 5379872 -
gacaaagagcaagtgcatgc

SEQ ID NO: 31336 - DNA, 20 bp, Artificial Sequence
  Synthetic oligonucleotide; AGG chr11 5379868 5379887 5379871 -
acaaagagcaagtgcatgca

SEQ ID NO: 31337 - DNA, 20 bp, Artificial Sequence
  Synthetic oligonucleotide; GAG chr11 5379866 5379885 5379869 -
aaagagcaagtgcatgcaag

SEQ ID NO: 31338 - DNA, 20 bp, Artificial Sequence
  Synthetic oligonucleotide; GAG chr11 5379853 5379872 5379856 -
atgcaaggagatcacatgat

SEQ ID NO: 31339 - DNA, 20 bp, Artificial Sequence
  Synthetic oligonucleotide; GAG chr11 5379851 5379870 5379854 -
gcaaggagatcacatgatga

SEQ ID NO: 31340 - DNA, 20 bp, Artificial Sequence
  Synthetic oligonucleotide; GAG chr11 5379849 5379868 5379852 -
aaggagatcacatgatgaga

SEQ ID NO: 31341 - DNA, 20 bp, Artificial Sequence
  Synthetic oligonucleotide; AGG chr11 5379848 5379867 5379851 -
aggagatcacatgatgagag

SEQ ID NO: 31342 - DNA, 20 bp, Artificial Sequence
  Synthetic oligonucleotide; CAG chr11 5379841 5379860 5379844 -
cacatgatgagagaggacgc

SEQ ID NO: 31343 - DNA, 20 bp, Artificial Sequence
  Synthetic oligonucleotide; AGG chr11 5379840 5379859 5379843 -
acatgatgagagaggacgcc

SEQ ID NO: 31344 - DNA, 20 bp, Artificial Sequence
  Synthetic oligonucleotide; GGG chr11 5379839 5379858 5379842 -
catgatgagagaggacgcca

SEQ ID NO: 31345 - DNA, 20 bp, Artificial Sequence
  Synthetic oligonucleotide; GAG chr11 5379837 5379856 5379840 -
tgatgagagaggacgccagg

SEQ ID NO: 31346 - DNA, 20 bp, Artificial Sequence
  Synthetic oligonucleotide; GAG chr11 5379835 5379854 5379838 -
atgagagaggacgccaggga

SEQ ID NO: 31347 - DNA, 20 bp, Artificial Sequence
  Synthetic oligonucleotide; CAG chr11 5379827 5379846 5379830 -
ggacgccagggagagaaacc

SEQ ID NO: 31348 - DNA, 20 bp, Artificial Sequence
  Synthetic oligonucleotide; AAG chr11 5379823 5379842 5379826 -
gccagggagagaaacccaga

SEQ ID NO: 31349 - DNA, 20 bp, Artificial Sequence
  Synthetic oligonucleotide; CAG chr11 5379819 5379838 5379822 -
gggagagaaacccagaaagc

SEQ ID NO: 31350 - DNA, 20 bp, Artificial Sequence
  Synthetic oligonucleotide; TGG chr11 5379811 5379830 5379814 -
aacccagaaagccagactca

SEQ ID NO: 31351 - DNA, 20 bp, Artificial Sequence
  Synthetic oligonucleotide; GGG chr11 5379810 5379829 5379813 -
acccagaaagccagactcat

SEQ ID NO: 31352 - DNA, 20 bp, Artificial Sequence
  Synthetic oligonucleotide; AAG chr11 5379806 5379825 5379809 -
agaaagccagactcatggga

SEQ ID NO: 31353 - DNA, 20 bp, Artificial Sequence
  Synthetic oligonucleotide; AAG chr11 5379799 5379818 5379802 -
cagactcatgggaaagtatc

SEQ ID NO: 31354 - DNA, 20 bp, Artificial Sequence
  Synthetic oligonucleotide; TAG chr11 5379776 5379795 5379779 -
ctgtccaccatatgtgaaat

SEQ ID NO: 31355 - DNA, 20 bp, Artificial Sequence
  Synthetic oligonucleotide; AAG chr11 5379765 5379784 5379768 -
atgtgaaattagaattctaa

SEQ ID NO: 31356 - DNA, 20 bp, Artificial Sequence
  Synthetic oligonucleotide; AGG chr11 5379764 5379783 5379767 -
tgtgaaattagaattctaaa

SEQ ID NO: 31357 - DNA, 20 bp, Artificial Sequence
  Synthetic oligonucleotide; TGG chr11 5379751 5379770 5379754 -
ttctaaaaggaaacaaaaaa

SEQ ID NO: 31358 - DNA, 20 bp, Artificial Sequence
  Synthetic oligonucleotide; GAG chr11 5379734 5379753 5379737 -
aaatggattaaacgtttttt

SEQ ID NO: 31359 - DNA, 20 bp, Artificial Sequence
  Synthetic oligonucleotide; AGG chr11 5379733 5379752 5379736 -
aatggattaaacgttttttg

SEQ ID NO: 31360 - DNA, 20 bp, Artificial Sequence
  Synthetic oligonucleotide; TGG chr11 5379704 5379723 5379707 -
tgactgaatgtttcaacatc

SEQ ID NO: 31361 - DNA, 20 bp, Artificial Sequence
  Synthetic oligonucleotide; TAG chr11 5379675 5379694 5379678 -
aatctattaattcatatctt

SEQ ID NO: 31362 - DNA, 20 bp, Artificial Sequence
  Synthetic oligonucleotide; GAG chr11 5379664 5379683 5379667 -
tcatatctttagctaacctt

SEQ ID NO: 31363 - DNA, 20 bp, Artificial Sequence
  Synthetic oligonucleotide; TGG chr11 5379614 5379633 5379617 -
ctaaatgcatatcttacaaa

SEQ ID NO: 31364 - DNA, 20 bp, Artificial Sequence
  Synthetic oligonucleotide; AAG chr11 5379582 5379601 5379585 -
caaatgtatgccaatcttaa

SEQ ID NO: 31365 - DNA, 20 bp, Artificial Sequence
  Synthetic oligonucleotide; CAG chr11 5379579 5379598 5379582 -
atgtatgccaatcttaaaag

SEQ ID NO: 31366 - DNA, 20 bp, Artificial Sequence
  Synthetic oligonucleotide; TAG chr11 5379573 5379592 5379576 -
gccaatcttaaaagcagaca

SEQ ID NO: 31367 - DNA, 20 bp, Artificial Sequence
  Synthetic oligonucleotide; AAG chr11 5379567 5379586 5379570 -
cttaaaagcagacatagaaa

SEQ ID NO: 31368 - DNA, 20 bp, Artificial Sequence
  Synthetic oligonucleotide; AAG chr11 5379551 5379570 5379554 -
gaaaaagacacattgcatac

SEQ ID NO: 31369 - DNA, 20 bp, Artificial Sequence
  Synthetic oligonucleotide; TAG chr11 5379540 5379559 5379543 -
attgcatacaagaaaattat

SEQ ID NO: 31370 - DNA, 20 bp, Artificial Sequence
  Synthetic oligonucleotide; GAG chr11 5379538 5379557 5379541 -
tgcatacaagaaaattatta

SEQ ID NO: 31371 - DNA, 20 bp, Artificial Sequence
  Synthetic oligonucleotide; AGG chr11 5379537 5379556 5379540 -
gcatacaagaaaattattag

SEQ ID NO: 31372 - DNA, 20 bp, Artificial Sequence
  Synthetic oligonucleotide; CGG chr11 5379528 5379547 5379531 -
aaaattattagaggaaacaa

SEQ ID NO: 31373 - DNA, 20 bp, Artificial Sequence
  Synthetic oligonucleotide; TGG chr11 5379507 5379526 5379510 -
ggaaacctgaaaaaataaac

SEQ ID NO: 31374 - DNA, 20 bp, Artificial Sequence
  Synthetic oligonucleotide; AAG chr11 5379451 5379470 5379454 -
tattattattattatacttt

SEQ ID NO: 31375 - DNA, 20 bp, Artificial Sequence
  Synthetic oligonucleotide; TAG chr11 5379445 5379464 5379448 -
tattattatactttaagatt

SEQ ID NO: 31376 - DNA, 20 bp, Artificial Sequence
  Synthetic oligonucleotide; AGG chr11 5379444 5379463 5379447 -
attattatactttaagattt

SEQ ID NO: 31377 - DNA, 20 bp, Artificial Sequence
  Synthetic oligonucleotide; GGG chr11 5379443 5379462 5379446 -
ttattatactttaagattta

SEQ ID NO: 31378 - DNA, 20 bp, Artificial Sequence
  Synthetic oligonucleotide; CGG chr11 5379422 5379441 5379425 -
ggtacatgtgcataatgtgc

SEQ ID NO: 31379 - DNA, 20 bp, Artificial Sequence
  Synthetic oligonucleotide; TAG chr11 5379418 5379437 5379421 -
catgtgcataatgtgccggt

SEQ ID NO: 31380 - DNA, 20 bp, Artificial Sequence
  Synthetic oligonucleotide; TGG chr11 5379390 5379409 5379393 -
tatgtatacatgtgccatgt

SEQ ID NO: 31381 - DNA, 20 bp, Artificial Sequence
  Synthetic oligonucleotide; TAG chr11 5379361 5379380 5379364 -
gcacccattaactcgtaatt

SEQ ID NO: 31382 - DNA, 20 bp, Artificial Sequence
  Synthetic oligonucleotide; TAG chr11 5379355 5379374 5379358 -
attaactcgtaatttagcat

SEQ ID NO: 31383 - DNA, 20 bp, Artificial Sequence
  Synthetic oligonucleotide; AGG chr11 5379354 5379373 5379357 -
ttaactcgtaatttagcatt

SEQ ID NO: 31384 - DNA, 20 bp, Artificial Sequence
  Synthetic oligonucleotide; CAG chr11 5379308 5379327 5379311 -
cctgcacccccaccccacaa

SEQ ID NO: 31385 - DNA, 20 bp, Artificial Sequence
  Synthetic oligonucleotide; CAG chr11 5379301 5379320 5379304 -
ccccaccccacaacagtccc

SEQ ID NO: 31386 - DNA, 20 bp, Artificial Sequence
  Synthetic oligonucleotide; GAG chr11 5379299 5379318 5379302 -
ccaccccacaacagtcccca

SEQ ID NO: 31387 - DNA, 20 bp, Artificial Sequence
  Synthetic oligonucleotide; CAG chr11 5379256 5379275 5379259 -
gtccatgtgttctcattgtt

SEQ ID NO: 31388 - DNA, 20 bp, Artificial Sequence
  Synthetic oligonucleotide; GAG chr11 5379242 5379261 5379245 -
attgttcagttcccatctat

SEQ ID NO: 31389 - DNA, 20 bp, Artificial Sequence
  Synthetic oligonucleotide; GAG chr11 5379238 5379257 5379241 -
ttcagttcccatctatgagt

SEQ ID NO: 31390 - DNA, 20 bp, Artificial Sequence
  Synthetic oligonucleotide; TGG chr11 5379229 5379248 5379232 -
catctatgagtgagaatatg

SEQ ID NO: 31391 - DNA, 20 bp, Artificial Sequence
  Synthetic oligonucleotide; TGG chr11 5379222 5379241 5379225 -
gagtgagaatatgtggtgtt

SEQ ID NO: 31392 - DNA, 20 bp, Artificial Sequence
  Synthetic oligonucleotide; TAG chr11 5379203 5379222 5379206 -
ttggttttttgtccttgcga

SEQ ID NO: 31393 - DNA, 20 bp, Artificial Sequence
  Synthetic oligonucleotide; GAG chr11 5379194 5379213 5379197 -
tgtccttgcgatagtttact

SEQ ID NO: 31394 - DNA, 20 bp, Artificial Sequence
  Synthetic oligonucleotide; AAG chr11 5379157 5379176 5379160 -
atttcatccatgtccctaca

SEQ ID NO: 31395 - DNA, 20 bp, Artificial Sequence
  Synthetic oligonucleotide; AGG chr11 5379156 5379175 5379159 -
tttcatccatgtccctacaa

SEQ ID NO: 31396 - DNA, 20 bp, Artificial Sequence
  Synthetic oligonucleotide; TGG chr11 5379133 5379152 5379136 -
acatgaactcatcattttta

SEQ ID NO: 31397 - DNA, 20 bp, Artificial Sequence
  Synthetic oligonucleotide; TAG chr11 5379125 5379144 5379128 -
tcatcatttttatggctgca

SEQ ID NO: 31398 - DNA, 20 bp, Artificial Sequence
  Synthetic oligonucleotide; TGG chr11 5379115 5379134 5379118 -
tatggctgcatagtattcca

SEQ ID NO: 31399 - DNA, 20 bp, Artificial Sequence
  Synthetic oligonucleotide; CAG chr11 5379086 5379105 5379089 -
tgtgccacattttcttaatc

SEQ ID NO: 31400 - DNA, 20 bp, Artificial Sequence
  Synthetic oligonucleotide; TGG chr11 5379072 5379091 5379075 -
ttaatccagtctatcattgt

SEQ ID NO: 31401 - DNA, 20 bp, Artificial Sequence
  Synthetic oligonucleotide; TGG chr11 5379064 5379083 5379067 -
gtctatcattgttggacatt

SEQ ID NO: 31402 - DNA, 20 bp, Artificial Sequence
  Synthetic oligonucleotide; GGG chr11 5379063 5379082 5379066 -
tctatcattgttggacattt

SEQ ID NO: 31403 - DNA, 20 bp, Artificial Sequence
  Synthetic oligonucleotide; TGG chr11 5379059 5379078 5379062 -
tcattgttggacatttgggt

SEQ ID NO: 31404 - DNA, 20 bp, Artificial Sequence
  Synthetic oligonucleotide; AAG chr11 5379052 5379071 5379055 -
tggacatttgggttggttcc

SEQ ID NO: 31405 - DNA, 20 bp, Artificial Sequence
  Synthetic oligonucleotide; TAG chr11 5379033 5379052 5379036 -
caagtctttgctattgtgaa

SEQ ID NO: 31406 - DNA, 20 bp, Artificial Sequence
  Synthetic oligonucleotide; TAG chr11 5378996 5379015 5378999 -
tacgtgtgcatgtgtcttta

SEQ ID NO: 31407 - DNA, 20 bp, Artificial Sequence
  Synthetic oligonucleotide; CAG chr11 5378993 5379012 5378996 -
gtgtgcatgtgtctttatag

SEQ ID NO: 31408 - DNA, 20 bp, Artificial Sequence
  Synthetic oligonucleotide; TGG chr11 5378973 5378992 5378976 -
cagcatgatttatattcctt

SEQ ID NO: 31409 - DNA, 20 bp, Artificial Sequence
  Synthetic oligonucleotide; GGG chr11 5378972 5378991 5378975 -
agcatgatttatattccttt

SEQ ID NO: 31410 - DNA, 20 bp, Artificial Sequence
  Synthetic oligonucleotide; CAG chr11 5378961 5378980 5378964 -
tattcctttgggtatatacc

SEQ ID NO: 31411 - DNA, 20 bp, Artificial Sequence
  Synthetic oligonucleotide; TGG chr11 5378955 5378974 5378958 -
tttgggtatatacccagtaa

SEQ ID NO: 31412 - DNA, 20 bp, Artificial Sequence
  Synthetic oligonucleotide; GGG chr11 5378954 5378973 5378957 -
ttgggtatatacccagtaat

SEQ ID NO: 31413 - DNA, 20 bp, Artificial Sequence
  Synthetic oligonucleotide; TGG chr11 5378950 5378969 5378953 -
gtatatacccagtaatggga

SEQ ID NO: 31414 - DNA, 20 bp, Artificial Sequence
  Synthetic oligonucleotide; TGG chr11 5378946 5378965 5378949 -
atacccagtaatgggatggc

SEQ ID NO: 31415 - DNA, 20 bp, Artificial Sequence
  Synthetic oligonucleotide; GGG chr11 5378945 5378964 5378948 -
tacccagtaatgggatggct

SEQ ID NO: 31416 - DNA, 20 bp, Artificial Sequence
  Synthetic oligonucleotide; TGG chr11 5378937 5378956 5378940 -
aatgggatggctgggtcaaa

SEQ ID NO: 31417 - DNA, 20 bp, Artificial Sequence
  Synthetic oligonucleotide; TAG chr11 5378928 5378947 5378931 -
gctgggtcaaatggtatttc

SEQ ID NO: 31418 - DNA, 20 bp, Artificial Sequence
  Synthetic oligonucleotide; TAG chr11 5378922 5378941 5378925 -
tcaaatggtatttctagttc

SEQ ID NO: 31419 - DNA, 20 bp, Artificial Sequence
  Synthetic oligonucleotide; GAG chr11 5378913 5378932 5378916 -
atttctagttctagatccct

SEQ ID NO: 31420 - DNA, 20 bp, Artificial Sequence
  Synthetic oligonucleotide; AGG chr11 5378912 5378931 5378915 -
tttctagttctagatccctg

SEQ ID NO: 31421 - DNA, 20 bp, Artificial Sequence
  Synthetic oligonucleotide; TGG chr11 5378886 5378905 5378889 -
cgccacactgacttccacaa

SEQ ID NO: 31422 - DNA, 20 bp, Artificial Sequence
  Synthetic oligonucleotide; TAG chr11 5378877 5378896 5378880 -
gacttccacaatggttgaac

SEQ ID NO: 31423 - DNA, 20 bp, Artificial Sequence
  Synthetic oligonucleotide; CAG chr11 5378870 5378889 5378873 -
acaatggttgaactagttta

SEQ ID NO: 31424 - DNA, 20 bp, Artificial Sequence
  Synthetic oligonucleotide; AAG chr11 5378860 5378879 5378863 -
aactagtttacagtcccacc

SEQ ID NO: 31425 - DNA, 20 bp, Artificial Sequence
  Synthetic oligonucleotide; GAG chr11 5378858 5378877 5378861 -
ctagtttacagtcccaccaa

SEQ ID NO: 31426 - DNA, 20 bp, Artificial Sequence
  Synthetic oligonucleotide; AAG chr11 5378850 5378869 5378853 -
cagtcccaccaagagtgtaa

SEQ ID NO: 31427 - DNA, 20 bp, Artificial Sequence
  Synthetic oligonucleotide; CAG chr11 5378822 5378841 5378825 -
ctatttctccacatcctctc

SEQ ID NO: 31428 - DNA, 20 bp, Artificial Sequence
  Synthetic oligonucleotide; TGG chr11 5378778 5378797 5378781 -
ttaatgattgccattctaac

SEQ ID NO: 31429 - DNA, 20 bp, Artificial Sequence
  Synthetic oligonucleotide; GAG chr11 5378772 5378791 5378775 -
attgccattctaactggtat

SEQ ID NO: 31430 - DNA, 20 bp, Artificial Sequence
  Synthetic oligonucleotide; TGG chr11 5378768 5378787 5378771 -
ccattctaactggtatgaga

SEQ ID NO: 31431 - DNA, 20 bp, Artificial Sequence
  Synthetic oligonucleotide; TGG chr11 5378755 5378774 5378758 -
tatgagatggtatctcattg

SEQ ID NO: 31432 - DNA, 20 bp, Artificial Sequence
  Synthetic oligonucleotide; TGG chr11 5378731 5378750 5378734 -
tttgatttgcatttctctga

SEQ ID NO: 31433 - DNA, 20 bp, Artificial Sequence
  Synthetic oligonucleotide; CAG chr11 5378727 5378746 5378730 -
atttgcatttctctgatggc

SEQ ID NO: 31434 - DNA, 20 bp, Artificial Sequence
  Synthetic oligonucleotide; GAG chr11 5378717 5378736 5378720 -
ctctgatggccagtgatgat

SEQ ID NO: 31435 - DNA, 20 bp, Artificial Sequence
  Synthetic oligonucleotide; TGG chr11 5378695 5378714 5378698 -
gcattttttcatgtgtcttt

SEQ ID NO: 31436 - DNA, 20 bp, Artificial Sequence
  Synthetic oligonucleotide; GAG chr11 5378672 5378691 5378675 -
ttgcataaatgttttctttt

SEQ ID NO: 31437 - DNA, 20 bp, Artificial Sequence
  Synthetic oligonucleotide; AAG chr11 5378669 5378688 5378672 -
cataaatgttttcttttgag

SEQ ID NO: 31438 - DNA, 20 bp, Artificial Sequence
  Synthetic oligonucleotide; TGG chr11 5378635 5378654 5378638 -
atcctttgcccacttgttga

SEQ ID NO: 31439 - DNA, 20 bp, Artificial Sequence
  Synthetic oligonucleotide; GGG chr11 5378634 5378653 5378637 -
tcctttgcccacttgttgat

SEQ ID NO: 31440 - DNA, 20 bp, Artificial Sequence
  Synthetic oligonucleotide; GGG chr11 5378633 5378652 5378636 -
cctttgcccacttgttgatg

SEQ ID NO: 31441 - DNA, 20 bp, Artificial Sequence
  Synthetic oligonucleotide; GAG chr11 5378601 5378620 5378604 -
tttttcttgtaaatttgttt

SEQ ID NO: 31442 - DNA, 20 bp, Artificial Sequence
  Synthetic oligonucleotide; TAG chr11 5378591 5378610 5378594 -
aaatttgtttgagttcatta

SEQ ID NO: 31443 - DNA, 20 bp, Artificial Sequence
  Synthetic oligonucleotide; TGG chr11 5378584 5378603 5378587 -
tttgagttcattatagattc

SEQ ID NO: 31444 - DNA, 20 bp, Artificial Sequence
  Synthetic oligonucleotide; TAG chr11 5378577 5378596 5378580 -
tcattatagattctggatat

SEQ ID NO: 31445 - DNA, 20 bp, Artificial Sequence
  Synthetic oligonucleotide; CAG chr11 5378566 5378585 5378569 -
tctggatattagccctttgt

SEQ ID NO: 31446 - DNA, 20 bp, Artificial Sequence
  Synthetic oligonucleotide; GAG chr11 5378561 5378580 5378564 -
atattagccctttgtcagat

SEQ ID NO: 31447 - DNA, 20 bp, Artificial Sequence
  Synthetic oligonucleotide; TAG chr11 5378558 5378577 5378561 -
ttagccctttgtcagatgag

SEQ ID NO: 31448 - DNA, 20 bp, Artificial Sequence
  Synthetic oligonucleotide; AGG chr11 5378557 5378576 5378560 -
tagccctttgtcagatgagt

SEQ ID NO: 31449 - DNA, 20 bp, Artificial Sequence
  Synthetic oligonucleotide; TAG chr11 5378530 5378549 5378533 -
gaaaattttctcccattgtg

SEQ ID NO: 31450 - DNA, 20 bp, Artificial Sequence
  Synthetic oligonucleotide; AGG chr11 5378529 5378548 5378532 -
aaaattttctcccattgtgt

SEQ ID NO: 31451 - DNA, 20 bp, Artificial Sequence
  Synthetic oligonucleotide; TGG chr11 5378509 5378528 5378512 -
aggttgcctgttcactctga

SEQ ID NO: 31452 - DNA, 20 bp, Artificial Sequence
  Synthetic oligonucleotide; TAG chr11 5378506 5378525 5378509 -
ttgcctgttcactctgatgg

SEQ ID NO: 31453 - DNA, 20 bp, Artificial Sequence
  Synthetic oligonucleotide; TAG chr11 5378497 5378516 5378500 -
cactctgatggtagtttctt

SEQ ID NO: 31454 - DNA, 20 bp, Artificial Sequence
  Synthetic oligonucleotide; CAG chr11 5378489 5378508 5378492 -
tggtagtttctttagctgtg

SEQ ID NO: 31455 - DNA, 20 bp, Artificial Sequence
  Synthetic oligonucleotide; AAG chr11 5378486 5378505 5378489 -
tagtttctttagctgtgcag

SEQ ID NO: 31456 - DNA, 20 bp, Artificial Sequence
  Synthetic oligonucleotide; TAG chr11 5378478 5378497 5378481 -
ttagctgtgcagaagctctt

SEQ ID NO: 31457 - DNA, 20 bp, Artificial Sequence
  Synthetic oligonucleotide; TAG chr11 5378469 5378488 5378472 -
cagaagctctttagtttcat

SEQ ID NO: 31458 - DNA, 20 bp, Artificial Sequence
  Synthetic oligonucleotide; TAG chr11 5378459 5378478 5378462 -
ttagtttcattagatcccat

SEQ ID NO: 31459 - DNA, 20 bp, Artificial Sequence
  Synthetic oligonucleotide; TGG chr11 5378449 5378468 5378452 -
tagatcccattagtgaattt

SEQ ID NO: 31460 - DNA, 20 bp, Artificial Sequence
  Synthetic oligonucleotide; TGG chr11 5378427 5378446 5378430 -
gcttttgttgccatcgcttt

SEQ ID NO: 31461 - DNA, 20 bp, Artificial Sequence
  Synthetic oligonucleotide; TAG chr11 5378419 5378438 5378422 -
tgccatcgcttttggtgttt

SEQ ID NO: 31462 - DNA, 20 bp, Artificial Sequence
  Synthetic oligonucleotide; AAG chr11 5378411 5378430 5378414 -
cttttggtgttttagacatg

SEQ ID NO: 31463 - DNA, 20 bp, Artificial Sequence
  Synthetic oligonucleotide; TGG chr11 5378383 5378402 5378386 -
gcccatgcctatgtcctgaa

SEQ ID NO: 31464 - DNA, 20 bp, Artificial Sequence
  Synthetic oligonucleotide; TAG chr11 5378361 5378380 5378364 -
gtaatgcctgcgttttcttc

SEQ ID NO: 31465 - DNA, 20 bp, Artificial Sequence
  Synthetic oligonucleotide; AGG chr11 5378360 5378379 5378363 -
taatgcctgcgttttcttct

SEQ ID NO: 31466 - DNA, 20 bp, Artificial Sequence
  Synthetic oligonucleotide; GGG chr11 5378359 5378378 5378362 -
aatgcctgcgttttcttcta

SEQ ID NO: 31467 - DNA, 20 bp, Artificial Sequence
  Synthetic oligonucleotide; TGG chr11 5378350 5378369 5378353 -
gttttcttctagggttttta

SEQ ID NO: 31468 - DNA, 20 bp, Artificial Sequence
  Synthetic oligonucleotide; TAG chr11 5378344 5378363 5378347 -
ttctagggtttttatggttt

SEQ ID NO: 31469 - DNA, 20 bp, Artificial Sequence
  Synthetic oligonucleotide; AGG chr11 5378343 5378362 5378346 -
tctagggtttttatggtttt

SEQ ID NO: 31470 - DNA, 20 bp, Artificial Sequence
  Synthetic oligonucleotide; AAG chr11 5378330 5378349 5378333 -
tggttttaggtctaatgttt

SEQ ID NO: 31471 - DNA, 20 bp, Artificial Sequence
  Synthetic oligonucleotide; AAG chr11 5378296 5378315 5378299 -
tcttgaattaatttttgtat

SEQ ID NO: 31472 - DNA, 20 bp, Artificial Sequence
  Synthetic oligonucleotide; AGG chr11 5378295 5378314 5378298 -
cttgaattaatttttgtata

SEQ ID NO: 31473 - DNA, 20 bp, Artificial Sequence
  Synthetic oligonucleotide; AAG chr11 5378289 5378308 5378292 -
ttaatttttgtataaggtgt

SEQ ID NO: 31474 - DNA, 20 bp, Artificial Sequence
  Synthetic oligonucleotide; AGG chr11 5378288 5378307 5378291 -
taatttttgtataaggtgta

SEQ ID NO: 31475 - DNA, 20 bp, Artificial Sequence
  Synthetic oligonucleotide; AAG chr11 5378285 5378304 5378288 -
tttttgtataaggtgtaagg

SEQ ID NO: 31476 - DNA, 20 bp, Artificial Sequence
  Synthetic oligonucleotide; AGG chr11 5378284 5378303 5378287 -
ttttgtataaggtgtaagga

SEQ ID NO: 31477 - DNA, 20 bp, Artificial Sequence
  Synthetic oligonucleotide; GGG chr11 5378283 5378302 5378286 -
tttgtataaggtgtaaggaa

SEQ ID NO: 31478 - DNA, 20 bp, Artificial Sequence
  Synthetic oligonucleotide; CAG chr11 5378277 5378296 5378280 -
taaggtgtaaggaagggatc

SEQ ID NO: 31479 - DNA, 20 bp, Artificial Sequence
  Synthetic oligonucleotide; CAG chr11 5378271 5378290 5378274 -
gtaaggaagggatccagttt

SEQ ID NO: 31480 - DNA, 20 bp, Artificial Sequence
  Synthetic oligonucleotide; TGG chr11 5378257 5378276 5378260 -
cagtttcagcattctacata

SEQ ID NO: 31481 - DNA, 20 bp, Artificial Sequence
  Synthetic oligonucleotide; TAG chr11 5378253 5378272 5378256 -
ttcagcattctacatatggc

SEQ ID NO: 31482 - DNA, 20 bp, Artificial Sequence
  Synthetic oligonucleotide; CAG chr11 5378249 5378268 5378252 -
gcattctacatatggctagc

SEQ ID NO: 31483 - DNA, 20 bp, Artificial Sequence
  Synthetic oligonucleotide; CAG chr11 5378240 5378259 5378243 -
atatggctagccagttctcc

SEQ ID NO: 31484 - DNA, 20 bp, Artificial Sequence
  Synthetic oligonucleotide; TAG chr11 5378223 5378242 5378226 -
tcccagcaccatttattaaa

SEQ ID NO: 31485 - DNA, 20 bp, Artificial Sequence
  Synthetic oligonucleotide; AGG chr11 5378222 5378241 5378225 -
cccagcaccatttattaaat

SEQ ID NO: 31486 - DNA, 20 bp, Artificial Sequence
  Synthetic oligonucleotide; GGG chr11 5378221 5378240 5378224 -
ccagcaccatttattaaata

SEQ ID NO: 31487 - DNA, 20 bp, Artificial Sequence
  Synthetic oligonucleotide; CAG chr11 5378191 5378210 5378194 -
tccccatttcttgtttttct

SEQ ID NO: 31488 - DNA, 20 bp, Artificial Sequence
  Synthetic oligonucleotide; AGG chr11 5378190 5378209 5378193 -
ccccatttcttgtttttctc

SEQ ID NO: 31489 - DNA, 20 bp, Artificial Sequence
  Synthetic oligonucleotide; AAG chr11 5378180 5378199 5378183 -
tgtttttctcaggtttttca

SEQ ID NO: 31490 - DNA, 20 bp, Artificial Sequence
  Synthetic oligonucleotide; CAG chr11 5378175 5378194 5378178 -
ttctcaggtttttcaaagat

SEQ ID NO: 31491 - DNA, 20 bp, Artificial Sequence
  Synthetic oligonucleotide; TAG chr11 5378171 5378190 5378174 -
caggtttttcaaagatcaga

SEQ ID NO: 31492 - DNA, 20 bp, Artificial Sequence
  Synthetic oligonucleotide; TAG chr11 5378165 5378184 5378168 -
tttcaaagatcagatagttg

SEQ ID NO: 31493 - DNA, 20 bp, Artificial Sequence
  Synthetic oligonucleotide; GAG chr11 5378144 5378163 5378147 -
agatatgcgtcgttatttct

SEQ ID NO: 31494 - DNA, 20 bp, Artificial Sequence
  Synthetic oligonucleotide; AGG chr11 5378143 5378162 5378146 -
gatatgcgtcgttatttctg

SEQ ID NO: 31495 - DNA, 20 bp, Artificial Sequence
  Synthetic oligonucleotide; GGG chr11 5378142 5378161 5378145 -
atatgcgtcgttatttctga

SEQ ID NO: 31496 - DNA, 20 bp, Artificial Sequence
  Synthetic oligonucleotide; TGG chr11 5378105 5378124 5378108 -
attgatctatatctgtgttt

SEQ ID NO: 31497 - DNA, 20 bp, Artificial Sequence
  Synthetic oligonucleotide; CAG chr11 5378099 5378118 5378102 -
ctatatctgtgttttggtac

SEQ ID NO: 31498 - DNA, 20 bp, Artificial Sequence
  Synthetic oligonucleotide; TGG chr11 5378083 5378102 5378086 -
gtaccagtaacatgctgttt

SEQ ID NO: 31499 - DNA, 20 bp, Artificial Sequence
  Synthetic oligonucleotide; TAG chr11 5378074 5378093 5378077 -
acatgctgttttggttactg

SEQ ID NO: 31500 - DNA, 20 bp, Artificial Sequence
  Synthetic oligonucleotide; TAG chr11 5378066 5378085 5378069 -
ttttggttactgtagccttg

SEQ ID NO: 31501 - DNA, 20 bp, Artificial Sequence
  Synthetic oligonucleotide; TAG chr11 5378061 5378080 5378064 -
gttactgtagccttgtagta

SEQ ID NO: 31502 - DNA, 20 bp, Artificial Sequence
  Synthetic oligonucleotide; AAG chr11 5378054 5378073 5378057 -
tagccttgtagtatagtttg

SEQ ID NO: 31503 - DNA, 20 bp, Artificial Sequence
  Synthetic oligonucleotide; GAG chr11 5378050 5378069 5378053 -
cttgtagtatagtttgaagt

SEQ ID NO: 31504 - DNA, 20 bp, Artificial Sequence
  Synthetic oligonucleotide; AGG chr11 5378049 5378068 5378052 -
ttgtagtatagtttgaagtg

SEQ ID NO: 31505 - DNA, 20 bp, Artificial Sequence
  Synthetic oligonucleotide; TAG chr11 5378046 5378065 5378049 -
tagtatagtttgaagtgagg

SEQ ID NO: 31506 - DNA, 20 bp, Artificial Sequence
  Synthetic oligonucleotide; CAG chr11 5378032 5378051 5378035 -
gtgaggtagcctgatgcctc

SEQ ID NO: 31507 - DNA, 20 bp, Artificial Sequence
  Synthetic oligonucleotide; TGG chr11 5378018 5378037 5378021 -
tgcctccagctttgttcttt

SEQ ID NO: 31508 - DNA, 20 bp, Artificial Sequence
  Synthetic oligonucleotide; TAG chr11 5378013 5378032 5378016 -
ccagctttgttcttttggct

SEQ ID NO: 31509 - DNA, 20 bp, Artificial Sequence
  Synthetic oligonucleotide; AGG chr11 5378012 5378031 5378015 -
cagctttgttcttttggctt

SEQ ID NO: 31510 - DNA, 20 bp, Artificial Sequence
  Synthetic oligonucleotide; TGG chr11 5378002 5378021 5378005 -
cttttggcttaggattgact

SEQ ID NO: 31511 - DNA, 20 bp, Artificial Sequence
  Synthetic oligonucleotide; CAG chr11 5377994 5378013 5377997 -
ttaggattgacttggcaatg

SEQ ID NO: 31512 - DNA, 20 bp, Artificial Sequence
  Synthetic oligonucleotide; AGG chr11 5377993 5378012 5377996 -
taggattgacttggcaatgc

SEQ ID NO: 31513 - DNA, 20 bp, Artificial Sequence
  Synthetic oligonucleotide; TGG chr11 5377982 5378001 5377985 -
tggcaatgcaggctcttttt

SEQ ID NO: 31514 - DNA, 20 bp, Artificial Sequence
  Synthetic oligonucleotide; AAG chr11 5377963 5377982 5377966 -
ttggttccatatgaacttta

SEQ ID NO: 31515 - DNA, 20 bp, Artificial Sequence
  Synthetic oligonucleotide; AAG chr11 5377941 5377960 5377944 -
gtcgtttttccaattctgtg

SEQ ID NO: 31516 - DNA, 20 bp, Artificial Sequence
  Synthetic oligonucleotide; TGG chr11 5377930 5377949 5377933 -
aattctgtgaagaaaatcat

SEQ ID NO: 31517 - DNA, 20 bp, Artificial Sequence
  Synthetic oligonucleotide; TAG chr11 5377927 5377946 5377930 -
tctgtgaagaaaatcattgg

SEQ ID NO: 31518 - DNA, 20 bp, Artificial Sequence
  Synthetic oligonucleotide; TGG chr11 5377919 5377938 5377922 -
gaaaatcattggtagcttga

SEQ ID NO: 31519 - DNA, 20 bp, Artificial Sequence
  Synthetic oligonucleotide; GGG chr11 5377918 5377937 5377921 -
aaaatcattggtagcttgat

SEQ ID NO: 31520 - DNA, 20 bp, Artificial Sequence
  Synthetic oligonucleotide; GGG chr11 5377917 5377936 5377920 -
aaatcattggtagcttgatg

SEQ ID NO: 31521 - DNA, 20 bp, Artificial Sequence
  Synthetic oligonucleotide; TGG chr11 5377913 5377932 5377916 -
cattggtagcttgatgggga

SEQ ID NO: 31522 - DNA, 20 bp, Artificial Sequence
  Synthetic oligonucleotide; TGG chr11 5377889 5377908 5377892 -
attgaatctataaattacct

SEQ ID NO: 31523 - DNA, 20 bp, Artificial Sequence
  Synthetic oligonucleotide; GGG chr11 5377888 5377907 5377891 -
ttgaatctataaattacctt

SEQ ID NO: 31524 - DNA, 20 bp, Artificial Sequence
  Synthetic oligonucleotide; TGG chr11 5377880 5377899 5377883 -
ataaattaccttgggcatta

SEQ ID NO: 31525 - DNA, 20 bp, Artificial Sequence
  Synthetic oligonucleotide; AAG chr11 5377845 5377864 5377848 -
tattgattcttcctacccat

SEQ ID NO: 31526 - DNA, 20 bp, Artificial Sequence
  Synthetic oligonucleotide; TGG chr11 5377840 5377859 5377843 -
attcttcctacccataagca

SEQ ID NO: 31527 - DNA, 20 bp, Artificial Sequence
  Synthetic oligonucleotide; GAG chr11 5377798 5377817 5377801 -
gtatcttcttttatttcatt

SEQ ID NO: 31528 - DNA, 20 bp, Artificial Sequence
  Synthetic oligonucleotide; CAG chr11 5377795 5377814 5377798 -
tcttcttttatttcattgag

SEQ ID NO: 31529 - DNA, 20 bp, Artificial Sequence
  Synthetic oligonucleotide; TGG chr11 5377792 5377811 5377795 -
tcttttatttcattgagcag

SEQ ID NO: 31530 - DNA, 20 bp, Artificial Sequence
  Synthetic oligonucleotide; TAG chr11 5377785 5377804 5377788 -
tttcattgagcagtggtttg

SEQ ID NO: 31531 - DNA, 20 bp, Artificial Sequence
  Synthetic oligonucleotide; AAG chr11 5377773 5377792 5377776 -
gtggtttgtagttctccttg

SEQ ID NO: 31532 - DNA, 20 bp, Artificial Sequence
  Synthetic oligonucleotide; GAG chr11 5377771 5377790 5377774 -
ggtttgtagttctccttgaa

SEQ ID NO: 31533 - DNA, 20 bp, Artificial Sequence
  Synthetic oligonucleotide; AGG chr11 5377770 5377789 5377773 -
gtttgtagttctccttgaag

SEQ ID NO: 31534 - DNA, 20 bp, Artificial Sequence
  Synthetic oligonucleotide; AAG chr11 5377750 5377769 5377753 -
aggtccttcacatcccttgt

SEQ ID NO: 31535 - DNA, 20 bp, Artificial Sequence
  Synthetic oligonucleotide; TGG chr11 5377746 5377765 5377749 -
ccttcacatcccttgtaagt

SEQ ID NO: 31536 - DNA, 20 bp, Artificial Sequence
  Synthetic oligonucleotide; TAG chr11 5377738 5377757 5377741 -
tcccttgtaagttggattcc

SEQ ID NO: 31537 - DNA, 20 bp, Artificial Sequence
  Synthetic oligonucleotide; AGG chr11 5377737 5377756 5377740 -
cccttgtaagttggattcct

SEQ ID NO: 31538 - DNA, 20 bp, Artificial Sequence
  Synthetic oligonucleotide; AAG chr11 5377718 5377737 5377721 -
taggtattttattctctttg

SEQ ID NO: 31539 - DNA, 20 bp, Artificial Sequence
  Synthetic oligonucleotide; TGG chr11 5377705 5377724 5377708 -
ctctttgaagcaattgtgaa

SEQ ID NO: 31540 - DNA, 20 bp, Artificial Sequence
  Synthetic oligonucleotide; GGG chr11 5377704 5377723 5377707 -
tctttgaagcaattgtgaat

SEQ ID NO: 31541 - DNA, 20 bp, Artificial Sequence
  Synthetic oligonucleotide; GAG chr11 5377702 5377721 5377705 -
tttgaagcaattgtgaatgg

SEQ ID NO: 31542 - DNA, 20 bp, Artificial Sequence
  Synthetic oligonucleotide; TGG chr11 5377686 5377705 5377689 -
atgggagttccctcatgatt

SEQ ID NO: 31543 - DNA, 20 bp, Artificial Sequence
  Synthetic oligonucleotide; TGG chr11 5377664 5377683 5377667 -
gctctctgtttgtctgttat

SEQ ID NO: 31544 - DNA, 20 bp, Artificial Sequence
  Synthetic oligonucleotide; AAG chr11 5377656 5377675 5377659 -
tttgtctgttattggtgtat

SEQ ID NO: 31545 - DNA, 20 bp, Artificial Sequence
  Synthetic oligonucleotide; TGG chr11 5377631 5377650 5377634 -
tgcttgtgatttttgcacat

SEQ ID NO: 31546 - DNA, 20 bp, Artificial Sequence
  Synthetic oligonucleotide; GAG chr11 5377617 5377636 5377620 -
gcacattggttttgtatcct

SEQ ID NO: 31547 - DNA, 20 bp, Artificial Sequence
  Synthetic oligonucleotide; AGG chr11 5377616 5377635 5377619 -
cacattggttttgtatcctg

SEQ ID NO: 31548 - DNA, 20 bp, Artificial Sequence
  Synthetic oligonucleotide; AAG chr11 5377605 5377624 5377608 -
tgtatcctgaggctttgctg

SEQ ID NO: 31549 - DNA, 20 bp, Artificial Sequence
  Synthetic oligonucleotide; CAG chr11 5377594 5377613 5377597 -
gctttgctgaagttgcttat

SEQ ID NO: 31550 - DNA, 20 bp, Artificial Sequence
  Synthetic oligonucleotide; AAG chr11 5377588 5377607 5377591 -
ctgaagttgcttatcagctt

SEQ ID NO: 31551 - DNA, 20 bp, Artificial Sequence
  Synthetic oligonucleotide; AGG chr11 5377587 5377606 5377590 -
tgaagttgcttatcagctta

SEQ ID NO: 31552 - DNA, 20 bp, Artificial Sequence
  Synthetic oligonucleotide; GAG chr11 5377585 5377604 5377588 -
aagttgcttatcagcttaag

SEQ ID NO: 31553 - DNA, 20 bp, Artificial Sequence
  Synthetic oligonucleotide; TGG chr11 5377578 5377597 5377581 -
ttatcagcttaaggagattt

SEQ ID NO: 31554 - DNA, 20 bp, Artificial Sequence
  Synthetic oligonucleotide; GGG chr11 5377577 5377596 5377580 -
tatcagcttaaggagatttt

SEQ ID NO: 31555 - DNA, 20 bp, Artificial Sequence
  Synthetic oligonucleotide; GAG chr11 5377572 5377591 5377575 -
gcttaaggagattttgggct

SEQ ID NO: 31556 - DNA, 20 bp, Artificial Sequence
  Synthetic oligonucleotide; AAG chr11 5377567 5377586 5377570 -
aggagattttgggctgagac

SEQ ID NO: 31557 - DNA, 20 bp, Artificial Sequence
  Synthetic oligonucleotide; AGG chr11 5377566 5377585 5377569 -
ggagattttgggctgagaca

SEQ ID NO: 31558 - DNA, 20 bp, Artificial Sequence
  Synthetic oligonucleotide; GGG chr11 5377565 5377584 5377568 -
gagattttgggctgagacaa

SEQ ID NO: 31559 - DNA, 20 bp, Artificial Sequence
  Synthetic oligonucleotide; GGG chr11 5377564 5377583 5377567 -
agattttgggctgagacaag

SEQ ID NO: 31560 - DNA, 20 bp, Artificial Sequence
  Synthetic oligonucleotide; GGG chr11 5377563 5377582 5377566 -
gattttgggctgagacaagg

SEQ ID NO: 31561 - DNA, 20 bp, Artificial Sequence
  Synthetic oligonucleotide; TAG chr11 5377555 5377574 5377558 -
gctgagacaagggggttttc

SEQ ID NO: 31562 - DNA, 20 bp, Artificial Sequence
  Synthetic oligonucleotide; CAG chr11 5377528 5377547 5377531 -
acaatcatgtcgtctgcaaa

SEQ ID NO: 31563 - DNA, 20 bp, Artificial Sequence
  Synthetic oligonucleotide; AGG chr11 5377527 5377546 5377530 -
caatcatgtcgtctgcaaac

SEQ ID NO: 31564 - DNA, 20 bp, Artificial Sequence
  Synthetic oligonucleotide; GGG chr11 5377526 5377545 5377529 -
aatcatgtcgtctgcaaaca

SEQ ID NO: 31565 - DNA, 20 bp, Artificial Sequence
  Synthetic oligonucleotide; TGG chr11 5377460 5377479 5377463 -
tgtcttctgcctaattgccc

SEQ ID NO: 31566 - DNA, 20 bp, Artificial Sequence
  Synthetic oligonucleotide; CAG chr11 5377456 5377475 5377459 -
ttctgcctaattgccctggc

SEQ ID NO: 31567 - DNA, 20 bp, Artificial Sequence
  Synthetic oligonucleotide; TAG chr11 5377432 5377451 5377435 -
acttccaacactatgttgaa

SEQ ID NO: 31568 - DNA, 20 bp, Artificial Sequence
  Synthetic oligonucleotide; AGG chr11 5377431 5377450 5377434 -
cttccaacactatgttgaat

SEQ ID NO: 31569 - DNA, 20 bp, Artificial Sequence
  Synthetic oligonucleotide; GAG chr11 5377429 5377448 5377432 -
tccaacactatgttgaatag

SEQ ID NO: 31570 - DNA, 20 bp, Artificial Sequence
  Synthetic oligonucleotide; TAG chr11 5377426 5377445 5377429 -
aacactatgttgaataggag

SEQ ID NO: 31571 - DNA, 20 bp, Artificial Sequence
  Synthetic oligonucleotide; GAG chr11 5377422 5377441 5377425 -
ctatgttgaataggagtagt

SEQ ID NO: 31572 - DNA, 20 bp, Artificial Sequence
  Synthetic oligonucleotide; GAG chr11 5377420 5377439 5377423 -
atgttgaataggagtagtga

SEQ ID NO: 31573 - DNA, 20 bp, Artificial Sequence
  Synthetic oligonucleotide; GAG chr11 5377418 5377437 5377421 -
gttgaataggagtagtgaga

SEQ ID NO: 31574 - DNA, 20 bp, Artificial Sequence
  Synthetic oligonucleotide; AGG chr11 5377417 5377436 5377420 -
ttgaataggagtagtgagag

SEQ ID NO: 31575 - DNA, 20 bp, Artificial Sequence
  Synthetic oligonucleotide; GGG chr11 5377416 5377435 5377419 -
tgaataggagtagtgagaga

SEQ ID NO: 31576 - DNA, 20 bp, Artificial Sequence
  Synthetic oligonucleotide; CAG chr11 5377397 5377416 5377400 -
agggcatccctgtcttgtgc

SEQ ID NO: 31577 - DNA, 20 bp, Artificial Sequence
  Synthetic oligonucleotide; AAG chr11 5377388 5377407 5377391 -
ctgtcttgtgccagtttaca

SEQ ID NO: 31578 - DNA, 20 bp, Artificial Sequence
  Synthetic oligonucleotide; AGG chr11 5377387 5377406 5377390 -
tgtcttgtgccagtttacaa

SEQ ID NO: 31579 - DNA, 20 bp, Artificial Sequence
  Synthetic oligonucleotide; GGG chr11 5377386 5377405 5377389 -
gtcttgtgccagtttacaaa

SEQ ID NO: 31580 - DNA, 20 bp, Artificial Sequence
  Synthetic oligonucleotide; CAG chr11 5377375 5377394 5377378 -
gtttacaaagggaatgcttc

SEQ ID NO: 31581 - DNA, 20 bp, Artificial Sequence
  Synthetic oligonucleotide; CAG chr11 5377360 5377379 5377363 -
gcttccagtttttgcccatt

SEQ ID NO: 31582 - DNA, 20 bp, Artificial Sequence
  Synthetic oligonucleotide; TGG chr11 5377349 5377368 5377352 -
ttgcccattcagtatgatat

SEQ ID NO: 31583 - DNA, 20 bp, Artificial Sequence
  Synthetic oligonucleotide; TGG chr11 5377343 5377362 5377346 -
attcagtatgatattggctg

SEQ ID NO: 31584 - DNA, 20 bp, Artificial Sequence
  Synthetic oligonucleotide; GGG chr11 5377342 5377361 5377345 -
ttcagtatgatattggctgt

SEQ ID NO: 31585 - DNA, 20 bp, Artificial Sequence
  Synthetic oligonucleotide; TAG chr11 5377332 5377351 5377335 -
tattggctgtgggtttgtca

SEQ ID NO: 31586 - DNA, 20 bp, Artificial Sequence
  Synthetic oligonucleotide; TAG chr11 5377328 5377347 5377331 -
ggctgtgggtttgtcataga

SEQ ID NO: 31587 - DNA, 20 bp, Artificial Sequence
  Synthetic oligonucleotide; GAG chr11 5377312 5377331 5377315 -
tagatagctcttattatttt

SEQ ID NO: 31588 - DNA, 20 bp, Artificial Sequence
  Synthetic oligonucleotide; AAG chr11 5377280 5377299 5377283 -
atcaatacctaatttattga

SEQ ID NO: 31589 - DNA, 20 bp, Artificial Sequence
  Synthetic oligonucleotide; TAG chr11 5377273 5377292 5377276 -
cctaatttattgaaagtttt

SEQ ID NO: 31590 - DNA, 20 bp, Artificial Sequence
  Synthetic oligonucleotide; AAG chr11 5377266 5377285 5377269 -
tattgaaagtttttagcatg

SEQ ID NO: 31591 - DNA, 20 bp, Artificial Sequence
  Synthetic oligonucleotide; AGG chr11 5377265 5377284 5377268 -
attgaaagtttttagcatga

SEQ ID NO: 31592 - DNA, 20 bp, Artificial Sequence
  Synthetic oligonucleotide; GGG chr11 5377264 5377283 5377267 -
ttgaaagtttttagcatgaa

SEQ ID NO: 31593 - DNA, 20 bp, Artificial Sequence
  Synthetic oligonucleotide; AAG chr11 5377245 5377264 5377248 -
agggttgttgaattttgtca

SEQ ID NO: 31594 - DNA, 20 bp, Artificial Sequence
  Synthetic oligonucleotide; AGG chr11 5377244 5377263 5377247 -
gggttgttgaattttgtcaa

SEQ ID NO: 31595 - DNA, 20 bp, Artificial Sequence
  Synthetic oligonucleotide; GAG chr11 5377224 5377243 5377227 -
aggccttttctgcatctatt

SEQ ID NO: 31596 - DNA, 20 bp, Artificial Sequence
  Synthetic oligonucleotide; TGG chr11 5377212 5377231 5377215 -
catctattgagataatcatg

SEQ ID NO: 31597 - DNA, 20 bp, Artificial Sequence
  Synthetic oligonucleotide; TGG chr11 5377199 5377218 5377202 -
aatcatgtggtttttgtctt

SEQ ID NO: 31598 - DNA, 20 bp, Artificial Sequence
  Synthetic oligonucleotide; TGG chr11 5377182 5377201 5377185 -
ctttggttctgtttatatgc

SEQ ID NO: 31599 - DNA, 20 bp, Artificial Sequence
  Synthetic oligonucleotide; CAG chr11 5377149 5377168 5377152 -
ttgatttgcatatattgaac

SEQ ID NO: 31600 - DNA, 20 bp, Artificial Sequence
  Synthetic oligonucleotide; CAG chr11 5377136 5377155 5377139 -
attgaaccagccttgcatcc

SEQ ID NO: 31601 - DNA, 20 bp, Artificial Sequence
  Synthetic oligonucleotide; AGG chr11 5377135 5377154 5377138 -
ttgaaccagccttgcatccc

SEQ ID NO: 31602 - DNA, 20 bp, Artificial Sequence
  Synthetic oligonucleotide; GGG chr11 5377134 5377153 5377137 -
tgaaccagccttgcatccca

SEQ ID NO: 31603 - DNA, 20 bp, Artificial Sequence
  Synthetic oligonucleotide; AAG chr11 5377128 5377147 5377131 -
agccttgcatcccagggatg

SEQ ID NO: 31604 - DNA, 20 bp, Artificial Sequence
  Synthetic oligonucleotide; TGG chr11 5377110 5377129 5377113 -
tgaagtccacttgatcatcg

SEQ ID NO: 31605 - DNA, 20 bp, Artificial Sequence
  Synthetic oligonucleotide; AAG chr11 5377105 5377124 5377108 -
tccacttgatcatcgtggat

SEQ ID NO: 31606 - DNA, 20 bp, Artificial Sequence
  Synthetic oligonucleotide; TGG chr11 5377086 5377105 5377089 -
taagctttttgatgtgctgc

SEQ ID NO: 31607 - DNA, 20 bp, Artificial Sequence
  Synthetic oligonucleotide; CGG chr11 5377080 5377099 5377083 -
ttttgatgtgctgctggatt

SEQ ID NO: 31608 - DNA, 20 bp, Artificial Sequence
  Synthetic oligonucleotide; CAG chr11 5377072 5377091 5377075 -
tgctgctggattcggtttgc

SEQ ID NO: 31609 - DNA, 20 bp, Artificial Sequence
  Synthetic oligonucleotide; GAG chr11 5377060 5377079 5377063 -
cggtttgccagtattttatt

SEQ ID NO: 31610 - DNA, 20 bp, Artificial Sequence
  Synthetic oligonucleotide; AGG chr11 5377059 5377078 5377062 -
ggtttgccagtattttattg

SEQ ID NO: 31611 - DNA, 20 bp, Artificial Sequence
  Synthetic oligonucleotide; CAG chr11 5377036 5377055 5377039 -
atttttgcatcgatgttcat

SEQ ID NO: 31612 - DNA, 20 bp, Artificial Sequence
  Synthetic oligonucleotide; AGG chr11 5377035 5377054 5377038 -
tttttgcatcgatgttcatc

SEQ ID NO: 31613 - DNA, 20 bp, Artificial Sequence
  Synthetic oligonucleotide; GGG chr11 5377034 5377053 5377037 -
ttttgcatcgatgttcatca

SEQ ID NO: 31614 - DNA, 20 bp, Artificial Sequence
  Synthetic oligonucleotide; TGG chr11 5377007 5377026 5377010 -
tcatctaaaattctcttttt

SEQ ID NO: 31615 - DNA, 20 bp, Artificial Sequence
  Synthetic oligonucleotide; TGG chr11 5376991 5377010 5376994 -
tttttggttgtgtctctttc

SEQ ID NO: 31616 - DNA, 20 bp, Artificial Sequence
  Synthetic oligonucleotide; TGG chr11 5376985 5377004 5376988 -
gttgtgtctctttctggctt

SEQ ID NO: 31617 - DNA, 20 bp, Artificial Sequence
  Synthetic oligonucleotide; TAG chr11 5376979 5376998 5376982 -
tctctttctggctttggtat

SEQ ID NO: 31618 - DNA, 20 bp, Artificial Sequence
  Synthetic oligonucleotide; AGG chr11 5376978 5376997 5376981 -
ctctttctggctttggtatt

SEQ ID NO: 31619 - DNA, 20 bp, Artificial Sequence
  Synthetic oligonucleotide; TGG chr11 5376968 5376987 5376971 -
ctttggtattaggatgatgc

SEQ ID NO: 31620 - DNA, 20 bp, Artificial Sequence
  Synthetic oligonucleotide; GAG chr11 5376954 5376973 5376957 -
tgatgctggcctcataaaat

SEQ ID NO: 31621 - DNA, 20 bp, Artificial Sequence
  Synthetic oligonucleotide; TAG chr11 5376950 5376969 5376953 -
gctggcctcataaaatgagt

SEQ ID NO: 31622 - DNA, 20 bp, Artificial Sequence
  Synthetic oligonucleotide; AGG chr11 5376949 5376968 5376952 -
ctggcctcataaaatgagtt

SEQ ID NO: 31623 - DNA, 20 bp, Artificial Sequence
  Synthetic oligonucleotide; GGG chr11 5376948 5376967 5376951 -
tggcctcataaaatgagtta

SEQ ID NO: 31624 - DNA, 20 bp, Artificial Sequence
  Synthetic oligonucleotide; GAG chr11 5376946 5376965 5376949 -
gcctcataaaatgagttagg

SEQ ID NO: 31625 - DNA, 20 bp, Artificial Sequence
  Synthetic oligonucleotide; AGG chr11 5376945 5376964 5376948 -
cctcataaaatgagttaggg

SEQ ID NO: 31626 - DNA, 20 bp, Artificial Sequence
  Synthetic oligonucleotide; TGG chr11 5376921 5376940 5376924 -
ttccttctttttctgttgat

SEQ ID NO: 31627 - DNA, 20 bp, Artificial Sequence
  Synthetic oligonucleotide; TAG chr11 5376916 5376935 5376919 -
tctttttctgttgattggaa

SEQ ID NO: 31628 - DNA, 20 bp, Artificial Sequence
  Synthetic oligonucleotide; CAG chr11 5376910 5376929 5376913 -
tctgttgattggaatagttt

SEQ ID NO: 31629 - DNA, 20 bp, Artificial Sequence
  Synthetic oligonucleotide; AAG chr11 5376907 5376926 5376910 -
gttgattggaatagtttcag

SEQ ID NO: 31630 - DNA, 20 bp, Artificial Sequence
  Synthetic oligonucleotide; AGG chr11 5376906 5376925 5376909 -
ttgattggaatagtttcaga

SEQ ID NO: 31631 - DNA, 20 bp, Artificial Sequence
  Synthetic oligonucleotide; TGG chr11 5376901 5376920 5376904 -
tggaatagtttcagaaggaa

SEQ ID NO: 31632 - DNA, 20 bp, Artificial Sequence
  Synthetic oligonucleotide; TAG chr11 5376873 5376892 5376876 -
attcctccttgtacctctgt

SEQ ID NO: 31633 - DNA, 20 bp, Artificial Sequence
  Synthetic oligonucleotide; TGG chr11 5376866 5376885 5376869 -
cttgtacctctgttagaatt

SEQ ID NO: 31634 - DNA, 20 bp, Artificial Sequence
  Synthetic oligonucleotide; TGG chr11 5376850 5376869 5376853 -
aatttggctgtgaatccatc

SEQ ID NO: 31635 - DNA, 20 bp, Artificial Sequence
  Synthetic oligonucleotide; TGG chr11 5376844 5376863 5376847 -
gctgtgaatccatctggtcc

SEQ ID NO: 31636 - DNA, 20 bp, Artificial Sequence
  Synthetic oligonucleotide; TGG chr11 5376833 5376852 5376836 -
atctggtcctggactctttt

SEQ ID NO: 31637 - DNA, 20 bp, Artificial Sequence
  Synthetic oligonucleotide; TGG chr11 5376829 5376848 5376832 -
ggtcctggactctttttggt

SEQ ID NO: 31638 - DNA, 20 bp, Artificial Sequence
  Synthetic oligonucleotide; AAG chr11 5376825 5376844 5376828 -
ctggactctttttggttggt

SEQ ID NO: 31639 - DNA, 20 bp, Artificial Sequence
  Synthetic oligonucleotide; CAG chr11 5376800 5376819 5376803 -
attgattattgccacaattt

SEQ ID NO: 31640 - DNA, 20 bp, Artificial Sequence
  Synthetic oligonucleotide; TGG chr11 5376787 5376806 5376790 -
acaatttcagatcctgttat

SEQ ID NO: 31641 - DNA, 20 bp, Artificial Sequence
  Synthetic oligonucleotide; CAG chr11 5376778 5376797 5376781 -
gatcctgttattggtctatt

SEQ ID NO: 31642 - DNA, 20 bp, Artificial Sequence
  Synthetic oligonucleotide; GAG chr11 5376776 5376795 5376779 -
tcctgttattggtctattca

SEQ ID NO: 31643 - DNA, 20 bp, Artificial Sequence
  Synthetic oligonucleotide; TGG chr11 5376759 5376778 5376762 -
tcagagattcaacttcttcc

SEQ ID NO: 31644 - DNA, 20 bp, Artificial Sequence
  Synthetic oligonucleotide; TAG chr11 5376754 5376773 5376757 -
gattcaacttcttcctggtt

SEQ ID NO: 31645 - DNA, 20 bp, Artificial Sequence
  Synthetic oligonucleotide; TGG chr11 5376748 5376767 5376751 -
acttcttcctggtttagtct

SEQ ID NO: 31646 - DNA, 20 bp, Artificial Sequence
  Synthetic oligonucleotide; GGG chr11 5376747 5376766 5376750 -
cttcttcctggtttagtctt

SEQ ID NO: 31647 - DNA, 20 bp, Artificial Sequence
  Synthetic oligonucleotide; TAG chr11 5376743 5376762 5376746 -
ttcctggtttagtcttggga

SEQ ID NO: 31648 - DNA, 20 bp, Artificial Sequence
  Synthetic oligonucleotide; CAG chr11 5376730 5376749 5376733 -
cttgggatagtgtatgtgtc

SEQ ID NO: 31649 - DNA, 20 bp, Artificial Sequence
  Synthetic oligonucleotide; AGG chr11 5376729 5376748 5376732 -
ttgggatagtgtatgtgtcc

SEQ ID NO: 31650 - DNA, 20 bp, Artificial Sequence
  Synthetic oligonucleotide; TAG chr11 5376709 5376728 5376712 -
aggaatttatccatttcttc

SEQ ID NO: 31651 - DNA, 20 bp, Artificial Sequence
  Synthetic oligonucleotide; TAG chr11 5376700 5376719 5376703 -
tccatttcttctagattttc

SEQ ID NO: 31652 - DNA, 20 bp, Artificial Sequence
  Synthetic oligonucleotide; TAG chr11 5376687 5376706 5376690 -
gattttctagtttatttgcg

SEQ ID NO: 31653 - DNA, 20 bp, Artificial Sequence
  Synthetic oligonucleotide; GAG chr11 5376685 5376704 5376688 -
ttttctagtttatttgcgta

SEQ ID NO: 31654 - DNA, 20 bp, Artificial Sequence
  Synthetic oligonucleotide; AGG chr11 5376684 5376703 5376687 -
tttctagtttatttgcgtag

SEQ ID NO: 31655 - DNA, 20 bp, Artificial Sequence
  Synthetic oligonucleotide; TAG chr11 5376675 5376694 5376678 -
tatttgcgtagaggtgtttg

SEQ ID NO: 31656 - DNA, 20 bp, Artificial Sequence
  Synthetic oligonucleotide; TGG chr11 5376662 5376681 5376665 -
gtgtttgtagtattctctga

SEQ ID NO: 31657 - DNA, 20 bp, Artificial Sequence
  Synthetic oligonucleotide; CAG chr11 5376659 5376678 5376662 -
tttgtagtattctctgatgg

SEQ ID NO: 31658 - DNA, 20 bp, Artificial Sequence
  Synthetic oligonucleotide; TGG chr11 5376644 5376663 5376647 -
gatggcagtttgtatttctg

SEQ ID NO: 31659 - DNA, 20 bp, Artificial Sequence
  Synthetic oligonucleotide; GGG chr11 5376643 5376662 5376646 -
atggcagtttgtatttctgt

SEQ ID NO: 31660 - DNA, 20 bp, Artificial Sequence
  Synthetic oligonucleotide; CGG chr11 5376638 5376657 5376641 -
agtttgtatttctgtgggat

SEQ ID NO: 31661 - DNA, 20 bp, Artificial Sequence
  Synthetic oligonucleotide; TGG chr11 5376635 5376654 5376638 -
ttgtatttctgtgggatcgg

SEQ ID NO: 31662 - DNA, 20 bp, Artificial Sequence
  Synthetic oligonucleotide; TAG chr11 5376574 5376593 5376577 -
attcttctctcttttcttat

SEQ ID NO: 31663 - DNA, 20 bp, Artificial Sequence
  Synthetic oligonucleotide; TAG chr11 5376565 5376584 5376568 -
tcttttcttattagtcttgc

SEQ ID NO: 31664 - DNA, 20 bp, Artificial Sequence
  Synthetic oligonucleotide; CGG chr11 5376562 5376581 5376565 -
tttcttattagtcttgctag

SEQ ID NO: 31665 - DNA, 20 bp, Artificial Sequence
  Synthetic oligonucleotide; CAG chr11 5376554 5376573 5376557 -
tagtcttgctagcggtctat

SEQ ID NO: 31666 - DNA, 20 bp, Artificial Sequence
  Synthetic oligonucleotide; CAG chr11 5376528 5376547 5376531 -
tgttgatcctttcaaaaaac

SEQ ID NO: 31667 - DNA, 20 bp, Artificial Sequence
  Synthetic oligonucleotide; CAG chr11 5376521 5376540 5376524 -
cctttcaaaaaaccagctcc

SEQ ID NO: 31668 - DNA, 20 bp, Artificial Sequence
  Synthetic oligonucleotide; AAG chr11 5376502 5376521 5376505 -
ccagattcattaattttttg

SEQ ID NO: 31669 - DNA, 20 bp, Artificial Sequence
  Synthetic oligonucleotide; AGG chr11 5376501 5376520 5376504 -
cagattcattaattttttga

SEQ ID NO: 31670 - DNA, 20 bp, Artificial Sequence
  Synthetic oligonucleotide; GGG chr11 5376500 5376519 5376503 -
agattcattaattttttgaa

SEQ ID NO: 31671 - DNA, 20 bp, Artificial Sequence
  Synthetic oligonucleotide; CAG chr11 5376475 5376494 5376478 -
ttttgtgtctctgtttcctt

SEQ ID NO: 31672 - DNA, 20 bp, Artificial Sequence
  Synthetic oligonucleotide; TAG chr11 5376458 5376477 5376461 -
cttcagttctgctctgattt

SEQ ID NO: 31673 - DNA, 20 bp, Artificial Sequence
  Synthetic oligonucleotide; TAG chr11 5376437 5376456 5376440 -
agttatttcttgacttctgc

SEQ ID NO: 31674 - DNA, 20 bp, Artificial Sequence
  Synthetic oligonucleotide; TAG chr11 5376406 5376425 5376409 -
tgtgtttgctcttgcttatc

SEQ ID NO: 31675 - DNA, 20 bp, Artificial Sequence
  Synthetic oligonucleotide; TAG chr11 5376385 5376404 5376388 -
agttcttttaattgtgatgt

SEQ ID NO: 31676 - DNA, 20 bp, Artificial Sequence
  Synthetic oligonucleotide; AGG chr11 5376384 5376403 5376387 -
gttcttttaattgtgatgtt

SEQ ID NO: 31677 - DNA, 20 bp, Artificial Sequence
  Synthetic oligonucleotide; GGG chr11 5376383 5376402 5376386 -
ttcttttaattgtgatgtta

SEQ ID NO: 31678 - DNA, 20 bp, Artificial Sequence
  Synthetic oligonucleotide; TGG chr11 5376371 5376390 5376374 -
tgatgttagggtgtcaattt

SEQ ID NO: 31679 - DNA, 20 bp, Artificial Sequence
  Synthetic oligonucleotide; TGG chr11 5376348 5376367 5376351 -
atctttcttgctttctcttg

SEQ ID NO: 31680 - DNA, 20 bp, Artificial Sequence
  Synthetic oligonucleotide; GGG chr11 5376347 5376366 5376350 -
tctttcttgctttctcttgt

SEQ ID NO: 31681 - DNA, 20 bp, Artificial Sequence
  Synthetic oligonucleotide; TAG chr11 5376340 5376359 5376343 -
tgctttctcttgtgggcgtt

SEQ ID NO: 31682 - DNA, 20 bp, Artificial Sequence
  Synthetic oligonucleotide; CAG chr11 5376297 5376316 5376300 -
acactgattcgaatgtgtcc

SEQ ID NO: 31683 - DNA, 20 bp, Artificial Sequence
  Synthetic oligonucleotide; GAG chr11 5376295 5376314 5376298 -
actgattcgaatgtgtccca

SEQ ID NO: 31684 - DNA, 20 bp, Artificial Sequence
  Synthetic oligonucleotide; TGG chr11 5376288 5376307 5376291 -
cgaatgtgtcccagagattc

SEQ ID NO: 31685 - DNA, 20 bp, Artificial Sequence
  Synthetic oligonucleotide; TGG chr11 5376263 5376282 5376266 -
tgttgtgtctttgttctcat

SEQ ID NO: 31686 - DNA, 20 bp, Artificial Sequence
  Synthetic oligonucleotide; AAG chr11 5376255 5376274 5376258 -
ctttgttctcattggtttca

SEQ ID NO: 31687 - DNA, 20 bp, Artificial Sequence
  Synthetic oligonucleotide; CAG chr11 5376216 5376235 5376219 -
ccttcatttcgttatgtacc

SEQ ID NO: 31688 - DNA, 20 bp, Artificial Sequence
  Synthetic oligonucleotide; TAG chr11 5376213 5376232 5376216 -
tcatttcgttatgtacccag

SEQ ID NO: 31689 - DNA, 20 bp, Artificial Sequence
  Synthetic oligonucleotide; CAG chr11 5376205 5376224 5376208 -
ttatgtacccagtagtcatt

SEQ ID NO: 31690 - DNA, 20 bp, Artificial Sequence
  Synthetic oligonucleotide; AGG chr11 5376204 5376223 5376207 -
tatgtacccagtagtcattc

SEQ ID NO: 31691 - DNA, 20 bp, Artificial Sequence
  Synthetic oligonucleotide; GAG chr11 5376202 5376221 5376205 -
tgtacccagtagtcattcag

SEQ ID NO: 31692 - DNA, 20 bp, Artificial Sequence
  Synthetic oligonucleotide; CAG chr11 5376199 5376218 5376202 -
acccagtagtcattcaggag

SEQ ID NO: 31693 - DNA, 20 bp, Artificial Sequence
  Synthetic oligonucleotide; AGG chr11 5376198 5376217 5376201 -
cccagtagtcattcaggagc

SEQ ID NO: 31694 - DNA, 20 bp, Artificial Sequence
  Synthetic oligonucleotide; CAG chr11 5376190 5376209 5376193 -
tcattcaggagcaggttgtt

SEQ ID NO: 31695 - DNA, 20 bp, Artificial Sequence
  Synthetic oligonucleotide; TAG chr11 5376179 5376198 5376182 -
caggttgttcagtttccatg

SEQ ID NO: 31696 - DNA, 20 bp, Artificial Sequence
  Synthetic oligonucleotide; GAG chr11 5376174 5376193 5376177 -
tgttcagtttccatgtagtt

SEQ ID NO: 31697 - DNA, 20 bp, Artificial Sequence
  Synthetic oligonucleotide; TGG chr11 5376171 5376190 5376174 -
tcagtttccatgtagttgag

SEQ ID NO: 31698 - DNA, 20 bp, Artificial Sequence
  Synthetic oligonucleotide; GAG chr11 5376164 5376183 5376167 -
ccatgtagttgagtggtttt

SEQ ID NO: 31699 - DNA, 20 bp, Artificial Sequence
  Synthetic oligonucleotide; GAG chr11 5376160 5376179 5376163 -
gtagttgagtggttttgagt

SEQ ID NO: 31700 - DNA, 20 bp, Artificial Sequence
  Synthetic oligonucleotide; GAG chr11 5376145 5376164 5376148 -
tgagtgagtttcttaatcct

SEQ ID NO: 31701 - DNA, 20 bp, Artificial Sequence
  Synthetic oligonucleotide; TAG chr11 5376139 5376158 5376142 -
agtttcttaatcctgagttc

SEQ ID NO: 31702 - DNA, 20 bp, Artificial Sequence
  Synthetic oligonucleotide; TGG chr11 5376123 5376142 5376126 -
gttctagtttgattgcactg

SEQ ID NO: 31703 - DNA, 20 bp, Artificial Sequence
  Synthetic oligonucleotide; GAG chr11 5376117 5376136 5376120 -
gtttgattgcactgtggtct

SEQ ID NO: 31704 - DNA, 20 bp, Artificial Sequence
  Synthetic oligonucleotide; GAG chr11 5376115 5376134 5376118 -
ttgattgcactgtggtctga

SEQ ID NO: 31705 - DNA, 20 bp, Artificial Sequence
  Synthetic oligonucleotide; CAG chr11 5376111 5376130 5376114 -
ttgcactgtggtctgagaga

SEQ ID NO: 31706 - DNA, 20 bp, Artificial Sequence
  Synthetic oligonucleotide; GAG chr11 5376076 5376095 5376079 -
tctgttcttttatatttgct

SEQ ID NO: 31707 - DNA, 20 bp, Artificial Sequence
  Synthetic oligonucleotide; AGG chr11 5376075 5376094 5376078 -
ctgttcttttatatttgctg

SEQ ID NO: 31708 - DNA, 20 bp, Artificial Sequence
  Synthetic oligonucleotide; GAG chr11 5376073 5376092 5376076 -
gttcttttatatttgctgag

SEQ ID NO: 31709 - DNA, 20 bp, Artificial Sequence
  Synthetic oligonucleotide; GAG chr11 5376071 5376090 5376074 -
tcttttatatttgctgagga

SEQ ID NO: 31710 - DNA, 20 bp, Artificial Sequence
  Synthetic oligonucleotide; AAG chr11 5376058 5376077 5376061 -
ctgaggagagctttacttcc

SEQ ID NO: 31711 - DNA, 20 bp, Artificial Sequence
  Synthetic oligonucleotide; TGG chr11 5376051 5376070 5376054 -
gagctttacttccaagtatg

SEQ ID NO: 31712 - DNA, 20 bp, Artificial Sequence
  Synthetic oligonucleotide; TGG chr11 5376041 5376060 5376044 -
tccaagtatgtggtcaattt

SEQ ID NO: 31713 - DNA, 20 bp, Artificial Sequence
  Synthetic oligonucleotide; TAG chr11 5376036 5376055 5376039 -
gtatgtggtcaattttggaa

SEQ ID NO: 31714 - DNA, 20 bp, Artificial Sequence
  Synthetic oligonucleotide; AGG chr11 5376035 5376054 5376038 -
tatgtggtcaattttggaat

SEQ ID NO: 31715 - DNA, 20 bp, Artificial Sequence
  Synthetic oligonucleotide; TGG chr11 5376025 5376044 5376028 -
attttggaataggtgttgtg

SEQ ID NO: 31716 - DNA, 20 bp, Artificial Sequence
  Synthetic oligonucleotide; TGG chr11 5375992 5376011 5375995 -
aaatgtatattctgttgatt

SEQ ID NO: 31717 - DNA, 20 bp, Artificial Sequence
  Synthetic oligonucleotide; GGG chr11 5375991 5376010 5375994 -
aatgtatattctgttgattt

SEQ ID NO: 31718 - DNA, 20 bp, Artificial Sequence
  Synthetic oligonucleotide; GGG chr11 5375990 5376009 5375993 -
atgtatattctgttgatttg

SEQ ID NO: 31719 - DNA, 20 bp, Artificial Sequence
  Synthetic oligonucleotide; TGG chr11 5375987 5376006 5375990 -
tatattctgttgatttgggg

SEQ ID NO: 31720 - DNA, 20 bp, Artificial Sequence
  Synthetic oligonucleotide; GAG chr11 5375985 5376004 5375988 -
tattctgttgatttggggtg

SEQ ID NO: 31721 - DNA, 20 bp, Artificial Sequence
  Synthetic oligonucleotide; GAG chr11 5375983 5376002 5375986 -
ttctgttgatttggggtgga

SEQ ID NO: 31722 - DNA, 20 bp, Artificial Sequence
  Synthetic oligonucleotide; TAG chr11 5375975 5375994 5375978 -
atttggggtggagagttctg

SEQ ID NO: 31723 - DNA, 20 bp, Artificial Sequence
  Synthetic oligonucleotide; TAG chr11 5375964 5375983 5375967 -
agagttctgtagatgtctat

SEQ ID NO: 31724 - DNA, 20 bp, Artificial Sequence
  Synthetic oligonucleotide; AGG chr11 5375963 5375982 5375966 -
gagttctgtagatgtctatt

SEQ ID NO: 31725 - DNA, 20 bp, Artificial Sequence
  Synthetic oligonucleotide; TGG chr11 5375954 5375973 5375957 -
agatgtctattaggtctgct

SEQ ID NO: 31726 - DNA, 20 bp, Artificial Sequence
  Synthetic oligonucleotide; CAG chr11 5375949 5375968 5375952 -
tctattaggtctgcttggtg

SEQ ID NO: 31727 - DNA, 20 bp, Artificial Sequence
  Synthetic oligonucleotide; GAG chr11 5375947 5375966 5375950 -
tattaggtctgcttggtgca

SEQ ID NO: 31728 - DNA, 20 bp, Artificial Sequence
  Synthetic oligonucleotide; TGG chr11 5375930 5375949 5375933 -
gcagagctgtgttcaattcc

SEQ ID NO: 31729 - DNA, 20 bp, Artificial Sequence
  Synthetic oligonucleotide; CAG chr11 5375883 5375902 5375886 -
gttgatctgtctaatgttga

SEQ ID NO: 31730 - DNA, 20 bp, Artificial Sequence
  Synthetic oligonucleotide; TGG chr11 5375880 5375899 5375883 -
gatctgtctaatgttgacag

SEQ ID NO: 31731 - DNA, 20 bp, Artificial Sequence
  Synthetic oligonucleotide; GGG chr11 5375879 5375898 5375882 -
atctgtctaatgttgacagt

SEQ ID NO: 31732 - DNA, 20 bp, Artificial Sequence
  Synthetic oligonucleotide; GGG chr11 5375878 5375897 5375881 -
tctgtctaatgttgacagtg

SEQ ID NO: 31733 - DNA, 20 bp, Artificial Sequence
  Synthetic oligonucleotide; AAG chr11 5375870 5375889 5375873 -
atgttgacagtggggtatta

SEQ ID NO: 31734 - DNA, 20 bp, Artificial Sequence
  Synthetic oligonucleotide; AAG chr11 5375854 5375873 5375857 -
attaaagtctcccattatta

SEQ ID NO: 31735 - DNA, 20 bp, Artificial Sequence
  Synthetic oligonucleotide; TGG chr11 5375849 5375868 5375852 -
agtctcccattattaaagtg

SEQ ID NO: 31736 - DNA, 20 bp, Artificial Sequence
  Synthetic oligonucleotide; GGG chr11 5375848 5375867 5375851 -
gtctcccattattaaagtgt

SEQ ID NO: 31737 - DNA, 20 bp, Artificial Sequence
  Synthetic oligonucleotide; GAG chr11 5375846 5375865 5375849 -
ctcccattattaaagtgtgg

SEQ ID NO: 31738 - DNA, 20 bp, Artificial Sequence
  Synthetic oligonucleotide; AAG chr11 5375840 5375859 5375843 -
ttattaaagtgtgggagtct

SEQ ID NO: 31739 - DNA, 20 bp, Artificial Sequence
  Synthetic oligonucleotide; TAG chr11 5375829 5375848 5375832 -
tgggagtctaagtctctttg

SEQ ID NO: 31740 - DNA, 20 bp, Artificial Sequence
  Synthetic oligonucleotide; AGG chr11 5375828 5375847 5375831 -
gggagtctaagtctctttgt

SEQ ID NO: 31741 - DNA, 20 bp, Artificial Sequence
  Synthetic oligonucleotide; AAG chr11 5375820 5375839 5375823 -
aagtctctttgtaggtctct

SEQ ID NO: 31742 - DNA, 20 bp, Artificial Sequence
  Synthetic oligonucleotide; AGG chr11 5375819 5375838 5375822 -
agtctctttgtaggtctcta

SEQ ID NO: 31743 - DNA, 20 bp, Artificial Sequence
  Synthetic oligonucleotide; TGG chr11 5375800 5375819 5375803 -
aaggacttgctttatgaatc

SEQ ID NO: 31744 - DNA, 20 bp, Artificial Sequence
  Synthetic oligonucleotide; GGG chr11 5375799 5375818 5375802 -
aggacttgctttatgaatct

SEQ ID NO: 31745 - DNA, 20 bp, Artificial Sequence
  Synthetic oligonucleotide; TGG chr11 5375785 5375804 5375788 -
gaatctgggtgctcctgtat

SEQ ID NO: 31746 - DNA, 20 bp, Artificial Sequence
  Synthetic oligonucleotide; GGG chr11 5375784 5375803 5375787 -
aatctgggtgctcctgtatt

SEQ ID NO: 31747 - DNA, 20 bp, Artificial Sequence
  Synthetic oligonucleotide; TAG chr11 5375769 5375788 5375772 -
gtattgggtgcatatatatt

SEQ ID NO: 31748 - DNA, 20 bp, Artificial Sequence
  Synthetic oligonucleotide; AGG chr11 5375768 5375787 5375771 -
tattgggtgcatatatattt

SEQ ID NO: 31749 - DNA, 20 bp, Artificial Sequence
  Synthetic oligonucleotide; TAG chr11 5375764 5375783 5375767 -
gggtgcatatatatttagga

SEQ ID NO: 31750 - DNA, 20 bp, Artificial Sequence
  Synthetic oligonucleotide; TAG chr11 5375760 5375779 5375763 -
gcatatatatttaggatagt

SEQ ID NO: 31751 - DNA, 20 bp, Artificial Sequence
  Synthetic oligonucleotide; TGG chr11 5375720 5375739 5375723 -
atccctttaccattatgtaa

SEQ ID NO: 31752 - DNA, 20 bp, Artificial Sequence
  Synthetic oligonucleotide; TGG chr11 5375691 5375710 5375694 -
ttgtctcttttgatctttgt

SEQ ID NO: 31753 - DNA, 20 bp, Artificial Sequence
  Synthetic oligonucleotide; AAG chr11 5375684 5375703 5375687 -
ttttgatctttgttggttta

SEQ ID NO: 31754 - DNA, 20 bp, Artificial Sequence
  Synthetic oligonucleotide; CAG chr11 5375671 5375690 5375674 -
tggtttaaagcctgttttat

SEQ ID NO: 31755 - DNA, 20 bp, Artificial Sequence
  Synthetic oligonucleotide; GAG chr11 5375669 5375688 5375672 -
gtttaaagcctgttttatca

SEQ ID NO: 31756 - DNA, 20 bp, Artificial Sequence
  Synthetic oligonucleotide; TAG chr11 5375664 5375683 5375667 -
aagcctgttttatcagagac

SEQ ID NO: 31757 - DNA, 20 bp, Artificial Sequence
  Synthetic oligonucleotide; AGG chr11 5375663 5375682 5375666 -
agcctgttttatcagagact

SEQ ID NO: 31758 - DNA, 20 bp, Artificial Sequence
  Synthetic oligonucleotide; TGG chr11 5375624 5375643 5375627 -
ttttttgttttccatttgct

SEQ ID NO: 31759 - DNA, 20 bp, Artificial Sequence
  Synthetic oligonucleotide; TAG chr11 5375621 5375640 5375624 -
tttgttttccatttgcttgg

SEQ ID NO: 31760 - DNA, 20 bp, Artificial Sequence
  Synthetic oligonucleotide; GAG chr11 5375595 5375614 5375598 -
ttcctccatccttttatttt

SEQ ID NO: 31761 - DNA, 20 bp, Artificial Sequence
  Synthetic oligonucleotide; GAG chr11 5375571 5375590 5375574 -
ctatgtgtgtgtgtgcacat

SEQ ID NO: 31762 - DNA, 20 bp, Artificial Sequence
  Synthetic oligonucleotide; TGG chr11 5375567 5375586 5375570 -
gtgtgtgtgtgcacatgaga

SEQ ID NO: 31763 - DNA, 20 bp, Artificial Sequence
  Synthetic oligonucleotide; GGG chr11 5375566 5375585 5375569 -
tgtgtgtgtgcacatgagat

SEQ ID NO: 31764 - DNA, 20 bp, Artificial Sequence
  Synthetic oligonucleotide; CAG chr11 5375533 5375552 5375536 -
acactctttatccaatttgc

SEQ ID NO: 31765 - DNA, 20 bp, Artificial Sequence
  Synthetic oligonucleotide; TGG chr11 5375515 5375534 5375518 -
gccagtctgtgtctttcaat

SEQ ID NO: 31766 - DNA, 20 bp, Artificial Sequence
  Synthetic oligonucleotide; GAG chr11 5375513 5375532 5375516 -
cagtctgtgtctttcaattg

SEQ ID NO: 31767 - DNA, 20 bp, Artificial Sequence
  Synthetic oligonucleotide; TAG chr11 5375506 5375525 5375509 -
tgtctttcaattggagcact

SEQ ID NO: 31768 - DNA, 20 bp, Artificial Sequence
  Synthetic oligonucleotide; AAG chr11 5375489 5375508 5375492 -
acttagtccatttacattta

SEQ ID NO: 31769 - DNA, 20 bp, Artificial Sequence
  Synthetic oligonucleotide; TAG chr11 5375448 5375467 5375451 -
atttgatcctgtcattatga

SEQ ID NO: 31770 - DNA, 20 bp, Artificial Sequence
  Synthetic oligonucleotide; TGG chr11 5375444 5375463 5375447 -
gatcctgtcattatgatagc

SEQ ID NO: 31771 - DNA, 20 bp, Artificial Sequence
  Synthetic oligonucleotide; TAG chr11 5375428 5375447 5375431 -
tagctggttattttgctcgt

SEQ ID NO: 31772 - DNA, 20 bp, Artificial Sequence
  Synthetic oligonucleotide; CAG chr11 5375419 5375438 5375422 -
attttgctcgttagttgatg

SEQ ID NO: 31773 - DNA, 20 bp, Artificial Sequence
  Synthetic oligonucleotide; TAG chr11 5375408 5375427 5375411 -
tagttgatgcagtttcttcc

SEQ ID NO: 31774 - DNA, 20 bp, Artificial Sequence
  Synthetic oligonucleotide; TGG chr11 5375399 5375418 5375402 -
cagtttcttcctagtcttga

SEQ ID NO: 31775 - DNA, 20 bp, Artificial Sequence
  Synthetic oligonucleotide; TGG chr11 5375385 5375404 5375388 -
tcttgatggtcttcacattt

SEQ ID NO: 31776 - DNA, 20 bp, Artificial Sequence
  Synthetic oligonucleotide; CAG chr11 5375372 5375391 5375375 -
cacattttggcctgattttg

SEQ ID NO: 31777 - DNA, 20 bp, Artificial Sequence
  Synthetic oligonucleotide; TGG chr11 5375369 5375388 5375372 -
attttggcctgattttgcag

SEQ ID NO: 31778 - DNA, 20 bp, Artificial Sequence
  Synthetic oligonucleotide; TGG chr11 5375365 5375384 5375368 -
tggcctgattttgcagtggc

SEQ ID NO: 31779 - DNA, 20 bp, Artificial Sequence
  Synthetic oligonucleotide; CGG chr11 5375359 5375378 5375362 -
gattttgcagtggctggtac

SEQ ID NO: 31780 - DNA, 20 bp, Artificial Sequence
  Synthetic oligonucleotide; TAG chr11 5375339 5375358 5375342 -
cggttgtgcctttccatgtt

SEQ ID NO: 31781 - DNA, 20 bp, Artificial Sequence
  Synthetic oligonucleotide; CAG chr11 5375327 5375346 5375330 -
tccatgtttagtgcttcctt

SEQ ID NO: 31782 - DNA, 20 bp, Artificial Sequence
  Synthetic oligonucleotide; AGG chr11 5375326 5375345 5375329 -
ccatgtttagtgcttccttc

SEQ ID NO: 31783 - DNA, 20 bp, Artificial Sequence
  Synthetic oligonucleotide; GAG chr11 5375324 5375343 5375327 -
atgtttagtgcttccttcag

SEQ ID NO: 31784 - DNA, 20 bp, Artificial Sequence
  Synthetic oligonucleotide; TAG chr11 5375315 5375334 5375318 -
gcttccttcaggagctcttt

SEQ ID NO: 31785 - DNA, 20 bp, Artificial Sequence
  Synthetic oligonucleotide; AGG chr11 5375314 5375333 5375317 -
cttccttcaggagctctttt

SEQ ID NO: 31786 - DNA, 20 bp, Artificial Sequence
  Synthetic oligonucleotide; CAG chr11 5375310 5375329 5375313 -
cttcaggagctcttttaggt

SEQ ID NO: 31787 - DNA, 20 bp, Artificial Sequence
  Synthetic oligonucleotide; AGG chr11 5375309 5375328 5375312 -
ttcaggagctcttttaggtc

SEQ ID NO: 31788 - DNA, 20 bp, Artificial Sequence
  Synthetic oligonucleotide; TGG chr11 5375304 5375323 5375307 -
gagctcttttaggtcaggcc

SEQ ID NO: 31789 - DNA, 20 bp, Artificial Sequence
  Synthetic oligonucleotide; CAG chr11 5375285 5375304 5375288 -
ctggtgatgacaaaatctct

SEQ ID NO: 31790 - DNA, 20 bp, Artificial Sequence
  Synthetic oligonucleotide; AAG chr11 5375266 5375285 5375269 -
tcagcatttgcttgtctgta

SEQ ID NO: 31791 - DNA, 20 bp, Artificial Sequence
  Synthetic oligonucleotide; AAG chr11 5375239 5375258 5375242 -
ttatttctccttcacttatg

SEQ ID NO: 31792 - DNA, 20 bp, Artificial Sequence
  Synthetic oligonucleotide; TAG chr11 5375234 5375253 5375237 -
tctccttcacttatgaagct

SEQ ID NO: 31793 - DNA, 20 bp, Artificial Sequence
  Synthetic oligonucleotide; TGG chr11 5375229 5375248 5375232 -
ttcacttatgaagcttagtt

SEQ ID NO: 31794 - DNA, 20 bp, Artificial Sequence
  Synthetic oligonucleotide; TGG chr11 5375225 5375244 5375228 -
cttatgaagcttagtttggc

SEQ ID NO: 31795 - DNA, 20 bp, Artificial Sequence
  Synthetic oligonucleotide; AAG chr11 5375189 5375208 5375192 -
tgttgaaaattctttccttt

SEQ ID NO: 31796 - DNA, 20 bp, Artificial Sequence
  Synthetic oligonucleotide; AGG chr11 5375188 5375207 5375191 -
gttgaaaattctttccttta

SEQ ID NO: 31797 - DNA, 20 bp, Artificial Sequence
  Synthetic oligonucleotide; TGG chr11 5375174 5375193 5375177 -
cctttaaggatgttgaatat

SEQ ID NO: 31798 - DNA, 20 bp, Artificial Sequence
  Synthetic oligonucleotide; TGG chr11 5375157 5375176 5375160 -
tattggcccccactctcttc

SEQ ID NO: 31799 - DNA, 20 bp, Artificial Sequence
  Synthetic oligonucleotide; TAG chr11 5375150 5375169 5375153 -
ccccactctcttctggcttg

SEQ ID NO: 31800 - DNA, 20 bp, Artificial Sequence
  Synthetic oligonucleotide; GAG chr11 5375148 5375167 5375151 -
ccactctcttctggcttgta

SEQ ID NO: 31801 - DNA, 20 bp, Artificial Sequence
  Synthetic oligonucleotide; AAG chr11 5375137 5375156 5375140 -
tggcttgtagagtttctgcc

SEQ ID NO: 31802 - DNA, 20 bp, Artificial Sequence
  Synthetic oligonucleotide; GAG chr11 5375135 5375154 5375138 -
gcttgtagagtttctgccaa

SEQ ID NO: 31803 - DNA, 20 bp, Artificial Sequence
  Synthetic oligonucleotide; GAG chr11 5375133 5375152 5375136 -
ttgtagagtttctgccaaga

SEQ ID NO: 31804 - DNA, 20 bp, Artificial Sequence
  Synthetic oligonucleotide; TAG chr11 5375123 5375142 5375126 -
tctgccaagagagctgctgt

SEQ ID NO: 31805 - DNA, 20 bp, Artificial Sequence
  Synthetic oligonucleotide; TGG chr11 5375115 5375134 5375118 -
gagagctgctgttagtctga

SEQ ID NO: 31806 - DNA, 20 bp, Artificial Sequence
  Synthetic oligonucleotide; GGG chr11 5375114 5375133 5375117 -
agagctgctgttagtctgat

SEQ ID NO: 31807 - DNA, 20 bp, Artificial Sequence
  Synthetic oligonucleotide; TGG chr11 5375101 5375120 5375104 -
gtctgatgggcttccctttg

SEQ ID NO: 31808 - DNA, 20 bp, Artificial Sequence
  Synthetic oligonucleotide; GGG chr11 5375100 5375119 5375103 -
tctgatgggcttccctttgt

SEQ ID NO: 31809 - DNA, 20 bp, Artificial Sequence
  Synthetic oligonucleotide; TGG chr11 5375079 5375098 5375082 -
ggtaacccgacctttctctc

SEQ ID NO: 31810 - DNA, 20 bp, Artificial Sequence
  Synthetic oligonucleotide; TGG chr11 5375043 5375062 5375046 -
tttttccttcatttcaactt

SEQ ID NO: 31811 - DNA, 20 bp, Artificial Sequence
  Synthetic oligonucleotide; TGG chr11 5375018 5375037 5375021 -
aatctgacaattatgtgtct

SEQ ID NO: 31812 - DNA, 20 bp, Artificial Sequence
  Synthetic oligonucleotide; GAG chr11 5375016 5375035 5375019 -
tctgacaattatgtgtcttg

SEQ ID NO: 31813 - DNA, 20 bp, Artificial Sequence
  Synthetic oligonucleotide; GAG chr11 5375002 5375021 5375005 -
gtcttggagttgctcttctc

SEQ ID NO: 31814 - DNA, 20 bp, Artificial Sequence
  Synthetic oligonucleotide; AGG chr11 5375001 5375020 5375004 -
tcttggagttgctcttctcg

SEQ ID NO: 31815 - DNA, 20 bp, Artificial Sequence
  Synthetic oligonucleotide; GAG chr11 5374999 5375018 5375002 -
ttggagttgctcttctcgag

SEQ ID NO: 31816 - DNA, 20 bp, Artificial Sequence
  Synthetic oligonucleotide; TGG chr11 5374988 5375007 5374991 -
cttctcgaggagtatgtttg

SEQ ID NO: 31817 - DNA, 20 bp, Artificial Sequence
  Synthetic oligonucleotide; TGG chr11 5374956 5374975 5374959 -
tatttcctgaatctgaatgt

SEQ ID NO: 31818 - DNA, 20 bp, Artificial Sequence
  Synthetic oligonucleotide; TAG chr11 5374943 5374962 5374946 -
tgaatgttggcctgccttgc

SEQ ID NO: 31819 - DNA, 20 bp, Artificial Sequence
  Synthetic oligonucleotide; TGG chr11 5374938 5374957 5374941 -
gttggcctgccttgctagat

SEQ ID NO: 31820 - DNA, 20 bp, Artificial Sequence
  Synthetic oligonucleotide; GGG chr11 5374937 5374956 5374940 -
ttggcctgccttgctagatt

SEQ ID NO: 31821 - DNA, 20 bp, Artificial Sequence
  Synthetic oligonucleotide; GGG chr11 5374936 5374955 5374939 -
tggcctgccttgctagattg

SEQ ID NO: 31822 - DNA, 20 bp, Artificial Sequence
  Synthetic oligonucleotide; AAG chr11 5374933 5374952 5374936 -
cctgccttgctagattgggg

SEQ ID NO: 31823 - DNA, 20 bp, Artificial Sequence
  Synthetic oligonucleotide; TGG chr11 5374924 5374943 5374927 -
ctagattggggaagttctcc

SEQ ID NO: 31824 - DNA, 20 bp, Artificial Sequence
  Synthetic oligonucleotide; CAG chr11 5374910 5374929 5374913 -
ttctcctggataatatcctg

SEQ ID NO: 31825 - DNA, 20 bp, Artificial Sequence
  Synthetic oligonucleotide; GAG chr11 5374908 5374927 5374911 -
ctcctggataatatcctgca

SEQ ID NO: 31826 - DNA, 20 bp, Artificial Sequence
  Synthetic oligonucleotide; TGG chr11 5374893 5374912 5374896 -
ctgcagagtgttttccaact

SEQ ID NO: 31827 - DNA, 20 bp, Artificial Sequence
  Synthetic oligonucleotide; CAG chr11 5374869 5374888 5374872 -
tcgattctccccgtcacttt

SEQ ID NO: 31828 - DNA, 20 bp, Artificial Sequence
  Synthetic oligonucleotide; AGG chr11 5374868 5374887 5374871 -
cgattctccccgtcactttc

SEQ ID NO: 31829 - DNA, 20 bp, Artificial Sequence
  Synthetic oligonucleotide; CAG chr11 5374856 5374875 5374859 -
tcactttcaggtacaccaat

SEQ ID NO: 31830 - DNA, 20 bp, Artificial Sequence
  Synthetic oligonucleotide; TAG chr11 5374850 5374869 5374853 -
tcaggtacaccaatcagacc

SEQ ID NO: 31831 - DNA, 20 bp, Artificial Sequence
  Synthetic oligonucleotide; TAG chr11 5374831 5374850 5374834 -
ctagatttgatcttttcaca

SEQ ID NO: 31832 - DNA, 20 bp, Artificial Sequence
  Synthetic oligonucleotide; TGG chr11 5374816 5374835 5374819 -
tcacatagtcccatatttct

SEQ ID NO: 31833 - DNA, 20 bp, Artificial Sequence
  Synthetic oligonucleotide; GAG chr11 5374814 5374833 5374817 -
acatagtcccatatttcttg

SEQ ID NO: 31834 - DNA, 20 bp, Artificial Sequence
  Synthetic oligonucleotide; AGG chr11 5374813 5374832 5374816 -
catagtcccatatttcttgg

SEQ ID NO: 31835 - DNA, 20 bp, Artificial Sequence
  Synthetic oligonucleotide; CAG chr11 5374718 5374737 5374721 -
atcactgataccctttcttc

SEQ ID NO: 31836 - DNA, 20 bp, Artificial Sequence
  Synthetic oligonucleotide; CAG chr11 5374705 5374724 5374708 -
tttcttccagttgatcgcat

SEQ ID NO: 31837 - DNA, 20 bp, Artificial Sequence
  Synthetic oligonucleotide; GAG chr11 5374697 5374716 5374700 -
agttgatcgcatcagctcct

SEQ ID NO: 31838 - DNA, 20 bp, Artificial Sequence
  Synthetic oligonucleotide; AGG chr11 5374696 5374715 5374699 -
gttgatcgcatcagctcctg

SEQ ID NO: 31839 - DNA, 20 bp, Artificial Sequence
  Synthetic oligonucleotide; GAG chr11 5374668 5374687 5374671 -
ccattcttcacgtcattctc

SEQ ID NO: 31840 - DNA, 20 bp, Artificial Sequence
  Synthetic oligonucleotide; TGG chr11 5374662 5374681 5374665 -
ttcacgtcattctcgagcct

SEQ ID NO: 31841 - DNA, 20 bp, Artificial Sequence
  Synthetic oligonucleotide; CAG chr11 5374655 5374674 5374658 -
cattctcgagccttggcttt

SEQ ID NO: 31842 - DNA, 20 bp, Artificial Sequence
  Synthetic oligonucleotide; CAG chr11 5374646 5374665 5374649 -
gccttggctttcagctccat

SEQ ID NO: 31843 - DNA, 20 bp, Artificial Sequence
  Synthetic oligonucleotide; AAG chr11 5374636 5374655 5374639 -
tcagctccatcagctccttt

SEQ ID NO: 31844 - DNA, 20 bp, Artificial Sequence
  Synthetic oligonucleotide; TGG chr11 5374620 5374639 5374623 -
ctttaagcacttctctgtat

SEQ ID NO: 31845 - DNA, 20 bp, Artificial Sequence
  Synthetic oligonucleotide; TAG chr11 5374611 5374630 5374614 -
cttctctgtattggttattc

SEQ ID NO: 31846 - DNA, 20 bp, Artificial Sequence
  Synthetic oligonucleotide; AAG chr11 5374581 5374600 5374584 -
ttcatctaaattttttttca

SEQ ID NO: 31847 - DNA, 20 bp, Artificial Sequence
  Synthetic oligonucleotide; TGG chr11 5374559 5374578 5374562 -
gtttttatcttctttgcctt

SEQ ID NO: 31848 - DNA, 20 bp, Artificial Sequence
  Synthetic oligonucleotide; TAG chr11 5374540 5374559 5374543 -
ttggtttgaatttcctcctg

SEQ ID NO: 31849 - DNA, 20 bp, Artificial Sequence
  Synthetic oligonucleotide; CGG chr11 5374535 5374554 5374538 -
ttgaatttcctcctgtagct

SEQ ID NO: 31850 - DNA, 20 bp, Artificial Sequence
  Synthetic oligonucleotide; GAG chr11 5374533 5374552 5374536 -
gaatttcctcctgtagctcg

SEQ ID NO: 31851 - DNA, 20 bp, Artificial Sequence
  Synthetic oligonucleotide; TAG chr11 5374530 5374549 5374533 -
tttcctcctgtagctcggag

SEQ ID NO: 31852 - DNA, 20 bp, Artificial Sequence
  Synthetic oligonucleotide; AAG chr11 5374515 5374534 5374518 -
cggagtagtttcatcgtctg

SEQ ID NO: 31853 - DNA, 20 bp, Artificial Sequence
  Synthetic oligonucleotide; CAG chr11 5374501 5374520 5374504 -
cgtctgaagtcttcttctct

SEQ ID NO: 31854 - DNA, 20 bp, Artificial Sequence
  Synthetic oligonucleotide; AAG chr11 5374491 5374510 5374494 -
cttcttctctcagctcgtca

SEQ ID NO: 31855 - DNA, 20 bp, Artificial Sequence
  Synthetic oligonucleotide; CAG chr11 5374476 5374495 5374479 -
cgtcaaagtcattctccatc

SEQ ID NO: 31856 - DNA, 20 bp, Artificial Sequence
  Synthetic oligonucleotide; TGG chr11 5374459 5374478 5374462 -
atccagctttgttccgttgc

SEQ ID NO: 31857 - DNA, 20 bp, Artificial Sequence
  Synthetic oligonucleotide; GAG chr11 5374455 5374474 5374458 -
agctttgttccgttgctggt

SEQ ID NO: 31858 - DNA, 20 bp, Artificial Sequence
  Synthetic oligonucleotide; AGG chr11 5374454 5374473 5374457 -
gctttgttccgttgctggtg

SEQ ID NO: 31859 - DNA, 20 bp, Artificial Sequence
  Synthetic oligonucleotide; TGG chr11 5374438 5374457 5374441 -
ggtgaggaactgctttcctt

SEQ ID NO: 31860 - DNA, 20 bp, Artificial Sequence
  Synthetic oligonucleotide; GAG chr11 5374436 5374455 5374439 -
tgaggaactgctttcctttg

SEQ ID NO: 31861 - DNA, 20 bp, Artificial Sequence
  Synthetic oligonucleotide; AGG chr11 5374435 5374454 5374438 -
gaggaactgctttcctttgg

SEQ ID NO: 31862 - DNA, 20 bp, Artificial Sequence
  Synthetic oligonucleotide; GAG chr11 5374433 5374452 5374436 -
ggaactgctttcctttggag

SEQ ID NO: 31863 - DNA, 20 bp, Artificial Sequence
  Synthetic oligonucleotide; AGG chr11 5374432 5374451 5374435 -
gaactgctttcctttggagg

SEQ ID NO: 31864 - DNA, 20 bp, Artificial Sequence
  Synthetic oligonucleotide; AAG chr11 5374428 5374447 5374431 -
tgctttcctttggaggagga

SEQ ID NO: 31865 - DNA, 20 bp, Artificial Sequence
  Synthetic oligonucleotide; AGG chr11 5374427 5374446 5374430 -
gctttcctttggaggaggaa

SEQ ID NO: 31866 - DNA, 20 bp, Artificial Sequence
  Synthetic oligonucleotide; TAG chr11 5374412 5374431 5374415 -
aggaaaggtgctctgctttt

SEQ ID NO: 31867 - DNA, 20 bp, Artificial Sequence
  Synthetic oligonucleotide; GAG chr11 5374410 5374429 5374413 -
gaaaggtgctctgcttttta

SEQ ID NO: 31868 - DNA, 20 bp, Artificial Sequence
  Synthetic oligonucleotide; CAG chr11 5374403 5374422 5374406 -
gctctgctttttagagtttc

SEQ ID NO: 31869 - DNA, 20 bp, Artificial Sequence
  Synthetic oligonucleotide; TGG chr11 5374370 5374389 5374373 -
ctgttttttccccaactttg

SEQ ID NO: 31870 - DNA, 20 bp, Artificial Sequence
  Synthetic oligonucleotide; TGG chr11 5374354 5374373 5374357 -
tttgtggttgtatctacttt

SEQ ID NO: 31871 - DNA, 20 bp, Artificial Sequence
  Synthetic oligonucleotide; TAG chr11 5374341 5374360 5374344 -
ctacttttggtctttgatga

SEQ ID NO: 31872 - DNA, 20 bp, Artificial Sequence
  Synthetic oligonucleotide; TGG chr11 5374327 5374346 5374330 -
tgatgatagtgatgtaccga

SEQ ID NO: 31873 - DNA, 20 bp, Artificial Sequence
  Synthetic oligonucleotide; GGG chr11 5374326 5374345 5374329 -
gatgatagtgatgtaccgat

SEQ ID NO: 31874 - DNA, 20 bp, Artificial Sequence
  Synthetic oligonucleotide; TGG chr11 5374319 5374338 5374322 -
gtgatgtaccgatgggtttt

SEQ ID NO: 31875 - DNA, 20 bp, Artificial Sequence
  Synthetic oligonucleotide; TGG chr11 5374314 5374333 5374317 -
gtaccgatgggtttttggtg

SEQ ID NO: 31876 - DNA, 20 bp, Artificial Sequence
  Synthetic oligonucleotide; TAG chr11 5374294 5374313 5374297 -
tggatgtcctttctgtttgt

SEQ ID NO: 31877 - DNA, 20 bp, Artificial Sequence
  Synthetic oligonucleotide; CAG chr11 5374279 5374298 5374282 -
tttgttagttttccttctaa

SEQ ID NO: 31878 - DNA, 20 bp, Artificial Sequence
  Synthetic oligonucleotide; CAG chr11 5374275 5374294 5374278 -
ttagttttccttctaacaga

SEQ ID NO: 31879 - DNA, 20 bp, Artificial Sequence
  Synthetic oligonucleotide; AGG chr11 5374274 5374293 5374277 -
tagttttccttctaacagac

SEQ ID NO: 31880 - DNA, 20 bp, Artificial Sequence
  Synthetic oligonucleotide; CAG chr11 5374266 5374285 5374269 -
cttctaacagacaggaccct

SEQ ID NO: 31881 - DNA, 20 bp, Artificial Sequence
  Synthetic oligonucleotide; CAG chr11 5374260 5374279 5374263 -
acagacaggaccctcagctg

SEQ ID NO: 31882 - DNA, 20 bp, Artificial Sequence
  Synthetic oligonucleotide; AGG chr11 5374259 5374278 5374262 -
cagacaggaccctcagctgc

SEQ ID NO: 31883 - DNA, 20 bp, Artificial Sequence
  Synthetic oligonucleotide; TGG chr11 5374251 5374270 5374254 -
accctcagctgcaggtctgt

SEQ ID NO: 31884 - DNA, 20 bp, Artificial Sequence
  Synthetic oligonucleotide; GAG chr11 5374249 5374268 5374252 -
cctcagctgcaggtctgttg

SEQ ID NO: 31885 - DNA, 20 bp, Artificial Sequence
  Synthetic oligonucleotide; TAG chr11 5374241 5374260 5374244 -
gcaggtctgttggagtttgc

SEQ ID NO: 31886 - DNA, 20 bp, Artificial Sequence
  Synthetic oligonucleotide; GAG chr11 5374239 5374258 5374242 -
aggtctgttggagtttgcta

SEQ ID NO: 31887 - DNA, 20 bp, Artificial Sequence
  Synthetic oligonucleotide; AGG chr11 5374238 5374257 5374241 -
ggtctgttggagtttgctag

SEQ ID NO: 31888 - DNA, 20 bp, Artificial Sequence
  Synthetic oligonucleotide; CAG chr11 5374228 5374247 5374231 -
agtttgctagaggtccactc

SEQ ID NO: 31889 - DNA, 20 bp, Artificial Sequence
  Synthetic oligonucleotide; TGG chr11 5374213 5374232 5374216 -
cactccagaccctgtttgcc

SEQ ID NO: 31890 - DNA, 20 bp, Artificial Sequence
  Synthetic oligonucleotide; GGG chr11 5374212 5374231 5374215 -
actccagaccctgtttgcct

SEQ ID NO: 31891 - DNA, 20 bp, Artificial Sequence
  Synthetic oligonucleotide; CAG chr11 5374206 5374225 5374209 -
gaccctgtttgcctgggtat

SEQ ID NO: 31892 - DNA, 20 bp, Artificial Sequence
  Synthetic oligonucleotide; CAG chr11 5374203 5374222 5374206 -
cctgtttgcctgggtatcag

SEQ ID NO: 31893 - DNA, 20 bp, Artificial Sequence
  Synthetic oligonucleotide; CGG chr11 5374200 5374219 5374203 -
gtttgcctgggtatcagcag

SEQ ID NO: 31894 - DNA, 20 bp, Artificial Sequence
  Synthetic oligonucleotide; CAG chr11 5374191 5374210 5374194 -
ggtatcagcagcggtgtctg

SEQ ID NO: 31895 - DNA, 20 bp, Artificial Sequence
  Synthetic oligonucleotide; CAG chr11 5374183 5374202 5374186 -
cagcggtgtctgcagaaccg

SEQ ID NO: 31896 - DNA, 20 bp, Artificial Sequence
  Synthetic oligonucleotide; TGG chr11 5374140 5374159 5374143 -
ctgctgtctgatcgttcctc

SEQ ID NO: 31897 - DNA, 20 bp, Artificial Sequence
  Synthetic oligonucleotide; AAG chr11 5374137 5374156 5374140 -
ctgtctgatcgttcctctgg

SEQ ID NO: 31898 - DNA, 20 bp, Artificial Sequence
  Synthetic oligonucleotide; CAG chr11 5374126 5374145 5374129 -
ttcctctggaagttttgtct

SEQ ID NO: 31899 - DNA, 20 bp, Artificial Sequence
  Synthetic oligonucleotide; GAG chr11 5374124 5374143 5374127 -
cctctggaagttttgtctca

SEQ ID NO: 31900 - DNA, 20 bp, Artificial Sequence
  Synthetic oligonucleotide; AGG chr11 5374123 5374142 5374126 -
ctctggaagttttgtctcag

SEQ ID NO: 31901 - DNA, 20 bp, Artificial Sequence
  Synthetic oligonucleotide; GAG chr11 5374121 5374140 5374124 -
ctggaagttttgtctcagag

SEQ ID NO: 31902 - DNA, 20 bp, Artificial Sequence
  Synthetic oligonucleotide; TGG chr11 5374114 5374133 5374117 -
ttttgtctcagaggagtacc

SEQ ID NO: 31903 - DNA, 20 bp, Artificial Sequence
  Synthetic oligonucleotide; GAG chr11 5374105 5374124 5374108 -
agaggagtacctggccgtgt

SEQ ID NO: 31904 - DNA, 20 bp, Artificial Sequence
  Synthetic oligonucleotide; AGG chr11 5374104 5374123 5374107 -
gaggagtacctggccgtgtg

SEQ ID NO: 31905 - DNA, 20 bp, Artificial Sequence
  Synthetic oligonucleotide; CAG chr11 5374098 5374117 5374101 -
tacctggccgtgtgaggtgt

SEQ ID NO: 31906 - DNA, 20 bp, Artificial Sequence
  Synthetic oligonucleotide; TGG chr11 5374083 5374102 5374086 -
ggtgtcagtctgcccttact

SEQ ID NO: 31907 - DNA, 20 bp, Artificial Sequence
  Synthetic oligonucleotide; GGG chr11 5374082 5374101 5374085 -
gtgtcagtctgcccttactt

SEQ ID NO: 31908 - DNA, 20 bp, Artificial Sequence
  Synthetic oligonucleotide; GGG chr11 5374081 5374100 5374084 -
tgtcagtctgcccttacttg

SEQ ID NO: 31909 - DNA, 20 bp, Artificial Sequence
  Synthetic oligonucleotide; GGG chr11 5374080 5374099 5374083 -
gtcagtctgcccttacttgg

SEQ ID NO: 31910 - DNA, 20 bp, Artificial Sequence
  Synthetic oligonucleotide; CAG chr11 5374070 5374089 5374073 -
ccttacttgggggtgcctcc

SEQ ID NO: 31911 - DNA, 20 bp, Artificial Sequence
  Synthetic oligonucleotide; TAG chr11 5374066 5374085 5374069 -
acttgggggtgcctcccagt

SEQ ID NO: 31912 - DNA, 20 bp, Artificial Sequence
  Synthetic oligonucleotide; AGG chr11 5374065 5374084 5374068 -
cttgggggtgcctcccagtt

SEQ ID NO: 31913 - DNA, 20 bp, Artificial Sequence
  Synthetic oligonucleotide; CGG chr11 5374057 5374076 5374060 -
tgcctcccagttaggctgct

SEQ ID NO: 31914 - DNA, 20 bp, Artificial Sequence
  Synthetic oligonucleotide; GGG chr11 5374056 5374075 5374059 -
gcctcccagttaggctgctc

SEQ ID NO: 31915 - DNA, 20 bp, Artificial Sequence
  Synthetic oligonucleotide; GGG chr11 5374055 5374074 5374058 -
cctcccagttaggctgctcg

SEQ ID NO: 31916 - DNA, 20 bp, Artificial Sequence
  Synthetic oligonucleotide; GGG chr11 5374054 5374073 5374057 -
ctcccagttaggctgctcgg

SEQ ID NO: 31917 - DNA, 20 bp, Artificial Sequence
  Synthetic oligonucleotide; CAG chr11 5374050 5374069 5374053 -
cagttaggctgctcgggggt

SEQ ID NO: 31918 - DNA, 20 bp, Artificial Sequence
  Synthetic oligonucleotide; AGG chr11 5374049 5374068 5374052 -
agttaggctgctcgggggtc

SEQ ID NO: 31919 - DNA, 20 bp, Artificial Sequence
  Synthetic oligonucleotide; GGG chr11 5374048 5374067 5374051 -
gttaggctgctcgggggtca

SEQ ID NO: 31920 - DNA, 20 bp, Artificial Sequence
  Synthetic oligonucleotide; GGG chr11 5374047 5374066 5374050 -
ttaggctgctcgggggtcag

SEQ ID NO: 31921 - DNA, 20 bp, Artificial Sequence
  Synthetic oligonucleotide; CAG chr11 5374043 5374062 5374046 -
gctgctcgggggtcaggggt

SEQ ID NO: 31922 - DNA, 20 bp, Artificial Sequence
  Synthetic oligonucleotide; AGG chr11 5374042 5374061 5374045 -
ctgctcgggggtcaggggtc

SEQ ID NO: 31923 - DNA, 20 bp, Artificial Sequence
  Synthetic oligonucleotide; GGG chr11 5374041 5374060 5374044 -
tgctcgggggtcaggggtca

SEQ ID NO: 31924 - DNA, 20 bp, Artificial Sequence
  Synthetic oligonucleotide; GAG chr11 5374030 5374049 5374033 -
caggggtcagggacccactt

SEQ ID NO: 31925 - DNA, 20 bp, Artificial Sequence
  Synthetic oligonucleotide; AGG chr11 5374029 5374048 5374032 -
aggggtcagggacccacttg

SEQ ID NO: 31926 - DNA, 20 bp, Artificial Sequence
  Synthetic oligonucleotide; GAG chr11 5374027 5374046 5374030 -
gggtcagggacccacttgag

SEQ ID NO: 31927 - DNA, 20 bp, Artificial Sequence
  Synthetic oligonucleotide; AGG chr11 5374026 5374045 5374029 -
ggtcagggacccacttgagg

SEQ ID NO: 31928 - DNA, 20 bp, Artificial Sequence
  Synthetic oligonucleotide; CAG chr11 5374023 5374042 5374026 -
cagggacccacttgaggagg

SEQ ID NO: 31929 - DNA, 20 bp, Artificial Sequence
  Synthetic oligonucleotide; CAG chr11 5374008 5374027 5374011 -
ggaggcagtctgcccgttct

SEQ ID NO: 31930 - DNA, 20 bp, Artificial Sequence
  Synthetic oligonucleotide; CAG chr11 5374000 5374019 5374003 -
tctgcccgttctcagatctc

SEQ ID NO: 31931 - DNA, 20 bp, Artificial Sequence
  Synthetic oligonucleotide; TGG chr11 5373989 5374008 5373992 -
tcagatctccagctgtgtgc

SEQ ID NO: 31932 - DNA, 20 bp, Artificial Sequence
  Synthetic oligonucleotide; GGG chr11 5373988 5374007 5373991 -
cagatctccagctgtgtgct

SEQ ID NO: 31933 - DNA, 20 bp, Artificial Sequence
  Synthetic oligonucleotide; GAG chr11 5373986 5374005 5373989 -
gatctccagctgtgtgctgg

SEQ ID NO: 31934 - DNA, 20 bp, Artificial Sequence
  Synthetic oligonucleotide; AAG chr11 5373966 5373985 5373969 -
gagaaccactgctctcctca

SEQ ID NO: 31935 - DNA, 20 bp, Artificial Sequence
  Synthetic oligonucleotide; CAG chr11 5373959 5373978 5373962 -
actgctctcctcaaagctgt

SEQ ID NO: 31936 - DNA, 20 bp, Artificial Sequence
  Synthetic oligonucleotide; CAG chr11 5373955 5373974 5373958 -
ctctcctcaaagctgtcaga

SEQ ID NO: 31937 - DNA, 20 bp, Artificial Sequence
  Synthetic oligonucleotide; AGG chr11 5373954 5373973 5373957 -
tctcctcaaagctgtcagac

SEQ ID NO: 31938 - DNA, 20 bp, Artificial Sequence
  Synthetic oligonucleotide; GGG chr11 5373953 5373972 5373956 -
ctcctcaaagctgtcagaca

SEQ ID NO: 31939 - DNA, 20 bp, Artificial Sequence
  Synthetic oligonucleotide; AAG chr11 5373944 5373963 5373947 -
gctgtcagacagggacattt

SEQ ID NO: 31940 - DNA, 20 bp, Artificial Sequence
  Synthetic oligonucleotide; CAG chr11 5373937 5373956 5373940 -
gacagggacatttaagtctg

SEQ ID NO: 31941 - DNA, 20 bp, Artificial Sequence
  Synthetic oligonucleotide; GAG chr11 5373935 5373954 5373938 -
cagggacatttaagtctgca

SEQ ID NO: 31942 - DNA, 20 bp, Artificial Sequence
  Synthetic oligonucleotide; AGG chr11 5373934 5373953 5373937 -
agggacatttaagtctgcag

SEQ ID NO: 31943 - DNA, 20 bp, Artificial Sequence
  Synthetic oligonucleotide; AAG chr11 5373893 5373912 5373896 -
ttgtctgtgccctgccccca

SEQ ID NO: 31944 - DNA, 20 bp, Artificial Sequence
  Synthetic oligonucleotide; AGG chr11 5373892 5373911 5373895 -
tgtctgtgccctgcccccaa

SEQ ID NO: 31945 - DNA, 20 bp, Artificial Sequence
  Synthetic oligonucleotide; TGG chr11 5373889 5373908 5373892 -
ctgtgccctgcccccaaagg

SEQ ID NO: 31946 - DNA, 20 bp, Artificial Sequence
  Synthetic oligonucleotide; GAG chr11 5373887 5373906 5373890 -
gtgccctgcccccaaaggtg

SEQ ID NO: 31947 - DNA, 20 bp, Artificial Sequence
  Synthetic oligonucleotide; CAG chr11 5373880 5373899 5373883 -
gcccccaaaggtggagccta

SEQ ID NO: 31948 - DNA, 20 bp, Artificial Sequence
  Synthetic oligonucleotide; GAG chr11 5373878 5373897 5373881 -
ccccaaaggtggagcctaca

SEQ ID NO: 31949 - DNA, 20 bp, Artificial Sequence
  Synthetic oligonucleotide; AGG chr11 5373877 5373896 5373880 -
cccaaaggtggagcctacag

SEQ ID NO: 31950 - DNA, 20 bp, Artificial Sequence
  Synthetic oligonucleotide; CAG chr11 5373874 5373893 5373877 -
aaaggtggagcctacagagg

SEQ ID NO: 31951 - DNA, 20 bp, Artificial Sequence
  Synthetic oligonucleotide; AGG chr11 5373873 5373892 5373876 -
aaggtggagcctacagaggc

SEQ ID NO: 31952 - DNA, 20 bp, Artificial Sequence
  Synthetic oligonucleotide; CAG chr11 5373870 5373889 5373873 -
gtggagcctacagaggcagg

SEQ ID NO: 31953 - DNA, 20 bp, Artificial Sequence
  Synthetic oligonucleotide; AGG chr11 5373869 5373888 5373872 -
tggagcctacagaggcaggc

SEQ ID NO: 31954 - DNA, 20 bp, Artificial Sequence
  Synthetic oligonucleotide; GAG chr11 5373859 5373878 5373862 -
agaggcaggcaggcctcctt

SEQ ID NO: 31955 - DNA, 20 bp, Artificial Sequence
  Synthetic oligonucleotide; TGG chr11 5373853 5373872 5373856 -
aggcaggcctccttgagctg

SEQ ID NO: 31956 - DNA, 20 bp, Artificial Sequence
  Synthetic oligonucleotide; TGG chr11 5373850 5373869 5373853 -
caggcctccttgagctgtgg

SEQ ID NO: 31957 - DNA, 20 bp, Artificial Sequence
  Synthetic oligonucleotide; GGG chr11 5373849 5373868 5373852 -
aggcctccttgagctgtggt

SEQ ID NO: 31958 - DNA, 20 bp, Artificial Sequence
  Synthetic oligonucleotide; GGG chr11 5373848 5373867 5373851 -
ggcctccttgagctgtggtg

SEQ ID NO: 31959 - DNA, 20 bp, Artificial Sequence
  Synthetic oligonucleotide; CAG chr11 5373839 5373858 5373842 -
gagctgtggtggggtccacc

SEQ ID NO: 31960 - DNA, 20 bp, Artificial Sequence
  Synthetic oligonucleotide; GAG chr11 5373833 5373852 5373836 -
tggtggggtccacccagttt

SEQ ID NO: 31961 - DNA, 20 bp, Artificial Sequence
  Synthetic oligonucleotide; TGG chr11 5373825 5373844 5373828 -
tccacccagtttgagcttcc

SEQ ID NO: 31962 - DNA, 20 bp, Artificial Sequence
  Synthetic oligonucleotide; AAG chr11 5373807 5373826 5373810 -
cctggctgctttgtttacct

SEQ ID NO: 31963 - DNA, 20 bp, Artificial Sequence
  Synthetic oligonucleotide; AAG chr11 5373803 5373822 5373806 -
gctgctttgtttacctaagc

SEQ ID NO: 31964 - DNA, 20 bp, Artificial Sequence
  Synthetic oligonucleotide; TGG chr11 5373798 5373817 5373801 -
tttgtttacctaagcaagcc

SEQ ID NO: 31965 - DNA, 20 bp, Artificial Sequence
  Synthetic oligonucleotide; GGG chr11 5373797 5373816 5373800 -
ttgtttacctaagcaagcct

SEQ ID NO: 31966 - DNA, 20 bp, Artificial Sequence
  Synthetic oligonucleotide; TGG chr11 5373791 5373810 5373794 -
acctaagcaagcctgggcaa

SEQ ID NO: 31967 - DNA, 20 bp, Artificial Sequence
  Synthetic oligonucleotide; CGG chr11 5373788 5373807 5373791 -
taagcaagcctgggcaatgg

SEQ ID NO: 31968 - DNA, 20 bp, Artificial Sequence
  Synthetic oligonucleotide; CAG chr11 5373773 5373792 5373776 -
aatggcggctgcccctcccc

SEQ ID NO: 31969 - DNA, 20 bp, Artificial Sequence
  Synthetic oligonucleotide; CAG chr11 5373754 5373773 5373757 -
ccagcctcgctgccaccttg

SEQ ID NO: 31970 - DNA, 20 bp, Artificial Sequence
  Synthetic oligonucleotide; CAG chr11 5373743 5373762 5373746 -
gccaccttgcagtttgatct

SEQ ID NO: 31971 - DNA, 20 bp, Artificial Sequence
  Synthetic oligonucleotide; TAG chr11 5373730 5373749 5373733 -
ttgatctcagactgctgtgc

SEQ ID NO: 31972 - DNA, 20 bp, Artificial Sequence
  Synthetic oligonucleotide; CAG chr11 5373723 5373742 5373726 -
cagactgctgtgctagcaat

SEQ ID NO: 31973 - DNA, 20 bp, Artificial Sequence
  Synthetic oligonucleotide; AGG chr11 5373722 5373741 5373725 -
agactgctgtgctagcaatc

SEQ ID NO: 31974 - DNA, 20 bp, Artificial Sequence
  Synthetic oligonucleotide; GGG chr11 5373721 5373740 5373724 -
gactgctgtgctagcaatca

SEQ ID NO: 31975 - DNA, 20 bp, Artificial Sequence
  Synthetic oligonucleotide; GAG chr11 5373719 5373738 5373722 -
ctgctgtgctagcaatcagg

SEQ ID NO: 31976 - DNA, 20 bp, Artificial Sequence
  Synthetic oligonucleotide; TGG chr11 5373710 5373729 5373713 -
tagcaatcagggagactccg

SEQ ID NO: 31977 - DNA, 20 bp, Artificial Sequence
  Synthetic oligonucleotide; GGG chr11 5373709 5373728 5373712 -
agcaatcagggagactccgt

SEQ ID NO: 31978 - DNA, 20 bp, Artificial Sequence
  Synthetic oligonucleotide; TAG chr11 5373704 5373723 5373707 -
tcagggagactccgtgggcg

SEQ ID NO: 31979 - DNA, 20 bp, Artificial Sequence
  Synthetic oligonucleotide; AGG chr11 5373703 5373722 5373706 -
cagggagactccgtgggcgt

SEQ ID NO: 31980 - DNA, 20 bp, Artificial Sequence
  Synthetic oligonucleotide; CGG chr11 5373695 5373714 5373698 -
ctccgtgggcgtaggaccct

SEQ ID NO: 31981 - DNA, 20 bp, Artificial Sequence
  Synthetic oligonucleotide; GAG chr11 5373693 5373712 5373696 -
ccgtgggcgtaggaccctcg

SEQ ID NO: 31982 - DNA, 20 bp, Artificial Sequence
  Synthetic oligonucleotide; CAG chr11 5373683 5373702 5373686 -
aggaccctcggagccatgtg

SEQ ID NO: 31983 - DNA, 20 bp, Artificial Sequence
  Synthetic oligonucleotide; AGG chr11 5373682 5373701 5373685 -
ggaccctcggagccatgtgc

SEQ ID NO: 31984 - DNA, 20 bp, Artificial Sequence
  Synthetic oligonucleotide; TGG chr11 5373668 5373687 5373671 -
atgtgcaggatataatctcc

SEQ ID NO: 31985 - DNA, 20 bp, Artificial Sequence
  Synthetic oligonucleotide; AAG chr11 5373652 5373671 5373655 -
ctcctggtgcgccatttcct

SEQ ID NO: 31986 - DNA, 20 bp, Artificial Sequence
  Synthetic oligonucleotide; CAG chr11 5373644 5373663 5373647 -
gcgccatttcctaagcctgt

SEQ ID NO: 31987 - DNA, 20 bp, Artificial Sequence
  Synthetic oligonucleotide; AAG chr11 5373639 5373658 5373642 -
atttcctaagcctgtcagaa

SEQ ID NO: 31988 - DNA, 20 bp, Artificial Sequence
  Synthetic oligonucleotide; CAG chr11 5373634 5373653 5373637 -
ctaagcctgtcagaaaagca

SEQ ID NO: 31989 - DNA, 20 bp, Artificial Sequence
  Synthetic oligonucleotide; CGG chr11 5373627 5373646 5373630 -
tgtcagaaaagcacagtatt

SEQ ID NO: 31990 - DNA, 20 bp, Artificial Sequence
  Synthetic oligonucleotide; GGG chr11 5373626 5373645 5373629 -
gtcagaaaagcacagtattc

SEQ ID NO: 31991 - DNA, 20 bp, Artificial Sequence
  Synthetic oligonucleotide; TGG chr11 5373623 5373642 5373626 -
agaaaagcacagtattcggg

SEQ ID NO: 31992 - DNA, 20 bp, Artificial Sequence
  Synthetic oligonucleotide; GGG chr11 5373622 5373641 5373625 -
gaaaagcacagtattcgggt

SEQ ID NO: 31993 - DNA, 20 bp, Artificial Sequence
  Synthetic oligonucleotide; GAG chr11 5373620 5373639 5373623 -
aaagcacagtattcgggtgg

SEQ ID NO: 31994 - DNA, 20 bp, Artificial Sequence
  Synthetic oligonucleotide; TGG chr11 5373617 5373636 5373620 -
gcacagtattcgggtgggag

SEQ ID NO: 31995 - DNA, 20 bp, Artificial Sequence
  Synthetic oligonucleotide; CAG chr11 5373604 5373623 5373607 -
gtgggagtggcccaattttc

SEQ ID NO: 31996 - DNA, 20 bp, Artificial Sequence
  Synthetic oligonucleotide; AGG chr11 5373603 5373622 5373606 -
tgggagtggcccaattttcc

SEQ ID NO: 31997 - DNA, 20 bp, Artificial Sequence
  Synthetic oligonucleotide; CAG chr11 5373574 5373593 5373577 -
atgtcacccctttccttgac

SEQ ID NO: 31998 - DNA, 20 bp, Artificial Sequence
  Synthetic oligonucleotide; AGG chr11 5373573 5373592 5373576 -
tgtcacccctttccttgacc

SEQ ID NO: 31999 - DNA, 20 bp, Artificial Sequence
  Synthetic oligonucleotide; AAG chr11 5373569 5373588 5373572 -
acccctttccttgaccagga

SEQ ID NO: 32000 - DNA, 20 bp, Artificial Sequence
  Synthetic oligonucleotide; AGG chr11 5373568 5373587 5373571 -
cccctttccttgaccaggaa

SEQ ID NO: 32001 - DNA, 20 bp, Artificial Sequence
  Synthetic oligonucleotide; GGG chr11 5373567 5373586 5373570 -
ccctttccttgaccaggaaa

SEQ ID NO: 32002 - DNA, 20 bp, Artificial Sequence
  Synthetic oligonucleotide; AAG chr11 5373539 5373558 5373542 -
catgaccccttgtgcttccc

SEQ ID NO: 32003 - DNA, 20 bp, Artificial Sequence
  Synthetic oligonucleotide; GAG chr11 5373535 5373554 5373538 -
accccttgtgcttcccaagt

SEQ ID NO: 32004 - DNA, 20 bp, Artificial Sequence
  Synthetic oligonucleotide; AGG chr11 5373534 5373553 5373537 -
ccccttgtgcttcccaagtg

SEQ ID NO: 32005 - DNA, 20 bp, Artificial Sequence
  Synthetic oligonucleotide; CGG chr11 5373513 5373532 5373516 -
ggcaatgcctcaccctgctt

SEQ ID NO: 32006 - DNA, 20 bp, Artificial Sequence
  Synthetic oligonucleotide; TGG chr11 5373509 5373528 5373512 -
atgcctcaccctgcttcggc

SEQ ID NO: 32007 - DNA, 20 bp, Artificial Sequence
  Synthetic oligonucleotide; TGG chr11 5373502 5373521 5373505 -
accctgcttcggctggtgca

SEQ ID NO: 32008 - DNA, 20 bp, Artificial Sequence
  Synthetic oligonucleotide; TGG chr11 5373467 5373486 5373470 -
actgacctgtgcccactgtc

SEQ ID NO: 32009 - DNA, 20 bp, Artificial Sequence
  Synthetic oligonucleotide; TAG chr11 5373457 5373476 5373460 -
gcccactgtctggcactccc

SEQ ID NO: 32010 - DNA, 20 bp, Artificial Sequence
  Synthetic oligonucleotide; GAG chr11 5373453 5373472 5373456 -
actgtctggcactccctagc

SEQ ID NO: 32011 - DNA, 20 bp, Artificial Sequence
  Synthetic oligonucleotide; CAG chr11 5373435 5373454 5373438 -
gcgagatgaaccccatacct

SEQ ID NO: 32012 - DNA, 20 bp, Artificial Sequence
  Synthetic oligonucleotide; TGG chr11 5373431 5373450 5373434 -
gatgaaccccatacctcaga

SEQ ID NO: 32013 - DNA, 20 bp, Artificial Sequence
  Synthetic oligonucleotide; CAG chr11 5373423 5373442 5373426 -
ccatacctcagatggaaatg

SEQ ID NO: 32014 - DNA, 20 bp, Artificial Sequence
  Synthetic oligonucleotide; TGG chr11 5373391 5373410 5373394 -
gtcttctgtgttgttcacgc

SEQ ID NO: 32015 - DNA, 20 bp, Artificial Sequence
  Synthetic oligonucleotide; GGG chr11 5373390 5373409 5373393 -
tcttctgtgttgttcacgct

SEQ ID NO: 32016 - DNA, 20 bp, Artificial Sequence
  Synthetic oligonucleotide; GAG chr11 5373388 5373407 5373391 -
ttctgtgttgttcacgctgg

SEQ ID NO: 32017 - DNA, 20 bp, Artificial Sequence
  Synthetic oligonucleotide; TAG chr11 5373382 5373401 5373385 -
gttgttcacgctgggagctg

SEQ ID NO: 32018 - DNA, 20 bp, Artificial Sequence
  Synthetic oligonucleotide; CAG chr11 5373377 5373396 5373380 -
tcacgctgggagctgtagac

SEQ ID NO: 32019 - DNA, 20 bp, Artificial Sequence
  Synthetic oligonucleotide; GAG chr11 5373375 5373394 5373378 -
acgctgggagctgtagacca

SEQ ID NO: 32020 - DNA, 20 bp, Artificial Sequence
  Synthetic oligonucleotide; TGG chr11 5373361 5373380 5373364 -
agaccagagctgttcctatt

SEQ ID NO: 32021 - DNA, 20 bp, Artificial Sequence
  Synthetic oligonucleotide; TGG chr11 5373352 5373371 5373355 -
ctgttcctatttggccatct

SEQ ID NO: 32022 - DNA, 20 bp, Artificial Sequence
  Synthetic oligonucleotide; TGG chr11 5373340 5373359 5373343 -
ggccatcttggctcaaaaac

SEQ ID NO: 32023 - DNA, 20 bp, Artificial Sequence
  Synthetic oligonucleotide; AAG chr11 5373323 5373342 5373326 -
aactggaactttatttgtga

SEQ ID NO: 32024 - DNA, 20 bp, Artificial Sequence
  Synthetic oligonucleotide; TAG chr11 5373304 5373323 5373307 -
aaagaaaaaatcgatcaata

SEQ ID NO: 32025 - DNA, 20 bp, Artificial Sequence
  Synthetic oligonucleotide; CAG chr11 5373296 5373315 5373299 -
aatcgatcaatatagacttc

SEQ ID NO: 32026 - DNA, 20 bp, Artificial Sequence
  Synthetic oligonucleotide; AAG chr11 5373274 5373293 5373277 -
gtgaaaattttcttcaaatc

SEQ ID NO: 32027 - DNA, 20 bp, Artificial Sequence
  Synthetic oligonucleotide; GAG chr11 5373251 5373270 5373254 -
acaatatctaaaaaattgcc

SEQ ID NO: 32028 - DNA, 20 bp, Artificial Sequence
  Synthetic oligonucleotide; AAG chr11 5373239 5373258 5373242 -
aaattgccgagactgatatc

SEQ ID NO: 32029 - DNA, 20 bp, Artificial Sequence
  Synthetic oligonucleotide; CAG chr11 5373236 5373255 5373239 -
ttgccgagactgatatcaag

SEQ ID NO: 32030 - DNA, 20 bp, Artificial Sequence
  Synthetic oligonucleotide; CAG chr11 5373212 5373231 5373215 -
tatctctatacatgttcttc

SEQ ID NO: 32031 - DNA, 20 bp, Artificial Sequence
  Synthetic oligonucleotide; AGG chr11 5373211 5373230 5373214 -
atctctatacatgttcttcc

SEQ ID NO: 32032 - DNA, 20 bp, Artificial Sequence
  Synthetic oligonucleotide; GAG chr11 5373209 5373228 5373212 -
ctctatacatgttcttccag

SEQ ID NO: 32033 - DNA, 20 bp, Artificial Sequence
  Synthetic oligonucleotide; CAG chr11 5373195 5373214 5373198 -
ttccaggagttttgtgattt

SEQ ID NO: 32034 - DNA, 20 bp, Artificial Sequence
  Synthetic oligonucleotide; AGG chr11 5373194 5373213 5373197 -
tccaggagttttgtgatttc

SEQ ID NO: 32035 - DNA, 20 bp, Artificial Sequence
  Synthetic oligonucleotide; GAG chr11 5373163 5373182 5373166 -
ttatgtctttaatctatttt

SEQ ID NO: 32036 - DNA, 20 bp, Artificial Sequence
  Synthetic oligonucleotide; TGG chr11 5373152 5373171 5373155 -
atctattttgagttgactta

SEQ ID NO: 32037 - DNA, 20 bp, Artificial Sequence
  Synthetic oligonucleotide; AAG chr11 5373146 5373165 5373149 -
tttgagttgacttatggctt

SEQ ID NO: 32038 - DNA, 20 bp, Artificial Sequence
  Synthetic oligonucleotide; AGG chr11 5373145 5373164 5373148 -
ttgagttgacttatggctta

SEQ ID NO: 32039 - DNA, 20 bp, Artificial Sequence
  Synthetic oligonucleotide; AAG chr11 5373140 5373159 5373143 -
ttgacttatggcttaaggta

SEQ ID NO: 32040 - DNA, 20 bp, Artificial Sequence
  Synthetic oligonucleotide; AGG chr11 5373139 5373158 5373142 -
tgacttatggcttaaggtaa

SEQ ID NO: 32041 - DNA, 20 bp, Artificial Sequence
  Synthetic oligonucleotide; TGG chr11 5373114 5373133 5373117 -
caattttattcttttgcatt

SEQ ID NO: 32042 - DNA, 20 bp, Artificial Sequence
  Synthetic oligonucleotide; CAG chr11 5373106 5373125 5373109 -
ttcttttgcatttggatatc

SEQ ID NO: 32043 - DNA, 20 bp, Artificial Sequence
  Synthetic oligonucleotide; GAG chr11 5373083 5373102 5373086 -
ttttcccaacactatttgtt

SEQ ID NO: 32044 - DNA, 20 bp, Artificial Sequence
  Synthetic oligonucleotide; AGG chr11 5373082 5373101 5373085 -
tttcccaacactatttgttg

SEQ ID NO: 32045 - DNA, 20 bp, Artificial Sequence
  Synthetic oligonucleotide; GAG chr11 5373080 5373099 5373083 -
tcccaacactatttgttgag

SEQ ID NO: 32046 - DNA, 20 bp, Artificial Sequence
  Synthetic oligonucleotide; TGG chr11 5373056 5373075 5373059 -
ctatccttcccctattgtgt

SEQ ID NO: 32047 - DNA, 20 bp, Artificial Sequence
  Synthetic oligonucleotide; TGG chr11 5373053 5373072 5373056 -
tccttcccctattgtgttgg

SEQ ID NO: 32048 - DNA, 20 bp, Artificial Sequence
  Synthetic oligonucleotide; GAG chr11 5373043 5373062 5373046 -
attgtgttggtggccttgtt

SEQ ID NO: 32049 - DNA, 20 bp, Artificial Sequence
  Synthetic oligonucleotide; TGG chr11 5373034 5373053 5373037 -
gtggccttgttgagaattac

SEQ ID NO: 32050 - DNA, 20 bp, Artificial Sequence
  Synthetic oligonucleotide; TGG chr11 5373007 5373026 5373010 -
tatatacgtaaatttatttc

SEQ ID NO: 32051 - DNA, 20 bp, Artificial Sequence
  Synthetic oligonucleotide; GGG chr11 5373006 5373025 5373009 -
atatacgtaaatttatttct

SEQ ID NO: 32052 - DNA, 20 bp, Artificial Sequence
  Synthetic oligonucleotide; TGG chr11 5372984 5373003 5372987 -
gctctttattctgttcaatt

SEQ ID NO: 32053 - DNA, 20 bp, Artificial Sequence
  Synthetic oligonucleotide; TAG chr11 5372960 5372979 5372963 -
ctatgtgtctatttatgtga

SEQ ID NO: 32054 - DNA, 20 bp, Artificial Sequence
  Synthetic oligonucleotide; TGG chr11 5372944 5372963 5372947 -
gtgatagtaccatacttttt

SEQ ID NO: 32055 - DNA, 20 bp, Artificial Sequence
  Synthetic oligonucleotide; TAG chr11 5372935 5372954 5372938 -
ccatacttttttggttacta

SEQ ID NO: 32056 - DNA, 20 bp, Artificial Sequence
  Synthetic oligonucleotide; CAG chr11 5372911 5372930 5372914 -
tttgtaatataatttgaaat

SEQ ID NO: 32057 - DNA, 20 bp, Artificial Sequence
  Synthetic oligonucleotide; AAG chr11 5372892 5372911 5372895 -
tcagaacgtgtgctgccatc

SEQ ID NO: 32058 - DNA, 20 bp, Artificial Sequence
  Synthetic oligonucleotide; TGG chr11 5372888 5372907 5372891 -
aacgtgtgctgccatcaagt

SEQ ID NO: 32059 - DNA, 20 bp, Artificial Sequence
  Synthetic oligonucleotide; AAG chr11 5372873 5372892 5372876 -
caagttggtttttctttctc

SEQ ID NO: 32060 - DNA, 20 bp, Artificial Sequence
  Synthetic oligonucleotide; TGG chr11 5372863 5372882 5372866 -
tttctttctcaagattgttt

SEQ ID NO: 32061 - DNA, 20 bp, Artificial Sequence
  Synthetic oligonucleotide; TGG chr11 5372855 5372874 5372858 -
tcaagattgttttggccatt

SEQ ID NO: 32062 - DNA, 20 bp, Artificial Sequence
  Synthetic oligonucleotide; GGG chr11 5372854 5372873 5372857 -
caagattgttttggccattt

SEQ ID NO: 32063 - DNA, 20 bp, Artificial Sequence
  Synthetic oligonucleotide; GGG chr11 5372853 5372872 5372856 -
aagattgttttggccatttg

SEQ ID NO: 32064 - DNA, 20 bp, Artificial Sequence
  Synthetic oligonucleotide; GGG chr11 5372852 5372871 5372855 -
agattgttttggccatttgg

SEQ ID NO: 32065 - DNA, 20 bp, Artificial Sequence
  Synthetic oligonucleotide; TGG chr11 5372842 5372861 5372845 -
ggccatttgggggtgttctg

SEQ ID NO: 32066 - DNA, 20 bp, Artificial Sequence
  Synthetic oligonucleotide; CAG chr11 5372800 5372819 5372803 -
ttgttttctgtaaaatgtgc

SEQ ID NO: 32067 - DNA, 20 bp, Artificial Sequence
  Synthetic oligonucleotide; GAG chr11 5372798 5372817 5372801 -
gttttctgtaaaatgtgcca

SEQ ID NO: 32068 - DNA, 20 bp, Artificial Sequence
  Synthetic oligonucleotide; CAG chr11 5372793 5372812 5372796 -
ctgtaaaatgtgccagagct

SEQ ID NO: 32069 - DNA, 20 bp, Artificial Sequence
  Synthetic oligonucleotide; AGG chr11 5372792 5372811 5372795 -
tgtaaaatgtgccagagctc

SEQ ID NO: 32070 - DNA, 20 bp, Artificial Sequence
  Synthetic oligonucleotide; AAG chr11 5372783 5372802 5372786 -
tgccagagctcaggtaacaa

SEQ ID NO: 32071 - DNA, 20 bp, Artificial Sequence
  Synthetic oligonucleotide; AAG chr11 5372769 5372788 5372772 -
taacaaaagcaaaaataaac

SEQ ID NO: 32072 - DNA, 20 bp, Artificial Sequence
  Synthetic oligonucleotide; TGG chr11 5372766 5372785 5372769 -
caaaagcaaaaataaacaag

SEQ ID NO: 32073 - DNA, 20 bp, Artificial Sequence
  Synthetic oligonucleotide; GAG chr11 5372764 5372783 5372767 -
aaagcaaaaataaacaagtg

SEQ ID NO: 32074 - DNA, 20 bp, Artificial Sequence
  Synthetic oligonucleotide; CAG chr11 5372735 5372754 5372738 -
caaactaaatattttctgca

SEQ ID NO: 32075 - DNA, 20 bp, Artificial Sequence
  Synthetic oligonucleotide; AAG chr11 5372730 5372749 5372733 -
taaatattttctgcacagca

SEQ ID NO: 32076 - DNA, 20 bp, Artificial Sequence
  Synthetic oligonucleotide; AAG chr11 5372713 5372732 5372716 -
gcaaagaaaacaatcatcaa

SEQ ID NO: 32077 - DNA, 20 bp, Artificial Sequence
  Synthetic oligonucleotide; AGG chr11 5372712 5372731 5372715 -
caaagaaaacaatcatcaaa

SEQ ID NO: 32078 - DNA, 20 bp, Artificial Sequence
  Synthetic oligonucleotide; CAG chr11 5372707 5372726 5372710 -
aaaacaatcatcaaaaggaa

SEQ ID NO: 32079 - DNA, 20 bp, Artificial Sequence
  Synthetic oligonucleotide; TGG chr11 5372702 5372721 5372705 -
aatcatcaaaaggaacagtt

SEQ ID NO: 32080 - DNA, 20 bp, Artificial Sequence
  Synthetic oligonucleotide; GGG chr11 5372701 5372720 5372704 -
atcatcaaaaggaacagttt

SEQ ID NO: 32081 - DNA, 20 bp, Artificial Sequence
  Synthetic oligonucleotide; GAG chr11 5372699 5372718 5372702 -
catcaaaaggaacagtttgg

SEQ ID NO: 32082 - DNA, 20 bp, Artificial Sequence
  Synthetic oligonucleotide; CAG chr11 5372686 5372705 5372689 -
agtttgggagaaaatattta

SEQ ID NO: 32083 - DNA, 20 bp, Artificial Sequence
  Synthetic oligonucleotide; AAG chr11 5372667 5372686 5372670 -
acagatcatatatctgatac

SEQ ID NO: 32084 - DNA, 20 bp, Artificial Sequence
  Synthetic oligonucleotide; AAG chr11 5372645 5372664 5372648 -
gtctaatacccaaaatatat

SEQ ID NO: 32085 - DNA, 20 bp, Artificial Sequence
  Synthetic oligonucleotide; AGG chr11 5372644 5372663 5372647 -
tctaatacccaaaatatata

SEQ ID NO: 32086 - DNA, 20 bp, Artificial Sequence
  Synthetic oligonucleotide; TAG chr11 5372610 5372629 5372613 -
ctaaatatgaaaaaatataa

SEQ ID NO: 32087 - DNA, 20 bp, Artificial Sequence
  Synthetic oligonucleotide; AAG chr11 5372601 5372620 5372604 -
aaaaaatataatagtaacct

SEQ ID NO: 32088 - DNA, 20 bp, Artificial Sequence
  Synthetic oligonucleotide; TGG chr11 5372592 5372611 5372595 -
aatagtaacctaagtaaaaa

SEQ ID NO: 32089 - DNA, 20 bp, Artificial Sequence
  Synthetic oligonucleotide; GGG chr11 5372591 5372610 5372594 -
atagtaacctaagtaaaaat

SEQ ID NO: 32090 - DNA, 20 bp, Artificial Sequence
  Synthetic oligonucleotide; AAG chr11 5372586 5372605 5372589 -
aacctaagtaaaaatgggca

SEQ ID NO: 32091 - DNA, 20 bp, Artificial Sequence
  Synthetic oligonucleotide; AGG chr11 5372585 5372604 5372588 -
acctaagtaaaaatgggcaa

SEQ ID NO: 32092 - DNA, 20 bp, Artificial Sequence
  Synthetic oligonucleotide; AAG chr11 5372561 5372580 5372564 -
tctgaatatacatttctctg

SEQ ID NO: 32093 - DNA, 20 bp, Artificial Sequence
  Synthetic oligonucleotide; TGG chr11 5372549 5372568 5372552 -
tttctctgaagacatgcaaa

SEQ ID NO: 32094 - DNA, 20 bp, Artificial Sequence
  Synthetic oligonucleotide; CAG chr11 5372545 5372564 5372548 -
tctgaagacatgcaaatggt

SEQ ID NO: 32095 - DNA, 20 bp, Artificial Sequence
  Synthetic oligonucleotide; CAG chr11 5372542 5372561 5372545 -
gaagacatgcaaatggtcag

SEQ ID NO: 32096 - DNA, 20 bp, Artificial Sequence
  Synthetic oligonucleotide; AGG chr11 5372541 5372560 5372544 -
aagacatgcaaatggtcagc

SEQ ID NO: 32097 - DNA, 20 bp, Artificial Sequence
  Synthetic oligonucleotide; AAG chr11 5372530 5372549 5372533 -
atggtcagcaggcatatgaa

SEQ ID NO: 32098 - DNA, 20 bp, Artificial Sequence
  Synthetic oligonucleotide; AGG chr11 5372529 5372548 5372532 -
tggtcagcaggcatatgaaa

SEQ ID NO: 32099 - DNA, 20 bp, Artificial Sequence
  Synthetic oligonucleotide; CAG chr11 5372506 5372525 5372509 -
tgcactacatcaccaatcat

SEQ ID NO: 32100 - DNA, 20 bp, Artificial Sequence
  Synthetic oligonucleotide; AGG chr11 5372505 5372524 5372508 -
gcactacatcaccaatcatc

SEQ ID NO: 32101 - DNA, 20 bp, Artificial Sequence
  Synthetic oligonucleotide; AAG chr11 5372482 5372501 5372485 -
aaaatgcaaatcaaaaccac

SEQ ID NO: 32102 - DNA, 20 bp, Artificial Sequence
  Synthetic oligonucleotide; GAG chr11 5372462 5372481 5372465 -
aagtatcactcacacctgtt

SEQ ID NO: 32103 - DNA, 20 bp, Artificial Sequence
  Synthetic oligonucleotide; TGG chr11 5372458 5372477 5372461 -
atcactcacacctgttgaga

SEQ ID NO: 32104 - DNA, 20 bp, Artificial Sequence
  Synthetic oligonucleotide; AAG chr11 5372443 5372462 5372446 -
tgagatggctattatcaaaa

SEQ ID NO: 32105 - DNA, 20 bp, Artificial Sequence
  Synthetic oligonucleotide; AAG chr11 5372438 5372457 5372441 -
tggctattatcaaaaaagac

SEQ ID NO: 32106 - DNA, 20 bp, Artificial Sequence
  Synthetic oligonucleotide; GAG chr11 5372436 5372455 5372439 -
gctattatcaaaaaagacaa

SEQ ID NO: 32107 - DNA, 20 bp, Artificial Sequence
  Synthetic oligonucleotide; TAG chr11 5372432 5372451 5372435 -
ttatcaaaaaagacaagaga

SEQ ID NO: 32108 - DNA, 20 bp, Artificial Sequence
  Synthetic oligonucleotide; AGG chr11 5372431 5372450 5372434 -
tatcaaaaaagacaagagat

SEQ ID NO: 32109 - DNA, 20 bp, Artificial Sequence
  Synthetic oligonucleotide; GGG chr11 5372430 5372449 5372433 -
atcaaaaaagacaagagata

SEQ ID NO: 32110 - DNA, 20 bp, Artificial Sequence
  Synthetic oligonucleotide; GGG chr11 5372429 5372448 5372432 -
tcaaaaaagacaagagatag

SEQ ID NO: 32111 - DNA, 20 bp, Artificial Sequence
  Synthetic oligonucleotide; TGG chr11 5372425 5372444 5372428 -
aaaagacaagagataggggt

SEQ ID NO: 32112 - DNA, 20 bp, Artificial Sequence
  Synthetic oligonucleotide; GAG chr11 5372423 5372442 5372426 -
aagacaagagataggggttg

SEQ ID NO: 32113 - DNA, 20 bp, Artificial Sequence
  Synthetic oligonucleotide; GAG chr11 5372421 5372440 5372424 -
gacaagagataggggttgga

SEQ ID NO: 32114 - DNA, 20 bp, Artificial Sequence
  Synthetic oligonucleotide; AGG chr11 5372420 5372439 5372423 -
acaagagataggggttggag

SEQ ID NO: 32115 - DNA, 20 bp, Artificial Sequence
  Synthetic oligonucleotide; TGG chr11 5372414 5372433 5372417 -
gataggggttggagaggctg

SEQ ID NO: 32116 - DNA, 20 bp, Artificial Sequence
  Synthetic oligonucleotide; GAG chr11 5372412 5372431 5372415 -
taggggttggagaggctgtg

SEQ ID NO: 32117 - DNA, 20 bp, Artificial Sequence
  Synthetic oligonucleotide; AAG chr11 5372408 5372427 5372411 -
ggttggagaggctgtggaga

SEQ ID NO: 32118 - DNA, 20 bp, Artificial Sequence
  Synthetic oligonucleotide; AGG chr11 5372407 5372426 5372410 -
gttggagaggctgtggagaa

SEQ ID NO: 32119 - DNA, 20 bp, Artificial Sequence
  Synthetic oligonucleotide; GAG chr11 5372405 5372424 5372408 -
tggagaggctgtggagaaag

SEQ ID NO: 32120 - DNA, 20 bp, Artificial Sequence
  Synthetic oligonucleotide; TAG chr11 5372390 5372409 5372393 -
gaaaggagaactcttgtgca

SEQ ID NO: 32121 - DNA, 20 bp, Artificial Sequence
  Synthetic oligonucleotide; TGG chr11 5372386 5372405 5372389 -
ggagaactcttgtgcatagc

SEQ ID NO: 32122 - DNA, 20 bp, Artificial Sequence
  Synthetic oligonucleotide; TGG chr11 5372383 5372402 5372386 -
gaactcttgtgcatagctgg

SEQ ID NO: 32123 - DNA, 20 bp, Artificial Sequence
  Synthetic oligonucleotide; GGG chr11 5372382 5372401 5372385 -
aactcttgtgcatagctggt

SEQ ID NO: 32124 - DNA, 20 bp, Artificial Sequence
  Synthetic oligonucleotide; AAG chr11 5372374 5372393 5372377 -
tgcatagctggtgggaatgt

SEQ ID NO: 32125 - DNA, 20 bp, Artificial Sequence
  Synthetic oligonucleotide; TAG chr11 5372365 5372384 5372368 -
ggtgggaatgtaagttaaca

SEQ ID NO: 32126 - DNA, 20 bp, Artificial Sequence
  Synthetic oligonucleotide; TAG chr11 5372356 5372375 5372359 -
gtaagttaacatagccatta

SEQ ID NO: 32127 - DNA, 20 bp, Artificial Sequence
  Synthetic oligonucleotide; TGG chr11 5372345 5372364 5372348 -
tagccattatagaaaacgta

SEQ ID NO: 32128 - DNA, 20 bp, Artificial Sequence
  Synthetic oligonucleotide; AAG chr11 5372342 5372361 5372345 -
ccattatagaaaacgtatgg

SEQ ID NO: 32129 - DNA, 20 bp, Artificial Sequence
  Synthetic oligonucleotide; TAG chr11 5372320 5372339 5372323 -
gtttctcaaacaactaaaaa

SEQ ID NO: 32130 - DNA, 20 bp, Artificial Sequence
  Synthetic oligonucleotide; GAG chr11 5372318 5372337 5372321 -
ttctcaaacaactaaaaata

SEQ ID NO: 32131 - DNA, 20 bp, Artificial Sequence
  Synthetic oligonucleotide; AAG chr11 5372302 5372321 5372305 -
aatagagttattgtatgatg

SEQ ID NO: 32132 - DNA, 20 bp, Artificial Sequence
  Synthetic oligonucleotide; TAG chr11 5372250 5372269 5372253 -
taaataaaatccgcattttc

SEQ ID NO: 32133 - DNA, 20 bp, Artificial Sequence
  Synthetic oligonucleotide; GAG chr11 5372248 5372267 5372251 -
aataaaatccgcattttcta

SEQ ID NO: 32134 - DNA, 20 bp, Artificial Sequence
  Synthetic oligonucleotide; CAG chr11 5372221 5372240 5372224 -
ctgcactctcatgttaattg

SEQ ID NO: 32135 - DNA, 20 bp, Artificial Sequence
  Synthetic oligonucleotide; TAG chr11 5372206 5372225 5372209 -
aattgcagcattattcacaa

SEQ ID NO: 32136 - DNA, 20 bp, Artificial Sequence
  Synthetic oligonucleotide; AAG chr11 5372201 5372220 5372204 -
cagcattattcacaatagcc

SEQ ID NO: 32137 - DNA, 20 bp, Artificial Sequence
  Synthetic oligonucleotide; TGG chr11 5372195 5372214 5372198 -
tattcacaatagccaagaca

SEQ ID NO: 32138 - DNA, 20 bp, Artificial Sequence
  Synthetic oligonucleotide; AAG chr11 5372183 5372202 5372186 -
ccaagacatggaaacaatct

SEQ ID NO: 32139 - DNA, 20 bp, Artificial Sequence
  Synthetic oligonucleotide; TGG chr11 5372180 5372199 5372183 -
agacatggaaacaatctaag

SEQ ID NO: 32140 - DNA, 20 bp, Artificial Sequence
  Synthetic oligonucleotide; TAG chr11 5372167 5372186 5372170 -
atctaagtggtatctatata

SEQ ID NO: 32141 - DNA, 20 bp, Artificial Sequence
  Synthetic oligonucleotide; CAG chr11 5372159 5372178 5372162 -
ggtatctatatatagatgaa

SEQ ID NO: 32142 - DNA, 20 bp, Artificial Sequence
  Synthetic oligonucleotide; AAG chr11 5372153 5372172 5372156 -
tatatatagatgaacagata

SEQ ID NO: 32143 - DNA, 20 bp, Artificial Sequence
  Synthetic oligonucleotide; CAG chr11 5372141 5372160 5372144 -
aacagataaagacattgtga

SEQ ID NO: 32144 - DNA, 20 bp, Artificial Sequence
  Synthetic oligonucleotide; AGG chr11 5372140 5372159 5372143 -
acagataaagacattgtgac

SEQ ID NO: 32145 - DNA, 20 bp, Artificial Sequence
  Synthetic oligonucleotide; CAG chr11 5372081 5372100 5372084 -
tatgatatcacaatattatt

SEQ ID NO: 32146 - DNA, 20 bp, Artificial Sequence
  Synthetic oligonucleotide; AAG chr11 5372070 5372089 5372073 -
aatattattcagccttaaaa

SEQ ID NO: 32147 - DNA, 20 bp, Artificial Sequence
  Synthetic oligonucleotide; AGG chr11 5372069 5372088 5372072 -
atattattcagccttaaaaa

SEQ ID NO: 32148 - DNA, 20 bp, Artificial Sequence
  Synthetic oligonucleotide; GAG chr11 5372067 5372086 5372070 -
attattcagccttaaaaaag

SEQ ID NO: 32149 - DNA, 20 bp, Artificial Sequence
  Synthetic oligonucleotide; TGG chr11 5372063 5372082 5372066 -
ttcagccttaaaaaaggaga

SEQ ID NO: 32150 - DNA, 20 bp, Artificial Sequence
  Synthetic oligonucleotide; GGG chr11 5372062 5372081 5372065 -
tcagccttaaaaaaggagat

SEQ ID NO: 32151 - DNA, 20 bp, Artificial Sequence
  Synthetic oligonucleotide; GGG chr11 5372061 5372080 5372064 -
cagccttaaaaaaggagatg

SEQ ID NO: 32152 - DNA, 20 bp, Artificial Sequence
  Synthetic oligonucleotide; GGG chr11 5372060 5372079 5372063 -
agccttaaaaaaggagatgg

SEQ ID NO: 32153 - DNA, 20 bp, Artificial Sequence
  Synthetic oligonucleotide; GGG chr11 5372059 5372078 5372062 -
gccttaaaaaaggagatggg

SEQ ID NO: 32154 - DNA, 20 bp, Artificial Sequence
  Synthetic oligonucleotide; TAG chr11 5372044 5372063 5372047 -
atggggggaatgtataaacc

SEQ ID NO: 32155 - DNA, 20 bp, Artificial Sequence
  Synthetic oligonucleotide; GAG chr11 5372042 5372061 5372045 -
ggggggaatgtataaaccta

SEQ ID NO: 32156 - DNA, 20 bp, Artificial Sequence
  Synthetic oligonucleotide; AAG chr11 5372028 5372047 5372031 -
aacctagagtacattttgct

SEQ ID NO: 32157 - DNA, 20 bp, Artificial Sequence
  Synthetic oligonucleotide; CAG chr11 5372015 5372034 5372018 -
ttttgctaagtgaaataaac

SEQ ID NO: 32158 - DNA, 20 bp, Artificial Sequence
  Synthetic oligonucleotide; CAG chr11 5372009 5372028 5372012 -
taagtgaaataaaccagaca

SEQ ID NO: 32159 - DNA, 20 bp, Artificial Sequence
  Synthetic oligonucleotide; AAG chr11 5371997 5372016 5372000 -
accagacacagaaacaaata

SEQ ID NO: 32160 - DNA, 20 bp, Artificial Sequence
  Synthetic oligonucleotide; AGG chr11 5371996 5372015 5371999 -
ccagacacagaaacaaataa

SEQ ID NO: 32161 - DNA, 20 bp, Artificial Sequence
  Synthetic oligonucleotide; TGG chr11 5371975 5371994 5371978 -
ggcatgatattacttatatg

SEQ ID NO: 32162 - DNA, 20 bp, Artificial Sequence
  Synthetic oligonucleotide; AAG chr11 5371964 5371983 5371967 -
acttatatgtggaatctcaa

SEQ ID NO: 32163 - DNA, 20 bp, Artificial Sequence
  Synthetic oligonucleotide; AAG chr11 5371955 5371974 5371958 -
tggaatctcaaaagaaaaat

SEQ ID NO: 32164 - DNA, 20 bp, Artificial Sequence
  Synthetic oligonucleotide; AGG chr11 5371954 5371973 5371957 -
ggaatctcaaaagaaaaata

SEQ ID NO: 32165 - DNA, 20 bp, Artificial Sequence
  Synthetic oligonucleotide; TAG chr11 5371942 5371961 5371945 -
gaaaaataaggtcaaatgca

SEQ ID NO: 32166 - DNA, 20 bp, Artificial Sequence
  Synthetic oligonucleotide; CAG chr11 5371936 5371955 5371939 -
taaggtcaaatgcatagaaa

SEQ ID NO: 32167 - DNA, 20 bp, Artificial Sequence
  Synthetic oligonucleotide; AAG chr11 5371927 5371946 5371930 -
atgcatagaaacagtgtaaa

SEQ ID NO: 32168 - DNA, 20 bp, Artificial Sequence
  Synthetic oligonucleotide; AGG chr11 5371926 5371945 5371929 -
tgcatagaaacagtgtaaaa

SEQ ID NO: 32169 - DNA, 20 bp, Artificial Sequence
  Synthetic oligonucleotide; GGG chr11 5371925 5371944 5371928 -
gcatagaaacagtgtaaaaa

SEQ ID NO: 32170 - DNA, 20 bp, Artificial Sequence
  Synthetic oligonucleotide; GGG chr11 5371924 5371943 5371927 -
catagaaacagtgtaaaaag

SEQ ID NO: 32171 - DNA, 20 bp, Artificial Sequence
  Synthetic oligonucleotide; AAG chr11 5371921 5371940 5371924 -
agaaacagtgtaaaaagggg

SEQ ID NO: 32172 - DNA, 20 bp, Artificial Sequence
  Synthetic oligonucleotide; AAG chr11 5371917 5371936 5371920 -
acagtgtaaaaaggggaaga

SEQ ID NO: 32173 - DNA, 20 bp, Artificial Sequence
  Synthetic oligonucleotide; AAG chr11 5371913 5371932 5371916 -
tgtaaaaaggggaagaaaga

SEQ ID NO: 32174 - DNA, 20 bp, Artificial Sequence
  Synthetic oligonucleotide; GAG chr11 5371911 5371930 5371914 -
taaaaaggggaagaaagaaa

SEQ ID NO: 32175 - DNA, 20 bp, Artificial Sequence
  Synthetic oligonucleotide; TAG chr11 5371904 5371923 5371907 -
gggaagaaagaaagagaaaa

SEQ ID NO: 32176 - DNA, 20 bp, Artificial Sequence
  Synthetic oligonucleotide; AGG chr11 5371903 5371922 5371906 -
ggaagaaagaaagagaaaat

SEQ ID NO: 32177 - DNA, 20 bp, Artificial Sequence
  Synthetic oligonucleotide; GGG chr11 5371902 5371921 5371905 -
gaagaaagaaagagaaaata

SEQ ID NO: 32178 - DNA, 20 bp, Artificial Sequence
  Synthetic oligonucleotide; GAG chr11 5371900 5371919 5371903 -
agaaagaaagagaaaatagg

SEQ ID NO: 32179 - DNA, 20 bp, Artificial Sequence
  Synthetic oligonucleotide; AAG chr11 5371897 5371916 5371900 -
aagaaagagaaaatagggag

SEQ ID NO: 32180 - DNA, 20 bp, Artificial Sequence
  Synthetic oligonucleotide; TAG chr11 5371894 5371913 5371897 -
aaagagaaaatagggagaag

SEQ ID NO: 32181 - DNA, 20 bp, Artificial Sequence
  Synthetic oligonucleotide; AGG chr11 5371893 5371912 5371896 -
aagagaaaatagggagaagt

SEQ ID NO: 32182 - DNA, 20 bp, Artificial Sequence
  Synthetic oligonucleotide; AAG chr11 5371887 5371906 5371890 -
aaatagggagaagtaggtca

SEQ ID NO: 32183 - DNA, 20 bp, Artificial Sequence
  Synthetic oligonucleotide; AGG chr11 5371886 5371905 5371889 -
aatagggagaagtaggtcaa

SEQ ID NO: 32184 - DNA, 20 bp, Artificial Sequence
  Synthetic oligonucleotide; CAG chr11 5371872 5371891 5371875 -
ggtcaaaggttataaacttg

SEQ ID NO: 32185 - DNA, 20 bp, Artificial Sequence
  Synthetic oligonucleotide; TAG chr11 5371864 5371883 5371867 -
gttataaacttgcagctgta

SEQ ID NO: 32186 - DNA, 20 bp, Artificial Sequence
  Synthetic oligonucleotide; AGG chr11 5371863 5371882 5371866 -
ttataaacttgcagctgtat

SEQ ID NO: 32187 - DNA, 20 bp, Artificial Sequence
  Synthetic oligonucleotide; AAG chr11 5371854 5371873 5371857 -
tgcagctgtataggataaat

SEQ ID NO: 32188 - DNA, 20 bp, Artificial Sequence
  Synthetic oligonucleotide; TAG chr11 5371849 5371868 5371852 -
ctgtataggataaataagtt

SEQ ID NO: 32189 - DNA, 20 bp, Artificial Sequence
  Synthetic oligonucleotide; GAG chr11 5371847 5371866 5371850 -
gtataggataaataagttta

SEQ ID NO: 32190 - DNA, 20 bp, Artificial Sequence
  Synthetic oligonucleotide; TAG chr11 5371841 5371860 5371844 -
gataaataagtttagagatc

SEQ ID NO: 32191 - DNA, 20 bp, Artificial Sequence
  Synthetic oligonucleotide; TGG chr11 5371834 5371853 5371837 -
aagtttagagatctagtgta

SEQ ID NO: 32192 - DNA, 20 bp, Artificial Sequence
  Synthetic oligonucleotide; AAG chr11 5371827 5371846 5371830 -
gagatctagtgtatggcatg

SEQ ID NO: 32193 - DNA, 20 bp, Artificial Sequence
  Synthetic oligonucleotide; CAG chr11 5371787 5371806 5371790 -
aaactaaacatttgttatga

SEQ ID NO: 32194 - DNA, 20 bp, Artificial Sequence
  Synthetic oligonucleotide; TAG chr11 5371784 5371803 5371787 -
ctaaacatttgttatgacag

SEQ ID NO: 32195 - DNA, 20 bp, Artificial Sequence
  Synthetic oligonucleotide; TAG chr11 5371777 5371796 5371780 -
tttgttatgacagtagatgt

SEQ ID NO: 32196 - DNA, 20 bp, Artificial Sequence
  Synthetic oligonucleotide; AAG chr11 5371761 5371780 5371764 -
atgttagatgcccttacaca

SEQ ID NO: 32197 - DNA, 20 bp, Artificial Sequence
  Synthetic oligonucleotide; AAG chr11 5371755 5371774 5371758 -
gatgcccttacacaaagaaa

SEQ ID NO: 32198 - DNA, 20 bp, Artificial Sequence
  Synthetic oligonucleotide; AAG chr11 5371749 5371768 5371752 -
cttacacaaagaaaaagcaa

SEQ ID NO: 32199 - DNA, 20 bp, Artificial Sequence
  Synthetic oligonucleotide; AGG chr11 5371748 5371767 5371751 -
ttacacaaagaaaaagcaaa

SEQ ID NO: 32200 - DNA, 20 bp, Artificial Sequence
  Synthetic oligonucleotide; TGG chr11 5371739 5371758 5371742 -
gaaaaagcaaaaggtatcta

SEQ ID NO: 32201 - DNA, 20 bp, Artificial Sequence
  Synthetic oligonucleotide; AAG chr11 5371736 5371755 5371739 -
aaagcaaaaggtatctatgg

SEQ ID NO: 32202 - DNA, 20 bp, Artificial Sequence
  Synthetic oligonucleotide; AGG chr11 5371735 5371754 5371738 -
aagcaaaaggtatctatgga

SEQ ID NO: 32203 - DNA, 20 bp, Artificial Sequence
  Synthetic oligonucleotide; TGG chr11 5371721 5371740 5371724 -
tatggaaggtgttgtattga

SEQ ID NO: 32204 - DNA, 20 bp, Artificial Sequence
  Synthetic oligonucleotide; TAG chr11 5371717 5371736 5371720 -
gaaggtgttgtattgatgga

SEQ ID NO: 32205 - DNA, 20 bp, Artificial Sequence
  Synthetic oligonucleotide; AGG chr11 5371716 5371735 5371719 -
aaggtgttgtattgatggat

SEQ ID NO: 32206 - DNA, 20 bp, Artificial Sequence
  Synthetic oligonucleotide; AAG chr11 5371697 5371716 5371700 -
taggttaatttgcttgattg

SEQ ID NO: 32207 - DNA, 20 bp, Artificial Sequence
  Synthetic oligonucleotide; AAG chr11 5371651 5371670 5371654 -
atatcctatattttttgaac

SEQ ID NO: 32208 - DNA, 20 bp, Artificial Sequence
  Synthetic oligonucleotide; CAG chr11 5371637 5371656 5371640 -
ttgaacaagcttacttgttt

SEQ ID NO: 32209 - DNA, 20 bp, Artificial Sequence
  Synthetic oligonucleotide; AAG chr11 5371620 5371639 5371623 -
tttcagataaaatattttaa

SEQ ID NO: 32210 - DNA, 20 bp, Artificial Sequence
  Synthetic oligonucleotide; AAG chr11 5371607 5371626 5371610 -
attttaaaagcttttatctg

SEQ ID NO: 32211 - DNA, 20 bp, Artificial Sequence
  Synthetic oligonucleotide; AAG chr11 5371603 5371622 5371606 -
taaaagcttttatctgaagc

SEQ ID NO: 32212 - DNA, 20 bp, Artificial Sequence
  Synthetic oligonucleotide; TAG chr11 5371576 5371595 5371579 -
atttctgtttcctaattgtt

SEQ ID NO: 32213 - DNA, 20 bp, Artificial Sequence
  Synthetic oligonucleotide; AGG chr11 5371575 5371594 5371578 -
tttctgtttcctaattgttt

SEQ ID NO: 32214 - DNA, 20 bp, Artificial Sequence
  Synthetic oligonucleotide; GGG chr11 5371574 5371593 5371577 -
ttctgtttcctaattgttta

SEQ ID NO: 32215 - DNA, 20 bp, Artificial Sequence
  Synthetic oligonucleotide; TGG chr11 5371530 5371549 5371533 -
ttaaaacttatgtaaccctt

SEQ ID NO: 32216 - DNA, 20 bp, Artificial Sequence
  Synthetic oligonucleotide; GAG chr11 5371520 5371539 5371523 -
tgtaaccctttggatataat

SEQ ID NO: 32217 - DNA, 20 bp, Artificial Sequence
  Synthetic oligonucleotide; CAG chr11 5371490 5371509 5371493 -
tttttctctatttttaatat

SEQ ID NO: 32218 - DNA, 20 bp, Artificial Sequence
  Synthetic oligonucleotide; TAG chr11 5371480 5371499 5371483 -
tttttaatatcagtactctt

SEQ ID NO: 32219 - DNA, 20 bp, Artificial Sequence
  Synthetic oligonucleotide; CAG chr11 5371474 5371493 5371477 -
atatcagtactctttagata

SEQ ID NO: 32220 - DNA, 20 bp, Artificial Sequence
  Synthetic oligonucleotide; CAG chr11 5371457 5371476 5371460 -
atacagctatcactgtctct

SEQ ID NO: 32221 - DNA, 20 bp, Artificial Sequence
  Synthetic oligonucleotide; AGG chr11 5371456 5371475 5371459 -
tacagctatcactgtctctc

SEQ ID NO: 32222 - DNA, 20 bp, Artificial Sequence
  Synthetic oligonucleotide; GGG chr11 5371455 5371474 5371458 -
acagctatcactgtctctca

SEQ ID NO: 32223 - DNA, 20 bp, Artificial Sequence
  Synthetic oligonucleotide; TGG chr11 5371440 5371459 5371443 -
tctcagggtacctctgcctc

SEQ ID NO: 32224 - DNA, 20 bp, Artificial Sequence
  Synthetic oligonucleotide; CGG chr11 5371399 5371418 5371402 -
atgttgaaattttatatctc

SEQ ID NO: 32225 - DNA, 20 bp, Artificial Sequence
  Synthetic oligonucleotide; CAG chr11 5371387 5371406 5371390 -
tatatctccggcctacaact

SEQ ID NO: 32226 - DNA, 20 bp, Artificial Sequence
  Synthetic oligonucleotide; AGG chr11 5371386 5371405 5371389 -
atatctccggcctacaactc

SEQ ID NO: 32227 - DNA, 20 bp, Artificial Sequence
  Synthetic oligonucleotide; GGG chr11 5371385 5371404 5371388 -
tatctccggcctacaactca

SEQ ID NO: 32228 - DNA, 20 bp, Artificial Sequence
  Synthetic oligonucleotide; CAG chr11 5371377 5371396 5371380 -
gcctacaactcagggtttta

SEQ ID NO: 32229 - DNA, 20 bp, Artificial Sequence
  Synthetic oligonucleotide; GAG chr11 5371345 5371364 5371348 -
tgtctctattaaatgtttat

SEQ ID NO: 32230 - DNA, 20 bp, Artificial Sequence
  Synthetic oligonucleotide; CAG chr11 5371339 5371358 5371342 -
tattaaatgtttatgagcca

SEQ ID NO: 32231 - DNA, 20 bp, Artificial Sequence
  Synthetic oligonucleotide; GAG chr11 5371337 5371356 5371340 -
ttaaatgtttatgagccaca

SEQ ID NO: 32232 - DNA, 20 bp, Artificial Sequence
  Synthetic oligonucleotide; GAG chr11 5371331 5371350 5371334 -
gtttatgagccacagagaat

SEQ ID NO: 32233 - DNA, 20 bp, Artificial Sequence
  Synthetic oligonucleotide; GAG chr11 5371293 5371312 5371296 -
ttttttgaacttctgtgttt

SEQ ID NO: 32234 - DNA, 20 bp, Artificial Sequence
  Synthetic oligonucleotide; AAG chr11 5371265 5371284 5371268 -
aaaaaattaacctaatgtga

SEQ ID NO: 32235 - DNA, 20 bp, Artificial Sequence
  Synthetic oligonucleotide; TAG chr11 5371258 5371277 5371261 -
taacctaatgtgaaagaccc

SEQ ID NO: 32236 - DNA, 20 bp, Artificial Sequence
  Synthetic oligonucleotide; CGG chr11 5371252 5371271 5371255 -
aatgtgaaagaccctagatc

SEQ ID NO: 32237 - DNA, 20 bp, Artificial Sequence
  Synthetic oligonucleotide; GGG chr11 5371251 5371270 5371254 -
atgtgaaagaccctagatcc

SEQ ID NO: 32238 - DNA, 20 bp, Artificial Sequence
  Synthetic oligonucleotide; GGG chr11 5371250 5371269 5371253 -
tgtgaaagaccctagatccg

SEQ ID NO: 32239 - DNA, 20 bp, Artificial Sequence
  Synthetic oligonucleotide; AAG chr11 5371246 5371265 5371249 -
aaagaccctagatccgggga

SEQ ID NO: 32240 - DNA, 20 bp, Artificial Sequence
  Synthetic oligonucleotide; AGG chr11 5371245 5371264 5371248 -
aagaccctagatccggggaa

SEQ ID NO: 32241 - DNA, 20 bp, Artificial Sequence
  Synthetic oligonucleotide; TGG chr11 5371235 5371254 5371238 -
atccggggaaaggtgctgtg

SEQ ID NO: 32242 - DNA, 20 bp, Artificial Sequence
  Synthetic oligonucleotide; TAG chr11 5371230 5371249 5371233 -
gggaaaggtgctgtgtggct

SEQ ID NO: 32243 - DNA, 20 bp, Artificial Sequence
  Synthetic oligonucleotide; GAG chr11 5371228 5371247 5371231 -
gaaaggtgctgtgtggctta

SEQ ID NO: 32244 - DNA, 20 bp, Artificial Sequence
  Synthetic oligonucleotide; CAG chr11 5371216 5371235 5371219 -
gtggcttagagtataaacat

SEQ ID NO: 32245 - DNA, 20 bp, Artificial Sequence
  Synthetic oligonucleotide; TGG chr11 5371204 5371223 5371207 -
ataaacatcagaatgtgcta

SEQ ID NO: 32246 - DNA, 20 bp, Artificial Sequence
  Synthetic oligonucleotide; TAG chr11 5371195 5371214 5371198 -
agaatgtgctatggactttc

SEQ ID NO: 32247 - DNA, 20 bp, Artificial Sequence
  Synthetic oligonucleotide; CAG chr11 5371185 5371204 5371188 -
atggactttctagaatattt

SEQ ID NO: 32248 - DNA, 20 bp, Artificial Sequence
  Synthetic oligonucleotide; CAG chr11 5371166 5371185 5371169 -
tcagtgcccttgtatatcct

SEQ ID NO: 32249 - DNA, 20 bp, Artificial Sequence
  Synthetic oligonucleotide; TGG chr11 5371157 5371176 5371160 -
ttgtatatcctcagaatgtg

SEQ ID NO: 32250 - DNA, 20 bp, Artificial Sequence
  Synthetic oligonucleotide; GAG chr11 5371155 5371174 5371158 -
gtatatcctcagaatgtgtg

SEQ ID NO: 32251 - DNA, 20 bp, Artificial Sequence
  Synthetic oligonucleotide; GAG chr11 5371153 5371172 5371156 -
atatcctcagaatgtgtgga

SEQ ID NO: 32252 - DNA, 20 bp, Artificial Sequence
  Synthetic oligonucleotide; AAG chr11 5371137 5371156 5371140 -
tggagagtaattccaaaaca

SEQ ID NO: 32253 - DNA, 20 bp, Artificial Sequence
  Synthetic oligonucleotide; TGG chr11 5371116 5371135 5371119 -
agcccttacttcaatatcca

SEQ ID NO: 32254 - DNA, 20 bp, Artificial Sequence
  Synthetic oligonucleotide; TGG chr11 5371113 5371132 5371116 -
ccttacttcaatatccatgg

SEQ ID NO: 32255 - DNA, 20 bp, Artificial Sequence
  Synthetic oligonucleotide; TAG chr11 5371106 5371125 5371109 -
tcaatatccatggtggtcca

SEQ ID NO: 32256 - DNA, 20 bp, Artificial Sequence
  Synthetic oligonucleotide; TAG chr11 5371102 5371121 5371105 -
tatccatggtggtccatagc

SEQ ID NO: 32257 - DNA, 20 bp, Artificial Sequence
  Synthetic oligonucleotide; AGG chr11 5371101 5371120 5371104 -
atccatggtggtccatagct

SEQ ID NO: 32258 - DNA, 20 bp, Artificial Sequence
  Synthetic oligonucleotide; GGG chr11 5371100 5371119 5371103 -
tccatggtggtccatagcta

SEQ ID NO: 32259 - DNA, 20 bp, Artificial Sequence
  Synthetic oligonucleotide; TAG chr11 5371096 5371115 5371099 -
tggtggtccatagctagggc

SEQ ID NO: 32260 - DNA, 20 bp, Artificial Sequence
  Synthetic oligonucleotide; CAG chr11 5371093 5371112 5371096 -
tggtccatagctagggctag

SEQ ID NO: 32261 - DNA, 20 bp, Artificial Sequence
  Synthetic oligonucleotide; AAG chr11 5371090 5371109 5371093 -
tccatagctagggctagcag

SEQ ID NO: 32262 - DNA, 20 bp, Artificial Sequence
  Synthetic oligonucleotide; AGG chr11 5371089 5371108 5371092 -
ccatagctagggctagcaga

SEQ ID NO: 32263 - DNA, 20 bp, Artificial Sequence
  Synthetic oligonucleotide; AAG chr11 5371086 5371105 5371089 -
tagctagggctagcagaagg

SEQ ID NO: 32264 - DNA, 20 bp, Artificial Sequence
  Synthetic oligonucleotide; AGG chr11 5371085 5371104 5371088 -
agctagggctagcagaagga

SEQ ID NO: 32265 - DNA, 20 bp, Artificial Sequence
  Synthetic oligonucleotide; GGG chr11 5371084 5371103 5371087 -
gctagggctagcagaaggaa

SEQ ID NO: 32266 - DNA, 20 bp, Artificial Sequence
  Synthetic oligonucleotide; TGG chr11 5371042 5371061 5371045 -
tcactcaaattatctgctct

SEQ ID NO: 32267 - DNA, 20 bp, Artificial Sequence
  Synthetic oligonucleotide; CAG chr11 5371033 5371052 5371036 -
ttatctgctcttggaaaaac

SEQ ID NO: 32268 - DNA, 20 bp, Artificial Sequence
  Synthetic oligonucleotide; TGG chr11 5371024 5371043 5371027 -
cttggaaaaaccagtccctt

SEQ ID NO: 32269 - DNA, 20 bp, Artificial Sequence
  Synthetic oligonucleotide; GGG chr11 5371023 5371042 5371026 -
ttggaaaaaccagtcccttt

SEQ ID NO: 32270 - DNA, 20 bp, Artificial Sequence
  Synthetic oligonucleotide; TAG chr11 5371020 5371039 5371023 -
gaaaaaccagtccctttggg

SEQ ID NO: 32271 - DNA, 20 bp, Artificial Sequence
  Synthetic oligonucleotide; AAG chr11 5371003 5371022 5371006 -
gggtagccccaatcatgtgt

SEQ ID NO: 32272 - DNA, 20 bp, Artificial Sequence
  Synthetic oligonucleotide; AAG chr11 5370989 5371008 5370992 -
atgtgtaagtctttttcctg

SEQ ID NO: 32273 - DNA, 20 bp, Artificial Sequence
  Synthetic oligonucleotide; TGG chr11 5370976 5370995 5370979 -
tttcctgaagtatgatcata

SEQ ID NO: 32274 - DNA, 20 bp, Artificial Sequence
  Synthetic oligonucleotide; CAG chr11 5370945 5370964 5370948 -
cttctgtctgctcattgaac

SEQ ID NO: 32275 - DNA, 20 bp, Artificial Sequence
  Synthetic oligonucleotide; GAG chr11 5370943 5370962 5370946 -
tctgtctgctcattgaacca

SEQ ID NO: 32276 - DNA, 20 bp, Artificial Sequence
  Synthetic oligonucleotide; CAG chr11 5370937 5370956 5370940 -
tgctcattgaaccagagctc

SEQ ID NO: 32277 - DNA, 20 bp, Artificial Sequence
  Synthetic oligonucleotide; AGG chr11 5370936 5370955 5370939 -
gctcattgaaccagagctcc

SEQ ID NO: 32278 - DNA, 20 bp, Artificial Sequence
  Synthetic oligonucleotide; TGG chr11 5370920 5370939 5370923 -
ctccaggaccaataccacta

SEQ ID NO: 32279 - DNA, 20 bp, Artificial Sequence
  Synthetic oligonucleotide; CAG chr11 5370890 5370909 5370893 -
tcttttgcctctacaactct

SEQ ID NO: 32280 - DNA, 20 bp, Artificial Sequence
  Synthetic oligonucleotide; AGG chr11 5370889 5370908 5370892 -
cttttgcctctacaactctc

SEQ ID NO: 32281 - DNA, 20 bp, Artificial Sequence
  Synthetic oligonucleotide; CAG chr11 5370883 5370902 5370886 -
cctctacaactctcaggtca

SEQ ID NO: 32282 - DNA, 20 bp, Artificial Sequence
  Synthetic oligonucleotide; CAG chr11 5370861 5370880 5370864 -
gctgaaatattacctcctct

SEQ ID NO: 32283 - DNA, 20 bp, Artificial Sequence
  Synthetic oligonucleotide; TAG chr11 5370840 5370859 5370843 -
agaacccgcatttgtcacac

SEQ ID NO: 32284 - DNA, 20 bp, Artificial Sequence
  Synthetic oligonucleotide; TAG chr11 5370786 5370805 5370789 -
caaattttttctttctttca

SEQ ID NO: 32285 - DNA, 20 bp, Artificial Sequence
  Synthetic oligonucleotide; CAG chr11 5370783 5370802 5370786 -
attttttctttctttcatag

SEQ ID NO: 32286 - DNA, 20 bp, Artificial Sequence
  Synthetic oligonucleotide; GAG chr11 5370774 5370793 5370777 -
ttctttcatagcagctatat

SEQ ID NO: 32287 - DNA, 20 bp, Artificial Sequence
  Synthetic oligonucleotide; AGG chr11 5370773 5370792 5370776 -
tctttcatagcagctatatg

SEQ ID NO: 32288 - DNA, 20 bp, Artificial Sequence
  Synthetic oligonucleotide; AAG chr11 5370721 5370740 5370724 -
tttcctttccgttaaaatac

SEQ ID NO: 32289 - DNA, 20 bp, Artificial Sequence
  Synthetic oligonucleotide; TAG chr11 5370713 5370732 5370716 -
ccgttaaaatacaagcttca

SEQ ID NO: 32290 - DNA, 20 bp, Artificial Sequence
  Synthetic oligonucleotide; AGG chr11 5370712 5370731 5370715 -
cgttaaaatacaagcttcat

SEQ ID NO: 32291 - DNA, 20 bp, Artificial Sequence
  Synthetic oligonucleotide; CAG chr11 5370707 5370726 5370710 -
aaatacaagcttcataggaa

SEQ ID NO: 32292 - DNA, 20 bp, Artificial Sequence
  Synthetic oligonucleotide; GAG chr11 5370705 5370724 5370708 -
atacaagcttcataggaaca

SEQ ID NO: 32293 - DNA, 20 bp, Artificial Sequence
  Synthetic oligonucleotide; CAG chr11 5370674 5370693 5370677 -
caccaatgtatttttgtacc

SEQ ID NO: 32294 - DNA, 20 bp, Artificial Sequence
  Synthetic oligonucleotide; TAG chr11 5370671 5370690 5370674 -
caatgtatttttgtacccag

SEQ ID NO: 32295 - DNA, 20 bp, Artificial Sequence
  Synthetic oligonucleotide; TAG chr11 5370659 5370678 5370662 -
gtacccagtagttgctaaaa

SEQ ID NO: 32296 - DNA, 20 bp, Artificial Sequence
  Synthetic oligonucleotide; GAG chr11 5370657 5370676 5370660 -
acccagtagttgctaaaata

SEQ ID NO: 32297 - DNA, 20 bp, Artificial Sequence
  Synthetic oligonucleotide; AAG chr11 5370654 5370673 5370657 -
cagtagttgctaaaatagag

SEQ ID NO: 32298 - DNA, 20 bp, Artificial Sequence
  Synthetic oligonucleotide; TAG chr11 5370643 5370662 5370646 -
aaaatagagaagcctctcat

SEQ ID NO: 32299 - DNA, 20 bp, Artificial Sequence
  Synthetic oligonucleotide; TAG chr11 5370595 5370614 5370598 -
gcttgttaaataaatgtatt

SEQ ID NO: 32300 - DNA, 20 bp, Artificial Sequence
  Synthetic oligonucleotide; CAG chr11 5370567 5370586 5370570 -
ctattattcatttctaaaca

SEQ ID NO: 32301 - DNA, 20 bp, Artificial Sequence
  Synthetic oligonucleotide; AAG chr11 5370563 5370582 5370566 -
tattcatttctaaacacaga

SEQ ID NO: 32302 - DNA, 20 bp, Artificial Sequence
  Synthetic oligonucleotide; GAG chr11 5370561 5370580 5370564 -
ttcatttctaaacacagaaa

SEQ ID NO: 32303 - DNA, 20 bp, Artificial Sequence
  Synthetic oligonucleotide; GAG chr11 5370557 5370576 5370560 -
tttctaaacacagaaagagt

SEQ ID NO: 32304 - DNA, 20 bp, Artificial Sequence
  Synthetic oligonucleotide; AAG chr11 5370553 5370572 5370556 -
taaacacagaaagagtgaga

SEQ ID NO: 32305 - DNA, 20 bp, Artificial Sequence
  Synthetic oligonucleotide; AGG chr11 5370552 5370571 5370555 -
aaacacagaaagagtgagaa

SEQ ID NO: 32306 - DNA, 20 bp, Artificial Sequence
  Synthetic oligonucleotide; GGG chr11 5370551 5370570 5370554 -
aacacagaaagagtgagaaa

SEQ ID NO: 32307 - DNA, 20 bp, Artificial Sequence
  Synthetic oligonucleotide; GAG chr11 5370549 5370568 5370552 -
cacagaaagagtgagaaagg

SEQ ID NO: 32308 - DNA, 20 bp, Artificial Sequence
  Synthetic oligonucleotide; AAG chr11 5370545 5370564 5370548 -
gaaagagtgagaaagggaga

SEQ ID NO: 32309 - DNA, 20 bp, Artificial Sequence
  Synthetic oligonucleotide; CAG chr11 5370541 5370560 5370544 -
gagtgagaaagggagaaaga

SEQ ID NO: 32310 - DNA, 20 bp, Artificial Sequence
  Synthetic oligonucleotide; AAG chr11 5370537 5370556 5370540 -
gagaaagggagaaagacaga

SEQ ID NO: 32311 - DNA, 20 bp, Artificial Sequence
  Synthetic oligonucleotide; AAG chr11 5370533 5370552 5370536 -
aagggagaaagacagaaagt

SEQ ID NO: 32312 - DNA, 20 bp, Artificial Sequence
  Synthetic oligonucleotide; AAG chr11 5370525 5370544 5370528 -
aagacagaaagtaagaatga

SEQ ID NO: 32313 - DNA, 20 bp, Artificial Sequence
  Synthetic oligonucleotide; AAG chr11 5370521 5370540 5370524 -
cagaaagtaagaatgaaaga

SEQ ID NO: 32314 - DNA, 20 bp, Artificial Sequence
  Synthetic oligonucleotide; GAG chr11 5370519 5370538 5370522 -
gaaagtaagaatgaaagaaa

SEQ ID NO: 32315 - DNA, 20 bp, Artificial Sequence
  Synthetic oligonucleotide; GAG chr11 5370517 5370536 5370520 -
aagtaagaatgaaagaaaga

SEQ ID NO: 32316 - DNA, 20 bp, Artificial Sequence
  Synthetic oligonucleotide; GAG chr11 5370513 5370532 5370516 -
aagaatgaaagaaagagagt

SEQ ID NO: 32317 - DNA, 20 bp, Artificial Sequence
  Synthetic oligonucleotide; AAG chr11 5370507 5370526 5370510 -
gaaagaaagagagtgagata

SEQ ID NO: 32318 - DNA, 20 bp, Artificial Sequence
  Synthetic oligonucleotide; TAG chr11 5370502 5370521 5370505 -
aaagagagtgagataaagaa

SEQ ID NO: 32319 - DNA, 20 bp, Artificial Sequence
  Synthetic oligonucleotide; TGG chr11 5370491 5370510 5370494 -
gataaagaatagatattttc

SEQ ID NO: 32320 - DNA, 20 bp, Artificial Sequence
  Synthetic oligonucleotide; TGG chr11 5370466 5370485 5370469 -
ttaaattattgccctcaaat

SEQ ID NO: 32321 - DNA, 20 bp, Artificial Sequence
  Synthetic oligonucleotide; CAG chr11 5370462 5370481 5370465 -
attattgccctcaaattgga

SEQ ID NO: 32322 - DNA, 20 bp, Artificial Sequence
  Synthetic oligonucleotide; GAG chr11 5370460 5370479 5370463 -
tattgccctcaaattggaca

SEQ ID NO: 32323 - DNA, 20 bp, Artificial Sequence
  Synthetic oligonucleotide; AAG chr11 5370434 5370453 5370437 -
taccaacaaatgatcctctg

SEQ ID NO: 32324 - DNA, 20 bp, Artificial Sequence
  Synthetic oligonucleotide; CAG chr11 5370387 5370406 5370390 -
attgctctgacctgacaacc

SEQ ID NO: 32325 - DNA, 20 bp, Artificial Sequence
  Synthetic oligonucleotide; TAG chr11 5370378 5370397 5370381 -
acctgacaacccagctattt

SEQ ID NO: 32326 - DNA, 20 bp, Artificial Sequence
  Synthetic oligonucleotide; TAG chr11 5370373 5370392 5370376 -
acaacccagctattttagtt

SEQ ID NO: 32327 - DNA, 20 bp, Artificial Sequence
  Synthetic oligonucleotide; CAG chr11 5370364 5370383 5370367 -
ctattttagtttagtctttg

SEQ ID NO: 32328 - DNA, 20 bp, Artificial Sequence
  Synthetic oligonucleotide; TAG chr11 5370327 5370346 5370330 -
atgcctatctcactttgctg

SEQ ID NO: 32329 - DNA, 20 bp, Artificial Sequence
  Synthetic oligonucleotide; TGG chr11 5370312 5370331 5370315 -
tgctgtagcatttccaatcc

SEQ ID NO: 32330 - DNA, 20 bp, Artificial Sequence
  Synthetic oligonucleotide; CAG chr11 5370308 5370327 5370311 -
gtagcatttccaatcctgga

SEQ ID NO: 32331 - DNA, 20 bp, Artificial Sequence
  Synthetic oligonucleotide; CAG chr11 5370304 5370323 5370307 -
catttccaatcctggacagt

SEQ ID NO: 32332 - DNA, 20 bp, Artificial Sequence
  Synthetic oligonucleotide; AAG chr11 5370296 5370315 5370299 -
atcctggacagtcagcataa

SEQ ID NO: 32333 - DNA, 20 bp, Artificial Sequence
  Synthetic oligonucleotide; TAG chr11 5370265 5370284 5370268 -
gtcacttatttaatatttca

SEQ ID NO: 32334 - DNA, 20 bp, Artificial Sequence
  Synthetic oligonucleotide; TAG chr11 5370237 5370256 5370240 -
aacattcaaaccttcaactt

SEQ ID NO: 32335 - DNA, 20 bp, Artificial Sequence
  Synthetic oligonucleotide; AGG chr11 5370236 5370255 5370239 -
acattcaaaccttcaacttt

SEQ ID NO: 32336 - DNA, 20 bp, Artificial Sequence
  Synthetic oligonucleotide; AAG chr11 5370222 5370241 5370225 -
aactttaggatttactataa

SEQ ID NO: 32337 - DNA, 20 bp, Artificial Sequence
  Synthetic oligonucleotide; GAG chr11 5370177 5370196 5370180 -
ataaatacattgatgattat

SEQ ID NO: 32338 - DNA, 20 bp, Artificial Sequence
  Synthetic oligonucleotide; TGG chr11 5370153 5370172 5370156 -
attatttttaaattacaact

SEQ ID NO: 32339 - DNA, 20 bp, Artificial Sequence
  Synthetic oligonucleotide; TAG chr11 5370150 5370169 5370153 -
atttttaaattacaacttgg

SEQ ID NO: 32340 - DNA, 20 bp, Artificial Sequence
  Synthetic oligonucleotide; TAG chr11 5370143 5370162 5370146 -
aattacaacttggtagcctc

SEQ ID NO: 32341 - DNA, 20 bp, Artificial Sequence
  Synthetic oligonucleotide; TAG chr11 5370105 5370124 5370108 -
attttctatatgcatttcta

SEQ ID NO: 32342 - DNA, 20 bp, Artificial Sequence
  Synthetic oligonucleotide; AAG chr11 5370102 5370121 5370105 -
ttctatatgcatttctatag

SEQ ID NO: 32343 - DNA, 20 bp, Artificial Sequence
  Synthetic oligonucleotide; CAG chr11 5370099 5370118 5370102 -
tatatgcatttctatagaag

SEQ ID NO: 32344 - DNA, 20 bp, Artificial Sequence
  Synthetic oligonucleotide; AAG chr11 5370073 5370092 5370076 -
gcacatgctgtacaaaccat

SEQ ID NO: 32345 - DNA, 20 bp, Artificial Sequence
  Synthetic oligonucleotide; TGG chr11 5370069 5370088 5370072 -
atgctgtacaaaccataaga

SEQ ID NO: 32346 - DNA, 20 bp, Artificial Sequence
  Synthetic oligonucleotide; CAG chr11 5370066 5370085 5370069 -
ctgtacaaaccataagatgg

SEQ ID NO: 32347 - DNA, 20 bp, Artificial Sequence
  Synthetic oligonucleotide; AGG chr11 5370065 5370084 5370068 -
tgtacaaaccataagatggc

SEQ ID NO: 32348 - DNA, 20 bp, Artificial Sequence
  Synthetic oligonucleotide; GAG chr11 5370063 5370082 5370066 -
tacaaaccataagatggcag

SEQ ID NO: 32349 - DNA, 20 bp, Artificial Sequence
  Synthetic oligonucleotide; GAG chr11 5370061 5370080 5370064 -
caaaccataagatggcagga

SEQ ID NO: 32350 - DNA, 20 bp, Artificial Sequence
  Synthetic oligonucleotide; AGG chr11 5370060 5370079 5370063 -
aaaccataagatggcaggag

SEQ ID NO: 32351 - DNA, 20 bp, Artificial Sequence
  Synthetic oligonucleotide; TGG chr11 5370053 5370072 5370056 -
aagatggcaggagaggtttg

SEQ ID NO: 32352 - DNA, 20 bp, Artificial Sequence
  Synthetic oligonucleotide; TGG chr11 5370036 5370055 5370039 -
ttgtggaacactgactctcc

SEQ ID NO: 32353 - DNA, 20 bp, Artificial Sequence
  Synthetic oligonucleotide; GGG chr11 5370035 5370054 5370038 -
tgtggaacactgactctcct

SEQ ID NO: 32354 - DNA, 20 bp, Artificial Sequence
  Synthetic oligonucleotide; GGG chr11 5370034 5370053 5370037 -
gtggaacactgactctcctg

SEQ ID NO: 32355 - DNA, 20 bp, Artificial Sequence
  Synthetic oligonucleotide; CAG chr11 5370026 5370045 5370029 -
ctgactctcctggggccatg

SEQ ID NO: 32356 - DNA, 20 bp, Artificial Sequence
  Synthetic oligonucleotide; GAG chr11 5370024 5370043 5370027 -
gactctcctggggccatgca

SEQ ID NO: 32357 - DNA, 20 bp, Artificial Sequence
  Synthetic oligonucleotide; AGG chr11 5370023 5370042 5370026 -
actctcctggggccatgcag

SEQ ID NO: 32358 - DNA, 20 bp, Artificial Sequence
  Synthetic oligonucleotide; GGG chr11 5370022 5370041 5370025 -
ctctcctggggccatgcaga

SEQ ID NO: 32359 - DNA, 20 bp, Artificial Sequence
  Synthetic oligonucleotide; GAG chr11 5370020 5370039 5370023 -
ctcctggggccatgcagagg

SEQ ID NO: 32360 - DNA, 20 bp, Artificial Sequence
  Synthetic oligonucleotide; AGG chr11 5370019 5370038 5370022 -
tcctggggccatgcagaggg

SEQ ID NO: 32361 - DNA, 20 bp, Artificial Sequence
  Synthetic oligonucleotide; AAG chr11 5370012 5370031 5370015 -
gccatgcagagggaggtttg

SEQ ID NO: 32362 - DNA, 20 bp, Artificial Sequence
  Synthetic oligonucleotide; CAG chr11 5369997 5370016 5370000 -
gtttgaagatcttgttgata

SEQ ID NO: 32363 - DNA, 20 bp, Artificial Sequence
  Synthetic oligonucleotide; CAG chr11 5369987 5370006 5369990 -
cttgttgatacagattgaca

SEQ ID NO: 32364 - DNA, 20 bp, Artificial Sequence
  Synthetic oligonucleotide; AAG chr11 5369977 5369996 5369980 -
cagattgacacagaatacca

SEQ ID NO: 32365 - DNA, 20 bp, Artificial Sequence
  Synthetic oligonucleotide; GAG chr11 5369950 5369969 5369953 -
tttccccactgcctttcctt

SEQ ID NO: 32366 - DNA, 20 bp, Artificial Sequence
  Synthetic oligonucleotide; GAG chr11 5369937 5369956 5369940 -
tttccttgagtaaaaatcct

SEQ ID NO: 32367 - DNA, 20 bp, Artificial Sequence
  Synthetic oligonucleotide; TAG chr11 5369905 5369924 5369908 -
tccctttctttctatgttga

SEQ ID NO: 32368 - DNA, 20 bp, Artificial Sequence
  Synthetic oligonucleotide; GAG chr11 5369892 5369911 5369895 -
atgttgatagcaaaaccaat

SEQ ID NO: 32369 - DNA, 20 bp, Artificial Sequence
  Synthetic oligonucleotide; AGG chr11 5369891 5369910 5369894 -
tgttgatagcaaaaccaatg

SEQ ID NO: 32370 - DNA, 20 bp, Artificial Sequence
  Synthetic oligonucleotide; TGG chr11 5369858 5369877 5369861 -
taacaactgttgacttattt

SEQ ID NO: 32371 - DNA, 20 bp, Artificial Sequence
  Synthetic oligonucleotide; TAG chr11 5369851 5369870 5369854 -
tgttgacttattttggattt

SEQ ID NO: 32372 - DNA, 20 bp, Artificial Sequence
  Synthetic oligonucleotide; CAG chr11 5369822 5369841 5369825 -
ttcactgtaacacaaaaatg

SEQ ID NO: 32373 - DNA, 20 bp, Artificial Sequence
  Synthetic oligonucleotide; AAG chr11 5369817 5369836 5369820 -
tgtaacacaaaaatgcagac

SEQ ID NO: 32374 - DNA, 20 bp, Artificial Sequence
  Synthetic oligonucleotide; CAG chr11 5369814 5369833 5369817 -
aacacaaaaatgcagacaag

SEQ ID NO: 32375 - DNA, 20 bp, Artificial Sequence
  Synthetic oligonucleotide; TAG chr11 5369802 5369821 5369805 -
cagacaagcagcactgattt

SEQ ID NO: 32376 - DNA, 20 bp, Artificial Sequence
  Synthetic oligonucleotide; TGG chr11 5369797 5369816 5369800 -
aagcagcactgattttagtg

SEQ ID NO: 32377 - DNA, 20 bp, Artificial Sequence
  Synthetic oligonucleotide; TGG chr11 5369789 5369808 5369792 -
ctgattttagtgtggcatca

SEQ ID NO: 32378 - DNA, 20 bp, Artificial Sequence
  Synthetic oligonucleotide; CAG chr11 5369780 5369799 5369783 -
gtgtggcatcatggaaataa

SEQ ID NO: 32379 - DNA, 20 bp, Artificial Sequence
  Synthetic oligonucleotide; TAG chr11 5369768 5369787 5369771 -
ggaaataacagtgctacaca

SEQ ID NO: 32380 - DNA, 20 bp, Artificial Sequence
  Synthetic oligonucleotide; CAG chr11 5369755 5369774 5369758 -
ctacacatagcccttgctac

SEQ ID NO: 32381 - DNA, 20 bp, Artificial Sequence
  Synthetic oligonucleotide; TAG chr11 5369748 5369767 5369751 -
tagcccttgctaccagccaa

SEQ ID NO: 32382 - DNA, 20 bp, Artificial Sequence
  Synthetic oligonucleotide; AGG chr11 5369747 5369766 5369750 -
agcccttgctaccagccaat

SEQ ID NO: 32383 - DNA, 20 bp, Artificial Sequence
  Synthetic oligonucleotide; GAG chr11 5369733 5369752 5369736 -
gccaataggactatttattt

SEQ ID NO: 32384 - DNA, 20 bp, Artificial Sequence
  Synthetic oligonucleotide; TAG chr11 5369702 5369721 5369705 -
tatatgtatatataaatgtg

SEQ ID NO: 32385 - DNA, 20 bp, Artificial Sequence
  Synthetic oligonucleotide; AAG chr11 5369697 5369716 5369700 -
gtatatataaatgtgtagaa

SEQ ID NO: 32386 - DNA, 20 bp, Artificial Sequence
  Synthetic oligonucleotide; CAG chr11 5369691 5369710 5369694 -
ataaatgtgtagaaaagttg

SEQ ID NO: 32387 - DNA, 20 bp, Artificial Sequence
  Synthetic oligonucleotide; GAG chr11 5369689 5369708 5369692 -
aaatgtgtagaaaagttgca

SEQ ID NO: 32388 - DNA, 20 bp, Artificial Sequence
  Synthetic oligonucleotide; TGG chr11 5369679 5369698 5369682 -
aaaagttgcagagaaatgta

SEQ ID NO: 32389 - DNA, 20 bp, Artificial Sequence
  Synthetic oligonucleotide; CAG chr11 5369676 5369695 5369679 -
agttgcagagaaatgtatgg

SEQ ID NO: 32390 - DNA, 20 bp, Artificial Sequence
  Synthetic oligonucleotide; AAG chr11 5369667 5369686 5369670 -
gaaatgtatggcagattata

SEQ ID NO: 32391 - DNA, 20 bp, Artificial Sequence
  Synthetic oligonucleotide; AGG chr11 5369666 5369685 5369669 -
aaatgtatggcagattataa

SEQ ID NO: 32392 - DNA, 20 bp, Artificial Sequence
  Synthetic oligonucleotide; GGG chr11 5369665 5369684 5369668 -
aatgtatggcagattataaa

SEQ ID NO: 32393 - DNA, 20 bp, Artificial Sequence
  Synthetic oligonucleotide; CAG chr11 5369652 5369671 5369655 -
ttataaagggaaattatctc

SEQ ID NO: 32394 - DNA, 20 bp, Artificial Sequence
  Synthetic oligonucleotide; AGG chr11 5369651 5369670 5369654 -
tataaagggaaattatctcc

SEQ ID NO: 32395 - DNA, 20 bp, Artificial Sequence
  Synthetic oligonucleotide; GGG chr11 5369650 5369669 5369653 -
ataaagggaaattatctcca

SEQ ID NO: 32396 - DNA, 20 bp, Artificial Sequence
  Synthetic oligonucleotide; GAG chr11 5369648 5369667 5369651 -
aaagggaaattatctccagg

SEQ ID NO: 32397 - DNA, 20 bp, Artificial Sequence
  Synthetic oligonucleotide; AGG chr11 5369647 5369666 5369650 -
aagggaaattatctccaggg

SEQ ID NO: 32398 - DNA, 20 bp, Artificial Sequence
  Synthetic oligonucleotide; TAG chr11 5369643 5369662 5369646 -
gaaattatctccagggagga

SEQ ID NO: 32399 - DNA, 20 bp, Artificial Sequence
  Synthetic oligonucleotide; AAG chr11 5369639 5369658 5369642 -
ttatctccagggaggataga

SEQ ID NO: 32400 - DNA, 20 bp, Artificial Sequence
  Synthetic oligonucleotide; AGG chr11 5369638 5369657 5369641 -
tatctccagggaggatagaa

SEQ ID NO: 32401 - DNA, 20 bp, Artificial Sequence
  Synthetic oligonucleotide; AAG chr11 5369634 5369653 5369637 -
tccagggaggatagaaaggt

SEQ ID NO: 32402 - DNA, 20 bp, Artificial Sequence
  Synthetic oligonucleotide; AGG chr11 5369633 5369652 5369636 -
ccagggaggatagaaaggta

SEQ ID NO: 32403 - DNA, 20 bp, Artificial Sequence
  Synthetic oligonucleotide; AAG chr11 5369626 5369645 5369629 -
ggatagaaaggtaaggataa

SEQ ID NO: 32404 - DNA, 20 bp, Artificial Sequence
  Synthetic oligonucleotide; AGG chr11 5369625 5369644 5369628 -
gatagaaaggtaaggataaa

SEQ ID NO: 32405 - DNA, 20 bp, Artificial Sequence
  Synthetic oligonucleotide; TGG chr11 5369598 5369617 5369601 -
tactttatatttaatataca

SEQ ID NO: 32406 - DNA, 20 bp, Artificial Sequence
  Synthetic oligonucleotide; GAG chr11 5369596 5369615 5369599 -
ctttatatttaatatacatg

SEQ ID NO: 32407 - DNA, 20 bp, Artificial Sequence
  Synthetic oligonucleotide; TAG chr11 5369567 5369586 5369570 -
taattttttaaattatatca

SEQ ID NO: 32408 - DNA, 20 bp, Artificial Sequence
  Synthetic oligonucleotide; TAG chr11 5369557 5369576 5369560 -
aattatatcatagacatatt

SEQ ID NO: 32409 - DNA, 20 bp, Artificial Sequence
  Synthetic oligonucleotide; AGG chr11 5369556 5369575 5369559 -
attatatcatagacatattt

SEQ ID NO: 32410 - DNA, 20 bp, Artificial Sequence
  Synthetic oligonucleotide; TAG chr11 5369552 5369571 5369555 -
tatcatagacatatttagga

SEQ ID NO: 32411 - DNA, 20 bp, Artificial Sequence
  Synthetic oligonucleotide; TGG chr11 5369545 5369564 5369548 -
gacatatttaggatagtgaa

SEQ ID NO: 32412 - DNA, 20 bp, Artificial Sequence
  Synthetic oligonucleotide; TAG chr11 5369516 5369535 5369519 -
ttaaaaatacaactacttac

SEQ ID NO: 32413 - DNA, 20 bp, Artificial Sequence
  Synthetic oligonucleotide; CAG chr11 5369483 5369502 5369486 -
ttttaaatgtctcaaattat

SEQ ID NO: 32414 - DNA, 20 bp, Artificial Sequence
  Synthetic oligonucleotide; CAG chr11 5369465 5369484 5369468 -
atcagattttattttttatc

SEQ ID NO: 32415 - DNA, 20 bp, Artificial Sequence
  Synthetic oligonucleotide; AAG chr11 5369448 5369467 5369451 -
atccagaaaaaatatataaa

SEQ ID NO: 32416 - DNA, 20 bp, Artificial Sequence
  Synthetic oligonucleotide; TAG chr11 5369436 5369455 5369439 -
tatataaaaagtctgtttca

SEQ ID NO: 32417 - DNA, 20 bp, Artificial Sequence
  Synthetic oligonucleotide; GAG chr11 5369434 5369453 5369437 -
tataaaaagtctgtttcata

SEQ ID NO: 32418 - DNA, 20 bp, Artificial Sequence
  Synthetic oligonucleotide; GAG chr11 5369424 5369443 5369427 -
ctgtttcatagagttttact

SEQ ID NO: 32419 - DNA, 20 bp, Artificial Sequence
  Synthetic oligonucleotide; AGG chr11 5369423 5369442 5369426 -
tgtttcatagagttttactg

SEQ ID NO: 32420 - DNA, 20 bp, Artificial Sequence
  Synthetic oligonucleotide; TAG chr11 5369415 5369434 5369418 -
agagttttactgaggtataa

SEQ ID NO: 32421 - DNA, 20 bp, Artificial Sequence
  Synthetic oligonucleotide; AAG chr11 5369397 5369416 5369400 -
aatagatgtaattctcctaa

SEQ ID NO: 32422 - DNA, 20 bp, Artificial Sequence
  Synthetic oligonucleotide; TAG chr11 5369378 5369397 5369381 -
aaagtgttatattttgcaaa

SEQ ID NO: 32423 - DNA, 20 bp, Artificial Sequence
  Synthetic oligonucleotide; TGG chr11 5369375 5369394 5369378 -
gtgttatattttgcaaatag

SEQ ID NO: 32424 - DNA, 20 bp, Artificial Sequence
  Synthetic oligonucleotide; TAG chr11 5369351 5369370 5369354 -
tgctaaaatattattgttaa

SEQ ID NO: 32425 - DNA, 20 bp, Artificial Sequence
  Synthetic oligonucleotide; TAG chr11 5369336 5369355 5369339 -
gttaatagtattccactaac

SEQ ID NO: 32426 - DNA, 20 bp, Artificial Sequence
  Synthetic oligonucleotide; AAG chr11 5369306 5369325 5369309 -
aactttaattaatatttgtt

SEQ ID NO: 32427 - DNA, 20 bp, Artificial Sequence
  Synthetic oligonucleotide; TGG chr11 5369272 5369291 5369275 -
tttctactaccccacacaca

SEQ ID NO: 32428 - DNA, 20 bp, Artificial Sequence
  Synthetic oligonucleotide; GGG chr11 5369271 5369290 5369274 -
ttctactaccccacacacat

SEQ ID NO: 32429 - DNA, 20 bp, Artificial Sequence
  Synthetic oligonucleotide; TGG chr11 5369244 5369263 5369247 -
catatcttcttctatcatgt

SEQ ID NO: 32430 - DNA, 20 bp, Artificial Sequence
  Synthetic oligonucleotide; CAG chr11 5369234 5369253 5369237 -
tctatcatgttggcctcatt

SEQ ID NO: 32431 - DNA, 20 bp, Artificial Sequence
  Synthetic oligonucleotide; CAG chr11 5369229 5369248 5369232 -
catgttggcctcattcagta

SEQ ID NO: 32432 - DNA, 20 bp, Artificial Sequence
  Synthetic oligonucleotide; TAG chr11 5369223 5369242 5369226 -
ggcctcattcagtacagtac

SEQ ID NO: 32433 - DNA, 20 bp, Artificial Sequence
  Synthetic oligonucleotide; CAG chr11 5369215 5369234 5369218 -
tcagtacagtactagaaaat

SEQ ID NO: 32434 - DNA, 20 bp, Artificial Sequence
  Synthetic oligonucleotide; TAG chr11 5369212 5369231 5369215 -
gtacagtactagaaaatcag

SEQ ID NO: 32435 - DNA, 20 bp, Artificial Sequence
  Synthetic oligonucleotide; AGG chr11 5369211 5369230 5369214 -
tacagtactagaaaatcagt

SEQ ID NO: 32436 - DNA, 20 bp, Artificial Sequence
  Synthetic oligonucleotide; GGG chr11 5369210 5369229 5369213 -
acagtactagaaaatcagta

SEQ ID NO: 32437 - DNA, 20 bp, Artificial Sequence
  Synthetic oligonucleotide; CAG chr11 5369204 5369223 5369207 -
ctagaaaatcagtagggact

SEQ ID NO: 32438 - DNA, 20 bp, Artificial Sequence
  Synthetic oligonucleotide; AGG chr11 5369203 5369222 5369206 -
tagaaaatcagtagggactc

SEQ ID NO: 32439 - DNA, 20 bp, Artificial Sequence
  Synthetic oligonucleotide; TGG chr11 5369187 5369206 5369190 -
actcaggttatatgtgtgaa

SEQ ID NO: 32440 - DNA, 20 bp, Artificial Sequence
  Synthetic oligonucleotide; AAG chr11 5369155 5369174 5369158 -
tgaatgaatgcctattttta

SEQ ID NO: 32441 - DNA, 20 bp, Artificial Sequence
  Synthetic oligonucleotide; TAG chr11 5369125 5369144 5369128 -
cctttctgtatgtctaacct

SEQ ID NO: 32442 - DNA, 20 bp, Artificial Sequence
  Synthetic oligonucleotide; TAG chr11 5369118 5369137 5369121 -
gtatgtctaaccttagattc

SEQ ID NO: 32443 - DNA, 20 bp, Artificial Sequence
  Synthetic oligonucleotide; TGG chr11 5369112 5369131 5369115 -
ctaaccttagattctagtca

SEQ ID NO: 32444 - DNA, 20 bp, Artificial Sequence
  Synthetic oligonucleotide; TAG chr11 5369098 5369117 5369101 -
tagtcatggccatatgtctc

SEQ ID NO: 32445 - DNA, 20 bp, Artificial Sequence
  Synthetic oligonucleotide; AGG chr11 5369097 5369116 5369100 -
agtcatggccatatgtctct

SEQ ID NO: 32446 - DNA, 20 bp, Artificial Sequence
  Synthetic oligonucleotide; TGG chr11 5369094 5369113 5369097 -
catggccatatgtctctagg

SEQ ID NO: 32447 - DNA, 20 bp, Artificial Sequence
  Synthetic oligonucleotide; CAG chr11 5369075 5369094 5369078 -
gtggcccaaccaccctatca

SEQ ID NO: 32448 - DNA, 20 bp, Artificial Sequence
  Synthetic oligonucleotide; AAG chr11 5369061 5369080 5369064 -
ctatcacagattctgcttca

SEQ ID NO: 32449 - DNA, 20 bp, Artificial Sequence
  Synthetic oligonucleotide; AGG chr11 5369060 5369079 5369063 -
tatcacagattctgcttcaa

SEQ ID NO: 32450 - DNA, 20 bp, Artificial Sequence
  Synthetic oligonucleotide; TGG chr11 5369048 5369067 5369051 -
tgcttcaaaggcactcatct

SEQ ID NO: 32451 - DNA, 20 bp, Artificial Sequence
  Synthetic oligonucleotide; TAG chr11 5369033 5369052 5369036 -
catcttggtgaatgaatatc

SEQ ID NO: 32452 - DNA, 20 bp, Artificial Sequence
  Synthetic oligonucleotide; CAG chr11 5369027 5369046 5369030 -
ggtgaatgaatatctagtcc

SEQ ID NO: 32453 - DNA, 20 bp, Artificial Sequence
  Synthetic oligonucleotide; AAG chr11 5369024 5369043 5369027 -
gaatgaatatctagtcccag

SEQ ID NO: 32454 - DNA, 20 bp, Artificial Sequence
  Synthetic oligonucleotide; AGG chr11 5369023 5369042 5369026 -
aatgaatatctagtcccaga

SEQ ID NO: 32455 - DNA, 20 bp, Artificial Sequence
  Synthetic oligonucleotide; GAG chr11 5369021 5369040 5369024 -
tgaatatctagtcccagaag

SEQ ID NO: 32456 - DNA, 20 bp, Artificial Sequence
  Synthetic oligonucleotide; AGG chr11 5369020 5369039 5369023 -
gaatatctagtcccagaagg

SEQ ID NO: 32457 - DNA, 20 bp, Artificial Sequence
  Synthetic oligonucleotide; TAG chr11 5368994 5369013 5368997 -
aaaactatcttgtccacatc

SEQ ID NO: 32458 - DNA, 20 bp, Artificial Sequence
  Synthetic oligonucleotide; TGG chr11 5368990 5369009 5368993 -
ctatcttgtccacatctagt

SEQ ID NO: 32459 - DNA, 20 bp, Artificial Sequence
  Synthetic oligonucleotide; TAG chr11 5368974 5368993 5368977 -
tagttggctgacacacaatt

SEQ ID NO: 32460 - DNA, 20 bp, Artificial Sequence
  Synthetic oligonucleotide; AGG chr11 5368973 5368992 5368976 -
agttggctgacacacaattt

SEQ ID NO: 32461 - DNA, 20 bp, Artificial Sequence
  Synthetic oligonucleotide; TGG chr11 5368965 5368984 5368968 -
gacacacaatttaggcttct

SEQ ID NO: 32462 - DNA, 20 bp, Artificial Sequence
  Synthetic oligonucleotide; GGG chr11 5368964 5368983 5368967 -
acacacaatttaggcttctt

SEQ ID NO: 32463 - DNA, 20 bp, Artificial Sequence
  Synthetic oligonucleotide; CAG chr11 5368955 5368974 5368958 -
ttaggcttcttgggtgtaat

SEQ ID NO: 32464 - DNA, 20 bp, Artificial Sequence
  Synthetic oligonucleotide; AAG chr11 5368946 5368965 5368949 -
ttgggtgtaatcagatctgt

SEQ ID NO: 32465 - DNA, 20 bp, Artificial Sequence
  Synthetic oligonucleotide; CGG chr11 5368936 5368955 5368939 -
tcagatctgtaagcatgatc

SEQ ID NO: 32466 - DNA, 20 bp, Artificial Sequence
  Synthetic oligonucleotide; AAG chr11 5368932 5368951 5368935 -
atctgtaagcatgatccgga

SEQ ID NO: 32467 - DNA, 20 bp, Artificial Sequence
  Synthetic oligonucleotide; AAG chr11 5368926 5368945 5368929 -
aagcatgatccggaaagaaa

SEQ ID NO: 32468 - DNA, 20 bp, Artificial Sequence
  Synthetic oligonucleotide; CAG chr11 5368915 5368934 5368918 -
ggaaagaaaaagttcctgaa

SEQ ID NO: 32469 - DNA, 20 bp, Artificial Sequence
  Synthetic oligonucleotide; GAG chr11 5368913 5368932 5368916 -
aaagaaaaagttcctgaaca

SEQ ID NO: 32470 - DNA, 20 bp, Artificial Sequence
  Synthetic oligonucleotide; AGG chr11 5368912 5368931 5368915 -
aagaaaaagttcctgaacag

SEQ ID NO: 32471 - DNA, 20 bp, Artificial Sequence
  Synthetic oligonucleotide; CAG chr11 5368896 5368915 5368899 -
acagaggcttccaacatcct

SEQ ID NO: 32472 - DNA, 20 bp, Artificial Sequence
  Synthetic oligonucleotide; AAG chr11 5368893 5368912 5368896 -
gaggcttccaacatcctcag

SEQ ID NO: 32473 - DNA, 20 bp, Artificial Sequence
  Synthetic oligonucleotide; AGG chr11 5368892 5368911 5368895 -
aggcttccaacatcctcaga

SEQ ID NO: 32474 - DNA, 20 bp, Artificial Sequence
  Synthetic oligonucleotide; AAG chr11 5368869 5368888 5368872 -
aaacctctcttaatccacat

SEQ ID NO: 32475 - DNA, 20 bp, Artificial Sequence
  Synthetic oligonucleotide; TGG chr11 5368864 5368883 5368867 -
tctcttaatccacataagaa

SEQ ID NO: 32476 - DNA, 20 bp, Artificial Sequence
  Synthetic oligonucleotide; AAG chr11 5368837 5368856 5368840 -
aattccaacatcttgctcct

SEQ ID NO: 32477 - DNA, 20 bp, Artificial Sequence
  Synthetic oligonucleotide; TGG chr11 5368822 5368841 5368825 -
ctcctaagaacactttgccc

SEQ ID NO: 32478 - DNA, 20 bp, Artificial Sequence
  Synthetic oligonucleotide; GGG chr11 5368821 5368840 5368824 -
tcctaagaacactttgccct

SEQ ID NO: 32479 - DNA, 20 bp, Artificial Sequence
  Synthetic oligonucleotide; GGG chr11 5368820 5368839 5368823 -
cctaagaacactttgccctg

SEQ ID NO: 32480 - DNA, 20 bp, Artificial Sequence
  Synthetic oligonucleotide; GGG chr11 5368819 5368838 5368822 -
ctaagaacactttgccctgg

SEQ ID NO: 32481 - DNA, 20 bp, Artificial Sequence
  Synthetic oligonucleotide; AAG chr11 5368811 5368830 5368814 -
actttgccctgggggaaaaa

SEQ ID NO: 32482 - DNA, 20 bp, Artificial Sequence
  Synthetic oligonucleotide; AAG chr11 5368806 5368825 5368809 -
gccctgggggaaaaaaagaa

SEQ ID NO: 32483 - DNA, 20 bp, Artificial Sequence
  Synthetic oligonucleotide; AAG chr11 5368796 5368815 5368799 -
aaaaaaagaaaagccatcgt

SEQ ID NO: 32484 - DNA, 20 bp, Artificial Sequence
  Synthetic oligonucleotide; CAG chr11 5368789 5368808 5368792 -
gaaaagccatcgtaagcttt

SEQ ID NO: 32485 - DNA, 20 bp, Artificial Sequence
  Synthetic oligonucleotide; AAG chr11 5368786 5368805 5368789 -
aagccatcgtaagctttcag

SEQ ID NO: 32486 - DNA, 20 bp, Artificial Sequence
  Synthetic oligonucleotide; AGG chr11 5368785 5368804 5368788 -
agccatcgtaagctttcaga

SEQ ID NO: 32487 - DNA, 20 bp, Artificial Sequence
  Synthetic oligonucleotide; GAG chr11 5368774 5368793 5368777 -
gctttcagaaggcctatgct

SEQ ID NO: 32488 - DNA, 20 bp, Artificial Sequence
  Synthetic oligonucleotide; AGG chr11 5368773 5368792 5368776 -
ctttcagaaggcctatgctg

SEQ ID NO: 32489 - DNA, 20 bp, Artificial Sequence
  Synthetic oligonucleotide; CAG chr11 5368758 5368777 5368761 -
tgctgaggttttgcttcctt

SEQ ID NO: 32490 - DNA, 20 bp, Artificial Sequence
  Synthetic oligonucleotide; AAG chr11 5368750 5368769 5368753 -
ttttgcttccttcagtttta

SEQ ID NO: 32491 - DNA, 20 bp, Artificial Sequence
  Synthetic oligonucleotide; GAG chr11 5368736 5368755 5368739 -
gttttaaagcataatatttt

SEQ ID NO: 32492 - DNA, 20 bp, Artificial Sequence
  Synthetic oligonucleotide; TAG chr11 5368721 5368740 5368724 -
attttgagtaactcaatgtt

SEQ ID NO: 32493 - DNA, 20 bp, Artificial Sequence
  Synthetic oligonucleotide; CAG chr11 5368696 5368715 5368699 -
acctcaaattttgctcttga

SEQ ID NO: 32494 - DNA, 20 bp, Artificial Sequence
  Synthetic oligonucleotide; CAG chr11 5368657 5368676 5368660 -
tactatgctctgctttctca

SEQ ID NO: 32495 - DNA, 20 bp, Artificial Sequence
  Synthetic oligonucleotide; AGG chr11 5368656 5368675 5368659 -
actatgctctgctttctcac

SEQ ID NO: 32496 - DNA, 20 bp, Artificial Sequence
  Synthetic oligonucleotide; GAG chr11 5368645 5368664 5368648 -
ctttctcacaggatgcatgt

SEQ ID NO: 32497 - DNA, 20 bp, Artificial Sequence
  Synthetic oligonucleotide; AAG chr11 5368631 5368650 5368634 -
gcatgtgagaataaaacaca

SEQ ID NO: 32498 - DNA, 20 bp, Artificial Sequence
  Synthetic oligonucleotide; TAG chr11 5368619 5368638 5368622 -
aaaacacaaagtctttatgt

SEQ ID NO: 32499 - DNA, 20 bp, Artificial Sequence
  Synthetic oligonucleotide; AAG chr11 5368598 5368617 5368601 -
agaatatcttgtgtaacttc

SEQ ID NO: 32500 - DNA, 20 bp, Artificial Sequence
  Synthetic oligonucleotide; GAG chr11 5368583 5368602 5368586 -
acttcaagtattacgattgt

SEQ ID NO: 32501 - DNA, 20 bp, Artificial Sequence
  Synthetic oligonucleotide; GAG chr11 5368581 5368600 5368584 -
ttcaagtattacgattgtga

SEQ ID NO: 32502 - DNA, 20 bp, Artificial Sequence
  Synthetic oligonucleotide; GAG chr11 5368579 5368598 5368582 -
caagtattacgattgtgaga

SEQ ID NO: 32503 - DNA, 20 bp, Artificial Sequence
  Synthetic oligonucleotide; AAG chr11 5368569 5368588 5368572 -
gattgtgagagagcttttta

SEQ ID NO: 32504 - DNA, 20 bp, Artificial Sequence
  Synthetic oligonucleotide; AGG chr11 5368568 5368587 5368571 -
attgtgagagagctttttaa

SEQ ID NO: 32505 - DNA, 20 bp, Artificial Sequence
  Synthetic oligonucleotide; CAG chr11 5368549 5368568 5368552 -
aaggtttttattttctttgt

SEQ ID NO: 32506 - DNA, 20 bp, Artificial Sequence
  Synthetic oligonucleotide; GAG chr11 5368547 5368566 5368550 -
ggtttttattttctttgtca

SEQ ID NO: 32507 - DNA, 20 bp, Artificial Sequence
  Synthetic oligonucleotide; TAG chr11 5368543 5368562 5368546 -
tttattttctttgtcagagc

SEQ ID NO: 32508 - DNA, 20 bp, Artificial Sequence
  Synthetic oligonucleotide; CAG chr11 5368539 5368558 5368542 -
ttttctttgtcagagctaga

SEQ ID NO: 32509 - DNA, 20 bp, Artificial Sequence
  Synthetic oligonucleotide; GAG chr11 5368537 5368556 5368540 -
ttctttgtcagagctagaca

SEQ ID NO: 32510 - DNA, 20 bp, Artificial Sequence
  Synthetic oligonucleotide; CAG chr11 5368526 5368545 5368529 -
agctagacagagtatcttct

SEQ ID NO: 32511 - DNA, 20 bp, Artificial Sequence
  Synthetic oligonucleotide; AAG chr11 5368519 5368538 5368522 -
cagagtatcttctcagccca

SEQ ID NO: 32512 - DNA, 20 bp, Artificial Sequence
  Synthetic oligonucleotide; AGG chr11 5368518 5368537 5368521 -
agagtatcttctcagcccaa

SEQ ID NO: 32513 - DNA, 20 bp, Artificial Sequence
  Synthetic oligonucleotide; TAG chr11 5368475 5368494 5368478 -
aaaattttcaatgatgatta

SEQ ID NO: 32514 - DNA, 20 bp, Artificial Sequence
  Synthetic oligonucleotide; TAG chr11 5368466 5368485 5368469 -
aatgatgattatagtaataa

SEQ ID NO: 32515 - DNA, 20 bp, Artificial Sequence
  Synthetic oligonucleotide; TGG chr11 5368439 5368458 5368442 -
gatttctataatacttacaa

SEQ ID NO: 32516 - DNA, 20 bp, Artificial Sequence
  Synthetic oligonucleotide; CAG chr11 5368434 5368453 5368437 -
ctataatacttacaatggac

SEQ ID NO: 32517 - DNA, 20 bp, Artificial Sequence
  Synthetic oligonucleotide; AGG chr11 5368433 5368452 5368436 -
tataatacttacaatggacc

SEQ ID NO: 32518 - DNA, 20 bp, Artificial Sequence
  Synthetic oligonucleotide; TAG chr11 5368415 5368434 5368418 -
ccaggcactattgaacacgt

SEQ ID NO: 32519 - DNA, 20 bp, Artificial Sequence
  Synthetic oligonucleotide; TGG chr11 5368372 5368391 5368375 -
attaaaataattcaaccatg

SEQ ID NO: 32520 - DNA, 20 bp, Artificial Sequence
  Synthetic oligonucleotide; GGG chr11 5368371 5368390 5368374 -
ttaaaataattcaaccatgt

SEQ ID NO: 32521 - DNA, 20 bp, Artificial Sequence
  Synthetic oligonucleotide; TGG chr11 5368362 5368381 5368365 -
ttcaaccatgtgggtactat

SEQ ID NO: 32522 - DNA, 20 bp, Artificial Sequence
  Synthetic oligonucleotide; AAG chr11 5368347 5368366 5368350 -
actattggtatccccactta

SEQ ID NO: 32523 - DNA, 20 bp, Artificial Sequence
  Synthetic oligonucleotide; GAG chr11 5368342 5368361 5368345 -
tggtatccccacttaaagat

SEQ ID NO: 32524 - DNA, 20 bp, Artificial Sequence
  Synthetic oligonucleotide; TGG chr11 5368339 5368358 5368342 -
tatccccacttaaagatgag

SEQ ID NO: 32525 - DNA, 20 bp, Artificial Sequence
  Synthetic oligonucleotide; CAG chr11 5368327 5368346 5368330 -
aagatgagtggaccaaaaca

SEQ ID NO: 32526 - DNA, 20 bp, Artificial Sequence
  Synthetic oligonucleotide; AAG chr11 5368323 5368342 5368326 -
tgagtggaccaaaacacaga

SEQ ID NO: 32527 - DNA, 20 bp, Artificial Sequence
  Synthetic oligonucleotide; TAG chr11 5368304 5368323 5368307 -
aaagataaattgctttgcta

SEQ ID NO: 32528 - DNA, 20 bp, Artificial Sequence
  Synthetic oligonucleotide; AGG chr11 5368303 5368322 5368306 -
aagataaattgctttgctat

SEQ ID NO: 32529 - DNA, 20 bp, Artificial Sequence
  Synthetic oligonucleotide; GGG chr11 5368302 5368321 5368305 -
agataaattgctttgctata

SEQ ID NO: 32530 - DNA, 20 bp, Artificial Sequence
  Synthetic oligonucleotide; CAG chr11 5368295 5368314 5368298 -
ttgctttgctatagggtacg

SEQ ID NO: 32531 - DNA, 20 bp, Artificial Sequence
  Synthetic oligonucleotide; AAG chr11 5368287 5368306 5368290 -
ctatagggtacgcagccaat

SEQ ID NO: 32532 - DNA, 20 bp, Artificial Sequence
  Synthetic oligonucleotide; TGG chr11 5368284 5368303 5368287 -
tagggtacgcagccaataag

SEQ ID NO: 32533 - DNA, 20 bp, Artificial Sequence
  Synthetic oligonucleotide; AAG chr11 5368281 5368300 5368284 -
ggtacgcagccaataagtgg

SEQ ID NO: 32534 - DNA, 20 bp, Artificial Sequence
  Synthetic oligonucleotide; AGG chr11 5368280 5368299 5368283 -
gtacgcagccaataagtgga

SEQ ID NO: 32535 - DNA, 20 bp, Artificial Sequence
  Synthetic oligonucleotide; TGG chr11 5368277 5368296 5368280 -
cgcagccaataagtggaagg

SEQ ID NO: 32536 - DNA, 20 bp, Artificial Sequence
  Synthetic oligonucleotide; GGG chr11 5368276 5368295 5368279 -
gcagccaataagtggaaggt

SEQ ID NO: 32537 - DNA, 20 bp, Artificial Sequence
  Synthetic oligonucleotide; AAG chr11 5368234 5368253 5368237 -
aattcccaaaactactgcat

SEQ ID NO: 32538 - DNA, 20 bp, Artificial Sequence
  Synthetic oligonucleotide; AAG chr11 5368223 5368242 5368226 -
ctactgcataagactgtatg

SEQ ID NO: 32539 - DNA, 20 bp, Artificial Sequence
  Synthetic oligonucleotide; AAG chr11 5368220 5368239 5368223 -
ctgcataagactgtatgaag

SEQ ID NO: 32540 - DNA, 20 bp, Artificial Sequence
  Synthetic oligonucleotide; TAG chr11 5368207 5368226 5368210 -
tatgaagaagcatgaaacaa

SEQ ID NO: 32541 - DNA, 20 bp, Artificial Sequence
  Synthetic oligonucleotide; AGG chr11 5368206 5368225 5368209 -
atgaagaagcatgaaacaat

SEQ ID NO: 32542 - DNA, 20 bp, Artificial Sequence
  Synthetic oligonucleotide; AAG chr11 5368199 5368218 5368202 -
agcatgaaacaataggtttc

SEQ ID NO: 32543 - DNA, 20 bp, Artificial Sequence
  Synthetic oligonucleotide; AAG chr11 5368196 5368215 5368199 -
atgaaacaataggtttcaag

SEQ ID NO: 32544 - DNA, 20 bp, Artificial Sequence
  Synthetic oligonucleotide; CAG chr11 5368189 5368208 5368192 -
aataggtttcaagaagccta

SEQ ID NO: 32545 - DNA, 20 bp, Artificial Sequence
  Synthetic oligonucleotide; CAG chr11 5368177 5368196 5368180 -
gaagcctacagaacacttaa

SEQ ID NO: 32546 - DNA, 20 bp, Artificial Sequence
  Synthetic oligonucleotide; AGG chr11 5368176 5368195 5368179 -
aagcctacagaacacttaac

SEQ ID NO: 32547 - DNA, 20 bp, Artificial Sequence
  Synthetic oligonucleotide; TGG chr11 5368162 5368181 5368165 -
cttaacaggatttttcatgc

SEQ ID NO: 32548 - DNA, 20 bp, Artificial Sequence
  Synthetic oligonucleotide; TAG chr11 5368155 5368174 5368158 -
ggatttttcatgctggttca

SEQ ID NO: 32549 - DNA, 20 bp, Artificial Sequence
  Synthetic oligonucleotide; AAG chr11 5368150 5368169 5368153 -
tttcatgctggttcatagtt

SEQ ID NO: 32550 - DNA, 20 bp, Artificial Sequence
  Synthetic oligonucleotide; TGG chr11 5368143 5368162 5368146 -
ctggttcatagttaagttat

SEQ ID NO: 32551 - DNA, 20 bp, Artificial Sequence
  Synthetic oligonucleotide; AAG chr11 5368137 5368156 5368140 -
catagttaagttattggttg

SEQ ID NO: 32552 - DNA, 20 bp, Artificial Sequence
  Synthetic oligonucleotide; TGG chr11 5368118 5368137 5368121 -
gaagatgcaacaaatctgaa

SEQ ID NO: 32553 - DNA, 20 bp, Artificial Sequence
  Synthetic oligonucleotide; CAG chr11 5368115 5368134 5368118 -
gatgcaacaaatctgaatgg

SEQ ID NO: 32554 - DNA, 20 bp, Artificial Sequence
  Synthetic oligonucleotide; GAG chr11 5368113 5368132 5368116 -
tgcaacaaatctgaatggca

SEQ ID NO: 32555 - DNA, 20 bp, Artificial Sequence
  Synthetic oligonucleotide; AGG chr11 5368112 5368131 5368115 -
gcaacaaatctgaatggcag

SEQ ID NO: 32556 - DNA, 20 bp, Artificial Sequence
  Synthetic oligonucleotide; AAG chr11 5368101 5368120 5368104 -
gaatggcagaggaaaaaaca

SEQ ID NO: 32557 - DNA, 20 bp, Artificial Sequence
  Synthetic oligonucleotide; AAG chr11 5368097 5368116 5368100 -
ggcagaggaaaaaacaaaga

SEQ ID NO: 32558 - DNA, 20 bp, Artificial Sequence
  Synthetic oligonucleotide; GAG chr11 5368095 5368114 5368098 -
cagaggaaaaaacaaagaaa

SEQ ID NO: 32559 - DNA, 20 bp, Artificial Sequence
  Synthetic oligonucleotide; GAG chr11 5368093 5368112 5368096 -
gaggaaaaaacaaagaaaga

SEQ ID NO: 32560 - DNA, 20 bp, Artificial Sequence
  Synthetic oligonucleotide; GAG chr11 5368086 5368105 5368089 -
aaacaaagaaagagagttct

SEQ ID NO: 32561 - DNA, 20 bp, Artificial Sequence
  Synthetic oligonucleotide; GAG chr11 5368082 5368101 5368085 -
aaagaaagagagttctgagt

SEQ ID NO: 32562 - DNA, 20 bp, Artificial Sequence
  Synthetic oligonucleotide; TGG chr11 5368077 5368096 5368080 -
aagagagttctgagtgagcc

SEQ ID NO: 32563 - DNA, 20 bp, Artificial Sequence
  Synthetic oligonucleotide; GGG chr11 5368076 5368095 5368079 -
agagagttctgagtgagcct

SEQ ID NO: 32564 - DNA, 20 bp, Artificial Sequence
  Synthetic oligonucleotide; TAG chr11 5368067 5368086 5368070 -
tgagtgagcctgggtctcca

SEQ ID NO: 32565 - DNA, 20 bp, Artificial Sequence
  Synthetic oligonucleotide; AGG chr11 5368066 5368085 5368069 -
gagtgagcctgggtctccat

SEQ ID NO: 32566 - DNA, 20 bp, Artificial Sequence
  Synthetic oligonucleotide; GAG chr11 5368064 5368083 5368067 -
gtgagcctgggtctccatag

SEQ ID NO: 32567 - DNA, 20 bp, Artificial Sequence
  Synthetic oligonucleotide; AAG chr11 5368059 5368078 5368062 -
cctgggtctccataggagca

SEQ ID NO: 32568 - DNA, 20 bp, Artificial Sequence
  Synthetic oligonucleotide; AAG chr11 5368052 5368071 5368055 -
ctccataggagcaaagaacc

SEQ ID NO: 32569 - DNA, 20 bp, Artificial Sequence
  Synthetic oligonucleotide; AAG chr11 5368047 5368066 5368050 -
taggagcaaagaaccaagtg

SEQ ID NO: 32570 - DNA, 20 bp, Artificial Sequence
  Synthetic oligonucleotide; TGG chr11 5368042 5368061 5368045 -
gcaaagaaccaagtgaagct

SEQ ID NO: 32571 - DNA, 20 bp, Artificial Sequence
  Synthetic oligonucleotide; GGG chr11 5368041 5368060 5368044 -
caaagaaccaagtgaagctt

SEQ ID NO: 32572 - DNA, 20 bp, Artificial Sequence
  Synthetic oligonucleotide; TAG chr11 5368037 5368056 5368040 -
gaaccaagtgaagcttgggt

SEQ ID NO: 32573 - DNA, 20 bp, Artificial Sequence
  Synthetic oligonucleotide; TGG chr11 5368031 5368050 5368034 -
agtgaagcttgggttagttg

SEQ ID NO: 32574 - DNA, 20 bp, Artificial Sequence
  Synthetic oligonucleotide; GGG chr11 5368030 5368049 5368033 -
gtgaagcttgggttagttgt

SEQ ID NO: 32575 - DNA, 20 bp, Artificial Sequence
  Synthetic oligonucleotide; GGG chr11 5368029 5368048 5368032 -
tgaagcttgggttagttgtg

SEQ ID NO: 32576 - DNA, 20 bp, Artificial Sequence
  Synthetic oligonucleotide; AAG chr11 5368023 5368042 5368026 -
ttgggttagttgtggggtgt

SEQ ID NO: 32577 - DNA, 20 bp, Artificial Sequence
  Synthetic oligonucleotide; TAG chr11 5368013 5368032 5368016 -
tgtggggtgtaagatataat

SEQ ID NO: 32578 - DNA, 20 bp, Artificial Sequence
  Synthetic oligonucleotide; AAG chr11 5368010 5368029 5368013 -
ggggtgtaagatataattag

SEQ ID NO: 32579 - DNA, 20 bp, Artificial Sequence
  Synthetic oligonucleotide; GAG chr11 5368008 5368027 5368011 -
ggtgtaagatataattagaa

SEQ ID NO: 32580 - DNA, 20 bp, Artificial Sequence
  Synthetic oligonucleotide; AAG chr11 5368005 5368024 5368008 -
gtaagatataattagaagag

SEQ ID NO: 32581 - DNA, 20 bp, Artificial Sequence
  Synthetic oligonucleotide; TAG chr11 5368002 5368021 5368005 -
agatataattagaagagaag

SEQ ID NO: 32582 - DNA, 20 bp, Artificial Sequence
  Synthetic oligonucleotide; TGG chr11 5367991 5368010 5367994 -
gaagagaagtagctctactc

SEQ ID NO: 32583 - DNA, 20 bp, Artificial Sequence
  Synthetic oligonucleotide; TAG chr11 5367988 5368007 5367991 -
gagaagtagctctactctgg

SEQ ID NO: 32584 - DNA, 20 bp, Artificial Sequence
  Synthetic oligonucleotide; AAG chr11 5367985 5368004 5367988 -
aagtagctctactctggtag

SEQ ID NO: 32585 - DNA, 20 bp, Artificial Sequence
  Synthetic oligonucleotide; AAG chr11 5367972 5367991 5367975 -
ctggtagaagtgaaactttg

SEQ ID NO: 32586 - DNA, 20 bp, Artificial Sequence
  Synthetic oligonucleotide; GAG chr11 5367944 5367963 5367947 -
ctgattcctcacaaactgct

SEQ ID NO: 32587 - DNA, 20 bp, Artificial Sequence
  Synthetic oligonucleotide; AAG chr11 5367940 5367959 5367943 -
ttcctcacaaactgctgagt

SEQ ID NO: 32588 - DNA, 20 bp, Artificial Sequence
  Synthetic oligonucleotide; AGG chr11 5367939 5367958 5367942 -
tcctcacaaactgctgagta

SEQ ID NO: 32589 - DNA, 20 bp, Artificial Sequence
  Synthetic oligonucleotide; TAG chr11 5367935 5367954 5367938 -
cacaaactgctgagtaagga

SEQ ID NO: 32590 - DNA, 20 bp, Artificial Sequence
  Synthetic oligonucleotide; AGG chr11 5367934 5367953 5367937 -
acaaactgctgagtaaggat

SEQ ID NO: 32591 - DNA, 20 bp, Artificial Sequence
  Synthetic oligonucleotide; TAG chr11 5367923 5367942 5367926 -
agtaaggataggaaaatgca

SEQ ID NO: 32592 - DNA, 20 bp, Artificial Sequence
  Synthetic oligonucleotide; TGG chr11 5367917 5367936 5367920 -
gataggaaaatgcatagcct

SEQ ID NO: 32593 - DNA, 20 bp, Artificial Sequence
  Synthetic oligonucleotide; AAG chr11 5367912 5367931 5367915 -
gaaaatgcatagccttggtc

SEQ ID NO: 32594 - DNA, 20 bp, Artificial Sequence
  Synthetic oligonucleotide; AAG chr11 5367905 5367924 5367908 -
catagccttggtcaagattt

SEQ ID NO: 32595 - DNA, 20 bp, Artificial Sequence
  Synthetic oligonucleotide; GAG chr11 5367899 5367918 5367902 -
cttggtcaagatttaagcat

SEQ ID NO: 32596 - DNA, 20 bp, Artificial Sequence
  Synthetic oligonucleotide; AGG chr11 5367898 5367917 5367901 -
ttggtcaagatttaagcatg

SEQ ID NO: 32597 - DNA, 20 bp, Artificial Sequence
  Synthetic oligonucleotide; TAG chr11 5367886 5367905 5367889 -
taagcatgaggacataaaaa

SEQ ID NO: 32598 - DNA, 20 bp, Artificial Sequence
  Synthetic oligonucleotide; TAG chr11 5367880 5367899 5367883 -
tgaggacataaaaatagata

SEQ ID NO: 32599 - DNA, 20 bp, Artificial Sequence
  Synthetic oligonucleotide; AGG chr11 5367879 5367898 5367882 -
gaggacataaaaatagatat

SEQ ID NO: 32600 - DNA, 20 bp, Artificial Sequence
  Synthetic oligonucleotide; CAG chr11 5367876 5367895 5367879 -
gacataaaaatagatatagg

SEQ ID NO: 32601 - DNA, 20 bp, Artificial Sequence
  Synthetic oligonucleotide; AAG chr11 5367872 5367891 5367875 -
taaaaatagatataggcaga

SEQ ID NO: 32602 - DNA, 20 bp, Artificial Sequence
  Synthetic oligonucleotide; AAG chr11 5367866 5367885 5367869 -
tagatataggcagaaagcac

SEQ ID NO: 32603 - DNA, 20 bp, Artificial Sequence
  Synthetic oligonucleotide; AAG chr11 5367827 5367846 5367830 -
tttgaatgcatatattgtgc

SEQ ID NO: 32604 - DNA, 20 bp, Artificial Sequence
  Synthetic oligonucleotide; TGG chr11 5367813 5367832 5367816 -
ttgtgcaagtgcctctattc

SEQ ID NO: 32605 - DNA, 20 bp, Artificial Sequence
  Synthetic oligonucleotide; GGG chr11 5367812 5367831 5367815 -
tgtgcaagtgcctctattct

SEQ ID NO: 32606 - DNA, 20 bp, Artificial Sequence
  Synthetic oligonucleotide; TAG chr11 5367806 5367825 5367809 -
agtgcctctattctgggtgc

SEQ ID NO: 32607 - DNA, 20 bp, Artificial Sequence
  Synthetic oligonucleotide; CAG chr11 5367798 5367817 5367801 -
tattctgggtgctagcatac

SEQ ID NO: 32608 - DNA, 20 bp, Artificial Sequence
  Synthetic oligonucleotide; CAG chr11 5367771 5367790 5367774 -
aacatttttgttccttttgt

SEQ ID NO: 32609 - DNA, 20 bp, Artificial Sequence
  Synthetic oligonucleotide; GAG chr11 5367769 5367788 5367772 -
catttttgttccttttgtca

SEQ ID NO: 32610 - DNA, 20 bp, Artificial Sequence
  Synthetic oligonucleotide; AGG chr11 5367768 5367787 5367771 -
atttttgttccttttgtcag

SEQ ID NO: 32611 - DNA, 20 bp, Artificial Sequence
  Synthetic oligonucleotide; CAG chr11 5367756 5367775 5367759 -
tttgtcagaggcatttgaac

SEQ ID NO: 32612 - DNA, 20 bp, Artificial Sequence
  Synthetic oligonucleotide; GAG chr11 5367754 5367773 5367757 -
tgtcagaggcatttgaacca

SEQ ID NO: 32613 - DNA, 20 bp, Artificial Sequence
  Synthetic oligonucleotide; TAG chr11 5367736 5367755 5367739 -
cagagcaactccatcttaaa

SEQ ID NO: 32614 - DNA, 20 bp, Artificial Sequence
  Synthetic oligonucleotide; AGG chr11 5367735 5367754 5367738 -
agagcaactccatcttaaat

SEQ ID NO: 32615 - DNA, 20 bp, Artificial Sequence
  Synthetic oligonucleotide; GAG chr11 5367733 5367752 5367736 -
agcaactccatcttaaatag

SEQ ID NO: 32616 - DNA, 20 bp, Artificial Sequence
  Synthetic oligonucleotide; TGG chr11 5367729 5367748 5367732 -
actccatcttaaataggagc

SEQ ID NO: 32617 - DNA, 20 bp, Artificial Sequence
  Synthetic oligonucleotide; GGG chr11 5367728 5367747 5367731 -
ctccatcttaaataggagct

SEQ ID NO: 32618 - DNA, 20 bp, Artificial Sequence
  Synthetic oligonucleotide; AAG chr11 5367719 5367738 5367722 -
aaataggagctgggtacaat

SEQ ID NO: 32619 - DNA, 20 bp, Artificial Sequence
  Synthetic oligonucleotide; AGG chr11 5367718 5367737 5367721 -
aataggagctgggtacaata

SEQ ID NO: 32620 - DNA, 20 bp, Artificial Sequence
  Synthetic oligonucleotide; GAG chr11 5367713 5367732 5367716 -
gagctgggtacaataaggct

SEQ ID NO: 32621 - DNA, 20 bp, Artificial Sequence
  Synthetic oligonucleotide; TGG chr11 5367704 5367723 5367707 -
acaataaggctgagacctac

SEQ ID NO: 32622 - DNA, 20 bp, Artificial Sequence
  Synthetic oligonucleotide; GGG chr11 5367703 5367722 5367706 -
caataaggctgagacctact

SEQ ID NO: 32623 - DNA, 20 bp, Artificial Sequence
  Synthetic oligonucleotide; CAG chr11 5367691 5367710 5367694 -
gacctactgggctgtattcc

SEQ ID NO: 32624 - DNA, 20 bp, Artificial Sequence
  Synthetic oligonucleotide; AAG chr11 5367687 5367706 5367690 -
tactgggctgtattcccaga

SEQ ID NO: 32625 - DNA, 20 bp, Artificial Sequence
  Synthetic oligonucleotide; TAG chr11 5367683 5367702 5367686 -
gggctgtattcccagaaagt

SEQ ID NO: 32626 - DNA, 20 bp, Artificial Sequence
  Synthetic oligonucleotide; AGG chr11 5367682 5367701 5367685 -
ggctgtattcccagaaagtt

SEQ ID NO: 32627 - DNA, 20 bp, Artificial Sequence
  Synthetic oligonucleotide; CAG chr11 5367673 5367692 5367676 -
cccagaaagttaggcattct

SEQ ID NO: 32628 - DNA, 20 bp, Artificial Sequence
  Synthetic oligonucleotide; CAG chr11 5367667 5367686 5367670 -
aagttaggcattctcagtca

SEQ ID NO: 32629 - DNA, 20 bp, Artificial Sequence
  Synthetic oligonucleotide; AGG chr11 5367666 5367685 5367669 -
agttaggcattctcagtcac

SEQ ID NO: 32630 - DNA, 20 bp, Artificial Sequence
  Synthetic oligonucleotide; GAG chr11 5367661 5367680 5367664 -
ggcattctcagtcacaggat

SEQ ID NO: 32631 - DNA, 20 bp, Artificial Sequence
  Synthetic oligonucleotide; AAG chr11 5367656 5367675 5367659 -
tctcagtcacaggatgagat

SEQ ID NO: 32632 - DNA, 20 bp, Artificial Sequence
  Synthetic oligonucleotide; GAG chr11 5367654 5367673 5367657 -
tcagtcacaggatgagataa

SEQ ID NO: 32633 - DNA, 20 bp, Artificial Sequence
  Synthetic oligonucleotide; AGG chr11 5367653 5367672 5367656 -
cagtcacaggatgagataag

SEQ ID NO: 32634 - DNA, 20 bp, Artificial Sequence
  Synthetic oligonucleotide; TGG chr11 5367649 5367668 5367652 -
cacaggatgagataagaggt

SEQ ID NO: 32635 - DNA, 20 bp, Artificial Sequence
  Synthetic oligonucleotide; AAG chr11 5367643 5367662 5367646 -
atgagataagaggttggcac

SEQ ID NO: 32636 - DNA, 20 bp, Artificial Sequence
  Synthetic oligonucleotide; CAG chr11 5367637 5367656 5367640 -
taagaggttggcacaagata

SEQ ID NO: 32637 - DNA, 20 bp, Artificial Sequence
  Synthetic oligonucleotide; AGG chr11 5367636 5367655 5367639 -
aagaggttggcacaagatac

SEQ ID NO: 32638 - DNA, 20 bp, Artificial Sequence
  Synthetic oligonucleotide; AAG chr11 5367628 5367647 5367631 -
ggcacaagatacaggtcata

SEQ ID NO: 32639 - DNA, 20 bp, Artificial Sequence
  Synthetic oligonucleotide; CAG chr11 5367610 5367629 5367613 -
taaagaccttgctgaaaaaa

SEQ ID NO: 32640 - DNA, 20 bp, Artificial Sequence
  Synthetic oligonucleotide; CAG chr11 5367603 5367622 5367606 -
cttgctgaaaaaacagtttg

SEQ ID NO: 32641 - DNA, 20 bp, Artificial Sequence
  Synthetic oligonucleotide; AAG chr11 5367598 5367617 5367601 -
tgaaaaaacagtttgcagta

SEQ ID NO: 32642 - DNA, 20 bp, Artificial Sequence
  Synthetic oligonucleotide; AAG chr11 5367595 5367614 5367598 -
aaaaacagtttgcagtaaag

SEQ ID NO: 32643 - DNA, 20 bp, Artificial Sequence
  Synthetic oligonucleotide; TGG chr11 5367591 5367610 5367594 -
acagtttgcagtaaagaagc

SEQ ID NO: 32644 - DNA, 20 bp, Artificial Sequence
  Synthetic oligonucleotide; AAG chr11 5367571 5367590 5367574 -
tggctgaaacccaccaaacc

SEQ ID NO: 32645 - DNA, 20 bp, Artificial Sequence
  Synthetic oligonucleotide; GAG chr11 5367560 5367579 5367563 -
caccaaaccaagattgtgat

SEQ ID NO: 32646 - DNA, 20 bp, Artificial Sequence
  Synthetic oligonucleotide; GAG chr11 5367558 5367577 5367561 -
ccaaaccaagattgtgatga

SEQ ID NO: 32647 - DNA, 20 bp, Artificial Sequence
  Synthetic oligonucleotide; TGG chr11 5367548 5367567 5367551 -
attgtgatgagagtgacctc

SEQ ID NO: 32648 - DNA, 20 bp, Artificial Sequence
  Synthetic oligonucleotide; TAG chr11 5367545 5367564 5367548 -
gtgatgagagtgacctctgg

SEQ ID NO: 32649 - DNA, 20 bp, Artificial Sequence
  Synthetic oligonucleotide; CAG chr11 5367521 5367540 5367524 -
cctcactgctactctcccac

SEQ ID NO: 32650 - DNA, 20 bp, Artificial Sequence
  Synthetic oligonucleotide; TAG chr11 5367505 5367524 5367508 -
ccaccagcactatgactgtt

SEQ ID NO: 32651 - DNA, 20 bp, Artificial Sequence
  Synthetic oligonucleotide; TGG chr11 5367494 5367513 5367497 -
atgactgtttagaaatgcca

SEQ ID NO: 32652 - DNA, 20 bp, Artificial Sequence
  Synthetic oligonucleotide; CAG chr11 5367485 5367504 5367488 -
tagaaatgccatggcaacat

SEQ ID NO: 32653 - DNA, 20 bp, Artificial Sequence
  Synthetic oligonucleotide; AGG chr11 5367484 5367503 5367487 -
agaaatgccatggcaacatc

SEQ ID NO: 32654 - DNA, 20 bp, Artificial Sequence
  Synthetic oligonucleotide; AAG chr11 5367481 5367500 5367484 -
aatgccatggcaacatcagg

SEQ ID NO: 32655 - DNA, 20 bp, Artificial Sequence
  Synthetic oligonucleotide; AAG chr11 5367471 5367490 5367474 -
caacatcaggaagttacgct

SEQ ID NO: 32656 - DNA, 20 bp, Artificial Sequence
  Synthetic oligonucleotide; CGG chr11 5367468 5367487 5367471 -
catcaggaagttacgctaag

SEQ ID NO: 32657 - DNA, 20 bp, Artificial Sequence
  Synthetic oligonucleotide; AAG chr11 5367459 5367478 5367462 -
gttacgctaagcggtctgaa

SEQ ID NO: 32658 - DNA, 20 bp, Artificial Sequence
  Synthetic oligonucleotide; AGG chr11 5367458 5367477 5367461 -
ttacgctaagcggtctgaaa

SEQ ID NO: 32659 - DNA, 20 bp, Artificial Sequence
  Synthetic oligonucleotide; GGG chr11 5367457 5367476 5367460 -
tacgctaagcggtctgaaaa

SEQ ID NO: 32660 - DNA, 20 bp, Artificial Sequence
  Synthetic oligonucleotide; GGG chr11 5367456 5367475 5367459 -
acgctaagcggtctgaaaag

SEQ ID NO: 32661 - DNA, 20 bp, Artificial Sequence
  Synthetic oligonucleotide; GAG chr11 5367454 5367473 5367457 -
gctaagcggtctgaaaaggg

SEQ ID NO: 32662 - DNA, 20 bp, Artificial Sequence
  Synthetic oligonucleotide; AGG chr11 5367453 5367472 5367456 -
ctaagcggtctgaaaagggg

SEQ ID NO: 32663 - DNA, 20 bp, Artificial Sequence
  Synthetic oligonucleotide; TAG chr11 5367428 5367447 5367431 -
tgaataatccaccccttgtt

SEQ ID NO: 32664 - DNA, 20 bp, Artificial Sequence
  Synthetic oligonucleotide; TGG chr11 5367398 5367417 5367401 -
tcaataaataaccataaaaa

SEQ ID NO: 32665 - DNA, 20 bp, Artificial Sequence
  Synthetic oligonucleotide; GGG chr11 5367397 5367416 5367400 -
caataaataaccataaaaat

SEQ ID NO: 32666 - DNA, 20 bp, Artificial Sequence
  Synthetic oligonucleotide; CAG chr11 5367390 5367409 5367393 -
taaccataaaaatgggcaac

SEQ ID NO: 32667 - DNA, 20 bp, Artificial Sequence
  Synthetic oligonucleotide; CAG chr11 5367387 5367406 5367390 -
ccataaaaatgggcaaccag

SEQ ID NO: 32668 - DNA, 20 bp, Artificial Sequence
  Synthetic oligonucleotide; CAG chr11 5367380 5367399 5367383 -
aatgggcaaccagcagtcct

SEQ ID NO: 32669 - DNA, 20 bp, Artificial Sequence
  Synthetic oligonucleotide; AGG chr11 5367379 5367398 5367382 -
atgggcaaccagcagtcctc

SEQ ID NO: 32670 - DNA, 20 bp, Artificial Sequence
  Synthetic oligonucleotide; TAG chr11 5367363 5367382 5367366 -
cctcaggactgttctgccta

SEQ ID NO: 32671 - DNA, 20 bp, Artificial Sequence
  Synthetic oligonucleotide; AGG chr11 5367362 5367381 5367365 -
ctcaggactgttctgcctat

SEQ ID NO: 32672 - DNA, 20 bp, Artificial Sequence
  Synthetic oligonucleotide; GGG chr11 5367361 5367380 5367364 -
tcaggactgttctgcctata

SEQ ID NO: 32673 - DNA, 20 bp, Artificial Sequence
  Synthetic oligonucleotide; TAG chr11 5367358 5367377 5367361 -
ggactgttctgcctataggg

SEQ ID NO: 32674 - DNA, 20 bp, Artificial Sequence
  Synthetic oligonucleotide; TGG chr11 5367303 5367322 5367306 -
cttgctttcacttttctgta

SEQ ID NO: 32675 - DNA, 20 bp, Artificial Sequence
  Synthetic oligonucleotide; TGG chr11 5367280 5367299 5367283 -
atttgccccaaattctttct

SEQ ID NO: 32676 - DNA, 20 bp, Artificial Sequence
  Synthetic oligonucleotide; GGG chr11 5367279 5367298 5367282 -
tttgccccaaattctttctt

SEQ ID NO: 32677 - DNA, 20 bp, Artificial Sequence
  Synthetic oligonucleotide; AAG chr11 5367266 5367285 5367269 -
ctttcttgggcacgaaatcc

SEQ ID NO: 32678 - DNA, 20 bp, Artificial Sequence
  Synthetic oligonucleotide; TAG chr11 5367253 5367272 5367256 -
gaaatccaagaaccctctct

SEQ ID NO: 32679 - DNA, 20 bp, Artificial Sequence
  Synthetic oligonucleotide; AGG chr11 5367252 5367271 5367255 -
aaatccaagaaccctctctt

SEQ ID NO: 32680 - DNA, 20 bp, Artificial Sequence
  Synthetic oligonucleotide; GGG chr11 5367251 5367270 5367254 -
aatccaagaaccctctctta

SEQ ID NO: 32681 - DNA, 20 bp, Artificial Sequence
  Synthetic oligonucleotide; TGG chr11 5367246 5367265 5367249 -
aagaaccctctcttagggtc

SEQ ID NO: 32682 - DNA, 20 bp, Artificial Sequence
  Synthetic oligonucleotide; TGG chr11 5367228 5367247 5367231 -
tctggattgtgactcctttc

SEQ ID NO: 32683 - DNA, 20 bp, Artificial Sequence
  Synthetic oligonucleotide; CAG chr11 5367180 5367199 5367183 -
ctttcaaaatgattttattc

SEQ ID NO: 32684 - DNA, 20 bp, Artificial Sequence
  Synthetic oligonucleotide; AAG chr11 5367144 5367163 5367147 -
aactaaaactctgtgtcact

SEQ ID NO: 32685 - DNA, 20 bp, Artificial Sequence
  Synthetic oligonucleotide; TGG chr11 5367141 5367160 5367144 -
taaaactctgtgtcactaag

SEQ ID NO: 32686 - DNA, 20 bp, Artificial Sequence
  Synthetic oligonucleotide; AAG chr11 5367132 5367151 5367135 -
gtgtcactaagtggctttgc

SEQ ID NO: 32687 - DNA, 20 bp, Artificial Sequence
  Synthetic oligonucleotide; AGG chr11 5367131 5367150 5367134 -
tgtcactaagtggctttgca

SEQ ID NO: 32688 - DNA, 20 bp, Artificial Sequence
  Synthetic oligonucleotide; TGG chr11 5367128 5367147 5367131 -
cactaagtggctttgcaagg

SEQ ID NO: 32689 - DNA, 20 bp, Artificial Sequence
  Synthetic oligonucleotide; TGG chr11 5367113 5367132 5367116 -
caaggtggcatgtgtatgtg

SEQ ID NO: 32690 - DNA, 20 bp, Artificial Sequence
  Synthetic oligonucleotide; CAG chr11 5367110 5367129 5367113 -
ggtggcatgtgtatgtgtgg

SEQ ID NO: 32691 - DNA, 20 bp, Artificial Sequence
  Synthetic oligonucleotide; GAG chr11 5367108 5367127 5367111 -
tggcatgtgtatgtgtggca

SEQ ID NO: 32692 - DNA, 20 bp, Artificial Sequence
  Synthetic oligonucleotide; CAG chr11 5367093 5367112 5367096 -
tggcagagcttctcttcctt

SEQ ID NO: 32693 - DNA, 20 bp, Artificial Sequence
  Synthetic oligonucleotide; GAG chr11 5367078 5367097 5367081 -
tccttcagaaccacattcct

SEQ ID NO: 32694 - DNA, 20 bp, Artificial Sequence
  Synthetic oligonucleotide; GAG chr11 5367071 5367090 5367074 -
gaaccacattcctgagactt

SEQ ID NO: 32695 - DNA, 20 bp, Artificial Sequence
  Synthetic oligonucleotide; GAG chr11 5367069 5367088 5367072 -
accacattcctgagacttga

SEQ ID NO: 32696 - DNA, 20 bp, Artificial Sequence
  Synthetic oligonucleotide; TGG chr11 5367058 5367077 5367061 -
gagacttgagagaatgtctt

SEQ ID NO: 32697 - DNA, 20 bp, Artificial Sequence
  Synthetic oligonucleotide; TAG chr11 5367045 5367064 5367048 -
atgtctttggtctctgctgc

SEQ ID NO: 32698 - DNA, 20 bp, Artificial Sequence
  Synthetic oligonucleotide; GAG chr11 5367043 5367062 5367046 -
gtctttggtctctgctgcta

SEQ ID NO: 32699 - DNA, 20 bp, Artificial Sequence
  Synthetic oligonucleotide; TGG chr11 5367030 5367049 5367033 -
gctgctagagaattttatcc

SEQ ID NO: 32700 - DNA, 20 bp, Artificial Sequence
  Synthetic oligonucleotide; TGG chr11 5367023 5367042 5367026 -
gagaattttatcctggttca

SEQ ID NO: 32701 - DNA, 20 bp, Artificial Sequence
  Synthetic oligonucleotide; CAG chr11 5367016 5367035 5367019 -
ttatcctggttcatggactg

SEQ ID NO: 32702 - DNA, 20 bp, Artificial Sequence
  Synthetic oligonucleotide; CGG chr11 5367013 5367032 5367016 -
tcctggttcatggactgcag

SEQ ID NO: 32703 - DNA, 20 bp, Artificial Sequence
  Synthetic oligonucleotide; GGG chr11 5367012 5367031 5367015 -
cctggttcatggactgcagc

SEQ ID NO: 32704 - DNA, 20 bp, Artificial Sequence
  Synthetic oligonucleotide; GAG chr11 5367010 5367029 5367013 -
tggttcatggactgcagcgg

SEQ ID NO: 32705 - DNA, 20 bp, Artificial Sequence
  Synthetic oligonucleotide; AGG chr11 5367009 5367028 5367012 -
ggttcatggactgcagcggg

SEQ ID NO: 32706 - DNA, 20 bp, Artificial Sequence
  Synthetic oligonucleotide; TGG chr11 5367006 5367025 5367009 -
tcatggactgcagcgggagg

SEQ ID NO: 32707 - DNA, 20 bp, Artificial Sequence
  Synthetic oligonucleotide; AAG chr11 5367003 5367022 5367006 -
tggactgcagcgggaggtgg

SEQ ID NO: 32708 - DNA, 20 bp, Artificial Sequence
  Synthetic oligonucleotide; TGG chr11 5366987 5367006 5366990 -
gtggaagcattttcaaactt

SEQ ID NO: 32709 - DNA, 20 bp, Artificial Sequence
  Synthetic oligonucleotide; GGG chr11 5366986 5367005 5366989 -
tggaagcattttcaaacttt

SEQ ID NO: 32710 - DNA, 20 bp, Artificial Sequence
  Synthetic oligonucleotide; GAG chr11 5366984 5367003 5366987 -
gaagcattttcaaactttgg

SEQ ID NO: 32711 - DNA, 20 bp, Artificial Sequence
  Synthetic oligonucleotide; AGG chr11 5366983 5367002 5366986 -
aagcattttcaaactttggg

SEQ ID NO: 32712 - DNA, 20 bp, Artificial Sequence
  Synthetic oligonucleotide; GGG chr11 5366982 5367001 5366985 -
agcattttcaaactttggga

SEQ ID NO: 32713 - DNA, 20 bp, Artificial Sequence
  Synthetic oligonucleotide; GGG chr11 5366981 5367000 5366984 -
gcattttcaaactttgggag

SEQ ID NO: 32714 - DNA, 20 bp, Artificial Sequence
  Synthetic oligonucleotide; TAG chr11 5366973 5366992 5366976 -
aaactttgggaggggaatgt

SEQ ID NO: 32715 - DNA, 20 bp, Artificial Sequence
  Synthetic oligonucleotide; AGG chr11 5366972 5366991 5366975 -
aactttgggaggggaatgtt

SEQ ID NO: 32716 - DNA, 20 bp, Artificial Sequence
  Synthetic oligonucleotide; GAG chr11 5366970 5366989 5366973 -
ctttgggaggggaatgttag

SEQ ID NO: 32717 - DNA, 20 bp, Artificial Sequence
  Synthetic oligonucleotide; TAG chr11 5366962 5366981 5366965 -
ggggaatgttaggagaccat

SEQ ID NO: 32718 - DNA, 20 bp, Artificial Sequence
  Synthetic oligonucleotide; AGG chr11 5366961 5366980 5366964 -
gggaatgttaggagaccatt

SEQ ID NO: 32719 - DNA, 20 bp, Artificial Sequence
  Synthetic oligonucleotide; AAG chr11 5366949 5366968 5366952 -
agaccattaggcatgtgctc

SEQ ID NO: 32720 - DNA, 20 bp, Artificial Sequence
  Synthetic oligonucleotide; GAG chr11 5366947 5366966 5366950 -
accattaggcatgtgctcaa

SEQ ID NO: 32721 - DNA, 20 bp, Artificial Sequence
  Synthetic oligonucleotide; AAG chr11 5366936 5366955 5366939 -
tgtgctcaagagatgacacc

SEQ ID NO: 32722 - DNA, 20 bp, Artificial Sequence
  Synthetic oligonucleotide; CAG chr11 5366931 5366950 5366934 -
tcaagagatgacaccaagtc

SEQ ID NO: 32723 - DNA, 20 bp, Artificial Sequence
  Synthetic oligonucleotide; AGG chr11 5366930 5366949 5366933 -
caagagatgacaccaagtcc

SEQ ID NO: 32724 - DNA, 20 bp, Artificial Sequence
  Synthetic oligonucleotide; CAG chr11 5366927 5366946 5366930 -
gagatgacaccaagtccagg

SEQ ID NO: 32725 - DNA, 20 bp, Artificial Sequence
  Synthetic oligonucleotide; AGG chr11 5366926 5366945 5366929 -
agatgacaccaagtccaggc

SEQ ID NO: 32726 - DNA, 20 bp, Artificial Sequence
  Synthetic oligonucleotide; GGG chr11 5366925 5366944 5366928 -
gatgacaccaagtccaggca

SEQ ID NO: 32727 - DNA, 20 bp, Artificial Sequence
  Synthetic oligonucleotide; CAG chr11 5366891 5366910 5366894 -
gtgcctgttgtctcatgaat

SEQ ID NO: 32728 - DNA, 20 bp, Artificial Sequence
  Synthetic oligonucleotide; TAG chr11 5366887 5366906 5366890 -
ctgttgtctcatgaatcaga

SEQ ID NO: 32729 - DNA, 20 bp, Artificial Sequence
  Synthetic oligonucleotide; CAG chr11 5366864 5366883 5366867 -
cacccctgcctaaaccttcc

SEQ ID NO: 32730 - DNA, 20 bp, Artificial Sequence
  Synthetic oligonucleotide; CAG chr11 5366849 5366868 5366852 -
cttcccagtcctgcattgca

SEQ ID NO: 32731 - DNA, 20 bp, Artificial Sequence
  Synthetic oligonucleotide; GAG chr11 5366847 5366866 5366850 -
tcccagtcctgcattgcaca

SEQ ID NO: 32732 - DNA, 20 bp, Artificial Sequence
  Synthetic oligonucleotide; TGG chr11 5366835 5366854 5366838 -
attgcacagagacccgtgct

SEQ ID NO: 32733 - DNA, 20 bp, Artificial Sequence
  Synthetic oligonucleotide; GGG chr11 5366834 5366853 5366837 -
ttgcacagagacccgtgctt

SEQ ID NO: 32734 - DNA, 20 bp, Artificial Sequence
  Synthetic oligonucleotide; TGG chr11 5366829 5366848 5366832 -
cagagacccgtgcttgggat

SEQ ID NO: 32735 - DNA, 20 bp, Artificial Sequence
  Synthetic oligonucleotide; TAG chr11 5366823 5366842 5366826 -
cccgtgcttgggattggaat

SEQ ID NO: 32736 - DNA, 20 bp, Artificial Sequence
  Synthetic oligonucleotide; AAG chr11 5366776 5366795 5366779 -
aaattttaatttttattcta

SEQ ID NO: 32737 - DNA, 20 bp, Artificial Sequence
  Synthetic oligonucleotide; AAG chr11 5366761 5366780 5366764 -
ttctaaagactttgaatctc

SEQ ID NO: 32738 - DNA, 20 bp, Artificial Sequence
  Synthetic oligonucleotide; CAG chr11 5366588 5366607 5366591 -
ctcatcttgcttttgccttc

SEQ ID NO: 32739 - DNA, 20 bp, Artificial Sequence
  Synthetic oligonucleotide; AGG chr11 5366587 5366606 5366590 -
tcatcttgcttttgccttcc

SEQ ID NO: 32740 - DNA, 20 bp, Artificial Sequence
  Synthetic oligonucleotide; TGG chr11 5366580 5366599 5366583 -
gcttttgccttccaggctgc

SEQ ID NO: 32741 - DNA, 20 bp, Artificial Sequence
  Synthetic oligonucleotide; GAG chr11 5366578 5366597 5366581 -
ttttgccttccaggctgctg

SEQ ID NO: 32742 - DNA, 20 bp, Artificial Sequence
  Synthetic oligonucleotide; TGG chr11 5366570 5366589 5366573 -
tccaggctgctggagtgcaa

SEQ ID NO: 32743 - DNA, 20 bp, Artificial Sequence
  Synthetic oligonucleotide; CGG chr11 5366559 5366578 5366562 -
ggagtgcaatggcgcgatct

SEQ ID NO: 32744 - DNA, 20 bp, Artificial Sequence
  Synthetic oligonucleotide; CAG chr11 5366535 5366554 5366538 -
tcactgcaacctccgcctcc

SEQ ID NO: 32745 - DNA, 20 bp, Artificial Sequence
  Synthetic oligonucleotide; AGG chr11 5366534 5366553 5366537 -
cactgcaacctccgcctccc

SEQ ID NO: 32746 - DNA, 20 bp, Artificial Sequence
  Synthetic oligonucleotide; AAG chr11 5366528 5366547 5366531 -
aacctccgcctcccaggttc

SEQ ID NO: 32747 - DNA, 20 bp, Artificial Sequence
  Synthetic oligonucleotide; CAG chr11 5366511 5366530 5366514 -
ttcaagcgattctcctacct

SEQ ID NO: 32748 - DNA, 20 bp, Artificial Sequence
  Synthetic oligonucleotide; TAG chr11 5366499 5366518 5366502 -
tcctacctcagcctcctgtg

SEQ ID NO: 32749 - DNA, 20 bp, Artificial Sequence
  Synthetic oligonucleotide; CAG chr11 5366487 5366506 5366490 -
ctcctgtgtagctgcaatta

SEQ ID NO: 32750 - DNA, 20 bp, Artificial Sequence
  Synthetic oligonucleotide; AGG chr11 5366486 5366505 5366489 -
tcctgtgtagctgcaattac

SEQ ID NO: 32751 - DNA, 20 bp, Artificial Sequence
  Synthetic oligonucleotide; CAG chr11 5366473 5366492 5366476 -
caattacaggcatctgccac

SEQ ID NO: 32752 - DNA, 20 bp, Artificial Sequence
  Synthetic oligonucleotide; AGG chr11 5366472 5366491 5366475 -
aattacaggcatctgccacc

SEQ ID NO: 32753 - DNA, 20 bp, Artificial Sequence
  Synthetic oligonucleotide; TAG chr11 5366443 5366462 5366446 -
taatttttttgtatttttat

SEQ ID NO: 32754 - DNA, 20 bp, Artificial Sequence
  Synthetic oligonucleotide; GAG chr11 5366441 5366460 5366444 -
atttttttgtatttttatta

SEQ ID NO: 32755 - DNA, 20 bp, Artificial Sequence
  Synthetic oligonucleotide; CAG chr11 5366437 5366456 5366440 -
ttttgtatttttattagaga

SEQ ID NO: 32756 - DNA, 20 bp, Artificial Sequence
  Synthetic oligonucleotide; AGG chr11 5366436 5366455 5366439 -
tttgtatttttattagagac

SEQ ID NO: 32757 - DNA, 20 bp, Artificial Sequence
  Synthetic oligonucleotide; GGG chr11 5366435 5366454 5366438 -
ttgtatttttattagagaca

SEQ ID NO: 32758 - DNA, 20 bp, Artificial Sequence
  Synthetic oligonucleotide; TGG chr11 5366421 5366440 5366424 -
gagacagggtttcaccatgt

SEQ ID NO: 32759 - DNA, 20 bp, Artificial Sequence
  Synthetic oligonucleotide; CAG chr11 5366417 5366436 5366420 -
cagggtttcaccatgttggt

SEQ ID NO: 32760 - DNA, 20 bp, Artificial Sequence
  Synthetic oligonucleotide; AGG chr11 5366416 5366435 5366419 -
agggtttcaccatgttggtc

SEQ ID NO: 32761 - DNA, 20 bp, Artificial Sequence
  Synthetic oligonucleotide; TGG chr11 5366412 5366431 5366415 -
tttcaccatgttggtcaggc

SEQ ID NO: 32762 - DNA, 20 bp, Artificial Sequence
  Synthetic oligonucleotide; CAG chr11 5366392 5366411 5366395 -
tggtctcgaactcttgccct

SEQ ID NO: 32763 - DNA, 20 bp, Artificial Sequence
  Synthetic oligonucleotide; AGG chr11 5366391 5366410 5366394 -
ggtctcgaactcttgccctc

SEQ ID NO: 32764 - DNA, 20 bp, Artificial Sequence
  Synthetic oligonucleotide; CAG chr11 5366374 5366393 5366377 -
ctcaggtgatcctcctgcct

SEQ ID NO: 32765 - DNA, 20 bp, Artificial Sequence
  Synthetic oligonucleotide; AAG chr11 5366364 5366383 5366367 -
cctcctgcctcagccaccca

SEQ ID NO: 32766 - DNA, 20 bp, Artificial Sequence
  Synthetic oligonucleotide; TGG chr11 5366358 5366377 5366361 -
gcctcagccacccaaagtgc

SEQ ID NO: 32767 - DNA, 20 bp, Artificial Sequence
  Synthetic oligonucleotide; GGG chr11 5366357 5366376 5366360 -
cctcagccacccaaagtgct

SEQ ID NO: 32768 - DNA, 20 bp, Artificial Sequence
  Synthetic oligonucleotide; CAG chr11 5366350 5366369 5366353 -
cacccaaagtgctgggatta

SEQ ID NO: 32769 - DNA, 20 bp, Artificial Sequence
  Synthetic oligonucleotide; AGG chr11 5366349 5366368 5366352 -
acccaaagtgctgggattac

SEQ ID NO: 32770 - DNA, 20 bp, Artificial Sequence
  Synthetic oligonucleotide; GAG chr11 5366343 5366362 5366346 -
agtgctgggattacaggcat

SEQ ID NO: 32771 - DNA, 20 bp, Artificial Sequence
  Synthetic oligonucleotide; TAG chr11 5366331 5366350 5366334 -
acaggcatgagtctgtaatg

SEQ ID NO: 32772 - DNA, 20 bp, Artificial Sequence
  Synthetic oligonucleotide; CAG chr11 5366316 5366335 5366319 -
taatgtagccttttctttaa

SEQ ID NO: 32773 - DNA, 20 bp, Artificial Sequence
  Synthetic oligonucleotide; AGG chr11 5366315 5366334 5366318 -
aatgtagccttttctttaac

SEQ ID NO: 32774 - DNA, 20 bp, Artificial Sequence
  Synthetic oligonucleotide; CAG chr11 5366305 5366324 5366308 -
tttctttaacaggctaccca

SEQ ID NO: 32775 - DNA, 20 bp, Artificial Sequence
  Synthetic oligonucleotide; GAG chr11 5366303 5366322 5366306 -
tctttaacaggctacccaca

SEQ ID NO: 32776 - DNA, 20 bp, Artificial Sequence
  Synthetic oligonucleotide; AGG chr11 5366302 5366321 5366305 -
ctttaacaggctacccacag

SEQ ID NO: 32777 - DNA, 20 bp, Artificial Sequence
  Synthetic oligonucleotide; GAG chr11 5366288 5366307 5366291 -
ccacagaggaaccttccctt

SEQ ID NO: 32778 - DNA, 20 bp, Artificial Sequence
  Synthetic oligonucleotide; CAG chr11 5366277 5366296 5366280 -
ccttcccttgagctcctttt

SEQ ID NO: 32779 - DNA, 20 bp, Artificial Sequence
  Synthetic oligonucleotide; TGG chr11 5366255 5366274 5366258 -
gattcttccttctgtttctc

SEQ ID NO: 32780 - DNA, 20 bp, Artificial Sequence
  Synthetic oligonucleotide; AAG chr11 5366179 5366198 5366182 -
tcatccttaacttcctactt

SEQ ID NO: 32781 - DNA, 20 bp, Artificial Sequence
  Synthetic oligonucleotide; AGG chr11 5366178 5366197 5366181 -
catccttaacttcctactta

SEQ ID NO: 32782 - DNA, 20 bp, Artificial Sequence
  Synthetic oligonucleotide; TGG chr11 5366133 5366152 5366136 -
ctgtttcttattttgcccac

SEQ ID NO: 32783 - DNA, 20 bp, Artificial Sequence
  Synthetic oligonucleotide; GGG chr11 5366132 5366151 5366135 -
tgtttcttattttgcccact

SEQ ID NO: 32784 - DNA, 20 bp, Artificial Sequence
  Synthetic oligonucleotide; AAG chr11 5366120 5366139 5366123 -
tgcccactgggttcacctct

SEQ ID NO: 32785 - DNA, 20 bp, Artificial Sequence
  Synthetic oligonucleotide; TGG chr11 5366106 5366125 5366109 -
acctctaagtcacacacaac

SEQ ID NO: 32786 - DNA, 20 bp, Artificial Sequence
  Synthetic oligonucleotide; AAG chr11 5366101 5366120 5366104 -
taagtcacacacaactggac

SEQ ID NO: 32787 - DNA, 20 bp, Artificial Sequence
  Synthetic oligonucleotide; AAG chr11 5366097 5366116 5366100 -
tcacacacaactggacaagt

SEQ ID NO: 32788 - DNA, 20 bp, Artificial Sequence
  Synthetic oligonucleotide; CAG chr11 5366085 5366104 5366088 -
ggacaagtaagcatacccct

SEQ ID NO: 32789 - DNA, 20 bp, Artificial Sequence
  Synthetic oligonucleotide; CAG chr11 5366067 5366086 5366070 -
ctcagcaactcttccattaa

SEQ ID NO: 32790 - DNA, 20 bp, Artificial Sequence
  Synthetic oligonucleotide; TGG chr11 5366043 5366062 5366046 -
ccccaaacatgctgattacc

SEQ ID NO: 32791 - DNA, 20 bp, Artificial Sequence
  Synthetic oligonucleotide; TAG chr11 5366032 5366051 5366035 -
ctgattacctggctgctcca

SEQ ID NO: 32792 - DNA, 20 bp, Artificial Sequence
  Synthetic oligonucleotide; AGG chr11 5366031 5366050 5366034 -
tgattacctggctgctccat

SEQ ID NO: 32793 - DNA, 20 bp, Artificial Sequence
  Synthetic oligonucleotide; GGG chr11 5366030 5366049 5366033 -
gattacctggctgctccata

SEQ ID NO: 32794 - DNA, 20 bp, Artificial Sequence
  Synthetic oligonucleotide; TGG chr11 5366027 5366046 5366030 -
tacctggctgctccataggg

SEQ ID NO: 32795 - DNA, 20 bp, Artificial Sequence
  Synthetic oligonucleotide; TGG chr11 5366023 5366042 5366026 -
tggctgctccatagggtggt

SEQ ID NO: 32796 - DNA, 20 bp, Artificial Sequence
  Synthetic oligonucleotide; TGG chr11 5366019 5366038 5366022 -
tgctccatagggtggttggt

SEQ ID NO: 32797 - DNA, 20 bp, Artificial Sequence
  Synthetic oligonucleotide; AAG chr11 5366012 5366031 5366015 -
tagggtggttggttggtctt

SEQ ID NO: 32798 - DNA, 20 bp, Artificial Sequence
  Synthetic oligonucleotide; TAG chr11 5366001 5366020 5366004 -
gttggtcttaagtctcccac

SEQ ID NO: 32799 - DNA, 20 bp, Artificial Sequence
  Synthetic oligonucleotide; CAG chr11 5365997 5366016 5366000 -
gtcttaagtctcccactagc

SEQ ID NO: 32800 - DNA, 20 bp, Artificial Sequence
  Synthetic oligonucleotide; TAG chr11 5365990 5366009 5365993 -
gtctcccactagccagcacc

SEQ ID NO: 32801 - DNA, 20 bp, Artificial Sequence
  Synthetic oligonucleotide; CAG chr11 5365987 5366006 5365990 -
tcccactagccagcacctag

SEQ ID NO: 32802 - DNA, 20 bp, Artificial Sequence
  Synthetic oligonucleotide; CAG chr11 5365979 5365998 5365982 -
gccagcacctagcagttctt

SEQ ID NO: 32803 - DNA, 20 bp, Artificial Sequence
  Synthetic oligonucleotide; TGG chr11 5365970 5365989 5365973 -
tagcagttcttcagtttgtg

SEQ ID NO: 32804 - DNA, 20 bp, Artificial Sequence
  Synthetic oligonucleotide; CAG chr11 5365963 5365982 5365966 -
tcttcagtttgtgtggttct

SEQ ID NO: 32805 - DNA, 20 bp, Artificial Sequence
  Synthetic oligonucleotide; TGG chr11 5365957 5365976 5365960 -
gtttgtgtggttctcagtgc

SEQ ID NO: 32806 - DNA, 20 bp, Artificial Sequence
  Synthetic oligonucleotide; GAG chr11 5365944 5365963 5365947 -
tcagtgctggtgatcatgct

SEQ ID NO: 32807 - DNA, 20 bp, Artificial Sequence
  Synthetic oligonucleotide; TGG chr11 5365920 5365939 5365923 -
ctgcccccttcatgcctctc

SEQ ID NO: 32808 - DNA, 20 bp, Artificial Sequence
  Synthetic oligonucleotide; CAG chr11 5365916 5365935 5365919 -
ccccttcatgcctctctggt

SEQ ID NO: 32809 - DNA, 20 bp, Artificial Sequence
  Synthetic oligonucleotide; CAG chr11 5365912 5365931 5365915 -
ttcatgcctctctggtcagt

SEQ ID NO: 32810 - DNA, 20 bp, Artificial Sequence
  Synthetic oligonucleotide; CAG chr11 5365903 5365922 5365906 -
ctctggtcagtcagaccctt

SEQ ID NO: 32811 - DNA, 20 bp, Artificial Sequence
  Synthetic oligonucleotide; AAG chr11 5365895 5365914 5365898 -
agtcagacccttcagaaccc

SEQ ID NO: 32812 - DNA, 20 bp, Artificial Sequence
  Synthetic oligonucleotide; GAG chr11 5365893 5365912 5365896 -
tcagacccttcagaacccaa

SEQ ID NO: 32813 - DNA, 20 bp, Artificial Sequence
  Synthetic oligonucleotide; AGG chr11 5365892 5365911 5365895 -
cagacccttcagaacccaag

SEQ ID NO: 32814 - DNA, 20 bp, Artificial Sequence
  Synthetic oligonucleotide; AAG chr11 5365888 5365907 5365891 -
cccttcagaacccaagaggt

SEQ ID NO: 32815 - DNA, 20 bp, Artificial Sequence
  Synthetic oligonucleotide; CAG chr11 5365885 5365904 5365888 -
ttcagaacccaagaggtaag

SEQ ID NO: 32816 - DNA, 20 bp, Artificial Sequence
  Synthetic oligonucleotide; GAG chr11 5365883 5365902 5365886 -
cagaacccaagaggtaagca

SEQ ID NO: 32817 - DNA, 20 bp, Artificial Sequence
  Synthetic oligonucleotide; AAG chr11 5365873 5365892 5365876 -
gaggtaagcagagttcctct

SEQ ID NO: 32818 - DNA, 20 bp, Artificial Sequence
  Synthetic oligonucleotide; TGG chr11 5365868 5365887 5365871 -
aagcagagttcctctaagaa

SEQ ID NO: 32819 - DNA, 20 bp, Artificial Sequence
  Synthetic oligonucleotide; TAG chr11 5365864 5365883 5365867 -
agagttcctctaagaatggt

SEQ ID NO: 32820 - DNA, 20 bp, Artificial Sequence
  Synthetic oligonucleotide; AAG chr11 5365837 5365856 5365840 -
ttaaacttcatcctgtcatc

SEQ ID NO: 32821 - DNA, 20 bp, Artificial Sequence
  Synthetic oligonucleotide; CAG chr11 5365833 5365852 5365836 -
acttcatcctgtcatcaagc

SEQ ID NO: 32822 - DNA, 20 bp, Artificial Sequence
  Synthetic oligonucleotide; AAG chr11 5365822 5365841 5365825 -
tcatcaagccagcacatact

SEQ ID NO: 32823 - DNA, 20 bp, Artificial Sequence
  Synthetic oligonucleotide; TAG chr11 5365805 5365824 5365808 -
actaagcatctataatgtgc

SEQ ID NO: 32824 - DNA, 20 bp, Artificial Sequence
  Synthetic oligonucleotide; TGG chr11 5365796 5365815 5365799 -
ctataatgtgctagacaatg

SEQ ID NO: 32825 - DNA, 20 bp, Artificial Sequence
  Synthetic oligonucleotide; GGG chr11 5365795 5365814 5365798 -
tataatgtgctagacaatgt

SEQ ID NO: 32826 - DNA, 20 bp, Artificial Sequence
  Synthetic oligonucleotide; TGG chr11 5365789 5365808 5365792 -
gtgctagacaatgtgggtaa

SEQ ID NO: 32827 - DNA, 20 bp, Artificial Sequence
  Synthetic oligonucleotide; GAG chr11 5365787 5365806 5365790 -
gctagacaatgtgggtaatg

SEQ ID NO: 32828 - DNA, 20 bp, Artificial Sequence
  Synthetic oligonucleotide; AGG chr11 5365786 5365805 5365789 -
ctagacaatgtgggtaatgg

SEQ ID NO: 32829 - DNA, 20 bp, Artificial Sequence
  Synthetic oligonucleotide; TGG chr11 5365776 5365795 5365779 -
tgggtaatggaggtgatgcc

SEQ ID NO: 32830 - DNA, 20 bp, Artificial Sequence
  Synthetic oligonucleotide; AAG chr11 5365753 5365772 5365756 -
attataatatctgccctcaa

SEQ ID NO: 32831 - DNA, 20 bp, Artificial Sequence
  Synthetic oligonucleotide; CAG chr11 5365725 5365744 5365728 -
atctattttttaaataatta

SEQ ID NO: 32832 - DNA, 20 bp, Artificial Sequence
  Synthetic oligonucleotide; AGG chr11 5365724 5365743 5365727 -
tctattttttaaataattac

SEQ ID NO: 32833 - DNA, 20 bp, Artificial Sequence
  Synthetic oligonucleotide; CAG chr11 5365706 5365725 5365709 -
acaggacaatttaaatgtat

SEQ ID NO: 32834 - DNA, 20 bp, Artificial Sequence
  Synthetic oligonucleotide; TGG chr11 5365701 5365720 5365704 -
acaatttaaatgtatcagtt

SEQ ID NO: 32835 - DNA, 20 bp, Artificial Sequence
  Synthetic oligonucleotide; GGG chr11 5365700 5365719 5365703 -
caatttaaatgtatcagttt

SEQ ID NO: 32836 - DNA, 20 bp, Artificial Sequence
  Synthetic oligonucleotide; CAG chr11 5365686 5365705 5365689 -
cagtttgggttgaataaaat

SEQ ID NO: 32837 - DNA, 20 bp, Artificial Sequence
  Synthetic oligonucleotide; AGG chr11 5365685 5365704 5365688 -
agtttgggttgaataaaatc

SEQ ID NO: 32838 - DNA, 20 bp, Artificial Sequence
  Synthetic oligonucleotide; GGG chr11 5365684 5365703 5365687 -
gtttgggttgaataaaatca

SEQ ID NO: 32839 - DNA, 20 bp, Artificial Sequence
  Synthetic oligonucleotide; TAG chr11 5365670 5365689 5365673 -
aaatcagggatgtttctcat

SEQ ID NO: 32840 - DNA, 20 bp, Artificial Sequence
  Synthetic oligonucleotide; AGG chr11 5365669 5365688 5365672 -
aatcagggatgtttctcatt

SEQ ID NO: 32841 - DNA, 20 bp, Artificial Sequence
  Synthetic oligonucleotide; GGG chr11 5365668 5365687 5365671 -
atcagggatgtttctcatta

SEQ ID NO: 32842 - DNA, 20 bp, Artificial Sequence
  Synthetic oligonucleotide; TGG chr11 5365653 5365672 5365656 -
cattagggcctcaacacatt

SEQ ID NO: 32843 - DNA, 20 bp, Artificial Sequence
  Synthetic oligonucleotide; GAG chr11 5365651 5365670 5365654 -
ttagggcctcaacacatttg

SEQ ID NO: 32844 - DNA, 20 bp, Artificial Sequence
  Synthetic oligonucleotide; AGG chr11 5365650 5365669 5365653 -
tagggcctcaacacatttgg

SEQ ID NO: 32845 - DNA, 20 bp, Artificial Sequence
  Synthetic oligonucleotide; AAG chr11 5365641 5365660 5365644 -
aacacatttggaggtgtgtt

SEQ ID NO: 32846 - DNA, 20 bp, Artificial Sequence
  Synthetic oligonucleotide; CAG chr11 5365637 5365656 5365640 -
catttggaggtgtgttaaga

SEQ ID NO: 32847 - DNA, 20 bp, Artificial Sequence
  Synthetic oligonucleotide; TAG chr11 5365634 5365653 5365637 -
ttggaggtgtgttaagacag

SEQ ID NO: 32848 - DNA, 20 bp, Artificial Sequence
  Synthetic oligonucleotide; CAG chr11 5365630 5365649 5365633 -
aggtgtgttaagacagtagt

SEQ ID NO: 32849 - DNA, 20 bp, Artificial Sequence
  Synthetic oligonucleotide; AAG chr11 5365618 5365637 5365621 -
acagtagtcagattcacacc

SEQ ID NO: 32850 - DNA, 20 bp, Artificial Sequence
  Synthetic oligonucleotide; GAG chr11 5365616 5365635 5365619 -
agtagtcagattcacaccaa

SEQ ID NO: 32851 - DNA, 20 bp, Artificial Sequence
  Synthetic oligonucleotide; TGG chr11 5365605 5365624 5365608 -
tcacaccaagagccctgtca

SEQ ID NO: 32852 - DNA, 20 bp, Artificial Sequence
  Synthetic oligonucleotide; GAG chr11 5365537 5365556 5365540 -
atgctttgtgaaaaaacttc

SEQ ID NO: 32853 - DNA, 20 bp, Artificial Sequence
  Synthetic oligonucleotide; AGG chr11 5365536 5365555 5365539 -
tgctttgtgaaaaaacttcg

SEQ ID NO: 32854 - DNA, 20 bp, Artificial Sequence
  Synthetic oligonucleotide; TAG chr11 5365533 5365552 5365536 -
tttgtgaaaaaacttcgagg

SEQ ID NO: 32855 - DNA, 20 bp, Artificial Sequence
  Synthetic oligonucleotide; CAG chr11 5365528 5365547 5365531 -
gaaaaaacttcgaggtagta

SEQ ID NO: 32856 - DNA, 20 bp, Artificial Sequence
  Synthetic oligonucleotide; TAG chr11 5365506 5365525 5365509 -
gccatatcctatcctgtgca

SEQ ID NO: 32857 - DNA, 20 bp, Artificial Sequence
  Synthetic oligonucleotide; CAG chr11 5365502 5365521 5365505 -
tatcctatcctgtgcataga

SEQ ID NO: 32858 - DNA, 20 bp, Artificial Sequence
  Synthetic oligonucleotide; AGG chr11 5365501 5365520 5365504 -
atcctatcctgtgcatagac

SEQ ID NO: 32859 - DNA, 20 bp, Artificial Sequence
  Synthetic oligonucleotide; TGG chr11 5365494 5365513 5365497 -
cctgtgcatagacaggaaaa

SEQ ID NO: 32860 - DNA, 20 bp, Artificial Sequence
  Synthetic oligonucleotide; TGG chr11 5365483 5365502 5365486 -
acaggaaaatggttgctgac

SEQ ID NO: 32861 - DNA, 20 bp, Artificial Sequence
  Synthetic oligonucleotide; CAG chr11 5365480 5365499 5365483 -
ggaaaatggttgctgactgg

SEQ ID NO: 32862 - DNA, 20 bp, Artificial Sequence
  Synthetic oligonucleotide; CAG chr11 5365475 5365494 5365478 -
atggttgctgactggcagac

SEQ ID NO: 32863 - DNA, 20 bp, Artificial Sequence
  Synthetic oligonucleotide; TGG chr11 5365469 5365488 5365472 -
gctgactggcagaccagaat

SEQ ID NO: 32864 - DNA, 20 bp, Artificial Sequence
  Synthetic oligonucleotide; GGG chr11 5365468 5365487 5365471 -
ctgactggcagaccagaatt

SEQ ID NO: 32865 - DNA, 20 bp, Artificial Sequence
  Synthetic oligonucleotide; CAG chr11 5365436 5365455 5365439 -
catctaaatgcatctctcca

SEQ ID NO: 32866 - DNA, 20 bp, Artificial Sequence
  Synthetic oligonucleotide; CAG chr11 5365424 5365443 5365427 -
tctctccacagcgatttcta

SEQ ID NO: 32867 - DNA, 20 bp, Artificial Sequence
  Synthetic oligonucleotide; TGG chr11 5365391 5365410 5365394 -
cttgtctctcatcccatatt

SEQ ID NO: 32868 - DNA, 20 bp, Artificial Sequence
  Synthetic oligonucleotide; CGG chr11 5365372 5365391 5365375 -
ttggttacttgttgccatgc

SEQ ID NO: 32869 - DNA, 20 bp, Artificial Sequence
  Synthetic oligonucleotide; GGG chr11 5365371 5365390 5365374 -
tggttacttgttgccatgcc

SEQ ID NO: 32870 - DNA, 20 bp, Artificial Sequence
  Synthetic oligonucleotide; CAG chr11 5365366 5365385 5365369 -
acttgttgccatgccgggac

SEQ ID NO: 32871 - DNA, 20 bp, Artificial Sequence
  Synthetic oligonucleotide; TGG chr11 5365355 5365374 5365358 -
tgccgggaccagccatgcat

SEQ ID NO: 32872 - DNA, 20 bp, Artificial Sequence
  Synthetic oligonucleotide; TGG chr11 5365344 5365363 5365347 -
gccatgcattggtttgcctt

SEQ ID NO: 32873 - DNA, 20 bp, Artificial Sequence
  Synthetic oligonucleotide; CAG chr11 5365338 5365357 5365341 -
cattggtttgcctttggcat

SEQ ID NO: 32874 - DNA, 20 bp, Artificial Sequence
  Synthetic oligonucleotide; CAG chr11 5365309 5365328 5365312 -
ctctatacccatgttttcca

SEQ ID NO: 32875 - DNA, 20 bp, Artificial Sequence
  Synthetic oligonucleotide; TGG chr11 5365305 5365324 5365308 -
atacccatgttttccacagc

SEQ ID NO: 32876 - DNA, 20 bp, Artificial Sequence
  Synthetic oligonucleotide; CAG chr11 5365295 5365314 5365298 -
tttccacagctggcaaacac

SEQ ID NO: 32877 - DNA, 20 bp, Artificial Sequence
  Synthetic oligonucleotide; TGG chr11 5365292 5365311 5365295 -
ccacagctggcaaacaccag

SEQ ID NO: 32878 - DNA, 20 bp, Artificial Sequence
  Synthetic oligonucleotide; CAG chr11 5365263 5365282 5365266 -
aataacactgttctcaccac

SEQ ID NO: 32879 - DNA, 20 bp, Artificial Sequence
  Synthetic oligonucleotide; TGG chr11 5365254 5365273 5365257 -
gttctcaccaccagcccttc

SEQ ID NO: 32880 - DNA, 20 bp, Artificial Sequence
  Synthetic oligonucleotide; TAG chr11 5365246 5365265 5365249 -
caccagcccttctggttcac

SEQ ID NO: 32881 - DNA, 20 bp, Artificial Sequence
  Synthetic oligonucleotide; TGG chr11 5365234 5365253 5365237 -
tggttcactagatgtttcca

SEQ ID NO: 32882 - DNA, 20 bp, Artificial Sequence
  Synthetic oligonucleotide; GAG chr11 5365232 5365251 5365235 -
gttcactagatgtttccatg

SEQ ID NO: 32883 - DNA, 20 bp, Artificial Sequence
  Synthetic oligonucleotide; TAG chr11 5365218 5365237 5365221 -
tccatggagtcctgatataa

SEQ ID NO: 32884 - DNA, 20 bp, Artificial Sequence
  Synthetic oligonucleotide; CAG chr11 5365198 5365217 5365201 -
tagacaacttattttaaaca

SEQ ID NO: 32885 - DNA, 20 bp, Artificial Sequence
  Synthetic oligonucleotide; CAG chr11 5365191 5365210 5365194 -
cttattttaaacacagttgc

SEQ ID NO: 32886 - DNA, 20 bp, Artificial Sequence
  Synthetic oligonucleotide; CAG chr11 5365168 5365187 5365171 -
ccctacactctaaatgtcta

SEQ ID NO: 32887 - DNA, 20 bp, Artificial Sequence
  Synthetic oligonucleotide; CAG chr11 5365158 5365177 5365161 -
taaatgtctacagaactcac

SEQ ID NO: 32888 - DNA, 20 bp, Artificial Sequence
  Synthetic oligonucleotide; AAG chr11 5365152 5365171 5365155 -
tctacagaactcaccagaca

SEQ ID NO: 32889 - DNA, 20 bp, Artificial Sequence
  Synthetic oligonucleotide; AAG chr11 5365149 5365168 5365152 -
acagaactcaccagacaaag

SEQ ID NO: 32890 - DNA, 20 bp, Artificial Sequence
  Synthetic oligonucleotide; AAG chr11 5365144 5365163 5365147 -
actcaccagacaaagaagaa

SEQ ID NO: 32891 - DNA, 20 bp, Artificial Sequence
  Synthetic oligonucleotide; TAG chr11 5365136 5365155 5365139 -
gacaaagaagaaaagttatt

SEQ ID NO: 32892 - DNA, 20 bp, Artificial Sequence
  Synthetic oligonucleotide; CAG chr11 5365133 5365152 5365136 -
aaagaagaaaagttatttag

SEQ ID NO: 32893 - DNA, 20 bp, Artificial Sequence
  Synthetic oligonucleotide; AAG chr11 5365123 5365142 5365126 -
agttatttagcagttgtgat

SEQ ID NO: 32894 - DNA, 20 bp, Artificial Sequence
  Synthetic oligonucleotide; AAG chr11 5365105 5365124 5365108 -
ataagctaccacttgaattc

SEQ ID NO: 32895 - DNA, 20 bp, Artificial Sequence
  Synthetic oligonucleotide; AGG chr11 5365104 5365123 5365107 -
taagctaccacttgaattca

SEQ ID NO: 32896 - DNA, 20 bp, Artificial Sequence
  Synthetic oligonucleotide; AAG chr11 5365094 5365113 5365097 -
cttgaattcaaggttattac

SEQ ID NO: 32897 - DNA, 20 bp, Artificial Sequence
  Synthetic oligonucleotide; TGG chr11 5365073 5365092 5365076 -
agcatgattattgacacatt

SEQ ID NO: 32898 - DNA, 20 bp, Artificial Sequence
  Synthetic oligonucleotide; GAG chr11 5365063 5365082 5365066 -
ttgacacatttggttttatt

SEQ ID NO: 32899 - DNA, 20 bp, Artificial Sequence
  Synthetic oligonucleotide; AAG chr11 5365044 5365063 5365047 -
tgagtgtcccttatttgccc

SEQ ID NO: 32900 - DNA, 20 bp, Artificial Sequence
  Synthetic oligonucleotide; AAG chr11 5365026 5365045 5365029 -
ccaagattcattgctgtgac

SEQ ID NO: 32901 - DNA, 20 bp, Artificial Sequence
  Synthetic oligonucleotide; AAG chr11 5365017 5365036 5365020 -
attgctgtgacaagaatgac

SEQ ID NO: 32902 - DNA, 20 bp, Artificial Sequence
  Synthetic oligonucleotide; AAG chr11 5365014 5365033 5365017 -
gctgtgacaagaatgacaag

SEQ ID NO: 32903 - DNA, 20 bp, Artificial Sequence
  Synthetic oligonucleotide; AAG chr11 5365011 5365030 5365014 -
gtgacaagaatgacaagaag

SEQ ID NO: 32904 - DNA, 20 bp, Artificial Sequence
  Synthetic oligonucleotide; CAG chr11 5365008 5365027 5365011 -
acaagaatgacaagaagaag

SEQ ID NO: 32905 - DNA, 20 bp, Artificial Sequence
  Synthetic oligonucleotide; GAG chr11 5364999 5365018 5365002 -
acaagaagaagcagttactt

SEQ ID NO: 32906 - DNA, 20 bp, Artificial Sequence
  Synthetic oligonucleotide; TAG chr11 5364985 5365004 5364988 -
ttacttgagaaatccccttg

SEQ ID NO: 32907 - DNA, 20 bp, Artificial Sequence
  Synthetic oligonucleotide; TAG chr11 5364926 5364945 5364929 -
ttctccttgtgtatccacca

SEQ ID NO: 32908 - DNA, 20 bp, Artificial Sequence
  Synthetic oligonucleotide; AAG chr11 5364923 5364942 5364926 -
tccttgtgtatccaccatag

SEQ ID NO: 32909 - DNA, 20 bp, Artificial Sequence
  Synthetic oligonucleotide; TGG chr11 5364868 5364887 5364871 -
tttaataaaactatattaaa

SEQ ID NO: 32910 - DNA, 20 bp, Artificial Sequence
  Synthetic oligonucleotide; TAG chr11 5364854 5364873 5364857 -
attaaatggaaattcaccaa

SEQ ID NO: 32911 - DNA, 20 bp, Artificial Sequence
  Synthetic oligonucleotide; TAG chr11 5364846 5364865 5364849 -
gaaattcaccaatagaaact

SEQ ID NO: 32912 - DNA, 20 bp, Artificial Sequence
  Synthetic oligonucleotide; AGG chr11 5364845 5364864 5364848 -
aaattcaccaatagaaactt

SEQ ID NO: 32913 - DNA, 20 bp, Artificial Sequence
  Synthetic oligonucleotide; AAG chr11 5364841 5364860 5364844 -
tcaccaatagaaacttagga

SEQ ID NO: 32914 - DNA, 20 bp, Artificial Sequence
  Synthetic oligonucleotide; AGG chr11 5364840 5364859 5364843 -
caccaatagaaacttaggaa

SEQ ID NO: 32915 - DNA, 20 bp, Artificial Sequence
  Synthetic oligonucleotide; AAG chr11 5364832 5364851 5364835 -
gaaacttaggaaaggtaaca

SEQ ID NO: 32916 - DNA, 20 bp, Artificial Sequence
  Synthetic oligonucleotide; GAG chr11 5364823 5364842 5364826 -
gaaaggtaacaaagtcctgt

SEQ ID NO: 32917 - DNA, 20 bp, Artificial Sequence
  Synthetic oligonucleotide; AGG chr11 5364822 5364841 5364825 -
aaaggtaacaaagtcctgtg

SEQ ID NO: 32918 - DNA, 20 bp, Artificial Sequence
  Synthetic oligonucleotide; TGG chr11 5364818 5364837 5364821 -
gtaacaaagtcctgtgaggt

SEQ ID NO: 32919 - DNA, 20 bp, Artificial Sequence
  Synthetic oligonucleotide; CAG chr11 5364812 5364831 5364815 -
aagtcctgtgaggttggctt

SEQ ID NO: 32920 - DNA, 20 bp, Artificial Sequence
  Synthetic oligonucleotide; CAG chr11 5364803 5364822 5364806 -
gaggttggcttcagcatatc

SEQ ID NO: 32921 - DNA, 20 bp, Artificial Sequence
  Synthetic oligonucleotide; CAG chr11 5364790 5364809 5364793 -
gcatatccagaacacatgct

SEQ ID NO: 32922 - DNA, 20 bp, Artificial Sequence
  Synthetic oligonucleotide; AGG chr11 5364789 5364808 5364792 -
catatccagaacacatgctc

SEQ ID NO: 32923 - DNA, 20 bp, Artificial Sequence
  Synthetic oligonucleotide; AAG chr11 5364786 5364805 5364789 -
atccagaacacatgctcagg

SEQ ID NO: 32924 - DNA, 20 bp, Artificial Sequence
  Synthetic oligonucleotide; AGG chr11 5364785 5364804 5364788 -
tccagaacacatgctcagga

SEQ ID NO: 32925 - DNA, 20 bp, Artificial Sequence
  Synthetic oligonucleotide; AAG chr11 5364782 5364801 5364785 -
agaacacatgctcaggaagg

SEQ ID NO: 32926 - DNA, 20 bp, Artificial Sequence
  Synthetic oligonucleotide; GAG chr11 5364780 5364799 5364783 -
aacacatgctcaggaaggaa

SEQ ID NO: 32927 - DNA, 20 bp, Artificial Sequence
  Synthetic oligonucleotide; AGG chr11 5364779 5364798 5364782 -
acacatgctcaggaaggaag

SEQ ID NO: 32928 - DNA, 20 bp, Artificial Sequence
  Synthetic oligonucleotide; GGG chr11 5364778 5364797 5364781 -
cacatgctcaggaaggaaga

SEQ ID NO: 32929 - DNA, 20 bp, Artificial Sequence
  Synthetic oligonucleotide; TGG chr11 5364775 5364794 5364778 -
atgctcaggaaggaagaggg

SEQ ID NO: 32930 - DNA, 20 bp, Artificial Sequence
  Synthetic oligonucleotide; GGG chr11 5364774 5364793 5364777 -
tgctcaggaaggaagagggt

SEQ ID NO: 32931 - DNA, 20 bp, Artificial Sequence
  Synthetic oligonucleotide; GGG chr11 5364773 5364792 5364776 -
gctcaggaaggaagagggtg

SEQ ID NO: 32932 - DNA, 20 bp, Artificial Sequence
  Synthetic oligonucleotide; GGG chr11 5364772 5364791 5364775 -
ctcaggaaggaagagggtgg

SEQ ID NO: 32933 - DNA, 20 bp, Artificial Sequence
  Synthetic oligonucleotide; GGG chr11 5364771 5364790 5364774 -
tcaggaaggaagagggtggg

SEQ ID NO: 32934 - DNA, 20 bp, Artificial Sequence
  Synthetic oligonucleotide; AAG chr11 5364757 5364776 5364760 -
ggtggggggaccctgtaaac

SEQ ID NO: 32935 - DNA, 20 bp, Artificial Sequence
  Synthetic oligonucleotide; AGG chr11 5364756 5364775 5364759 -
gtggggggaccctgtaaaca

SEQ ID NO: 32936 - DNA, 20 bp, Artificial Sequence
  Synthetic oligonucleotide; GGG chr11 5364755 5364774 5364758 -
tggggggaccctgtaaacaa

SEQ ID NO: 32937 - DNA, 20 bp, Artificial Sequence
  Synthetic oligonucleotide; AAG chr11 5364733 5364752 5364736 -
gactttgatcattcactttg

SEQ ID NO: 32938 - DNA, 20 bp, Artificial Sequence
  Synthetic oligonucleotide; GAG chr11 5364731 5364750 5364734 -
ctttgatcattcactttgaa

SEQ ID NO: 32939 - DNA, 20 bp, Artificial Sequence
  Synthetic oligonucleotide; TGG chr11 5364713 5364732 5364716 -
aagagtcttctgtcatatgc

SEQ ID NO: 32940 - DNA, 20 bp, Artificial Sequence
  Synthetic oligonucleotide; TGG chr11 5364709 5364728 5364712 -
gtcttctgtcatatgctgga

SEQ ID NO: 32941 - DNA, 20 bp, Artificial Sequence
  Synthetic oligonucleotide; GGG chr11 5364708 5364727 5364711 -
tcttctgtcatatgctggat

SEQ ID NO: 32942 - DNA, 20 bp, Artificial Sequence
  Synthetic oligonucleotide; CAG chr11 5364701 5364720 5364704 -
tcatatgctggatgggcaaa

SEQ ID NO: 32943 - DNA, 20 bp, Artificial Sequence
  Synthetic oligonucleotide; TAG chr11 5364696 5364715 5364699 -
tgctggatgggcaaacagct

SEQ ID NO: 32944 - DNA, 20 bp, Artificial Sequence
  Synthetic oligonucleotide; GAG chr11 5364694 5364713 5364697 -
ctggatgggcaaacagctta

SEQ ID NO: 32945 - DNA, 20 bp, Artificial Sequence
  Synthetic oligonucleotide; AGG chr11 5364693 5364712 5364696 -
tggatgggcaaacagcttag

SEQ ID NO: 32946 - DNA, 20 bp, Artificial Sequence
  Synthetic oligonucleotide; GGG chr11 5364692 5364711 5364695 -
ggatgggcaaacagcttaga

SEQ ID NO: 32947 - DNA, 20 bp, Artificial Sequence
  Synthetic oligonucleotide; TAG chr11 5364683 5364702 5364686 -
aacagcttagagggctgcct

SEQ ID NO: 32948 - DNA, 20 bp, Artificial Sequence
  Synthetic oligonucleotide; GAG chr11 5364681 5364700 5364684 -
cagcttagagggctgcctta

SEQ ID NO: 32949 - DNA, 20 bp, Artificial Sequence
  Synthetic oligonucleotide; CAG chr11 5364668 5364687 5364671 -
tgccttagagtgcacaaaat

SEQ ID NO: 32950 - DNA, 20 bp, Artificial Sequence
  Synthetic oligonucleotide; GAG chr11 5364666 5364685 5364669 -
ccttagagtgcacaaaatca

SEQ ID NO: 32951 - DNA, 20 bp, Artificial Sequence
  Synthetic oligonucleotide; CAG chr11 5364658 5364677 5364661 -
tgcacaaaatcagagatatt

SEQ ID NO: 32952 - DNA, 20 bp, Artificial Sequence
  Synthetic oligonucleotide; GAG chr11 5364656 5364675 5364659 -
cacaaaatcagagatattca

SEQ ID NO: 32953 - DNA, 20 bp, Artificial Sequence
  Synthetic oligonucleotide; GAG chr11 5364645 5364664 5364648 -
agatattcagagatgcacat

SEQ ID NO: 32954 - DNA, 20 bp, Artificial Sequence
  Synthetic oligonucleotide; AGG chr11 5364644 5364663 5364647 -
gatattcagagatgcacatg

SEQ ID NO: 32955 - DNA, 20 bp, Artificial Sequence
  Synthetic oligonucleotide; TGG chr11 5364640 5364659 5364643 -
ttcagagatgcacatgagga

SEQ ID NO: 32956 - DNA, 20 bp, Artificial Sequence
  Synthetic oligonucleotide; GAG chr11 5364638 5364657 5364641 -
cagagatgcacatgaggatg

SEQ ID NO: 32957 - DNA, 20 bp, Artificial Sequence
  Synthetic oligonucleotide; GAG chr11 5364634 5364653 5364637 -
gatgcacatgaggatggagt

SEQ ID NO: 32958 - DNA, 20 bp, Artificial Sequence
  Synthetic oligonucleotide; AAG chr11 5364631 5364650 5364634 -
gcacatgaggatggagtgag

SEQ ID NO: 32959 - DNA, 20 bp, Artificial Sequence
  Synthetic oligonucleotide; GAG chr11 5364629 5364648 5364632 -
acatgaggatggagtgagaa

SEQ ID NO: 32960 - DNA, 20 bp, Artificial Sequence
  Synthetic oligonucleotide; AGG chr11 5364628 5364647 5364631 -
catgaggatggagtgagaag

SEQ ID NO: 32961 - DNA, 20 bp, Artificial Sequence
  Synthetic oligonucleotide; AAG chr11 5364625 5364644 5364628 -
gaggatggagtgagaagagg

SEQ ID NO: 32962 - DNA, 20 bp, Artificial Sequence
  Synthetic oligonucleotide; GAG chr11 5364623 5364642 5364626 -
ggatggagtgagaagaggaa

SEQ ID NO: 32963 - DNA, 20 bp, Artificial Sequence
  Synthetic oligonucleotide; GAG chr11 5364621 5364640 5364624 -
atggagtgagaagaggaaga

SEQ ID NO: 32964 - DNA, 20 bp, Artificial Sequence
  Synthetic oligonucleotide; GAG chr11 5364619 5364638 5364622 -
ggagtgagaagaggaagaga

SEQ ID NO: 32965 - DNA, 20 bp, Artificial Sequence
  Synthetic oligonucleotide; TAG chr11 5364594 5364613 5364597 -
acataaatacctctcacgct

SEQ ID NO: 32966 - DNA, 20 bp, Artificial Sequence
  Synthetic oligonucleotide; CAG chr11 5364572 5364591 5364575 -
gtttattttttcatttaata

SEQ ID NO: 32967 - DNA, 20 bp, Artificial Sequence
  Synthetic oligonucleotide; AAG chr11 5364559 5364578 5364562 -
tttaatacagaatatttttt

SEQ ID NO: 32968 - DNA, 20 bp, Artificial Sequence
  Synthetic oligonucleotide; AAG chr11 5364541 5364560 5364544 -
ttaagctcctactctcttca

SEQ ID NO: 32969 - DNA, 20 bp, Artificial Sequence
  Synthetic oligonucleotide; AAG chr11 5364527 5364546 5364530 -
tcttcaaagcactgtgctta

SEQ ID NO: 32970 - DNA, 20 bp, Artificial Sequence
  Synthetic oligonucleotide; TGG chr11 5364523 5364542 5364526 -
caaagcactgtgcttaaagc

SEQ ID NO: 32971 - DNA, 20 bp, Artificial Sequence
  Synthetic oligonucleotide; TAG chr11 5364516 5364535 5364519 -
ctgtgcttaaagctggcatg

SEQ ID NO: 32972 - DNA, 20 bp, Artificial Sequence
  Synthetic oligonucleotide; TAG chr11 5364504 5364523 5364507 -
ctggcatgtagttgaattta

SEQ ID NO: 32973 - DNA, 20 bp, Artificial Sequence
  Synthetic oligonucleotide; CAG chr11 5364499 5364518 5364502 -
atgtagttgaatttatagtc

SEQ ID NO: 32974 - DNA, 20 bp, Artificial Sequence
  Synthetic oligonucleotide; AAG chr11 5364495 5364514 5364498 -
agttgaatttatagtccagc

SEQ ID NO: 32975 - DNA, 20 bp, Artificial Sequence
  Synthetic oligonucleotide; AGG chr11 5364494 5364513 5364497 -
gttgaatttatagtccagca

SEQ ID NO: 32976 - DNA, 20 bp, Artificial Sequence
  Synthetic oligonucleotide; GAG chr11 5364492 5364511 5364495 -
tgaatttatagtccagcaag

SEQ ID NO: 32977 - DNA, 20 bp, Artificial Sequence
  Synthetic oligonucleotide; GAG chr11 5364479 5364498 5364482 -
cagcaaggagactgaccatt

SEQ ID NO: 32978 - DNA, 20 bp, Artificial Sequence
  Synthetic oligonucleotide; TGG chr11 5364465 5364484 5364468 -
accattgagaattacaaata

SEQ ID NO: 32979 - DNA, 20 bp, Artificial Sequence
  Synthetic oligonucleotide; CAG chr11 5364462 5364481 5364465 -
attgagaattacaaatatgg

SEQ ID NO: 32980 - DNA, 20 bp, Artificial Sequence
  Synthetic oligonucleotide; AGG chr11 5364461 5364480 5364464 -
ttgagaattacaaatatggc

SEQ ID NO: 32981 - DNA, 20 bp, Artificial Sequence
  Synthetic oligonucleotide; CAG chr11 5364448 5364467 5364451 -
atatggcaggaatttctaaa

SEQ ID NO: 32982 - DNA, 20 bp, Artificial Sequence
  Synthetic oligonucleotide; AAG chr11 5364444 5364463 5364447 -
ggcaggaatttctaaacaga

SEQ ID NO: 32983 - DNA, 20 bp, Artificial Sequence
  Synthetic oligonucleotide; CAG chr11 5364436 5364455 5364439 -
tttctaaacagaaagatgtg

SEQ ID NO: 32984 - DNA, 20 bp, Artificial Sequence
  Synthetic oligonucleotide; CAG chr11 5364417 5364436 5364420 -
gcagctctcatatcctgtca

SEQ ID NO: 32985 - DNA, 20 bp, Artificial Sequence
  Synthetic oligonucleotide; TAG chr11 5364399 5364418 5364402 -
cacagaaatgacacatcaca

SEQ ID NO: 32986 - DNA, 20 bp, Artificial Sequence
  Synthetic oligonucleotide; TAG chr11 5364380 5364399 5364383 -
atagctcctaaactgcatca

SEQ ID NO: 32987 - DNA, 20 bp, Artificial Sequence
  Synthetic oligonucleotide; TGG chr11 5364349 5364368 5364352 -
tgacctcctgtttctgcatt

SEQ ID NO: 32988 - DNA, 20 bp, Artificial Sequence
  Synthetic oligonucleotide; TGG chr11 5364318 5364337 5364321 -
catatcaccccaaattccaa

SEQ ID NO: 32989 - DNA, 20 bp, Artificial Sequence
  Synthetic oligonucleotide; AAG chr11 5364308 5364327 5364311 -
caaattccaatggttttgtg

SEQ ID NO: 32990 - DNA, 20 bp, Artificial Sequence
  Synthetic oligonucleotide; AAG chr11 5364303 5364322 5364306 -
tccaatggttttgtgaagtc

SEQ ID NO: 32991 - DNA, 20 bp, Artificial Sequence
  Synthetic oligonucleotide; TGG chr11 5364298 5364317 5364301 -
tggttttgtgaagtcaagat

SEQ ID NO: 32992 - DNA, 20 bp, Artificial Sequence
  Synthetic oligonucleotide; TGG chr11 5364295 5364314 5364298 -
ttttgtgaagtcaagattgg

SEQ ID NO: 32993 - DNA, 20 bp, Artificial Sequence
  Synthetic oligonucleotide; AAG chr11 5364290 5364309 5364293 -
tgaagtcaagattggtggtc

SEQ ID NO: 32994 - DNA, 20 bp, Artificial Sequence
  Synthetic oligonucleotide; AGG chr11 5364289 5364308 5364292 -
gaagtcaagattggtggtca

SEQ ID NO: 32995 - DNA, 20 bp, Artificial Sequence
  Synthetic oligonucleotide; GAG chr11 5364284 5364303 5364287 -
caagattggtggtcaaggtc

SEQ ID NO: 32996 - DNA, 20 bp, Artificial Sequence
  Synthetic oligonucleotide; AGG chr11 5364283 5364302 5364286 -
aagattggtggtcaaggtcg

SEQ ID NO: 32997 - DNA, 20 bp, Artificial Sequence
  Synthetic oligonucleotide; GGG chr11 5364282 5364301 5364285 -
agattggtggtcaaggtcga

SEQ ID NO: 32998 - DNA, 20 bp, Artificial Sequence
  Synthetic oligonucleotide; AAG chr11 5364278 5364297 5364281 -
tggtggtcaaggtcgaggga

SEQ ID NO: 32999 - DNA, 20 bp, Artificial Sequence
  Synthetic oligonucleotide; CAG chr11 5364271 5364290 5364274 -
caaggtcgagggaaagtgca

SEQ ID NO: 33000 - DNA, 20 bp, Artificial Sequence
  Synthetic oligonucleotide; AAG chr11 5364263 5364282 5364266 -
agggaaagtgcacagatcaa

SEQ ID NO: 33001 - DNA, 20 bp, Artificial Sequence
  Synthetic oligonucleotide; TAG chr11 5364233 5364252 5364236 -
aactatgtcaaactttgtca

SEQ ID NO: 33002 - DNA, 20 bp, Artificial Sequence
  Synthetic oligonucleotide; TAG chr11 5364229 5364248 5364232 -
atgtcaaactttgtcatagc

SEQ ID NO: 33003 - DNA, 20 bp, Artificial Sequence
  Synthetic oligonucleotide; GAG chr11 5364224 5364243 5364227 -
aaactttgtcatagctagat

SEQ ID NO: 33004 - DNA, 20 bp, Artificial Sequence
  Synthetic oligonucleotide; AAG chr11 5364208 5364227 5364211 -
agatgagctttttgaactta

SEQ ID NO: 33005 - DNA, 20 bp, Artificial Sequence
  Synthetic oligonucleotide; TAG chr11 5364193 5364212 5364196 -
acttaaagtttgtcaaaatt

SEQ ID NO: 33006 - DNA, 20 bp, Artificial Sequence
  Synthetic oligonucleotide; AGG chr11 5364192 5364211 5364195 -
cttaaagtttgtcaaaattt

SEQ ID NO: 33007 - DNA, 20 bp, Artificial Sequence
  Synthetic oligonucleotide; TAG chr11 5364174 5364193 5364177 -
ttaggaaaatattttgccct

SEQ ID NO: 33008 - DNA, 20 bp, Artificial Sequence
  Synthetic oligonucleotide; AGG chr11 5364173 5364192 5364176 -
taggaaaatattttgccctt

SEQ ID NO: 33009 - DNA, 20 bp, Artificial Sequence
  Synthetic oligonucleotide; TGG chr11 5364170 5364189 5364173 -
gaaaatattttgcccttagg

SEQ ID NO: 33010 - DNA, 20 bp, Artificial Sequence
  Synthetic oligonucleotide; TAG chr11 5364132 5364151 5364135 -
tgaaaattttactctttctt

SEQ ID NO: 33011 - DNA, 20 bp, Artificial Sequence
  Synthetic oligonucleotide; GAG chr11 5364125 5364144 5364128 -
tttactctttctttagtgtt

SEQ ID NO: 33012 - DNA, 20 bp, Artificial Sequence
  Synthetic oligonucleotide; TGG chr11 5364077 5364096 5364080 -
aatcgaccttattgcaacca

SEQ ID NO: 33013 - DNA, 20 bp, Artificial Sequence
  Synthetic oligonucleotide; GAG chr11 5364075 5364094 5364078 -
tcgaccttattgcaaccatg

SEQ ID NO: 33014 - DNA, 20 bp, Artificial Sequence
  Synthetic oligonucleotide; GAG chr11 5364069 5364088 5364072 -
ttattgcaaccatggagaat

SEQ ID NO: 33015 - DNA, 20 bp, Artificial Sequence
  Synthetic oligonucleotide; TAG chr11 5364065 5364084 5364068 -
tgcaaccatggagaatgaga

SEQ ID NO: 33016 - DNA, 20 bp, Artificial Sequence
  Synthetic oligonucleotide; TGG chr11 5364058 5364077 5364061 -
atggagaatgagatagtacc

SEQ ID NO: 33017 - DNA, 20 bp, Artificial Sequence
  Synthetic oligonucleotide; CAG chr11 5364053 5364072 5364056 -
gaatgagatagtacctggct

SEQ ID NO: 33018 - DNA, 20 bp, Artificial Sequence
  Synthetic oligonucleotide; GAG chr11 5364051 5364070 5364054 -
atgagatagtacctggctca

SEQ ID NO: 33019 - DNA, 20 bp, Artificial Sequence
  Synthetic oligonucleotide; AGG chr11 5364050 5364069 5364053 -
tgagatagtacctggctcag

SEQ ID NO: 33020 - DNA, 20 bp, Artificial Sequence
  Synthetic oligonucleotide; TGG chr11 5364029 5364048 5364032 -
ggtccacatcacataatatg

SEQ ID NO: 33021 - DNA, 20 bp, Artificial Sequence
  Synthetic oligonucleotide; GGG chr11 5364028 5364047 5364031 -
gtccacatcacataatatgt

SEQ ID NO: 33022 - DNA, 20 bp, Artificial Sequence
  Synthetic oligonucleotide; AAG chr11 5364001 5364020 5364004 -
tctatcactacactgttgtg

SEQ ID NO: 33023 - DNA, 20 bp, Artificial Sequence
  Synthetic oligonucleotide; CAG chr11 5363988 5364007 5363991 -
tgttgtgaagccctgttctc

SEQ ID NO: 33024 - DNA, 20 bp, Artificial Sequence
  Synthetic oligonucleotide; CAG chr11 5363983 5364002 5363986 -
tgaagccctgttctccagcc

SEQ ID NO: 33025 - DNA, 20 bp, Artificial Sequence
  Synthetic oligonucleotide; AGG chr11 5363982 5364001 5363985 -
gaagccctgttctccagccc

SEQ ID NO: 33026 - DNA, 20 bp, Artificial Sequence
  Synthetic oligonucleotide; AAG chr11 5363959 5363978 5363962 -
cattcttccattcctaacac

SEQ ID NO: 33027 - DNA, 20 bp, Artificial Sequence
  Synthetic oligonucleotide; CAG chr11 5363942 5363961 5363945 -
cacaagcttctcctccttta

SEQ ID NO: 33028 - DNA, 20 bp, Artificial Sequence
  Synthetic oligonucleotide; TGG chr11 5363936 5363955 5363939 -
cttctcctcctttacagaaa

SEQ ID NO: 33029 - DNA, 20 bp, Artificial Sequence
  Synthetic oligonucleotide; GGG chr11 5363935 5363954 5363938 -
ttctcctcctttacagaaat

SEQ ID NO: 33030 - DNA, 20 bp, Artificial Sequence
  Synthetic oligonucleotide; GAG chr11 5363929 5363948 5363932 -
tcctttacagaaatgggtct

SEQ ID NO: 33031 - DNA, 20 bp, Artificial Sequence
  Synthetic oligonucleotide; GAG chr11 5363895 5363914 5363898 -
tatacctgccatgtcatgct

SEQ ID NO: 33032 - DNA, 20 bp, Artificial Sequence
  Synthetic oligonucleotide; TGG chr11 5363892 5363911 5363895 -
acctgccatgtcatgctgag

SEQ ID NO: 33033 - DNA, 20 bp, Artificial Sequence
  Synthetic oligonucleotide; GGG chr11 5363891 5363910 5363894 -
cctgccatgtcatgctgagt

SEQ ID NO: 33034 - DNA, 20 bp, Artificial Sequence
  Synthetic oligonucleotide; GGG chr11 5363890 5363909 5363893 -
ctgccatgtcatgctgagtg

SEQ ID NO: 33035 - DNA, 20 bp, Artificial Sequence
  Synthetic oligonucleotide; GGG chr11 5363889 5363908 5363892 -
tgccatgtcatgctgagtgg

SEQ ID NO: 33036 - DNA, 20 bp, Artificial Sequence
  Synthetic oligonucleotide; TGG chr11 5363885 5363904 5363888 -
atgtcatgctgagtgggggc

SEQ ID NO: 33037 - DNA, 20 bp, Artificial Sequence
  Synthetic oligonucleotide; GGG chr11 5363884 5363903 5363887 -
tgtcatgctgagtgggggct

SEQ ID NO: 33038 - DNA, 20 bp, Artificial Sequence
  Synthetic oligonucleotide; GGG chr11 5363883 5363902 5363886 -
gtcatgctgagtgggggctg

SEQ ID NO: 33039 - DNA, 20 bp, Artificial Sequence
  Synthetic oligonucleotide; AAG chr11 5363874 5363893 5363877 -
agtgggggctggggtttgca

SEQ ID NO: 33040 - DNA, 20 bp, Artificial Sequence
  Synthetic oligonucleotide; GAG chr11 5363872 5363891 5363875 -
tgggggctggggtttgcaaa

SEQ ID NO: 33041 - DNA, 20 bp, Artificial Sequence
  Synthetic oligonucleotide; GAG chr11 5363870 5363889 5363873 -
ggggctggggtttgcaaaga

SEQ ID NO: 33042 - DNA, 20 bp, Artificial Sequence
  Synthetic oligonucleotide; AAG chr11 5363867 5363886 5363870 -
gctggggtttgcaaagagag

SEQ ID NO: 33043 - DNA, 20 bp, Artificial Sequence
  Synthetic oligonucleotide; CAG chr11 5363863 5363882 5363866 -
gggtttgcaaagagagaaga

SEQ ID NO: 33044 - DNA, 20 bp, Artificial Sequence
  Synthetic oligonucleotide; TAG chr11 5363859 5363878 5363862 -
ttgcaaagagagaagacagc

SEQ ID NO: 33045 - DNA, 20 bp, Artificial Sequence
  Synthetic oligonucleotide; AGG chr11 5363858 5363877 5363861 -
tgcaaagagagaagacagct

SEQ ID NO: 33046 - DNA, 20 bp, Artificial Sequence
  Synthetic oligonucleotide; GGG chr11 5363857 5363876 5363860 -
gcaaagagagaagacagcta

SEQ ID NO: 33047 - DNA, 20 bp, Artificial Sequence
  Synthetic oligonucleotide; TGG chr11 5363841 5363860 5363844 -
gctagggaacataattgcta

SEQ ID NO: 33048 - DNA, 20 bp, Artificial Sequence
  Synthetic oligonucleotide; TAG chr11 5363811 5363830 5363814 -
tttctattgtacactaaata

SEQ ID NO: 33049 - DNA, 20 bp, Artificial Sequence
  Synthetic oligonucleotide; TGG chr11 5363806 5363825 5363809 -
attgtacactaaatatagtc

SEQ ID NO: 33050 - DNA, 20 bp, Artificial Sequence
  Synthetic oligonucleotide; TGG chr11 5363791 5363810 5363794 -
tagtctggatgtattgcata

SEQ ID NO: 33051 - DNA, 20 bp, Artificial Sequence
  Synthetic oligonucleotide; TAG chr11 5363784 5363803 5363787 -
gatgtattgcatatggtccc

SEQ ID NO: 33052 - DNA, 20 bp, Artificial Sequence
  Synthetic oligonucleotide; TAG chr11 5363774 5363793 5363777 -
atatggtccctagtttttaa

SEQ ID NO: 33053 - DNA, 20 bp, Artificial Sequence
  Synthetic oligonucleotide; CAG chr11 5363733 5363752 5363736 -
actttcccgctttccaataa

SEQ ID NO: 33054 - DNA, 20 bp, Artificial Sequence
  Synthetic oligonucleotide; TGG chr11 5363725 5363744 5363728 -
gctttccaataacagaatga

SEQ ID NO: 33055 - DNA, 20 bp, Artificial Sequence
  Synthetic oligonucleotide; AAG chr11 5363721 5363740 5363724 -
tccaataacagaatgatgga

SEQ ID NO: 33056 - DNA, 20 bp, Artificial Sequence
  Synthetic oligonucleotide; AAG chr11 5363710 5363729 5363713 -
aatgatggaaagaccttcac

SEQ ID NO: 33057 - DNA, 20 bp, Artificial Sequence
  Synthetic oligonucleotide; AAG chr11 5363698 5363717 5363701 -
accttcacaagtccaaacac

SEQ ID NO: 33058 - DNA, 20 bp, Artificial Sequence
  Synthetic oligonucleotide; TGG chr11 5363691 5363710 5363694 -
caagtccaaacacaagcaaa

SEQ ID NO: 33059 - DNA, 20 bp, Artificial Sequence
  Synthetic oligonucleotide; TGG chr11 5363683 5363702 5363686 -
aacacaagcaaatggccaaa

SEQ ID NO: 33060 - DNA, 20 bp, Artificial Sequence
  Synthetic oligonucleotide; CAG chr11 5363680 5363699 5363683 -
acaagcaaatggccaaatgg

SEQ ID NO: 33061 - DNA, 20 bp, Artificial Sequence
  Synthetic oligonucleotide; GAG chr11 5363678 5363697 5363681 -
aagcaaatggccaaatggca

SEQ ID NO: 33062 - DNA, 20 bp, Artificial Sequence
  Synthetic oligonucleotide; AAG chr11 5363653 5363672 5363656 -
gttctttttctgtgtcacat

SEQ ID NO: 33063 - DNA, 20 bp, Artificial Sequence
  Synthetic oligonucleotide; CAG chr11 5363646 5363665 5363649 -
ttctgtgtcacataagattc

SEQ ID NO: 33064 - DNA, 20 bp, Artificial Sequence
  Synthetic oligonucleotide; TAG chr11 5363631 5363650 5363634 -
gattccagacaatataatct

SEQ ID NO: 33065 - DNA, 20 bp, Artificial Sequence
  Synthetic oligonucleotide; TAG chr11 5363628 5363647 5363631 -
tccagacaatataatcttag

SEQ ID NO: 33066 - DNA, 20 bp, Artificial Sequence
  Synthetic oligonucleotide; GAG chr11 5363618 5363637 5363621 -
ataatcttagtagtatctat

SEQ ID NO: 33067 - DNA, 20 bp, Artificial Sequence
  Synthetic oligonucleotide; TGG chr11 5363567 5363586 5363570 -
tgcattcacactcaaaaact

SEQ ID NO: 33068 - DNA, 20 bp, Artificial Sequence
  Synthetic oligonucleotide; TGG chr11 5363554 5363573 5363557 -
aaaaacttggtatctgtgct

SEQ ID NO: 33069 - DNA, 20 bp, Artificial Sequence
  Synthetic oligonucleotide; AAG chr11 5363543 5363562 5363546 -
atctgtgcttggtttaataa

SEQ ID NO: 33070 - DNA, 20 bp, Artificial Sequence
  Synthetic oligonucleotide; TAG chr11 5363540 5363559 5363543 -
tgtgcttggtttaataaaag

SEQ ID NO: 33071 - DNA, 20 bp, Artificial Sequence
  Synthetic oligonucleotide; GAG chr11 5363536 5363555 5363539 -
cttggtttaataaaagtagt

SEQ ID NO: 33072 - DNA, 20 bp, Artificial Sequence
  Synthetic oligonucleotide; TGG chr11 5363524 5363543 5363527 -
aaagtagtgagtgtacctca

SEQ ID NO: 33073 - DNA, 20 bp, Artificial Sequence
  Synthetic oligonucleotide; GAG chr11 5363522 5363541 5363525 -
agtagtgagtgtacctcatg

SEQ ID NO: 33074 - DNA, 20 bp, Artificial Sequence
  Synthetic oligonucleotide; GAG chr11 5363517 5363536 5363520 -
tgagtgtacctcatggagct

SEQ ID NO: 33075 - DNA, 20 bp, Artificial Sequence
  Synthetic oligonucleotide; TGG chr11 5363514 5363533 5363517 -
gtgtacctcatggagctgag

SEQ ID NO: 33076 - DNA, 20 bp, Artificial Sequence
  Synthetic oligonucleotide; TGG chr11 5363511 5363530 5363514 -
tacctcatggagctgagtgg

SEQ ID NO: 33077 - DNA, 20 bp, Artificial Sequence
  Synthetic oligonucleotide; TGG chr11 5363483 5363502 5363486 -
tgtgtttatgattgtgtgtg

SEQ ID NO: 33078 - DNA, 20 bp, Artificial Sequence
  Synthetic oligonucleotide; GAG chr11 5363469 5363488 5363472 -
tgtgtgtggcgcttttgtgt

SEQ ID NO: 33079 - DNA, 20 bp, Artificial Sequence
  Synthetic oligonucleotide; GAG chr11 5363467 5363486 5363470 -
tgtgtggcgcttttgtgtga

SEQ ID NO: 33080 - DNA, 20 bp, Artificial Sequence
  Synthetic oligonucleotide; GAG chr11 5363465 5363484 5363468 -
tgtggcgcttttgtgtgaga

SEQ ID NO: 33081 - DNA, 20 bp, Artificial Sequence
  Synthetic oligonucleotide; GAG chr11 5363463 5363482 5363466 -
tggcgcttttgtgtgagaga

SEQ ID NO: 33082 - DNA, 20 bp, Artificial Sequence
  Synthetic oligonucleotide; GAG chr11 5363461 5363480 5363464 -
gcgcttttgtgtgagagaga

SEQ ID NO: 33083 - DNA, 20 bp, Artificial Sequence
  Synthetic oligonucleotide; AAG chr11 5363440 5363459 5363443 -
agtgtgtgtgtatgtgtgtc

SEQ ID NO: 33084 - DNA, 20 bp, Artificial Sequence
  Synthetic oligonucleotide; GAG chr11 5363438 5363457 5363441 -
tgtgtgtgtatgtgtgtcaa

SEQ ID NO: 33085 - DNA, 20 bp, Artificial Sequence
  Synthetic oligonucleotide; AGG chr11 5363437 5363456 5363440 -
gtgtgtgtatgtgtgtcaag

SEQ ID NO: 33086 - DNA, 20 bp, Artificial Sequence
  Synthetic oligonucleotide; AAG chr11 5363432 5363451 5363435 -
tgtatgtgtgtcaagaggtt

SEQ ID NO: 33087 - DNA, 20 bp, Artificial Sequence
  Synthetic oligonucleotide; AGG chr11 5363431 5363450 5363434 -
gtatgtgtgtcaagaggtta

SEQ ID NO: 33088 - DNA, 20 bp, Artificial Sequence
  Synthetic oligonucleotide; GGG chr11 5363430 5363449 5363433 -
tatgtgtgtcaagaggttaa

SEQ ID NO: 33089 - DNA, 20 bp, Artificial Sequence
  Synthetic oligonucleotide; AAG chr11 5363423 5363442 5363426 -
gtcaagaggttaagggctta

SEQ ID NO: 33090 - DNA, 20 bp, Artificial Sequence
  Synthetic oligonucleotide; AGG chr11 5363422 5363441 5363425 -
tcaagaggttaagggcttaa

SEQ ID NO: 33091 - DNA, 20 bp, Artificial Sequence
  Synthetic oligonucleotide; TGG chr11 5363409 5363428 5363412 -
ggcttaaaggaacaattaat

SEQ ID NO: 33092 - DNA, 20 bp, Artificial Sequence
  Synthetic oligonucleotide; TAG chr11 5363402 5363421 5363405 -
aggaacaattaattggtgat

SEQ ID NO: 33093 - DNA, 20 bp, Artificial Sequence
  Synthetic oligonucleotide; AGG chr11 5363401 5363420 5363404 -
ggaacaattaattggtgatt

SEQ ID NO: 33094 - DNA, 20 bp, Artificial Sequence
  Synthetic oligonucleotide; TAG chr11 5363380 5363399 5363383 -
ggatcatgtactcaacacca

SEQ ID NO: 33095 - DNA, 20 bp, Artificial Sequence
  Synthetic oligonucleotide; AAG chr11 5363373 5363392 5363376 -
gtactcaacaccatagcttg

SEQ ID NO: 33096 - DNA, 20 bp, Artificial Sequence
  Synthetic oligonucleotide; CGG chr11 5363289 5363308 5363292 -
aacgatgtctgtccactcac

SEQ ID NO: 33097 - DNA, 20 bp, Artificial Sequence
  Synthetic oligonucleotide; GAG chr11 5363239 5363258 5363242 -
gtgtgtgtgtgtgtgtgtgt

SEQ ID NO: 33098 - DNA, 20 bp, Artificial Sequence
  Synthetic oligonucleotide; AGG chr11 5363238 5363257 5363241 -
tgtgtgtgtgtgtgtgtgtg

SEQ ID NO: 33099 - DNA, 20 bp, Artificial Sequence
  Synthetic oligonucleotide; GGG chr11 5363237 5363256 5363240 -
gtgtgtgtgtgtgtgtgtga

SEQ ID NO: 33100 - DNA, 20 bp, Artificial Sequence
  Synthetic oligonucleotide; GGG chr11 5363236 5363255 5363239 -
tgtgtgtgtgtgtgtgtgag

SEQ ID NO: 33101 - DNA, 20 bp, Artificial Sequence
  Synthetic oligonucleotide; TGG chr11 5363232 5363251 5363235 -
tgtgtgtgtgtgtgaggggt

SEQ ID NO: 33102 - DNA, 20 bp, Artificial Sequence
  Synthetic oligonucleotide; GGG chr11 5363231 5363250 5363234 -
gtgtgtgtgtgtgaggggtt

SEQ ID NO: 33103 - DNA, 20 bp, Artificial Sequence
  Synthetic oligonucleotide; TGG chr11 5363221 5363240 5363224 -
gtgaggggttgggttcgttg

SEQ ID NO: 33104 - DNA, 20 bp, Artificial Sequence
  Synthetic oligonucleotide; GGG chr11 5363220 5363239 5363223 -
tgaggggttgggttcgttgt

SEQ ID NO: 33105 - DNA, 20 bp, Artificial Sequence
  Synthetic oligonucleotide; GGG chr11 5363219 5363238 5363222 -
gaggggttgggttcgttgtg

SEQ ID NO: 33106 - DNA, 20 bp, Artificial Sequence
  Synthetic oligonucleotide; GAG chr11 5363208 5363227 5363211 -
ttcgttgtggggaaacactt

SEQ ID NO: 33107 - DNA, 20 bp, Artificial Sequence
  Synthetic oligonucleotide; CAG chr11 5363177 5363196 5363180 -
ttgatgaaaaatgatttctc

SEQ ID NO: 33108 - DNA, 20 bp, Artificial Sequence
  Synthetic oligonucleotide; GAG chr11 5363148 5363167 5363151 -
cattctgttcgtaaaacttt

SEQ ID NO: 33109 - DNA, 20 bp, Artificial Sequence
  Synthetic oligonucleotide; AAG chr11 5363140 5363159 5363143 -
tcgtaaaactttgagttttg

SEQ ID NO: 33110 - DNA, 20 bp, Artificial Sequence
  Synthetic oligonucleotide; CAG chr11 5363132 5363151 5363135 -
ctttgagttttgaagacact

SEQ ID NO: 33111 - DNA, 20 bp, Artificial Sequence
  Synthetic oligonucleotide; AGG chr11 5363131 5363150 5363134 -
tttgagttttgaagacactc

SEQ ID NO: 33112 - DNA, 20 bp, Artificial Sequence
  Synthetic oligonucleotide; GGG chr11 5363130 5363149 5363133 -
ttgagttttgaagacactca

SEQ ID NO: 33113 - DNA, 20 bp, Artificial Sequence
  Synthetic oligonucleotide; AAG chr11 5363112 5363131 5363115 -
cagggtctctttcttccctt

SEQ ID NO: 33114 - DNA, 20 bp, Artificial Sequence
  Synthetic oligonucleotide; TGG chr11 5363099 5363118 5363102 -
ttcccttaagctttctctca

SEQ ID NO: 33115 - DNA, 20 bp, Artificial Sequence
  Synthetic oligonucleotide; GAG chr11 5363097 5363116 5363100 -
cccttaagctttctctcatg

SEQ ID NO: 33116 - DNA, 20 bp, Artificial Sequence
  Synthetic oligonucleotide; AGG chr11 5363096 5363115 5363099 -
ccttaagctttctctcatgg

SEQ ID NO: 33117 - DNA, 20 bp, Artificial Sequence
  Synthetic oligonucleotide; CAG chr11 5363084 5363103 5363087 -
tctcatggaggaatgccact

SEQ ID NO: 33118 - DNA, 20 bp, Artificial Sequence
  Synthetic oligonucleotide; TAG chr11 5363072 5363091 5363075 -
atgccactcagacatctact

SEQ ID NO: 33119 - DNA, 20 bp, Artificial Sequence
  Synthetic oligonucleotide; TGG chr11 5363043 5363062 5363046 -
ttacaacacttgcatttcct

SEQ ID NO: 33120 - DNA, 20 bp, Artificial Sequence
  Synthetic oligonucleotide; GGG chr11 5363042 5363061 5363045 -
tacaacacttgcatttcctt

SEQ ID NO: 33121 - DNA, 20 bp, Artificial Sequence
  Synthetic oligonucleotide; AAG chr11 5362944 5362963 5362947 -
catacatctgcatttattat

SEQ ID NO: 33122 - DNA, 20 bp, Artificial Sequence
  Synthetic oligonucleotide; CAG chr11 5362938 5362957 5362941 -
tctgcatttattataagcaa

SEQ ID NO: 33123 - DNA, 20 bp, Artificial Sequence
  Synthetic oligonucleotide; AGG chr11 5362937 5362956 5362940 -
ctgcatttattataagcaac

SEQ ID NO: 33124 - DNA, 20 bp, Artificial Sequence
  Synthetic oligonucleotide; CGG chr11 5362934 5362953 5362937 -
catttattataagcaacagg

SEQ ID NO: 33125 - DNA, 20 bp, Artificial Sequence
  Synthetic oligonucleotide; GGG chr11 5362933 5362952 5362936 -
atttattataagcaacaggc

SEQ ID NO: 33126 - DNA, 20 bp, Artificial Sequence
  Synthetic oligonucleotide; CAG chr11 5362923 5362942 5362926 -
agcaacaggcgggacacttc

SEQ ID NO: 33127 - DNA, 20 bp, Artificial Sequence
  Synthetic oligonucleotide; TAG chr11 5362917 5362936 5362920 -
aggcgggacacttccagcaa

SEQ ID NO: 33128 - DNA, 20 bp, Artificial Sequence
  Synthetic oligonucleotide; AAG chr11 5362913 5362932 5362916 -
gggacacttccagcaataga

SEQ ID NO: 33129 - DNA, 20 bp, Artificial Sequence
  Synthetic oligonucleotide; AAG chr11 5362894 5362913 5362897 -
aaagaaaacttaatttacaa

SEQ ID NO: 33130 - DNA, 20 bp, Artificial Sequence
  Synthetic oligonucleotide; CAG chr11 5362891 5362910 5362894 -
gaaaacttaatttacaaaag

SEQ ID NO: 33131 - DNA, 20 bp, Artificial Sequence
  Synthetic oligonucleotide; AGG chr11 5362890 5362909 5362893 -
aaaacttaatttacaaaagc

SEQ ID NO: 33132 - DNA, 20 bp, Artificial Sequence
  Synthetic oligonucleotide; GGG chr11 5362889 5362908 5362892 -
aaacttaatttacaaaagca

SEQ ID NO: 33133 - DNA, 20 bp, Artificial Sequence
  Synthetic oligonucleotide; CAG chr11 5362883 5362902 5362886 -
aatttacaaaagcagggatt

SEQ ID NO: 33134 - DNA, 20 bp, Artificial Sequence
  Synthetic oligonucleotide; AAG chr11 5362878 5362897 5362881 -
acaaaagcagggattcagtg

SEQ ID NO: 33135 - DNA, 20 bp, Artificial Sequence
  Synthetic oligonucleotide; TGG chr11 5362870 5362889 5362873 -
agggattcagtgaagccacc

SEQ ID NO: 33136 - DNA, 20 bp, Artificial Sequence
  Synthetic oligonucleotide; TGG chr11 5362857 5362876 5362860 -
agccacctggttgttactct

SEQ ID NO: 33137 - DNA, 20 bp, Artificial Sequence
  Synthetic oligonucleotide; GGG chr11 5362856 5362875 5362859 -
gccacctggttgttactctt

SEQ ID NO: 33138 - DNA, 20 bp, Artificial Sequence
  Synthetic oligonucleotide; TAG chr11 5362843 5362862 5362846 -
tactcttgggcactcacatg

SEQ ID NO: 33139 - DNA, 20 bp, Artificial Sequence
  Synthetic oligonucleotide; CAG chr11 5362831 5362850 5362834 -
ctcacatgtagatgccaacc

SEQ ID NO: 33140 - DNA, 20 bp, Artificial Sequence
  Synthetic oligonucleotide; GAG chr11 5362829 5362848 5362832 -
cacatgtagatgccaaccca

SEQ ID NO: 33141 - DNA, 20 bp, Artificial Sequence
  Synthetic oligonucleotide; CAG chr11 5362823 5362842 5362826 -
tagatgccaacccagagcat

SEQ ID NO: 33142 - DNA, 20 bp, Artificial Sequence
  Synthetic oligonucleotide; AGG chr11 5362822 5362841 5362825 -
agatgccaacccagagcatc

SEQ ID NO: 33143 - DNA, 20 bp, Artificial Sequence
  Synthetic oligonucleotide; AAG chr11 5362819 5362838 5362822 -
tgccaacccagagcatcagg

SEQ ID NO: 33144 - DNA, 20 bp, Artificial Sequence
  Synthetic oligonucleotide; GAG chr11 5362817 5362836 5362820 -
ccaacccagagcatcaggaa

SEQ ID NO: 33145 - DNA, 20 bp, Artificial Sequence
  Synthetic oligonucleotide; AGG chr11 5362816 5362835 5362819 -
caacccagagcatcaggaag

SEQ ID NO: 33146 - DNA, 20 bp, Artificial Sequence
  Synthetic oligonucleotide; AAG chr11 5362807 5362826 5362810 -
gcatcaggaagaggacttca

SEQ ID NO: 33147 - DNA, 20 bp, Artificial Sequence
  Synthetic oligonucleotide; AAG chr11 5362798 5362817 5362801 -
agaggacttcaaagcccatg

SEQ ID NO: 33148 - DNA, 20 bp, Artificial Sequence
  Synthetic oligonucleotide; GAG chr11 5362796 5362815 5362799 -
aggacttcaaagcccatgaa

SEQ ID NO: 33149 - DNA, 20 bp, Artificial Sequence
  Synthetic oligonucleotide; GAG chr11 5362792 5362811 5362795 -
cttcaaagcccatgaagagt

SEQ ID NO: 33150 - DNA, 20 bp, Artificial Sequence
  Synthetic oligonucleotide; AGG chr11 5362791 5362810 5362794 -
ttcaaagcccatgaagagtg

SEQ ID NO: 33151 - DNA, 20 bp, Artificial Sequence
  Synthetic oligonucleotide; AAG chr11 5362783 5362802 5362786 -
ccatgaagagtgaggccacc

SEQ ID NO: 33152 - DNA, 20 bp, Artificial Sequence
  Synthetic oligonucleotide; AGG chr11 5362782 5362801 5362785 -
catgaagagtgaggccacca

SEQ ID NO: 33153 - DNA, 20 bp, Artificial Sequence
  Synthetic oligonucleotide; GAG chr11 5362780 5362799 5362783 -
tgaagagtgaggccaccaag

SEQ ID NO: 33154 - DNA, 20 bp, Artificial Sequence
  Synthetic oligonucleotide; TAG chr11 5362767 5362786 5362770 -
caccaaggagatactcttta

SEQ ID NO: 33155 - DNA, 20 bp, Artificial Sequence
  Synthetic oligonucleotide; AAG chr11 5362757 5362776 5362760 -
atactctttatagatatcac

SEQ ID NO: 33156 - DNA, 20 bp, Artificial Sequence
  Synthetic oligonucleotide; TGG chr11 5362748 5362767 5362751 -
atagatatcacaagtgtact

SEQ ID NO: 33157 - DNA, 20 bp, Artificial Sequence
  Synthetic oligonucleotide; TAG chr11 5362745 5362764 5362748 -
gatatcacaagtgtacttgg

SEQ ID NO: 33158 - DNA, 20 bp, Artificial Sequence
  Synthetic oligonucleotide; GAG chr11 5362743 5362762 5362746 -
tatcacaagtgtacttggta

SEQ ID NO: 33159 - DNA, 20 bp, Artificial Sequence
  Synthetic oligonucleotide; AGG chr11 5362742 5362761 5362745 -
atcacaagtgtacttggtag

SEQ ID NO: 33160 - DNA, 20 bp, Artificial Sequence
  Synthetic oligonucleotide; AAG chr11 5362725 5362744 5362728 -
tagaggtgacctcgtaaaca

SEQ ID NO: 33161 - DNA, 20 bp, Artificial Sequence
  Synthetic oligonucleotide; CAG chr11 5362719 5362738 5362722 -
tgacctcgtaaacaaagaac

SEQ ID NO: 33162 - DNA, 20 bp, Artificial Sequence
  Synthetic oligonucleotide; AGG chr11 5362718 5362737 5362721 -
gacctcgtaaacaaagaacc

SEQ ID NO: 33163 - DNA, 20 bp, Artificial Sequence
  Synthetic oligonucleotide; TGG chr11 5362715 5362734 5362718 -
ctcgtaaacaaagaaccagg

SEQ ID NO: 33164 - DNA, 20 bp, Artificial Sequence
  Synthetic oligonucleotide; AAG chr11 5362710 5362729 5362713 -
aaacaaagaaccaggtggtg

SEQ ID NO: 33165 - DNA, 20 bp, Artificial Sequence
  Synthetic oligonucleotide; TGG chr11 5362697 5362716 5362700 -
ggtggtgaagaacatgtcga

SEQ ID NO: 33166 - DNA, 20 bp, Artificial Sequence
  Synthetic oligonucleotide; AAG chr11 5362690 5362709 5362693 -
aagaacatgtcgatggccaa

SEQ ID NO: 33167 - DNA, 20 bp, Artificial Sequence
  Synthetic oligonucleotide; CAG chr11 5362678 5362697 5362681 -
atggccaaaagctctacaat

SEQ ID NO: 33168 - DNA, 20 bp, Artificial Sequence
  Synthetic oligonucleotide; TGG chr11 5362674 5362693 5362677 -
ccaaaagctctacaatcaga

SEQ ID NO: 33169 - DNA, 20 bp, Artificial Sequence
  Synthetic oligonucleotide; GGG chr11 5362673 5362692 5362676 -
caaaagctctacaatcagat

SEQ ID NO: 33170 - DNA, 20 bp, Artificial Sequence
  Synthetic oligonucleotide; GGG chr11 5362672 5362691 5362675 -
aaaagctctacaatcagatg

SEQ ID NO: 33171 - DNA, 20 bp, Artificial Sequence
  Synthetic oligonucleotide; GGG chr11 5362671 5362690 5362674 -
aaagctctacaatcagatgg

SEQ ID NO: 33172 - DNA, 20 bp, Artificial Sequence
  Synthetic oligonucleotide; AAG chr11 5362668 5362687 5362671 -
gctctacaatcagatggggg

SEQ ID NO: 33173 - DNA, 20 bp, Artificial Sequence
  Synthetic oligonucleotide; CAG chr11 5362664 5362683 5362667 -
tacaatcagatgggggaaga

SEQ ID NO: 33174 - DNA, 20 bp, Artificial Sequence
  Synthetic oligonucleotide; TGG chr11 5362660 5362679 5362663 -
atcagatgggggaagacagc

SEQ ID NO: 33175 - DNA, 20 bp, Artificial Sequence
  Synthetic oligonucleotide; GGG chr11 5362659 5362678 5362662 -
tcagatgggggaagacagct

SEQ ID NO: 33176 - DNA, 20 bp, Artificial Sequence
  Synthetic oligonucleotide; CGG chr11 5362651 5362670 5362654 -
gggaagacagctgggttgac

SEQ ID NO: 33177 - DNA, 20 bp, Artificial Sequence
  Synthetic oligonucleotide; GGG chr11 5362650 5362669 5362653 -
ggaagacagctgggttgacc

SEQ ID NO: 33178 - DNA, 20 bp, Artificial Sequence
  Synthetic oligonucleotide; TGG chr11 5362631 5362650 5362634 -
cgggctgttgtatctgctca

SEQ ID NO: 33179 - DNA, 20 bp, Artificial Sequence
  Synthetic oligonucleotide; GAG chr11 5362624 5362643 5362627 -
ttgtatctgctcatggcctt

SEQ ID NO: 33180 - DNA, 20 bp, Artificial Sequence
  Synthetic oligonucleotide; CAG chr11 5362608 5362627 5362611 -
ccttgagctccattttgccc

SEQ ID NO: 33181 - DNA, 20 bp, Artificial Sequence
  Synthetic oligonucleotide; CAG chr11 5362605 5362624 5362608 -
tgagctccattttgccccag

SEQ ID NO: 33182 - DNA, 20 bp, Artificial Sequence
  Synthetic oligonucleotide; AGG chr11 5362604 5362623 5362607 -
gagctccattttgccccagc

SEQ ID NO: 33183 - DNA, 20 bp, Artificial Sequence
  Synthetic oligonucleotide; AAG chr11 5362599 5362618 5362602 -
ccattttgccccagcaggct

SEQ ID NO: 33184 - DNA, 20 bp, Artificial Sequence
  Synthetic oligonucleotide; CAG chr11 5362581 5362600 5362584 -
ctaagccaccactctgccac

SEQ ID NO: 33185 - DNA, 20 bp, Artificial Sequence
  Synthetic oligonucleotide; AAG chr11 5362578 5362597 5362581 -
agccaccactctgccaccag

SEQ ID NO: 33186 - DNA, 20 bp, Artificial Sequence
  Synthetic oligonucleotide; TAG chr11 5362522 5362541 5362525 -
cttcatctctgctctctgac

SEQ ID NO: 33187 - DNA, 20 bp, Artificial Sequence
  Synthetic oligonucleotide; AGG chr11 5362521 5362540 5362524 -
ttcatctctgctctctgact

SEQ ID NO: 33188 - DNA, 20 bp, Artificial Sequence
  Synthetic oligonucleotide; TAG chr11 5362483 5362502 5362486 -
atgttatctattctgattca

SEQ ID NO: 33189 - DNA, 20 bp, Artificial Sequence
  Synthetic oligonucleotide; CAG chr11 5362476 5362495 5362479 -
ctattctgattcatagtatc

SEQ ID NO: 33190 - DNA, 20 bp, Artificial Sequence
  Synthetic oligonucleotide; TAG chr11 5362473 5362492 5362476 -
ttctgattcatagtatccag

SEQ ID NO: 33191 - DNA, 20 bp, Artificial Sequence
  Synthetic oligonucleotide; AAG chr11 5362441 5362460 5362444 -
aatcatcacattctcattat

SEQ ID NO: 33192 - DNA, 20 bp, Artificial Sequence
  Synthetic oligonucleotide; AGG chr11 5362440 5362459 5362443 -
atcatcacattctcattata

SEQ ID NO: 33193 - DNA, 20 bp, Artificial Sequence
  Synthetic oligonucleotide; AAG chr11 5362409 5362428 5362412 -
ctaatgttcacaattttcca

SEQ ID NO: 33194 - DNA, 20 bp, Artificial Sequence
  Synthetic oligonucleotide; TAG chr11 5362403 5362422 5362406 -
ttcacaattttccaaagcca

SEQ ID NO: 33195 - DNA, 20 bp, Artificial Sequence
  Synthetic oligonucleotide; TAG chr11 5362354 5362373 5362357 -
taaattcctgaccatcttcg

SEQ ID NO: 33196 - DNA, 20 bp, Artificial Sequence
  Synthetic oligonucleotide; TGG chr11 5362344 5362363 5362347 -
accatcttcgtagttgatta

SEQ ID NO: 33197 - DNA, 20 bp, Artificial Sequence
  Synthetic oligonucleotide; TGG chr11 5362334 5362353 5362337 -
tagttgattatggctctgaa

SEQ ID NO: 33198 - DNA, 20 bp, Artificial Sequence
  Synthetic oligonucleotide; AAG chr11 5362320 5362339 5362323 -
tctgaatggctttttgccca

SEQ ID NO: 33199 - DNA, 20 bp, Artificial Sequence
  Synthetic oligonucleotide; CAG chr11 5362313 5362332 5362316 -
ggctttttgcccaaagcatc

SEQ ID NO: 33200 - DNA, 20 bp, Artificial Sequence
  Synthetic oligonucleotide; TGG chr11 5362297 5362316 5362300 -
catccagcaccattttcatc

SEQ ID NO: 33201 - DNA, 20 bp, Artificial Sequence
  Synthetic oligonucleotide; GGG chr11 5362296 5362315 5362299 -
atccagcaccattttcatct

SEQ ID NO: 33202 - DNA, 20 bp, Artificial Sequence
  Synthetic oligonucleotide; TAG chr11 5362293 5362312 5362296 -
cagcaccattttcatctggg

SEQ ID NO: 33203 - DNA, 20 bp, Artificial Sequence
  Synthetic oligonucleotide; TGG chr11 5362280 5362299 5362283 -
atctgggtagtttcccctgc

SEQ ID NO: 33204 - DNA, 20 bp, Artificial Sequence
  Synthetic oligonucleotide; TAG chr11 5362271 5362290 5362274 -
gtttcccctgctggtaaaaa

SEQ ID NO: 33205 - DNA, 20 bp, Artificial Sequence
  Synthetic oligonucleotide; CAG chr11 5362234 5362253 5362237 -
tatctactcccatcccccga

SEQ ID NO: 33206 - DNA, 20 bp, Artificial Sequence
  Synthetic oligonucleotide; CGG chr11 5362226 5362245 5362229 -
cccatcccccgacagaaaca

SEQ ID NO: 33207 - DNA, 20 bp, Artificial Sequence
  Synthetic oligonucleotide; GGG chr11 5362225 5362244 5362228 -
ccatcccccgacagaaacac

SEQ ID NO: 33208 - DNA, 20 bp, Artificial Sequence
  Synthetic oligonucleotide; TGG chr11 5362202 5362221 5362205 -
atccactatcactctctatc

SEQ ID NO: 33209 - DNA, 20 bp, Artificial Sequence
  Synthetic oligonucleotide; GGG chr11 5362201 5362220 5362204 -
tccactatcactctctatct

SEQ ID NO: 33210 - DNA, 20 bp, Artificial Sequence
  Synthetic oligonucleotide; TGG chr11 5362196 5362215 5362199 -
tatcactctctatctgggtg

SEQ ID NO: 33211 - DNA, 20 bp, Artificial Sequence
  Synthetic oligonucleotide; GAG chr11 5362191 5362210 5362194 -
ctctctatctgggtgtggtt

SEQ ID NO: 33212 - DNA, 20 bp, Artificial Sequence
  Synthetic oligonucleotide; CAG chr11 5362174 5362193 5362177 -
gttgagatcttcaaaatctg

SEQ ID NO: 33213 - DNA, 20 bp, Artificial Sequence
  Synthetic oligonucleotide; TAG chr11 5362165 5362184 5362168 -
ttcaaaatctgcagtgctga

SEQ ID NO: 33214 - DNA, 20 bp, Artificial Sequence
  Synthetic oligonucleotide; CAG chr11 5362160 5362179 5362163 -
aatctgcagtgctgatagct

SEQ ID NO: 33215 - DNA, 20 bp, Artificial Sequence
  Synthetic oligonucleotide; TGG chr11 5362155 5362174 5362158 -
gcagtgctgatagctcagca

SEQ ID NO: 33216 - DNA, 20 bp, Artificial Sequence
  Synthetic oligonucleotide; AAG chr11 5362148 5362167 5362151 -
tgatagctcagcatggaatg

SEQ ID NO: 33217 - DNA, 20 bp, Artificial Sequence
  Synthetic oligonucleotide; AAG chr11 5362136 5362155 5362139 -
atggaatgaagtgaaccaac

SEQ ID NO: 33218 - DNA, 20 bp, Artificial Sequence
  Synthetic oligonucleotide; TGG chr11 5362120 5362139 5362123 -
caacaagctctctctgactt

SEQ ID NO: 33219 - DNA, 20 bp, Artificial Sequence
  Synthetic oligonucleotide; AAG chr11 5362112 5362131 5362115 -
tctctctgactttggtttat

SEQ ID NO: 33220 - DNA, 20 bp, Artificial Sequence
  Synthetic oligonucleotide; AGG chr11 5362111 5362130 5362114 -
ctctctgactttggtttata

SEQ ID NO: 33221 - DNA, 20 bp, Artificial Sequence
  Synthetic oligonucleotide; TGG chr11 5362089 5362108 5362092 -
gatttgcatacattttctga

SEQ ID NO: 33222 - DNA, 20 bp, Artificial Sequence
  Synthetic oligonucleotide; TAG chr11 5362082 5362101 5362085 -
atacattttctgatggatac

SEQ ID NO: 33223 - DNA, 20 bp, Artificial Sequence
  Synthetic oligonucleotide; AGG chr11 5362081 5362100 5362084 -
tacattttctgatggatact

SEQ ID NO: 33224 - DNA, 20 bp, Artificial Sequence
  Synthetic oligonucleotide; TGG chr11 5362070 5362089 5362073 -
atggatactaggctcatttc

SEQ ID NO: 33225 - DNA, 20 bp, Artificial Sequence
  Synthetic oligonucleotide; GGG chr11 5362069 5362088 5362072 -
tggatactaggctcatttct

SEQ ID NO: 33226 - DNA, 20 bp, Artificial Sequence
  Synthetic oligonucleotide; CAG chr11 5362060 5362079 5362063 -
ggctcatttctgggaatatg

SEQ ID NO: 33227 - DNA, 20 bp, Artificial Sequence
  Synthetic oligonucleotide; AAG chr11 5362050 5362069 5362053 -
tgggaatatgcagcaattta

SEQ ID NO: 33228 - DNA, 20 bp, Artificial Sequence
  Synthetic oligonucleotide; AAG chr11 5362030 5362049 5362033 -
aagcattgtgcctcatgtca

SEQ ID NO: 33229 - DNA, 20 bp, Artificial Sequence
  Synthetic oligonucleotide; TGG chr11 5361996 5362015 5361999 -
caatctgacactaatctatt

SEQ ID NO: 33230 - DNA, 20 bp, Artificial Sequence
  Synthetic oligonucleotide; AAG chr11 5361992 5362011 5361995 -
ctgacactaatctatttggt

SEQ ID NO: 33231 - DNA, 20 bp, Artificial Sequence
  Synthetic oligonucleotide; TAG chr11 5361976 5361995 5361979 -
tggtaagtttttctttctgt

SEQ ID NO: 33232 - DNA, 20 bp, Artificial Sequence
  Synthetic oligonucleotide; CAG chr11 5361955 5361974 5361958 -
agtctatacccttgtcatta

SEQ ID NO: 33233 - DNA, 20 bp, Artificial Sequence
  Synthetic oligonucleotide; TGG chr11 5361919 5361938 5361922 -
cactctaacttcatcttttt

SEQ ID NO: 33234 - DNA, 20 bp, Artificial Sequence
  Synthetic oligonucleotide; GGG chr11 5361918 5361937 5361921 -
actctaacttcatctttttt

SEQ ID NO: 33235 - DNA, 20 bp, Artificial Sequence
  Synthetic oligonucleotide; GAG chr11 5361916 5361935 5361919 -
tctaacttcatcttttttgg

SEQ ID NO: 33236 - DNA, 20 bp, Artificial Sequence
  Synthetic oligonucleotide; AAG chr11 5361912 5361931 5361915 -
acttcatcttttttgggagt

SEQ ID NO: 33237 - DNA, 20 bp, Artificial Sequence
  Synthetic oligonucleotide; TGG chr11 5361905 5361924 5361908 -
cttttttgggagtaagtact

SEQ ID NO: 33238 - DNA, 20 bp, Artificial Sequence
  Synthetic oligonucleotide; TAG chr11 5361902 5361921 5361905 -
ttttgggagtaagtacttgg

SEQ ID NO: 33239 - DNA, 20 bp, Artificial Sequence
  Synthetic oligonucleotide; TAG chr11 5361893 5361912 5361896 -
taagtacttggtagaacaca

SEQ ID NO: 33240 - DNA, 20 bp, Artificial Sequence
  Synthetic oligonucleotide; GAG chr11 5361891 5361910 5361894 -
agtacttggtagaacacata

SEQ ID NO: 33241 - DNA, 20 bp, Artificial Sequence
  Synthetic oligonucleotide; AGG chr11 5361890 5361909 5361893 -
gtacttggtagaacacatag

SEQ ID NO: 33242 - DNA, 20 bp, Artificial Sequence
  Synthetic oligonucleotide; AAG chr11 5361885 5361904 5361888 -
tggtagaacacatagaggca

SEQ ID NO: 33243 - DNA, 20 bp, Artificial Sequence
  Synthetic oligonucleotide; GAG chr11 5361883 5361902 5361886 -
gtagaacacatagaggcaaa

SEQ ID NO: 33244 - DNA, 20 bp, Artificial Sequence
  Synthetic oligonucleotide; AGG chr11 5361882 5361901 5361885 -
tagaacacatagaggcaaag

SEQ ID NO: 33245 - DNA, 20 bp, Artificial Sequence
  Synthetic oligonucleotide; AAG chr11 5361879 5361898 5361882 -
aacacatagaggcaaagagg

SEQ ID NO: 33246 - DNA, 20 bp, Artificial Sequence
  Synthetic oligonucleotide; TGG chr11 5361875 5361894 5361878 -
catagaggcaaagaggaagc

SEQ ID NO: 33247 - DNA, 20 bp, Artificial Sequence
  Synthetic oligonucleotide; CAG chr11 5361866 5361885 5361869 -
aaagaggaagctggtttatg

SEQ ID NO: 33248 - DNA, 20 bp, Artificial Sequence
  Synthetic oligonucleotide; AAG chr11 5361859 5361878 5361862 -
aagctggtttatgcagcccg

SEQ ID NO: 33249 - DNA, 20 bp, Artificial Sequence
  Synthetic oligonucleotide; GAG chr11 5361857 5361876 5361860 -
gctggtttatgcagcccgaa

SEQ ID NO: 33250 - DNA, 20 bp, Artificial Sequence
  Synthetic oligonucleotide; GAG chr11 5361855 5361874 5361858 -
tggtttatgcagcccgaaga

SEQ ID NO: 33251 - DNA, 20 bp, Artificial Sequence
  Synthetic oligonucleotide; AAG chr11 5361847 5361866 5361850 -
gcagcccgaagagagcaaca

SEQ ID NO: 33252 - DNA, 20 bp, Artificial Sequence
  Synthetic oligonucleotide; AGG chr11 5361846 5361865 5361849 -
cagcccgaagagagcaacaa

SEQ ID NO: 33253 - DNA, 20 bp, Artificial Sequence
  Synthetic oligonucleotide; TAG chr11 5361840 5361859 5361843 -
gaagagagcaacaaaggaaa

SEQ ID NO: 33254 - DNA, 20 bp, Artificial Sequence
  Synthetic oligonucleotide; CAG chr11 5361826 5361845 5361829 -
aggaaatagataatccaaac

SEQ ID NO: 33255 - DNA, 20 bp, Artificial Sequence
  Synthetic oligonucleotide; GAG chr11 5361824 5361843 5361827 -
gaaatagataatccaaacca

SEQ ID NO: 33256 - DNA, 20 bp, Artificial Sequence
  Synthetic oligonucleotide; TGG chr11 5361819 5361838 5361822 -
agataatccaaaccagagtc

SEQ ID NO: 33257 - DNA, 20 bp, Artificial Sequence
  Synthetic oligonucleotide; CAG chr11 5361808 5361827 5361811 -
accagagtctggaactacac

SEQ ID NO: 33258 - DNA, 20 bp, Artificial Sequence
  Synthetic oligonucleotide; GAG chr11 5361806 5361825 5361809 -
cagagtctggaactacacca

SEQ ID NO: 33259 - DNA, 20 bp, Artificial Sequence
  Synthetic oligonucleotide; TGG chr11 5361784 5361803 5361787 -
gatatcattctgtattcccg

SEQ ID NO: 33260 - DNA, 20 bp, Artificial Sequence
  Synthetic oligonucleotide; TAG chr11 5361756 5361775 5361759 -
caacttgattttttcctaac

SEQ ID NO: 33261 - DNA, 20 bp, Artificial Sequence
  Synthetic oligonucleotide; TAG chr11 5361743 5361762 5361746 -
tcctaactagatcactctgc

SEQ ID NO: 33262 - DNA, 20 bp, Artificial Sequence
  Synthetic oligonucleotide; AGG chr11 5361742 5361761 5361745 -
cctaactagatcactctgct

SEQ ID NO: 33263 - DNA, 20 bp, Artificial Sequence
  Synthetic oligonucleotide; GGG chr11 5361741 5361760 5361744 -
ctaactagatcactctgcta

SEQ ID NO: 33264 - DNA, 20 bp, Artificial Sequence
  Synthetic oligonucleotide; AAG chr11 5361731 5361750 5361734 -
cactctgctagggaatgaaa

SEQ ID NO: 33265 - DNA, 20 bp, Artificial Sequence
  Synthetic oligonucleotide; AGG chr11 5361730 5361749 5361733 -
actctgctagggaatgaaaa

SEQ ID NO: 33266 - DNA, 20 bp, Artificial Sequence
  Synthetic oligonucleotide; GAG chr11 5361728 5361747 5361731 -
tctgctagggaatgaaaaag

SEQ ID NO: 33267 - DNA, 20 bp, Artificial Sequence
  Synthetic oligonucleotide; TAG chr11 5361722 5361741 5361725 -
agggaatgaaaaaggagatc

SEQ ID NO: 33268 - DNA, 20 bp, Artificial Sequence
  Synthetic oligonucleotide; AGG chr11 5361721 5361740 5361724 -
gggaatgaaaaaggagatct

SEQ ID NO: 33269 - DNA, 20 bp, Artificial Sequence
  Synthetic oligonucleotide; TAG chr11 5361705 5361724 5361708 -
atctaggattttccctcttc

SEQ ID NO: 33270 - DNA, 20 bp, Artificial Sequence
  Synthetic oligonucleotide; AGG chr11 5361704 5361723 5361707 -
tctaggattttccctcttct

SEQ ID NO: 33271 - DNA, 20 bp, Artificial Sequence
  Synthetic oligonucleotide; AAG chr11 5361692 5361711 5361695 -
cctcttctaggaatttgcaa

SEQ ID NO: 33272 - DNA, 20 bp, Artificial Sequence
  Synthetic oligonucleotide; GAG chr11 5361690 5361709 5361693 -
tcttctaggaatttgcaaaa

SEQ ID NO: 33273 - DNA, 20 bp, Artificial Sequence
  Synthetic oligonucleotide; CAG chr11 5361681 5361700 5361684 -
aatttgcaaaagagattatt

SEQ ID NO: 33274 - DNA, 20 bp, Artificial Sequence
  Synthetic oligonucleotide; AAG chr11 5361678 5361697 5361681 -
ttgcaaaagagattattcag

SEQ ID NO: 33275 - DNA, 20 bp, Artificial Sequence
  Synthetic oligonucleotide; AAG chr11 5361673 5361692 5361676 -
aaagagattattcagaagcc

SEQ ID NO: 33276 - DNA, 20 bp, Artificial Sequence
  Synthetic oligonucleotide; AAG chr11 5361665 5361684 5361668 -
tattcagaagccaagttcta

SEQ ID NO: 33277 - DNA, 20 bp, Artificial Sequence
  Synthetic oligonucleotide; TAG chr11 5361658 5361677 5361661 -
aagccaagttctaaagattt

SEQ ID NO: 33278 - DNA, 20 bp, Artificial Sequence
  Synthetic oligonucleotide; AGG chr11 5361657 5361676 5361660 -
agccaagttctaaagatttt

SEQ ID NO: 33279 - DNA, 20 bp, Artificial Sequence
  Synthetic oligonucleotide; GGG chr11 5361656 5361675 5361659 -
gccaagttctaaagatttta

SEQ ID NO: 33280 - DNA, 20 bp, Artificial Sequence
  Synthetic oligonucleotide; GAG chr11 5361654 5361673 5361657 -
caagttctaaagattttagg

SEQ ID NO: 33281 - DNA, 20 bp, Artificial Sequence
  Synthetic oligonucleotide; TGG chr11 5361647 5361666 5361650 -
taaagattttagggagtctt

SEQ ID NO: 33282 - DNA, 20 bp, Artificial Sequence
  Synthetic oligonucleotide; GGG chr11 5361646 5361665 5361649 -
aaagattttagggagtcttt

SEQ ID NO: 33283 - DNA, 20 bp, Artificial Sequence
  Synthetic oligonucleotide; TAG chr11 5361639 5361658 5361642 -
ttagggagtctttgggatga

SEQ ID NO: 33284 - DNA, 20 bp, Artificial Sequence
  Synthetic oligonucleotide; AAG chr11 5361572 5361591 5361575 -
ccctctctgcaatctctgat

SEQ ID NO: 33285 - DNA, 20 bp, Artificial Sequence
  Synthetic oligonucleotide; CGG chr11 5361543 5361562 5361546 -
gtctactgctcattcctatg

SEQ ID NO: 33286 - DNA, 20 bp, Artificial Sequence
  Synthetic oligonucleotide; GAG chr11 5361541 5361560 5361544 -
ctactgctcattcctatgcg

SEQ ID NO: 33287 - DNA, 20 bp, Artificial Sequence
  Synthetic oligonucleotide; TAG chr11 5361534 5361553 5361537 -
tcattcctatgcggagcctc

SEQ ID NO: 33288 - DNA, 20 bp, Artificial Sequence
  Synthetic oligonucleotide; AGG chr11 5361533 5361552 5361536 -
cattcctatgcggagcctct

SEQ ID NO: 33289 - DNA, 20 bp, Artificial Sequence
  Synthetic oligonucleotide; AAG chr11 5361528 5361547 5361531 -
ctatgcggagcctctaggcc

SEQ ID NO: 33290 - DNA, 20 bp, Artificial Sequence
  Synthetic oligonucleotide; TGG chr11 5361519 5361538 5361522 -
gcctctaggccaagacacac

SEQ ID NO: 33291 - DNA, 20 bp, Artificial Sequence
  Synthetic oligonucleotide; GAG chr11 5361517 5361536 5361520 -
ctctaggccaagacacactg

SEQ ID NO: 33292 - DNA, 20 bp, Artificial Sequence
  Synthetic oligonucleotide; AAG chr11 5361494 5361513 5361497 -
ttctttaccgacctgttcat

SEQ ID NO: 33293 - DNA, 20 bp, Artificial Sequence
  Synthetic oligonucleotide; CAG chr11 5361474 5361493 5361477 -
aagtctgttcattgttgcca

SEQ ID NO: 33294 - DNA, 20 bp, Artificial Sequence
  Synthetic oligonucleotide; AAG chr11 5361453 5361472 5361456 -
agatgtgactatgaacccct

SEQ ID NO: 33295 - DNA, 20 bp, Artificial Sequence
  Synthetic oligonucleotide; TGG chr11 5361448 5361467 5361451 -
tgactatgaacccctaagcc

SEQ ID NO: 33296 - DNA, 20 bp, Artificial Sequence
  Synthetic oligonucleotide; AAG chr11 5361443 5361462 5361446 -
atgaacccctaagcctggtc

SEQ ID NO: 33297 - DNA, 20 bp, Artificial Sequence
  Synthetic oligonucleotide; TGG chr11 5361436 5361455 5361439 -
cctaagcctggtcaagatat

SEQ ID NO: 33298 - DNA, 20 bp, Artificial Sequence
  Synthetic oligonucleotide; TAG chr11 5361416 5361435 5361419 -
tggatccaacaccaactttt

SEQ ID NO: 33299 - DNA, 20 bp, Artificial Sequence
  Synthetic oligonucleotide; CAG chr11 5361405 5361424 5361408 -
ccaactttttagactatact

SEQ ID NO: 33300 - DNA, 20 bp, Artificial Sequence
  Synthetic oligonucleotide; AAG chr11 5361402 5361421 5361405 -
actttttagactatactcag

SEQ ID NO: 33301 - DNA, 20 bp, Artificial Sequence
  Synthetic oligonucleotide; AAG chr11 5361397 5361416 5361400 -
ttagactatactcagaagcc

SEQ ID NO: 33302 - DNA, 20 bp, Artificial Sequence
  Synthetic oligonucleotide; AAG chr11 5361389 5361408 5361392 -
tactcagaagccaagctgca

SEQ ID NO: 33303 - DNA, 20 bp, Artificial Sequence
  Synthetic oligonucleotide; TAG chr11 5361381 5361400 5361384 -
agccaagctgcaaagaaaat

SEQ ID NO: 33304 - DNA, 20 bp, Artificial Sequence
  Synthetic oligonucleotide; CAG chr11 5361375 5361394 5361378 -
gctgcaaagaaaattagttt

SEQ ID NO: 33305 - DNA, 20 bp, Artificial Sequence
  Synthetic oligonucleotide; CGG chr11 5361359 5361378 5361362 -
gtttcagaaactcctcccta

SEQ ID NO: 33306 - DNA, 20 bp, Artificial Sequence
  Synthetic oligonucleotide; CAG chr11 5361321 5361340 5361324 -
tccctccttctttattctcc

SEQ ID NO: 33307 - DNA, 20 bp, Artificial Sequence
  Synthetic oligonucleotide; GAG chr11 5361315 5361334 5361318 -
cttctttattctcccagcct

SEQ ID NO: 33308 - DNA, 20 bp, Artificial Sequence
  Synthetic oligonucleotide; AGG chr11 5361314 5361333 5361317 -
ttctttattctcccagcctg

SEQ ID NO: 33309 - DNA, 20 bp, Artificial Sequence
  Synthetic oligonucleotide; GGG chr11 5361313 5361332 5361316 -
tctttattctcccagcctga

SEQ ID NO: 33310 - DNA, 20 bp, Artificial Sequence
  Synthetic oligonucleotide; TAG chr11 5361307 5361326 5361310 -
ttctcccagcctgagggatt

SEQ ID NO: 33311 - DNA, 20 bp, Artificial Sequence
  Synthetic oligonucleotide; TGG chr11 5361299 5361318 5361302 -
gcctgagggatttagaactt

SEQ ID NO: 33312 - DNA, 20 bp, Artificial Sequence
  Synthetic oligonucleotide; CAG chr11 5361294 5361313 5361297 -
agggatttagaactttggaa

SEQ ID NO: 33313 - DNA, 20 bp, Artificial Sequence
  Synthetic oligonucleotide; AGG chr11 5361293 5361312 5361296 -
gggatttagaactttggaac

SEQ ID NO: 33314 - DNA, 20 bp, Artificial Sequence
  Synthetic oligonucleotide; GAG chr11 5361291 5361310 5361294 -
gatttagaactttggaacag

SEQ ID NO: 33315 - DNA, 20 bp, Artificial Sequence
  Synthetic oligonucleotide; AAG chr11 5361283 5361302 5361286 -
actttggaacaggagtcgct

SEQ ID NO: 33316 - DNA, 20 bp, Artificial Sequence
  Synthetic oligonucleotide; AGG chr11 5361282 5361301 5361285 -
ctttggaacaggagtcgcta

SEQ ID NO: 33317 - DNA, 20 bp, Artificial Sequence
  Synthetic oligonucleotide; TAG chr11 5361265 5361284 5361268 -
ctaaggtttcttcctgcatc

SEQ ID NO: 33318 - DNA, 20 bp, Artificial Sequence
  Synthetic oligonucleotide; AGG chr11 5361264 5361283 5361267 -
taaggtttcttcctgcatct

SEQ ID NO: 33319 - DNA, 20 bp, Artificial Sequence
  Synthetic oligonucleotide; TAG chr11 5361260 5361279 5361263 -
gtttcttcctgcatctaggt

SEQ ID NO: 33320 - DNA, 20 bp, Artificial Sequence
  Synthetic oligonucleotide; AGG chr11 5361259 5361278 5361262 -
tttcttcctgcatctaggtt

SEQ ID NO: 33321 - DNA, 20 bp, Artificial Sequence
  Synthetic oligonucleotide; GGG chr11 5361258 5361277 5361261 -
ttcttcctgcatctaggtta

SEQ ID NO: 33322 - DNA, 20 bp, Artificial Sequence
  Synthetic oligonucleotide; TAG chr11 5361252 5361271 5361255 -
ctgcatctaggttagggaat

SEQ ID NO: 33323 - DNA, 20 bp, Artificial Sequence
  Synthetic oligonucleotide; CAG chr11 5361240 5361259 5361243 -
tagggaattagccacatctc

SEQ ID NO: 33324 - DNA, 20 bp, Artificial Sequence
  Synthetic oligonucleotide; AAG chr11 5361233 5361252 5361236 -
ttagccacatctccagaaat

SEQ ID NO: 33325 - DNA, 20 bp, Artificial Sequence
  Synthetic oligonucleotide; AAG chr11 5361221 5361240 5361224 -
ccagaaataagatttatttt

SEQ ID NO: 33326 - DNA, 20 bp, Artificial Sequence
  Synthetic oligonucleotide; TAG chr11 5361211 5361230 5361214 -
gatttattttaagcatcaca

SEQ ID NO: 33327 - DNA, 20 bp, Artificial Sequence
  Synthetic oligonucleotide; AGG chr11 5361210 5361229 5361213 -
atttattttaagcatcacat

SEQ ID NO: 33328 - DNA, 20 bp, Artificial Sequence
  Synthetic oligonucleotide; GGG chr11 5361209 5361228 5361212 -
tttattttaagcatcacata

SEQ ID NO: 33329 - DNA, 20 bp, Artificial Sequence
  Synthetic oligonucleotide; GGG chr11 5361208 5361227 5361211 -
ttattttaagcatcacatag

SEQ ID NO: 33330 - DNA, 20 bp, Artificial Sequence
  Synthetic oligonucleotide; TAG chr11 5361205 5361224 5361208 -
ttttaagcatcacatagggg

SEQ ID NO: 33331 - DNA, 20 bp, Artificial Sequence
  Synthetic oligonucleotide; AAG chr11 5361200 5361219 5361203 -
agcatcacataggggtagaa

SEQ ID NO: 33332 - DNA, 20 bp, Artificial Sequence
  Synthetic oligonucleotide; TAG chr11 5361191 5361210 5361194 -
taggggtagaaaagaaaatg

SEQ ID NO: 33333 - DNA, 20 bp, Artificial Sequence
  Synthetic oligonucleotide; AGG chr11 5361190 5361209 5361193 -
aggggtagaaaagaaaatgt

SEQ ID NO: 33334 - DNA, 20 bp, Artificial Sequence
  Synthetic oligonucleotide; GGG chr11 5361189 5361208 5361192 -
ggggtagaaaagaaaatgta

SEQ ID NO: 33335 - DNA, 20 bp, Artificial Sequence
  Synthetic oligonucleotide; GAG chr11 5361187 5361206 5361190 -
ggtagaaaagaaaatgtagg

SEQ ID NO: 33336 - DNA, 20 bp, Artificial Sequence
  Synthetic oligonucleotide; AGG chr11 5361186 5361205 5361189 -
gtagaaaagaaaatgtaggg

SEQ ID NO: 33337 - DNA, 20 bp, Artificial Sequence
  Synthetic oligonucleotide; TGG chr11 5361182 5361201 5361185 -
aaaagaaaatgtagggagga

SEQ ID NO: 33338 - DNA, 20 bp, Artificial Sequence
  Synthetic oligonucleotide; CAG chr11 5361171 5361190 5361174 -
tagggaggatggcctttttg

SEQ ID NO: 33339 - DNA, 20 bp, Artificial Sequence
  Synthetic oligonucleotide; CAG chr11 5361168 5361187 5361171 -
ggaggatggcctttttgcag

SEQ ID NO: 33340 - DNA, 20 bp, Artificial Sequence
  Synthetic oligonucleotide; AAG chr11 5361131 5361150 5361134 -
ttcttttattattatacttt

SEQ ID NO: 33341 - DNA, 20 bp, Artificial Sequence
  Synthetic oligonucleotide; TAG chr11 5361125 5361144 5361128 -
tattattatactttaagttt

SEQ ID NO: 33342 - DNA, 20 bp, Artificial Sequence
  Synthetic oligonucleotide; AGG chr11 5361124 5361143 5361127 -
attattatactttaagtttt

SEQ ID NO: 33343 - DNA, 20 bp, Artificial Sequence
  Synthetic oligonucleotide; GGG chr11 5361123 5361142 5361126 -
ttattatactttaagtttta

SEQ ID NO: 33344 - DNA, 20 bp, Artificial Sequence
  Synthetic oligonucleotide; CAG chr11 5361103 5361122 5361106 -
gggtacatttgcacaacgtg

SEQ ID NO: 33345 - DNA, 20 bp, Artificial Sequence
  Synthetic oligonucleotide; AGG chr11 5361102 5361121 5361105 -
ggtacatttgcacaacgtgc

SEQ ID NO: 33346 - DNA, 20 bp, Artificial Sequence
  Synthetic oligonucleotide; TGG chr11 5361070 5361089 5361073 -
tatgtatacatgtgccatgt

SEQ ID NO: 33347 - DNA, 20 bp, Artificial Sequence
  Synthetic oligonucleotide; TAG chr11 5361041 5361060 5361044 -
gcacccattaactcgtcact

SEQ ID NO: 33348 - DNA, 20 bp, Artificial Sequence
  Synthetic oligonucleotide; TAG chr11 5361035 5361054 5361038 -
attaactcgtcacttagcat

SEQ ID NO: 33349 - DNA, 20 bp, Artificial Sequence
  Synthetic oligonucleotide; AGG chr11 5361034 5361053 5361037 -
ttaactcgtcacttagcatt

SEQ ID NO: 33350 - DNA, 20 bp, Artificial Sequence
  Synthetic oligonucleotide; CAG chr11 5360987 5361006 5360990 -
ccccgacccccaccccactg

SEQ ID NO: 33351 - DNA, 20 bp, Artificial Sequence
  Synthetic oligonucleotide; AGG chr11 5360986 5361005 5360989 -
cccgacccccaccccactgc

SEQ ID NO: 33352 - DNA, 20 bp, Artificial Sequence
  Synthetic oligonucleotide; TGG chr11 5360980 5360999 5360983 -
ccccaccccactgcaggccc

SEQ ID NO: 33353 - DNA, 20 bp, Artificial Sequence
  Synthetic oligonucleotide; GAG chr11 5360921 5360940 5360924 -
attgttcaattcccacctat

SEQ ID NO: 33354 - DNA, 20 bp, Artificial Sequence
  Synthetic oligonucleotide; GAG chr11 5360917 5360936 5360920 -
ttcaattcccacctatgagt

SEQ ID NO: 33355 - DNA, 20 bp, Artificial Sequence
  Synthetic oligonucleotide; CAG chr11 5360908 5360927 5360911 -
cacctatgagtgagaacatg

SEQ ID NO: 33356 - DNA, 20 bp, Artificial Sequence
  Synthetic oligonucleotide; TGG chr11 5360901 5360920 5360904 -
gagtgagaacatgcagtgtt

SEQ ID NO: 33357 - DNA, 20 bp, Artificial Sequence
  Synthetic oligonucleotide; TAG chr11 5360883 5360902 5360886 -
tttggtttttgtccttgcga

SEQ ID NO: 33358 - DNA, 20 bp, Artificial Sequence
  Synthetic oligonucleotide; GAG chr11 5360874 5360893 5360877 -
tgtccttgcgatagtttgct

SEQ ID NO: 33359 - DNA, 20 bp, Artificial Sequence
  Synthetic oligonucleotide; TGG chr11 5360866 5360885 5360869 -
cgatagtttgctgagaatga

SEQ ID NO: 33360 - DNA, 20 bp, Artificial Sequence
  Synthetic oligonucleotide; CAG chr11 5360859 5360878 5360862 -
ttgctgagaatgatggtttc

SEQ ID NO: 33361 - DNA, 20 bp, Artificial Sequence
  Synthetic oligonucleotide; AAG chr11 5360837 5360856 5360840 -
gcttcatccatgtccctaca

SEQ ID NO: 33362 - DNA, 20 bp, Artificial Sequence
  Synthetic oligonucleotide; AGG chr11 5360836 5360855 5360839 -
cttcatccatgtccctacaa

SEQ ID NO: 33363 - DNA, 20 bp, Artificial Sequence
  Synthetic oligonucleotide; TGG chr11 5360812 5360831 5360815 -
catgaactcttcatttttta

SEQ ID NO: 33364 - DNA, 20 bp, Artificial Sequence
  Synthetic oligonucleotide; TAG chr11 5360804 5360823 5360807 -
cttcattttttatggctgca

SEQ ID NO: 33365 - DNA, 20 bp, Artificial Sequence
  Synthetic oligonucleotide; TGG chr11 5360794 5360813 5360797 -
tatggctgcatagtattcca

SEQ ID NO: 33366 - DNA, 20 bp, Artificial Sequence
  Synthetic oligonucleotide; CAG chr11 5360765 5360784 5360768 -
tgtgccacgttttcttaatc

SEQ ID NO: 33367 - DNA, 20 bp, Artificial Sequence
  Synthetic oligonucleotide; TGG chr11 5360751 5360770 5360754 -
ttaatccagtctatcattgt

SEQ ID NO: 33368 - DNA, 20 bp, Artificial Sequence
  Synthetic oligonucleotide; TGG chr11 5360743 5360762 5360746 -
gtctatcattgttggacatt

SEQ ID NO: 33369 - DNA, 20 bp, Artificial Sequence
  Synthetic oligonucleotide; GGG chr11 5360742 5360761 5360745 -
tctatcattgttggacattt

SEQ ID NO: 33370 - DNA, 20 bp, Artificial Sequence
  Synthetic oligonucleotide; TGG chr11 5360738 5360757 5360741 -
tcattgttggacatttgggt

SEQ ID NO: 33371 - DNA, 20 bp, Artificial Sequence
  Synthetic oligonucleotide; AAG chr11 5360731 5360750 5360734 -
tggacatttgggttggttcc

SEQ ID NO: 33372 - DNA, 20 bp, Artificial Sequence
  Synthetic oligonucleotide; TAG chr11 5360712 5360731 5360715 -
caagtctttgctattgtgaa

SEQ ID NO: 33373 - DNA, 20 bp, Artificial Sequence
  Synthetic oligonucleotide; TAG chr11 5360675 5360694 5360678 -
tacatgtgcatgtgtcttta

SEQ ID NO: 33374 - DNA, 20 bp, Artificial Sequence
  Synthetic oligonucleotide; CAG chr11 5360672 5360691 5360675 -
atgtgcatgtgtctttatag

SEQ ID NO: 33375 - DNA, 20 bp, Artificial Sequence
  Synthetic oligonucleotide; GAG chr11 5360651 5360670 5360654 -
agcatgatttataatccttt

SEQ ID NO: 33376 - DNA, 20 bp, Artificial Sequence
  Synthetic oligonucleotide; CAG chr11 5360640 5360659 5360643 -
taatcctttgagtatgtacc

SEQ ID NO: 33377 - DNA, 20 bp, Artificial Sequence
  Synthetic oligonucleotide; TGG chr11 5360634 5360653 5360637 -
tttgagtatgtacccagtaa

SEQ ID NO: 33378 - DNA, 20 bp, Artificial Sequence
  Synthetic oligonucleotide; GGG chr11 5360633 5360652 5360636 -
ttgagtatgtacccagtaat

SEQ ID NO: 33379 - DNA, 20 bp, Artificial Sequence
  Synthetic oligonucleotide; TGG chr11 5360629 5360648 5360632 -
gtatgtacccagtaatggga

SEQ ID NO: 33380 - DNA, 20 bp, Artificial Sequence
  Synthetic oligonucleotide; TGG chr11 5360625 5360644 5360628 -
gtacccagtaatgggatggc

SEQ ID NO: 33381 - DNA, 20 bp, Artificial Sequence
  Synthetic oligonucleotide; GGG chr11 5360624 5360643 5360627 -
tacccagtaatgggatggct

SEQ ID NO: 33382 - DNA, 20 bp, Artificial Sequence
  Synthetic oligonucleotide; TGG chr11 5360616 5360635 5360619 -
aatgggatggctgggtcaaa

SEQ ID NO: 33383 - DNA, 20 bp, Artificial Sequence
  Synthetic oligonucleotide; TAG chr11 5360607 5360626 5360610 -
gctgggtcaaatggtatttc

SEQ ID NO: 33384 - DNA, 20 bp, Artificial Sequence
  Synthetic oligonucleotide; TAG chr11 5360601 5360620 5360604 -
tcaaatggtatttctagttc

SEQ ID NO: 33385 - DNA, 20 bp, Artificial Sequence
  Synthetic oligonucleotide; GAG chr11 5360592 5360611 5360595 -
atttctagttctagatccct

SEQ ID NO: 33386 - DNA, 20 bp, Artificial Sequence
  Synthetic oligonucleotide; AGG chr11 5360591 5360610 5360594 -
tttctagttctagatccctg

SEQ ID NO: 33387 - DNA, 20 bp, Artificial Sequence
  Synthetic oligonucleotide; TGG chr11 5360565 5360584 5360568 -
cgccacactgacttccacaa

SEQ ID NO: 33388 - DNA, 20 bp, Artificial Sequence
  Synthetic oligonucleotide; TAG chr11 5360556 5360575 5360559 -
gacttccacaatggttgaac

SEQ ID NO: 33389 - DNA, 20 bp, Artificial Sequence
  Synthetic oligonucleotide; CAG chr11 5360549 5360568 5360552 -
acaatggttgaactagttta

SEQ ID NO: 33390 - DNA, 20 bp, Artificial Sequence
  Synthetic oligonucleotide; CAG chr11 5360537 5360556 5360540 -
ctagtttacagtctcaccaa

SEQ ID NO: 33391 - DNA, 20 bp, Artificial Sequence
  Synthetic oligonucleotide; AAG chr11 5360529 5360548 5360532 -
cagtctcaccaacagtgtaa

SEQ ID NO: 33392 - DNA, 20 bp, Artificial Sequence
  Synthetic oligonucleotide; CAG chr11 5360501 5360520 5360504 -
ctacttcttcacatcctctc

SEQ ID NO: 33393 - DNA, 20 bp, Artificial Sequence
  Synthetic oligonucleotide; TGG chr11 5360457 5360476 5360460 -
ttaatgatcgccattctaac

SEQ ID NO: 33394 - DNA, 20 bp, Artificial Sequence
  Synthetic oligonucleotide; GAG chr11 5360451 5360470 5360454 -
atcgccattctaactggtgt

SEQ ID NO: 33395 - DNA, 20 bp, Artificial Sequence
  Synthetic oligonucleotide; TGG chr11 5360447 5360466 5360450 -
ccattctaactggtgtgaga

SEQ ID NO: 33396 - DNA, 20 bp, Artificial Sequence
  Synthetic oligonucleotide; TGG chr11 5360434 5360453 5360437 -
tgtgagatggtatctcactg

SEQ ID NO: 33397 - DNA, 20 bp, Artificial Sequence
  Synthetic oligonucleotide; TGG chr11 5360410 5360429 5360413 -
tttgatttgtatttctctga

SEQ ID NO: 33398 - DNA, 20 bp, Artificial Sequence
  Synthetic oligonucleotide; CAG chr11 5360406 5360425 5360409 -
atttgtatttctctgatggc

SEQ ID NO: 33399 - DNA, 20 bp, Artificial Sequence
  Synthetic oligonucleotide; GAG chr11 5360396 5360415 5360399 -
ctctgatggccagtgatgat

SEQ ID NO: 33400 - DNA, 20 bp, Artificial Sequence
  Synthetic oligonucleotide; GAG chr11 5360351 5360370 5360354 -
ctgcataaatgtcttctttt

SEQ ID NO: 33401 - DNA, 20 bp, Artificial Sequence
  Synthetic oligonucleotide; AAG chr11 5360348 5360367 5360351 -
cataaatgtcttcttttgag

SEQ ID NO: 33402 - DNA, 20 bp, Artificial Sequence
  Synthetic oligonucleotide; TGG chr11 5360314 5360333 5360317 -
atcctttgcccactttttga

SEQ ID NO: 33403 - DNA, 20 bp, Artificial Sequence
  Synthetic oligonucleotide; GGG chr11 5360313 5360332 5360316 -
tcctttgcccactttttgat

SEQ ID NO: 33404 - DNA, 20 bp, Artificial Sequence
  Synthetic oligonucleotide; GGG chr11 5360312 5360331 5360315 -
cctttgcccactttttgatg

SEQ ID NO: 33405 - DNA, 20 bp, Artificial Sequence
  Synthetic oligonucleotide; GAG chr11 5360284 5360303 5360287 -
tttttcttgtaaatttgttt

SEQ ID NO: 33406 - DNA, 20 bp, Artificial Sequence
  Synthetic oligonucleotide; TAG chr11 5360274 5360293 5360277 -
aaatttgtttgagttcatca

SEQ ID NO: 33407 - DNA, 20 bp, Artificial Sequence
  Synthetic oligonucleotide; TGG chr11 5360267 5360286 5360270 -
tttgagttcatcatagattc

SEQ ID NO: 33408 - DNA, 20 bp, Artificial Sequence
  Synthetic oligonucleotide; TAG chr11 5360260 5360279 5360263 -
tcatcatagattctggatat

SEQ ID NO: 33409 - DNA, 20 bp, Artificial Sequence
  Synthetic oligonucleotide; CGG chr11 5360249 5360268 5360252 -
tctggatattagccctttgt

SEQ ID NO: 33410 - DNA, 20 bp, Artificial Sequence
  Synthetic oligonucleotide; GAG chr11 5360244 5360263 5360247 -
atattagccctttgtcggat

SEQ ID NO: 33411 - DNA, 20 bp, Artificial Sequence
  Synthetic oligonucleotide; TAG chr11 5360241 5360260 5360244 -
ttagccctttgtcggatgag

SEQ ID NO: 33412 - DNA, 20 bp, Artificial Sequence
  Synthetic oligonucleotide; TGG chr11 5360192 5360211 5360195 -
atgttgcctgttcactctga

SEQ ID NO: 33413 - DNA, 20 bp, Artificial Sequence
  Synthetic oligonucleotide; TAG chr11 5360189 5360208 5360192 -
ttgcctgttcactctgatgg

SEQ ID NO: 33414 - DNA, 20 bp, Artificial Sequence
  Synthetic oligonucleotide; CAG chr11 5360172 5360191 5360175 -
tggtagtttcttttgctgtg

SEQ ID NO: 33415 - DNA, 20 bp, Artificial Sequence
  Synthetic oligonucleotide; AAG chr11 5360169 5360188 5360172 -
tagtttcttttgctgtgcag

SEQ ID NO: 33416 - DNA, 20 bp, Artificial Sequence
  Synthetic oligonucleotide; TAG chr11 5360161 5360180 5360164 -
tttgctgtgcagaagctctt

SEQ ID NO: 33417 - DNA, 20 bp, Artificial Sequence
  Synthetic oligonucleotide; TAG chr11 5360152 5360171 5360155 -
cagaagctctttagtttaat

SEQ ID NO: 33418 - DNA, 20 bp, Artificial Sequence
  Synthetic oligonucleotide; TGG chr11 5360132 5360151 5360135 -
tagatcccatttgtccattt

SEQ ID NO: 33419 - DNA, 20 bp, Artificial Sequence
  Synthetic oligonucleotide; TGG chr11 5360110 5360129 5360113 -
gcttttgttgccattgcttt

SEQ ID NO: 33420 - DNA, 20 bp, Artificial Sequence
  Synthetic oligonucleotide; TAG chr11 5360102 5360121 5360105 -
tgccattgcttttggtgttt

SEQ ID NO: 33421 - DNA, 20 bp, Artificial Sequence
  Synthetic oligonucleotide; AAG chr11 5360094 5360113 5360097 -
cttttggtgttttagacatg

SEQ ID NO: 33422 - DNA, 20 bp, Artificial Sequence
  Synthetic oligonucleotide; TGG chr11 5360066 5360085 5360069 -
gcccatgcctatgtcctgaa

SEQ ID NO: 33423 - DNA, 20 bp, Artificial Sequence
  Synthetic oligonucleotide; TAG chr11 5360056 5360075 5360059 -
atgtcctgaatggtattgcc

SEQ ID NO: 33424 - DNA, 20 bp, Artificial Sequence
  Synthetic oligonucleotide; AGG chr11 5360055 5360074 5360058 -
tgtcctgaatggtattgcct

SEQ ID NO: 33425 - DNA, 20 bp, Artificial Sequence
  Synthetic oligonucleotide; CAG chr11 5360044 5360063 5360047 -
gtattgcctaggttttcttc

SEQ ID NO: 33426 - DNA, 20 bp, Artificial Sequence
  Synthetic oligonucleotide; GAG chr11 5360042 5360061 5360045 -
attgcctaggttttcttcca

SEQ ID NO: 33427 - DNA, 20 bp, Artificial Sequence
  Synthetic oligonucleotide; TGG chr11 5360033 5360052 5360036 -
gttttcttccagagttttta

SEQ ID NO: 33428 - DNA, 20 bp, Artificial Sequence
  Synthetic oligonucleotide; CAG chr11 5360026 5360045 5360029 -
tccagagtttttatggtttt

SEQ ID NO: 33429 - DNA, 20 bp, Artificial Sequence
  Synthetic oligonucleotide; AAG chr11 5360013 5360032 5360016 -
tggttttcagtctaacattt

SEQ ID NO: 33430 - DNA, 20 bp, Artificial Sequence
  Synthetic oligonucleotide; AAG chr11 5359979 5359998 5359982 -
tcttgaattaatttttgtat

SEQ ID NO: 33431 - DNA, 20 bp, Artificial Sequence
  Synthetic oligonucleotide; AGG chr11 5359978 5359997 5359981 -
cttgaattaatttttgtata

SEQ ID NO: 33432 - DNA, 20 bp, Artificial Sequence
  Synthetic oligonucleotide; AAG chr11 5359972 5359991 5359975 -
ttaatttttgtataaggtgt

SEQ ID NO: 33433 - DNA, 20 bp, Artificial Sequence
  Synthetic oligonucleotide; AAG chr11 5359968 5359987 5359971 -
tttttgtataaggtgtaaga

SEQ ID NO: 33434 - DNA, 20 bp, Artificial Sequence
  Synthetic oligonucleotide; AGG chr11 5359967 5359986 5359970 -
ttttgtataaggtgtaagaa

SEQ ID NO: 33435 - DNA, 20 bp, Artificial Sequence
  Synthetic oligonucleotide; GGG chr11 5359966 5359985 5359969 -
tttgtataaggtgtaagaaa

SEQ ID NO: 33436 - DNA, 20 bp, Artificial Sequence
  Synthetic oligonucleotide; CAG chr11 5359960 5359979 5359963 -
taaggtgtaagaaagggatc

SEQ ID NO: 33437 - DNA, 20 bp, Artificial Sequence
  Synthetic oligonucleotide; CAG chr11 5359954 5359973 5359957 -
gtaagaaagggatccagttt

SEQ ID NO: 33438 - DNA, 20 bp, Artificial Sequence
  Synthetic oligonucleotide; TGG chr11 5359940 5359959 5359943 -
cagtttcagctttctgcgta

SEQ ID NO: 33439 - DNA, 20 bp, Artificial Sequence
  Synthetic oligonucleotide; TAG chr11 5359936 5359955 5359939 -
ttcagctttctgcgtatggt

SEQ ID NO: 33440 - DNA, 20 bp, Artificial Sequence
  Synthetic oligonucleotide; CAG chr11 5359932 5359951 5359935 -
gctttctgcgtatggttagc

SEQ ID NO: 33441 - DNA, 20 bp, Artificial Sequence
  Synthetic oligonucleotide; CAG chr11 5359923 5359942 5359926 -
gtatggttagccagttttcc

SEQ ID NO: 33442 - DNA, 20 bp, Artificial Sequence
  Synthetic oligonucleotide; TAG chr11 5359906 5359925 5359909 -
tcccagcaccatttattaaa

SEQ ID NO: 33443 - DNA, 20 bp, Artificial Sequence
  Synthetic oligonucleotide; AGG chr11 5359905 5359924 5359908 -
cccagcaccatttattaaat

SEQ ID NO: 33444 - DNA, 20 bp, Artificial Sequence
  Synthetic oligonucleotide; GGG chr11 5359904 5359923 5359907 -
ccagcaccatttattaaata

SEQ ID NO: 33445 - DNA, 20 bp, Artificial Sequence
  Synthetic oligonucleotide; CAG chr11 5359874 5359893 5359877 -
tccccatttgttttttttgt

SEQ ID NO: 33446 - DNA, 20 bp, Artificial Sequence
  Synthetic oligonucleotide; AGG chr11 5359873 5359892 5359876 -
ccccatttgttttttttgtc

SEQ ID NO: 33447 - DNA, 20 bp, Artificial Sequence
  Synthetic oligonucleotide; AAG chr11 5359863 5359882 5359866 -
tttttttgtcaggtttgtca

SEQ ID NO: 33448 - DNA, 20 bp, Artificial Sequence
  Synthetic oligonucleotide; CAG chr11 5359858 5359877 5359861 -
ttgtcaggtttgtcaaagat

SEQ ID NO: 33449 - DNA, 20 bp, Artificial Sequence
  Synthetic oligonucleotide; TGG chr11 5359854 5359873 5359857 -
caggtttgtcaaagatcaga

SEQ ID NO: 33450 - DNA, 20 bp, Artificial Sequence
  Synthetic oligonucleotide; TAG chr11 5359848 5359867 5359851 -
tgtcaaagatcagatggttg

SEQ ID NO: 33451 - DNA, 20 bp, Artificial Sequence
  Synthetic oligonucleotide; CGG chr11 5359840 5359859 5359843 -
atcagatggttgtagacatg

SEQ ID NO: 33452 - DNA, 20 bp, Artificial Sequence
  Synthetic oligonucleotide; GAG chr11 5359827 5359846 5359830 -
agacatgcggcattatttct

SEQ ID NO: 33453 - DNA, 20 bp, Artificial Sequence
  Synthetic oligonucleotide; AGG chr11 5359826 5359845 5359829 -
gacatgcggcattatttctg

SEQ ID NO: 33454 - DNA, 20 bp, Artificial Sequence
  Synthetic oligonucleotide; TGG chr11 5359806 5359825 5359809 -
aggcctctgttctgttccat

SEQ ID NO: 33455 - DNA, 20 bp, Artificial Sequence
  Synthetic oligonucleotide; TGG chr11 5359788 5359807 5359791 -
attggtctatatctctgttt

SEQ ID NO: 33456 - DNA, 20 bp, Artificial Sequence
  Synthetic oligonucleotide; CAG chr11 5359782 5359801 5359785 -
ctatatctctgttttggtac

SEQ ID NO: 33457 - DNA, 20 bp, Artificial Sequence
  Synthetic oligonucleotide; TGG chr11 5359766 5359785 5359769 -
gtaccagtaccatgctgttt

SEQ ID NO: 33458 - DNA, 20 bp, Artificial Sequence
  Synthetic oligonucleotide; TAG chr11 5359757 5359776 5359760 -
ccatgctgttttggttactg

SEQ ID NO: 33459 - DNA, 20 bp, Artificial Sequence
  Synthetic oligonucleotide; TAG chr11 5359749 5359768 5359752 -
ttttggttactgtagccttg

SEQ ID NO: 33460 - DNA, 20 bp, Artificial Sequence
  Synthetic oligonucleotide; TAG chr11 5359744 5359763 5359747 -
gttactgtagccttgtagta

SEQ ID NO: 33461 - DNA, 20 bp, Artificial Sequence
  Synthetic oligonucleotide; AAG chr11 5359737 5359756 5359740 -
tagccttgtagtatagtttg

SEQ ID NO: 33462 - DNA, 20 bp, Artificial Sequence
  Synthetic oligonucleotide; CAG chr11 5359733 5359752 5359736 -
cttgtagtatagtttgaagt

SEQ ID NO: 33463 - DNA, 20 bp, Artificial Sequence
  Synthetic oligonucleotide; AGG chr11 5359732 5359751 5359735 -
ttgtagtatagtttgaagtc

SEQ ID NO: 33464 - DNA, 20 bp, Artificial Sequence
  Synthetic oligonucleotide; TAG chr11 5359729 5359748 5359732 -
tagtatagtttgaagtcagg

SEQ ID NO: 33465 - DNA, 20 bp, Artificial Sequence
  Synthetic oligonucleotide; CAG chr11 5359715 5359734 5359718 -
gtcaggtagcgtgatgcctc

SEQ ID NO: 33466 - DNA, 20 bp, Artificial Sequence
  Synthetic oligonucleotide; TGG chr11 5359701 5359720 5359704 -
tgcctccagctttgttcttt

SEQ ID NO: 33467 - DNA, 20 bp, Artificial Sequence
  Synthetic oligonucleotide; TAG chr11 5359696 5359715 5359699 -
ccagctttgttcttttggct

SEQ ID NO: 33468 - DNA, 20 bp, Artificial Sequence
  Synthetic oligonucleotide; AGG chr11 5359695 5359714 5359698 -
cagctttgttcttttggctt

SEQ ID NO: 33469 - DNA, 20 bp, Artificial Sequence
  Synthetic oligonucleotide; TGG chr11 5359690 5359709 5359693 -
ttgttcttttggcttaggat

SEQ ID NO: 33470 - DNA, 20 bp, Artificial Sequence
  Synthetic oligonucleotide; TGG chr11 5359677 5359696 5359680 -
ttaggattggcatgtcaatg

SEQ ID NO: 33471 - DNA, 20 bp, Artificial Sequence
  Synthetic oligonucleotide; GGG chr11 5359676 5359695 5359679 -
taggattggcatgtcaatgt

SEQ ID NO: 33472 - DNA, 20 bp, Artificial Sequence
  Synthetic oligonucleotide; TGG chr11 5359665 5359684 5359668 -
tgtcaatgtgggctcttttt

SEQ ID NO: 33473 - DNA, 20 bp, Artificial Sequence
  Synthetic oligonucleotide; AAG chr11 5359646 5359665 5359649 -
ttggttccatatgaacttta

SEQ ID NO: 33474 - DNA, 20 bp, Artificial Sequence
  Synthetic oligonucleotide; TAG chr11 5359643 5359662 5359646 -
gttccatatgaactttaaag

SEQ ID NO: 33475 - DNA, 20 bp, Artificial Sequence
  Synthetic oligonucleotide; AAG chr11 5359623 5359642 5359626 -
tagttttttccaattctgtg

SEQ ID NO: 33476 - DNA, 20 bp, Artificial Sequence
  Synthetic oligonucleotide; AAG chr11 5359619 5359638 5359622 -
tttttccaattctgtgaaga

SEQ ID NO: 33477 - DNA, 20 bp, Artificial Sequence
  Synthetic oligonucleotide; TGG chr11 5359612 5359631 5359615 -
aattctgtgaagaaagtcat

SEQ ID NO: 33478 - DNA, 20 bp, Artificial Sequence
  Synthetic oligonucleotide; TAG chr11 5359609 5359628 5359612 -
tctgtgaagaaagtcattgg

SEQ ID NO: 33479 - DNA, 20 bp, Artificial Sequence
  Synthetic oligonucleotide; TGG chr11 5359601 5359620 5359604 -
gaaagtcattggtagcttga

SEQ ID NO: 33480 - DNA, 20 bp, Artificial Sequence
  Synthetic oligonucleotide; GGG chr11 5359600 5359619 5359603 -
aaagtcattggtagcttgat

SEQ ID NO: 33481 - DNA, 20 bp, Artificial Sequence
  Synthetic oligonucleotide; GGG chr11 5359599 5359618 5359602 -
aagtcattggtagcttgatg

SEQ ID NO: 33482 - DNA, 20 bp, Artificial Sequence
  Synthetic oligonucleotide; TGG chr11 5359595 5359614 5359598 -
cattggtagcttgatgggga

SEQ ID NO: 33483 - DNA, 20 bp, Artificial Sequence
  Synthetic oligonucleotide; TGG chr11 5359571 5359590 5359574 -
attgaatctataaattacct

SEQ ID NO: 33484 - DNA, 20 bp, Artificial Sequence
  Synthetic oligonucleotide; GGG chr11 5359570 5359589 5359573 -
ttgaatctataaattacctt

SEQ ID NO: 33485 - DNA, 20 bp, Artificial Sequence
  Synthetic oligonucleotide; TGG chr11 5359562 5359581 5359565 -
ataaattaccttgggctgta

SEQ ID NO: 33486 - DNA, 20 bp, Artificial Sequence
  Synthetic oligonucleotide; GAG chr11 5359527 5359546 5359530 -
tattgattcttcctacccat

SEQ ID NO: 33487 - DNA, 20 bp, Artificial Sequence
  Synthetic oligonucleotide; TGG chr11 5359522 5359541 5359525 -
attcttcctacccatgagca

SEQ ID NO: 33488 - DNA, 20 bp, Artificial Sequence
  Synthetic oligonucleotide; CAG chr11 5359480 5359499 5359483 -
gtatcttcttttatttcatt

SEQ ID NO: 33489 - DNA, 20 bp, Artificial Sequence
  Synthetic oligonucleotide; CAG chr11 5359477 5359496 5359480 -
tcttcttttatttcattcag

SEQ ID NO: 33490 - DNA, 20 bp, Artificial Sequence
  Synthetic oligonucleotide; TGG chr11 5359474 5359493 5359477 -
tcttttatttcattcagcag

SEQ ID NO: 33491 - DNA, 20 bp, Artificial Sequence
  Synthetic oligonucleotide; TAG chr11 5359467 5359486 5359470 -
tttcattcagcagtggtttg

SEQ ID NO: 33492 - DNA, 20 bp, Artificial Sequence
  Synthetic oligonucleotide; AAG chr11 5359455 5359474 5359458 -
gtggtttgtagttctccttg

SEQ ID NO: 33493 - DNA, 20 bp, Artificial Sequence
  Synthetic oligonucleotide; GAG chr11 5359453 5359472 5359456 -
ggtttgtagttctccttgaa

SEQ ID NO: 33494 - DNA, 20 bp, Artificial Sequence
  Synthetic oligonucleotide; AGG chr11 5359452 5359471 5359455 -
gtttgtagttctccttgaag

SEQ ID NO: 33495 - DNA, 20 bp, Artificial Sequence
  Synthetic oligonucleotide; AAG chr11 5359432 5359451 5359435 -
aggtccttcacctctcttgt

SEQ ID NO: 33496 - DNA, 20 bp, Artificial Sequence
  Synthetic oligonucleotide; TGG chr11 5359428 5359447 5359431 -
ccttcacctctcttgtaagt

SEQ ID NO: 33497 - DNA, 20 bp, Artificial Sequence
  Synthetic oligonucleotide; TAG chr11 5359420 5359439 5359423 -
tctcttgtaagttggattcc

SEQ ID NO: 33498 - DNA, 20 bp, Artificial Sequence
  Synthetic oligonucleotide; AGG chr11 5359419 5359438 5359422 -
ctcttgtaagttggattcct

SEQ ID NO: 33499 - DNA, 20 bp, Artificial Sequence
  Synthetic oligonucleotide; AAG chr11 5359400 5359419 5359403 -
taggtattttattctctttg

SEQ ID NO: 33500 - DNA, 20 bp, Artificial Sequence
  Synthetic oligonucleotide; TGG chr11 5359387 5359406 5359390 -
ctctttgaagcaattgtgaa

SEQ ID NO: 33501 - DNA, 20 bp, Artificial Sequence
  Synthetic oligonucleotide; GGG chr11 5359386 5359405 5359389 -
tctttgaagcaattgtgaat

SEQ ID NO: 33502 - DNA, 20 bp, Artificial Sequence
  Synthetic oligonucleotide; GAG chr11 5359384 5359403 5359387 -
tttgaagcaattgtgaatgg

SEQ ID NO: 33503 - DNA, 20 bp, Artificial Sequence
  Synthetic oligonucleotide; TGG chr11 5359368 5359387 5359371 -
atgggagttccctcatgatt

SEQ ID NO: 33504 - DNA, 20 bp, Artificial Sequence
  Synthetic oligonucleotide; TGG chr11 5359346 5359365 5359349 -
gctctctgtttgtctgttat

SEQ ID NO: 33505 - DNA, 20 bp, Artificial Sequence
  Synthetic oligonucleotide; AAG chr11 5359338 5359357 5359341 -
tttgtctgttattggtgtat

SEQ ID NO: 33506 - DNA, 20 bp, Artificial Sequence
  Synthetic oligonucleotide; GAG chr11 5359299 5359318 5359302 -
gcacattgattttgtatcct

SEQ ID NO: 33507 - DNA, 20 bp, Artificial Sequence
  Synthetic oligonucleotide; AAG chr11 5359287 5359306 5359290 -
tgtatcctgagactttgctg

SEQ ID NO: 33508 - DNA, 20 bp, Artificial Sequence
  Synthetic oligonucleotide; CAG chr11 5359276 5359295 5359279 -
actttgctgaagttgcctat

SEQ ID NO: 33509 - DNA, 20 bp, Artificial Sequence
  Synthetic oligonucleotide; AAG chr11 5359270 5359289 5359273 -
ctgaagttgcctatcagttt

SEQ ID NO: 33510 - DNA, 20 bp, Artificial Sequence
  Synthetic oligonucleotide; AGG chr11 5359269 5359288 5359272 -
tgaagttgcctatcagttta

SEQ ID NO: 33511 - DNA, 20 bp, Artificial Sequence
  Synthetic oligonucleotide; TGG chr11 5359260 5359279 5359263 -
ctatcagtttaaggacattt

SEQ ID NO: 33512 - DNA, 20 bp, Artificial Sequence
  Synthetic oligonucleotide; GGG chr11 5359259 5359278 5359262 -
tatcagtttaaggacatttt

SEQ ID NO: 33513 - DNA, 20 bp, Artificial Sequence
  Synthetic oligonucleotide; GAG chr11 5359254 5359273 5359257 -
gtttaaggacattttgggct

SEQ ID NO: 33514 - DNA, 20 bp, Artificial Sequence
  Synthetic oligonucleotide; CAG chr11 5359250 5359269 5359253 -
aaggacattttgggctgaga

SEQ ID NO: 33515 - DNA, 20 bp, Artificial Sequence
  Synthetic oligonucleotide; TGG chr11 5359247 5359266 5359250 -
gacattttgggctgagacag

SEQ ID NO: 33516 - DNA, 20 bp, Artificial Sequence
  Synthetic oligonucleotide; GGG chr11 5359246 5359265 5359249 -
acattttgggctgagacagt

SEQ ID NO: 33517 - DNA, 20 bp, Artificial Sequence
  Synthetic oligonucleotide; GGG chr11 5359245 5359264 5359248 -
cattttgggctgagacagtg

SEQ ID NO: 33518 - DNA, 20 bp, Artificial Sequence
  Synthetic oligonucleotide; TAG chr11 5359237 5359256 5359240 -
gctgagacagtggggttttc

SEQ ID NO: 33519 - DNA, 20 bp, Artificial Sequence
  Synthetic oligonucleotide; CAG chr11 5359210 5359229 5359213 -
acaatcgtgtcatctgcaaa

SEQ ID NO: 33520 - DNA, 20 bp, Artificial Sequence
  Synthetic oligonucleotide; AGG chr11 5359209 5359228 5359212 -
caatcgtgtcatctgcaaac

SEQ ID NO: 33521 - DNA, 20 bp, Artificial Sequence
  Synthetic oligonucleotide; GGG chr11 5359208 5359227 5359211 -
aatcgtgtcatctgcaaaca

SEQ ID NO: 33522 - DNA, 20 bp, Artificial Sequence
  Synthetic oligonucleotide; TGG chr11 5359143 5359162 5359146 -
cttctcctgcctaattgccc

SEQ ID NO: 33523 - DNA, 20 bp, Artificial Sequence
  Synthetic oligonucleotide; CAG chr11 5359139 5359158 5359142 -
tcctgcctaattgccctggc

SEQ ID NO: 33524 - DNA, 20 bp, Artificial Sequence
  Synthetic oligonucleotide; TAG chr11 5359115 5359134 5359118 -
aattccaacactatgttgaa

SEQ ID NO: 33525 - DNA, 20 bp, Artificial Sequence
  Synthetic oligonucleotide; AGG chr11 5359114 5359133 5359117 -
attccaacactatgttgaat

SEQ ID NO: 33526 - DNA, 20 bp, Artificial Sequence
  Synthetic oligonucleotide; GAG chr11 5359112 5359131 5359115 -
tccaacactatgttgaatag

SEQ ID NO: 33527 - DNA, 20 bp, Artificial Sequence
  Synthetic oligonucleotide; TAG chr11 5359109 5359128 5359112 -
aacactatgttgaataggag

SEQ ID NO: 33528 - DNA, 20 bp, Artificial Sequence
  Synthetic oligonucleotide; GAG chr11 5359105 5359124 5359108 -
ctatgttgaataggagtagt

SEQ ID NO: 33529 - DNA, 20 bp, Artificial Sequence
  Synthetic oligonucleotide; GAG chr11 5359103 5359122 5359106 -
atgttgaataggagtagtga

SEQ ID NO: 33530 - DNA, 20 bp, Artificial Sequence
  Synthetic oligonucleotide; GAG chr11 5359101 5359120 5359104 -
gttgaataggagtagtgaga

SEQ ID NO: 33531 - DNA, 20 bp, Artificial Sequence
  Synthetic oligonucleotide; AGG chr11 5359100 5359119 5359103 -
ttgaataggagtagtgagag

SEQ ID NO: 33532 - DNA, 20 bp, Artificial Sequence
  Synthetic oligonucleotide; GGG chr11 5359099 5359118 5359102 -
tgaataggagtagtgagaga

SEQ ID NO: 33533 - DNA, 20 bp, Artificial Sequence
  Synthetic oligonucleotide; CAG chr11 5359080 5359099 5359083 -
agggcatccctgtcttgtgc

SEQ ID NO: 33534 - DNA, 20 bp, Artificial Sequence
  Synthetic oligonucleotide; AAG chr11 5359071 5359090 5359074 -
ctgtcttgtgccagttttca

SEQ ID NO: 33535 - DNA, 20 bp, Artificial Sequence
  Synthetic oligonucleotide; AGG chr11 5359070 5359089 5359073 -
tgtcttgtgccagttttcaa

SEQ ID NO: 33536 - DNA, 20 bp, Artificial Sequence
  Synthetic oligonucleotide; GGG chr11 5359069 5359088 5359072 -
gtcttgtgccagttttcaaa

SEQ ID NO: 33537 - DNA, 20 bp, Artificial Sequence
  Synthetic oligonucleotide; CAG chr11 5359058 5359077 5359061 -
gttttcaaagggaatgcttc

SEQ ID NO: 33538 - DNA, 20 bp, Artificial Sequence
  Synthetic oligonucleotide; CAG chr11 5359043 5359062 5359046 -
gcttccagtttttgtccatt

SEQ ID NO: 33539 - DNA, 20 bp, Artificial Sequence
  Synthetic oligonucleotide; TGG chr11 5359032 5359051 5359035 -
ttgtccattcagtatgatat

SEQ ID NO: 33540 - DNA, 20 bp, Artificial Sequence
  Synthetic oligonucleotide; TGG chr11 5359026 5359045 5359029 -
attcagtatgatattggctg

SEQ ID NO: 33541 - DNA, 20 bp, Artificial Sequence
  Synthetic oligonucleotide; GGG chr11 5359025 5359044 5359028 -
ttcagtatgatattggctgt

SEQ ID NO: 33542 - DNA, 20 bp, Artificial Sequence
  Synthetic oligonucleotide; TAG chr11 5359015 5359034 5359018 -
tattggctgtgggtttgtca

SEQ ID NO: 33543 - DNA, 20 bp, Artificial Sequence
  Synthetic oligonucleotide; TGG chr11 5359011 5359030 5359014 -
ggctgtgggtttgtcataga

SEQ ID NO: 33544 - DNA, 20 bp, Artificial Sequence
  Synthetic oligonucleotide; GAG chr11 5358995 5359014 5358998 -
tagatggctcttattatttt

SEQ ID NO: 33545 - DNA, 20 bp, Artificial Sequence
  Synthetic oligonucleotide; GAG chr11 5358965 5358984 5358968 -
ccatcaatacctaatttatt

SEQ ID NO: 33546 - DNA, 20 bp, Artificial Sequence
  Synthetic oligonucleotide; GAG chr11 5358963 5358982 5358966 -
atcaatacctaatttattga

SEQ ID NO: 33547 - DNA, 20 bp, Artificial Sequence
  Synthetic oligonucleotide; TAG chr11 5358956 5358975 5358959 -
cctaatttattgagagtttt

SEQ ID NO: 33548 - DNA, 20 bp, Artificial Sequence
  Synthetic oligonucleotide; AAG chr11 5358949 5358968 5358952 -
tattgagagtttttagcatg

SEQ ID NO: 33549 - DNA, 20 bp, Artificial Sequence
  Synthetic oligonucleotide; AGG chr11 5358948 5358967 5358951 -
attgagagtttttagcatga

SEQ ID NO: 33550 - DNA, 20 bp, Artificial Sequence
  Synthetic oligonucleotide; GGG chr11 5358947 5358966 5358950 -
ttgagagtttttagcatgaa

SEQ ID NO: 33551 - DNA, 20 bp, Artificial Sequence
  Synthetic oligonucleotide; AAG chr11 5358928 5358947 5358931 -
agggttgttgaattttgtca

SEQ ID NO: 33552 - DNA, 20 bp, Artificial Sequence
  Synthetic oligonucleotide; AGG chr11 5358927 5358946 5358930 -
gggttgttgaattttgtcaa

SEQ ID NO: 33553 - DNA, 20 bp, Artificial Sequence
  Synthetic oligonucleotide; GAG chr11 5358907 5358926 5358910 -
aggccttttctgcatctatt

SEQ ID NO: 33554 - DNA, 20 bp, Artificial Sequence
  Synthetic oligonucleotide; TGG chr11 5358895 5358914 5358898 -
catctattgagataatcatg

SEQ ID NO: 33555 - DNA, 20 bp, Artificial Sequence
  Synthetic oligonucleotide; TGG chr11 5358882 5358901 5358885 -
aatcatgtggtttttgtctt

SEQ ID NO: 33556 - DNA, 20 bp, Artificial Sequence
  Synthetic oligonucleotide; TGG chr11 5358865 5358884 5358868 -
ctttggttctgtttatatgc

SEQ ID NO: 33557 - DNA, 20 bp, Artificial Sequence
  Synthetic oligonucleotide; CAG chr11 5358832 5358851 5358835 -
ttgatttgcatatgttgaac

SEQ ID NO: 33558 - DNA, 20 bp, Artificial Sequence
  Synthetic oligonucleotide; CAG chr11 5358819 5358838 5358822 -
gttgaaccagccttgcatcc

SEQ ID NO: 33559 - DNA, 20 bp, Artificial Sequence
  Synthetic oligonucleotide; AGG chr11 5358818 5358837 5358821 -
ttgaaccagccttgcatccc

SEQ ID NO: 33560 - DNA, 20 bp, Artificial Sequence
  Synthetic oligonucleotide; GGG chr11 5358817 5358836 5358820 -
tgaaccagccttgcatccca

SEQ ID NO: 33561 - DNA, 20 bp, Artificial Sequence
  Synthetic oligonucleotide; AAG chr11 5358811 5358830 5358814 -
agccttgcatcccagggatg

SEQ ID NO: 33562 - DNA, 20 bp, Artificial Sequence
  Synthetic oligonucleotide; TGG chr11 5358796 5358815 5358799 -
ggatgaagcccacttgatca

SEQ ID NO: 33563 - DNA, 20 bp, Artificial Sequence
  Synthetic oligonucleotide; TGG chr11 5358793 5358812 5358796 -
tgaagcccacttgatcatgg

SEQ ID NO: 33564 - DNA, 20 bp, Artificial Sequence
  Synthetic oligonucleotide; AAG chr11 5358788 5358807 5358791 -
cccacttgatcatggtggat

SEQ ID NO: 33565 - DNA, 20 bp, Artificial Sequence
  Synthetic oligonucleotide; TGG chr11 5358781 5358800 5358784 -
gatcatggtggataagcttt

SEQ ID NO: 33566 - DNA, 20 bp, Artificial Sequence
  Synthetic oligonucleotide; TGG chr11 5358769 5358788 5358772 -
taagcttttggatgtgctgc

SEQ ID NO: 33567 - DNA, 20 bp, Artificial Sequence
  Synthetic oligonucleotide; CAG chr11 5358755 5358774 5358758 -
tgctgctggatttgctttgc

SEQ ID NO: 33568 - DNA, 20 bp, Artificial Sequence
  Synthetic oligonucleotide; GAG chr11 5358743 5358762 5358746 -
tgctttgccagtattttatt

SEQ ID NO: 33569 - DNA, 20 bp, Artificial Sequence
  Synthetic oligonucleotide; AGG chr11 5358742 5358761 5358745 -
gctttgccagtattttattg

SEQ ID NO: 33570 - DNA, 20 bp, Artificial Sequence
  Synthetic oligonucleotide; CAG chr11 5358719 5358738 5358722 -
ttttttgcatcgatgtccat

SEQ ID NO: 33571 - DNA, 20 bp, Artificial Sequence
  Synthetic oligonucleotide; AGG chr11 5358718 5358737 5358721 -
tttttgcatcgatgtccatc

SEQ ID NO: 33572 - DNA, 20 bp, Artificial Sequence
  Synthetic oligonucleotide; GGG chr11 5358717 5358736 5358720 -
ttttgcatcgatgtccatca

SEQ ID NO: 33573 - DNA, 20 bp, Artificial Sequence
  Synthetic oligonucleotide; TGG chr11 5358710 5358729 5358713 -
tcgatgtccatcagggatat

SEQ ID NO: 33574 - DNA, 20 bp, Artificial Sequence
  Synthetic oligonucleotide; CGG chr11 5358674 5358693 5358677 -
ttttttgttgtgtctctgcc

SEQ ID NO: 33575 - DNA, 20 bp, Artificial Sequence
  Synthetic oligonucleotide; TGG chr11 5358668 5358687 5358671 -
gttgtgtctctgcccggctt

SEQ ID NO: 33576 - DNA, 20 bp, Artificial Sequence
  Synthetic oligonucleotide; CAG chr11 5358662 5358681 5358665 -
tctctgcccggctttggtat

SEQ ID NO: 33577 - DNA, 20 bp, Artificial Sequence
  Synthetic oligonucleotide; AGG chr11 5358661 5358680 5358664 -
ctctgcccggctttggtatc

SEQ ID NO: 33578 - DNA, 20 bp, Artificial Sequence
  Synthetic oligonucleotide; TGG chr11 5358651 5358670 5358654 -
ctttggtatcaggatgatgc

SEQ ID NO: 33579 - DNA, 20 bp, Artificial Sequence
  Synthetic oligonucleotide; GAG chr11 5358637 5358656 5358640 -
tgatgctggcctcataaaat

SEQ ID NO: 33580 - DNA, 20 bp, Artificial Sequence
  Synthetic oligonucleotide; TAG chr11 5358633 5358652 5358636 -
gctggcctcataaaatgagt

SEQ ID NO: 33581 - DNA, 20 bp, Artificial Sequence
  Synthetic oligonucleotide; AGG chr11 5358632 5358651 5358635 -
ctggcctcataaaatgagtt

SEQ ID NO: 33582 - DNA, 20 bp, Artificial Sequence
  Synthetic oligonucleotide; GGG chr11 5358631 5358650 5358634 -
tggcctcataaaatgagtta

SEQ ID NO: 33583 - DNA, 20 bp, Artificial Sequence
  Synthetic oligonucleotide; GAG chr11 5358629 5358648 5358632 -
gcctcataaaatgagttagg

SEQ ID NO: 33584 - DNA, 20 bp, Artificial Sequence
  Synthetic oligonucleotide; AGG chr11 5358628 5358647 5358631 -
cctcataaaatgagttaggg

SEQ ID NO: 33585 - DNA, 20 bp, Artificial Sequence
  Synthetic oligonucleotide; TAG chr11 5358599 5358618 5358602 -
tcttttactattgattcgaa

SEQ ID NO: 33586 - DNA, 20 bp, Artificial Sequence
  Synthetic oligonucleotide; CAG chr11 5358593 5358612 5358596 -
actattgattcgaatagttt

SEQ ID NO: 33587 - DNA, 20 bp, Artificial Sequence
  Synthetic oligonucleotide; GAG chr11 5358591 5358610 5358594 -
tattgattcgaatagtttca

SEQ ID NO: 33588 - DNA, 20 bp, Artificial Sequence
  Synthetic oligonucleotide; AGG chr11 5358590 5358609 5358593 -
attgattcgaatagtttcag

SEQ ID NO: 33589 - DNA, 20 bp, Artificial Sequence
  Synthetic oligonucleotide; GGG chr11 5358589 5358608 5358592 -
ttgattcgaatagtttcaga

SEQ ID NO: 33590 - DNA, 20 bp, Artificial Sequence
  Synthetic oligonucleotide; TGG chr11 5358584 5358603 5358587 -
tcgaatagtttcagagggaa

SEQ ID NO: 33591 - DNA, 20 bp, Artificial Sequence
  Synthetic oligonucleotide; CAG chr11 5358578 5358597 5358581 -
agtttcagagggaatggtac

SEQ ID NO: 33592 - DNA, 20 bp, Artificial Sequence
  Synthetic oligonucleotide; TGG chr11 5358559 5358578 5358562 -
ccagctcctccttgtacctc

SEQ ID NO: 33593 - DNA, 20 bp, Artificial Sequence
  Synthetic oligonucleotide; TAG chr11 5358556 5358575 5358559 -
gctcctccttgtacctctgg

SEQ ID NO: 33594 - DNA, 20 bp, Artificial Sequence
  Synthetic oligonucleotide; TGG chr11 5358549 5358568 5358552 -
cttgtacctctggtagaatt

SEQ ID NO: 33595 - DNA, 20 bp, Artificial Sequence
  Synthetic oligonucleotide; TGG chr11 5358533 5358552 5358536 -
aatttggctgtgactccatc

SEQ ID NO: 33596 - DNA, 20 bp, Artificial Sequence
  Synthetic oligonucleotide; TGG chr11 5358527 5358546 5358530 -
gctgtgactccatctggtcc

SEQ ID NO: 33597 - DNA, 20 bp, Artificial Sequence
  Synthetic oligonucleotide; TGG chr11 5358516 5358535 5358519 -
atctggtcctggactgtttt

SEQ ID NO: 33598 - DNA, 20 bp, Artificial Sequence
  Synthetic oligonucleotide; TGG chr11 5358512 5358531 5358515 -
ggtcctggactgtttttggt

SEQ ID NO: 33599 - DNA, 20 bp, Artificial Sequence
  Synthetic oligonucleotide; AAG chr11 5358508 5358527 5358511 -
ctggactgtttttggttggt

SEQ ID NO: 33600 - DNA, 20 bp, Artificial Sequence
  Synthetic oligonucleotide; CAG chr11 5358483 5358502 5358486 -
attaattattgcctcaattt

SEQ ID NO: 33601 - DNA, 20 bp, Artificial Sequence
  Synthetic oligonucleotide; TGG chr11 5358470 5358489 5358473 -
tcaatttcagatcctgttat

SEQ ID NO: 33602 - DNA, 20 bp, Artificial Sequence
  Synthetic oligonucleotide; CAG chr11 5358461 5358480 5358464 -
gatcctgttattggtctatt

SEQ ID NO: 33603 - DNA, 20 bp, Artificial Sequence
  Synthetic oligonucleotide; GAG chr11 5358459 5358478 5358462 -
tcctgttattggtctattca

SEQ ID NO: 33604 - DNA, 20 bp, Artificial Sequence
  Synthetic oligonucleotide; TGG chr11 5358442 5358461 5358445 -
tcagagattcaacttcttcc

SEQ ID NO: 33605 - DNA, 20 bp, Artificial Sequence
  Synthetic oligonucleotide; TAG chr11 5358437 5358456 5358440 -
gattcaacttcttcctggtt

SEQ ID NO: 33606 - DNA, 20 bp, Artificial Sequence
  Synthetic oligonucleotide; TGG chr11 5358431 5358450 5358434 -
acttcttcctggtttagtct

SEQ ID NO: 33607 - DNA, 20 bp, Artificial Sequence
  Synthetic oligonucleotide; GGG chr11 5358430 5358449 5358433 -
cttcttcctggtttagtctt

SEQ ID NO: 33608 - DNA, 20 bp, Artificial Sequence
  Synthetic oligonucleotide; GAG chr11 5358428 5358447 5358431 -
tcttcctggtttagtcttgg

SEQ ID NO: 33609 - DNA, 20 bp, Artificial Sequence
  Synthetic oligonucleotide; AGG chr11 5358427 5358446 5358430 -
cttcctggtttagtcttggg

SEQ ID NO: 33610 - DNA, 20 bp, Artificial Sequence
  Synthetic oligonucleotide; GGG chr11 5358426 5358445 5358429 -
ttcctggtttagtcttggga

SEQ ID NO: 33611 - DNA, 20 bp, Artificial Sequence
  Synthetic oligonucleotide; AAG chr11 5358413 5358432 5358416 -
cttgggagggtgtatgtgtc

SEQ ID NO: 33612 - DNA, 20 bp, Artificial Sequence
  Synthetic oligonucleotide; AGG chr11 5358412 5358431 5358415 -
ttgggagggtgtatgtgtca

SEQ ID NO: 33613 - DNA, 20 bp, Artificial Sequence
  Synthetic oligonucleotide; TAG chr11 5358392 5358411 5358395 -
aggaatttatccatttcttc

SEQ ID NO: 33614 - DNA, 20 bp, Artificial Sequence
  Synthetic oligonucleotide; TAG chr11 5358383 5358402 5358386 -
tccatttcttctagattttc

SEQ ID NO: 33615 - DNA, 20 bp, Artificial Sequence
  Synthetic oligonucleotide; TAG chr11 5358370 5358389 5358373 -
gattttctagtttatttgtg

SEQ ID NO: 33616 - DNA, 20 bp, Artificial Sequence
  Synthetic oligonucleotide; GAG chr11 5358368 5358387 5358371 -
ttttctagtttatttgtgta

SEQ ID NO: 33617 - DNA, 20 bp, Artificial Sequence
  Synthetic oligonucleotide; AGG chr11 5358367 5358386 5358370 -
tttctagtttatttgtgtag

SEQ ID NO: 33618 - DNA, 20 bp, Artificial Sequence
  Synthetic oligonucleotide; TAG chr11 5358358 5358377 5358361 -
tatttgtgtagaggtgttta

SEQ ID NO: 33619 - DNA, 20 bp, Artificial Sequence
  Synthetic oligonucleotide; TGG chr11 5358345 5358364 5358348 -
gtgtttatagtattctctga

SEQ ID NO: 33620 - DNA, 20 bp, Artificial Sequence
  Synthetic oligonucleotide; TGG chr11 5358342 5358361 5358345 -
tttatagtattctctgatgg

SEQ ID NO: 33621 - DNA, 20 bp, Artificial Sequence
  Synthetic oligonucleotide; TGG chr11 5358327 5358346 5358330 -
gatggtggtttgtatttctg

SEQ ID NO: 33622 - DNA, 20 bp, Artificial Sequence
  Synthetic oligonucleotide; GGG chr11 5358326 5358345 5358329 -
atggtggtttgtatttctgt

SEQ ID NO: 33623 - DNA, 20 bp, Artificial Sequence
  Synthetic oligonucleotide; CGG chr11 5358321 5358340 5358324 -
ggtttgtatttctgtgggat

SEQ ID NO: 33624 - DNA, 20 bp, Artificial Sequence
  Synthetic oligonucleotide; TGG chr11 5358318 5358337 5358321 -
ttgtatttctgtgggatcgg

SEQ ID NO: 33625 - DNA, 20 bp, Artificial Sequence
  Synthetic oligonucleotide; TAG chr11 5358254 5358273 5358257 -
ttctctcttttcttctttat

SEQ ID NO: 33626 - DNA, 20 bp, Artificial Sequence
  Synthetic oligonucleotide; TAG chr11 5358245 5358264 5358248 -
ttcttctttattagtcttgc

SEQ ID NO: 33627 - DNA, 20 bp, Artificial Sequence
  Synthetic oligonucleotide; CAG chr11 5358242 5358261 5358245 -
ttctttattagtcttgctag

SEQ ID NO: 33628 - DNA, 20 bp, Artificial Sequence
  Synthetic oligonucleotide; CAG chr11 5358208 5358227 5358211 -
tgttgatctttttgaaaaac

SEQ ID NO: 33629 - DNA, 20 bp, Artificial Sequence
  Synthetic oligonucleotide; TGG chr11 5358201 5358220 5358204 -
ctttttgaaaaaccagcttc

SEQ ID NO: 33630 - DNA, 20 bp, Artificial Sequence
  Synthetic oligonucleotide; AAG chr11 5358182 5358201 5358185 -
ctggattcattgattttttg

SEQ ID NO: 33631 - DNA, 20 bp, Artificial Sequence
  Synthetic oligonucleotide; AGG chr11 5358181 5358200 5358184 -
tggattcattgattttttga

SEQ ID NO: 33632 - DNA, 20 bp, Artificial Sequence
  Synthetic oligonucleotide; GGG chr11 5358180 5358199 5358183 -
ggattcattgattttttgaa

SEQ ID NO: 33633 - DNA, 20 bp, Artificial Sequence
  Synthetic oligonucleotide; CAG chr11 5358154 5358173 5358157 -
ttttgtgtctctatttcctt

SEQ ID NO: 33634 - DNA, 20 bp, Artificial Sequence
  Synthetic oligonucleotide; TAG chr11 5358137 5358156 5358140 -
cttcagttctgctctgattt

SEQ ID NO: 33635 - DNA, 20 bp, Artificial Sequence
  Synthetic oligonucleotide; TAG chr11 5358116 5358135 5358119 -
agttatttcttgccttctgc

SEQ ID NO: 33636 - DNA, 20 bp, Artificial Sequence
  Synthetic oligonucleotide; TAG chr11 5358085 5358104 5358088 -
tgtgtttgctcttgcttctc

SEQ ID NO: 33637 - DNA, 20 bp, Artificial Sequence
  Synthetic oligonucleotide; TAG chr11 5358064 5358083 5358067 -
agttcttttaattgtgatgt

SEQ ID NO: 33638 - DNA, 20 bp, Artificial Sequence
  Synthetic oligonucleotide; AGG chr11 5358063 5358082 5358066 -
gttcttttaattgtgatgtt

SEQ ID NO: 33639 - DNA, 20 bp, Artificial Sequence
  Synthetic oligonucleotide; GGG chr11 5358062 5358081 5358065 -
ttcttttaattgtgatgtta

SEQ ID NO: 33640 - DNA, 20 bp, Artificial Sequence
  Synthetic oligonucleotide; TAG chr11 5358050 5358069 5358053 -
tgatgttagggtgtcaattt

SEQ ID NO: 33641 - DNA, 20 bp, Artificial Sequence
  Synthetic oligonucleotide; TGG chr11 5358027 5358046 5358030 -
atctttcctgctttctcttc

SEQ ID NO: 33642 - DNA, 20 bp, Artificial Sequence
  Synthetic oligonucleotide; GGG chr11 5358026 5358045 5358029 -
tctttcctgctttctcttct

SEQ ID NO: 33643 - DNA, 20 bp, Artificial Sequence
  Synthetic oligonucleotide; TAG chr11 5358019 5358038 5358022 -
tgctttctcttctgggcgtt

SEQ ID NO: 33644 - DNA, 20 bp, Artificial Sequence
  Synthetic oligonucleotide; CAG chr11 5357976 5357995 5357979 -
acactgctttgaatgtgtcc

SEQ ID NO: 33645 - DNA, 20 bp, Artificial Sequence
  Synthetic oligonucleotide; GAG chr11 5357974 5357993 5357977 -
actgctttgaatgtgtccca

SEQ ID NO: 33646 - DNA, 20 bp, Artificial Sequence
  Synthetic oligonucleotide; TGG chr11 5357967 5357986 5357970 -
tgaatgtgtcccagagattc

SEQ ID NO: 33647 - DNA, 20 bp, Artificial Sequence
  Synthetic oligonucleotide; TGG chr11 5357942 5357961 5357945 -
tgttgtgtctttgttctctt

SEQ ID NO: 33648 - DNA, 20 bp, Artificial Sequence
  Synthetic oligonucleotide; AAG chr11 5357934 5357953 5357937 -
ctttgttctctttggttcca

SEQ ID NO: 33649 - DNA, 20 bp, Artificial Sequence
  Synthetic oligonucleotide; CAG chr11 5357895 5357914 5357898 -
ccttcattttgttatgaacc

SEQ ID NO: 33650 - DNA, 20 bp, Artificial Sequence
  Synthetic oligonucleotide; TAG chr11 5357892 5357911 5357895 -
tcattttgttatgaacccag

SEQ ID NO: 33651 - DNA, 20 bp, Artificial Sequence
  Synthetic oligonucleotide; CAG chr11 5357884 5357903 5357887 -
ttatgaacccagtagtcatt

SEQ ID NO: 33652 - DNA, 20 bp, Artificial Sequence
  Synthetic oligonucleotide; AGG chr11 5357883 5357902 5357886 -
tatgaacccagtagtcattc

SEQ ID NO: 33653 - DNA, 20 bp, Artificial Sequence
  Synthetic oligonucleotide; GAG chr11 5357881 5357900 5357884 -
tgaacccagtagtcattcag

SEQ ID NO: 33654 - DNA, 20 bp, Artificial Sequence
  Synthetic oligonucleotide; CGG chr11 5357869 5357888 5357872 -
tcattcaggagcaatttgtt

SEQ ID NO: 33655 - DNA, 20 bp, Artificial Sequence
  Synthetic oligonucleotide; TAG chr11 5357858 5357877 5357861 -
caatttgttcggtttccatg

SEQ ID NO: 33656 - DNA, 20 bp, Artificial Sequence
  Synthetic oligonucleotide; GAG chr11 5357853 5357872 5357856 -
tgttcggtttccatgtagtt

SEQ ID NO: 33657 - DNA, 20 bp, Artificial Sequence
  Synthetic oligonucleotide; CGG chr11 5357850 5357869 5357853 -
tcggtttccatgtagttgag

SEQ ID NO: 33658 - DNA, 20 bp, Artificial Sequence
  Synthetic oligonucleotide; GAG chr11 5357843 5357862 5357846 -
ccatgtagttgagcggtttt

SEQ ID NO: 33659 - DNA, 20 bp, Artificial Sequence
  Synthetic oligonucleotide; GAG chr11 5357839 5357858 5357842 -
gtagttgagcggttttgagt

SEQ ID NO: 33660 - DNA, 20 bp, Artificial Sequence
  Synthetic oligonucleotide; GAG chr11 5357824 5357843 5357827 -
tgagtgagtttcttaatcct

SEQ ID NO: 33661 - DNA, 20 bp, Artificial Sequence
  Synthetic oligonucleotide; TAG chr11 5357818 5357837 5357821 -
agtttcttaatcctgagttc

SEQ ID NO: 33662 - DNA, 20 bp, Artificial Sequence
  Synthetic oligonucleotide; TGG chr11 5357802 5357821 5357805 -
gttctagtttgattgcactg

SEQ ID NO: 33663 - DNA, 20 bp, Artificial Sequence
  Synthetic oligonucleotide; GAG chr11 5357796 5357815 5357799 -
gtttgattgcactgtggtct

SEQ ID NO: 33664 - DNA, 20 bp, Artificial Sequence
  Synthetic oligonucleotide; GAG chr11 5357794 5357813 5357797 -
ttgattgcactgtggtctga

SEQ ID NO: 33665 - DNA, 20 bp, Artificial Sequence
  Synthetic oligonucleotide; CAG chr11 5357790 5357809 5357793 -
ttgcactgtggtctgagaga

SEQ ID NO: 33666 - DNA, 20 bp, Artificial Sequence
  Synthetic oligonucleotide; GAG chr11 5357755 5357774 5357758 -
tctgttcttttacatttgct

SEQ ID NO: 33667 - DNA, 20 bp, Artificial Sequence
  Synthetic oligonucleotide; AGG chr11 5357754 5357773 5357757 -
ctgttcttttacatttgctg

SEQ ID NO: 33668 - DNA, 20 bp, Artificial Sequence
  Synthetic oligonucleotide; GAG chr11 5357752 5357771 5357755 -
gttcttttacatttgctgag

SEQ ID NO: 33669 - DNA, 20 bp, Artificial Sequence
  Synthetic oligonucleotide; TGG chr11 5357730 5357749 5357733 -
gtgctttacttccaactatg

SEQ ID NO: 33670 - DNA, 20 bp, Artificial Sequence
  Synthetic oligonucleotide; TGG chr11 5357720 5357739 5357723 -
tccaactatgtggtcaattt

SEQ ID NO: 33671 - DNA, 20 bp, Artificial Sequence
  Synthetic oligonucleotide; TAG chr11 5357715 5357734 5357718 -
ctatgtggtcaattttggaa

SEQ ID NO: 33672 - DNA, 20 bp, Artificial Sequence
  Synthetic oligonucleotide; AGG chr11 5357714 5357733 5357717 -
tatgtggtcaattttggaat

SEQ ID NO: 33673 - DNA, 20 bp, Artificial Sequence
  Synthetic oligonucleotide; TGG chr11 5357709 5357728 5357712 -
ggtcaattttggaataggtg

SEQ ID NO: 33674 - DNA, 20 bp, Artificial Sequence
  Synthetic oligonucleotide; TGG chr11 5357704 5357723 5357707 -
attttggaataggtgtggtg

SEQ ID NO: 33675 - DNA, 20 bp, Artificial Sequence
  Synthetic oligonucleotide; AAG chr11 5357694 5357713 5357697 -
aggtgtggtgtggtgctgaa

SEQ ID NO: 33676 - DNA, 20 bp, Artificial Sequence
  Synthetic oligonucleotide; TGG chr11 5357672 5357691 5357675 -
gaatgtatattctgttgatt

SEQ ID NO: 33677 - DNA, 20 bp, Artificial Sequence
  Synthetic oligonucleotide; GGG chr11 5357671 5357690 5357674 -
aatgtatattctgttgattt

SEQ ID NO: 33678 - DNA, 20 bp, Artificial Sequence
  Synthetic oligonucleotide; GGG chr11 5357670 5357689 5357673 -
atgtatattctgttgatttg

SEQ ID NO: 33679 - DNA, 20 bp, Artificial Sequence
  Synthetic oligonucleotide; TGG chr11 5357667 5357686 5357670 -
tatattctgttgatttgggg

SEQ ID NO: 33680 - DNA, 20 bp, Artificial Sequence
  Synthetic oligonucleotide; GAG chr11 5357665 5357684 5357668 -
tattctgttgatttggggtg

SEQ ID NO: 33681 - DNA, 20 bp, Artificial Sequence
  Synthetic oligonucleotide; GAG chr11 5357663 5357682 5357666 -
ttctgttgatttggggtgga

SEQ ID NO: 33682 - DNA, 20 bp, Artificial Sequence
  Synthetic oligonucleotide; TAG chr11 5357655 5357674 5357658 -
atttggggtggagagttctg

SEQ ID NO: 33683 - DNA, 20 bp, Artificial Sequence
  Synthetic oligonucleotide; TAG chr11 5357644 5357663 5357647 -
agagttctgtagatgtctat

SEQ ID NO: 33684 - DNA, 20 bp, Artificial Sequence
  Synthetic oligonucleotide; AGG chr11 5357643 5357662 5357646 -
gagttctgtagatgtctatt

SEQ ID NO: 33685 - DNA, 20 bp, Artificial Sequence
  Synthetic oligonucleotide; TGG chr11 5357634 5357653 5357637 -
agatgtctattaggtccgct

SEQ ID NO: 33686 - DNA, 20 bp, Artificial Sequence
  Synthetic oligonucleotide; CAG chr11 5357629 5357648 5357632 -
tctattaggtccgcttggtg

SEQ ID NO: 33687 - DNA, 20 bp, Artificial Sequence
  Synthetic oligonucleotide; GAG chr11 5357627 5357646 5357630 -
tattaggtccgcttggtgca

SEQ ID NO: 33688 - DNA, 20 bp, Artificial Sequence
  Synthetic oligonucleotide; GAG chr11 5357622 5357641 5357625 -
ggtccgcttggtgcagagct

SEQ ID NO: 33689 - DNA, 20 bp, Artificial Sequence
  Synthetic oligonucleotide; TGG chr11 5357610 5357629 5357613 -
gcagagctgagttcaattcc

SEQ ID NO: 33690 - DNA, 20 bp, Artificial Sequence
  Synthetic oligonucleotide; CAG chr11 5357548 5357567 5357551 -
gttgatctgtctaatgttga

SEQ ID NO: 33691 - DNA, 20 bp, Artificial Sequence
  Synthetic oligonucleotide; TGG chr11 5357545 5357564 5357548 -
gatctgtctaatgttgacag

SEQ ID NO: 33692 - DNA, 20 bp, Artificial Sequence
  Synthetic oligonucleotide; GGG chr11 5357544 5357563 5357547 -
atctgtctaatgttgacagt

SEQ ID NO: 33693 - DNA, 20 bp, Artificial Sequence
  Synthetic oligonucleotide; GGG chr11 5357543 5357562 5357546 -
tctgtctaatgttgacagtg

SEQ ID NO: 33694 - DNA, 20 bp, Artificial Sequence
  Synthetic oligonucleotide; AAG chr11 5357535 5357554 5357538 -
atgttgacagtggggtgtta

SEQ ID NO: 33695 - DNA, 20 bp, Artificial Sequence
  Synthetic oligonucleotide; GAG chr11 5357513 5357532 5357516 -
gtctcccattgttattgtgt

SEQ ID NO: 33696 - DNA, 20 bp, Artificial Sequence
  Synthetic oligonucleotide; GAG chr11 5357511 5357530 5357514 -
ctcccattgttattgtgtga

SEQ ID NO: 33697 - DNA, 20 bp, Artificial Sequence
  Synthetic oligonucleotide; AAG chr11 5357505 5357524 5357508 -
ttgttattgtgtgagagtct

SEQ ID NO: 33698 - DNA, 20 bp, Artificial Sequence
  Synthetic oligonucleotide; TAG chr11 5357494 5357513 5357497 -
tgagagtctaagtctctttg

SEQ ID NO: 33699 - DNA, 20 bp, Artificial Sequence
  Synthetic oligonucleotide; AGG chr11 5357493 5357512 5357496 -
gagagtctaagtctctttgt

SEQ ID NO: 33700 - DNA, 20 bp, Artificial Sequence
  Synthetic oligonucleotide; AAG chr11 5357485 5357504 5357488 -
aagtctctttgtaggtctct

SEQ ID NO: 33701 - DNA, 20 bp, Artificial Sequence
  Synthetic oligonucleotide; AGG chr11 5357484 5357503 5357487 -
agtctctttgtaggtctcta

SEQ ID NO: 33702 - DNA, 20 bp, Artificial Sequence
  Synthetic oligonucleotide; TGG chr11 5357465 5357484 5357468 -
aaggacttgctttatgaacc

SEQ ID NO: 33703 - DNA, 20 bp, Artificial Sequence
  Synthetic oligonucleotide; GGG chr11 5357464 5357483 5357467 -
aggacttgctttatgaacct

SEQ ID NO: 33704 - DNA, 20 bp, Artificial Sequence
  Synthetic oligonucleotide; TGG chr11 5357450 5357469 5357453 -
gaacctgggtgttcctgtat

SEQ ID NO: 33705 - DNA, 20 bp, Artificial Sequence
  Synthetic oligonucleotide; GGG chr11 5357449 5357468 5357452 -
aacctgggtgttcctgtatt

SEQ ID NO: 33706 - DNA, 20 bp, Artificial Sequence
  Synthetic oligonucleotide; TAG chr11 5357434 5357453 5357437 -
gtattgggtgcatatatgtt

SEQ ID NO: 33707 - DNA, 20 bp, Artificial Sequence
  Synthetic oligonucleotide; AGG chr11 5357433 5357452 5357436 -
tattgggtgcatatatgttt

SEQ ID NO: 33708 - DNA, 20 bp, Artificial Sequence
  Synthetic oligonucleotide; TAG chr11 5357429 5357448 5357432 -
gggtgcatatatgtttagga

SEQ ID NO: 33709 - DNA, 20 bp, Artificial Sequence
  Synthetic oligonucleotide; TAG chr11 5357425 5357444 5357428 -
gcatatatgtttaggatagt

SEQ ID NO: 33710 - DNA, 20 bp, Artificial Sequence
  Synthetic oligonucleotide; TGG chr11 5357385 5357404 5357388 -
atccctttaccattatgtaa

SEQ ID NO: 33711 - DNA, 20 bp, Artificial Sequence
  Synthetic oligonucleotide; TGG chr11 5357356 5357375 5357359 -
ttgtctcttttgatctttgt

SEQ ID NO: 33712 - DNA, 20 bp, Artificial Sequence
  Synthetic oligonucleotide; AAG chr11 5357349 5357368 5357352 -
ttttgatctttgttggttta

SEQ ID NO: 33713 - DNA, 20 bp, Artificial Sequence
  Synthetic oligonucleotide; CAG chr11 5357336 5357355 5357339 -
tggtttaaagcctgttttat

SEQ ID NO: 33714 - DNA, 20 bp, Artificial Sequence
  Synthetic oligonucleotide; GAG chr11 5357334 5357353 5357337 -
gtttaaagcctgttttatca

SEQ ID NO: 33715 - DNA, 20 bp, Artificial Sequence
  Synthetic oligonucleotide; GAG chr11 5357329 5357348 5357332 -
aagcctgttttatcagagat

SEQ ID NO: 33716 - DNA, 20 bp, Artificial Sequence
  Synthetic oligonucleotide; AGG chr11 5357328 5357347 5357331 -
agcctgttttatcagagatg

SEQ ID NO: 33717 - DNA, 20 bp, Artificial Sequence
  Synthetic oligonucleotide; TGG chr11 5357289 5357308 5357292 -
ttttttgttttccattttct

SEQ ID NO: 33718 - DNA, 20 bp, Artificial Sequence
  Synthetic oligonucleotide; TAG chr11 5357286 5357305 5357289 -
tttgttttccattttcttgg

SEQ ID NO: 33719 - DNA, 20 bp, Artificial Sequence
  Synthetic oligonucleotide; GAG chr11 5357260 5357279 5357263 -
ttcctccatccctttatttt

SEQ ID NO: 33720 - DNA, 20 bp, Artificial Sequence
  Synthetic oligonucleotide; GAG chr11 5357236 5357255 5357239 -
ctatgtgtgtgtgtgcacat

SEQ ID NO: 33721 - DNA, 20 bp, Artificial Sequence
  Synthetic oligonucleotide; TGG chr11 5357232 5357251 5357235 -
gtgtgtgtgtgcacatgaga

SEQ ID NO: 33722 - DNA, 20 bp, Artificial Sequence
  Synthetic oligonucleotide; GGG chr11 5357231 5357250 5357234 -
tgtgtgtgtgcacatgagat

SEQ ID NO: 33723 - DNA, 20 bp, Artificial Sequence
  Synthetic oligonucleotide; CAG chr11 5357217 5357236 5357220 -
tgagatgggtttcctgaata

SEQ ID NO: 33724 - DNA, 20 bp, Artificial Sequence
  Synthetic oligonucleotide; TGG chr11 5357206 5357225 5357209 -
tcctgaatacagcacactga

SEQ ID NO: 33725 - DNA, 20 bp, Artificial Sequence
  Synthetic oligonucleotide; GGG chr11 5357205 5357224 5357208 -
cctgaatacagcacactgat

SEQ ID NO: 33726 - DNA, 20 bp, Artificial Sequence
  Synthetic oligonucleotide; TGG chr11 5357161 5357180 5357164 -
gcccgtctgtgtctttttac

SEQ ID NO: 33727 - DNA, 20 bp, Artificial Sequence
  Synthetic oligonucleotide; GAG chr11 5357159 5357178 5357162 -
ccgtctgtgtctttttactg

SEQ ID NO: 33728 - DNA, 20 bp, Artificial Sequence
  Synthetic oligonucleotide; TAG chr11 5357152 5357171 5357155 -
tgtctttttactggagcatt

SEQ ID NO: 33729 - DNA, 20 bp, Artificial Sequence
  Synthetic oligonucleotide; AAG chr11 5357137 5357156 5357140 -
gcatttagcccatttacatt

SEQ ID NO: 33730 - DNA, 20 bp, Artificial Sequence
  Synthetic oligonucleotide; AGG chr11 5357136 5357155 5357139 -
catttagcccatttacatta

SEQ ID NO: 33731 - DNA, 20 bp, Artificial Sequence
  Synthetic oligonucleotide; TAG chr11 5357091 5357110 5357094 -
tgatcctgtcattatgatgt

SEQ ID NO: 33732 - DNA, 20 bp, Artificial Sequence
  Synthetic oligonucleotide; TGG chr11 5357087 5357106 5357090 -
cctgtcattatgatgttagc

SEQ ID NO: 33733 - DNA, 20 bp, Artificial Sequence
  Synthetic oligonucleotide; TAG chr11 5357071 5357090 5357074 -
tagctggttattttgctcat

SEQ ID NO: 33734 - DNA, 20 bp, Artificial Sequence
  Synthetic oligonucleotide; CAG chr11 5357062 5357081 5357065 -
attttgctcattagttgatg

SEQ ID NO: 33735 - DNA, 20 bp, Artificial Sequence
  Synthetic oligonucleotide; TAG chr11 5357051 5357070 5357054 -
tagttgatgcagtttcttcc

SEQ ID NO: 33736 - DNA, 20 bp, Artificial Sequence
  Synthetic oligonucleotide; TGG chr11 5357042 5357061 5357045 -
cagtttcttcctagcctcaa

SEQ ID NO: 33737 - DNA, 20 bp, Artificial Sequence
  Synthetic oligonucleotide; TGG chr11 5357028 5357047 5357031 -
cctcaatggtctttacaatt

SEQ ID NO: 33738 - DNA, 20 bp, Artificial Sequence
  Synthetic oligonucleotide; CAG chr11 5357015 5357034 5357018 -
tacaatttggcatgtttttg

SEQ ID NO: 33739 - DNA, 20 bp, Artificial Sequence
  Synthetic oligonucleotide; TGG chr11 5357012 5357031 5357015 -
aatttggcatgtttttgcag

SEQ ID NO: 33740 - DNA, 20 bp, Artificial Sequence
  Synthetic oligonucleotide; TGG chr11 5357008 5357027 5357011 -
tggcatgtttttgcagtggc

SEQ ID NO: 33741 - DNA, 20 bp, Artificial Sequence
  Synthetic oligonucleotide; CGG chr11 5357002 5357021 5357005 -
gtttttgcagtggctggtac

SEQ ID NO: 33742 - DNA, 20 bp, Artificial Sequence
  Synthetic oligonucleotide; TAG chr11 5356982 5357001 5356985 -
cggttgtgcctttccatatt

SEQ ID NO: 33743 - DNA, 20 bp, Artificial Sequence
  Synthetic oligonucleotide; CAG chr11 5356970 5356989 5356973 -
tccatatttagtgcttcctt

SEQ ID NO: 33744 - DNA, 20 bp, Artificial Sequence
  Synthetic oligonucleotide; AGG chr11 5356969 5356988 5356972 -
ccatatttagtgcttccttc

SEQ ID NO: 33745 - DNA, 20 bp, Artificial Sequence
  Synthetic oligonucleotide; GAG chr11 5356967 5356986 5356970 -
atatttagtgcttccttcag

SEQ ID NO: 33746 - DNA, 20 bp, Artificial Sequence
  Synthetic oligonucleotide; TAG chr11 5356958 5356977 5356961 -
gcttccttcaggagctcttt

SEQ ID NO: 33747 - DNA, 20 bp, Artificial Sequence
  Synthetic oligonucleotide; AGG chr11 5356957 5356976 5356960 -
cttccttcaggagctctttt

SEQ ID NO: 33748 - DNA, 20 bp, Artificial Sequence
  Synthetic oligonucleotide; CAG chr11 5356953 5356972 5356956 -
cttcaggagctcttttaggt

SEQ ID NO: 33749 - DNA, 20 bp, Artificial Sequence
  Synthetic oligonucleotide; AGG chr11 5356952 5356971 5356955 -
ttcaggagctcttttaggtc

SEQ ID NO: 33750 - DNA, 20 bp, Artificial Sequence
  Synthetic oligonucleotide; TGG chr11 5356947 5356966 5356950 -
gagctcttttaggtcaggcc

SEQ ID NO: 33751 - DNA, 20 bp, Artificial Sequence
  Synthetic oligonucleotide; CAG chr11 5356928 5356947 5356931 -
ctggtgatgacaaaatctct

SEQ ID NO: 33752 - DNA, 20 bp, Artificial Sequence
  Synthetic oligonucleotide; AAG chr11 5356909 5356928 5356912 -
tcagcatttgcttgtctgta

SEQ ID NO: 33753 - DNA, 20 bp, Artificial Sequence
  Synthetic oligonucleotide; AAG chr11 5356882 5356901 5356885 -
ttatttctccttcacttatg

SEQ ID NO: 33754 - DNA, 20 bp, Artificial Sequence
  Synthetic oligonucleotide; TAG chr11 5356877 5356896 5356880 -
tctccttcacttatgaagct

SEQ ID NO: 33755 - DNA, 20 bp, Artificial Sequence
  Synthetic oligonucleotide; TGG chr11 5356872 5356891 5356875 -
ttcacttatgaagcttagtt

SEQ ID NO: 33756 - DNA, 20 bp, Artificial Sequence
  Synthetic oligonucleotide; TGG chr11 5356868 5356887 5356871 -
cttatgaagcttagtttggc

SEQ ID NO: 33757 - DNA, 20 bp, Artificial Sequence
  Synthetic oligonucleotide; AAG chr11 5356832 5356851 5356835 -
tgttgaaaattctttccttt

SEQ ID NO: 33758 - DNA, 20 bp, Artificial Sequence
  Synthetic oligonucleotide; AGG chr11 5356831 5356850 5356834 -
gttgaaaattctttccttta

SEQ ID NO: 33759 - DNA, 20 bp, Artificial Sequence
  Synthetic oligonucleotide; TGG chr11 5356817 5356836 5356820 -
cctttaaggatgttgaatat

SEQ ID NO: 33760 - DNA, 20 bp, Artificial Sequence
  Synthetic oligonucleotide; TGG chr11 5356800 5356819 5356803 -
tattggcccccactctcttc

SEQ ID NO: 33761 - DNA, 20 bp, Artificial Sequence
  Synthetic oligonucleotide; TAG chr11 5356793 5356812 5356796 -
ccccactctcttctggcttg

SEQ ID NO: 33762 - DNA, 20 bp, Artificial Sequence
  Synthetic oligonucleotide; GAG chr11 5356791 5356810 5356794 -
ccactctcttctggcttgta

SEQ ID NO: 33763 - DNA, 20 bp, Artificial Sequence
  Synthetic oligonucleotide; GAG chr11 5356780 5356799 5356783 -
tggcttgtagagtttctgct

SEQ ID NO: 33764 - DNA, 20 bp, Artificial Sequence
  Synthetic oligonucleotide; GAG chr11 5356778 5356797 5356781 -
gcttgtagagtttctgctga

SEQ ID NO: 33765 - DNA, 20 bp, Artificial Sequence
  Synthetic oligonucleotide; TGG chr11 5356758 5356777 5356761 -
gagatctgctgttattctga

SEQ ID NO: 33766 - DNA, 20 bp, Artificial Sequence
  Synthetic oligonucleotide; GGG chr11 5356757 5356776 5356760 -
agatctgctgttattctgat

SEQ ID NO: 33767 - DNA, 20 bp, Artificial Sequence
  Synthetic oligonucleotide; TGG chr11 5356744 5356763 5356747 -
ttctgatgggcttccctttg

SEQ ID NO: 33768 - DNA, 20 bp, Artificial Sequence
  Synthetic oligonucleotide; GGG chr11 5356743 5356762 5356746 -
tctgatgggcttccctttgt

SEQ ID NO: 33769 - DNA, 20 bp, Artificial Sequence
  Synthetic oligonucleotide; TGG chr11 5356722 5356741 5356725 -
ggtaacccgacctttctctc

SEQ ID NO: 33770 - DNA, 20 bp, Artificial Sequence
  Synthetic oligonucleotide; TGG chr11 5356686 5356705 5356689 -
ttttcccttcatttcaactt

SEQ ID NO: 33771 - DNA, 20 bp, Artificial Sequence
  Synthetic oligonucleotide; TAG chr11 5356659 5356678 5356662 -
tctgacaattatgtgccttg

SEQ ID NO: 33772 - DNA, 20 bp, Artificial Sequence
  Synthetic oligonucleotide; AAG chr11 5356645 5356664 5356648 -
gccttgtagttgctcttctc

SEQ ID NO: 33773 - DNA, 20 bp, Artificial Sequence
  Synthetic oligonucleotide; AGG chr11 5356644 5356663 5356647 -
ccttgtagttgctcttctca

SEQ ID NO: 33774 - DNA, 20 bp, Artificial Sequence
  Synthetic oligonucleotide; GAG chr11 5356642 5356661 5356645 -
ttgtagttgctcttctcaag

SEQ ID NO: 33775 - DNA, 20 bp, Artificial Sequence
  Synthetic oligonucleotide; TGG chr11 5356631 5356650 5356634 -
cttctcaaggagtatctttg

SEQ ID NO: 33776 - DNA, 20 bp, Artificial Sequence
  Synthetic oligonucleotide; TAG chr11 5356586 5356605 5356589 -
tgaatgttgacctgccttgc

SEQ ID NO: 33777 - DNA, 20 bp, Artificial Sequence
  Synthetic oligonucleotide; TGG chr11 5356581 5356600 5356584 -
gttgacctgccttgctagat

SEQ ID NO: 33778 - DNA, 20 bp, Artificial Sequence
  Synthetic oligonucleotide; GGG chr11 5356580 5356599 5356583 -
ttgacctgccttgctagatt

SEQ ID NO: 33779 - DNA, 20 bp, Artificial Sequence
  Synthetic oligonucleotide; GGG chr11 5356579 5356598 5356582 -
tgacctgccttgctagattg

SEQ ID NO: 33780 - DNA, 20 bp, Artificial Sequence
  Synthetic oligonucleotide; AAG chr11 5356576 5356595 5356579 -
cctgccttgctagattgggg

SEQ ID NO: 33781 - DNA, 20 bp, Artificial Sequence
  Synthetic oligonucleotide; TGG chr11 5356567 5356586 5356570 -
ctagattggggaagttctcc

SEQ ID NO: 33782 - DNA, 20 bp, Artificial Sequence
  Synthetic oligonucleotide; CAG chr11 5356553 5356572 5356556 -
ttctcctggataatatcctg

SEQ ID NO: 33783 - DNA, 20 bp, Artificial Sequence
  Synthetic oligonucleotide; GAG chr11 5356551 5356570 5356554 -
ctcctggataatatcctgca

SEQ ID NO: 33784 - DNA, 20 bp, Artificial Sequence
  Synthetic oligonucleotide; TGG chr11 5356536 5356555 5356539 -
ctgcagagtgttttccaact

SEQ ID NO: 33785 - DNA, 20 bp, Artificial Sequence
  Synthetic oligonucleotide; CAG chr11 5356512 5356531 5356515 -
tccattctgcccgtcacttt

SEQ ID NO: 33786 - DNA, 20 bp, Artificial Sequence
  Synthetic oligonucleotide; AGG chr11 5356511 5356530 5356514 -
ccattctgcccgtcactttc

SEQ ID NO: 33787 - DNA, 20 bp, Artificial Sequence
  Synthetic oligonucleotide; CAG chr11 5356499 5356518 5356502 -
tcactttcaggtacaccaat

SEQ ID NO: 33788 - DNA, 20 bp, Artificial Sequence
  Synthetic oligonucleotide; TAG chr11 5356493 5356512 5356496 -
tcaggtacaccaatcagata

SEQ ID NO: 33789 - DNA, 20 bp, Artificial Sequence
  Synthetic oligonucleotide; TGG chr11 5356487 5356506 5356490 -
acaccaatcagatatagatt

SEQ ID NO: 33790 - DNA, 20 bp, Artificial Sequence
  Synthetic oligonucleotide; TAG chr11 5356474 5356493 5356477 -
atagatttggtcttttcaca

SEQ ID NO: 33791 - DNA, 20 bp, Artificial Sequence
  Synthetic oligonucleotide; TGG chr11 5356459 5356478 5356462 -
tcacatagtcccatatttct

SEQ ID NO: 33792 - DNA, 20 bp, Artificial Sequence
  Synthetic oligonucleotide; GAG chr11 5356457 5356476 5356460 -
acatagtcccatatttcttg

SEQ ID NO: 33793 - DNA, 20 bp, Artificial Sequence
  Synthetic oligonucleotide; AGG chr11 5356456 5356475 5356459 -
catagtcccatatttcttgg

SEQ ID NO: 33794 - DNA, 20 bp, Artificial Sequence
  Synthetic oligonucleotide; CAG chr11 5356361 5356380 5356364 -
atcactgataccctttcttc

SEQ ID NO: 33795 - DNA, 20 bp, Artificial Sequence
  Synthetic oligonucleotide; CAG chr11 5356348 5356367 5356351 -
tttcttccagttgatcgaat

SEQ ID NO: 33796 - DNA, 20 bp, Artificial Sequence
  Synthetic oligonucleotide; GAG chr11 5356340 5356359 5356343 -
agttgatcgaatcagctact

SEQ ID NO: 33797 - DNA, 20 bp, Artificial Sequence
  Synthetic oligonucleotide; TAG chr11 5356319 5356338 5356322 -
agtcttgtgcattcatcatg

SEQ ID NO: 33798 - DNA, 20 bp, Artificial Sequence
  Synthetic oligonucleotide; TGG chr11 5356305 5356324 5356308 -
atcatgtagttctcatgcct

SEQ ID NO: 33799 - DNA, 20 bp, Artificial Sequence
  Synthetic oligonucleotide; CAG chr11 5356298 5356317 5356301 -
agttctcatgccttggtttt

SEQ ID NO: 33800 - DNA, 20 bp, Artificial Sequence
  Synthetic oligonucleotide; CAG chr11 5356289 5356308 5356292 -
gccttggttttcagctccat

SEQ ID NO: 33801 - DNA, 20 bp, Artificial Sequence
  Synthetic oligonucleotide; AGG chr11 5356288 5356307 5356291 -
ccttggttttcagctccatc

SEQ ID NO: 33802 - DNA, 20 bp, Artificial Sequence
  Synthetic oligonucleotide; AAG chr11 5356279 5356298 5356282 -
tcagctccatcaggtccttt

SEQ ID NO: 33803 - DNA, 20 bp, Artificial Sequence
  Synthetic oligonucleotide; AGG chr11 5356278 5356297 5356281 -
cagctccatcaggtccttta

SEQ ID NO: 33804 - DNA, 20 bp, Artificial Sequence
  Synthetic oligonucleotide; TGG chr11 5356263 5356282 5356266 -
ctttaaggacttctctgtat

SEQ ID NO: 33805 - DNA, 20 bp, Artificial Sequence
  Synthetic oligonucleotide; TAG chr11 5356254 5356273 5356257 -
cttctctgtattggttattc

SEQ ID NO: 33806 - DNA, 20 bp, Artificial Sequence
  Synthetic oligonucleotide; TAG chr11 5356250 5356269 5356253 -
tctgtattggttattctagt

SEQ ID NO: 33807 - DNA, 20 bp, Artificial Sequence
  Synthetic oligonucleotide; TAG chr11 5356243 5356262 5356246 -
tggttattctagttagccat

SEQ ID NO: 33808 - DNA, 20 bp, Artificial Sequence
  Synthetic oligonucleotide; AAG chr11 5356226 5356245 5356229 -
cattagtctaatttattttc

SEQ ID NO: 33809 - DNA, 20 bp, Artificial Sequence
  Synthetic oligonucleotide; AGG chr11 5356225 5356244 5356228 -
attagtctaatttattttca

SEQ ID NO: 33810 - DNA, 20 bp, Artificial Sequence
  Synthetic oligonucleotide; TGG chr11 5356204 5356223 5356207 -
ggtttttaacttttttgcca

SEQ ID NO: 33811 - DNA, 20 bp, Artificial Sequence
  Synthetic oligonucleotide; GGG chr11 5356203 5356222 5356206 -
gtttttaacttttttgccat

SEQ ID NO: 33812 - DNA, 20 bp, Artificial Sequence
  Synthetic oligonucleotide; GAG chr11 5356197 5356216 5356200 -
aacttttttgccatgggttc

SEQ ID NO: 33813 - DNA, 20 bp, Artificial Sequence
  Synthetic oligonucleotide; TAG chr11 5356184 5356203 5356187 -
tgggttcgagcttcctcctt

SEQ ID NO: 33814 - DNA, 20 bp, Artificial Sequence
  Synthetic oligonucleotide; CGG chr11 5356179 5356198 5356182 -
tcgagcttcctcctttagct

SEQ ID NO: 33815 - DNA, 20 bp, Artificial Sequence
  Synthetic oligonucleotide; GAG chr11 5356177 5356196 5356180 -
gagcttcctcctttagctcg

SEQ ID NO: 33816 - DNA, 20 bp, Artificial Sequence
  Synthetic oligonucleotide; TAG chr11 5356174 5356193 5356177 -
cttcctcctttagctcggag

SEQ ID NO: 33817 - DNA, 20 bp, Artificial Sequence
  Synthetic oligonucleotide; AAG chr11 5356159 5356178 5356162 -
cggagtagtttgatcgtctg

SEQ ID NO: 33818 - DNA, 20 bp, Artificial Sequence
  Synthetic oligonucleotide; AAG chr11 5356135 5356154 5356138 -
cttcttctctcaacttgtca

SEQ ID NO: 33819 - DNA, 20 bp, Artificial Sequence
  Synthetic oligonucleotide; CAG chr11 5356120 5356139 5356123 -
tgtcaaagtcattctctgtc

SEQ ID NO: 33820 - DNA, 20 bp, Artificial Sequence
  Synthetic oligonucleotide; TGG chr11 5356103 5356122 5356106 -
gtccagctttgtaccgttgc

SEQ ID NO: 33821 - DNA, 20 bp, Artificial Sequence
  Synthetic oligonucleotide; GAG chr11 5356099 5356118 5356102 -
agctttgtaccgttgctggt

SEQ ID NO: 33822 - DNA, 20 bp, Artificial Sequence
  Synthetic oligonucleotide; AGG chr11 5356098 5356117 5356101 -
gctttgtaccgttgctggtg

SEQ ID NO: 33823 - DNA, 20 bp, Artificial Sequence
  Synthetic oligonucleotide; GAG chr11 5356096 5356115 5356099 -
tttgtaccgttgctggtgag

SEQ ID NO: 33824 - DNA, 20 bp, Artificial Sequence
  Synthetic oligonucleotide; TGG chr11 5356082 5356101 5356085 -
ggtgaggagctgcattcctt

SEQ ID NO: 33825 - DNA, 20 bp, Artificial Sequence
  Synthetic oligonucleotide; GAG chr11 5356080 5356099 5356083 -
tgaggagctgcattcctttg

SEQ ID NO: 33826 - DNA, 20 bp, Artificial Sequence
  Synthetic oligonucleotide; AGG chr11 5356079 5356098 5356082 -
gaggagctgcattcctttgg

SEQ ID NO: 33827 - DNA, 20 bp, Artificial Sequence
  Synthetic oligonucleotide; GAG chr11 5356077 5356096 5356080 -
ggagctgcattcctttggag

SEQ ID NO: 33828 - DNA, 20 bp, Artificial Sequence
  Synthetic oligonucleotide; AGG chr11 5356076 5356095 5356079 -
gagctgcattcctttggagg

SEQ ID NO: 33829 - DNA, 20 bp, Artificial Sequence
  Synthetic oligonucleotide; GAG chr11 5356074 5356093 5356077 -
gctgcattcctttggaggag

SEQ ID NO: 33830 - DNA, 20 bp, Artificial Sequence
  Synthetic oligonucleotide; GAG chr11 5356072 5356091 5356075 -
tgcattcctttggaggagga

SEQ ID NO: 33831 - DNA, 20 bp, Artificial Sequence
  Synthetic oligonucleotide; AGG chr11 5356071 5356090 5356074 -
gcattcctttggaggaggag

SEQ ID NO: 33832 - DNA, 20 bp, Artificial Sequence
  Synthetic oligonucleotide; TAG chr11 5356056 5356075 5356059 -
aggagaggcactctgatttt

SEQ ID NO: 33833 - DNA, 20 bp, Artificial Sequence
  Synthetic oligonucleotide; GAG chr11 5356054 5356073 5356057 -
gagaggcactctgattttta

SEQ ID NO: 33834 - DNA, 20 bp, Artificial Sequence
  Synthetic oligonucleotide; CAG chr11 5356047 5356066 5356050 -
actctgatttttagagtttc

SEQ ID NO: 33835 - DNA, 20 bp, Artificial Sequence
  Synthetic oligonucleotide; TGG chr11 5356015 5356034 5356018 -
tctgtttttccccatctttg

SEQ ID NO: 33836 - DNA, 20 bp, Artificial Sequence
  Synthetic oligonucleotide; TGG chr11 5355999 5356018 5356002 -
tttgtggttttatctacctt

SEQ ID NO: 33837 - DNA, 20 bp, Artificial Sequence
  Synthetic oligonucleotide; TGG chr11 5355986 5356005 5355989 -
ctacctttggtctttgatga

SEQ ID NO: 33838 - DNA, 20 bp, Artificial Sequence
  Synthetic oligonucleotide; CAG chr11 5355976 5355995 5355979 -
tctttgatgatggtgacgta

SEQ ID NO: 33839 - DNA, 20 bp, Artificial Sequence
  Synthetic oligonucleotide; TGG chr11 5355972 5355991 5355975 -
tgatgatggtgacgtacaga

SEQ ID NO: 33840 - DNA, 20 bp, Artificial Sequence
  Synthetic oligonucleotide; GGG chr11 5355971 5355990 5355974 -
gatgatggtgacgtacagat

SEQ ID NO: 33841 - DNA, 20 bp, Artificial Sequence
  Synthetic oligonucleotide; TGG chr11 5355964 5355983 5355967 -
gtgacgtacagatgggtttt

SEQ ID NO: 33842 - DNA, 20 bp, Artificial Sequence
  Synthetic oligonucleotide; TGG chr11 5355959 5355978 5355962 -
gtacagatgggtttttggtg

SEQ ID NO: 33843 - DNA, 20 bp, Artificial Sequence
  Synthetic oligonucleotide; TAG chr11 5355939 5355958 5355942 -
tggatgtcctttctgtttgt

SEQ ID NO: 33844 - DNA, 20 bp, Artificial Sequence
  Synthetic oligonucleotide; CAG chr11 5355924 5355943 5355927 -
tttgttagttttccttctaa

SEQ ID NO: 33845 - DNA, 20 bp, Artificial Sequence
  Synthetic oligonucleotide; AGG chr11 5355923 5355942 5355926 -
ttgttagttttccttctaac

SEQ ID NO: 33846 - DNA, 20 bp, Artificial Sequence
  Synthetic oligonucleotide; CAG chr11 5355915 5355934 5355918 -
tttccttctaacaggaccct

SEQ ID NO: 33847 - DNA, 20 bp, Artificial Sequence
  Synthetic oligonucleotide; CAG chr11 5355908 5355927 5355911 -
ctaacaggaccctcagcttg

SEQ ID NO: 33848 - DNA, 20 bp, Artificial Sequence
  Synthetic oligonucleotide; CAG chr11 5355905 5355924 5355908 -
acaggaccctcagcttgcag

SEQ ID NO: 33849 - DNA, 20 bp, Artificial Sequence
  Synthetic oligonucleotide; AAG chr11 5355894 5355913 5355897 -
agcttgcagcagatttttaa

SEQ ID NO: 33850 - DNA, 20 bp, Artificial Sequence
  Synthetic oligonucleotide; CAG chr11 5355885 5355904 5355888 -
cagatttttaaaagaacttc

SEQ ID NO: 33851 - DNA, 20 bp, Artificial Sequence
  Synthetic oligonucleotide; AGG chr11 5355884 5355903 5355887 -
agatttttaaaagaacttcc

SEQ ID NO: 33852 - DNA, 20 bp, Artificial Sequence
  Synthetic oligonucleotide; CAG chr11 5355849 5355868 5355852 -
tattgacgcctatgtcacta

SEQ ID NO: 33853 - DNA, 20 bp, Artificial Sequence
  Synthetic oligonucleotide; AGG chr11 5355848 5355867 5355851 -
attgacgcctatgtcactac

SEQ ID NO: 33854 - DNA, 20 bp, Artificial Sequence
  Synthetic oligonucleotide; CAG chr11 5355842 5355861 5355845 -
gcctatgtcactacaggaat

SEQ ID NO: 33855 - DNA, 20 bp, Artificial Sequence
  Synthetic oligonucleotide; GAG chr11 5355840 5355859 5355843 -
ctatgtcactacaggaatca

SEQ ID NO: 33856 - DNA, 20 bp, Artificial Sequence
  Synthetic oligonucleotide; CAG chr11 5355837 5355856 5355840 -
tgtcactacaggaatcagag

SEQ ID NO: 33857 - DNA, 20 bp, Artificial Sequence
  Synthetic oligonucleotide; AGG chr11 5355836 5355855 5355839 -
gtcactacaggaatcagagc

SEQ ID NO: 33858 - DNA, 20 bp, Artificial Sequence
  Synthetic oligonucleotide; GGG chr11 5355835 5355854 5355838 -
tcactacaggaatcagagca

SEQ ID NO: 33859 - DNA, 20 bp, Artificial Sequence
  Synthetic oligonucleotide; AAG chr11 5355815 5355834 5355818 -
gggcattacattgatccttt

SEQ ID NO: 33860 - DNA, 20 bp, Artificial Sequence
  Synthetic oligonucleotide; AAG chr11 5355755 5355774 5355758 -
ttttttttttttaattttta

SEQ ID NO: 33861 - DNA, 20 bp, Artificial Sequence
  Synthetic oligonucleotide; AGG chr11 5355754 5355773 5355757 -
tttttttttttaatttttaa

SEQ ID NO: 33862 - DNA, 20 bp, Artificial Sequence
  Synthetic oligonucleotide; TAG chr11 5355744 5355763 5355747 -
taatttttaaaggtaattgt

SEQ ID NO: 33863 - DNA, 20 bp, Artificial Sequence
  Synthetic oligonucleotide; AAG chr11 5355732 5355751 5355735 -
gtaattgttagaaatttccc

SEQ ID NO: 33864 - DNA, 20 bp, Artificial Sequence
  Synthetic oligonucleotide; AGG chr11 5355731 5355750 5355734 -
taattgttagaaatttccca

SEQ ID NO: 33865 - DNA, 20 bp, Artificial Sequence
  Synthetic oligonucleotide; CAG chr11 5355689 5355708 5355692 -
cactgaaaacataactttta

SEQ ID NO: 33866 - DNA, 20 bp, Artificial Sequence
  Synthetic oligonucleotide; TGG chr11 5355678 5355697 5355681 -
taacttttacagatgatttg

SEQ ID NO: 33867 - DNA, 20 bp, Artificial Sequence
  Synthetic oligonucleotide; CAG chr11 5355672 5355691 5355675 -
ttacagatgatttgtggata

SEQ ID NO: 33868 - DNA, 20 bp, Artificial Sequence
  Synthetic oligonucleotide; TAG chr11 5355648 5355667 5355651 -
acacatcacctatcttactt

SEQ ID NO: 33869 - DNA, 20 bp, Artificial Sequence
  Synthetic oligonucleotide; AGG chr11 5355647 5355666 5355650 -
cacatcacctatcttacttt

SEQ ID NO: 33870 - DNA, 20 bp, Artificial Sequence
  Synthetic oligonucleotide; CAG chr11 5355643 5355662 5355646 -
tcacctatcttactttagga

SEQ ID NO: 33871 - DNA, 20 bp, Artificial Sequence
  Synthetic oligonucleotide; AAG chr11 5355634 5355653 5355637 -
ttactttaggacagtctgtg

SEQ ID NO: 33872 - DNA, 20 bp, Artificial Sequence
  Synthetic oligonucleotide; CAG chr11 5355613 5355632 5355616 -
agatgatatttttcctgctg

SEQ ID NO: 33873 - DNA, 20 bp, Artificial Sequence
  Synthetic oligonucleotide; AAG chr11 5355600 5355619 5355603 -
cctgctgcagttcctttgtc

SEQ ID NO: 33874 - DNA, 20 bp, Artificial Sequence
  Synthetic oligonucleotide; TAG chr11 5355591 5355610 5355594 -
gttcctttgtcaagtgactt

SEQ ID NO: 33875 - DNA, 20 bp, Artificial Sequence
  Synthetic oligonucleotide; CAG chr11 5355587 5355606 5355590 -
ctttgtcaagtgactttaga

SEQ ID NO: 33876 - DNA, 20 bp, Artificial Sequence
  Synthetic oligonucleotide; CAG chr11 5355581 5355600 5355584 -
caagtgactttagacagata

SEQ ID NO: 33877 - DNA, 20 bp, Artificial Sequence
  Synthetic oligonucleotide; AGG chr11 5355580 5355599 5355583 -
aagtgactttagacagatac

SEQ ID NO: 33878 - DNA, 20 bp, Artificial Sequence
  Synthetic oligonucleotide; AAG chr11 5355572 5355591 5355575 -
ttagacagatacaggactgc

SEQ ID NO: 33879 - DNA, 20 bp, Artificial Sequence
  Synthetic oligonucleotide; GAG chr11 5355570 5355589 5355573 -
agacagatacaggactgcaa

SEQ ID NO: 33880 - DNA, 20 bp, Artificial Sequence
  Synthetic oligonucleotide; CAG chr11 5355562 5355581 5355565 -
acaggactgcaagagtgact

SEQ ID NO: 33881 - DNA, 20 bp, Artificial Sequence
  Synthetic oligonucleotide; AGG chr11 5355561 5355580 5355564 -
caggactgcaagagtgactc

SEQ ID NO: 33882 - DNA, 20 bp, Artificial Sequence
  Synthetic oligonucleotide; TGG chr11 5355552 5355571 5355555 -
aagagtgactcaggtcatgc

SEQ ID NO: 33883 - DNA, 20 bp, Artificial Sequence
  Synthetic oligonucleotide; TAG chr11 5355547 5355566 5355550 -
tgactcaggtcatgctggca

SEQ ID NO: 33884 - DNA, 20 bp, Artificial Sequence
  Synthetic oligonucleotide; AGG chr11 5355546 5355565 5355549 -
gactcaggtcatgctggcat

SEQ ID NO: 33885 - DNA, 20 bp, Artificial Sequence
  Synthetic oligonucleotide; GAG chr11 5355544 5355563 5355547 -
ctcaggtcatgctggcatag

SEQ ID NO: 33886 - DNA, 20 bp, Artificial Sequence
  Synthetic oligonucleotide; AAG chr11 5355541 5355560 5355544 -
aggtcatgctggcataggag

SEQ ID NO: 33887 - DNA, 20 bp, Artificial Sequence
  Synthetic oligonucleotide; CAG chr11 5355538 5355557 5355541 -
tcatgctggcataggagaag

SEQ ID NO: 33888 - DNA, 20 bp, Artificial Sequence
  Synthetic oligonucleotide; AGG chr11 5355537 5355556 5355540 -
catgctggcataggagaagc

SEQ ID NO: 33889 - DNA, 20 bp, Artificial Sequence
  Synthetic oligonucleotide; TAG chr11 5355531 5355550 5355534 -
ggcataggagaagcaggtgc

SEQ ID NO: 33890 - DNA, 20 bp, Artificial Sequence
  Synthetic oligonucleotide; TAG chr11 5355514 5355533 5355517 -
tgctagtgtttcacttgaac

SEQ ID NO: 33891 - DNA, 20 bp, Artificial Sequence
  Synthetic oligonucleotide; TGG chr11 5355507 5355526 5355510 -
gtttcacttgaactagttgt

SEQ ID NO: 33892 - DNA, 20 bp, Artificial Sequence
  Synthetic oligonucleotide; GGG chr11 5355506 5355525 5355509 -
tttcacttgaactagttgtt

SEQ ID NO: 33893 - DNA, 20 bp, Artificial Sequence
  Synthetic oligonucleotide; TGG chr11 5355502 5355521 5355505 -
acttgaactagttgttgggc

SEQ ID NO: 33894 - DNA, 20 bp, Artificial Sequence
  Synthetic oligonucleotide; GGG chr11 5355501 5355520 5355504 -
cttgaactagttgttgggct

SEQ ID NO: 33895 - DNA, 20 bp, Artificial Sequence
  Synthetic oligonucleotide; GGG chr11 5355500 5355519 5355503 -
ttgaactagttgttgggctg

SEQ ID NO: 33896 - DNA, 20 bp, Artificial Sequence
  Synthetic oligonucleotide; TGG chr11 5355497 5355516 5355500 -
aactagttgttgggctgggg

SEQ ID NO: 33897 - DNA, 20 bp, Artificial Sequence
  Synthetic oligonucleotide; AAG chr11 5355489 5355508 5355492 -
gttgggctggggtggaatga

SEQ ID NO: 33898 - DNA, 20 bp, Artificial Sequence
  Synthetic oligonucleotide; TAG chr11 5355481 5355500 5355484 -
ggggtggaatgaaagctccc

SEQ ID NO: 33899 - DNA, 20 bp, Artificial Sequence
  Synthetic oligonucleotide; AGG chr11 5355480 5355499 5355483 -
gggtggaatgaaagctccct

SEQ ID NO: 33900 - DNA, 20 bp, Artificial Sequence
  Synthetic oligonucleotide; GAG chr11 5355473 5355492 5355476 -
atgaaagctccctaggccat

SEQ ID NO: 33901 - DNA, 20 bp, Artificial Sequence
  Synthetic oligonucleotide; AGG chr11 5355472 5355491 5355475 -
tgaaagctccctaggccatg

SEQ ID NO: 33902 - DNA, 20 bp, Artificial Sequence
  Synthetic oligonucleotide; TGG chr11 5355455 5355474 5355458 -
atgaggacatctttgcaatg

SEQ ID NO: 33903 - DNA, 20 bp, Artificial Sequence
  Synthetic oligonucleotide; GAG chr11 5355453 5355472 5355456 -
gaggacatctttgcaatgtg

SEQ ID NO: 33904 - DNA, 20 bp, Artificial Sequence
  Synthetic oligonucleotide; GAG chr11 5355451 5355470 5355454 -
ggacatctttgcaatgtgga

SEQ ID NO: 33905 - DNA, 20 bp, Artificial Sequence
  Synthetic oligonucleotide; AGG chr11 5355450 5355469 5355453 -
gacatctttgcaatgtggag

SEQ ID NO: 33906 - DNA, 20 bp, Artificial Sequence
  Synthetic oligonucleotide; CAG chr11 5355439 5355458 5355442 -
aatgtggagaggacccaaat

SEQ ID NO: 33907 - DNA, 20 bp, Artificial Sequence
  Synthetic oligonucleotide; TGG chr11 5355436 5355455 5355439 -
gtggagaggacccaaatcag

SEQ ID NO: 33908 - DNA, 20 bp, Artificial Sequence
  Synthetic oligonucleotide; GGG chr11 5355435 5355454 5355438 -
tggagaggacccaaatcagt

SEQ ID NO: 33909 - DNA, 20 bp, Artificial Sequence
  Synthetic oligonucleotide; AAG chr11 5355413 5355432 5355416 -
gtgttgctctttgaatgttg

SEQ ID NO: 33910 - DNA, 20 bp, Artificial Sequence
  Synthetic oligonucleotide; AGG chr11 5355412 5355431 5355415 -
tgttgctctttgaatgttga

SEQ ID NO: 33911 - DNA, 20 bp, Artificial Sequence
  Synthetic oligonucleotide; CAG chr11 5355403 5355422 5355406 -
ttgaatgttgaaggccttgt

SEQ ID NO: 33912 - DNA, 20 bp, Artificial Sequence
  Synthetic oligonucleotide; TGG chr11 5355395 5355414 5355398 -
tgaaggccttgtcagcatac

SEQ ID NO: 33913 - DNA, 20 bp, Artificial Sequence
  Synthetic oligonucleotide; CAG chr11 5355387 5355406 5355390 -
ttgtcagcatactggtcacc

SEQ ID NO: 33914 - DNA, 20 bp, Artificial Sequence
  Synthetic oligonucleotide; AAG chr11 5355354 5355373 5355357 -
acttcatactgtttgtacca

SEQ ID NO: 33915 - DNA, 20 bp, Artificial Sequence
  Synthetic oligonucleotide; CAG chr11 5355346 5355365 5355349 -
ctgtttgtaccaaagcacca

SEQ ID NO: 33916 - DNA, 20 bp, Artificial Sequence
  Synthetic oligonucleotide; TAG chr11 5355328 5355347 5355331 -
cacagtttccttatgaaact

SEQ ID NO: 33917 - DNA, 20 bp, Artificial Sequence
  Synthetic oligonucleotide; AAG chr11 5355321 5355340 5355324 -
tccttatgaaacttagcttc

SEQ ID NO: 33918 - DNA, 20 bp, Artificial Sequence
  Synthetic oligonucleotide; AGG chr11 5355320 5355339 5355323 -
ccttatgaaacttagcttca

SEQ ID NO: 33919 - DNA, 20 bp, Artificial Sequence
  Synthetic oligonucleotide; TGG chr11 5355316 5355335 5355319 -
atgaaacttagcttcaaggc

SEQ ID NO: 33920 - DNA, 20 bp, Artificial Sequence
  Synthetic oligonucleotide; GAG chr11 5355314 5355333 5355317 -
gaaacttagcttcaaggctg

SEQ ID NO: 33921 - DNA, 20 bp, Artificial Sequence
  Synthetic oligonucleotide; AAG chr11 5355301 5355320 5355304 -
aaggctggagatgtttttga

SEQ ID NO: 33922 - DNA, 20 bp, Artificial Sequence
  Synthetic oligonucleotide; TGG chr11 5355261 5355280 5355264 -
attcgtcttgactataataa

SEQ ID NO: 33923 - DNA, 20 bp, Artificial Sequence
  Synthetic oligonucleotide; AAG chr11 5355245 5355264 5355248 -
ataatggtaacttttcttgt

SEQ ID NO: 33924 - DNA, 20 bp, Artificial Sequence
  Synthetic oligonucleotide; TAG chr11 5355187 5355206 5355190 -
ctgaaattctacttctgcct

SEQ ID NO: 33925 - DNA, 20 bp, Artificial Sequence
  Synthetic oligonucleotide; CAG chr11 5355183 5355202 5355186 -
aattctacttctgccttaga

SEQ ID NO: 33926 - DNA, 20 bp, Artificial Sequence
  Synthetic oligonucleotide; GAG chr11 5355181 5355200 5355184 -
ttctacttctgccttagaca

SEQ ID NO: 33927 - DNA, 20 bp, Artificial Sequence
  Synthetic oligonucleotide; AGG chr11 5355180 5355199 5355183 -
tctacttctgccttagacag

SEQ ID NO: 33928 - DNA, 20 bp, Artificial Sequence
  Synthetic oligonucleotide; AAG chr11 5355159 5355178 5355162 -
ggctcctatccttcctcctg

SEQ ID NO: 33929 - DNA, 20 bp, Artificial Sequence
  Synthetic oligonucleotide; GAG chr11 5355149 5355168 5355152 -
cttcctcctgaagctctgtt

SEQ ID NO: 33930 - DNA, 20 bp, Artificial Sequence
  Synthetic oligonucleotide; TGG chr11 5355141 5355160 5355144 -
tgaagctctgttgagcccga

SEQ ID NO: 33931 - DNA, 20 bp, Artificial Sequence
  Synthetic oligonucleotide; GAG chr11 5355139 5355158 5355142 -
aagctctgttgagcccgatg

SEQ ID NO: 33932 - DNA, 20 bp, Artificial Sequence
  Synthetic oligonucleotide; AGG chr11 5355138 5355157 5355141 -
agctctgttgagcccgatgg

SEQ ID NO: 33933 - DNA, 20 bp, Artificial Sequence
  Synthetic oligonucleotide; TGG chr11 5355135 5355154 5355138 -
tctgttgagcccgatggagg

SEQ ID NO: 33934 - DNA, 20 bp, Artificial Sequence
  Synthetic oligonucleotide; GGG chr11 5355134 5355153 5355137 -
ctgttgagcccgatggaggt

SEQ ID NO: 33935 - DNA, 20 bp, Artificial Sequence
  Synthetic oligonucleotide; CAG chr11 5355131 5355150 5355134 -
ttgagcccgatggaggtggg

SEQ ID NO: 33936 - DNA, 20 bp, Artificial Sequence
  Synthetic oligonucleotide; AGG chr11 5355130 5355149 5355133 -
tgagcccgatggaggtgggc

SEQ ID NO: 33937 - DNA, 20 bp, Artificial Sequence
  Synthetic oligonucleotide; TAG chr11 5355119 5355138 5355122 -
gaggtgggcaggcactgtca

SEQ ID NO: 33938 - DNA, 20 bp, Artificial Sequence
  Synthetic oligonucleotide; AAG chr11 5355111 5355130 5355114 -
caggcactgtcatagtccgt

SEQ ID NO: 33939 - DNA, 20 bp, Artificial Sequence
  Synthetic oligonucleotide; TGG chr11 5355094 5355113 5355097 -
cgtaagcttcctgctgcact

SEQ ID NO: 33940 - DNA, 20 bp, Artificial Sequence
  Synthetic oligonucleotide; AAG chr11 5355077 5355096 5355080 -
acttggtgatgtgattcttc

SEQ ID NO: 33941 - DNA, 20 bp, Artificial Sequence
  Synthetic oligonucleotide; CAG chr11 5355073 5355092 5355076 -
ggtgatgtgattcttcaagt

SEQ ID NO: 33942 - DNA, 20 bp, Artificial Sequence
  Synthetic oligonucleotide; AGG chr11 5355072 5355091 5355075 -
gtgatgtgattcttcaagtc

SEQ ID NO: 33943 - DNA, 20 bp, Artificial Sequence
  Synthetic oligonucleotide; TGG chr11 5355065 5355084 5355068 -
gattcttcaagtcaggaaat

SEQ ID NO: 33944 - DNA, 20 bp, Artificial Sequence
  Synthetic oligonucleotide; CAG chr11 5355060 5355079 5355063 -
ttcaagtcaggaaattggtc

SEQ ID NO: 33945 - DNA, 20 bp, Artificial Sequence
  Synthetic oligonucleotide; AGG chr11 5355059 5355078 5355062 -
tcaagtcaggaaattggtcc

SEQ ID NO: 33946 - DNA, 20 bp, Artificial Sequence
  Synthetic oligonucleotide; TAG chr11 5355056 5355075 5355059 -
agtcaggaaattggtccagg

SEQ ID NO: 33947 - DNA, 20 bp, Artificial Sequence
  Synthetic oligonucleotide; CAG chr11 5355048 5355067 5355051 -
aattggtccaggtagttttc

SEQ ID NO: 33948 - DNA, 20 bp, Artificial Sequence
  Synthetic oligonucleotide; TAG chr11 5355042 5355061 5355045 -
tccaggtagttttccagtgt

SEQ ID NO: 33949 - DNA, 20 bp, Artificial Sequence
  Synthetic oligonucleotide; AAG chr11 5355038 5355057 5355041 -
ggtagttttccagtgttagc

SEQ ID NO: 33950 - DNA, 20 bp, Artificial Sequence
  Synthetic oligonucleotide; AGG chr11 5355037 5355056 5355040 -
gtagttttccagtgttagca

SEQ ID NO: 33951 - DNA, 20 bp, Artificial Sequence
  Synthetic oligonucleotide; GAG chr11 5355024 5355043 5355027 -
gttagcaaggatgcatccat

SEQ ID NO: 33952 - DNA, 20 bp, Artificial Sequence
  Synthetic oligonucleotide; TGG chr11 5355014 5355033 5355017 -
atgcatccatgagttttttg

SEQ ID NO: 33953 - DNA, 20 bp, Artificial Sequence
  Synthetic oligonucleotide; CAG chr11 5355002 5355021 5355005 -
gttttttgtggatatcctcc

SEQ ID NO: 33954 - DNA, 20 bp, Artificial Sequence
  Synthetic oligonucleotide; GAG chr11 5355000 5355019 5355003 -
tttttgtggatatcctccca

SEQ ID NO: 33955 - DNA, 20 bp, Artificial Sequence
  Synthetic oligonucleotide; CAG chr11 5354956 5354975 5354959 -
cattttcacaccttcctgcc

SEQ ID NO: 33956 - DNA, 20 bp, Artificial Sequence
  Synthetic oligonucleotide; CAG chr11 5354946 5354965 5354949 -
ccttcctgcccagaccaatc

SEQ ID NO: 33957 - DNA, 20 bp, Artificial Sequence
  Synthetic oligonucleotide; CAG chr11 5354939 5354958 5354942 -
gcccagaccaatccagcgca

SEQ ID NO: 33958 - DNA, 20 bp, Artificial Sequence
  Synthetic oligonucleotide; CAG chr11 5354928 5354947 5354931 -
tccagcgcacagacttcaca

SEQ ID NO: 33959 - DNA, 20 bp, Artificial Sequence
  Synthetic oligonucleotide; CAG chr11 5354920 5354939 5354923 -
acagacttcacacagtgact

SEQ ID NO: 33960 - DNA, 20 bp, Artificial Sequence
  Synthetic oligonucleotide; AAG chr11 5354910 5354929 5354913 -
cacagtgactcagcttcgtc

SEQ ID NO: 33961 - DNA, 20 bp, Artificial Sequence
  Synthetic oligonucleotide; AGG chr11 5354909 5354928 5354912 -
acagtgactcagcttcgtca

SEQ ID NO: 33962 - DNA, 20 bp, Artificial Sequence
  Synthetic oligonucleotide; CAG chr11 5354871 5354890 5354874 -
tgattgcttctaaacatcct

SEQ ID NO: 33963 - DNA, 20 bp, Artificial Sequence
  Synthetic oligonucleotide; GAG chr11 5354869 5354888 5354872 -
attgcttctaaacatcctca

SEQ ID NO: 33964 - DNA, 20 bp, Artificial Sequence
  Synthetic oligonucleotide; CAG chr11 5354860 5354879 5354863 -
aaacatcctcagagttctct

SEQ ID NO: 33965 - DNA, 20 bp, Artificial Sequence
  Synthetic oligonucleotide; AGG chr11 5354859 5354878 5354862 -
aacatcctcagagttctctc

SEQ ID NO: 33966 - DNA, 20 bp, Artificial Sequence
  Synthetic oligonucleotide; TGG chr11 5354854 5354873 5354857 -
cctcagagttctctcaggtc

SEQ ID NO: 33967 - DNA, 20 bp, Artificial Sequence
  Synthetic oligonucleotide; TGG chr11 5354835 5354854 5354838 -
ctggtaccctctgcttcttg

SEQ ID NO: 33968 - DNA, 20 bp, Artificial Sequence
  Synthetic oligonucleotide; AAG chr11 5354828 5354847 5354831 -
cctctgcttcttgtggcttg

SEQ ID NO: 33969 - DNA, 20 bp, Artificial Sequence
  Synthetic oligonucleotide; TGG chr11 5354822 5354841 5354825 -
cttcttgtggcttgaagttc

SEQ ID NO: 33970 - DNA, 20 bp, Artificial Sequence
  Synthetic oligonucleotide; CAG chr11 5354788 5354807 5354791 -
aaactgtttgtcttttgtct

SEQ ID NO: 33971 - DNA, 20 bp, Artificial Sequence
  Synthetic oligonucleotide; CAG chr11 5354785 5354804 5354788 -
ctgtttgtcttttgtctcag

SEQ ID NO: 33972 - DNA, 20 bp, Artificial Sequence
  Synthetic oligonucleotide; TGG chr11 5354775 5354794 5354778 -
tttgtctcagcagctttccc

SEQ ID NO: 33973 - DNA, 20 bp, Artificial Sequence
  Synthetic oligonucleotide; TGG chr11 5354768 5354787 5354771 -
cagcagctttccctggcttc

SEQ ID NO: 33974 - DNA, 20 bp, Artificial Sequence
  Synthetic oligonucleotide; GAG chr11 5354766 5354785 5354769 -
gcagctttccctggcttctg

SEQ ID NO: 33975 - DNA, 20 bp, Artificial Sequence
  Synthetic oligonucleotide; AGG chr11 5354765 5354784 5354768 -
cagctttccctggcttctgg

SEQ ID NO: 33976 - DNA, 20 bp, Artificial Sequence
  Synthetic oligonucleotide; GAG chr11 5354750 5354769 5354753 -
tctggaggacgttttcctgt

SEQ ID NO: 33977 - DNA, 20 bp, Artificial Sequence
  Synthetic oligonucleotide; TGG chr11 5354747 5354766 5354750 -
ggaggacgttttcctgtgag

SEQ ID NO: 33978 - DNA, 20 bp, Artificial Sequence
  Synthetic oligonucleotide; GAG chr11 5354742 5354761 5354745 -
acgttttcctgtgagtggct

SEQ ID NO: 33979 - DNA, 20 bp, Artificial Sequence
  Synthetic oligonucleotide; CAG chr11 5354732 5354751 5354735 -
gtgagtggctgagtctcttc

SEQ ID NO: 33980 - DNA, 20 bp, Artificial Sequence
  Synthetic oligonucleotide; AGG chr11 5354731 5354750 5354734 -
tgagtggctgagtctcttcc

SEQ ID NO: 33981 - DNA, 20 bp, Artificial Sequence
  Synthetic oligonucleotide; TGG chr11 5354722 5354741 5354725 -
gagtctcttccaggcattct

SEQ ID NO: 33982 - DNA, 20 bp, Artificial Sequence
  Synthetic oligonucleotide; AAG chr11 5354717 5354736 5354720 -
tcttccaggcattcttggca

SEQ ID NO: 33983 - DNA, 20 bp, Artificial Sequence
  Synthetic oligonucleotide; TGG chr11 5354699 5354718 5354702 -
caaagatgccctcttgatgt

SEQ ID NO: 33984 - DNA, 20 bp, Artificial Sequence
  Synthetic oligonucleotide; CAG chr11 5354695 5354714 5354698 -
gatgccctcttgatgttggc

SEQ ID NO: 33985 - DNA, 20 bp, Artificial Sequence
  Synthetic oligonucleotide; AGG chr11 5354694 5354713 5354697 -
atgccctcttgatgttggcc

SEQ ID NO: 33986 - DNA, 20 bp, Artificial Sequence
  Synthetic oligonucleotide; GGG chr11 5354693 5354712 5354696 -
tgccctcttgatgttggcca

SEQ ID NO: 33987 - DNA, 20 bp, Artificial Sequence
  Synthetic oligonucleotide; CAG chr11 5354687 5354706 5354690 -
cttgatgttggccagggctg

SEQ ID NO: 33988 - DNA, 20 bp, Artificial Sequence
  Synthetic oligonucleotide; AGG chr11 5354686 5354705 5354689 -
ttgatgttggccagggctgc

SEQ ID NO: 33989 - DNA, 20 bp, Artificial Sequence
  Synthetic oligonucleotide; CAG chr11 5354681 5354700 5354684 -
gttggccagggctgcaggtc

SEQ ID NO: 33990 - DNA, 20 bp, Artificial Sequence
  Synthetic oligonucleotide; AGG chr11 5354680 5354699 5354683 -
ttggccagggctgcaggtcc

SEQ ID NO: 33991 - DNA, 20 bp, Artificial Sequence
  Synthetic oligonucleotide; TGG chr11 5354674 5354693 5354677 -
agggctgcaggtccaggacc

SEQ ID NO: 33992 - DNA, 20 bp, Artificial Sequence
  Synthetic oligonucleotide; GGG chr11 5354673 5354692 5354676 -
gggctgcaggtccaggacct

SEQ ID NO: 33993 - DNA, 20 bp, Artificial Sequence
  Synthetic oligonucleotide; GAG chr11 5354671 5354690 5354674 -
gctgcaggtccaggacctgg

SEQ ID NO: 33994 - DNA, 20 bp, Artificial Sequence
  Synthetic oligonucleotide; AGG chr11 5354670 5354689 5354673 -
ctgcaggtccaggacctggg

SEQ ID NO: 33995 - DNA, 20 bp, Artificial Sequence
  Synthetic oligonucleotide; GAG chr11 5354668 5354687 5354671 -
gcaggtccaggacctgggag

SEQ ID NO: 33996 - DNA, 20 bp, Artificial Sequence
  Synthetic oligonucleotide; GAG chr11 5354663 5354682 5354666 -
tccaggacctgggaggagct

SEQ ID NO: 33997 - DNA, 20 bp, Artificial Sequence
  Synthetic oligonucleotide; CAG chr11 5354656 5354675 5354659 -
cctgggaggagctgagcgct

SEQ ID NO: 33998 - DNA, 20 bp, Artificial Sequence
  Synthetic oligonucleotide; TGG chr11 5354651 5354670 5354654 -
gaggagctgagcgctcagtg

SEQ ID NO: 33999 - DNA, 20 bp, Artificial Sequence
  Synthetic oligonucleotide; TGG chr11 5354647 5354666 5354650 -
agctgagcgctcagtgtggc

SEQ ID NO: 34000 - DNA, 20 bp, Artificial Sequence
  Synthetic oligonucleotide; TGG chr11 5354644 5354663 5354647 -
tgagcgctcagtgtggctgg

SEQ ID NO: 34001 - DNA, 20 bp, Artificial Sequence
  Synthetic oligonucleotide; TGG chr11 5354639 5354658 5354642 -
gctcagtgtggctggtggcg

SEQ ID NO: 34002 - DNA, 20 bp, Artificial Sequence
  Synthetic oligonucleotide; GAG chr11 5354637 5354656 5354640 -
tcagtgtggctggtggcgtg

SEQ ID NO: 34003 - DNA, 20 bp, Artificial Sequence
  Synthetic oligonucleotide; AGG chr11 5354636 5354655 5354639 -
cagtgtggctggtggcgtgg

SEQ ID NO: 34004 - DNA, 20 bp, Artificial Sequence
  Synthetic oligonucleotide; GGG chr11 5354635 5354654 5354638 -
agtgtggctggtggcgtgga

SEQ ID NO: 34005 - DNA, 20 bp, Artificial Sequence
  Synthetic oligonucleotide; GGG chr11 5354634 5354653 5354637 -
gtgtggctggtggcgtggag

SEQ ID NO: 34006 - DNA, 20 bp, Artificial Sequence
  Synthetic oligonucleotide; CGG chr11 5354631 5354650 5354634 -
tggctggtggcgtggagggg

SEQ ID NO: 34007 - DNA, 20 bp, Artificial Sequence
  Synthetic oligonucleotide; GGG chr11 5354630 5354649 5354633 -
ggctggtggcgtggaggggc

SEQ ID NO: 34008 - DNA, 20 bp, Artificial Sequence
  Synthetic oligonucleotide; GAG chr11 5354628 5354647 5354631 -
ctggtggcgtggaggggcgg

SEQ ID NO: 34009 - DNA, 20 bp, Artificial Sequence
  Synthetic oligonucleotide; AGG chr11 5354627 5354646 5354630 -
tggtggcgtggaggggcggg

SEQ ID NO: 34010 - DNA, 20 bp, Artificial Sequence
  Synthetic oligonucleotide; AAG chr11 5354624 5354643 5354627 -
tggcgtggaggggcgggagg

SEQ ID NO: 34011 - DNA, 20 bp, Artificial Sequence
  Synthetic oligonucleotide; TGG chr11 5354621 5354640 5354624 -
cgtggaggggcgggaggaag

SEQ ID NO: 34012 - DNA, 20 bp, Artificial Sequence
  Synthetic oligonucleotide; GGG chr11 5354620 5354639 5354623 -
gtggaggggcgggaggaagt

SEQ ID NO: 34013 - DNA, 20 bp, Artificial Sequence
  Synthetic oligonucleotide; GGG chr11 5354619 5354638 5354622 -
tggaggggcgggaggaagtg

SEQ ID NO: 34014 - DNA, 20 bp, Artificial Sequence
  Synthetic oligonucleotide; GAG chr11 5354617 5354636 5354620 -
gaggggcgggaggaagtggg

SEQ ID NO: 34015 - DNA, 20 bp, Artificial Sequence
  Synthetic oligonucleotide; AGG chr11 5354616 5354635 5354619 -
aggggcgggaggaagtgggg

SEQ ID NO: 34016 - DNA, 20 bp, Artificial Sequence
  Synthetic oligonucleotide; GAG chr11 5354608 5354627 5354611 -
gaggaagtggggaggatcat

SEQ ID NO: 34017 - DNA, 20 bp, Artificial Sequence
  Synthetic oligonucleotide; AGG chr11 5354607 5354626 5354610 -
aggaagtggggaggatcatg

SEQ ID NO: 34018 - DNA, 20 bp, Artificial Sequence
  Synthetic oligonucleotide; GAG chr11 5354605 5354624 5354608 -
gaagtggggaggatcatgag

SEQ ID NO: 34019 - DNA, 20 bp, Artificial Sequence
  Synthetic oligonucleotide; AGG chr11 5354604 5354623 5354607 -
aagtggggaggatcatgagg

SEQ ID NO: 34020 - DNA, 20 bp, Artificial Sequence
  Synthetic oligonucleotide; GGG chr11 5354603 5354622 5354606 -
agtggggaggatcatgagga

SEQ ID NO: 34021 - DNA, 20 bp, Artificial Sequence
  Synthetic oligonucleotide; GGG chr11 5354602 5354621 5354605 -
gtggggaggatcatgaggag

SEQ ID NO: 34022 - DNA, 20 bp, Artificial Sequence
  Synthetic oligonucleotide; GAG chr11 5354598 5354617 5354601 -
ggaggatcatgaggaggggt

SEQ ID NO: 34023 - DNA, 20 bp, Artificial Sequence
  Synthetic oligonucleotide; AGG chr11 5354597 5354616 5354600 -
gaggatcatgaggaggggtg

SEQ ID NO: 34024 - DNA, 20 bp, Artificial Sequence
  Synthetic oligonucleotide; CAG chr11 5354566 5354585 5354569 -
cctactgttgatatgttgtt

SEQ ID NO: 34025 - DNA, 20 bp, Artificial Sequence
  Synthetic oligonucleotide; AGG chr11 5354565 5354584 5354568 -
ctactgttgatatgttgttc

SEQ ID NO: 34026 - DNA, 20 bp, Artificial Sequence
  Synthetic oligonucleotide; GGG chr11 5354564 5354583 5354567 -
tactgttgatatgttgttca

SEQ ID NO: 34027 - DNA, 20 bp, Artificial Sequence
  Synthetic oligonucleotide; CGG chr11 5354556 5354575 5354559 -
atatgttgttcagggaccat

SEQ ID NO: 34028 - DNA, 20 bp, Artificial Sequence
  Synthetic oligonucleotide; GGG chr11 5354555 5354574 5354558 -
tatgttgttcagggaccatc

SEQ ID NO: 34029 - DNA, 20 bp, Artificial Sequence
  Synthetic oligonucleotide; GAG chr11 5354553 5354572 5354556 -
tgttgttcagggaccatcgg

SEQ ID NO: 34030 - DNA, 20 bp, Artificial Sequence
  Synthetic oligonucleotide; CAG chr11 5354548 5354567 5354551 -
ttcagggaccatcgggagcc

SEQ ID NO: 34031 - DNA, 20 bp, Artificial Sequence
  Synthetic oligonucleotide; GAG chr11 5354546 5354565 5354549 -
cagggaccatcgggagccca

SEQ ID NO: 34032 - DNA, 20 bp, Artificial Sequence
  Synthetic oligonucleotide; CGG chr11 5354528 5354547 5354531 -
cagagctctgctctgtttca

SEQ ID NO: 34033 - DNA, 20 bp, Artificial Sequence
  Synthetic oligonucleotide; GGG chr11 5354527 5354546 5354530 -
agagctctgctctgtttcac

SEQ ID NO: 34034 - DNA, 20 bp, Artificial Sequence
  Synthetic oligonucleotide; AAG chr11 5354516 5354535 5354519 -
ctgtttcacgggactccaca

SEQ ID NO: 34035 - DNA, 20 bp, Artificial Sequence
  Synthetic oligonucleotide; GAG chr11 5354514 5354533 5354517 -
gtttcacgggactccacaaa

SEQ ID NO: 34036 - DNA, 20 bp, Artificial Sequence
  Synthetic oligonucleotide; AAG chr11 5354505 5354524 5354508 -
gactccacaaagagaactgc

SEQ ID NO: 34037 - DNA, 20 bp, Artificial Sequence
  Synthetic oligonucleotide; CAG chr11 5354499 5354518 5354502 -
acaaagagaactgcaagtcc

SEQ ID NO: 34038 - DNA, 20 bp, Artificial Sequence
  Synthetic oligonucleotide; TGG chr11 5354482 5354501 5354485 -
tcccagtctttcacctctct

SEQ ID NO: 34039 - DNA, 20 bp, Artificial Sequence
  Synthetic oligonucleotide; CAG chr11 5354447 5354466 5354450 -
gtctcttcatcacatctctt

SEQ ID NO: 34040 - DNA, 20 bp, Artificial Sequence
  Synthetic oligonucleotide; AAG chr11 5354441 5354460 5354444 -
tcatcacatctcttcagtat

SEQ ID NO: 34041 - DNA, 20 bp, Artificial Sequence
  Synthetic oligonucleotide; AGG chr11 5354440 5354459 5354443 -
catcacatctcttcagtata

SEQ ID NO: 34042 - DNA, 20 bp, Artificial Sequence
  Synthetic oligonucleotide; AAG chr11 5354437 5354456 5354440 -
cacatctcttcagtataagg

SEQ ID NO: 34043 - DNA, 20 bp, Artificial Sequence
  Synthetic oligonucleotide; CAG chr11 5354432 5354451 5354435 -
ctcttcagtataaggaagaa

SEQ ID NO: 34044 - DNA, 20 bp, Artificial Sequence
  Synthetic oligonucleotide; AAG chr11 5354428 5354447 5354431 -
tcagtataaggaagaacaga

SEQ ID NO: 34045 - DNA, 20 bp, Artificial Sequence
  Synthetic oligonucleotide; AGG chr11 5354427 5354446 5354430 -
cagtataaggaagaacagaa

SEQ ID NO: 34046 - DNA, 20 bp, Artificial Sequence
  Synthetic oligonucleotide; GGG chr11 5354426 5354445 5354429 -
agtataaggaagaacagaaa

SEQ ID NO: 34047 - DNA, 20 bp, Artificial Sequence
  Synthetic oligonucleotide; GAG chr11 5354424 5354443 5354427 -
tataaggaagaacagaaagg

SEQ ID NO: 34048 - DNA, 20 bp, Artificial Sequence
  Synthetic oligonucleotide; AGG chr11 5354423 5354442 5354426 -
ataaggaagaacagaaaggg

SEQ ID NO: 34049 - DNA, 20 bp, Artificial Sequence
  Synthetic oligonucleotide; GAG chr11 5354421 5354440 5354424 -
aaggaagaacagaaagggag

SEQ ID NO: 34050 - DNA, 20 bp, Artificial Sequence
  Synthetic oligonucleotide; GAG chr11 5354419 5354438 5354422 -
ggaagaacagaaagggagga

SEQ ID NO: 34051 - DNA, 20 bp, Artificial Sequence
  Synthetic oligonucleotide; CAG chr11 5354411 5354430 5354414 -
agaaagggaggagagaaact

SEQ ID NO: 34052 - DNA, 20 bp, Artificial Sequence
  Synthetic oligonucleotide; AGG chr11 5354410 5354429 5354413 -
gaaagggaggagagaaactc

SEQ ID NO: 34053 - DNA, 20 bp, Artificial Sequence
  Synthetic oligonucleotide; GGG chr11 5354409 5354428 5354412 -
aaagggaggagagaaactca

SEQ ID NO: 34054 - DNA, 20 bp, Artificial Sequence
  Synthetic oligonucleotide; CAG chr11 5354402 5354421 5354405 -
ggagagaaactcagggttgt

SEQ ID NO: 34055 - DNA, 20 bp, Artificial Sequence
  Synthetic oligonucleotide; CAG chr11 5354382 5354401 5354385 -
cagtcaaatgtgtccattta

SEQ ID NO: 34056 - DNA, 20 bp, Artificial Sequence
  Synthetic oligonucleotide; TAG chr11 5354355 5354374 5354358 -
tataaaatgtattgttatcc

SEQ ID NO: 34057 - DNA, 20 bp, Artificial Sequence
  Synthetic oligonucleotide; TAG chr11 5354340 5354359 5354343 -
tatcctagttatctttatac

SEQ ID NO: 34058 - DNA, 20 bp, Artificial Sequence
  Synthetic oligonucleotide; TGG chr11 5354330 5354349 5354333 -
atctttatactagcctgcta

SEQ ID NO: 34059 - DNA, 20 bp, Artificial Sequence
  Synthetic oligonucleotide; CAG chr11 5354327 5354346 5354330 -
tttatactagcctgctatgg

SEQ ID NO: 34060 - DNA, 20 bp, Artificial Sequence
  Synthetic oligonucleotide; AGG chr11 5354326 5354345 5354329 -
ttatactagcctgctatggc

SEQ ID NO: 34061 - DNA, 20 bp, Artificial Sequence
  Synthetic oligonucleotide; CAG chr11 5354320 5354339 5354323 -
tagcctgctatggcaggttt

SEQ ID NO: 34062 - DNA, 20 bp, Artificial Sequence
  Synthetic oligonucleotide; AGG chr11 5354319 5354338 5354322 -
agcctgctatggcaggtttc

SEQ ID NO: 34063 - DNA, 20 bp, Artificial Sequence
  Synthetic oligonucleotide; TGG chr11 5354311 5354330 5354314 -
atggcaggtttcaggatcac

SEQ ID NO: 34064 - DNA, 20 bp, Artificial Sequence
  Synthetic oligonucleotide; TAG chr11 5354305 5354324 5354308 -
ggtttcaggatcactggacc

SEQ ID NO: 34065 - DNA, 20 bp, Artificial Sequence
  Synthetic oligonucleotide; GAG chr11 5354303 5354322 5354306 -
tttcaggatcactggaccta

SEQ ID NO: 34066 - DNA, 20 bp, Artificial Sequence
  Synthetic oligonucleotide; AGG chr11 5354302 5354321 5354305 -
ttcaggatcactggacctag

SEQ ID NO: 34067 - DNA, 20 bp, Artificial Sequence
  Synthetic oligonucleotide; GGG chr11 5354301 5354320 5354304 -
tcaggatcactggacctaga

SEQ ID NO: 34068 - DNA, 20 bp, Artificial Sequence
  Synthetic oligonucleotide; GAG chr11 5354297 5354316 5354300 -
gatcactggacctagagggt

SEQ ID NO: 34069 - DNA, 20 bp, Artificial Sequence
  Synthetic oligonucleotide; AAG chr11 5354292 5354311 5354295 -
ctggacctagagggtgagtc

SEQ ID NO: 34070 - DNA, 20 bp, Artificial Sequence
  Synthetic oligonucleotide; AAG chr11 5354288 5354307 5354291 -
acctagagggtgagtcaaga

SEQ ID NO: 34071 - DNA, 20 bp, Artificial Sequence
  Synthetic oligonucleotide; TGG chr11 5354272 5354291 5354275 -
aagaaagattttctttgatg

SEQ ID NO: 34072 - DNA, 20 bp, Artificial Sequence
  Synthetic oligonucleotide; TAG chr11 5354267 5354286 5354270 -
agattttctttgatgtggct

SEQ ID NO: 34073 - DNA, 20 bp, Artificial Sequence
  Synthetic oligonucleotide; AAG chr11 5354242 5354261 5354245 -
ccccctgaattcattcccaa

SEQ ID NO: 34074 - DNA, 20 bp, Artificial Sequence
  Synthetic oligonucleotide; AAG chr11 5354236 5354255 5354239 -
gaattcattcccaaaagccc

SEQ ID NO: 34075 - DNA, 20 bp, Artificial Sequence
  Synthetic oligonucleotide; AGG chr11 5354235 5354254 5354238 -
aattcattcccaaaagccca

SEQ ID NO: 34076 - DNA, 20 bp, Artificial Sequence
  Synthetic oligonucleotide; GGG chr11 5354234 5354253 5354237 -
attcattcccaaaagcccaa

SEQ ID NO: 34077 - DNA, 20 bp, Artificial Sequence
  Synthetic oligonucleotide; AAG chr11 5354231 5354250 5354234 -
cattcccaaaagcccaaggg

SEQ ID NO: 34078 - DNA, 20 bp, Artificial Sequence
  Synthetic oligonucleotide; AAG chr11 5354227 5354246 5354230 -
cccaaaagcccaagggaaga

SEQ ID NO: 34079 - DNA, 20 bp, Artificial Sequence
  Synthetic oligonucleotide; CAG chr11 5354222 5354241 5354225 -
aagcccaagggaagaaagaa

SEQ ID NO: 34080 - DNA, 20 bp, Artificial Sequence
  Synthetic oligonucleotide; AGG chr11 5354221 5354240 5354224 -
agcccaagggaagaaagaac

SEQ ID NO: 34081 - DNA, 20 bp, Artificial Sequence
  Synthetic oligonucleotide; AAG chr11 5354215 5354234 5354218 -
agggaagaaagaacaggatt

SEQ ID NO: 34082 - DNA, 20 bp, Artificial Sequence
  Synthetic oligonucleotide; TGG chr11 5354194 5354213 5354197 -
agtatacattgcccatatct

SEQ ID NO: 34083 - DNA, 20 bp, Artificial Sequence
  Synthetic oligonucleotide; AAG chr11 5354191 5354210 5354194 -
atacattgcccatatcttgg

SEQ ID NO: 34084 - DNA, 20 bp, Artificial Sequence
  Synthetic oligonucleotide; CAG chr11 5354182 5354201 5354185 -
ccatatcttggaagacaata

SEQ ID NO: 34085 - DNA, 20 bp, Artificial Sequence
  Synthetic oligonucleotide; GAG chr11 5354180 5354199 5354183 -
atatcttggaagacaataca

SEQ ID NO: 34086 - DNA, 20 bp, Artificial Sequence
  Synthetic oligonucleotide; GAG chr11 5354178 5354197 5354181 -
atcttggaagacaatacaga

SEQ ID NO: 34087 - DNA, 20 bp, Artificial Sequence
  Synthetic oligonucleotide; CAG chr11 5354175 5354194 5354178 -
ttggaagacaatacagagag

SEQ ID NO: 34088 - DNA, 20 bp, Artificial Sequence
  Synthetic oligonucleotide; CAG chr11 5354169 5354188 5354172 -
gacaatacagagagcagtaa

SEQ ID NO: 34089 - DNA, 20 bp, Artificial Sequence
  Synthetic oligonucleotide; CAG chr11 5354165 5354184 5354168 -
atacagagagcagtaacaga

SEQ ID NO: 34090 - DNA, 20 bp, Artificial Sequence
  Synthetic oligonucleotide; AAG chr11 5354162 5354181 5354165 -
cagagagcagtaacagacag

SEQ ID NO: 34091 - DNA, 20 bp, Artificial Sequence
  Synthetic oligonucleotide; TAG chr11 5354156 5354175 5354159 -
gcagtaacagacagaagaac

SEQ ID NO: 34092 - DNA, 20 bp, Artificial Sequence
  Synthetic oligonucleotide; CAG chr11 5354153 5354172 5354156 -
gtaacagacagaagaactag

SEQ ID NO: 34093 - DNA, 20 bp, Artificial Sequence
  Synthetic oligonucleotide; CAG chr11 5354145 5354164 5354148 -
cagaagaactagcagacaca

SEQ ID NO: 34094 - DNA, 20 bp, Artificial Sequence
  Synthetic oligonucleotide; AAG chr11 5354141 5354160 5354144 -
agaactagcagacacacaga

SEQ ID NO: 34095 - DNA, 20 bp, Artificial Sequence
  Synthetic oligonucleotide; TGG chr11 5354135 5354154 5354138 -
agcagacacacagaaagaca

SEQ ID NO: 34096 - DNA, 20 bp, Artificial Sequence
  Synthetic oligonucleotide; GGG chr11 5354134 5354153 5354137 -
gcagacacacagaaagacat

SEQ ID NO: 34097 - DNA, 20 bp, Artificial Sequence
  Synthetic oligonucleotide; TGG chr11 5354078 5354097 5354081 -
aaattatattttgttaaaaa

SEQ ID NO: 34098 - DNA, 20 bp, Artificial Sequence
  Synthetic oligonucleotide; GAG chr11 5354068 5354087 5354071 -
ttgttaaaaatggtctatgt

SEQ ID NO: 34099 - DNA, 20 bp, Artificial Sequence
  Synthetic oligonucleotide; AAG chr11 5354065 5354084 5354068 -
ttaaaaatggtctatgtgag

SEQ ID NO: 34100 - DNA, 20 bp, Artificial Sequence
  Synthetic oligonucleotide; CAG chr11 5354052 5354071 5354055 -
atgtgagaagttctgtaata

SEQ ID NO: 34101 - DNA, 20 bp, Artificial Sequence
  Synthetic oligonucleotide; TAG chr11 5354049 5354068 5354052 -
tgagaagttctgtaatacag

SEQ ID NO: 34102 - DNA, 20 bp, Artificial Sequence
  Synthetic oligonucleotide; AGG chr11 5354048 5354067 5354051 -
gagaagttctgtaatacagt

SEQ ID NO: 34103 - DNA, 20 bp, Artificial Sequence
  Synthetic oligonucleotide; GGG chr11 5354047 5354066 5354050 -
agaagttctgtaatacagta

SEQ ID NO: 34104 - DNA, 20 bp, Artificial Sequence
  Synthetic oligonucleotide; AAG chr11 5354041 5354060 5354044 -
tctgtaatacagtagggaat

SEQ ID NO: 34105 - DNA, 20 bp, Artificial Sequence
  Synthetic oligonucleotide; GAG chr11 5354014 5354033 5354017 -
atgttatatttaccatcctc

SEQ ID NO: 34106 - DNA, 20 bp, Artificial Sequence
  Synthetic oligonucleotide; CAG chr11 5354007 5354026 5354010 -
atttaccatcctcgagcaca

SEQ ID NO: 34107 - DNA, 20 bp, Artificial Sequence
  Synthetic oligonucleotide; AAG chr11 5354002 5354021 5354005 -
ccatcctcgagcacacagtc

SEQ ID NO: 34108 - DNA, 20 bp, Artificial Sequence
  Synthetic oligonucleotide; AAG chr11 5353999 5354018 5354002 -
tcctcgagcacacagtcaag

SEQ ID NO: 34109 - DNA, 20 bp, Artificial Sequence
  Synthetic oligonucleotide; AAG chr11 5353990 5354009 5353993 -
acacagtcaagaagctacaa

SEQ ID NO: 34110 - DNA, 20 bp, Artificial Sequence
  Synthetic oligonucleotide; GAG chr11 5353988 5354007 5353991 -
acagtcaagaagctacaaaa

SEQ ID NO: 34111 - DNA, 20 bp, Artificial Sequence
  Synthetic oligonucleotide; AAG chr11 5353984 5354003 5353987 -
tcaagaagctacaaaagaga

SEQ ID NO: 34112 - DNA, 20 bp, Artificial Sequence
  Synthetic oligonucleotide; AGG chr11 5353983 5354002 5353986 -
caagaagctacaaaagagaa

SEQ ID NO: 34113 - DNA, 20 bp, Artificial Sequence
  Synthetic oligonucleotide; CAG chr11 5353967 5353986 5353970 -
agaaaggcaaatttcacaca

SEQ ID NO: 34114 - DNA, 20 bp, Artificial Sequence
  Synthetic oligonucleotide; AAG chr11 5353962 5353981 5353965 -
ggcaaatttcacacacagcc

SEQ ID NO: 34115 - DNA, 20 bp, Artificial Sequence
  Synthetic oligonucleotide; GAG chr11 5353957 5353976 5353960 -
atttcacacacagccaagtt

SEQ ID NO: 34116 - DNA, 20 bp, Artificial Sequence
  Synthetic oligonucleotide; TGG chr11 5353935 5353954 5353938 -
gtaaaacaaacaaaatcttt

SEQ ID NO: 34117 - DNA, 20 bp, Artificial Sequence
  Synthetic oligonucleotide; CAG chr11 5353926 5353945 5353929 -
acaaaatcttttggtctaat

SEQ ID NO: 34118 - DNA, 20 bp, Artificial Sequence
  Synthetic oligonucleotide; AAG chr11 5353920 5353939 5353923 -
tcttttggtctaatcagata

SEQ ID NO: 34119 - DNA, 20 bp, Artificial Sequence
  Synthetic oligonucleotide; TAG chr11 5353908 5353927 5353911 -
atcagataaagatcatttac

SEQ ID NO: 34120 - DNA, 20 bp, Artificial Sequence
  Synthetic oligonucleotide; TGG chr11 5353903 5353922 5353906 -
ataaagatcatttactagcc

SEQ ID NO: 34121 - DNA, 20 bp, Artificial Sequence
  Synthetic oligonucleotide; AAG chr11 5353889 5353908 5353892 -
ctagcctggaaactattgtg

SEQ ID NO: 34122 - DNA, 20 bp, Artificial Sequence
  Synthetic oligonucleotide; AGG chr11 5353888 5353907 5353891 -
tagcctggaaactattgtga

SEQ ID NO: 34123 - DNA, 20 bp, Artificial Sequence
  Synthetic oligonucleotide; AAG chr11 5353843 5353862 5353846 -
ctgtgttatttatacatccc

SEQ ID NO: 34124 - DNA, 20 bp, Artificial Sequence
  Synthetic oligonucleotide; AAG chr11 5353809 5353828 5353812 -
atccccacctttctgtgatg

SEQ ID NO: 34125 - DNA, 20 bp, Artificial Sequence
  Synthetic oligonucleotide; GAG chr11 5353807 5353826 5353810 -
ccccacctttctgtgatgaa

SEQ ID NO: 34126 - DNA, 20 bp, Artificial Sequence
  Synthetic oligonucleotide; TAG chr11 5353804 5353823 5353807 -
cacctttctgtgatgaagag

SEQ ID NO: 34127 - DNA, 20 bp, Artificial Sequence
  Synthetic oligonucleotide; AGG chr11 5353803 5353822 5353806 -
acctttctgtgatgaagagt

SEQ ID NO: 34128 - DNA, 20 bp, Artificial Sequence
  Synthetic oligonucleotide; TGG chr11 5353800 5353819 5353803 -
tttctgtgatgaagagtagg

SEQ ID NO: 34129 - DNA, 20 bp, Artificial Sequence
  Synthetic oligonucleotide; GGG chr11 5353799 5353818 5353802 -
ttctgtgatgaagagtaggt

SEQ ID NO: 34130 - DNA, 20 bp, Artificial Sequence
  Synthetic oligonucleotide; CAG chr11 5353796 5353815 5353799 -
tgtgatgaagagtaggtggg

SEQ ID NO: 34131 - DNA, 20 bp, Artificial Sequence
  Synthetic oligonucleotide; TAG chr11 5353790 5353809 5353793 -
gaagagtaggtgggcagcca

SEQ ID NO: 34132 - DNA, 20 bp, Artificial Sequence
  Synthetic oligonucleotide; GAG chr11 5353781 5353800 5353784 -
gtgggcagccatagatcact

SEQ ID NO: 34133 - DNA, 20 bp, Artificial Sequence
  Synthetic oligonucleotide; CAG chr11 5353775 5353794 5353778 -
agccatagatcactgagtgt

SEQ ID NO: 34134 - DNA, 20 bp, Artificial Sequence
  Synthetic oligonucleotide; CAG chr11 5353767 5353786 5353770 -
atcactgagtgtcagtatga

SEQ ID NO: 34135 - DNA, 20 bp, Artificial Sequence
  Synthetic oligonucleotide; GAG chr11 5353765 5353784 5353768 -
cactgagtgtcagtatgaca

SEQ ID NO: 34136 - DNA, 20 bp, Artificial Sequence
  Synthetic oligonucleotide; AGG chr11 5353764 5353783 5353767 -
actgagtgtcagtatgacag

SEQ ID NO: 34137 - DNA, 20 bp, Artificial Sequence
  Synthetic oligonucleotide; CAG chr11 5353760 5353779 5353763 -
agtgtcagtatgacagaggc

SEQ ID NO: 34138 - DNA, 20 bp, Artificial Sequence
  Synthetic oligonucleotide; GAG chr11 5353758 5353777 5353761 -
tgtcagtatgacagaggcca

SEQ ID NO: 34139 - DNA, 20 bp, Artificial Sequence
  Synthetic oligonucleotide; GAG chr11 5353753 5353772 5353756 -
gtatgacagaggccagagat

SEQ ID NO: 34140 - DNA, 20 bp, Artificial Sequence
  Synthetic oligonucleotide; AGG chr11 5353752 5353771 5353755 -
tatgacagaggccagagatg

SEQ ID NO: 34141 - DNA, 20 bp, Artificial Sequence
  Synthetic oligonucleotide; GGG chr11 5353751 5353770 5353754 -
atgacagaggccagagatga

SEQ ID NO: 34142 - DNA, 20 bp, Artificial Sequence
  Synthetic oligonucleotide; GGG chr11 5353750 5353769 5353753 -
tgacagaggccagagatgag

SEQ ID NO: 34143 - DNA, 20 bp, Artificial Sequence
  Synthetic oligonucleotide; CAG chr11 5353743 5353762 5353746 -
ggccagagatgaggggcatc

SEQ ID NO: 34144 - DNA, 20 bp, Artificial Sequence
  Synthetic oligonucleotide; TGG chr11 5353735 5353754 5353738 -
atgaggggcatccagctgac

SEQ ID NO: 34145 - DNA, 20 bp, Artificial Sequence
  Synthetic oligonucleotide; TGG chr11 5353728 5353747 5353731 -
gcatccagctgactggtcac

SEQ ID NO: 34146 - DNA, 20 bp, Artificial Sequence
  Synthetic oligonucleotide; GGG chr11 5353727 5353746 5353730 -
catccagctgactggtcact

SEQ ID NO: 34147 - DNA, 20 bp, Artificial Sequence
  Synthetic oligonucleotide; TGG chr11 5353724 5353743 5353727 -
ccagctgactggtcactggg

SEQ ID NO: 34148 - DNA, 20 bp, Artificial Sequence
  Synthetic oligonucleotide; TAG chr11 5353712 5353731 5353715 -
tcactgggtggccccttgtg

SEQ ID NO: 34149 - DNA, 20 bp, Artificial Sequence
  Synthetic oligonucleotide; AAG chr11 5353706 5353725 5353709 -
ggtggccccttgtgtagtcc

SEQ ID NO: 34150 - DNA, 20 bp, Artificial Sequence
  Synthetic oligonucleotide; TGG chr11 5353684 5353703 5353687 -
gcacatcataccctgtattt

SEQ ID NO: 34151 - DNA, 20 bp, Artificial Sequence
  Synthetic oligonucleotide; AAG chr11 5353677 5353696 5353680 -
ataccctgtattttggtcaa

SEQ ID NO: 34152 - DNA, 20 bp, Artificial Sequence
  Synthetic oligonucleotide; GAG chr11 5353635 5353654 5353638 -
taatttaaaacttatcattt

SEQ ID NO: 34153 - DNA, 20 bp, Artificial Sequence
  Synthetic oligonucleotide; TGG chr11 5353629 5353648 5353632 -
aaaacttatcatttgagtca

SEQ ID NO: 34154 - DNA, 20 bp, Artificial Sequence
  Synthetic oligonucleotide; TGG chr11 5353622 5353641 5353625 -
atcatttgagtcatggatac

SEQ ID NO: 34155 - DNA, 20 bp, Artificial Sequence
  Synthetic oligonucleotide; TGG chr11 5353610 5353629 5353613 -
atggatactggctcttcacc

SEQ ID NO: 34156 - DNA, 20 bp, Artificial Sequence
  Synthetic oligonucleotide; TAG chr11 5353604 5353623 5353607 -
actggctcttcacctggcca

SEQ ID NO: 34157 - DNA, 20 bp, Artificial Sequence
  Synthetic oligonucleotide; AGG chr11 5353603 5353622 5353606 -
ctggctcttcacctggccat

SEQ ID NO: 34158 - DNA, 20 bp, Artificial Sequence
  Synthetic oligonucleotide; TAG chr11 5353575 5353594 5353578 -
aaaccccctcttctcatgcc

SEQ ID NO: 34159 - DNA, 20 bp, Artificial Sequence
  Synthetic oligonucleotide; AAG chr11 5353564 5353583 5353567 -
tctcatgcctagactctgaa

SEQ ID NO: 34160 - DNA, 20 bp, Artificial Sequence
  Synthetic oligonucleotide; AAG chr11 5353555 5353574 5353558 -
tagactctgaaaagaatcaa

SEQ ID NO: 34161 - DNA, 20 bp, Artificial Sequence
  Synthetic oligonucleotide; TGG chr11 5353548 5353567 5353551 -
tgaaaagaatcaaaagtatt

SEQ ID NO: 34162 - DNA, 20 bp, Artificial Sequence
  Synthetic oligonucleotide; GAG chr11 5353546 5353565 5353549 -
aaaagaatcaaaagtatttg

SEQ ID NO: 34163 - DNA, 20 bp, Artificial Sequence
  Synthetic oligonucleotide; CAG chr11 5353542 5353561 5353545 -
gaatcaaaagtatttggagc

SEQ ID NO: 34164 - DNA, 20 bp, Artificial Sequence
  Synthetic oligonucleotide; AAG chr11 5353537 5353556 5353540 -
aaaagtatttggagccagaa

SEQ ID NO: 34165 - DNA, 20 bp, Artificial Sequence
  Synthetic oligonucleotide; AGG chr11 5353536 5353555 5353539 -
aaagtatttggagccagaaa

SEQ ID NO: 34166 - DNA, 20 bp, Artificial Sequence
  Synthetic oligonucleotide; TAG chr11 5353520 5353539 5353523 -
gaaaaggccattttatcttc

SEQ ID NO: 34167 - DNA, 20 bp, Artificial Sequence
  Synthetic oligonucleotide; GAG chr11 5353513 5353532 5353516 -
ccattttatcttctagttat

SEQ ID NO: 34168 - DNA, 20 bp, Artificial Sequence
  Synthetic oligonucleotide; CAG chr11 5353427 5353446 5353430 -
ctctgctattttgcacatgc

SEQ ID NO: 34169 - DNA, 20 bp, Artificial Sequence
  Synthetic oligonucleotide; TAG chr11 5353413 5353432 5353416 -
acatgccagacacccctatc

SEQ ID NO: 34170 - DNA, 20 bp, Artificial Sequence
  Synthetic oligonucleotide; CAG chr11 5353385 5353404 5353388 -
tctctgatgttcccctaaac

SEQ ID NO: 34171 - DNA, 20 bp, Artificial Sequence
  Synthetic oligonucleotide; CAG chr11 5353344 5353363 5353347 -
tgaaaatgcatctctctgtt

SEQ ID NO: 34172 - DNA, 20 bp, Artificial Sequence
  Synthetic oligonucleotide; TAG chr11 5353341 5353360 5353344 -
aaatgcatctctctgttcag

SEQ ID NO: 34173 - DNA, 20 bp, Artificial Sequence
  Synthetic oligonucleotide; TGG chr11 5353334 5353353 5353337 -
tctctctgttcagtagtaac

SEQ ID NO: 34174 - DNA, 20 bp, Artificial Sequence
  Synthetic oligonucleotide; AAG chr11 5353320 5353339 5353323 -
agtaactggaattaactatc

SEQ ID NO: 34175 - DNA, 20 bp, Artificial Sequence
  Synthetic oligonucleotide; TGG chr11 5353313 5353332 5353316 -
ggaattaactatcaagacaa

SEQ ID NO: 34176 - DNA, 20 bp, Artificial Sequence
  Synthetic oligonucleotide; TAG chr11 5353300 5353319 5353303 -
aagacaatggtcatctgaat

SEQ ID NO: 34177 - DNA, 20 bp, Artificial Sequence
  Synthetic oligonucleotide; AAG chr11 5353242 5353261 5353245 -
tatttgataaatgttaacca

SEQ ID NO: 34178 - DNA, 20 bp, Artificial Sequence
  Synthetic oligonucleotide; TAG chr11 5353217 5353236 5353220 -
ttaactgaacacatttctca

SEQ ID NO: 34179 - DNA, 20 bp, Artificial Sequence
  Synthetic oligonucleotide; GAG chr11 5353215 5353234 5353218 -
aactgaacacatttctcata

SEQ ID NO: 34180 - DNA, 20 bp, Artificial Sequence
  Synthetic oligonucleotide; TAG chr11 5353202 5353221 5353205 -
tctcatagagatactttccc

SEQ ID NO: 34181 - DNA, 20 bp, Artificial Sequence
  Synthetic oligonucleotide; GAG chr11 5353182 5353201 5353185 -
tagactcatcattttgaatt

SEQ ID NO: 34182 - DNA, 20 bp, Artificial Sequence
  Synthetic oligonucleotide; AGG chr11 5353181 5353200 5353184 -
agactcatcattttgaattg

SEQ ID NO: 34183 - DNA, 20 bp, Artificial Sequence
  Synthetic oligonucleotide; GGG chr11 5353180 5353199 5353183 -
gactcatcattttgaattga

SEQ ID NO: 34184 - DNA, 20 bp, Artificial Sequence
  Synthetic oligonucleotide; TGG chr11 5353174 5353193 5353177 -
tcattttgaattgagggaaa

SEQ ID NO: 34185 - DNA, 20 bp, Artificial Sequence
  Synthetic oligonucleotide; AAG chr11 5353158 5353177 5353161 -
gaaatggtttaccctcattg

SEQ ID NO: 34186 - DNA, 20 bp, Artificial Sequence
  Synthetic oligonucleotide; AAG chr11 5353154 5353173 5353157 -
tggtttaccctcattgaaga

SEQ ID NO: 34187 - DNA, 20 bp, Artificial Sequence
  Synthetic oligonucleotide; GAG chr11 5353146 5353165 5353149 -
cctcattgaagaaagtaatt

SEQ ID NO: 34188 - DNA, 20 bp, Artificial Sequence
  Synthetic oligonucleotide; AGG chr11 5353145 5353164 5353148 -
ctcattgaagaaagtaattg

SEQ ID NO: 34189 - DNA, 20 bp, Artificial Sequence
  Synthetic oligonucleotide; GGG chr11 5353144 5353163 5353147 -
tcattgaagaaagtaattga

SEQ ID NO: 34190 - DNA, 20 bp, Artificial Sequence
  Synthetic oligonucleotide; TGG chr11 5353138 5353157 5353141 -
aagaaagtaattgagggaaa

SEQ ID NO: 34191 - DNA, 20 bp, Artificial Sequence
  Synthetic oligonucleotide; AAG chr11 5353122 5353141 5353125 -
gaaatggcttactctcattg

SEQ ID NO: 34192 - DNA, 20 bp, Artificial Sequence
  Synthetic oligonucleotide; AAG chr11 5353118 5353137 5353121 -
tggcttactctcattgaaga

SEQ ID NO: 34193 - DNA, 20 bp, Artificial Sequence
  Synthetic oligonucleotide; TAG chr11 5353090 5353109 5353093 -
tttcttcacgtgcaattttc

SEQ ID NO: 34194 - DNA, 20 bp, Artificial Sequence
  Synthetic oligonucleotide; CAG chr11 5353084 5353103 5353087 -
cacgtgcaattttctagaaa

SEQ ID NO: 34195 - DNA, 20 bp, Artificial Sequence
  Synthetic oligonucleotide; CAG chr11 5353081 5353100 5353084 -
gtgcaattttctagaaacag

SEQ ID NO: 34196 - DNA, 20 bp, Artificial Sequence
  Synthetic oligonucleotide; CAG chr11 5353077 5353096 5353080 -
aattttctagaaacagcagc

SEQ ID NO: 34197 - DNA, 20 bp, Artificial Sequence
  Synthetic oligonucleotide; AAG chr11 5353062 5353081 5353065 -
gcagccagctccatatatgc

SEQ ID NO: 34198 - DNA, 20 bp, Artificial Sequence
  Synthetic oligonucleotide; GAG chr11 5353060 5353079 5353063 -
agccagctccatatatgcaa

SEQ ID NO: 34199 - DNA, 20 bp, Artificial Sequence
  Synthetic oligonucleotide; TGG chr11 5353054 5353073 5353057 -
ctccatatatgcaagagaac

SEQ ID NO: 34200 - DNA, 20 bp, Artificial Sequence
  Synthetic oligonucleotide; AAG chr11 5353040 5353059 5353043 -
gagaactggatgtatgtctg

SEQ ID NO: 34201 - DNA, 20 bp, Artificial Sequence
  Synthetic oligonucleotide; CAG chr11 5353010 5353029 5353013 -
tgccttattcctatgtataa

SEQ ID NO: 34202 - DNA, 20 bp, Artificial Sequence
  Synthetic oligonucleotide; AGG chr11 5353009 5353028 5353012 -
gccttattcctatgtataac

SEQ ID NO: 34203 - DNA, 20 bp, Artificial Sequence
  Synthetic oligonucleotide; AAG chr11 5352994 5353013 5352997 -
ataacaggactaatatatgc

SEQ ID NO: 34204 - DNA, 20 bp, Artificial Sequence
  Synthetic oligonucleotide; TGG chr11 5352986 5353005 5352989 -
actaatatatgcaagccata

SEQ ID NO: 34205 - DNA, 20 bp, Artificial Sequence
  Synthetic oligonucleotide; GAG chr11 5352984 5353003 5352987 -
taatatatgcaagccatatg

SEQ ID NO: 34206 - DNA, 20 bp, Artificial Sequence
  Synthetic oligonucleotide; GAG chr11 5352982 5353001 5352985 -
atatatgcaagccatatgga

SEQ ID NO: 34207 - DNA, 20 bp, Artificial Sequence
  Synthetic oligonucleotide; TGG chr11 5352976 5352995 5352979 -
gcaagccatatggagagcaa

SEQ ID NO: 34208 - DNA, 20 bp, Artificial Sequence
  Synthetic oligonucleotide; GGG chr11 5352975 5352994 5352978 -
caagccatatggagagcaat

SEQ ID NO: 34209 - DNA, 20 bp, Artificial Sequence
  Synthetic oligonucleotide; CGG chr11 5352957 5352976 5352960 -
atgggcattgactgaaatgc

SEQ ID NO: 34210 - DNA, 20 bp, Artificial Sequence
  Synthetic oligonucleotide; TAG chr11 5352942 5352961 5352945 -
aatgccggtgacccaaatca

SEQ ID NO: 34211 - DNA, 20 bp, Artificial Sequence
  Synthetic oligonucleotide; AAG chr11 5352935 5352954 5352938 -
gtgacccaaatcatagaccc

SEQ ID NO: 34212 - DNA, 20 bp, Artificial Sequence
  Synthetic oligonucleotide; TGG chr11 5352917 5352936 5352920 -
ccaagaattatatatataat

SEQ ID NO: 34213 - DNA, 20 bp, Artificial Sequence
  Synthetic oligonucleotide; CAG chr11 5352872 5352891 5352875 -
ataatatatataaacacaca

SEQ ID NO: 34214 - DNA, 20 bp, Artificial Sequence
  Synthetic oligonucleotide; AAG chr11 5352844 5352863 5352847 -
tacacacactattatatatt

SEQ ID NO: 34215 - DNA, 20 bp, Artificial Sequence
  Synthetic oligonucleotide; TAG chr11 5352832 5352851 5352835 -
tatatattaagtatatataa

SEQ ID NO: 34216 - DNA, 20 bp, Artificial Sequence
  Synthetic oligonucleotide; TAG chr11 5352800 5352819 5352803 -
tatatattaaatatatataa

SEQ ID NO: 34217 - DNA, 20 bp, Artificial Sequence
  Synthetic oligonucleotide; TGG chr11 5352793 5352812 5352796 -
taaatatatataatagtgta

SEQ ID NO: 34218 - DNA, 20 bp, Artificial Sequence
  Synthetic oligonucleotide; GGG chr11 5352792 5352811 5352795 -
aaatatatataatagtgtat

SEQ ID NO: 34219 - DNA, 20 bp, Artificial Sequence
  Synthetic oligonucleotide; AAG chr11 5352758 5352777 5352761 -
gtgtgtatatgtatgtgtgt

SEQ ID NO: 34220 - DNA, 20 bp, Artificial Sequence
  Synthetic oligonucleotide; TGG chr11 5352739 5352758 5352742 -
taagtatgtatgtatgtgta

SEQ ID NO: 34221 - DNA, 20 bp, Artificial Sequence
  Synthetic oligonucleotide; CAG chr11 5352733 5352752 5352736 -
tgtatgtatgtgtatggtgc

SEQ ID NO: 34222 - DNA, 20 bp, Artificial Sequence
  Synthetic oligonucleotide; AAG chr11 5352726 5352745 5352729 -
atgtgtatggtgccagccat

SEQ ID NO: 34223 - DNA, 20 bp, Artificial Sequence
  Synthetic oligonucleotide; GAG chr11 5352708 5352727 5352711 -
ataagctaatcaaacaatgt

SEQ ID NO: 34224 - DNA, 20 bp, Artificial Sequence
  Synthetic oligonucleotide; GAG chr11 5352694 5352713 5352697 -
caatgtgagttaaattacct

SEQ ID NO: 34225 - DNA, 20 bp, Artificial Sequence
  Synthetic oligonucleotide; CAG chr11 5352681 5352700 5352684 -
attacctgagaaaacaatat

SEQ ID NO: 34226 - DNA, 20 bp, Artificial Sequence
  Synthetic oligonucleotide; GAG chr11 5352676 5352695 5352679 -
ctgagaaaacaatatcagtt

SEQ ID NO: 34227 - DNA, 20 bp, Artificial Sequence
  Synthetic oligonucleotide; GAG chr11 5352669 5352688 5352672 -
aacaatatcagttgagcact

SEQ ID NO: 34228 - DNA, 20 bp, Artificial Sequence
  Synthetic oligonucleotide; TAG chr11 5352657 5352676 5352660 -
tgagcactgagatatgtact

SEQ ID NO: 34229 - DNA, 20 bp, Artificial Sequence
  Synthetic oligonucleotide; CAG chr11 5352629 5352648 5352632 -
tacatatatcttatacaaat

SEQ ID NO: 34230 - DNA, 20 bp, Artificial Sequence
  Synthetic oligonucleotide; TAG chr11 5352623 5352642 5352626 -
tatcttatacaaatcagcaa

SEQ ID NO: 34231 - DNA, 20 bp, Artificial Sequence
  Synthetic oligonucleotide; CAG chr11 5352619 5352638 5352622 -
ttatacaaatcagcaataga

SEQ ID NO: 34232 - DNA, 20 bp, Artificial Sequence
  Synthetic oligonucleotide; AGG chr11 5352618 5352637 5352621 -
tatacaaatcagcaatagac

SEQ ID NO: 34233 - DNA, 20 bp, Artificial Sequence
  Synthetic oligonucleotide; CAG chr11 5352615 5352634 5352618 -
acaaatcagcaatagacagg

SEQ ID NO: 34234 - DNA, 20 bp, Artificial Sequence
  Synthetic oligonucleotide; AGG chr11 5352614 5352633 5352617 -
caaatcagcaatagacaggc

SEQ ID NO: 34235 - DNA, 20 bp, Artificial Sequence
  Synthetic oligonucleotide; GGG chr11 5352613 5352632 5352616 -
aaatcagcaatagacaggca

SEQ ID NO: 34236 - DNA, 20 bp, Artificial Sequence
  Synthetic oligonucleotide; AAG chr11 5352596 5352615 5352599 -
gcagggtaaaataatgttct

SEQ ID NO: 34237 - DNA, 20 bp, Artificial Sequence
  Synthetic oligonucleotide; TAG chr11 5352593 5352612 5352596 -
gggtaaaataatgttctaag

SEQ ID NO: 34238 - DNA, 20 bp, Artificial Sequence
  Synthetic oligonucleotide; CAG chr11 5352590 5352609 5352593 -
taaaataatgttctaagtag

SEQ ID NO: 34239 - DNA, 20 bp, Artificial Sequence
  Synthetic oligonucleotide; GAG chr11 5352588 5352607 5352591 -
aaataatgttctaagtagca

SEQ ID NO: 34240 - DNA, 20 bp, Artificial Sequence
  Synthetic oligonucleotide; AGG chr11 5352587 5352606 5352590 -
aataatgttctaagtagcag

SEQ ID NO: 34241 - DNA, 20 bp, Artificial Sequence
  Synthetic oligonucleotide; GGG chr11 5352586 5352605 5352589 -
ataatgttctaagtagcaga

SEQ ID NO: 34242 - DNA, 20 bp, Artificial Sequence
  Synthetic oligonucleotide; CAG chr11 5352558 5352577 5352561 -
ctgatttccactgaaatgct

SEQ ID NO: 34243 - DNA, 20 bp, Artificial Sequence
  Synthetic oligonucleotide; AGG chr11 5352557 5352576 5352560 -
tgatttccactgaaatgctc

SEQ ID NO: 34244 - DNA, 20 bp, Artificial Sequence
  Synthetic oligonucleotide; GGG chr11 5352556 5352575 5352559 -
gatttccactgaaatgctca

SEQ ID NO: 34245 - DNA, 20 bp, Artificial Sequence
  Synthetic oligonucleotide; TAG chr11 5352547 5352566 5352550 -
tgaaatgctcagggattgat

SEQ ID NO: 34246 - DNA, 20 bp, Artificial Sequence
  Synthetic oligonucleotide; TAG chr11 5352522 5352541 5352525 -
ctcattgaaatgactttccc

SEQ ID NO: 34247 - DNA, 20 bp, Artificial Sequence
  Synthetic oligonucleotide; TGG chr11 5352509 5352528 5352512 -
ctttccctagttacttatgc

SEQ ID NO: 34248 - DNA, 20 bp, Artificial Sequence
  Synthetic oligonucleotide; CAG chr11 5352488 5352507 5352491 -
ggcaacattgtcatcctgtc

SEQ ID NO: 34249 - DNA, 20 bp, Artificial Sequence
  Synthetic oligonucleotide; AGG chr11 5352487 5352506 5352490 -
gcaacattgtcatcctgtcc

SEQ ID NO: 34250 - DNA, 20 bp, Artificial Sequence
  Synthetic oligonucleotide; CAG chr11 5352467 5352486 5352470 -
aggtcccctgaattattcct

SEQ ID NO: 34251 - DNA, 20 bp, Artificial Sequence
  Synthetic oligonucleotide; GAG chr11 5352465 5352484 5352468 -
gtcccctgaattattcctca

SEQ ID NO: 34252 - DNA, 20 bp, Artificial Sequence
  Synthetic oligonucleotide; CAG chr11 5352460 5352479 5352463 -
ctgaattattcctcagagac

SEQ ID NO: 34253 - DNA, 20 bp, Artificial Sequence
  Synthetic oligonucleotide; TAG chr11 5352439 5352458 5352442 -
agtgaaacaatgtcatgctc

SEQ ID NO: 34254 - DNA, 20 bp, Artificial Sequence
  Synthetic oligonucleotide; GAG chr11 5352437 5352456 5352440 -
tgaaacaatgtcatgctcta

SEQ ID NO: 34255 - DNA, 20 bp, Artificial Sequence
  Synthetic oligonucleotide; GAG chr11 5352433 5352452 5352436 -
acaatgtcatgctctagagt

SEQ ID NO: 34256 - DNA, 20 bp, Artificial Sequence
  Synthetic oligonucleotide; AGG chr11 5352432 5352451 5352435 -
caatgtcatgctctagagtg

SEQ ID NO: 34257 - DNA, 20 bp, Artificial Sequence
  Synthetic oligonucleotide; CAG chr11 5352429 5352448 5352432 -
tgtcatgctctagagtgagg

SEQ ID NO: 34258 - DNA, 20 bp, Artificial Sequence
  Synthetic oligonucleotide; GAG chr11 5352427 5352446 5352430 -
tcatgctctagagtgaggca

SEQ ID NO: 34259 - DNA, 20 bp, Artificial Sequence
  Synthetic oligonucleotide; GAG chr11 5352425 5352444 5352428 -
atgctctagagtgaggcaga

SEQ ID NO: 34260 - DNA, 20 bp, Artificial Sequence
  Synthetic oligonucleotide; AAG chr11 5352414 5352433 5352417 -
tgaggcagagagaataaacg

SEQ ID NO: 34261 - DNA, 20 bp, Artificial Sequence
  Synthetic oligonucleotide; TAG chr11 5352391 5352410 5352394 -
tatgccactctgaatctgct

SEQ ID NO: 34262 - DNA, 20 bp, Artificial Sequence
  Synthetic oligonucleotide; TAG chr11 5352377 5352396 5352380 -
tctgcttagttttaatgcta

SEQ ID NO: 34263 - DNA, 20 bp, Artificial Sequence
  Synthetic oligonucleotide; TGG chr11 5352369 5352388 5352372 -
gttttaatgctatagataaa

SEQ ID NO: 34264 - DNA, 20 bp, Artificial Sequence
  Synthetic oligonucleotide; GGG chr11 5352368 5352387 5352371 -
ttttaatgctatagataaat

SEQ ID NO: 34265 - DNA, 20 bp, Artificial Sequence
  Synthetic oligonucleotide; AAG chr11 5352358 5352377 5352361 -
atagataaatgggttcataa

SEQ ID NO: 34266 - DNA, 20 bp, Artificial Sequence
  Synthetic oligonucleotide; AGG chr11 5352357 5352376 5352360 -
tagataaatgggttcataaa

SEQ ID NO: 34267 - DNA, 20 bp, Artificial Sequence
  Synthetic oligonucleotide; TGG chr11 5352354 5352373 5352357 -
ataaatgggttcataaaagg

SEQ ID NO: 34268 - DNA, 20 bp, Artificial Sequence
  Synthetic oligonucleotide; GGG chr11 5352353 5352372 5352356 -
taaatgggttcataaaaggt

SEQ ID NO: 34269 - DNA, 20 bp, Artificial Sequence
  Synthetic oligonucleotide; AAG chr11 5352348 5352367 5352351 -
gggttcataaaaggtgggaa

SEQ ID NO: 34270 - DNA, 20 bp, Artificial Sequence
  Synthetic oligonucleotide; AGG chr11 5352347 5352366 5352350 -
ggttcataaaaggtgggaaa

SEQ ID NO: 34271 - DNA, 20 bp, Artificial Sequence
  Synthetic oligonucleotide; AAG chr11 5352344 5352363 5352347 -
tcataaaaggtgggaaaagg

SEQ ID NO: 34272 - DNA, 20 bp, Artificial Sequence
  Synthetic oligonucleotide; TGG chr11 5352341 5352360 5352344 -
taaaaggtgggaaaaggaag

SEQ ID NO: 34273 - DNA, 20 bp, Artificial Sequence
  Synthetic oligonucleotide; TAG chr11 5352335 5352354 5352338 -
gtgggaaaaggaagtggatg

SEQ ID NO: 34274 - DNA, 20 bp, Artificial Sequence
  Synthetic oligonucleotide; GAG chr11 5352310 5352329 5352313 -
cattgtgatgtgaacgacat

SEQ ID NO: 34275 - DNA, 20 bp, Artificial Sequence
  Synthetic oligonucleotide; AGG chr11 5352309 5352328 5352312 -
attgtgatgtgaacgacatg

SEQ ID NO: 34276 - DNA, 20 bp, Artificial Sequence
  Synthetic oligonucleotide; CAG chr11 5352276 5352295 5352279 -
ccaaacctatgaataaatgt

SEQ ID NO: 34277 - DNA, 20 bp, Artificial Sequence
  Synthetic oligonucleotide; CAG chr11 5352265 5352284 5352268 -
aataaatgtcagacaaacta

SEQ ID NO: 34278 - DNA, 20 bp, Artificial Sequence
  Synthetic oligonucleotide; TAG chr11 5352257 5352276 5352260 -
tcagacaaactacagtgaca

SEQ ID NO: 34279 - DNA, 20 bp, Artificial Sequence
  Synthetic oligonucleotide; AAG chr11 5352254 5352273 5352257 -
gacaaactacagtgacatag

SEQ ID NO: 34280 - DNA, 20 bp, Artificial Sequence
  Synthetic oligonucleotide; CAG chr11 5352249 5352268 5352252 -
actacagtgacatagaagac

SEQ ID NO: 34281 - DNA, 20 bp, Artificial Sequence
  Synthetic oligonucleotide; AGG chr11 5352248 5352267 5352251 -
ctacagtgacatagaagacc

SEQ ID NO: 34282 - DNA, 20 bp, Artificial Sequence
  Synthetic oligonucleotide; CAG chr11 5352242 5352261 5352245 -
tgacatagaagaccaggatg

SEQ ID NO: 34283 - DNA, 20 bp, Artificial Sequence
  Synthetic oligonucleotide; CAG chr11 5352239 5352258 5352242 -
catagaagaccaggatgcag

SEQ ID NO: 34284 - DNA, 20 bp, Artificial Sequence
  Synthetic oligonucleotide; GAG chr11 5352232 5352251 5352235 -
gaccaggatgcagcagatat

SEQ ID NO: 34285 - DNA, 20 bp, Artificial Sequence
  Synthetic oligonucleotide; GAG chr11 5352230 5352249 5352233 -
ccaggatgcagcagatatga

SEQ ID NO: 34286 - DNA, 20 bp, Artificial Sequence
  Synthetic oligonucleotide; GAG chr11 5352216 5352235 5352219 -
atatgagagacacatgtgtt

SEQ ID NO: 34287 - DNA, 20 bp, Artificial Sequence
  Synthetic oligonucleotide; AGG chr11 5352215 5352234 5352218 -
tatgagagacacatgtgttg

SEQ ID NO: 34288 - DNA, 20 bp, Artificial Sequence
  Synthetic oligonucleotide; GGG chr11 5352214 5352233 5352217 -
atgagagacacatgtgttga

SEQ ID NO: 34289 - DNA, 20 bp, Artificial Sequence
  Synthetic oligonucleotide; TGG chr11 5352208 5352227 5352211 -
gacacatgtgttgagggcct

SEQ ID NO: 34290 - DNA, 20 bp, Artificial Sequence
  Synthetic oligonucleotide; CAG chr11 5352193 5352212 5352196 -
ggccttggccctttctcctc

SEQ ID NO: 34291 - DNA, 20 bp, Artificial Sequence
  Synthetic oligonucleotide; CAG chr11 5352175 5352194 5352178 -
tccagaaccaatgcccatga

SEQ ID NO: 34292 - DNA, 20 bp, Artificial Sequence
  Synthetic oligonucleotide; GAG chr11 5352168 5352187 5352171 -
ccaatgcccatgacagtctt

SEQ ID NO: 34293 - DNA, 20 bp, Artificial Sequence
  Synthetic oligonucleotide; TAG chr11 5352155 5352174 5352158 -
cagtcttgagaatcaaaatg

SEQ ID NO: 34294 - DNA, 20 bp, Artificial Sequence
  Synthetic oligonucleotide; AGG chr11 5352154 5352173 5352157 -
agtcttgagaatcaaaatgt

SEQ ID NO: 34295 - DNA, 20 bp, Artificial Sequence
  Synthetic oligonucleotide; GAG chr11 5352152 5352171 5352155 -
tcttgagaatcaaaatgtag

SEQ ID NO: 34296 - DNA, 20 bp, Artificial Sequence
  Synthetic oligonucleotide; AAG chr11 5352146 5352165 5352149 -
gaatcaaaatgtaggagaaa

SEQ ID NO: 34297 - DNA, 20 bp, Artificial Sequence
  Synthetic oligonucleotide; GAG chr11 5352138 5352157 5352141 -
atgtaggagaaaaagatgat

SEQ ID NO: 34298 - DNA, 20 bp, Artificial Sequence
  Synthetic oligonucleotide; AAG chr11 5352134 5352153 5352137 -
aggagaaaaagatgatgaga

SEQ ID NO: 34299 - DNA, 20 bp, Artificial Sequence
  Synthetic oligonucleotide; AAG chr11 5352125 5352144 5352128 -
agatgatgagaaagtccaac

SEQ ID NO: 34300 - DNA, 20 bp, Artificial Sequence
  Synthetic oligonucleotide; TGG chr11 5352099 5352118 5352102 -
attgcaaataaaactacaac

SEQ ID NO: 34301 - DNA, 20 bp, Artificial Sequence
  Synthetic oligonucleotide; TAG chr11 5352095 5352114 5352098 -
caaataaaactacaactgga

SEQ ID NO: 34302 - DNA, 20 bp, Artificial Sequence
  Synthetic oligonucleotide; GAG chr11 5352093 5352112 5352096 -
aataaaactacaactggata

SEQ ID NO: 34303 - DNA, 20 bp, Artificial Sequence
  Synthetic oligonucleotide; CGG chr11 5352089 5352108 5352092 -
aaactacaactggatagaga

SEQ ID NO: 34304 - DNA, 20 bp, Artificial Sequence
  Synthetic oligonucleotide; AAG chr11 5352083 5352102 5352086 -
caactggatagagacggttg

SEQ ID NO: 34305 - DNA, 20 bp, Artificial Sequence
  Synthetic oligonucleotide; AGG chr11 5352082 5352101 5352085 -
aactggatagagacggttga

SEQ ID NO: 34306 - DNA, 20 bp, Artificial Sequence
  Synthetic oligonucleotide; CAG chr11 5352073 5352092 5352076 -
gagacggttgaaggtgatgt

SEQ ID NO: 34307 - DNA, 20 bp, Artificial Sequence
  Synthetic oligonucleotide; CAG chr11 5352068 5352087 5352071 -
ggttgaaggtgatgtcagca

SEQ ID NO: 34308 - DNA, 20 bp, Artificial Sequence
  Synthetic oligonucleotide; AGG chr11 5352067 5352086 5352070 -
gttgaaggtgatgtcagcac

SEQ ID NO: 34309 - DNA, 20 bp, Artificial Sequence
  Synthetic oligonucleotide; TAG chr11 5352063 5352082 5352066 -
aaggtgatgtcagcacaggc

SEQ ID NO: 34310 - DNA, 20 bp, Artificial Sequence
  Synthetic oligonucleotide; TGG chr11 5352047 5352066 5352050 -
aggctagcttgatgacatct

SEQ ID NO: 34311 - DNA, 20 bp, Artificial Sequence
  Synthetic oligonucleotide; TAG chr11 5352042 5352061 5352045 -
agcttgatgacatcttggtg

SEQ ID NO: 34312 - DNA, 20 bp, Artificial Sequence
  Synthetic oligonucleotide; CAG chr11 5352038 5352057 5352041 -
tgatgacatcttggtgtaga

SEQ ID NO: 34313 - DNA, 20 bp, Artificial Sequence
  Synthetic oligonucleotide; AAG chr11 5352034 5352053 5352037 -
gacatcttggtgtagacaga

SEQ ID NO: 34314 - DNA, 20 bp, Artificial Sequence
  Synthetic oligonucleotide; TGG chr11 5352029 5352048 5352032 -
cttggtgtagacagaaagca

SEQ ID NO: 34315 - DNA, 20 bp, Artificial Sequence
  Synthetic oligonucleotide; GGG chr11 5352028 5352047 5352031 -
ttggtgtagacagaaagcat

SEQ ID NO: 34316 - DNA, 20 bp, Artificial Sequence
  Synthetic oligonucleotide; GAG chr11 5352026 5352045 5352029 -
ggtgtagacagaaagcatgg

SEQ ID NO: 34317 - DNA, 20 bp, Artificial Sequence
  Synthetic oligonucleotide; GAG chr11 5352024 5352043 5352027 -
tgtagacagaaagcatggga

SEQ ID NO: 34318 - DNA, 20 bp, Artificial Sequence
  Synthetic oligonucleotide; TGG chr11 5352017 5352036 5352020 -
agaaagcatgggagagtaca

SEQ ID NO: 34319 - DNA, 20 bp, Artificial Sequence
  Synthetic oligonucleotide; GGG chr11 5352016 5352035 5352019 -
gaaagcatgggagagtacat

SEQ ID NO: 34320 - DNA, 20 bp, Artificial Sequence
  Synthetic oligonucleotide; CAG chr11 5352008 5352027 5352011 -
gggagagtacatgggatcga

SEQ ID NO: 34321 - DNA, 20 bp, Artificial Sequence
  Synthetic oligonucleotide; TAG chr11 5352005 5352024 5352008 -
agagtacatgggatcgacag

SEQ ID NO: 34322 - DNA, 20 bp, Artificial Sequence
  Synthetic oligonucleotide; AGG chr11 5352004 5352023 5352007 -
gagtacatgggatcgacagt

SEQ ID NO: 34323 - DNA, 20 bp, Artificial Sequence
  Synthetic oligonucleotide; GGG chr11 5352003 5352022 5352006 -
agtacatgggatcgacagta

SEQ ID NO: 34324 - DNA, 20 bp, Artificial Sequence
  Synthetic oligonucleotide; CAG chr11 5351996 5352015 5351999 -
gggatcgacagtagggaaac

SEQ ID NO: 34325 - DNA, 20 bp, Artificial Sequence
  Synthetic oligonucleotide; TAG chr11 5351991 5352010 5351994 -
cgacagtagggaaaccagtg

SEQ ID NO: 34326 - DNA, 20 bp, Artificial Sequence
  Synthetic oligonucleotide; AGG chr11 5351990 5352009 5351993 -
gacagtagggaaaccagtgt

SEQ ID NO: 34327 - DNA, 20 bp, Artificial Sequence
  Synthetic oligonucleotide; TGG chr11 5351976 5351995 5351979 -
cagtgtaggcgaacaactat

SEQ ID NO: 34328 - DNA, 20 bp, Artificial Sequence
  Synthetic oligonucleotide; TGG chr11 5351968 5351987 5351971 -
gcgaacaactattggcataa

SEQ ID NO: 34329 - DNA, 20 bp, Artificial Sequence
  Synthetic oligonucleotide; CAG chr11 5351964 5351983 5351967 -
acaactattggcataatgga

SEQ ID NO: 34330 - DNA, 20 bp, Artificial Sequence
  Synthetic oligonucleotide; CAG chr11 5351959 5351978 5351962 -
tattggcataatggacagac

SEQ ID NO: 34331 - DNA, 20 bp, Artificial Sequence
  Synthetic oligonucleotide; TGG chr11 5351921 5351940 5351924 -
gcacaccaatcttcattacc

SEQ ID NO: 34332 - DNA, 20 bp, Artificial Sequence
  Synthetic oligonucleotide; GGG chr11 5351920 5351939 5351923 -
cacaccaatcttcattacct

SEQ ID NO: 34333 - DNA, 20 bp, Artificial Sequence
  Synthetic oligonucleotide; TGG chr11 5351914 5351933 5351917 -
aatcttcattacctgggtgt

SEQ ID NO: 34334 - DNA, 20 bp, Artificial Sequence
  Synthetic oligonucleotide; CAG chr11 5351910 5351929 5351913 -
ttcattacctgggtgttggt

SEQ ID NO: 34335 - DNA, 20 bp, Artificial Sequence
  Synthetic oligonucleotide; AGG chr11 5351909 5351928 5351912 -
tcattacctgggtgttggtc

SEQ ID NO: 34336 - DNA, 20 bp, Artificial Sequence
  Synthetic oligonucleotide; TAG chr11 5351905 5351924 5351908 -
tacctgggtgttggtcagga

SEQ ID NO: 34337 - DNA, 20 bp, Artificial Sequence
  Synthetic oligonucleotide; GAG chr11 5351903 5351922 5351906 -
cctgggtgttggtcaggata

SEQ ID NO: 34338 - DNA, 20 bp, Artificial Sequence
  Synthetic oligonucleotide; AGG chr11 5351902 5351921 5351905 -
ctgggtgttggtcaggatag

SEQ ID NO: 34339 - DNA, 20 bp, Artificial Sequence
  Synthetic oligonucleotide; AAG chr11 5351891 5351910 5351894 -
tcaggatagaggtatatctt

SEQ ID NO: 34340 - DNA, 20 bp, Artificial Sequence
  Synthetic oligonucleotide; AGG chr11 5351890 5351909 5351893 -
caggatagaggtatatctta

SEQ ID NO: 34341 - DNA, 20 bp, Artificial Sequence
  Synthetic oligonucleotide; GGG chr11 5351889 5351908 5351892 -
aggatagaggtatatcttaa

SEQ ID NO: 34342 - DNA, 20 bp, Artificial Sequence
  Synthetic oligonucleotide; GGG chr11 5351888 5351907 5351891 -
ggatagaggtatatcttaag

SEQ ID NO: 34343 - DNA, 20 bp, Artificial Sequence
  Synthetic oligonucleotide; CGG chr11 5351882 5351901 5351885 -
aggtatatcttaaggggctg

SEQ ID NO: 34344 - DNA, 20 bp, Artificial Sequence
  Synthetic oligonucleotide; TGG chr11 5351878 5351897 5351881 -
atatcttaaggggctgcgga

SEQ ID NO: 34345 - DNA, 20 bp, Artificial Sequence
  Synthetic oligonucleotide; CAG chr11 5351867 5351886 5351870 -
ggctgcggatggtaatgaaa

SEQ ID NO: 34346 - DNA, 20 bp, Artificial Sequence
  Synthetic oligonucleotide; AAG chr11 5351860 5351879 5351863 -
gatggtaatgaaacagtcat

SEQ ID NO: 34347 - DNA, 20 bp, Artificial Sequence
  Synthetic oligonucleotide; TGG chr11 5351854 5351873 5351857 -
aatgaaacagtcataagcca

SEQ ID NO: 34348 - DNA, 20 bp, Artificial Sequence
  Synthetic oligonucleotide; AAG chr11 5351850 5351869 5351853 -
aaacagtcataagccatggc

SEQ ID NO: 34349 - DNA, 20 bp, Artificial Sequence
  Synthetic oligonucleotide; AAG chr11 5351846 5351865 5351849 -
agtcataagccatggcaagc

SEQ ID NO: 34350 - DNA, 20 bp, Artificial Sequence
  Synthetic oligonucleotide; CAG chr11 5351827 5351846 5351830 -
caagacacctgactccatga

SEQ ID NO: 34351 - DNA, 20 bp, Artificial Sequence
  Synthetic oligonucleotide; AAG chr11 5351823 5351842 5351826 -
acacctgactccatgacaga

SEQ ID NO: 34352 - DNA, 20 bp, Artificial Sequence
  Synthetic oligonucleotide; GAG chr11 5351821 5351840 5351824 -
acctgactccatgacagaaa

SEQ ID NO: 34353 - DNA, 20 bp, Artificial Sequence
  Synthetic oligonucleotide; TGG chr11 5351816 5351835 5351819 -
actccatgacagaaagagta

SEQ ID NO: 34354 - DNA, 20 bp, Artificial Sequence
  Synthetic oligonucleotide; TAG chr11 5351807 5351826 5351810 -
cagaaagagtatggataaaa

SEQ ID NO: 34355 - DNA, 20 bp, Artificial Sequence
  Synthetic oligonucleotide; AGG chr11 5351806 5351825 5351809 -
agaaagagtatggataaaat

SEQ ID NO: 34356 - DNA, 20 bp, Artificial Sequence
  Synthetic oligonucleotide; GAG chr11 5351800 5351819 5351803 -
agtatggataaaataggcct

SEQ ID NO: 34357 - DNA, 20 bp, Artificial Sequence
  Synthetic oligonucleotide; GAG chr11 5351798 5351817 5351801 -
tatggataaaataggcctga

SEQ ID NO: 34358 - DNA, 20 bp, Artificial Sequence
  Synthetic oligonucleotide; AAG chr11 5351795 5351814 5351798 -
ggataaaataggcctgagag

SEQ ID NO: 34359 - DNA, 20 bp, Artificial Sequence
  Synthetic oligonucleotide; CAG chr11 5351792 5351811 5351795 -
taaaataggcctgagagaag

SEQ ID NO: 34360 - DNA, 20 bp, Artificial Sequence
  Synthetic oligonucleotide; AGG chr11 5351791 5351810 5351794 -
aaaataggcctgagagaagc

SEQ ID NO: 34361 - DNA, 20 bp, Artificial Sequence
  Synthetic oligonucleotide; TGG chr11 5351783 5351802 5351786 -
cctgagagaagcaggctcca

SEQ ID NO: 34362 - DNA, 20 bp, Artificial Sequence
  Synthetic oligonucleotide; CAG chr11 5351757 5351776 5351760 -
atctccctgtgatctaacca

SEQ ID NO: 34363 - DNA, 20 bp, Artificial Sequence
  Synthetic oligonucleotide; TAG chr11 5351748 5351767 5351751 -
tgatctaaccacagaacacc

SEQ ID NO: 34364 - DNA, 20 bp, Artificial Sequence
  Synthetic oligonucleotide; TGG chr11 5351740 5351759 5351743 -
ccacagaacacctagcactg

SEQ ID NO: 34365 - DNA, 20 bp, Artificial Sequence
  Synthetic oligonucleotide; GGG chr11 5351739 5351758 5351742 -
cacagaacacctagcactgt

SEQ ID NO: 34366 - DNA, 20 bp, Artificial Sequence
  Synthetic oligonucleotide; TGG chr11 5351731 5351750 5351734 -
acctagcactgtgggcattg

SEQ ID NO: 34367 - DNA, 20 bp, Artificial Sequence
  Synthetic oligonucleotide; GAG chr11 5351715 5351734 5351718 -
attgtggtcaatgtcactcc

SEQ ID NO: 34368 - DNA, 20 bp, Artificial Sequence
  Synthetic oligonucleotide; AGG chr11 5351714 5351733 5351717 -
ttgtggtcaatgtcactccg

SEQ ID NO: 34369 - DNA, 20 bp, Artificial Sequence
  Synthetic oligonucleotide; TAG chr11 5351707 5351726 5351710 -
caatgtcactccgaggtctg

SEQ ID NO: 34370 - DNA, 20 bp, Artificial Sequence
  Synthetic oligonucleotide; TAG chr11 5351695 5351714 5351698 -
gaggtctgtagctgccaaca

SEQ ID NO: 34371 - DNA, 20 bp, Artificial Sequence
  Synthetic oligonucleotide; AAG chr11 5351690 5351709 5351693 -
ctgtagctgccaacatagct

SEQ ID NO: 34372 - DNA, 20 bp, Artificial Sequence
  Synthetic oligonucleotide; TAG chr11 5351684 5351703 5351687 -
ctgccaacatagctaagaaa

SEQ ID NO: 34373 - DNA, 20 bp, Artificial Sequence
  Synthetic oligonucleotide; TGG chr11 5351677 5351696 5351680 -
catagctaagaaatagtaca

SEQ ID NO: 34374 - DNA, 20 bp, Artificial Sequence
  Synthetic oligonucleotide; GGG chr11 5351676 5351695 5351679 -
atagctaagaaatagtacat

SEQ ID NO: 34375 - DNA, 20 bp, Artificial Sequence
  Synthetic oligonucleotide; TGG chr11 5351669 5351688 5351672 -
agaaatagtacatgggctca

SEQ ID NO: 34376 - DNA, 20 bp, Artificial Sequence
  Synthetic oligonucleotide; GAG chr11 5351667 5351686 5351670 -
aaatagtacatgggctcatg

SEQ ID NO: 34377 - DNA, 20 bp, Artificial Sequence
  Synthetic oligonucleotide; AGG chr11 5351666 5351685 5351669 -
aatagtacatgggctcatgg

SEQ ID NO: 34378 - DNA, 20 bp, Artificial Sequence
  Synthetic oligonucleotide; GAG chr11 5351646 5351665 5351649 -
aggttatgatcattcctgat

SEQ ID NO: 34379 - DNA, 20 bp, Artificial Sequence
  Synthetic oligonucleotide; AAG chr11 5351642 5351661 5351645 -
tatgatcattcctgatgaga

SEQ ID NO: 34380 - DNA, 20 bp, Artificial Sequence
  Synthetic oligonucleotide; GAG chr11 5351640 5351659 5351643 -
tgatcattcctgatgagaaa

SEQ ID NO: 34381 - DNA, 20 bp, Artificial Sequence
  Synthetic oligonucleotide; AAG chr11 5351637 5351656 5351640 -
tcattcctgatgagaaagag

SEQ ID NO: 34382 - DNA, 20 bp, Artificial Sequence
  Synthetic oligonucleotide; GAG chr11 5351635 5351654 5351638 -
attcctgatgagaaagagaa

SEQ ID NO: 34383 - DNA, 20 bp, Artificial Sequence
  Synthetic oligonucleotide; AAG chr11 5351622 5351641 5351625 -
aagagaagagtgccattgcc

SEQ ID NO: 34384 - DNA, 20 bp, Artificial Sequence
  Synthetic oligonucleotide; AAG chr11 5351619 5351638 5351622 -
agaagagtgccattgccaag

SEQ ID NO: 34385 - DNA, 20 bp, Artificial Sequence
  Synthetic oligonucleotide; TGG chr11 5351614 5351633 5351617 -
agtgccattgccaagaagta

SEQ ID NO: 34386 - DNA, 20 bp, Artificial Sequence
  Synthetic oligonucleotide; GAG chr11 5351612 5351631 5351615 -
tgccattgccaagaagtatg

SEQ ID NO: 34387 - DNA, 20 bp, Artificial Sequence
  Synthetic oligonucleotide; TAG chr11 5351606 5351625 5351609 -
tgccaagaagtatggagatg

SEQ ID NO: 34388 - DNA, 20 bp, Artificial Sequence
  Synthetic oligonucleotide; AGG chr11 5351605 5351624 5351608 -
gccaagaagtatggagatgt

SEQ ID NO: 34389 - DNA, 20 bp, Artificial Sequence
  Synthetic oligonucleotide; TGG chr11 5351592 5351611 5351595 -
gagatgtaggctgccaataa

SEQ ID NO: 34390 - DNA, 20 bp, Artificial Sequence
  Synthetic oligonucleotide; GGG chr11 5351591 5351610 5351594 -
agatgtaggctgccaataat

SEQ ID NO: 34391 - DNA, 20 bp, Artificial Sequence
  Synthetic oligonucleotide; CAG chr11 5351579 5351598 5351582 -
ccaataatgggatgaatatc

SEQ ID NO: 34392 - DNA, 20 bp, Artificial Sequence
  Synthetic oligonucleotide; TGG chr11 5351556 5351575 5351559 -
tgatgtgccttctccatgcc

SEQ ID NO: 34393 - DNA, 20 bp, Artificial Sequence
  Synthetic oligonucleotide; GGG chr11 5351555 5351574 5351558 -
gatgtgccttctccatgcct

SEQ ID NO: 34394 - DNA, 20 bp, Artificial Sequence
  Synthetic oligonucleotide; AAG chr11 5351552 5351571 5351555 -
gtgccttctccatgcctggg

SEQ ID NO: 34395 - DNA, 20 bp, Artificial Sequence
  Synthetic oligonucleotide; CAG chr11 5351548 5351567 5351551 -
cttctccatgcctgggaagc

SEQ ID NO: 34396 - DNA, 20 bp, Artificial Sequence
  Synthetic oligonucleotide; AAG chr11 5351544 5351563 5351547 -
tccatgcctgggaagccagt

SEQ ID NO: 34397 - DNA, 20 bp, Artificial Sequence
  Synthetic oligonucleotide; TGG chr11 5351540 5351559 5351543 -
tgcctgggaagccagtaagc

SEQ ID NO: 34398 - DNA, 20 bp, Artificial Sequence
  Synthetic oligonucleotide; AAG chr11 5351537 5351556 5351540 -
ctgggaagccagtaagctgg

SEQ ID NO: 34399 - DNA, 20 bp, Artificial Sequence
  Synthetic oligonucleotide; AGG chr11 5351536 5351555 5351539 -
tgggaagccagtaagctgga

SEQ ID NO: 34400 - DNA, 20 bp, Artificial Sequence
  Synthetic oligonucleotide; TGG chr11 5351533 5351552 5351536 -
gaagccagtaagctggaagg

SEQ ID NO: 34401 - DNA, 20 bp, Artificial Sequence
  Synthetic oligonucleotide; AAG chr11 5351530 5351549 5351533 -
gccagtaagctggaaggtgg

SEQ ID NO: 34402 - DNA, 20 bp, Artificial Sequence
  Synthetic oligonucleotide; CAG chr11 5351527 5351546 5351530 -
agtaagctggaaggtggaag

SEQ ID NO: 34403 - DNA, 20 bp, Artificial Sequence
  Synthetic oligonucleotide; GAG chr11 5351517 5351536 5351520 -
aaggtggaagcagacttatt

SEQ ID NO: 34404 - DNA, 20 bp, Artificial Sequence
  Synthetic oligonucleotide; CAG chr11 5351505 5351524 5351508 -
gacttattgagccccattgc

SEQ ID NO: 34405 - DNA, 20 bp, Artificial Sequence
  Synthetic oligonucleotide; AAG chr11 5351495 5351514 5351498 -
gccccattgccagctttgca

SEQ ID NO: 34406 - DNA, 20 bp, Artificial Sequence
  Synthetic oligonucleotide; GAG chr11 5351493 5351512 5351496 -
cccattgccagctttgcaaa

SEQ ID NO: 34407 - DNA, 20 bp, Artificial Sequence
  Synthetic oligonucleotide; AGG chr11 5351492 5351511 5351495 -
ccattgccagctttgcaaag

SEQ ID NO: 34408 - DNA, 20 bp, Artificial Sequence
  Synthetic oligonucleotide; CAG chr11 5351476 5351495 5351479 -
aaagaggcaaatatttactc

SEQ ID NO: 34409 - DNA, 20 bp, Artificial Sequence
  Synthetic oligonucleotide; AGG chr11 5351475 5351494 5351478 -
aagaggcaaatatttactcc

SEQ ID NO: 34410 - DNA, 20 bp, Artificial Sequence
  Synthetic oligonucleotide; AAG chr11 5351470 5351489 5351473 -
gcaaatatttactccaggta

SEQ ID NO: 34411 - DNA, 20 bp, Artificial Sequence
  Synthetic oligonucleotide; TAG chr11 5351464 5351483 5351467 -
atttactccaggtaaagcaa

SEQ ID NO: 34412 - DNA, 20 bp, Artificial Sequence
  Synthetic oligonucleotide; CAG chr11 5351457 5351476 5351460 -
ccaggtaaagcaatagtaat

SEQ ID NO: 34413 - DNA, 20 bp, Artificial Sequence
  Synthetic oligonucleotide; AAG chr11 5351446 5351465 5351449 -
aatagtaatcagttgtataa

SEQ ID NO: 34414 - DNA, 20 bp, Artificial Sequence
  Synthetic oligonucleotide; GAG chr11 5351434 5351453 5351437 -
ttgtataaaagttgctcctt

SEQ ID NO: 34415 - DNA, 20 bp, Artificial Sequence
  Synthetic oligonucleotide; AAG chr11 5351415 5351434 5351418 -
tgagaattctacctgttcat

SEQ ID NO: 34416 - DNA, 20 bp, Artificial Sequence
  Synthetic oligonucleotide; CAG chr11 5351404 5351423 5351407 -
cctgttcataagatgttcac

SEQ ID NO: 34417 - DNA, 20 bp, Artificial Sequence
  Synthetic oligonucleotide; CAG chr11 5351391 5351410 5351394 -
tgttcaccagtcctgacttt

SEQ ID NO: 34418 - DNA, 20 bp, Artificial Sequence
  Synthetic oligonucleotide; CAG chr11 5351385 5351404 5351388 -
ccagtcctgactttcagtga

SEQ ID NO: 34419 - DNA, 20 bp, Artificial Sequence
  Synthetic oligonucleotide; AAG chr11 5351381 5351400 5351384 -
tcctgactttcagtgacagc

SEQ ID NO: 34420 - DNA, 20 bp, Artificial Sequence
  Synthetic oligonucleotide; AGG chr11 5351380 5351399 5351383 -
cctgactttcagtgacagca

SEQ ID NO: 34421 - DNA, 20 bp, Artificial Sequence
  Synthetic oligonucleotide; TAG chr11 5351368 5351387 5351371 -
tgacagcaaggatgataatt

SEQ ID NO: 34422 - DNA, 20 bp, Artificial Sequence
  Synthetic oligonucleotide; TGG chr11 5351358 5351377 5351361 -
gatgataatttagtcattcc

SEQ ID NO: 34423 - DNA, 20 bp, Artificial Sequence
  Synthetic oligonucleotide; GGG chr11 5351357 5351376 5351360 -
atgataatttagtcattcct

SEQ ID NO: 34424 - DNA, 20 bp, Artificial Sequence
  Synthetic oligonucleotide; GAG chr11 5351355 5351374 5351358 -
gataatttagtcattcctgg

SEQ ID NO: 34425 - DNA, 20 bp, Artificial Sequence
  Synthetic oligonucleotide; TAG chr11 5351348 5351367 5351351 -
tagtcattcctgggagatcc

SEQ ID NO: 34426 - DNA, 20 bp, Artificial Sequence
  Synthetic oligonucleotide; AGG chr11 5351347 5351366 5351350 -
agtcattcctgggagatcct

SEQ ID NO: 34427 - DNA, 20 bp, Artificial Sequence
  Synthetic oligonucleotide; TGG chr11 5351342 5351361 5351345 -
ttcctgggagatcctaggta

SEQ ID NO: 34428 - DNA, 20 bp, Artificial Sequence
  Synthetic oligonucleotide; GGG chr11 5351341 5351360 5351344 -
tcctgggagatcctaggtat

SEQ ID NO: 34429 - DNA, 20 bp, Artificial Sequence
  Synthetic oligonucleotide; TAG chr11 5351334 5351353 5351337 -
agatcctaggtatgggaaaa

SEQ ID NO: 34430 - DNA, 20 bp, Artificial Sequence
  Synthetic oligonucleotide; AAG chr11 5351323 5351342 5351326 -
atgggaaaatagaatgtata

SEQ ID NO: 34431 - DNA, 20 bp, Artificial Sequence
  Synthetic oligonucleotide; AAG chr11 5351320 5351339 5351323 -
ggaaaatagaatgtataaag

SEQ ID NO: 34432 - DNA, 20 bp, Artificial Sequence
  Synthetic oligonucleotide; TAG chr11 5351309 5351328 5351312 -
tgtataaagaagatattatt

SEQ ID NO: 34433 - DNA, 20 bp, Artificial Sequence
  Synthetic oligonucleotide; AGG chr11 5351308 5351327 5351311 -
gtataaagaagatattattt

SEQ ID NO: 34434 - DNA, 20 bp, Artificial Sequence
  Synthetic oligonucleotide; GGG chr11 5351307 5351326 5351310 -
tataaagaagatattattta

SEQ ID NO: 34435 - DNA, 20 bp, Artificial Sequence
  Synthetic oligonucleotide; AAG chr11 5351292 5351311 5351295 -
atttagggtttactctatgt

SEQ ID NO: 34436 - DNA, 20 bp, Artificial Sequence
  Synthetic oligonucleotide; TGG chr11 5351284 5351303 5351287 -
tttactctatgtaagattat

SEQ ID NO: 34437 - DNA, 20 bp, Artificial Sequence
  Synthetic oligonucleotide; TGG chr11 5351272 5351291 5351275 -
aagattattggatactacgt

SEQ ID NO: 34438 - DNA, 20 bp, Artificial Sequence
  Synthetic oligonucleotide; GGG chr11 5351271 5351290 5351274 -
agattattggatactacgtt

SEQ ID NO: 34439 - DNA, 20 bp, Artificial Sequence
  Synthetic oligonucleotide; GGG chr11 5351270 5351289 5351273 -
gattattggatactacgttg

SEQ ID NO: 34440 - DNA, 20 bp, Artificial Sequence
  Synthetic oligonucleotide; CAG chr11 5351264 5351283 5351267 -
tggatactacgttggggata

SEQ ID NO: 34441 - DNA, 20 bp, Artificial Sequence
  Synthetic oligonucleotide; CAG chr11 5351252 5351271 5351255 -
tggggatacagctattcatg

SEQ ID NO: 34442 - DNA, 20 bp, Artificial Sequence
  Synthetic oligonucleotide; CAG chr11 5351212 5351231 5351215 -
tcattgtaaatcatataacc

SEQ ID NO: 34443 - DNA, 20 bp, Artificial Sequence
  Synthetic oligonucleotide; AAG chr11 5351191 5351210 5351194 -
agaaaataaaaacaaaatga

SEQ ID NO: 34444 - DNA, 20 bp, Artificial Sequence
  Synthetic oligonucleotide; AAG chr11 5351188 5351207 5351191 -
aaataaaaacaaaatgaaag

SEQ ID NO: 34445 - DNA, 20 bp, Artificial Sequence
  Synthetic oligonucleotide; TAG chr11 5351168 5351187 5351171 -
aagaaatcactatatttgaa

SEQ ID NO: 34446 - DNA, 20 bp, Artificial Sequence
  Synthetic oligonucleotide; TGG chr11 5351157 5351176 5351160 -
atatttgaatagtgctgtaa

SEQ ID NO: 34447 - DNA, 20 bp, Artificial Sequence
  Synthetic oligonucleotide; TAG chr11 5351143 5351162 5351146 -
ctgtaatggcctgaaactta

SEQ ID NO: 34448 - DNA, 20 bp, Artificial Sequence
  Synthetic oligonucleotide; AGG chr11 5351142 5351161 5351145 -
tgtaatggcctgaaacttat

SEQ ID NO: 34449 - DNA, 20 bp, Artificial Sequence
  Synthetic oligonucleotide; TGG chr11 5351129 5351148 5351132 -
aacttataggtcacttttca

SEQ ID NO: 34450 - DNA, 20 bp, Artificial Sequence
  Synthetic oligonucleotide; TGG chr11 5351110 5351129 5351113 -
atggtgctcttcatcctgac

SEQ ID NO: 34451 - DNA, 20 bp, Artificial Sequence
  Synthetic oligonucleotide; TGG chr11 5351107 5351126 5351110 -
gtgctcttcatcctgactgg

SEQ ID NO: 34452 - DNA, 20 bp, Artificial Sequence
  Synthetic oligonucleotide; TAG chr11 5351099 5351118 5351102 -
catcctgactggtggtatta

SEQ ID NO: 34453 - DNA, 20 bp, Artificial Sequence
  Synthetic oligonucleotide; AGG chr11 5351098 5351117 5351101 -
atcctgactggtggtattat

SEQ ID NO: 34454 - DNA, 20 bp, Artificial Sequence
  Synthetic oligonucleotide; GGG chr11 5351097 5351116 5351100 -
tcctgactggtggtattata

SEQ ID NO: 34455 - DNA, 20 bp, Artificial Sequence
  Synthetic oligonucleotide; TGG chr11 5351094 5351113 5351097 -
tgactggtggtattataggg

SEQ ID NO: 34456 - DNA, 20 bp, Artificial Sequence
  Synthetic oligonucleotide; AAG chr11 5351086 5351105 5351089 -
ggtattatagggtggatgta

SEQ ID NO: 34457 - DNA, 20 bp, Artificial Sequence
  Synthetic oligonucleotide; AGG chr11 5351085 5351104 5351088 -
gtattatagggtggatgtaa

SEQ ID NO: 34458 - DNA, 20 bp, Artificial Sequence
  Synthetic oligonucleotide; CAG chr11 5351077 5351096 5351080 -
gggtggatgtaaaggtttcc

SEQ ID NO: 34459 - DNA, 20 bp, Artificial Sequence
  Synthetic oligonucleotide; AGG chr11 5351076 5351095 5351079 -
ggtggatgtaaaggtttccc

SEQ ID NO: 34460 - DNA, 20 bp, Artificial Sequence
  Synthetic oligonucleotide; GAG chr11 5351067 5351086 5351070 -
aaaggtttcccaggctatgt

SEQ ID NO: 34461 - DNA, 20 bp, Artificial Sequence
  Synthetic oligonucleotide; AAG chr11 5351058 5351077 5351061 -
ccaggctatgtgagacctaa

SEQ ID NO: 34462 - DNA, 20 bp, Artificial Sequence
  Synthetic oligonucleotide; CAG chr11 5351053 5351072 5351056 -
ctatgtgagacctaaaagat

SEQ ID NO: 34463 - DNA, 20 bp, Artificial Sequence
  Synthetic oligonucleotide; TAG chr11 5351050 5351069 5351053 -
tgtgagacctaaaagatcag

SEQ ID NO: 34464 - DNA, 20 bp, Artificial Sequence
  Synthetic oligonucleotide; TGG chr11 5351042 5351061 5351045 -
ctaaaagatcagtagaaaaa

SEQ ID NO: 34465 - DNA, 20 bp, Artificial Sequence
  Synthetic oligonucleotide; AAG chr11 5351035 5351054 5351038 -
atcagtagaaaaatggttct

SEQ ID NO: 34466 - DNA, 20 bp, Artificial Sequence
  Synthetic oligonucleotide; TGG chr11 5351026 5351045 5351029 -
aaaatggttctaagcactat

SEQ ID NO: 34467 - DNA, 20 bp, Artificial Sequence
  Synthetic oligonucleotide; AAG chr11 5351021 5351040 5351024 -
ggttctaagcactattggaa

SEQ ID NO: 34468 - DNA, 20 bp, Artificial Sequence
  Synthetic oligonucleotide; CAG chr11 5351018 5351037 5351021 -
tctaagcactattggaaaag

SEQ ID NO: 34469 - DNA, 20 bp, Artificial Sequence
  Synthetic oligonucleotide; AAG chr11 5351010 5351029 5351013 -
ctattggaaaagcagatata

SEQ ID NO: 34470 - DNA, 20 bp, Artificial Sequence
  Synthetic oligonucleotide; TGG chr11 5351001 5351020 5351004 -
aagcagatataaagattata

SEQ ID NO: 34471 - DNA, 20 bp, Artificial Sequence
  Synthetic oligonucleotide; AAG chr11 5350984 5351003 5350987 -
atatggaaaaacaaatacac

SEQ ID NO: 34472 - DNA, 20 bp, Artificial Sequence
  Synthetic oligonucleotide; AAG chr11 5350980 5350999 5350983 -
ggaaaaacaaatacacaagt

SEQ ID NO: 34473 - DNA, 20 bp, Artificial Sequence
  Synthetic oligonucleotide; GAG chr11 5350969 5350988 5350972 -
tacacaagtaagaaatatat

SEQ ID NO: 34474 - DNA, 20 bp, Artificial Sequence
  Synthetic oligonucleotide; TAG chr11 5350952 5350971 5350955 -
tatgagcaaatacaataaaa

SEQ ID NO: 34475 - DNA, 20 bp, Artificial Sequence
  Synthetic oligonucleotide; CAG chr11 5350942 5350961 5350945 -
tacaataaaatagtaaattt

SEQ ID NO: 34476 - DNA, 20 bp, Artificial Sequence
  Synthetic oligonucleotide; GAG chr11 5350940 5350959 5350943 -
caataaaatagtaaatttca

SEQ ID NO: 34477 - DNA, 20 bp, Artificial Sequence
  Synthetic oligonucleotide; TGG chr11 5350915 5350934 5350918 -
tgacttttcttcaatattcc

SEQ ID NO: 34478 - DNA, 20 bp, Artificial Sequence
  Synthetic oligonucleotide; GAG chr11 5350913 5350932 5350916 -
acttttcttcaatattcctg

SEQ ID NO: 34479 - DNA, 20 bp, Artificial Sequence
  Synthetic oligonucleotide; AGG chr11 5350912 5350931 5350915 -
cttttcttcaatattcctgg

SEQ ID NO: 34480 - DNA, 20 bp, Artificial Sequence
  Synthetic oligonucleotide; GGG chr11 5350911 5350930 5350914 -
ttttcttcaatattcctgga

SEQ ID NO: 34481 - DNA, 20 bp, Artificial Sequence
  Synthetic oligonucleotide; AAG chr11 5350893 5350912 5350896 -
gagggaaaattcaattgatg

SEQ ID NO: 34482 - DNA, 20 bp, Artificial Sequence
  Synthetic oligonucleotide; CAG chr11 5350887 5350906 5350890 -
aaattcaattgatgaagctc

SEQ ID NO: 34483 - DNA, 20 bp, Artificial Sequence
  Synthetic oligonucleotide; GAG chr11 5350885 5350904 5350888 -
attcaattgatgaagctcca

SEQ ID NO: 34484 - DNA, 20 bp, Artificial Sequence
  Synthetic oligonucleotide; TGG chr11 5350877 5350896 5350880 -
gatgaagctccagagacttt

SEQ ID NO: 34485 - DNA, 20 bp, Artificial Sequence
  Synthetic oligonucleotide; GGG chr11 5350876 5350895 5350879 -
atgaagctccagagactttt

SEQ ID NO: 34486 - DNA, 20 bp, Artificial Sequence
  Synthetic oligonucleotide; TAG chr11 5350873 5350892 5350876 -
aagctccagagacttttggg

SEQ ID NO: 34487 - DNA, 20 bp, Artificial Sequence
  Synthetic oligonucleotide; TAG chr11 5350869 5350888 5350872 -
tccagagacttttgggtagt

SEQ ID NO: 34488 - DNA, 20 bp, Artificial Sequence
  Synthetic oligonucleotide; AAG chr11 5350856 5350875 5350859 -
gggtagttagaaaatgacgt

SEQ ID NO: 34489 - DNA, 20 bp, Artificial Sequence
  Synthetic oligonucleotide; GAG chr11 5350854 5350873 5350857 -
gtagttagaaaatgacgtaa

SEQ ID NO: 34490 - DNA, 20 bp, Artificial Sequence
  Synthetic oligonucleotide; AAG chr11 5350828 5350847 5350831 -
cttacctgtgtgtgtttcca

SEQ ID NO: 34491 - DNA, 20 bp, Artificial Sequence
  Synthetic oligonucleotide; TAG chr11 5350821 5350840 5350824 -
gtgtgtgtttccaaagcaca

SEQ ID NO: 34492 - DNA, 20 bp, Artificial Sequence
  Synthetic oligonucleotide; AAG chr11 5350812 5350831 5350815 -
tccaaagcacatagaactct

SEQ ID NO: 34493 - DNA, 20 bp, Artificial Sequence
  Synthetic oligonucleotide; CAG chr11 5350804 5350823 5350807 -
acatagaactctaagttgcc

SEQ ID NO: 34494 - DNA, 20 bp, Artificial Sequence
  Synthetic oligonucleotide; TAG chr11 5350790 5350809 5350793 -
gttgcccagctttataaccc

SEQ ID NO: 34495 - DNA, 20 bp, Artificial Sequence
  Synthetic oligonucleotide; AAG chr11 5350768 5350787 5350771 -
gttattgatacactgcttca

SEQ ID NO: 34496 - DNA, 20 bp, Artificial Sequence
  Synthetic oligonucleotide; AAG chr11 5350739 5350758 5350742 -
aattttcataatataaattg

SEQ ID NO: 34497 - DNA, 20 bp, Artificial Sequence
  Synthetic oligonucleotide; CAG chr11 5350730 5350749 5350733 -
aatataaattgaagaataaa

SEQ ID NO: 34498 - DNA, 20 bp, Artificial Sequence
  Synthetic oligonucleotide; TGG chr11 5350720 5350739 5350723 -
gaagaataaacagtaaaatg

SEQ ID NO: 34499 - DNA, 20 bp, Artificial Sequence
  Synthetic oligonucleotide; AAG chr11 5350707 5350726 5350710 -
taaaatgtggatttgatgat

SEQ ID NO: 34500 - DNA, 20 bp, Artificial Sequence
  Synthetic oligonucleotide; AAG chr11 5350698 5350717 5350701 -
gatttgatgataagcttttg

SEQ ID NO: 34501 - DNA, 20 bp, Artificial Sequence
  Synthetic oligonucleotide; AGG chr11 5350697 5350716 5350700 -
atttgatgataagcttttga

SEQ ID NO: 34502 - DNA, 20 bp, Artificial Sequence
  Synthetic oligonucleotide; TAG chr11 5350681 5350700 5350684 -
ttgaaggcactaattgataa

SEQ ID NO: 34503 - DNA, 20 bp, Artificial Sequence
  Synthetic oligonucleotide; TGG chr11 5350649 5350668 5350652 -
actgttgcatatcacctact

SEQ ID NO: 34504 - DNA, 20 bp, Artificial Sequence
  Synthetic oligonucleotide; TGG chr11 5350628 5350647 5350631 -
ggtgatgcaaaaataaaaat

SEQ ID NO: 34505 - DNA, 20 bp, Artificial Sequence
  Synthetic oligonucleotide; TAG chr11 5350620 5350639 5350623 -
aaaaataaaaattggtaatt

SEQ ID NO: 34506 - DNA, 20 bp, Artificial Sequence
  Synthetic oligonucleotide; AGG chr11 5350619 5350638 5350622 -
aaaataaaaattggtaattt

SEQ ID NO: 34507 - DNA, 20 bp, Artificial Sequence
  Synthetic oligonucleotide; AAG chr11 5350615 5350634 5350618 -
taaaaattggtaatttaggc

SEQ ID NO: 34508 - DNA, 20 bp, Artificial Sequence
  Synthetic oligonucleotide; AAG chr11 5350609 5350628 5350612 -
ttggtaatttaggcaagatc

SEQ ID NO: 34509 - DNA, 20 bp, Artificial Sequence
  Synthetic oligonucleotide; AGG chr11 5350608 5350627 5350611 -
tggtaatttaggcaagatca

SEQ ID NO: 34510 - DNA, 20 bp, Artificial Sequence
  Synthetic oligonucleotide; GAG chr11 5350606 5350625 5350609 -
gtaatttaggcaagatcaag

SEQ ID NO: 34511 - DNA, 20 bp, Artificial Sequence
  Synthetic oligonucleotide; TGG chr11 5350584 5350603 5350587 -
gaattttttttttaaaacta

SEQ ID NO: 34512 - DNA, 20 bp, Artificial Sequence
  Synthetic oligonucleotide; TGG chr11 5350574 5350593 5350577 -
tttaaaactatggaatctga

SEQ ID NO: 34513 - DNA, 20 bp, Artificial Sequence
  Synthetic oligonucleotide; GGG chr11 5350573 5350592 5350576 -
ttaaaactatggaatctgat

SEQ ID NO: 34514 - DNA, 20 bp, Artificial Sequence
  Synthetic oligonucleotide; AAG chr11 5350561 5350580 5350564 -
aatctgatgggatttgacaa

SEQ ID NO: 34515 - DNA, 20 bp, Artificial Sequence
  Synthetic oligonucleotide; GAG chr11 5350557 5350576 5350560 -
tgatgggatttgacaaaagt

SEQ ID NO: 34516 - DNA, 20 bp, Artificial Sequence
  Synthetic oligonucleotide; AAG chr11 5350554 5350573 5350557 -
tgggatttgacaaaagtgag

SEQ ID NO: 34517 - DNA, 20 bp, Artificial Sequence
  Synthetic oligonucleotide; AGG chr11 5350553 5350572 5350556 -
gggatttgacaaaagtgaga

SEQ ID NO: 34518 - DNA, 20 bp, Artificial Sequence
  Synthetic oligonucleotide; TAG chr11 5350537 5350556 5350540 -
gagaaggctctgtgactcat

SEQ ID NO: 34519 - DNA, 20 bp, Artificial Sequence
  Synthetic oligonucleotide; AAG chr11 5350528 5350547 5350531 -
ctgtgactcattagaattct

SEQ ID NO: 34520 - DNA, 20 bp, Artificial Sequence
  Synthetic oligonucleotide; CAG chr11 5350521 5350540 5350524 -
tcattagaattctaagattt

SEQ ID NO: 34521 - DNA, 20 bp, Artificial Sequence
  Synthetic oligonucleotide; TGG chr11 5350517 5350536 5350520 -
tagaattctaagatttcagc

SEQ ID NO: 34522 - DNA, 20 bp, Artificial Sequence
  Synthetic oligonucleotide; CAG chr11 5350512 5350531 5350515 -
ttctaagatttcagctggtg

SEQ ID NO: 34523 - DNA, 20 bp, Artificial Sequence
  Synthetic oligonucleotide; AGG chr11 5350511 5350530 5350514 -
tctaagatttcagctggtgc

SEQ ID NO: 34524 - DNA, 20 bp, Artificial Sequence
  Synthetic oligonucleotide; CAG chr11 5350508 5350527 5350511 -
aagatttcagctggtgcagg

SEQ ID NO: 34525 - DNA, 20 bp, Artificial Sequence
  Synthetic oligonucleotide; GAG chr11 5350496 5350515 5350499 -
ggtgcaggcagccaacctct

SEQ ID NO: 34526 - DNA, 20 bp, Artificial Sequence
  Synthetic oligonucleotide; TGG chr11 5350475 5350494 5350478 -
agaatacataaattgtgtgt

SEQ ID NO: 34527 - DNA, 20 bp, Artificial Sequence
  Synthetic oligonucleotide; TGG chr11 5350472 5350491 5350475 -
atacataaattgtgtgttgg

SEQ ID NO: 34528 - DNA, 20 bp, Artificial Sequence
  Synthetic oligonucleotide; GAG chr11 5350466 5350485 5350469 -
aaattgtgtgttggtggcat

SEQ ID NO: 34529 - DNA, 20 bp, Artificial Sequence
  Synthetic oligonucleotide; CAG chr11 5350462 5350481 5350465 -
tgtgtgttggtggcatgagc

SEQ ID NO: 34530 - DNA, 20 bp, Artificial Sequence
  Synthetic oligonucleotide; GAG chr11 5350460 5350479 5350463 -
tgtgttggtggcatgagcca

SEQ ID NO: 34531 - DNA, 20 bp, Artificial Sequence
  Synthetic oligonucleotide; TAG chr11 5350453 5350472 5350456 -
gtggcatgagccagagaaaa

SEQ ID NO: 34532 - DNA, 20 bp, Artificial Sequence
  Synthetic oligonucleotide; AGG chr11 5350452 5350471 5350455 -
tggcatgagccagagaaaat

SEQ ID NO: 34533 - DNA, 20 bp, Artificial Sequence
  Synthetic oligonucleotide; TGG chr11 5350435 5350454 5350438 -
aataggcccaccttctctta

SEQ ID NO: 34534 - DNA, 20 bp, Artificial Sequence
  Synthetic oligonucleotide; TGG chr11 5350431 5350450 5350434 -
ggcccaccttctcttatggt

SEQ ID NO: 34535 - DNA, 20 bp, Artificial Sequence
  Synthetic oligonucleotide; TGG chr11 5350426 5350445 5350429 -
accttctcttatggttggtt

SEQ ID NO: 34536 - DNA, 20 bp, Artificial Sequence
  Synthetic oligonucleotide; AAG chr11 5350399 5350418 5350402 -
tacatctcatatactattga

SEQ ID NO: 34537 - DNA, 20 bp, Artificial Sequence
  Synthetic oligonucleotide; GAG chr11 5350397 5350416 5350400 -
catctcatatactattgaaa

SEQ ID NO: 34538 - DNA, 20 bp, Artificial Sequence
  Synthetic oligonucleotide; AAG chr11 5350364 5350383 5350367 -
taaatttatgcacgatttac

SEQ ID NO: 34539 - DNA, 20 bp, Artificial Sequence
  Synthetic oligonucleotide; AAG chr11 5350342 5350361 5350345 -
gacctctttctgtccatgaa

SEQ ID NO: 34540 - DNA, 20 bp, Artificial Sequence
  Synthetic oligonucleotide; AAG chr11 5350330 5350349 5350333 -
tccatgaaaagaatgcatcc

SEQ ID NO: 34541 - DNA, 20 bp, Artificial Sequence
  Synthetic oligonucleotide; TGG chr11 5350322 5350341 5350325 -
aagaatgcatccaagattac

SEQ ID NO: 34542 - DNA, 20 bp, Artificial Sequence
  Synthetic oligonucleotide; CAG chr11 5350308 5350327 5350311 -
gattactggactttcatttt

SEQ ID NO: 34543 - DNA, 20 bp, Artificial Sequence
  Synthetic oligonucleotide; AAG chr11 5350305 5350324 5350308 -
tactggactttcattttcag

SEQ ID NO: 34544 - DNA, 20 bp, Artificial Sequence
  Synthetic oligonucleotide; AAG chr11 5350293 5350312 5350296 -
attttcagaagaatttgttg

SEQ ID NO: 34545 - DNA, 20 bp, Artificial Sequence
  Synthetic oligonucleotide; CAG chr11 5350287 5350306 5350290 -
agaagaatttgttgaagttt

SEQ ID NO: 34546 - DNA, 20 bp, Artificial Sequence
  Synthetic oligonucleotide; TGG chr11 5350257 5350276 5350260 -
ctttctaacaataatgatct

SEQ ID NO: 34547 - DNA, 20 bp, Artificial Sequence
  Synthetic oligonucleotide; GGG chr11 5350256 5350275 5350259 -
tttctaacaataatgatctt

SEQ ID NO: 34548 - DNA, 20 bp, Artificial Sequence
  Synthetic oligonucleotide; AAG chr11 5350252 5350271 5350255 -
taacaataatgatcttggga

SEQ ID NO: 34549 - DNA, 20 bp, Artificial Sequence
  Synthetic oligonucleotide; GAG chr11 5350237 5350256 5350240 -
tgggaaagtaatttaatctt

SEQ ID NO: 34550 - DNA, 20 bp, Artificial Sequence
  Synthetic oligonucleotide; TGG chr11 5350231 5350250 5350234 -
agtaatttaatcttgagatt

SEQ ID NO: 34551 - DNA, 20 bp, Artificial Sequence
  Synthetic oligonucleotide; AAG chr11 5350214 5350233 5350217 -
atttggttacataacctgta

SEQ ID NO: 34552 - DNA, 20 bp, Artificial Sequence
  Synthetic oligonucleotide; TAG chr11 5350206 5350225 5350209 -
acataacctgtaaagactac

SEQ ID NO: 34553 - DNA, 20 bp, Artificial Sequence
  Synthetic oligonucleotide; CAG chr11 5350188 5350207 5350191 -
actagtgatttctgtcttct

SEQ ID NO: 34554 - DNA, 20 bp, Artificial Sequence
  Synthetic oligonucleotide; AAG chr11 5350169 5350188 5350172 -
tcagtcattctcttgacaca

SEQ ID NO: 34555 - DNA, 20 bp, Artificial Sequence
  Synthetic oligonucleotide; AAG chr11 5350165 5350184 5350168 -
tcattctcttgacacaaagt

SEQ ID NO: 34556 - DNA, 20 bp, Artificial Sequence
  Synthetic oligonucleotide; AGG chr11 5350164 5350183 5350167 -
cattctcttgacacaaagta

SEQ ID NO: 34557 - DNA, 20 bp, Artificial Sequence
  Synthetic oligonucleotide; GGG chr11 5350163 5350182 5350166 -
attctcttgacacaaagtaa

SEQ ID NO: 34558 - DNA, 20 bp, Artificial Sequence
  Synthetic oligonucleotide; GGG chr11 5350162 5350181 5350165 -
ttctcttgacacaaagtaag

SEQ ID NO: 34559 - DNA, 20 bp, Artificial Sequence
  Synthetic oligonucleotide; AAG chr11 5350147 5350166 5350150 -
gtaaggggaaatgttttgta

SEQ ID NO: 34560 - DNA, 20 bp, Artificial Sequence
  Synthetic oligonucleotide; GAG chr11 5350145 5350164 5350148 -
aaggggaaatgttttgtaaa

SEQ ID NO: 34561 - DNA, 20 bp, Artificial Sequence
  Synthetic oligonucleotide; TGG chr11 5350142 5350161 5350145 -
gggaaatgttttgtaaagag

SEQ ID NO: 34562 - DNA, 20 bp, Artificial Sequence
  Synthetic oligonucleotide; CAG chr11 5350104 5350123 5350107 -
ttgtgtttttgttattgttt

SEQ ID NO: 34563 - DNA, 20 bp, Artificial Sequence
  Synthetic oligonucleotide; GAG chr11 5350102 5350121 5350105 -
gtgtttttgttattgtttca

SEQ ID NO: 34564 - DNA, 20 bp, Artificial Sequence
  Synthetic oligonucleotide; AAG chr11 5350099 5350118 5350102 -
tttttgttattgtttcagag

SEQ ID NO: 34565 - DNA, 20 bp, Artificial Sequence
  Synthetic oligonucleotide; TAG chr11 5350077 5350096 5350080 -
gtacctcctttctctttctc

SEQ ID NO: 34566 - DNA, 20 bp, Artificial Sequence
  Synthetic oligonucleotide; GAG chr11 5350073 5350092 5350076 -
ctcctttctctttctctagt

SEQ ID NO: 34567 - DNA, 20 bp, Artificial Sequence
  Synthetic oligonucleotide; CAG chr11 5350063 5350082 5350066 -
tttctctagtgagtacatgt

SEQ ID NO: 34568 - DNA, 20 bp, Artificial Sequence
  Synthetic oligonucleotide; AGG chr11 5350062 5350081 5350065 -
ttctctagtgagtacatgtc

SEQ ID NO: 34569 - DNA, 20 bp, Artificial Sequence
  Synthetic oligonucleotide; CAG chr11 5350049 5350068 5350052 -
acatgtcaggattattcacc

SEQ ID NO: 34570 - DNA, 20 bp, Artificial Sequence
  Synthetic oligonucleotide; GAG chr11 5350047 5350066 5350050 -
atgtcaggattattcaccca

SEQ ID NO: 34571 - DNA, 20 bp, Artificial Sequence
  Synthetic oligonucleotide; AGG chr11 5350046 5350065 5350049 -
tgtcaggattattcacccag

SEQ ID NO: 34572 - DNA, 20 bp, Artificial Sequence
  Synthetic oligonucleotide; TGG chr11 5350016 5350035 5350019 -
aatgatttcctttttttctg

SEQ ID NO: 34573 - DNA, 20 bp, Artificial Sequence
  Synthetic oligonucleotide; AAG chr11 5350013 5350032 5350016 -
gatttcctttttttctgtgg

SEQ ID NO: 34574 - DNA, 20 bp, Artificial Sequence
  Synthetic oligonucleotide; TGG chr11 5350007 5350026 5350010 -
ctttttttctgtggaagcct

SEQ ID NO: 34575 - DNA, 20 bp, Artificial Sequence
  Synthetic oligonucleotide; GGG chr11 5350006 5350025 5350009 -
tttttttctgtggaagcctt

SEQ ID NO: 34576 - DNA, 20 bp, Artificial Sequence
  Synthetic oligonucleotide; CAG chr11 5350001 5350020 5350004 -
ttctgtggaagccttgggaa

SEQ ID NO: 34577 - DNA, 20 bp, Artificial Sequence
  Synthetic oligonucleotide; AAG chr11 5349994 5350013 5349997 -
gaagccttgggaacagatat

SEQ ID NO: 34578 - DNA, 20 bp, Artificial Sequence
  Synthetic oligonucleotide; TGG chr11 5349984 5350003 5349987 -
gaacagatataagatgatga

SEQ ID NO: 34579 - DNA, 20 bp, Artificial Sequence
  Synthetic oligonucleotide; GGG chr11 5349983 5350002 5349986 -
aacagatataagatgatgat

SEQ ID NO: 34580 - DNA, 20 bp, Artificial Sequence
  Synthetic oligonucleotide; GGG chr11 5349982 5350001 5349985 -
acagatataagatgatgatg

SEQ ID NO: 34581 - DNA, 20 bp, Artificial Sequence
  Synthetic oligonucleotide; TAG chr11 5349975 5349994 5349978 -
taagatgatgatggggtttt

SEQ ID NO: 34582 - DNA, 20 bp, Artificial Sequence
  Synthetic oligonucleotide; AGG chr11 5349974 5349993 5349977 -
aagatgatgatggggttttt

SEQ ID NO: 34583 - DNA, 20 bp, Artificial Sequence
  Synthetic oligonucleotide; GAG chr11 5349972 5349991 5349975 -
gatgatgatggggtttttag

SEQ ID NO: 34584 - DNA, 20 bp, Artificial Sequence
  Synthetic oligonucleotide; AAG chr11 5349949 5349968 5349952 -
cctgtgtttgactttaaata

SEQ ID NO: 34585 - DNA, 20 bp, Artificial Sequence
  Synthetic oligonucleotide; TAG chr11 5349935 5349954 5349938 -
taaataaagatattaaacta

SEQ ID NO: 34586 - DNA, 20 bp, Artificial Sequence
  Synthetic oligonucleotide; CAG chr11 5349922 5349941 5349925 -
taaactatagtttctctaat

SEQ ID NO: 34587 - DNA, 20 bp, Artificial Sequence
  Synthetic oligonucleotide; CAG chr11 5349919 5349938 5349922 -
actatagtttctctaatcag

SEQ ID NO: 34588 - DNA, 20 bp, Artificial Sequence
  Synthetic oligonucleotide; TGG chr11 5349899 5349918 5349902 -
cagataaaatgtgatatgtc

SEQ ID NO: 34589 - DNA, 20 bp, Artificial Sequence
  Synthetic oligonucleotide; GGG chr11 5349898 5349917 5349901 -
agataaaatgtgatatgtct

SEQ ID NO: 34590 - DNA, 20 bp, Artificial Sequence
  Synthetic oligonucleotide; TGG chr11 5349895 5349914 5349898 -
taaaatgtgatatgtctggg

SEQ ID NO: 34591 - DNA, 20 bp, Artificial Sequence
  Synthetic oligonucleotide; GGG chr11 5349894 5349913 5349897 -
aaaatgtgatatgtctgggt

SEQ ID NO: 34592 - DNA, 20 bp, Artificial Sequence
  Synthetic oligonucleotide; AAG chr11 5349890 5349909 5349893 -
tgtgatatgtctgggtggga

SEQ ID NO: 34593 - DNA, 20 bp, Artificial Sequence
  Synthetic oligonucleotide; AGG chr11 5349889 5349908 5349892 -
gtgatatgtctgggtgggaa

SEQ ID NO: 34594 - DNA, 20 bp, Artificial Sequence
  Synthetic oligonucleotide; GGG chr11 5349888 5349907 5349891 -
tgatatgtctgggtgggaaa

SEQ ID NO: 34595 - DNA, 20 bp, Artificial Sequence
  Synthetic oligonucleotide; AAG chr11 5349884 5349903 5349887 -
atgtctgggtgggaaaggga

SEQ ID NO: 34596 - DNA, 20 bp, Artificial Sequence
  Synthetic oligonucleotide; AGG chr11 5349883 5349902 5349886 -
tgtctgggtgggaaagggaa

SEQ ID NO: 34597 - DNA, 20 bp, Artificial Sequence
  Synthetic oligonucleotide; GAG chr11 5349881 5349900 5349884 -
tctgggtgggaaagggaaag

SEQ ID NO: 34598 - DNA, 20 bp, Artificial Sequence
  Synthetic oligonucleotide; AAG chr11 5349876 5349895 5349879 -
gtgggaaagggaaaggagaa

SEQ ID NO: 34599 - DNA, 20 bp, Artificial Sequence
  Synthetic oligonucleotide; GAG chr11 5349867 5349886 5349870 -
ggaaaggagaaaagattgat

SEQ ID NO: 34600 - DNA, 20 bp, Artificial Sequence
  Synthetic oligonucleotide; TGG chr11 5349858 5349877 5349861 -
aaaagattgatgagccaatg

SEQ ID NO: 34601 - DNA, 20 bp, Artificial Sequence
  Synthetic oligonucleotide; GGG chr11 5349857 5349876 5349860 -
aaagattgatgagccaatgt

SEQ ID NO: 34602 - DNA, 20 bp, Artificial Sequence
  Synthetic oligonucleotide; TAG chr11 5349843 5349862 5349846 -
caatgtgggaacttctgaca

SEQ ID NO: 34603 - DNA, 20 bp, Artificial Sequence
  Synthetic oligonucleotide; AAG chr11 5349836 5349855 5349839 -
ggaacttctgacatagctaa

SEQ ID NO: 34604 - DNA, 20 bp, Artificial Sequence
  Synthetic oligonucleotide; GAG chr11 5349826 5349845 5349829 -
acatagctaaaagtaacgtt

SEQ ID NO: 34605 - DNA, 20 bp, Artificial Sequence
  Synthetic oligonucleotide; TGG chr11 5349821 5349840 5349824 -
gctaaaagtaacgttgagcc

SEQ ID NO: 34606 - DNA, 20 bp, Artificial Sequence
  Synthetic oligonucleotide; GGG chr11 5349820 5349839 5349823 -
ctaaaagtaacgttgagcct

SEQ ID NO: 34607 - DNA, 20 bp, Artificial Sequence
  Synthetic oligonucleotide; GGG chr11 5349819 5349838 5349822 -
taaaagtaacgttgagcctg

SEQ ID NO: 34608 - DNA, 20 bp, Artificial Sequence
  Synthetic oligonucleotide; TGG chr11 5349813 5349832 5349816 -
taacgttgagcctggggcat

SEQ ID NO: 34609 - DNA, 20 bp, Artificial Sequence
  Synthetic oligonucleotide; GGG chr11 5349812 5349831 5349815 -
aacgttgagcctggggcatt

SEQ ID NO: 34610 - DNA, 20 bp, Artificial Sequence
  Synthetic oligonucleotide; GAG chr11 5349806 5349825 5349809 -
gagcctggggcattgggact

SEQ ID NO: 34611 - DNA, 20 bp, Artificial Sequence
  Synthetic oligonucleotide; AGG chr11 5349805 5349824 5349808 -
agcctggggcattgggactg

SEQ ID NO: 34612 - DNA, 20 bp, Artificial Sequence
  Synthetic oligonucleotide; GGG chr11 5349804 5349823 5349807 -
gcctggggcattgggactga

SEQ ID NO: 34613 - DNA, 20 bp, Artificial Sequence
  Synthetic oligonucleotide; AAG chr11 5349801 5349820 5349804 -
tggggcattgggactgaggg

SEQ ID NO: 34614 - DNA, 20 bp, Artificial Sequence
  Synthetic oligonucleotide; TAG chr11 5349798 5349817 5349801 -
ggcattgggactgagggaag

SEQ ID NO: 34615 - DNA, 20 bp, Artificial Sequence
  Synthetic oligonucleotide; GAG chr11 5349796 5349815 5349799 -
cattgggactgagggaagta

SEQ ID NO: 34616 - DNA, 20 bp, Artificial Sequence
  Synthetic oligonucleotide; AGG chr11 5349795 5349814 5349798 -
attgggactgagggaagtag

SEQ ID NO: 34617 - DNA, 20 bp, Artificial Sequence
  Synthetic oligonucleotide; GGG chr11 5349794 5349813 5349797 -
ttgggactgagggaagtaga

SEQ ID NO: 34618 - DNA, 20 bp, Artificial Sequence
  Synthetic oligonucleotide; GGG chr11 5349793 5349812 5349796 -
tgggactgagggaagtagag

SEQ ID NO: 34619 - DNA, 20 bp, Artificial Sequence
  Synthetic oligonucleotide; AAG chr11 5349789 5349808 5349792 -
actgagggaagtagagggga

SEQ ID NO: 34620 - DNA, 20 bp, Artificial Sequence
  Synthetic oligonucleotide; AAG chr11 5349770 5349789 5349773 -
aaagcaactctgtcctcaaa

SEQ ID NO: 34621 - DNA, 20 bp, Artificial Sequence
  Synthetic oligonucleotide; GAG chr11 5349766 5349785 5349769 -
caactctgtcctcaaaaagt

SEQ ID NO: 34622 - DNA, 20 bp, Artificial Sequence
  Synthetic oligonucleotide; AAG chr11 5349761 5349780 5349764 -
ctgtcctcaaaaagtgagaa

SEQ ID NO: 34623 - DNA, 20 bp, Artificial Sequence
  Synthetic oligonucleotide; AGG chr11 5349760 5349779 5349763 -
tgtcctcaaaaagtgagaaa

SEQ ID NO: 34624 - DNA, 20 bp, Artificial Sequence
  Synthetic oligonucleotide; GAG chr11 5349758 5349777 5349761 -
tcctcaaaaagtgagaaaag

SEQ ID NO: 34625 - DNA, 20 bp, Artificial Sequence
  Synthetic oligonucleotide; AGG chr11 5349757 5349776 5349760 -
cctcaaaaagtgagaaaagg

SEQ ID NO: 34626 - DNA, 20 bp, Artificial Sequence
  Synthetic oligonucleotide; CAG chr11 5349732 5349751 5349735 -
ttattgctcaatctgcctgc

SEQ ID NO: 34627 - DNA, 20 bp, Artificial Sequence
  Synthetic oligonucleotide; GAG chr11 5349728 5349747 5349731 -
tgctcaatctgcctgccagt

SEQ ID NO: 34628 - DNA, 20 bp, Artificial Sequence
  Synthetic oligonucleotide; GAG chr11 5349726 5349745 5349729 -
ctcaatctgcctgccagtga

SEQ ID NO: 34629 - DNA, 20 bp, Artificial Sequence
  Synthetic oligonucleotide; AGG chr11 5349725 5349744 5349728 -
tcaatctgcctgccagtgag

SEQ ID NO: 34630 - DNA, 20 bp, Artificial Sequence
  Synthetic oligonucleotide; CAG chr11 5349720 5349739 5349723 -
ctgcctgccagtgagaggtt

SEQ ID NO: 34631 - DNA, 20 bp, Artificial Sequence
  Synthetic oligonucleotide; CAG chr11 5349709 5349728 5349712 -
tgagaggttcagacaatact

SEQ ID NO: 34632 - DNA, 20 bp, Artificial Sequence
  Synthetic oligonucleotide; CAG chr11 5349700 5349719 5349703 -
cagacaatactcagcttatg

SEQ ID NO: 34633 - DNA, 20 bp, Artificial Sequence
  Synthetic oligonucleotide; AGG chr11 5349699 5349718 5349702 -
agacaatactcagcttatgc

SEQ ID NO: 34634 - DNA, 20 bp, Artificial Sequence
  Synthetic oligonucleotide; AAG chr11 5349692 5349711 5349695 -
actcagcttatgcaggatta

SEQ ID NO: 34635 - DNA, 20 bp, Artificial Sequence
  Synthetic oligonucleotide; AAG chr11 5349689 5349708 5349692 -
cagcttatgcaggattaaag

SEQ ID NO: 34636 - DNA, 20 bp, Artificial Sequence
  Synthetic oligonucleotide; CAG chr11 5349686 5349705 5349689 -
cttatgcaggattaaagaag

SEQ ID NO: 34637 - DNA, 20 bp, Artificial Sequence
  Synthetic oligonucleotide; TGG chr11 5349681 5349700 5349684 -
gcaggattaaagaagcagta

SEQ ID NO: 34638 - DNA, 20 bp, Artificial Sequence
  Synthetic oligonucleotide; TAG chr11 5349661 5349680 5349664 -
tggcaaataaaaattgtaca

SEQ ID NO: 34639 - DNA, 20 bp, Artificial Sequence
  Synthetic oligonucleotide; AGG chr11 5349660 5349679 5349663 -
ggcaaataaaaattgtacat

SEQ ID NO: 34640 - DNA, 20 bp, Artificial Sequence
  Synthetic oligonucleotide; TAG chr11 5349635 5349654 5349638 -
tataacttattgttttatta

SEQ ID NO: 34641 - DNA, 20 bp, Artificial Sequence
  Synthetic oligonucleotide; AGG chr11 5349634 5349653 5349637 -
ataacttattgttttattat

SEQ ID NO: 34642 - DNA, 20 bp, Artificial Sequence
  Synthetic oligonucleotide; TGG chr11 5349556 5349575 5349559 -
cataataactttaatttttt

SEQ ID NO: 34643 - DNA, 20 bp, Artificial Sequence
  Synthetic oligonucleotide; TAG chr11 5349553 5349572 5349556 -
aataactttaatttttttgg

SEQ ID NO: 34644 - DNA, 20 bp, Artificial Sequence
  Synthetic oligonucleotide; GAG chr11 5349539 5349558 5349542 -
ttttggtagtaaaaatatgt

SEQ ID NO: 34645 - DNA, 20 bp, Artificial Sequence
  Synthetic oligonucleotide; AGG chr11 5349538 5349557 5349541 -
tttggtagtaaaaatatgtg

SEQ ID NO: 34646 - DNA, 20 bp, Artificial Sequence
  Synthetic oligonucleotide; TAG chr11 5349525 5349544 5349528 -
atatgtgaggtctgctttct

SEQ ID NO: 34647 - DNA, 20 bp, Artificial Sequence
  Synthetic oligonucleotide; AAG chr11 5349499 5349518 5349502 -
attttaaatatacctaaata

SEQ ID NO: 34648 - DNA, 20 bp, Artificial Sequence
  Synthetic oligonucleotide; TGG chr11 5349495 5349514 5349498 -
taaatatacctaaataaagc

SEQ ID NO: 34649 - DNA, 20 bp, Artificial Sequence
  Synthetic oligonucleotide; GGG chr11 5349494 5349513 5349497 -
aaatatacctaaataaagct

SEQ ID NO: 34650 - DNA, 20 bp, Artificial Sequence
  Synthetic oligonucleotide; GAG chr11 5349492 5349511 5349495 -
atatacctaaataaagctgg

SEQ ID NO: 34651 - DNA, 20 bp, Artificial Sequence
  Synthetic oligonucleotide; AGG chr11 5349491 5349510 5349494 -
tatacctaaataaagctggg

SEQ ID NO: 34652 - DNA, 20 bp, Artificial Sequence
  Synthetic oligonucleotide; GGG chr11 5349490 5349509 5349493 -
atacctaaataaagctggga

SEQ ID NO: 34653 - DNA, 20 bp, Artificial Sequence
  Synthetic oligonucleotide; AAG chr11 5349485 5349504 5349488 -
taaataaagctgggagggaa

SEQ ID NO: 34654 - DNA, 20 bp, Artificial Sequence
  Synthetic oligonucleotide; CAG chr11 5349476 5349495 5349479 -
ctgggagggaaaagataata

SEQ ID NO: 34655 - DNA, 20 bp, Artificial Sequence
  Synthetic oligonucleotide; TAG chr11 5349463 5349482 5349466 -
gataatacagaacattaatc

SEQ ID NO: 34656 - DNA, 20 bp, Artificial Sequence
  Synthetic oligonucleotide; CAG chr11 5349405 5349424 5349408 -
attgataaattaaaaaaaaa

SEQ ID NO: 34657 - DNA, 20 bp, Artificial Sequence
  Synthetic oligonucleotide; AGG chr11 5349404 5349423 5349407 -
ttgataaattaaaaaaaaac

SEQ ID NO: 34658 - DNA, 20 bp, Artificial Sequence
  Synthetic oligonucleotide; GAG chr11 5349402 5349421 5349405 -
gataaattaaaaaaaaacag

SEQ ID NO: 34659 - DNA, 20 bp, Artificial Sequence
  Synthetic oligonucleotide; TAG chr11 5349399 5349418 5349402 -
aaattaaaaaaaaacaggag

SEQ ID NO: 34660 - DNA, 20 bp, Artificial Sequence
  Synthetic oligonucleotide; AGG chr11 5349398 5349417 5349401 -
aattaaaaaaaaacaggagt

SEQ ID NO: 34661 - DNA, 20 bp, Artificial Sequence
  Synthetic oligonucleotide; CAG chr11 5349390 5349409 5349393 -
aaaaacaggagtaggaatac

SEQ ID NO: 34662 - DNA, 20 bp, Artificial Sequence
  Synthetic oligonucleotide; TAG chr11 5349386 5349405 5349389 -
acaggagtaggaataccaga

SEQ ID NO: 34663 - DNA, 20 bp, Artificial Sequence
  Synthetic oligonucleotide; AGG chr11 5349385 5349404 5349388 -
caggagtaggaataccagat

SEQ ID NO: 34664 - DNA, 20 bp, Artificial Sequence
  Synthetic oligonucleotide; GGG chr11 5349384 5349403 5349387 -
aggagtaggaataccagata

SEQ ID NO: 34665 - DNA, 20 bp, Artificial Sequence
  Synthetic oligonucleotide; AAG chr11 5349375 5349394 5349378 -
aataccagatagggaaaata

SEQ ID NO: 34666 - DNA, 20 bp, Artificial Sequence
  Synthetic oligonucleotide; GAG chr11 5349370 5349389 5349373 -
cagatagggaaaataaagct

SEQ ID NO: 34667 - DNA, 20 bp, Artificial Sequence
  Synthetic oligonucleotide; TGG chr11 5349356 5349375 5349359 -
aaagctgagaaacaaatgta

SEQ ID NO: 34668 - DNA, 20 bp, Artificial Sequence
  Synthetic oligonucleotide; AAG chr11 5349321 5349340 5349324 -
ttgaatttctaccgtgtgtc

SEQ ID NO: 34669 - DNA, 20 bp, Artificial Sequence
  Synthetic oligonucleotide; TGG chr11 5349315 5349334 5349318 -
ttctaccgtgtgtcaagtat

SEQ ID NO: 34670 - DNA, 20 bp, Artificial Sequence
  Synthetic oligonucleotide; TGG chr11 5349310 5349329 5349313 -
ccgtgtgtcaagtattggac

SEQ ID NO: 34671 - DNA, 20 bp, Artificial Sequence
  Synthetic oligonucleotide; GGG chr11 5349309 5349328 5349312 -
cgtgtgtcaagtattggact

SEQ ID NO: 34672 - DNA, 20 bp, Artificial Sequence
  Synthetic oligonucleotide; GGG chr11 5349308 5349327 5349311 -
gtgtgtcaagtattggactg

SEQ ID NO: 34673 - DNA, 20 bp, Artificial Sequence
  Synthetic oligonucleotide; TGG chr11 5349284 5349303 5349287 -
attatatacacctcattttt

SEQ ID NO: 34674 - DNA, 20 bp, Artificial Sequence
  Synthetic oligonucleotide; GGG chr11 5349283 5349302 5349286 -
ttatatacacctcatttttt

SEQ ID NO: 34675 - DNA, 20 bp, Artificial Sequence
  Synthetic oligonucleotide; AAG chr11 5349280 5349299 5349283 -
tatacacctcattttttggg

SEQ ID NO: 34676 - DNA, 20 bp, Artificial Sequence
  Synthetic oligonucleotide; TAG chr11 5349266 5349285 5349269 -
tttgggaagaatccttaaaa

SEQ ID NO: 34677 - DNA, 20 bp, Artificial Sequence
  Synthetic oligonucleotide; GAG chr11 5349230 5349249 5349233 -
ctgttttcatattgaaaact

SEQ ID NO: 34678 - DNA, 20 bp, Artificial Sequence
  Synthetic oligonucleotide; CAG chr11 5349208 5349227 5349211 -
gtgctttcacttgattcact

SEQ ID NO: 34679 - DNA, 20 bp, Artificial Sequence
  Synthetic oligonucleotide; TGG chr11 5349196 5349215 5349199 -
gattcactcagttgcttttg

SEQ ID NO: 34680 - DNA, 20 bp, Artificial Sequence
  Synthetic oligonucleotide; GAG chr11 5349188 5349207 5349191 -
cagttgcttttgtggtatat

SEQ ID NO: 34681 - DNA, 20 bp, Artificial Sequence
  Synthetic oligonucleotide; GAG chr11 5349176 5349195 5349179 -
tggtatatgagatgatctgt

SEQ ID NO: 34682 - DNA, 20 bp, Artificial Sequence
  Synthetic oligonucleotide; CAG chr11 5349170 5349189 5349173 -
atgagatgatctgtgagttt

SEQ ID NO: 34683 - DNA, 20 bp, Artificial Sequence
  Synthetic oligonucleotide; GAG chr11 5349168 5349187 5349171 -
gagatgatctgtgagtttca

SEQ ID NO: 34684 - DNA, 20 bp, Artificial Sequence
  Synthetic oligonucleotide; AGG chr11 5349167 5349186 5349170 -
agatgatctgtgagtttcag

SEQ ID NO: 34685 - DNA, 20 bp, Artificial Sequence
  Synthetic oligonucleotide; GGG chr11 5349166 5349185 5349169 -
gatgatctgtgagtttcaga

SEQ ID NO: 34686 - DNA, 20 bp, Artificial Sequence
  Synthetic oligonucleotide; GGG chr11 5349165 5349184 5349168 -
atgatctgtgagtttcagag

SEQ ID NO: 34687 - DNA, 20 bp, Artificial Sequence
  Synthetic oligonucleotide; CAG chr11 5349131 5349150 5349134 -
aaacctttgcctcatccctg

SEQ ID NO: 34688 - DNA, 20 bp, Artificial Sequence
  Synthetic oligonucleotide; CAG chr11 5349113 5349132 5349116 -
tgcagccattcaccctcttc

SEQ ID NO: 34689 - DNA, 20 bp, Artificial Sequence
  Synthetic oligonucleotide; AGG chr11 5349112 5349131 5349115 -
gcagccattcaccctcttcc

SEQ ID NO: 34690 - DNA, 20 bp, Artificial Sequence
  Synthetic oligonucleotide; GGG chr11 5349111 5349130 5349114 -
cagccattcaccctcttcca

SEQ ID NO: 34691 - DNA, 20 bp, Artificial Sequence
  Synthetic oligonucleotide; TAG chr11 5349099 5349118 5349102 -
ctcttccagggtctctgtca

SEQ ID NO: 34692 - DNA, 20 bp, Artificial Sequence
  Synthetic oligonucleotide; TAG chr11 5349094 5349113 5349097 -
ccagggtctctgtcatagaa

SEQ ID NO: 34693 - DNA, 20 bp, Artificial Sequence
  Synthetic oligonucleotide; GAG chr11 5349087 5349106 5349090 -
ctctgtcatagaatagactt

SEQ ID NO: 34694 - DNA, 20 bp, Artificial Sequence
  Synthetic oligonucleotide; GAG chr11 5349073 5349092 5349076 -
agacttgagtttttattaat

SEQ ID NO: 34695 - DNA, 20 bp, Artificial Sequence
  Synthetic oligonucleotide; AAG chr11 5349057 5349076 5349060 -
taatgagaaactaattctca

SEQ ID NO: 34696 - DNA, 20 bp, Artificial Sequence
  Synthetic oligonucleotide; TGG chr11 5349029 5349048 5349032 -
aactctgccgcataaactga

SEQ ID NO: 34697 - DNA, 20 bp, Artificial Sequence
  Synthetic oligonucleotide; CAG chr11 5349019 5349038 5349022 -
cataaactgatggctctatg

SEQ ID NO: 34698 - DNA, 20 bp, Artificial Sequence
  Synthetic oligonucleotide; CAG chr11 5349010 5349029 5349013 -
atggctctatgcagacacct

SEQ ID NO: 34699 - DNA, 20 bp, Artificial Sequence
  Synthetic oligonucleotide; CAG chr11 5349007 5349026 5349010 -
gctctatgcagacacctcag

SEQ ID NO: 34700 - DNA, 20 bp, Artificial Sequence
  Synthetic oligonucleotide; AGG chr11 5349006 5349025 5349009 -
ctctatgcagacacctcagc

SEQ ID NO: 34701 - DNA, 20 bp, Artificial Sequence
  Synthetic oligonucleotide; GAG chr11 5349004 5349023 5349007 -
ctatgcagacacctcagcag

SEQ ID NO: 34702 - DNA, 20 bp, Artificial Sequence
  Synthetic oligonucleotide; CAG chr11 5348995 5349014 5348998 -
cacctcagcaggagcccatt

SEQ ID NO: 34703 - DNA, 20 bp, Artificial Sequence
  Synthetic oligonucleotide; TGG chr11 5348958 5348977 5348961 -
atattctctcaccttccctt

SEQ ID NO: 34704 - DNA, 20 bp, Artificial Sequence
  Synthetic oligonucleotide; AAG chr11 5348916 5348935 5348919 -
ctgacactcttttctgtctc

SEQ ID NO: 34705 - DNA, 20 bp, Artificial Sequence
  Synthetic oligonucleotide; TAG chr11 5348909 5348928 5348912 -
tcttttctgtctcaagcact

SEQ ID NO: 34706 - DNA, 20 bp, Artificial Sequence
  Synthetic oligonucleotide; TGG chr11 5348875 5348894 5348878 -
tttttttacccccttacctt

SEQ ID NO: 34707 - DNA, 20 bp, Artificial Sequence
  Synthetic oligonucleotide; TGG chr11 5348854 5348873 5348857 -
ggctattatcctttctgtga

SEQ ID NO: 34708 - DNA, 20 bp, Artificial Sequence
  Synthetic oligonucleotide; GAG chr11 5348843 5348862 5348846 -
tttctgtgatggttaatatt

SEQ ID NO: 34709 - DNA, 20 bp, Artificial Sequence
  Synthetic oligonucleotide; TGG chr11 5348828 5348847 5348831 -
atattgagtgcaaacttgat

SEQ ID NO: 34710 - DNA, 20 bp, Artificial Sequence
  Synthetic oligonucleotide; AAG chr11 5348821 5348840 5348824 -
gtgcaaacttgattggattg

SEQ ID NO: 34711 - DNA, 20 bp, Artificial Sequence
  Synthetic oligonucleotide; AGG chr11 5348820 5348839 5348823 -
tgcaaacttgattggattga

SEQ ID NO: 34712 - DNA, 20 bp, Artificial Sequence
  Synthetic oligonucleotide; AAG chr11 5348812 5348831 5348815 -
tgattggattgaaggatgca

SEQ ID NO: 34713 - DNA, 20 bp, Artificial Sequence
  Synthetic oligonucleotide; TGG chr11 5348800 5348819 5348803 -
aggatgcaaagtattgttcc

SEQ ID NO: 34714 - DNA, 20 bp, Artificial Sequence
  Synthetic oligonucleotide; GGG chr11 5348799 5348818 5348802 -
ggatgcaaagtattgttcct

SEQ ID NO: 34715 - DNA, 20 bp, Artificial Sequence
  Synthetic oligonucleotide; AAG chr11 5348788 5348807 5348791 -
attgttcctgggtgtgctgt

SEQ ID NO: 34716 - DNA, 20 bp, Artificial Sequence
  Synthetic oligonucleotide; AGG chr11 5348787 5348806 5348790 -
ttgttcctgggtgtgctgta

SEQ ID NO: 34717 - DNA, 20 bp, Artificial Sequence
  Synthetic oligonucleotide; GGG chr11 5348786 5348805 5348789 -
tgttcctgggtgtgctgtaa

SEQ ID NO: 34718 - DNA, 20 bp, Artificial Sequence
  Synthetic oligonucleotide; AAG chr11 5348775 5348794 5348778 -
gtgctgtaagggtgttgcca

SEQ ID NO: 34719 - DNA, 20 bp, Artificial Sequence
  Synthetic oligonucleotide; AGG chr11 5348774 5348793 5348777 -
tgctgtaagggtgttgccaa

SEQ ID NO: 34720 - DNA, 20 bp, Artificial Sequence
  Synthetic oligonucleotide; GAG chr11 5348772 5348791 5348775 -
ctgtaagggtgttgccaaag

SEQ ID NO: 34721 - DNA, 20 bp, Artificial Sequence
  Synthetic oligonucleotide; GAG chr11 5348759 5348778 5348762 -
gccaaaggagattaacattt

SEQ ID NO: 34722 - DNA, 20 bp, Artificial Sequence
  Synthetic oligonucleotide; CAG chr11 5348755 5348774 5348758 -
aaggagattaacatttgagt

SEQ ID NO: 34723 - DNA, 20 bp, Artificial Sequence
  Synthetic oligonucleotide; TAG chr11 5348752 5348771 5348755 -
gagattaacatttgagtcag

SEQ ID NO: 34724 - DNA, 20 bp, Artificial Sequence
  Synthetic oligonucleotide; TGG chr11 5348747 5348766 5348750 -
taacatttgagtcagtagac

SEQ ID NO: 34725 - DNA, 20 bp, Artificial Sequence
  Synthetic oligonucleotide; GGG chr11 5348746 5348765 5348749 -
aacatttgagtcagtagact

SEQ ID NO: 34726 - DNA, 20 bp, Artificial Sequence
  Synthetic oligonucleotide; GAG chr11 5348744 5348763 5348747 -
catttgagtcagtagactgg

SEQ ID NO: 34727 - DNA, 20 bp, Artificial Sequence
  Synthetic oligonucleotide; GAG chr11 5348742 5348761 5348745 -
tttgagtcagtagactggga

SEQ ID NO: 34728 - DNA, 20 bp, Artificial Sequence
  Synthetic oligonucleotide; AGG chr11 5348741 5348760 5348744 -
ttgagtcagtagactgggag

SEQ ID NO: 34729 - DNA, 20 bp, Artificial Sequence
  Synthetic oligonucleotide; CAG chr11 5348738 5348757 5348741 -
agtcagtagactgggagagg

SEQ ID NO: 34730 - DNA, 20 bp, Artificial Sequence
  Synthetic oligonucleotide; TGG chr11 5348717 5348736 5348720 -
agacccacccaccctccgtc

SEQ ID NO: 34731 - DNA, 20 bp, Artificial Sequence
  Synthetic oligonucleotide; GGG chr11 5348716 5348735 5348719 -
gacccacccaccctccgtct

SEQ ID NO: 34732 - DNA, 20 bp, Artificial Sequence
  Synthetic oligonucleotide; TGG chr11 5348713 5348732 5348716 -
ccacccaccctccgtctggg

SEQ ID NO: 34733 - DNA, 20 bp, Artificial Sequence
  Synthetic oligonucleotide; GGG chr11 5348712 5348731 5348715 -
cacccaccctccgtctgggt

SEQ ID NO: 34734 - DNA, 20 bp, Artificial Sequence
  Synthetic oligonucleotide; CAG chr11 5348698 5348717 5348701 -
ctgggtgggtactatctaat

SEQ ID NO: 34735 - DNA, 20 bp, Artificial Sequence
  Synthetic oligonucleotide; CAG chr11 5348691 5348710 5348694 -
ggtactatctaatcagctgc

SEQ ID NO: 34736 - DNA, 20 bp, Artificial Sequence
  Synthetic oligonucleotide; AGG chr11 5348690 5348709 5348693 -
gtactatctaatcagctgcc

SEQ ID NO: 34737 - DNA, 20 bp, Artificial Sequence
  Synthetic oligonucleotide; GGG chr11 5348689 5348708 5348692 -
tactatctaatcagctgcca

SEQ ID NO: 34738 - DNA, 20 bp, Artificial Sequence
  Synthetic oligonucleotide; CGG chr11 5348686 5348705 5348689 -
tatctaatcagctgccaggg

SEQ ID NO: 34739 - DNA, 20 bp, Artificial Sequence
  Synthetic oligonucleotide; TAG chr11 5348682 5348701 5348685 -
taatcagctgccagggcggc

SEQ ID NO: 34740 - DNA, 20 bp, Artificial Sequence
  Synthetic oligonucleotide; AAG chr11 5348679 5348698 5348682 -
tcagctgccagggcggctag

SEQ ID NO: 34741 - DNA, 20 bp, Artificial Sequence
  Synthetic oligonucleotide; AAG chr11 5348675 5348694 5348678 -
ctgccagggcggctagaaga

SEQ ID NO: 34742 - DNA, 20 bp, Artificial Sequence
  Synthetic oligonucleotide; CAG chr11 5348672 5348691 5348675 -
ccagggcggctagaagaaag

SEQ ID NO: 34743 - DNA, 20 bp, Artificial Sequence
  Synthetic oligonucleotide; AGG chr11 5348671 5348690 5348674 -
cagggcggctagaagaaagc

SEQ ID NO: 34744 - DNA, 20 bp, Artificial Sequence
  Synthetic oligonucleotide; AAG chr11 5348665 5348684 5348668 -
ggctagaagaaagcaggcaa

SEQ ID NO: 34745 - DNA, 20 bp, Artificial Sequence
  Synthetic oligonucleotide; AAG chr11 5348662 5348681 5348665 -
tagaagaaagcaggcaaaag

SEQ ID NO: 34746 - DNA, 20 bp, Artificial Sequence
  Synthetic oligonucleotide; TGG chr11 5348658 5348677 5348661 -
agaaagcaggcaaaagaaga

SEQ ID NO: 34747 - DNA, 20 bp, Artificial Sequence
  Synthetic oligonucleotide; AAG chr11 5348655 5348674 5348658 -
aagcaggcaaaagaagatgg

SEQ ID NO: 34748 - DNA, 20 bp, Artificial Sequence
  Synthetic oligonucleotide; GAG chr11 5348653 5348672 5348656 -
gcaggcaaaagaagatggaa

SEQ ID NO: 34749 - DNA, 20 bp, Artificial Sequence
  Synthetic oligonucleotide; TAG chr11 5348650 5348669 5348653 -
ggcaaaagaagatggaagag

SEQ ID NO: 34750 - DNA, 20 bp, Artificial Sequence
  Synthetic oligonucleotide; TGG chr11 5348647 5348666 5348650 -
aaaagaagatggaagagtag

SEQ ID NO: 34751 - DNA, 20 bp, Artificial Sequence
  Synthetic oligonucleotide; CAG chr11 5348617 5348636 5348620 -
ttacacaatataaacctttc

SEQ ID NO: 34752 - DNA, 20 bp, Artificial Sequence
  Synthetic oligonucleotide; AGG chr11 5348616 5348635 5348619 -
tacacaatataaacctttcc

SEQ ID NO: 34753 - DNA, 20 bp, Artificial Sequence
  Synthetic oligonucleotide; AAG chr11 5348608 5348627 5348611 -
ataaacctttccaggtgcta

SEQ ID NO: 34754 - DNA, 20 bp, Artificial Sequence
  Synthetic oligonucleotide; CAG chr11 5348600 5348619 5348603 -
ttccaggtgctaaagtcaca

SEQ ID NO: 34755 - DNA, 20 bp, Artificial Sequence
  Synthetic oligonucleotide; AGG chr11 5348599 5348618 5348602 -
tccaggtgctaaagtcacac

SEQ ID NO: 34756 - DNA, 20 bp, Artificial Sequence
  Synthetic oligonucleotide; CAG chr11 5348572 5348591 5348575 -
gtgaatctgtacccctgatc

SEQ ID NO: 34757 - DNA, 20 bp, Artificial Sequence
  Synthetic oligonucleotide; GAG chr11 5348570 5348589 5348573 -
gaatctgtacccctgatcca

SEQ ID NO: 34758 - DNA, 20 bp, Artificial Sequence
  Synthetic oligonucleotide; AGG chr11 5348569 5348588 5348572 -
aatctgtacccctgatccag

SEQ ID NO: 34759 - DNA, 20 bp, Artificial Sequence
  Synthetic oligonucleotide; AAG chr11 5348554 5348573 5348557 -
tccagaggcacacataaccc

SEQ ID NO: 34760 - DNA, 20 bp, Artificial Sequence
  Synthetic oligonucleotide; AAG chr11 5348543 5348562 5348546 -
acataacccaagctccgtcc

SEQ ID NO: 34761 - DNA, 20 bp, Artificial Sequence
  Synthetic oligonucleotide; TGG chr11 5348527 5348546 5348530 -
gtccaagcttaattttgaat

SEQ ID NO: 34762 - DNA, 20 bp, Artificial Sequence
  Synthetic oligonucleotide; TAG chr11 5348519 5348538 5348522 -
ttaattttgaattggtttat

SEQ ID NO: 34763 - DNA, 20 bp, Artificial Sequence
  Synthetic oligonucleotide; TGG chr11 5348511 5348530 5348514 -
gaattggtttattagtcata

SEQ ID NO: 34764 - DNA, 20 bp, Artificial Sequence
  Synthetic oligonucleotide; CAG chr11 5348507 5348526 5348510 -
tggtttattagtcatatggt

SEQ ID NO: 34765 - DNA, 20 bp, Artificial Sequence
  Synthetic oligonucleotide; TAG chr11 5348503 5348522 5348506 -
ttattagtcatatggtcaga

SEQ ID NO: 34766 - DNA, 20 bp, Artificial Sequence
  Synthetic oligonucleotide; TAG chr11 5348488 5348507 5348491 -
tcagatagtgactttttttc

SEQ ID NO: 34767 - DNA, 20 bp, Artificial Sequence
  Synthetic oligonucleotide; AAG chr11 5348484 5348503 5348487 -
atagtgactttttttctaga

SEQ ID NO: 34768 - DNA, 20 bp, Artificial Sequence
  Synthetic oligonucleotide; CAG chr11 5348460 5348479 5348463 -
atttgaacctctgatgatta

SEQ ID NO: 34769 - DNA, 20 bp, Artificial Sequence
  Synthetic oligonucleotide; GAG chr11 5348458 5348477 5348461 -
ttgaacctctgatgattaca

SEQ ID NO: 34770 - DNA, 20 bp, Artificial Sequence
  Synthetic oligonucleotide; AGG chr11 5348457 5348476 5348460 -
tgaacctctgatgattacag

SEQ ID NO: 34771 - DNA, 20 bp, Artificial Sequence
  Synthetic oligonucleotide; AAG chr11 5348443 5348462 5348446 -
ttacagaggtatacctcctc

SEQ ID NO: 34772 - DNA, 20 bp, Artificial Sequence
  Synthetic oligonucleotide; TGG chr11 5348436 5348455 5348439 -
ggtatacctcctcaagaatt

SEQ ID NO: 34773 - DNA, 20 bp, Artificial Sequence
  Synthetic oligonucleotide; AAG chr11 5348433 5348452 5348436 -
atacctcctcaagaatttgg

SEQ ID NO: 34774 - DNA, 20 bp, Artificial Sequence
  Synthetic oligonucleotide; GAG chr11 5348431 5348450 5348434 -
acctcctcaagaatttggaa

SEQ ID NO: 34775 - DNA, 20 bp, Artificial Sequence
  Synthetic oligonucleotide; TGG chr11 5348415 5348434 5348418 -
ggaagagttgattctatatt

SEQ ID NO: 34776 - DNA, 20 bp, Artificial Sequence
  Synthetic oligonucleotide; TGG chr11 5348404 5348423 5348407 -
ttctatatttggcacttatc

SEQ ID NO: 34777 - DNA, 20 bp, Artificial Sequence
  Synthetic oligonucleotide; AAG chr11 5348395 5348414 5348398 -
tggcacttatctggacttct

SEQ ID NO: 34778 - DNA, 20 bp, Artificial Sequence
  Synthetic oligonucleotide; AGG chr11 5348394 5348413 5348397 -
ggcacttatctggacttcta

SEQ ID NO: 34779 - DNA, 20 bp, Artificial Sequence
  Synthetic oligonucleotide; AAG chr11 5348388 5348407 5348391 -
tatctggacttctaaggtaa

SEQ ID NO: 34780 - DNA, 20 bp, Artificial Sequence
  Synthetic oligonucleotide; TGG chr11 5348382 5348401 5348385 -
gacttctaaggtaaaagaca

SEQ ID NO: 34781 - DNA, 20 bp, Artificial Sequence
  Synthetic oligonucleotide; GGG chr11 5348381 5348400 5348384 -
acttctaaggtaaaagacat

SEQ ID NO: 34782 - DNA, 20 bp, Artificial Sequence
  Synthetic oligonucleotide; GGG chr11 5348380 5348399 5348383 -
cttctaaggtaaaagacatg

SEQ ID NO: 34783 - DNA, 20 bp, Artificial Sequence
  Synthetic oligonucleotide; TGG chr11 5348376 5348395 5348379 -
taaggtaaaagacatggggt

SEQ ID NO: 34784 - DNA, 20 bp, Artificial Sequence
  Synthetic oligonucleotide; GGG chr11 5348375 5348394 5348378 -
aaggtaaaagacatggggtt

SEQ ID NO: 34785 - DNA, 20 bp, Artificial Sequence
  Synthetic oligonucleotide; GGG chr11 5348374 5348393 5348377 -
aggtaaaagacatggggttg

SEQ ID NO: 34786 - DNA, 20 bp, Artificial Sequence
  Synthetic oligonucleotide; GGG chr11 5348373 5348392 5348376 -
ggtaaaagacatggggttgg

SEQ ID NO: 34787 - DNA, 20 bp, Artificial Sequence
  Synthetic oligonucleotide; CAG chr11 5348370 5348389 5348373 -
aaaagacatggggttggggg

SEQ ID NO: 34788 - DNA, 20 bp, Artificial Sequence
  Synthetic oligonucleotide; AGG chr11 5348369 5348388 5348372 -
aaagacatggggttgggggc

SEQ ID NO: 34789 - DNA, 20 bp, Artificial Sequence
  Synthetic oligonucleotide; GGG chr11 5348368 5348387 5348371 -
aagacatggggttgggggca

SEQ ID NO: 34790 - DNA, 20 bp, Artificial Sequence
  Synthetic oligonucleotide; GGG chr11 5348367 5348386 5348370 -
agacatggggttgggggcag

SEQ ID NO: 34791 - DNA, 20 bp, Artificial Sequence
  Synthetic oligonucleotide; GGG chr11 5348366 5348385 5348369 -
gacatggggttgggggcagg

SEQ ID NO: 34792 - DNA, 20 bp, Artificial Sequence
  Synthetic oligonucleotide; CAG chr11 5348358 5348377 5348361 -
gttgggggcagggggactct

SEQ ID NO: 34793 - DNA, 20 bp, Artificial Sequence
  Synthetic oligonucleotide; AGG chr11 5348357 5348376 5348360 -
ttgggggcagggggactctc

SEQ ID NO: 34794 - DNA, 20 bp, Artificial Sequence
  Synthetic oligonucleotide; GGG chr11 5348356 5348375 5348359 -
tgggggcagggggactctca

SEQ ID NO: 34795 - DNA, 20 bp, Artificial Sequence
  Synthetic oligonucleotide; TAG chr11 5348352 5348371 5348355 -
ggcagggggactctcagggt

SEQ ID NO: 34796 - DNA, 20 bp, Artificial Sequence
  Synthetic oligonucleotide; TGG chr11 5348347 5348366 5348350 -
ggggactctcagggttagaa

SEQ ID NO: 34797 - DNA, 20 bp, Artificial Sequence
  Synthetic oligonucleotide; AAG chr11 5348344 5348363 5348347 -
gactctcagggttagaatgg

SEQ ID NO: 34798 - DNA, 20 bp, Artificial Sequence
  Synthetic oligonucleotide; CAG chr11 5348340 5348359 5348343 -
ctcagggttagaatggaagc

SEQ ID NO: 34799 - DNA, 20 bp, Artificial Sequence
  Synthetic oligonucleotide; GAG chr11 5348338 5348357 5348341 -
cagggttagaatggaagcca

SEQ ID NO: 34800 - DNA, 20 bp, Artificial Sequence
  Synthetic oligonucleotide; GAG chr11 5348336 5348355 5348339 -
gggttagaatggaagccaga

SEQ ID NO: 34801 - DNA, 20 bp, Artificial Sequence
  Synthetic oligonucleotide; AAG chr11 5348329 5348348 5348332 -
aatggaagccagagagatta

SEQ ID NO: 34802 - DNA, 20 bp, Artificial Sequence
  Synthetic oligonucleotide; CAG chr11 5348323 5348342 5348326 -
agccagagagattaaagaat

SEQ ID NO: 34803 - DNA, 20 bp, Artificial Sequence
  Synthetic oligonucleotide; CAG chr11 5348319 5348338 5348322 -
agagagattaaagaatcagt

SEQ ID NO: 34804 - DNA, 20 bp, Artificial Sequence
  Synthetic oligonucleotide; AGG chr11 5348318 5348337 5348321 -
gagagattaaagaatcagtc

SEQ ID NO: 34805 - DNA, 20 bp, Artificial Sequence
  Synthetic oligonucleotide; TGG chr11 5348315 5348334 5348318 -
agattaaagaatcagtcagg

SEQ ID NO: 34806 - DNA, 20 bp, Artificial Sequence
  Synthetic oligonucleotide; GAG chr11 5348313 5348332 5348316 -
attaaagaatcagtcaggtg

SEQ ID NO: 34807 - DNA, 20 bp, Artificial Sequence
  Synthetic oligonucleotide; GAG chr11 5348311 5348330 5348314 -
taaagaatcagtcaggtgga

SEQ ID NO: 34808 - DNA, 20 bp, Artificial Sequence
  Synthetic oligonucleotide; GAG chr11 5348279 5348298 5348282 -
caaccccataattcatgcct

SEQ ID NO: 34809 - DNA, 20 bp, Artificial Sequence
  Synthetic oligonucleotide; TGG chr11 5348261 5348280 5348264 -
ctgagtcaacacccatgctc

SEQ ID NO: 34810 - DNA, 20 bp, Artificial Sequence
  Synthetic oligonucleotide; TAG chr11 5348250 5348269 5348253 -
cccatgctctggtttgttcg

SEQ ID NO: 34811 - DNA, 20 bp, Artificial Sequence
  Synthetic oligonucleotide; CAG chr11 5348226 5348245 5348229 -
attgtttgccttatgtgttc

SEQ ID NO: 34812 - DNA, 20 bp, Artificial Sequence
  Synthetic oligonucleotide; AAG chr11 5348196 5348215 5348199 -
ccttcacttttttatatttg

SEQ ID NO: 34813 - DNA, 20 bp, Artificial Sequence
  Synthetic oligonucleotide; GAG chr11 5348194 5348213 5348197 -
ttcacttttttatatttgaa

SEQ ID NO: 34814 - DNA, 20 bp, Artificial Sequence
  Synthetic oligonucleotide; AGG chr11 5348193 5348212 5348196 -
tcacttttttatatttgaag

SEQ ID NO: 34815 - DNA, 20 bp, Artificial Sequence
  Synthetic oligonucleotide; AAG chr11 5348181 5348200 5348184 -
atttgaagaggtaactctca

SEQ ID NO: 34816 - DNA, 20 bp, Artificial Sequence
  Synthetic oligonucleotide; AAG chr11 5348173 5348192 5348176 -
aggtaactctcaaagaaacc

SEQ ID NO: 34817 - DNA, 20 bp, Artificial Sequence
  Synthetic oligonucleotide; TAG chr11 5348167 5348186 5348170 -
ctctcaaagaaaccaagttt

SEQ ID NO: 34818 - DNA, 20 bp, Artificial Sequence
  Synthetic oligonucleotide; GAG chr11 5348165 5348184 5348168 -
ctcaaagaaaccaagtttta

SEQ ID NO: 34819 - DNA, 20 bp, Artificial Sequence
  Synthetic oligonucleotide; CAG chr11 5348158 5348177 5348161 -
aaaccaagttttagagatgt

SEQ ID NO: 34820 - DNA, 20 bp, Artificial Sequence
  Synthetic oligonucleotide; AGG chr11 5348157 5348176 5348160 -
aaccaagttttagagatgtc

SEQ ID NO: 34821 - DNA, 20 bp, Artificial Sequence
  Synthetic oligonucleotide; GGG chr11 5348156 5348175 5348159 -
accaagttttagagatgtca

SEQ ID NO: 34822 - DNA, 20 bp, Artificial Sequence
  Synthetic oligonucleotide; GAG chr11 5348154 5348173 5348157 -
caagttttagagatgtcagg

SEQ ID NO: 34823 - DNA, 20 bp, Artificial Sequence
  Synthetic oligonucleotide; TAG chr11 5348147 5348166 5348150 -
tagagatgtcagggagtctt

SEQ ID NO: 34824 - DNA, 20 bp, Artificial Sequence
  Synthetic oligonucleotide; AGG chr11 5348146 5348165 5348149 -
agagatgtcagggagtcttt

SEQ ID NO: 34825 - DNA, 20 bp, Artificial Sequence
  Synthetic oligonucleotide; TAG chr11 5348115 5348134 5348118 -
ctactacatatatctactct

SEQ ID NO: 34826 - DNA, 20 bp, Artificial Sequence
  Synthetic oligonucleotide; CAG chr11 5348112 5348131 5348115 -
ctacatatatctactcttag

SEQ ID NO: 34827 - DNA, 20 bp, Artificial Sequence
  Synthetic oligonucleotide; AAG chr11 5348084 5348103 5348087 -
actattacttttctcttgct

SEQ ID NO: 34828 - DNA, 20 bp, Artificial Sequence
  Synthetic oligonucleotide; CAG chr11 5348077 5348096 5348080 -
cttttctcttgctaagaaat

SEQ ID NO: 34829 - DNA, 20 bp, Artificial Sequence
  Synthetic oligonucleotide; TGG chr11 5348046 5348065 5348049 -
tctctgttttttttttgcct

SEQ ID NO: 34830 - DNA, 20 bp, Artificial Sequence
  Synthetic oligonucleotide; GAG chr11 5348033 5348052 5348036 -
tttgccttggttcctgcaat

SEQ ID NO: 34831 - DNA, 20 bp, Artificial Sequence
  Synthetic oligonucleotide; CAG chr11 5348024 5348043 5348027 -
gttcctgcaatgagatctta

SEQ ID NO: 34832 - DNA, 20 bp, Artificial Sequence
  Synthetic oligonucleotide; GAG chr11 5348022 5348041 5348025 -
tcctgcaatgagatcttaca

SEQ ID NO: 34833 - DNA, 20 bp, Artificial Sequence
  Synthetic oligonucleotide; AGG chr11 5348021 5348040 5348024 -
cctgcaatgagatcttacag

SEQ ID NO: 34834 - DNA, 20 bp, Artificial Sequence
  Synthetic oligonucleotide; GAG chr11 5348019 5348038 5348022 -
tgcaatgagatcttacagag

SEQ ID NO: 34835 - DNA, 20 bp, Artificial Sequence
  Synthetic oligonucleotide; CAG chr11 5347967 5347986 5347970 -
ctttgttcccttccattctt

SEQ ID NO: 34836 - DNA, 20 bp, Artificial Sequence
  Synthetic oligonucleotide; TAG chr11 5347959 5347978 5347962 -
ccttccattcttcagttcca

SEQ ID NO: 34837 - DNA, 20 bp, Artificial Sequence
  Synthetic oligonucleotide; TAG chr11 5347938 5347957 5347941 -
agtcatgtatctcacatctt

SEQ ID NO: 34838 - DNA, 20 bp, Artificial Sequence
  Synthetic oligonucleotide; AAG chr11 5347927 5347946 5347930 -
tcacatctttagccgtatga

SEQ ID NO: 34839 - DNA, 20 bp, Artificial Sequence
  Synthetic oligonucleotide; TGG chr11 5347921 5347940 5347924 -
ctttagccgtatgaaagatt

SEQ ID NO: 34840 - DNA, 20 bp, Artificial Sequence
  Synthetic oligonucleotide; GGG chr11 5347920 5347939 5347923 -
tttagccgtatgaaagattt

SEQ ID NO: 34841 - DNA, 20 bp, Artificial Sequence
  Synthetic oligonucleotide; CAG chr11 5347906 5347925 5347909 -
agatttgggcatcatctttt

SEQ ID NO: 34842 - DNA, 20 bp, Artificial Sequence
  Synthetic oligonucleotide; GAG chr11 5347892 5347911 5347895 -
tcttttcagaatctgcacat

SEQ ID NO: 34843 - DNA, 20 bp, Artificial Sequence
  Synthetic oligonucleotide; TGG chr11 5347887 5347906 5347890 -
tcagaatctgcacatgagcc

SEQ ID NO: 34844 - DNA, 20 bp, Artificial Sequence
  Synthetic oligonucleotide; TGG chr11 5347883 5347902 5347886 -
aatctgcacatgagcctggc

SEQ ID NO: 34845 - DNA, 20 bp, Artificial Sequence
  Synthetic oligonucleotide; TAG chr11 5347880 5347899 5347883 -
ctgcacatgagcctggctgg

SEQ ID NO: 34846 - DNA, 20 bp, Artificial Sequence
  Synthetic oligonucleotide; AGG chr11 5347879 5347898 5347882 -
tgcacatgagcctggctggt

SEQ ID NO: 34847 - DNA, 20 bp, Artificial Sequence
  Synthetic oligonucleotide; TAG chr11 5347865 5347884 5347868 -
gctggtaggaacatttattt

SEQ ID NO: 34848 - DNA, 20 bp, Artificial Sequence
  Synthetic oligonucleotide; AAG chr11 5347862 5347881 5347865 -
ggtaggaacatttattttag

SEQ ID NO: 34849 - DNA, 20 bp, Artificial Sequence
  Synthetic oligonucleotide; CAG chr11 5347851 5347870 5347854 -
ttattttagaagctcctccc

SEQ ID NO: 34850 - DNA, 20 bp, Artificial Sequence
  Synthetic oligonucleotide; GAG chr11 5347849 5347868 5347852 -
attttagaagctcctcccca

SEQ ID NO: 34851 - DNA, 20 bp, Artificial Sequence
  Synthetic oligonucleotide; TAG chr11 5347833 5347852 5347836 -
cccagagaccattcctgatt

SEQ ID NO: 34852 - DNA, 20 bp, Artificial Sequence
  Synthetic oligonucleotide; CAG chr11 5347731 5347750 5347734 -
ttctctattatttgtgccct

SEQ ID NO: 34853 - DNA, 20 bp, Artificial Sequence
  Synthetic oligonucleotide; TGG chr11 5347723 5347742 5347726 -
tatttgtgccctcagccttg

SEQ ID NO: 34854 - DNA, 20 bp, Artificial Sequence
  Synthetic oligonucleotide; GGG chr11 5347722 5347741 5347725 -
atttgtgccctcagccttgt

SEQ ID NO: 34855 - DNA, 20 bp, Artificial Sequence
  Synthetic oligonucleotide; TGG chr11 5347716 5347735 5347719 -
gccctcagccttgtgggtat

SEQ ID NO: 34856 - DNA, 20 bp, Artificial Sequence
  Synthetic oligonucleotide; GGG chr11 5347715 5347734 5347718 -
ccctcagccttgtgggtatt

SEQ ID NO: 34857 - DNA, 20 bp, Artificial Sequence
  Synthetic oligonucleotide; CAG chr11 5347705 5347724 5347708 -
tgtgggtattgggctttgaa

SEQ ID NO: 34858 - DNA, 20 bp, Artificial Sequence
  Synthetic oligonucleotide; AAG chr11 5347694 5347713 5347697 -
ggctttgaacagcacaactc

SEQ ID NO: 34859 - DNA, 20 bp, Artificial Sequence
  Synthetic oligonucleotide; TGG chr11 5347675 5347694 5347678 -
caagatctctgtctctgtcc

SEQ ID NO: 34860 - DNA, 20 bp, Artificial Sequence
  Synthetic oligonucleotide; TGG chr11 5347665 5347684 5347668 -
gtctctgtcctggcttttac

SEQ ID NO: 34861 - DNA, 20 bp, Artificial Sequence
  Synthetic oligonucleotide; GAG chr11 5347663 5347682 5347666 -
ctctgtcctggcttttactg

SEQ ID NO: 34862 - DNA, 20 bp, Artificial Sequence
  Synthetic oligonucleotide; AGG chr11 5347662 5347681 5347665 -
tctgtcctggcttttactgg

SEQ ID NO: 34863 - DNA, 20 bp, Artificial Sequence
  Synthetic oligonucleotide; TGG chr11 5347648 5347667 5347651 -
tactggaggttttcctctgt

SEQ ID NO: 34864 - DNA, 20 bp, Artificial Sequence
  Synthetic oligonucleotide; GAG chr11 5347646 5347665 5347649 -
ctggaggttttcctctgttg

SEQ ID NO: 34865 - DNA, 20 bp, Artificial Sequence
  Synthetic oligonucleotide; AGG chr11 5347645 5347664 5347648 -
tggaggttttcctctgttgg

SEQ ID NO: 34866 - DNA, 20 bp, Artificial Sequence
  Synthetic oligonucleotide; TGG chr11 5347621 5347640 5347624 -
tgaatattttgtctacattg

SEQ ID NO: 34867 - DNA, 20 bp, Artificial Sequence
  Synthetic oligonucleotide; TGG chr11 5347615 5347634 5347618 -
ttttgtctacattgtggctt

SEQ ID NO: 34868 - DNA, 20 bp, Artificial Sequence
  Synthetic oligonucleotide; TGG chr11 5347595 5347614 5347598 -
tggctcttgctgtgctactt

SEQ ID NO: 34869 - DNA, 20 bp, Artificial Sequence
  Synthetic oligonucleotide; TAG chr11 5347567 5347586 5347570 -
ttttatctcattgcatttca

SEQ ID NO: 34870 - DNA, 20 bp, Artificial Sequence
  Synthetic oligonucleotide; AAG chr11 5347527 5347546 5347530 -
atataataattgccatcaca

SEQ ID NO: 34871 - DNA, 20 bp, Artificial Sequence
  Synthetic oligonucleotide; TGG chr11 5347519 5347538 5347522 -
attgccatcacaaagtgatg

SEQ ID NO: 34872 - DNA, 20 bp, Artificial Sequence
  Synthetic oligonucleotide; TGG chr11 5347510 5347529 5347513 -
acaaagtgatgtggtgtgct

SEQ ID NO: 34873 - DNA, 20 bp, Artificial Sequence
  Synthetic oligonucleotide; AAG chr11 5347504 5347523 5347507 -
tgatgtggtgtgcttggctg

SEQ ID NO: 34874 - DNA, 20 bp, Artificial Sequence
  Synthetic oligonucleotide; GAG chr11 5347490 5347509 5347493 -
tggctgaagcaccatgtgat

SEQ ID NO: 34875 - DNA, 20 bp, Artificial Sequence
  Synthetic oligonucleotide; TGG chr11 5347469 5347488 5347472 -
agtatgcctgctgcatcccc

SEQ ID NO: 34876 - DNA, 20 bp, Artificial Sequence
  Synthetic oligonucleotide; AAG chr11 5347464 5347483 5347467 -
gcctgctgcatcccctggaa

SEQ ID NO: 34877 - DNA, 20 bp, Artificial Sequence
  Synthetic oligonucleotide; GAG chr11 5347462 5347481 5347465 -
ctgctgcatcccctggaaaa

SEQ ID NO: 34878 - DNA, 20 bp, Artificial Sequence
  Synthetic oligonucleotide; TGG chr11 5347451 5347470 5347454 -
cctggaaaagagaaaacttc

SEQ ID NO: 34879 - DNA, 20 bp, Artificial Sequence
  Synthetic oligonucleotide; TAG chr11 5347448 5347467 5347451 -
ggaaaagagaaaacttctgg

SEQ ID NO: 34880 - DNA, 20 bp, Artificial Sequence
  Synthetic oligonucleotide; AGG chr11 5347447 5347466 5347450 -
gaaaagagaaaacttctggt

SEQ ID NO: 34881 - DNA, 20 bp, Artificial Sequence
  Synthetic oligonucleotide; AAG chr11 5347436 5347455 5347439 -
acttctggtaggctaaactc

SEQ ID NO: 34882 - DNA, 20 bp, Artificial Sequence
  Synthetic oligonucleotide; AAG chr11 5347433 5347452 5347436 -
tctggtaggctaaactcaag

SEQ ID NO: 34883 - DNA, 20 bp, Artificial Sequence
  Synthetic oligonucleotide; AGG chr11 5347432 5347451 5347435 -
ctggtaggctaaactcaaga

SEQ ID NO: 34884 - DNA, 20 bp, Artificial Sequence
  Synthetic oligonucleotide; GGG chr11 5347431 5347450 5347434 -
tggtaggctaaactcaagaa

SEQ ID NO: 34885 - DNA, 20 bp, Artificial Sequence
  Synthetic oligonucleotide; TAG chr11 5347426 5347445 5347429 -
ggctaaactcaagaagggaa

SEQ ID NO: 34886 - DNA, 20 bp, Artificial Sequence
  Synthetic oligonucleotide; TAG chr11 5347422 5347441 5347425 -
aaactcaagaagggaatagt

SEQ ID NO: 34887 - DNA, 20 bp, Artificial Sequence
  Synthetic oligonucleotide; CAG chr11 5347410 5347429 5347413 -
ggaatagttagtgataactg

SEQ ID NO: 34888 - DNA, 20 bp, Artificial Sequence
  Synthetic oligonucleotide; TGG chr11 5347392 5347411 5347395 -
tgcagaatgtgcgttcacgt

SEQ ID NO: 34889 - DNA, 20 bp, Artificial Sequence
  Synthetic oligonucleotide; GGG chr11 5347391 5347410 5347394 -
gcagaatgtgcgttcacgtt

SEQ ID NO: 34890 - DNA, 20 bp, Artificial Sequence
  Synthetic oligonucleotide; TAG chr11 5347385 5347404 5347388 -
tgtgcgttcacgttgggtac

SEQ ID NO: 34891 - DNA, 20 bp, Artificial Sequence
  Synthetic oligonucleotide; GAG chr11 5347383 5347402 5347386 -
tgcgttcacgttgggtacta

SEQ ID NO: 34892 - DNA, 20 bp, Artificial Sequence
  Synthetic oligonucleotide; AAG chr11 5347380 5347399 5347383 -
gttcacgttgggtactagag

SEQ ID NO: 34893 - DNA, 20 bp, Artificial Sequence
  Synthetic oligonucleotide; AGG chr11 5347379 5347398 5347382 -
ttcacgttgggtactagaga

SEQ ID NO: 34894 - DNA, 20 bp, Artificial Sequence
  Synthetic oligonucleotide; TAG chr11 5347350 5347369 5347353 -
gaattttattatattgactc

SEQ ID NO: 34895 - DNA, 20 bp, Artificial Sequence
  Synthetic oligonucleotide; TAG chr11 5347341 5347360 5347344 -
tatattgactctagtctatc

SEQ ID NO: 34896 - DNA, 20 bp, Artificial Sequence
  Synthetic oligonucleotide; AAG chr11 5347326 5347345 5347329 -
ctatctagctctctgctttc

SEQ ID NO: 34897 - DNA, 20 bp, Artificial Sequence
  Synthetic oligonucleotide; AAG chr11 5347305 5347324 5347308 -
agctttctctgatctaaacc

SEQ ID NO: 34898 - DNA, 20 bp, Artificial Sequence
  Synthetic oligonucleotide; CAG chr11 5347302 5347321 5347305 -
tttctctgatctaaaccaag

SEQ ID NO: 34899 - DNA, 20 bp, Artificial Sequence
  Synthetic oligonucleotide; AGG chr11 5347301 5347320 5347304 -
ttctctgatctaaaccaagc

SEQ ID NO: 34900 - DNA, 20 bp, Artificial Sequence
  Synthetic oligonucleotide; TAG chr11 5347293 5347312 5347296 -
tctaaaccaagcaggaaata

SEQ ID NO: 34901 - DNA, 20 bp, Artificial Sequence
  Synthetic oligonucleotide; TAG chr11 5347290 5347309 5347293 -
aaaccaagcaggaaatatag

SEQ ID NO: 34902 - DNA, 20 bp, Artificial Sequence
  Synthetic oligonucleotide; CAG chr11 5347282 5347301 5347285 -
caggaaatatagtagaaatt

SEQ ID NO: 34903 - DNA, 20 bp, Artificial Sequence
  Synthetic oligonucleotide; AGG chr11 5347281 5347300 5347284 -
aggaaatatagtagaaattc

SEQ ID NO: 34904 - DNA, 20 bp, Artificial Sequence
  Synthetic oligonucleotide; TAG chr11 5347273 5347292 5347276 -
tagtagaaattcaggttaca

SEQ ID NO: 34905 - DNA, 20 bp, Artificial Sequence
  Synthetic oligonucleotide; AGG chr11 5347272 5347291 5347275 -
agtagaaattcaggttacat

SEQ ID NO: 34906 - DNA, 20 bp, Artificial Sequence
  Synthetic oligonucleotide; AAG chr11 5347267 5347286 5347270 -
aaattcaggttacataggcc

SEQ ID NO: 34907 - DNA, 20 bp, Artificial Sequence
  Synthetic oligonucleotide; AAG chr11 5347264 5347283 5347267 -
ttcaggttacataggccaag

SEQ ID NO: 34908 - DNA, 20 bp, Artificial Sequence
  Synthetic oligonucleotide; TAG chr11 5347256 5347275 5347259 -
acataggccaagaagatata

SEQ ID NO: 34909 - DNA, 20 bp, Artificial Sequence
  Synthetic oligonucleotide; AGG chr11 5347255 5347274 5347258 -
cataggccaagaagatatat

SEQ ID NO: 34910 - DNA, 20 bp, Artificial Sequence
  Synthetic oligonucleotide; GAG chr11 5347243 5347262 5347246 -
agatatataggctttctctt

SEQ ID NO: 34911 - DNA, 20 bp, Artificial Sequence
  Synthetic oligonucleotide; TGG chr11 5347234 5347253 5347237 -
ggctttctcttgagataaac

SEQ ID NO: 34912 - DNA, 20 bp, Artificial Sequence
  Synthetic oligonucleotide; GGG chr11 5347233 5347252 5347236 -
gctttctcttgagataaact

SEQ ID NO: 34913 - DNA, 20 bp, Artificial Sequence
  Synthetic oligonucleotide; AAG chr11 5347229 5347248 5347232 -
tctcttgagataaactggga

SEQ ID NO: 34914 - DNA, 20 bp, Artificial Sequence
  Synthetic oligonucleotide; AAG chr11 5347214 5347233 5347217 -
tgggaaagatttgactgttg

SEQ ID NO: 34915 - DNA, 20 bp, Artificial Sequence
  Synthetic oligonucleotide; TAG chr11 5347205 5347224 5347208 -
tttgactgttgaagtaaatg

SEQ ID NO: 34916 - DNA, 20 bp, Artificial Sequence
  Synthetic oligonucleotide; AGG chr11 5347204 5347223 5347207 -
ttgactgttgaagtaaatgt

SEQ ID NO: 34917 - DNA, 20 bp, Artificial Sequence
  Synthetic oligonucleotide; GGG chr11 5347203 5347222 5347206 -
tgactgttgaagtaaatgta

SEQ ID NO: 34918 - DNA, 20 bp, Artificial Sequence
  Synthetic oligonucleotide; CAG chr11 5347186 5347205 5347189 -
gtagggaataaattacctcc

SEQ ID NO: 34919 - DNA, 20 bp, Artificial Sequence
  Synthetic oligonucleotide; GAG chr11 5347184 5347203 5347187 -
agggaataaattacctccca

SEQ ID NO: 34920 - DNA, 20 bp, Artificial Sequence
  Synthetic oligonucleotide; AGG chr11 5347183 5347202 5347186 -
gggaataaattacctcccag

SEQ ID NO: 34921 - DNA, 20 bp, Artificial Sequence
  Synthetic oligonucleotide; CAG chr11 5347174 5347193 5347177 -
ttacctcccagaggtgatac

SEQ ID NO: 34922 - DNA, 20 bp, Artificial Sequence
  Synthetic oligonucleotide; GAG chr11 5347172 5347191 5347175 -
acctcccagaggtgatacca

SEQ ID NO: 34923 - DNA, 20 bp, Artificial Sequence
  Synthetic oligonucleotide; TGG chr11 5347164 5347183 5347167 -
gaggtgataccagagtctgc

SEQ ID NO: 34924 - DNA, 20 bp, Artificial Sequence
  Synthetic oligonucleotide; GGG chr11 5347163 5347182 5347166 -
aggtgataccagagtctgct

SEQ ID NO: 34925 - DNA, 20 bp, Artificial Sequence
  Synthetic oligonucleotide; GGG chr11 5347162 5347181 5347165 -
ggtgataccagagtctgctg

SEQ ID NO: 34926 - DNA, 20 bp, Artificial Sequence
  Synthetic oligonucleotide; AAG chr11 5347154 5347173 5347157 -
cagagtctgctggggctatg

SEQ ID NO: 34927 - DNA, 20 bp, Artificial Sequence
  Synthetic oligonucleotide; CAG chr11 5347150 5347169 5347153 -
gtctgctggggctatgaaga

SEQ ID NO: 34928 - DNA, 20 bp, Artificial Sequence
  Synthetic oligonucleotide; AGG chr11 5347149 5347168 5347152 -
tctgctggggctatgaagac

SEQ ID NO: 34929 - DNA, 20 bp, Artificial Sequence
  Synthetic oligonucleotide; AAG chr11 5347125 5347144 5347128 -
tgtctgattccccacacata

SEQ ID NO: 34930 - DNA, 20 bp, Artificial Sequence
  Synthetic oligonucleotide; AGG chr11 5347124 5347143 5347127 -
gtctgattccccacacataa

SEQ ID NO: 34931 - DNA, 20 bp, Artificial Sequence
  Synthetic oligonucleotide; CAG chr11 5347115 5347134 5347118 -
cccacacataaaggtcctac

SEQ ID NO: 34932 - DNA, 20 bp, Artificial Sequence
  Synthetic oligonucleotide; TGG chr11 5347112 5347131 5347115 -
acacataaaggtcctaccag

SEQ ID NO: 34933 - DNA, 20 bp, Artificial Sequence
  Synthetic oligonucleotide; CAG chr11 5347102 5347121 5347105 -
gtcctaccagtggcttgatt

SEQ ID NO: 34934 - DNA, 20 bp, Artificial Sequence
  Synthetic oligonucleotide; CAG chr11 5347098 5347117 5347101 -
taccagtggcttgattcagc

SEQ ID NO: 34935 - DNA, 20 bp, Artificial Sequence
  Synthetic oligonucleotide; AAG chr11 5347080 5347099 5347083 -
gccagtaacttatttgaaaa

SEQ ID NO: 34936 - DNA, 20 bp, Artificial Sequence
  Synthetic oligonucleotide; AAG chr11 5347076 5347095 5347079 -
gtaacttatttgaaaaaaga

SEQ ID NO: 34937 - DNA, 20 bp, Artificial Sequence
  Synthetic oligonucleotide; AAG chr11 5347064 5347083 5347067 -
aaaaaagaaagattatttaa

SEQ ID NO: 34938 - DNA, 20 bp, Artificial Sequence
  Synthetic oligonucleotide; TGG chr11 5347059 5347078 5347062 -
agaaagattatttaaaagct

SEQ ID NO: 34939 - DNA, 20 bp, Artificial Sequence
  Synthetic oligonucleotide; GGG chr11 5347058 5347077 5347061 -
gaaagattatttaaaagctt

SEQ ID NO: 34940 - DNA, 20 bp, Artificial Sequence
  Synthetic oligonucleotide; GGG chr11 5347057 5347076 5347060 -
aaagattatttaaaagcttg

SEQ ID NO: 34941 - DNA, 20 bp, Artificial Sequence
  Synthetic oligonucleotide; GGG chr11 5347056 5347075 5347059 -
aagattatttaaaagcttgg

SEQ ID NO: 34942 - DNA, 20 bp, Artificial Sequence
  Synthetic oligonucleotide; GGG chr11 5347055 5347074 5347058 -
agattatttaaaagcttggg

SEQ ID NO: 34943 - DNA, 20 bp, Artificial Sequence
  Synthetic oligonucleotide; AAG chr11 5347045 5347064 5347048 -
aaagcttggggggactaatt

SEQ ID NO: 34944 - DNA, 20 bp, Artificial Sequence
  Synthetic oligonucleotide; CAG chr11 5347037 5347056 5347040 -
gggggactaattaagtgttc

SEQ ID NO: 34945 - DNA, 20 bp, Artificial Sequence
  Synthetic oligonucleotide; AAG chr11 5347026 5347045 5347029 -
taagtgttccagctccctct

SEQ ID NO: 34946 - DNA, 20 bp, Artificial Sequence
  Synthetic oligonucleotide; AGG chr11 5347025 5347044 5347028 -
aagtgttccagctccctcta

SEQ ID NO: 34947 - DNA, 20 bp, Artificial Sequence
  Synthetic oligonucleotide; GAG chr11 5347023 5347042 5347026 -
gtgttccagctccctctaag

SEQ ID NO: 34948 - DNA, 20 bp, Artificial Sequence
  Synthetic oligonucleotide; AGG chr11 5347022 5347041 5347025 -
tgttccagctccctctaagg

SEQ ID NO: 34949 - DNA, 20 bp, Artificial Sequence
  Synthetic oligonucleotide; GAG chr11 5347020 5347039 5347023 -
ttccagctccctctaaggag

SEQ ID NO: 34950 - DNA, 20 bp, Artificial Sequence
  Synthetic oligonucleotide; CAG chr11 5347011 5347030 5347014 -
cctctaaggaggagttaata

SEQ ID NO: 34951 - DNA, 20 bp, Artificial Sequence
  Synthetic oligonucleotide; GAG chr11 5347009 5347028 5347012 -
tctaaggaggagttaataca

SEQ ID NO: 34952 - DNA, 20 bp, Artificial Sequence
  Synthetic oligonucleotide; AAG chr11 5346994 5347013 5346997 -
atacagagtaaatatttctt

SEQ ID NO: 34953 - DNA, 20 bp, Artificial Sequence
  Synthetic oligonucleotide; AAG chr11 5346987 5347006 5346990 -
gtaaatatttcttaagatcc

SEQ ID NO: 34954 - DNA, 20 bp, Artificial Sequence
  Synthetic oligonucleotide; TGG chr11 5346983 5347002 5346986 -
atatttcttaagatccaagt

SEQ ID NO: 34955 - DNA, 20 bp, Artificial Sequence
  Synthetic oligonucleotide; AAG chr11 5346974 5346993 5346977 -
aagatccaagttggctataa

SEQ ID NO: 34956 - DNA, 20 bp, Artificial Sequence
  Synthetic oligonucleotide; AGG chr11 5346973 5346992 5346976 -
agatccaagttggctataaa

SEQ ID NO: 34957 - DNA, 20 bp, Artificial Sequence
  Synthetic oligonucleotide; GGG chr11 5346972 5346991 5346975 -
gatccaagttggctataaaa

SEQ ID NO: 34958 - DNA, 20 bp, Artificial Sequence
  Synthetic oligonucleotide; GAG chr11 5346970 5346989 5346973 -
tccaagttggctataaaagg

SEQ ID NO: 34959 - DNA, 20 bp, Artificial Sequence
  Synthetic oligonucleotide; TGG chr11 5346962 5346981 5346965 -
ggctataaaagggagacatc

SEQ ID NO: 34960 - DNA, 20 bp, Artificial Sequence
  Synthetic oligonucleotide; GGG chr11 5346961 5346980 5346964 -
gctataaaagggagacatct

SEQ ID NO: 34961 - DNA, 20 bp, Artificial Sequence
  Synthetic oligonucleotide; AAG chr11 5346958 5346977 5346961 -
ataaaagggagacatctggg

SEQ ID NO: 34962 - DNA, 20 bp, Artificial Sequence
  Synthetic oligonucleotide; AGG chr11 5346957 5346976 5346960 -
taaaagggagacatctggga

SEQ ID NO: 34963 - DNA, 20 bp, Artificial Sequence
  Synthetic oligonucleotide; CAG chr11 5346933 5346952 5346936 -
gctatctttattaataacca

SEQ ID NO: 34964 - DNA, 20 bp, Artificial Sequence
  Synthetic oligonucleotide; CAG chr11 5346914 5346933 5346917 -
acagtgactgcttctcttca

SEQ ID NO: 34965 - DNA, 20 bp, Artificial Sequence
  Synthetic oligonucleotide; GAG chr11 5346906 5346925 5346909 -
tgcttctcttcacagatgtt

SEQ ID NO: 34966 - DNA, 20 bp, Artificial Sequence
  Synthetic oligonucleotide; AAG chr11 5346903 5346922 5346906 -
ttctcttcacagatgttgag

SEQ ID NO: 34967 - DNA, 20 bp, Artificial Sequence
  Synthetic oligonucleotide; AGG chr11 5346902 5346921 5346905 -
tctcttcacagatgttgaga

SEQ ID NO: 34968 - DNA, 20 bp, Artificial Sequence
  Synthetic oligonucleotide; AAG chr11 5346886 5346905 5346889 -
gagaaggaacaacatgatct

SEQ ID NO: 34969 - DNA, 20 bp, Artificial Sequence
  Synthetic oligonucleotide; TAG chr11 5346879 5346898 5346882 -
aacaacatgatctaagtctt

SEQ ID NO: 34970 - DNA, 20 bp, Artificial Sequence
  Synthetic oligonucleotide; AGG chr11 5346878 5346897 5346881 -
acaacatgatctaagtcttt

SEQ ID NO: 34971 - DNA, 20 bp, Artificial Sequence
  Synthetic oligonucleotide; AAG chr11 5346874 5346893 5346877 -
catgatctaagtctttaggt

SEQ ID NO: 34972 - DNA, 20 bp, Artificial Sequence
  Synthetic oligonucleotide; AAG chr11 5346867 5346886 5346870 -
taagtctttaggtaagacac

SEQ ID NO: 34973 - DNA, 20 bp, Artificial Sequence
  Synthetic oligonucleotide; AAG chr11 5346838 5346857 5346841 -
gctcttcctcaccatcaaac

SEQ ID NO: 34974 - DNA, 20 bp, Artificial Sequence
  Synthetic oligonucleotide; TGG chr11 5346832 5346851 5346835 -
cctcaccatcaaacaagtta

SEQ ID NO: 34975 - DNA, 20 bp, Artificial Sequence
  Synthetic oligonucleotide; TGG chr11 5346825 5346844 5346828 -
atcaaacaagttatggtacc

SEQ ID NO: 34976 - DNA, 20 bp, Artificial Sequence
  Synthetic oligonucleotide; GGG chr11 5346824 5346843 5346827 -
tcaaacaagttatggtacct

SEQ ID NO: 34977 - DNA, 20 bp, Artificial Sequence
  Synthetic oligonucleotide; GAG chr11 5346822 5346841 5346825 -
aaacaagttatggtacctgg

SEQ ID NO: 34978 - DNA, 20 bp, Artificial Sequence
  Synthetic oligonucleotide; TGG chr11 5346817 5346836 5346820 -
agttatggtacctgggagta

SEQ ID NO: 34979 - DNA, 20 bp, Artificial Sequence
  Synthetic oligonucleotide; TAG chr11 5346803 5346822 5346806 -
ggagtatggtgaaatactcc

SEQ ID NO: 34980 - DNA, 20 bp, Artificial Sequence
  Synthetic oligonucleotide; AAG chr11 5346793 5346812 5346796 -
gaaatactcctagatatata

SEQ ID NO: 34981 - DNA, 20 bp, Artificial Sequence
  Synthetic oligonucleotide; GAG chr11 5346791 5346810 5346794 -
aatactcctagatatataaa

SEQ ID NO: 34982 - DNA, 20 bp, Artificial Sequence
  Synthetic oligonucleotide; TAG chr11 5346783 5346802 5346786 -
tagatatataaagagtgtac

SEQ ID NO: 34983 - DNA, 20 bp, Artificial Sequence
  Synthetic oligonucleotide; AGG chr11 5346782 5346801 5346785 -
agatatataaagagtgtact

SEQ ID NO: 34984 - DNA, 20 bp, Artificial Sequence
  Synthetic oligonucleotide; GAG chr11 5346780 5346799 5346783 -
atatataaagagtgtactag

SEQ ID NO: 34985 - DNA, 20 bp, Artificial Sequence
  Synthetic oligonucleotide; AAG chr11 5346767 5346786 5346770 -
gtactaggagactcctctat

SEQ ID NO: 34986 - DNA, 20 bp, Artificial Sequence
  Synthetic oligonucleotide; CAG chr11 5346759 5346778 5346762 -
agactcctctataagctctc

SEQ ID NO: 34987 - DNA, 20 bp, Artificial Sequence
  Synthetic oligonucleotide; GAG chr11 5346757 5346776 5346760 -
actcctctataagctctcca

SEQ ID NO: 34988 - DNA, 20 bp, Artificial Sequence
  Synthetic oligonucleotide; AAG chr11 5346753 5346772 5346756 -
ctctataagctctccagaga

SEQ ID NO: 34989 - DNA, 20 bp, Artificial Sequence
  Synthetic oligonucleotide; CGG chr11 5346747 5346766 5346750 -
aagctctccagagaaagata

SEQ ID NO: 34990 - DNA, 20 bp, Artificial Sequence
  Synthetic oligonucleotide; GAG chr11 5346745 5346764 5346748 -
gctctccagagaaagatacg

SEQ ID NO: 34991 - DNA, 20 bp, Artificial Sequence
  Synthetic oligonucleotide; AAG chr11 5346742 5346761 5346745 -
ctccagagaaagatacggag

SEQ ID NO: 34992 - DNA, 20 bp, Artificial Sequence
  Synthetic oligonucleotide; AAG chr11 5346739 5346758 5346742 -
cagagaaagatacggagaag

SEQ ID NO: 34993 - DNA, 20 bp, Artificial Sequence
  Synthetic oligonucleotide; AAG chr11 5346734 5346753 5346737 -
aaagatacggagaagaagtg

SEQ ID NO: 34994 - DNA, 20 bp, Artificial Sequence
  Synthetic oligonucleotide; AGG chr11 5346733 5346752 5346736 -
aagatacggagaagaagtga

SEQ ID NO: 34995 - DNA, 20 bp, Artificial Sequence
  Synthetic oligonucleotide; TAG chr11 5346723 5346742 5346726 -
gaagaagtgaaggatctcaa

SEQ ID NO: 34996 - DNA, 20 bp, Artificial Sequence
  Synthetic oligonucleotide; CAG chr11 5346716 5346735 5346719 -
tgaaggatctcaatagtcca

SEQ ID NO: 34997 - DNA, 20 bp, Artificial Sequence
  Synthetic oligonucleotide; TGG chr11 5346710 5346729 5346713 -
atctcaatagtccacagctt

SEQ ID NO: 34998 - DNA, 20 bp, Artificial Sequence
  Synthetic oligonucleotide; CAG chr11 5346698 5346717 5346701 -
cacagctttggatgtgtgca

SEQ ID NO: 34999 - DNA, 20 bp, Artificial Sequence
  Synthetic oligonucleotide; CAG chr11 5346691 5346710 5346694 -
ttggatgtgtgcacagattt

SEQ ID NO: 35000 - DNA, 20 bp, Artificial Sequence
  Synthetic oligonucleotide; AAG chr11 5346684 5346703 5346687 -
tgtgcacagatttcagtctg

SEQ ID NO: 35001 - DNA, 20 bp, Artificial Sequence
  Synthetic oligonucleotide; TAG chr11 5346677 5346696 5346680 -
agatttcagtctgaagttga

SEQ ID NO: 35002 - DNA, 20 bp, Artificial Sequence
  Synthetic oligonucleotide; AAG chr11 5346666 5346685 5346669 -
tgaagttgatagaacttcaa

SEQ ID NO: 35003 - DNA, 20 bp, Artificial Sequence
  Synthetic oligonucleotide; AAG chr11 5346656 5346675 5346659 -
agaacttcaaaagcaattcc

SEQ ID NO: 35004 - DNA, 20 bp, Artificial Sequence
  Synthetic oligonucleotide; AAG chr11 5346634 5346653 5346637 -
gtgctaccaaccaactacct

SEQ ID NO: 35005 - DNA, 20 bp, Artificial Sequence
  Synthetic oligonucleotide; CAG chr11 5346619 5346638 5346622 -
tacctaagaccttctgtact

SEQ ID NO: 35006 - DNA, 20 bp, Artificial Sequence
  Synthetic oligonucleotide; AAG chr11 5346569 5346588 5346572 -
atgtcttctttcctttctaa

SEQ ID NO: 35007 - DNA, 20 bp, Artificial Sequence
  Synthetic oligonucleotide; CAG chr11 5346561 5346580 5346564 -
tttcctttctaaaagatgaa

SEQ ID NO: 35008 - DNA, 20 bp, Artificial Sequence
  Synthetic oligonucleotide; AGG chr11 5346560 5346579 5346563 -
ttcctttctaaaagatgaac

SEQ ID NO: 35009 - DNA, 20 bp, Artificial Sequence
  Synthetic oligonucleotide; AAG chr11 5346557 5346576 5346560 -
ctttctaaaagatgaacagg

SEQ ID NO: 35010 - DNA, 20 bp, Artificial Sequence
  Synthetic oligonucleotide; AGG chr11 5346556 5346575 5346559 -
tttctaaaagatgaacagga

SEQ ID NO: 35011 - DNA, 20 bp, Artificial Sequence
  Synthetic oligonucleotide; AAG chr11 5346518 5346537 5346521 -
tacattttactttttaaaca

SEQ ID NO: 35012 - DNA, 20 bp, Artificial Sequence
  Synthetic oligonucleotide; CAG chr11 5346515 5346534 5346518 -
attttactttttaaacaaag

SEQ ID NO: 35013 - DNA, 20 bp, Artificial Sequence
  Synthetic oligonucleotide; GAG chr11 5346513 5346532 5346516 -
tttactttttaaacaaagca

SEQ ID NO: 35014 - DNA, 20 bp, Artificial Sequence
  Synthetic oligonucleotide; TGG chr11 5346502 5346521 5346505 -
aacaaagcagagaaaaatta

SEQ ID NO: 35015 - DNA, 20 bp, Artificial Sequence
  Synthetic oligonucleotide; TAG chr11 5346489 5346508 5346492 -
aaaattatggctgtaaatgt

SEQ ID NO: 35016 - DNA, 20 bp, Artificial Sequence
  Synthetic oligonucleotide; AAG chr11 5346486 5346505 5346489 -
attatggctgtaaatgttag

SEQ ID NO: 35017 - DNA, 20 bp, Artificial Sequence
  Synthetic oligonucleotide; TAG chr11 5346469 5346488 5346472 -
tagaagtttatctgattttc

SEQ ID NO: 35018 - DNA, 20 bp, Artificial Sequence
  Synthetic oligonucleotide; AGG chr11 5346468 5346487 5346471 -
agaagtttatctgattttct

SEQ ID NO: 35019 - DNA, 20 bp, Artificial Sequence
  Synthetic oligonucleotide; TAG chr11 5346455 5346474 5346458 -
attttctaggtgttccatta

SEQ ID NO: 35020 - DNA, 20 bp, Artificial Sequence
  Synthetic oligonucleotide; CAG chr11 5346432 5346451 5346435 -
aatcttcttgcttctatcct

SEQ ID NO: 35021 - DNA, 20 bp, Artificial Sequence
  Synthetic oligonucleotide; CAG chr11 5346391 5346410 5346394 -
ttccctatattttttttcct

SEQ ID NO: 35022 - DNA, 20 bp, Artificial Sequence
  Synthetic oligonucleotide; CAG chr11 5346357 5346376 5346360 -
tctctcattgtctttcttct

SEQ ID NO: 35023 - DNA, 20 bp, Artificial Sequence
  Synthetic oligonucleotide; AAG chr11 5346349 5346368 5346352 -
tgtctttcttctcagaaacc

SEQ ID NO: 35024 - DNA, 20 bp, Artificial Sequence
  Synthetic oligonucleotide; GAG chr11 5346347 5346366 5346350 -
tctttcttctcagaaaccaa

SEQ ID NO: 35025 - DNA, 20 bp, Artificial Sequence
  Synthetic oligonucleotide; TAG chr11 5346337 5346356 5346340 -
cagaaaccaagagccacgac

SEQ ID NO: 35026 - DNA, 20 bp, Artificial Sequence
  Synthetic oligonucleotide; GAG chr11 5346332 5346351 5346335 -
accaagagccacgactagct

SEQ ID NO: 35027 - DNA, 20 bp, Artificial Sequence
  Synthetic oligonucleotide; AGG chr11 5346331 5346350 5346334 -
ccaagagccacgactagctg

SEQ ID NO: 35028 - DNA, 20 bp, Artificial Sequence
  Synthetic oligonucleotide; AAG chr11 5346324 5346343 5346327 -
ccacgactagctgaggacac

SEQ ID NO: 35029 - DNA, 20 bp, Artificial Sequence
  Synthetic oligonucleotide; AAG chr11 5346306 5346325 5346309 -
acaagaattttcacaaaaca

SEQ ID NO: 35030 - DNA, 20 bp, Artificial Sequence
  Synthetic oligonucleotide; TAG chr11 5346303 5346322 5346306 -
agaattttcacaaaacaaag

SEQ ID NO: 35031 - DNA, 20 bp, Artificial Sequence
  Synthetic oligonucleotide; GAG chr11 5346301 5346320 5346304 -
aattttcacaaaacaaagta

SEQ ID NO: 35032 - DNA, 20 bp, Artificial Sequence
  Synthetic oligonucleotide; TAG chr11 5346290 5346309 5346293 -
aacaaagtagagtgattcca

SEQ ID NO: 35033 - DNA, 20 bp, Artificial Sequence
  Synthetic oligonucleotide; TAG chr11 5346277 5346296 5346280 -
gattccatagatcactatta

SEQ ID NO: 35034 - DNA, 20 bp, Artificial Sequence
  Synthetic oligonucleotide; CAG chr11 5346265 5346284 5346268 -
cactattatagctgcattac

SEQ ID NO: 35035 - DNA, 20 bp, Artificial Sequence
  Synthetic oligonucleotide; AGG chr11 5346264 5346283 5346267 -
actattatagctgcattacc

SEQ ID NO: 35036 - DNA, 20 bp, Artificial Sequence
  Synthetic oligonucleotide; TGG chr11 5346251 5346270 5346254 -
cattaccaggtatgtctgca

SEQ ID NO: 35037 - DNA, 20 bp, Artificial Sequence
  Synthetic oligonucleotide; TGG chr11 5346242 5346261 5346245 -
gtatgtctgcatggaattct

SEQ ID NO: 35038 - DNA, 20 bp, Artificial Sequence
  Synthetic oligonucleotide; GGG chr11 5346241 5346260 5346244 -
tatgtctgcatggaattctt

SEQ ID NO: 35039 - DNA, 20 bp, Artificial Sequence
  Synthetic oligonucleotide; TGG chr11 5346236 5346255 5346239 -
ctgcatggaattcttgggaa

SEQ ID NO: 35040 - DNA, 20 bp, Artificial Sequence
  Synthetic oligonucleotide; GAG chr11 5346234 5346253 5346237 -
gcatggaattcttgggaatg

SEQ ID NO: 35041 - DNA, 20 bp, Artificial Sequence
  Synthetic oligonucleotide; AAG chr11 5346231 5346250 5346234 -
tggaattcttgggaatggag

SEQ ID NO: 35042 - DNA, 20 bp, Artificial Sequence
  Synthetic oligonucleotide; AGG chr11 5346230 5346249 5346233 -
ggaattcttgggaatggaga

SEQ ID NO: 35043 - DNA, 20 bp, Artificial Sequence
  Synthetic oligonucleotide; GAG chr11 5346228 5346247 5346231 -
aattcttgggaatggagaag

SEQ ID NO: 35044 - DNA, 20 bp, Artificial Sequence
  Synthetic oligonucleotide; AGG chr11 5346227 5346246 5346230 -
attcttgggaatggagaagg

SEQ ID NO: 35045 - DNA, 20 bp, Artificial Sequence
  Synthetic oligonucleotide; AAG chr11 5346217 5346236 5346220 -
atggagaaggaggaaacttt

SEQ ID NO: 35046 - DNA, 20 bp, Artificial Sequence
  Synthetic oligonucleotide; CAG chr11 5346211 5346230 5346214 -
aaggaggaaactttaagttg

SEQ ID NO: 35047 - DNA, 20 bp, Artificial Sequence
  Synthetic oligonucleotide; AGG chr11 5346210 5346229 5346213 -
aggaggaaactttaagttgc

SEQ ID NO: 35048 - DNA, 20 bp, Artificial Sequence
  Synthetic oligonucleotide; TGG chr11 5346200 5346219 5346203 -
tttaagttgcaggttattat

SEQ ID NO: 35049 - DNA, 20 bp, Artificial Sequence
  Synthetic oligonucleotide; CAG chr11 5346176 5346195 5346179 -
aaaatacaatcattgcctta

SEQ ID NO: 35050 - DNA, 20 bp, Artificial Sequence
  Synthetic oligonucleotide; TGG chr11 5346171 5346190 5346174 -
acaatcattgccttacagtt

SEQ ID NO: 35051 - DNA, 20 bp, Artificial Sequence
  Synthetic oligonucleotide; TAG chr11 5346167 5346186 5346170 -
tcattgccttacagtttggt

SEQ ID NO: 35052 - DNA, 20 bp, Artificial Sequence
  Synthetic oligonucleotide; TAG chr11 5346155 5346174 5346158 -
agtttggttagctttccctg

SEQ ID NO: 35053 - DNA, 20 bp, Artificial Sequence
  Synthetic oligonucleotide; AAG chr11 5346120 5346139 5346123 -
tgtgctgcatattctctgat

SEQ ID NO: 35054 - DNA, 20 bp, Artificial Sequence
  Synthetic oligonucleotide; AAG chr11 5346117 5346136 5346120 -
gctgcatattctctgataag

SEQ ID NO: 35055 - DNA, 20 bp, Artificial Sequence
  Synthetic oligonucleotide; AGG chr11 5346116 5346135 5346119 -
ctgcatattctctgataaga

SEQ ID NO: 35056 - DNA, 20 bp, Artificial Sequence
  Synthetic oligonucleotide; AAG chr11 5346102 5346121 5346105 -
ataagaaggaatttttcaca

SEQ ID NO: 35057 - DNA, 20 bp, Artificial Sequence
  Synthetic oligonucleotide; GAG chr11 5346097 5346116 5346100 -
aaggaatttttcacaaagtt

SEQ ID NO: 35058 - DNA, 20 bp, Artificial Sequence
  Synthetic oligonucleotide; CAG chr11 5346091 5346110 5346094 -
tttttcacaaagttgagata

SEQ ID NO: 35059 - DNA, 20 bp, Artificial Sequence
  Synthetic oligonucleotide; AAG chr11 5346085 5346104 5346088 -
acaaagttgagatacagtga

SEQ ID NO: 35060 - DNA, 20 bp, Artificial Sequence
  Synthetic oligonucleotide; TAG chr11 5346080 5346099 5346083 -
gttgagatacagtgaaagat

SEQ ID NO: 35061 - DNA, 20 bp, Artificial Sequence
  Synthetic oligonucleotide; AGG chr11 5346079 5346098 5346082 -
ttgagatacagtgaaagatt

SEQ ID NO: 35062 - DNA, 20 bp, Artificial Sequence
  Synthetic oligonucleotide; AAG chr11 5346073 5346092 5346076 -
tacagtgaaagattaggtta

SEQ ID NO: 35063 - DNA, 20 bp, Artificial Sequence
  Synthetic oligonucleotide; AGG chr11 5346072 5346091 5346075 -
acagtgaaagattaggttaa

SEQ ID NO: 35064 - DNA, 20 bp, Artificial Sequence
  Synthetic oligonucleotide; GAG chr11 5346070 5346089 5346073 -
agtgaaagattaggttaaag

SEQ ID NO: 35065 - DNA, 20 bp, Artificial Sequence
  Synthetic oligonucleotide; CAG chr11 5346051 5346070 5346054 -
ggagattattgctgaaacgt

SEQ ID NO: 35066 - DNA, 20 bp, Artificial Sequence
  Synthetic oligonucleotide; GAG chr11 5346049 5346068 5346052 -
agattattgctgaaacgtca

SEQ ID NO: 35067 - DNA, 20 bp, Artificial Sequence
  Synthetic oligonucleotide; AAG chr11 5346046 5346065 5346049 -
ttattgctgaaacgtcagag

SEQ ID NO: 35068 - DNA, 20 bp, Artificial Sequence
  Synthetic oligonucleotide; AAG chr11 5346042 5346061 5346045 -
tgctgaaacgtcagagaagt

SEQ ID NO: 35069 - DNA, 20 bp, Artificial Sequence
  Synthetic oligonucleotide; GAG chr11 5346040 5346059 5346043 -
ctgaaacgtcagagaagtaa

SEQ ID NO: 35070 - DNA, 20 bp, Artificial Sequence
  Synthetic oligonucleotide; CAG chr11 5346031 5346050 5346034 -
cagagaagtaagagtgttga

SEQ ID NO: 35071 - DNA, 20 bp, Artificial Sequence
  Synthetic oligonucleotide; GAG chr11 5346029 5346048 5346032 -
gagaagtaagagtgttgaca

SEQ ID NO: 35072 - DNA, 20 bp, Artificial Sequence
  Synthetic oligonucleotide; AAG chr11 5346021 5346040 5346024 -
agagtgttgacagagaaatg

SEQ ID NO: 35073 - DNA, 20 bp, Artificial Sequence
  Synthetic oligonucleotide; TAG chr11 5346014 5346033 5346017 -
tgacagagaaatgaagtaca

SEQ ID NO: 35074 - DNA, 20 bp, Artificial Sequence
  Synthetic oligonucleotide; CAG chr11 5346007 5346026 5346010 -
gaaatgaagtacatagaaca

SEQ ID NO: 35075 - DNA, 20 bp, Artificial Sequence
  Synthetic oligonucleotide; AAG chr11 5346004 5346023 5346007 -
atgaagtacatagaacacag

SEQ ID NO: 35076 - DNA, 20 bp, Artificial Sequence
  Synthetic oligonucleotide; AGG chr11 5346003 5346022 5346006 -
tgaagtacatagaacacaga

SEQ ID NO: 35077 - DNA, 20 bp, Artificial Sequence
  Synthetic oligonucleotide; GGG chr11 5346002 5346021 5346005 -
gaagtacatagaacacagaa

SEQ ID NO: 35078 - DNA, 20 bp, Artificial Sequence
  Synthetic oligonucleotide; GGG chr11 5346001 5346020 5346004 -
aagtacatagaacacagaag

SEQ ID NO: 35079 - DNA, 20 bp, Artificial Sequence
  Synthetic oligonucleotide; GAG chr11 5345999 5346018 5346002 -
gtacatagaacacagaaggg

SEQ ID NO: 35080 - DNA, 20 bp, Artificial Sequence
  Synthetic oligonucleotide; AGG chr11 5345998 5346017 5346001 -
tacatagaacacagaagggg

SEQ ID NO: 35081 - DNA, 20 bp, Artificial Sequence
  Synthetic oligonucleotide; GAG chr11 5345996 5346015 5345999 -
catagaacacagaaggggag

SEQ ID NO: 35082 - DNA, 20 bp, Artificial Sequence
  Synthetic oligonucleotide; AAG chr11 5345991 5346010 5345994 -
aacacagaaggggaggagct

SEQ ID NO: 35083 - DNA, 20 bp, Artificial Sequence
  Synthetic oligonucleotide; TGG chr11 5345987 5346006 5345990 -
cagaaggggaggagctaagc

SEQ ID NO: 35084 - DNA, 20 bp, Artificial Sequence
  Synthetic oligonucleotide; TAG chr11 5345970 5345989 5345973 -
agctggattatctttgcgtc

SEQ ID NO: 35085 - DNA, 20 bp, Artificial Sequence
  Synthetic oligonucleotide; AAG chr11 5345961 5345980 5345964 -
atctttgcgtctagtaactg

SEQ ID NO: 35086 - DNA, 20 bp, Artificial Sequence
  Synthetic oligonucleotide; CAG chr11 5345934 5345953 5345937 -
tacatcactcattgtatgtt

SEQ ID NO: 35087 - DNA, 20 bp, Artificial Sequence
  Synthetic oligonucleotide; TAG chr11 5345931 5345950 5345934 -
atcactcattgtatgttcag

SEQ ID NO: 35088 - DNA, 20 bp, Artificial Sequence
  Synthetic oligonucleotide; AGG chr11 5345930 5345949 5345933 -
tcactcattgtatgttcagt

SEQ ID NO: 35089 - DNA, 20 bp, Artificial Sequence
  Synthetic oligonucleotide; TGG chr11 5345917 5345936 5345920 -
gttcagtaggcactgaattc

SEQ ID NO: 35090 - DNA, 20 bp, Artificial Sequence
  Synthetic oligonucleotide; CAG chr11 5345903 5345922 5345906 -
gaattctggtttatgtctct

SEQ ID NO: 35091 - DNA, 20 bp, Artificial Sequence
  Synthetic oligonucleotide; TAG chr11 5345897 5345916 5345900 -
tggtttatgtctctcagtcc

SEQ ID NO: 35092 - DNA, 20 bp, Artificial Sequence
  Synthetic oligonucleotide; AGG chr11 5345896 5345915 5345899 -
ggtttatgtctctcagtcct

SEQ ID NO: 35093 - DNA, 20 bp, Artificial Sequence
  Synthetic oligonucleotide; CAG chr11 5345892 5345911 5345895 -
tatgtctctcagtcctagga

SEQ ID NO: 35094 - DNA, 20 bp, Artificial Sequence
  Synthetic oligonucleotide; TGG chr11 5345885 5345904 5345888 -
ctcagtcctaggacagaata

SEQ ID NO: 35095 - DNA, 20 bp, Artificial Sequence
  Synthetic oligonucleotide; AAG chr11 5345860 5345879 5345863 -
gctgaaaaatgattctttca

SEQ ID NO: 35096 - DNA, 20 bp, Artificial Sequence
  Synthetic oligonucleotide; GAG chr11 5345853 5345872 5345856 -
aatgattctttcaaagtgct

SEQ ID NO: 35097 - DNA, 20 bp, Artificial Sequence
  Synthetic oligonucleotide; CAG chr11 5345835 5345854 5345838 -
ctgagttgttgcctcacgcc

SEQ ID NO: 35098 - DNA, 20 bp, Artificial Sequence
  Synthetic oligonucleotide; TGG chr11 5345827 5345846 5345830 -
ttgcctcacgcccagttgtc

SEQ ID NO: 35099 - DNA, 20 bp, Artificial Sequence
  Synthetic oligonucleotide; CAG chr11 5345802 5345821 5345805 -
tctcttcactgaaactatta

SEQ ID NO: 35100 - DNA, 20 bp, Artificial Sequence
  Synthetic oligonucleotide; TAG chr11 5345798 5345817 5345801 -
ttcactgaaactattacagt

SEQ ID NO: 35101 - DNA, 20 bp, Artificial Sequence
  Synthetic oligonucleotide; TGG chr11 5345783 5345802 5345786 -
acagttagatctcatctcta

SEQ ID NO: 35102 - DNA, 20 bp, Artificial Sequence
  Synthetic oligonucleotide; GGG chr11 5345782 5345801 5345785 -
cagttagatctcatctctat

SEQ ID NO: 35103 - DNA, 20 bp, Artificial Sequence
  Synthetic oligonucleotide; TGG chr11 5345779 5345798 5345782 -
ttagatctcatctctatggg

SEQ ID NO: 35104 - DNA, 20 bp, Artificial Sequence
  Synthetic oligonucleotide; AAG chr11 5345776 5345795 5345779 -
gatctcatctctatgggtgg

SEQ ID NO: 35105 - DNA, 20 bp, Artificial Sequence
  Synthetic oligonucleotide; AGG chr11 5345775 5345794 5345778 -
atctcatctctatgggtgga

SEQ ID NO: 35106 - DNA, 20 bp, Artificial Sequence
  Synthetic oligonucleotide; AAG chr11 5345771 5345790 5345774 -
catctctatgggtggaaggt

SEQ ID NO: 35107 - DNA, 20 bp, Artificial Sequence
  Synthetic oligonucleotide; GAG chr11 5345769 5345788 5345772 -
tctctatgggtggaaggtaa

SEQ ID NO: 35108 - DNA, 20 bp, Artificial Sequence
  Synthetic oligonucleotide; AGG chr11 5345768 5345787 5345771 -
ctctatgggtggaaggtaag

SEQ ID NO: 35109 - DNA, 20 bp, Artificial Sequence
  Synthetic oligonucleotide; TGG chr11 5345754 5345773 5345757 -
ggtaagaggatcgtttcctt

SEQ ID NO: 35110 - DNA, 20 bp, Artificial Sequence
  Synthetic oligonucleotide; TGG chr11 5345751 5345770 5345754 -
aagaggatcgtttcctttgg

SEQ ID NO: 35111 - DNA, 20 bp, Artificial Sequence
  Synthetic oligonucleotide; TAG chr11 5345742 5345761 5345745 -
gtttcctttggtggcatctt

SEQ ID NO: 35112 - DNA, 20 bp, Artificial Sequence
  Synthetic oligonucleotide; AGG chr11 5345741 5345760 5345744 -
tttcctttggtggcatcttt

SEQ ID NO: 35113 - DNA, 20 bp, Artificial Sequence
  Synthetic oligonucleotide; GGG chr11 5345740 5345759 5345743 -
ttcctttggtggcatcttta

SEQ ID NO: 35114 - DNA, 20 bp, Artificial Sequence
  Synthetic oligonucleotide; TAG chr11 5345737 5345756 5345740 -
ctttggtggcatctttaggg

SEQ ID NO: 35115 - DNA, 20 bp, Artificial Sequence
  Synthetic oligonucleotide; AAG chr11 5345719 5345738 5345722 -
ggtagtgccttacactgaca

SEQ ID NO: 35116 - DNA, 20 bp, Artificial Sequence
  Synthetic oligonucleotide; AAG chr11 5345708 5345727 5345711 -
acactgacaaagtaactctg

SEQ ID NO: 35117 - DNA, 20 bp, Artificial Sequence
  Synthetic oligonucleotide; AGG chr11 5345707 5345726 5345710 -
cactgacaaagtaactctga

SEQ ID NO: 35118 - DNA, 20 bp, Artificial Sequence
  Synthetic oligonucleotide; GGG chr11 5345706 5345725 5345709 -
actgacaaagtaactctgaa

SEQ ID NO: 35119 - DNA, 20 bp, Artificial Sequence
  Synthetic oligonucleotide; GGG chr11 5345705 5345724 5345708 -
ctgacaaagtaactctgaag

SEQ ID NO: 35120 - DNA, 20 bp, Artificial Sequence
  Synthetic oligonucleotide; TGG chr11 5345696 5345715 5345699 -
taactctgaaggggtatatt

SEQ ID NO: 35121 - DNA, 20 bp, Artificial Sequence
  Synthetic oligonucleotide; TAG chr11 5345673 5345692 5345676 -
atacgaccatctttttaact

SEQ ID NO: 35122 - DNA, 20 bp, Artificial Sequence
  Synthetic oligonucleotide; AGG chr11 5345672 5345691 5345675 -
tacgaccatctttttaactt

SEQ ID NO: 35123 - DNA, 20 bp, Artificial Sequence
  Synthetic oligonucleotide; AAG chr11 5345655 5345674 5345658 -
cttaggataaaaacaacttc

SEQ ID NO: 35124 - DNA, 20 bp, Artificial Sequence
  Synthetic oligonucleotide; AAG chr11 5345652 5345671 5345655 -
aggataaaaacaacttcaag

SEQ ID NO: 35125 - DNA, 20 bp, Artificial Sequence
  Synthetic oligonucleotide; TGG chr11 5345643 5345662 5345646 -
acaacttcaagaagttgttc

SEQ ID NO: 35126 - DNA, 20 bp, Artificial Sequence
  Synthetic oligonucleotide; AAG chr11 5345632 5345651 5345635 -
aagttgttctggcatgtgac

SEQ ID NO: 35127 - DNA, 20 bp, Artificial Sequence
  Synthetic oligonucleotide; AAG chr11 5345623 5345642 5345626 -
tggcatgtgacaagaaaaaa

SEQ ID NO: 35128 - DNA, 20 bp, Artificial Sequence
  Synthetic oligonucleotide; AAG chr11 5345619 5345638 5345622 -
atgtgacaagaaaaaaaagc

SEQ ID NO: 35129 - DNA, 20 bp, Artificial Sequence
  Synthetic oligonucleotide; AGG chr11 5345618 5345637 5345621 -
tgtgacaagaaaaaaaagca

SEQ ID NO: 35130 - DNA, 20 bp, Artificial Sequence
  Synthetic oligonucleotide; GGG chr11 5345617 5345636 5345620 -
gtgacaagaaaaaaaagcaa

SEQ ID NO: 35131 - DNA, 20 bp, Artificial Sequence
  Synthetic oligonucleotide; CAG chr11 5345597 5345616 5345600 -
gggatgcatttgctctaatt

SEQ ID NO: 35132 - DNA, 20 bp, Artificial Sequence
  Synthetic oligonucleotide; AAG chr11 5345562 5345581 5345565 -
atgactcttgatttcctcac

SEQ ID NO: 35133 - DNA, 20 bp, Artificial Sequence
  Synthetic oligonucleotide; CAG chr11 5345542 5345561 5345545 -
aagtgaatatgtatccccct

SEQ ID NO: 35134 - DNA, 20 bp, Artificial Sequence
  Synthetic oligonucleotide; GAG chr11 5345528 5345547 5345531 -
ccccctcagacttccatttt

SEQ ID NO: 35135 - DNA, 20 bp, Artificial Sequence
  Synthetic oligonucleotide; TGG chr11 5345521 5345540 5345524 -
agacttccattttgagtaaa

SEQ ID NO: 35136 - DNA, 20 bp, Artificial Sequence
  Synthetic oligonucleotide; CAG chr11 5345492 5345511 5345495 -
cattctttcatttgttcaaa

SEQ ID NO: 35137 - DNA, 20 bp, Artificial Sequence
  Synthetic oligonucleotide; TAG chr11 5345484 5345503 5345487 -
catttgttcaaacagaaatc

SEQ ID NO: 35138 - DNA, 20 bp, Artificial Sequence
  Synthetic oligonucleotide; AGG chr11 5345483 5345502 5345486 -
atttgttcaaacagaaatct

SEQ ID NO: 35139 - DNA, 20 bp, Artificial Sequence
  Synthetic oligonucleotide; GGG chr11 5345482 5345501 5345485 -
tttgttcaaacagaaatcta

SEQ ID NO: 35140 - DNA, 20 bp, Artificial Sequence
  Synthetic oligonucleotide; GGG chr11 5345481 5345500 5345484 -
ttgttcaaacagaaatctag

SEQ ID NO: 35141 - DNA, 20 bp, Artificial Sequence
  Synthetic oligonucleotide; CAG chr11 5345436 5345455 5345439 -
cactcccatttttaatatat

SEQ ID NO: 35142 - DNA, 20 bp, Artificial Sequence
  Synthetic oligonucleotide; TGG chr11 5345426 5345445 5345429 -
tttaatatatcagcaaatct

SEQ ID NO: 35143 - DNA, 20 bp, Artificial Sequence
  Synthetic oligonucleotide; AAG chr11 5345392 5345411 5345395 -
aaatgcatctgtctctgttt

SEQ ID NO: 35144 - DNA, 20 bp, Artificial Sequence
  Synthetic oligonucleotide; TAG chr11 5345346 5345365 5345349 -
catttcccctgcttctctcc

SEQ ID NO: 35145 - DNA, 20 bp, Artificial Sequence
  Synthetic oligonucleotide; AAG chr11 5345341 5345360 5345344 -
cccctgcttctctcctagtc

SEQ ID NO: 35146 - DNA, 20 bp, Artificial Sequence
  Synthetic oligonucleotide; AGG chr11 5345340 5345359 5345343 -
ccctgcttctctcctagtca

SEQ ID NO: 35147 - DNA, 20 bp, Artificial Sequence
  Synthetic oligonucleotide; TGG chr11 5345319 5345338 5345322 -
ggtcaccatgactcttcata

SEQ ID NO: 35148 - DNA, 20 bp, Artificial Sequence
  Synthetic oligonucleotide; TAG chr11 5345306 5345325 5345309 -
cttcatatggatttttaaaa

SEQ ID NO: 35149 - DNA, 20 bp, Artificial Sequence
  Synthetic oligonucleotide; TAG chr11 5345270 5345289 5345273 -
ctcttttcttgtctcttgct

SEQ ID NO: 35150 - DNA, 20 bp, Artificial Sequence
  Synthetic oligonucleotide; TAG chr11 5345256 5345275 5345259 -
cttgcttagtcttcttcaca

SEQ ID NO: 35151 - DNA, 20 bp, Artificial Sequence
  Synthetic oligonucleotide; CAG chr11 5345253 5345272 5345256 -
gcttagtcttcttcacatag

SEQ ID NO: 35152 - DNA, 20 bp, Artificial Sequence
  Synthetic oligonucleotide; AAG chr11 5345247 5345266 5345250 -
tcttcttcacatagcagtct

SEQ ID NO: 35153 - DNA, 20 bp, Artificial Sequence
  Synthetic oligonucleotide; GAG chr11 5345243 5345262 5345246 -
cttcacatagcagtctaagt

SEQ ID NO: 35154 - DNA, 20 bp, Artificial Sequence
  Synthetic oligonucleotide; CAG chr11 5345222 5345241 5345225 -
agtaatttaaaaatacaaat

SEQ ID NO: 35155 - DNA, 20 bp, Artificial Sequence
  Synthetic oligonucleotide; AAG chr11 5345183 5345202 5345186 -
attttccattgtgattttca

SEQ ID NO: 35156 - DNA, 20 bp, Artificial Sequence
  Synthetic oligonucleotide; TAG chr11 5345155 5345174 5345158 -
taatgtctttactacattta

SEQ ID NO: 35157 - DNA, 20 bp, Artificial Sequence
  Synthetic oligonucleotide; AAG chr11 5345151 5345170 5345154 -
gtctttactacatttatagt

SEQ ID NO: 35158 - DNA, 20 bp, Artificial Sequence
  Synthetic oligonucleotide; AAG chr11 5345148 5345167 5345151 -
tttactacatttatagtaag

SEQ ID NO: 35159 - DNA, 20 bp, Artificial Sequence
  Synthetic oligonucleotide; TGG chr11 5345120 5345139 5345123 -
aaaacaaaacaaaaattccg

SEQ ID NO: 35160 - DNA, 20 bp, Artificial Sequence
  Synthetic oligonucleotide; TGG chr11 5345117 5345136 5345120 -
acaaaacaaaaattccgtgg

SEQ ID NO: 35161 - DNA, 20 bp, Artificial Sequence
  Synthetic oligonucleotide; AAG chr11 5345109 5345128 5345112 -
aaaattccgtggtggtctgt

SEQ ID NO: 35162 - DNA, 20 bp, Artificial Sequence
  Synthetic oligonucleotide; AGG chr11 5345108 5345127 5345111 -
aaattccgtggtggtctgta

SEQ ID NO: 35163 - DNA, 20 bp, Artificial Sequence
  Synthetic oligonucleotide; CAG chr11 5345032 5345051 5345035 -
cctgttttcttatcaaatgc

SEQ ID NO: 35164 - DNA, 20 bp, Artificial Sequence
  Synthetic oligonucleotide; TGG chr11 5345011 5345030 5345014 -
agtcatgctgattttccctc

SEQ ID NO: 35165 - DNA, 20 bp, Artificial Sequence
  Synthetic oligonucleotide; CAG chr11 5345006 5345025 5345009 -
tgctgattttccctctggaa

SEQ ID NO: 35166 - DNA, 20 bp, Artificial Sequence
  Synthetic oligonucleotide; TAG chr11 5344995 5345014 5344998 -
cctctggaacagttttcctc

SEQ ID NO: 35167 - DNA, 20 bp, Artificial Sequence
  Synthetic oligonucleotide; AGG chr11 5344994 5345013 5344997 -
ctctggaacagttttcctct

SEQ ID NO: 35168 - DNA, 20 bp, Artificial Sequence
  Synthetic oligonucleotide; CGG chr11 5344983 5345002 5344986 -
ttttcctctaggtctgtata

SEQ ID NO: 35169 - DNA, 20 bp, Artificial Sequence
  Synthetic oligonucleotide; CAG chr11 5344979 5344998 5344982 -
cctctaggtctgtatacggt

SEQ ID NO: 35170 - DNA, 20 bp, Artificial Sequence
  Synthetic oligonucleotide; AGG chr11 5344978 5344997 5344981 -
ctctaggtctgtatacggtc

SEQ ID NO: 35171 - DNA, 20 bp, Artificial Sequence
  Synthetic oligonucleotide; GAG chr11 5344961 5344980 5344964 -
gtcaggttttcttttgtatt

SEQ ID NO: 35172 - DNA, 20 bp, Artificial Sequence
  Synthetic oligonucleotide; AGG chr11 5344960 5344979 5344963 -
tcaggttttcttttgtattg

SEQ ID NO: 35173 - DNA, 20 bp, Artificial Sequence
  Synthetic oligonucleotide; CAG chr11 5344954 5344973 5344957 -
tttcttttgtattgaggtct

SEQ ID NO: 35174 - DNA, 20 bp, Artificial Sequence
  Synthetic oligonucleotide; TGG chr11 5344945 5344964 5344948 -
tattgaggtctcagttcaaa

SEQ ID NO: 35175 - DNA, 20 bp, Artificial Sequence
  Synthetic oligonucleotide; GGG chr11 5344944 5344963 5344947 -
attgaggtctcagttcaaat

SEQ ID NO: 35176 - DNA, 20 bp, Artificial Sequence
  Synthetic oligonucleotide; TAG chr11 5344932 5344951 5344935 -
gttcaaatgggacctcctca

SEQ ID NO: 35177 - DNA, 20 bp, Artificial Sequence
  Synthetic oligonucleotide; AGG chr11 5344931 5344950 5344934 -
ttcaaatgggacctcctcat

SEQ ID NO: 35178 - DNA, 20 bp, Artificial Sequence
  Synthetic oligonucleotide; CAG chr11 5344926 5344945 5344929 -
atgggacctcctcataggtg

SEQ ID NO: 35179 - DNA, 20 bp, Artificial Sequence
  Synthetic oligonucleotide; TAG chr11 5344920 5344939 5344923 -
cctcctcataggtgcagttc

SEQ ID NO: 35180 - DNA, 20 bp, Artificial Sequence
  Synthetic oligonucleotide; AGG chr11 5344919 5344938 5344922 -
ctcctcataggtgcagttct

SEQ ID NO: 35181 - DNA, 20 bp, Artificial Sequence
  Synthetic oligonucleotide; AAG chr11 5344862 5344881 5344865 -
ccatccaattaatctacatc

SEQ ID NO: 35182 - DNA, 20 bp, Artificial Sequence
  Synthetic oligonucleotide; TAG chr11 5344859 5344878 5344862 -
tccaattaatctacatcaag

SEQ ID NO: 35183 - DNA, 20 bp, Artificial Sequence
  Synthetic oligonucleotide; TGG chr11 5344787 5344806 5344790 -
ttatttttcaacttaattta

SEQ ID NO: 35184 - DNA, 20 bp, Artificial Sequence
  Synthetic oligonucleotide; AAG chr11 5344779 5344798 5344782 -
caacttaatttatggtttat

SEQ ID NO: 35185 - DNA, 20 bp, Artificial Sequence
  Synthetic oligonucleotide; TAG chr11 5344774 5344793 5344777 -
taatttatggtttataagat

SEQ ID NO: 35186 - DNA, 20 bp, Artificial Sequence
  Synthetic oligonucleotide; AGG chr11 5344773 5344792 5344776 -
aatttatggtttataagatt

SEQ ID NO: 35187 - DNA, 20 bp, Artificial Sequence
  Synthetic oligonucleotide; GGG chr11 5344772 5344791 5344775 -
atttatggtttataagatta

SEQ ID NO: 35188 - DNA, 20 bp, Artificial Sequence
  Synthetic oligonucleotide; CAG chr11 5344744 5344763 5344747 -
gtcttattaccatttaattc

SEQ ID NO: 35189 - DNA, 20 bp, Artificial Sequence
  Synthetic oligonucleotide; GAG chr11 5344742 5344761 5344745 -
cttattaccatttaattcca

SEQ ID NO: 35190 - DNA, 20 bp, Artificial Sequence
  Synthetic oligonucleotide; GAG chr11 5344740 5344759 5344743 -
tattaccatttaattccaga

SEQ ID NO: 35191 - DNA, 20 bp, Artificial Sequence
  Synthetic oligonucleotide; TGG chr11 5344725 5344744 5344728 -
ccagagagctttaaatatca

SEQ ID NO: 35192 - DNA, 20 bp, Artificial Sequence
  Synthetic oligonucleotide; TAG chr11 5344694 5344713 5344697 -
tgatgcgtgttcacaaatat

SEQ ID NO: 35193 - DNA, 20 bp, Artificial Sequence
  Synthetic oligonucleotide; AGG chr11 5344693 5344712 5344696 -
gatgcgtgttcacaaatatt

SEQ ID NO: 35194 - DNA, 20 bp, Artificial Sequence
  Synthetic oligonucleotide; AAG chr11 5344684 5344703 5344687 -
tcacaaatattaggtgaact

SEQ ID NO: 35195 - DNA, 20 bp, Artificial Sequence
  Synthetic oligonucleotide; CAG chr11 5344671 5344690 5344674 -
gtgaactaagaaatgtttat

SEQ ID NO: 35196 - DNA, 20 bp, Artificial Sequence
  Synthetic oligonucleotide; TAG chr11 5344660 5344679 5344663 -
aatgtttatcagtcacatgt

SEQ ID NO: 35197 - DNA, 20 bp, Artificial Sequence
  Synthetic oligonucleotide; AAG chr11 5344648 5344667 5344651 -
tcacatgttagatactttgc

SEQ ID NO: 35198 - DNA, 20 bp, Artificial Sequence
  Synthetic oligonucleotide; AGG chr11 5344647 5344666 5344650 -
cacatgttagatactttgca

SEQ ID NO: 35199 - DNA, 20 bp, Artificial Sequence
  Synthetic oligonucleotide; GAG chr11 5344640 5344659 5344643 -
tagatactttgcaaggtgtt

SEQ ID NO: 35200 - DNA, 20 bp, Artificial Sequence
  Synthetic oligonucleotide; AAG chr11 5344635 5344654 5344638 -
actttgcaaggtgttgagca

SEQ ID NO: 35201 - DNA, 20 bp, Artificial Sequence
  Synthetic oligonucleotide; AAG chr11 5344608 5344627 5344611 -
taaacaccatgtctatatgc

SEQ ID NO: 35202 - DNA, 20 bp, Artificial Sequence
  Synthetic oligonucleotide; AAG chr11 5344605 5344624 5344608 -
acaccatgtctatatgcaag

SEQ ID NO: 35203 - DNA, 20 bp, Artificial Sequence
  Synthetic oligonucleotide; TAG chr11 5344598 5344617 5344601 -
gtctatatgcaagaagcccc

SEQ ID NO: 35204 - DNA, 20 bp, Artificial Sequence
  Synthetic oligonucleotide; TAG chr11 5344593 5344612 5344596 -
tatgcaagaagcccctagtc

SEQ ID NO: 35205 - DNA, 20 bp, Artificial Sequence
  Synthetic oligonucleotide; TGG chr11 5344590 5344609 5344593 -
gcaagaagcccctagtctag

SEQ ID NO: 35206 - DNA, 20 bp, Artificial Sequence
  Synthetic oligonucleotide; CAG chr11 5344587 5344606 5344590 -
agaagcccctagtctagtgg

SEQ ID NO: 35207 - DNA, 20 bp, Artificial Sequence
  Synthetic oligonucleotide; AAG chr11 5344584 5344603 5344587 -
agcccctagtctagtggcag

SEQ ID NO: 35208 - DNA, 20 bp, Artificial Sequence
  Synthetic oligonucleotide; AGG chr11 5344583 5344602 5344586 -
gcccctagtctagtggcaga

SEQ ID NO: 35209 - DNA, 20 bp, Artificial Sequence
  Synthetic oligonucleotide; AAG chr11 5344562 5344581 5344565 -
ggaatattaaaaccttctca

SEQ ID NO: 35210 - DNA, 20 bp, Artificial Sequence
  Synthetic oligonucleotide; AGG chr11 5344561 5344580 5344564 -
gaatattaaaaccttctcaa

SEQ ID NO: 35211 - DNA, 20 bp, Artificial Sequence
  Synthetic oligonucleotide; CAG chr11 5344542 5344561 5344545 -
aaggactaatctcttctctt

SEQ ID NO: 35212 - DNA, 20 bp, Artificial Sequence
  Synthetic oligonucleotide; AAG chr11 5344536 5344555 5344539 -
taatctcttctcttcagtaa

SEQ ID NO: 35213 - DNA, 20 bp, Artificial Sequence
  Synthetic oligonucleotide; CAG chr11 5344532 5344551 5344535 -
ctcttctcttcagtaaaaga

SEQ ID NO: 35214 - DNA, 20 bp, Artificial Sequence
  Synthetic oligonucleotide; AAG chr11 5344519 5344538 5344522 -
taaaagacagcaccacgttt

SEQ ID NO: 35215 - DNA, 20 bp, Artificial Sequence
  Synthetic oligonucleotide; CAG chr11 5344516 5344535 5344519 -
aagacagcaccacgtttaag

SEQ ID NO: 35216 - DNA, 20 bp, Artificial Sequence
  Synthetic oligonucleotide; AGG chr11 5344515 5344534 5344518 -
agacagcaccacgtttaagc

SEQ ID NO: 35217 - DNA, 20 bp, Artificial Sequence
  Synthetic oligonucleotide; GGG chr11 5344514 5344533 5344517 -
gacagcaccacgtttaagca

SEQ ID NO: 35218 - DNA, 20 bp, Artificial Sequence
  Synthetic oligonucleotide; TAG chr11 5344508 5344527 5344511 -
accacgtttaagcagggaaa

SEQ ID NO: 35219 - DNA, 20 bp, Artificial Sequence
  Synthetic oligonucleotide; CAG chr11 5344497 5344516 5344500 -
gcagggaaatagctctcact

SEQ ID NO: 35220 - DNA, 20 bp, Artificial Sequence
  Synthetic oligonucleotide; TGG chr11 5344491 5344510 5344494 -
aaatagctctcactcagtat

SEQ ID NO: 35221 - DNA, 20 bp, Artificial Sequence
  Synthetic oligonucleotide; GGG chr11 5344490 5344509 5344493 -
aatagctctcactcagtatt

SEQ ID NO: 35222 - DNA, 20 bp, Artificial Sequence
  Synthetic oligonucleotide; GGG chr11 5344489 5344508 5344492 -
atagctctcactcagtattg

SEQ ID NO: 35223 - DNA, 20 bp, Artificial Sequence
  Synthetic oligonucleotide; GAG chr11 5344487 5344506 5344490 -
agctctcactcagtattggg

SEQ ID NO: 35224 - DNA, 20 bp, Artificial Sequence
  Synthetic oligonucleotide; CAG chr11 5344482 5344501 5344485 -
tcactcagtattggggagaa

SEQ ID NO: 35225 - DNA, 20 bp, Artificial Sequence
  Synthetic oligonucleotide; CAG chr11 5344476 5344495 5344479 -
agtattggggagaacagatt

SEQ ID NO: 35226 - DNA, 20 bp, Artificial Sequence
  Synthetic oligonucleotide; AAG chr11 5344473 5344492 5344476 -
attggggagaacagattcag

SEQ ID NO: 35227 - DNA, 20 bp, Artificial Sequence
  Synthetic oligonucleotide; TGG chr11 5344466 5344485 5344469 -
agaacagattcagaagccta

SEQ ID NO: 35228 - DNA, 20 bp, Artificial Sequence
  Synthetic oligonucleotide; TGG chr11 5344462 5344481 5344465 -
cagattcagaagcctatggc

SEQ ID NO: 35229 - DNA, 20 bp, Artificial Sequence
  Synthetic oligonucleotide; GGG chr11 5344461 5344480 5344464 -
agattcagaagcctatggct

SEQ ID NO: 35230 - DNA, 20 bp, Artificial Sequence
  Synthetic oligonucleotide; GGG chr11 5344460 5344479 5344463 -
gattcagaagcctatggctg

SEQ ID NO: 35231 - DNA, 20 bp, Artificial Sequence
  Synthetic oligonucleotide; AAG chr11 5344454 5344473 5344457 -
gaagcctatggctggggata

SEQ ID NO: 35232 - DNA, 20 bp, Artificial Sequence
  Synthetic oligonucleotide; AGG chr11 5344453 5344472 5344456 -
aagcctatggctggggataa

SEQ ID NO: 35233 - DNA, 20 bp, Artificial Sequence
  Synthetic oligonucleotide; GGG chr11 5344452 5344471 5344455 -
agcctatggctggggataaa

SEQ ID NO: 35234 - DNA, 20 bp, Artificial Sequence
  Synthetic oligonucleotide; AAG chr11 5344449 5344468 5344452 -
ctatggctggggataaaggg

SEQ ID NO: 35235 - DNA, 20 bp, Artificial Sequence
  Synthetic oligonucleotide; AGG chr11 5344448 5344467 5344451 -
tatggctggggataaaggga

SEQ ID NO: 35236 - DNA, 20 bp, Artificial Sequence
  Synthetic oligonucleotide; CAG chr11 5344441 5344460 5344444 -
ggggataaagggaaggaaac

SEQ ID NO: 35237 - DNA, 20 bp, Artificial Sequence
  Synthetic oligonucleotide; AGG chr11 5344440 5344459 5344443 -
gggataaagggaaggaaacc

SEQ ID NO: 35238 - DNA, 20 bp, Artificial Sequence
  Synthetic oligonucleotide; AAG chr11 5344437 5344456 5344440 -
ataaagggaaggaaaccagg

SEQ ID NO: 35239 - DNA, 20 bp, Artificial Sequence
  Synthetic oligonucleotide; TGG chr11 5344433 5344452 5344436 -
agggaaggaaaccaggaaga

SEQ ID NO: 35240 - DNA, 20 bp, Artificial Sequence
  Synthetic oligonucleotide; TGG chr11 5344415 5344434 5344418 -
gatggatgtttaaatataaa

SEQ ID NO: 35241 - DNA, 20 bp, Artificial Sequence
  Synthetic oligonucleotide; GAG chr11 5344413 5344432 5344416 -
tggatgtttaaatataaatg

SEQ ID NO: 35242 - DNA, 20 bp, Artificial Sequence
  Synthetic oligonucleotide; GAG chr11 5344400 5344419 5344403 -
ataaatggagaacttgaaat

SEQ ID NO: 35243 - DNA, 20 bp, Artificial Sequence
  Synthetic oligonucleotide; GAG chr11 5344398 5344417 5344401 -
aaatggagaacttgaaatga

SEQ ID NO: 35244 - DNA, 20 bp, Artificial Sequence
  Synthetic oligonucleotide; GAG chr11 5344396 5344415 5344399 -
atggagaacttgaaatgaga

SEQ ID NO: 35245 - DNA, 20 bp, Artificial Sequence
  Synthetic oligonucleotide; AGG chr11 5344395 5344414 5344398 -
tggagaacttgaaatgagag

SEQ ID NO: 35246 - DNA, 20 bp, Artificial Sequence
  Synthetic oligonucleotide; CAG chr11 5344391 5344410 5344394 -
gaacttgaaatgagagaggt

SEQ ID NO: 35247 - DNA, 20 bp, Artificial Sequence
  Synthetic oligonucleotide; TAG chr11 5344384 5344403 5344387 -
aaatgagagaggtcagattc

SEQ ID NO: 35248 - DNA, 20 bp, Artificial Sequence
  Synthetic oligonucleotide; AGG chr11 5344383 5344402 5344386 -
aatgagagaggtcagattct

SEQ ID NO: 35249 - DNA, 20 bp, Artificial Sequence
  Synthetic oligonucleotide; GGG chr11 5344382 5344401 5344385 -
atgagagaggtcagattcta

SEQ ID NO: 35250 - DNA, 20 bp, Artificial Sequence
  Synthetic oligonucleotide; CAG chr11 5344371 5344390 5344374 -
cagattctagggaattactt

SEQ ID NO: 35251 - DNA, 20 bp, Artificial Sequence
  Synthetic oligonucleotide; TAG chr11 5344368 5344387 5344371 -
attctagggaattacttcag

SEQ ID NO: 35252 - DNA, 20 bp, Artificial Sequence
  Synthetic oligonucleotide; AGG chr11 5344367 5344386 5344370 -
ttctagggaattacttcagt

SEQ ID NO: 35253 - DNA, 20 bp, Artificial Sequence
  Synthetic oligonucleotide; TAG chr11 5344360 5344379 5344363 -
gaattacttcagtaggccta

SEQ ID NO: 35254 - DNA, 20 bp, Artificial Sequence
  Synthetic oligonucleotide; AAG chr11 5344343 5344362 5344346 -
ctatagaaaaataatttaaa

SEQ ID NO: 35255 - DNA, 20 bp, Artificial Sequence
  Synthetic oligonucleotide; AAG chr11 5344337 5344356 5344340 -
aaaaataatttaaaaagaaa

SEQ ID NO: 35256 - DNA, 20 bp, Artificial Sequence
  Synthetic oligonucleotide; AAG chr11 5344319 5344338 5344322 -
aaaagacactacttgtaaat

SEQ ID NO: 35257 - DNA, 20 bp, Artificial Sequence
  Synthetic oligonucleotide; CAG chr11 5344313 5344332 5344316 -
cactacttgtaaataagaaa

SEQ ID NO: 35258 - DNA, 20 bp, Artificial Sequence
  Synthetic oligonucleotide; AAG chr11 5344309 5344328 5344312 -
acttgtaaataagaaacagt

SEQ ID NO: 35259 - DNA, 20 bp, Artificial Sequence
  Synthetic oligonucleotide; AAG chr11 5344294 5344313 5344297 -
acagtaagatgtttaaactg

SEQ ID NO: 35260 - DNA, 20 bp, Artificial Sequence
  Synthetic oligonucleotide; AGG chr11 5344293 5344312 5344296 -
cagtaagatgtttaaactga

SEQ ID NO: 35261 - DNA, 20 bp, Artificial Sequence
  Synthetic oligonucleotide; GAG chr11 5344291 5344310 5344294 -
gtaagatgtttaaactgaag

SEQ ID NO: 35262 - DNA, 20 bp, Artificial Sequence
  Synthetic oligonucleotide; AAG chr11 5344276 5344295 5344279 -
tgaaggagatacactattat

SEQ ID NO: 35263 - DNA, 20 bp, Artificial Sequence
  Synthetic oligonucleotide; TGG chr11 5344264 5344283 5344267 -
actattataagtgatgtctt

SEQ ID NO: 35264 - DNA, 20 bp, Artificial Sequence
  Synthetic oligonucleotide; TGG chr11 5344260 5344279 5344263 -
ttataagtgatgtctttggc

SEQ ID NO: 35265 - DNA, 20 bp, Artificial Sequence
  Synthetic oligonucleotide; CAG chr11 5344242 5344261 5344245 -
gctggcctaatcatttattc

SEQ ID NO: 35266 - DNA, 20 bp, Artificial Sequence
  Synthetic oligonucleotide; AAG chr11 5344234 5344253 5344237 -
aatcatttattccagcccca

SEQ ID NO: 35267 - DNA, 20 bp, Artificial Sequence
  Synthetic oligonucleotide; TAG chr11 5344218 5344237 5344221 -
cccaaagtctaacttataat

SEQ ID NO: 35268 - DNA, 20 bp, Artificial Sequence
  Synthetic oligonucleotide; GAG chr11 5344212 5344231 5344215 -
gtctaacttataattagact

SEQ ID NO: 35269 - DNA, 20 bp, Artificial Sequence
  Synthetic oligonucleotide; AAG chr11 5344199 5344218 5344202 -
ttagactgagctattgtcac

SEQ ID NO: 35270 - DNA, 20 bp, Artificial Sequence
  Synthetic oligonucleotide; TAG chr11 5344196 5344215 5344199 -
gactgagctattgtcacaag

SEQ ID NO: 35271 - DNA, 20 bp, Artificial Sequence
  Synthetic oligonucleotide; GAG chr11 5344192 5344211 5344195 -
gagctattgtcacaagtagt

SEQ ID NO: 35272 - DNA, 20 bp, Artificial Sequence
  Synthetic oligonucleotide; TAG chr11 5344189 5344208 5344192 -
ctattgtcacaagtagtgag

SEQ ID NO: 35273 - DNA, 20 bp, Artificial Sequence
  Synthetic oligonucleotide; AAG chr11 5344181 5344200 5344184 -
acaagtagtgagtagtactg

SEQ ID NO: 35274 - DNA, 20 bp, Artificial Sequence
  Synthetic oligonucleotide; AGG chr11 5344180 5344199 5344183 -
caagtagtgagtagtactga

SEQ ID NO: 35275 - DNA, 20 bp, Artificial Sequence
  Synthetic oligonucleotide; AAG chr11 5344170 5344189 5344173 -
gtagtactgaaggattctac

SEQ ID NO: 35276 - DNA, 20 bp, Artificial Sequence
  Synthetic oligonucleotide; GAG chr11 5344168 5344187 5344171 -
agtactgaaggattctacaa

SEQ ID NO: 35277 - DNA, 20 bp, Artificial Sequence
  Synthetic oligonucleotide; AGG chr11 5344167 5344186 5344170 -
gtactgaaggattctacaag

SEQ ID NO: 35278 - DNA, 20 bp, Artificial Sequence
  Synthetic oligonucleotide; GGG chr11 5344166 5344185 5344169 -
tactgaaggattctacaaga

SEQ ID NO: 35279 - DNA, 20 bp, Artificial Sequence
  Synthetic oligonucleotide; TAG chr11 5344126 5344145 5344129 -
gaatgtctgttccccatcac

SEQ ID NO: 35280 - DNA, 20 bp, Artificial Sequence
  Synthetic oligonucleotide; TGG chr11 5344112 5344131 5344115 -
catcactagtccatgaaatc

SEQ ID NO: 35281 - DNA, 20 bp, Artificial Sequence
  Synthetic oligonucleotide; GAG chr11 5344110 5344129 5344113 -
tcactagtccatgaaatctg

SEQ ID NO: 35282 - DNA, 20 bp, Artificial Sequence
  Synthetic oligonucleotide; AGG chr11 5344109 5344128 5344112 -
cactagtccatgaaatctgg

SEQ ID NO: 35283 - DNA, 20 bp, Artificial Sequence
  Synthetic oligonucleotide; AAG chr11 5344104 5344123 5344107 -
gtccatgaaatctggaggcc

SEQ ID NO: 35284 - DNA, 20 bp, Artificial Sequence
  Synthetic oligonucleotide; TAG chr11 5344074 5344093 5344077 -
ttctcaatctgactgctcct

SEQ ID NO: 35285 - DNA, 20 bp, Artificial Sequence
  Synthetic oligonucleotide; CAG chr11 5344068 5344087 5344071 -
atctgactgctccttagcta

SEQ ID NO: 35286 - DNA, 20 bp, Artificial Sequence
  Synthetic oligonucleotide; TGG chr11 5344065 5344084 5344068 -
tgactgctccttagctacag

SEQ ID NO: 35287 - DNA, 20 bp, Artificial Sequence
  Synthetic oligonucleotide; TAG chr11 5344062 5344081 5344065 -
ctgctccttagctacagtgg

SEQ ID NO: 35288 - DNA, 20 bp, Artificial Sequence
  Synthetic oligonucleotide; TGG chr11 5344059 5344078 5344062 -
ctccttagctacagtggtag

SEQ ID NO: 35289 - DNA, 20 bp, Artificial Sequence
  Synthetic oligonucleotide; CAG chr11 5344056 5344075 5344059 -
cttagctacagtggtagtgg

SEQ ID NO: 35290 - DNA, 20 bp, Artificial Sequence
  Synthetic oligonucleotide; GAG chr11 5344054 5344073 5344057 -
tagctacagtggtagtggca

SEQ ID NO: 35291 - DNA, 20 bp, Artificial Sequence
  Synthetic oligonucleotide; TAG chr11 5344026 5344045 5344029 -
cttcccacacttttctttct

SEQ ID NO: 35292 - DNA, 20 bp, Artificial Sequence
  Synthetic oligonucleotide; AGG chr11 5344025 5344044 5344028 -
ttcccacacttttctttctt

SEQ ID NO: 35293 - DNA, 20 bp, Artificial Sequence
  Synthetic oligonucleotide; GAG chr11 5344017 5344036 5344020 -
cttttctttcttaggctgtt

SEQ ID NO: 35294 - DNA, 20 bp, Artificial Sequence
  Synthetic oligonucleotide; TAG chr11 5344010 5344029 5344013 -
ttcttaggctgttgagactt

SEQ ID NO: 35295 - DNA, 20 bp, Artificial Sequence
  Synthetic oligonucleotide; CAG chr11 5343998 5344017 5344001 -
tgagactttagctgataatt

SEQ ID NO: 35296 - DNA, 20 bp, Artificial Sequence
  Synthetic oligonucleotide; AGG chr11 5343997 5344016 5344000 -
gagactttagctgataattc

SEQ ID NO: 35297 - DNA, 20 bp, Artificial Sequence
  Synthetic oligonucleotide; AAG chr11 5343993 5344012 5343996 -
ctttagctgataattcaggt

SEQ ID NO: 35298 - DNA, 20 bp, Artificial Sequence
  Synthetic oligonucleotide; CAG chr11 5343980 5343999 5343983 -
ttcaggtaagtctttacatg

SEQ ID NO: 35299 - DNA, 20 bp, Artificial Sequence
  Synthetic oligonucleotide; AGG chr11 5343979 5343998 5343982 -
tcaggtaagtctttacatgc

SEQ ID NO: 35300 - DNA, 20 bp, Artificial Sequence
  Synthetic oligonucleotide; TGG chr11 5343970 5343989 5343973 -
tctttacatgcaggaaaatg

SEQ ID NO: 35301 - DNA, 20 bp, Artificial Sequence
  Synthetic oligonucleotide; TAG chr11 5343965 5343984 5343968 -
acatgcaggaaaatgtggat

SEQ ID NO: 35302 - DNA, 20 bp, Artificial Sequence
  Synthetic oligonucleotide; AGG chr11 5343964 5343983 5343967 -
catgcaggaaaatgtggatt

SEQ ID NO: 35303 - DNA, 20 bp, Artificial Sequence
  Synthetic oligonucleotide; GGG chr11 5343963 5343982 5343966 -
atgcaggaaaatgtggatta

SEQ ID NO: 35304 - DNA, 20 bp, Artificial Sequence
  Synthetic oligonucleotide; AAG chr11 5343948 5343967 5343951 -
gattagggatcactactgtg

SEQ ID NO: 35305 - DNA, 20 bp, Artificial Sequence
  Synthetic oligonucleotide; AGG chr11 5343947 5343966 5343950 -
attagggatcactactgtga

SEQ ID NO: 35306 - DNA, 20 bp, Artificial Sequence
  Synthetic oligonucleotide; CAG chr11 5343938 5343957 5343941 -
cactactgtgaaggcaatta

SEQ ID NO: 35307 - DNA, 20 bp, Artificial Sequence
  Synthetic oligonucleotide; AGG chr11 5343937 5343956 5343940 -
actactgtgaaggcaattac

SEQ ID NO: 35308 - DNA, 20 bp, Artificial Sequence
  Synthetic oligonucleotide; TAG chr11 5343932 5343951 5343935 -
tgtgaaggcaattacaggtt

SEQ ID NO: 35309 - DNA, 20 bp, Artificial Sequence
  Synthetic oligonucleotide; AGG chr11 5343931 5343950 5343934 -
gtgaaggcaattacaggttt

SEQ ID NO: 35310 - DNA, 20 bp, Artificial Sequence
  Synthetic oligonucleotide; TGG chr11 5343928 5343947 5343931 -
aaggcaattacaggtttagg

SEQ ID NO: 35311 - DNA, 20 bp, Artificial Sequence
  Synthetic oligonucleotide; TAG chr11 5343925 5343944 5343928 -
gcaattacaggtttaggtgg

SEQ ID NO: 35312 - DNA, 20 bp, Artificial Sequence
  Synthetic oligonucleotide; CAG chr11 5343920 5343939 5343923 -
tacaggtttaggtggtagac

SEQ ID NO: 35313 - DNA, 20 bp, Artificial Sequence
  Synthetic oligonucleotide; TAG chr11 5343909 5343928 5343912 -
gtggtagaccagaaaaaaat

SEQ ID NO: 35314 - DNA, 20 bp, Artificial Sequence
  Synthetic oligonucleotide; TAG chr11 5343903 5343922 5343906 -
gaccagaaaaaaattagtgt

SEQ ID NO: 35315 - DNA, 20 bp, Artificial Sequence
  Synthetic oligonucleotide; TGG chr11 5343895 5343914 5343898 -
aaaaattagtgttagctttc

SEQ ID NO: 35316 - DNA, 20 bp, Artificial Sequence
  Synthetic oligonucleotide; TAG chr11 5343872 5343891 5343875 -
aaatccccttgaatgcccca

SEQ ID NO: 35317 - DNA, 20 bp, Artificial Sequence
  Synthetic oligonucleotide; TAG chr11 5343845 5343864 5343848 -
cgaattctttaaaatctgca

SEQ ID NO: 35318 - DNA, 20 bp, Artificial Sequence
  Synthetic oligonucleotide; AAG chr11 5343840 5343859 5343843 -
tctttaaaatctgcatagtt

SEQ ID NO: 35319 - DNA, 20 bp, Artificial Sequence
  Synthetic oligonucleotide; AGG chr11 5343839 5343858 5343842 -
ctttaaaatctgcatagtta

SEQ ID NO: 35320 - DNA, 20 bp, Artificial Sequence
  Synthetic oligonucleotide; GGG chr11 5343838 5343857 5343841 -
tttaaaatctgcatagttaa

SEQ ID NO: 35321 - DNA, 20 bp, Artificial Sequence
  Synthetic oligonucleotide; CAG chr11 5343832 5343851 5343835 -
atctgcatagttaagggtaa

SEQ ID NO: 35322 - DNA, 20 bp, Artificial Sequence
  Synthetic oligonucleotide; TAG chr11 5343827 5343846 5343830 -
catagttaagggtaacagtt

SEQ ID NO: 35323 - DNA, 20 bp, Artificial Sequence
  Synthetic oligonucleotide; AAG chr11 5343824 5343843 5343827 -
agttaagggtaacagtttag

SEQ ID NO: 35324 - DNA, 20 bp, Artificial Sequence
  Synthetic oligonucleotide; TAG chr11 5343818 5343837 5343821 -
gggtaacagtttagaagttg

SEQ ID NO: 35325 - DNA, 20 bp, Artificial Sequence
  Synthetic oligonucleotide; AAG chr11 5343795 5343814 5343798 -
tttacataattttttttctg

SEQ ID NO: 35326 - DNA, 20 bp, Artificial Sequence
  Synthetic oligonucleotide; GAG chr11 5343793 5343812 5343796 -
tacataattttttttctgaa

SEQ ID NO: 35327 - DNA, 20 bp, Artificial Sequence
  Synthetic oligonucleotide; CAG chr11 5343770 5343789 5343773 -
aatgcttaaatgcatataaa

SEQ ID NO: 35328 - DNA, 20 bp, Artificial Sequence
  Synthetic oligonucleotide; AAG chr11 5343757 5343776 5343760 -
atataaacagttgaaactcc

SEQ ID NO: 35329 - DNA, 20 bp, Artificial Sequence
  Synthetic oligonucleotide; TAG chr11 5343742 5343761 5343745 -
actccaagaatttgattacg

SEQ ID NO: 35330 - DNA, 20 bp, Artificial Sequence
  Synthetic oligonucleotide; AGG chr11 5343741 5343760 5343744 -
ctccaagaatttgattacgt

SEQ ID NO: 35331 - DNA, 20 bp, Artificial Sequence
  Synthetic oligonucleotide; TAG chr11 5343738 5343757 5343741 -
caagaatttgattacgtagg

SEQ ID NO: 35332 - DNA, 20 bp, Artificial Sequence
  Synthetic oligonucleotide; AGG chr11 5343737 5343756 5343740 -
aagaatttgattacgtaggt

SEQ ID NO: 35333 - DNA, 20 bp, Artificial Sequence
  Synthetic oligonucleotide; GAG chr11 5343735 5343754 5343738 -
gaatttgattacgtaggtag

SEQ ID NO: 35334 - DNA, 20 bp, Artificial Sequence
  Synthetic oligonucleotide; TAG chr11 5343731 5343750 5343734 -
ttgattacgtaggtaggaga

SEQ ID NO: 35335 - DNA, 20 bp, Artificial Sequence
  Synthetic oligonucleotide; TGG chr11 5343724 5343743 5343727 -
cgtaggtaggagatagatcc

SEQ ID NO: 35336 - DNA, 20 bp, Artificial Sequence
  Synthetic oligonucleotide; CAG chr11 5343715 5343734 5343718 -
gagatagatcctggaatgtg

SEQ ID NO: 35337 - DNA, 20 bp, Artificial Sequence
  Synthetic oligonucleotide; AAG chr11 5343710 5343729 5343713 -
agatcctggaatgtgcagtt

SEQ ID NO: 35338 - DNA, 20 bp, Artificial Sequence
  Synthetic oligonucleotide; TAG chr11 5343699 5343718 5343702 -
tgtgcagttaagaatacaaa

SEQ ID NO: 35339 - DNA, 20 bp, Artificial Sequence
  Synthetic oligonucleotide; GAG chr11 5343693 5343712 5343696 -
gttaagaatacaaatagtat

SEQ ID NO: 35340 - DNA, 20 bp, Artificial Sequence
  Synthetic oligonucleotide; GAG chr11 5343683 5343702 5343686 -
caaatagtatgagtaaccct

SEQ ID NO: 35341 - DNA, 20 bp, Artificial Sequence
  Synthetic oligonucleotide; GAG chr11 5343670 5343689 5343673 -
taaccctgagaatgtatttt

SEQ ID NO: 35342 - DNA, 20 bp, Artificial Sequence
  Synthetic oligonucleotide; TAG chr11 5343633 5343652 5343636 -
attgatgtcattattatctt

SEQ ID NO: 35343 - DNA, 20 bp, Artificial Sequence
  Synthetic oligonucleotide; AGG chr11 5343632 5343651 5343635 -
ttgatgtcattattatcttt

SEQ ID NO: 35344 - DNA, 20 bp, Artificial Sequence
  Synthetic oligonucleotide; GAG chr11 5343619 5343638 5343622 -
tatctttaggaaaaaattct

SEQ ID NO: 35345 - DNA, 20 bp, Artificial Sequence
  Synthetic oligonucleotide; TAG chr11 5343609 5343628 5343612 -
aaaaaattctgagaatgata

SEQ ID NO: 35346 - DNA, 20 bp, Artificial Sequence
  Synthetic oligonucleotide; AAG chr11 5343603 5343622 5343606 -
ttctgagaatgatatagtcg

SEQ ID NO: 35347 - DNA, 20 bp, Artificial Sequence
  Synthetic oligonucleotide; AAG chr11 5343590 5343609 5343593 -
atagtcgaagtgataccttg

SEQ ID NO: 35348 - DNA, 20 bp, Artificial Sequence
  Synthetic oligonucleotide; AGG chr11 5343589 5343608 5343592 -
tagtcgaagtgataccttga

SEQ ID NO: 35349 - DNA, 20 bp, Artificial Sequence
  Synthetic oligonucleotide; TAG chr11 5343586 5343605 5343589 -
tcgaagtgataccttgaagg

SEQ ID NO: 35350 - DNA, 20 bp, Artificial Sequence
  Synthetic oligonucleotide; TGG chr11 5343571 5343590 5343574 -
gaaggtagaactgtgcactg

SEQ ID NO: 35351 - DNA, 20 bp, Artificial Sequence
  Synthetic oligonucleotide; CAG chr11 5343562 5343581 5343565 -
actgtgcactgtggtaataa

SEQ ID NO: 35352 - DNA, 20 bp, Artificial Sequence
  Synthetic oligonucleotide; CAG chr11 5343556 5343575 5343559 -
cactgtggtaataacagaaa

SEQ ID NO: 35353 - DNA, 20 bp, Artificial Sequence
  Synthetic oligonucleotide; AAG chr11 5343552 5343571 5343555 -
gtggtaataacagaaacaga

SEQ ID NO: 35354 - DNA, 20 bp, Artificial Sequence
  Synthetic oligonucleotide; CAG chr11 5343529 5343548 5343532 -
acatttcttctatataaacc

SEQ ID NO: 35355 - DNA, 20 bp, Artificial Sequence
  Synthetic oligonucleotide; AGG chr11 5343528 5343547 5343531 -
catttcttctatataaaccc

SEQ ID NO: 35356 - DNA, 20 bp, Artificial Sequence
  Synthetic oligonucleotide; CAG chr11 5343517 5343536 5343520 -
tataaacccaggatgtcgtc

SEQ ID NO: 35357 - DNA, 20 bp, Artificial Sequence
  Synthetic oligonucleotide; CGG chr11 5343514 5343533 5343517 -
aaacccaggatgtcgtccag

SEQ ID NO: 35358 - DNA, 20 bp, Artificial Sequence
  Synthetic oligonucleotide; CAG chr11 5343511 5343530 5343514 -
cccaggatgtcgtccagcgg

SEQ ID NO: 35359 - DNA, 20 bp, Artificial Sequence
  Synthetic oligonucleotide; TGG chr11 5343487 5343506 5343490 -
tcccatcccttcctattgac

SEQ ID NO: 35360 - DNA, 20 bp, Artificial Sequence
  Synthetic oligonucleotide; CAG chr11 5343479 5343498 5343482 -
cttcctattgactggttttc

SEQ ID NO: 35361 - DNA, 20 bp, Artificial Sequence
  Synthetic oligonucleotide; AGG chr11 5343478 5343497 5343481 -
ttcctattgactggttttcc

SEQ ID NO: 35362 - DNA, 20 bp, Artificial Sequence
  Synthetic oligonucleotide; TGG chr11 5343473 5343492 5343476 -
attgactggttttccaggct

SEQ ID NO: 35363 - DNA, 20 bp, Artificial Sequence
  Synthetic oligonucleotide; GAG chr11 5343471 5343490 5343474 -
tgactggttttccaggcttg

SEQ ID NO: 35364 - DNA, 20 bp, Artificial Sequence
  Synthetic oligonucleotide; AGG chr11 5343470 5343489 5343473 -
gactggttttccaggcttgg

SEQ ID NO: 35365 - DNA, 20 bp, Artificial Sequence
  Synthetic oligonucleotide; AAG chr11 5343467 5343486 5343470 -
tggttttccaggcttggagg

SEQ ID NO: 35366 - DNA, 20 bp, Artificial Sequence
  Synthetic oligonucleotide; TGG chr11 5343456 5343475 5343459 -
gcttggaggaagctcatcac

SEQ ID NO: 35367 - DNA, 20 bp, Artificial Sequence
  Synthetic oligonucleotide; TGG chr11 5343412 5343431 5343415 -
atgtatatatccatcctttt

SEQ ID NO: 35368 - DNA, 20 bp, Artificial Sequence
  Synthetic oligonucleotide; TGG chr11 5343406 5343425 5343409 -
atatccatcctttttggcaa

SEQ ID NO: 35369 - DNA, 20 bp, Artificial Sequence
  Synthetic oligonucleotide; AAG chr11 5343384 5343403 5343387 -
gcaccctccttcttctcatt

SEQ ID NO: 35370 - DNA, 20 bp, Artificial Sequence
  Synthetic oligonucleotide; AGG chr11 5343383 5343402 5343386 -
caccctccttcttctcatta

SEQ ID NO: 35371 - DNA, 20 bp, Artificial Sequence
  Synthetic oligonucleotide; AAG chr11 5343380 5343399 5343383 -
cctccttcttctcattaagg

SEQ ID NO: 35372 - DNA, 20 bp, Artificial Sequence
  Synthetic oligonucleotide; GAG chr11 5343363 5343382 5343366 -
aggaagatcacaatcttcat

SEQ ID NO: 35373 - DNA, 20 bp, Artificial Sequence
  Synthetic oligonucleotide; TGG chr11 5343344 5343363 5343347 -
tgagcccatgtacttctttc

SEQ ID NO: 35374 - DNA, 20 bp, Artificial Sequence
  Synthetic oligonucleotide; TGG chr11 5343335 5343354 5343338 -
gtacttctttctggccatgc

SEQ ID NO: 35375 - DNA, 20 bp, Artificial Sequence
  Synthetic oligonucleotide; CAG chr11 5343326 5343345 5343329 -
tctggccatgctggctgcca

SEQ ID NO: 35376 - DNA, 20 bp, Artificial Sequence
  Synthetic oligonucleotide; TGG chr11 5343320 5343339 5343323 -
catgctggctgccacagacc

SEQ ID NO: 35377 - DNA, 20 bp, Artificial Sequence
  Synthetic oligonucleotide; GGG chr11 5343319 5343338 5343322 -
atgctggctgccacagacct

SEQ ID NO: 35378 - DNA, 20 bp, Artificial Sequence
  Synthetic oligonucleotide; GGG chr11 5343318 5343337 5343321 -
tgctggctgccacagacctg

SEQ ID NO: 35379 - DNA, 20 bp, Artificial Sequence
  Synthetic oligonucleotide; TGG chr11 5343314 5343333 5343317 -
ggctgccacagacctggggc

SEQ ID NO: 35380 - DNA, 20 bp, Artificial Sequence
  Synthetic oligonucleotide; CGG chr11 5343293 5343312 5343296 -
ggccctgaccacaatgccca

SEQ ID NO: 35381 - DNA, 20 bp, Artificial Sequence
  Synthetic oligonucleotide; TGG chr11 5343287 5343306 5343290 -
gaccacaatgcccacggtgc

SEQ ID NO: 35382 - DNA, 20 bp, Artificial Sequence
  Synthetic oligonucleotide; GGG chr11 5343286 5343305 5343289 -
accacaatgcccacggtgct

SEQ ID NO: 35383 - DNA, 20 bp, Artificial Sequence
  Synthetic oligonucleotide; GAG chr11 5343284 5343303 5343287 -
cacaatgcccacggtgctgg

SEQ ID NO: 35384 - DNA, 20 bp, Artificial Sequence
  Synthetic oligonucleotide; TGG chr11 5343276 5343295 5343279 -
ccacggtgctgggagtcctc

SEQ ID NO: 35385 - DNA, 20 bp, Artificial Sequence
  Synthetic oligonucleotide; TGG chr11 5343272 5343291 5343275 -
ggtgctgggagtcctctggc

SEQ ID NO: 35386 - DNA, 20 bp, Artificial Sequence
  Synthetic oligonucleotide; CAG chr11 5343265 5343284 5343268 -
ggagtcctctggctggatca

SEQ ID NO: 35387 - DNA, 20 bp, Artificial Sequence
  Synthetic oligonucleotide; AGG chr11 5343264 5343283 5343267 -
gagtcctctggctggatcac

SEQ ID NO: 35388 - DNA, 20 bp, Artificial Sequence
  Synthetic oligonucleotide; GGG chr11 5343263 5343282 5343266 -
agtcctctggctggatcaca

SEQ ID NO: 35389 - DNA, 20 bp, Artificial Sequence
  Synthetic oligonucleotide; GAG chr11 5343261 5343280 5343264 -
tcctctggctggatcacagg

SEQ ID NO: 35390 - DNA, 20 bp, Artificial Sequence
  Synthetic oligonucleotide; TGG chr11 5343256 5343275 5343259 -
tggctggatcacagggagat

SEQ ID NO: 35391 - DNA, 20 bp, Artificial Sequence
  Synthetic oligonucleotide; AAG chr11 5343253 5343272 5343256 -
ctggatcacagggagattgg

SEQ ID NO: 35392 - DNA, 20 bp, Artificial Sequence
  Synthetic oligonucleotide; CGG chr11 5343248 5343267 5343251 -
tcacagggagattggaagtg

SEQ ID NO: 35393 - DNA, 20 bp, Artificial Sequence
  Synthetic oligonucleotide; CAG chr11 5343234 5343253 5343237 -
gaagtgcggcctgcttttcc

SEQ ID NO: 35394 - DNA, 20 bp, Artificial Sequence
  Synthetic oligonucleotide; AGG chr11 5343233 5343252 5343236 -
aagtgcggcctgcttttccc

SEQ ID NO: 35395 - DNA, 20 bp, Artificial Sequence
  Synthetic oligonucleotide; GAG chr11 5343201 5343220 5343204 -
tacactcactttcctttctc

SEQ ID NO: 35396 - DNA, 20 bp, Artificial Sequence
  Synthetic oligonucleotide; TGG chr11 5343196 5343215 5343199 -
tcactttcctttctcgagtc

SEQ ID NO: 35397 - DNA, 20 bp, Artificial Sequence
  Synthetic oligonucleotide; TGG chr11 5343179 5343198 5343182 -
gtctggcattctgcttgcca

SEQ ID NO: 35398 - DNA, 20 bp, Artificial Sequence
  Synthetic oligonucleotide; TAG chr11 5343142 5343161 5343145 -
attgccatctgcaaccctct

SEQ ID NO: 35399 - DNA, 20 bp, Artificial Sequence
  Synthetic oligonucleotide; GAG chr11 5343113 5343132 5343116 -
ctctgtacttactaatactc

SEQ ID NO: 35400 - DNA, 20 bp, Artificial Sequence
  Synthetic oligonucleotide; TAG chr11 5343110 5343129 5343113 -
tgtacttactaatactcgag

SEQ ID NO: 35401 - DNA, 20 bp, Artificial Sequence
  Synthetic oligonucleotide; AAG chr11 5343105 5343124 5343108 -
ttactaatactcgagtagtg

SEQ ID NO: 35402 - DNA, 20 bp, Artificial Sequence
  Synthetic oligonucleotide; TGG chr11 5343100 5343119 5343103 -
aatactcgagtagtgaagat

SEQ ID NO: 35403 - DNA, 20 bp, Artificial Sequence
  Synthetic oligonucleotide; GGG chr11 5343099 5343118 5343102 -
atactcgagtagtgaagatt

SEQ ID NO: 35404 - DNA, 20 bp, Artificial Sequence
  Synthetic oligonucleotide; TGG chr11 5343095 5343114 5343098 -
tcgagtagtgaagattgggc

SEQ ID NO: 35405 - DNA, 20 bp, Artificial Sequence
  Synthetic oligonucleotide; GGG chr11 5343094 5343113 5343097 -
cgagtagtgaagattgggct

SEQ ID NO: 35406 - DNA, 20 bp, Artificial Sequence
  Synthetic oligonucleotide; GAG chr11 5343092 5343111 5343095 -
agtagtgaagattgggctgg

SEQ ID NO: 35407 - DNA, 20 bp, Artificial Sequence
  Synthetic oligonucleotide; GAG chr11 5343082 5343101 5343085 -
attgggctgggagttctgat

SEQ ID NO: 35408 - DNA, 20 bp, Artificial Sequence
  Synthetic oligonucleotide; AGG chr11 5343081 5343100 5343084 -
ttgggctgggagttctgatg

SEQ ID NO: 35409 - DNA, 20 bp, Artificial Sequence
  Synthetic oligonucleotide; GGG chr11 5343080 5343099 5343083 -
tgggctgggagttctgatga

SEQ ID NO: 35410 - DNA, 20 bp, Artificial Sequence
  Synthetic oligonucleotide; GGG chr11 5343079 5343098 5343082 -
gggctgggagttctgatgag

SEQ ID NO: 35411 - DNA, 20 bp, Artificial Sequence
  Synthetic oligonucleotide; CAG chr11 5343052 5343071 5343055 -
gtatccgttgttcccccaat

SEQ ID NO: 35412 - DNA, 20 bp, Artificial Sequence
  Synthetic oligonucleotide; AGG chr11 5343051 5343070 5343054 -
tatccgttgttcccccaatc

SEQ ID NO: 35413 - DNA, 20 bp, Artificial Sequence
  Synthetic oligonucleotide; CAG chr11 5342988 5343007 5342991 -
cacatgcattctgccttcac

SEQ ID NO: 35414 - DNA, 20 bp, Artificial Sequence
  Synthetic oligonucleotide; AGG chr11 5342987 5343006 5342990 -
acatgcattctgccttcacc

SEQ ID NO: 35415 - DNA, 20 bp, Artificial Sequence
  Synthetic oligonucleotide; CAG chr11 5342936 5342955 5342939 -
caccttcaaccgactgtacc

SEQ ID NO: 35416 - DNA, 20 bp, Artificial Sequence
  Synthetic oligonucleotide; TAG chr11 5342924 5342943 5342927 -
actgtacccagctgtgcttg

SEQ ID NO: 35417 - DNA, 20 bp, Artificial Sequence
  Synthetic oligonucleotide; TGG chr11 5342906 5342925 5342909 -
tgtagtctttatatttgtgc

SEQ ID NO: 35418 - DNA, 20 bp, Artificial Sequence
  Synthetic oligonucleotide; AAG chr11 5342865 5342884 5342868 -
tctcctatgtgttgatactc

SEQ ID NO: 35419 - DNA, 20 bp, Artificial Sequence
  Synthetic oligonucleotide; GAG chr11 5342854 5342873 5342857 -
ttgatactcaagactgtcct

SEQ ID NO: 35420 - DNA, 20 bp, Artificial Sequence
  Synthetic oligonucleotide; CAG chr11 5342842 5342861 5342845 -
actgtcctgagcattgcctc

SEQ ID NO: 35421 - DNA, 20 bp, Artificial Sequence
  Synthetic oligonucleotide; GAG chr11 5342840 5342859 5342843 -
tgtcctgagcattgcctcca

SEQ ID NO: 35422 - DNA, 20 bp, Artificial Sequence
  Synthetic oligonucleotide; GAG chr11 5342838 5342857 5342841 -
tcctgagcattgcctccaga

SEQ ID NO: 35423 - DNA, 20 bp, Artificial Sequence
  Synthetic oligonucleotide; AGG chr11 5342837 5342856 5342840 -
cctgagcattgcctccagag

SEQ ID NO: 35424 - DNA, 20 bp, Artificial Sequence
  Synthetic oligonucleotide; GAG chr11 5342835 5342854 5342838 -
tgagcattgcctccagagag

SEQ ID NO: 35425 - DNA, 20 bp, Artificial Sequence
  Synthetic oligonucleotide; GAG chr11 5342833 5342852 5342836 -
agcattgcctccagagagga

SEQ ID NO: 35426 - DNA, 20 bp, Artificial Sequence
  Synthetic oligonucleotide; AGG chr11 5342832 5342851 5342835 -
gcattgcctccagagaggag

SEQ ID NO: 35427 - DNA, 20 bp, Artificial Sequence
  Synthetic oligonucleotide; GGG chr11 5342831 5342850 5342834 -
cattgcctccagagaggaga

SEQ ID NO: 35428 - DNA, 20 bp, Artificial Sequence
  Synthetic oligonucleotide; AAG chr11 5342826 5342845 5342829 -
cctccagagaggagagggcc

SEQ ID NO: 35429 - DNA, 20 bp, Artificial Sequence
  Synthetic oligonucleotide; AGG chr11 5342825 5342844 5342828 -
ctccagagaggagagggcca

SEQ ID NO: 35430 - DNA, 20 bp, Artificial Sequence
  Synthetic oligonucleotide; TGG chr11 5342786 5342805 5342789 -
ctcccatatctgctgtgtcc

SEQ ID NO: 35431 - DNA, 20 bp, Artificial Sequence
  Synthetic oligonucleotide; CAG chr11 5342771 5342790 5342774 -
tgtcctggttttttatgtca

SEQ ID NO: 35432 - DNA, 20 bp, Artificial Sequence
  Synthetic oligonucleotide; TGG chr11 5342764 5342783 5342767 -
gttttttatgtcacagtgat

SEQ ID NO: 35433 - DNA, 20 bp, Artificial Sequence
  Synthetic oligonucleotide; TGG chr11 5342740 5342759 5342743 -
ttgtctctgattcatcgttt

SEQ ID NO: 35434 - DNA, 20 bp, Artificial Sequence
  Synthetic oligonucleotide; AAG chr11 5342736 5342755 5342739 -
ctctgattcatcgttttgga

SEQ ID NO: 35435 - DNA, 20 bp, Artificial Sequence
  Synthetic oligonucleotide; CAG chr11 5342733 5342752 5342736 -
tgattcatcgttttggaaag

SEQ ID NO: 35436 - DNA, 20 bp, Artificial Sequence
  Synthetic oligonucleotide; AGG chr11 5342732 5342751 5342735 -
gattcatcgttttggaaagc

SEQ ID NO: 35437 - DNA, 20 bp, Artificial Sequence
  Synthetic oligonucleotide; GAG chr11 5342704 5342723 5342707 -
catattgttcacctcattat

SEQ ID NO: 35438 - DNA, 20 bp, Artificial Sequence
  Synthetic oligonucleotide; TAG chr11 5342656 5342675 5342659 -
ctaatgaatcctataacata

SEQ ID NO: 35439 - DNA, 20 bp, Artificial Sequence
  Synthetic oligonucleotide; AAG chr11 5342649 5342668 5342652 -
atcctataacatatagtgtc

SEQ ID NO: 35440 - DNA, 20 bp, Artificial Sequence
  Synthetic oligonucleotide; AAG chr11 5342643 5342662 5342646 -
taacatatagtgtcaagacc

SEQ ID NO: 35441 - DNA, 20 bp, Artificial Sequence
  Synthetic oligonucleotide; CAG chr11 5342640 5342659 5342643 -
catatagtgtcaagaccaag

SEQ ID NO: 35442 - DNA, 20 bp, Artificial Sequence
  Synthetic oligonucleotide; CAG chr11 5342634 5342653 5342637 -
gtgtcaagaccaagcagatt

SEQ ID NO: 35443 - DNA, 20 bp, Artificial Sequence
  Synthetic oligonucleotide; TAG chr11 5342602 5342621 5342605 -
cttcacctttttactaccca

SEQ ID NO: 35444 - DNA, 20 bp, Artificial Sequence
  Synthetic oligonucleotide; TGG chr11 5342596 5342615 5342599 -
ctttttactacccatagaat

SEQ ID NO: 35445 - DNA, 20 bp, Artificial Sequence
  Synthetic oligonucleotide; CAG chr11 5342573 5342592 5342576 -
aacctgatctccaatcatca

SEQ ID NO: 35446 - DNA, 20 bp, Artificial Sequence
  Synthetic oligonucleotide; CAG chr11 5342561 5342580 5342564 -
aatcatcacagtcactctca

SEQ ID NO: 35447 - DNA, 20 bp, Artificial Sequence
  Synthetic oligonucleotide; TAG chr11 5342538 5342557 5342541 -
aatgtaaaaactctaatatt

SEQ ID NO: 35448 - DNA, 20 bp, Artificial Sequence
  Synthetic oligonucleotide; CAG chr11 5342535 5342554 5342538 -
gtaaaaactctaatatttag

SEQ ID NO: 35449 - DNA, 20 bp, Artificial Sequence
  Synthetic oligonucleotide; AGG chr11 5342534 5342553 5342537 -
taaaaactctaatatttagc

SEQ ID NO: 35450 - DNA, 20 bp, Artificial Sequence
  Synthetic oligonucleotide; GAG chr11 5342532 5342551 5342535 -
aaaactctaatatttagcag

SEQ ID NO: 35451 - DNA, 20 bp, Artificial Sequence
  Synthetic oligonucleotide; GAG chr11 5342530 5342549 5342533 -
aactctaatatttagcagga

SEQ ID NO: 35452 - DNA, 20 bp, Artificial Sequence
  Synthetic oligonucleotide; AAG chr11 5342525 5342544 5342528 -
taatatttagcaggagagca

SEQ ID NO: 35453 - DNA, 20 bp, Artificial Sequence
  Synthetic oligonucleotide; AAG chr11 5342522 5342541 5342525 -
tatttagcaggagagcaaag

SEQ ID NO: 35454 - DNA, 20 bp, Artificial Sequence
  Synthetic oligonucleotide; TAG chr11 5342510 5342529 5342513 -
gagcaaagaagtctcatatc

SEQ ID NO: 35455 - DNA, 20 bp, Artificial Sequence
  Synthetic oligonucleotide; TGG chr11 5342488 5342507 5342491 -
gcatgcatgctcatatgact

SEQ ID NO: 35456 - DNA, 20 bp, Artificial Sequence
  Synthetic oligonucleotide; TAG chr11 5342480 5342499 5342483 -
gctcatatgacttggtaaaa

SEQ ID NO: 35457 - DNA, 20 bp, Artificial Sequence
  Synthetic oligonucleotide; AGG chr11 5342479 5342498 5342482 -
ctcatatgacttggtaaaat

SEQ ID NO: 35458 - DNA, 20 bp, Artificial Sequence
  Synthetic oligonucleotide; CAG chr11 5342466 5342485 5342469 -
gtaaaataggtgttaaaata

SEQ ID NO: 35459 - DNA, 20 bp, Artificial Sequence
  Synthetic oligonucleotide; AAG chr11 5342459 5342478 5342462 -
aggtgttaaaatacagcttc

SEQ ID NO: 35460 - DNA, 20 bp, Artificial Sequence
  Synthetic oligonucleotide; AAG chr11 5342449 5342468 5342452 -
atacagcttcaagtttccct

SEQ ID NO: 35461 - DNA, 20 bp, Artificial Sequence
  Synthetic oligonucleotide; AGG chr11 5342448 5342467 5342451 -
tacagcttcaagtttcccta

SEQ ID NO: 35462 - DNA, 20 bp, Artificial Sequence
  Synthetic oligonucleotide; AAG chr11 5342436 5342455 5342439 -
tttccctaaggtatctcttt

SEQ ID NO: 35463 - DNA, 20 bp, Artificial Sequence
  Synthetic oligonucleotide; TAG chr11 5342423 5342442 5342426 -
tctctttaagcccaactctt

SEQ ID NO: 35464 - DNA, 20 bp, Artificial Sequence
  Synthetic oligonucleotide; TAG chr11 5342413 5342432 5342416 -
cccaactctttagctaaatg

SEQ ID NO: 35465 - DNA, 20 bp, Artificial Sequence
  Synthetic oligonucleotide; CGG chr11 5342379 5342398 5342382 -
ttttgttgcattcctgtaaa

SEQ ID NO: 35466 - DNA, 20 bp, Artificial Sequence
  Synthetic oligonucleotide; AAG chr11 5342365 5342384 5342368 -
tgtaaacggaatatttctct

SEQ ID NO: 35467 - DNA, 20 bp, Artificial Sequence
  Synthetic oligonucleotide; TAG chr11 5342330 5342349 5342333 -
ttattgtgataacaatacct

SEQ ID NO: 35468 - DNA, 20 bp, Artificial Sequence
  Synthetic oligonucleotide; AGG chr11 5342329 5342348 5342332 -
tattgtgataacaatacctt

SEQ ID NO: 35469 - DNA, 20 bp, Artificial Sequence
  Synthetic oligonucleotide; TGG chr11 5342319 5342338 5342322 -
acaataccttaggcatctat

SEQ ID NO: 35470 - DNA, 20 bp, Artificial Sequence
  Synthetic oligonucleotide; TGG chr11 5342281 5342300 5342284 -
actaacatatgtttatttca

SEQ ID NO: 35471 - DNA, 20 bp, Artificial Sequence
  Synthetic oligonucleotide; AAG chr11 5342274 5342293 5342277 -
tatgtttatttcatggtata

SEQ ID NO: 35472 - DNA, 20 bp, Artificial Sequence
  Synthetic oligonucleotide; TAG chr11 5342270 5342289 5342273 -
tttatttcatggtataaagt

SEQ ID NO: 35473 - DNA, 20 bp, Artificial Sequence
  Synthetic oligonucleotide; CAG chr11 5342267 5342286 5342270 -
atttcatggtataaagttag

SEQ ID NO: 35474 - DNA, 20 bp, Artificial Sequence
  Synthetic oligonucleotide; TAG chr11 5342263 5342282 5342266 -
catggtataaagttagcaga

SEQ ID NO: 35475 - DNA, 20 bp, Artificial Sequence
  Synthetic oligonucleotide; AGG chr11 5342262 5342281 5342265 -
atggtataaagttagcagat

SEQ ID NO: 35476 - DNA, 20 bp, Artificial Sequence
  Synthetic oligonucleotide; CAG chr11 5342257 5342276 5342260 -
ataaagttagcagataggaa

SEQ ID NO: 35477 - DNA, 20 bp, Artificial Sequence
  Synthetic oligonucleotide; TAG chr11 5342232 5342251 5342235 -
tcataaaaatataaaattat

SEQ ID NO: 35478 - DNA, 20 bp, Artificial Sequence
  Synthetic oligonucleotide; TGG chr11 5342228 5342247 5342231 -
aaaaatataaaattattagt

SEQ ID NO: 35479 - DNA, 20 bp, Artificial Sequence
  Synthetic oligonucleotide; GAG chr11 5342222 5342241 5342225 -
ataaaattattagttggttc

SEQ ID NO: 35480 - DNA, 20 bp, Artificial Sequence
  Synthetic oligonucleotide; TGG chr11 5342214 5342233 5342217 -
attagttggttcgagtgaaa

SEQ ID NO: 35481 - DNA, 20 bp, Artificial Sequence
  Synthetic oligonucleotide; TAG chr11 5342209 5342228 5342212 -
ttggttcgagtgaaatggaa

SEQ ID NO: 35482 - DNA, 20 bp, Artificial Sequence
  Synthetic oligonucleotide; GAG chr11 5342207 5342226 5342210 -
ggttcgagtgaaatggaata

SEQ ID NO: 35483 - DNA, 20 bp, Artificial Sequence
  Synthetic oligonucleotide; TGG chr11 5342202 5342221 5342205 -
gagtgaaatggaatagagtt

SEQ ID NO: 35484 - DNA, 20 bp, Artificial Sequence
  Synthetic oligonucleotide; CAG chr11 5342155 5342174 5342158 -
aactcttatgaatttctctg

SEQ ID NO: 35485 - DNA, 20 bp, Artificial Sequence
  Synthetic oligonucleotide; AGG chr11 5342154 5342173 5342157 -
actcttatgaatttctctgc

SEQ ID NO: 35486 - DNA, 20 bp, Artificial Sequence
  Synthetic oligonucleotide; TGG chr11 5342136 5342155 5342139 -
gcaggtgtccatacaaacaa

SEQ ID NO: 35487 - DNA, 20 bp, Artificial Sequence
  Synthetic oligonucleotide; GGG chr11 5342135 5342154 5342138 -
caggtgtccatacaaacaat

SEQ ID NO: 35488 - DNA, 20 bp, Artificial Sequence
  Synthetic oligonucleotide; TGG chr11 5342120 5342139 5342123 -
acaatgggaacctataaatt

SEQ ID NO: 35489 - DNA, 20 bp, Artificial Sequence
  Synthetic oligonucleotide; AAG chr11 5342111 5342130 5342114 -
acctataaatttggtcactg

SEQ ID NO: 35490 - DNA, 20 bp, Artificial Sequence
  Synthetic oligonucleotide; CAG chr11 5342106 5342125 5342109 -
taaatttggtcactgaagtc

SEQ ID NO: 35491 - DNA, 20 bp, Artificial Sequence
  Synthetic oligonucleotide; AGG chr11 5342105 5342124 5342108 -
aaatttggtcactgaagtcc

SEQ ID NO: 35492 - DNA, 20 bp, Artificial Sequence
  Synthetic oligonucleotide; AAG chr11 5342087 5342106 5342090 -
ccaggaattttcctgcaaaa

SEQ ID NO: 35493 - DNA, 20 bp, Artificial Sequence
  Synthetic oligonucleotide; CAG chr11 5342066 5342085 5342069 -
agaatataatcttctttgat

SEQ ID NO: 35494 - DNA, 20 bp, Artificial Sequence
  Synthetic oligonucleotide; CAG chr11 5342039 5342058 5342042 -
ctaattacttatcatctcaa

SEQ ID NO: 35495 - DNA, 20 bp, Artificial Sequence
  Synthetic oligonucleotide; TAG chr11 5342034 5342053 5342037 -
tacttatcatctcaacagtc

SEQ ID NO: 35496 - DNA, 20 bp, Artificial Sequence
  Synthetic oligonucleotide; TGG chr11 5342030 5342049 5342033 -
tatcatctcaacagtctagt

SEQ ID NO: 35497 - DNA, 20 bp, Artificial Sequence
  Synthetic oligonucleotide; AAG chr11 5341961 5341980 5341964 -
taaactcatatttattcccc

SEQ ID NO: 35498 - DNA, 20 bp, Artificial Sequence
  Synthetic oligonucleotide; AGG chr11 5341960 5341979 5341963 -
aaactcatatttattcccca

SEQ ID NO: 35499 - DNA, 20 bp, Artificial Sequence
  Synthetic oligonucleotide; CAG chr11 5341957 5341976 5341960 -
ctcatatttattccccaagg

SEQ ID NO: 35500 - DNA, 20 bp, Artificial Sequence
  Synthetic oligonucleotide; GAG chr11 5341922 5341941 5341925 -
aacttgtaacaaaaaaatgt

SEQ ID NO: 35501 - DNA, 20 bp, Artificial Sequence
  Synthetic oligonucleotide; AAG chr11 5341919 5341938 5341922 -
ttgtaacaaaaaaatgtgag

SEQ ID NO: 35502 - DNA, 20 bp, Artificial Sequence
  Synthetic oligonucleotide; GAG chr11 5341917 5341936 5341920 -
gtaacaaaaaaatgtgagaa

SEQ ID NO: 35503 - DNA, 20 bp, Artificial Sequence
  Synthetic oligonucleotide; AGG chr11 5341916 5341935 5341919 -
taacaaaaaaatgtgagaag

SEQ ID NO: 35504 - DNA, 20 bp, Artificial Sequence
  Synthetic oligonucleotide; CGG chr11 5341908 5341927 5341911 -
aaatgtgagaagaggaatca

SEQ ID NO: 35505 - DNA, 20 bp, Artificial Sequence
  Synthetic oligonucleotide; GAG chr11 5341899 5341918 5341902 -
aagaggaatcacggataaat

SEQ ID NO: 35506 - DNA, 20 bp, Artificial Sequence
  Synthetic oligonucleotide; GAG chr11 5341897 5341916 5341900 -
gaggaatcacggataaatga

SEQ ID NO: 35507 - DNA, 20 bp, Artificial Sequence
  Synthetic oligonucleotide; AGG chr11 5341896 5341915 5341899 -
aggaatcacggataaatgag

SEQ ID NO: 35508 - DNA, 20 bp, Artificial Sequence
  Synthetic oligonucleotide; TAG chr11 5341890 5341909 5341893 -
cacggataaatgagaggacg

SEQ ID NO: 35509 - DNA, 20 bp, Artificial Sequence
  Synthetic oligonucleotide; CAG chr11 5341884 5341903 5341887 -
taaatgagaggacgtagaca

SEQ ID NO: 35510 - DNA, 20 bp, Artificial Sequence
  Synthetic oligonucleotide; CAG chr11 5341880 5341899 5341883 -
tgagaggacgtagacacagt

SEQ ID NO: 35511 - DNA, 20 bp, Artificial Sequence
  Synthetic oligonucleotide; TAG chr11 5341837 5341856 5341840 -
tcattcttattctactaccc

SEQ ID NO: 35512 - DNA, 20 bp, Artificial Sequence
  Synthetic oligonucleotide; TAG chr11 5341830 5341849 5341833 -
tattctactaccctagttgc

SEQ ID NO: 35513 - DNA, 20 bp, Artificial Sequence
  Synthetic oligonucleotide; GAG chr11 5341817 5341836 5341820 -
tagttgctagctccaatgtt

SEQ ID NO: 35514 - DNA, 20 bp, Artificial Sequence
  Synthetic oligonucleotide; AGG chr11 5341816 5341835 5341819 -
agttgctagctccaatgttg

SEQ ID NO: 35515 - DNA, 20 bp, Artificial Sequence
  Synthetic oligonucleotide; CAG chr11 5341806 5341825 5341809 -
tccaatgttgaggccatcct

SEQ ID NO: 35516 - DNA, 20 bp, Artificial Sequence
  Synthetic oligonucleotide; TGG chr11 5341793 5341812 5341796 -
ccatcctcagatatctacgc

SEQ ID NO: 35517 - DNA, 20 bp, Artificial Sequence
  Synthetic oligonucleotide; TAG chr11 5341785 5341804 5341788 -
agatatctacgctggctgac

SEQ ID NO: 35518 - DNA, 20 bp, Artificial Sequence
  Synthetic oligonucleotide; TAG chr11 5341775 5341794 5341778 -
gctggctgactagtccaaat

SEQ ID NO: 35519 - DNA, 20 bp, Artificial Sequence
  Synthetic oligonucleotide; TGG chr11 5341772 5341791 5341775 -
ggctgactagtccaaattag

SEQ ID NO: 35520 - DNA, 20 bp, Artificial Sequence
  Synthetic oligonucleotide; AAG chr11 5341769 5341788 5341772 -
tgactagtccaaattagtgg

SEQ ID NO: 35521 - DNA, 20 bp, Artificial Sequence
  Synthetic oligonucleotide; GAG chr11 5341767 5341786 5341770 -
actagtccaaattagtggaa

SEQ ID NO: 35522 - DNA, 20 bp, Artificial Sequence
  Synthetic oligonucleotide; CAG chr11 5341763 5341782 5341766 -
gtccaaattagtggaagaga

SEQ ID NO: 35523 - DNA, 20 bp, Artificial Sequence
  Synthetic oligonucleotide; AAG chr11 5341733 5341752 5341736 -
accctccttttgctatgaaa

SEQ ID NO: 35524 - DNA, 20 bp, Artificial Sequence
  Synthetic oligonucleotide; AGG chr11 5341732 5341751 5341735 -
ccctccttttgctatgaaaa

SEQ ID NO: 35525 - DNA, 20 bp, Artificial Sequence
  Synthetic oligonucleotide; AAG chr11 5341725 5341744 5341728 -
tttgctatgaaaaaggtctg

SEQ ID NO: 35526 - DNA, 20 bp, Artificial Sequence
  Synthetic oligonucleotide; AGG chr11 5341724 5341743 5341727 -
ttgctatgaaaaaggtctga

SEQ ID NO: 35527 - DNA, 20 bp, Artificial Sequence
  Synthetic oligonucleotide; TAG chr11 5341709 5341728 5341712 -
tctgaaggaacaaaaaaaaa

SEQ ID NO: 35528 - DNA, 20 bp, Artificial Sequence
  Synthetic oligonucleotide; AGG chr11 5341708 5341727 5341711 -
ctgaaggaacaaaaaaaaat

SEQ ID NO: 35529 - DNA, 20 bp, Artificial Sequence
  Synthetic oligonucleotide; AAG chr11 5341689 5341708 5341692 -
taggtttctgcatttttttg

SEQ ID NO: 35530 - DNA, 20 bp, Artificial Sequence
  Synthetic oligonucleotide; AAG chr11 5341646 5341665 5341649 -
acattctgattccatgtaat

SEQ ID NO: 35531 - DNA, 20 bp, Artificial Sequence
  Synthetic oligonucleotide; AAG chr11 5341630 5341649 5341633 -
taataagtgtaaatttccca

SEQ ID NO: 35532 - DNA, 20 bp, Artificial Sequence
  Synthetic oligonucleotide; GAG chr11 5341586 5341605 5341589 -
tttgattaaaattgtctgat

SEQ ID NO: 35533 - DNA, 20 bp, Artificial Sequence
  Synthetic oligonucleotide; TAG chr11 5341582 5341601 5341585 -
attaaaattgtctgatgagt

SEQ ID NO: 35534 - DNA, 20 bp, Artificial Sequence
  Synthetic oligonucleotide; AGG chr11 5341581 5341600 5341584 -
ttaaaattgtctgatgagtt

SEQ ID NO: 35535 - DNA, 20 bp, Artificial Sequence
  Synthetic oligonucleotide; AAG chr11 5341578 5341597 5341581 -
aaattgtctgatgagttagg

SEQ ID NO: 35536 - DNA, 20 bp, Artificial Sequence
  Synthetic oligonucleotide; AGG chr11 5341577 5341596 5341580 -
aattgtctgatgagttagga

SEQ ID NO: 35537 - DNA, 20 bp, Artificial Sequence
  Synthetic oligonucleotide; GGG chr11 5341576 5341595 5341579 -
attgtctgatgagttaggaa

SEQ ID NO: 35538 - DNA, 20 bp, Artificial Sequence
  Synthetic oligonucleotide; AAG chr11 5341544 5341563 5341547 -
tcaatttaaaatatcctaaa

SEQ ID NO: 35539 - DNA, 20 bp, Artificial Sequence
  Synthetic oligonucleotide; GAG chr11 5341542 5341561 5341545 -
aatttaaaatatcctaaaaa

SEQ ID NO: 35540 - DNA, 20 bp, Artificial Sequence
  Synthetic oligonucleotide; AGG chr11 5341541 5341560 5341544 -
atttaaaatatcctaaaaag

SEQ ID NO: 35541 - DNA, 20 bp, Artificial Sequence
  Synthetic oligonucleotide; GGG chr11 5341540 5341559 5341543 -
tttaaaatatcctaaaaaga

SEQ ID NO: 35542 - DNA, 20 bp, Artificial Sequence
  Synthetic oligonucleotide; GAG chr11 5341538 5341557 5341541 -
taaaatatcctaaaaagagg

SEQ ID NO: 35543 - DNA, 20 bp, Artificial Sequence
  Synthetic oligonucleotide; AGG chr11 5341537 5341556 5341540 -
aaaatatcctaaaaagaggg

SEQ ID NO: 35544 - DNA, 20 bp, Artificial Sequence
  Synthetic oligonucleotide; CAG chr11 5341511 5341530 5341514 -
tgtcttaattatactttaat

SEQ ID NO: 35545 - DNA, 20 bp, Artificial Sequence
  Synthetic oligonucleotide; GAG chr11 5341509 5341528 5341512 -
tcttaattatactttaatca

SEQ ID NO: 35546 - DNA, 20 bp, Artificial Sequence
  Synthetic oligonucleotide; CAG chr11 5341492 5341511 5341495 -
tcagagcaaaaataatactt

SEQ ID NO: 35547 - DNA, 20 bp, Artificial Sequence
  Synthetic oligonucleotide; GAG chr11 5341488 5341507 5341491 -
agcaaaaataatacttcagt

SEQ ID NO: 35548 - DNA, 20 bp, Artificial Sequence
  Synthetic oligonucleotide; AAG chr11 5341483 5341502 5341486 -
aaataatacttcagtgagac

SEQ ID NO: 35549 - DNA, 20 bp, Artificial Sequence
  Synthetic oligonucleotide; GAG chr11 5341481 5341500 5341484 -
ataatacttcagtgagacaa

SEQ ID NO: 35550 - DNA, 20 bp, Artificial Sequence
  Synthetic oligonucleotide; GAG chr11 5341479 5341498 5341482 -
aatacttcagtgagacaaga

SEQ ID NO: 35551 - DNA, 20 bp, Artificial Sequence
  Synthetic oligonucleotide; AGG chr11 5341478 5341497 5341481 -
atacttcagtgagacaagag

SEQ ID NO: 35552 - DNA, 20 bp, Artificial Sequence
  Synthetic oligonucleotide; GGG chr11 5341477 5341496 5341480 -
tacttcagtgagacaagaga

SEQ ID NO: 35553 - DNA, 20 bp, Artificial Sequence
  Synthetic oligonucleotide; GGG chr11 5341476 5341495 5341479 -
acttcagtgagacaagagag

SEQ ID NO: 35554 - DNA, 20 bp, Artificial Sequence
  Synthetic oligonucleotide; TAG chr11 5341467 5341486 5341470 -
agacaagagaggggactata

SEQ ID NO: 35555 - DNA, 20 bp, Artificial Sequence
  Synthetic oligonucleotide; AAG chr11 5341464 5341483 5341467 -
caagagaggggactatatag

SEQ ID NO: 35556 - DNA, 20 bp, Artificial Sequence
  Synthetic oligonucleotide; TGG chr11 5341445 5341464 5341448 -
gaagatattgtttatgtctt

SEQ ID NO: 35557 - DNA, 20 bp, Artificial Sequence
  Synthetic oligonucleotide; CAG chr11 5341421 5341440 5341424 -
gttttaccccgatcatttta

SEQ ID NO: 35558 - DNA, 20 bp, Artificial Sequence
  Synthetic oligonucleotide; TGG chr11 5341398 5341417 5341401 -
aattgtgcacctgtgaatgt

SEQ ID NO: 35559 - DNA, 20 bp, Artificial Sequence
  Synthetic oligonucleotide; CAG chr11 5341366 5341385 5341369 -
gttcatgtttctgctttctg

SEQ ID NO: 35560 - DNA, 20 bp, Artificial Sequence
  Synthetic oligonucleotide; AGG chr11 5341365 5341384 5341368 -
ttcatgtttctgctttctgc

SEQ ID NO: 35561 - DNA, 20 bp, Artificial Sequence
  Synthetic oligonucleotide; CAG chr11 5341347 5341366 5341350 -
gcaggttgttgttctcaact

SEQ ID NO: 35562 - DNA, 20 bp, Artificial Sequence
  Synthetic oligonucleotide; CAG chr11 5341344 5341363 5341347 -
ggttgttgttctcaactcag

SEQ ID NO: 35563 - DNA, 20 bp, Artificial Sequence
  Synthetic oligonucleotide; AGG chr11 5341343 5341362 5341346 -
gttgttgttctcaactcagc

SEQ ID NO: 35564 - DNA, 20 bp, Artificial Sequence
  Synthetic oligonucleotide; AAG chr11 5341328 5341347 5341331 -
tcagcaggaaatgtcttatg

SEQ ID NO: 35565 - DNA, 20 bp, Artificial Sequence
  Synthetic oligonucleotide; TGG chr11 5341321 5341340 5341324 -
gaaatgtcttatgaagaaaa

SEQ ID NO: 35566 - DNA, 20 bp, Artificial Sequence
  Synthetic oligonucleotide; TAG chr11 5341307 5341326 5341310 -
agaaaatggcccctgctcct

SEQ ID NO: 35567 - DNA, 20 bp, Artificial Sequence
  Synthetic oligonucleotide; AGG chr11 5341306 5341325 5341309 -
gaaaatggcccctgctcctt

SEQ ID NO: 35568 - DNA, 20 bp, Artificial Sequence
  Synthetic oligonucleotide; TAG chr11 5341303 5341322 5341306 -
aatggcccctgctccttagg

SEQ ID NO: 35569 - DNA, 20 bp, Artificial Sequence
  Synthetic oligonucleotide; CAG chr11 5341300 5341319 5341303 -
ggcccctgctccttaggtag

SEQ ID NO: 35570 - DNA, 20 bp, Artificial Sequence
  Synthetic oligonucleotide; AGG chr11 5341299 5341318 5341302 -
gcccctgctccttaggtagc

SEQ ID NO: 35571 - DNA, 20 bp, Artificial Sequence
  Synthetic oligonucleotide; TAG chr11 5341293 5341312 5341296 -
gctccttaggtagcaggcca

SEQ ID NO: 35572 - DNA, 20 bp, Artificial Sequence
  Synthetic oligonucleotide; AGG chr11 5341292 5341311 5341295 -
ctccttaggtagcaggccat

SEQ ID NO: 35573 - DNA, 20 bp, Artificial Sequence
  Synthetic oligonucleotide; AAG chr11 5341264 5341283 5341267 -
actgaccctcttgccttctg

SEQ ID NO: 35574 - DNA, 20 bp, Artificial Sequence
  Synthetic oligonucleotide; AAG chr11 5341259 5341278 5341262 -
ccctcttgccttctgaagct

SEQ ID NO: 35575 - DNA, 20 bp, Artificial Sequence
  Synthetic oligonucleotide; CAG chr11 5341253 5341272 5341256 -
tgccttctgaagctaagctc

SEQ ID NO: 35576 - DNA, 20 bp, Artificial Sequence
  Synthetic oligonucleotide; CAG chr11 5341247 5341266 5341250 -
ctgaagctaagctccagctt

SEQ ID NO: 35577 - DNA, 20 bp, Artificial Sequence
  Synthetic oligonucleotide; GAG chr11 5341185 5341204 5341188 -
ttacttgctccctgtctcct

SEQ ID NO: 35578 - DNA, 20 bp, Artificial Sequence
  Synthetic oligonucleotide; GAG chr11 5341183 5341202 5341186 -
acttgctccctgtctcctga

SEQ ID NO: 35579 - DNA, 20 bp, Artificial Sequence
  Synthetic oligonucleotide; CAG chr11 5341142 5341161 5341145 -
acacatttgaatccctatct

SEQ ID NO: 35580 - DNA, 20 bp, Artificial Sequence
  Synthetic oligonucleotide; AGG chr11 5341141 5341160 5341144 -
cacatttgaatccctatctc

SEQ ID NO: 35581 - DNA, 20 bp, Artificial Sequence
  Synthetic oligonucleotide; TAG chr11 5341129 5341148 5341132 -
cctatctcaggtattgctca

SEQ ID NO: 35582 - DNA, 20 bp, Artificial Sequence
  Synthetic oligonucleotide; GAG chr11 5341127 5341146 5341130 -
tatctcaggtattgctcata

SEQ ID NO: 35583 - DNA, 20 bp, Artificial Sequence
  Synthetic oligonucleotide; GAG chr11 5341125 5341144 5341128 -
tctcaggtattgctcataga

SEQ ID NO: 35584 - DNA, 20 bp, Artificial Sequence
  Synthetic oligonucleotide; AAG chr11 5341114 5341133 5341117 -
gctcatagagagtccaactt

SEQ ID NO: 35585 - DNA, 20 bp, Artificial Sequence
  Synthetic oligonucleotide; AAG chr11 5341076 5341095 5341079 -
tatttatattctgtttcatt

SEQ ID NO: 35586 - DNA, 20 bp, Artificial Sequence
  Synthetic oligonucleotide; GAG chr11 5341074 5341093 5341077 -
tttatattctgtttcattaa

SEQ ID NO: 35587 - DNA, 20 bp, Artificial Sequence
  Synthetic oligonucleotide; AAG chr11 5341059 5341078 5341062 -
attaagagatgtaattgtga

SEQ ID NO: 35588 - DNA, 20 bp, Artificial Sequence
  Synthetic oligonucleotide; CAG chr11 5341036 5341055 5341039 -
aactgaacatataaaaaaat

SEQ ID NO: 35589 - DNA, 20 bp, Artificial Sequence
  Synthetic oligonucleotide; GAG chr11 5340994 5341013 5340997 -
cttgtcacgccatgtcacct

SEQ ID NO: 35590 - DNA, 20 bp, Artificial Sequence
  Synthetic oligonucleotide; CAG chr11 5340986 5341005 5340989 -
gccatgtcacctgagcaaca

SEQ ID NO: 35591 - DNA, 20 bp, Artificial Sequence
  Synthetic oligonucleotide; GAG chr11 5340966 5340985 5340969 -
cagtctgaatactaaattgt

SEQ ID NO: 35592 - DNA, 20 bp, Artificial Sequence
  Synthetic oligonucleotide; GAG chr11 5340960 5340979 5340963 -
gaatactaaattgtgagtgt

SEQ ID NO: 35593 - DNA, 20 bp, Artificial Sequence
  Synthetic oligonucleotide; TGG chr11 5340944 5340963 5340947 -
gtgtgagtgcatatatgtga

SEQ ID NO: 35594 - DNA, 20 bp, Artificial Sequence
  Synthetic oligonucleotide; TAG chr11 5340941 5340960 5340944 -
tgagtgcatatatgtgatgg

SEQ ID NO: 35595 - DNA, 20 bp, Artificial Sequence
  Synthetic oligonucleotide; AGG chr11 5340940 5340959 5340943 -
gagtgcatatatgtgatggt

SEQ ID NO: 35596 - DNA, 20 bp, Artificial Sequence
  Synthetic oligonucleotide; TGG chr11 5340842 5340861 5340845 -
ttttattcataaaaatattg

SEQ ID NO: 35597 - DNA, 20 bp, Artificial Sequence
  Synthetic oligonucleotide; GGG chr11 5340841 5340860 5340844 -
tttattcataaaaatattgt

SEQ ID NO: 35598 - DNA, 20 bp, Artificial Sequence
  Synthetic oligonucleotide; GGG chr11 5340840 5340859 5340843 -
ttattcataaaaatattgtg

SEQ ID NO: 35599 - DNA, 20 bp, Artificial Sequence
  Synthetic oligonucleotide; TAG chr11 5340837 5340856 5340840 -
ttcataaaaatattgtgggg

SEQ ID NO: 35600 - DNA, 20 bp, Artificial Sequence
  Synthetic oligonucleotide; TGG chr11 5340813 5340832 5340816 -
tattatcactgttttcttga

SEQ ID NO: 35601 - DNA, 20 bp, Artificial Sequence
  Synthetic oligonucleotide; GGG chr11 5340812 5340831 5340815 -
attatcactgttttcttgat

SEQ ID NO: 35602 - DNA, 20 bp, Artificial Sequence
  Synthetic oligonucleotide; GGG chr11 5340811 5340830 5340814 -
ttatcactgttttcttgatg

SEQ ID NO: 35603 - DNA, 20 bp, Artificial Sequence
  Synthetic oligonucleotide; AAG chr11 5340793 5340812 5340796 -
tggggaaatttaatataaaa

SEQ ID NO: 35604 - DNA, 20 bp, Artificial Sequence
  Synthetic oligonucleotide; AAG chr11 5340775 5340794 5340778 -
aaaagttaaatattccctcc

SEQ ID NO: 35605 - DNA, 20 bp, Artificial Sequence
  Synthetic oligonucleotide; AGG chr11 5340774 5340793 5340777 -
aaagttaaatattccctcca

SEQ ID NO: 35606 - DNA, 20 bp, Artificial Sequence
  Synthetic oligonucleotide; GGG chr11 5340773 5340792 5340776 -
aagttaaatattccctccaa

SEQ ID NO: 35607 - DNA, 20 bp, Artificial Sequence
  Synthetic oligonucleotide; TGG chr11 5340755 5340774 5340758 -
aagggcataacatttttaat

SEQ ID NO: 35608 - DNA, 20 bp, Artificial Sequence
  Synthetic oligonucleotide; TAG chr11 5340750 5340769 5340753 -
cataacatttttaattggta

SEQ ID NO: 35609 - DNA, 20 bp, Artificial Sequence
  Synthetic oligonucleotide; AAG chr11 5340717 5340736 5340720 -
aatttatatcttctaactat

SEQ ID NO: 35610 - DNA, 20 bp, Artificial Sequence
  Synthetic oligonucleotide; AGG chr11 5340716 5340735 5340719 -
atttatatcttctaactata

SEQ ID NO: 35611 - DNA, 20 bp, Artificial Sequence
  Synthetic oligonucleotide; CAG chr11 5340712 5340731 5340715 -
atatcttctaactataaggc

SEQ ID NO: 35612 - DNA, 20 bp, Artificial Sequence
  Synthetic oligonucleotide; TGG chr11 5340703 5340722 5340706 -
aactataaggccagtgtgaa

SEQ ID NO: 35613 - DNA, 20 bp, Artificial Sequence
  Synthetic oligonucleotide; CAG chr11 5340690 5340709 5340693 -
gtgtgaatggtactccacta

SEQ ID NO: 35614 - DNA, 20 bp, Artificial Sequence
  Synthetic oligonucleotide; TAG chr11 5340687 5340706 5340690 -
tgaatggtactccactacag

SEQ ID NO: 35615 - DNA, 20 bp, Artificial Sequence
  Synthetic oligonucleotide; TAG chr11 5340676 5340695 5340679 -
ccactacagtagactatcct

SEQ ID NO: 35616 - DNA, 20 bp, Artificial Sequence
  Synthetic oligonucleotide; TGG chr11 5340673 5340692 5340676 -
ctacagtagactatccttag

SEQ ID NO: 35617 - DNA, 20 bp, Artificial Sequence
  Synthetic oligonucleotide; TAG chr11 5340636 5340655 5340639 -
cttgtattccgtcatgcttg

SEQ ID NO: 35618 - DNA, 20 bp, Artificial Sequence
  Synthetic oligonucleotide; CAG chr11 5340532 5340551 5340535 -
tatctccaaactcctaaccg

SEQ ID NO: 35619 - DNA, 20 bp, Artificial Sequence
  Synthetic oligonucleotide; TAG chr11 5340529 5340548 5340532 -
ctccaaactcctaaccgcag

SEQ ID NO: 35620 - DNA, 20 bp, Artificial Sequence
  Synthetic oligonucleotide; AAG chr11 5340526 5340545 5340529 -
caaactcctaaccgcagtag

SEQ ID NO: 35621 - DNA, 20 bp, Artificial Sequence
  Synthetic oligonucleotide; AAG chr11 5340511 5340530 5340514 -
agtagaagaacttttttaaa

SEQ ID NO: 35622 - DNA, 20 bp, Artificial Sequence
  Synthetic oligonucleotide; AAG chr11 5340478 5340497 5340481 -
tatgacattgcaaaaaaaaa

SEQ ID NO: 35623 - DNA, 20 bp, Artificial Sequence
  Synthetic oligonucleotide; GAG chr11 5340476 5340495 5340479 -
tgacattgcaaaaaaaaaaa

SEQ ID NO: 35624 - DNA, 20 bp, Artificial Sequence
  Synthetic oligonucleotide; TAG chr11 5340459 5340478 5340462 -
aaagagtaatgcttttgttg

SEQ ID NO: 35625 - DNA, 20 bp, Artificial Sequence
  Synthetic oligonucleotide; TAG chr11 5340436 5340455 5340439 -
aattactaaaatgcaatgct

SEQ ID NO: 35626 - DNA, 20 bp, Artificial Sequence
  Synthetic oligonucleotide; CAG chr11 5340408 5340427 5340411 -
ttaatgacaatgtttttcat

SEQ ID NO: 35627 - DNA, 20 bp, Artificial Sequence
  Synthetic oligonucleotide; AGG chr11 5340407 5340426 5340410 -
taatgacaatgtttttcatc

SEQ ID NO: 35628 - DNA, 20 bp, Artificial Sequence
  Synthetic oligonucleotide; AAG chr11 5340403 5340422 5340406 -
gacaatgtttttcatcaggc

SEQ ID NO: 35629 - DNA, 20 bp, Artificial Sequence
  Synthetic oligonucleotide; TAG chr11 5340376 5340395 5340379 -
ttcaaactataataaatatt

SEQ ID NO: 35630 - DNA, 20 bp, Artificial Sequence
  Synthetic oligonucleotide; GAG chr11 5340374 5340393 5340377 -
caaactataataaatattta

SEQ ID NO: 35631 - DNA, 20 bp, Artificial Sequence
  Synthetic oligonucleotide; TAG chr11 5340364 5340383 5340367 -
taaatatttagagtaaatta

SEQ ID NO: 35632 - DNA, 20 bp, Artificial Sequence
  Synthetic oligonucleotide; AAG chr11 5340358 5340377 5340361 -
tttagagtaaattatagata

SEQ ID NO: 35633 - DNA, 20 bp, Artificial Sequence
  Synthetic oligonucleotide; AAG chr11 5340338 5340357 5340341 -
aagaaatgataataaataaa

SEQ ID NO: 35634 - DNA, 20 bp, Artificial Sequence
  Synthetic oligonucleotide; GAG chr11 5340304 5340323 5340307 -
ctctgattccatgttttcct

SEQ ID NO: 35635 - DNA, 20 bp, Artificial Sequence
  Synthetic oligonucleotide; CAG chr11 5340298 5340317 5340301 -
ttccatgttttcctgagact

SEQ ID NO: 35636 - DNA, 20 bp, Artificial Sequence
  Synthetic oligonucleotide; AAG chr11 5340291 5340310 5340294 -
ttttcctgagactcagtgac

SEQ ID NO: 35637 - DNA, 20 bp, Artificial Sequence
  Synthetic oligonucleotide; AGG chr11 5340290 5340309 5340293 -
tttcctgagactcagtgaca

SEQ ID NO: 35638 - DNA, 20 bp, Artificial Sequence
  Synthetic oligonucleotide; GAG chr11 5340288 5340307 5340291 -
tcctgagactcagtgacaag

SEQ ID NO: 35639 - DNA, 20 bp, Artificial Sequence
  Synthetic oligonucleotide; AGG chr11 5340287 5340306 5340290 -
cctgagactcagtgacaagg

SEQ ID NO: 35640 - DNA, 20 bp, Artificial Sequence
  Synthetic oligonucleotide; CAG chr11 5340283 5340302 5340286 -
agactcagtgacaaggagga

SEQ ID NO: 35641 - DNA, 20 bp, Artificial Sequence
  Synthetic oligonucleotide; CAG chr11 5340257 5340276 5340260 -
gaatcttttttttgattcca

SEQ ID NO: 35642 - DNA, 20 bp, Artificial Sequence
  Synthetic oligonucleotide; CAG chr11 5340219 5340238 5340222 -
ttcttgtaatttgttttgtt

SEQ ID NO: 35643 - DNA, 20 bp, Artificial Sequence
  Synthetic oligonucleotide; TAG chr11 5340214 5340233 5340217 -
gtaatttgttttgttcagcc

SEQ ID NO: 35644 - DNA, 20 bp, Artificial Sequence
  Synthetic oligonucleotide; CAG chr11 5340208 5340227 5340211 -
tgttttgttcagcctagttt

SEQ ID NO: 35645 - DNA, 20 bp, Artificial Sequence
  Synthetic oligonucleotide; GAG chr11 5340203 5340222 5340206 -
tgttcagcctagtttcagtt

SEQ ID NO: 35646 - DNA, 20 bp, Artificial Sequence
  Synthetic oligonucleotide; AAG chr11 5340185 5340204 5340188 -
ttgagtttcacttataacca

SEQ ID NO: 35647 - DNA, 20 bp, Artificial Sequence
  Synthetic oligonucleotide; AGG chr11 5340184 5340203 5340187 -
tgagtttcacttataaccaa

SEQ ID NO: 35648 - DNA, 20 bp, Artificial Sequence
  Synthetic oligonucleotide; CAG chr11 5340160 5340179 5340163 -
tattaataattatatcatct

SEQ ID NO: 35649 - DNA, 20 bp, Artificial Sequence
  Synthetic oligonucleotide; TAG chr11 5340154 5340173 5340157 -
taattatatcatctcagtta

SEQ ID NO: 35650 - DNA, 20 bp, Artificial Sequence
  Synthetic oligonucleotide; TGG chr11 5340118 5340137 5340121 -
ctctaactaatatttaaaac

SEQ ID NO: 35651 - DNA, 20 bp, Artificial Sequence
  Synthetic oligonucleotide; TAG chr11 5340105 5340124 5340108 -
ttaaaactggaaaatactgt

SEQ ID NO: 35652 - DNA, 20 bp, Artificial Sequence
  Synthetic oligonucleotide; AGG chr11 5340104 5340123 5340107 -
taaaactggaaaatactgtt

SEQ ID NO: 35653 - DNA, 20 bp, Artificial Sequence
  Synthetic oligonucleotide; TAG chr11 5340101 5340120 5340104 -
aactggaaaatactgttagg

SEQ ID NO: 35654 - DNA, 20 bp, Artificial Sequence
  Synthetic oligonucleotide; AAG chr11 5340098 5340117 5340101 -
tggaaaatactgttaggtag

SEQ ID NO: 35655 - DNA, 20 bp, Artificial Sequence
  Synthetic oligonucleotide; GAG chr11 5340096 5340115 5340099 -
gaaaatactgttaggtagaa

SEQ ID NO: 35656 - DNA, 20 bp, Artificial Sequence
  Synthetic oligonucleotide; CAG chr11 5340073 5340092 5340076 -
ctgcctctttttctaaaata

SEQ ID NO: 35657 - DNA, 20 bp, Artificial Sequence
  Synthetic oligonucleotide; AGG chr11 5340072 5340091 5340075 -
tgcctctttttctaaaatac

SEQ ID NO: 35658 - DNA, 20 bp, Artificial Sequence
  Synthetic oligonucleotide; TGG chr11 5340066 5340085 5340069 -
tttttctaaaatacaggaaa

SEQ ID NO: 35659 - DNA, 20 bp, Artificial Sequence
  Synthetic oligonucleotide; TGG chr11 5340053 5340072 5340056 -
caggaaatggaacctaaaaa

SEQ ID NO: 35660 - DNA, 20 bp, Artificial Sequence
  Synthetic oligonucleotide; CAG chr11 5340050 5340069 5340053 -
gaaatggaacctaaaaatgg

SEQ ID NO: 35661 - DNA, 20 bp, Artificial Sequence
  Synthetic oligonucleotide; AGG chr11 5340049 5340068 5340052 -
aaatggaacctaaaaatggc

SEQ ID NO: 35662 - DNA, 20 bp, Artificial Sequence
  Synthetic oligonucleotide; AAG chr11 5340045 5340064 5340048 -
ggaacctaaaaatggcagga

SEQ ID NO: 35663 - DNA, 20 bp, Artificial Sequence
  Synthetic oligonucleotide; TGG chr11 5340033 5340052 5340036 -
tggcaggaaagttgaccatt

SEQ ID NO: 35664 - DNA, 20 bp, Artificial Sequence
  Synthetic oligonucleotide; AAG chr11 5340017 5340036 5340020 -
catttggtgaatgatttatg

SEQ ID NO: 35665 - DNA, 20 bp, Artificial Sequence
  Synthetic oligonucleotide; AAG chr11 5339999 5340018 5340002 -
tgaagttatttcccttgttt

SEQ ID NO: 35666 - DNA, 20 bp, Artificial Sequence
  Synthetic oligonucleotide; AAG chr11 5339996 5340015 5339999 -
agttatttcccttgtttaag

SEQ ID NO: 35667 - DNA, 20 bp, Artificial Sequence
  Synthetic oligonucleotide; AAG chr11 5339977 5339996 5339980 -
gaagttcatttctgacttga

SEQ ID NO: 35668 - DNA, 20 bp, Artificial Sequence
  Synthetic oligonucleotide; AAG chr11 5339973 5339992 5339976 -
ttcatttctgacttgaaagt

SEQ ID NO: 35669 - DNA, 20 bp, Artificial Sequence
  Synthetic oligonucleotide; GAG chr11 5339952 5339971 5339955 -
agtgtgaaactaaattcact

SEQ ID NO: 35670 - DNA, 20 bp, Artificial Sequence
  Synthetic oligonucleotide; AAG chr11 5339949 5339968 5339952 -
gtgaaactaaattcactgag

SEQ ID NO: 35671 - DNA, 20 bp, Artificial Sequence
  Synthetic oligonucleotide; TAG chr11 5339940 5339959 5339943 -
aattcactgagaagatgctg

SEQ ID NO: 35672 - DNA, 20 bp, Artificial Sequence
  Synthetic oligonucleotide; AGG chr11 5339939 5339958 5339942 -
attcactgagaagatgctgt

SEQ ID NO: 35673 - DNA, 20 bp, Artificial Sequence
  Synthetic oligonucleotide; CAG chr11 5339929 5339948 5339932 -
aagatgctgtaggatgaata

SEQ ID NO: 35674 - DNA, 20 bp, Artificial Sequence
  Synthetic oligonucleotide; CAG chr11 5339923 5339942 5339926 -
ctgtaggatgaatacagaca

SEQ ID NO: 35675 - DNA, 20 bp, Artificial Sequence
  Synthetic oligonucleotide; AGG chr11 5339922 5339941 5339925 -
tgtaggatgaatacagacac

SEQ ID NO: 35676 - DNA, 20 bp, Artificial Sequence
  Synthetic oligonucleotide; CGG chr11 5339915 5339934 5339918 -
tgaatacagacacaggacat

SEQ ID NO: 35677 - DNA, 20 bp, Artificial Sequence
  Synthetic oligonucleotide; GAG chr11 5339913 5339932 5339916 -
aatacagacacaggacatcg

SEQ ID NO: 35678 - DNA, 20 bp, Artificial Sequence
  Synthetic oligonucleotide; AGG chr11 5339912 5339931 5339915 -
atacagacacaggacatcgg

SEQ ID NO: 35679 - DNA, 20 bp, Artificial Sequence
  Synthetic oligonucleotide; TGG chr11 5339909 5339928 5339912 -
cagacacaggacatcggagg

SEQ ID NO: 35680 - DNA, 20 bp, Artificial Sequence
  Synthetic oligonucleotide; GGG chr11 5339908 5339927 5339911 -
agacacaggacatcggaggt

SEQ ID NO: 35681 - DNA, 20 bp, Artificial Sequence
  Synthetic oligonucleotide; GGG chr11 5339907 5339926 5339910 -
gacacaggacatcggaggtg

SEQ ID NO: 35682 - DNA, 20 bp, Artificial Sequence
  Synthetic oligonucleotide; GGG chr11 5339906 5339925 5339909 -
acacaggacatcggaggtgg

SEQ ID NO: 35683 - DNA, 20 bp, Artificial Sequence
  Synthetic oligonucleotide; GGG chr11 5339905 5339924 5339908 -
cacaggacatcggaggtggg

SEQ ID NO: 35684 - DNA, 20 bp, Artificial Sequence
  Synthetic oligonucleotide; AAG chr11 5339902 5339921 5339905 -
aggacatcggaggtgggggg

SEQ ID NO: 35685 - DNA, 20 bp, Artificial Sequence
  Synthetic oligonucleotide; TAG chr11 5339878 5339897 5339881 -
ctaaataattatctcaaact

SEQ ID NO: 35686 - DNA, 20 bp, Artificial Sequence
  Synthetic oligonucleotide; CAG chr11 5339870 5339889 5339873 -
ttatctcaaacttagttata

SEQ ID NO: 35687 - DNA, 20 bp, Artificial Sequence
  Synthetic oligonucleotide; AAG chr11 5339867 5339886 5339870 -
tctcaaacttagttatacag

SEQ ID NO: 35688 - DNA, 20 bp, Artificial Sequence
  Synthetic oligonucleotide; AGG chr11 5339866 5339885 5339869 -
ctcaaacttagttatacaga

SEQ ID NO: 35689 - DNA, 20 bp, Artificial Sequence
  Synthetic oligonucleotide; TGG chr11 5339858 5339877 5339861 -
tagttatacagaaggctaca

SEQ ID NO: 35690 - DNA, 20 bp, Artificial Sequence
  Synthetic oligonucleotide; TGG chr11 5339855 5339874 5339858 -
ttatacagaaggctacatgg

SEQ ID NO: 35691 - DNA, 20 bp, Artificial Sequence
  Synthetic oligonucleotide; CAG chr11 5339843 5339862 5339846 -
ctacatggtggaaatccact

SEQ ID NO: 35692 - DNA, 20 bp, Artificial Sequence
  Synthetic oligonucleotide; CAG chr11 5339795 5339814 5339798 -
tgtaacaatcaacataaaca

SEQ ID NO: 35693 - DNA, 20 bp, Artificial Sequence
  Synthetic oligonucleotide; TAG chr11 5339787 5339806 5339790 -
tcaacataaacacagtatgt

SEQ ID NO: 35694 - DNA, 20 bp, Artificial Sequence
  Synthetic oligonucleotide; TAG chr11 5339769 5339788 5339772 -
gttagtattatcataaaatt

SEQ ID NO: 35695 - DNA, 20 bp, Artificial Sequence
  Synthetic oligonucleotide; AAG chr11 5339746 5339765 5339749 -
aactttctgtgatctcctac

SEQ ID NO: 35696 - DNA, 20 bp, Artificial Sequence
  Synthetic oligonucleotide; TGG chr11 5339735 5339754 5339738 -
atctcctacaagtcttcctg

SEQ ID NO: 35697 - DNA, 20 bp, Artificial Sequence
  Synthetic oligonucleotide; TAG chr11 5339714 5339733 5339717 -
ggtaaaatgctatgtactat

SEQ ID NO: 35698 - DNA, 20 bp, Artificial Sequence
  Synthetic oligonucleotide; AAG chr11 5339711 5339730 5339714 -
aaaatgctatgtactattag

SEQ ID NO: 35699 - DNA, 20 bp, Artificial Sequence
  Synthetic oligonucleotide; TAG chr11 5339705 5339724 5339708 -
ctatgtactattagaagcct

SEQ ID NO: 35700 - DNA, 20 bp, Artificial Sequence
  Synthetic oligonucleotide; CAG chr11 5339692 5339711 5339695 -
gaagccttagcaaattaata

SEQ ID NO: 35701 - DNA, 20 bp, Artificial Sequence
  Synthetic oligonucleotide; AGG chr11 5339691 5339710 5339694 -
aagccttagcaaattaatac

SEQ ID NO: 35702 - DNA, 20 bp, Artificial Sequence
  Synthetic oligonucleotide; CAG chr11 5339686 5339705 5339689 -
ttagcaaattaatacaggaa

SEQ ID NO: 35703 - DNA, 20 bp, Artificial Sequence
  Synthetic oligonucleotide; GAG chr11 5339654 5339673 5339657 -
taccacgtgttctcacttat

SEQ ID NO: 35704 - DNA, 20 bp, Artificial Sequence
  Synthetic oligonucleotide; TGG chr11 5339651 5339670 5339654 -
cacgtgttctcacttatgag

SEQ ID NO: 35705 - DNA, 20 bp, Artificial Sequence
  Synthetic oligonucleotide; GGG chr11 5339650 5339669 5339653 -
acgtgttctcacttatgagt

SEQ ID NO: 35706 - DNA, 20 bp, Artificial Sequence
  Synthetic oligonucleotide; GAG chr11 5339648 5339667 5339651 -
gtgttctcacttatgagtgg

SEQ ID NO: 35707 - DNA, 20 bp, Artificial Sequence
  Synthetic oligonucleotide; GAG chr11 5339636 5339655 5339639 -
atgagtgggagctaaatgat

SEQ ID NO: 35708 - DNA, 20 bp, Artificial Sequence
  Synthetic oligonucleotide; TGG chr11 5339627 5339646 5339630 -
agctaaatgatgagaacaca

SEQ ID NO: 35709 - DNA, 20 bp, Artificial Sequence
  Synthetic oligonucleotide; TGG chr11 5339619 5339638 5339622 -
gatgagaacacatggacaca

SEQ ID NO: 35710 - DNA, 20 bp, Artificial Sequence
  Synthetic oligonucleotide; GAG chr11 5339617 5339636 5339620 -
tgagaacacatggacacatg

SEQ ID NO: 35711 - DNA, 20 bp, Artificial Sequence
  Synthetic oligonucleotide; AGG chr11 5339616 5339635 5339619 -
gagaacacatggacacatgg

SEQ ID NO: 35712 - DNA, 20 bp, Artificial Sequence
  Synthetic oligonucleotide; GGG chr11 5339615 5339634 5339618 -
agaacacatggacacatgga

SEQ ID NO: 35713 - DNA, 20 bp, Artificial Sequence
  Synthetic oligonucleotide; GGG chr11 5339614 5339633 5339617 -
gaacacatggacacatggag

SEQ ID NO: 35714 - DNA, 20 bp, Artificial Sequence
  Synthetic oligonucleotide; TGG chr11 5339599 5339618 5339602 -
tggaggggaacatcacacac

SEQ ID NO: 35715 - DNA, 20 bp, Artificial Sequence
  Synthetic oligonucleotide; GGG chr11 5339598 5339617 5339601 -
ggaggggaacatcacacact

SEQ ID NO: 35716 - DNA, 20 bp, Artificial Sequence
  Synthetic oligonucleotide; GGG chr11 5339597 5339616 5339600 -
gaggggaacatcacacactg

SEQ ID NO: 35717 - DNA, 20 bp, Artificial Sequence
  Synthetic oligonucleotide; TGG chr11 5339589 5339608 5339592 -
catcacacactggggcctat

SEQ ID NO: 35718 - DNA, 20 bp, Artificial Sequence
  Synthetic oligonucleotide; GAG chr11 5339587 5339606 5339590 -
tcacacactggggcctattg

SEQ ID NO: 35719 - DNA, 20 bp, Artificial Sequence
  Synthetic oligonucleotide; AGG chr11 5339586 5339605 5339589 -
cacacactggggcctattgg

SEQ ID NO: 35720 - DNA, 20 bp, Artificial Sequence
  Synthetic oligonucleotide; TGG chr11 5339582 5339601 5339585 -
cactggggcctattggagga

SEQ ID NO: 35721 - DNA, 20 bp, Artificial Sequence
  Synthetic oligonucleotide; GAG chr11 5339580 5339599 5339583 -
ctggggcctattggaggatg

SEQ ID NO: 35722 - DNA, 20 bp, Artificial Sequence
  Synthetic oligonucleotide; AGG chr11 5339579 5339598 5339582 -
tggggcctattggaggatgg

SEQ ID NO: 35723 - DNA, 20 bp, Artificial Sequence
  Synthetic oligonucleotide; GGG chr11 5339578 5339597 5339581 -
ggggcctattggaggatgga

SEQ ID NO: 35724 - DNA, 20 bp, Artificial Sequence
  Synthetic oligonucleotide; AAG chr11 5339572 5339591 5339575 -
tattggaggatggagggtga

SEQ ID NO: 35725 - DNA, 20 bp, Artificial Sequence
  Synthetic oligonucleotide; AGG chr11 5339571 5339590 5339574 -
attggaggatggagggtgaa

SEQ ID NO: 35726 - DNA, 20 bp, Artificial Sequence
  Synthetic oligonucleotide; GAG chr11 5339569 5339588 5339572 -
tggaggatggagggtgaaag

SEQ ID NO: 35727 - DNA, 20 bp, Artificial Sequence
  Synthetic oligonucleotide; AGG chr11 5339568 5339587 5339571 -
ggaggatggagggtgaaagg

SEQ ID NO: 35728 - DNA, 20 bp, Artificial Sequence
  Synthetic oligonucleotide; GGG chr11 5339567 5339586 5339570 -
gaggatggagggtgaaagga

SEQ ID NO: 35729 - DNA, 20 bp, Artificial Sequence
  Synthetic oligonucleotide; GAG chr11 5339565 5339584 5339568 -
ggatggagggtgaaaggagg

SEQ ID NO: 35730 - DNA, 20 bp, Artificial Sequence
  Synthetic oligonucleotide; GAG chr11 5339563 5339582 5339566 -
atggagggtgaaaggaggga

SEQ ID NO: 35731 - DNA, 20 bp, Artificial Sequence
  Synthetic oligonucleotide; AGG chr11 5339562 5339581 5339565 -
tggagggtgaaaggagggag

SEQ ID NO: 35732 - DNA, 20 bp, Artificial Sequence
  Synthetic oligonucleotide; CAG chr11 5339557 5339576 5339560 -
ggtgaaaggagggagaggat

SEQ ID NO: 35733 - DNA, 20 bp, Artificial Sequence
  Synthetic oligonucleotide; AGG chr11 5339556 5339575 5339559 -
gtgaaaggagggagaggatc

SEQ ID NO: 35734 - DNA, 20 bp, Artificial Sequence
  Synthetic oligonucleotide; AAG chr11 5339551 5339570 5339554 -
aggagggagaggatcaggaa

SEQ ID NO: 35735 - DNA, 20 bp, Artificial Sequence
  Synthetic oligonucleotide; AAG chr11 5339542 5339561 5339545 -
aggatcaggaaaagtaacaa

SEQ ID NO: 35736 - DNA, 20 bp, Artificial Sequence
  Synthetic oligonucleotide; AGG chr11 5339541 5339560 5339544 -
ggatcaggaaaagtaacaaa

SEQ ID NO: 35737 - DNA, 20 bp, Artificial Sequence
  Synthetic oligonucleotide; GGG chr11 5339540 5339559 5339543 -
gatcaggaaaagtaacaaaa

SEQ ID NO: 35738 - DNA, 20 bp, Artificial Sequence
  Synthetic oligonucleotide; TAG chr11 5339534 5339553 5339537 -
gaaaagtaacaaaagggtac

SEQ ID NO: 35739 - DNA, 20 bp, Artificial Sequence
  Synthetic oligonucleotide; AGG chr11 5339533 5339552 5339536 -
aaaagtaacaaaagggtact

SEQ ID NO: 35740 - DNA, 20 bp, Artificial Sequence
  Synthetic oligonucleotide; GAG chr11 5339520 5339539 5339523 -
gggtactaggcttaatacct

SEQ ID NO: 35741 - DNA, 20 bp, Artificial Sequence
  Synthetic oligonucleotide; GAG chr11 5339516 5339535 5339519 -
actaggcttaatacctgagt

SEQ ID NO: 35742 - DNA, 20 bp, Artificial Sequence
  Synthetic oligonucleotide; AAG chr11 5339477 5339496 5339480 -
acaacaaaccctcgtgacac

SEQ ID NO: 35743 - DNA, 20 bp, Artificial Sequence
  Synthetic oligonucleotide; CAG chr11 5339461 5339480 5339464 -
acacaagtttaaatatgtaa

SEQ ID NO: 35744 - DNA, 20 bp, Artificial Sequence
  Synthetic oligonucleotide; AAG chr11 5339427 5339446 5339430 -
tactcctgaacctaaaataa

SEQ ID NO: 35745 - DNA, 20 bp, Artificial Sequence
  Synthetic oligonucleotide; TAG chr11 5339423 5339442 5339426 -
cctgaacctaaaataaaagt

SEQ ID NO: 35746 - DNA, 20 bp, Artificial Sequence
  Synthetic oligonucleotide; TAG chr11 5339419 5339438 5339422 -
aacctaaaataaaagttagt

SEQ ID NO: 35747 - DNA, 20 bp, Artificial Sequence
  Synthetic oligonucleotide; AGG chr11 5339418 5339437 5339421 -
acctaaaataaaagttagtt

SEQ ID NO: 35748 - DNA, 20 bp, Artificial Sequence
  Synthetic oligonucleotide; AAG chr11 5339413 5339432 5339416 -
aaataaaagttagttaggaa

SEQ ID NO: 35749 - DNA, 20 bp, Artificial Sequence
  Synthetic oligonucleotide; AAG chr11 5339410 5339429 5339413 -
taaaagttagttaggaaaag

SEQ ID NO: 35750 - DNA, 20 bp, Artificial Sequence
  Synthetic oligonucleotide; TAG chr11 5339386 5339405 5339389 -
ctatttataacactatctcc

SEQ ID NO: 35751 - DNA, 20 bp, Artificial Sequence
  Synthetic oligonucleotide; AGG chr11 5339385 5339404 5339388 -
tatttataacactatctcct

SEQ ID NO: 35752 - DNA, 20 bp, Artificial Sequence
  Synthetic oligonucleotide; AAG chr11 5339355 5339374 5339358 -
gcacatgaatttgtattcat

SEQ ID NO: 35753 - DNA, 20 bp, Artificial Sequence
  Synthetic oligonucleotide; AAG chr11 5339352 5339371 5339355 -
catgaatttgtattcataag

SEQ ID NO: 35754 - DNA, 20 bp, Artificial Sequence
  Synthetic oligonucleotide; GAG chr11 5339350 5339369 5339353 -
tgaatttgtattcataagaa

SEQ ID NO: 35755 - DNA, 20 bp, Artificial Sequence
  Synthetic oligonucleotide; TAG chr11 5339347 5339366 5339350 -
atttgtattcataagaagag

SEQ ID NO: 35756 - DNA, 20 bp, Artificial Sequence
  Synthetic oligonucleotide; CAG chr11 5339340 5339359 5339343 -
ttcataagaagagtagaatt

SEQ ID NO: 35757 - DNA, 20 bp, Artificial Sequence
  Synthetic oligonucleotide; GAG chr11 5339338 5339357 5339341 -
cataagaagagtagaattca

SEQ ID NO: 35758 - DNA, 20 bp, Artificial Sequence
  Synthetic oligonucleotide; TGG chr11 5339335 5339354 5339338 -
aagaagagtagaattcagag

SEQ ID NO: 35759 - DNA, 20 bp, Artificial Sequence
  Synthetic oligonucleotide; CAG chr11 5339330 5339349 5339333 -
gagtagaattcagagtggtc

SEQ ID NO: 35760 - DNA, 20 bp, Artificial Sequence
  Synthetic oligonucleotide; TGG chr11 5339327 5339346 5339330 -
tagaattcagagtggtccag

SEQ ID NO: 35761 - DNA, 20 bp, Artificial Sequence
  Synthetic oligonucleotide; TGG chr11 5339314 5339333 5339317 -
ggtccagtggactaacaaac

SEQ ID NO: 35762 - DNA, 20 bp, Artificial Sequence
  Synthetic oligonucleotide; CAG chr11 5339296 5339315 5339299 -
actggtgaaccaccttctta

SEQ ID NO: 35763 - DNA, 20 bp, Artificial Sequence
  Synthetic oligonucleotide; CAG chr11 5339293 5339312 5339296 -
ggtgaaccaccttcttacag

SEQ ID NO: 35764 - DNA, 20 bp, Artificial Sequence
  Synthetic oligonucleotide; AGG chr11 5339292 5339311 5339295 -
gtgaaccaccttcttacagc

SEQ ID NO: 35765 - DNA, 20 bp, Artificial Sequence
  Synthetic oligonucleotide; AAG chr11 5339287 5339306 5339290 -
ccaccttcttacagcaggtg

SEQ ID NO: 35766 - DNA, 20 bp, Artificial Sequence
  Synthetic oligonucleotide; CAG chr11 5339275 5339294 5339278 -
agcaggtgaagcctgtaatt

SEQ ID NO: 35767 - DNA, 20 bp, Artificial Sequence
  Synthetic oligonucleotide; AAG chr11 5339259 5339278 5339262 -
aattcagcttttcatcattc

SEQ ID NO: 35768 - DNA, 20 bp, Artificial Sequence
  Synthetic oligonucleotide; AAG chr11 5339251 5339270 5339254 -
ttttcatcattcaagactga

SEQ ID NO: 35769 - DNA, 20 bp, Artificial Sequence
  Synthetic oligonucleotide; AAG chr11 5339248 5339267 5339251 -
tcatcattcaagactgaaag

SEQ ID NO: 35770 - DNA, 20 bp, Artificial Sequence
  Synthetic oligonucleotide; TAG chr11 5339232 5339251 5339235 -
aaagaagaatataacttata

SEQ ID NO: 35771 - DNA, 20 bp, Artificial Sequence
  Synthetic oligonucleotide; GAG chr11 5339230 5339249 5339233 -
agaagaatataacttatata

SEQ ID NO: 35772 - DNA, 20 bp, Artificial Sequence
  Synthetic oligonucleotide; AAG chr11 5339227 5339246 5339230 -
agaatataacttatatagag

SEQ ID NO: 35773 - DNA, 20 bp, Artificial Sequence
  Synthetic oligonucleotide; AGG chr11 5339226 5339245 5339229 -
gaatataacttatatagaga

SEQ ID NO: 35774 - DNA, 20 bp, Artificial Sequence
  Synthetic oligonucleotide; GAG chr11 5339216 5339235 5339219 -
tatatagagaaggacctcat

SEQ ID NO: 35775 - DNA, 20 bp, Artificial Sequence
  Synthetic oligonucleotide; AGG chr11 5339215 5339234 5339218 -
atatagagaaggacctcatg

SEQ ID NO: 35776 - DNA, 20 bp, Artificial Sequence
  Synthetic oligonucleotide; TGG chr11 5339201 5339220 5339204 -
ctcatgaggaataaatttca

SEQ ID NO: 35777 - DNA, 20 bp, Artificial Sequence
  Synthetic oligonucleotide; AAG chr11 5339190 5339209 5339193 -
taaatttcatggtgcctatt

SEQ ID NO: 35778 - DNA, 20 bp, Artificial Sequence
  Synthetic oligonucleotide; AAG chr11 5339181 5339200 5339184 -
tggtgcctattaagataaat

SEQ ID NO: 35779 - DNA, 20 bp, Artificial Sequence
  Synthetic oligonucleotide; TAG chr11 5339171 5339190 5339174 -
taagataaataagtaccatg

SEQ ID NO: 35780 - DNA, 20 bp, Artificial Sequence
  Synthetic oligonucleotide; TGG chr11 5339165 5339184 5339168 -
aaataagtaccatgtagtta

SEQ ID NO: 35781 - DNA, 20 bp, Artificial Sequence
  Synthetic oligonucleotide; GGG chr11 5339164 5339183 5339167 -
aataagtaccatgtagttat

SEQ ID NO: 35782 - DNA, 20 bp, Artificial Sequence
  Synthetic oligonucleotide; AAG chr11 5339155 5339174 5339158 -
catgtagttatgggaaatct

SEQ ID NO: 35783 - DNA, 20 bp, Artificial Sequence
  Synthetic oligonucleotide; AGG chr11 5339154 5339173 5339157 -
atgtagttatgggaaatcta

SEQ ID NO: 35784 - DNA, 20 bp, Artificial Sequence
  Synthetic oligonucleotide; AAG chr11 5339146 5339165 5339149 -
atgggaaatctaaggtgtaa

SEQ ID NO: 35785 - DNA, 20 bp, Artificial Sequence
  Synthetic oligonucleotide; AAG chr11 5339128 5339147 5339131 -
aaaagaatatacattaaaaa

SEQ ID NO: 35786 - DNA, 20 bp, Artificial Sequence
  Synthetic oligonucleotide; TAG chr11 5339077 5339096 5339080 -
caaataataatatacttgtg

SEQ ID NO: 35787 - DNA, 20 bp, Artificial Sequence
  Synthetic oligonucleotide; TGG chr11 5339072 5339091 5339075 -
aataatatacttgtgtagta

SEQ ID NO: 35788 - DNA, 20 bp, Artificial Sequence
  Synthetic oligonucleotide; GGG chr11 5339071 5339090 5339074 -
ataatatacttgtgtagtat

SEQ ID NO: 35789 - DNA, 20 bp, Artificial Sequence
  Synthetic oligonucleotide; AAG chr11 5339064 5339083 5339067 -
acttgtgtagtatgggcttg

SEQ ID NO: 35790 - DNA, 20 bp, Artificial Sequence
  Synthetic oligonucleotide; AGG chr11 5339063 5339082 5339066 -
cttgtgtagtatgggcttga

SEQ ID NO: 35791 - DNA, 20 bp, Artificial Sequence
  Synthetic oligonucleotide; GGG chr11 5339062 5339081 5339065 -
ttgtgtagtatgggcttgaa

SEQ ID NO: 35792 - DNA, 20 bp, Artificial Sequence
  Synthetic oligonucleotide; AAG chr11 5339047 5339066 5339050 -
ttgaagggataacataccat

SEQ ID NO: 35793 - DNA, 20 bp, Artificial Sequence
  Synthetic oligonucleotide; GAG chr11 5339032 5339051 5339035 -
accataagaatatttaattt

SEQ ID NO: 35794 - DNA, 20 bp, Artificial Sequence
  Synthetic oligonucleotide; CAG chr11 5339028 5339047 5339031 -
taagaatatttaatttgagt

SEQ ID NO: 35795 - DNA, 20 bp, Artificial Sequence
  Synthetic oligonucleotide; AGG chr11 5339027 5339046 5339030 -
aagaatatttaatttgagtc

SEQ ID NO: 35796 - DNA, 20 bp, Artificial Sequence
  Synthetic oligonucleotide; AAG chr11 5339018 5339037 5339021 -
taatttgagtcaggaaatga

SEQ ID NO: 35797 - DNA, 20 bp, Artificial Sequence
  Synthetic oligonucleotide; AGG chr11 5339017 5339036 5339020 -
aatttgagtcaggaaatgaa

SEQ ID NO: 35798 - DNA, 20 bp, Artificial Sequence
  Synthetic oligonucleotide; AAG chr11 5339012 5339031 5339015 -
gagtcaggaaatgaaaggct

SEQ ID NO: 35799 - DNA, 20 bp, Artificial Sequence
  Synthetic oligonucleotide; TAG chr11 5338997 5339016 5339000 -
aggctaagtgtgcatttctg

SEQ ID NO: 35800 - DNA, 20 bp, Artificial Sequence
  Synthetic oligonucleotide; AAG chr11 5338991 5339010 5338994 -
agtgtgcatttctgtagact

SEQ ID NO: 35801 - DNA, 20 bp, Artificial Sequence
  Synthetic oligonucleotide; TAG chr11 5338981 5339000 5338984 -
tctgtagactaagccaatct

SEQ ID NO: 35802 - DNA, 20 bp, Artificial Sequence
  Synthetic oligonucleotide; AAG chr11 5338970 5338989 5338973 -
agccaatcttagaaatgatt

SEQ ID NO: 35803 - DNA, 20 bp, Artificial Sequence
  Synthetic oligonucleotide; AAG chr11 5338967 5338986 5338970 -
caatcttagaaatgattaag

SEQ ID NO: 35804 - DNA, 20 bp, Artificial Sequence
  Synthetic oligonucleotide; TGG chr11 5338961 5338980 5338964 -
tagaaatgattaagaagacg

SEQ ID NO: 35805 - DNA, 20 bp, Artificial Sequence
  Synthetic oligonucleotide; AAG chr11 5338958 5338977 5338961 -
aaatgattaagaagacgtgg

SEQ ID NO: 35806 - DNA, 20 bp, Artificial Sequence
  Synthetic oligonucleotide; TAG chr11 5338950 5338969 5338953 -
aagaagacgtggaagaatct

SEQ ID NO: 35807 - DNA, 20 bp, Artificial Sequence
  Synthetic oligonucleotide; GAG chr11 5338948 5338967 5338951 -
gaagacgtggaagaatctta

SEQ ID NO: 35808 - DNA, 20 bp, Artificial Sequence
  Synthetic oligonucleotide; TGG chr11 5338925 5338944 5338928 -
acacactgaaaaaatatgta

SEQ ID NO: 35809 - DNA, 20 bp, Artificial Sequence
  Synthetic oligonucleotide; GAG chr11 5338916 5338935 5338919 -
aaaaatatgtatggtctaat

SEQ ID NO: 35810 - DNA, 20 bp, Artificial Sequence
  Synthetic oligonucleotide; CAG chr11 5338909 5338928 5338912 -
tgtatggtctaatgagttta

SEQ ID NO: 35811 - DNA, 20 bp, Artificial Sequence
  Synthetic oligonucleotide; TAG chr11 5338872 5338891 5338875 -
catataaaatgaatttatac

SEQ ID NO: 35812 - DNA, 20 bp, Artificial Sequence
  Synthetic oligonucleotide; AAG chr11 5338867 5338886 5338870 -
aaaatgaatttatactagat

SEQ ID NO: 35813 - DNA, 20 bp, Artificial Sequence
  Synthetic oligonucleotide; AGG chr11 5338866 5338885 5338869 -
aaatgaatttatactagata

SEQ ID NO: 35814 - DNA, 20 bp, Artificial Sequence
  Synthetic oligonucleotide; GGG chr11 5338865 5338884 5338868 -
aatgaatttatactagataa

SEQ ID NO: 35815 - DNA, 20 bp, Artificial Sequence
  Synthetic oligonucleotide; GGG chr11 5338864 5338883 5338867 -
atgaatttatactagataag

SEQ ID NO: 35816 - DNA, 20 bp, Artificial Sequence
  Synthetic oligonucleotide; AAG chr11 5338861 5338880 5338864 -
aatttatactagataagggg

SEQ ID NO: 35817 - DNA, 20 bp, Artificial Sequence
  Synthetic oligonucleotide; TGG chr11 5338824 5338843 5338827 -
tctcattaacaaataattgc

SEQ ID NO: 35818 - DNA, 20 bp, Artificial Sequence
  Synthetic oligonucleotide; GGG chr11 5338823 5338842 5338826 -
ctcattaacaaataattgct

SEQ ID NO: 35819 - DNA, 20 bp, Artificial Sequence
  Synthetic oligonucleotide; CAG chr11 5338811 5338830 5338814 -
taattgctgggttccttcac

SEQ ID NO: 35820 - DNA, 20 bp, Artificial Sequence
  Synthetic oligonucleotide; GAG chr11 5338809 5338828 5338812 -
attgctgggttccttcacca

SEQ ID NO: 35821 - DNA, 20 bp, Artificial Sequence
  Synthetic oligonucleotide; CAG chr11 5338803 5338822 5338806 -
gggttccttcaccagagatg

SEQ ID NO: 35822 - DNA, 20 bp, Artificial Sequence
  Synthetic oligonucleotide; TAG chr11 5338793 5338812 5338796 -
accagagatgcagattttta

SEQ ID NO: 35823 - DNA, 20 bp, Artificial Sequence
  Synthetic oligonucleotide; AGG chr11 5338792 5338811 5338795 -
ccagagatgcagatttttat

SEQ ID NO: 35824 - DNA, 20 bp, Artificial Sequence
  Synthetic oligonucleotide; GGG chr11 5338791 5338810 5338794 -
cagagatgcagatttttata

SEQ ID NO: 35825 - DNA, 20 bp, Artificial Sequence
  Synthetic oligonucleotide; AAG chr11 5338781 5338800 5338784 -
gatttttatagggtaaatga

SEQ ID NO: 35826 - DNA, 20 bp, Artificial Sequence
  Synthetic oligonucleotide; AGG chr11 5338780 5338799 5338783 -
atttttatagggtaaatgaa

SEQ ID NO: 35827 - DNA, 20 bp, Artificial Sequence
  Synthetic oligonucleotide; AAG chr11 5338766 5338785 5338769 -
aatgaaaggtgatatattta

SEQ ID NO: 35828 - DNA, 20 bp, Artificial Sequence
  Synthetic oligonucleotide; TAG chr11 5338755 5338774 5338758 -
atatatttaaagatacttac

SEQ ID NO: 35829 - DNA, 20 bp, Artificial Sequence
  Synthetic oligonucleotide; GAG chr11 5338745 5338764 5338748 -
agatacttactagattatat

SEQ ID NO: 35830 - DNA, 20 bp, Artificial Sequence
  Synthetic oligonucleotide; TGG chr11 5338734 5338753 5338737 -
agattatatgagtattaaat

SEQ ID NO: 35831 - DNA, 20 bp, Artificial Sequence
  Synthetic oligonucleotide; GGG chr11 5338733 5338752 5338736 -
gattatatgagtattaaatt

SEQ ID NO: 35832 - DNA, 20 bp, Artificial Sequence
  Synthetic oligonucleotide; CAG chr11 5338730 5338749 5338733 -
tatatgagtattaaattggg

SEQ ID NO: 35833 - DNA, 20 bp, Artificial Sequence
  Synthetic oligonucleotide; AAG chr11 5338726 5338745 5338729 -
tgagtattaaattgggcagc

SEQ ID NO: 35834 - DNA, 20 bp, Artificial Sequence
  Synthetic oligonucleotide; AGG chr11 5338725 5338744 5338728 -
gagtattaaattgggcagca

SEQ ID NO: 35835 - DNA, 20 bp, Artificial Sequence
  Synthetic oligonucleotide; TAG chr11 5338717 5338736 5338720 -
aattgggcagcaaggatgat

SEQ ID NO: 35836 - DNA, 20 bp, Artificial Sequence
  Synthetic oligonucleotide; AAG chr11 5338706 5338725 5338709 -
aaggatgattagaaatgatt

SEQ ID NO: 35837 - DNA, 20 bp, Artificial Sequence
  Synthetic oligonucleotide; AGG chr11 5338705 5338724 5338708 -
aggatgattagaaatgatta

SEQ ID NO: 35838 - DNA, 20 bp, Artificial Sequence
  Synthetic oligonucleotide; CAG chr11 5338699 5338718 5338702 -
attagaaatgattaaggacc

SEQ ID NO: 35839 - DNA, 20 bp, Artificial Sequence
  Synthetic oligonucleotide; GAG chr11 5338697 5338716 5338700 -
tagaaatgattaaggaccca

SEQ ID NO: 35840 - DNA, 20 bp, Artificial Sequence
  Synthetic oligonucleotide; AGG chr11 5338696 5338715 5338699 -
agaaatgattaaggacccag

SEQ ID NO: 35841 - DNA, 20 bp, Artificial Sequence
  Synthetic oligonucleotide; AAG chr11 5338677 5338696 5338680 -
gaggtctccatgtccaatta

SEQ ID NO: 35842 - DNA, 20 bp, Artificial Sequence
  Synthetic oligonucleotide; TAG chr11 5338650 5338669 5338653 -
taaatctgtttttgatttta

SEQ ID NO: 35843 - DNA, 20 bp, Artificial Sequence
  Synthetic oligonucleotide; TAG chr11 5338637 5338656 5338640 -
gattttatagcctaaatcct

SEQ ID NO: 35844 - DNA, 20 bp, Artificial Sequence
  Synthetic oligonucleotide; CAG chr11 5338631 5338650 5338634 -
atagcctaaatccttagaca

SEQ ID NO: 35845 - DNA, 20 bp, Artificial Sequence
  Synthetic oligonucleotide; TAG chr11 5338607 5338626 5338610 -
cattgttattaataaactca

SEQ ID NO: 35846 - DNA, 20 bp, Artificial Sequence
  Synthetic oligonucleotide; TGG chr11 5338589 5338608 5338592 -
catagacaaaatttatttta

SEQ ID NO: 35847 - DNA, 20 bp, Artificial Sequence
  Synthetic oligonucleotide; GGG chr11 5338588 5338607 5338591 -
atagacaaaatttattttat

SEQ ID NO: 35848 - DNA, 20 bp, Artificial Sequence
  Synthetic oligonucleotide; TAG chr11 5338580 5338599 5338583 -
aatttattttatgggaaatt

SEQ ID NO: 35849 - DNA, 20 bp, Artificial Sequence
  Synthetic oligonucleotide; AGG chr11 5338579 5338598 5338582 -
atttattttatgggaaattt

SEQ ID NO: 35850 - DNA, 20 bp, Artificial Sequence
  Synthetic oligonucleotide; GAG chr11 5338577 5338596 5338580 -
ttattttatgggaaatttag

SEQ ID NO: 35851 - DNA, 20 bp, Artificial Sequence
  Synthetic oligonucleotide; TAG chr11 5338564 5338583 5338567 -
aatttaggagtttatgtccc

SEQ ID NO: 35852 - DNA, 20 bp, Artificial Sequence
  Synthetic oligonucleotide; AAG chr11 5338556 5338575 5338559 -
agtttatgtccctagatttc

SEQ ID NO: 35853 - DNA, 20 bp, Artificial Sequence
  Synthetic oligonucleotide; CAG chr11 5338535 5338554 5338538 -
agtacatgccaccaaactga

SEQ ID NO: 35854 - DNA, 20 bp, Artificial Sequence
  Synthetic oligonucleotide; CAG chr11 5338528 5338547 5338531 -
gccaccaaactgacagatga

SEQ ID NO: 35855 - DNA, 20 bp, Artificial Sequence
  Synthetic oligonucleotide; TAG chr11 5338521 5338540 5338524 -
aactgacagatgacagtgat

SEQ ID NO: 35856 - DNA, 20 bp, Artificial Sequence
  Synthetic oligonucleotide; AAG chr11 5338513 5338532 5338516 -
gatgacagtgattagtcaca

SEQ ID NO: 35857 - DNA, 20 bp, Artificial Sequence
  Synthetic oligonucleotide; TAG chr11 5338499 5338518 5338502 -
gtcacaaagtgcctcaaaaa

SEQ ID NO: 35858 - DNA, 20 bp, Artificial Sequence
  Synthetic oligonucleotide; TGG chr11 5338495 5338514 5338498 -
caaagtgcctcaaaaataga

SEQ ID NO: 35859 - DNA, 20 bp, Artificial Sequence
  Synthetic oligonucleotide; TAG chr11 5338484 5338503 5338487 -
aaaaatagatggccctatgt

SEQ ID NO: 35860 - DNA, 20 bp, Artificial Sequence
  Synthetic oligonucleotide; TGG chr11 5338478 5338497 5338481 -
agatggccctatgttagtca

SEQ ID NO: 35861 - DNA, 20 bp, Artificial Sequence
  Synthetic oligonucleotide; CAG chr11 5338470 5338489 5338473 -
ctatgttagtcatggttctc

SEQ ID NO: 35862 - DNA, 20 bp, Artificial Sequence
  Synthetic oligonucleotide; TAG chr11 5338462 5338481 5338465 -
gtcatggttctccagaaaaa

SEQ ID NO: 35863 - DNA, 20 bp, Artificial Sequence
  Synthetic oligonucleotide; CAG chr11 5338453 5338472 5338456 -
ctccagaaaaatagaatcaa

SEQ ID NO: 35864 - DNA, 20 bp, Artificial Sequence
  Synthetic oligonucleotide; AGG chr11 5338452 5338471 5338455 -
tccagaaaaatagaatcaac

SEQ ID NO: 35865 - DNA, 20 bp, Artificial Sequence
  Synthetic oligonucleotide; AAG chr11 5338423 5338442 5338426 -
ccaacttcaaattatactac

SEQ ID NO: 35866 - DNA, 20 bp, Artificial Sequence
  Synthetic oligonucleotide; AGG chr11 5338422 5338441 5338425 -
caacttcaaattatactaca

SEQ ID NO: 35867 - DNA, 20 bp, Artificial Sequence
  Synthetic oligonucleotide; CAG chr11 5338416 5338435 5338419 -
caaattatactacaaggtga

SEQ ID NO: 35868 - DNA, 20 bp, Artificial Sequence
  Synthetic oligonucleotide; CAG chr11 5338400 5338419 5338403 -
gtgacagtaactaactgaaa

SEQ ID NO: 35869 - DNA, 20 bp, Artificial Sequence
  Synthetic oligonucleotide; TGG chr11 5338395 5338414 5338398 -
agtaactaactgaaacagca

SEQ ID NO: 35870 - DNA, 20 bp, Artificial Sequence
  Synthetic oligonucleotide; CAG chr11 5338379 5338398 5338382 -
agcatggtactgataccaaa

SEQ ID NO: 35871 - DNA, 20 bp, Artificial Sequence
  Synthetic oligonucleotide; TGG chr11 5338363 5338382 5338366 -
caaacagacacactgactaa

SEQ ID NO: 35872 - DNA, 20 bp, Artificial Sequence
  Synthetic oligonucleotide; CAG chr11 5338358 5338377 5338361 -
agacacactgactaatggaa

SEQ ID NO: 35873 - DNA, 20 bp, Artificial Sequence
  Synthetic oligonucleotide; TGG chr11 5338353 5338372 5338356 -
cactgactaatggaacagaa

SEQ ID NO: 35874 - DNA, 20 bp, Artificial Sequence
  Synthetic oligonucleotide; GAG chr11 5338351 5338370 5338354 -
ctgactaatggaacagaatg

SEQ ID NO: 35875 - DNA, 20 bp, Artificial Sequence
  Synthetic oligonucleotide; CAG chr11 5338344 5338363 5338347 -
atggaacagaatggagaact

SEQ ID NO: 35876 - DNA, 20 bp, Artificial Sequence
  Synthetic oligonucleotide; AAG chr11 5338341 5338360 5338344 -
gaacagaatggagaactcag

SEQ ID NO: 35877 - DNA, 20 bp, Artificial Sequence
  Synthetic oligonucleotide; AAG chr11 5338337 5338356 5338340 -
agaatggagaactcagaagt

SEQ ID NO: 35878 - DNA, 20 bp, Artificial Sequence
  Synthetic oligonucleotide; TGG chr11 5338298 5338317 5338301 -
aatctgatcttcaacaaacc

SEQ ID NO: 35879 - DNA, 20 bp, Artificial Sequence
  Synthetic oligonucleotide; AAG chr11 5338288 5338307 5338291 -
tcaacaaacctggtaaaaac

SEQ ID NO: 35880 - DNA, 20 bp, Artificial Sequence
  Synthetic oligonucleotide; TGG chr11 5338282 5338301 5338285 -
aacctggtaaaaacaagtaa

SEQ ID NO: 35881 - DNA, 20 bp, Artificial Sequence
  Synthetic oligonucleotide; GGG chr11 5338281 5338300 5338284 -
acctggtaaaaacaagtaat

SEQ ID NO: 35882 - DNA, 20 bp, Artificial Sequence
  Synthetic oligonucleotide; GGG chr11 5338280 5338299 5338283 -
cctggtaaaaacaagtaatg

SEQ ID NO: 35883 - DNA, 20 bp, Artificial Sequence
  Synthetic oligonucleotide; AAG chr11 5338277 5338296 5338280 -
ggtaaaaacaagtaatgggg

SEQ ID NO: 35884 - DNA, 20 bp, Artificial Sequence
  Synthetic oligonucleotide; AGG chr11 5338276 5338295 5338279 -
gtaaaaacaagtaatgggga

SEQ ID NO: 35885 - DNA, 20 bp, Artificial Sequence
  Synthetic oligonucleotide; GGG chr11 5338275 5338294 5338278 -
taaaaacaagtaatggggaa

SEQ ID NO: 35886 - DNA, 20 bp, Artificial Sequence
  Synthetic oligonucleotide; TGG chr11 5338249 5338268 5338252 -
ccctattttataaattgtgc

SEQ ID NO: 35887 - DNA, 20 bp, Artificial Sequence
  Synthetic oligonucleotide; GGG chr11 5338248 5338267 5338251 -
cctattttataaattgtgct

SEQ ID NO: 35888 - DNA, 20 bp, Artificial Sequence
  Synthetic oligonucleotide; GAG chr11 5338246 5338265 5338249 -
tattttataaattgtgctgg

SEQ ID NO: 35889 - DNA, 20 bp, Artificial Sequence
  Synthetic oligonucleotide; TGG chr11 5338240 5338259 5338243 -
ataaattgtgctgggagaac

SEQ ID NO: 35890 - DNA, 20 bp, Artificial Sequence
  Synthetic oligonucleotide; TAG chr11 5338236 5338255 5338239 -
attgtgctgggagaactggc

SEQ ID NO: 35891 - DNA, 20 bp, Artificial Sequence
  Synthetic oligonucleotide; CAG chr11 5338226 5338245 5338229 -
gagaactggctagccatatg

SEQ ID NO: 35892 - DNA, 20 bp, Artificial Sequence
  Synthetic oligonucleotide; TGG chr11 5338212 5338231 5338215 -
catatgcagaaaattgaaac

SEQ ID NO: 35893 - DNA, 20 bp, Artificial Sequence
  Synthetic oligonucleotide; AAG chr11 5338175 5338194 5338178 -
tcttatacataaattaactc

SEQ ID NO: 35894 - DNA, 20 bp, Artificial Sequence
  Synthetic oligonucleotide; AAG chr11 5338164 5338183 5338167 -
aattaactcaagatgcatta

SEQ ID NO: 35895 - DNA, 20 bp, Artificial Sequence
  Synthetic oligonucleotide; AAG chr11 5338157 5338176 5338160 -
tcaagatgcattaaagactt

SEQ ID NO: 35896 - DNA, 20 bp, Artificial Sequence
  Synthetic oligonucleotide; TAG chr11 5338128 5338147 5338131 -
acccaaaactataaaaactt

SEQ ID NO: 35897 - DNA, 20 bp, Artificial Sequence
  Synthetic oligonucleotide; AAG chr11 5338125 5338144 5338128 -
caaaactataaaaactttag

SEQ ID NO: 35898 - DNA, 20 bp, Artificial Sequence
  Synthetic oligonucleotide; TAG chr11 5338116 5338135 5338119 -
aaaaactttagaagaaaacc

SEQ ID NO: 35899 - DNA, 20 bp, Artificial Sequence
  Synthetic oligonucleotide; AGG chr11 5338115 5338134 5338118 -
aaaactttagaagaaaacct

SEQ ID NO: 35900 - DNA, 20 bp, Artificial Sequence
  Synthetic oligonucleotide; CGG chr11 5338101 5338120 5338104 -
aaacctaggcaataccattc

SEQ ID NO: 35901 - DNA, 20 bp, Artificial Sequence
  Synthetic oligonucleotide; TAG chr11 5338095 5338114 5338098 -
aggcaataccattccggaca

SEQ ID NO: 35902 - DNA, 20 bp, Artificial Sequence
  Synthetic oligonucleotide; CAG chr11 5338089 5338108 5338092 -
taccattccggacatagaca

SEQ ID NO: 35903 - DNA, 20 bp, Artificial Sequence
  Synthetic oligonucleotide; AGG chr11 5338088 5338107 5338091 -
accattccggacatagacac

SEQ ID NO: 35904 - DNA, 20 bp, Artificial Sequence
  Synthetic oligonucleotide; AAG chr11 5338083 5338102 5338086 -
tccggacatagacacaggca

SEQ ID NO: 35905 - DNA, 20 bp, Artificial Sequence
  Synthetic oligonucleotide; AAG chr11 5338044 5338063 5338047 -
gtcaaaaacaattgcaacaa

SEQ ID NO: 35906 - DNA, 20 bp, Artificial Sequence
  Synthetic oligonucleotide; GAG chr11 5338026 5338045 5338029 -
aaaagcaaacactgtcaaat

SEQ ID NO: 35907 - DNA, 20 bp, Artificial Sequence
  Synthetic oligonucleotide; AAG chr11 5338009 5338028 5338012 -
aatgagatctaattaaacta

SEQ ID NO: 35908 - DNA, 20 bp, Artificial Sequence
  Synthetic oligonucleotide; GAG chr11 5338007 5338026 5338010 -
tgagatctaattaaactaaa

SEQ ID NO: 35909 - DNA, 20 bp, Artificial Sequence
  Synthetic oligonucleotide; CGG chr11 5338002 5338021 5338005 -
tctaattaaactaaagagat

SEQ ID NO: 35910 - DNA, 20 bp, Artificial Sequence
  Synthetic oligonucleotide; GGG chr11 5338001 5338020 5338004 -
ctaattaaactaaagagatc

SEQ ID NO: 35911 - DNA, 20 bp, Artificial Sequence
  Synthetic oligonucleotide; TGG chr11 5337996 5338015 5337999 -
taaactaaagagatcgggca

SEQ ID NO: 35912 - DNA, 20 bp, Artificial Sequence
  Synthetic oligonucleotide; TGG chr11 5337993 5338012 5337996 -
actaaagagatcgggcatgg

SEQ ID NO: 35913 - DNA, 20 bp, Artificial Sequence
  Synthetic oligonucleotide; CAG chr11 5337974 5337993 5337977 -
gtggctcacgcctgtaatcc

SEQ ID NO: 35914 - DNA, 20 bp, Artificial Sequence
  Synthetic oligonucleotide; TGG chr11 5337966 5337985 5337969 -
cgcctgtaatcccagcactt

SEQ ID NO: 35915 - DNA, 20 bp, Artificial Sequence
  Synthetic oligonucleotide; GGG chr11 5337965 5337984 5337968 -
gcctgtaatcccagcacttt

SEQ ID NO: 35916 - DNA, 20 bp, Artificial Sequence
  Synthetic oligonucleotide; GAG chr11 5337963 5337982 5337966 -
ctgtaatcccagcactttgg

SEQ ID NO: 35917 - DNA, 20 bp, Artificial Sequence
  Synthetic oligonucleotide; AGG chr11 5337962 5337981 5337965 -
tgtaatcccagcactttggg

SEQ ID NO: 35918 - DNA, 20 bp, Artificial Sequence
  Synthetic oligonucleotide; AAG chr11 5337957 5337976 5337960 -
tcccagcactttgggaggcc

SEQ ID NO: 35919 - DNA, 20 bp, Artificial Sequence
  Synthetic oligonucleotide; AGG chr11 5337956 5337975 5337959 -
cccagcactttgggaggcca

SEQ ID NO: 35920 - DNA, 20 bp, Artificial Sequence
  Synthetic oligonucleotide; TGG chr11 5337953 5337972 5337956 -
agcactttgggaggccaagg

SEQ ID NO: 35921 - DNA, 20 bp, Artificial Sequence
  Synthetic oligonucleotide; GGG chr11 5337952 5337971 5337955 -
gcactttgggaggccaaggt

SEQ ID NO: 35922 - DNA, 20 bp, Artificial Sequence
  Synthetic oligonucleotide; TGG chr11 5337949 5337968 5337952 -
ctttgggaggccaaggtggg

SEQ ID NO: 35923 - DNA, 20 bp, Artificial Sequence
  Synthetic oligonucleotide; GAG chr11 5337939 5337958 5337942 -
ccaaggtgggtggatcactt

SEQ ID NO: 35924 - DNA, 20 bp, Artificial Sequence
  Synthetic oligonucleotide; AGG chr11 5337938 5337957 5337941 -
caaggtgggtggatcacttg

SEQ ID NO: 35925 - DNA, 20 bp, Artificial Sequence
  Synthetic oligonucleotide; TGG chr11 5337935 5337954 5337938 -
ggtgggtggatcacttgagg

SEQ ID NO: 35926 - DNA, 20 bp, Artificial Sequence
  Synthetic oligonucleotide; GGG chr11 5337934 5337953 5337937 -
gtgggtggatcacttgaggt

SEQ ID NO: 35927 - DNA, 20 bp, Artificial Sequence
  Synthetic oligonucleotide; GGG chr11 5337933 5337952 5337936 -
tgggtggatcacttgaggtg

SEQ ID NO: 35928 - DNA, 20 bp, Artificial Sequence
  Synthetic oligonucleotide; GAG chr11 5337931 5337950 5337934 -
ggtggatcacttgaggtggg

SEQ ID NO: 35929 - DNA, 20 bp, Artificial Sequence
  Synthetic oligonucleotide; AAG chr11 5337925 5337944 5337928 -
tcacttgaggtggggagtat

SEQ ID NO: 35930 - DNA, 20 bp, Artificial Sequence
  Synthetic oligonucleotide; GAG chr11 5337923 5337942 5337926 -
acttgaggtggggagtataa

SEQ ID NO: 35931 - DNA, 20 bp, Artificial Sequence
  Synthetic oligonucleotide; CAG chr11 5337920 5337939 5337923 -
tgaggtggggagtataagag

SEQ ID NO: 35932 - DNA, 20 bp, Artificial Sequence
  Synthetic oligonucleotide; TGG chr11 5337915 5337934 5337918 -
tggggagtataagagcagcc

SEQ ID NO: 35933 - DNA, 20 bp, Artificial Sequence
  Synthetic oligonucleotide; TGG chr11 5337906 5337925 5337909 -
taagagcagcctggccaaca

SEQ ID NO: 35934 - DNA, 20 bp, Artificial Sequence
  Synthetic oligonucleotide; TGG chr11 5337866 5337885 5337869 -
taaaaatacaaaaaatgtgc

SEQ ID NO: 35935 - DNA, 20 bp, Artificial Sequence
  Synthetic oligonucleotide; GGG chr11 5337865 5337884 5337868 -
aaaaatacaaaaaatgtgct

SEQ ID NO: 35936 - DNA, 20 bp, Artificial Sequence
  Synthetic oligonucleotide; TGG chr11 5337860 5337879 5337863 -
tacaaaaaatgtgctgggta

SEQ ID NO: 35937 - DNA, 20 bp, Artificial Sequence
  Synthetic oligonucleotide; TGG chr11 5337857 5337876 5337860 -
aaaaaatgtgctgggtatgg

SEQ ID NO: 35938 - DNA, 20 bp, Artificial Sequence
  Synthetic oligonucleotide; CAG chr11 5337838 5337857 5337841 -
gtggtgcgtacctgtaatct

SEQ ID NO: 35939 - DNA, 20 bp, Artificial Sequence
  Synthetic oligonucleotide; CAG chr11 5337830 5337849 5337833 -
tacctgtaatctcagctact

SEQ ID NO: 35940 - DNA, 20 bp, Artificial Sequence
  Synthetic oligonucleotide; AGG chr11 5337829 5337848 5337832 -
acctgtaatctcagctactc

SEQ ID NO: 35941 - DNA, 20 bp, Artificial Sequence
  Synthetic oligonucleotide; GAG chr11 5337827 5337846 5337830 -
ctgtaatctcagctactcag

SEQ ID NO: 35942 - DNA, 20 bp, Artificial Sequence
  Synthetic oligonucleotide; AGG chr11 5337826 5337845 5337829 -
tgtaatctcagctactcagg

SEQ ID NO: 35943 - DNA, 20 bp, Artificial Sequence
  Synthetic oligonucleotide; GAG chr11 5337821 5337840 5337824 -
tctcagctactcaggaggct

SEQ ID NO: 35944 - DNA, 20 bp, Artificial Sequence
  Synthetic oligonucleotide; AGG chr11 5337820 5337839 5337823 -
ctcagctactcaggaggctg

SEQ ID NO: 35945 - DNA, 20 bp, Artificial Sequence
  Synthetic oligonucleotide; CAG chr11 5337817 5337836 5337820 -
agctactcaggaggctgagg

SEQ ID NO: 35946 - DNA, 20 bp, Artificial Sequence
  Synthetic oligonucleotide; AGG chr11 5337816 5337835 5337819 -
gctactcaggaggctgaggc

SEQ ID NO: 35947 - DNA, 20 bp, Artificial Sequence
  Synthetic oligonucleotide; GAG chr11 5337814 5337833 5337817 -
tactcaggaggctgaggcag

SEQ ID NO: 35948 - DNA, 20 bp, Artificial Sequence
  Synthetic oligonucleotide; CAG chr11 5337798 5337817 5337801 -
gcaggagaattgcttgaacc

SEQ ID NO: 35949 - DNA, 20 bp, Artificial Sequence
  Synthetic oligonucleotide; AGG chr11 5337797 5337816 5337800 -
caggagaattgcttgaaccc

SEQ ID NO: 35950 - DNA, 20 bp, Artificial Sequence
  Synthetic oligonucleotide; GAG chr11 5337795 5337814 5337798 -
ggagaattgcttgaacccag

SEQ ID NO: 35951 - DNA, 20 bp, Artificial Sequence
  Synthetic oligonucleotide; AGG chr11 5337794 5337813 5337797 -
gagaattgcttgaacccagg

SEQ ID NO: 35952 - DNA, 20 bp, Artificial Sequence
  Synthetic oligonucleotide; CAG chr11 5337791 5337810 5337794 -
aattgcttgaacccaggagg

SEQ ID NO: 35953 - DNA, 20 bp, Artificial Sequence
  Synthetic oligonucleotide; GAG chr11 5337789 5337808 5337792 -
ttgcttgaacccaggaggca

SEQ ID NO: 35954 - DNA, 20 bp, Artificial Sequence
  Synthetic oligonucleotide; AGG chr11 5337788 5337807 5337791 -
tgcttgaacccaggaggcag

SEQ ID NO: 35955 - DNA, 20 bp, Artificial Sequence
  Synthetic oligonucleotide; CAG chr11 5337782 5337801 5337785 -
aacccaggaggcagaggttg

SEQ ID NO: 35956 - DNA, 20 bp, Artificial Sequence
  Synthetic oligonucleotide; GAG chr11 5337778 5337797 5337781 -
caggaggcagaggttgcagt

SEQ ID NO: 35957 - DNA, 20 bp, Artificial Sequence
  Synthetic oligonucleotide; GAG chr11 5337773 5337792 5337776 -
ggcagaggttgcagtgagct

SEQ ID NO: 35958 - DNA, 20 bp, Artificial Sequence
  Synthetic oligonucleotide; TAG chr11 5337753 5337772 5337756 -
gagatcgcaccactgcactc

SEQ ID NO: 35959 - DNA, 20 bp, Artificial Sequence
  Synthetic oligonucleotide; TGG chr11 5337748 5337767 5337751 -
cgcaccactgcactctagca

SEQ ID NO: 35960 - DNA, 20 bp, Artificial Sequence
  Synthetic oligonucleotide; GGG chr11 5337747 5337766 5337750 -
gcaccactgcactctagcat

SEQ ID NO: 35961 - DNA, 20 bp, Artificial Sequence
  Synthetic oligonucleotide; AAG chr11 5337741 5337760 5337744 -
ctgcactctagcatgggtga

SEQ ID NO: 35962 - DNA, 20 bp, Artificial Sequence
  Synthetic oligonucleotide; GAG chr11 5337739 5337758 5337742 -
gcactctagcatgggtgaaa

SEQ ID NO: 35963 - DNA, 20 bp, Artificial Sequence
  Synthetic oligonucleotide; GAG chr11 5337735 5337754 5337738 -
tctagcatgggtgaaagagt

SEQ ID NO: 35964 - DNA, 20 bp, Artificial Sequence
  Synthetic oligonucleotide; AAG chr11 5337716 5337735 5337719 -
tgagacttcatctcaaaata

SEQ ID NO: 35965 - DNA, 20 bp, Artificial Sequence
  Synthetic oligonucleotide; CAG chr11 5337696 5337715 5337699 -
aagaaaaatacaattaaata

SEQ ID NO: 35966 - DNA, 20 bp, Artificial Sequence
  Synthetic oligonucleotide; GAG chr11 5337694 5337713 5337697 -
gaaaaatacaattaaataca

SEQ ID NO: 35967 - DNA, 20 bp, Artificial Sequence
  Synthetic oligonucleotide; CAG chr11 5337683 5337702 5337686 -
ttaaatacagagcttctaaa

SEQ ID NO: 35968 - DNA, 20 bp, Artificial Sequence
  Synthetic oligonucleotide; CAG chr11 5337664 5337683 5337667 -
acagcaaaataaactatcat

SEQ ID NO: 35969 - DNA, 20 bp, Artificial Sequence
  Synthetic oligonucleotide; GAG chr11 5337662 5337681 5337665 -
agcaaaataaactatcatca

SEQ ID NO: 35970 - DNA, 20 bp, Artificial Sequence
  Synthetic oligonucleotide; CAG chr11 5337655 5337674 5337658 -
taaactatcatcagagcgaa

SEQ ID NO: 35971 - DNA, 20 bp, Artificial Sequence
  Synthetic oligonucleotide; AGG chr11 5337654 5337673 5337657 -
aaactatcatcagagcgaac

SEQ ID NO: 35972 - DNA, 20 bp, Artificial Sequence
  Synthetic oligonucleotide; CAG chr11 5337644 5337663 5337647 -
cagagcgaacaggcaaccta

SEQ ID NO: 35973 - DNA, 20 bp, Artificial Sequence
  Synthetic oligonucleotide; TGG chr11 5337639 5337658 5337642 -
cgaacaggcaacctacagaa

SEQ ID NO: 35974 - DNA, 20 bp, Artificial Sequence
  Synthetic oligonucleotide; GGG chr11 5337638 5337657 5337641 -
gaacaggcaacctacagaat

SEQ ID NO: 35975 - DNA, 20 bp, Artificial Sequence
  Synthetic oligonucleotide; GAG chr11 5337636 5337655 5337639 -
acaggcaacctacagaatgg

SEQ ID NO: 35976 - DNA, 20 bp, Artificial Sequence
  Synthetic oligonucleotide; AAG chr11 5337605 5337624 5337608 -
tgcaatctacccatctgaca

SEQ ID NO: 35977 - DNA, 20 bp, Artificial Sequence
  Synthetic oligonucleotide; AGG chr11 5337604 5337623 5337607 -
gcaatctacccatctgacaa

SEQ ID NO: 35978 - DNA, 20 bp, Artificial Sequence
  Synthetic oligonucleotide; CAG chr11 5337592 5337611 5337595 -
tctgacaaaggtctaatatc

SEQ ID NO: 35979 - DNA, 20 bp, Artificial Sequence
  Synthetic oligonucleotide; GAG chr11 5337582 5337601 5337585 -
gtctaatatccagaatctat

SEQ ID NO: 35980 - DNA, 20 bp, Artificial Sequence
  Synthetic oligonucleotide; AGG chr11 5337581 5337600 5337584 -
tctaatatccagaatctatg

SEQ ID NO: 35981 - DNA, 20 bp, Artificial Sequence
  Synthetic oligonucleotide; TAG chr11 5337574 5337593 5337577 -
tccagaatctatgaggaact

SEQ ID NO: 35982 - DNA, 20 bp, Artificial Sequence
  Synthetic oligonucleotide; AAG chr11 5337559 5337578 5337562 -
gaacttagacatatttacaa

SEQ ID NO: 35983 - DNA, 20 bp, Artificial Sequence
  Synthetic oligonucleotide; AAG chr11 5337532 5337551 5337535 -
acacaaacaaccccattaaa

SEQ ID NO: 35984 - DNA, 20 bp, Artificial Sequence
  Synthetic oligonucleotide; TGG chr11 5337529 5337548 5337532 -
caaacaaccccattaaaaag

SEQ ID NO: 35985 - DNA, 20 bp, Artificial Sequence
  Synthetic oligonucleotide; GGG chr11 5337528 5337547 5337531 -
aaacaaccccattaaaaagt

SEQ ID NO: 35986 - DNA, 20 bp, Artificial Sequence
  Synthetic oligonucleotide; AAG chr11 5337523 5337542 5337526 -
accccattaaaaagtgggca

SEQ ID NO: 35987 - DNA, 20 bp, Artificial Sequence
  Synthetic oligonucleotide; AGG chr11 5337522 5337541 5337525 -
ccccattaaaaagtgggcaa

SEQ ID NO: 35988 - DNA, 20 bp, Artificial Sequence
  Synthetic oligonucleotide; CAG chr11 5337512 5337531 5337515 -
aagtgggcaaaggacatgaa

SEQ ID NO: 35989 - DNA, 20 bp, Artificial Sequence
  Synthetic oligonucleotide; AAG chr11 5337498 5337517 5337501 -
catgaacagacacttctcaa

SEQ ID NO: 35990 - DNA, 20 bp, Artificial Sequence
  Synthetic oligonucleotide; AAG chr11 5337495 5337514 5337498 -
gaacagacacttctcaaaag

SEQ ID NO: 35991 - DNA, 20 bp, Artificial Sequence
  Synthetic oligonucleotide; TGG chr11 5337483 5337502 5337486 -
ctcaaaagaagacatttatg

SEQ ID NO: 35992 - DNA, 20 bp, Artificial Sequence
  Synthetic oligonucleotide; AAG chr11 5337478 5337497 5337481 -
aagaagacatttatgtggct

SEQ ID NO: 35993 - DNA, 20 bp, Artificial Sequence
  Synthetic oligonucleotide; AAG chr11 5337462 5337481 5337465 -
ggctaagaaacatacgaaaa

SEQ ID NO: 35994 - DNA, 20 bp, Artificial Sequence
  Synthetic oligonucleotide; TAG chr11 5337440 5337459 5337443 -
gtctcaatgtcactgatcat

SEQ ID NO: 35995 - DNA, 20 bp, Artificial Sequence
  Synthetic oligonucleotide; GAG chr11 5337438 5337457 5337441 -
ctcaatgtcactgatcatta

SEQ ID NO: 35996 - DNA, 20 bp, Artificial Sequence
  Synthetic oligonucleotide; CAG chr11 5337396 5337415 5337399 -
aatgaaataccatctgacac

SEQ ID NO: 35997 - DNA, 20 bp, Artificial Sequence
  Synthetic oligonucleotide; CAG chr11 5337392 5337411 5337395 -
aaataccatctgacaccagt

SEQ ID NO: 35998 - DNA, 20 bp, Artificial Sequence
  Synthetic oligonucleotide; TGG chr11 5337387 5337406 5337390 -
ccatctgacaccagtcagaa

SEQ ID NO: 35999 - DNA, 20 bp, Artificial Sequence
  Synthetic oligonucleotide; TGG chr11 5337384 5337403 5337387 -
tctgacaccagtcagaatgg

SEQ ID NO: 36000 - DNA, 20 bp, Artificial Sequence
  Synthetic oligonucleotide; AAG chr11 5337375 5337394 5337378 -
agtcagaatggtggttttta

SEQ ID NO: 36001 - DNA, 20 bp, Artificial Sequence
  Synthetic oligonucleotide; AAG chr11 5337370 5337389 5337373 -
gaatggtggtttttaaagtc

SEQ ID NO: 36002 - DNA, 20 bp, Artificial Sequence
  Synthetic oligonucleotide; CAG chr11 5337361 5337380 5337364 -
tttttaaagtcaagaaacaa

SEQ ID NO: 36003 - DNA, 20 bp, Artificial Sequence
  Synthetic oligonucleotide; TAG chr11 5337354 5337373 5337357 -
agtcaagaaacaacagatgc

SEQ ID NO: 36004 - DNA, 20 bp, Artificial Sequence
  Synthetic oligonucleotide; AAG chr11 5337350 5337369 5337353 -
aagaaacaacagatgctagc

SEQ ID NO: 36005 - DNA, 20 bp, Artificial Sequence
  Synthetic oligonucleotide; AGG chr11 5337349 5337368 5337352 -
agaaacaacagatgctagca

SEQ ID NO: 36006 - DNA, 20 bp, Artificial Sequence
  Synthetic oligonucleotide; CAG chr11 5337343 5337362 5337346 -
aacagatgctagcaaggttg

SEQ ID NO: 36007 - DNA, 20 bp, Artificial Sequence
  Synthetic oligonucleotide; GAG chr11 5337341 5337360 5337344 -
cagatgctagcaaggttgca

SEQ ID NO: 36008 - DNA, 20 bp, Artificial Sequence
  Synthetic oligonucleotide; TAG chr11 5337335 5337354 5337338 -
ctagcaaggttgcagagaaa

SEQ ID NO: 36009 - DNA, 20 bp, Artificial Sequence
  Synthetic oligonucleotide; AGG chr11 5337334 5337353 5337337 -
tagcaaggttgcagagaaat

SEQ ID NO: 36010 - DNA, 20 bp, Artificial Sequence
  Synthetic oligonucleotide; TGG chr11 5337315 5337334 5337318 -
taggaacacttttacactgt

SEQ ID NO: 36011 - DNA, 20 bp, Artificial Sequence
  Synthetic oligonucleotide; TGG chr11 5337312 5337331 5337315 -
gaacacttttacactgttgg

SEQ ID NO: 36012 - DNA, 20 bp, Artificial Sequence
  Synthetic oligonucleotide; GGG chr11 5337311 5337330 5337314 -
aacacttttacactgttggt

SEQ ID NO: 36013 - DNA, 20 bp, Artificial Sequence
  Synthetic oligonucleotide; TGG chr11 5337285 5337304 5337288 -
gtaaactaattcaaccattg

SEQ ID NO: 36014 - DNA, 20 bp, Artificial Sequence
  Synthetic oligonucleotide; AAG chr11 5337282 5337301 5337285 -
aactaattcaaccattgtgg

SEQ ID NO: 36015 - DNA, 20 bp, Artificial Sequence
  Synthetic oligonucleotide; CAG chr11 5337278 5337297 5337281 -
aattcaaccattgtggaaga

SEQ ID NO: 36016 - DNA, 20 bp, Artificial Sequence
  Synthetic oligonucleotide; TGG chr11 5337273 5337292 5337276 -
aaccattgtggaagacagtg

SEQ ID NO: 36017 - DNA, 20 bp, Artificial Sequence
  Synthetic oligonucleotide; AAG chr11 5337260 5337279 5337263 -
gacagtgtggcaattcctca

SEQ ID NO: 36018 - DNA, 20 bp, Artificial Sequence
  Synthetic oligonucleotide; TAG chr11 5337254 5337273 5337257 -
gtggcaattcctcaaagatt

SEQ ID NO: 36019 - DNA, 20 bp, Artificial Sequence
  Synthetic oligonucleotide; CAG chr11 5337248 5337267 5337251 -
attcctcaaagatttagaac

SEQ ID NO: 36020 - DNA, 20 bp, Artificial Sequence
  Synthetic oligonucleotide; TGG chr11 5337215 5337234 5337218 -
tgacctcacaatcccattac

SEQ ID NO: 36021 - DNA, 20 bp, Artificial Sequence
  Synthetic oligonucleotide; GGG chr11 5337214 5337233 5337217 -
gacctcacaatcccattact

SEQ ID NO: 36022 - DNA, 20 bp, Artificial Sequence
  Synthetic oligonucleotide; AAG chr11 5337201 5337220 5337204 -
cattactgggtatataccta

SEQ ID NO: 36023 - DNA, 20 bp, Artificial Sequence
  Synthetic oligonucleotide; AGG chr11 5337200 5337219 5337203 -
attactgggtatatacctaa

SEQ ID NO: 36024 - DNA, 20 bp, Artificial Sequence
  Synthetic oligonucleotide; GAG chr11 5337198 5337217 5337201 -
tactgggtatatacctaaag

SEQ ID NO: 36025 - DNA, 20 bp, Artificial Sequence
  Synthetic oligonucleotide; AAG chr11 5337176 5337195 5337179 -
gtataaatcattctattact

SEQ ID NO: 36026 - DNA, 20 bp, Artificial Sequence
  Synthetic oligonucleotide; TAG chr11 5337149 5337168 5337152 -
atgcacatgtatgttcattg

SEQ ID NO: 36027 - DNA, 20 bp, Artificial Sequence
  Synthetic oligonucleotide; TAG chr11 5337134 5337153 5337137 -
cattgtagcactattcacaa

SEQ ID NO: 36028 - DNA, 20 bp, Artificial Sequence
  Synthetic oligonucleotide; AAG chr11 5337129 5337148 5337132 -
tagcactattcacaatagca

SEQ ID NO: 36029 - DNA, 20 bp, Artificial Sequence
  Synthetic oligonucleotide; TAG chr11 5337123 5337142 5337126 -
tattcacaatagcaaagaca

SEQ ID NO: 36030 - DNA, 20 bp, Artificial Sequence
  Synthetic oligonucleotide; TGG chr11 5337108 5337127 5337111 -
agacatagaatcaacccaaa

SEQ ID NO: 36031 - DNA, 20 bp, Artificial Sequence
  Synthetic oligonucleotide; TAG chr11 5337095 5337114 5337098 -
acccaaatggccatcaatga

SEQ ID NO: 36032 - DNA, 20 bp, Artificial Sequence
  Synthetic oligonucleotide; TGG chr11 5337077 5337096 5337080 -
gatagacaatttaaaaaatg

SEQ ID NO: 36033 - DNA, 20 bp, Artificial Sequence
  Synthetic oligonucleotide; AAG chr11 5337039 5337058 5337042 -
aaatactatctaaccataaa

SEQ ID NO: 36034 - DNA, 20 bp, Artificial Sequence
  Synthetic oligonucleotide; AGG chr11 5337038 5337057 5337041 -
aatactatctaaccataaaa

SEQ ID NO: 36035 - DNA, 20 bp, Artificial Sequence
  Synthetic oligonucleotide; GGG chr11 5337037 5337056 5337040 -
atactatctaaccataaaaa

SEQ ID NO: 36036 - DNA, 20 bp, Artificial Sequence
  Synthetic oligonucleotide; GAG chr11 5337032 5337051 5337035 -
atctaaccataaaaagggat

SEQ ID NO: 36037 - DNA, 20 bp, Artificial Sequence
  Synthetic oligonucleotide; TGG chr11 5337015 5337034 5337018 -
gatgagatcatgccctttgc

SEQ ID NO: 36038 - DNA, 20 bp, Artificial Sequence
  Synthetic oligonucleotide; GGG chr11 5337014 5337033 5337017 -
atgagatcatgccctttgct

SEQ ID NO: 36039 - DNA, 20 bp, Artificial Sequence
  Synthetic oligonucleotide; TGG chr11 5337008 5337027 5337011 -
tcatgccctttgctgggaca

SEQ ID NO: 36040 - DNA, 20 bp, Artificial Sequence
  Synthetic oligonucleotide; TGG chr11 5337004 5337023 5337007 -
gccctttgctgggacatgga

SEQ ID NO: 36041 - DNA, 20 bp, Artificial Sequence
  Synthetic oligonucleotide; GAG chr11 5337002 5337021 5337005 -
cctttgctgggacatggatg

SEQ ID NO: 36042 - DNA, 20 bp, Artificial Sequence
  Synthetic oligonucleotide; AAG chr11 5336995 5337014 5336998 -
tgggacatggatggagccga

SEQ ID NO: 36043 - DNA, 20 bp, Artificial Sequence
  Synthetic oligonucleotide; CAG chr11 5336982 5337001 5336985 -
gagccgaaagccattatctt

SEQ ID NO: 36044 - DNA, 20 bp, Artificial Sequence
  Synthetic oligonucleotide; CAG chr11 5336969 5336988 5336972 -
ttatcttcagtaaactaatg

SEQ ID NO: 36045 - DNA, 20 bp, Artificial Sequence
  Synthetic oligonucleotide; AGG chr11 5336968 5336987 5336971 -
tatcttcagtaaactaatgc

SEQ ID NO: 36046 - DNA, 20 bp, Artificial Sequence
  Synthetic oligonucleotide; CAG chr11 5336963 5336982 5336966 -
tcagtaaactaatgcaggaa

SEQ ID NO: 36047 - DNA, 20 bp, Artificial Sequence
  Synthetic oligonucleotide; TAG chr11 5336934 5336953 5336937 -
aaacaccacatgttctcact

SEQ ID NO: 36048 - DNA, 20 bp, Artificial Sequence
  Synthetic oligonucleotide; AAG chr11 5336931 5336950 5336934 -
caccacatgttctcacttag

SEQ ID NO: 36049 - DNA, 20 bp, Artificial Sequence
  Synthetic oligonucleotide; TGG chr11 5336928 5336947 5336931 -
cacatgttctcacttagaag

SEQ ID NO: 36050 - DNA, 20 bp, Artificial Sequence
  Synthetic oligonucleotide; GGG chr11 5336927 5336946 5336930 -
acatgttctcacttagaagt

SEQ ID NO: 36051 - DNA, 20 bp, Artificial Sequence
  Synthetic oligonucleotide; GAG chr11 5336925 5336944 5336928 -
atgttctcacttagaagtgg

SEQ ID NO: 36052 - DNA, 20 bp, Artificial Sequence
  Synthetic oligonucleotide; GAG chr11 5336913 5336932 5336916 -
agaagtgggagctgaacaat

SEQ ID NO: 36053 - DNA, 20 bp, Artificial Sequence
  Synthetic oligonucleotide; GAG chr11 5336907 5336926 5336910 -
gggagctgaacaatgagaat

SEQ ID NO: 36054 - DNA, 20 bp, Artificial Sequence
  Synthetic oligonucleotide; TGG chr11 5336898 5336917 5336901 -
acaatgagaatgagaacaca

SEQ ID NO: 36055 - DNA, 20 bp, Artificial Sequence
  Synthetic oligonucleotide; CAG chr11 5336892 5336911 5336895 -
agaatgagaacacatggaaa

SEQ ID NO: 36056 - DNA, 20 bp, Artificial Sequence
  Synthetic oligonucleotide; GAG chr11 5336888 5336907 5336891 -
tgagaacacatggaaacagt

SEQ ID NO: 36057 - DNA, 20 bp, Artificial Sequence
  Synthetic oligonucleotide; AGG chr11 5336887 5336906 5336890 -
gagaacacatggaaacagtg

SEQ ID NO: 36058 - DNA, 20 bp, Artificial Sequence
  Synthetic oligonucleotide; GGG chr11 5336886 5336905 5336889 -
agaacacatggaaacagtga

SEQ ID NO: 36059 - DNA, 20 bp, Artificial Sequence
  Synthetic oligonucleotide; GGG chr11 5336885 5336904 5336888 -
gaacacatggaaacagtgag

SEQ ID NO: 36060 - DNA, 20 bp, Artificial Sequence
  Synthetic oligonucleotide; AAG chr11 5336882 5336901 5336885 -
cacatggaaacagtgagggg

SEQ ID NO: 36061 - DNA, 20 bp, Artificial Sequence
  Synthetic oligonucleotide; TGG chr11 5336870 5336889 5336873 -
gtgaggggaagaacacacac

SEQ ID NO: 36062 - DNA, 20 bp, Artificial Sequence
  Synthetic oligonucleotide; GAG chr11 5336868 5336887 5336871 -
gaggggaagaacacacactg

SEQ ID NO: 36063 - DNA, 20 bp, Artificial Sequence
  Synthetic oligonucleotide; CAG chr11 5336860 5336879 5336863 -
gaacacacactggagcctgt

SEQ ID NO: 36064 - DNA, 20 bp, Artificial Sequence
  Synthetic oligonucleotide; AGG chr11 5336859 5336878 5336862 -
aacacacactggagcctgtc

SEQ ID NO: 36065 - DNA, 20 bp, Artificial Sequence
  Synthetic oligonucleotide; GGG chr11 5336858 5336877 5336861 -
acacacactggagcctgtca

SEQ ID NO: 36066 - DNA, 20 bp, Artificial Sequence
  Synthetic oligonucleotide; TGG chr11 5336853 5336872 5336856 -
cactggagcctgtcagggca

SEQ ID NO: 36067 - DNA, 20 bp, Artificial Sequence
  Synthetic oligonucleotide; GGG chr11 5336852 5336871 5336855 -
actggagcctgtcagggcat

SEQ ID NO: 36068 - DNA, 20 bp, Artificial Sequence
  Synthetic oligonucleotide; GGG chr11 5336851 5336870 5336854 -
ctggagcctgtcagggcatg

SEQ ID NO: 36069 - DNA, 20 bp, Artificial Sequence
  Synthetic oligonucleotide; TGG chr11 5336846 5336865 5336849 -
gcctgtcagggcatggggtg

SEQ ID NO: 36070 - DNA, 20 bp, Artificial Sequence
  Synthetic oligonucleotide; AAG chr11 5336841 5336860 5336844 -
tcagggcatggggtgtggtg

SEQ ID NO: 36071 - DNA, 20 bp, Artificial Sequence
  Synthetic oligonucleotide; AGG chr11 5336840 5336859 5336843 -
cagggcatggggtgtggtga

SEQ ID NO: 36072 - DNA, 20 bp, Artificial Sequence
  Synthetic oligonucleotide; GGG chr11 5336839 5336858 5336842 -
agggcatggggtgtggtgaa

SEQ ID NO: 36073 - DNA, 20 bp, Artificial Sequence
  Synthetic oligonucleotide; GGG chr11 5336838 5336857 5336841 -
gggcatggggtgtggtgaag

SEQ ID NO: 36074 - DNA, 20 bp, Artificial Sequence
  Synthetic oligonucleotide; GAG chr11 5336836 5336855 5336839 -
gcatggggtgtggtgaaggg

SEQ ID NO: 36075 - DNA, 20 bp, Artificial Sequence
  Synthetic oligonucleotide; TAG chr11 5336830 5336849 5336833 -
ggtgtggtgaaggggagcat

SEQ ID NO: 36076 - DNA, 20 bp, Artificial Sequence
  Synthetic oligonucleotide; TAG chr11 5336821 5336840 5336824 -
aaggggagcattagaaaaaa

SEQ ID NO: 36077 - DNA, 20 bp, Artificial Sequence
  Synthetic oligonucleotide; TGG chr11 5336807 5336826 5336810 -
aaaaaatagctaatgcatgc

SEQ ID NO: 36078 - DNA, 20 bp, Artificial Sequence
  Synthetic oligonucleotide; GGG chr11 5336806 5336825 5336809 -
aaaaatagctaatgcatgct

SEQ ID NO: 36079 - DNA, 20 bp, Artificial Sequence
  Synthetic oligonucleotide; TAG chr11 5336794 5336813 5336797 -
tgcatgctgggcttaacacc

SEQ ID NO: 36080 - DNA, 20 bp, Artificial Sequence
  Synthetic oligonucleotide; AGG chr11 5336793 5336812 5336796 -
gcatgctgggcttaacacct

SEQ ID NO: 36081 - DNA, 20 bp, Artificial Sequence
  Synthetic oligonucleotide; TGG chr11 5336787 5336806 5336790 -
tgggcttaacacctaggtga

SEQ ID NO: 36082 - DNA, 20 bp, Artificial Sequence
  Synthetic oligonucleotide; GGG chr11 5336786 5336805 5336789 -
gggcttaacacctaggtgat

SEQ ID NO: 36083 - DNA, 20 bp, Artificial Sequence
  Synthetic oligonucleotide; TAG chr11 5336779 5336798 5336782 -
acacctaggtgatgggttga

SEQ ID NO: 36084 - DNA, 20 bp, Artificial Sequence
  Synthetic oligonucleotide; AGG chr11 5336778 5336797 5336781 -
cacctaggtgatgggttgat

SEQ ID NO: 36085 - DNA, 20 bp, Artificial Sequence
  Synthetic oligonucleotide; CAG chr11 5336773 5336792 5336776 -
aggtgatgggttgataggta

SEQ ID NO: 36086 - DNA, 20 bp, Artificial Sequence
  Synthetic oligonucleotide; CAG chr11 5336710 5336729 5336713 -
cacatcctgcacatgtacct

SEQ ID NO: 36087 - DNA, 20 bp, Artificial Sequence
  Synthetic oligonucleotide; TGG chr11 5336669 5336688 5336672 -
attgaatgtacataaaaata

SEQ ID NO: 36088 - DNA, 20 bp, Artificial Sequence
  Synthetic oligonucleotide; TGG chr11 5336627 5336646 5336630 -
actgcattaaaaaaaaataa

SEQ ID NO: 36089 - DNA, 20 bp, Artificial Sequence
  Synthetic oligonucleotide; AAG chr11 5336589 5336608 5336592 -
ctgttgcaccaacctaatat

SEQ ID NO: 36090 - DNA, 20 bp, Artificial Sequence
  Synthetic oligonucleotide; AGG chr11 5336588 5336607 5336591 -
tgttgcaccaacctaatata

SEQ ID NO: 36091 - DNA, 20 bp, Artificial Sequence
  Synthetic oligonucleotide; TAG chr11 5336582 5336601 5336585 -
accaacctaatataaggaaa

SEQ ID NO: 36092 - DNA, 20 bp, Artificial Sequence
  Synthetic oligonucleotide; CAG chr11 5336579 5336598 5336582 -
aacctaatataaggaaatag

SEQ ID NO: 36093 - DNA, 20 bp, Artificial Sequence
  Synthetic oligonucleotide; TGG chr11 5336567 5336586 5336570 -
ggaaatagcagatgtgatta

SEQ ID NO: 36094 - DNA, 20 bp, Artificial Sequence
  Synthetic oligonucleotide; GAG chr11 5336565 5336584 5336568 -
aaatagcagatgtgattatg

SEQ ID NO: 36095 - DNA, 20 bp, Artificial Sequence
  Synthetic oligonucleotide; AGG chr11 5336564 5336583 5336567 -
aatagcagatgtgattatgg

SEQ ID NO: 36096 - DNA, 20 bp, Artificial Sequence
  Synthetic oligonucleotide; AAG chr11 5336561 5336580 5336564 -
agcagatgtgattatggagg

SEQ ID NO: 36097 - DNA, 20 bp, Artificial Sequence
  Synthetic oligonucleotide; AGG chr11 5336560 5336579 5336563 -
gcagatgtgattatggagga

SEQ ID NO: 36098 - DNA, 20 bp, Artificial Sequence
  Synthetic oligonucleotide; AAG chr11 5336556 5336575 5336559 -
atgtgattatggaggaaggc

SEQ ID NO: 36099 - DNA, 20 bp, Artificial Sequence
  Synthetic oligonucleotide; AAG chr11 5336549 5336568 5336552 -
tatggaggaaggcaagtccc

SEQ ID NO: 36100 - DNA, 20 bp, Artificial Sequence
  Synthetic oligonucleotide; CAG chr11 5336541 5336560 5336544 -
aaggcaagtcccaagatatg

SEQ ID NO: 36101 - DNA, 20 bp, Artificial Sequence
  Synthetic oligonucleotide; GAG chr11 5336539 5336558 5336542 -
ggcaagtcccaagatatgca

SEQ ID NO: 36102 - DNA, 20 bp, Artificial Sequence
  Synthetic oligonucleotide; GAG chr11 5336535 5336554 5336538 -
agtcccaagatatgcagagt

SEQ ID NO: 36103 - DNA, 20 bp, Artificial Sequence
  Synthetic oligonucleotide; AAG chr11 5336527 5336546 5336530 -
gatatgcagagtgagtcatc

SEQ ID NO: 36104 - DNA, 20 bp, Artificial Sequence
  Synthetic oligonucleotide; AAG chr11 5336514 5336533 5336517 -
agtcatcaagttgaaaactc

SEQ ID NO: 36105 - DNA, 20 bp, Artificial Sequence
  Synthetic oligonucleotide; GAG chr11 5336512 5336531 5336515 -
tcatcaagttgaaaactcaa

SEQ ID NO: 36106 - DNA, 20 bp, Artificial Sequence
  Synthetic oligonucleotide; GAG chr11 5336510 5336529 5336513 -
atcaagttgaaaactcaaga

SEQ ID NO: 36107 - DNA, 20 bp, Artificial Sequence
  Synthetic oligonucleotide; TGG chr11 5336505 5336524 5336508 -
gttgaaaactcaagagagcc

SEQ ID NO: 36108 - DNA, 20 bp, Artificial Sequence
  Synthetic oligonucleotide; TAG chr11 5336502 5336521 5336505 -
gaaaactcaagagagcctgg

SEQ ID NO: 36109 - DNA, 20 bp, Artificial Sequence
  Synthetic oligonucleotide; TAG chr11 5336497 5336516 5336500 -
ctcaagagagcctggtagtt

SEQ ID NO: 36110 - DNA, 20 bp, Artificial Sequence
  Synthetic oligonucleotide; CAG chr11 5336491 5336510 5336494 -
agagcctggtagtttagtcc

SEQ ID NO: 36111 - DNA, 20 bp, Artificial Sequence
  Synthetic oligonucleotide; AAG chr11 5336485 5336504 5336488 -
tggtagtttagtcccagtcc

SEQ ID NO: 36112 - DNA, 20 bp, Artificial Sequence
  Synthetic oligonucleotide; AAG chr11 5336478 5336497 5336481 -
ttagtcccagtccaagtctg

SEQ ID NO: 36113 - DNA, 20 bp, Artificial Sequence
  Synthetic oligonucleotide; AGG chr11 5336477 5336496 5336480 -
tagtcccagtccaagtctga

SEQ ID NO: 36114 - DNA, 20 bp, Artificial Sequence
  Synthetic oligonucleotide; TGG chr11 5336472 5336491 5336475 -
ccagtccaagtctgaaggcc

SEQ ID NO: 36115 - DNA, 20 bp, Artificial Sequence
  Synthetic oligonucleotide; GGG chr11 5336471 5336490 5336474 -
cagtccaagtctgaaggcct

SEQ ID NO: 36116 - DNA, 20 bp, Artificial Sequence
  Synthetic oligonucleotide; CAG chr11 5336465 5336484 5336468 -
aagtctgaaggcctgggaaa

SEQ ID NO: 36117 - DNA, 20 bp, Artificial Sequence
  Synthetic oligonucleotide; AGG chr11 5336464 5336483 5336467 -
agtctgaaggcctgggaaac

SEQ ID NO: 36118 - DNA, 20 bp, Artificial Sequence
  Synthetic oligonucleotide; GAG chr11 5336462 5336481 5336465 -
tctgaaggcctgggaaacag

SEQ ID NO: 36119 - DNA, 20 bp, Artificial Sequence
  Synthetic oligonucleotide; AGG chr11 5336461 5336480 5336464 -
ctgaaggcctgggaaacagg

SEQ ID NO: 36120 - DNA, 20 bp, Artificial Sequence
  Synthetic oligonucleotide; TGG chr11 5336453 5336472 5336456 -
ctgggaaacaggaggattga

SEQ ID NO: 36121 - DNA, 20 bp, Artificial Sequence
  Synthetic oligonucleotide; AAG chr11 5336434 5336453 5336437 -
atggtgtacttgcaacccaa

SEQ ID NO: 36122 - DNA, 20 bp, Artificial Sequence
  Synthetic oligonucleotide; CAG chr11 5336427 5336446 5336430 -
acttgcaacccaaaagccat

SEQ ID NO: 36123 - DNA, 20 bp, Artificial Sequence
  Synthetic oligonucleotide; AGG chr11 5336426 5336445 5336429 -
cttgcaacccaaaagccatc

SEQ ID NO: 36124 - DNA, 20 bp, Artificial Sequence
  Synthetic oligonucleotide; CAG chr11 5336420 5336439 5336423 -
acccaaaagccatcaggctt

SEQ ID NO: 36125 - DNA, 20 bp, Artificial Sequence
  Synthetic oligonucleotide; CAG chr11 5336414 5336433 5336417 -
aagccatcaggcttcagacc

SEQ ID NO: 36126 - DNA, 20 bp, Artificial Sequence
  Synthetic oligonucleotide; AGG chr11 5336413 5336432 5336416 -
agccatcaggcttcagaccc

SEQ ID NO: 36127 - DNA, 20 bp, Artificial Sequence
  Synthetic oligonucleotide; AAG chr11 5336410 5336429 5336413 -
catcaggcttcagacccagg

SEQ ID NO: 36128 - DNA, 20 bp, Artificial Sequence
  Synthetic oligonucleotide; CAG chr11 5336396 5336415 5336399 -
cccaggaagttttgatgttt

SEQ ID NO: 36129 - DNA, 20 bp, Artificial Sequence
  Synthetic oligonucleotide; AAG chr11 5336384 5336403 5336387 -
tgatgtttcagttcaatcta

SEQ ID NO: 36130 - DNA, 20 bp, Artificial Sequence
  Synthetic oligonucleotide; AGG chr11 5336383 5336402 5336386 -
gatgtttcagttcaatctaa

SEQ ID NO: 36131 - DNA, 20 bp, Artificial Sequence
  Synthetic oligonucleotide; CAG chr11 5336380 5336399 5336383 -
gtttcagttcaatctaaagg

SEQ ID NO: 36132 - DNA, 20 bp, Artificial Sequence
  Synthetic oligonucleotide; AAG chr11 5336372 5336391 5336375 -
tcaatctaaaggcagaaaaa

SEQ ID NO: 36133 - DNA, 20 bp, Artificial Sequence
  Synthetic oligonucleotide; AGG chr11 5336371 5336390 5336374 -
caatctaaaggcagaaaaaa

SEQ ID NO: 36134 - DNA, 20 bp, Artificial Sequence
  Synthetic oligonucleotide; TAG chr11 5336366 5336385 5336369 -
taaaggcagaaaaaaaggtc

SEQ ID NO: 36135 - DNA, 20 bp, Artificial Sequence
  Synthetic oligonucleotide; CAG chr11 5336359 5336378 5336362 -
agaaaaaaaggtctagattc

SEQ ID NO: 36136 - DNA, 20 bp, Artificial Sequence
  Synthetic oligonucleotide; AAG chr11 5336352 5336371 5336355 -
aaggtctagattccagtttg

SEQ ID NO: 36137 - DNA, 20 bp, Artificial Sequence
  Synthetic oligonucleotide; AGG chr11 5336351 5336370 5336354 -
aggtctagattccagtttga

SEQ ID NO: 36138 - DNA, 20 bp, Artificial Sequence
  Synthetic oligonucleotide; AAG chr11 5336340 5336359 5336343 -
ccagtttgaaggccatcaat

SEQ ID NO: 36139 - DNA, 20 bp, Artificial Sequence
  Synthetic oligonucleotide; AGG chr11 5336339 5336358 5336342 -
cagtttgaaggccatcaata

SEQ ID NO: 36140 - DNA, 20 bp, Artificial Sequence
  Synthetic oligonucleotide; TGG chr11 5336319 5336338 5336322 -
aggaataattctctctgatt

SEQ ID NO: 36141 - DNA, 20 bp, Artificial Sequence
  Synthetic oligonucleotide; GGG chr11 5336318 5336337 5336321 -
ggaataattctctctgattt

SEQ ID NO: 36142 - DNA, 20 bp, Artificial Sequence
  Synthetic oligonucleotide; GGG chr11 5336317 5336336 5336320 -
gaataattctctctgatttg

SEQ ID NO: 36143 - DNA, 20 bp, Artificial Sequence
  Synthetic oligonucleotide; AAG chr11 5336314 5336333 5336317 -
taattctctctgatttgggg

SEQ ID NO: 36144 - DNA, 20 bp, Artificial Sequence
  Synthetic oligonucleotide; AGG chr11 5336313 5336332 5336316 -
aattctctctgatttgggga

SEQ ID NO: 36145 - DNA, 20 bp, Artificial Sequence
  Synthetic oligonucleotide; GGG chr11 5336312 5336331 5336315 -
attctctctgatttggggaa

SEQ ID NO: 36146 - DNA, 20 bp, Artificial Sequence
  Synthetic oligonucleotide; CAG chr11 5336308 5336327 5336311 -
tctctgatttggggaagggt

SEQ ID NO: 36147 - DNA, 20 bp, Artificial Sequence
  Synthetic oligonucleotide; CAG chr11 5336290 5336309 5336293 -
gtcagactttttgttctatt

SEQ ID NO: 36148 - DNA, 20 bp, Artificial Sequence
  Synthetic oligonucleotide; AGG chr11 5336289 5336308 5336292 -
tcagactttttgttctattc

SEQ ID NO: 36149 - DNA, 20 bp, Artificial Sequence
  Synthetic oligonucleotide; TGG chr11 5336274 5336293 5336277 -
tattcaggttttcaactgat

SEQ ID NO: 36150 - DNA, 20 bp, Artificial Sequence
  Synthetic oligonucleotide; GAG chr11 5336272 5336291 5336275 -
ttcaggttttcaactgattg

SEQ ID NO: 36151 - DNA, 20 bp, Artificial Sequence
  Synthetic oligonucleotide; AGG chr11 5336271 5336290 5336274 -
tcaggttttcaactgattgg

SEQ ID NO: 36152 - DNA, 20 bp, Artificial Sequence
  Synthetic oligonucleotide; AAG chr11 5336268 5336287 5336271 -
ggttttcaactgattggagg

SEQ ID NO: 36153 - DNA, 20 bp, Artificial Sequence
  Synthetic oligonucleotide; TAG chr11 5336255 5336274 5336258 -
ttggaggaagccgcctgcaa

SEQ ID NO: 36154 - DNA, 20 bp, Artificial Sequence
  Synthetic oligonucleotide; AGG chr11 5336254 5336273 5336257 -
tggaggaagccgcctgcaat

SEQ ID NO: 36155 - DNA, 20 bp, Artificial Sequence
  Synthetic oligonucleotide; AAG chr11 5336251 5336270 5336254 -
aggaagccgcctgcaatagg

SEQ ID NO: 36156 - DNA, 20 bp, Artificial Sequence
  Synthetic oligonucleotide; AGG chr11 5336250 5336269 5336253 -
ggaagccgcctgcaatagga

SEQ ID NO: 36157 - DNA, 20 bp, Artificial Sequence
  Synthetic oligonucleotide; TGG chr11 5336232 5336251 5336235 -
gaaggaccatctgctctact

SEQ ID NO: 36158 - DNA, 20 bp, Artificial Sequence
  Synthetic oligonucleotide; TAG chr11 5336178 5336197 5336181 -
aacaccctcacaaaaacatc

SEQ ID NO: 36159 - DNA, 20 bp, Artificial Sequence
  Synthetic oligonucleotide; TGG chr11 5336155 5336174 5336158 -
aataatgtttgacaaatatt

SEQ ID NO: 36160 - DNA, 20 bp, Artificial Sequence
  Synthetic oligonucleotide; GGG chr11 5336154 5336173 5336157 -
ataatgtttgacaaatattt

SEQ ID NO: 36161 - DNA, 20 bp, Artificial Sequence
  Synthetic oligonucleotide; TGG chr11 5336144 5336163 5336147 -
acaaatatttgggcacccca

SEQ ID NO: 36162 - DNA, 20 bp, Artificial Sequence
  Synthetic oligonucleotide; CAG chr11 5336139 5336158 5336142 -
tatttgggcaccccatggcc

SEQ ID NO: 36163 - DNA, 20 bp, Artificial Sequence
  Synthetic oligonucleotide; TGG chr11 5336130 5336149 5336133 -
accccatggcccagtcaaat

SEQ ID NO: 36164 - DNA, 20 bp, Artificial Sequence
  Synthetic oligonucleotide; CAG chr11 5336110 5336129 5336113 -
tggcatataaaattaaccat

SEQ ID NO: 36165 - DNA, 20 bp, Artificial Sequence
  Synthetic oligonucleotide; GAG chr11 5336108 5336127 5336111 -
gcatataaaattaaccatca

SEQ ID NO: 36166 - DNA, 20 bp, Artificial Sequence
  Synthetic oligonucleotide; TAG chr11 5336101 5336120 5336104 -
aaattaaccatcagagcctg

SEQ ID NO: 36167 - DNA, 20 bp, Artificial Sequence
  Synthetic oligonucleotide; GAG chr11 5336099 5336118 5336102 -
attaaccatcagagcctgta

SEQ ID NO: 36168 - DNA, 20 bp, Artificial Sequence
  Synthetic oligonucleotide; AGG chr11 5336098 5336117 5336101 -
ttaaccatcagagcctgtag

SEQ ID NO: 36169 - DNA, 20 bp, Artificial Sequence
  Synthetic oligonucleotide; GAG chr11 5336093 5336112 5336096 -
catcagagcctgtagaggat

SEQ ID NO: 36170 - DNA, 20 bp, Artificial Sequence
  Synthetic oligonucleotide; AAG chr11 5336087 5336106 5336090 -
agcctgtagaggatgagtta

SEQ ID NO: 36171 - DNA, 20 bp, Artificial Sequence
  Synthetic oligonucleotide; AGG chr11 5336086 5336105 5336089 -
gcctgtagaggatgagttaa

SEQ ID NO: 36172 - DNA, 20 bp, Artificial Sequence
  Synthetic oligonucleotide; TGG chr11 5336082 5336101 5336085 -
gtagaggatgagttaaagga

SEQ ID NO: 36173 - DNA, 20 bp, Artificial Sequence
  Synthetic oligonucleotide; CGG chr11 5336073 5336092 5336076 -
gagttaaaggatggaatctt

SEQ ID NO: 36174 - DNA, 20 bp, Artificial Sequence
  Synthetic oligonucleotide; GAG chr11 5336071 5336090 5336074 -
gttaaaggatggaatcttcg

SEQ ID NO: 36175 - DNA, 20 bp, Artificial Sequence
  Synthetic oligonucleotide; TGG chr11 5336061 5336080 5336064 -
ggaatcttcggagataattg

SEQ ID NO: 36176 - DNA, 20 bp, Artificial Sequence
  Synthetic oligonucleotide; CAG chr11 5336054 5336073 5336057 -
tcggagataattgtggaatc

SEQ ID NO: 36177 - DNA, 20 bp, Artificial Sequence
  Synthetic oligonucleotide; AAG chr11 5336051 5336070 5336054 -
gagataattgtggaatccag

SEQ ID NO: 36178 - DNA, 20 bp, Artificial Sequence
  Synthetic oligonucleotide; AGG chr11 5336050 5336069 5336053 -
agataattgtggaatccaga

SEQ ID NO: 36179 - DNA, 20 bp, Artificial Sequence
  Synthetic oligonucleotide; CAG chr11 5336043 5336062 5336046 -
tgtggaatccagaaggctga

SEQ ID NO: 36180 - DNA, 20 bp, Artificial Sequence
  Synthetic oligonucleotide; TAG chr11 5336036 5336055 5336039 -
tccagaaggctgacagataa

SEQ ID NO: 36181 - DNA, 20 bp, Artificial Sequence
  Synthetic oligonucleotide; CAG chr11 5336021 5336040 5336024 -
gataatagaatcaaactaca

SEQ ID NO: 36182 - DNA, 20 bp, Artificial Sequence
  Synthetic oligonucleotide; AAG chr11 5336006 5336025 5336009 -
ctacacagaaaaaaaaaaaa

SEQ ID NO: 36183 - DNA, 20 bp, Artificial Sequence
  Synthetic oligonucleotide; AAG chr11 5336003 5336022 5336006 -
cacagaaaaaaaaaaaaaag

SEQ ID NO: 36184 - DNA, 20 bp, Artificial Sequence
  Synthetic oligonucleotide; TGG chr11 5335999 5336018 5336002 -
gaaaaaaaaaaaaaagaagc

SEQ ID NO: 36185 - DNA, 20 bp, Artificial Sequence
  Synthetic oligonucleotide; CAG chr11 5335990 5336009 5335993 -
aaaaaagaagctggtattgt

SEQ ID NO: 36186 - DNA, 20 bp, Artificial Sequence
  Synthetic oligonucleotide; CAG chr11 5335985 5336004 5335988 -
agaagctggtattgtcagca

SEQ ID NO: 36187 - DNA, 20 bp, Artificial Sequence
  Synthetic oligonucleotide; CAG chr11 5335968 5335987 5335971 -
gcacagacttactcaacaaa

SEQ ID NO: 36188 - DNA, 20 bp, Artificial Sequence
  Synthetic oligonucleotide; TAG chr11 5335956 5335975 5335959 -
tcaacaaacagcaaaaatcc

SEQ ID NO: 36189 - DNA, 20 bp, Artificial Sequence
  Synthetic oligonucleotide; AGG chr11 5335955 5335974 5335958 -
caacaaacagcaaaaatcct

SEQ ID NO: 36190 - DNA, 20 bp, Artificial Sequence
  Synthetic oligonucleotide; TAG chr11 5335951 5335970 5335954 -
aaacagcaaaaatcctagga

SEQ ID NO: 36191 - DNA, 20 bp, Artificial Sequence
  Synthetic oligonucleotide; GAG chr11 5335949 5335968 5335952 -
acagcaaaaatcctaggata

SEQ ID NO: 36192 - DNA, 20 bp, Artificial Sequence
  Synthetic oligonucleotide; TAG chr11 5335931 5335950 5335934 -
tagagaccttcctgaatcgt

SEQ ID NO: 36193 - DNA, 20 bp, Artificial Sequence
  Synthetic oligonucleotide; AAG chr11 5335922 5335941 5335925 -
tcctgaatcgttagcgatat

SEQ ID NO: 36194 - DNA, 20 bp, Artificial Sequence
  Synthetic oligonucleotide; AAG chr11 5335874 5335893 5335877 -
ctatatgccatatgtaatat

SEQ ID NO: 36195 - DNA, 20 bp, Artificial Sequence
  Synthetic oligonucleotide; AGG chr11 5335873 5335892 5335876 -
tatatgccatatgtaatata

SEQ ID NO: 36196 - DNA, 20 bp, Artificial Sequence
  Synthetic oligonucleotide; CAG chr11 5335870 5335889 5335873 -
atgccatatgtaatataagg

SEQ ID NO: 36197 - DNA, 20 bp, Artificial Sequence
  Synthetic oligonucleotide; CAG chr11 5335867 5335886 5335870 -
ccatatgtaatataaggcag

SEQ ID NO: 36198 - DNA, 20 bp, Artificial Sequence
  Synthetic oligonucleotide; TAG chr11 5335863 5335882 5335866 -
atgtaatataaggcagcagt

SEQ ID NO: 36199 - DNA, 20 bp, Artificial Sequence
  Synthetic oligonucleotide; TAG chr11 5335857 5335876 5335860 -
tataaggcagcagttagata

SEQ ID NO: 36200 - DNA, 20 bp, Artificial Sequence
  Synthetic oligonucleotide; CAG chr11 5335844 5335863 5335847 -
ttagatatagactgtgatgc

SEQ ID NO: 36201 - DNA, 20 bp, Artificial Sequence
  Synthetic oligonucleotide; GAG chr11 5335842 5335861 5335845 -
agatatagactgtgatgcca

SEQ ID NO: 36202 - DNA, 20 bp, Artificial Sequence
  Synthetic oligonucleotide; CAG chr11 5335837 5335856 5335840 -
tagactgtgatgccagagct

SEQ ID NO: 36203 - DNA, 20 bp, Artificial Sequence
  Synthetic oligonucleotide; AAG chr11 5335831 5335850 5335834 -
gtgatgccagagctcagacc

SEQ ID NO: 36204 - DNA, 20 bp, Artificial Sequence
  Synthetic oligonucleotide; GAG chr11 5335829 5335848 5335832 -
gatgccagagctcagaccaa

SEQ ID NO: 36205 - DNA, 20 bp, Artificial Sequence
  Synthetic oligonucleotide; AAG chr11 5335824 5335843 5335827 -
cagagctcagaccaagagcc

SEQ ID NO: 36206 - DNA, 20 bp, Artificial Sequence
  Synthetic oligonucleotide; AGG chr11 5335823 5335842 5335826 -
agagctcagaccaagagcca

SEQ ID NO: 36207 - DNA, 20 bp, Artificial Sequence
  Synthetic oligonucleotide; TAG chr11 5335818 5335837 5335821 -
tcagaccaagagccaaggaa

SEQ ID NO: 36208 - DNA, 20 bp, Artificial Sequence
  Synthetic oligonucleotide; AGG chr11 5335817 5335836 5335820 -
cagaccaagagccaaggaat

SEQ ID NO: 36209 - DNA, 20 bp, Artificial Sequence
  Synthetic oligonucleotide; AAG chr11 5335814 5335833 5335817 -
accaagagccaaggaatagg

SEQ ID NO: 36210 - DNA, 20 bp, Artificial Sequence
  Synthetic oligonucleotide; CAG chr11 5335809 5335828 5335812 -
gagccaaggaataggaagac

SEQ ID NO: 36211 - DNA, 20 bp, Artificial Sequence
  Synthetic oligonucleotide; AAG chr11 5335786 5335805 5335789 -
aaaaatattttcattttaaa

SEQ ID NO: 36212 - DNA, 20 bp, Artificial Sequence
  Synthetic oligonucleotide; TAG chr11 5335782 5335801 5335785 -
atattttcattttaaaaagt

SEQ ID NO: 36213 - DNA, 20 bp, Artificial Sequence
  Synthetic oligonucleotide; AGG chr11 5335781 5335800 5335784 -
tattttcattttaaaaagtt

SEQ ID NO: 36214 - DNA, 20 bp, Artificial Sequence
  Synthetic oligonucleotide; TGG chr11 5335763 5335782 5335766 -
ttaggtaatttctaataatg

SEQ ID NO: 36215 - DNA, 20 bp, Artificial Sequence
  Synthetic oligonucleotide; GAG chr11 5335754 5335773 5335757 -
ttctaataatgtggctgcct

SEQ ID NO: 36216 - DNA, 20 bp, Artificial Sequence
  Synthetic oligonucleotide; CAG chr11 5335745 5335764 5335748 -
tgtggctgcctgagtatttt

SEQ ID NO: 36217 - DNA, 20 bp, Artificial Sequence
  Synthetic oligonucleotide; CAG chr11 5335740 5335759 5335743 -
ctgcctgagtattttcagca

SEQ ID NO: 36218 - DNA, 20 bp, Artificial Sequence
  Synthetic oligonucleotide; TAG chr11 5335707 5335726 5335710 -
aaatattgtgttatgtgatt

SEQ ID NO: 36219 - DNA, 20 bp, Artificial Sequence
  Synthetic oligonucleotide; AAG chr11 5335703 5335722 5335706 -
attgtgttatgtgatttaga

SEQ ID NO: 36220 - DNA, 20 bp, Artificial Sequence
  Synthetic oligonucleotide; GAG chr11 5335701 5335720 5335704 -
tgtgttatgtgatttagaaa

SEQ ID NO: 36221 - DNA, 20 bp, Artificial Sequence
  Synthetic oligonucleotide; CAG chr11 5335697 5335716 5335700 -
ttatgtgatttagaaagaga

SEQ ID NO: 36222 - DNA, 20 bp, Artificial Sequence
  Synthetic oligonucleotide; AGG chr11 5335696 5335715 5335699 -
tatgtgatttagaaagagac

SEQ ID NO: 36223 - DNA, 20 bp, Artificial Sequence
  Synthetic oligonucleotide; CAG chr11 5335689 5335708 5335692 -
tttagaaagagacaggcact

SEQ ID NO: 36224 - DNA, 20 bp, Artificial Sequence
  Synthetic oligonucleotide; CGG chr11 5335686 5335705 5335689 -
agaaagagacaggcactcag

SEQ ID NO: 36225 - DNA, 20 bp, Artificial Sequence
  Synthetic oligonucleotide; CAG chr11 5335672 5335691 5335675 -
actcagcggatgacccttgt

SEQ ID NO: 36226 - DNA, 20 bp, Artificial Sequence
  Synthetic oligonucleotide; AGG chr11 5335671 5335690 5335674 -
ctcagcggatgacccttgtc

SEQ ID NO: 36227 - DNA, 20 bp, Artificial Sequence
  Synthetic oligonucleotide; AAG chr11 5335655 5335674 5335658 -
tgtcaggaaacactgcatca

SEQ ID NO: 36228 - DNA, 20 bp, Artificial Sequence
  Synthetic oligonucleotide; AAG chr11 5335652 5335671 5335655 -
caggaaacactgcatcaaag

SEQ ID NO: 36229 - DNA, 20 bp, Artificial Sequence
  Synthetic oligonucleotide; AGG chr11 5335651 5335670 5335654 -
aggaaacactgcatcaaaga

SEQ ID NO: 36230 - DNA, 20 bp, Artificial Sequence
  Synthetic oligonucleotide; CAG chr11 5335639 5335658 5335642 -
atcaaagaaggcttttatta

SEQ ID NO: 36231 - DNA, 20 bp, Artificial Sequence
  Synthetic oligonucleotide; AGG chr11 5335638 5335657 5335641 -
tcaaagaaggcttttattac

SEQ ID NO: 36232 - DNA, 20 bp, Artificial Sequence
  Synthetic oligonucleotide; GAG chr11 5335636 5335655 5335639 -
aaagaaggcttttattacag

SEQ ID NO: 36233 - DNA, 20 bp, Artificial Sequence
  Synthetic oligonucleotide; TGG chr11 5335632 5335651 5335635 -
aaggcttttattacaggaga

SEQ ID NO: 36234 - DNA, 20 bp, Artificial Sequence
  Synthetic oligonucleotide; GAG chr11 5335630 5335649 5335633 -
ggcttttattacaggagatg

SEQ ID NO: 36235 - DNA, 20 bp, Artificial Sequence
  Synthetic oligonucleotide; AGG chr11 5335629 5335648 5335632 -
gcttttattacaggagatgg

SEQ ID NO: 36236 - DNA, 20 bp, Artificial Sequence
  Synthetic oligonucleotide; GAG chr11 5335613 5335632 5335616 -
atggaggtccttcccaatct

SEQ ID NO: 36237 - DNA, 20 bp, Artificial Sequence
  Synthetic oligonucleotide; CAG chr11 5335578 5335597 5335581 -
tgacatgatactttacttca

SEQ ID NO: 36238 - DNA, 20 bp, Artificial Sequence
  Synthetic oligonucleotide; AGG chr11 5335577 5335596 5335580 -
gacatgatactttacttcac

SEQ ID NO: 36239 - DNA, 20 bp, Artificial Sequence
  Synthetic oligonucleotide; CAG chr11 5335569 5335588 5335572 -
actttacttcacaggcaata

SEQ ID NO: 36240 - DNA, 20 bp, Artificial Sequence
  Synthetic oligonucleotide; CAG chr11 5335566 5335585 5335569 -
ttacttcacaggcaatacag

SEQ ID NO: 36241 - DNA, 20 bp, Artificial Sequence
  Synthetic oligonucleotide; AGG chr11 5335565 5335584 5335568 -
tacttcacaggcaatacagc

SEQ ID NO: 36242 - DNA, 20 bp, Artificial Sequence
  Synthetic oligonucleotide; AAG chr11 5335553 5335572 5335556 -
aatacagcaggaaatatgaa

SEQ ID NO: 36243 - DNA, 20 bp, Artificial Sequence
  Synthetic oligonucleotide; AAG chr11 5335543 5335562 5335546 -
gaaatatgaaaagaatgaac

SEQ ID NO: 36244 - DNA, 20 bp, Artificial Sequence
  Synthetic oligonucleotide; AGG chr11 5335542 5335561 5335545 -
aaatatgaaaagaatgaaca

SEQ ID NO: 36245 - DNA, 20 bp, Artificial Sequence
  Synthetic oligonucleotide; TAG chr11 5335536 5335555 5335539 -
gaaaagaatgaacaaggtct

SEQ ID NO: 36246 - DNA, 20 bp, Artificial Sequence
  Synthetic oligonucleotide; GAG chr11 5335520 5335539 5335523 -
gtcttagaaaatacatgaat

SEQ ID NO: 36247 - DNA, 20 bp, Artificial Sequence
  Synthetic oligonucleotide; GAG chr11 5335518 5335537 5335521 -
cttagaaaatacatgaatga

SEQ ID NO: 36248 - DNA, 20 bp, Artificial Sequence
  Synthetic oligonucleotide; TGG chr11 5335506 5335525 5335509 -
atgaatgagagacacatcaa

SEQ ID NO: 36249 - DNA, 20 bp, Artificial Sequence
  Synthetic oligonucleotide; AAG chr11 5335497 5335516 5335500 -
agacacatcaatggctattt

SEQ ID NO: 36250 - DNA, 20 bp, Artificial Sequence
  Synthetic oligonucleotide; AGG chr11 5335496 5335515 5335499 -
gacacatcaatggctattta

SEQ ID NO: 36251 - DNA, 20 bp, Artificial Sequence
  Synthetic oligonucleotide; TAG chr11 5335490 5335509 5335493 -
tcaatggctatttaaggaaa

SEQ ID NO: 36252 - DNA, 20 bp, Artificial Sequence
  Synthetic oligonucleotide; AAG chr11 5335487 5335506 5335490 -
atggctatttaaggaaatag

SEQ ID NO: 36253 - DNA, 20 bp, Artificial Sequence
  Synthetic oligonucleotide; TGG chr11 5335478 5335497 5335481 -
taaggaaatagaagatattt

SEQ ID NO: 36254 - DNA, 20 bp, Artificial Sequence
  Synthetic oligonucleotide; GGG chr11 5335477 5335496 5335480 -
aaggaaatagaagatatttt

SEQ ID NO: 36255 - DNA, 20 bp, Artificial Sequence
  Synthetic oligonucleotide; CAG chr11 5335455 5335474 5335458 -
gtgccctgcctacttcctcc

SEQ ID NO: 36256 - DNA, 20 bp, Artificial Sequence
  Synthetic oligonucleotide; AAG chr11 5335445 5335464 5335448 -
tacttcctcccagtgcccct

SEQ ID NO: 36257 - DNA, 20 bp, Artificial Sequence
  Synthetic oligonucleotide; TGG chr11 5335440 5335459 5335443 -
cctcccagtgcccctaagct

SEQ ID NO: 36258 - DNA, 20 bp, Artificial Sequence
  Synthetic oligonucleotide; GAG chr11 5335430 5335449 5335433 -
cccctaagcttggtgacttt

SEQ ID NO: 36259 - DNA, 20 bp, Artificial Sequence
  Synthetic oligonucleotide; TGG chr11 5335424 5335443 5335427 -
agcttggtgactttgagtgt

SEQ ID NO: 36260 - DNA, 20 bp, Artificial Sequence
  Synthetic oligonucleotide; TAG chr11 5335414 5335433 5335417 -
ctttgagtgttggctgataa

SEQ ID NO: 36261 - DNA, 20 bp, Artificial Sequence
  Synthetic oligonucleotide; TGG chr11 5335397 5335416 5335400 -
taatagttgttcccattctc

SEQ ID NO: 36262 - DNA, 20 bp, Artificial Sequence
  Synthetic oligonucleotide; GAG chr11 5335395 5335414 5335398 -
atagttgttcccattctctg

SEQ ID NO: 36263 - DNA, 20 bp, Artificial Sequence
  Synthetic oligonucleotide; AGG chr11 5335394 5335413 5335397 -
tagttgttcccattctctgg

SEQ ID NO: 36264 - DNA, 20 bp, Artificial Sequence
  Synthetic oligonucleotide; CAG chr11 5335376 5335395 5335379 -
ggaggcttatcctccaccaa

SEQ ID NO: 36265 - DNA, 20 bp, Artificial Sequence
  Synthetic oligonucleotide; GAG chr11 5335360 5335379 5335363 -
ccaacagtgtcacttcacat

SEQ ID NO: 36266 - DNA, 20 bp, Artificial Sequence
  Synthetic oligonucleotide; TGG chr11 5335342 5335361 5335345 -
atgagattttatcccaactc

SEQ ID NO: 36267 - DNA, 20 bp, Artificial Sequence
  Synthetic oligonucleotide; GGG chr11 5335341 5335360 5335344 -
tgagattttatcccaactct

SEQ ID NO: 36268 - DNA, 20 bp, Artificial Sequence
  Synthetic oligonucleotide; GGG chr11 5335340 5335359 5335343 -
gagattttatcccaactctg

SEQ ID NO: 36269 - DNA, 20 bp, Artificial Sequence
  Synthetic oligonucleotide; CAG chr11 5335337 5335356 5335340 -
attttatcccaactctgggg

SEQ ID NO: 36270 - DNA, 20 bp, Artificial Sequence
  Synthetic oligonucleotide; CAG chr11 5335330 5335349 5335333 -
cccaactctggggcagtctg

SEQ ID NO: 36271 - DNA, 20 bp, Artificial Sequence
  Synthetic oligonucleotide; AGG chr11 5335329 5335348 5335332 -
ccaactctggggcagtctgc

SEQ ID NO: 36272 - DNA, 20 bp, Artificial Sequence
  Synthetic oligonucleotide; AAG chr11 5335305 5335324 5335308 -
aattactttatatctgttct

SEQ ID NO: 36273 - DNA, 20 bp, Artificial Sequence
  Synthetic oligonucleotide; AAG chr11 5335300 5335319 5335303 -
ctttatatctgttctaagat

SEQ ID NO: 36274 - DNA, 20 bp, Artificial Sequence
  Synthetic oligonucleotide; CAG chr11 5335288 5335307 5335291 -
tctaagataagtgatgtttc

SEQ ID NO: 36275 - DNA, 20 bp, Artificial Sequence
  Synthetic oligonucleotide; AGG chr11 5335287 5335306 5335290 -
ctaagataagtgatgtttcc

SEQ ID NO: 36276 - DNA, 20 bp, Artificial Sequence
  Synthetic oligonucleotide; TAG chr11 5335282 5335301 5335285 -
ataagtgatgtttccaggaa

SEQ ID NO: 36277 - DNA, 20 bp, Artificial Sequence
  Synthetic oligonucleotide; GAG chr11 5335280 5335299 5335283 -
aagtgatgtttccaggaata

SEQ ID NO: 36278 - DNA, 20 bp, Artificial Sequence
  Synthetic oligonucleotide; TGG chr11 5335268 5335287 5335271 -
caggaatagagtcatattta

SEQ ID NO: 36279 - DNA, 20 bp, Artificial Sequence
  Synthetic oligonucleotide; GGG chr11 5335267 5335286 5335270 -
aggaatagagtcatatttat

SEQ ID NO: 36280 - DNA, 20 bp, Artificial Sequence
  Synthetic oligonucleotide; GGG chr11 5335266 5335285 5335269 -
ggaatagagtcatatttatg

SEQ ID NO: 36281 - DNA, 20 bp, Artificial Sequence
  Synthetic oligonucleotide; CAG chr11 5335263 5335282 5335266 -
atagagtcatatttatgggg

SEQ ID NO: 36282 - DNA, 20 bp, Artificial Sequence
  Synthetic oligonucleotide; AAG chr11 5335260 5335279 5335263 -
gagtcatatttatggggcag

SEQ ID NO: 36283 - DNA, 20 bp, Artificial Sequence
  Synthetic oligonucleotide; CAG chr11 5335244 5335263 5335247 -
gcagaagattcgtgtactgc

SEQ ID NO: 36284 - DNA, 20 bp, Artificial Sequence
  Synthetic oligonucleotide; GAG chr11 5335240 5335259 5335243 -
aagattcgtgtactgccagt

SEQ ID NO: 36285 - DNA, 20 bp, Artificial Sequence
  Synthetic oligonucleotide; GAG chr11 5335238 5335257 5335241 -
gattcgtgtactgccagtga

SEQ ID NO: 36286 - DNA, 20 bp, Artificial Sequence
  Synthetic oligonucleotide; AGG chr11 5335237 5335256 5335240 -
attcgtgtactgccagtgag

SEQ ID NO: 36287 - DNA, 20 bp, Artificial Sequence
  Synthetic oligonucleotide; GGG chr11 5335236 5335255 5335239 -
ttcgtgtactgccagtgaga

SEQ ID NO: 36288 - DNA, 20 bp, Artificial Sequence
  Synthetic oligonucleotide; TGG chr11 5335212 5335231 5335215 -
caatatacctactaatgaaa

SEQ ID NO: 36289 - DNA, 20 bp, Artificial Sequence
  Synthetic oligonucleotide; GGG chr11 5335211 5335230 5335214 -
aatatacctactaatgaaat

SEQ ID NO: 36290 - DNA, 20 bp, Artificial Sequence
  Synthetic oligonucleotide; GAG chr11 5335209 5335228 5335212 -
tatacctactaatgaaatgg

SEQ ID NO: 36291 - DNA, 20 bp, Artificial Sequence
  Synthetic oligonucleotide; AGG chr11 5335208 5335227 5335211 -
atacctactaatgaaatggg

SEQ ID NO: 36292 - DNA, 20 bp, Artificial Sequence
  Synthetic oligonucleotide; GGG chr11 5335207 5335226 5335210 -
tacctactaatgaaatggga

SEQ ID NO: 36293 - DNA, 20 bp, Artificial Sequence
  Synthetic oligonucleotide; CAG chr11 5335204 5335223 5335207 -
ctactaatgaaatgggaggg

SEQ ID NO: 36294 - DNA, 20 bp, Artificial Sequence
  Synthetic oligonucleotide; CAG chr11 5335188 5335207 5335191 -
agggcagcctgaaattaaat

SEQ ID NO: 36295 - DNA, 20 bp, Artificial Sequence
  Synthetic oligonucleotide; CAG chr11 5335179 5335198 5335182 -
tgaaattaaatcagttatct

SEQ ID NO: 36296 - DNA, 20 bp, Artificial Sequence
  Synthetic oligonucleotide; AGG chr11 5335178 5335197 5335181 -
gaaattaaatcagttatctc

SEQ ID NO: 36297 - DNA, 20 bp, Artificial Sequence
  Synthetic oligonucleotide; GGG chr11 5335177 5335196 5335180 -
aaattaaatcagttatctca

SEQ ID NO: 36298 - DNA, 20 bp, Artificial Sequence
  Synthetic oligonucleotide; AAG chr11 5335152 5335171 5335155 -
ttactacctcacctcatttt

SEQ ID NO: 36299 - DNA, 20 bp, Artificial Sequence
  Synthetic oligonucleotide; AAG chr11 5335145 5335164 5335148 -
ctcacctcattttaagttca

SEQ ID NO: 36300 - DNA, 20 bp, Artificial Sequence
  Synthetic oligonucleotide; TGG chr11 5335140 5335159 5335143 -
ctcattttaagttcaaagca

SEQ ID NO: 36301 - DNA, 20 bp, Artificial Sequence
  Synthetic oligonucleotide; CAG chr11 5335121 5335140 5335124 -
atggctcccctaaatcaatc

SEQ ID NO: 36302 - DNA, 20 bp, Artificial Sequence
  Synthetic oligonucleotide; TAG chr11 5335103 5335122 5335106 -
tccagacctaaattttaact

SEQ ID NO: 36303 - DNA, 20 bp, Artificial Sequence
  Synthetic oligonucleotide; AAG chr11 5335096 5335115 5335099 -
ctaaattttaacttagtaca

SEQ ID NO: 36304 - DNA, 20 bp, Artificial Sequence
  Synthetic oligonucleotide; GAG chr11 5335094 5335113 5335097 -
aaattttaacttagtacaaa

SEQ ID NO: 36305 - DNA, 20 bp, Artificial Sequence
  Synthetic oligonucleotide; AGG chr11 5335093 5335112 5335096 -
aattttaacttagtacaaag

SEQ ID NO: 36306 - DNA, 20 bp, Artificial Sequence
  Synthetic oligonucleotide; CAG chr11 5335077 5335096 5335080 -
aaagaggacacacaaatttt

SEQ ID NO: 36307 - DNA, 20 bp, Artificial Sequence
  Synthetic oligonucleotide; AAG chr11 5335070 5335089 5335073 -
acacacaaattttcagactt

SEQ ID NO: 36308 - DNA, 20 bp, Artificial Sequence
  Synthetic oligonucleotide; CAG chr11 5335060 5335079 5335063 -
tttcagacttaagccatttc

SEQ ID NO: 36309 - DNA, 20 bp, Artificial Sequence
  Synthetic oligonucleotide; GAG chr11 5335058 5335077 5335061 -
tcagacttaagccatttcca

SEQ ID NO: 36310 - DNA, 20 bp, Artificial Sequence
  Synthetic oligonucleotide; TAG chr11 5335011 5335030 5335014 -
actactattctgcttacatt

SEQ ID NO: 36311 - DNA, 20 bp, Artificial Sequence
  Synthetic oligonucleotide; AGG chr11 5335010 5335029 5335013 -
ctactattctgcttacattt

SEQ ID NO: 36312 - DNA, 20 bp, Artificial Sequence
  Synthetic oligonucleotide; AAG chr11 5335007 5335026 5335010 -
ctattctgcttacatttagg

SEQ ID NO: 36313 - DNA, 20 bp, Artificial Sequence
  Synthetic oligonucleotide; GAG chr11 5334998 5335017 5335001 -
ttacatttaggaagacctat

SEQ ID NO: 36314 - DNA, 20 bp, Artificial Sequence
  Synthetic oligonucleotide; CAG chr11 5334995 5335014 5334998 -
catttaggaagacctatgag

SEQ ID NO: 36315 - DNA, 20 bp, Artificial Sequence
  Synthetic oligonucleotide; CAG chr11 5334988 5335007 5334991 -
gaagacctatgagcagaatg

SEQ ID NO: 36316 - DNA, 20 bp, Artificial Sequence
  Synthetic oligonucleotide; CAG chr11 5334983 5335002 5334986 -
cctatgagcagaatgcagtt

SEQ ID NO: 36317 - DNA, 20 bp, Artificial Sequence
  Synthetic oligonucleotide; AGG chr11 5334982 5335001 5334985 -
ctatgagcagaatgcagttc

SEQ ID NO: 36318 - DNA, 20 bp, Artificial Sequence
  Synthetic oligonucleotide; GAG chr11 5334980 5334999 5334983 -
atgagcagaatgcagttcag

SEQ ID NO: 36319 - DNA, 20 bp, Artificial Sequence
  Synthetic oligonucleotide; AGG chr11 5334979 5334998 5334982 -
tgagcagaatgcagttcagg

SEQ ID NO: 36320 - DNA, 20 bp, Artificial Sequence
  Synthetic oligonucleotide; CAG chr11 5334955 5334974 5334958 -
acttaactgatgtgaaatgt

SEQ ID NO: 36321 - DNA, 20 bp, Artificial Sequence
  Synthetic oligonucleotide; AGG chr11 5334954 5334973 5334957 -
cttaactgatgtgaaatgtc

SEQ ID NO: 36322 - DNA, 20 bp, Artificial Sequence
  Synthetic oligonucleotide; TGG chr11 5334932 5334951 5334935 -
gcaccaaaatgtgaccctca

SEQ ID NO: 36323 - DNA, 20 bp, Artificial Sequence
  Synthetic oligonucleotide; TAG chr11 5334892 5334911 5334895 -
atactcattttaaaatctca

SEQ ID NO: 36324 - DNA, 20 bp, Artificial Sequence
  Synthetic oligonucleotide; TGG chr11 5334888 5334907 5334891 -
tcattttaaaatctcatagt

SEQ ID NO: 36325 - DNA, 20 bp, Artificial Sequence
  Synthetic oligonucleotide; GGG chr11 5334887 5334906 5334890 -
cattttaaaatctcatagtt

SEQ ID NO: 36326 - DNA, 20 bp, Artificial Sequence
  Synthetic oligonucleotide; AAG chr11 5334882 5334901 5334885 -
taaaatctcatagttgggct

SEQ ID NO: 36327 - DNA, 20 bp, Artificial Sequence
  Synthetic oligonucleotide; CAG chr11 5334876 5334895 5334879 -
ctcatagttgggctaagttc

SEQ ID NO: 36328 - DNA, 20 bp, Artificial Sequence
  Synthetic oligonucleotide; AGG chr11 5334875 5334894 5334878 -
tcatagttgggctaagttcc

SEQ ID NO: 36329 - DNA, 20 bp, Artificial Sequence
  Synthetic oligonucleotide; TAG chr11 5334865 5334884 5334868 -
gctaagttccaggataaatt

SEQ ID NO: 36330 - DNA, 20 bp, Artificial Sequence
  Synthetic oligonucleotide; AGG chr11 5334864 5334883 5334867 -
ctaagttccaggataaattt

SEQ ID NO: 36331 - DNA, 20 bp, Artificial Sequence
  Synthetic oligonucleotide; AAG chr11 5334857 5334876 5334860 -
ccaggataaatttaggattt

SEQ ID NO: 36332 - DNA, 20 bp, Artificial Sequence
  Synthetic oligonucleotide; GAG chr11 5334848 5334867 5334851 -
atttaggatttaagactgat

SEQ ID NO: 36333 - DNA, 20 bp, Artificial Sequence
  Synthetic oligonucleotide; TAG chr11 5334841 5334860 5334844 -
atttaagactgatgagacaa

SEQ ID NO: 36334 - DNA, 20 bp, Artificial Sequence
  Synthetic oligonucleotide; CAG chr11 5334831 5334850 5334834 -
gatgagacaatagaaattct

SEQ ID NO: 36335 - DNA, 20 bp, Artificial Sequence
  Synthetic oligonucleotide; CAG chr11 5334812 5334831 5334815 -
tcagatccttatttctctga

SEQ ID NO: 36336 - DNA, 20 bp, Artificial Sequence
  Synthetic oligonucleotide; GAG chr11 5334804 5334823 5334807 -
ttatttctctgacagactat

SEQ ID NO: 36337 - DNA, 20 bp, Artificial Sequence
  Synthetic oligonucleotide; AAG chr11 5334789 5334808 5334792 -
actatgagatgattgtattc

SEQ ID NO: 36338 - DNA, 20 bp, Artificial Sequence
  Synthetic oligonucleotide; CAG chr11 5334776 5334795 5334779 -
tgtattcaagtacaaattgt

SEQ ID NO: 36339 - DNA, 20 bp, Artificial Sequence
  Synthetic oligonucleotide; AAG chr11 5334770 5334789 5334773 -
caagtacaaattgtcagaca

SEQ ID NO: 36340 - DNA, 20 bp, Artificial Sequence
  Synthetic oligonucleotide; CAG chr11 5334766 5334785 5334769 -
tacaaattgtcagacaaagc

SEQ ID NO: 36341 - DNA, 20 bp, Artificial Sequence
  Synthetic oligonucleotide; AGG chr11 5334765 5334784 5334768 -
acaaattgtcagacaaagcc

SEQ ID NO: 36342 - DNA, 20 bp, Artificial Sequence
  Synthetic oligonucleotide; GGG chr11 5334764 5334783 5334767 -
caaattgtcagacaaagcca

SEQ ID NO: 36343 - DNA, 20 bp, Artificial Sequence
  Synthetic oligonucleotide; AAG chr11 5334757 5334776 5334760 -
tcagacaaagccagggatta

SEQ ID NO: 36344 - DNA, 20 bp, Artificial Sequence
  Synthetic oligonucleotide; CAG chr11 5334719 5334738 5334722 -
tcccctttttaacattacta

SEQ ID NO: 36345 - DNA, 20 bp, Artificial Sequence
  Synthetic oligonucleotide; AGG chr11 5334718 5334737 5334721 -
cccctttttaacattactac

SEQ ID NO: 36346 - DNA, 20 bp, Artificial Sequence
  Synthetic oligonucleotide; CAG chr11 5334675 5334694 5334678 -
aaacttgatttatattgctc

SEQ ID NO: 36347 - DNA, 20 bp, Artificial Sequence
  Synthetic oligonucleotide; AAG chr11 5334672 5334691 5334675 -
cttgatttatattgctccag

SEQ ID NO: 36348 - DNA, 20 bp, Artificial Sequence
  Synthetic oligonucleotide; CAG chr11 5334669 5334688 5334672 -
gatttatattgctccagaag

SEQ ID NO: 36349 - DNA, 20 bp, Artificial Sequence
  Synthetic oligonucleotide; TGG chr11 5334653 5334672 5334656 -
gaagcagtaactctgattct

SEQ ID NO: 36350 - DNA, 20 bp, Artificial Sequence
  Synthetic oligonucleotide; GGG chr11 5334652 5334671 5334655 -
aagcagtaactctgattctt

SEQ ID NO: 36351 - DNA, 20 bp, Artificial Sequence
  Synthetic oligonucleotide; AAG chr11 5334648 5334667 5334651 -
agtaactctgattcttgggc

SEQ ID NO: 36352 - DNA, 20 bp, Artificial Sequence
  Synthetic oligonucleotide; AAG chr11 5334638 5334657 5334641 -
attcttgggcaagacttacc

SEQ ID NO: 36353 - DNA, 20 bp, Artificial Sequence
  Synthetic oligonucleotide; GAG chr11 5334636 5334655 5334639 -
tcttgggcaagacttaccaa

SEQ ID NO: 36354 - DNA, 20 bp, Artificial Sequence
  Synthetic oligonucleotide; CAG chr11 5334632 5334651 5334635 -
gggcaagacttaccaagaga

SEQ ID NO: 36355 - DNA, 20 bp, Artificial Sequence
  Synthetic oligonucleotide; AAG chr11 5334624 5334643 5334627 -
cttaccaagagacagaaaac

SEQ ID NO: 36356 - DNA, 20 bp, Artificial Sequence
  Synthetic oligonucleotide; AAG chr11 5334609 5334628 5334612 -
aaaacaagcttactgtttga

SEQ ID NO: 36357 - DNA, 20 bp, Artificial Sequence
  Synthetic oligonucleotide; CAG chr11 5334599 5334618 5334602 -
tactgtttgaaagaacttat

SEQ ID NO: 36358 - DNA, 20 bp, Artificial Sequence
  Synthetic oligonucleotide; CAG chr11 5334596 5334615 5334599 -
tgtttgaaagaacttatcag

SEQ ID NO: 36359 - DNA, 20 bp, Artificial Sequence
  Synthetic oligonucleotide; GAG chr11 5334582 5334601 5334585 -
tatcagcagcactcatttgt

SEQ ID NO: 36360 - DNA, 20 bp, Artificial Sequence
  Synthetic oligonucleotide; AAG chr11 5334549 5334568 5334552 -
aaacaatcttatttgaaacc

SEQ ID NO: 36361 - DNA, 20 bp, Artificial Sequence
  Synthetic oligonucleotide; AAG chr11 5334544 5334563 5334547 -
atcttatttgaaaccaagaa

SEQ ID NO: 36362 - DNA, 20 bp, Artificial Sequence
  Synthetic oligonucleotide; AAG chr11 5334538 5334557 5334541 -
tttgaaaccaagaaaagatt

SEQ ID NO: 36363 - DNA, 20 bp, Artificial Sequence
  Synthetic oligonucleotide; GAG chr11 5334532 5334551 5334535 -
accaagaaaagattaagtgt

SEQ ID NO: 36364 - DNA, 20 bp, Artificial Sequence
  Synthetic oligonucleotide; AGG chr11 5334531 5334550 5334534 -
ccaagaaaagattaagtgtg

SEQ ID NO: 36365 - DNA, 20 bp, Artificial Sequence
  Synthetic oligonucleotide; GGG chr11 5334530 5334549 5334533 -
caagaaaagattaagtgtga

SEQ ID NO: 36366 - DNA, 20 bp, Artificial Sequence
  Synthetic oligonucleotide; AAG chr11 5334521 5334540 5334524 -
attaagtgtgagggattatt

SEQ ID NO: 36367 - DNA, 20 bp, Artificial Sequence
  Synthetic oligonucleotide; AAG chr11 5334510 5334529 5334513 -
gggattattaagctttgtct

SEQ ID NO: 36368 - DNA, 20 bp, Artificial Sequence
  Synthetic oligonucleotide; GAG chr11 5334505 5334524 5334508 -
tattaagctttgtctaagtt

SEQ ID NO: 36369 - DNA, 20 bp, Artificial Sequence
  Synthetic oligonucleotide; GAG chr11 5334501 5334520 5334504 -
aagctttgtctaagttgagt

SEQ ID NO: 36370 - DNA, 20 bp, Artificial Sequence
  Synthetic oligonucleotide; TGG chr11 5334493 5334512 5334496 -
tctaagttgagtgagcttat

SEQ ID NO: 36371 - DNA, 20 bp, Artificial Sequence
  Synthetic oligonucleotide; CAG chr11 5334487 5334506 5334490 -
ttgagtgagcttattggcta

SEQ ID NO: 36372 - DNA, 20 bp, Artificial Sequence
  Synthetic oligonucleotide; AGG chr11 5334486 5334505 5334489 -
tgagtgagcttattggctac

SEQ ID NO: 36373 - DNA, 20 bp, Artificial Sequence
  Synthetic oligonucleotide; GGG chr11 5334485 5334504 5334488 -
gagtgagcttattggctaca

SEQ ID NO: 36374 - DNA, 20 bp, Artificial Sequence
  Synthetic oligonucleotide; AAG chr11 5334480 5334499 5334483 -
agcttattggctacagggtt

SEQ ID NO: 36375 - DNA, 20 bp, Artificial Sequence
  Synthetic oligonucleotide; AGG chr11 5334479 5334498 5334482 -
gcttattggctacagggtta

SEQ ID NO: 36376 - DNA, 20 bp, Artificial Sequence
  Synthetic oligonucleotide; AAG chr11 5334468 5334487 5334471 -
acagggttaaggaataacaa

SEQ ID NO: 36377 - DNA, 20 bp, Artificial Sequence
  Synthetic oligonucleotide; TAG chr11 5334465 5334484 5334468 -
gggttaaggaataacaaaag

SEQ ID NO: 36378 - DNA, 20 bp, Artificial Sequence
  Synthetic oligonucleotide; AGG chr11 5334464 5334483 5334467 -
ggttaaggaataacaaaagt

SEQ ID NO: 36379 - DNA, 20 bp, Artificial Sequence
  Synthetic oligonucleotide; CGG chr11 5334456 5334475 5334459 -
aataacaaaagtaggcttca

SEQ ID NO: 36380 - DNA, 20 bp, Artificial Sequence
  Synthetic oligonucleotide; GAG chr11 5334441 5334460 5334444 -
cttcacggtatcttcttttt

SEQ ID NO: 36381 - DNA, 20 bp, Artificial Sequence
  Synthetic oligonucleotide; AGG chr11 5334440 5334459 5334443 -
ttcacggtatcttctttttg

SEQ ID NO: 36382 - DNA, 20 bp, Artificial Sequence
  Synthetic oligonucleotide; TGG chr11 5334437 5334456 5334440 -
acggtatcttctttttgagg

SEQ ID NO: 36383 - DNA, 20 bp, Artificial Sequence
  Synthetic oligonucleotide; GGG chr11 5334436 5334455 5334439 -
cggtatcttctttttgaggt

SEQ ID NO: 36384 - DNA, 20 bp, Artificial Sequence
  Synthetic oligonucleotide; GGG chr11 5334435 5334454 5334438 -
ggtatcttctttttgaggtg

SEQ ID NO: 36385 - DNA, 20 bp, Artificial Sequence
  Synthetic oligonucleotide; AAG chr11 5334424 5334443 5334427 -
tttgaggtggggaatcatac

SEQ ID NO: 36386 - DNA, 20 bp, Artificial Sequence
  Synthetic oligonucleotide; AGG chr11 5334423 5334442 5334426 -
ttgaggtggggaatcataca

SEQ ID NO: 36387 - DNA, 20 bp, Artificial Sequence
  Synthetic oligonucleotide; AAG chr11 5334418 5334437 5334421 -
gtggggaatcatacaaggca

SEQ ID NO: 36388 - DNA, 20 bp, Artificial Sequence
  Synthetic oligonucleotide; AGG chr11 5334417 5334436 5334420 -
tggggaatcatacaaggcaa

SEQ ID NO: 36389 - DNA, 20 bp, Artificial Sequence
  Synthetic oligonucleotide; TAG chr11 5334414 5334433 5334417 -
ggaatcatacaaggcaaagg

SEQ ID NO: 36390 - DNA, 20 bp, Artificial Sequence
  Synthetic oligonucleotide; TAG chr11 5334410 5334429 5334413 -
tcatacaaggcaaaggtagt

SEQ ID NO: 36391 - DNA, 20 bp, Artificial Sequence
  Synthetic oligonucleotide; TAG chr11 5334406 5334425 5334409 -
acaaggcaaaggtagttaga

SEQ ID NO: 36392 - DNA, 20 bp, Artificial Sequence
  Synthetic oligonucleotide; TGG chr11 5334387 5334406 5334390 -
atagcatgacttccatgtgc

SEQ ID NO: 36393 - DNA, 20 bp, Artificial Sequence
  Synthetic oligonucleotide; AAG chr11 5334381 5334400 5334384 -
tgacttccatgtgctggatg

SEQ ID NO: 36394 - DNA, 20 bp, Artificial Sequence
  Synthetic oligonucleotide; AAG chr11 5334354 5334373 5334357 -
aattctgttttctttttgca

SEQ ID NO: 36395 - DNA, 20 bp, Artificial Sequence
  Synthetic oligonucleotide; TGG chr11 5334345 5334364 5334348 -
ttctttttgcaaagaaaata

SEQ ID NO: 36396 - DNA, 20 bp, Artificial Sequence
  Synthetic oligonucleotide; GGG chr11 5334344 5334363 5334347 -
tctttttgcaaagaaaatat

SEQ ID NO: 36397 - DNA, 20 bp, Artificial Sequence
  Synthetic oligonucleotide; GGG chr11 5334343 5334362 5334346 -
ctttttgcaaagaaaatatg

SEQ ID NO: 36398 - DNA, 20 bp, Artificial Sequence
  Synthetic oligonucleotide; AAG chr11 5334336 5334355 5334339 -
caaagaaaatatggggcttt

SEQ ID NO: 36399 - DNA, 20 bp, Artificial Sequence
  Synthetic oligonucleotide; CAG chr11 5334329 5334348 5334332 -
aatatggggctttaagaaca

SEQ ID NO: 36400 - DNA, 20 bp, Artificial Sequence
  Synthetic oligonucleotide; TGG chr11 5334323 5334342 5334326 -
gggctttaagaacacagttc

SEQ ID NO: 36401 - DNA, 20 bp, Artificial Sequence
  Synthetic oligonucleotide; GAG chr11 5334321 5334340 5334324 -
gctttaagaacacagttctg

SEQ ID NO: 36402 - DNA, 20 bp, Artificial Sequence
  Synthetic oligonucleotide; AAG chr11 5334302 5334321 5334305 -
ggagcccacttccttctcca

SEQ ID NO: 36403 - DNA, 20 bp, Artificial Sequence
  Synthetic oligonucleotide; AGG chr11 5334301 5334320 5334304 -
gagcccacttccttctccaa

SEQ ID NO: 36404 - DNA, 20 bp, Artificial Sequence
  Synthetic oligonucleotide; GAG chr11 5334299 5334318 5334302 -
gcccacttccttctccaaag

SEQ ID NO: 36405 - DNA, 20 bp, Artificial Sequence
  Synthetic oligonucleotide; AGG chr11 5334298 5334317 5334301 -
cccacttccttctccaaagg

SEQ ID NO: 36406 - DNA, 20 bp, Artificial Sequence
  Synthetic oligonucleotide; CAG chr11 5334278 5334297 5334281 -
aggcttgaaaaaaaatatcc

SEQ ID NO: 36407 - DNA, 20 bp, Artificial Sequence
  Synthetic oligonucleotide; TAG chr11 5334275 5334294 5334278 -
cttgaaaaaaaatatcccag

SEQ ID NO: 36408 - DNA, 20 bp, Artificial Sequence
  Synthetic oligonucleotide; CAG chr11 5334262 5334281 5334265 -
atcccagtagcctaattatc

SEQ ID NO: 36409 - DNA, 20 bp, Artificial Sequence
  Synthetic oligonucleotide; AAG chr11 5334255 5334274 5334258 -
tagcctaattatccagcatc

SEQ ID NO: 36410 - DNA, 20 bp, Artificial Sequence
  Synthetic oligonucleotide; CAG chr11 5334251 5334270 5334254 -
ctaattatccagcatcaaga

SEQ ID NO: 36411 - DNA, 20 bp, Artificial Sequence
  Synthetic oligonucleotide; TGG chr11 5334244 5334263 5334247 -
tccagcatcaagacagatac

SEQ ID NO: 36412 - DNA, 20 bp, Artificial Sequence
  Synthetic oligonucleotide; GGG chr11 5334243 5334262 5334246 -
ccagcatcaagacagatact

SEQ ID NO: 36413 - DNA, 20 bp, Artificial Sequence
  Synthetic oligonucleotide; GGG chr11 5334242 5334261 5334245 -
cagcatcaagacagatactg

SEQ ID NO: 36414 - DNA, 20 bp, Artificial Sequence
  Synthetic oligonucleotide; TAG chr11 5334199 5334218 5334202 -
acctcacaaattaaccctgt

SEQ ID NO: 36415 - DNA, 20 bp, Artificial Sequence
  Synthetic oligonucleotide; CAG chr11 5334196 5334215 5334199 -
tcacaaattaaccctgttag

SEQ ID NO: 36416 - DNA, 20 bp, Artificial Sequence
  Synthetic oligonucleotide; CAG chr11 5334189 5334208 5334192 -
ttaaccctgttagcagtctt

SEQ ID NO: 36417 - DNA, 20 bp, Artificial Sequence
  Synthetic oligonucleotide; GAG chr11 5334187 5334206 5334190 -
aaccctgttagcagtcttca

SEQ ID NO: 36418 - DNA, 20 bp, Artificial Sequence
  Synthetic oligonucleotide; CAG chr11 5334159 5334178 5334162 -
atttaaaccaatttctacac

SEQ ID NO: 36419 - DNA, 20 bp, Artificial Sequence
  Synthetic oligonucleotide; AGG chr11 5334158 5334177 5334161 -
tttaaaccaatttctacacc

SEQ ID NO: 36420 - DNA, 20 bp, Artificial Sequence
  Synthetic oligonucleotide; CAG chr11 5334152 5334171 5334155 -
ccaatttctacaccaggact

SEQ ID NO: 36421 - DNA, 20 bp, Artificial Sequence
  Synthetic oligonucleotide; CAG chr11 5334118 5334137 5334121 -
ccccttaatttctgataccc

SEQ ID NO: 36422 - DNA, 20 bp, Artificial Sequence
  Synthetic oligonucleotide; AGG chr11 5334117 5334136 5334120 -
cccttaatttctgatacccc

SEQ ID NO: 36423 - DNA, 20 bp, Artificial Sequence
  Synthetic oligonucleotide; CAG chr11 5334113 5334132 5334116 -
taatttctgataccccaggt

SEQ ID NO: 36424 - DNA, 20 bp, Artificial Sequence
  Synthetic oligonucleotide; AGG chr11 5334112 5334131 5334115 -
aatttctgataccccaggtc

SEQ ID NO: 36425 - DNA, 20 bp, Artificial Sequence
  Synthetic oligonucleotide; TAG chr11 5334106 5334125 5334109 -
tgataccccaggtcaggctc

SEQ ID NO: 36426 - DNA, 20 bp, Artificial Sequence
  Synthetic oligonucleotide; TGG chr11 5334097 5334116 5334100 -
aggtcaggctctagtgacta

SEQ ID NO: 36427 - DNA, 20 bp, Artificial Sequence
  Synthetic oligonucleotide; GGG chr11 5334096 5334115 5334099 -
ggtcaggctctagtgactat

SEQ ID NO: 36428 - DNA, 20 bp, Artificial Sequence
  Synthetic oligonucleotide; GAG chr11 5334094 5334113 5334097 -
tcaggctctagtgactatgg

SEQ ID NO: 36429 - DNA, 20 bp, Artificial Sequence
  Synthetic oligonucleotide; TGG chr11 5334089 5334108 5334092 -
ctctagtgactatgggagaa

SEQ ID NO: 36430 - DNA, 20 bp, Artificial Sequence
  Synthetic oligonucleotide; AAG chr11 5334082 5334101 5334085 -
gactatgggagaatggaatg

SEQ ID NO: 36431 - DNA, 20 bp, Artificial Sequence
  Synthetic oligonucleotide; AGG chr11 5334081 5334100 5334084 -
actatgggagaatggaatga

SEQ ID NO: 36432 - DNA, 20 bp, Artificial Sequence
  Synthetic oligonucleotide; GAG chr11 5334073 5334092 5334076 -
agaatggaatgaaggtaatt

SEQ ID NO: 36433 - DNA, 20 bp, Artificial Sequence
  Synthetic oligonucleotide; GAG chr11 5334071 5334090 5334074 -
aatggaatgaaggtaattga

SEQ ID NO: 36434 - DNA, 20 bp, Artificial Sequence
  Synthetic oligonucleotide; AGG chr11 5334070 5334089 5334073 -
atggaatgaaggtaattgag

SEQ ID NO: 36435 - DNA, 20 bp, Artificial Sequence
  Synthetic oligonucleotide; AAG chr11 5334061 5334080 5334064 -
aggtaattgagaggaaaata

SEQ ID NO: 36436 - DNA, 20 bp, Artificial Sequence
  Synthetic oligonucleotide; TGG chr11 5334047 5334066 5334050 -
aaaataaagactaatcttct

SEQ ID NO: 36437 - DNA, 20 bp, Artificial Sequence
  Synthetic oligonucleotide; TAG chr11 5334028 5334047 5334031 -
ttggattctcttccaccaca

SEQ ID NO: 36438 - DNA, 20 bp, Artificial Sequence
  Synthetic oligonucleotide; AAG chr11 5334018 5334037 5334021 -
ttccaccacatagttgttgc

SEQ ID NO: 36439 - DNA, 20 bp, Artificial Sequence
  Synthetic oligonucleotide; GAG chr11 5334016 5334035 5334019 -
ccaccacatagttgttgcaa

SEQ ID NO: 36440 - DNA, 20 bp, Artificial Sequence
  Synthetic oligonucleotide; AGG chr11 5334015 5334034 5334018 -
caccacatagttgttgcaag

SEQ ID NO: 36441 - DNA, 20 bp, Artificial Sequence
  Synthetic oligonucleotide; GGG chr11 5334014 5334033 5334017 -
accacatagttgttgcaaga

SEQ ID NO: 36442 - DNA, 20 bp, Artificial Sequence
  Synthetic oligonucleotide; TAG chr11 5334007 5334026 5334010 -
agttgttgcaagagggtaaa

SEQ ID NO: 36443 - DNA, 20 bp, Artificial Sequence
  Synthetic oligonucleotide; GAG chr11 5334005 5334024 5334008 -
ttgttgcaagagggtaaata

SEQ ID NO: 36444 - DNA, 20 bp, Artificial Sequence
  Synthetic oligonucleotide; AAG chr11 5334000 5334019 5334003 -
gcaagagggtaaatagagaa

SEQ ID NO: 36445 - DNA, 20 bp, Artificial Sequence
  Synthetic oligonucleotide; GAG chr11 5333998 5334017 5334001 -
aagagggtaaatagagaaaa

SEQ ID NO: 36446 - DNA, 20 bp, Artificial Sequence
  Synthetic oligonucleotide; AGG chr11 5333997 5334016 5334000 -
agagggtaaatagagaaaag

SEQ ID NO: 36447 - DNA, 20 bp, Artificial Sequence
  Synthetic oligonucleotide; AAG chr11 5333993 5334012 5333996 -
ggtaaatagagaaaagaggc

SEQ ID NO: 36448 - DNA, 20 bp, Artificial Sequence
  Synthetic oligonucleotide; CAG chr11 5333977 5333996 5333980 -
aggcaagatatctgtatcta

SEQ ID NO: 36449 - DNA, 20 bp, Artificial Sequence
  Synthetic oligonucleotide; CGG chr11 5333967 5333986 5333970 -
tctgtatctacagattctgc

SEQ ID NO: 36450 - DNA, 20 bp, Artificial Sequence
  Synthetic oligonucleotide; GGG chr11 5333966 5333985 5333969 -
ctgtatctacagattctgcc

SEQ ID NO: 36451 - DNA, 20 bp, Artificial Sequence
  Synthetic oligonucleotide; AAG chr11 5333943 5333962 5333946 -
tgtatcaacctccaacataa

SEQ ID NO: 36452 - DNA, 20 bp, Artificial Sequence
  Synthetic oligonucleotide; TAG chr11 5333930 5333949 5333933 -
aacataaaagttcaacttcc

SEQ ID NO: 36453 - DNA, 20 bp, Artificial Sequence
  Synthetic oligonucleotide; CAG chr11 5333903 5333922 5333906 -
tgttaactctgaaataaaaa

SEQ ID NO: 36454 - DNA, 20 bp, Artificial Sequence
  Synthetic oligonucleotide; TAG chr11 5333900 5333919 5333903 -
taactctgaaataaaaacag

SEQ ID NO: 36455 - DNA, 20 bp, Artificial Sequence
  Synthetic oligonucleotide; TGG chr11 5333887 5333906 5333890 -
aaaacagtagttttatgtga

SEQ ID NO: 36456 - DNA, 20 bp, Artificial Sequence
  Synthetic oligonucleotide; GGG chr11 5333886 5333905 5333889 -
aaacagtagttttatgtgat

SEQ ID NO: 36457 - DNA, 20 bp, Artificial Sequence
  Synthetic oligonucleotide; AAG chr11 5333866 5333885 5333869 -
gggtgcttacatgaataatt

SEQ ID NO: 36458 - DNA, 20 bp, Artificial Sequence
  Synthetic oligonucleotide; GAG chr11 5333864 5333883 5333867 -
gtgcttacatgaataattaa

SEQ ID NO: 36459 - DNA, 20 bp, Artificial Sequence
  Synthetic oligonucleotide; GAG chr11 5333857 5333876 5333860 -
catgaataattaagagttct

SEQ ID NO: 36460 - DNA, 20 bp, Artificial Sequence
  Synthetic oligonucleotide; TAG chr11 5333846 5333865 5333849 -
aagagttctgagttgatatc

SEQ ID NO: 36461 - DNA, 20 bp, Artificial Sequence
  Synthetic oligonucleotide; AAG chr11 5333843 5333862 5333846 -
agttctgagttgatatctag

SEQ ID NO: 36462 - DNA, 20 bp, Artificial Sequence
  Synthetic oligonucleotide; TAG chr11 5333833 5333852 5333836 -
tgatatctagaagttcttgt

SEQ ID NO: 36463 - DNA, 20 bp, Artificial Sequence
  Synthetic oligonucleotide; CAG chr11 5333828 5333847 5333831 -
tctagaagttcttgttagct

SEQ ID NO: 36464 - DNA, 20 bp, Artificial Sequence
  Synthetic oligonucleotide; AAG chr11 5333818 5333837 5333821 -
cttgttagctcagcgctatt

SEQ ID NO: 36465 - DNA, 20 bp, Artificial Sequence
  Synthetic oligonucleotide; TAG chr11 5333799 5333818 5333802 -
taagaacacttttcctacaa

SEQ ID NO: 36466 - DNA, 20 bp, Artificial Sequence
  Synthetic oligonucleotide; TGG chr11 5333786 5333805 5333789 -
cctacaatagaaattttctt

SEQ ID NO: 36467 - DNA, 20 bp, Artificial Sequence
  Synthetic oligonucleotide; AAG chr11 5333783 5333802 5333786 -
acaatagaaattttctttgg

SEQ ID NO: 36468 - DNA, 20 bp, Artificial Sequence
  Synthetic oligonucleotide; GAG chr11 5333781 5333800 5333784 -
aatagaaattttctttggaa

SEQ ID NO: 36469 - DNA, 20 bp, Artificial Sequence
  Synthetic oligonucleotide; AGG chr11 5333780 5333799 5333783 -
atagaaattttctttggaag

SEQ ID NO: 36470 - DNA, 20 bp, Artificial Sequence
  Synthetic oligonucleotide; CAG chr11 5333777 5333796 5333780 -
gaaattttctttggaagagg

SEQ ID NO: 36471 - DNA, 20 bp, Artificial Sequence
  Synthetic oligonucleotide; AGG chr11 5333776 5333795 5333779 -
aaattttctttggaagaggc

SEQ ID NO: 36472 - DNA, 20 bp, Artificial Sequence
  Synthetic oligonucleotide; GAG chr11 5333774 5333793 5333777 -
attttctttggaagaggcag

SEQ ID NO: 36473 - DNA, 20 bp, Artificial Sequence
  Synthetic oligonucleotide; GAG chr11 5333772 5333791 5333775 -
tttctttggaagaggcagga

SEQ ID NO: 36474 - DNA, 20 bp, Artificial Sequence
  Synthetic oligonucleotide; AGG chr11 5333771 5333790 5333774 -
ttctttggaagaggcaggag

SEQ ID NO: 36475 - DNA, 20 bp, Artificial Sequence
  Synthetic oligonucleotide; AAG chr11 5333767 5333786 5333770 -
ttggaagaggcaggagagga

SEQ ID NO: 36476 - DNA, 20 bp, Artificial Sequence
  Synthetic oligonucleotide; GAG chr11 5333765 5333784 5333768 -
ggaagaggcaggagaggaaa

SEQ ID NO: 36477 - DNA, 20 bp, Artificial Sequence
  Synthetic oligonucleotide; TGG chr11 5333754 5333773 5333757 -
gagaggaaagagactgactc

SEQ ID NO: 36478 - DNA, 20 bp, Artificial Sequence
  Synthetic oligonucleotide; GGG chr11 5333753 5333772 5333756 -
agaggaaagagactgactct

SEQ ID NO: 36479 - DNA, 20 bp, Artificial Sequence
  Synthetic oligonucleotide; GAG chr11 5333751 5333770 5333754 -
aggaaagagactgactctgg

SEQ ID NO: 36480 - DNA, 20 bp, Artificial Sequence
  Synthetic oligonucleotide; CAG chr11 5333740 5333759 5333743 -
tgactctgggagtgaatgtg

SEQ ID NO: 36481 - DNA, 20 bp, Artificial Sequence
  Synthetic oligonucleotide; AGG chr11 5333739 5333758 5333742 -
gactctgggagtgaatgtgc

SEQ ID NO: 36482 - DNA, 20 bp, Artificial Sequence
  Synthetic oligonucleotide; GGG chr11 5333738 5333757 5333741 -
actctgggagtgaatgtgca

SEQ ID NO: 36483 - DNA, 20 bp, Artificial Sequence
  Synthetic oligonucleotide; TGG chr11 5333735 5333754 5333738 -
ctgggagtgaatgtgcaggg

SEQ ID NO: 36484 - DNA, 20 bp, Artificial Sequence
  Synthetic oligonucleotide; GGG chr11 5333734 5333753 5333737 -
tgggagtgaatgtgcagggt

SEQ ID NO: 36485 - DNA, 20 bp, Artificial Sequence
  Synthetic oligonucleotide; GGG chr11 5333733 5333752 5333736 -
gggagtgaatgtgcagggtg

SEQ ID NO: 36486 - DNA, 20 bp, Artificial Sequence
  Synthetic oligonucleotide; TAG chr11 5333715 5333734 5333718 -
tggggtcaccatgacacctg

SEQ ID NO: 36487 - DNA, 20 bp, Artificial Sequence
  Synthetic oligonucleotide; AGG chr11 5333714 5333733 5333717 -
ggggtcaccatgacacctgt

SEQ ID NO: 36488 - DNA, 20 bp, Artificial Sequence
  Synthetic oligonucleotide; CAG chr11 5333679 5333698 5333682 -
ctctcctcctcctcttgatg

SEQ ID NO: 36489 - DNA, 20 bp, Artificial Sequence
  Synthetic oligonucleotide; TAG chr11 5333671 5333690 5333674 -
ctcctcttgatgcagttctc

SEQ ID NO: 36490 - DNA, 20 bp, Artificial Sequence
  Synthetic oligonucleotide; AGG chr11 5333670 5333689 5333673 -
tcctcttgatgcagttctct

SEQ ID NO: 36491 - DNA, 20 bp, Artificial Sequence
  Synthetic oligonucleotide; CAG chr11 5333665 5333684 5333668 -
ttgatgcagttctctaggct

SEQ ID NO: 36492 - DNA, 20 bp, Artificial Sequence
  Synthetic oligonucleotide; TAG chr11 5333604 5333623 5333607 -
cttcttcctcctctactttg

SEQ ID NO: 36493 - DNA, 20 bp, Artificial Sequence
  Synthetic oligonucleotide; CAG chr11 5333589 5333608 5333592 -
ctttgtagctcccacatttt

SEQ ID NO: 36494 - DNA, 20 bp, Artificial Sequence
  Synthetic oligonucleotide; TAG chr11 5333577 5333596 5333580 -
cacattttcagcttatatat

SEQ ID NO: 36495 - DNA, 20 bp, Artificial Sequence
  Synthetic oligonucleotide; TAG chr11 5333569 5333588 5333572 -
cagcttatatattagccaat

SEQ ID NO: 36496 - DNA, 20 bp, Artificial Sequence
  Synthetic oligonucleotide; TAG chr11 5333561 5333580 5333564 -
atattagccaattagtatat

SEQ ID NO: 36497 - DNA, 20 bp, Artificial Sequence
  Synthetic oligonucleotide; AAG chr11 5333548 5333567 5333551 -
agtatattagtaatattttg

SEQ ID NO: 36498 - DNA, 20 bp, Artificial Sequence
  Synthetic oligonucleotide; AAG chr11 5333530 5333549 5333533 -
tgaagtcactgttcttacct

SEQ ID NO: 36499 - DNA, 20 bp, Artificial Sequence
  Synthetic oligonucleotide; CAG chr11 5333526 5333545 5333529 -
gtcactgttcttacctaagt

SEQ ID NO: 36500 - DNA, 20 bp, Artificial Sequence
  Synthetic oligonucleotide; CAG chr11 5333514 5333533 5333517 -
acctaagtcagtttaacaat

SEQ ID NO: 36501 - DNA, 20 bp, Artificial Sequence
  Synthetic oligonucleotide; CAG chr11 5333506 5333525 5333509 -
cagtttaacaatcagcatac

SEQ ID NO: 36502 - DNA, 20 bp, Artificial Sequence
  Synthetic oligonucleotide; CAG chr11 5333502 5333521 5333505 -
ttaacaatcagcataccagt

SEQ ID NO: 36503 - DNA, 20 bp, Artificial Sequence
  Synthetic oligonucleotide; TAG chr11 5333498 5333517 5333501 -
caatcagcataccagtcagt

SEQ ID NO: 36504 - DNA, 20 bp, Artificial Sequence
  Synthetic oligonucleotide; AAG chr11 5333475 5333494 5333478 -
tgatcaatgtgttaatcata

SEQ ID NO: 36505 - DNA, 20 bp, Artificial Sequence
  Synthetic oligonucleotide; CAG chr11 5333415 5333434 5333418 -
tcaaactctgtcattgcttc

SEQ ID NO: 36506 - DNA, 20 bp, Artificial Sequence
  Synthetic oligonucleotide; AGG chr11 5333414 5333433 5333417 -
caaactctgtcattgcttcc

SEQ ID NO: 36507 - DNA, 20 bp, Artificial Sequence
  Synthetic oligonucleotide; GGG chr11 5333413 5333432 5333416 -
aaactctgtcattgcttcca

SEQ ID NO: 36508 - DNA, 20 bp, Artificial Sequence
  Synthetic oligonucleotide; TGG chr11 5333406 5333425 5333409 -
gtcattgcttccagggccat

SEQ ID NO: 36509 - DNA, 20 bp, Artificial Sequence
  Synthetic oligonucleotide; TAG chr11 5333386 5333405 5333389 -
tggtgtgttaatacaacact

SEQ ID NO: 36510 - DNA, 20 bp, Artificial Sequence
  Synthetic oligonucleotide; AAG chr11 5333381 5333400 5333384 -
tgttaatacaacacttagta

SEQ ID NO: 36511 - DNA, 20 bp, Artificial Sequence
  Synthetic oligonucleotide; AAG chr11 5333377 5333396 5333380 -
aatacaacacttagtaaagt

SEQ ID NO: 36512 - DNA, 20 bp, Artificial Sequence
  Synthetic oligonucleotide; TAG chr11 5333368 5333387 5333371 -
cttagtaaagtaagcaatgt

SEQ ID NO: 36513 - DNA, 20 bp, Artificial Sequence
  Synthetic oligonucleotide; TGG chr11 5333362 5333381 5333365 -
aaagtaagcaatgttagtgt

SEQ ID NO: 36514 - DNA, 20 bp, Artificial Sequence
  Synthetic oligonucleotide; GAG chr11 5333360 5333379 5333363 -
agtaagcaatgttagtgttg

SEQ ID NO: 36515 - DNA, 20 bp, Artificial Sequence
  Synthetic oligonucleotide; TGG chr11 5333357 5333376 5333360 -
aagcaatgttagtgttggag

SEQ ID NO: 36516 - DNA, 20 bp, Artificial Sequence
  Synthetic oligonucleotide; GGG chr11 5333356 5333375 5333359 -
agcaatgttagtgttggagt

SEQ ID NO: 36517 - DNA, 20 bp, Artificial Sequence
  Synthetic oligonucleotide; GAG chr11 5333354 5333373 5333357 -
caatgttagtgttggagtgg

SEQ ID NO: 36518 - DNA, 20 bp, Artificial Sequence
  Synthetic oligonucleotide; TAG chr11 5333351 5333370 5333354 -
tgttagtgttggagtgggag

SEQ ID NO: 36519 - DNA, 20 bp, Artificial Sequence
  Synthetic oligonucleotide; GAG chr11 5333327 5333346 5333330 -
accgtgttttttactacaat

SEQ ID NO: 36520 - DNA, 20 bp, Artificial Sequence
  Synthetic oligonucleotide; TAG chr11 5333323 5333342 5333326 -
tgttttttactacaatgagt

SEQ ID NO: 36521 - DNA, 20 bp, Artificial Sequence
  Synthetic oligonucleotide; GAG chr11 5333321 5333340 5333324 -
ttttttactacaatgagtta

SEQ ID NO: 36522 - DNA, 20 bp, Artificial Sequence
  Synthetic oligonucleotide; TAG chr11 5333314 5333333 5333317 -
ctacaatgagttagagccac

SEQ ID NO: 36523 - DNA, 20 bp, Artificial Sequence
  Synthetic oligonucleotide; AGG chr11 5333313 5333332 5333316 -
tacaatgagttagagccact

SEQ ID NO: 36524 - DNA, 20 bp, Artificial Sequence
  Synthetic oligonucleotide; GAG chr11 5333307 5333326 5333310 -
gagttagagccactaggtct

SEQ ID NO: 36525 - DNA, 20 bp, Artificial Sequence
  Synthetic oligonucleotide; GAG chr11 5333305 5333324 5333308 -
gttagagccactaggtctga

SEQ ID NO: 36526 - DNA, 20 bp, Artificial Sequence
  Synthetic oligonucleotide; TAG chr11 5333300 5333319 5333303 -
agccactaggtctgagagac

SEQ ID NO: 36527 - DNA, 20 bp, Artificial Sequence
  Synthetic oligonucleotide; AAG chr11 5333294 5333313 5333297 -
taggtctgagagactagtaa

SEQ ID NO: 36528 - DNA, 20 bp, Artificial Sequence
  Synthetic oligonucleotide; CAG chr11 5333283 5333302 5333286 -
gactagtaaaagaatgtaaa

SEQ ID NO: 36529 - DNA, 20 bp, Artificial Sequence
  Synthetic oligonucleotide; AAG chr11 5333265 5333284 5333268 -
aacagtaaaaattttgtgct

SEQ ID NO: 36530 - DNA, 20 bp, Artificial Sequence
  Synthetic oligonucleotide; AAG chr11 5333252 5333271 5333255 -
ttgtgctaagttttatgcta

SEQ ID NO: 36531 - DNA, 20 bp, Artificial Sequence
  Synthetic oligonucleotide; TGG chr11 5333247 5333266 5333250 -
ctaagttttatgctaaagtc

SEQ ID NO: 36532 - DNA, 20 bp, Artificial Sequence
  Synthetic oligonucleotide; GGG chr11 5333246 5333265 5333249 -
taagttttatgctaaagtct

SEQ ID NO: 36533 - DNA, 20 bp, Artificial Sequence
  Synthetic oligonucleotide; AAG chr11 5333235 5333254 5333238 -
ctaaagtctgggtgatgcaa

SEQ ID NO: 36534 - DNA, 20 bp, Artificial Sequence
  Synthetic oligonucleotide; GAG chr11 5333233 5333252 5333236 -
aaagtctgggtgatgcaaaa

SEQ ID NO: 36535 - DNA, 20 bp, Artificial Sequence
  Synthetic oligonucleotide; TGG chr11 5333225 5333244 5333228 -
ggtgatgcaaaagagacatc

SEQ ID NO: 36536 - DNA, 20 bp, Artificial Sequence
  Synthetic oligonucleotide; GGG chr11 5333224 5333243 5333227 -
gtgatgcaaaagagacatct

SEQ ID NO: 36537 - DNA, 20 bp, Artificial Sequence
  Synthetic oligonucleotide; GGG chr11 5333223 5333242 5333226 -
tgatgcaaaagagacatctg

SEQ ID NO: 36538 - DNA, 20 bp, Artificial Sequence
  Synthetic oligonucleotide; TAG chr11 5333218 5333237 5333221 -
caaaagagacatctggggtt

SEQ ID NO: 36539 - DNA, 20 bp, Artificial Sequence
  Synthetic oligonucleotide; TAG chr11 5333214 5333233 5333217 -
agagacatctggggtttagt

SEQ ID NO: 36540 - DNA, 20 bp, Artificial Sequence
  Synthetic oligonucleotide; GAG chr11 5333212 5333231 5333215 -
agacatctggggtttagtta

SEQ ID NO: 36541 - DNA, 20 bp, Artificial Sequence
  Synthetic oligonucleotide; GAG chr11 5333210 5333229 5333213 -
acatctggggtttagttaga

SEQ ID NO: 36542 - DNA, 20 bp, Artificial Sequence
  Synthetic oligonucleotide; AGG chr11 5333209 5333228 5333212 -
catctggggtttagttagag

SEQ ID NO: 36543 - DNA, 20 bp, Artificial Sequence
  Synthetic oligonucleotide; GGG chr11 5333208 5333227 5333211 -
atctggggtttagttagaga

SEQ ID NO: 36544 - DNA, 20 bp, Artificial Sequence
  Synthetic oligonucleotide; AAG chr11 5333199 5333218 5333202 -
ttagttagagagggcaaaat

SEQ ID NO: 36545 - DNA, 20 bp, Artificial Sequence
  Synthetic oligonucleotide; GAG chr11 5333197 5333216 5333200 -
agttagagagggcaaaataa

SEQ ID NO: 36546 - DNA, 20 bp, Artificial Sequence
  Synthetic oligonucleotide; TAG chr11 5333188 5333207 5333191 -
gggcaaaataagagacaata

SEQ ID NO: 36547 - DNA, 20 bp, Artificial Sequence
  Synthetic oligonucleotide; TAG chr11 5333182 5333201 5333185 -
aataagagacaatatagaaa

SEQ ID NO: 36548 - DNA, 20 bp, Artificial Sequence
  Synthetic oligonucleotide; AAG chr11 5333170 5333189 5333173 -
tatagaaatagatacaacaa

SEQ ID NO: 36549 - DNA, 20 bp, Artificial Sequence
  Synthetic oligonucleotide; AGG chr11 5333169 5333188 5333172 -
atagaaatagatacaacaaa

SEQ ID NO: 36550 - DNA, 20 bp, Artificial Sequence
  Synthetic oligonucleotide; GGG chr11 5333168 5333187 5333171 -
tagaaatagatacaacaaaa

SEQ ID NO: 36551 - DNA, 20 bp, Artificial Sequence
  Synthetic oligonucleotide; TGG chr11 5333162 5333181 5333165 -
tagatacaacaaaagggtga

SEQ ID NO: 36552 - DNA, 20 bp, Artificial Sequence
  Synthetic oligonucleotide; TAG chr11 5333156 5333175 5333159 -
caacaaaagggtgatggata

SEQ ID NO: 36553 - DNA, 20 bp, Artificial Sequence
  Synthetic oligonucleotide; AGG chr11 5333155 5333174 5333158 -
aacaaaagggtgatggatat

SEQ ID NO: 36554 - DNA, 20 bp, Artificial Sequence
  Synthetic oligonucleotide; AAG chr11 5333152 5333171 5333155 -
aaaagggtgatggatatagg

SEQ ID NO: 36555 - DNA, 20 bp, Artificial Sequence
  Synthetic oligonucleotide; CAG chr11 5333142 5333161 5333145 -
tggatataggaagaacgaca

SEQ ID NO: 36556 - DNA, 20 bp, Artificial Sequence
  Synthetic oligonucleotide; AGG chr11 5333141 5333160 5333144 -
ggatataggaagaacgacac

SEQ ID NO: 36557 - DNA, 20 bp, Artificial Sequence
  Synthetic oligonucleotide; TAG chr11 5333131 5333150 5333134 -
agaacgacacaggaaaacaa

SEQ ID NO: 36558 - DNA, 20 bp, Artificial Sequence
  Synthetic oligonucleotide; AGG chr11 5333130 5333149 5333133 -
gaacgacacaggaaaacaat

SEQ ID NO: 36559 - DNA, 20 bp, Artificial Sequence
  Synthetic oligonucleotide; TAG chr11 5333126 5333145 5333129 -
gacacaggaaaacaatagga

SEQ ID NO: 36560 - DNA, 20 bp, Artificial Sequence
  Synthetic oligonucleotide; AGG chr11 5333125 5333144 5333128 -
acacaggaaaacaataggat

SEQ ID NO: 36561 - DNA, 20 bp, Artificial Sequence
  Synthetic oligonucleotide; GGG chr11 5333124 5333143 5333127 -
cacaggaaaacaataggata

SEQ ID NO: 36562 - DNA, 20 bp, Artificial Sequence
  Synthetic oligonucleotide; CAG chr11 5333113 5333132 5333116 -
aataggatagggatgacgta

SEQ ID NO: 36563 - DNA, 20 bp, Artificial Sequence
  Synthetic oligonucleotide; GAG chr11 5333093 5333112 5333096 -
cagctgcaccctatgtacct

SEQ ID NO: 36564 - DNA, 20 bp, Artificial Sequence
  Synthetic oligonucleotide; CAG chr11 5333090 5333109 5333093 -
ctgcaccctatgtacctgag

SEQ ID NO: 36565 - DNA, 20 bp, Artificial Sequence
  Synthetic oligonucleotide; TGG chr11 5333086 5333105 5333089 -
accctatgtacctgagcaga

SEQ ID NO: 36566 - DNA, 20 bp, Artificial Sequence
  Synthetic oligonucleotide; CAG chr11 5333081 5333100 5333084 -
atgtacctgagcagatggtg

SEQ ID NO: 36567 - DNA, 20 bp, Artificial Sequence
  Synthetic oligonucleotide; CAG chr11 5333071 5333090 5333074 -
gcagatggtgcagaaatgat

SEQ ID NO: 36568 - DNA, 20 bp, Artificial Sequence
  Synthetic oligonucleotide; CAG chr11 5333061 5333080 5333064 -
cagaaatgatcagtgctgcc

SEQ ID NO: 36569 - DNA, 20 bp, Artificial Sequence
  Synthetic oligonucleotide; AAG chr11 5333056 5333075 5333059 -
atgatcagtgctgcccagcc

SEQ ID NO: 36570 - DNA, 20 bp, Artificial Sequence
  Synthetic oligonucleotide; CAG chr11 5333051 5333070 5333054 -
cagtgctgcccagccaagcc

SEQ ID NO: 36571 - DNA, 20 bp, Artificial Sequence
  Synthetic oligonucleotide; AAG chr11 5333041 5333060 5333044 -
cagccaagcccagcctaaat

SEQ ID NO: 36572 - DNA, 20 bp, Artificial Sequence
  Synthetic oligonucleotide; TAG chr11 5333025 5333044 5333028 -
aaataagttgaaccatgcat

SEQ ID NO: 36573 - DNA, 20 bp, Artificial Sequence
  Synthetic oligonucleotide; GAG chr11 5333023 5333042 5333026 -
ataagttgaaccatgcatta

SEQ ID NO: 36574 - DNA, 20 bp, Artificial Sequence
  Synthetic oligonucleotide; CAG chr11 5332996 5333015 5332999 -
aaataaatgtttaatgttgt

SEQ ID NO: 36575 - DNA, 20 bp, Artificial Sequence
  Synthetic oligonucleotide; CAG chr11 5332979 5332998 5332982 -
tgtcagccactgatgctata

SEQ ID NO: 36576 - DNA, 20 bp, Artificial Sequence
  Synthetic oligonucleotide; AGG chr11 5332978 5332997 5332981 -
gtcagccactgatgctatac

SEQ ID NO: 36577 - DNA, 20 bp, Artificial Sequence
  Synthetic oligonucleotide; GGG chr11 5332977 5332996 5332980 -
tcagccactgatgctataca

SEQ ID NO: 36578 - DNA, 20 bp, Artificial Sequence
  Synthetic oligonucleotide; TAG chr11 5332947 5332966 5332950 -
atgtgacaattctgtgataa

SEQ ID NO: 36579 - DNA, 20 bp, Artificial Sequence
  Synthetic oligonucleotide; TAG chr11 5332906 5332925 5332909 -
tacataaaccctgtaaatat

SEQ ID NO: 36580 - DNA, 20 bp, Artificial Sequence
  Synthetic oligonucleotide; TAG chr11 5332896 5332915 5332899 -
ctgtaaatattagtttatta

SEQ ID NO: 36581 - DNA, 20 bp, Artificial Sequence
  Synthetic oligonucleotide; TGG chr11 5332868 5332887 5332871 -
tataaactcttaataaaata

SEQ ID NO: 36582 - DNA, 20 bp, Artificial Sequence
  Synthetic oligonucleotide; TAG chr11 5332861 5332880 5332864 -
tcttaataaaatatggataa

SEQ ID NO: 36583 - DNA, 20 bp, Artificial Sequence
  Synthetic oligonucleotide; TAG chr11 5332845 5332864 5332848 -
ataatagtaatactttgcat

SEQ ID NO: 36584 - DNA, 20 bp, Artificial Sequence
  Synthetic oligonucleotide; GAG chr11 5332809 5332828 5332812 -
tacataaattactgcaactt

SEQ ID NO: 36585 - DNA, 20 bp, Artificial Sequence
  Synthetic oligonucleotide; TAG chr11 5332790 5332809 5332793 -
tgagctgcttcaaacattat

SEQ ID NO: 36586 - DNA, 20 bp, Artificial Sequence
  Synthetic oligonucleotide; TAG chr11 5332767 5332786 5332770 -
tttattatatcacatttcta

SEQ ID NO: 36587 - DNA, 20 bp, Artificial Sequence
  Synthetic oligonucleotide; AGG chr11 5332766 5332785 5332769 -
ttattatatcacatttctat

SEQ ID NO: 36588 - DNA, 20 bp, Artificial Sequence
  Synthetic oligonucleotide; TAG chr11 5332751 5332770 5332754 -
tctataggtctgcactctca

SEQ ID NO: 36589 - DNA, 20 bp, Artificial Sequence
  Synthetic oligonucleotide; AGG chr11 5332750 5332769 5332753 -
ctataggtctgcactctcat

SEQ ID NO: 36590 - DNA, 20 bp, Artificial Sequence
  Synthetic oligonucleotide; GAG chr11 5332740 5332759 5332743 -
gcactctcataggcttaact

SEQ ID NO: 36591 - DNA, 20 bp, Artificial Sequence
  Synthetic oligonucleotide; TAG chr11 5332728 5332747 5332731 -
gcttaactgagttctctgct

SEQ ID NO: 36592 - DNA, 20 bp, Artificial Sequence
  Synthetic oligonucleotide; AGG chr11 5332727 5332746 5332730 -
cttaactgagttctctgctt

SEQ ID NO: 36593 - DNA, 20 bp, Artificial Sequence
  Synthetic oligonucleotide; GGG chr11 5332726 5332745 5332729 -
ttaactgagttctctgctta

SEQ ID NO: 36594 - DNA, 20 bp, Artificial Sequence
  Synthetic oligonucleotide; AAG chr11 5332717 5332736 5332720 -
ttctctgcttagggtatcat

SEQ ID NO: 36595 - DNA, 20 bp, Artificial Sequence
  Synthetic oligonucleotide; AGG chr11 5332716 5332735 5332719 -
tctctgcttagggtatcata

SEQ ID NO: 36596 - DNA, 20 bp, Artificial Sequence
  Synthetic oligonucleotide; CGG chr11 5332698 5332717 5332701 -
taaggtcaaattcaaaatat

SEQ ID NO: 36597 - DNA, 20 bp, Artificial Sequence
  Synthetic oligonucleotide; GGG chr11 5332697 5332716 5332700 -
aaggtcaaattcaaaatatc

SEQ ID NO: 36598 - DNA, 20 bp, Artificial Sequence
  Synthetic oligonucleotide; GAG chr11 5332695 5332714 5332698 -
ggtcaaattcaaaatatcgg

SEQ ID NO: 36599 - DNA, 20 bp, Artificial Sequence
  Synthetic oligonucleotide; AGG chr11 5332694 5332713 5332697 -
gtcaaattcaaaatatcggg

SEQ ID NO: 36600 - DNA, 20 bp, Artificial Sequence
  Synthetic oligonucleotide; GGG chr11 5332693 5332712 5332696 -
tcaaattcaaaatatcggga

SEQ ID NO: 36601 - DNA, 20 bp, Artificial Sequence
  Synthetic oligonucleotide; TGG chr11 5332689 5332708 5332692 -
attcaaaatatcgggagggc

SEQ ID NO: 36602 - DNA, 20 bp, Artificial Sequence
  Synthetic oligonucleotide; GGG chr11 5332688 5332707 5332691 -
ttcaaaatatcgggagggct

SEQ ID NO: 36603 - DNA, 20 bp, Artificial Sequence
  Synthetic oligonucleotide; AAG chr11 5332675 5332694 5332678 -
gagggctgggctcttatcca

SEQ ID NO: 36604 - DNA, 20 bp, Artificial Sequence
  Synthetic oligonucleotide; AGG chr11 5332674 5332693 5332677 -
agggctgggctcttatccaa

SEQ ID NO: 36605 - DNA, 20 bp, Artificial Sequence
  Synthetic oligonucleotide; TGG chr11 5332668 5332687 5332671 -
gggctcttatccaaaggctc

SEQ ID NO: 36606 - DNA, 20 bp, Artificial Sequence
  Synthetic oligonucleotide; GGG chr11 5332667 5332686 5332670 -
ggctcttatccaaaggctct

SEQ ID NO: 36607 - DNA, 20 bp, Artificial Sequence
  Synthetic oligonucleotide; GGG chr11 5332666 5332685 5332669 -
gctcttatccaaaggctctg

SEQ ID NO: 36608 - DNA, 20 bp, Artificial Sequence
  Synthetic oligonucleotide; AAG chr11 5332663 5332682 5332666 -
cttatccaaaggctctgggg

SEQ ID NO: 36609 - DNA, 20 bp, Artificial Sequence
  Synthetic oligonucleotide; CAG chr11 5332640 5332659 5332643 -
aattcgcttccacgttcatt

SEQ ID NO: 36610 - DNA, 20 bp, Artificial Sequence
  Synthetic oligonucleotide; TAG chr11 5332633 5332652 5332636 -
ttccacgttcattcagattg

SEQ ID NO: 36611 - DNA, 20 bp, Artificial Sequence
  Synthetic oligonucleotide; CAG chr11 5332629 5332648 5332632 -
acgttcattcagattgtagt

SEQ ID NO: 36612 - DNA, 20 bp, Artificial Sequence
  Synthetic oligonucleotide; GAG chr11 5332627 5332646 5332630 -
gttcattcagattgtagtca

SEQ ID NO: 36613 - DNA, 20 bp, Artificial Sequence
  Synthetic oligonucleotide; CAG chr11 5332622 5332641 5332625 -
ttcagattgtagtcagagct

SEQ ID NO: 36614 - DNA, 20 bp, Artificial Sequence
  Synthetic oligonucleotide; GAG chr11 5332585 5332604 5332588 -
tttttttttttttttttttt

SEQ ID NO: 36615 - DNA, 20 bp, Artificial Sequence
  Synthetic oligonucleotide; TGG chr11 5332581 5332600 5332584 -
ttttttttttttttttgaga

SEQ ID NO: 36616 - DNA, 20 bp, Artificial Sequence
  Synthetic oligonucleotide; GAG chr11 5332579 5332598 5332582 -
ttttttttttttttgagatg

SEQ ID NO: 36617 - DNA, 20 bp, Artificial Sequence
  Synthetic oligonucleotide; CAG chr11 5332561 5332580 5332564 -
tggagtctcgctctgtcacc

SEQ ID NO: 36618 - DNA, 20 bp, Artificial Sequence
  Synthetic oligonucleotide; TGG chr11 5332556 5332575 5332559 -
tctcgctctgtcacccagcc

SEQ ID NO: 36619 - DNA, 20 bp, Artificial Sequence
  Synthetic oligonucleotide; GAG chr11 5332554 5332573 5332557 -
tcgctctgtcacccagcctg

SEQ ID NO: 36620 - DNA, 20 bp, Artificial Sequence
  Synthetic oligonucleotide; CAG chr11 5332549 5332568 5332552 -
ctgtcacccagcctggagtg

SEQ ID NO: 36621 - DNA, 20 bp, Artificial Sequence
  Synthetic oligonucleotide; TGG chr11 5332546 5332565 5332549 -
tcacccagcctggagtgcag

SEQ ID NO: 36622 - DNA, 20 bp, Artificial Sequence
  Synthetic oligonucleotide; CGG chr11 5332510 5332529 5332513 -
tccctgcaacctgtgcctcc

SEQ ID NO: 36623 - DNA, 20 bp, Artificial Sequence
  Synthetic oligonucleotide; GGG chr11 5332509 5332528 5332512 -
ccctgcaacctgtgcctccc

SEQ ID NO: 36624 - DNA, 20 bp, Artificial Sequence
  Synthetic oligonucleotide; AAG chr11 5332503 5332522 5332506 -
aacctgtgcctcccgggttc

SEQ ID NO: 36625 - DNA, 20 bp, Artificial Sequence
  Synthetic oligonucleotide; CAG chr11 5332486 5332505 5332489 -
ttcaagcaattctcctgcct

SEQ ID NO: 36626 - DNA, 20 bp, Artificial Sequence
  Synthetic oligonucleotide; AAG chr11 5332477 5332496 5332480 -
ttctcctgcctcagtttccc

SEQ ID NO: 36627 - DNA, 20 bp, Artificial Sequence
  Synthetic oligonucleotide; TAG chr11 5332474 5332493 5332477 -
tcctgcctcagtttcccaag

SEQ ID NO: 36628 - DNA, 20 bp, Artificial Sequence
  Synthetic oligonucleotide; TGG chr11 5332470 5332489 5332473 -
gcctcagtttcccaagtagc

SEQ ID NO: 36629 - DNA, 20 bp, Artificial Sequence
  Synthetic oligonucleotide; CAG chr11 5332462 5332481 5332465 -
ttcccaagtagctggaacta

SEQ ID NO: 36630 - DNA, 20 bp, Artificial Sequence
  Synthetic oligonucleotide; AGG chr11 5332461 5332480 5332464 -
tcccaagtagctggaactac

SEQ ID NO: 36631 - DNA, 20 bp, Artificial Sequence
  Synthetic oligonucleotide; TGG chr11 5332442 5332461 5332445 -
caggcaactgcaaccacacc

SEQ ID NO: 36632 - DNA, 20 bp, Artificial Sequence
  Synthetic oligonucleotide; TGG chr11 5332422 5332441 5332425 -
tggctaatttttatattttt

SEQ ID NO: 36633 - DNA, 20 bp, Artificial Sequence
  Synthetic oligonucleotide; TAG chr11 5332419 5332438 5332422 -
ctaatttttatattttttgg

SEQ ID NO: 36634 - DNA, 20 bp, Artificial Sequence
  Synthetic oligonucleotide; AGG chr11 5332418 5332437 5332421 -
taatttttatattttttggt

SEQ ID NO: 36635 - DNA, 20 bp, Artificial Sequence
  Synthetic oligonucleotide; GGG chr11 5332417 5332436 5332420 -
aatttttatattttttggta

SEQ ID NO: 36636 - DNA, 20 bp, Artificial Sequence
  Synthetic oligonucleotide; TGG chr11 5332413 5332432 5332416 -
tttatattttttggtaggga

SEQ ID NO: 36637 - DNA, 20 bp, Artificial Sequence
  Synthetic oligonucleotide; TGG chr11 5332397 5332416 5332400 -
gggatggaatttcaccatgt

SEQ ID NO: 36638 - DNA, 20 bp, Artificial Sequence
  Synthetic oligonucleotide; CAG chr11 5332393 5332412 5332396 -
tggaatttcaccatgttggc

SEQ ID NO: 36639 - DNA, 20 bp, Artificial Sequence
  Synthetic oligonucleotide; AGG chr11 5332392 5332411 5332395 -
ggaatttcaccatgttggcc

SEQ ID NO: 36640 - DNA, 20 bp, Artificial Sequence
  Synthetic oligonucleotide; TGG chr11 5332388 5332407 5332391 -
tttcaccatgttggccaggc

SEQ ID NO: 36641 - DNA, 20 bp, Artificial Sequence
  Synthetic oligonucleotide; TGG chr11 5332383 5332402 5332386 -
ccatgttggccaggctggtc

SEQ ID NO: 36642 - DNA, 20 bp, Artificial Sequence
  Synthetic oligonucleotide; CAG chr11 5332368 5332387 5332371 -
tggtctggaactcctgacct

SEQ ID NO: 36643 - DNA, 20 bp, Artificial Sequence
  Synthetic oligonucleotide; AGG chr11 5332367 5332386 5332370 -
ggtctggaactcctgacctc

SEQ ID NO: 36644 - DNA, 20 bp, Artificial Sequence
  Synthetic oligonucleotide; TGG chr11 5332350 5332369 5332353 -
ctcaggtgatccgcccgcct

SEQ ID NO: 36645 - DNA, 20 bp, Artificial Sequence
  Synthetic oligonucleotide; AAG chr11 5332340 5332359 5332343 -
ccgcccgccttggcctccca

SEQ ID NO: 36646 - DNA, 20 bp, Artificial Sequence
  Synthetic oligonucleotide; TGG chr11 5332334 5332353 5332337 -
gccttggcctcccaaagtgc

SEQ ID NO: 36647 - DNA, 20 bp, Artificial Sequence
  Synthetic oligonucleotide; GGG chr11 5332333 5332352 5332336 -
ccttggcctcccaaagtgct

SEQ ID NO: 36648 - DNA, 20 bp, Artificial Sequence
  Synthetic oligonucleotide; CAG chr11 5332326 5332345 5332329 -
ctcccaaagtgctgggatta

SEQ ID NO: 36649 - DNA, 20 bp, Artificial Sequence
  Synthetic oligonucleotide; AGG chr11 5332325 5332344 5332328 -
tcccaaagtgctgggattac

SEQ ID NO: 36650 - DNA, 20 bp, Artificial Sequence
  Synthetic oligonucleotide; GAG chr11 5332315 5332334 5332318 -
ctgggattacaggcttgaat

SEQ ID NO: 36651 - DNA, 20 bp, Artificial Sequence
  Synthetic oligonucleotide; CGG chr11 5332302 5332321 5332305 -
cttgaatgagccattgcacc

SEQ ID NO: 36652 - DNA, 20 bp, Artificial Sequence
  Synthetic oligonucleotide; CAG chr11 5332295 5332314 5332298 -
gagccattgcacccggctgt

SEQ ID NO: 36653 - DNA, 20 bp, Artificial Sequence
  Synthetic oligonucleotide; GAG chr11 5332293 5332312 5332296 -
gccattgcacccggctgtca

SEQ ID NO: 36654 - DNA, 20 bp, Artificial Sequence
  Synthetic oligonucleotide; CAG chr11 5332288 5332307 5332291 -
tgcacccggctgtcagagtt

SEQ ID NO: 36655 - DNA, 20 bp, Artificial Sequence
  Synthetic oligonucleotide; AAG chr11 5332265 5332284 5332268 -
tttcctactgctgaactctg

SEQ ID NO: 36656 - DNA, 20 bp, Artificial Sequence
  Synthetic oligonucleotide; CAG chr11 5332221 5332240 5332224 -
gttttttgtttgtttgtttg

SEQ ID NO: 36657 - DNA, 20 bp, Artificial Sequence
  Synthetic oligonucleotide; AGG chr11 5332220 5332239 5332223 -
ttttttgtttgtttgtttgc

SEQ ID NO: 36658 - DNA, 20 bp, Artificial Sequence
  Synthetic oligonucleotide; TAG chr11 5332213 5332232 5332216 -
tttgtttgtttgcaggctgt

SEQ ID NO: 36659 - DNA, 20 bp, Artificial Sequence
  Synthetic oligonucleotide; TAG chr11 5332209 5332228 5332212 -
tttgtttgcaggctgttagc

SEQ ID NO: 36660 - DNA, 20 bp, Artificial Sequence
  Synthetic oligonucleotide; AGG chr11 5332208 5332227 5332211 -
ttgtttgcaggctgttagct

SEQ ID NO: 36661 - DNA, 20 bp, Artificial Sequence
  Synthetic oligonucleotide; TAG chr11 5332189 5332208 5332192 -
taggatgcccgttctgtacc

SEQ ID NO: 36662 - DNA, 20 bp, Artificial Sequence
  Synthetic oligonucleotide; AGG chr11 5332188 5332207 5332191 -
aggatgcccgttctgtacct

SEQ ID NO: 36663 - DNA, 20 bp, Artificial Sequence
  Synthetic oligonucleotide; GGG chr11 5332187 5332206 5332190 -
ggatgcccgttctgtaccta

SEQ ID NO: 36664 - DNA, 20 bp, Artificial Sequence
  Synthetic oligonucleotide; GGG chr11 5332186 5332205 5332189 -
gatgcccgttctgtacctag

SEQ ID NO: 36665 - DNA, 20 bp, Artificial Sequence
  Synthetic oligonucleotide; CAG chr11 5332141 5332160 5332144 -
gacctccttatatttcaaac

SEQ ID NO: 36666 - DNA, 20 bp, Artificial Sequence
  Synthetic oligonucleotide; TGG chr11 5332099 5332118 5332102 -
tctcaaattttgaatatgtc

SEQ ID NO: 36667 - DNA, 20 bp, Artificial Sequence
  Synthetic oligonucleotide; TGG chr11 5332076 5332095 5332079 -
cttcctattctcctactact

SEQ ID NO: 36668 - DNA, 20 bp, Artificial Sequence
  Synthetic oligonucleotide; TAG chr11 5332058 5332077 5332061 -
cttggtgaaaactctgcttt

SEQ ID NO: 36669 - DNA, 20 bp, Artificial Sequence
  Synthetic oligonucleotide; AGG chr11 5332057 5332076 5332060 -
ttggtgaaaactctgctttt

SEQ ID NO: 36670 - DNA, 20 bp, Artificial Sequence
  Synthetic oligonucleotide; GGG chr11 5332056 5332075 5332059 -
tggtgaaaactctgctttta

SEQ ID NO: 36671 - DNA, 20 bp, Artificial Sequence
  Synthetic oligonucleotide; GGG chr11 5332055 5332074 5332058 -
ggtgaaaactctgcttttag

SEQ ID NO: 36672 - DNA, 20 bp, Artificial Sequence
  Synthetic oligonucleotide; TGG chr11 5332048 5332067 5332051 -
actctgcttttaggggctca

SEQ ID NO: 36673 - DNA, 20 bp, Artificial Sequence
  Synthetic oligonucleotide; TAG chr11 5332042 5332061 5332045 -
cttttaggggctcatggaat

SEQ ID NO: 36674 - DNA, 20 bp, Artificial Sequence
  Synthetic oligonucleotide; TAG chr11 5332037 5332056 5332040 -
aggggctcatggaattagac

SEQ ID NO: 36675 - DNA, 20 bp, Artificial Sequence
  Synthetic oligonucleotide; AGG chr11 5332036 5332055 5332039 -
ggggctcatggaattagact

SEQ ID NO: 36676 - DNA, 20 bp, Artificial Sequence
  Synthetic oligonucleotide; GAG chr11 5332026 5332045 5332029 -
gaattagactaggttcccct

SEQ ID NO: 36677 - DNA, 20 bp, Artificial Sequence
  Synthetic oligonucleotide; AAG chr11 5332000 5332019 5332003 -
tttccttttcaattaactca

SEQ ID NO: 36678 - DNA, 20 bp, Artificial Sequence
  Synthetic oligonucleotide; TAG chr11 5331993 5332012 5331996 -
ttcaattaactcaaagtcaa

SEQ ID NO: 36679 - DNA, 20 bp, Artificial Sequence
  Synthetic oligonucleotide; CAG chr11 5331988 5332007 5331991 -
ttaactcaaagtcaatagat

SEQ ID NO: 36680 - DNA, 20 bp, Artificial Sequence
  Synthetic oligonucleotide; AAG chr11 5331958 5331977 5331961 -
aattacatctgtataacccc

SEQ ID NO: 36681 - DNA, 20 bp, Artificial Sequence
  Synthetic oligonucleotide; CAG chr11 5331934 5331953 5331937 -
atgatattgtatcatattca

SEQ ID NO: 36682 - DNA, 20 bp, Artificial Sequence
  Synthetic oligonucleotide; TAG chr11 5331928 5331947 5331931 -
ttgtatcatattcacagtcc

SEQ ID NO: 36683 - DNA, 20 bp, Artificial Sequence
  Synthetic oligonucleotide; TAG chr11 5331921 5331940 5331924 -
atattcacagtcctagaaat

SEQ ID NO: 36684 - DNA, 20 bp, Artificial Sequence
  Synthetic oligonucleotide; AGG chr11 5331920 5331939 5331923 -
tattcacagtcctagaaatt

SEQ ID NO: 36685 - DNA, 20 bp, Artificial Sequence
  Synthetic oligonucleotide; TAG chr11 5331916 5331935 5331919 -
cacagtcctagaaattagga

SEQ ID NO: 36686 - DNA, 20 bp, Artificial Sequence
  Synthetic oligonucleotide; AGG chr11 5331915 5331934 5331918 -
acagtcctagaaattaggat

SEQ ID NO: 36687 - DNA, 20 bp, Artificial Sequence
  Synthetic oligonucleotide; TGG chr11 5331904 5331923 5331907 -
aattaggataggaaatcttg

SEQ ID NO: 36688 - DNA, 20 bp, Artificial Sequence
  Synthetic oligonucleotide; TAG chr11 5331901 5331920 5331904 -
taggataggaaatcttgtgg

SEQ ID NO: 36689 - DNA, 20 bp, Artificial Sequence
  Synthetic oligonucleotide; AAG chr11 5331897 5331916 5331900 -
ataggaaatcttgtggtaga

SEQ ID NO: 36690 - DNA, 20 bp, Artificial Sequence
  Synthetic oligonucleotide; AGG chr11 5331896 5331915 5331899 -
taggaaatcttgtggtagaa

SEQ ID NO: 36691 - DNA, 20 bp, Artificial Sequence
  Synthetic oligonucleotide; TAG chr11 5331858 5331877 5331861 -
ctatcacaccatttaaaaaa

SEQ ID NO: 36692 - DNA, 20 bp, Artificial Sequence
  Synthetic oligonucleotide; TAG chr11 5331854 5331873 5331857 -
cacaccatttaaaaaatagc

SEQ ID NO: 36693 - DNA, 20 bp, Artificial Sequence
  Synthetic oligonucleotide; GAG chr11 5331850 5331869 5331853 -
ccatttaaaaaatagctagt

SEQ ID NO: 36694 - DNA, 20 bp, Artificial Sequence
  Synthetic oligonucleotide; GAG chr11 5331848 5331867 5331851 -
atttaaaaaatagctagtga

SEQ ID NO: 36695 - DNA, 20 bp, Artificial Sequence
  Synthetic oligonucleotide; GAG chr11 5331846 5331865 5331849 -
ttaaaaaatagctagtgaga

SEQ ID NO: 36696 - DNA, 20 bp, Artificial Sequence
  Synthetic oligonucleotide; AGG chr11 5331845 5331864 5331848 -
taaaaaatagctagtgagag

SEQ ID NO: 36697 - DNA, 20 bp, Artificial Sequence
  Synthetic oligonucleotide; GAG chr11 5331843 5331862 5331846 -
aaaaatagctagtgagagag

SEQ ID NO: 36698 - DNA, 20 bp, Artificial Sequence
  Synthetic oligonucleotide; TAG chr11 5331817 5331836 5331820 -
ttcttttccaatatatgtgt

SEQ ID NO: 36699 - DNA, 20 bp, Artificial Sequence
  Synthetic oligonucleotide; AAG chr11 5331809 5331828 5331812 -
caatatatgtgttagtttta

SEQ ID NO: 36700 - DNA, 20 bp, Artificial Sequence
  Synthetic oligonucleotide; AAG chr11 5331766 5331785 5331769 -
ttcttaacatttttttgatg

SEQ ID NO: 36701 - DNA, 20 bp, Artificial Sequence
  Synthetic oligonucleotide; AAG chr11 5331751 5331770 5331754 -
tgatgaagcacaatgtctga

SEQ ID NO: 36702 - DNA, 20 bp, Artificial Sequence
  Synthetic oligonucleotide; AGG chr11 5331750 5331769 5331753 -
gatgaagcacaatgtctgaa

SEQ ID NO: 36703 - DNA, 20 bp, Artificial Sequence
  Synthetic oligonucleotide; GGG chr11 5331749 5331768 5331752 -
atgaagcacaatgtctgaaa

SEQ ID NO: 36704 - DNA, 20 bp, Artificial Sequence
  Synthetic oligonucleotide; TGG chr11 5331746 5331765 5331749 -
aagcacaatgtctgaaaggg

SEQ ID NO: 36705 - DNA, 20 bp, Artificial Sequence
  Synthetic oligonucleotide; TAG chr11 5331743 5331762 5331746 -
cacaatgtctgaaagggtgg

SEQ ID NO: 36706 - DNA, 20 bp, Artificial Sequence
  Synthetic oligonucleotide; AAG chr11 5331739 5331758 5331742 -
atgtctgaaagggtggtaga

SEQ ID NO: 36707 - DNA, 20 bp, Artificial Sequence
  Synthetic oligonucleotide; CAG chr11 5331736 5331755 5331739 -
tctgaaagggtggtagaaag

SEQ ID NO: 36708 - DNA, 20 bp, Artificial Sequence
  Synthetic oligonucleotide; TGG chr11 5331732 5331751 5331735 -
aaagggtggtagaaagcagc

SEQ ID NO: 36709 - DNA, 20 bp, Artificial Sequence
  Synthetic oligonucleotide; GAG chr11 5331730 5331749 5331733 -
agggtggtagaaagcagctg

SEQ ID NO: 36710 - DNA, 20 bp, Artificial Sequence
  Synthetic oligonucleotide; GAG chr11 5331719 5331738 5331722 -
aagcagctggagtcgaaact

SEQ ID NO: 36711 - DNA, 20 bp, Artificial Sequence
  Synthetic oligonucleotide; AGG chr11 5331718 5331737 5331721 -
agcagctggagtcgaaactg

SEQ ID NO: 36712 - DNA, 20 bp, Artificial Sequence
  Synthetic oligonucleotide; AAG chr11 5331712 5331731 5331715 -
tggagtcgaaactgaggatg

SEQ ID NO: 36713 - DNA, 20 bp, Artificial Sequence
  Synthetic oligonucleotide; TAG chr11 5331704 5331723 5331707 -
aaactgaggatgaagtcgta

SEQ ID NO: 36714 - DNA, 20 bp, Artificial Sequence
  Synthetic oligonucleotide; TAG chr11 5331699 5331718 5331702 -
gaggatgaagtcgtatagtc

SEQ ID NO: 36715 - DNA, 20 bp, Artificial Sequence
  Synthetic oligonucleotide; GAG chr11 5331697 5331716 5331700 -
ggatgaagtcgtatagtcta

SEQ ID NO: 36716 - DNA, 20 bp, Artificial Sequence
  Synthetic oligonucleotide; CAG chr11 5331679 5331698 5331682 -
tagagctgtgctgtccaaaa

SEQ ID NO: 36717 - DNA, 20 bp, Artificial Sequence
  Synthetic oligonucleotide; TAG chr11 5331676 5331695 5331679 -
agctgtgctgtccaaaacag

SEQ ID NO: 36718 - DNA, 20 bp, Artificial Sequence
  Synthetic oligonucleotide; TGG chr11 5331669 5331688 5331672 -
ctgtccaaaacagtagcatc

SEQ ID NO: 36719 - DNA, 20 bp, Artificial Sequence
  Synthetic oligonucleotide; TAG chr11 5331665 5331684 5331668 -
ccaaaacagtagcatctggt

SEQ ID NO: 36720 - DNA, 20 bp, Artificial Sequence
  Synthetic oligonucleotide; GAG chr11 5331659 5331678 5331662 -
cagtagcatctggttagctt

SEQ ID NO: 36721 - DNA, 20 bp, Artificial Sequence
  Synthetic oligonucleotide; CAG chr11 5331655 5331674 5331658 -
agcatctggttagcttgagt

SEQ ID NO: 36722 - DNA, 20 bp, Artificial Sequence
  Synthetic oligonucleotide; AAG chr11 5331642 5331661 5331645 -
cttgagtcagaattttctgt

SEQ ID NO: 36723 - DNA, 20 bp, Artificial Sequence
  Synthetic oligonucleotide; AAG chr11 5331621 5331640 5331624 -
agtgtaaacactcgattttg

SEQ ID NO: 36724 - DNA, 20 bp, Artificial Sequence
  Synthetic oligonucleotide; TGG chr11 5331596 5331615 5331599 -
tttgtaccaaaaaaaaatcg

SEQ ID NO: 36725 - DNA, 20 bp, Artificial Sequence
  Synthetic oligonucleotide; GGG chr11 5331595 5331614 5331598 -
ttgtaccaaaaaaaaatcgt

SEQ ID NO: 36726 - DNA, 20 bp, Artificial Sequence
  Synthetic oligonucleotide; TAG chr11 5331533 5331552 5331536 -
aaatgataatatttttgata

SEQ ID NO: 36727 - DNA, 20 bp, Artificial Sequence
  Synthetic oligonucleotide; TAG chr11 5331530 5331549 5331533 -
tgataatatttttgatatag

SEQ ID NO: 36728 - DNA, 20 bp, Artificial Sequence
  Synthetic oligonucleotide; AAG chr11 5331520 5331539 5331523 -
tttgatatagtagcttaaat

SEQ ID NO: 36729 - DNA, 20 bp, Artificial Sequence
  Synthetic oligonucleotide; CAG chr11 5331463 5331482 5331466 -
actccttttaatgtgactac

SEQ ID NO: 36730 - DNA, 20 bp, Artificial Sequence
  Synthetic oligonucleotide; TAG chr11 5331440 5331459 5331443 -
aacatttaacatcacatatt

SEQ ID NO: 36731 - DNA, 20 bp, Artificial Sequence
  Synthetic oligonucleotide; TAG chr11 5331415 5331434 5331418 -
ctaattatatttccaccaca

SEQ ID NO: 36732 - DNA, 20 bp, Artificial Sequence
  Synthetic oligonucleotide; TGG chr11 5331409 5331428 5331412 -
atatttccaccacatagtgc

SEQ ID NO: 36733 - DNA, 20 bp, Artificial Sequence
  Synthetic oligonucleotide; TAG chr11 5331404 5331423 5331407 -
tccaccacatagtgctggtc

SEQ ID NO: 36734 - DNA, 20 bp, Artificial Sequence
  Synthetic oligonucleotide; GAG chr11 5331402 5331421 5331405 -
caccacatagtgctggtcta

SEQ ID NO: 36735 - DNA, 20 bp, Artificial Sequence
  Synthetic oligonucleotide; GAG chr11 5331400 5331419 5331403 -
ccacatagtgctggtctaga

SEQ ID NO: 36736 - DNA, 20 bp, Artificial Sequence
  Synthetic oligonucleotide; CAG chr11 5331373 5331392 5331376 -
tttgtttgtttgtttctcct

SEQ ID NO: 36737 - DNA, 20 bp, Artificial Sequence
  Synthetic oligonucleotide; AGG chr11 5331372 5331391 5331375 -
ttgtttgtttgtttctcctc

SEQ ID NO: 36738 - DNA, 20 bp, Artificial Sequence
  Synthetic oligonucleotide; TGG chr11 5331323 5331342 5331326 -
gctgccccttttctcctcac

SEQ ID NO: 36739 - DNA, 20 bp, Artificial Sequence
  Synthetic oligonucleotide; CAG chr11 5331315 5331334 5331318 -
ttttctcctcactggctttc

SEQ ID NO: 36740 - DNA, 20 bp, Artificial Sequence
  Synthetic oligonucleotide; AGG chr11 5331314 5331333 5331317 -
tttctcctcactggctttcc

SEQ ID NO: 36741 - DNA, 20 bp, Artificial Sequence
  Synthetic oligonucleotide; TGG chr11 5331309 5331328 5331312 -
cctcactggctttccaggtc

SEQ ID NO: 36742 - DNA, 20 bp, Artificial Sequence
  Synthetic oligonucleotide; GAG chr11 5331307 5331326 5331310 -
tcactggctttccaggtctg

SEQ ID NO: 36743 - DNA, 20 bp, Artificial Sequence
  Synthetic oligonucleotide; GAG chr11 5331305 5331324 5331308 -
actggctttccaggtctgga

SEQ ID NO: 36744 - DNA, 20 bp, Artificial Sequence
  Synthetic oligonucleotide; TGG chr11 5331292 5331311 5331295 -
gtctggagagatttcatcct

SEQ ID NO: 36745 - DNA, 20 bp, Artificial Sequence
  Synthetic oligonucleotide; GAG chr11 5331290 5331309 5331293 -
ctggagagatttcatccttg

SEQ ID NO: 36746 - DNA, 20 bp, Artificial Sequence
  Synthetic oligonucleotide; CAG chr11 5331255 5331274 5331258 -
ctttatcatctatgtctcta

SEQ ID NO: 36747 - DNA, 20 bp, Artificial Sequence
  Synthetic oligonucleotide; TGG chr11 5331248 5331267 5331251 -
atctatgtctctacagtcct

SEQ ID NO: 36748 - DNA, 20 bp, Artificial Sequence
  Synthetic oligonucleotide; TGG chr11 5331242 5331261 5331245 -
gtctctacagtccttggcaa

SEQ ID NO: 36749 - DNA, 20 bp, Artificial Sequence
  Synthetic oligonucleotide; CAG chr11 5331239 5331258 5331242 -
tctacagtccttggcaatgg

SEQ ID NO: 36750 - DNA, 20 bp, Artificial Sequence
  Synthetic oligonucleotide; CAG chr11 5331221 5331240 5331224 -
ggcagcctcctcctctttat

SEQ ID NO: 36751 - DNA, 20 bp, Artificial Sequence
  Synthetic oligonucleotide; GAG chr11 5331219 5331238 5331222 -
cagcctcctcctctttatca

SEQ ID NO: 36752 - DNA, 20 bp, Artificial Sequence
  Synthetic oligonucleotide; AAG chr11 5331216 5331235 5331219 -
cctcctcctctttatcagag

SEQ ID NO: 36753 - DNA, 20 bp, Artificial Sequence
  Synthetic oligonucleotide; GAG chr11 5331199 5331218 5331202 -
gagaagactgcactcttcat

SEQ ID NO: 36754 - DNA, 20 bp, Artificial Sequence
  Synthetic oligonucleotide; TGG chr11 5331171 5331190 5331174 -
gtactactctctgactatac

SEQ ID NO: 36755 - DNA, 20 bp, Artificial Sequence
  Synthetic oligonucleotide; CAG chr11 5331168 5331187 5331171 -
ctactctctgactatactgg

SEQ ID NO: 36756 - DNA, 20 bp, Artificial Sequence
  Synthetic oligonucleotide; TAG chr11 5331162 5331181 5331165 -
tctgactatactggcagcca

SEQ ID NO: 36757 - DNA, 20 bp, Artificial Sequence
  Synthetic oligonucleotide; TGG chr11 5331155 5331174 5331158 -
atactggcagccatagacct

SEQ ID NO: 36758 - DNA, 20 bp, Artificial Sequence
  Synthetic oligonucleotide; TGG chr11 5331122 5331141 5331125 -
acaacaatgtccactgtcct

SEQ ID NO: 36759 - DNA, 20 bp, Artificial Sequence
  Synthetic oligonucleotide; TGG chr11 5331112 5331131 5331115 -
ccactgtccttggtgttctc

SEQ ID NO: 36760 - DNA, 20 bp, Artificial Sequence
  Synthetic oligonucleotide; TAG chr11 5331108 5331127 5331111 -
tgtccttggtgttctctggc

SEQ ID NO: 36761 - DNA, 20 bp, Artificial Sequence
  Synthetic oligonucleotide; CAG chr11 5331101 5331120 5331104 -
ggtgttctctggctagatca

SEQ ID NO: 36762 - DNA, 20 bp, Artificial Sequence
  Synthetic oligonucleotide; AGG chr11 5331100 5331119 5331103 -
gtgttctctggctagatcac

SEQ ID NO: 36763 - DNA, 20 bp, Artificial Sequence
  Synthetic oligonucleotide; GAG chr11 5331092 5331111 5331095 -
tggctagatcacaggaaaat

SEQ ID NO: 36764 - DNA, 20 bp, Artificial Sequence
  Synthetic oligonucleotide; TGG chr11 5331086 5331105 5331089 -
gatcacaggaaaatgagcca

SEQ ID NO: 36765 - DNA, 20 bp, Artificial Sequence
  Synthetic oligonucleotide; GAG chr11 5331084 5331103 5331087 -
tcacaggaaaatgagccatg

SEQ ID NO: 36766 - DNA, 20 bp, Artificial Sequence
  Synthetic oligonucleotide; CAG chr11 5331070 5331089 5331073 -
gccatggagcctgcttcctc

SEQ ID NO: 36767 - DNA, 20 bp, Artificial Sequence
  Synthetic oligonucleotide; AGG chr11 5331069 5331088 5331072 -
ccatggagcctgcttcctcc

SEQ ID NO: 36768 - DNA, 20 bp, Artificial Sequence
  Synthetic oligonucleotide; TGG chr11 5331039 5331058 5331042 -
aatccactccctctctatcg

SEQ ID NO: 36769 - DNA, 20 bp, Artificial Sequence
  Synthetic oligonucleotide; GAG chr11 5331037 5331056 5331040 -
tccactccctctctatcgtg

SEQ ID NO: 36770 - DNA, 20 bp, Artificial Sequence
  Synthetic oligonucleotide; CAG chr11 5331032 5331051 5331035 -
tccctctctatcgtggagtc

SEQ ID NO: 36771 - DNA, 20 bp, Artificial Sequence
  Synthetic oligonucleotide; GAG chr11 5331030 5331049 5331033 -
cctctctatcgtggagtcca

SEQ ID NO: 36772 - DNA, 20 bp, Artificial Sequence
  Synthetic oligonucleotide; TGG chr11 5331015 5331034 5331018 -
gtccagagtgttgctcatca

SEQ ID NO: 36773 - DNA, 20 bp, Artificial Sequence
  Synthetic oligonucleotide; TGG chr11 5330996 5331015 5330999 -
atggcccatgactgttttat

SEQ ID NO: 36774 - DNA, 20 bp, Artificial Sequence
  Synthetic oligonucleotide; GAG chr11 5330978 5330997 5330981 -
attggcatccataatcccct

SEQ ID NO: 36775 - DNA, 20 bp, Artificial Sequence
  Synthetic oligonucleotide; AAG chr11 5330950 5330969 5330953 -
cctccattctcaccaatgct

SEQ ID NO: 36776 - DNA, 20 bp, Artificial Sequence
  Synthetic oligonucleotide; AGG chr11 5330949 5330968 5330952 -
ctccattctcaccaatgcta

SEQ ID NO: 36777 - DNA, 20 bp, Artificial Sequence
  Synthetic oligonucleotide; TGG chr11 5330946 5330965 5330949 -
cattctcaccaatgctaagg

SEQ ID NO: 36778 - DNA, 20 bp, Artificial Sequence
  Synthetic oligonucleotide; AAG chr11 5330941 5330960 5330944 -
tcaccaatgctaaggtggtg

SEQ ID NO: 36779 - DNA, 20 bp, Artificial Sequence
  Synthetic oligonucleotide; TAG chr11 5330937 5330956 5330940 -
caatgctaaggtggtgaaga

SEQ ID NO: 36780 - DNA, 20 bp, Artificial Sequence
  Synthetic oligonucleotide; TGG chr11 5330931 5330950 5330934 -
taaggtggtgaagatagatc

SEQ ID NO: 36781 - DNA, 20 bp, Artificial Sequence
  Synthetic oligonucleotide; GGG chr11 5330930 5330949 5330933 -
aaggtggtgaagatagatct

SEQ ID NO: 36782 - DNA, 20 bp, Artificial Sequence
  Synthetic oligonucleotide; GGG chr11 5330929 5330948 5330932 -
aggtggtgaagatagatctg

SEQ ID NO: 36783 - DNA, 20 bp, Artificial Sequence
  Synthetic oligonucleotide; GGG chr11 5330928 5330947 5330931 -
ggtggtgaagatagatctgg

SEQ ID NO: 36784 - DNA, 20 bp, Artificial Sequence
  Synthetic oligonucleotide; GAG chr11 5330918 5330937 5330921 -
atagatctgggggttcaaat

SEQ ID NO: 36785 - DNA, 20 bp, Artificial Sequence
  Synthetic oligonucleotide; AGG chr11 5330917 5330936 5330920 -
tagatctgggggttcaaatg

SEQ ID NO: 36786 - DNA, 20 bp, Artificial Sequence
  Synthetic oligonucleotide; GGG chr11 5330916 5330935 5330919 -
agatctgggggttcaaatga

SEQ ID NO: 36787 - DNA, 20 bp, Artificial Sequence
  Synthetic oligonucleotide; GGG chr11 5330915 5330934 5330918 -
gatctgggggttcaaatgag

SEQ ID NO: 36788 - DNA, 20 bp, Artificial Sequence
  Synthetic oligonucleotide; TGG chr11 5330873 5330892 5330876 -
cccataatcatcaccctctc

SEQ ID NO: 36789 - DNA, 20 bp, Artificial Sequence
  Synthetic oligonucleotide; CAG chr11 5330821 5330840 5330824 -
cccatgctttctgcctgcac

SEQ ID NO: 36790 - DNA, 20 bp, Artificial Sequence
  Synthetic oligonucleotide; TGG chr11 5330806 5330825 5330809 -
tgcaccagatgtgatcaaac

SEQ ID NO: 36791 - DNA, 20 bp, Artificial Sequence
  Synthetic oligonucleotide; CAG chr11 5330797 5330816 5330800 -
tgtgatcaaactggcctgtg

SEQ ID NO: 36792 - DNA, 20 bp, Artificial Sequence
  Synthetic oligonucleotide; TAG chr11 5330781 5330800 5330784 -
tgtgcagacatcacctttaa

SEQ ID NO: 36793 - DNA, 20 bp, Artificial Sequence
  Synthetic oligonucleotide; TAG chr11 5330767 5330786 5330770 -
ctttaatagactttatccta

SEQ ID NO: 36794 - DNA, 20 bp, Artificial Sequence
  Synthetic oligonucleotide; TGG chr11 5330761 5330780 5330764 -
tagactttatcctatagtcc

SEQ ID NO: 36795 - DNA, 20 bp, Artificial Sequence
  Synthetic oligonucleotide; TGG chr11 5330748 5330767 5330751 -
atagtcctggtctcatcaac

SEQ ID NO: 36796 - DNA, 20 bp, Artificial Sequence
  Synthetic oligonucleotide; TGG chr11 5330740 5330759 5330743 -
ggtctcatcaactggtttct

SEQ ID NO: 36797 - DNA, 20 bp, Artificial Sequence
  Synthetic oligonucleotide; AAG chr11 5330699 5330718 5330702 -
tctcttacattctgatcctt

SEQ ID NO: 36798 - DNA, 20 bp, Artificial Sequence
  Synthetic oligonucleotide; AAG chr11 5330696 5330715 5330699 -
cttacattctgatccttaag

SEQ ID NO: 36799 - DNA, 20 bp, Artificial Sequence
  Synthetic oligonucleotide; AGG chr11 5330695 5330714 5330698 -
ttacattctgatccttaaga

SEQ ID NO: 36800 - DNA, 20 bp, Artificial Sequence
  Synthetic oligonucleotide; TGG chr11 5330689 5330708 5330692 -
tctgatccttaagaaggtca

SEQ ID NO: 36801 - DNA, 20 bp, Artificial Sequence
  Synthetic oligonucleotide; GGG chr11 5330688 5330707 5330691 -
ctgatccttaagaaggtcat

SEQ ID NO: 36802 - DNA, 20 bp, Artificial Sequence
  Synthetic oligonucleotide; CAG chr11 5330677 5330696 5330680 -
gaaggtcatgggaattgcct

SEQ ID NO: 36803 - DNA, 20 bp, Artificial Sequence
  Synthetic oligonucleotide; AAG chr11 5330672 5330691 5330675 -
tcatgggaattgcctcagac

SEQ ID NO: 36804 - DNA, 20 bp, Artificial Sequence
  Synthetic oligonucleotide; AGG chr11 5330671 5330690 5330674 -
catgggaattgcctcagaca

SEQ ID NO: 36805 - DNA, 20 bp, Artificial Sequence
  Synthetic oligonucleotide; GAG chr11 5330669 5330688 5330672 -
tgggaattgcctcagacaag

SEQ ID NO: 36806 - DNA, 20 bp, Artificial Sequence
  Synthetic oligonucleotide; CAG chr11 5330666 5330685 5330669 -
gaattgcctcagacaaggag

SEQ ID NO: 36807 - DNA, 20 bp, Artificial Sequence
  Synthetic oligonucleotide; AAG chr11 5330660 5330679 5330663 -
cctcagacaaggagcagact

SEQ ID NO: 36808 - DNA, 20 bp, Artificial Sequence
  Synthetic oligonucleotide; AGG chr11 5330659 5330678 5330662 -
ctcagacaaggagcagacta

SEQ ID NO: 36809 - DNA, 20 bp, Artificial Sequence
  Synthetic oligonucleotide; TAG chr11 5330631 5330650 5330634 -
aatacttgtatttctcacat

SEQ ID NO: 36810 - DNA, 20 bp, Artificial Sequence
  Synthetic oligonucleotide; TGG chr11 5330620 5330639 5330623 -
ttctcacattagctgtgttc

SEQ ID NO: 36811 - DNA, 20 bp, Artificial Sequence
  Synthetic oligonucleotide; TGG chr11 5330599 5330618 5330602 -
ggtttttaatgtcacttgat

SEQ ID NO: 36812 - DNA, 20 bp, Artificial Sequence
  Synthetic oligonucleotide; GGG chr11 5330598 5330617 5330601 -
gtttttaatgtcacttgatt

SEQ ID NO: 36813 - DNA, 20 bp, Artificial Sequence
  Synthetic oligonucleotide; CAG chr11 5330583 5330602 5330586 -
tgattgggctaccacccttt

SEQ ID NO: 36814 - DNA, 20 bp, Artificial Sequence
  Synthetic oligonucleotide; AAG chr11 5330554 5330573 5330557 -
tgcttcatcaaaaaaatgtt

SEQ ID NO: 36815 - DNA, 20 bp, Artificial Sequence
  Synthetic oligonucleotide; AAG chr11 5330490 5330509 5330493 -
caatgcaaatcaaaaccaca

SEQ ID NO: 36816 - DNA, 20 bp, Artificial Sequence
  Synthetic oligonucleotide; GAG chr11 5330488 5330507 5330491 -
atgcaaatcaaaaccacaaa

SEQ ID NO: 36817 - DNA, 20 bp, Artificial Sequence
  Synthetic oligonucleotide; CAG chr11 5330471 5330490 5330474 -
aaagagataccatctcacac

SEQ ID NO: 36818 - DNA, 20 bp, Artificial Sequence
  Synthetic oligonucleotide; TAG chr11 5330467 5330486 5330470 -
agataccatctcacaccagt

SEQ ID NO: 36819 - DNA, 20 bp, Artificial Sequence
  Synthetic oligonucleotide; TGG chr11 5330462 5330481 5330465 -
ccatctcacaccagttagaa

SEQ ID NO: 36820 - DNA, 20 bp, Artificial Sequence
  Synthetic oligonucleotide; AAG chr11 5330448 5330467 5330451 -
ttagaatggcaatcattaaa

SEQ ID NO: 36821 - DNA, 20 bp, Artificial Sequence
  Synthetic oligonucleotide; CAG chr11 5330444 5330463 5330447 -
aatggcaatcattaaaaagt

SEQ ID NO: 36822 - DNA, 20 bp, Artificial Sequence
  Synthetic oligonucleotide; AGG chr11 5330443 5330462 5330446 -
atggcaatcattaaaaagtc

SEQ ID NO: 36823 - DNA, 20 bp, Artificial Sequence
  Synthetic oligonucleotide; GGG chr11 5330442 5330461 5330445 -
tggcaatcattaaaaagtca

SEQ ID NO: 36824 - DNA, 20 bp, Artificial Sequence
  Synthetic oligonucleotide; CAG chr11 5330434 5330453 5330437 -
attaaaaagtcagggaacaa

SEQ ID NO: 36825 - DNA, 20 bp, Artificial Sequence
  Synthetic oligonucleotide; AGG chr11 5330433 5330452 5330436 -
ttaaaaagtcagggaacaac

SEQ ID NO: 36826 - DNA, 20 bp, Artificial Sequence
  Synthetic oligonucleotide; TGG chr11 5330427 5330446 5330430 -
agtcagggaacaacaggtgc

SEQ ID NO: 36827 - DNA, 20 bp, Artificial Sequence
  Synthetic oligonucleotide; GAG chr11 5330425 5330444 5330428 -
tcagggaacaacaggtgctg

SEQ ID NO: 36828 - DNA, 20 bp, Artificial Sequence
  Synthetic oligonucleotide; GAG chr11 5330423 5330442 5330426 -
agggaacaacaggtgctgga

SEQ ID NO: 36829 - DNA, 20 bp, Artificial Sequence
  Synthetic oligonucleotide; AGG chr11 5330422 5330441 5330425 -
gggaacaacaggtgctggag

SEQ ID NO: 36830 - DNA, 20 bp, Artificial Sequence
  Synthetic oligonucleotide; TGG chr11 5330416 5330435 5330419 -
aacaggtgctggagaggatg

SEQ ID NO: 36831 - DNA, 20 bp, Artificial Sequence
  Synthetic oligonucleotide; GAG chr11 5330414 5330433 5330417 -
caggtgctggagaggatgtg

SEQ ID NO: 36832 - DNA, 20 bp, Artificial Sequence
  Synthetic oligonucleotide; TAG chr11 5330408 5330427 5330411 -
ctggagaggatgtggagaaa

SEQ ID NO: 36833 - DNA, 20 bp, Artificial Sequence
  Synthetic oligonucleotide; AGG chr11 5330407 5330426 5330410 -
tggagaggatgtggagaaat

SEQ ID NO: 36834 - DNA, 20 bp, Artificial Sequence
  Synthetic oligonucleotide; TGG chr11 5330388 5330407 5330391 -
taggaacacttttacactct

SEQ ID NO: 36835 - DNA, 20 bp, Artificial Sequence
  Synthetic oligonucleotide; TGG chr11 5330385 5330404 5330388 -
gaacacttttacactcttgg

SEQ ID NO: 36836 - DNA, 20 bp, Artificial Sequence
  Synthetic oligonucleotide; GGG chr11 5330384 5330403 5330387 -
aacacttttacactcttggt

SEQ ID NO: 36837 - DNA, 20 bp, Artificial Sequence
  Synthetic oligonucleotide; TAG chr11 5330372 5330391 5330375 -
ctcttggtgggactgtaaac

SEQ ID NO: 36838 - DNA, 20 bp, Artificial Sequence
  Synthetic oligonucleotide; TGG chr11 5330358 5330377 5330361 -
gtaaactagttcaaccattg

SEQ ID NO: 36839 - DNA, 20 bp, Artificial Sequence
  Synthetic oligonucleotide; AAG chr11 5330355 5330374 5330358 -
aactagttcaaccattgtgg

SEQ ID NO: 36840 - DNA, 20 bp, Artificial Sequence
  Synthetic oligonucleotide; CAG chr11 5330351 5330370 5330354 -
agttcaaccattgtggaagt

SEQ ID NO: 36841 - DNA, 20 bp, Artificial Sequence
  Synthetic oligonucleotide; TGG chr11 5330346 5330365 5330349 -
aaccattgtggaagtcagtg

SEQ ID NO: 36842 - DNA, 20 bp, Artificial Sequence
  Synthetic oligonucleotide; CAG chr11 5330335 5330354 5330338 -
aagtcagtgtggcgattcct

SEQ ID NO: 36843 - DNA, 20 bp, Artificial Sequence
  Synthetic oligonucleotide; AGG chr11 5330334 5330353 5330337 -
agtcagtgtggcgattcctc

SEQ ID NO: 36844 - DNA, 20 bp, Artificial Sequence
  Synthetic oligonucleotide; GGG chr11 5330333 5330352 5330336 -
gtcagtgtggcgattcctca

SEQ ID NO: 36845 - DNA, 20 bp, Artificial Sequence
  Synthetic oligonucleotide; TAG chr11 5330327 5330346 5330330 -
gtggcgattcctcagggatc

SEQ ID NO: 36846 - DNA, 20 bp, Artificial Sequence
  Synthetic oligonucleotide; TAG chr11 5330321 5330340 5330324 -
attcctcagggatctagaac

SEQ ID NO: 36847 - DNA, 20 bp, Artificial Sequence
  Synthetic oligonucleotide; CAG chr11 5330303 5330322 5330306 -
actagaaataccatttgacc

SEQ ID NO: 36848 - DNA, 20 bp, Artificial Sequence
  Synthetic oligonucleotide; TGG chr11 5330288 5330307 5330291 -
tgacccagccatcccattac

SEQ ID NO: 36849 - DNA, 20 bp, Artificial Sequence
  Synthetic oligonucleotide; GGG chr11 5330287 5330306 5330290 -
gacccagccatcccattact

SEQ ID NO: 36850 - DNA, 20 bp, Artificial Sequence
  Synthetic oligonucleotide; CGG chr11 5330273 5330292 5330276 -
attactgggtatatacccaa

SEQ ID NO: 36851 - DNA, 20 bp, Artificial Sequence
  Synthetic oligonucleotide; AAG chr11 5330249 5330268 5330252 -
ttataaatcatgctgctata

SEQ ID NO: 36852 - DNA, 20 bp, Artificial Sequence
  Synthetic oligonucleotide; TGG chr11 5330222 5330241 5330225 -
atgcacacgtatgtttactg

SEQ ID NO: 36853 - DNA, 20 bp, Artificial Sequence
  Synthetic oligonucleotide; TAG chr11 5330207 5330226 5330210 -
tactgtggcactattcacaa

SEQ ID NO: 36854 - DNA, 20 bp, Artificial Sequence
  Synthetic oligonucleotide; AAG chr11 5330202 5330221 5330205 -
tggcactattcacaatagca

SEQ ID NO: 36855 - DNA, 20 bp, Artificial Sequence
  Synthetic oligonucleotide; TGG chr11 5330196 5330215 5330199 -
tattcacaatagcaaagact

SEQ ID NO: 36856 - DNA, 20 bp, Artificial Sequence
  Synthetic oligonucleotide; TAG chr11 5330168 5330187 5330171 -
acccaaatgtccaacaatga

SEQ ID NO: 36857 - DNA, 20 bp, Artificial Sequence
  Synthetic oligonucleotide; AAG chr11 5330157 5330176 5330160 -
caacaatgatagactgaatt

SEQ ID NO: 36858 - DNA, 20 bp, Artificial Sequence
  Synthetic oligonucleotide; TGG chr11 5330148 5330167 5330151 -
tagactgaattaagaaaatg

SEQ ID NO: 36859 - DNA, 20 bp, Artificial Sequence
  Synthetic oligonucleotide; TGG chr11 5330132 5330151 5330135 -
aatgtggcacatatacacca

SEQ ID NO: 36860 - DNA, 20 bp, Artificial Sequence
  Synthetic oligonucleotide; CAG chr11 5330120 5330139 5330123 -
atacaccatggaatactatg

SEQ ID NO: 36861 - DNA, 20 bp, Artificial Sequence
  Synthetic oligonucleotide; AAG chr11 5330105 5330124 5330108 -
ctatgcagccataaaaaatg

SEQ ID NO: 36862 - DNA, 20 bp, Artificial Sequence
  Synthetic oligonucleotide; GAG chr11 5330103 5330122 5330106 -
atgcagccataaaaaatgaa

SEQ ID NO: 36863 - DNA, 20 bp, Artificial Sequence
  Synthetic oligonucleotide; TAG chr11 5330087 5330106 5330090 -
tgaagagttcatgtcatttg

SEQ ID NO: 36864 - DNA, 20 bp, Artificial Sequence
  Synthetic oligonucleotide; AGG chr11 5330086 5330105 5330089 -
gaagagttcatgtcatttgt

SEQ ID NO: 36865 - DNA, 20 bp, Artificial Sequence
  Synthetic oligonucleotide; GGG chr11 5330085 5330104 5330088 -
aagagttcatgtcatttgta

SEQ ID NO: 36866 - DNA, 20 bp, Artificial Sequence
  Synthetic oligonucleotide; TGG chr11 5330079 5330098 5330082 -
tcatgtcatttgtagggaca

SEQ ID NO: 36867 - DNA, 20 bp, Artificial Sequence
  Synthetic oligonucleotide; TGG chr11 5330069 5330088 5330072 -
tgtagggacatggatgaaac

SEQ ID NO: 36868 - DNA, 20 bp, Artificial Sequence
  Synthetic oligonucleotide; CAG chr11 5330053 5330072 5330056 -
aaactggaaaccatcattct

SEQ ID NO: 36869 - DNA, 20 bp, Artificial Sequence
  Synthetic oligonucleotide; AAG chr11 5330039 5330058 5330042 -
cattctcagcaaactatcgc

SEQ ID NO: 36870 - DNA, 20 bp, Artificial Sequence
  Synthetic oligonucleotide; AGG chr11 5330038 5330057 5330041 -
attctcagcaaactatcgca

SEQ ID NO: 36871 - DNA, 20 bp, Artificial Sequence
  Synthetic oligonucleotide; AAG chr11 5330025 5330044 5330028 -
tatcgcaaggacaaaaaacc

SEQ ID NO: 36872 - DNA, 20 bp, Artificial Sequence
  Synthetic oligonucleotide; TAG chr11 5330003 5330022 5330006 -
gcactgcatgttctcactca

SEQ ID NO: 36873 - DNA, 20 bp, Artificial Sequence
  Synthetic oligonucleotide; AGG chr11 5330002 5330021 5330005 -
cactgcatgttctcactcat

SEQ ID NO: 36874 - DNA, 20 bp, Artificial Sequence
  Synthetic oligonucleotide; TGG chr11 5329999 5330018 5330002 -
tgcatgttctcactcatagg

SEQ ID NO: 36875 - DNA, 20 bp, Artificial Sequence
  Synthetic oligonucleotide; GGG chr11 5329998 5330017 5330001 -
gcatgttctcactcataggt

SEQ ID NO: 36876 - DNA, 20 bp, Artificial Sequence
  Synthetic oligonucleotide; GAG chr11 5329984 5330003 5329987 -
ataggtgggaattgaacaat

SEQ ID NO: 36877 - DNA, 20 bp, Artificial Sequence
  Synthetic oligonucleotide; TGG chr11 5329975 5329994 5329978 -
aattgaacaatgagaacaca

SEQ ID NO: 36878 - DNA, 20 bp, Artificial Sequence
  Synthetic oligonucleotide; CAG chr11 5329969 5329988 5329972 -
acaatgagaacacatggaca

SEQ ID NO: 36879 - DNA, 20 bp, Artificial Sequence
  Synthetic oligonucleotide; AGG chr11 5329968 5329987 5329971 -
caatgagaacacatggacac

SEQ ID NO: 36880 - DNA, 20 bp, Artificial Sequence
  Synthetic oligonucleotide; AAG chr11 5329965 5329984 5329968 -
tgagaacacatggacacagg

SEQ ID NO: 36881 - DNA, 20 bp, Artificial Sequence
  Synthetic oligonucleotide; AGG chr11 5329964 5329983 5329967 -
gagaacacatggacacagga

SEQ ID NO: 36882 - DNA, 20 bp, Artificial Sequence
  Synthetic oligonucleotide; GGG chr11 5329963 5329982 5329966 -
agaacacatggacacaggaa

SEQ ID NO: 36883 - DNA, 20 bp, Artificial Sequence
  Synthetic oligonucleotide; GGG chr11 5329962 5329981 5329965 -
gaacacatggacacaggaag

SEQ ID NO: 36884 - DNA, 20 bp, Artificial Sequence
  Synthetic oligonucleotide; CGG chr11 5329947 5329966 5329950 -
ggaaggggaacaacacactc

SEQ ID NO: 36885 - DNA, 20 bp, Artificial Sequence
  Synthetic oligonucleotide; GGG chr11 5329946 5329965 5329949 -
gaaggggaacaacacactcc

SEQ ID NO: 36886 - DNA, 20 bp, Artificial Sequence
  Synthetic oligonucleotide; GGG chr11 5329945 5329964 5329948 -
aaggggaacaacacactccg

SEQ ID NO: 36887 - DNA, 20 bp, Artificial Sequence
  Synthetic oligonucleotide; GAG chr11 5329934 5329953 5329937 -
cacactccggggactgttgt

SEQ ID NO: 36888 - DNA, 20 bp, Artificial Sequence
  Synthetic oligonucleotide; AGG chr11 5329933 5329952 5329936 -
acactccggggactgttgtg

SEQ ID NO: 36889 - DNA, 20 bp, Artificial Sequence
  Synthetic oligonucleotide; TGG chr11 5329930 5329949 5329933 -
ctccggggactgttgtgagg

SEQ ID NO: 36890 - DNA, 20 bp, Artificial Sequence
  Synthetic oligonucleotide; GGG chr11 5329929 5329948 5329932 -
tccggggactgttgtgaggt

SEQ ID NO: 36891 - DNA, 20 bp, Artificial Sequence
  Synthetic oligonucleotide; GGG chr11 5329928 5329947 5329931 -
ccggggactgttgtgaggtg

SEQ ID NO: 36892 - DNA, 20 bp, Artificial Sequence
  Synthetic oligonucleotide; GGG chr11 5329927 5329946 5329930 -
cggggactgttgtgaggtgg

SEQ ID NO: 36893 - DNA, 20 bp, Artificial Sequence
  Synthetic oligonucleotide; GGG chr11 5329926 5329945 5329929 -
ggggactgttgtgaggtggg

SEQ ID NO: 36894 - DNA, 20 bp, Artificial Sequence
  Synthetic oligonucleotide; AAG chr11 5329923 5329942 5329926 -
gactgttgtgaggtgggggg

SEQ ID NO: 36895 - DNA, 20 bp, Artificial Sequence
  Synthetic oligonucleotide; AGG chr11 5329922 5329941 5329925 -
actgttgtgaggtgggggga

SEQ ID NO: 36896 - DNA, 20 bp, Artificial Sequence
  Synthetic oligonucleotide; GGG chr11 5329921 5329940 5329924 -
ctgttgtgaggtggggggaa

SEQ ID NO: 36897 - DNA, 20 bp, Artificial Sequence
  Synthetic oligonucleotide; GGG chr11 5329920 5329939 5329923 -
tgttgtgaggtggggggaag

SEQ ID NO: 36898 - DNA, 20 bp, Artificial Sequence
  Synthetic oligonucleotide; GGG chr11 5329919 5329938 5329922 -
gttgtgaggtggggggaagg

SEQ ID NO: 36899 - DNA, 20 bp, Artificial Sequence
  Synthetic oligonucleotide; GAG chr11 5329917 5329936 5329920 -
tgtgaggtggggggaagggg

SEQ ID NO: 36900 - DNA, 20 bp, Artificial Sequence
  Synthetic oligonucleotide; GAG chr11 5329915 5329934 5329918 -
tgaggtggggggaaggggga

SEQ ID NO: 36901 - DNA, 20 bp, Artificial Sequence
  Synthetic oligonucleotide; GAG chr11 5329913 5329932 5329916 -
aggtggggggaagggggaga

SEQ ID NO: 36902 - DNA, 20 bp, Artificial Sequence
  Synthetic oligonucleotide; GAG chr11 5329911 5329930 5329914 -
gtggggggaagggggagaga

SEQ ID NO: 36903 - DNA, 20 bp, Artificial Sequence
  Synthetic oligonucleotide; TAG chr11 5329905 5329924 5329908 -
ggaagggggagagagagcat

SEQ ID NO: 36904 - DNA, 20 bp, Artificial Sequence
  Synthetic oligonucleotide; AGG chr11 5329904 5329923 5329907 -
gaagggggagagagagcatt

SEQ ID NO: 36905 - DNA, 20 bp, Artificial Sequence
  Synthetic oligonucleotide; GAG chr11 5329902 5329921 5329905 -
agggggagagagagcattag

SEQ ID NO: 36906 - DNA, 20 bp, Artificial Sequence
  Synthetic oligonucleotide; AAG chr11 5329885 5329904 5329888 -
taggagatatacctaatgct

SEQ ID NO: 36907 - DNA, 20 bp, Artificial Sequence
  Synthetic oligonucleotide; AAG chr11 5329878 5329897 5329881 -
tatacctaatgctaagtgac

SEQ ID NO: 36908 - DNA, 20 bp, Artificial Sequence
  Synthetic oligonucleotide; TGG chr11 5329871 5329890 5329874 -
aatgctaagtgacaagttaa

SEQ ID NO: 36909 - DNA, 20 bp, Artificial Sequence
  Synthetic oligonucleotide; GGG chr11 5329870 5329889 5329873 -
atgctaagtgacaagttaat

SEQ ID NO: 36910 - DNA, 20 bp, Artificial Sequence
  Synthetic oligonucleotide; CAG chr11 5329865 5329884 5329868 -
aagtgacaagttaatgggtg

SEQ ID NO: 36911 - DNA, 20 bp, Artificial Sequence
  Synthetic oligonucleotide; TGG chr11 5329852 5329871 5329855 -
atgggtgcagcacaccaaca

SEQ ID NO: 36912 - DNA, 20 bp, Artificial Sequence
  Synthetic oligonucleotide; AAG chr11 5329793 5329812 5329796 -
cacatgtaccctaaaactta

SEQ ID NO: 36913 - DNA, 20 bp, Artificial Sequence
  Synthetic oligonucleotide; TGG chr11 5329757 5329776 5329760 -
ataataaaaatacattattt

SEQ ID NO: 36914 - DNA, 20 bp, Artificial Sequence
  Synthetic oligonucleotide; CAG chr11 5329739 5329758 5329742 -
tttggattaacaaaaaccaa

SEQ ID NO: 36915 - DNA, 20 bp, Artificial Sequence
  Synthetic oligonucleotide; AGG chr11 5329738 5329757 5329741 -
ttggattaacaaaaaccaac

SEQ ID NO: 36916 - DNA, 20 bp, Artificial Sequence
  Synthetic oligonucleotide; CAG chr11 5329729 5329748 5329732 -
caaaaaccaacaggctacca

SEQ ID NO: 36917 - DNA, 20 bp, Artificial Sequence
  Synthetic oligonucleotide; TGG chr11 5329686 5329705 5329689 -
tctcacatgttttgttattc

SEQ ID NO: 36918 - DNA, 20 bp, Artificial Sequence
  Synthetic oligonucleotide; TAG chr11 5329677 5329696 5329680 -
ttttgttattctggctctgc

SEQ ID NO: 36919 - DNA, 20 bp, Artificial Sequence
  Synthetic oligonucleotide; GAG chr11 5329660 5329679 5329663 -
tgctagaattctcttgattt

SEQ ID NO: 36920 - DNA, 20 bp, Artificial Sequence
  Synthetic oligonucleotide; TAG chr11 5329633 5329652 5329636 -
tcatattttctctttcccca

SEQ ID NO: 36921 - DNA, 20 bp, Artificial Sequence
  Synthetic oligonucleotide; TAG chr11 5329548 5329567 5329551 -
cttccttgtttttcaattat

SEQ ID NO: 36922 - DNA, 20 bp, Artificial Sequence
  Synthetic oligonucleotide; GAG chr11 5329526 5329545 5329529 -
gcttaaataatatttctttt

SEQ ID NO: 36923 - DNA, 20 bp, Artificial Sequence
  Synthetic oligonucleotide; AAG chr11 5329505 5329524 5329508 -
agaaattttcccctgcccca

SEQ ID NO: 36924 - DNA, 20 bp, Artificial Sequence
  Synthetic oligonucleotide; TGG chr11 5329492 5329511 5329495 -
tgccccaaagatgctttctg

SEQ ID NO: 36925 - DNA, 20 bp, Artificial Sequence
  Synthetic oligonucleotide; GGG chr11 5329491 5329510 5329494 -
gccccaaagatgctttctgt

SEQ ID NO: 36926 - DNA, 20 bp, Artificial Sequence
  Synthetic oligonucleotide; TAG chr11 5329481 5329500 5329484 -
tgctttctgtgggctccctt

SEQ ID NO: 36927 - DNA, 20 bp, Artificial Sequence
  Synthetic oligonucleotide; CAG chr11 5329462 5329481 5329465 -
ttagcatgctaccatctatg

SEQ ID NO: 36928 - DNA, 20 bp, Artificial Sequence
  Synthetic oligonucleotide; TAG chr11 5329453 5329472 5329456 -
taccatctatgcagtaatga

SEQ ID NO: 36929 - DNA, 20 bp, Artificial Sequence
  Synthetic oligonucleotide; TGG chr11 5329435 5329454 5329438 -
gatagtgctatgaaaatttg

SEQ ID NO: 36930 - DNA, 20 bp, Artificial Sequence
  Synthetic oligonucleotide; AAG chr11 5329388 5329407 5329391 -
ctatttacattctgtgaata

SEQ ID NO: 36931 - DNA, 20 bp, Artificial Sequence
  Synthetic oligonucleotide; TGG chr11 5329363 5329382 5329366 -
tatgctcctcattgtgtatc

SEQ ID NO: 36932 - DNA, 20 bp, Artificial Sequence
  Synthetic oligonucleotide; AAG chr11 5329346 5329365 5329349 -
atctggcaaaaaaaaaaaaa

SEQ ID NO: 36933 - DNA, 20 bp, Artificial Sequence
  Synthetic oligonucleotide; AGG chr11 5329345 5329364 5329348 -
tctggcaaaaaaaaaaaaaa

SEQ ID NO: 36934 - DNA, 20 bp, Artificial Sequence
  Synthetic oligonucleotide; GGG chr11 5329344 5329363 5329347 -
ctggcaaaaaaaaaaaaaaa

SEQ ID NO: 36935 - DNA, 20 bp, Artificial Sequence
  Synthetic oligonucleotide; GAG chr11 5329337 5329356 5329340 -
aaaaaaaaaaaaagggcaat

SEQ ID NO: 36936 - DNA, 20 bp, Artificial Sequence
  Synthetic oligonucleotide; AAG chr11 5329330 5329349 5329333 -
aaaaaagggcaatgagctac

SEQ ID NO: 36937 - DNA, 20 bp, Artificial Sequence
  Synthetic oligonucleotide; AAG chr11 5329315 5329334 5329318 -
gctacaagtaatataatttt

SEQ ID NO: 36938 - DNA, 20 bp, Artificial Sequence
  Synthetic oligonucleotide; AAG chr11 5329307 5329326 5329310 -
taatataattttaagataaa

SEQ ID NO: 36939 - DNA, 20 bp, Artificial Sequence
  Synthetic oligonucleotide; CAG chr11 5329296 5329315 5329299 -
taagataaaaagctgaatgt

SEQ ID NO: 36940 - DNA, 20 bp, Artificial Sequence
  Synthetic oligonucleotide; CGG chr11 5329292 5329311 5329295 -
ataaaaagctgaatgtcagc

SEQ ID NO: 36941 - DNA, 20 bp, Artificial Sequence
  Synthetic oligonucleotide; GGG chr11 5329291 5329310 5329294 -
taaaaagctgaatgtcagcc

SEQ ID NO: 36942 - DNA, 20 bp, Artificial Sequence
  Synthetic oligonucleotide; CAG chr11 5329286 5329305 5329289 -
agctgaatgtcagccgggcg

SEQ ID NO: 36943 - DNA, 20 bp, Artificial Sequence
  Synthetic oligonucleotide; CAG chr11 5329264 5329283 5329267 -
gtgactcacacctgcaatcc

SEQ ID NO: 36944 - DNA, 20 bp, Artificial Sequence
  Synthetic oligonucleotide; TGG chr11 5329256 5329275 5329259 -
cacctgcaatcccagcactt

SEQ ID NO: 36945 - DNA, 20 bp, Artificial Sequence
  Synthetic oligonucleotide; GGG chr11 5329255 5329274 5329258 -
acctgcaatcccagcacttt

SEQ ID NO: 36946 - DNA, 20 bp, Artificial Sequence
  Synthetic oligonucleotide; GAG chr11 5329253 5329272 5329256 -
ctgcaatcccagcactttgg

SEQ ID NO: 36947 - DNA, 20 bp, Artificial Sequence
  Synthetic oligonucleotide; AGG chr11 5329252 5329271 5329255 -
tgcaatcccagcactttggg

SEQ ID NO: 36948 - DNA, 20 bp, Artificial Sequence
  Synthetic oligonucleotide; AAG chr11 5329247 5329266 5329250 -
tcccagcactttgggaggcc

SEQ ID NO: 36949 - DNA, 20 bp, Artificial Sequence
  Synthetic oligonucleotide; AGG chr11 5329246 5329265 5329249 -
cccagcactttgggaggcca

SEQ ID NO: 36950 - DNA, 20 bp, Artificial Sequence
  Synthetic oligonucleotide; GAG chr11 5329244 5329263 5329247 -
cagcactttgggaggccaag

SEQ ID NO: 36951 - DNA, 20 bp, Artificial Sequence
  Synthetic oligonucleotide; AGG chr11 5329243 5329262 5329246 -
agcactttgggaggccaagg

SEQ ID NO: 36952 - DNA, 20 bp, Artificial Sequence
  Synthetic oligonucleotide; GGG chr11 5329242 5329261 5329245 -
gcactttgggaggccaagga

SEQ ID NO: 36953 - DNA, 20 bp, Artificial Sequence
  Synthetic oligonucleotide; TGG chr11 5329239 5329258 5329242 -
ctttgggaggccaaggaggg

SEQ ID NO: 36954 - DNA, 20 bp, Artificial Sequence
  Synthetic oligonucleotide; GAG chr11 5329231 5329250 5329234 -
ggccaaggagggtggatcac

SEQ ID NO: 36955 - DNA, 20 bp, Artificial Sequence
  Synthetic oligonucleotide; AGG chr11 5329230 5329249 5329233 -
gccaaggagggtggatcacg

SEQ ID NO: 36956 - DNA, 20 bp, Artificial Sequence
  Synthetic oligonucleotide; AAG chr11 5329225 5329244 5329228 -
ggagggtggatcacgaggtc

SEQ ID NO: 36957 - DNA, 20 bp, Artificial Sequence
  Synthetic oligonucleotide; GAG chr11 5329223 5329242 5329226 -
agggtggatcacgaggtcaa

SEQ ID NO: 36958 - DNA, 20 bp, Artificial Sequence
  Synthetic oligonucleotide; GAG chr11 5329217 5329236 5329220 -
gatcacgaggtcaagagatc

SEQ ID NO: 36959 - DNA, 20 bp, Artificial Sequence
  Synthetic oligonucleotide; TGG chr11 5329207 5329226 5329210 -
tcaagagatcgagaccatcc

SEQ ID NO: 36960 - DNA, 20 bp, Artificial Sequence
  Synthetic oligonucleotide; TGG chr11 5329198 5329217 5329201 -
cgagaccatcctggccaata

SEQ ID NO: 36961 - DNA, 20 bp, Artificial Sequence
  Synthetic oligonucleotide; TAG chr11 5329163 5329182 5329166 -
tctactaaaaatacaaaaat

SEQ ID NO: 36962 - DNA, 20 bp, Artificial Sequence
  Synthetic oligonucleotide; TGG chr11 5329159 5329178 5329162 -
ctaaaaatacaaaaattagc

SEQ ID NO: 36963 - DNA, 20 bp, Artificial Sequence
  Synthetic oligonucleotide; GGG chr11 5329158 5329177 5329161 -
taaaaatacaaaaattagct

SEQ ID NO: 36964 - DNA, 20 bp, Artificial Sequence
  Synthetic oligonucleotide; TGG chr11 5329153 5329172 5329156 -
atacaaaaattagctgggtg

SEQ ID NO: 36965 - DNA, 20 bp, Artificial Sequence
  Synthetic oligonucleotide; TAG chr11 5329137 5329156 5329140 -
ggtgtggtgacgcgctactg

SEQ ID NO: 36966 - DNA, 20 bp, Artificial Sequence
  Synthetic oligonucleotide; CAG chr11 5329131 5329150 5329134 -
gtgacgcgctactgtagtcc

SEQ ID NO: 36967 - DNA, 20 bp, Artificial Sequence
  Synthetic oligonucleotide; CAG chr11 5329123 5329142 5329126 -
ctactgtagtcccagcttct

SEQ ID NO: 36968 - DNA, 20 bp, Artificial Sequence
  Synthetic oligonucleotide; AGG chr11 5329122 5329141 5329125 -
tactgtagtcccagcttctc

SEQ ID NO: 36969 - DNA, 20 bp, Artificial Sequence
  Synthetic oligonucleotide; GAG chr11 5329120 5329139 5329123 -
ctgtagtcccagcttctcag

SEQ ID NO: 36970 - DNA, 20 bp, Artificial Sequence
  Synthetic oligonucleotide; AGG chr11 5329119 5329138 5329122 -
tgtagtcccagcttctcagg

SEQ ID NO: 36971 - DNA, 20 bp, Artificial Sequence
  Synthetic oligonucleotide; TGG chr11 5329113 5329132 5329116 -
cccagcttctcaggaggctg

SEQ ID NO: 36972 - DNA, 20 bp, Artificial Sequence
  Synthetic oligonucleotide; CAG chr11 5329110 5329129 5329113 -
agcttctcaggaggctgtgg

SEQ ID NO: 36973 - DNA, 20 bp, Artificial Sequence
  Synthetic oligonucleotide; AGG chr11 5329109 5329128 5329112 -
gcttctcaggaggctgtggc

SEQ ID NO: 36974 - DNA, 20 bp, Artificial Sequence
  Synthetic oligonucleotide; GAG chr11 5329107 5329126 5329110 -
ttctcaggaggctgtggcag

SEQ ID NO: 36975 - DNA, 20 bp, Artificial Sequence
  Synthetic oligonucleotide; TGG chr11 5329091 5329110 5329094 -
gcaggagaatcacttgaacc

SEQ ID NO: 36976 - DNA, 20 bp, Artificial Sequence
  Synthetic oligonucleotide; GGG chr11 5329090 5329109 5329093 -
caggagaatcacttgaacct

SEQ ID NO: 36977 - DNA, 20 bp, Artificial Sequence
  Synthetic oligonucleotide; GAG chr11 5329088 5329107 5329091 -
ggagaatcacttgaacctgg

SEQ ID NO: 36978 - DNA, 20 bp, Artificial Sequence
  Synthetic oligonucleotide; AGG chr11 5329087 5329106 5329090 -
gagaatcacttgaacctggg

SEQ ID NO: 36979 - DNA, 20 bp, Artificial Sequence
  Synthetic oligonucleotide; TGG chr11 5329084 5329103 5329087 -
aatcacttgaacctgggagg

SEQ ID NO: 36980 - DNA, 20 bp, Artificial Sequence
  Synthetic oligonucleotide; GAG chr11 5329082 5329101 5329085 -
tcacttgaacctgggaggtg

SEQ ID NO: 36981 - DNA, 20 bp, Artificial Sequence
  Synthetic oligonucleotide; CAG chr11 5329075 5329094 5329078 -
aacctgggaggtggagtttg

SEQ ID NO: 36982 - DNA, 20 bp, Artificial Sequence
  Synthetic oligonucleotide; GAG chr11 5329071 5329090 5329074 -
tgggaggtggagtttgcagt

SEQ ID NO: 36983 - DNA, 20 bp, Artificial Sequence
  Synthetic oligonucleotide; GAG chr11 5329066 5329085 5329069 -
ggtggagtttgcagtgagct

SEQ ID NO: 36984 - DNA, 20 bp, Artificial Sequence
  Synthetic oligonucleotide; CAG chr11 5329046 5329065 5329049 -
gagattgtgctactgcactc

SEQ ID NO: 36985 - DNA, 20 bp, Artificial Sequence
  Synthetic oligonucleotide; TGG chr11 5329041 5329060 5329044 -
tgtgctactgcactccagcc

SEQ ID NO: 36986 - DNA, 20 bp, Artificial Sequence
  Synthetic oligonucleotide; CAG chr11 5329035 5329054 5329038 -
actgcactccagcctggcga

SEQ ID NO: 36987 - DNA, 20 bp, Artificial Sequence
  Synthetic oligonucleotide; GAG chr11 5329033 5329052 5329036 -
tgcactccagcctggcgaca

SEQ ID NO: 36988 - DNA, 20 bp, Artificial Sequence
  Synthetic oligonucleotide; GAG chr11 5329029 5329048 5329032 -
ctccagcctggcgacagagt

SEQ ID NO: 36989 - DNA, 20 bp, Artificial Sequence
  Synthetic oligonucleotide; AAG chr11 5328991 5329010 5328994 -
aaaaaaaaaaaaaaaaaaaa

SEQ ID NO: 36990 - DNA, 20 bp, Artificial Sequence
  Synthetic oligonucleotide; CAG chr11 5328958 5328977 5328961 -
tgaatctgcatgactattaa

SEQ ID NO: 36991 - DNA, 20 bp, Artificial Sequence
  Synthetic oligonucleotide; AAG chr11 5328947 5328966 5328950 -
gactattaacagatccattg

SEQ ID NO: 36992 - DNA, 20 bp, Artificial Sequence
  Synthetic oligonucleotide; CAG chr11 5328941 5328960 5328944 -
taacagatccattgaagttc

SEQ ID NO: 36993 - DNA, 20 bp, Artificial Sequence
  Synthetic oligonucleotide; TAG chr11 5328938 5328957 5328941 -
cagatccattgaagttccag

SEQ ID NO: 36994 - DNA, 20 bp, Artificial Sequence
  Synthetic oligonucleotide; AAG chr11 5328933 5328952 5328936 -
ccattgaagttccagtagat

SEQ ID NO: 36995 - DNA, 20 bp, Artificial Sequence
  Synthetic oligonucleotide; AAG chr11 5328916 5328935 5328919 -
gataagaacaaattttacca

SEQ ID NO: 36996 - DNA, 20 bp, Artificial Sequence
  Synthetic oligonucleotide; CAG chr11 5328910 5328929 5328913 -
aacaaattttaccaaagtaa

SEQ ID NO: 36997 - DNA, 20 bp, Artificial Sequence
  Synthetic oligonucleotide; AGG chr11 5328909 5328928 5328912 -
acaaattttaccaaagtaac

SEQ ID NO: 36998 - DNA, 20 bp, Artificial Sequence
  Synthetic oligonucleotide; AAG chr11 5328905 5328924 5328908 -
attttaccaaagtaacagga

SEQ ID NO: 36999 - DNA, 20 bp, Artificial Sequence
  Synthetic oligonucleotide; TGG chr11 5328889 5328908 5328892 -
aggaaagacaaaaacgcaat

SEQ ID NO: 37000 - DNA, 20 bp, Artificial Sequence
  Synthetic oligonucleotide; AAG chr11 5328879 5328898 5328882 -
aaaacgcaattggaattcat

SEQ ID NO: 37001 - DNA, 20 bp, Artificial Sequence
  Synthetic oligonucleotide; TAG chr11 5328873 5328892 5328876 -
caattggaattcataagctc

SEQ ID NO: 37002 - DNA, 20 bp, Artificial Sequence
  Synthetic oligonucleotide; AGG chr11 5328872 5328891 5328875 -
aattggaattcataagctct

SEQ ID NO: 37003 - DNA, 20 bp, Artificial Sequence
  Synthetic oligonucleotide; TAG chr11 5328864 5328883 5328867 -
ttcataagctctaggacccg

SEQ ID NO: 37004 - DNA, 20 bp, Artificial Sequence
  Synthetic oligonucleotide; GAG chr11 5328862 5328881 5328865 -
cataagctctaggacccgta

SEQ ID NO: 37005 - DNA, 20 bp, Artificial Sequence
  Synthetic oligonucleotide; AGG chr11 5328861 5328880 5328864 -
ataagctctaggacccgtag

SEQ ID NO: 37006 - DNA, 20 bp, Artificial Sequence
  Synthetic oligonucleotide; AAG chr11 5328843 5328862 5328846 -
agaggtacatatgatccctg

SEQ ID NO: 37007 - DNA, 20 bp, Artificial Sequence
  Synthetic oligonucleotide; AAG chr11 5328806 5328825 5328809 -
ctaaccctttcaaataaact

SEQ ID NO: 37008 - DNA, 20 bp, Artificial Sequence
  Synthetic oligonucleotide; GAG chr11 5328793 5328812 5328796 -
ataaactaagttatgatgct

SEQ ID NO: 37009 - DNA, 20 bp, Artificial Sequence
  Synthetic oligonucleotide; TGG chr11 5328784 5328803 5328787 -
gttatgatgctgagcctcct

SEQ ID NO: 37010 - DNA, 20 bp, Artificial Sequence
  Synthetic oligonucleotide; GGG chr11 5328783 5328802 5328786 -
ttatgatgctgagcctcctt

SEQ ID NO: 37011 - DNA, 20 bp, Artificial Sequence
  Synthetic oligonucleotide; AAG chr11 5328770 5328789 5328773 -
cctccttgggtcacataacc

SEQ ID NO: 37012 - DNA, 20 bp, Artificial Sequence
  Synthetic oligonucleotide; TGG chr11 5328764 5328783 5328767 -
tgggtcacataaccaagccc

SEQ ID NO: 37013 - DNA, 20 bp, Artificial Sequence
  Synthetic oligonucleotide; CAG chr11 5328745 5328764 5328748 -
ctggtatccctatcttacat

SEQ ID NO: 37014 - DNA, 20 bp, Artificial Sequence
  Synthetic oligonucleotide; TGG chr11 5328741 5328760 5328744 -
tatccctatcttacatcagc

SEQ ID NO: 37015 - DNA, 20 bp, Artificial Sequence
  Synthetic oligonucleotide; CAG chr11 5328704 5328723 5328707 -
attttcctcaccccattctt

SEQ ID NO: 37016 - DNA, 20 bp, Artificial Sequence
  Synthetic oligonucleotide; AGG chr11 5328703 5328722 5328706 -
ttttcctcaccccattcttc

SEQ ID NO: 37017 - DNA, 20 bp, Artificial Sequence
  Synthetic oligonucleotide; GAG chr11 5328683 5328702 5328686 -
aggaaacacctgaaaatccc

SEQ ID NO: 37018 - DNA, 20 bp, Artificial Sequence
  Synthetic oligonucleotide; AGG chr11 5328682 5328701 5328685 -
ggaaacacctgaaaatcccg

SEQ ID NO: 37019 - DNA, 20 bp, Artificial Sequence
  Synthetic oligonucleotide; CAG chr11 5328675 5328694 5328678 -
cctgaaaatcccgaggacat

SEQ ID NO: 37020 - DNA, 20 bp, Artificial Sequence
  Synthetic oligonucleotide; TGG chr11 5328669 5328688 5328672 -
aatcccgaggacatcagttg

SEQ ID NO: 37021 - DNA, 20 bp, Artificial Sequence
  Synthetic oligonucleotide; GGG chr11 5328668 5328687 5328671 -
atcccgaggacatcagttgt

SEQ ID NO: 37022 - DNA, 20 bp, Artificial Sequence
  Synthetic oligonucleotide; GGG chr11 5328667 5328686 5328670 -
tcccgaggacatcagttgtg

SEQ ID NO: 37023 - DNA, 20 bp, Artificial Sequence
  Synthetic oligonucleotide; CAG chr11 5328648 5328667 5328651 -
ggggccctgttcctcccgaa

SEQ ID NO: 37024 - DNA, 20 bp, Artificial Sequence
  Synthetic oligonucleotide; GAG chr11 5328646 5328665 5328649 -
ggccctgttcctcccgaaca

SEQ ID NO: 37025 - DNA, 20 bp, Artificial Sequence
  Synthetic oligonucleotide; AAG chr11 5328643 5328662 5328646 -
cctgttcctcccgaacagag

SEQ ID NO: 37026 - DNA, 20 bp, Artificial Sequence
  Synthetic oligonucleotide; GAG chr11 5328641 5328660 5328644 -
tgttcctcccgaacagagaa

SEQ ID NO: 37027 - DNA, 20 bp, Artificial Sequence
  Synthetic oligonucleotide; GAG chr11 5328639 5328658 5328642 -
ttcctcccgaacagagaaga

SEQ ID NO: 37028 - DNA, 20 bp, Artificial Sequence
  Synthetic oligonucleotide; AGG chr11 5328638 5328657 5328641 -
tcctcccgaacagagaagag

SEQ ID NO: 37029 - DNA, 20 bp, Artificial Sequence
  Synthetic oligonucleotide; GGG chr11 5328637 5328656 5328640 -
cctcccgaacagagaagaga

SEQ ID NO: 37030 - DNA, 20 bp, Artificial Sequence
  Synthetic oligonucleotide; AAG chr11 5328634 5328653 5328637 -
cccgaacagagaagagaggg

SEQ ID NO: 37031 - DNA, 20 bp, Artificial Sequence
  Synthetic oligonucleotide; AGG chr11 5328633 5328652 5328636 -
ccgaacagagaagagaggga

SEQ ID NO: 37032 - DNA, 20 bp, Artificial Sequence
  Synthetic oligonucleotide; GGG chr11 5328632 5328651 5328635 -
cgaacagagaagagagggaa

SEQ ID NO: 37033 - DNA, 20 bp, Artificial Sequence
  Synthetic oligonucleotide; GAG chr11 5328630 5328649 5328633 -
aacagagaagagagggaagg

SEQ ID NO: 37034 - DNA, 20 bp, Artificial Sequence
  Synthetic oligonucleotide; AAG chr11 5328624 5328643 5328627 -
gaagagagggaagggagatc

SEQ ID NO: 37035 - DNA, 20 bp, Artificial Sequence
  Synthetic oligonucleotide; AGG chr11 5328623 5328642 5328626 -
aagagagggaagggagatca

SEQ ID NO: 37036 - DNA, 20 bp, Artificial Sequence
  Synthetic oligonucleotide; GGG chr11 5328622 5328641 5328625 -
agagagggaagggagatcaa

SEQ ID NO: 37037 - DNA, 20 bp, Artificial Sequence
  Synthetic oligonucleotide; GGG chr11 5328621 5328640 5328624 -
gagagggaagggagatcaag

SEQ ID NO: 37038 - DNA, 20 bp, Artificial Sequence
  Synthetic oligonucleotide; GAG chr11 5328612 5328631 5328615 -
gggagatcaaggggtctcct

SEQ ID NO: 37039 - DNA, 20 bp, Artificial Sequence
  Synthetic oligonucleotide; TAG chr11 5328605 5328624 5328608 -
caaggggtctcctgagatgc

SEQ ID NO: 37040 - DNA, 20 bp, Artificial Sequence
  Synthetic oligonucleotide; AAG chr11 5328601 5328620 5328604 -
gggtctcctgagatgctaga

SEQ ID NO: 37041 - DNA, 20 bp, Artificial Sequence
  Synthetic oligonucleotide; CAG chr11 5328590 5328609 5328593 -
gatgctagaaagatgaaact

SEQ ID NO: 37042 - DNA, 20 bp, Artificial Sequence
  Synthetic oligonucleotide; AGG chr11 5328589 5328608 5328592 -
atgctagaaagatgaaactc

SEQ ID NO: 37043 - DNA, 20 bp, Artificial Sequence
  Synthetic oligonucleotide; GGG chr11 5328588 5328607 5328591 -
tgctagaaagatgaaactca

SEQ ID NO: 37044 - DNA, 20 bp, Artificial Sequence
  Synthetic oligonucleotide; GGG chr11 5328587 5328606 5328590 -
gctagaaagatgaaactcag

SEQ ID NO: 37045 - DNA, 20 bp, Artificial Sequence
  Synthetic oligonucleotide; GAG chr11 5328585 5328604 5328588 -
tagaaagatgaaactcaggg

SEQ ID NO: 37046 - DNA, 20 bp, Artificial Sequence
  Synthetic oligonucleotide; AGG chr11 5328584 5328603 5328587 -
agaaagatgaaactcagggg

SEQ ID NO: 37047 - DNA, 20 bp, Artificial Sequence
  Synthetic oligonucleotide; AAG chr11 5328565 5328584 5328568 -
gaggtgatttccacatgcat

SEQ ID NO: 37048 - DNA, 20 bp, Artificial Sequence
  Synthetic oligonucleotide; GAG chr11 5328553 5328572 5328556 -
acatgcataagctttaaaat

SEQ ID NO: 37049 - DNA, 20 bp, Artificial Sequence
  Synthetic oligonucleotide; AGG chr11 5328552 5328571 5328555 -
catgcataagctttaaaatg

SEQ ID NO: 37050 - DNA, 20 bp, Artificial Sequence
  Synthetic oligonucleotide; GAG chr11 5328543 5328562 5328546 -
gctttaaaatgaggcctcat

SEQ ID NO: 37051 - DNA, 20 bp, Artificial Sequence
  Synthetic oligonucleotide; GAG chr11 5328541 5328560 5328544 -
tttaaaatgaggcctcatga

SEQ ID NO: 37052 - DNA, 20 bp, Artificial Sequence
  Synthetic oligonucleotide; AGG chr11 5328540 5328559 5328543 -
ttaaaatgaggcctcatgag

SEQ ID NO: 37053 - DNA, 20 bp, Artificial Sequence
  Synthetic oligonucleotide; GAG chr11 5328532 5328551 5328535 -
aggcctcatgagaggtctgt

SEQ ID NO: 37054 - DNA, 20 bp, Artificial Sequence
  Synthetic oligonucleotide; GAG chr11 5328514 5328533 5328517 -
gtgagtgaatgatctgaact

SEQ ID NO: 37055 - DNA, 20 bp, Artificial Sequence
  Synthetic oligonucleotide; AAG chr11 5328505 5328524 5328508 -
tgatctgaactgagtcctca

SEQ ID NO: 37056 - DNA, 20 bp, Artificial Sequence
  Synthetic oligonucleotide; GAG chr11 5328503 5328522 5328506 -
atctgaactgagtcctcaaa

SEQ ID NO: 37057 - DNA, 20 bp, Artificial Sequence
  Synthetic oligonucleotide; AGG chr11 5328502 5328521 5328505 -
tctgaactgagtcctcaaag

SEQ ID NO: 37058 - DNA, 20 bp, Artificial Sequence
  Synthetic oligonucleotide; CAG chr11 5328498 5328517 5328501 -
aactgagtcctcaaagagga

SEQ ID NO: 37059 - DNA, 20 bp, Artificial Sequence
  Synthetic oligonucleotide; AGG chr11 5328497 5328516 5328500 -
actgagtcctcaaagaggac

SEQ ID NO: 37060 - DNA, 20 bp, Artificial Sequence
  Synthetic oligonucleotide; TAG chr11 5328492 5328511 5328495 -
gtcctcaaagaggacaggaa

SEQ ID NO: 37061 - DNA, 20 bp, Artificial Sequence
  Synthetic oligonucleotide; AGG chr11 5328491 5328510 5328494 -
tcctcaaagaggacaggaat

SEQ ID NO: 37062 - DNA, 20 bp, Artificial Sequence
  Synthetic oligonucleotide; TAG chr11 5328479 5328498 5328482 -
acaggaataggttcctattt

SEQ ID NO: 37063 - DNA, 20 bp, Artificial Sequence
  Synthetic oligonucleotide; GAG chr11 5328464 5328483 5328467 -
tattttagccacaatactgt

SEQ ID NO: 37064 - DNA, 20 bp, Artificial Sequence
  Synthetic oligonucleotide; TGG chr11 5328461 5328480 5328464 -
tttagccacaatactgtgag

SEQ ID NO: 37065 - DNA, 20 bp, Artificial Sequence
  Synthetic oligonucleotide; GGG chr11 5328460 5328479 5328463 -
ttagccacaatactgtgagt

SEQ ID NO: 37066 - DNA, 20 bp, Artificial Sequence
  Synthetic oligonucleotide; GAG chr11 5328456 5328475 5328459 -
ccacaatactgtgagtgggt

SEQ ID NO: 37067 - DNA, 20 bp, Artificial Sequence
  Synthetic oligonucleotide; CAG chr11 5328450 5328469 5328453 -
tactgtgagtgggtgagtgc

SEQ ID NO: 37068 - DNA, 20 bp, Artificial Sequence
  Synthetic oligonucleotide; AGG chr11 5328449 5328468 5328452 -
actgtgagtgggtgagtgcc

SEQ ID NO: 37069 - DNA, 20 bp, Artificial Sequence
  Synthetic oligonucleotide; TGG chr11 5328436 5328455 5328439 -
gagtgccaggaacttgaata

SEQ ID NO: 37070 - DNA, 20 bp, Artificial Sequence
  Synthetic oligonucleotide; GAG chr11 5328409 5328428 5328412 -
attcctctctcttctgatgt

SEQ ID NO: 37071 - DNA, 20 bp, Artificial Sequence
  Synthetic oligonucleotide; AAG chr11 5328398 5328417 5328401 -
ttctgatgtgagatgcactc

SEQ ID NO: 37072 - DNA, 20 bp, Artificial Sequence
  Synthetic oligonucleotide; AGG chr11 5328397 5328416 5328400 -
tctgatgtgagatgcactca

SEQ ID NO: 37073 - DNA, 20 bp, Artificial Sequence
  Synthetic oligonucleotide; AAG chr11 5328393 5328412 5328396 -
atgtgagatgcactcaagga

SEQ ID NO: 37074 - DNA, 20 bp, Artificial Sequence
  Synthetic oligonucleotide; AAG chr11 5328385 5328404 5328388 -
tgcactcaaggaaagcatat

SEQ ID NO: 37075 - DNA, 20 bp, Artificial Sequence
  Synthetic oligonucleotide; AAG chr11 5328382 5328401 5328385 -
actcaaggaaagcatataag

SEQ ID NO: 37076 - DNA, 20 bp, Artificial Sequence
  Synthetic oligonucleotide; AGG chr11 5328381 5328400 5328384 -
ctcaaggaaagcatataaga

SEQ ID NO: 37077 - DNA, 20 bp, Artificial Sequence
  Synthetic oligonucleotide; CAG chr11 5328373 5328392 5328376 -
aagcatataagaaggttttc

SEQ ID NO: 37078 - DNA, 20 bp, Artificial Sequence
  Synthetic oligonucleotide; GAG chr11 5328371 5328390 5328374 -
gcatataagaaggttttcca

SEQ ID NO: 37079 - DNA, 20 bp, Artificial Sequence
  Synthetic oligonucleotide; AGG chr11 5328370 5328389 5328373 -
catataagaaggttttccag

SEQ ID NO: 37080 - DNA, 20 bp, Artificial Sequence
  Synthetic oligonucleotide; TAG chr11 5328361 5328380 5328364 -
aggttttccagaggtctgcc

SEQ ID NO: 37081 - DNA, 20 bp, Artificial Sequence
  Synthetic oligonucleotide; GAG chr11 5328359 5328378 5328362 -
gttttccagaggtctgccta

SEQ ID NO: 37082 - DNA, 20 bp, Artificial Sequence
  Synthetic oligonucleotide; AGG chr11 5328358 5328377 5328361 -
ttttccagaggtctgcctag

SEQ ID NO: 37083 - DNA, 20 bp, Artificial Sequence
  Synthetic oligonucleotide; AAG chr11 5328353 5328372 5328356 -
cagaggtctgcctagaggta

SEQ ID NO: 37084 - DNA, 20 bp, Artificial Sequence
  Synthetic oligonucleotide; CAG chr11 5328346 5328365 5328349 -
ctgcctagaggtaaagatca

SEQ ID NO: 37085 - DNA, 20 bp, Artificial Sequence
  Synthetic oligonucleotide; GAG chr11 5328341 5328360 5328344 -
tagaggtaaagatcacagct

SEQ ID NO: 37086 - DNA, 20 bp, Artificial Sequence
  Synthetic oligonucleotide; AGG chr11 5328340 5328359 5328343 -
agaggtaaagatcacagctg

SEQ ID NO: 37087 - DNA, 20 bp, Artificial Sequence
  Synthetic oligonucleotide; TGG chr11 5328337 5328356 5328340 -
ggtaaagatcacagctgagg

SEQ ID NO: 37088 - DNA, 20 bp, Artificial Sequence
  Synthetic oligonucleotide; GGG chr11 5328336 5328355 5328339 -
gtaaagatcacagctgaggt

SEQ ID NO: 37089 - DNA, 20 bp, Artificial Sequence
  Synthetic oligonucleotide; CAG chr11 5328325 5328344 5328328 -
agctgaggtgggatatccta

SEQ ID NO: 37090 - DNA, 20 bp, Artificial Sequence
  Synthetic oligonucleotide; CAG chr11 5328320 5328339 5328323 -
aggtgggatatcctacagca

SEQ ID NO: 37091 - DNA, 20 bp, Artificial Sequence
  Synthetic oligonucleotide; AAG chr11 5328296 5328315 5328299 -
tttttttttttcttttttga

SEQ ID NO: 37092 - DNA, 20 bp, Artificial Sequence
  Synthetic oligonucleotide; GAG chr11 5328294 5328313 5328297 -
tttttttttcttttttgaaa

SEQ ID NO: 37093 - DNA, 20 bp, Artificial Sequence
  Synthetic oligonucleotide; AAG chr11 5328286 5328305 5328289 -
tcttttttgaaagagtattt

SEQ ID NO: 37094 - DNA, 20 bp, Artificial Sequence
  Synthetic oligonucleotide; AGG chr11 5328285 5328304 5328288 -
cttttttgaaagagtattta

SEQ ID NO: 37095 - DNA, 20 bp, Artificial Sequence
  Synthetic oligonucleotide; TAG chr11 5328274 5328293 5328277 -
gagtatttaaggaactgtga

SEQ ID NO: 37096 - DNA, 20 bp, Artificial Sequence
  Synthetic oligonucleotide; TAG chr11 5328268 5328287 5328271 -
ttaaggaactgtgatagatt

SEQ ID NO: 37097 - DNA, 20 bp, Artificial Sequence
  Synthetic oligonucleotide; AGG chr11 5328267 5328286 5328270 -
taaggaactgtgatagattt

SEQ ID NO: 37098 - DNA, 20 bp, Artificial Sequence
  Synthetic oligonucleotide; TGG chr11 5328254 5328273 5328257 -
tagatttaggttttctaatc

SEQ ID NO: 37099 - DNA, 20 bp, Artificial Sequence
  Synthetic oligonucleotide; GGG chr11 5328253 5328272 5328256 -
agatttaggttttctaatct

SEQ ID NO: 37100 - DNA, 20 bp, Artificial Sequence
  Synthetic oligonucleotide; TGG chr11 5328245 5328264 5328248 -
gttttctaatctgggaccct

SEQ ID NO: 37101 - DNA, 20 bp, Artificial Sequence
  Synthetic oligonucleotide; TGG chr11 5328240 5328259 5328243 -
ctaatctgggacccttggat

SEQ ID NO: 37102 - DNA, 20 bp, Artificial Sequence
  Synthetic oligonucleotide; AAG chr11 5328234 5328253 5328237 -
tgggacccttggattggcat

SEQ ID NO: 37103 - DNA, 20 bp, Artificial Sequence
  Synthetic oligonucleotide; CAG chr11 5328215 5328234 5328218 -
taagtataattgttaatgct

SEQ ID NO: 37104 - DNA, 20 bp, Artificial Sequence
  Synthetic oligonucleotide; TAG chr11 5328171 5328190 5328174 -
ttcttactcatttttctatg

SEQ ID NO: 37105 - DNA, 20 bp, Artificial Sequence
  Synthetic oligonucleotide; TAG chr11 5328161 5328180 5328164 -
tttttctatgtagatgttta

SEQ ID NO: 37106 - DNA, 20 bp, Artificial Sequence
  Synthetic oligonucleotide; CAG chr11 5328149 5328168 5328152 -
gatgtttatagctttttttt

SEQ ID NO: 37107 - DNA, 20 bp, Artificial Sequence
  Synthetic oligonucleotide; GAG chr11 5328147 5328166 5328150 -
tgtttatagcttttttttca

SEQ ID NO: 37108 - DNA, 20 bp, Artificial Sequence
  Synthetic oligonucleotide; CAG chr11 5328124 5328143 5328127 -
aatatttcttcattccaaaa

SEQ ID NO: 37109 - DNA, 20 bp, Artificial Sequence
  Synthetic oligonucleotide; CAG chr11 5328095 5328114 5328098 -
tatcactcacctcctttgtt

SEQ ID NO: 37110 - DNA, 20 bp, Artificial Sequence
  Synthetic oligonucleotide; TGG chr11 5328088 5328107 5328091 -
cacctcctttgttcagttat

SEQ ID NO: 37111 - DNA, 20 bp, Artificial Sequence
  Synthetic oligonucleotide; TAG chr11 5328059 5328078 5328062 -
tattacatttatatttgtaa

SEQ ID NO: 37112 - DNA, 20 bp, Artificial Sequence
  Synthetic oligonucleotide; CAG chr11 5328053 5328072 5328056 -
atttatatttgtaatagttc

SEQ ID NO: 37113 - DNA, 20 bp, Artificial Sequence
  Synthetic oligonucleotide; AAG chr11 5328005 5328024 5328008 -
atacattcatttttgaaaat

SEQ ID NO: 37114 - DNA, 20 bp, Artificial Sequence
  Synthetic oligonucleotide; AAG chr11 5328002 5328021 5328005 -
cattcatttttgaaaataag

SEQ ID NO: 37115 - DNA, 20 bp, Artificial Sequence
  Synthetic oligonucleotide; CAG chr11 5327999 5328018 5328002 -
tcatttttgaaaataagaag

SEQ ID NO: 37116 - DNA, 20 bp, Artificial Sequence
  Synthetic oligonucleotide; AAG chr11 5327995 5328014 5327998 -
ttttgaaaataagaagcaga

SEQ ID NO: 37117 - DNA, 20 bp, Artificial Sequence
  Synthetic oligonucleotide; AGG chr11 5327994 5328013 5327997 -
tttgaaaataagaagcagaa

SEQ ID NO: 37118 - DNA, 20 bp, Artificial Sequence
  Synthetic oligonucleotide; TGG chr11 5327946 5327965 5327949 -
aatgacatgactatctttac

SEQ ID NO: 37119 - DNA, 20 bp, Artificial Sequence
  Synthetic oligonucleotide; TAG chr11 5327925 5327944 5327928 -
ggtgcttttgtcattttatg

SEQ ID NO: 37120 - DNA, 20 bp, Artificial Sequence
  Synthetic oligonucleotide; TGG chr11 5327905 5327924 5327908 -
tagattcaaatgatcatctt

SEQ ID NO: 37121 - DNA, 20 bp, Artificial Sequence
  Synthetic oligonucleotide; TGG chr11 5327897 5327916 5327900 -
aatgatcatctttggtcatt

SEQ ID NO: 37122 - DNA, 20 bp, Artificial Sequence
  Synthetic oligonucleotide; TAG chr11 5327886 5327905 5327889 -
ttggtcatttggtttcaact

SEQ ID NO: 37123 - DNA, 20 bp, Artificial Sequence
  Synthetic oligonucleotide; CAG chr11 5327871 5327890 5327874 -
caacttagttgaaatcaact

SEQ ID NO: 37124 - DNA, 20 bp, Artificial Sequence
  Synthetic oligonucleotide; CAG chr11 5327856 5327875 5327859 -
caactcagtttttgtttatc

SEQ ID NO: 37125 - DNA, 20 bp, Artificial Sequence
  Synthetic oligonucleotide; AAG chr11 5327852 5327871 5327855 -
tcagtttttgtttatccaga

SEQ ID NO: 37126 - DNA, 20 bp, Artificial Sequence
  Synthetic oligonucleotide; AGG chr11 5327851 5327870 5327854 -
cagtttttgtttatccagaa

SEQ ID NO: 37127 - DNA, 20 bp, Artificial Sequence
  Synthetic oligonucleotide; GGG chr11 5327850 5327869 5327853 -
agtttttgtttatccagaaa

SEQ ID NO: 37128 - DNA, 20 bp, Artificial Sequence
  Synthetic oligonucleotide; CAG chr11 5327808 5327827 5327811 -
ttattgataactttcctgtt

SEQ ID NO: 37129 - DNA, 20 bp, Artificial Sequence
  Synthetic oligonucleotide; GAG chr11 5327806 5327825 5327809 -
attgataactttcctgttca

SEQ ID NO: 37130 - DNA, 20 bp, Artificial Sequence
  Synthetic oligonucleotide; AGG chr11 5327805 5327824 5327808 -
ttgataactttcctgttcag

SEQ ID NO: 37131 - DNA, 20 bp, Artificial Sequence
  Synthetic oligonucleotide; TAG chr11 5327790 5327809 5327793 -
ttcagaggattttttgttga

SEQ ID NO: 37132 - DNA, 20 bp, Artificial Sequence
  Synthetic oligonucleotide; AAG chr11 5327777 5327796 5327780 -
ttgttgatagtttttctctg

SEQ ID NO: 37133 - DNA, 20 bp, Artificial Sequence
  Synthetic oligonucleotide; GAG chr11 5327775 5327794 5327778 -
gttgatagtttttctctgaa

SEQ ID NO: 37134 - DNA, 20 bp, Artificial Sequence
  Synthetic oligonucleotide; TAG chr11 5327772 5327791 5327775 -
gatagtttttctctgaagag

SEQ ID NO: 37135 - DNA, 20 bp, Artificial Sequence
  Synthetic oligonucleotide; GAG chr11 5327752 5327771 5327755 -
tagacaaaaaattctgaatc

SEQ ID NO: 37136 - DNA, 20 bp, Artificial Sequence
  Synthetic oligonucleotide; AAG chr11 5327745 5327764 5327748 -
aaaattctgaatcgagttga

SEQ ID NO: 37137 - DNA, 20 bp, Artificial Sequence
  Synthetic oligonucleotide; AGG chr11 5327744 5327763 5327747 -
aaattctgaatcgagttgaa

SEQ ID NO: 37138 - DNA, 20 bp, Artificial Sequence
  Synthetic oligonucleotide; TAG chr11 5327739 5327758 5327742 -
ctgaatcgagttgaaaggct

SEQ ID NO: 37139 - DNA, 20 bp, Artificial Sequence
  Synthetic oligonucleotide; AAG chr11 5327734 5327753 5327737 -
tcgagttgaaaggcttagaa

SEQ ID NO: 37140 - DNA, 20 bp, Artificial Sequence
  Synthetic oligonucleotide; AGG chr11 5327733 5327752 5327736 -
cgagttgaaaggcttagaaa

SEQ ID NO: 37141 - DNA, 20 bp, Artificial Sequence
  Synthetic oligonucleotide; GGG chr11 5327732 5327751 5327735 -
gagttgaaaggcttagaaaa

SEQ ID NO: 37142 - DNA, 20 bp, Artificial Sequence
  Synthetic oligonucleotide; CAG chr11 5327729 5327748 5327732 -
ttgaaaggcttagaaaaggg

SEQ ID NO: 37143 - DNA, 20 bp, Artificial Sequence
  Synthetic oligonucleotide; AAG chr11 5327719 5327738 5327722 -
tagaaaagggcagccaaatt

SEQ ID NO: 37144 - DNA, 20 bp, Artificial Sequence
  Synthetic oligonucleotide; AAG chr11 5327712 5327731 5327715 -
gggcagccaaattaagatct

SEQ ID NO: 37145 - DNA, 20 bp, Artificial Sequence
  Synthetic oligonucleotide; AAG chr11 5327708 5327727 5327711 -
agccaaattaagatctaaga

SEQ ID NO: 37146 - DNA, 20 bp, Artificial Sequence
  Synthetic oligonucleotide; TGG chr11 5327700 5327719 5327703 -
taagatctaagaaagcaaat

SEQ ID NO: 37147 - DNA, 20 bp, Artificial Sequence
  Synthetic oligonucleotide; TGG chr11 5327675 5327694 5327678 -
tgaaaatgaaatcatattga

SEQ ID NO: 37148 - DNA, 20 bp, Artificial Sequence
  Synthetic oligonucleotide; CAG chr11 5327672 5327691 5327675 -
aaatgaaatcatattgatgg

SEQ ID NO: 37149 - DNA, 20 bp, Artificial Sequence
  Synthetic oligonucleotide; TGG chr11 5327657 5327676 5327660 -
gatggcagatgataatatat

SEQ ID NO: 37150 - DNA, 20 bp, Artificial Sequence
  Synthetic oligonucleotide; TGG chr11 5327652 5327671 5327655 -
cagatgataatatattggac

SEQ ID NO: 37151 - DNA, 20 bp, Artificial Sequence
  Synthetic oligonucleotide; GGG chr11 5327651 5327670 5327654 -
agatgataatatattggact

SEQ ID NO: 37152 - DNA, 20 bp, Artificial Sequence
  Synthetic oligonucleotide; TGG chr11 5327647 5327666 5327650 -
gataatatattggactgggt

SEQ ID NO: 37153 - DNA, 20 bp, Artificial Sequence
  Synthetic oligonucleotide; GAG chr11 5327645 5327664 5327648 -
taatatattggactgggttg

SEQ ID NO: 37154 - DNA, 20 bp, Artificial Sequence
  Synthetic oligonucleotide; AAG chr11 5327642 5327661 5327645 -
tatattggactgggttggag

SEQ ID NO: 37155 - DNA, 20 bp, Artificial Sequence
  Synthetic oligonucleotide; AGG chr11 5327641 5327660 5327644 -
atattggactgggttggaga

SEQ ID NO: 37156 - DNA, 20 bp, Artificial Sequence
  Synthetic oligonucleotide; CAG chr11 5327638 5327657 5327641 -
ttggactgggttggagaagg

SEQ ID NO: 37157 - DNA, 20 bp, Artificial Sequence
  Synthetic oligonucleotide; AGG chr11 5327637 5327656 5327640 -
tggactgggttggagaaggc

SEQ ID NO: 37158 - DNA, 20 bp, Artificial Sequence
  Synthetic oligonucleotide; GAG chr11 5327635 5327654 5327638 -
gactgggttggagaaggcag

SEQ ID NO: 37159 - DNA, 20 bp, Artificial Sequence
  Synthetic oligonucleotide; AGG chr11 5327634 5327653 5327637 -
actgggttggagaaggcagg

SEQ ID NO: 37160 - DNA, 20 bp, Artificial Sequence
  Synthetic oligonucleotide; TGG chr11 5327620 5327639 5327623 -
ggcaggaggaatttaacttg

SEQ ID NO: 37161 - DNA, 20 bp, Artificial Sequence
  Synthetic oligonucleotide; TAG chr11 5327613 5327632 5327616 -
ggaatttaacttgtggacaa

SEQ ID NO: 37162 - DNA, 20 bp, Artificial Sequence
  Synthetic oligonucleotide; GAG chr11 5327604 5327623 5327607 -
cttgtggacaatagaaatct

SEQ ID NO: 37163 - DNA, 20 bp, Artificial Sequence
  Synthetic oligonucleotide; GAG chr11 5327602 5327621 5327605 -
tgtggacaatagaaatctga

SEQ ID NO: 37164 - DNA, 20 bp, Artificial Sequence
  Synthetic oligonucleotide; TGG chr11 5327598 5327617 5327601 -
gacaatagaaatctgagagt

SEQ ID NO: 37165 - DNA, 20 bp, Artificial Sequence
  Synthetic oligonucleotide; GGG chr11 5327597 5327616 5327600 -
acaatagaaatctgagagtt

SEQ ID NO: 37166 - DNA, 20 bp, Artificial Sequence
  Synthetic oligonucleotide; TAG chr11 5327594 5327613 5327597 -
atagaaatctgagagttggg

SEQ ID NO: 37167 - DNA, 20 bp, Artificial Sequence
  Synthetic oligonucleotide; CAG chr11 5327581 5327600 5327584 -
agttgggtagtcccaactgt

SEQ ID NO: 37168 - DNA, 20 bp, Artificial Sequence
  Synthetic oligonucleotide; AGG chr11 5327580 5327599 5327583 -
gttgggtagtcccaactgtc

SEQ ID NO: 37169 - DNA, 20 bp, Artificial Sequence
  Synthetic oligonucleotide; CAG chr11 5327573 5327592 5327576 -
agtcccaactgtcaggccct

SEQ ID NO: 37170 - DNA, 20 bp, Artificial Sequence
  Synthetic oligonucleotide; AGG chr11 5327572 5327591 5327575 -
gtcccaactgtcaggccctc

SEQ ID NO: 37171 - DNA, 20 bp, Artificial Sequence
  Synthetic oligonucleotide; TGG chr11 5327567 5327586 5327570 -
aactgtcaggccctcaggac

SEQ ID NO: 37172 - DNA, 20 bp, Artificial Sequence
  Synthetic oligonucleotide; GGG chr11 5327566 5327585 5327569 -
actgtcaggccctcaggact

SEQ ID NO: 37173 - DNA, 20 bp, Artificial Sequence
  Synthetic oligonucleotide; GGG chr11 5327565 5327584 5327568 -
ctgtcaggccctcaggactg

SEQ ID NO: 37174 - DNA, 20 bp, Artificial Sequence
  Synthetic oligonucleotide; TGG chr11 5327557 5327576 5327560 -
ccctcaggactggggccaaa

SEQ ID NO: 37175 - DNA, 20 bp, Artificial Sequence
  Synthetic oligonucleotide; GAG chr11 5327555 5327574 5327558 -
ctcaggactggggccaaatg

SEQ ID NO: 37176 - DNA, 20 bp, Artificial Sequence
  Synthetic oligonucleotide; AGG chr11 5327554 5327573 5327557 -
tcaggactggggccaaatgg

SEQ ID NO: 37177 - DNA, 20 bp, Artificial Sequence
  Synthetic oligonucleotide; AAG chr11 5327538 5327557 5327541 -
atggaggactcacttttttg

SEQ ID NO: 37178 - DNA, 20 bp, Artificial Sequence
  Synthetic oligonucleotide; AAG chr11 5327531 5327550 5327534 -
actcacttttttgaagatta

SEQ ID NO: 37179 - DNA, 20 bp, Artificial Sequence
  Synthetic oligonucleotide; GAG chr11 5327519 5327538 5327522 -
gaagattaaagacaatgcgt

SEQ ID NO: 37180 - DNA, 20 bp, Artificial Sequence
  Synthetic oligonucleotide; GAG chr11 5327517 5327536 5327520 -
agattaaagacaatgcgtga

SEQ ID NO: 37181 - DNA, 20 bp, Artificial Sequence
  Synthetic oligonucleotide; CGG chr11 5327512 5327531 5327515 -
aaagacaatgcgtgagagca

SEQ ID NO: 37182 - DNA, 20 bp, Artificial Sequence
  Synthetic oligonucleotide; GAG chr11 5327510 5327529 5327513 -
agacaatgcgtgagagcacg

SEQ ID NO: 37183 - DNA, 20 bp, Artificial Sequence
  Synthetic oligonucleotide; CAG chr11 5327494 5327513 5327497 -
cacggagttctgaacctaaa

SEQ ID NO: 37184 - DNA, 20 bp, Artificial Sequence
  Synthetic oligonucleotide; AGG chr11 5327493 5327512 5327496 -
acggagttctgaacctaaac

SEQ ID NO: 37185 - DNA, 20 bp, Artificial Sequence
  Synthetic oligonucleotide; GAG chr11 5327488 5327507 5327491 -
gttctgaacctaaacaggct

SEQ ID NO: 37186 - DNA, 20 bp, Artificial Sequence
  Synthetic oligonucleotide; AAG chr11 5327470 5327489 5327473 -
ctgagcttctgcactctgct

SEQ ID NO: 37187 - DNA, 20 bp, Artificial Sequence
  Synthetic oligonucleotide; TAG chr11 5327454 5327473 5327457 -
tgctaagatcctgaaattta

SEQ ID NO: 37188 - DNA, 20 bp, Artificial Sequence
  Synthetic oligonucleotide; AAG chr11 5327450 5327469 5327453 -
aagatcctgaaatttataga

SEQ ID NO: 37189 - DNA, 20 bp, Artificial Sequence
  Synthetic oligonucleotide; AAG chr11 5327445 5327464 5327448 -
cctgaaatttatagaaagaa

SEQ ID NO: 37190 - DNA, 20 bp, Artificial Sequence
  Synthetic oligonucleotide; AAG chr11 5327410 5327429 5327413 -
catataacaatttaatttat

SEQ ID NO: 37191 - DNA, 20 bp, Artificial Sequence
  Synthetic oligonucleotide; AAG chr11 5327351 5327370 5327354 -
tgtgtctgtgtgtttgtttg

SEQ ID NO: 37192 - DNA, 20 bp, Artificial Sequence
  Synthetic oligonucleotide; AAG chr11 5327339 5327358 5327342 -
tttgtttgaagaactgctct

SEQ ID NO: 37193 - DNA, 20 bp, Artificial Sequence
  Synthetic oligonucleotide; GAG chr11 5327337 5327356 5327340 -
tgtttgaagaactgctctaa

SEQ ID NO: 37194 - DNA, 20 bp, Artificial Sequence
  Synthetic oligonucleotide; TGG chr11 5327333 5327352 5327336 -
tgaagaactgctctaagaga

SEQ ID NO: 37195 - DNA, 20 bp, Artificial Sequence
  Synthetic oligonucleotide; GAG chr11 5327327 5327346 5327330 -
actgctctaagagatggcat

SEQ ID NO: 37196 - DNA, 20 bp, Artificial Sequence
  Synthetic oligonucleotide; TAG chr11 5327324 5327343 5327327 -
gctctaagagatggcatgag

SEQ ID NO: 37197 - DNA, 20 bp, Artificial Sequence
  Synthetic oligonucleotide; CAG chr11 5327320 5327339 5327323 -
taagagatggcatgagtagt

SEQ ID NO: 37198 - DNA, 20 bp, Artificial Sequence
  Synthetic oligonucleotide; TGG chr11 5327317 5327336 5327320 -
gagatggcatgagtagtcag

SEQ ID NO: 37199 - DNA, 20 bp, Artificial Sequence
  Synthetic oligonucleotide; GGG chr11 5327316 5327335 5327319 -
agatggcatgagtagtcagt

SEQ ID NO: 37200 - DNA, 20 bp, Artificial Sequence
  Synthetic oligonucleotide; TAG chr11 5327307 5327326 5327310 -
gagtagtcagtgggactcac

SEQ ID NO: 37201 - DNA, 20 bp, Artificial Sequence
  Synthetic oligonucleotide; TAG chr11 5327296 5327315 5327299 -
gggactcactagaaaaattc

SEQ ID NO: 37202 - DNA, 20 bp, Artificial Sequence
  Synthetic oligonucleotide; GAG chr11 5327294 5327313 5327297 -
gactcactagaaaaattcta

SEQ ID NO: 37203 - DNA, 20 bp, Artificial Sequence
  Synthetic oligonucleotide; CAG chr11 5327290 5327309 5327293 -
cactagaaaaattctagaga

SEQ ID NO: 37204 - DNA, 20 bp, Artificial Sequence
  Synthetic oligonucleotide; AGG chr11 5327289 5327308 5327292 -
actagaaaaattctagagac

SEQ ID NO: 37205 - DNA, 20 bp, Artificial Sequence
  Synthetic oligonucleotide; GGG chr11 5327288 5327307 5327291 -
ctagaaaaattctagagaca

SEQ ID NO: 37206 - DNA, 20 bp, Artificial Sequence
  Synthetic oligonucleotide; TAG chr11 5327275 5327294 5327278 -
agagacagggcccatctcct

SEQ ID NO: 37207 - DNA, 20 bp, Artificial Sequence
  Synthetic oligonucleotide; AGG chr11 5327274 5327293 5327277 -
gagacagggcccatctcctt

SEQ ID NO: 37208 - DNA, 20 bp, Artificial Sequence
  Synthetic oligonucleotide; AAG chr11 5327271 5327290 5327274 -
acagggcccatctccttagg

SEQ ID NO: 37209 - DNA, 20 bp, Artificial Sequence
  Synthetic oligonucleotide; AGG chr11 5327270 5327289 5327273 -
cagggcccatctccttagga

SEQ ID NO: 37210 - DNA, 20 bp, Artificial Sequence
  Synthetic oligonucleotide; CGG chr11 5327265 5327284 5327268 -
cccatctccttaggaaggtg

SEQ ID NO: 37211 - DNA, 20 bp, Artificial Sequence
  Synthetic oligonucleotide; GGG chr11 5327264 5327283 5327267 -
ccatctccttaggaaggtgc

SEQ ID NO: 37212 - DNA, 20 bp, Artificial Sequence
  Synthetic oligonucleotide; GGG chr11 5327263 5327282 5327266 -
catctccttaggaaggtgcg

SEQ ID NO: 37213 - DNA, 20 bp, Artificial Sequence
  Synthetic oligonucleotide; CAG chr11 5327241 5327260 5327244 -
gacacatcttccatccaact

SEQ ID NO: 37214 - DNA, 20 bp, Artificial Sequence
  Synthetic oligonucleotide; AAG chr11 5327238 5327257 5327241 -
acatcttccatccaactcag

SEQ ID NO: 37215 - DNA, 20 bp, Artificial Sequence
  Synthetic oligonucleotide; AGG chr11 5327237 5327256 5327240 -
catcttccatccaactcaga

SEQ ID NO: 37216 - DNA, 20 bp, Artificial Sequence
  Synthetic oligonucleotide; GAG chr11 5327235 5327254 5327238 -
tcttccatccaactcagaag

SEQ ID NO: 37217 - DNA, 20 bp, Artificial Sequence
  Synthetic oligonucleotide; AGG chr11 5327234 5327253 5327237 -
cttccatccaactcagaagg

SEQ ID NO: 37218 - DNA, 20 bp, Artificial Sequence
  Synthetic oligonucleotide; GGG chr11 5327233 5327252 5327236 -
ttccatccaactcagaagga

SEQ ID NO: 37219 - DNA, 20 bp, Artificial Sequence
  Synthetic oligonucleotide; CAG chr11 5327230 5327249 5327233 -
catccaactcagaaggaggg

SEQ ID NO: 37220 - DNA, 20 bp, Artificial Sequence
  Synthetic oligonucleotide; GAG chr11 5327228 5327247 5327231 -
tccaactcagaaggagggca

SEQ ID NO: 37221 - DNA, 20 bp, Artificial Sequence
  Synthetic oligonucleotide; TAG chr11 5327225 5327244 5327228 -
aactcagaaggagggcagag

SEQ ID NO: 37222 - DNA, 20 bp, Artificial Sequence
  Synthetic oligonucleotide; AGG chr11 5327224 5327243 5327227 -
actcagaaggagggcagagt

SEQ ID NO: 37223 - DNA, 20 bp, Artificial Sequence
  Synthetic oligonucleotide; GAG chr11 5327217 5327236 5327220 -
aggagggcagagtaggaaat

SEQ ID NO: 37224 - DNA, 20 bp, Artificial Sequence
  Synthetic oligonucleotide; AAG chr11 5327214 5327233 5327217 -
agggcagagtaggaaatgag

SEQ ID NO: 37225 - DNA, 20 bp, Artificial Sequence
  Synthetic oligonucleotide; GAG chr11 5327209 5327228 5327212 -
agagtaggaaatgagaagat

SEQ ID NO: 37226 - DNA, 20 bp, Artificial Sequence
  Synthetic oligonucleotide; AGG chr11 5327208 5327227 5327211 -
gagtaggaaatgagaagatg

SEQ ID NO: 37227 - DNA, 20 bp, Artificial Sequence
  Synthetic oligonucleotide; GGG chr11 5327207 5327226 5327210 -
agtaggaaatgagaagatga

SEQ ID NO: 37228 - DNA, 20 bp, Artificial Sequence
  Synthetic oligonucleotide; AAG chr11 5327203 5327222 5327206 -
ggaaatgagaagatgaggga

SEQ ID NO: 37229 - DNA, 20 bp, Artificial Sequence
  Synthetic oligonucleotide; AGG chr11 5327202 5327221 5327205 -
gaaatgagaagatgagggaa

SEQ ID NO: 37230 - DNA, 20 bp, Artificial Sequence
  Synthetic oligonucleotide; GAG chr11 5327200 5327219 5327203 -
aatgagaagatgagggaaag

SEQ ID NO: 37231 - DNA, 20 bp, Artificial Sequence
  Synthetic oligonucleotide; AGG chr11 5327199 5327218 5327202 -
atgagaagatgagggaaagg

SEQ ID NO: 37232 - DNA, 20 bp, Artificial Sequence
  Synthetic oligonucleotide; TAG chr11 5327164 5327183 5327167 -
tcctctttcacttgtttatg

SEQ ID NO: 37233 - DNA, 20 bp, Artificial Sequence
  Synthetic oligonucleotide; TAG chr11 5327152 5327171 5327155 -
tgtttatgtagactgtataa

SEQ ID NO: 37234 - DNA, 20 bp, Artificial Sequence
  Synthetic oligonucleotide; GAG chr11 5327125 5327144 5327128 -
actatttactacattttctt

SEQ ID NO: 37235 - DNA, 20 bp, Artificial Sequence
  Synthetic oligonucleotide; AGG chr11 5327124 5327143 5327127 -
ctatttactacattttcttg

SEQ ID NO: 37236 - DNA, 20 bp, Artificial Sequence
  Synthetic oligonucleotide; CAG chr11 5327117 5327136 5327120 -
ctacattttcttgaggctaa

SEQ ID NO: 37237 - DNA, 20 bp, Artificial Sequence
  Synthetic oligonucleotide; AAG chr11 5327082 5327101 5327085 -
tgttccttcttcatactaca

SEQ ID NO: 37238 - DNA, 20 bp, Artificial Sequence
  Synthetic oligonucleotide; TGG chr11 5327049 5327068 5327052 -
ctcctttactcccttgtatc

SEQ ID NO: 37239 - DNA, 20 bp, Artificial Sequence
  Synthetic oligonucleotide; AAG chr11 5327024 5327043 5327027 -
acattcaaattatgttctca

SEQ ID NO: 37240 - DNA, 20 bp, Artificial Sequence
  Synthetic oligonucleotide; GAG chr11 5327020 5327039 5327023 -
tcaaattatgttctcaaagt

SEQ ID NO: 37241 - DNA, 20 bp, Artificial Sequence
  Synthetic oligonucleotide; TGG chr11 5326999 5327018 5327002 -
agcatgacaacttttttcca

SEQ ID NO: 37242 - DNA, 20 bp, Artificial Sequence
  Synthetic oligonucleotide; TGG chr11 5326974 5326993 5326977 -
ctgtatgtatttatgcatct

SEQ ID NO: 37243 - DNA, 20 bp, Artificial Sequence
  Synthetic oligonucleotide; GAG chr11 5326970 5326989 5326973 -
atgtatttatgcatcttggt

SEQ ID NO: 37244 - DNA, 20 bp, Artificial Sequence
  Synthetic oligonucleotide; GAG chr11 5326968 5326987 5326971 -
gtatttatgcatcttggtga

SEQ ID NO: 37245 - DNA, 20 bp, Artificial Sequence
  Synthetic oligonucleotide; AAG chr11 5326956 5326975 5326959 -
cttggtgagagtgttgctac

SEQ ID NO: 37246 - DNA, 20 bp, Artificial Sequence
  Synthetic oligonucleotide; TAG chr11 5326951 5326970 5326954 -
tgagagtgttgctacaagta

SEQ ID NO: 37247 - DNA, 20 bp, Artificial Sequence
  Synthetic oligonucleotide; AGG chr11 5326950 5326969 5326953 -
gagagtgttgctacaagtat

SEQ ID NO: 37248 - DNA, 20 bp, Artificial Sequence
  Synthetic oligonucleotide; TAG chr11 5326934 5326953 5326937 -
gtataggaatcttattcatc

SEQ ID NO: 37249 - DNA, 20 bp, Artificial Sequence
  Synthetic oligonucleotide; CAG chr11 5326909 5326928 5326912 -
atatatcatcatgtgaaatt

SEQ ID NO: 37250 - DNA, 20 bp, Artificial Sequence
  Synthetic oligonucleotide; AGG chr11 5326908 5326927 5326911 -
tatatcatcatgtgaaattc

SEQ ID NO: 37251 - DNA, 20 bp, Artificial Sequence
  Synthetic oligonucleotide; TAG chr11 5326901 5326920 5326904 -
tcatgtgaaattcaggtcaa

SEQ ID NO: 37252 - DNA, 20 bp, Artificial Sequence
  Synthetic oligonucleotide; TAG chr11 5326892 5326911 5326895 -
attcaggtcaatagaacatc

SEQ ID NO: 37253 - DNA, 20 bp, Artificial Sequence
  Synthetic oligonucleotide; AAG chr11 5326885 5326904 5326888 -
tcaatagaacatctagaatg

SEQ ID NO: 37254 - DNA, 20 bp, Artificial Sequence
  Synthetic oligonucleotide; TAG chr11 5326881 5326900 5326884 -
tagaacatctagaatgaagc

SEQ ID NO: 37255 - DNA, 20 bp, Artificial Sequence
  Synthetic oligonucleotide; AAG chr11 5326874 5326893 5326877 -
tctagaatgaagctagaatg

SEQ ID NO: 37256 - DNA, 20 bp, Artificial Sequence
  Synthetic oligonucleotide; CAG chr11 5326871 5326890 5326874 -
agaatgaagctagaatgaag

SEQ ID NO: 37257 - DNA, 20 bp, Artificial Sequence
  Synthetic oligonucleotide; AGG chr11 5326870 5326889 5326873 -
gaatgaagctagaatgaagc

SEQ ID NO: 37258 - DNA, 20 bp, Artificial Sequence
  Synthetic oligonucleotide; GGG chr11 5326869 5326888 5326872 -
aatgaagctagaatgaagca

SEQ ID NO: 37259 - DNA, 20 bp, Artificial Sequence
  Synthetic oligonucleotide; TAG chr11 5326864 5326883 5326867 -
agctagaatgaagcagggct

SEQ ID NO: 37260 - DNA, 20 bp, Artificial Sequence
  Synthetic oligonucleotide; AAG chr11 5326845 5326864 5326848 -
ttagatctatgatttttctc

SEQ ID NO: 37261 - DNA, 20 bp, Artificial Sequence
  Synthetic oligonucleotide; CAG chr11 5326838 5326857 5326841 -
tatgatttttctcaagtttt

SEQ ID NO: 37262 - DNA, 20 bp, Artificial Sequence
  Synthetic oligonucleotide; TGG chr11 5326830 5326849 5326833 -
ttctcaagttttcagcatta

SEQ ID NO: 37263 - DNA, 20 bp, Artificial Sequence
  Synthetic oligonucleotide; GAG chr11 5326819 5326838 5326822 -
tcagcattatggatcctgtt

SEQ ID NO: 37264 - DNA, 20 bp, Artificial Sequence
  Synthetic oligonucleotide; AAG chr11 5326810 5326829 5326813 -
tggatcctgttgagacattc

SEQ ID NO: 37265 - DNA, 20 bp, Artificial Sequence
  Synthetic oligonucleotide; AGG chr11 5326809 5326828 5326812 -
ggatcctgttgagacattca

SEQ ID NO: 37266 - DNA, 20 bp, Artificial Sequence
  Synthetic oligonucleotide; GGG chr11 5326808 5326827 5326811 -
gatcctgttgagacattcaa

SEQ ID NO: 37267 - DNA, 20 bp, Artificial Sequence
  Synthetic oligonucleotide; AAG chr11 5326785 5326804 5326788 -
caatattctgcataaaattg

SEQ ID NO: 37268 - DNA, 20 bp, Artificial Sequence
  Synthetic oligonucleotide; AGG chr11 5326784 5326803 5326787 -
aatattctgcataaaattga

SEQ ID NO: 37269 - DNA, 20 bp, Artificial Sequence
  Synthetic oligonucleotide; GGG chr11 5326783 5326802 5326786 -
atattctgcataaaattgaa

SEQ ID NO: 37270 - DNA, 20 bp, Artificial Sequence
  Synthetic oligonucleotide; GAG chr11 5326781 5326800 5326784 -
attctgcataaaattgaagg

SEQ ID NO: 37271 - DNA, 20 bp, Artificial Sequence
  Synthetic oligonucleotide; AAG chr11 5326772 5326791 5326775 -
aaaattgaagggagaatatt

SEQ ID NO: 37272 - DNA, 20 bp, Artificial Sequence
  Synthetic oligonucleotide; TAG chr11 5326753 5326772 5326756 -
taagcactattataaactca

SEQ ID NO: 37273 - DNA, 20 bp, Artificial Sequence
  Synthetic oligonucleotide; AGG chr11 5326752 5326771 5326755 -
aagcactattataaactcat

SEQ ID NO: 37274 - DNA, 20 bp, Artificial Sequence
  Synthetic oligonucleotide; GAG chr11 5326742 5326761 5326745 -
ataaactcataggccatatt

SEQ ID NO: 37275 - DNA, 20 bp, Artificial Sequence
  Synthetic oligonucleotide; GAG chr11 5326740 5326759 5326743 -
aaactcataggccatattga

SEQ ID NO: 37276 - DNA, 20 bp, Artificial Sequence
  Synthetic oligonucleotide; AAG chr11 5326731 5326750 5326734 -
ggccatattgagagcttctt

SEQ ID NO: 37277 - DNA, 20 bp, Artificial Sequence
  Synthetic oligonucleotide; GAG chr11 5326729 5326748 5326732 -
ccatattgagagcttcttaa

SEQ ID NO: 37278 - DNA, 20 bp, Artificial Sequence
  Synthetic oligonucleotide; CAG chr11 5326726 5326745 5326729 -
tattgagagcttcttaagag

SEQ ID NO: 37279 - DNA, 20 bp, Artificial Sequence
  Synthetic oligonucleotide; TGG chr11 5326708 5326727 5326711 -
agcagactgtgcttattaca

SEQ ID NO: 37280 - DNA, 20 bp, Artificial Sequence
  Synthetic oligonucleotide; TAG chr11 5326700 5326719 5326703 -
gtgcttattacatggttatt

SEQ ID NO: 37281 - DNA, 20 bp, Artificial Sequence
  Synthetic oligonucleotide; CAG chr11 5326688 5326707 5326691 -
tggttatttagaactaaaca

SEQ ID NO: 37282 - DNA, 20 bp, Artificial Sequence
  Synthetic oligonucleotide; CAG chr11 5326683 5326702 5326686 -
atttagaactaaacacagtg

SEQ ID NO: 37283 - DNA, 20 bp, Artificial Sequence
  Synthetic oligonucleotide; TGG chr11 5326675 5326694 5326678 -
ctaaacacagtgcagttgtg

SEQ ID NO: 37284 - DNA, 20 bp, Artificial Sequence
  Synthetic oligonucleotide; TAG chr11 5326640 5326659 5326643 -
aattctgtgctgactcaaaa

SEQ ID NO: 37285 - DNA, 20 bp, Artificial Sequence
  Synthetic oligonucleotide; CAG chr11 5326619 5326638 5326622 -
agtcattttccaacttgtcc

SEQ ID NO: 37286 - DNA, 20 bp, Artificial Sequence
  Synthetic oligonucleotide; TGG chr11 5326615 5326634 5326618 -
attttccaacttgtcccaga

SEQ ID NO: 37287 - DNA, 20 bp, Artificial Sequence
  Synthetic oligonucleotide; TGG chr11 5326609 5326628 5326612 -
caacttgtcccagatggtat

SEQ ID NO: 37288 - DNA, 20 bp, Artificial Sequence
  Synthetic oligonucleotide; TGG chr11 5326602 5326621 5326605 -
tcccagatggtattggtgaa

SEQ ID NO: 37289 - DNA, 20 bp, Artificial Sequence
  Synthetic oligonucleotide; GAG chr11 5326600 5326619 5326603 -
ccagatggtattggtgaatg

SEQ ID NO: 37290 - DNA, 20 bp, Artificial Sequence
  Synthetic oligonucleotide; CAG chr11 5326591 5326610 5326594 -
attggtgaatggagctccta

SEQ ID NO: 37291 - DNA, 20 bp, Artificial Sequence
  Synthetic oligonucleotide; AGG chr11 5326590 5326609 5326593 -
ttggtgaatggagctcctac

SEQ ID NO: 37292 - DNA, 20 bp, Artificial Sequence
  Synthetic oligonucleotide; CAG chr11 5326560 5326579 5326563 -
tatcttcatatatgatatat

SEQ ID NO: 37293 - DNA, 20 bp, Artificial Sequence
  Synthetic oligonucleotide; AAG chr11 5326554 5326573 5326557 -
catatatgatatatcagttc

SEQ ID NO: 37294 - DNA, 20 bp, Artificial Sequence
  Synthetic oligonucleotide; AGG chr11 5326553 5326572 5326556 -
atatatgatatatcagttca

SEQ ID NO: 37295 - DNA, 20 bp, Artificial Sequence
  Synthetic oligonucleotide; AAG chr11 5326533 5326552 5326536 -
aggaaaaatcatcacacatc

SEQ ID NO: 37296 - DNA, 20 bp, Artificial Sequence
  Synthetic oligonucleotide; CAG chr11 5326529 5326548 5326532 -
aaaatcatcacacatcaagt

SEQ ID NO: 37297 - DNA, 20 bp, Artificial Sequence
  Synthetic oligonucleotide; AGG chr11 5326528 5326547 5326531 -
aaatcatcacacatcaagtc

SEQ ID NO: 37298 - DNA, 20 bp, Artificial Sequence
  Synthetic oligonucleotide; CAG chr11 5326521 5326540 5326524 -
cacacatcaagtcaggaccc

SEQ ID NO: 37299 - DNA, 20 bp, Artificial Sequence
  Synthetic oligonucleotide; TAG chr11 5326513 5326532 5326516 -
aagtcaggaccccagatcct

SEQ ID NO: 37300 - DNA, 20 bp, Artificial Sequence
  Synthetic oligonucleotide; AGG chr11 5326512 5326531 5326515 -
agtcaggaccccagatcctt

SEQ ID NO: 37301 - DNA, 20 bp, Artificial Sequence
  Synthetic oligonucleotide; GAG chr11 5326486 5326505 5326489 -
tcactaaacatttatgttct

SEQ ID NO: 37302 - DNA, 20 bp, Artificial Sequence
  Synthetic oligonucleotide; GAG chr11 5326481 5326500 5326484 -
aaacatttatgttctgagtt

SEQ ID NO: 37303 - DNA, 20 bp, Artificial Sequence
  Synthetic oligonucleotide; GAG chr11 5326479 5326498 5326482 -
acatttatgttctgagttga

SEQ ID NO: 37304 - DNA, 20 bp, Artificial Sequence
  Synthetic oligonucleotide; CAG chr11 5326460 5326479 5326463 -
agagctgcctatcaatttca

SEQ ID NO: 37305 - DNA, 20 bp, Artificial Sequence
  Synthetic oligonucleotide; TAG chr11 5326454 5326473 5326457 -
gcctatcaatttcacagcca

SEQ ID NO: 37306 - DNA, 20 bp, Artificial Sequence
  Synthetic oligonucleotide; CAG chr11 5326435 5326454 5326438 -
atagctgctccacctttatc

SEQ ID NO: 37307 - DNA, 20 bp, Artificial Sequence
  Synthetic oligonucleotide; TAG chr11 5326426 5326445 5326429 -
ccacctttatccagaaaaac

SEQ ID NO: 37308 - DNA, 20 bp, Artificial Sequence
  Synthetic oligonucleotide; TAG chr11 5326411 5326430 5326414 -
aaaactagttcttgtgcttc

SEQ ID NO: 37309 - DNA, 20 bp, Artificial Sequence
  Synthetic oligonucleotide; TAG chr11 5326384 5326403 5326387 -
attttcttaacacttgttaa

SEQ ID NO: 37310 - DNA, 20 bp, Artificial Sequence
  Synthetic oligonucleotide; AAG chr11 5326379 5326398 5326382 -
cttaacacttgttaatagct

SEQ ID NO: 37311 - DNA, 20 bp, Artificial Sequence
  Synthetic oligonucleotide; TGG chr11 5326367 5326386 5326370 -
taatagctaagccatctgaa

SEQ ID NO: 37312 - DNA, 20 bp, Artificial Sequence
  Synthetic oligonucleotide; TAG chr11 5326352 5326371 5326355 -
ctgaatggaattttgccaca

SEQ ID NO: 37313 - DNA, 20 bp, Artificial Sequence
  Synthetic oligonucleotide; CAG chr11 5326347 5326366 5326350 -
tggaattttgccacatagtg

SEQ ID NO: 37314 - DNA, 20 bp, Artificial Sequence
  Synthetic oligonucleotide; TGG chr11 5326341 5326360 5326344 -
tttgccacatagtgcagcct

SEQ ID NO: 37315 - DNA, 20 bp, Artificial Sequence
  Synthetic oligonucleotide; GGG chr11 5326340 5326359 5326343 -
ttgccacatagtgcagcctt

SEQ ID NO: 37316 - DNA, 20 bp, Artificial Sequence
  Synthetic oligonucleotide; GAG chr11 5326338 5326357 5326341 -
gccacatagtgcagccttgg

SEQ ID NO: 37317 - DNA, 20 bp, Artificial Sequence
  Synthetic oligonucleotide; CAG chr11 5326327 5326346 5326330 -
cagccttgggagcatgcata

SEQ ID NO: 37318 - DNA, 20 bp, Artificial Sequence
  Synthetic oligonucleotide; TGG chr11 5326322 5326341 5326325 -
ttgggagcatgcatacagta

SEQ ID NO: 37319 - DNA, 20 bp, Artificial Sequence
  Synthetic oligonucleotide; TGG chr11 5326310 5326329 5326313 -
atacagtatggcttcatctc

SEQ ID NO: 37320 - DNA, 20 bp, Artificial Sequence
  Synthetic oligonucleotide; TAG chr11 5326295 5326314 5326298 -
atctctggtgacactgctta

SEQ ID NO: 37321 - DNA, 20 bp, Artificial Sequence
  Synthetic oligonucleotide; TGG chr11 5326292 5326311 5326295 -
tctggtgacactgcttatag

SEQ ID NO: 37322 - DNA, 20 bp, Artificial Sequence
  Synthetic oligonucleotide; GGG chr11 5326291 5326310 5326294 -
ctggtgacactgcttatagt

SEQ ID NO: 37323 - DNA, 20 bp, Artificial Sequence
  Synthetic oligonucleotide; CAG chr11 5326285 5326304 5326288 -
acactgcttatagtgggcct

SEQ ID NO: 37324 - DNA, 20 bp, Artificial Sequence
  Synthetic oligonucleotide; CAG chr11 5326274 5326293 5326277 -
agtgggcctcagtttgatga

SEQ ID NO: 37325 - DNA, 20 bp, Artificial Sequence
  Synthetic oligonucleotide; TAG chr11 5326267 5326286 5326270 -
ctcagtttgatgacagtatc

SEQ ID NO: 37326 - DNA, 20 bp, Artificial Sequence
  Synthetic oligonucleotide; TAG chr11 5326258 5326277 5326261 -
atgacagtatctagctctcc

SEQ ID NO: 37327 - DNA, 20 bp, Artificial Sequence
  Synthetic oligonucleotide; TGG chr11 5326235 5326254 5326238 -
aatccccacacgcctgcctc

SEQ ID NO: 37328 - DNA, 20 bp, Artificial Sequence
  Synthetic oligonucleotide; GGG chr11 5326234 5326253 5326237 -
atccccacacgcctgcctct

SEQ ID NO: 37329 - DNA, 20 bp, Artificial Sequence
  Synthetic oligonucleotide; CGG chr11 5326221 5326240 5326224 -
tgcctctgggtaaatatcaa

SEQ ID NO: 37330 - DNA, 20 bp, Artificial Sequence
  Synthetic oligonucleotide; CAG chr11 5326213 5326232 5326216 -
ggtaaatatcaacggcttcc

SEQ ID NO: 37331 - DNA, 20 bp, Artificial Sequence
  Synthetic oligonucleotide; TGG chr11 5326207 5326226 5326210 -
tatcaacggcttcccagtgt

SEQ ID NO: 37332 - DNA, 20 bp, Artificial Sequence
  Synthetic oligonucleotide; GGG chr11 5326206 5326225 5326209 -
atcaacggcttcccagtgtt

SEQ ID NO: 37333 - DNA, 20 bp, Artificial Sequence
  Synthetic oligonucleotide; CAG chr11 5326203 5326222 5326206 -
aacggcttcccagtgttggg

SEQ ID NO: 37334 - DNA, 20 bp, Artificial Sequence
  Synthetic oligonucleotide; AGG chr11 5326202 5326221 5326205 -
acggcttcccagtgttgggc

SEQ ID NO: 37335 - DNA, 20 bp, Artificial Sequence
  Synthetic oligonucleotide; CAG chr11 5326166 5326185 5326169 -
tctttttattcccaaaatct

SEQ ID NO: 37336 - DNA, 20 bp, Artificial Sequence
  Synthetic oligonucleotide; GAG chr11 5326138 5326157 5326141 -
atttacctttcattttcttt

SEQ ID NO: 37337 - DNA, 20 bp, Artificial Sequence
  Synthetic oligonucleotide; AGG chr11 5326137 5326156 5326140 -
tttacctttcattttctttg

SEQ ID NO: 37338 - DNA, 20 bp, Artificial Sequence
  Synthetic oligonucleotide; AAG chr11 5326099 5326118 5326102 -
tgtcttacttttaatgaccc

SEQ ID NO: 37339 - DNA, 20 bp, Artificial Sequence
  Synthetic oligonucleotide; TAG chr11 5326094 5326113 5326097 -
tacttttaatgacccaagct

SEQ ID NO: 37340 - DNA, 20 bp, Artificial Sequence
  Synthetic oligonucleotide; GAG chr11 5326092 5326111 5326095 -
cttttaatgacccaagctta

SEQ ID NO: 37341 - DNA, 20 bp, Artificial Sequence
  Synthetic oligonucleotide; TGG chr11 5326088 5326107 5326091 -
taatgacccaagcttagaga

SEQ ID NO: 37342 - DNA, 20 bp, Artificial Sequence
  Synthetic oligonucleotide; GAG chr11 5326086 5326105 5326089 -
atgacccaagcttagagatg

SEQ ID NO: 37343 - DNA, 20 bp, Artificial Sequence
  Synthetic oligonucleotide; AGG chr11 5326085 5326104 5326088 -
tgacccaagcttagagatgg

SEQ ID NO: 37344 - DNA, 20 bp, Artificial Sequence
  Synthetic oligonucleotide; GGG chr11 5326084 5326103 5326087 -
gacccaagcttagagatgga

SEQ ID NO: 37345 - DNA, 20 bp, Artificial Sequence
  Synthetic oligonucleotide; GAG chr11 5326082 5326101 5326085 -
cccaagcttagagatggagg

SEQ ID NO: 37346 - DNA, 20 bp, Artificial Sequence
  Synthetic oligonucleotide; TGG chr11 5326024 5326043 5326027 -
taataaaaaactttcttttt

SEQ ID NO: 37347 - DNA, 20 bp, Artificial Sequence
  Synthetic oligonucleotide; AAG chr11 5326017 5326036 5326020 -
aaactttcttttttggtttc

SEQ ID NO: 37348 - DNA, 20 bp, Artificial Sequence
  Synthetic oligonucleotide; TGG chr11 5326007 5326026 5326010 -
ttttggtttcaagtgtttta

SEQ ID NO: 37349 - DNA, 20 bp, Artificial Sequence
  Synthetic oligonucleotide; AAG chr11 5325992 5326011 5325995 -
ttttatggccaatttctcta

SEQ ID NO: 37350 - DNA, 20 bp, Artificial Sequence
  Synthetic oligonucleotide; AAG chr11 5325974 5325993 5325977 -
taaagacgttattgtttttt

SEQ ID NO: 37351 - DNA, 20 bp, Artificial Sequence
  Synthetic oligonucleotide; AGG chr11 5325973 5325992 5325976 -
aaagacgttattgtttttta

SEQ ID NO: 37352 - DNA, 20 bp, Artificial Sequence
  Synthetic oligonucleotide; AAG chr11 5325968 5325987 5325971 -
cgttattgttttttaaggaa

SEQ ID NO: 37353 - DNA, 20 bp, Artificial Sequence
  Synthetic oligonucleotide; AAG chr11 5325948 5325967 5325951 -
aagctcacaaacattttaaa

SEQ ID NO: 37354 - DNA, 20 bp, Artificial Sequence
  Synthetic oligonucleotide; TGG chr11 5325934 5325953 5325937 -
tttaaaaagtacttgtgctc

SEQ ID NO: 37355 - DNA, 20 bp, Artificial Sequence
  Synthetic oligonucleotide; TAG chr11 5325926 5325945 5325929 -
gtacttgtgctctggaaatc

SEQ ID NO: 37356 - DNA, 20 bp, Artificial Sequence
  Synthetic oligonucleotide; AAG chr11 5325898 5325917 5325901 -
tccttacacaatttttttta

SEQ ID NO: 37357 - DNA, 20 bp, Artificial Sequence
  Synthetic oligonucleotide; AGG chr11 5325897 5325916 5325900 -
ccttacacaattttttttaa

SEQ ID NO: 37358 - DNA, 20 bp, Artificial Sequence
  Synthetic oligonucleotide; CAG chr11 5325889 5325908 5325892 -
aattttttttaaaggaatcc

SEQ ID NO: 37359 - DNA, 20 bp, Artificial Sequence
  Synthetic oligonucleotide; TGG chr11 5325880 5325899 5325883 -
taaaggaatcccagatttta

SEQ ID NO: 37360 - DNA, 20 bp, Artificial Sequence
  Synthetic oligonucleotide; CAG chr11 5325788 5325807 5325791 -
tttcttctatgtttaccctt

SEQ ID NO: 37361 - DNA, 20 bp, Artificial Sequence
  Synthetic oligonucleotide; AAG chr11 5325690 5325709 5325693 -
attcctcaatctgtgttttt

SEQ ID NO: 37362 - DNA, 20 bp, Artificial Sequence
  Synthetic oligonucleotide; AAG chr11 5325683 5325702 5325686 -
aatctgtgtttttaagcatg

SEQ ID NO: 37363 - DNA, 20 bp, Artificial Sequence
  Synthetic oligonucleotide; AGG chr11 5325682 5325701 5325685 -
atctgtgtttttaagcatga

SEQ ID NO: 37364 - DNA, 20 bp, Artificial Sequence
  Synthetic oligonucleotide; AAG chr11 5325671 5325690 5325674 -
taagcatgaaggatctttcg

SEQ ID NO: 37365 - DNA, 20 bp, Artificial Sequence
  Synthetic oligonucleotide; AGG chr11 5325670 5325689 5325673 -
aagcatgaaggatctttcga

SEQ ID NO: 37366 - DNA, 20 bp, Artificial Sequence
  Synthetic oligonucleotide; TAG chr11 5325667 5325686 5325670 -
catgaaggatctttcgaagg

SEQ ID NO: 37367 - DNA, 20 bp, Artificial Sequence
  Synthetic oligonucleotide; CAG chr11 5325637 5325656 5325640 -
tttgtgtaataattataatt

SEQ ID NO: 37368 - DNA, 20 bp, Artificial Sequence
  Synthetic oligonucleotide; TAG chr11 5325603 5325622 5325606 -
aattcaatgtgatttaattt

SEQ ID NO: 37369 - DNA, 20 bp, Artificial Sequence
  Synthetic oligonucleotide; AGG chr11 5325602 5325621 5325605 -
attcaatgtgatttaatttt

SEQ ID NO: 37370 - DNA, 20 bp, Artificial Sequence
  Synthetic oligonucleotide; GGG chr11 5325601 5325620 5325604 -
ttcaatgtgatttaatttta

SEQ ID NO: 37371 - DNA, 20 bp, Artificial Sequence
  Synthetic oligonucleotide; TAG chr11 5325592 5325611 5325595 -
atttaattttagggattccc

SEQ ID NO: 37372 - DNA, 20 bp, Artificial Sequence
  Synthetic oligonucleotide; TGG chr11 5325586 5325605 5325589 -
ttttagggattccctagtgt

SEQ ID NO: 37373 - DNA, 20 bp, Artificial Sequence
  Synthetic oligonucleotide; CAG chr11 5325571 5325590 5325574 -
agtgttggtgatttcaatct

SEQ ID NO: 37374 - DNA, 20 bp, Artificial Sequence
  Synthetic oligonucleotide; AAG chr11 5325567 5325586 5325570 -
ttggtgatttcaatctcagt

SEQ ID NO: 37375 - DNA, 20 bp, Artificial Sequence
  Synthetic oligonucleotide; TAG chr11 5325563 5325582 5325566 -
tgatttcaatctcagtaagt

SEQ ID NO: 37376 - DNA, 20 bp, Artificial Sequence
  Synthetic oligonucleotide; CAG chr11 5325547 5325566 5325550 -
aagttagtaatcctgactca

SEQ ID NO: 37377 - DNA, 20 bp, Artificial Sequence
  Synthetic oligonucleotide; AGG chr11 5325546 5325565 5325549 -
agttagtaatcctgactcac

SEQ ID NO: 37378 - DNA, 20 bp, Artificial Sequence
  Synthetic oligonucleotide; GAG chr11 5325544 5325563 5325547 -
ttagtaatcctgactcacag

SEQ ID NO: 37379 - DNA, 20 bp, Artificial Sequence
  Synthetic oligonucleotide; CAG chr11 5325535 5325554 5325538 -
ctgactcacaggagctgata

SEQ ID NO: 37380 - DNA, 20 bp, Artificial Sequence
  Synthetic oligonucleotide; GAG chr11 5325533 5325552 5325536 -
gactcacaggagctgataca

SEQ ID NO: 37381 - DNA, 20 bp, Artificial Sequence
  Synthetic oligonucleotide; AGG chr11 5325532 5325551 5325535 -
actcacaggagctgatacag

SEQ ID NO: 37382 - DNA, 20 bp, Artificial Sequence
  Synthetic oligonucleotide; TAG chr11 5325529 5325548 5325532 -
cacaggagctgatacagagg

SEQ ID NO: 37383 - DNA, 20 bp, Artificial Sequence
  Synthetic oligonucleotide; CAG chr11 5325523 5325542 5325526 -
agctgatacagaggtagcat

SEQ ID NO: 37384 - DNA, 20 bp, Artificial Sequence
  Synthetic oligonucleotide; GAG chr11 5325455 5325474 5325458 -
tctgatttatttttgatact

SEQ ID NO: 37385 - DNA, 20 bp, Artificial Sequence
  Synthetic oligonucleotide; AGG chr11 5325454 5325473 5325457 -
ctgatttatttttgatactg

SEQ ID NO: 37386 - DNA, 20 bp, Artificial Sequence
  Synthetic oligonucleotide; AAG chr11 5325441 5325460 5325444 -
gatactgaggccattttatg

SEQ ID NO: 37387 - DNA, 20 bp, Artificial Sequence
  Synthetic oligonucleotide; TAG chr11 5325430 5325449 5325433 -
cattttatgaagaaaactgc

SEQ ID NO: 37388 - DNA, 20 bp, Artificial Sequence
  Synthetic oligonucleotide; AGG chr11 5325429 5325448 5325432 -
attttatgaagaaaactgct

SEQ ID NO: 37389 - DNA, 20 bp, Artificial Sequence
  Synthetic oligonucleotide; AAG chr11 5325421 5325440 5325424 -
aagaaaactgctaggtgcta

SEQ ID NO: 37390 - DNA, 20 bp, Artificial Sequence
  Synthetic oligonucleotide; CAG chr11 5325409 5325428 5325412 -
aggtgctaaagacttgcctc

SEQ ID NO: 37391 - DNA, 20 bp, Artificial Sequence
  Synthetic oligonucleotide; AGG chr11 5325408 5325427 5325411 -
ggtgctaaagacttgcctcc

SEQ ID NO: 37392 - DNA, 20 bp, Artificial Sequence
  Synthetic oligonucleotide; AAG chr11 5325384 5325403 5325387 -
ttctgaatttctcgttaaat

SEQ ID NO: 37393 - DNA, 20 bp, Artificial Sequence
  Synthetic oligonucleotide; CAG chr11 5325377 5325396 5325380 -
tttctcgttaaataagactg

SEQ ID NO: 37394 - DNA, 20 bp, Artificial Sequence
  Synthetic oligonucleotide; CAG chr11 5325374 5325393 5325377 -
ctcgttaaataagactgcag

SEQ ID NO: 37395 - DNA, 20 bp, Artificial Sequence
  Synthetic oligonucleotide; GAG chr11 5325372 5325391 5325375 -
cgttaaataagactgcagca

SEQ ID NO: 37396 - DNA, 20 bp, Artificial Sequence
  Synthetic oligonucleotide; TGG chr11 5325368 5325387 5325371 -
aaataagactgcagcagagc

SEQ ID NO: 37397 - DNA, 20 bp, Artificial Sequence
  Synthetic oligonucleotide; AAG chr11 5325361 5325380 5325364 -
actgcagcagagctggtaat

SEQ ID NO: 37398 - DNA, 20 bp, Artificial Sequence
  Synthetic oligonucleotide; TGG chr11 5325333 5325352 5325336 -
tctttctcccatacccctct

SEQ ID NO: 37399 - DNA, 20 bp, Artificial Sequence
  Synthetic oligonucleotide; TGG chr11 5325326 5325345 5325329 -
cccatacccctcttggatcg

SEQ ID NO: 37400 - DNA, 20 bp, Artificial Sequence
  Synthetic oligonucleotide; AAG chr11 5325318 5325337 5325321 -
cctcttggatcgtggcaacc

SEQ ID NO: 37401 - DNA, 20 bp, Artificial Sequence
  Synthetic oligonucleotide; CAG chr11 5325311 5325330 5325314 -
gatcgtggcaaccaagaaaa

SEQ ID NO: 37402 - DNA, 20 bp, Artificial Sequence
  Synthetic oligonucleotide; CAG chr11 5325305 5325324 5325308 -
ggcaaccaagaaaacagaaa

SEQ ID NO: 37403 - DNA, 20 bp, Artificial Sequence
  Synthetic oligonucleotide; TAG chr11 5325302 5325321 5325305 -
aaccaagaaaacagaaacag

SEQ ID NO: 37404 - DNA, 20 bp, Artificial Sequence
  Synthetic oligonucleotide; TGG chr11 5325296 5325315 5325299 -
gaaaacagaaacagtagtga

SEQ ID NO: 37405 - DNA, 20 bp, Artificial Sequence
  Synthetic oligonucleotide; TGG chr11 5325292 5325311 5325295 -
acagaaacagtagtgatggc

SEQ ID NO: 37406 - DNA, 20 bp, Artificial Sequence
  Synthetic oligonucleotide; TAG chr11 5325283 5325302 5325286 -
gtagtgatggctggcatcct

SEQ ID NO: 37407 - DNA, 20 bp, Artificial Sequence
  Synthetic oligonucleotide; AGG chr11 5325282 5325301 5325285 -
tagtgatggctggcatcctt

SEQ ID NO: 37408 - DNA, 20 bp, Artificial Sequence
  Synthetic oligonucleotide; TGG chr11 5325276 5325295 5325279 -
tggctggcatccttaggctg

SEQ ID NO: 37409 - DNA, 20 bp, Artificial Sequence
  Synthetic oligonucleotide; CAG chr11 5325250 5325269 5325253 -
cattataattttacctgtta

SEQ ID NO: 37410 - DNA, 20 bp, Artificial Sequence
  Synthetic oligonucleotide; CAG chr11 5325239 5325258 5325242 -
tacctgttacagaactgcaa

SEQ ID NO: 37411 - DNA, 20 bp, Artificial Sequence
  Synthetic oligonucleotide; CAG chr11 5325231 5325250 5325234 -
acagaactgcaacagttcct

SEQ ID NO: 37412 - DNA, 20 bp, Artificial Sequence
  Synthetic oligonucleotide; AGG chr11 5325230 5325249 5325233 -
cagaactgcaacagttcctc

SEQ ID NO: 37413 - DNA, 20 bp, Artificial Sequence
  Synthetic oligonucleotide; GAG chr11 5325228 5325247 5325231 -
gaactgcaacagttcctcag

SEQ ID NO: 37414 - DNA, 20 bp, Artificial Sequence
  Synthetic oligonucleotide; TGG chr11 5325223 5325242 5325226 -
gcaacagttcctcaggagtt

SEQ ID NO: 37415 - DNA, 20 bp, Artificial Sequence
  Synthetic oligonucleotide; GAG chr11 5325221 5325240 5325224 -
aacagttcctcaggagtttg

SEQ ID NO: 37416 - DNA, 20 bp, Artificial Sequence
  Synthetic oligonucleotide; TGG chr11 5325214 5325233 5325217 -
cctcaggagtttggagttga

SEQ ID NO: 37417 - DNA, 20 bp, Artificial Sequence
  Synthetic oligonucleotide; AAG chr11 5325209 5325228 5325212 -
ggagtttggagttgatggaa

SEQ ID NO: 37418 - DNA, 20 bp, Artificial Sequence
  Synthetic oligonucleotide; CAG chr11 5325206 5325225 5325209 -
gtttggagttgatggaaaag

SEQ ID NO: 37419 - DNA, 20 bp, Artificial Sequence
  Synthetic oligonucleotide; GAG chr11 5325204 5325223 5325207 -
ttggagttgatggaaaagca

SEQ ID NO: 37420 - DNA, 20 bp, Artificial Sequence
  Synthetic oligonucleotide; GAG chr11 5325202 5325221 5325205 -
ggagttgatggaaaagcaga

SEQ ID NO: 37421 - DNA, 20 bp, Artificial Sequence
  Synthetic oligonucleotide; GAG chr11 5325200 5325219 5325203 -
agttgatggaaaagcagaga

SEQ ID NO: 37422 - DNA, 20 bp, Artificial Sequence
  Synthetic oligonucleotide; AGG chr11 5325199 5325218 5325202 -
gttgatggaaaagcagagag

SEQ ID NO: 37423 - DNA, 20 bp, Artificial Sequence
  Synthetic oligonucleotide; AAG chr11 5325195 5325214 5325198 -
atggaaaagcagagagaggt

SEQ ID NO: 37424 - DNA, 20 bp, Artificial Sequence
  Synthetic oligonucleotide; AAG chr11 5325192 5325211 5325195 -
gaaaagcagagagaggtaag

SEQ ID NO: 37425 - DNA, 20 bp, Artificial Sequence
  Synthetic oligonucleotide; AGG chr11 5325191 5325210 5325194 -
aaaagcagagagaggtaaga

SEQ ID NO: 37426 - DNA, 20 bp, Artificial Sequence
  Synthetic oligonucleotide; CAG chr11 5325187 5325206 5325190 -
gcagagagaggtaagaagga

SEQ ID NO: 37427 - DNA, 20 bp, Artificial Sequence
  Synthetic oligonucleotide; CAG chr11 5325179 5325198 5325182 -
aggtaagaaggacagaaaac

SEQ ID NO: 37428 - DNA, 20 bp, Artificial Sequence
  Synthetic oligonucleotide; AAG chr11 5325174 5325193 5325177 -
agaaggacagaaaaccagct

SEQ ID NO: 37429 - DNA, 20 bp, Artificial Sequence
  Synthetic oligonucleotide; TGG chr11 5325161 5325180 5325164 -
accagctaagtatttaatta

SEQ ID NO: 37430 - DNA, 20 bp, Artificial Sequence
  Synthetic oligonucleotide; GGG chr11 5325160 5325179 5325163 -
ccagctaagtatttaattat

SEQ ID NO: 37431 - DNA, 20 bp, Artificial Sequence
  Synthetic oligonucleotide; TGG chr11 5325148 5325167 5325151 -
ttaattatgggaaataatgt

SEQ ID NO: 37432 - DNA, 20 bp, Artificial Sequence
  Synthetic oligonucleotide; AAG chr11 5325144 5325163 5325147 -
ttatgggaaataatgttgga

SEQ ID NO: 37433 - DNA, 20 bp, Artificial Sequence
  Synthetic oligonucleotide; AGG chr11 5325143 5325162 5325146 -
tatgggaaataatgttggaa

SEQ ID NO: 37434 - DNA, 20 bp, Artificial Sequence
  Synthetic oligonucleotide; GGG chr11 5325142 5325161 5325145 -
atgggaaataatgttggaaa

SEQ ID NO: 37435 - DNA, 20 bp, Artificial Sequence
  Synthetic oligonucleotide; AAG chr11 5325138 5325157 5325141 -
gaaataatgttggaaagggc

SEQ ID NO: 37436 - DNA, 20 bp, Artificial Sequence
  Synthetic oligonucleotide; TGG chr11 5325135 5325154 5325138 -
ataatgttggaaagggcaag

SEQ ID NO: 37437 - DNA, 20 bp, Artificial Sequence
  Synthetic oligonucleotide; CAG chr11 5325132 5325151 5325135 -
atgttggaaagggcaagtgg

SEQ ID NO: 37438 - DNA, 20 bp, Artificial Sequence
  Synthetic oligonucleotide; AAG chr11 5325128 5325147 5325131 -
tggaaagggcaagtggcaga

SEQ ID NO: 37439 - DNA, 20 bp, Artificial Sequence
  Synthetic oligonucleotide; AAG chr11 5325124 5325143 5325127 -
aagggcaagtggcagaaaga

SEQ ID NO: 37440 - DNA, 20 bp, Artificial Sequence
  Synthetic oligonucleotide; CAG chr11 5325120 5325139 5325123 -
gcaagtggcagaaagaaagc

SEQ ID NO: 37441 - DNA, 20 bp, Artificial Sequence
  Synthetic oligonucleotide; TGG chr11 5325113 5325132 5325116 -
gcagaaagaaagccagtaaa

SEQ ID NO: 37442 - DNA, 20 bp, Artificial Sequence
  Synthetic oligonucleotide; AAG chr11 5325107 5325126 5325110 -
agaaagccagtaaatggtga

SEQ ID NO: 37443 - DNA, 20 bp, Artificial Sequence
  Synthetic oligonucleotide; AAG chr11 5325094 5325113 5325097 -
atggtgaaagaaacataaaa

SEQ ID NO: 37444 - DNA, 20 bp, Artificial Sequence
  Synthetic oligonucleotide; AAG chr11 5325080 5325099 5325083 -
ataaaaaagataattgtatg

SEQ ID NO: 37445 - DNA, 20 bp, Artificial Sequence
  Synthetic oligonucleotide; TGG chr11 5325072 5325091 5325075 -
gataattgtatgaagatatt

SEQ ID NO: 37446 - DNA, 20 bp, Artificial Sequence
  Synthetic oligonucleotide; GAG chr11 5325070 5325089 5325073 -
taattgtatgaagatatttg

SEQ ID NO: 37447 - DNA, 20 bp, Artificial Sequence
  Synthetic oligonucleotide; GAG chr11 5325062 5325081 5325065 -
tgaagatatttggagaaaat

SEQ ID NO: 37448 - DNA, 20 bp, Artificial Sequence
  Synthetic oligonucleotide; TGG chr11 5325050 5325069 5325053 -
gagaaaatgagaaaatcaac

SEQ ID NO: 37449 - DNA, 20 bp, Artificial Sequence
  Synthetic oligonucleotide; TGG chr11 5325046 5325065 5325049 -
aaatgagaaaatcaactgga

SEQ ID NO: 37450 - DNA, 20 bp, Artificial Sequence
  Synthetic oligonucleotide; AAG chr11 5325043 5325062 5325046 -
tgagaaaatcaactggatgg

SEQ ID NO: 37451 - DNA, 20 bp, Artificial Sequence
  Synthetic oligonucleotide; AAG chr11 5325034 5325053 5325037 -
caactggatggaagcattaa

SEQ ID NO: 37452 - DNA, 20 bp, Artificial Sequence
  Synthetic oligonucleotide; AGG chr11 5325033 5325052 5325036 -
aactggatggaagcattaaa

SEQ ID NO: 37453 - DNA, 20 bp, Artificial Sequence
  Synthetic oligonucleotide; AAG chr11 5325018 5325037 5325021 -
ttaaaaggtttctatctcga

SEQ ID NO: 37454 - DNA, 20 bp, Artificial Sequence
  Synthetic oligonucleotide; TGG chr11 5325014 5325033 5325017 -
aaggtttctatctcgaaaga

SEQ ID NO: 37455 - DNA, 20 bp, Artificial Sequence
  Synthetic oligonucleotide; TAG chr11 5325009 5325028 5325012 -
ttctatctcgaaagatggat

SEQ ID NO: 37456 - DNA, 20 bp, Artificial Sequence
  Synthetic oligonucleotide; AGG chr11 5325008 5325027 5325011 -
tctatctcgaaagatggatt

SEQ ID NO: 37457 - DNA, 20 bp, Artificial Sequence
  Synthetic oligonucleotide; TAG chr11 5324992 5325011 5324995 -
gattaggtatgaaatgctta

SEQ ID NO: 37458 - DNA, 20 bp, Artificial Sequence
  Synthetic oligonucleotide; CAG chr11 5324989 5325008 5324992 -
taggtatgaaatgcttatag

SEQ ID NO: 37459 - DNA, 20 bp, Artificial Sequence
  Synthetic oligonucleotide; CAG chr11 5324979 5324998 5324982 -
atgcttatagcagtgatgcc

SEQ ID NO: 37460 - DNA, 20 bp, Artificial Sequence
  Synthetic oligonucleotide; TGG chr11 5324962 5324981 5324965 -
gcccagacattgttttgcac

SEQ ID NO: 37461 - DNA, 20 bp, Artificial Sequence
  Synthetic oligonucleotide; GAG chr11 5324951 5324970 5324954 -
gttttgcactggaatcacct

SEQ ID NO: 37462 - DNA, 20 bp, Artificial Sequence
  Synthetic oligonucleotide; AGG chr11 5324950 5324969 5324953 -
ttttgcactggaatcacctg

SEQ ID NO: 37463 - DNA, 20 bp, Artificial Sequence
  Synthetic oligonucleotide; AAG chr11 5324938 5324957 5324941 -
atcacctgaggacctgaaaa

SEQ ID NO: 37464 - DNA, 20 bp, Artificial Sequence
  Synthetic oligonucleotide; CAG chr11 5324924 5324943 5324927 -
tgaaaaaagcgaatttgatt

SEQ ID NO: 37465 - DNA, 20 bp, Artificial Sequence
  Synthetic oligonucleotide; TGG chr11 5324916 5324935 5324919 -
gcgaatttgattcagaatgt

SEQ ID NO: 37466 - DNA, 20 bp, Artificial Sequence
  Synthetic oligonucleotide; AAG chr11 5324913 5324932 5324916 -
aatttgattcagaatgttgg

SEQ ID NO: 37467 - DNA, 20 bp, Artificial Sequence
  Synthetic oligonucleotide; AGG chr11 5324912 5324931 5324915 -
atttgattcagaatgttgga

SEQ ID NO: 37468 - DNA, 20 bp, Artificial Sequence
  Synthetic oligonucleotide; GGG chr11 5324911 5324930 5324914 -
tttgattcagaatgttggaa

SEQ ID NO: 37469 - DNA, 20 bp, Artificial Sequence
  Synthetic oligonucleotide; GGG chr11 5324910 5324929 5324913 -
ttgattcagaatgttggaag

SEQ ID NO: 37470 - DNA, 20 bp, Artificial Sequence
  Synthetic oligonucleotide; CAG chr11 5324907 5324926 5324910 -
attcagaatgttggaagggg

SEQ ID NO: 37471 - DNA, 20 bp, Artificial Sequence
  Synthetic oligonucleotide; GAG chr11 5324899 5324918 5324902 -
tgttggaaggggcagaatct

SEQ ID NO: 37472 - DNA, 20 bp, Artificial Sequence
  Synthetic oligonucleotide; AGG chr11 5324898 5324917 5324901 -
gttggaaggggcagaatctg

SEQ ID NO: 37473 - DNA, 20 bp, Artificial Sequence
  Synthetic oligonucleotide; AAG chr11 5324882 5324901 5324885 -
tctgaggctgcatgcctaac

SEQ ID NO: 37474 - DNA, 20 bp, Artificial Sequence
  Synthetic oligonucleotide; TAG chr11 5324867 5324886 5324870 -
ctaacaagcccgctgcttgt

SEQ ID NO: 37475 - DNA, 20 bp, Artificial Sequence
  Synthetic oligonucleotide; TAG chr11 5324857 5324876 5324860 -
cgctgcttgttagctgcgtc

SEQ ID NO: 37476 - DNA, 20 bp, Artificial Sequence
  Synthetic oligonucleotide; TGG chr11 5324837 5324856 5324840 -
tagtctgtgatccacaactc

SEQ ID NO: 37477 - DNA, 20 bp, Artificial Sequence
  Synthetic oligonucleotide; TGG chr11 5324834 5324853 5324837 -
tctgtgatccacaactctgg

SEQ ID NO: 37478 - DNA, 20 bp, Artificial Sequence
  Synthetic oligonucleotide; AAG chr11 5324829 5324848 5324832 -
gatccacaactctggtggcc

SEQ ID NO: 37479 - DNA, 20 bp, Artificial Sequence
  Synthetic oligonucleotide; AAG chr11 5324823 5324842 5324826 -
caactctggtggccaagctc

SEQ ID NO: 37480 - DNA, 20 bp, Artificial Sequence
  Synthetic oligonucleotide; TAG chr11 5324813 5324832 5324816 -
ggccaagctcaagtaactgt

SEQ ID NO: 37481 - DNA, 20 bp, Artificial Sequence
  Synthetic oligonucleotide; GAG chr11 5324811 5324830 5324814 -
ccaagctcaagtaactgtta

SEQ ID NO: 37482 - DNA, 20 bp, Artificial Sequence
  Synthetic oligonucleotide; AAG chr11 5324803 5324822 5324806 -
aagtaactgttagagtgaca

SEQ ID NO: 37483 - DNA, 20 bp, Artificial Sequence
  Synthetic oligonucleotide; TGG chr11 5324792 5324811 5324795 -
agagtgacaaagccgttcat

SEQ ID NO: 37484 - DNA, 20 bp, Artificial Sequence
  Synthetic oligonucleotide; TAG chr11 5324789 5324808 5324792 -
gtgacaaagccgttcattgg

SEQ ID NO: 37485 - DNA, 20 bp, Artificial Sequence
  Synthetic oligonucleotide; TGG chr11 5324783 5324802 5324786 -
aagccgttcattggtagtga

SEQ ID NO: 37486 - DNA, 20 bp, Artificial Sequence
  Synthetic oligonucleotide; TAG chr11 5324768 5324787 5324771 -
agtgatggtgatgcacgcta

SEQ ID NO: 37487 - DNA, 20 bp, Artificial Sequence
  Synthetic oligonucleotide; GAG chr11 5324729 5324748 5324732 -
attcaatttccaaaaaaaat

SEQ ID NO: 37488 - DNA, 20 bp, Artificial Sequence
  Synthetic oligonucleotide; TGG chr11 5324653 5324672 5324656 -
ttacaacaatcatttccaaa

SEQ ID NO: 37489 - DNA, 20 bp, Artificial Sequence
  Synthetic oligonucleotide; CAG chr11 5324649 5324668 5324652 -
aacaatcatttccaaatggt

SEQ ID NO: 37490 - DNA, 20 bp, Artificial Sequence
  Synthetic oligonucleotide; CAG chr11 5324640 5324659 5324643 -
ttccaaatggtcagtaatca

SEQ ID NO: 37491 - DNA, 20 bp, Artificial Sequence
  Synthetic oligonucleotide; AAG chr11 5324636 5324655 5324639 -
aaatggtcagtaatcacagc

SEQ ID NO: 37492 - DNA, 20 bp, Artificial Sequence
  Synthetic oligonucleotide; AAG chr11 5324633 5324652 5324636 -
tggtcagtaatcacagcaag

SEQ ID NO: 37493 - DNA, 20 bp, Artificial Sequence
  Synthetic oligonucleotide; AAG chr11 5324624 5324643 5324627 -
atcacagcaagaagacaact

SEQ ID NO: 37494 - DNA, 20 bp, Artificial Sequence
  Synthetic oligonucleotide; CAG chr11 5324620 5324639 5324623 -
cagcaagaagacaactaagc

SEQ ID NO: 37495 - DNA, 20 bp, Artificial Sequence
  Synthetic oligonucleotide; AAG chr11 5324551 5324570 5324554 -
ctgttgttgcaaatatttat

SEQ ID NO: 37496 - DNA, 20 bp, Artificial Sequence
  Synthetic oligonucleotide; TAG chr11 5324537 5324556 5324540 -
atttataagtaccctcaaaa

SEQ ID NO: 37497 - DNA, 20 bp, Artificial Sequence
  Synthetic oligonucleotide; CGG chr11 5324531 5324550 5324534 -
aagtaccctcaaaatagttg

SEQ ID NO: 37498 - DNA, 20 bp, Artificial Sequence
  Synthetic oligonucleotide; GAG chr11 5324491 5324510 5324494 -
aatgaaaaatttttgaattt

SEQ ID NO: 37499 - DNA, 20 bp, Artificial Sequence
  Synthetic oligonucleotide; CAG chr11 5324469 5324488 5324472 -
gaaaaatcgaaccattaact

SEQ ID NO: 37500 - DNA, 20 bp, Artificial Sequence
  Synthetic oligonucleotide; TAG chr11 5324453 5324472 5324456 -
aactcagtattttttctaat

SEQ ID NO: 37501 - DNA, 20 bp, Artificial Sequence
  Synthetic oligonucleotide; AGG chr11 5324452 5324471 5324455 -
actcagtattttttctaatt

SEQ ID NO: 37502 - DNA, 20 bp, Artificial Sequence
  Synthetic oligonucleotide; GGG chr11 5324451 5324470 5324454 -
ctcagtattttttctaatta

SEQ ID NO: 37503 - DNA, 20 bp, Artificial Sequence
  Synthetic oligonucleotide; TAG chr11 5324439 5324458 5324442 -
tctaattagggaaaaaacca

SEQ ID NO: 37504 - DNA, 20 bp, Artificial Sequence
  Synthetic oligonucleotide; CAG chr11 5324415 5324434 5324418 -
ctgtacatgctattcttctt

SEQ ID NO: 37505 - DNA, 20 bp, Artificial Sequence
  Synthetic oligonucleotide; AGG chr11 5324414 5324433 5324417 -
tgtacatgctattcttcttc

SEQ ID NO: 37506 - DNA, 20 bp, Artificial Sequence
  Synthetic oligonucleotide; TAG chr11 5324407 5324426 5324410 -
gctattcttcttcaggaaaa

SEQ ID NO: 37507 - DNA, 20 bp, Artificial Sequence
  Synthetic oligonucleotide; CAG chr11 5324401 5324420 5324404 -
cttcttcaggaaaatagttg

SEQ ID NO: 37508 - DNA, 20 bp, Artificial Sequence
  Synthetic oligonucleotide; GAG chr11 5324399 5324418 5324402 -
tcttcaggaaaatagttgca

SEQ ID NO: 37509 - DNA, 20 bp, Artificial Sequence
  Synthetic oligonucleotide; CAG chr11 5324381 5324400 5324384 -
cagagtcaaatttatcacac

SEQ ID NO: 37510 - DNA, 20 bp, Artificial Sequence
  Synthetic oligonucleotide; AAG chr11 5324366 5324385 5324369 -
cacaccagttaatcatctcc

SEQ ID NO: 37511 - DNA, 20 bp, Artificial Sequence
  Synthetic oligonucleotide; CAG chr11 5324363 5324382 5324366 -
accagttaatcatctccaag

SEQ ID NO: 37512 - DNA, 20 bp, Artificial Sequence
  Synthetic oligonucleotide; AGG chr11 5324362 5324381 5324365 -
ccagttaatcatctccaagc

SEQ ID NO: 37513 - DNA, 20 bp, Artificial Sequence
  Synthetic oligonucleotide; AAG chr11 5324359 5324378 5324362 -
gttaatcatctccaagcagg

SEQ ID NO: 37514 - DNA, 20 bp, Artificial Sequence
  Synthetic oligonucleotide; TGG chr11 5324354 5324373 5324357 -
tcatctccaagcaggaagat

SEQ ID NO: 37515 - DNA, 20 bp, Artificial Sequence
  Synthetic oligonucleotide; GAG chr11 5324352 5324371 5324355 -
atctccaagcaggaagattg

SEQ ID NO: 37516 - DNA, 20 bp, Artificial Sequence
  Synthetic oligonucleotide; AGG chr11 5324351 5324370 5324354 -
tctccaagcaggaagattgg

SEQ ID NO: 37517 - DNA, 20 bp, Artificial Sequence
  Synthetic oligonucleotide; TGG chr11 5324344 5324363 5324347 -
gcaggaagattggaggctcc

SEQ ID NO: 37518 - DNA, 20 bp, Artificial Sequence
  Synthetic oligonucleotide; AAG chr11 5324337 5324356 5324340 -
gattggaggctcctggtttc

SEQ ID NO: 37519 - DNA, 20 bp, Artificial Sequence
  Synthetic oligonucleotide; AGG chr11 5324336 5324355 5324339 -
attggaggctcctggtttca

SEQ ID NO: 37520 - DNA, 20 bp, Artificial Sequence
  Synthetic oligonucleotide; AAG chr11 5324329 5324348 5324332 -
gctcctggtttcaaggtttc

SEQ ID NO: 37521 - DNA, 20 bp, Artificial Sequence
  Synthetic oligonucleotide; CGG chr11 5324311 5324330 5324314 -
tcaagaaatctgatctttac

SEQ ID NO: 37522 - DNA, 20 bp, Artificial Sequence
  Synthetic oligonucleotide; TGG chr11 5324308 5324327 5324311 -
agaaatctgatctttaccgg

SEQ ID NO: 37523 - DNA, 20 bp, Artificial Sequence
  Synthetic oligonucleotide; TGG chr11 5324295 5324314 5324298 -
ttaccggtggatacactatg

SEQ ID NO: 37524 - DNA, 20 bp, Artificial Sequence
  Synthetic oligonucleotide; CAG chr11 5324279 5324298 5324282 -
tatgtggcccaatattactg

SEQ ID NO: 37525 - DNA, 20 bp, Artificial Sequence
  Synthetic oligonucleotide; TGG chr11 5324260 5324279 5324263 -
gcagccccttttttgctgac

SEQ ID NO: 37526 - DNA, 20 bp, Artificial Sequence
  Synthetic oligonucleotide; CAG chr11 5324252 5324271 5324255 -
ttttttgctgactggctttc

SEQ ID NO: 37527 - DNA, 20 bp, Artificial Sequence
  Synthetic oligonucleotide; AGG chr11 5324251 5324270 5324254 -
tttttgctgactggctttcc

SEQ ID NO: 37528 - DNA, 20 bp, Artificial Sequence
  Synthetic oligonucleotide; GGG chr11 5324250 5324269 5324253 -
ttttgctgactggctttcca

SEQ ID NO: 37529 - DNA, 20 bp, Artificial Sequence
  Synthetic oligonucleotide; TGG chr11 5324246 5324265 5324249 -
gctgactggctttccagggc

SEQ ID NO: 37530 - DNA, 20 bp, Artificial Sequence
  Synthetic oligonucleotide; GAG chr11 5324244 5324263 5324247 -
tgactggctttccagggctg

SEQ ID NO: 37531 - DNA, 20 bp, Artificial Sequence
  Synthetic oligonucleotide; AGG chr11 5324243 5324262 5324246 -
gactggctttccagggctgg

SEQ ID NO: 37532 - DNA, 20 bp, Artificial Sequence
  Synthetic oligonucleotide; CAG chr11 5324240 5324259 5324243 -
tggctttccagggctggagg

SEQ ID NO: 37533 - DNA, 20 bp, Artificial Sequence
  Synthetic oligonucleotide; TGG chr11 5324229 5324248 5324232 -
ggctggaggcagctcatcac

SEQ ID NO: 37534 - DNA, 20 bp, Artificial Sequence
  Synthetic oligonucleotide; TGG chr11 5324186 5324205 5324189 -
tgtttatgtgtgcatccttc

SEQ ID NO: 37535 - DNA, 20 bp, Artificial Sequence
  Synthetic oligonucleotide; GGG chr11 5324185 5324204 5324188 -
gtttatgtgtgcatccttct

SEQ ID NO: 37536 - DNA, 20 bp, Artificial Sequence
  Synthetic oligonucleotide; TGG chr11 5324179 5324198 5324182 -
gtgtgcatccttctgggcaa

SEQ ID NO: 37537 - DNA, 20 bp, Artificial Sequence
  Synthetic oligonucleotide; AAG chr11 5324157 5324176 5324160 -
gcatgctcctctacctcatc

SEQ ID NO: 37538 - DNA, 20 bp, Artificial Sequence
  Synthetic oligonucleotide; CAG chr11 5324146 5324165 5324149 -
tacctcatcaagcatgacca

SEQ ID NO: 37539 - DNA, 20 bp, Artificial Sequence
  Synthetic oligonucleotide; GAG chr11 5324136 5324155 5324139 -
agcatgaccacagtcttcat

SEQ ID NO: 37540 - DNA, 20 bp, Artificial Sequence
  Synthetic oligonucleotide; TGG chr11 5324108 5324127 5324111 -
gtactacttcctcaccatgc

SEQ ID NO: 37541 - DNA, 20 bp, Artificial Sequence
  Synthetic oligonucleotide; CAG chr11 5324105 5324124 5324108 -
ctacttcctcaccatgctgg

SEQ ID NO: 37542 - DNA, 20 bp, Artificial Sequence
  Synthetic oligonucleotide; AGG chr11 5324104 5324123 5324107 -
tacttcctcaccatgctggc

SEQ ID NO: 37543 - DNA, 20 bp, Artificial Sequence
  Synthetic oligonucleotide; CAG chr11 5324099 5324118 5324102 -
cctcaccatgctggcaggca

SEQ ID NO: 37544 - DNA, 20 bp, Artificial Sequence
  Synthetic oligonucleotide; TGG chr11 5324090 5324109 5324093 -
gctggcaggcacagacctca

SEQ ID NO: 37545 - DNA, 20 bp, Artificial Sequence
  Synthetic oligonucleotide; TGG chr11 5324060 5324079 5324063 -
gaccacgatgcctactgtaa

SEQ ID NO: 37546 - DNA, 20 bp, Artificial Sequence
  Synthetic oligonucleotide; GGG chr11 5324059 5324078 5324062 -
accacgatgcctactgtaat

SEQ ID NO: 37547 - DNA, 20 bp, Artificial Sequence
  Synthetic oligonucleotide; TGG chr11 5324049 5324068 5324052 -
ctactgtaatgggcatccta

SEQ ID NO: 37548 - DNA, 20 bp, Artificial Sequence
  Synthetic oligonucleotide; GGG chr11 5324048 5324067 5324051 -
tactgtaatgggcatcctat

SEQ ID NO: 37549 - DNA, 20 bp, Artificial Sequence
  Synthetic oligonucleotide; CAG chr11 5324038 5324057 5324041 -
ggcatcctatgggtgaatca

SEQ ID NO: 37550 - DNA, 20 bp, Artificial Sequence
  Synthetic oligonucleotide; AGG chr11 5324037 5324056 5324040 -
gcatcctatgggtgaatcac

SEQ ID NO: 37551 - DNA, 20 bp, Artificial Sequence
  Synthetic oligonucleotide; GGG chr11 5324036 5324055 5324039 -
catcctatgggtgaatcaca

SEQ ID NO: 37552 - DNA, 20 bp, Artificial Sequence
  Synthetic oligonucleotide; GAG chr11 5324034 5324053 5324037 -
tcctatgggtgaatcacagg

SEQ ID NO: 37553 - DNA, 20 bp, Artificial Sequence
  Synthetic oligonucleotide; TAG chr11 5324029 5324048 5324032 -
tgggtgaatcacagggagat

SEQ ID NO: 37554 - DNA, 20 bp, Artificial Sequence
  Synthetic oligonucleotide; CAG chr11 5324026 5324045 5324029 -
gtgaatcacagggagattag

SEQ ID NO: 37555 - DNA, 20 bp, Artificial Sequence
  Synthetic oligonucleotide; TGG chr11 5324021 5324040 5324024 -
tcacagggagattagcagtg

SEQ ID NO: 37556 - DNA, 20 bp, Artificial Sequence
  Synthetic oligonucleotide; GGG chr11 5324020 5324039 5324023 -
cacagggagattagcagtgt

SEQ ID NO: 37557 - DNA, 20 bp, Artificial Sequence
  Synthetic oligonucleotide; CAG chr11 5324007 5324026 5324010 -
gcagtgtgggctgcttccta

SEQ ID NO: 37558 - DNA, 20 bp, Artificial Sequence
  Synthetic oligonucleotide; AGG chr11 5324006 5324025 5324009 -
cagtgtgggctgcttcctac

SEQ ID NO: 37559 - DNA, 20 bp, Artificial Sequence
  Synthetic oligonucleotide; TGG chr11 5323976 5323995 5323979 -
tattcactccctttctgttg

SEQ ID NO: 37560 - DNA, 20 bp, Artificial Sequence
  Synthetic oligonucleotide; CAG chr11 5323970 5323989 5323973 -
ctccctttctgttgtggaat

SEQ ID NO: 37561 - DNA, 20 bp, Artificial Sequence
  Synthetic oligonucleotide; AGG chr11 5323969 5323988 5323972 -
tccctttctgttgtggaatc

SEQ ID NO: 37562 - DNA, 20 bp, Artificial Sequence
  Synthetic oligonucleotide; TGG chr11 5323958 5323977 5323961 -
tgtggaatcaggttccctcc

SEQ ID NO: 37563 - DNA, 20 bp, Artificial Sequence
  Synthetic oligonucleotide; TGG chr11 5323952 5323971 5323955 -
atcaggttccctcctggcaa

SEQ ID NO: 37564 - DNA, 20 bp, Artificial Sequence
  Synthetic oligonucleotide; GAG chr11 5323915 5323934 5323918 -
attgccatccgcaatccttt

SEQ ID NO: 37565 - DNA, 20 bp, Artificial Sequence
  Synthetic oligonucleotide; TAG chr11 5323888 5323907 5323891 -
gcttccattctcaccaatac

SEQ ID NO: 37566 - DNA, 20 bp, Artificial Sequence
  Synthetic oligonucleotide; GAG chr11 5323886 5323905 5323889 -
ttccattctcaccaatacta

SEQ ID NO: 37567 - DNA, 20 bp, Artificial Sequence
  Synthetic oligonucleotide; TAG chr11 5323880 5323899 5323883 -
tctcaccaatactagagtca

SEQ ID NO: 37568 - DNA, 20 bp, Artificial Sequence
  Synthetic oligonucleotide; TAG chr11 5323874 5323893 5323877 -
caatactagagtcatagcgt

SEQ ID NO: 37569 - DNA, 20 bp, Artificial Sequence
  Synthetic oligonucleotide; AGG chr11 5323873 5323892 5323876 -
aatactagagtcatagcgtt

SEQ ID NO: 37570 - DNA, 20 bp, Artificial Sequence
  Synthetic oligonucleotide; GAG chr11 5323871 5323890 5323874 -
tactagagtcatagcgttag

SEQ ID NO: 37571 - DNA, 20 bp, Artificial Sequence
  Synthetic oligonucleotide; TGG chr11 5323868 5323887 5323871 -
tagagtcatagcgttaggag

SEQ ID NO: 37572 - DNA, 20 bp, Artificial Sequence
  Synthetic oligonucleotide; GGG chr11 5323867 5323886 5323870 -
agagtcatagcgttaggagt

SEQ ID NO: 37573 - DNA, 20 bp, Artificial Sequence
  Synthetic oligonucleotide; GAG chr11 5323865 5323884 5323868 -
agtcatagcgttaggagtgg

SEQ ID NO: 37574 - DNA, 20 bp, Artificial Sequence
  Synthetic oligonucleotide; AAG chr11 5323855 5323874 5323858 -
ttaggagtgggagtgtttct

SEQ ID NO: 37575 - DNA, 20 bp, Artificial Sequence
  Synthetic oligonucleotide; AGG chr11 5323854 5323873 5323857 -
taggagtgggagtgtttcta

SEQ ID NO: 37576 - DNA, 20 bp, Artificial Sequence
  Synthetic oligonucleotide; GGG chr11 5323853 5323872 5323856 -
aggagtgggagtgtttctaa

SEQ ID NO: 37577 - DNA, 20 bp, Artificial Sequence
  Synthetic oligonucleotide; GGG chr11 5323852 5323871 5323855 -
ggagtgggagtgtttctaag

SEQ ID NO: 37578 - DNA, 20 bp, Artificial Sequence
  Synthetic oligonucleotide; AAG chr11 5323760 5323779 5323763 -
acgtgctttctgcctccacc

SEQ ID NO: 37579 - DNA, 20 bp, Artificial Sequence
  Synthetic oligonucleotide; GAG chr11 5323750 5323769 5323753 -
tgcctccaccaagaaatcat

SEQ ID NO: 37580 - DNA, 20 bp, Artificial Sequence
  Synthetic oligonucleotide; TGG chr11 5323745 5323764 5323748 -
ccaccaagaaatcatgagac

SEQ ID NO: 37581 - DNA, 20 bp, Artificial Sequence
  Synthetic oligonucleotide; TAG chr11 5323720 5323739 5323723 -
tgtgctgacataactttcaa

SEQ ID NO: 37582 - DNA, 20 bp, Artificial Sequence
  Synthetic oligonucleotide; TAG chr11 5323679 5323698 5323682 -
gatctctttaacaatcttcc

SEQ ID NO: 37583 - DNA, 20 bp, Artificial Sequence
  Synthetic oligonucleotide; TAG chr11 5323628 5323647 5323631 -
tctaattcttaatactgtca

SEQ ID NO: 37584 - DNA, 20 bp, Artificial Sequence
  Synthetic oligonucleotide; AGG chr11 5323627 5323646 5323630 -
ctaattcttaatactgtcat

SEQ ID NO: 37585 - DNA, 20 bp, Artificial Sequence
  Synthetic oligonucleotide; TGG chr11 5323615 5323634 5323618 -
actgtcataggcattgcttc

SEQ ID NO: 37586 - DNA, 20 bp, Artificial Sequence
  Synthetic oligonucleotide; AAG chr11 5323610 5323629 5323613 -
cataggcattgcttctggtg

SEQ ID NO: 37587 - DNA, 20 bp, Artificial Sequence
  Synthetic oligonucleotide; GAG chr11 5323608 5323627 5323611 -
taggcattgcttctggtgaa

SEQ ID NO: 37588 - DNA, 20 bp, Artificial Sequence
  Synthetic oligonucleotide; GAG chr11 5323606 5323625 5323609 -
ggcattgcttctggtgaaga

SEQ ID NO: 37589 - DNA, 20 bp, Artificial Sequence
  Synthetic oligonucleotide; GAG chr11 5323604 5323623 5323607 -
cattgcttctggtgaagaga

SEQ ID NO: 37590 - DNA, 20 bp, Artificial Sequence
  Synthetic oligonucleotide; AAG chr11 5323598 5323617 5323601 -
ttctggtgaagagagagcca

SEQ ID NO: 37591 - DNA, 20 bp, Artificial Sequence
  Synthetic oligonucleotide; TAG chr11 5323570 5323589 5323573 -
aatacctgtatctcccacat

SEQ ID NO: 37592 - DNA, 20 bp, Artificial Sequence
  Synthetic oligonucleotide; CAG chr11 5323544 5323563 5323547 -
tgttcttatcttctatgtta

SEQ ID NO: 37593 - DNA, 20 bp, Artificial Sequence
  Synthetic oligonucleotide; TGG chr11 5323538 5323557 5323541 -
tatcttctatgttacagtga

SEQ ID NO: 37594 - DNA, 20 bp, Artificial Sequence
  Synthetic oligonucleotide; GGG chr11 5323537 5323556 5323540 -
atcttctatgttacagtgat

SEQ ID NO: 37595 - DNA, 20 bp, Artificial Sequence
  Synthetic oligonucleotide; CAG chr11 5323519 5323538 5323522 -
atgggtttgacattcattta

SEQ ID NO: 37596 - DNA, 20 bp, Artificial Sequence
  Synthetic oligonucleotide; TGG chr11 5323513 5323532 5323516 -
ttgacattcatttacagatt

SEQ ID NO: 37597 - DNA, 20 bp, Artificial Sequence
  Synthetic oligonucleotide; GGG chr11 5323512 5323531 5323515 -
tgacattcatttacagattt

SEQ ID NO: 37598 - DNA, 20 bp, Artificial Sequence
  Synthetic oligonucleotide; AAG chr11 5323509 5323528 5323512 -
cattcatttacagatttggg

SEQ ID NO: 37599 - DNA, 20 bp, Artificial Sequence
  Synthetic oligonucleotide; CAG chr11 5323499 5323518 5323502 -
cagatttgggaagaatgtgc

SEQ ID NO: 37600 - DNA, 20 bp, Artificial Sequence
  Synthetic oligonucleotide; GAG chr11 5323497 5323516 5323500 -
gatttgggaagaatgtgcca

SEQ ID NO: 37601 - DNA, 20 bp, Artificial Sequence
  Synthetic oligonucleotide; AGG chr11 5323496 5323515 5323499 -
atttgggaagaatgtgccag

SEQ ID NO: 37602 - DNA, 20 bp, Artificial Sequence
  Synthetic oligonucleotide; GAG chr11 5323477 5323496 5323480 -
gaggttgtccacattatcat

SEQ ID NO: 37603 - DNA, 20 bp, Artificial Sequence
  Synthetic oligonucleotide; CAG chr11 5323429 5323448 5323432 -
ttaatgaaccctgtcatcta

SEQ ID NO: 37604 - DNA, 20 bp, Artificial Sequence
  Synthetic oligonucleotide; AAG chr11 5323416 5323435 5323419 -
tcatctacagcatcaaaacc

SEQ ID NO: 37605 - DNA, 20 bp, Artificial Sequence
  Synthetic oligonucleotide; TGG chr11 5323402 5323421 5323405 -
aaaaccaagcaaatacaata

SEQ ID NO: 37606 - DNA, 20 bp, Artificial Sequence
  Synthetic oligonucleotide; TAG chr11 5323375 5323394 5323378 -
atccgccttttatctaaaca

SEQ ID NO: 37607 - DNA, 20 bp, Artificial Sequence
  Synthetic oligonucleotide; AGG chr11 5323374 5323393 5323377 -
tccgccttttatctaaacat

SEQ ID NO: 37608 - DNA, 20 bp, Artificial Sequence
  Synthetic oligonucleotide; TAG chr11 5323369 5323388 5323372 -
cttttatctaaacataggtt

SEQ ID NO: 37609 - DNA, 20 bp, Artificial Sequence
  Synthetic oligonucleotide; TAG chr11 5323366 5323385 5323369 -
ttatctaaacataggtttag

SEQ ID NO: 37610 - DNA, 20 bp, Artificial Sequence
  Synthetic oligonucleotide; CGG chr11 5323356 5323375 5323359 -
ataggtttagtagttaaact

SEQ ID NO: 37611 - DNA, 20 bp, Artificial Sequence
  Synthetic oligonucleotide; TGG chr11 5323350 5323369 5323353 -
ttagtagttaaactcggatc

SEQ ID NO: 37612 - DNA, 20 bp, Artificial Sequence
  Synthetic oligonucleotide; GAG chr11 5323348 5323367 5323351 -
agtagttaaactcggatctg

SEQ ID NO: 37613 - DNA, 20 bp, Artificial Sequence
  Synthetic oligonucleotide; CAG chr11 5323342 5323361 5323345 -
taaactcggatctggagaat

SEQ ID NO: 37614 - DNA, 20 bp, Artificial Sequence
  Synthetic oligonucleotide; CAG chr11 5323336 5323355 5323339 -
cggatctggagaatcagaca

SEQ ID NO: 37615 - DNA, 20 bp, Artificial Sequence
  Synthetic oligonucleotide; AAG chr11 5323322 5323341 5323325 -
cagacacagacataaaaatg

SEQ ID NO: 37616 - DNA, 20 bp, Artificial Sequence
  Synthetic oligonucleotide; CAG chr11 5323318 5323337 5323321 -
cacagacataaaaatgaagc

SEQ ID NO: 37617 - DNA, 20 bp, Artificial Sequence
  Synthetic oligonucleotide; AAG chr11 5323303 5323322 5323306 -
gaagccagaatgaaaaatga

SEQ ID NO: 37618 - DNA, 20 bp, Artificial Sequence
  Synthetic oligonucleotide; TGG chr11 5323298 5323317 5323301 -
cagaatgaaaaatgaaagcc

SEQ ID NO: 37619 - DNA, 20 bp, Artificial Sequence
  Synthetic oligonucleotide; GAG chr11 5323296 5323315 5323299 -
gaatgaaaaatgaaagcctg

SEQ ID NO: 37620 - DNA, 20 bp, Artificial Sequence
  Synthetic oligonucleotide; TAG chr11 5323285 5323304 5323288 -
gaaagcctggagttctttct

SEQ ID NO: 37621 - DNA, 20 bp, Artificial Sequence
  Synthetic oligonucleotide; AAG chr11 5323280 5323299 5323283 -
cctggagttctttcttagca

SEQ ID NO: 37622 - DNA, 20 bp, Artificial Sequence
  Synthetic oligonucleotide; GAG chr11 5323278 5323297 5323281 -
tggagttctttcttagcaaa

SEQ ID NO: 37623 - DNA, 20 bp, Artificial Sequence
  Synthetic oligonucleotide; AAG chr11 5323274 5323293 5323277 -
gttctttcttagcaaagagc

SEQ ID NO: 37624 - DNA, 20 bp, Artificial Sequence
  Synthetic oligonucleotide; AGG chr11 5323273 5323292 5323276 -
ttctttcttagcaaagagca

SEQ ID NO: 37625 - DNA, 20 bp, Artificial Sequence
  Synthetic oligonucleotide; GGG chr11 5323272 5323291 5323275 -
tctttcttagcaaagagcaa

SEQ ID NO: 37626 - DNA, 20 bp, Artificial Sequence
  Synthetic oligonucleotide; TGG chr11 5323264 5323283 5323267 -
agcaaagagcaagggtatac

SEQ ID NO: 37627 - DNA, 20 bp, Artificial Sequence
  Synthetic oligonucleotide; AAG chr11 5323261 5323280 5323264 -
aaagagcaagggtatactgg

SEQ ID NO: 37628 - DNA, 20 bp, Artificial Sequence
  Synthetic oligonucleotide; AAG chr11 5323241 5323260 5323244 -
aagacaatgttgtcactcac

SEQ ID NO: 37629 - DNA, 20 bp, Artificial Sequence
  Synthetic oligonucleotide; AGG chr11 5323240 5323259 5323243 -
agacaatgttgtcactcaca

SEQ ID NO: 37630 - DNA, 20 bp, Artificial Sequence
  Synthetic oligonucleotide; AAG chr11 5323233 5323252 5323236 -
gttgtcactcacaaggactt

SEQ ID NO: 37631 - DNA, 20 bp, Artificial Sequence
  Synthetic oligonucleotide; TAG chr11 5323220 5323239 5323223 -
aggacttaagtactttacca

SEQ ID NO: 37632 - DNA, 20 bp, Artificial Sequence
  Synthetic oligonucleotide; AGG chr11 5323219 5323238 5323222 -
ggacttaagtactttaccat

SEQ ID NO: 37633 - DNA, 20 bp, Artificial Sequence
  Synthetic oligonucleotide; GGG chr11 5323218 5323237 5323221 -
gacttaagtactttaccata

SEQ ID NO: 37634 - DNA, 20 bp, Artificial Sequence
  Synthetic oligonucleotide; TGG chr11 5323214 5323233 5323217 -
taagtactttaccatagggt

SEQ ID NO: 37635 - DNA, 20 bp, Artificial Sequence
  Synthetic oligonucleotide; GGG chr11 5323213 5323232 5323216 -
aagtactttaccatagggtt

SEQ ID NO: 37636 - DNA, 20 bp, Artificial Sequence
  Synthetic oligonucleotide; GGG chr11 5323212 5323231 5323215 -
agtactttaccatagggttg

SEQ ID NO: 37637 - DNA, 20 bp, Artificial Sequence
  Synthetic oligonucleotide; GGG chr11 5323211 5323230 5323214 -
gtactttaccatagggttgg

SEQ ID NO: 37638 - DNA, 20 bp, Artificial Sequence
  Synthetic oligonucleotide; TAG chr11 5323201 5323220 5323204 -
atagggttgggggcatatct

SEQ ID NO: 37639 - DNA, 20 bp, Artificial Sequence
  Synthetic oligonucleotide; AGG chr11 5323200 5323219 5323203 -
tagggttgggggcatatctt

SEQ ID NO: 37640 - DNA, 20 bp, Artificial Sequence
  Synthetic oligonucleotide; GAG chr11 5323198 5323217 5323201 -
gggttgggggcatatcttag

SEQ ID NO: 37641 - DNA, 20 bp, Artificial Sequence
  Synthetic oligonucleotide; AAG chr11 5323195 5323214 5323198 -
ttgggggcatatcttaggag

SEQ ID NO: 37642 - DNA, 20 bp, Artificial Sequence
  Synthetic oligonucleotide; TGG chr11 5323190 5323209 5323193 -
ggcatatcttaggagaagtc

SEQ ID NO: 37643 - DNA, 20 bp, Artificial Sequence
  Synthetic oligonucleotide; CAG chr11 5323184 5323203 5323187 -
tcttaggagaagtctggtga

SEQ ID NO: 37644 - DNA, 20 bp, Artificial Sequence
  Synthetic oligonucleotide; TAG chr11 5323172 5323191 5323175 -
tctggtgacagaacactgaa

SEQ ID NO: 37645 - DNA, 20 bp, Artificial Sequence
  Synthetic oligonucleotide; TGG chr11 5323163 5323182 5323166 -
agaacactgaatagaccata

SEQ ID NO: 37646 - DNA, 20 bp, Artificial Sequence
  Synthetic oligonucleotide; AAG chr11 5323152 5323171 5323155 -
tagaccatatggaactgaaa

SEQ ID NO: 37647 - DNA, 20 bp, Artificial Sequence
  Synthetic oligonucleotide; TAG chr11 5323112 5323131 5323115 -
ctttcaaatgcacctgaaat

SEQ ID NO: 37648 - DNA, 20 bp, Artificial Sequence
  Synthetic oligonucleotide; CAG chr11 5323103 5323122 5323106 -
gcacctgaaattagccacct

SEQ ID NO: 37649 - DNA, 20 bp, Artificial Sequence
  Synthetic oligonucleotide; GAG chr11 5323092 5323111 5323095 -
tagccacctcagtgaaattt

SEQ ID NO: 37650 - DNA, 20 bp, Artificial Sequence
  Synthetic oligonucleotide; AGG chr11 5323091 5323110 5323094 -
agccacctcagtgaaatttg

SEQ ID NO: 37651 - DNA, 20 bp, Artificial Sequence
  Synthetic oligonucleotide; AAG chr11 5323086 5323105 5323089 -
cctcagtgaaatttgaggaa

SEQ ID NO: 37652 - DNA, 20 bp, Artificial Sequence
  Synthetic oligonucleotide; AGG chr11 5323085 5323104 5323088 -
ctcagtgaaatttgaggaaa

SEQ ID NO: 37653 - DNA, 20 bp, Artificial Sequence
  Synthetic oligonucleotide; CAG chr11 5323082 5323101 5323085 -
agtgaaatttgaggaaaagg

SEQ ID NO: 37654 - DNA, 20 bp, Artificial Sequence
  Synthetic oligonucleotide; CAG chr11 5323048 5323067 5323051 -
tctatgaaaaacttttgcct

SEQ ID NO: 37655 - DNA, 20 bp, Artificial Sequence
  Synthetic oligonucleotide; TAG chr11 5323009 5323028 5323012 -
tacatgtttatgtgtttgca

SEQ ID NO: 37656 - DNA, 20 bp, Artificial Sequence
  Synthetic oligonucleotide; AGG chr11 5323008 5323027 5323011 -
acatgtttatgtgtttgcat

SEQ ID NO: 37657 - DNA, 20 bp, Artificial Sequence
  Synthetic oligonucleotide; AAG chr11 5322994 5323013 5322997 -
ttgcataggctaatgcacac

SEQ ID NO: 37658 - DNA, 20 bp, Artificial Sequence
  Synthetic oligonucleotide; AAG chr11 5322980 5322999 5322983 -
gcacacaagtgtaaaaaaaa

SEQ ID NO: 37659 - DNA, 20 bp, Artificial Sequence
  Synthetic oligonucleotide; TAG chr11 5322962 5322981 5322965 -
aaaagttgatcatcattctc

SEQ ID NO: 37660 - DNA, 20 bp, Artificial Sequence
  Synthetic oligonucleotide; TGG chr11 5322924 5322943 5322927 -
taaaattttcattattctca

SEQ ID NO: 37661 - DNA, 20 bp, Artificial Sequence
  Synthetic oligonucleotide; TAG chr11 5322915 5322934 5322918 -
cattattctcatggcaaata

SEQ ID NO: 37662 - DNA, 20 bp, Artificial Sequence
  Synthetic oligonucleotide; AAG chr11 5322908 5322927 5322911 -
ctcatggcaaatatagtgat

SEQ ID NO: 37663 - DNA, 20 bp, Artificial Sequence
  Synthetic oligonucleotide; AAG chr11 5322876 5322895 5322879 -
ttttaaatttacttttaaat

SEQ ID NO: 37664 - DNA, 20 bp, Artificial Sequence
  Synthetic oligonucleotide; AAG chr11 5322872 5322891 5322875 -
aaatttacttttaaataagt

SEQ ID NO: 37665 - DNA, 20 bp, Artificial Sequence
  Synthetic oligonucleotide; TGG chr11 5322866 5322885 5322869 -
acttttaaataagtaagtgt

SEQ ID NO: 37666 - DNA, 20 bp, Artificial Sequence
  Synthetic oligonucleotide; GAG chr11 5322838 5322857 5322841 -
ttttaactgtcctctaccct

SEQ ID NO: 37667 - DNA, 20 bp, Artificial Sequence
  Synthetic oligonucleotide; TAG chr11 5322834 5322853 5322837 -
aactgtcctctaccctgagt

SEQ ID NO: 37668 - DNA, 20 bp, Artificial Sequence
  Synthetic oligonucleotide; AGG chr11 5322833 5322852 5322836 -
actgtcctctaccctgagtt

SEQ ID NO: 37669 - DNA, 20 bp, Artificial Sequence
  Synthetic oligonucleotide; GGG chr11 5322832 5322851 5322835 -
ctgtcctctaccctgagtta

SEQ ID NO: 37670 - DNA, 20 bp, Artificial Sequence
  Synthetic oligonucleotide; TAG chr11 5322822 5322841 5322825 -
ccctgagttagggtactctc

SEQ ID NO: 37671 - DNA, 20 bp, Artificial Sequence
  Synthetic oligonucleotide; AGG chr11 5322821 5322840 5322824 -
cctgagttagggtactctct

SEQ ID NO: 37672 - DNA, 20 bp, Artificial Sequence
  Synthetic oligonucleotide; GGG chr11 5322820 5322839 5322823 -
ctgagttagggtactctcta

SEQ ID NO: 37673 - DNA, 20 bp, Artificial Sequence
  Synthetic oligonucleotide; CAG chr11 5322787 5322806 5322790 -
catttaatattttctaaata

SEQ ID NO: 37674 - DNA, 20 bp, Artificial Sequence
  Synthetic oligonucleotide; AAG chr11 5322780 5322799 5322783 -
tattttctaaatacagtcgt

SEQ ID NO: 37675 - DNA, 20 bp, Artificial Sequence
  Synthetic oligonucleotide; CAG chr11 5322770 5322789 5322773 -
atacagtcgtaagtcactta

SEQ ID NO: 37676 - DNA, 20 bp, Artificial Sequence
  Synthetic oligonucleotide; GAG chr11 5322768 5322787 5322771 -
acagtcgtaagtcacttaca

SEQ ID NO: 37677 - DNA, 20 bp, Artificial Sequence
  Synthetic oligonucleotide; AAG chr11 5322756 5322775 5322759 -
cacttacagagtatttcaat

SEQ ID NO: 37678 - DNA, 20 bp, Artificial Sequence
  Synthetic oligonucleotide; GAG chr11 5322754 5322773 5322757 -
cttacagagtatttcaataa

SEQ ID NO: 37679 - DNA, 20 bp, Artificial Sequence
  Synthetic oligonucleotide; CAG chr11 5322725 5322744 5322728 -
aattttcaatacattccttg

SEQ ID NO: 37680 - DNA, 20 bp, Artificial Sequence
  Synthetic oligonucleotide; AGG chr11 5322724 5322743 5322727 -
attttcaatacattccttgc

SEQ ID NO: 37681 - DNA, 20 bp, Artificial Sequence
  Synthetic oligonucleotide; TGG chr11 5322716 5322735 5322719 -
tacattccttgcaggatgtc

SEQ ID NO: 37682 - DNA, 20 bp, Artificial Sequence
  Synthetic oligonucleotide; AAG chr11 5322704 5322723 5322707 -
aggatgtctggattttataa

SEQ ID NO: 37683 - DNA, 20 bp, Artificial Sequence
  Synthetic oligonucleotide; TAG chr11 5322649 5322668 5322652 -
tcttttgcccaaaaaaatct

SEQ ID NO: 37684 - DNA, 20 bp, Artificial Sequence
  Synthetic oligonucleotide; AAG chr11 5322646 5322665 5322649 -
tttgcccaaaaaaatcttag

SEQ ID NO: 37685 - DNA, 20 bp, Artificial Sequence
  Synthetic oligonucleotide; AGG chr11 5322645 5322664 5322648 -
ttgcccaaaaaaatcttaga

SEQ ID NO: 37686 - DNA, 20 bp, Artificial Sequence
  Synthetic oligonucleotide; TAG chr11 5322635 5322654 5322638 -
aaatcttagaaggaaaaacc

SEQ ID NO: 37687 - DNA, 20 bp, Artificial Sequence
  Synthetic oligonucleotide; AAG chr11 5322630 5322649 5322633 -
ttagaaggaaaaacctagac

SEQ ID NO: 37688 - DNA, 20 bp, Artificial Sequence
  Synthetic oligonucleotide; CAG chr11 5322619 5322638 5322622 -
aacctagacaagcttcttgt

SEQ ID NO: 37689 - DNA, 20 bp, Artificial Sequence
  Synthetic oligonucleotide; AAG chr11 5322607 5322626 5322610 -
cttcttgtcagctcgtaaaa

SEQ ID NO: 37690 - DNA, 20 bp, Artificial Sequence
  Synthetic oligonucleotide; AAG chr11 5322600 5322619 5322603 -
tcagctcgtaaaaaagtaaa

SEQ ID NO: 37691 - DNA, 20 bp, Artificial Sequence
  Synthetic oligonucleotide; GAG chr11 5322596 5322615 5322599 -
ctcgtaaaaaagtaaaaagt

SEQ ID NO: 37692 - DNA, 20 bp, Artificial Sequence
  Synthetic oligonucleotide; AAG chr11 5322588 5322607 5322591 -
aaagtaaaaagtgagttttt

SEQ ID NO: 37693 - DNA, 20 bp, Artificial Sequence
  Synthetic oligonucleotide; GAG chr11 5322586 5322605 5322589 -
agtaaaaagtgagtttttaa

SEQ ID NO: 37694 - DNA, 20 bp, Artificial Sequence
  Synthetic oligonucleotide; CAG chr11 5322570 5322589 5322573 -
ttaagagtatgtttgctctt

SEQ ID NO: 37695 - DNA, 20 bp, Artificial Sequence
  Synthetic oligonucleotide; TGG chr11 5322544 5322563 5322547 -
attttaacatacttttccct

SEQ ID NO: 37696 - DNA, 20 bp, Artificial Sequence
  Synthetic oligonucleotide; TAG chr11 5322533 5322552 5322536 -
cttttcccttggcctaataa

SEQ ID NO: 37697 - DNA, 20 bp, Artificial Sequence
  Synthetic oligonucleotide; AGG chr11 5322532 5322551 5322535 -
ttttcccttggcctaataat

SEQ ID NO: 37698 - DNA, 20 bp, Artificial Sequence
  Synthetic oligonucleotide; AAG chr11 5322529 5322548 5322532 -
tcccttggcctaataatagg

SEQ ID NO: 37699 - DNA, 20 bp, Artificial Sequence
  Synthetic oligonucleotide; AGG chr11 5322528 5322547 5322531 -
cccttggcctaataatagga

SEQ ID NO: 37700 - DNA, 20 bp, Artificial Sequence
  Synthetic oligonucleotide; GGG chr11 5322527 5322546 5322530 -
ccttggcctaataataggaa

SEQ ID NO: 37701 - DNA, 20 bp, Artificial Sequence
  Synthetic oligonucleotide; AAG chr11 5322522 5322541 5322525 -
gcctaataataggaagggtc

SEQ ID NO: 37702 - DNA, 20 bp, Artificial Sequence
  Synthetic oligonucleotide; AGG chr11 5322521 5322540 5322524 -
cctaataataggaagggtca

SEQ ID NO: 37703 - DNA, 20 bp, Artificial Sequence
  Synthetic oligonucleotide; TAG chr11 5322505 5322524 5322508 -
gtcaaggctctattcaaaaa

SEQ ID NO: 37704 - DNA, 20 bp, Artificial Sequence
  Synthetic oligonucleotide; TAG chr11 5322496 5322515 5322499 -
ctattcaaaaatagaaaata

SEQ ID NO: 37705 - DNA, 20 bp, Artificial Sequence
  Synthetic oligonucleotide; TAG chr11 5322487 5322506 5322490 -
aatagaaaatatagccattc

SEQ ID NO: 37706 - DNA, 20 bp, Artificial Sequence
  Synthetic oligonucleotide; GAG chr11 5322472 5322491 5322475 -
cattctagaatgaaaaatat

SEQ ID NO: 37707 - DNA, 20 bp, Artificial Sequence
  Synthetic oligonucleotide; AAG chr11 5322454 5322473 5322457 -
atgagacatcattacttcac

SEQ ID NO: 37708 - DNA, 20 bp, Artificial Sequence
  Synthetic oligonucleotide; CAG chr11 5322429 5322448 5322432 -
atatatactttatatatgtt

SEQ ID NO: 37709 - DNA, 20 bp, Artificial Sequence
  Synthetic oligonucleotide; GAG chr11 5322427 5322446 5322430 -
atatactttatatatgttca

SEQ ID NO: 37710 - DNA, 20 bp, Artificial Sequence
  Synthetic oligonucleotide; AGG chr11 5322426 5322445 5322429 -
tatactttatatatgttcag

SEQ ID NO: 37711 - DNA, 20 bp, Artificial Sequence
  Synthetic oligonucleotide; GGG chr11 5322425 5322444 5322428 -
atactttatatatgttcaga

SEQ ID NO: 37712 - DNA, 20 bp, Artificial Sequence
  Synthetic oligonucleotide; TAG chr11 5322416 5322435 5322419 -
atatgttcagagggaaaaat

SEQ ID NO: 37713 - DNA, 20 bp, Artificial Sequence
  Synthetic oligonucleotide; TGG chr11 5322410 5322429 5322413 -
tcagagggaaaaattagaaa

SEQ ID NO: 37714 - DNA, 20 bp, Artificial Sequence
  Synthetic oligonucleotide; TAG chr11 5322354 5322373 5322357 -
ctactgtaaactctctatat

SEQ ID NO: 37715 - DNA, 20 bp, Artificial Sequence
  Synthetic oligonucleotide; AGG chr11 5322353 5322372 5322356 -
tactgtaaactctctatatt

SEQ ID NO: 37716 - DNA, 20 bp, Artificial Sequence
  Synthetic oligonucleotide; AAG chr11 5322350 5322369 5322353 -
tgtaaactctctatattagg

SEQ ID NO: 37717 - DNA, 20 bp, Artificial Sequence
  Synthetic oligonucleotide; GAG chr11 5322335 5322354 5322338 -
ttaggaagaccaacaatgtt

SEQ ID NO: 37718 - DNA, 20 bp, Artificial Sequence
  Synthetic oligonucleotide; GAG chr11 5322333 5322352 5322336 -
aggaagaccaacaatgttga

SEQ ID NO: 37719 - DNA, 20 bp, Artificial Sequence
  Synthetic oligonucleotide; TGG chr11 5322327 5322346 5322330 -
accaacaatgttgagagaaa

SEQ ID NO: 37720 - DNA, 20 bp, Artificial Sequence
  Synthetic oligonucleotide; TGG chr11 5322294 5322313 5322297 -
atccaatgactaaaaaattg

SEQ ID NO: 37721 - DNA, 20 bp, Artificial Sequence
  Synthetic oligonucleotide; TGG chr11 5322291 5322310 5322294 -
caatgactaaaaaattgtgg

SEQ ID NO: 37722 - DNA, 20 bp, Artificial Sequence
  Synthetic oligonucleotide; GGG chr11 5322290 5322309 5322293 -
aatgactaaaaaattgtggt

SEQ ID NO: 37723 - DNA, 20 bp, Artificial Sequence
  Synthetic oligonucleotide; GAG chr11 5322288 5322307 5322291 -
tgactaaaaaattgtggtgg

SEQ ID NO: 37724 - DNA, 20 bp, Artificial Sequence
  Synthetic oligonucleotide; AGG chr11 5322287 5322306 5322290 -
gactaaaaaattgtggtggg

SEQ ID NO: 37725 - DNA, 20 bp, Artificial Sequence
  Synthetic oligonucleotide; GAG chr11 5322285 5322304 5322288 -
ctaaaaaattgtggtgggag

SEQ ID NO: 37726 - DNA, 20 bp, Artificial Sequence
  Synthetic oligonucleotide; AAG chr11 5322260 5322279 5322263 -
tttgtgtgactgtgtactaa

SEQ ID NO: 37727 - DNA, 20 bp, Artificial Sequence
  Synthetic oligonucleotide; TAG chr11 5322250 5322269 5322253 -
tgtgtactaaaagcttcttt

SEQ ID NO: 37728 - DNA, 20 bp, Artificial Sequence
  Synthetic oligonucleotide; CAG chr11 5322229 5322248 5322232 -
agactgatttaattgtgaaa

SEQ ID NO: 37729 - DNA, 20 bp, Artificial Sequence
  Synthetic oligonucleotide; AGG chr11 5322228 5322247 5322231 -
gactgatttaattgtgaaac

SEQ ID NO: 37730 - DNA, 20 bp, Artificial Sequence
  Synthetic oligonucleotide; AAG chr11 5322204 5322223 5322207 -
ttttcatccacaaatttcaa

SEQ ID NO: 37731 - DNA, 20 bp, Artificial Sequence
  Synthetic oligonucleotide; AGG chr11 5322203 5322222 5322206 -
tttcatccacaaatttcaaa

SEQ ID NO: 37732 - DNA, 20 bp, Artificial Sequence
  Synthetic oligonucleotide; GGG chr11 5322202 5322221 5322205 -
ttcatccacaaatttcaaaa

SEQ ID NO: 37733 - DNA, 20 bp, Artificial Sequence
  Synthetic oligonucleotide; GGG chr11 5322201 5322220 5322204 -
tcatccacaaatttcaaaag

SEQ ID NO: 37734 - DNA, 20 bp, Artificial Sequence
  Synthetic oligonucleotide; CAG chr11 5322187 5322206 5322190 -
caaaaggggaaaacctatct

SEQ ID NO: 37735 - DNA, 20 bp, Artificial Sequence
  Synthetic oligonucleotide; GAG chr11 5322185 5322204 5322188 -
aaaggggaaaacctatctca

SEQ ID NO: 37736 - DNA, 20 bp, Artificial Sequence
  Synthetic oligonucleotide; AAG chr11 5322172 5322191 5322175 -
tatctcagagtataatgttc

SEQ ID NO: 37737 - DNA, 20 bp, Artificial Sequence
  Synthetic oligonucleotide; AAG chr11 5322137 5322156 5322140 -
aatataaactcaaatcctaa

SEQ ID NO: 37738 - DNA, 20 bp, Artificial Sequence
  Synthetic oligonucleotide; CAG chr11 5322133 5322152 5322136 -
taaactcaaatcctaaaagt

SEQ ID NO: 37739 - DNA, 20 bp, Artificial Sequence
  Synthetic oligonucleotide; AAG chr11 5322120 5322139 5322123 -
taaaagtcagttatctacca

SEQ ID NO: 37740 - DNA, 20 bp, Artificial Sequence
  Synthetic oligonucleotide; GAG chr11 5322089 5322108 5322092 -
tgttccttatatgtgaccat

SEQ ID NO: 37741 - DNA, 20 bp, Artificial Sequence
  Synthetic oligonucleotide; AGG chr11 5322088 5322107 5322091 -
gttccttatatgtgaccatg

SEQ ID NO: 37742 - DNA, 20 bp, Artificial Sequence
  Synthetic oligonucleotide; TAG chr11 5322072 5322091 5322075 -
catgaggtctataatacatc

SEQ ID NO: 37743 - DNA, 20 bp, Artificial Sequence
  Synthetic oligonucleotide; AGG chr11 5322071 5322090 5322074 -
atgaggtctataatacatct

SEQ ID NO: 37744 - DNA, 20 bp, Artificial Sequence
  Synthetic oligonucleotide; TGG chr11 5322060 5322079 5322063 -
aatacatctaggcatcttaa

SEQ ID NO: 37745 - DNA, 20 bp, Artificial Sequence
  Synthetic oligonucleotide; CGG chr11 5322044 5322063 5322047 -
ttaatggaaaaatctcattt

SEQ ID NO: 37746 - DNA, 20 bp, Artificial Sequence
  Synthetic oligonucleotide; CAG chr11 5322010 5322029 5322013 -
cttgatttgctatcttgatg

SEQ ID NO: 37747 - DNA, 20 bp, Artificial Sequence
  Synthetic oligonucleotide; TAG chr11 5321998 5322017 5322001 -
tcttgatgcagaacctcttg

SEQ ID NO: 37748 - DNA, 20 bp, Artificial Sequence
  Synthetic oligonucleotide; GAG chr11 5321993 5322012 5321996 -
atgcagaacctcttgtagct

SEQ ID NO: 37749 - DNA, 20 bp, Artificial Sequence
  Synthetic oligonucleotide; AGG chr11 5321992 5322011 5321995 -
tgcagaacctcttgtagctg

SEQ ID NO: 37750 - DNA, 20 bp, Artificial Sequence
  Synthetic oligonucleotide; AAG chr11 5321988 5322007 5321991 -
gaacctcttgtagctgagga

SEQ ID NO: 37751 - DNA, 20 bp, Artificial Sequence
  Synthetic oligonucleotide; TAG chr11 5321962 5321981 5321965 -
gcctttgtttcccatctttg

SEQ ID NO: 37752 - DNA, 20 bp, Artificial Sequence
  Synthetic oligonucleotide; CAG chr11 5321957 5321976 5321960 -
tgtttcccatctttgtagaa

SEQ ID NO: 37753 - DNA, 20 bp, Artificial Sequence
  Synthetic oligonucleotide; AAG chr11 5321954 5321973 5321957 -
ttcccatctttgtagaacag

SEQ ID NO: 37754 - DNA, 20 bp, Artificial Sequence
  Synthetic oligonucleotide; TGG chr11 5321948 5321967 5321951 -
tctttgtagaacagaagctg

SEQ ID NO: 37755 - DNA, 20 bp, Artificial Sequence
  Synthetic oligonucleotide; GGG chr11 5321947 5321966 5321950 -
ctttgtagaacagaagctgt

SEQ ID NO: 37756 - DNA, 20 bp, Artificial Sequence
  Synthetic oligonucleotide; AAG chr11 5321937 5321956 5321940 -
cagaagctgtgggacatcac

SEQ ID NO: 37757 - DNA, 20 bp, Artificial Sequence
  Synthetic oligonucleotide; TGG chr11 5321928 5321947 5321931 -
tgggacatcacaagttgctg

SEQ ID NO: 37758 - DNA, 20 bp, Artificial Sequence
  Synthetic oligonucleotide; AAG chr11 5321918 5321937 5321921 -
caagttgctgtggtaatcac

SEQ ID NO: 37759 - DNA, 20 bp, Artificial Sequence
  Synthetic oligonucleotide; GAG chr11 5321876 5321895 5321879 -
ccatctgatatctaaatttt

SEQ ID NO: 37760 - DNA, 20 bp, Artificial Sequence
  Synthetic oligonucleotide; AGG chr11 5321875 5321894 5321878 -
catctgatatctaaattttg

SEQ ID NO: 37761 - DNA, 20 bp, Artificial Sequence
  Synthetic oligonucleotide; TAG chr11 5321871 5321890 5321874 -
tgatatctaaattttgagga

SEQ ID NO: 37762 - DNA, 20 bp, Artificial Sequence
  Synthetic oligonucleotide; AGG chr11 5321870 5321889 5321873 -
gatatctaaattttgaggat

SEQ ID NO: 37763 - DNA, 20 bp, Artificial Sequence
  Synthetic oligonucleotide; CAG chr11 5321855 5321874 5321858 -
aggataggctatctgtttta

SEQ ID NO: 37764 - DNA, 20 bp, Artificial Sequence
  Synthetic oligonucleotide; TGG chr11 5321840 5321859 5321843 -
ttttacagtgatacatttga

SEQ ID NO: 37765 - DNA, 20 bp, Artificial Sequence
  Synthetic oligonucleotide; AAG chr11 5321837 5321856 5321840 -
tacagtgatacatttgatgg

SEQ ID NO: 37766 - DNA, 20 bp, Artificial Sequence
  Synthetic oligonucleotide; AGG chr11 5321836 5321855 5321839 -
acagtgatacatttgatgga

SEQ ID NO: 37767 - DNA, 20 bp, Artificial Sequence
  Synthetic oligonucleotide; TAG chr11 5321828 5321847 5321831 -
acatttgatggaaggactct

SEQ ID NO: 37768 - DNA, 20 bp, Artificial Sequence
  Synthetic oligonucleotide; TGG chr11 5321819 5321838 5321822 -
ggaaggactcttagtttaac

SEQ ID NO: 37769 - DNA, 20 bp, Artificial Sequence
  Synthetic oligonucleotide; AAG chr11 5321814 5321833 5321817 -
gactcttagtttaactggcc

SEQ ID NO: 37770 - DNA, 20 bp, Artificial Sequence
  Synthetic oligonucleotide; AGG chr11 5321813 5321832 5321816 -
actcttagtttaactggcca

SEQ ID NO: 37771 - DNA, 20 bp, Artificial Sequence
  Synthetic oligonucleotide; CAG chr11 5321809 5321828 5321812 -
ttagtttaactggccaaggc

SEQ ID NO: 37772 - DNA, 20 bp, Artificial Sequence
  Synthetic oligonucleotide; AGG chr11 5321808 5321827 5321811 -
tagtttaactggccaaggcc

SEQ ID NO: 37773 - DNA, 20 bp, Artificial Sequence
  Synthetic oligonucleotide; AAG chr11 5321800 5321819 5321803 -
ctggccaaggccaggacttc

SEQ ID NO: 37774 - DNA, 20 bp, Artificial Sequence
  Synthetic oligonucleotide; TAG chr11 5321794 5321813 5321797 -
aaggccaggacttcaagcca

SEQ ID NO: 37775 - DNA, 20 bp, Artificial Sequence
  Synthetic oligonucleotide; GAG chr11 5321769 5321788 5321772 -
taattacctgccacatgtgt

SEQ ID NO: 37776 - DNA, 20 bp, Artificial Sequence
  Synthetic oligonucleotide; AAG chr11 5321762 5321781 5321765 -
ctgccacatgtgtgagaaat

SEQ ID NO: 37777 - DNA, 20 bp, Artificial Sequence
  Synthetic oligonucleotide; AGG chr11 5321761 5321780 5321764 -
tgccacatgtgtgagaaata

SEQ ID NO: 37778 - DNA, 20 bp, Artificial Sequence
  Synthetic oligonucleotide; AAG chr11 5321758 5321777 5321761 -
cacatgtgtgagaaataagg

SEQ ID NO: 37779 - DNA, 20 bp, Artificial Sequence
  Synthetic oligonucleotide; TGG chr11 5321742 5321761 5321745 -
aaggaagtttcaaaccatga

SEQ ID NO: 37780 - DNA, 20 bp, Artificial Sequence
  Synthetic oligonucleotide; GAG chr11 5321740 5321759 5321743 -
ggaagtttcaaaccatgatg

SEQ ID NO: 37781 - DNA, 20 bp, Artificial Sequence
  Synthetic oligonucleotide; CAG chr11 5321737 5321756 5321740 -
agtttcaaaccatgatggag

SEQ ID NO: 37782 - DNA, 20 bp, Artificial Sequence
  Synthetic oligonucleotide; TGG chr11 5321728 5321747 5321731 -
ccatgatggagcagcatcac

SEQ ID NO: 37783 - DNA, 20 bp, Artificial Sequence
  Synthetic oligonucleotide; TGG chr11 5321708 5321727 5321711 -
tggcatgccttttgtgtata

SEQ ID NO: 37784 - DNA, 20 bp, Artificial Sequence
  Synthetic oligonucleotide; TGG chr11 5321705 5321724 5321708 -
catgccttttgtgtatatgg

SEQ ID NO: 37785 - DNA, 20 bp, Artificial Sequence
  Synthetic oligonucleotide; GGG chr11 5321704 5321723 5321707 -
atgccttttgtgtatatggt

SEQ ID NO: 37786 - DNA, 20 bp, Artificial Sequence
  Synthetic oligonucleotide; GAG chr11 5321699 5321718 5321702 -
ttttgtgtatatggtgggtt

SEQ ID NO: 37787 - DNA, 20 bp, Artificial Sequence
  Synthetic oligonucleotide; AGG chr11 5321698 5321717 5321701 -
tttgtgtatatggtgggttg

SEQ ID NO: 37788 - DNA, 20 bp, Artificial Sequence
  Synthetic oligonucleotide; TGG chr11 5321692 5321711 5321695 -
tatatggtgggttgaggata

SEQ ID NO: 37789 - DNA, 20 bp, Artificial Sequence
  Synthetic oligonucleotide; CAG chr11 5321681 5321700 5321684 -
ttgaggatatggcaatattg

SEQ ID NO: 37790 - DNA, 20 bp, Artificial Sequence
  Synthetic oligonucleotide; TAG chr11 5321668 5321687 5321671 -
aatattgcagcctcactgaa

SEQ ID NO: 37791 - DNA, 20 bp, Artificial Sequence
  Synthetic oligonucleotide; AGG chr11 5321667 5321686 5321670 -
atattgcagcctcactgaat

SEQ ID NO: 37792 - DNA, 20 bp, Artificial Sequence
  Synthetic oligonucleotide; AAG chr11 5321661 5321680 5321664 -
cagcctcactgaataggtat

SEQ ID NO: 37793 - DNA, 20 bp, Artificial Sequence
  Synthetic oligonucleotide; AGG chr11 5321660 5321679 5321663 -
agcctcactgaataggtata

SEQ ID NO: 37794 - DNA, 20 bp, Artificial Sequence
  Synthetic oligonucleotide; GAG chr11 5321658 5321677 5321661 -
cctcactgaataggtataag

SEQ ID NO: 37795 - DNA, 20 bp, Artificial Sequence
  Synthetic oligonucleotide; AGG chr11 5321657 5321676 5321660 -
ctcactgaataggtataagg

SEQ ID NO: 37796 - DNA, 20 bp, Artificial Sequence
  Synthetic oligonucleotide; TGG chr11 5321645 5321664 5321648 -
gtataaggaggtgcttactt

SEQ ID NO: 37797 - DNA, 20 bp, Artificial Sequence
  Synthetic oligonucleotide; AAG chr11 5321640 5321659 5321643 -
aggaggtgcttactttggat

SEQ ID NO: 37798 - DNA, 20 bp, Artificial Sequence
  Synthetic oligonucleotide; CAG chr11 5321637 5321656 5321640 -
aggtgcttactttggataag

SEQ ID NO: 37799 - DNA, 20 bp, Artificial Sequence
  Synthetic oligonucleotide; AAG chr11 5321624 5321643 5321627 -
ggataagcagtgttgtttcc

SEQ ID NO: 37800 - DNA, 20 bp, Artificial Sequence
  Synthetic oligonucleotide; AAG chr11 5321617 5321636 5321620 -
cagtgttgtttccaagatga

SEQ ID NO: 37801 - DNA, 20 bp, Artificial Sequence
  Synthetic oligonucleotide; AAG chr11 5321614 5321633 5321617 -
tgttgtttccaagatgaaag

SEQ ID NO: 37802 - DNA, 20 bp, Artificial Sequence
  Synthetic oligonucleotide; TGG chr11 5321601 5321620 5321604 -
atgaaagaagcccaaattat

SEQ ID NO: 37803 - DNA, 20 bp, Artificial Sequence
  Synthetic oligonucleotide; GGG chr11 5321600 5321619 5321603 -
tgaaagaagcccaaattatt

SEQ ID NO: 37804 - DNA, 20 bp, Artificial Sequence
  Synthetic oligonucleotide; TGG chr11 5321562 5321581 5321565 -
taatgacgttgtccttaaac

SEQ ID NO: 37805 - DNA, 20 bp, Artificial Sequence
  Synthetic oligonucleotide; TAG chr11 5321557 5321576 5321560 -
acgttgtccttaaactggtt

SEQ ID NO: 37806 - DNA, 20 bp, Artificial Sequence
  Synthetic oligonucleotide; TGG chr11 5321535 5321554 5321538 -
gacgttgaattctctgttct

SEQ ID NO: 37807 - DNA, 20 bp, Artificial Sequence
  Synthetic oligonucleotide; TGG chr11 5321524 5321543 5321527 -
ctctgttcttggtgccttca

SEQ ID NO: 37808 - DNA, 20 bp, Artificial Sequence
  Synthetic oligonucleotide; AAG chr11 5321514 5321533 5321517 -
ggtgccttcatggttgttta

SEQ ID NO: 37809 - DNA, 20 bp, Artificial Sequence
  Synthetic oligonucleotide; AAG chr11 5321488 5321507 5321491 -
atatttttcaaattgattct

SEQ ID NO: 37810 - DNA, 20 bp, Artificial Sequence
  Synthetic oligonucleotide; GAG chr11 5321486 5321505 5321489 -
atttttcaaattgattctaa

SEQ ID NO: 37811 - DNA, 20 bp, Artificial Sequence
  Synthetic oligonucleotide; AGG chr11 5321485 5321504 5321488 -
tttttcaaattgattctaag

SEQ ID NO: 37812 - DNA, 20 bp, Artificial Sequence
  Synthetic oligonucleotide; GGG chr11 5321484 5321503 5321487 -
ttttcaaattgattctaaga

SEQ ID NO: 37813 - DNA, 20 bp, Artificial Sequence
  Synthetic oligonucleotide; TAG chr11 5321467 5321486 5321470 -
agagggtgatctgaatccac

SEQ ID NO: 37814 - DNA, 20 bp, Artificial Sequence
  Synthetic oligonucleotide; GAG chr11 5321450 5321469 5321453 -
cactagcattttatttcatt

SEQ ID NO: 37815 - DNA, 20 bp, Artificial Sequence
  Synthetic oligonucleotide; TAG chr11 5321430 5321449 5321433 -
gagacttttcatcttttaca

SEQ ID NO: 37816 - DNA, 20 bp, Artificial Sequence
  Synthetic oligonucleotide; AAG chr11 5321427 5321446 5321430 -
acttttcatcttttacatag

SEQ ID NO: 37817 - DNA, 20 bp, Artificial Sequence
  Synthetic oligonucleotide; AGG chr11 5321426 5321445 5321429 -
cttttcatcttttacataga

SEQ ID NO: 37818 - DNA, 20 bp, Artificial Sequence
  Synthetic oligonucleotide; AAG chr11 5321418 5321437 5321421 -
cttttacatagaaggaaact

SEQ ID NO: 37819 - DNA, 20 bp, Artificial Sequence
  Synthetic oligonucleotide; TAG chr11 5321411 5321430 5321414 -
atagaaggaaactaagttat

SEQ ID NO: 37820 - DNA, 20 bp, Artificial Sequence
  Synthetic oligonucleotide; AAG chr11 5321380 5321399 5321383 -
aatatcaactttcatgataa

SEQ ID NO: 37821 - DNA, 20 bp, Artificial Sequence
  Synthetic oligonucleotide; CAG chr11 5321372 5321391 5321375 -
ctttcatgataaaagataca

SEQ ID NO: 37822 - DNA, 20 bp, Artificial Sequence
  Synthetic oligonucleotide; GAG chr11 5321361 5321380 5321364 -
aaagatacacagtcccttct

SEQ ID NO: 37823 - DNA, 20 bp, Artificial Sequence
  Synthetic oligonucleotide; AGG chr11 5321360 5321379 5321363 -
aagatacacagtcccttctg

SEQ ID NO: 37824 - DNA, 20 bp, Artificial Sequence
  Synthetic oligonucleotide; GGG chr11 5321359 5321378 5321362 -
agatacacagtcccttctga

SEQ ID NO: 37825 - DNA, 20 bp, Artificial Sequence
  Synthetic oligonucleotide; AAG chr11 5321353 5321372 5321356 -
acagtcccttctgagggcac

SEQ ID NO: 37826 - DNA, 20 bp, Artificial Sequence
  Synthetic oligonucleotide; CAG chr11 5321328 5321347 5321331 -
aatacttcattaaaccaaac

SEQ ID NO: 37827 - DNA, 20 bp, Artificial Sequence
  Synthetic oligonucleotide; AAG chr11 5321298 5321317 5321301 -
tcttctgtcatatttttaat

SEQ ID NO: 37828 - DNA, 20 bp, Artificial Sequence
  Synthetic oligonucleotide; AGG chr11 5321297 5321316 5321300 -
cttctgtcatatttttaata

SEQ ID NO: 37829 - DNA, 20 bp, Artificial Sequence
  Synthetic oligonucleotide; GAG chr11 5321295 5321314 5321298 -
tctgtcatatttttaataag

SEQ ID NO: 37830 - DNA, 20 bp, Artificial Sequence
  Synthetic oligonucleotide; AGG chr11 5321294 5321313 5321297 -
ctgtcatatttttaataagg

SEQ ID NO: 37831 - DNA, 20 bp, Artificial Sequence
  Synthetic oligonucleotide; CAG chr11 5321290 5321309 5321293 -
catatttttaataaggagga

SEQ ID NO: 37832 - DNA, 20 bp, Artificial Sequence
  Synthetic oligonucleotide; CAG chr11 5321247 5321266 5321250 -
aacaaaataatatccttatt

SEQ ID NO: 37833 - DNA, 20 bp, Artificial Sequence
  Synthetic oligonucleotide; TAG chr11 5321147 5321166 5321150 -
ctatatgttaatgaaactgt

SEQ ID NO: 37834 - DNA, 20 bp, Artificial Sequence
  Synthetic oligonucleotide; AAG chr11 5321142 5321161 5321145 -
tgttaatgaaactgttagaa

SEQ ID NO: 37835 - DNA, 20 bp, Artificial Sequence
  Synthetic oligonucleotide; GAG chr11 5321129 5321148 5321132 -
gttagaaaagaaaatgatat

SEQ ID NO: 37836 - DNA, 20 bp, Artificial Sequence
  Synthetic oligonucleotide; CAG chr11 5321116 5321135 5321119 -
atgatatgagtaattttctc

SEQ ID NO: 37837 - DNA, 20 bp, Artificial Sequence
  Synthetic oligonucleotide; AGG chr11 5321115 5321134 5321118 -
tgatatgagtaattttctcc

SEQ ID NO: 37838 - DNA, 20 bp, Artificial Sequence
  Synthetic oligonucleotide; GGG chr11 5321114 5321133 5321117 -
gatatgagtaattttctcca

SEQ ID NO: 37839 - DNA, 20 bp, Artificial Sequence
  Synthetic oligonucleotide; AAG chr11 5321098 5321117 5321101 -
tccagggtatcctttgtgca

SEQ ID NO: 37840 - DNA, 20 bp, Artificial Sequence
  Synthetic oligonucleotide; AAG chr11 5321058 5321077 5321061 -
ttctcttcatcttttctaca

SEQ ID NO: 37841 - DNA, 20 bp, Artificial Sequence
  Synthetic oligonucleotide; CAG chr11 5321054 5321073 5321057 -
cttcatcttttctacaaagt

SEQ ID NO: 37842 - DNA, 20 bp, Artificial Sequence
  Synthetic oligonucleotide; TAG chr11 5320999 5321018 5321002 -
atcaataaataactgttgat

SEQ ID NO: 37843 - DNA, 20 bp, Artificial Sequence
  Synthetic oligonucleotide; AAG chr11 5320990 5321009 5320993 -
taactgttgattagtgaata

SEQ ID NO: 37844 - DNA, 20 bp, Artificial Sequence
  Synthetic oligonucleotide; TGG chr11 5320964 5320983 5320967 -
ttatcttcttgtgataacta

SEQ ID NO: 37845 - DNA, 20 bp, Artificial Sequence
  Synthetic oligonucleotide; AAG chr11 5320961 5320980 5320964 -
tcttcttgtgataactatgg

SEQ ID NO: 37846 - DNA, 20 bp, Artificial Sequence
  Synthetic oligonucleotide; TGG chr11 5320954 5320973 5320957 -
gtgataactatggaagtcaa

SEQ ID NO: 37847 - DNA, 20 bp, Artificial Sequence
  Synthetic oligonucleotide; CAG chr11 5320937 5320956 5320940 -
caatggaactactctccatt

SEQ ID NO: 37848 - DNA, 20 bp, Artificial Sequence
  Synthetic oligonucleotide; CAG chr11 5320927 5320946 5320930 -
actctccattcagcaaaact

SEQ ID NO: 37849 - DNA, 20 bp, Artificial Sequence
  Synthetic oligonucleotide; CAG chr11 5320919 5320938 5320922 -
ttcagcaaaactcagaaatt

SEQ ID NO: 37850 - DNA, 20 bp, Artificial Sequence
  Synthetic oligonucleotide; AGG chr11 5320918 5320937 5320921 -
tcagcaaaactcagaaattc

SEQ ID NO: 37851 - DNA, 20 bp, Artificial Sequence
  Synthetic oligonucleotide; TGG chr11 5320915 5320934 5320918 -
gcaaaactcagaaattcagg

SEQ ID NO: 37852 - DNA, 20 bp, Artificial Sequence
  Synthetic oligonucleotide; CAG chr11 5320867 5320886 5320870 -
atctactaccttcaatcact

SEQ ID NO: 37853 - DNA, 20 bp, Artificial Sequence
  Synthetic oligonucleotide; AAG chr11 5320855 5320874 5320858 -
caatcactcagttctattct

SEQ ID NO: 37854 - DNA, 20 bp, Artificial Sequence
  Synthetic oligonucleotide; TAG chr11 5320849 5320868 5320852 -
ctcagttctattctaagtca

SEQ ID NO: 37855 - DNA, 20 bp, Artificial Sequence
  Synthetic oligonucleotide; AAG chr11 5320830 5320849 5320833 -
atagaatctctcttctattc

SEQ ID NO: 37856 - DNA, 20 bp, Artificial Sequence
  Synthetic oligonucleotide; TAG chr11 5320802 5320821 5320805 -
ctaatgctactgataacaac

SEQ ID NO: 37857 - DNA, 20 bp, Artificial Sequence
  Synthetic oligonucleotide; TAG chr11 5320704 5320723 5320707 -
ccaacatgtttctcatactg

SEQ ID NO: 37858 - DNA, 20 bp, Artificial Sequence
  Synthetic oligonucleotide; TAG chr11 5320698 5320717 5320701 -
tgtttctcatactgtagcca

SEQ ID NO: 37859 - DNA, 20 bp, Artificial Sequence
  Synthetic oligonucleotide; AAG chr11 5320667 5320686 5320670 -
aacaataactacttgattat

SEQ ID NO: 37860 - DNA, 20 bp, Artificial Sequence
  Synthetic oligonucleotide; TGG chr11 5320627 5320646 5320630 -
gttttatattcattccctta

SEQ ID NO: 37861 - DNA, 20 bp, Artificial Sequence
  Synthetic oligonucleotide; AAG chr11 5320596 5320615 5320599 -
aaatgttttacatgatttgc

SEQ ID NO: 37862 - DNA, 20 bp, Artificial Sequence
  Synthetic oligonucleotide; CAG chr11 5320581 5320600 5320584 -
tttgcaagatatattgtgat

SEQ ID NO: 37863 - DNA, 20 bp, Artificial Sequence
  Synthetic oligonucleotide; CAG chr11 5320563 5320582 5320566 -
atcagaacctgctactacta

SEQ ID NO: 37864 - DNA, 20 bp, Artificial Sequence
  Synthetic oligonucleotide; AAG chr11 5320546 5320565 5320549 -
ctacagattcattttctctc

SEQ ID NO: 37865 - DNA, 20 bp, Artificial Sequence
  Synthetic oligonucleotide; AAG chr11 5320520 5320539 5320523 -
tttttcatgtattgttgttc

SEQ ID NO: 37866 - DNA, 20 bp, Artificial Sequence
  Synthetic oligonucleotide; GAG chr11 5320518 5320537 5320521 -
tttcatgtattgttgttcaa

SEQ ID NO: 37867 - DNA, 20 bp, Artificial Sequence
  Synthetic oligonucleotide; TAG chr11 5320461 5320480 5320464 -
attatttttatttgaattta

SEQ ID NO: 37868 - DNA, 20 bp, Artificial Sequence
  Synthetic oligonucleotide; TAG chr11 5320325 5320344 5320328 -
atactactacactactaata

SEQ ID NO: 37869 - DNA, 20 bp, Artificial Sequence
  Synthetic oligonucleotide; TAG chr11 5320322 5320341 5320325 -
ctactacactactaatatag

SEQ ID NO: 37870 - DNA, 20 bp, Artificial Sequence
  Synthetic oligonucleotide; CAG chr11 5320308 5320327 5320311 -
atatagtagcatttaattct

SEQ ID NO: 37871 - DNA, 20 bp, Artificial Sequence
  Synthetic oligonucleotide; AAG chr11 5320302 5320321 5320305 -
tagcatttaattctcagctt

SEQ ID NO: 37872 - DNA, 20 bp, Artificial Sequence
  Synthetic oligonucleotide; TAG chr11 5320299 5320318 5320302 -
catttaattctcagcttaag

SEQ ID NO: 37873 - DNA, 20 bp, Artificial Sequence
  Synthetic oligonucleotide; TGG chr11 5320287 5320306 5320290 -
agcttaagtagcatttcttc

SEQ ID NO: 37874 - DNA, 20 bp, Artificial Sequence
  Synthetic oligonucleotide; CAG chr11 5320267 5320286 5320270 -
tggaaaatgttccctgatcc

SEQ ID NO: 37875 - DNA, 20 bp, Artificial Sequence
  Synthetic oligonucleotide; TAG chr11 5320241 5320260 5320244 -
tttatttgatgtgtctctca

SEQ ID NO: 37876 - DNA, 20 bp, Artificial Sequence
  Synthetic oligonucleotide; TAG chr11 5320222 5320241 5320225 -
atagcacactaatattcacg

SEQ ID NO: 37877 - DNA, 20 bp, Artificial Sequence
  Synthetic oligonucleotide; TAG chr11 5320213 5320232 5320216 -
taatattcacgtagtaatga

SEQ ID NO: 37878 - DNA, 20 bp, Artificial Sequence
  Synthetic oligonucleotide; TGG chr11 5320195 5320214 5320198 -
gatagtgttgtatgaattca

SEQ ID NO: 37879 - DNA, 20 bp, Artificial Sequence
  Synthetic oligonucleotide; TAG chr11 5320177 5320196 5320180 -
catggtaaatattttctttc

SEQ ID NO: 37880 - DNA, 20 bp, Artificial Sequence
  Synthetic oligonucleotide; TGG chr11 5320166 5320185 5320169 -
ttttctttctagtgcctgct

SEQ ID NO: 37881 - DNA, 20 bp, Artificial Sequence
  Synthetic oligonucleotide; GGG chr11 5320165 5320184 5320168 -
tttctttctagtgcctgctt

SEQ ID NO: 37882 - DNA, 20 bp, Artificial Sequence
  Synthetic oligonucleotide; AAG chr11 5320145 5320164 5320148 -
gggttttaaatttcaataaa

SEQ ID NO: 37883 - DNA, 20 bp, Artificial Sequence
  Synthetic oligonucleotide; AAG chr11 5320139 5320158 5320142 -
taaatttcaataaaaagaac

SEQ ID NO: 37884 - DNA, 20 bp, Artificial Sequence
  Synthetic oligonucleotide; TAG chr11 5320133 5320152 5320136 -
tcaataaaaagaacaagtcc

SEQ ID NO: 37885 - DNA, 20 bp, Artificial Sequence
  Synthetic oligonucleotide; AGG chr11 5320132 5320151 5320135 -
caataaaaagaacaagtcct

SEQ ID NO: 37886 - DNA, 20 bp, Artificial Sequence
  Synthetic oligonucleotide; TGG chr11 5320113 5320132 5320116 -
taggtatttcattttctttg

SEQ ID NO: 37887 - DNA, 20 bp, Artificial Sequence
  Synthetic oligonucleotide; TGG chr11 5320100 5320119 5320103 -
ttctttgtggctgttcttaa

SEQ ID NO: 37888 - DNA, 20 bp, Artificial Sequence
  Synthetic oligonucleotide; GGG chr11 5320099 5320118 5320102 -
tctttgtggctgttcttaat

SEQ ID NO: 37889 - DNA, 20 bp, Artificial Sequence
  Synthetic oligonucleotide; CAG chr11 5320074 5320093 5320077 -
tgtgttctcgatttgactct

SEQ ID NO: 37890 - DNA, 20 bp, Artificial Sequence
  Synthetic oligonucleotide; TGG chr11 5320069 5320088 5320072 -
tctcgatttgactctcagcc

SEQ ID NO: 37891 - DNA, 20 bp, Artificial Sequence
  Synthetic oligonucleotide; GGG chr11 5320068 5320087 5320071 -
ctcgatttgactctcagcct

SEQ ID NO: 37892 - DNA, 20 bp, Artificial Sequence
  Synthetic oligonucleotide; TGG chr11 5320059 5320078 5320062 -
actctcagcctgggccttat

SEQ ID NO: 37893 - DNA, 20 bp, Artificial Sequence
  Synthetic oligonucleotide; TGG chr11 5320052 5320071 5320055 -
gcctgggccttattggtgta

SEQ ID NO: 37894 - DNA, 20 bp, Artificial Sequence
  Synthetic oligonucleotide; CAG chr11 5319990 5320009 5319993 -
accttgctaaaattgtttat

SEQ ID NO: 37895 - DNA, 20 bp, Artificial Sequence
  Synthetic oligonucleotide; TAG chr11 5319984 5320003 5319987 -
ctaaaattgtttatcagttc

SEQ ID NO: 37896 - DNA, 20 bp, Artificial Sequence
  Synthetic oligonucleotide; CAG chr11 5319981 5320000 5319984 -
aaattgtttatcagttctag

SEQ ID NO: 37897 - DNA, 20 bp, Artificial Sequence
  Synthetic oligonucleotide; TGG chr11 5319973 5319992 5319976 -
tatcagttctagcagccttt

SEQ ID NO: 37898 - DNA, 20 bp, Artificial Sequence
  Synthetic oligonucleotide; AAG chr11 5319970 5319989 5319973 -
cagttctagcagccttttgg

SEQ ID NO: 37899 - DNA, 20 bp, Artificial Sequence
  Synthetic oligonucleotide; TAG chr11 5319961 5319980 5319964 -
cagccttttggaagaatctg

SEQ ID NO: 37900 - DNA, 20 bp, Artificial Sequence
  Synthetic oligonucleotide; AGG chr11 5319960 5319979 5319963 -
agccttttggaagaatctgt

SEQ ID NO: 37901 - DNA, 20 bp, Artificial Sequence
  Synthetic oligonucleotide; AAG chr11 5319950 5319969 5319953 -
aagaatctgtaggattttct

SEQ ID NO: 37902 - DNA, 20 bp, Artificial Sequence
  Synthetic oligonucleotide; TAG chr11 5319945 5319964 5319948 -
tctgtaggattttctaagta

SEQ ID NO: 37903 - DNA, 20 bp, Artificial Sequence
  Synthetic oligonucleotide; GAG chr11 5319943 5319962 5319946 -
tgtaggattttctaagtata

SEQ ID NO: 37904 - DNA, 20 bp, Artificial Sequence
  Synthetic oligonucleotide; CAG chr11 5319931 5319950 5319934 -
taagtatagagtcatatcat

SEQ ID NO: 37905 - DNA, 20 bp, Artificial Sequence
  Synthetic oligonucleotide; AAG chr11 5319926 5319945 5319929 -
atagagtcatatcatcagca

SEQ ID NO: 37906 - DNA, 20 bp, Artificial Sequence
  Synthetic oligonucleotide; GAG chr11 5319924 5319943 5319927 -
agagtcatatcatcagcaaa

SEQ ID NO: 37907 - DNA, 20 bp, Artificial Sequence
  Synthetic oligonucleotide; GAG chr11 5319922 5319941 5319925 -
agtcatatcatcagcaaaga

SEQ ID NO: 37908 - DNA, 20 bp, Artificial Sequence
  Synthetic oligonucleotide; TAG chr11 5319918 5319937 5319921 -
atatcatcagcaaagagaga

SEQ ID NO: 37909 - DNA, 20 bp, Artificial Sequence
  Synthetic oligonucleotide; TGG chr11 5319913 5319932 5319916 -
atcagcaaagagagatagtt

SEQ ID NO: 37910 - DNA, 20 bp, Artificial Sequence
  Synthetic oligonucleotide; TGG chr11 5319859 5319878 5319862 -
tttctctcgcctgattgccc

SEQ ID NO: 37911 - DNA, 20 bp, Artificial Sequence
  Synthetic oligonucleotide; TAG chr11 5319855 5319874 5319858 -
tctcgcctgattgccctggt

SEQ ID NO: 37912 - DNA, 20 bp, Artificial Sequence
  Synthetic oligonucleotide; AGG chr11 5319854 5319873 5319857 -
ctcgcctgattgccctggtt

SEQ ID NO: 37913 - DNA, 20 bp, Artificial Sequence
  Synthetic oligonucleotide; TAG chr11 5319831 5319850 5319834 -
acttccaattttatgttcac

SEQ ID NO: 37914 - DNA, 20 bp, Artificial Sequence
  Synthetic oligonucleotide; AGG chr11 5319830 5319849 5319833 -
cttccaattttatgttcact

SEQ ID NO: 37915 - DNA, 20 bp, Artificial Sequence
  Synthetic oligonucleotide; GAG chr11 5319828 5319847 5319831 -
tccaattttatgttcactag

SEQ ID NO: 37916 - DNA, 20 bp, Artificial Sequence
  Synthetic oligonucleotide; TGG chr11 5319825 5319844 5319828 -
aattttatgttcactaggag

SEQ ID NO: 37917 - DNA, 20 bp, Artificial Sequence
  Synthetic oligonucleotide; GAG chr11 5319821 5319840 5319824 -
ttatgttcactaggagtggt

SEQ ID NO: 37918 - DNA, 20 bp, Artificial Sequence
  Synthetic oligonucleotide; TGG chr11 5319816 5319835 5319819 -
ttcactaggagtggtgagaa

SEQ ID NO: 37919 - DNA, 20 bp, Artificial Sequence
  Synthetic oligonucleotide; GGG chr11 5319815 5319834 5319818 -
tcactaggagtggtgagaat

SEQ ID NO: 37920 - DNA, 20 bp, Artificial Sequence
  Synthetic oligonucleotide; CAG chr11 5319796 5319815 5319799 -
tgggaatccttgtcttgttg

SEQ ID NO: 37921 - DNA, 20 bp, Artificial Sequence
  Synthetic oligonucleotide; GAG chr11 5319788 5319807 5319791 -
cttgtcttgttgcagttttc

SEQ ID NO: 37922 - DNA, 20 bp, Artificial Sequence
  Synthetic oligonucleotide; AGG chr11 5319787 5319806 5319790 -
ttgtcttgttgcagttttcg

SEQ ID NO: 37923 - DNA, 20 bp, Artificial Sequence
  Synthetic oligonucleotide; GAG chr11 5319785 5319804 5319788 -
gtcttgttgcagttttcgag

SEQ ID NO: 37924 - DNA, 20 bp, Artificial Sequence
  Synthetic oligonucleotide; TAG chr11 5319780 5319799 5319783 -
gttgcagttttcgaggagaa

SEQ ID NO: 37925 - DNA, 20 bp, Artificial Sequence
  Synthetic oligonucleotide; CAG chr11 5319774 5319793 5319777 -
gttttcgaggagaatagttc

SEQ ID NO: 37926 - DNA, 20 bp, Artificial Sequence
  Synthetic oligonucleotide; CAG chr11 5319759 5319778 5319762 -
agttccagcttttgcccatt

SEQ ID NO: 37927 - DNA, 20 bp, Artificial Sequence
  Synthetic oligonucleotide; TGG chr11 5319754 5319773 5319757 -
cagcttttgcccattcagta

SEQ ID NO: 37928 - DNA, 20 bp, Artificial Sequence
  Synthetic oligonucleotide; TGG chr11 5319748 5319767 5319751 -
ttgcccattcagtatggttt

SEQ ID NO: 37929 - DNA, 20 bp, Artificial Sequence
  Synthetic oligonucleotide; TGG chr11 5319742 5319761 5319745 -
attcagtatggttttggtta

SEQ ID NO: 37930 - DNA, 20 bp, Artificial Sequence
  Synthetic oligonucleotide; GGG chr11 5319741 5319760 5319744 -
ttcagtatggttttggttat

SEQ ID NO: 37931 - DNA, 20 bp, Artificial Sequence
  Synthetic oligonucleotide; TGG chr11 5319727 5319746 5319730 -
ggttatgggtttttcatacg

SEQ ID NO: 37932 - DNA, 20 bp, Artificial Sequence
  Synthetic oligonucleotide; GAG chr11 5319711 5319730 5319714 -
tacgtggcttttattctttt

SEQ ID NO: 37933 - DNA, 20 bp, Artificial Sequence
  Synthetic oligonucleotide; AGG chr11 5319710 5319729 5319713 -
acgtggcttttattcttttg

SEQ ID NO: 37934 - DNA, 20 bp, Artificial Sequence
  Synthetic oligonucleotide; TAG chr11 5319690 5319709 5319693 -
aggtatgttcctttgatgcc

SEQ ID NO: 37935 - DNA, 20 bp, Artificial Sequence
  Synthetic oligonucleotide; TGG chr11 5319682 5319701 5319685 -
tcctttgatgcctagtctgt

SEQ ID NO: 37936 - DNA, 20 bp, Artificial Sequence
  Synthetic oligonucleotide; GAG chr11 5319680 5319699 5319683 -
ctttgatgcctagtctgttg

SEQ ID NO: 37937 - DNA, 20 bp, Artificial Sequence
  Synthetic oligonucleotide; AGG chr11 5319679 5319698 5319682 -
tttgatgcctagtctgttgg

SEQ ID NO: 37938 - DNA, 20 bp, Artificial Sequence
  Synthetic oligonucleotide; AAG chr11 5319665 5319684 5319668 -
tgttggaggtttttatcatg

SEQ ID NO: 37939 - DNA, 20 bp, Artificial Sequence
  Synthetic oligonucleotide; AGG chr11 5319664 5319683 5319667 -
gttggaggtttttatcatga

SEQ ID NO: 37940 - DNA, 20 bp, Artificial Sequence
  Synthetic oligonucleotide; GGG chr11 5319663 5319682 5319666 -
ttggaggtttttatcatgaa

SEQ ID NO: 37941 - DNA, 20 bp, Artificial Sequence
  Synthetic oligonucleotide; AAG chr11 5319643 5319662 5319646 -
gggatgttgaattttattga

SEQ ID NO: 37942 - DNA, 20 bp, Artificial Sequence
  Synthetic oligonucleotide; AGG chr11 5319642 5319661 5319645 -
ggatgttgaattttattgaa

SEQ ID NO: 37943 - DNA, 20 bp, Artificial Sequence
  Synthetic oligonucleotide; CAG chr11 5319632 5319651 5319635 -
ttttattgaaaggtttttct

SEQ ID NO: 37944 - DNA, 20 bp, Artificial Sequence
  Synthetic oligonucleotide; GAG chr11 5319623 5319642 5319626 -
aaggtttttctcagtctatt

SEQ ID NO: 37945 - DNA, 20 bp, Artificial Sequence
  Synthetic oligonucleotide; TGG chr11 5319611 5319630 5319614 -
agtctattgagatgatcata

SEQ ID NO: 37946 - DNA, 20 bp, Artificial Sequence
  Synthetic oligonucleotide; TGG chr11 5319604 5319623 5319607 -
tgagatgatcatatggtttg

SEQ ID NO: 37947 - DNA, 20 bp, Artificial Sequence
  Synthetic oligonucleotide; GGG chr11 5319603 5319622 5319606 -
gagatgatcatatggtttgt

SEQ ID NO: 37948 - DNA, 20 bp, Artificial Sequence
  Synthetic oligonucleotide; GAG chr11 5319601 5319620 5319604 -
gatgatcatatggtttgtgg

SEQ ID NO: 37949 - DNA, 20 bp, Artificial Sequence
  Synthetic oligonucleotide; AGG chr11 5319600 5319619 5319603 -
atgatcatatggtttgtggg

SEQ ID NO: 37950 - DNA, 20 bp, Artificial Sequence
  Synthetic oligonucleotide; AAG chr11 5319594 5319613 5319597 -
atatggtttgtgggaggtga

SEQ ID NO: 37951 - DNA, 20 bp, Artificial Sequence
  Synthetic oligonucleotide; AAG chr11 5319583 5319602 5319586 -
gggaggtgaaagatctctac

SEQ ID NO: 37952 - DNA, 20 bp, Artificial Sequence
  Synthetic oligonucleotide; AGG chr11 5319582 5319601 5319585 -
ggaggtgaaagatctctaca

SEQ ID NO: 37953 - DNA, 20 bp, Artificial Sequence
  Synthetic oligonucleotide; GAG chr11 5319580 5319599 5319583 -
aggtgaaagatctctacaag

SEQ ID NO: 37954 - DNA, 20 bp, Artificial Sequence
  Synthetic oligonucleotide; AAG chr11 5319558 5319577 5319561 -
gaactacaaaacactgctga

SEQ ID NO: 37955 - DNA, 20 bp, Artificial Sequence
  Synthetic oligonucleotide; CAG chr11 5319551 5319570 5319554 -
aaaacactgctgaaagaaat

SEQ ID NO: 37956 - DNA, 20 bp, Artificial Sequence
  Synthetic oligonucleotide; AAG chr11 5319525 5319544 5319528 -
caacacaaataaataaataa

SEQ ID NO: 37957 - DNA, 20 bp, Artificial Sequence
  Synthetic oligonucleotide; CAG chr11 5319517 5319536 5319520 -
ataaataaataaaagctttc

SEQ ID NO: 37958 - DNA, 20 bp, Artificial Sequence
  Synthetic oligonucleotide; AGG chr11 5319516 5319535 5319519 -
taaataaataaaagctttcc

SEQ ID NO: 37959 - DNA, 20 bp, Artificial Sequence
  Synthetic oligonucleotide; TGG chr11 5319509 5319528 5319512 -
ataaaagctttccaggctca

SEQ ID NO: 37960 - DNA, 20 bp, Artificial Sequence
  Synthetic oligonucleotide; TGG chr11 5319504 5319523 5319507 -
agctttccaggctcatggat

SEQ ID NO: 37961 - DNA, 20 bp, Artificial Sequence
  Synthetic oligonucleotide; AAG chr11 5319501 5319520 5319504 -
tttccaggctcatggattgg

SEQ ID NO: 37962 - DNA, 20 bp, Artificial Sequence
  Synthetic oligonucleotide; TGG chr11 5319480 5319499 5319483 -
agaatcaatatgaatttaaa

SEQ ID NO: 37963 - DNA, 20 bp, Artificial Sequence
  Synthetic oligonucleotide; AAG chr11 5319465 5319484 5319468 -
ttaaatggccatactgctca

SEQ ID NO: 37964 - DNA, 20 bp, Artificial Sequence
  Synthetic oligonucleotide; TAG chr11 5319457 5319476 5319460 -
ccatactgctcaaagcaatt

SEQ ID NO: 37965 - DNA, 20 bp, Artificial Sequence
  Synthetic oligonucleotide; CAG chr11 5319411 5319430 5319414 -
attaccaatgtcattcttca

SEQ ID NO: 37966 - DNA, 20 bp, Artificial Sequence
  Synthetic oligonucleotide; TAG chr11 5319405 5319424 5319408 -
aatgtcattcttcacagtat

SEQ ID NO: 37967 - DNA, 20 bp, Artificial Sequence
  Synthetic oligonucleotide; TAG chr11 5319396 5319415 5319399 -
cttcacagtattagaaaaac

SEQ ID NO: 37968 - DNA, 20 bp, Artificial Sequence
  Synthetic oligonucleotide; TGG chr11 5319380 5319399 5319383 -
aaactagtttaaaattcata

SEQ ID NO: 37969 - DNA, 20 bp, Artificial Sequence
  Synthetic oligonucleotide; AAG chr11 5319370 5319389 5319373 -
aaaattcatatggaaccaaa

SEQ ID NO: 37970 - DNA, 20 bp, Artificial Sequence
  Synthetic oligonucleotide; GAG chr11 5319368 5319387 5319371 -
aattcatatggaaccaaaaa

SEQ ID NO: 37971 - DNA, 20 bp, Artificial Sequence
  Synthetic oligonucleotide; CAG chr11 5319359 5319378 5319362 -
ggaaccaaaaagagcctgaa

SEQ ID NO: 37972 - DNA, 20 bp, Artificial Sequence
  Synthetic oligonucleotide; AGG chr11 5319358 5319377 5319361 -
gaaccaaaaagagcctgaac

SEQ ID NO: 37973 - DNA, 20 bp, Artificial Sequence
  Synthetic oligonucleotide; AAG chr11 5319353 5319372 5319356 -
aaaaagagcctgaacaggca

SEQ ID NO: 37974 - DNA, 20 bp, Artificial Sequence
  Synthetic oligonucleotide; AAG chr11 5319343 5319362 5319346 -
tgaacaggcaaagcaatctt

SEQ ID NO: 37975 - DNA, 20 bp, Artificial Sequence
  Synthetic oligonucleotide; CAG chr11 5319340 5319359 5319343 -
acaggcaaagcaatcttaag

SEQ ID NO: 37976 - DNA, 20 bp, Artificial Sequence
  Synthetic oligonucleotide; AAG chr11 5319336 5319355 5319339 -
gcaaagcaatcttaagcaga

SEQ ID NO: 37977 - DNA, 20 bp, Artificial Sequence
  Synthetic oligonucleotide; TGG chr11 5319325 5319344 5319328 -
ttaagcagaaagaacaaaat

SEQ ID NO: 37978 - DNA, 20 bp, Artificial Sequence
  Synthetic oligonucleotide; AAG chr11 5319322 5319341 5319325 -
agcagaaagaacaaaattgg

SEQ ID NO: 37979 - DNA, 20 bp, Artificial Sequence
  Synthetic oligonucleotide; CAG chr11 5319294 5319313 5319297 -
caccacctgacttgaaacta

SEQ ID NO: 37980 - DNA, 20 bp, Artificial Sequence
  Synthetic oligonucleotide; AGG chr11 5319293 5319312 5319296 -
accacctgacttgaaactac

SEQ ID NO: 37981 - DNA, 20 bp, Artificial Sequence
  Synthetic oligonucleotide; CAG chr11 5319289 5319308 5319292 -
cctgacttgaaactacaggc

SEQ ID NO: 37982 - DNA, 20 bp, Artificial Sequence
  Synthetic oligonucleotide; AGG chr11 5319288 5319307 5319291 -
ctgacttgaaactacaggcc

SEQ ID NO: 37983 - DNA, 20 bp, Artificial Sequence
  Synthetic oligonucleotide; CGG chr11 5319283 5319302 5319286 -
ttgaaactacaggccaggca

SEQ ID NO: 37984 - DNA, 20 bp, Artificial Sequence
  Synthetic oligonucleotide; TGG chr11 5319280 5319299 5319283 -
aaactacaggccaggcacgg

SEQ ID NO: 37985 - DNA, 20 bp, Artificial Sequence
  Synthetic oligonucleotide; TAG chr11 5319261 5319280 5319264 -
gtggctcacgcctgtaactc

SEQ ID NO: 37986 - DNA, 20 bp, Artificial Sequence
  Synthetic oligonucleotide; TAG chr11 5319253 5319272 5319256 -
cgcctgtaactctagcactt

SEQ ID NO: 37987 - DNA, 20 bp, Artificial Sequence
  Synthetic oligonucleotide; AGG chr11 5319252 5319271 5319255 -
gcctgtaactctagcacttt

SEQ ID NO: 37988 - DNA, 20 bp, Artificial Sequence
  Synthetic oligonucleotide; GGG chr11 5319251 5319270 5319254 -
cctgtaactctagcacttta

SEQ ID NO: 37989 - DNA, 20 bp, Artificial Sequence
  Synthetic oligonucleotide; GGG chr11 5319250 5319269 5319253 -
ctgtaactctagcactttag

SEQ ID NO: 37990 - DNA, 20 bp, Artificial Sequence
  Synthetic oligonucleotide; GGG chr11 5319249 5319268 5319252 -
tgtaactctagcactttagg

SEQ ID NO: 37991 - DNA, 20 bp, Artificial Sequence
  Synthetic oligonucleotide; GAG chr11 5319244 5319263 5319247 -
ctctagcactttagggggct

SEQ ID NO: 37992 - DNA, 20 bp, Artificial Sequence
  Synthetic oligonucleotide; AGG chr11 5319243 5319262 5319246 -
tctagcactttagggggctg

SEQ ID NO: 37993 - DNA, 20 bp, Artificial Sequence
  Synthetic oligonucleotide; TGG chr11 5319240 5319259 5319243 -
agcactttagggggctgagg

SEQ ID NO: 37994 - DNA, 20 bp, Artificial Sequence
  Synthetic oligonucleotide; GGG chr11 5319239 5319258 5319242 -
gcactttagggggctgaggt

SEQ ID NO: 37995 - DNA, 20 bp, Artificial Sequence
  Synthetic oligonucleotide; GAG chr11 5319226 5319245 5319229 -
ctgaggtgggtgtatcacct

SEQ ID NO: 37996 - DNA, 20 bp, Artificial Sequence
  Synthetic oligonucleotide; AGG chr11 5319225 5319244 5319228 -
tgaggtgggtgtatcacctg

SEQ ID NO: 37997 - DNA, 20 bp, Artificial Sequence
  Synthetic oligonucleotide; CAG chr11 5319221 5319240 5319224 -
gtgggtgtatcacctgaggt

SEQ ID NO: 37998 - DNA, 20 bp, Artificial Sequence
  Synthetic oligonucleotide; AGG chr11 5319220 5319239 5319223 -
tgggtgtatcacctgaggtc

SEQ ID NO: 37999 - DNA, 20 bp, Artificial Sequence
  Synthetic oligonucleotide; GAG chr11 5319218 5319237 5319221 -
ggtgtatcacctgaggtcag

SEQ ID NO: 38000 - DNA, 20 bp, Artificial Sequence
  Synthetic oligonucleotide; AAG chr11 5319212 5319231 5319215 -
tcacctgaggtcaggagttc

SEQ ID NO: 38001 - DNA, 20 bp, Artificial Sequence
  Synthetic oligonucleotide; CAG chr11 5319207 5319226 5319210 -
tgaggtcaggagttcaagac

SEQ ID NO: 38002 - DNA, 20 bp, Artificial Sequence
  Synthetic oligonucleotide; TGG chr11 5319202 5319221 5319205 -
tcaggagttcaagaccagcc

SEQ ID NO: 38003 - DNA, 20 bp, Artificial Sequence
  Synthetic oligonucleotide; TGG chr11 5319193 5319212 5319196 -
caagaccagcctggtcaaca

SEQ ID NO: 38004 - DNA, 20 bp, Artificial Sequence
  Synthetic oligonucleotide; TAG chr11 5319159 5319178 5319162 -
ctctactaaaaatacaaaat

SEQ ID NO: 38005 - DNA, 20 bp, Artificial Sequence
  Synthetic oligonucleotide; CGG chr11 5319155 5319174 5319158 -
actaaaaatacaaaattagc

SEQ ID NO: 38006 - DNA, 20 bp, Artificial Sequence
  Synthetic oligonucleotide; TGG chr11 5319149 5319168 5319152 -
aatacaaaattagccggctg

SEQ ID NO: 38007 - DNA, 20 bp, Artificial Sequence
  Synthetic oligonucleotide; TGG chr11 5319146 5319165 5319149 -
acaaaattagccggctgtgg

SEQ ID NO: 38008 - DNA, 20 bp, Artificial Sequence
  Synthetic oligonucleotide; TGG chr11 5319143 5319162 5319146 -
aaattagccggctgtggtgg

SEQ ID NO: 38009 - DNA, 20 bp, Artificial Sequence
  Synthetic oligonucleotide; GGG chr11 5319142 5319161 5319145 -
aattagccggctgtggtggt

SEQ ID NO: 38010 - DNA, 20 bp, Artificial Sequence
  Synthetic oligonucleotide; GGG chr11 5319141 5319160 5319144 -
attagccggctgtggtggtg

SEQ ID NO: 38011 - DNA, 20 bp, Artificial Sequence
  Synthetic oligonucleotide; GGG chr11 5319140 5319159 5319143 -
ttagccggctgtggtggtgg

SEQ ID NO: 38012 - DNA, 20 bp, Artificial Sequence
  Synthetic oligonucleotide; CAG chr11 5319128 5319147 5319131 -
ggtggtgggggctgtaatcc

SEQ ID NO: 38013 - DNA, 20 bp, Artificial Sequence
  Synthetic oligonucleotide; CGG chr11 5319120 5319139 5319123 -
gggctgtaatcccagctact

SEQ ID NO: 38014 - DNA, 20 bp, Artificial Sequence
  Synthetic oligonucleotide; AAG chr11 5319117 5319136 5319120 -
ctgtaatcccagctactcgg

SEQ ID NO: 38015 - DNA, 20 bp, Artificial Sequence
  Synthetic oligonucleotide; AGG chr11 5319116 5319135 5319119 -
tgtaatcccagctactcgga

SEQ ID NO: 38016 - DNA, 20 bp, Artificial Sequence
  Synthetic oligonucleotide; GAG chr11 5319111 5319130 5319114 -
tcccagctactcggaaggct

SEQ ID NO: 38017 - DNA, 20 bp, Artificial Sequence
  Synthetic oligonucleotide; AGG chr11 5319110 5319129 5319113 -
cccagctactcggaaggctg

SEQ ID NO: 38018 - DNA, 20 bp, Artificial Sequence
  Synthetic oligonucleotide; CAG chr11 5319107 5319126 5319110 -
agctactcggaaggctgagg

SEQ ID NO: 38019 - DNA, 20 bp, Artificial Sequence
  Synthetic oligonucleotide; AGG chr11 5319106 5319125 5319109 -
gctactcggaaggctgaggc

SEQ ID NO: 38020 - DNA, 20 bp, Artificial Sequence
  Synthetic oligonucleotide; GAG chr11 5319104 5319123 5319107 -
tactcggaaggctgaggcag

SEQ ID NO: 38021 - DNA, 20 bp, Artificial Sequence
  Synthetic oligonucleotide; TGG chr11 5319087 5319106 5319090 -
caggagaattgcttgaactc

SEQ ID NO: 38022 - DNA, 20 bp, Artificial Sequence
  Synthetic oligonucleotide; GAG chr11 5319085 5319104 5319088 -
ggagaattgcttgaactctg

SEQ ID NO: 38023 - DNA, 20 bp, Artificial Sequence
  Synthetic oligonucleotide; AGG chr11 5319084 5319103 5319087 -
gagaattgcttgaactctgg

SEQ ID NO: 38024 - DNA, 20 bp, Artificial Sequence
  Synthetic oligonucleotide; CAG chr11 5319081 5319100 5319084 -
aattgcttgaactctggagg

SEQ ID NO: 38025 - DNA, 20 bp, Artificial Sequence
  Synthetic oligonucleotide; CGG chr11 5319077 5319096 5319080 -
gcttgaactctggaggcaga

SEQ ID NO: 38026 - DNA, 20 bp, Artificial Sequence
  Synthetic oligonucleotide; CAG chr11 5319072 5319091 5319075 -
aactctggaggcagacggtg

SEQ ID NO: 38027 - DNA, 20 bp, Artificial Sequence
  Synthetic oligonucleotide; GAG chr11 5319068 5319087 5319071 -
ctggaggcagacggtgcagt

SEQ ID NO: 38028 - DNA, 20 bp, Artificial Sequence
  Synthetic oligonucleotide; AAG chr11 5319063 5319082 5319066 -
ggcagacggtgcagtgagcc

SEQ ID NO: 38029 - DNA, 20 bp, Artificial Sequence
  Synthetic oligonucleotide; CAG chr11 5319043 5319062 5319046 -
aagatcgcaccactgcactc

SEQ ID NO: 38030 - DNA, 20 bp, Artificial Sequence
  Synthetic oligonucleotide; TGG chr11 5319038 5319057 5319041 -
cgcaccactgcactccagcc

SEQ ID NO: 38031 - DNA, 20 bp, Artificial Sequence
  Synthetic oligonucleotide; GGG chr11 5319037 5319056 5319040 -
gcaccactgcactccagcct

SEQ ID NO: 38032 - DNA, 20 bp, Artificial Sequence
  Synthetic oligonucleotide; CAG chr11 5319031 5319050 5319034 -
ctgcactccagcctgggtga

SEQ ID NO: 38033 - DNA, 20 bp, Artificial Sequence
  Synthetic oligonucleotide; GAG chr11 5319029 5319048 5319032 -
gcactccagcctgggtgaca

SEQ ID NO: 38034 - DNA, 20 bp, Artificial Sequence
  Synthetic oligonucleotide; AAG chr11 5319004 5319023 5319007 -
aaactctgaaaaaataaaaa

SEQ ID NO: 38035 - DNA, 20 bp, Artificial Sequence
  Synthetic oligonucleotide; AAG chr11 5319000 5319019 5319003 -
tctgaaaaaataaaaaaaga

SEQ ID NO: 38036 - DNA, 20 bp, Artificial Sequence
  Synthetic oligonucleotide; AAG chr11 5318995 5319014 5318998 -
aaaaataaaaaaagaaagaa

SEQ ID NO: 38037 - DNA, 20 bp, Artificial Sequence
  Synthetic oligonucleotide; AAG chr11 5318991 5319010 5318994 -
ataaaaaaagaaagaaaaga

SEQ ID NO: 38038 - DNA, 20 bp, Artificial Sequence
  Synthetic oligonucleotide; AAG chr11 5318987 5319006 5318990 -
aaaaagaaagaaaagaaaga

SEQ ID NO: 38039 - DNA, 20 bp, Artificial Sequence
  Synthetic oligonucleotide; GAG chr11 5318985 5319004 5318988 -
aaagaaagaaaagaaagaaa

SEQ ID NO: 38040 - DNA, 20 bp, Artificial Sequence
  Synthetic oligonucleotide; GAG chr11 5318983 5319002 5318986 -
agaaagaaaagaaagaaaga

SEQ ID NO: 38041 - DNA, 20 bp, Artificial Sequence
  Synthetic oligonucleotide; AGG chr11 5318982 5319001 5318985 -
gaaagaaaagaaagaaagag

SEQ ID NO: 38042 - DNA, 20 bp, Artificial Sequence
  Synthetic oligonucleotide; GGG chr11 5318981 5319000 5318984 -
aaagaaaagaaagaaagaga

SEQ ID NO: 38043 - DNA, 20 bp, Artificial Sequence
  Synthetic oligonucleotide; AAG chr11 5318978 5318997 5318981 -
gaaaagaaagaaagagaggg

SEQ ID NO: 38044 - DNA, 20 bp, Artificial Sequence
  Synthetic oligonucleotide; AAG chr11 5318974 5318993 5318977 -
agaaagaaagagagggaaga

SEQ ID NO: 38045 - DNA, 20 bp, Artificial Sequence
  Synthetic oligonucleotide; AGG chr11 5318973 5318992 5318976 -
gaaagaaagagagggaagaa

SEQ ID NO: 38046 - DNA, 20 bp, Artificial Sequence
  Synthetic oligonucleotide; AAG chr11 5318969 5318988 5318972 -
gaaagagagggaagaaagga

SEQ ID NO: 38047 - DNA, 20 bp, Artificial Sequence
  Synthetic oligonucleotide; AAG chr11 5318954 5318973 5318957 -
aaggaaagaaactacattat

SEQ ID NO: 38048 - DNA, 20 bp, Artificial Sequence
  Synthetic oligonucleotide; AGG chr11 5318953 5318972 5318956 -
aggaaagaaactacattata

SEQ ID NO: 38049 - DNA, 20 bp, Artificial Sequence
  Synthetic oligonucleotide; CAG chr11 5318947 5318966 5318950 -
gaaactacattataaggcca

SEQ ID NO: 38050 - DNA, 20 bp, Artificial Sequence
  Synthetic oligonucleotide; CAG chr11 5318935 5318954 5318938 -
taaggccacagtaccccaaa

SEQ ID NO: 38051 - DNA, 20 bp, Artificial Sequence
  Synthetic oligonucleotide; TAG chr11 5318913 5318932 5318916 -
gcatgatattgttacaaaaa

SEQ ID NO: 38052 - DNA, 20 bp, Artificial Sequence
  Synthetic oligonucleotide; AAG chr11 5318899 5318918 5318902 -
caaaaatagacacattgact

SEQ ID NO: 38053 - DNA, 20 bp, Artificial Sequence
  Synthetic oligonucleotide; AGG chr11 5318898 5318917 5318901 -
aaaaatagacacattgacta

SEQ ID NO: 38054 - DNA, 20 bp, Artificial Sequence
  Synthetic oligonucleotide; TAG chr11 5318887 5318906 5318890 -
cattgactaaggaaacacaa

SEQ ID NO: 38055 - DNA, 20 bp, Artificial Sequence
  Synthetic oligonucleotide; AAG chr11 5318870 5318889 5318873 -
caatagaaaactcaaaaata

SEQ ID NO: 38056 - DNA, 20 bp, Artificial Sequence
  Synthetic oligonucleotide; TAG chr11 5318862 5318881 5318865 -
aactcaaaaataaagctaca

SEQ ID NO: 38057 - DNA, 20 bp, Artificial Sequence
  Synthetic oligonucleotide; AAG chr11 5318822 5318841 5318825 -
tcaacaacactgacaaaaac

SEQ ID NO: 38058 - DNA, 20 bp, Artificial Sequence
  Synthetic oligonucleotide; CAG chr11 5318819 5318838 5318822 -
acaacactgacaaaaacaag

SEQ ID NO: 38059 - DNA, 20 bp, Artificial Sequence
  Synthetic oligonucleotide; CGG chr11 5318816 5318835 5318819 -
acactgacaaaaacaagcag

SEQ ID NO: 38060 - DNA, 20 bp, Artificial Sequence
  Synthetic oligonucleotide; GGG chr11 5318815 5318834 5318818 -
cactgacaaaaacaagcagc

SEQ ID NO: 38061 - DNA, 20 bp, Artificial Sequence
  Synthetic oligonucleotide; AAG chr11 5318810 5318829 5318813 -
acaaaaacaagcagcgggaa

SEQ ID NO: 38062 - DNA, 20 bp, Artificial Sequence
  Synthetic oligonucleotide; AGG chr11 5318809 5318828 5318812 -
caaaaacaagcagcgggaaa

SEQ ID NO: 38063 - DNA, 20 bp, Artificial Sequence
  Synthetic oligonucleotide; TGG chr11 5318783 5318802 5318786 -
acctatccaataaactgtgc

SEQ ID NO: 38064 - DNA, 20 bp, Artificial Sequence
  Synthetic oligonucleotide; TGG chr11 5318774 5318793 5318777 -
ataaactgtgctggaatacg

SEQ ID NO: 38065 - DNA, 20 bp, Artificial Sequence
  Synthetic oligonucleotide; TAG chr11 5318770 5318789 5318773 -
actgtgctggaatacgtggc

SEQ ID NO: 38066 - DNA, 20 bp, Artificial Sequence
  Synthetic oligonucleotide; CAG chr11 5318760 5318779 5318763 -
aatacgtggctagccatatg

SEQ ID NO: 38067 - DNA, 20 bp, Artificial Sequence
  Synthetic oligonucleotide; AAG chr11 5318757 5318776 5318760 -
acgtggctagccatatgcag

SEQ ID NO: 38068 - DNA, 20 bp, Artificial Sequence
  Synthetic oligonucleotide; TAG chr11 5318746 5318765 5318749 -
catatgcagaagaatgaaac

SEQ ID NO: 38069 - DNA, 20 bp, Artificial Sequence
  Synthetic oligonucleotide; TAG chr11 5318724 5318743 5318727 -
gacccttaccttacaccatt

SEQ ID NO: 38070 - DNA, 20 bp, Artificial Sequence
  Synthetic oligonucleotide; GAG chr11 5318722 5318741 5318725 -
cccttaccttacaccattta

SEQ ID NO: 38071 - DNA, 20 bp, Artificial Sequence
  Synthetic oligonucleotide; AAG chr11 5318685 5318704 5318688 -
tgaattcaaaacttaaatgt

SEQ ID NO: 38072 - DNA, 20 bp, Artificial Sequence
  Synthetic oligonucleotide; TGG chr11 5318662 5318681 5318665 -
atctcaaatcttacctgcac

SEQ ID NO: 38073 - DNA, 20 bp, Artificial Sequence
  Synthetic oligonucleotide; CAG chr11 5318659 5318678 5318662 -
tcaaatcttacctgcactgg

SEQ ID NO: 38074 - DNA, 20 bp, Artificial Sequence
  Synthetic oligonucleotide; TGG chr11 5318648 5318667 5318651 -
ctgcactggcagtgcatttt

SEQ ID NO: 38075 - DNA, 20 bp, Artificial Sequence
  Synthetic oligonucleotide; AAG chr11 5318643 5318662 5318646 -
ctggcagtgcatttttggct

SEQ ID NO: 38076 - DNA, 20 bp, Artificial Sequence
  Synthetic oligonucleotide; AAG chr11 5318633 5318652 5318636 -
atttttggctaagcccccaa

SEQ ID NO: 38077 - DNA, 20 bp, Artificial Sequence
  Synthetic oligonucleotide; AAG chr11 5318617 5318636 5318620 -
ccaaaagcaattgcaatgca

SEQ ID NO: 38078 - DNA, 20 bp, Artificial Sequence
  Synthetic oligonucleotide; AAG chr11 5318604 5318623 5318607 -
caatgcaaagaaaaattcac

SEQ ID NO: 38079 - DNA, 20 bp, Artificial Sequence
  Synthetic oligonucleotide; TGG chr11 5318601 5318620 5318604 -
tgcaaagaaaaattcacaag

SEQ ID NO: 38080 - DNA, 20 bp, Artificial Sequence
  Synthetic oligonucleotide; AAG chr11 5318583 5318602 5318586 -
agtggaacctaattaaacta

SEQ ID NO: 38081 - DNA, 20 bp, Artificial Sequence
  Synthetic oligonucleotide; GAG chr11 5318581 5318600 5318584 -
tggaacctaattaaactaaa

SEQ ID NO: 38082 - DNA, 20 bp, Artificial Sequence
  Synthetic oligonucleotide; AAG chr11 5318558 5318577 5318561 -
cttcactattcacaataaca

SEQ ID NO: 38083 - DNA, 20 bp, Artificial Sequence
  Synthetic oligonucleotide; TGG chr11 5318552 5318571 5318555 -
tattcacaataacaaagact

SEQ ID NO: 38084 - DNA, 20 bp, Artificial Sequence
  Synthetic oligonucleotide; TAG chr11 5318524 5318543 5318527 -
acccaaatgtccaacaatga

SEQ ID NO: 38085 - DNA, 20 bp, Artificial Sequence
  Synthetic oligonucleotide; TGG chr11 5318519 5318538 5318522 -
aatgtccaacaatgatagaa

SEQ ID NO: 38086 - DNA, 20 bp, Artificial Sequence
  Synthetic oligonucleotide; AAG chr11 5318513 5318532 5318516 -
caacaatgatagaatggatt

SEQ ID NO: 38087 - DNA, 20 bp, Artificial Sequence
  Synthetic oligonucleotide; TGG chr11 5318504 5318523 5318507 -
tagaatggattaagaaaatg

SEQ ID NO: 38088 - DNA, 20 bp, Artificial Sequence
  Synthetic oligonucleotide; TGG chr11 5318488 5318507 5318491 -
aatgtggcacatatacacca

SEQ ID NO: 38089 - DNA, 20 bp, Artificial Sequence
  Synthetic oligonucleotide; CAG chr11 5318476 5318495 5318479 -
atacaccatggaatactatg

SEQ ID NO: 38090 - DNA, 20 bp, Artificial Sequence
  Synthetic oligonucleotide; GAG chr11 5318459 5318478 5318462 -
atgcagccataaaaaatgat

SEQ ID NO: 38091 - DNA, 20 bp, Artificial Sequence
  Synthetic oligonucleotide; TAG chr11 5318443 5318462 5318446 -
tgatgagttcatgtcctttg

SEQ ID NO: 38092 - DNA, 20 bp, Artificial Sequence
  Synthetic oligonucleotide; AGG chr11 5318442 5318461 5318445 -
gatgagttcatgtcctttgt

SEQ ID NO: 38093 - DNA, 20 bp, Artificial Sequence
  Synthetic oligonucleotide; GGG chr11 5318441 5318460 5318444 -
atgagttcatgtcctttgta

SEQ ID NO: 38094 - DNA, 20 bp, Artificial Sequence
  Synthetic oligonucleotide; TGG chr11 5318435 5318454 5318438 -
tcatgtcctttgtagggaca

SEQ ID NO: 38095 - DNA, 20 bp, Artificial Sequence
  Synthetic oligonucleotide; AAG chr11 5318429 5318448 5318432 -
cctttgtagggacatggatg

SEQ ID NO: 38096 - DNA, 20 bp, Artificial Sequence
  Synthetic oligonucleotide; TGG chr11 5318425 5318444 5318428 -
tgtagggacatggatgaagc

SEQ ID NO: 38097 - DNA, 20 bp, Artificial Sequence
  Synthetic oligonucleotide; CAG chr11 5318409 5318428 5318412 -
aagctggaaaccatcattct

SEQ ID NO: 38098 - DNA, 20 bp, Artificial Sequence
  Synthetic oligonucleotide; AAG chr11 5318395 5318414 5318398 -
cattctcagcaaactatcac

SEQ ID NO: 38099 - DNA, 20 bp, Artificial Sequence
  Synthetic oligonucleotide; AGG chr11 5318394 5318413 5318397 -
attctcagcaaactatcaca

SEQ ID NO: 38100 - DNA, 20 bp, Artificial Sequence
  Synthetic oligonucleotide; TAG chr11 5318359 5318378 5318362 -
ataccacatgttctcactta

SEQ ID NO: 38101 - DNA, 20 bp, Artificial Sequence
  Synthetic oligonucleotide; AGG chr11 5318358 5318377 5318361 -
taccacatgttctcacttat

SEQ ID NO: 38102 - DNA, 20 bp, Artificial Sequence
  Synthetic oligonucleotide; TGG chr11 5318355 5318374 5318358 -
cacatgttctcacttatagg

SEQ ID NO: 38103 - DNA, 20 bp, Artificial Sequence
  Synthetic oligonucleotide; GGG chr11 5318354 5318373 5318357 -
acatgttctcacttataggt

SEQ ID NO: 38104 - DNA, 20 bp, Artificial Sequence
  Synthetic oligonucleotide; GAG chr11 5318340 5318359 5318343 -
ataggtgggaattgaacaat

SEQ ID NO: 38105 - DNA, 20 bp, Artificial Sequence
  Synthetic oligonucleotide; TGG chr11 5318331 5318350 5318334 -
aattgaacaatgagaacact

SEQ ID NO: 38106 - DNA, 20 bp, Artificial Sequence
  Synthetic oligonucleotide; CAG chr11 5318327 5318346 5318330 -
gaacaatgagaacacttgga

SEQ ID NO: 38107 - DNA, 20 bp, Artificial Sequence
  Synthetic oligonucleotide; GAG chr11 5318325 5318344 5318328 -
acaatgagaacacttggaca

SEQ ID NO: 38108 - DNA, 20 bp, Artificial Sequence
  Synthetic oligonucleotide; AGG chr11 5318324 5318343 5318327 -
caatgagaacacttggacag

SEQ ID NO: 38109 - DNA, 20 bp, Artificial Sequence
  Synthetic oligonucleotide; AAG chr11 5318321 5318340 5318324 -
tgagaacacttggacagagg

SEQ ID NO: 38110 - DNA, 20 bp, Artificial Sequence
  Synthetic oligonucleotide; AGG chr11 5318320 5318339 5318323 -
gagaacacttggacagagga

SEQ ID NO: 38111 - DNA, 20 bp, Artificial Sequence
  Synthetic oligonucleotide; GGG chr11 5318319 5318338 5318322 -
agaacacttggacagaggaa

SEQ ID NO: 38112 - DNA, 20 bp, Artificial Sequence
  Synthetic oligonucleotide; GGG chr11 5318318 5318337 5318321 -
gaacacttggacagaggaag

SEQ ID NO: 38113 - DNA, 20 bp, Artificial Sequence
  Synthetic oligonucleotide; CAG chr11 5318303 5318322 5318306 -
ggaaggggaacatcacacac

SEQ ID NO: 38114 - DNA, 20 bp, Artificial Sequence
  Synthetic oligonucleotide; AGG chr11 5318302 5318321 5318305 -
gaaggggaacatcacacacc

SEQ ID NO: 38115 - DNA, 20 bp, Artificial Sequence
  Synthetic oligonucleotide; GGG chr11 5318301 5318320 5318304 -
aaggggaacatcacacacca

SEQ ID NO: 38116 - DNA, 20 bp, Artificial Sequence
  Synthetic oligonucleotide; TGG chr11 5318291 5318310 5318294 -
tcacacaccagggcctgttg

SEQ ID NO: 38117 - DNA, 20 bp, Artificial Sequence
  Synthetic oligonucleotide; GGG chr11 5318290 5318309 5318293 -
cacacaccagggcctgttgt

SEQ ID NO: 38118 - DNA, 20 bp, Artificial Sequence
  Synthetic oligonucleotide; GGG chr11 5318289 5318308 5318292 -
acacaccagggcctgttgtg

SEQ ID NO: 38119 - DNA, 20 bp, Artificial Sequence
  Synthetic oligonucleotide; TGG chr11 5318286 5318305 5318289 -
caccagggcctgttgtgggg

SEQ ID NO: 38120 - DNA, 20 bp, Artificial Sequence
  Synthetic oligonucleotide; GGG chr11 5318285 5318304 5318288 -
accagggcctgttgtggggt

SEQ ID NO: 38121 - DNA, 20 bp, Artificial Sequence
  Synthetic oligonucleotide; GGG chr11 5318284 5318303 5318287 -
ccagggcctgttgtggggtg

SEQ ID NO: 38122 - DNA, 20 bp, Artificial Sequence
  Synthetic oligonucleotide; GGG chr11 5318283 5318302 5318286 -
cagggcctgttgtggggtgg

SEQ ID NO: 38123 - DNA, 20 bp, Artificial Sequence
  Synthetic oligonucleotide; TGG chr11 5318280 5318299 5318283 -
ggcctgttgtggggtggggg

SEQ ID NO: 38124 - DNA, 20 bp, Artificial Sequence
  Synthetic oligonucleotide; GGG chr11 5318279 5318298 5318282 -
gcctgttgtggggtgggggt

SEQ ID NO: 38125 - DNA, 20 bp, Artificial Sequence
  Synthetic oligonucleotide; GGG chr11 5318278 5318297 5318281 -
cctgttgtggggtgggggtg

SEQ ID NO: 38126 - DNA, 20 bp, Artificial Sequence
  Synthetic oligonucleotide; GGG chr11 5318277 5318296 5318280 -
ctgttgtggggtgggggtgg

SEQ ID NO: 38127 - DNA, 20 bp, Artificial Sequence
  Synthetic oligonucleotide; GGG chr11 5318276 5318295 5318279 -
tgttgtggggtgggggtggg

SEQ ID NO: 38128 - DNA, 20 bp, Artificial Sequence
  Synthetic oligonucleotide; TGG chr11 5318273 5318292 5318276 -
tgtggggtgggggtgggggg

SEQ ID NO: 38129 - DNA, 20 bp, Artificial Sequence
  Synthetic oligonucleotide; GAG chr11 5318271 5318290 5318274 -
tggggtgggggtggggggtg

SEQ ID NO: 38130 - DNA, 20 bp, Artificial Sequence
  Synthetic oligonucleotide; GAG chr11 5318269 5318288 5318272 -
gggtgggggtggggggtgga

SEQ ID NO: 38131 - DNA, 20 bp, Artificial Sequence
  Synthetic oligonucleotide; AGG chr11 5318268 5318287 5318271 -
ggtgggggtggggggtggag

SEQ ID NO: 38132 - DNA, 20 bp, Artificial Sequence
  Synthetic oligonucleotide; GGG chr11 5318267 5318286 5318270 -
gtgggggtggggggtggaga

SEQ ID NO: 38133 - DNA, 20 bp, Artificial Sequence
  Synthetic oligonucleotide; TAG chr11 5318263 5318282 5318266 -
gggtggggggtggagaggga

SEQ ID NO: 38134 - DNA, 20 bp, Artificial Sequence
  Synthetic oligonucleotide; TAG chr11 5318257 5318276 5318260 -
ggggtggagagggatagcat

SEQ ID NO: 38135 - DNA, 20 bp, Artificial Sequence
  Synthetic oligonucleotide; AGG chr11 5318256 5318275 5318259 -
gggtggagagggatagcatt

SEQ ID NO: 38136 - DNA, 20 bp, Artificial Sequence
  Synthetic oligonucleotide; GAG chr11 5318254 5318273 5318257 -
gtggagagggatagcattag

SEQ ID NO: 38137 - DNA, 20 bp, Artificial Sequence
  Synthetic oligonucleotide; GAG chr11 5318231 5318250 5318234 -
atatacctaatgtaaatgat

SEQ ID NO: 38138 - DNA, 20 bp, Artificial Sequence
  Synthetic oligonucleotide; TGG chr11 5318224 5318243 5318227 -
taatgtaaatgatgagttaa

SEQ ID NO: 38139 - DNA, 20 bp, Artificial Sequence
  Synthetic oligonucleotide; GGG chr11 5318223 5318242 5318226 -
aatgtaaatgatgagttaat

SEQ ID NO: 38140 - DNA, 20 bp, Artificial Sequence
  Synthetic oligonucleotide; CAG chr11 5318218 5318237 5318221 -
aaatgatgagttaatgggtg

SEQ ID NO: 38141 - DNA, 20 bp, Artificial Sequence
  Synthetic oligonucleotide; TGG chr11 5318205 5318224 5318208 -
atgggtgcagcacaccaaca

SEQ ID NO: 38142 - DNA, 20 bp, Artificial Sequence
  Synthetic oligonucleotide; TAG chr11 5318155 5318174 5318158 -
cacgttgcgcacatgtaccc

SEQ ID NO: 38143 - DNA, 20 bp, Artificial Sequence
  Synthetic oligonucleotide; AAG chr11 5318146 5318165 5318149 -
cacatgtaccctagaactta

SEQ ID NO: 38144 - DNA, 20 bp, Artificial Sequence
  Synthetic oligonucleotide; AAG chr11 5318125 5318144 5318128 -
agtataataataataataaa

SEQ ID NO: 38145 - DNA, 20 bp, Artificial Sequence
  Synthetic oligonucleotide; GAG chr11 5318123 5318142 5318126 -
tataataataataataaaaa

SEQ ID NO: 38146 - DNA, 20 bp, Artificial Sequence
  Synthetic oligonucleotide; CAG chr11 5318112 5318131 5318115 -
taataaaaagagcttctgtg

SEQ ID NO: 38147 - DNA, 20 bp, Artificial Sequence
  Synthetic oligonucleotide; CAG chr11 5318109 5318128 5318112 -
taaaaagagcttctgtgcag

SEQ ID NO: 38148 - DNA, 20 bp, Artificial Sequence
  Synthetic oligonucleotide; AAG chr11 5318106 5318125 5318109 -
aaagagcttctgtgcagcag

SEQ ID NO: 38149 - DNA, 20 bp, Artificial Sequence
  Synthetic oligonucleotide; CAG chr11 5318093 5318112 5318096 -
gcagcagaagaaactatcaa

SEQ ID NO: 38150 - DNA, 20 bp, Artificial Sequence
  Synthetic oligonucleotide; GAG chr11 5318091 5318110 5318094 -
agcagaagaaactatcaaca

SEQ ID NO: 38151 - DNA, 20 bp, Artificial Sequence
  Synthetic oligonucleotide; CAG chr11 5318073 5318092 5318076 -
cagagtaaactgacaatcta

SEQ ID NO: 38152 - DNA, 20 bp, Artificial Sequence
  Synthetic oligonucleotide; AGG chr11 5318072 5318091 5318075 -
agagtaaactgacaatctac

SEQ ID NO: 38153 - DNA, 20 bp, Artificial Sequence
  Synthetic oligonucleotide; TAG chr11 5318068 5318087 5318071 -
taaactgacaatctacagga

SEQ ID NO: 38154 - DNA, 20 bp, Artificial Sequence
  Synthetic oligonucleotide; AGG chr11 5318067 5318086 5318070 -
aaactgacaatctacaggat

SEQ ID NO: 38155 - DNA, 20 bp, Artificial Sequence
  Synthetic oligonucleotide; GAG chr11 5318065 5318084 5318068 -
actgacaatctacaggatag

SEQ ID NO: 38156 - DNA, 20 bp, Artificial Sequence
  Synthetic oligonucleotide; TGG chr11 5318039 5318058 5318042 -
ctattcacaaactgtgcatc

SEQ ID NO: 38157 - DNA, 20 bp, Artificial Sequence
  Synthetic oligonucleotide; AAG chr11 5318034 5318053 5318037 -
cacaaactgtgcatctggaa

SEQ ID NO: 38158 - DNA, 20 bp, Artificial Sequence
  Synthetic oligonucleotide; AGG chr11 5318033 5318052 5318036 -
acaaactgtgcatctggaaa

SEQ ID NO: 38159 - DNA, 20 bp, Artificial Sequence
  Synthetic oligonucleotide; CAG chr11 5318021 5318040 5318024 -
tctggaaaaggtctaatatt

SEQ ID NO: 38160 - DNA, 20 bp, Artificial Sequence
  Synthetic oligonucleotide; AAG chr11 5318011 5318030 5318014 -
gtctaatattcagaatctat

SEQ ID NO: 38161 - DNA, 20 bp, Artificial Sequence
  Synthetic oligonucleotide; AGG chr11 5318010 5318029 5318013 -
tctaatattcagaatctata

SEQ ID NO: 38162 - DNA, 20 bp, Artificial Sequence
  Synthetic oligonucleotide; CAG chr11 5317994 5318013 5317997 -
tataaggaattcgaacatat

SEQ ID NO: 38163 - DNA, 20 bp, Artificial Sequence
  Synthetic oligonucleotide; AAG chr11 5317990 5318009 5317993 -
aggaattcgaacatatcagc

SEQ ID NO: 38164 - DNA, 20 bp, Artificial Sequence
  Synthetic oligonucleotide; AAG chr11 5317983 5318002 5317986 -
cgaacatatcagcaagcaaa

SEQ ID NO: 38165 - DNA, 20 bp, Artificial Sequence
  Synthetic oligonucleotide; TGG chr11 5317960 5317979 5317963 -
caaacaattccatttaaaaa

SEQ ID NO: 38166 - DNA, 20 bp, Artificial Sequence
  Synthetic oligonucleotide; GGG chr11 5317959 5317978 5317962 -
aaacaattccatttaaaaat

SEQ ID NO: 38167 - DNA, 20 bp, Artificial Sequence
  Synthetic oligonucleotide; CAG chr11 5317943 5317962 5317946 -
aaatgggcaaaatccacgaa

SEQ ID NO: 38168 - DNA, 20 bp, Artificial Sequence
  Synthetic oligonucleotide; AAG chr11 5317931 5317950 5317934 -
tccacgaacagactcttctc

SEQ ID NO: 38169 - DNA, 20 bp, Artificial Sequence
  Synthetic oligonucleotide; GAG chr11 5317929 5317948 5317932 -
cacgaacagactcttctcaa

SEQ ID NO: 38170 - DNA, 20 bp, Artificial Sequence
  Synthetic oligonucleotide; AAG chr11 5317926 5317945 5317929 -
gaacagactcttctcaagag

SEQ ID NO: 38171 - DNA, 20 bp, Artificial Sequence
  Synthetic oligonucleotide; CAG chr11 5317918 5317937 5317921 -
tcttctcaagagaagacata

SEQ ID NO: 38172 - DNA, 20 bp, Artificial Sequence
  Synthetic oligonucleotide; AGG chr11 5317917 5317936 5317920 -
cttctcaagagaagacatac

SEQ ID NO: 38173 - DNA, 20 bp, Artificial Sequence
  Synthetic oligonucleotide; CAG chr11 5317914 5317933 5317917 -
ctcaagagaagacatacagg

SEQ ID NO: 38174 - DNA, 20 bp, Artificial Sequence
  Synthetic oligonucleotide; GAG chr11 5317874 5317893 5317877 -
aaatgatcatcatcactaat

SEQ ID NO: 38175 - DNA, 20 bp, Artificial Sequence
  Synthetic oligonucleotide; GAG chr11 5317872 5317891 5317875 -
atgatcatcatcactaatga

SEQ ID NO: 38176 - DNA, 20 bp, Artificial Sequence
  Synthetic oligonucleotide; AAG chr11 5317850 5317869 5317853 -
gaaatgcaaatcaaaaccac

SEQ ID NO: 38177 - DNA, 20 bp, Artificial Sequence
  Synthetic oligonucleotide; GAG chr11 5317848 5317867 5317851 -
aatgcaaatcaaaaccacaa

SEQ ID NO: 38178 - DNA, 20 bp, Artificial Sequence
  Synthetic oligonucleotide; CAG chr11 5317831 5317850 5317834 -
caagagatactatctcatac

SEQ ID NO: 38179 - DNA, 20 bp, Artificial Sequence
  Synthetic oligonucleotide; CAG chr11 5317827 5317846 5317830 -
agatactatctcataccagt

SEQ ID NO: 38180 - DNA, 20 bp, Artificial Sequence
  Synthetic oligonucleotide; TAG chr11 5317822 5317841 5317825 -
ctatctcataccagtcagaa

SEQ ID NO: 38181 - DNA, 20 bp, Artificial Sequence
  Synthetic oligonucleotide; AAG chr11 5317808 5317827 5317811 -
tcagaatagctatttttaaa

SEQ ID NO: 38182 - DNA, 20 bp, Artificial Sequence
  Synthetic oligonucleotide; CAG chr11 5317797 5317816 5317800 -
atttttaaaaagccaaaaaa

SEQ ID NO: 38183 - DNA, 20 bp, Artificial Sequence
  Synthetic oligonucleotide; GAG chr11 5317786 5317805 5317789 -
gccaaaaaacagattctcat

SEQ ID NO: 38184 - DNA, 20 bp, Artificial Sequence
  Synthetic oligonucleotide; AGG chr11 5317785 5317804 5317788 -
ccaaaaaacagattctcatg

SEQ ID NO: 38185 - DNA, 20 bp, Artificial Sequence
  Synthetic oligonucleotide; TGG chr11 5317779 5317798 5317782 -
aacagattctcatgaggcta

SEQ ID NO: 38186 - DNA, 20 bp, Artificial Sequence
  Synthetic oligonucleotide; GAG chr11 5317777 5317796 5317780 -
cagattctcatgaggctatg

SEQ ID NO: 38187 - DNA, 20 bp, Artificial Sequence
  Synthetic oligonucleotide; AAG chr11 5317772 5317791 5317775 -
tctcatgaggctatggagaa

SEQ ID NO: 38188 - DNA, 20 bp, Artificial Sequence
  Synthetic oligonucleotide; AGG chr11 5317771 5317790 5317774 -
ctcatgaggctatggagaaa

SEQ ID NO: 38189 - DNA, 20 bp, Artificial Sequence
  Synthetic oligonucleotide; GGG chr11 5317770 5317789 5317773 -
tcatgaggctatggagaaaa

SEQ ID NO: 38190 - DNA, 20 bp, Artificial Sequence
  Synthetic oligonucleotide; TGG chr11 5317748 5317767 5317751 -
gaacacttatacaatgatga

SEQ ID NO: 38191 - DNA, 20 bp, Artificial Sequence
  Synthetic oligonucleotide; GGG chr11 5317747 5317766 5317750 -
aacacttatacaatgatgat

SEQ ID NO: 38192 - DNA, 20 bp, Artificial Sequence
  Synthetic oligonucleotide; GGG chr11 5317746 5317765 5317749 -
acacttatacaatgatgatg

SEQ ID NO: 38193 - DNA, 20 bp, Artificial Sequence
  Synthetic oligonucleotide; TAG chr11 5317735 5317754 5317738 -
atgatgatggggatgtaaat

SEQ ID NO: 38194 - DNA, 20 bp, Artificial Sequence
  Synthetic oligonucleotide; CAG chr11 5317721 5317740 5317724 -
gtaaattagttcaaccactg

SEQ ID NO: 38195 - DNA, 20 bp, Artificial Sequence
  Synthetic oligonucleotide; CAG chr11 5317714 5317733 5317717 -
agttcaaccactgcagaaaa

SEQ ID NO: 38196 - DNA, 20 bp, Artificial Sequence
  Synthetic oligonucleotide; TGG chr11 5317709 5317728 5317712 -
aaccactgcagaaaacagtt

SEQ ID NO: 38197 - DNA, 20 bp, Artificial Sequence
  Synthetic oligonucleotide; GAG chr11 5317707 5317726 5317710 -
ccactgcagaaaacagtttg

SEQ ID NO: 38198 - DNA, 20 bp, Artificial Sequence
  Synthetic oligonucleotide; GAG chr11 5317705 5317724 5317708 -
actgcagaaaacagtttgga

SEQ ID NO: 38199 - DNA, 20 bp, Artificial Sequence
  Synthetic oligonucleotide; AAG chr11 5317696 5317715 5317699 -
aacagtttggagagtcttca

SEQ ID NO: 38200 - DNA, 20 bp, Artificial Sequence
  Synthetic oligonucleotide; AAG chr11 5317687 5317706 5317690 -
gagagtcttcaaagaacttt

SEQ ID NO: 38201 - DNA, 20 bp, Artificial Sequence
  Synthetic oligonucleotide; CAG chr11 5317684 5317703 5317687 -
agtcttcaaagaactttaag

SEQ ID NO: 38202 - DNA, 20 bp, Artificial Sequence
  Synthetic oligonucleotide; GAG chr11 5317682 5317701 5317685 -
tcttcaaagaactttaagca

SEQ ID NO: 38203 - DNA, 20 bp, Artificial Sequence
  Synthetic oligonucleotide; CAG chr11 5317666 5317685 5317669 -
agcagagctacaatttgaca

SEQ ID NO: 38204 - DNA, 20 bp, Artificial Sequence
  Synthetic oligonucleotide; TGG chr11 5317651 5317670 5317654 -
tgacacagcaatcccgctac

SEQ ID NO: 38205 - DNA, 20 bp, Artificial Sequence
  Synthetic oligonucleotide; GGG chr11 5317650 5317669 5317653 -
gacacagcaatcccgctact

SEQ ID NO: 38206 - DNA, 20 bp, Artificial Sequence
  Synthetic oligonucleotide; TAG chr11 5317637 5317656 5317640 -
cgctactgggtatatatcca

SEQ ID NO: 38207 - DNA, 20 bp, Artificial Sequence
  Synthetic oligonucleotide; AGG chr11 5317636 5317655 5317639 -
gctactgggtatatatccat

SEQ ID NO: 38208 - DNA, 20 bp, Artificial Sequence
  Synthetic oligonucleotide; CAG chr11 5317629 5317648 5317632 -
ggtatatatccataggaaaa

SEQ ID NO: 38209 - DNA, 20 bp, Artificial Sequence
  Synthetic oligonucleotide; GAG chr11 5317627 5317646 5317630 -
tatatatccataggaaaaca

SEQ ID NO: 38210 - DNA, 20 bp, Artificial Sequence
  Synthetic oligonucleotide; TAG chr11 5317621 5317640 5317624 -
tccataggaaaacagagcat

SEQ ID NO: 38211 - DNA, 20 bp, Artificial Sequence
  Synthetic oligonucleotide; TAG chr11 5317612 5317631 5317615 -
aaacagagcattagaccaac

SEQ ID NO: 38212 - DNA, 20 bp, Artificial Sequence
  Synthetic oligonucleotide; TAG chr11 5317575 5317594 5317578 -
atgttcactgtaatgctgtt

SEQ ID NO: 38213 - DNA, 20 bp, Artificial Sequence
  Synthetic oligonucleotide; TAG chr11 5317570 5317589 5317573 -
cactgtaatgctgtttagaa

SEQ ID NO: 38214 - DNA, 20 bp, Artificial Sequence
  Synthetic oligonucleotide; TGG chr11 5317553 5317572 5317556 -
gaatagcaaatacaaataac

SEQ ID NO: 38215 - DNA, 20 bp, Artificial Sequence
  Synthetic oligonucleotide; TAG chr11 5317548 5317567 5317551 -
gcaaatacaaataactggcc

SEQ ID NO: 38216 - DNA, 20 bp, Artificial Sequence
  Synthetic oligonucleotide; AGG chr11 5317547 5317566 5317550 -
caaatacaaataactggcct

SEQ ID NO: 38217 - DNA, 20 bp, Artificial Sequence
  Synthetic oligonucleotide; AAG chr11 5317535 5317554 5317538 -
actggcctaggtgtctatca

SEQ ID NO: 38218 - DNA, 20 bp, Artificial Sequence
  Synthetic oligonucleotide; AGG chr11 5317534 5317553 5317537 -
ctggcctaggtgtctatcaa

SEQ ID NO: 38219 - DNA, 20 bp, Artificial Sequence
  Synthetic oligonucleotide; CGG chr11 5317531 5317550 5317534 -
gcctaggtgtctatcaaagg

SEQ ID NO: 38220 - DNA, 20 bp, Artificial Sequence
  Synthetic oligonucleotide; CGG chr11 5317527 5317546 5317530 -
aggtgtctatcaaaggcgga

SEQ ID NO: 38221 - DNA, 20 bp, Artificial Sequence
  Synthetic oligonucleotide; GGG chr11 5317526 5317545 5317529 -
ggtgtctatcaaaggcggac

SEQ ID NO: 38222 - DNA, 20 bp, Artificial Sequence
  Synthetic oligonucleotide; AAG chr11 5317520 5317539 5317523 -
tatcaaaggcggacgggata

SEQ ID NO: 38223 - DNA, 20 bp, Artificial Sequence
  Synthetic oligonucleotide; TGG chr11 5317511 5317530 5317514 -
cggacgggataaagaaactg

SEQ ID NO: 38224 - DNA, 20 bp, Artificial Sequence
  Synthetic oligonucleotide; TGG chr11 5317487 5317506 5317490 -
acatatacaccaccactatg

SEQ ID NO: 38225 - DNA, 20 bp, Artificial Sequence
  Synthetic oligonucleotide; AAG chr11 5317480 5317499 5317483 -
caccaccactatgtggcaat

SEQ ID NO: 38226 - DNA, 20 bp, Artificial Sequence
  Synthetic oligonucleotide; CAG chr11 5317454 5317473 5317457 -
aaatgaaatcatgtcctttt

SEQ ID NO: 38227 - DNA, 20 bp, Artificial Sequence
  Synthetic oligonucleotide; TGG chr11 5317446 5317465 5317449 -
tcatgtccttttcagcaaca

SEQ ID NO: 38228 - DNA, 20 bp, Artificial Sequence
  Synthetic oligonucleotide; GGG chr11 5317445 5317464 5317448 -
catgtccttttcagcaacat

SEQ ID NO: 38229 - DNA, 20 bp, Artificial Sequence
  Synthetic oligonucleotide; TGG chr11 5317442 5317461 5317445 -
gtccttttcagcaacatggg

SEQ ID NO: 38230 - DNA, 20 bp, Artificial Sequence
  Synthetic oligonucleotide; GAG chr11 5317440 5317459 5317443 -
ccttttcagcaacatgggtg

SEQ ID NO: 38231 - DNA, 20 bp, Artificial Sequence
  Synthetic oligonucleotide; TGG chr11 5317436 5317455 5317439 -
ttcagcaacatgggtggagc

SEQ ID NO: 38232 - DNA, 20 bp, Artificial Sequence
  Synthetic oligonucleotide; GAG chr11 5317434 5317453 5317437 -
cagcaacatgggtggagctg

SEQ ID NO: 38233 - DNA, 20 bp, Artificial Sequence
  Synthetic oligonucleotide; AGG chr11 5317433 5317452 5317436 -
agcaacatgggtggagctgg

SEQ ID NO: 38234 - DNA, 20 bp, Artificial Sequence
  Synthetic oligonucleotide; AAG chr11 5317420 5317439 5317423 -
gagctggaggctataatcct

SEQ ID NO: 38235 - DNA, 20 bp, Artificial Sequence
  Synthetic oligonucleotide; AAG chr11 5317406 5317425 5317409 -
aatcctaagcaaattaacgc

SEQ ID NO: 38236 - DNA, 20 bp, Artificial Sequence
  Synthetic oligonucleotide; AAG chr11 5317396 5317415 5317399 -
aaattaacgcaagaacacaa

SEQ ID NO: 38237 - DNA, 20 bp, Artificial Sequence
  Synthetic oligonucleotide; AAG chr11 5317369 5317388 5317372 -
taccatatattctcatttat

SEQ ID NO: 38238 - DNA, 20 bp, Artificial Sequence
  Synthetic oligonucleotide; TGG chr11 5317366 5317385 5317369 -
catatattctcatttataag

SEQ ID NO: 38239 - DNA, 20 bp, Artificial Sequence
  Synthetic oligonucleotide; AAG chr11 5317363 5317382 5317366 -
atattctcatttataagtgg

SEQ ID NO: 38240 - DNA, 20 bp, Artificial Sequence
  Synthetic oligonucleotide; GAG chr11 5317351 5317370 5317354 -
ataagtggaagctaaacatt

SEQ ID NO: 38241 - DNA, 20 bp, Artificial Sequence
  Synthetic oligonucleotide; TGG chr11 5317342 5317361 5317345 -
agctaaacattgagtacacg

SEQ ID NO: 38242 - DNA, 20 bp, Artificial Sequence
  Synthetic oligonucleotide; TGG chr11 5317330 5317349 5317333 -
agtacacgtggatataaaca

SEQ ID NO: 38243 - DNA, 20 bp, Artificial Sequence
  Synthetic oligonucleotide; GGG chr11 5317329 5317348 5317332 -
gtacacgtggatataaacat

SEQ ID NO: 38244 - DNA, 20 bp, Artificial Sequence
  Synthetic oligonucleotide; TAG chr11 5317321 5317340 5317324 -
ggatataaacatgggaacaa

SEQ ID NO: 38245 - DNA, 20 bp, Artificial Sequence
  Synthetic oligonucleotide; AAG chr11 5317301 5317320 5317304 -
tagccacttgaaactactac

SEQ ID NO: 38246 - DNA, 20 bp, Artificial Sequence
  Synthetic oligonucleotide; AGG chr11 5317300 5317319 5317303 -
agccacttgaaactactaca

SEQ ID NO: 38247 - DNA, 20 bp, Artificial Sequence
  Synthetic oligonucleotide; GGG chr11 5317299 5317318 5317302 -
gccacttgaaactactacaa

SEQ ID NO: 38248 - DNA, 20 bp, Artificial Sequence
  Synthetic oligonucleotide; GGG chr11 5317298 5317317 5317301 -
ccacttgaaactactacaag

SEQ ID NO: 38249 - DNA, 20 bp, Artificial Sequence
  Synthetic oligonucleotide; CAG chr11 5317295 5317314 5317298 -
cttgaaactactacaagggg

SEQ ID NO: 38250 - DNA, 20 bp, Artificial Sequence
  Synthetic oligonucleotide; AGG chr11 5317294 5317313 5317297 -
ttgaaactactacaaggggc

SEQ ID NO: 38251 - DNA, 20 bp, Artificial Sequence
  Synthetic oligonucleotide; GGG chr11 5317293 5317312 5317296 -
tgaaactactacaaggggca

SEQ ID NO: 38252 - DNA, 20 bp, Artificial Sequence
  Synthetic oligonucleotide; GAG chr11 5317291 5317310 5317294 -
aaactactacaaggggcagg

SEQ ID NO: 38253 - DNA, 20 bp, Artificial Sequence
  Synthetic oligonucleotide; GAG chr11 5317289 5317308 5317292 -
actactacaaggggcaggga

SEQ ID NO: 38254 - DNA, 20 bp, Artificial Sequence
  Synthetic oligonucleotide; CGG chr11 5317283 5317302 5317286 -
acaaggggcagggagagatg

SEQ ID NO: 38255 - DNA, 20 bp, Artificial Sequence
  Synthetic oligonucleotide; GGG chr11 5317282 5317301 5317285 -
caaggggcagggagagatgc

SEQ ID NO: 38256 - DNA, 20 bp, Artificial Sequence
  Synthetic oligonucleotide; GAG chr11 5317280 5317299 5317283 -
aggggcagggagagatgcgg

SEQ ID NO: 38257 - DNA, 20 bp, Artificial Sequence
  Synthetic oligonucleotide; GAG chr11 5317278 5317297 5317281 -
gggcagggagagatgcggga

SEQ ID NO: 38258 - DNA, 20 bp, Artificial Sequence
  Synthetic oligonucleotide; AGG chr11 5317277 5317296 5317280 -
ggcagggagagatgcgggag

SEQ ID NO: 38259 - DNA, 20 bp, Artificial Sequence
  Synthetic oligonucleotide; GGG chr11 5317276 5317295 5317279 -
gcagggagagatgcgggaga

SEQ ID NO: 38260 - DNA, 20 bp, Artificial Sequence
  Synthetic oligonucleotide; TGG chr11 5317260 5317279 5317263 -
gagagggttaaaaaatctat

SEQ ID NO: 38261 - DNA, 20 bp, Artificial Sequence
  Synthetic oligonucleotide; TAG chr11 5317256 5317275 5317259 -
gggttaaaaaatctattgga

SEQ ID NO: 38262 - DNA, 20 bp, Artificial Sequence
  Synthetic oligonucleotide; AAG chr11 5317208 5317227 5317211 -
tccatgtaaaaaacctgcac

SEQ ID NO: 38263 - DNA, 20 bp, Artificial Sequence
  Synthetic oligonucleotide; AAG chr11 5317190 5317209 5317193 -
acaagtacccactgtatcta

SEQ ID NO: 38264 - DNA, 20 bp, Artificial Sequence
  Synthetic oligonucleotide; AAG chr11 5317169 5317188 5317172 -
agtaaatgttgaaaatttaa

SEQ ID NO: 38265 - DNA, 20 bp, Artificial Sequence
  Synthetic oligonucleotide; AAG chr11 5317145 5317164 5317148 -
aaaaacaaataaataaaaac

SEQ ID NO: 38266 - DNA, 20 bp, Artificial Sequence
  Synthetic oligonucleotide; TGG chr11 5317129 5317148 5317132 -
aaacaagtctatcctgaacc

SEQ ID NO: 38267 - DNA, 20 bp, Artificial Sequence
  Synthetic oligonucleotide; TGG chr11 5317119 5317138 5317122 -
atcctgaacctggtatgaaa

SEQ ID NO: 38268 - DNA, 20 bp, Artificial Sequence
  Synthetic oligonucleotide; GGG chr11 5317118 5317137 5317121 -
tcctgaacctggtatgaaat

SEQ ID NO: 38269 - DNA, 20 bp, Artificial Sequence
  Synthetic oligonucleotide; CAG chr11 5317115 5317134 5317118 -
tgaacctggtatgaaatggg

SEQ ID NO: 38270 - DNA, 20 bp, Artificial Sequence
  Synthetic oligonucleotide; AAG chr11 5317095 5317114 5317098 -
cagtgatttttatataaaca

SEQ ID NO: 38271 - DNA, 20 bp, Artificial Sequence
  Synthetic oligonucleotide; AAG chr11 5317085 5317104 5317088 -
tatataaacaaagttatttt

SEQ ID NO: 38272 - DNA, 20 bp, Artificial Sequence
  Synthetic oligonucleotide; TAG chr11 5317071 5317090 5317074 -
tattttaagacaaaatataa

SEQ ID NO: 38273 - DNA, 20 bp, Artificial Sequence
  Synthetic oligonucleotide; AGG chr11 5317070 5317089 5317073 -
attttaagacaaaatataat

SEQ ID NO: 38274 - DNA, 20 bp, Artificial Sequence
  Synthetic oligonucleotide; TGG chr11 5317054 5317073 5317057 -
taataggcccttcatttact

SEQ ID NO: 38275 - DNA, 20 bp, Artificial Sequence
  Synthetic oligonucleotide; TAG chr11 5317044 5317063 5317047 -
ttcatttacttggctattaa

SEQ ID NO: 38276 - DNA, 20 bp, Artificial Sequence
  Synthetic oligonucleotide; GAG chr11 5317034 5317053 5317037 -
tggctattaatagatccatt

SEQ ID NO: 38277 - DNA, 20 bp, Artificial Sequence
  Synthetic oligonucleotide; AGG chr11 5317033 5317052 5317036 -
ggctattaatagatccattg

SEQ ID NO: 38278 - DNA, 20 bp, Artificial Sequence
  Synthetic oligonucleotide; TGG chr11 5317024 5317043 5317027 -
tagatccattgaggttcctg

SEQ ID NO: 38279 - DNA, 20 bp, Artificial Sequence
  Synthetic oligonucleotide; CAG chr11 5317019 5317038 5317022 -
ccattgaggttcctgtggat

SEQ ID NO: 38280 - DNA, 20 bp, Artificial Sequence
  Synthetic oligonucleotide; AAG chr11 5317002 5317021 5317005 -
gatcagaactgattttccca

SEQ ID NO: 38281 - DNA, 20 bp, Artificial Sequence
  Synthetic oligonucleotide; CAG chr11 5316996 5317015 5316999 -
aactgattttcccaaagtat

SEQ ID NO: 38282 - DNA, 20 bp, Artificial Sequence
  Synthetic oligonucleotide; AAG chr11 5316991 5317010 5316994 -
attttcccaaagtatcagaa

SEQ ID NO: 38283 - DNA, 20 bp, Artificial Sequence
  Synthetic oligonucleotide; CAG chr11 5316959 5316978 5316962 -
caattgaaatgcataaactc

SEQ ID NO: 38284 - DNA, 20 bp, Artificial Sequence
  Synthetic oligonucleotide; AGG chr11 5316958 5316977 5316961 -
aattgaaatgcataaactcc

SEQ ID NO: 38285 - DNA, 20 bp, Artificial Sequence
  Synthetic oligonucleotide; AAG chr11 5316952 5316971 5316955 -
aatgcataaactccaggaca

SEQ ID NO: 38286 - DNA, 20 bp, Artificial Sequence
  Synthetic oligonucleotide; TAG chr11 5316926 5316945 5316929 -
catgtgaccctgcattcaac

SEQ ID NO: 38287 - DNA, 20 bp, Artificial Sequence
  Synthetic oligonucleotide; GAG chr11 5316897 5316916 5316900 -
tcaatactttgcattgtatt

SEQ ID NO: 38288 - DNA, 20 bp, Artificial Sequence
  Synthetic oligonucleotide; CAG chr11 5316893 5316912 5316896 -
tactttgcattgtattgaga

SEQ ID NO: 38289 - DNA, 20 bp, Artificial Sequence
  Synthetic oligonucleotide; AAG chr11 5316882 5316901 5316885 -
gtattgagacagacaatgca

SEQ ID NO: 38290 - DNA, 20 bp, Artificial Sequence
  Synthetic oligonucleotide; TGG chr11 5316871 5316890 5316874 -
gacaatgcaaagtacacaca

SEQ ID NO: 38291 - DNA, 20 bp, Artificial Sequence
  Synthetic oligonucleotide; TAG chr11 5316848 5316867 5316851 -
atatactgtgtactgatgct

SEQ ID NO: 38292 - DNA, 20 bp, Artificial Sequence
  Synthetic oligonucleotide; AGG chr11 5316847 5316866 5316850 -
tatactgtgtactgatgctt

SEQ ID NO: 38293 - DNA, 20 bp, Artificial Sequence
  Synthetic oligonucleotide; GGG chr11 5316846 5316865 5316849 -
atactgtgtactgatgctta

SEQ ID NO: 38294 - DNA, 20 bp, Artificial Sequence
  Synthetic oligonucleotide; AAG chr11 5316838 5316857 5316841 -
tactgatgcttagggtcctg

SEQ ID NO: 38295 - DNA, 20 bp, Artificial Sequence
  Synthetic oligonucleotide; AGG chr11 5316837 5316856 5316840 -
actgatgcttagggtcctga

SEQ ID NO: 38296 - DNA, 20 bp, Artificial Sequence
  Synthetic oligonucleotide; GGG chr11 5316836 5316855 5316839 -
ctgatgcttagggtcctgaa

SEQ ID NO: 38297 - DNA, 20 bp, Artificial Sequence
  Synthetic oligonucleotide; AAG chr11 5316823 5316842 5316826 -
tcctgaagggtcacataatt

SEQ ID NO: 38298 - DNA, 20 bp, Artificial Sequence
  Synthetic oligonucleotide; TGG chr11 5316817 5316836 5316820 -
agggtcacataattaagtcc

SEQ ID NO: 38299 - DNA, 20 bp, Artificial Sequence
  Synthetic oligonucleotide; TAG chr11 5316804 5316823 5316807 -
taagtcctggcatcccaatg

SEQ ID NO: 38300 - DNA, 20 bp, Artificial Sequence
  Synthetic oligonucleotide; GAG chr11 5316802 5316821 5316805 -
agtcctggcatcccaatgta

SEQ ID NO: 38301 - DNA, 20 bp, Artificial Sequence
  Synthetic oligonucleotide; AGG chr11 5316801 5316820 5316804 -
gtcctggcatcccaatgtag

SEQ ID NO: 38302 - DNA, 20 bp, Artificial Sequence
  Synthetic oligonucleotide; TGG chr11 5316798 5316817 5316801 -
ctggcatcccaatgtagagg

SEQ ID NO: 38303 - DNA, 20 bp, Artificial Sequence
  Synthetic oligonucleotide; TGG chr11 5316792 5316811 5316795 -
tcccaatgtagaggtggcat

SEQ ID NO: 38304 - DNA, 20 bp, Artificial Sequence
  Synthetic oligonucleotide; GAG chr11 5316790 5316809 5316793 -
ccaatgtagaggtggcattg

SEQ ID NO: 38305 - DNA, 20 bp, Artificial Sequence
  Synthetic oligonucleotide; CAG chr11 5316783 5316802 5316786 -
agaggtggcattggagtatg

SEQ ID NO: 38306 - DNA, 20 bp, Artificial Sequence
  Synthetic oligonucleotide; TGG chr11 5316763 5316782 5316766 -
cagcttttctcatccatcct

SEQ ID NO: 38307 - DNA, 20 bp, Artificial Sequence
  Synthetic oligonucleotide; GAG chr11 5316761 5316780 5316764 -
gcttttctcatccatccttg

SEQ ID NO: 38308 - DNA, 20 bp, Artificial Sequence
  Synthetic oligonucleotide; AAG chr11 5316748 5316767 5316751 -
atccttggagaaatacctga

SEQ ID NO: 38309 - DNA, 20 bp, Artificial Sequence
  Synthetic oligonucleotide; GAG chr11 5316741 5316760 5316744 -
gagaaatacctgaaagttcc

SEQ ID NO: 38310 - DNA, 20 bp, Artificial Sequence
  Synthetic oligonucleotide; AGG chr11 5316740 5316759 5316743 -
agaaatacctgaaagttccg

SEQ ID NO: 38311 - DNA, 20 bp, Artificial Sequence
  Synthetic oligonucleotide; TGG chr11 5316733 5316752 5316736 -
cctgaaagttccgaggacat

SEQ ID NO: 38312 - DNA, 20 bp, Artificial Sequence
  Synthetic oligonucleotide; GAG chr11 5316728 5316747 5316731 -
aagttccgaggacattggtt

SEQ ID NO: 38313 - DNA, 20 bp, Artificial Sequence
  Synthetic oligonucleotide; CAG chr11 5316710 5316729 5316713 -
ttgagcgtccctgcttctcc

SEQ ID NO: 38314 - DNA, 20 bp, Artificial Sequence
  Synthetic oligonucleotide; CAG chr11 5316706 5316725 5316709 -
gcgtccctgcttctcccaga

SEQ ID NO: 38315 - DNA, 20 bp, Artificial Sequence
  Synthetic oligonucleotide; GAG chr11 5316704 5316723 5316707 -
gtccctgcttctcccagaca

SEQ ID NO: 38316 - DNA, 20 bp, Artificial Sequence
  Synthetic oligonucleotide; AGG chr11 5316703 5316722 5316706 -
tccctgcttctcccagacag

SEQ ID NO: 38317 - DNA, 20 bp, Artificial Sequence
  Synthetic oligonucleotide; GAG chr11 5316701 5316720 5316704 -
cctgcttctcccagacagag

SEQ ID NO: 38318 - DNA, 20 bp, Artificial Sequence
  Synthetic oligonucleotide; AGG chr11 5316700 5316719 5316703 -
ctgcttctcccagacagagg

SEQ ID NO: 38319 - DNA, 20 bp, Artificial Sequence
  Synthetic oligonucleotide; GGG chr11 5316699 5316718 5316702 -
tgcttctcccagacagagga

SEQ ID NO: 38320 - DNA, 20 bp, Artificial Sequence
  Synthetic oligonucleotide; GAG chr11 5316697 5316716 5316700 -
cttctcccagacagaggagg

SEQ ID NO: 38321 - DNA, 20 bp, Artificial Sequence
  Synthetic oligonucleotide; AGG chr11 5316696 5316715 5316699 -
ttctcccagacagaggaggg

SEQ ID NO: 38322 - DNA, 20 bp, Artificial Sequence
  Synthetic oligonucleotide; GGG chr11 5316695 5316714 5316698 -
tctcccagacagaggaggga

SEQ ID NO: 38323 - DNA, 20 bp, Artificial Sequence
  Synthetic oligonucleotide; GGG chr11 5316694 5316713 5316697 -
ctcccagacagaggagggag

SEQ ID NO: 38324 - DNA, 20 bp, Artificial Sequence
  Synthetic oligonucleotide; GAG chr11 5316692 5316711 5316695 -
cccagacagaggagggaggg

SEQ ID NO: 38325 - DNA, 20 bp, Artificial Sequence
  Synthetic oligonucleotide; AAG chr11 5316686 5316705 5316689 -
cagaggagggaggggagatc

SEQ ID NO: 38326 - DNA, 20 bp, Artificial Sequence
  Synthetic oligonucleotide; AGG chr11 5316685 5316704 5316688 -
agaggagggaggggagatca

SEQ ID NO: 38327 - DNA, 20 bp, Artificial Sequence
  Synthetic oligonucleotide; GGG chr11 5316684 5316703 5316687 -
gaggagggaggggagatcaa

SEQ ID NO: 38328 - DNA, 20 bp, Artificial Sequence
  Synthetic oligonucleotide; GAG chr11 5316674 5316693 5316677 -
gggagatcaagggttcttct

SEQ ID NO: 38329 - DNA, 20 bp, Artificial Sequence
  Synthetic oligonucleotide; TGG chr11 5316667 5316686 5316670 -
caagggttcttctgagtatt

SEQ ID NO: 38330 - DNA, 20 bp, Artificial Sequence
  Synthetic oligonucleotide; AAG chr11 5316663 5316682 5316666 -
ggttcttctgagtatttgga

SEQ ID NO: 38331 - DNA, 20 bp, Artificial Sequence
  Synthetic oligonucleotide; GAG chr11 5316661 5316680 5316664 -
ttcttctgagtatttggaaa

SEQ ID NO: 38332 - DNA, 20 bp, Artificial Sequence
  Synthetic oligonucleotide; AGG chr11 5316660 5316679 5316663 -
tcttctgagtatttggaaag

SEQ ID NO: 38333 - DNA, 20 bp, Artificial Sequence
  Synthetic oligonucleotide; TGG chr11 5316651 5316670 5316654 -
tatttggaaagaggaaactc

SEQ ID NO: 38334 - DNA, 20 bp, Artificial Sequence
  Synthetic oligonucleotide; GGG chr11 5316650 5316669 5316653 -
atttggaaagaggaaactct

SEQ ID NO: 38335 - DNA, 20 bp, Artificial Sequence
  Synthetic oligonucleotide; GGG chr11 5316649 5316668 5316652 -
tttggaaagaggaaactctg

SEQ ID NO: 38336 - DNA, 20 bp, Artificial Sequence
  Synthetic oligonucleotide; AAG chr11 5316646 5316665 5316649 -
ggaaagaggaaactctgggg

SEQ ID NO: 38337 - DNA, 20 bp, Artificial Sequence
  Synthetic oligonucleotide; TGG chr11 5316614 5316633 5316617 -
catacataaactctctaatt

SEQ ID NO: 38338 - DNA, 20 bp, Artificial Sequence
  Synthetic oligonucleotide; TAG chr11 5316602 5316621 5316605 -
ctctaatttggcctcttgaa

SEQ ID NO: 38339 - DNA, 20 bp, Artificial Sequence
  Synthetic oligonucleotide; GAG chr11 5316594 5316613 5316597 -
tggcctcttgaatagtcttt

SEQ ID NO: 38340 - DNA, 20 bp, Artificial Sequence
  Synthetic oligonucleotide; AAG chr11 5316591 5316610 5316594 -
cctcttgaatagtctttgag

SEQ ID NO: 38341 - DNA, 20 bp, Artificial Sequence
  Synthetic oligonucleotide; GAG chr11 5316587 5316606 5316590 -
ttgaatagtctttgagaagt

SEQ ID NO: 38342 - DNA, 20 bp, Artificial Sequence
  Synthetic oligonucleotide; GAG chr11 5316574 5316593 5316577 -
gagaagtgagtgtctgaact

SEQ ID NO: 38343 - DNA, 20 bp, Artificial Sequence
  Synthetic oligonucleotide; TAG chr11 5316563 5316582 5316566 -
gtctgaactgagtcttcaaa

SEQ ID NO: 38344 - DNA, 20 bp, Artificial Sequence
  Synthetic oligonucleotide; GAG chr11 5316561 5316580 5316564 -
ctgaactgagtcttcaaata

SEQ ID NO: 38345 - DNA, 20 bp, Artificial Sequence
  Synthetic oligonucleotide; CAG chr11 5316558 5316577 5316561 -
aactgagtcttcaaatagag

SEQ ID NO: 38346 - DNA, 20 bp, Artificial Sequence
  Synthetic oligonucleotide; AGG chr11 5316557 5316576 5316560 -
actgagtcttcaaatagagc

SEQ ID NO: 38347 - DNA, 20 bp, Artificial Sequence
  Synthetic oligonucleotide; TGG chr11 5316552 5316571 5316555 -
gtcttcaaatagagcaggaa

SEQ ID NO: 38348 - DNA, 20 bp, Artificial Sequence
  Synthetic oligonucleotide; GGG chr11 5316551 5316570 5316554 -
tcttcaaatagagcaggaat

SEQ ID NO: 38349 - DNA, 20 bp, Artificial Sequence
  Synthetic oligonucleotide; CAG chr11 5316539 5316558 5316542 -
gcaggaatgggtccttattc

SEQ ID NO: 38350 - DNA, 20 bp, Artificial Sequence
  Synthetic oligonucleotide; AAG chr11 5316535 5316554 5316538 -
gaatgggtccttattccagc

SEQ ID NO: 38351 - DNA, 20 bp, Artificial Sequence
  Synthetic oligonucleotide; CAG chr11 5316525 5316544 5316528 -
ttattccagcaagaaaatga

SEQ ID NO: 38352 - DNA, 20 bp, Artificial Sequence
  Synthetic oligonucleotide; TAG chr11 5316520 5316539 5316523 -
ccagcaagaaaatgacagca

SEQ ID NO: 38353 - DNA, 20 bp, Artificial Sequence
  Synthetic oligonucleotide; AGG chr11 5316519 5316538 5316522 -
cagcaagaaaatgacagcat

SEQ ID NO: 38354 - DNA, 20 bp, Artificial Sequence
  Synthetic oligonucleotide; GAG chr11 5316515 5316534 5316518 -
aagaaaatgacagcataggt

SEQ ID NO: 38355 - DNA, 20 bp, Artificial Sequence
  Synthetic oligonucleotide; CAG chr11 5316509 5316528 5316512 -
atgacagcataggtgagtgc

SEQ ID NO: 38356 - DNA, 20 bp, Artificial Sequence
  Synthetic oligonucleotide; AGG chr11 5316508 5316527 5316511 -
tgacagcataggtgagtgcc

SEQ ID NO: 38357 - DNA, 20 bp, Artificial Sequence
  Synthetic oligonucleotide; CAG chr11 5316503 5316522 5316506 -
gcataggtgagtgccaggaa

SEQ ID NO: 38358 - DNA, 20 bp, Artificial Sequence
  Synthetic oligonucleotide; AGG chr11 5316502 5316521 5316505 -
cataggtgagtgccaggaac

SEQ ID NO: 38359 - DNA, 20 bp, Artificial Sequence
  Synthetic oligonucleotide; AAG chr11 5316496 5316515 5316499 -
tgagtgccaggaacaggaat

SEQ ID NO: 38360 - DNA, 20 bp, Artificial Sequence
  Synthetic oligonucleotide; AGG chr11 5316495 5316514 5316498 -
gagtgccaggaacaggaata

SEQ ID NO: 38361 - DNA, 20 bp, Artificial Sequence
  Synthetic oligonucleotide; TAG chr11 5316468 5316487 5316471 -
attcctcttccttcttatgt

SEQ ID NO: 38362 - DNA, 20 bp, Artificial Sequence
  Synthetic oligonucleotide; CAG chr11 5316462 5316481 5316465 -
cttccttcttatgttagatg

SEQ ID NO: 38363 - DNA, 20 bp, Artificial Sequence
  Synthetic oligonucleotide; AAG chr11 5316457 5316476 5316460 -
ttcttatgttagatgcagcg

SEQ ID NO: 38364 - DNA, 20 bp, Artificial Sequence
  Synthetic oligonucleotide; GAG chr11 5316455 5316474 5316458 -
cttatgttagatgcagcgaa

SEQ ID NO: 38365 - DNA, 20 bp, Artificial Sequence
  Synthetic oligonucleotide; AAG chr11 5316452 5316471 5316455 -
atgttagatgcagcgaagag

SEQ ID NO: 38366 - DNA, 20 bp, Artificial Sequence
  Synthetic oligonucleotide; TAG chr11 5316448 5316467 5316451 -
tagatgcagcgaagagaaga

SEQ ID NO: 38367 - DNA, 20 bp, Artificial Sequence
  Synthetic oligonucleotide; AGG chr11 5316447 5316466 5316450 -
agatgcagcgaagagaagat

SEQ ID NO: 38368 - DNA, 20 bp, Artificial Sequence
  Synthetic oligonucleotide; AAG chr11 5316444 5316463 5316447 -
tgcagcgaagagaagatagg

SEQ ID NO: 38369 - DNA, 20 bp, Artificial Sequence
  Synthetic oligonucleotide; CAG chr11 5316436 5316455 5316439 -
agagaagataggaagatttt

SEQ ID NO: 38370 - DNA, 20 bp, Artificial Sequence
  Synthetic oligonucleotide; GAG chr11 5316434 5316453 5316437 -
agaagataggaagattttca

SEQ ID NO: 38371 - DNA, 20 bp, Artificial Sequence
  Synthetic oligonucleotide; AGG chr11 5316433 5316452 5316436 -
gaagataggaagattttcag

SEQ ID NO: 38372 - DNA, 20 bp, Artificial Sequence
  Synthetic oligonucleotide; TAG chr11 5316424 5316443 5316427 -
aagattttcagaggtctgca

SEQ ID NO: 38373 - DNA, 20 bp, Artificial Sequence
  Synthetic oligonucleotide; AGG chr11 5316423 5316442 5316426 -
agattttcagaggtctgcat

SEQ ID NO: 38374 - DNA, 20 bp, Artificial Sequence
  Synthetic oligonucleotide; GAG chr11 5316421 5316440 5316424 -
attttcagaggtctgcatag

SEQ ID NO: 38375 - DNA, 20 bp, Artificial Sequence
  Synthetic oligonucleotide; TGG chr11 5316405 5316424 5316408 -
ataggagaacatactccatc

SEQ ID NO: 38376 - DNA, 20 bp, Artificial Sequence
  Synthetic oligonucleotide; GGG chr11 5316404 5316423 5316407 -
taggagaacatactccatct

SEQ ID NO: 38377 - DNA, 20 bp, Artificial Sequence
  Synthetic oligonucleotide; AAG chr11 5316387 5316406 5316390 -
tctgggatgaccaacaccta

SEQ ID NO: 38378 - DNA, 20 bp, Artificial Sequence
  Synthetic oligonucleotide; CAG chr11 5316382 5316401 5316385 -
gatgaccaacacctaaagca

SEQ ID NO: 38379 - DNA, 20 bp, Artificial Sequence
  Synthetic oligonucleotide; AAG chr11 5316354 5316373 5316357 -
ttcatctcaacacatgtttc

SEQ ID NO: 38380 - DNA, 20 bp, Artificial Sequence
  Synthetic oligonucleotide; AGG chr11 5316353 5316372 5316356 -
tcatctcaacacatgtttca

SEQ ID NO: 38381 - DNA, 20 bp, Artificial Sequence
  Synthetic oligonucleotide; CAG chr11 5316350 5316369 5316353 -
tctcaacacatgtttcaagg

SEQ ID NO: 38382 - DNA, 20 bp, Artificial Sequence
  Synthetic oligonucleotide; AGG chr11 5316349 5316368 5316352 -
ctcaacacatgtttcaaggc

SEQ ID NO: 38383 - DNA, 20 bp, Artificial Sequence
  Synthetic oligonucleotide; AAG chr11 5316342 5316361 5316345 -
catgtttcaaggcaggcttg

SEQ ID NO: 38384 - DNA, 20 bp, Artificial Sequence
  Synthetic oligonucleotide; TGG chr11 5316330 5316349 5316333 -
caggcttgaagtttcaaatg

SEQ ID NO: 38385 - DNA, 20 bp, Artificial Sequence
  Synthetic oligonucleotide; TGG chr11 5316321 5316340 5316324 -
agtttcaaatgtggtgctca

SEQ ID NO: 38386 - DNA, 20 bp, Artificial Sequence
  Synthetic oligonucleotide; TAG chr11 5316316 5316335 5316319 -
caaatgtggtgctcatggat

SEQ ID NO: 38387 - DNA, 20 bp, Artificial Sequence
  Synthetic oligonucleotide; CAG chr11 5316310 5316329 5316313 -
tggtgctcatggattagctt

SEQ ID NO: 38388 - DNA, 20 bp, Artificial Sequence
  Synthetic oligonucleotide; AGG chr11 5316309 5316328 5316312 -
ggtgctcatggattagcttc

SEQ ID NO: 38389 - DNA, 20 bp, Artificial Sequence
  Synthetic oligonucleotide; TAG chr11 5316288 5316307 5316291 -
ggaaaacgtgtgaatatttt

SEQ ID NO: 38390 - DNA, 20 bp, Artificial Sequence
  Synthetic oligonucleotide; CAG chr11 5316245 5316264 5316248 -
cttttgtccatttttctcca

SEQ ID NO: 38391 - DNA, 20 bp, Artificial Sequence
  Synthetic oligonucleotide; GAG chr11 5316243 5316262 5316246 -
tttgtccatttttctccaca

SEQ ID NO: 38392 - DNA, 20 bp, Artificial Sequence
  Synthetic oligonucleotide; AGG chr11 5316242 5316261 5316245 -
ttgtccatttttctccacag

SEQ ID NO: 38393 - DNA, 20 bp, Artificial Sequence
  Synthetic oligonucleotide; GGG chr11 5316241 5316260 5316244 -
tgtccatttttctccacaga

SEQ ID NO: 38394 - DNA, 20 bp, Artificial Sequence
  Synthetic oligonucleotide; TGG chr11 5316234 5316253 5316237 -
ttttctccacagagggctca

SEQ ID NO: 38395 - DNA, 20 bp, Artificial Sequence
  Synthetic oligonucleotide; TAG chr11 5316224 5316243 5316227 -
agagggctcatggcttttgt

SEQ ID NO: 38396 - DNA, 20 bp, Artificial Sequence
  Synthetic oligonucleotide; AAG chr11 5316181 5316200 5316184 -
ttctatttcaaaactaaaca

SEQ ID NO: 38397 - DNA, 20 bp, Artificial Sequence
  Synthetic oligonucleotide; AAG chr11 5316176 5316195 5316179 -
tttcaaaactaaacaaagaa

SEQ ID NO: 38398 - DNA, 20 bp, Artificial Sequence
  Synthetic oligonucleotide; AAG chr11 5316118 5316137 5316121 -
tgaaacataaaataaaaatc

SEQ ID NO: 38399 - DNA, 20 bp, Artificial Sequence
  Synthetic oligonucleotide; AAG chr11 5316090 5316109 5316093 -
atgtatccaaatatgcaatt

SEQ ID NO: 38400 - DNA, 20 bp, Artificial Sequence
  Synthetic oligonucleotide; AAG chr11 5316085 5316104 5316088 -
tccaaatatgcaattaagct

SEQ ID NO: 38401 - DNA, 20 bp, Artificial Sequence
  Synthetic oligonucleotide; CAG chr11 5316082 5316101 5316085 -
aaatatgcaattaagctaag

SEQ ID NO: 38402 - DNA, 20 bp, Artificial Sequence
  Synthetic oligonucleotide; CAG chr11 5316079 5316098 5316082 -
tatgcaattaagctaagcag

SEQ ID NO: 38403 - DNA, 20 bp, Artificial Sequence
  Synthetic oligonucleotide; AGG chr11 5316078 5316097 5316081 -
atgcaattaagctaagcagc

SEQ ID NO: 38404 - DNA, 20 bp, Artificial Sequence
  Synthetic oligonucleotide; TGG chr11 5316018 5316037 5316021 -
gccttcttttttgttactat

SEQ ID NO: 38405 - DNA, 20 bp, Artificial Sequence
  Synthetic oligonucleotide; CAG chr11 5316002 5316021 5316005 -
ctattggttcaaacattgtg

SEQ ID NO: 38406 - DNA, 20 bp, Artificial Sequence
  Synthetic oligonucleotide; AAG chr11 5315998 5316017 5316001 -
tggttcaaacattgtgcagc

SEQ ID NO: 38407 - DNA, 20 bp, Artificial Sequence
  Synthetic oligonucleotide; CAG chr11 5315988 5316007 5315991 -
attgtgcagcaagcacacca

SEQ ID NO: 38408 - DNA, 20 bp, Artificial Sequence
  Synthetic oligonucleotide; GAG chr11 5315986 5316005 5315989 -
tgtgcagcaagcacaccaca

SEQ ID NO: 38409 - DNA, 20 bp, Artificial Sequence
  Synthetic oligonucleotide; AGG chr11 5315985 5316004 5315988 -
gtgcagcaagcacaccacag

SEQ ID NO: 38410 - DNA, 20 bp, Artificial Sequence
  Synthetic oligonucleotide; GGG chr11 5315984 5316003 5315987 -
tgcagcaagcacaccacaga

SEQ ID NO: 38411 - DNA, 20 bp, Artificial Sequence
  Synthetic oligonucleotide; GGG chr11 5315983 5316002 5315986 -
gcagcaagcacaccacagag

SEQ ID NO: 38412 - DNA, 20 bp, Artificial Sequence
  Synthetic oligonucleotide; TAG chr11 5315952 5315971 5315955 -
attttttaaaatgtgttttt

SEQ ID NO: 38413 - DNA, 20 bp, Artificial Sequence
  Synthetic oligonucleotide; AAG chr11 5315946 5315965 5315949 -
taaaatgtgttttttagatt

SEQ ID NO: 38414 - DNA, 20 bp, Artificial Sequence
  Synthetic oligonucleotide; AAG chr11 5315913 5315932 5315916 -
tacttaattattcataactg

SEQ ID NO: 38415 - DNA, 20 bp, Artificial Sequence
  Synthetic oligonucleotide; TAG chr11 5315887 5315906 5315890 -
tgatcatcattccttatctc

SEQ ID NO: 38416 - DNA, 20 bp, Artificial Sequence
  Synthetic oligonucleotide; CAG chr11 5315882 5315901 5315885 -
atcattccttatctctagca

SEQ ID NO: 38417 - DNA, 20 bp, Artificial Sequence
  Synthetic oligonucleotide; AAG chr11 5315855 5315874 5315858 -
taaatgtattgctcttctat

SEQ ID NO: 38418 - DNA, 20 bp, Artificial Sequence
  Synthetic oligonucleotide; TAG chr11 5315798 5315817 5315801 -
ttattgctaaatatgaatat

SEQ ID NO: 38419 - DNA, 20 bp, Artificial Sequence
  Synthetic oligonucleotide; AGG chr11 5315797 5315816 5315800 -
tattgctaaatatgaatatt

SEQ ID NO: 38420 - DNA, 20 bp, Artificial Sequence
  Synthetic oligonucleotide; GAG chr11 5315791 5315810 5315794 -
taaatatgaatattaggatt

SEQ ID NO: 38421 - DNA, 20 bp, Artificial Sequence
  Synthetic oligonucleotide; AGG chr11 5315790 5315809 5315793 -
aaatatgaatattaggattg

SEQ ID NO: 38422 - DNA, 20 bp, Artificial Sequence
  Synthetic oligonucleotide; CAG chr11 5315784 5315803 5315787 -
gaatattaggattgaggctg

SEQ ID NO: 38423 - DNA, 20 bp, Artificial Sequence
  Synthetic oligonucleotide; CAG chr11 5315776 5315795 5315779 -
ggattgaggctgcagaaata

SEQ ID NO: 38424 - DNA, 20 bp, Artificial Sequence
  Synthetic oligonucleotide; AAG chr11 5315767 5315786 5315770 -
ctgcagaaatacagtttcac

SEQ ID NO: 38425 - DNA, 20 bp, Artificial Sequence
  Synthetic oligonucleotide; AAG chr11 5315764 5315783 5315767 -
cagaaatacagtttcacaag

SEQ ID NO: 38426 - DNA, 20 bp, Artificial Sequence
  Synthetic oligonucleotide; AGG chr11 5315763 5315782 5315766 -
agaaatacagtttcacaaga

SEQ ID NO: 38427 - DNA, 20 bp, Artificial Sequence
  Synthetic oligonucleotide; TAG chr11 5315760 5315779 5315763 -
aatacagtttcacaagaagg

SEQ ID NO: 38428 - DNA, 20 bp, Artificial Sequence
  Synthetic oligonucleotide; AAG chr11 5315746 5315765 5315749 -
agaaggtagtaaaaactgat

SEQ ID NO: 38429 - DNA, 20 bp, Artificial Sequence
  Synthetic oligonucleotide; AGG chr11 5315745 5315764 5315748 -
gaaggtagtaaaaactgata

SEQ ID NO: 38430 - DNA, 20 bp, Artificial Sequence
  Synthetic oligonucleotide; CAG chr11 5315742 5315761 5315745 -
ggtagtaaaaactgataagg

SEQ ID NO: 38431 - DNA, 20 bp, Artificial Sequence
  Synthetic oligonucleotide; AGG chr11 5315741 5315760 5315744 -
gtagtaaaaactgataaggc

SEQ ID NO: 38432 - DNA, 20 bp, Artificial Sequence
  Synthetic oligonucleotide; GGG chr11 5315740 5315759 5315743 -
tagtaaaaactgataaggca

SEQ ID NO: 38433 - DNA, 20 bp, Artificial Sequence
  Synthetic oligonucleotide; CAG chr11 5315733 5315752 5315736 -
aactgataaggcagggattt

SEQ ID NO: 38434 - DNA, 20 bp, Artificial Sequence
  Synthetic oligonucleotide; TAG chr11 5315725 5315744 5315728 -
aggcagggatttcagtgtaa

SEQ ID NO: 38435 - DNA, 20 bp, Artificial Sequence
  Synthetic oligonucleotide; AAG chr11 5315714 5315733 5315717 -
tcagtgtaatagtttctata

SEQ ID NO: 38436 - DNA, 20 bp, Artificial Sequence
  Synthetic oligonucleotide; CGG chr11 5315684 5315703 5315687 -
ccacttgtgaacacacaatg

SEQ ID NO: 38437 - DNA, 20 bp, Artificial Sequence
  Synthetic oligonucleotide; TGG chr11 5315665 5315684 5315668 -
gcggctccttttttgctgcc

SEQ ID NO: 38438 - DNA, 20 bp, Artificial Sequence
  Synthetic oligonucleotide; CAG chr11 5315657 5315676 5315660 -
ttttttgctgcctggctttt

SEQ ID NO: 38439 - DNA, 20 bp, Artificial Sequence
  Synthetic oligonucleotide; TGG chr11 5315651 5315670 5315654 -
gctgcctggcttttcagtac

SEQ ID NO: 38440 - DNA, 20 bp, Artificial Sequence
  Synthetic oligonucleotide; GAG chr11 5315649 5315668 5315652 -
tgcctggcttttcagtactg

SEQ ID NO: 38441 - DNA, 20 bp, Artificial Sequence
  Synthetic oligonucleotide; AGG chr11 5315648 5315667 5315651 -
gcctggcttttcagtactgg

SEQ ID NO: 38442 - DNA, 20 bp, Artificial Sequence
  Synthetic oligonucleotide; TGG chr11 5315590 5315609 5315593 -
gtttatgtgtgcgtccttct

SEQ ID NO: 38443 - DNA, 20 bp, Artificial Sequence
  Synthetic oligonucleotide; TGG chr11 5315584 5315603 5315587 -
gtgtgcgtccttcttggcaa

SEQ ID NO: 38444 - DNA, 20 bp, Artificial Sequence
  Synthetic oligonucleotide; AAG chr11 5315580 5315599 5315583 -
gcgtccttcttggcaatggc

SEQ ID NO: 38445 - DNA, 20 bp, Artificial Sequence
  Synthetic oligonucleotide; AAG chr11 5315562 5315581 5315565 -
gcaagctcctctacctcatc

SEQ ID NO: 38446 - DNA, 20 bp, Artificial Sequence
  Synthetic oligonucleotide; CAG chr11 5315551 5315570 5315554 -
tacctcatcaagcatgacca

SEQ ID NO: 38447 - DNA, 20 bp, Artificial Sequence
  Synthetic oligonucleotide; GAG chr11 5315512 5315531 5315515 -
tactgtttccttgccacact

SEQ ID NO: 38448 - DNA, 20 bp, Artificial Sequence
  Synthetic oligonucleotide; AGG chr11 5315511 5315530 5315514 -
actgtttccttgccacactg

SEQ ID NO: 38449 - DNA, 20 bp, Artificial Sequence
  Synthetic oligonucleotide; AAG chr11 5315507 5315526 5315510 -
tttccttgccacactgaggc

SEQ ID NO: 38450 - DNA, 20 bp, Artificial Sequence
  Synthetic oligonucleotide; TGG chr11 5315498 5315517 5315501 -
cacactgaggcaagacctca

SEQ ID NO: 38451 - DNA, 20 bp, Artificial Sequence
  Synthetic oligonucleotide; TGG chr11 5315468 5315487 5315471 -
gaccatgatgcccactgtaa

SEQ ID NO: 38452 - DNA, 20 bp, Artificial Sequence
  Synthetic oligonucleotide; GGG chr11 5315467 5315486 5315470 -
accatgatgcccactgtaat

SEQ ID NO: 38453 - DNA, 20 bp, Artificial Sequence
  Synthetic oligonucleotide; TGG chr11 5315457 5315476 5315460 -
ccactgtaatgggcgtcttg

SEQ ID NO: 38454 - DNA, 20 bp, Artificial Sequence
  Synthetic oligonucleotide; AAG chr11 5315444 5315463 5315447 -
cgtcttgtggatgaatcaca

SEQ ID NO: 38455 - DNA, 20 bp, Artificial Sequence
  Synthetic oligonucleotide; GAG chr11 5315442 5315461 5315445 -
tcttgtggatgaatcacaaa

SEQ ID NO: 38456 - DNA, 20 bp, Artificial Sequence
  Synthetic oligonucleotide; AGG chr11 5315441 5315460 5315444 -
cttgtggatgaatcacaaag

SEQ ID NO: 38457 - DNA, 20 bp, Artificial Sequence
  Synthetic oligonucleotide; TGG chr11 5315431 5315450 5315434 -
aatcacaaagaggttatcca

SEQ ID NO: 38458 - DNA, 20 bp, Artificial Sequence
  Synthetic oligonucleotide; GGG chr11 5315430 5315449 5315433 -
atcacaaagaggttatccat

SEQ ID NO: 38459 - DNA, 20 bp, Artificial Sequence
  Synthetic oligonucleotide; GGG chr11 5315429 5315448 5315432 -
tcacaaagaggttatccatg

SEQ ID NO: 38460 - DNA, 20 bp, Artificial Sequence
  Synthetic oligonucleotide; CAG chr11 5315415 5315434 5315418 -
tccatggggcctgcttcttg

SEQ ID NO: 38461 - DNA, 20 bp, Artificial Sequence
  Synthetic oligonucleotide; AGG chr11 5315414 5315433 5315417 -
ccatggggcctgcttcttgc

SEQ ID NO: 38462 - DNA, 20 bp, Artificial Sequence
  Synthetic oligonucleotide; CAG chr11 5315381 5315400 5315384 -
ccactcccattatccacttg

SEQ ID NO: 38463 - DNA, 20 bp, Artificial Sequence
  Synthetic oligonucleotide; CAG chr11 5315375 5315394 5315378 -
ccattatccacttgcagaat

SEQ ID NO: 38464 - DNA, 20 bp, Artificial Sequence
  Synthetic oligonucleotide; AGG chr11 5315374 5315393 5315377 -
cattatccacttgcagaatc

SEQ ID NO: 38465 - DNA, 20 bp, Artificial Sequence
  Synthetic oligonucleotide; TGG chr11 5315357 5315376 5315360 -
atcaggtattctcctgtcaa

SEQ ID NO: 38466 - DNA, 20 bp, Artificial Sequence
  Synthetic oligonucleotide; CAG chr11 5315320 5315339 5315323 -
attatcatccacatgcttct

SEQ ID NO: 38467 - DNA, 20 bp, Artificial Sequence
  Synthetic oligonucleotide; AGG chr11 5315319 5315338 5315322 -
ttatcatccacatgcttctc

SEQ ID NO: 38468 - DNA, 20 bp, Artificial Sequence
  Synthetic oligonucleotide; TGG chr11 5315294 5315313 5315297 -
taactatttctactaaatct

SEQ ID NO: 38469 - DNA, 20 bp, Artificial Sequence
  Synthetic oligonucleotide; GGG chr11 5315293 5315312 5315296 -
aactatttctactaaatctt

SEQ ID NO: 38470 - DNA, 20 bp, Artificial Sequence
  Synthetic oligonucleotide; AAG chr11 5315288 5315307 5315291 -
tttctactaaatcttgggtg

SEQ ID NO: 38471 - DNA, 20 bp, Artificial Sequence
  Synthetic oligonucleotide; TAG chr11 5315284 5315303 5315287 -
tactaaatcttgggtgaaga

SEQ ID NO: 38472 - DNA, 20 bp, Artificial Sequence
  Synthetic oligonucleotide; TGG chr11 5315276 5315295 5315279 -
cttgggtgaagatagaactg

SEQ ID NO: 38473 - DNA, 20 bp, Artificial Sequence
  Synthetic oligonucleotide; GAG chr11 5315265 5315284 5315268 -
atagaactgtggctatttat

SEQ ID NO: 38474 - DNA, 20 bp, Artificial Sequence
  Synthetic oligonucleotide; AGG chr11 5315264 5315283 5315267 -
tagaactgtggctatttatg

SEQ ID NO: 38475 - DNA, 20 bp, Artificial Sequence
  Synthetic oligonucleotide; GGG chr11 5315263 5315282 5315266 -
agaactgtggctatttatga

SEQ ID NO: 38476 - DNA, 20 bp, Artificial Sequence
  Synthetic oligonucleotide; AAG chr11 5315170 5315189 5315173 -
ccacaccttttttctccatc

SEQ ID NO: 38477 - DNA, 20 bp, Artificial Sequence
  Synthetic oligonucleotide; CAG chr11 5315119 5315138 5315122 -
tacattcaatcacttatacc

SEQ ID NO: 38478 - DNA, 20 bp, Artificial Sequence
  Synthetic oligonucleotide; TGG chr11 5315110 5315129 5315113 -
tcacttatacccagctattc

SEQ ID NO: 38479 - DNA, 20 bp, Artificial Sequence
  Synthetic oligonucleotide; TAG chr11 5315089 5315108 5315092 -
ggttgctttgattttcttcc

SEQ ID NO: 38480 - DNA, 20 bp, Artificial Sequence
  Synthetic oligonucleotide; CAG chr11 5315044 5315063 5315047 -
ttatatcctgatccttaaaa

SEQ ID NO: 38481 - DNA, 20 bp, Artificial Sequence
  Synthetic oligonucleotide; AAG chr11 5315038 5315057 5315041 -
cctgatccttaaaacagtta

SEQ ID NO: 38482 - DNA, 20 bp, Artificial Sequence
  Synthetic oligonucleotide; AGG chr11 5315037 5315056 5315040 -
ctgatccttaaaacagttaa

SEQ ID NO: 38483 - DNA, 20 bp, Artificial Sequence
  Synthetic oligonucleotide; CAG chr11 5315025 5315044 5315028 -
acagttaaaggtattgcctc

SEQ ID NO: 38484 - DNA, 20 bp, Artificial Sequence
  Synthetic oligonucleotide; AAG chr11 5315020 5315039 5315023 -
taaaggtattgcctccagaa

SEQ ID NO: 38485 - DNA, 20 bp, Artificial Sequence
  Synthetic oligonucleotide; GAG chr11 5315018 5315037 5315021 -
aaggtattgcctccagaaaa

SEQ ID NO: 38486 - DNA, 20 bp, Artificial Sequence
  Synthetic oligonucleotide; AAG chr11 5315014 5315033 5315017 -
tattgcctccagaaaagagc

SEQ ID NO: 38487 - DNA, 20 bp, Artificial Sequence
  Synthetic oligonucleotide; AAG chr11 5315008 5315027 5315011 -
ctccagaaaagagcaagcca

SEQ ID NO: 38488 - DNA, 20 bp, Artificial Sequence
  Synthetic oligonucleotide; CAG chr11 5314980 5314999 5314983 -
aacatgtgtgtctcccatat

SEQ ID NO: 38489 - DNA, 20 bp, Artificial Sequence
  Synthetic oligonucleotide; TGG chr11 5314969 5314988 5314972 -
ctcccatatcagctgtgtct

SEQ ID NO: 38490 - DNA, 20 bp, Artificial Sequence
  Synthetic oligonucleotide; CAG chr11 5314947 5314966 5314950 -
gtatttcacatcaccgtgat

SEQ ID NO: 38491 - DNA, 20 bp, Artificial Sequence
  Synthetic oligonucleotide; GAG chr11 5314943 5314962 5314946 -
ttcacatcaccgtgatcagt

SEQ ID NO: 38492 - DNA, 20 bp, Artificial Sequence
  Synthetic oligonucleotide; CAG chr11 5314929 5314948 5314932 -
atcagtgagactttcattca

SEQ ID NO: 38493 - DNA, 20 bp, Artificial Sequence
  Synthetic oligonucleotide; AGG chr11 5314928 5314947 5314931 -
tcagtgagactttcattcac

SEQ ID NO: 38494 - DNA, 20 bp, Artificial Sequence
  Synthetic oligonucleotide; TGG chr11 5314923 5314942 5314926 -
gagactttcattcacaggtt

SEQ ID NO: 38495 - DNA, 20 bp, Artificial Sequence
  Synthetic oligonucleotide; GGG chr11 5314922 5314941 5314925 -
agactttcattcacaggttt

SEQ ID NO: 38496 - DNA, 20 bp, Artificial Sequence
  Synthetic oligonucleotide; TGG chr11 5314903 5314922 5314906 -
tgggaaacatgcaccacatg

SEQ ID NO: 38497 - DNA, 20 bp, Artificial Sequence
  Synthetic oligonucleotide; GAG chr11 5314887 5314906 5314890 -
catgtggtgcacattaccgt

SEQ ID NO: 38498 - DNA, 20 bp, Artificial Sequence
  Synthetic oligonucleotide; CAG chr11 5314838 5314857 5314841 -
ttcatgaaccctattatata

SEQ ID NO: 38499 - DNA, 20 bp, Artificial Sequence
  Synthetic oligonucleotide; AAG chr11 5314826 5314845 5314829 -
attatatacagcatcaaacc

SEQ ID NO: 38500 - DNA, 20 bp, Artificial Sequence
  Synthetic oligonucleotide; CAG chr11 5314823 5314842 5314826 -
atatacagcatcaaaccaag

SEQ ID NO: 38501 - DNA, 20 bp, Artificial Sequence
  Synthetic oligonucleotide; AAG chr11 5314815 5314834 5314818 -
catcaaaccaagcagatcca

SEQ ID NO: 38502 - DNA, 20 bp, Artificial Sequence
  Synthetic oligonucleotide; AAG chr11 5314812 5314831 5314815 -
caaaccaagcagatccaaag

SEQ ID NO: 38503 - DNA, 20 bp, Artificial Sequence
  Synthetic oligonucleotide; TGG chr11 5314791 5314810 5314794 -
agcattgttcgcctattttc

SEQ ID NO: 38504 - DNA, 20 bp, Artificial Sequence
  Synthetic oligonucleotide; GGG chr11 5314790 5314809 5314793 -
gcattgttcgcctattttct

SEQ ID NO: 38505 - DNA, 20 bp, Artificial Sequence
  Synthetic oligonucleotide; CAG chr11 5314785 5314804 5314788 -
gttcgcctattttctgggca

SEQ ID NO: 38506 - DNA, 20 bp, Artificial Sequence
  Synthetic oligonucleotide; TGG chr11 5314780 5314799 5314783 -
cctattttctgggcacagaa

SEQ ID NO: 38507 - DNA, 20 bp, Artificial Sequence
  Synthetic oligonucleotide; GAG chr11 5314774 5314793 5314777 -
ttctgggcacagaatggctt

SEQ ID NO: 38508 - DNA, 20 bp, Artificial Sequence
  Synthetic oligonucleotide; CAG chr11 5314762 5314781 5314765 -
aatggcttgagccctttttt

SEQ ID NO: 38509 - DNA, 20 bp, Artificial Sequence
  Synthetic oligonucleotide; TGG chr11 5314736 5314755 5314739 -
tttgtgatcttcatgatttc

SEQ ID NO: 38510 - DNA, 20 bp, Artificial Sequence
  Synthetic oligonucleotide; GGG chr11 5314735 5314754 5314738 -
ttgtgatcttcatgatttct

SEQ ID NO: 38511 - DNA, 20 bp, Artificial Sequence
  Synthetic oligonucleotide; GAG chr11 5314726 5314745 5314729 -
tcatgatttctgggcctttt

SEQ ID NO: 38512 - DNA, 20 bp, Artificial Sequence
  Synthetic oligonucleotide; TGG chr11 5314719 5314738 5314722 -
ttctgggccttttgagtaat

SEQ ID NO: 38513 - DNA, 20 bp, Artificial Sequence
  Synthetic oligonucleotide; AAG chr11 5314715 5314734 5314718 -
gggccttttgagtaattgga

SEQ ID NO: 38514 - DNA, 20 bp, Artificial Sequence
  Synthetic oligonucleotide; AGG chr11 5314714 5314733 5314717 -
ggccttttgagtaattggaa

SEQ ID NO: 38515 - DNA, 20 bp, Artificial Sequence
  Synthetic oligonucleotide; GAG chr11 5314712 5314731 5314715 -
ccttttgagtaattggaaag

SEQ ID NO: 38516 - DNA, 20 bp, Artificial Sequence
  Synthetic oligonucleotide; CAG chr11 5314681 5314700 5314684 -
atacccaatatctcttgtat

SEQ ID NO: 38517 - DNA, 20 bp, Artificial Sequence
  Synthetic oligonucleotide; TAG chr11 5314675 5314694 5314678 -
aatatctcttgtatcagtgt

SEQ ID NO: 38518 - DNA, 20 bp, Artificial Sequence
  Synthetic oligonucleotide; TAG chr11 5314671 5314690 5314674 -
tctcttgtatcagtgttaga

SEQ ID NO: 38519 - DNA, 20 bp, Artificial Sequence
  Synthetic oligonucleotide; AGG chr11 5314670 5314689 5314673 -
ctcttgtatcagtgttagat

SEQ ID NO: 38520 - DNA, 20 bp, Artificial Sequence
  Synthetic oligonucleotide; AAG chr11 5314651 5314670 5314654 -
taggctttaactattatcta

SEQ ID NO: 38521 - DNA, 20 bp, Artificial Sequence
  Synthetic oligonucleotide; AAG chr11 5314644 5314663 5314647 -
taactattatctaaagtgaa

SEQ ID NO: 38522 - DNA, 20 bp, Artificial Sequence
  Synthetic oligonucleotide; TGG chr11 5314636 5314655 5314639 -
atctaaagtgaaaagctaca

SEQ ID NO: 38523 - DNA, 20 bp, Artificial Sequence
  Synthetic oligonucleotide; TAG chr11 5314556 5314575 5314559 -
tgtataaatgtattcatatg

SEQ ID NO: 38524 - DNA, 20 bp, Artificial Sequence
  Synthetic oligonucleotide; AAG chr11 5314548 5314567 5314551 -
tgtattcatatgtagatgta

SEQ ID NO: 38525 - DNA, 20 bp, Artificial Sequence
  Synthetic oligonucleotide; GAG chr11 5314538 5314557 5314541 -
tgtagatgtaaagctttatc

SEQ ID NO: 38526 - DNA, 20 bp, Artificial Sequence
  Synthetic oligonucleotide; AGG chr11 5314537 5314556 5314540 -
gtagatgtaaagctttatcg

SEQ ID NO: 38527 - DNA, 20 bp, Artificial Sequence
  Synthetic oligonucleotide; GGG chr11 5314536 5314555 5314539 -
tagatgtaaagctttatcga

SEQ ID NO: 38528 - DNA, 20 bp, Artificial Sequence
  Synthetic oligonucleotide; GAG chr11 5314534 5314553 5314537 -
gatgtaaagctttatcgagg

SEQ ID NO: 38529 - DNA, 20 bp, Artificial Sequence
  Synthetic oligonucleotide; GAG chr11 5314505 5314524 5314508 -
ctataatttacctatctatt

SEQ ID NO: 38530 - DNA, 20 bp, Artificial Sequence
  Synthetic oligonucleotide; GAG chr11 5314503 5314522 5314506 -
ataatttacctatctattga

SEQ ID NO: 38531 - DNA, 20 bp, Artificial Sequence
  Synthetic oligonucleotide; TAG chr11 5314496 5314515 5314499 -
acctatctattgagagatac

SEQ ID NO: 38532 - DNA, 20 bp, Artificial Sequence
  Synthetic oligonucleotide; AGG chr11 5314495 5314514 5314498 -
cctatctattgagagatact

SEQ ID NO: 38533 - DNA, 20 bp, Artificial Sequence
  Synthetic oligonucleotide; AAG chr11 5314491 5314510 5314494 -
tctattgagagatactagga

SEQ ID NO: 38534 - DNA, 20 bp, Artificial Sequence
  Synthetic oligonucleotide; TGG chr11 5314488 5314507 5314491 -
attgagagatactaggaaag

SEQ ID NO: 38535 - DNA, 20 bp, Artificial Sequence
  Synthetic oligonucleotide; TGG chr11 5314471 5314490 5314474 -
aagtggaatactattgaata

SEQ ID NO: 38536 - DNA, 20 bp, Artificial Sequence
  Synthetic oligonucleotide; GAG chr11 5314469 5314488 5314472 -
gtggaatactattgaatatg

SEQ ID NO: 38537 - DNA, 20 bp, Artificial Sequence
  Synthetic oligonucleotide; TAG chr11 5314456 5314475 5314459 -
gaatatggagataaaacatg

SEQ ID NO: 38538 - DNA, 20 bp, Artificial Sequence
  Synthetic oligonucleotide; CAG chr11 5314436 5314455 5314439 -
tagataaataccctaataat

SEQ ID NO: 38539 - DNA, 20 bp, Artificial Sequence
  Synthetic oligonucleotide; AGG chr11 5314435 5314454 5314438 -
agataaataccctaataatc

SEQ ID NO: 38540 - DNA, 20 bp, Artificial Sequence
  Synthetic oligonucleotide; GGG chr11 5314434 5314453 5314437 -
gataaataccctaataatca

SEQ ID NO: 38541 - DNA, 20 bp, Artificial Sequence
  Synthetic oligonucleotide; TGG chr11 5314425 5314444 5314428 -
cctaataatcagggaaaata

SEQ ID NO: 38542 - DNA, 20 bp, Artificial Sequence
  Synthetic oligonucleotide; AAG chr11 5314401 5314420 5314404 -
tattcataacctgtattcat

SEQ ID NO: 38543 - DNA, 20 bp, Artificial Sequence
  Synthetic oligonucleotide; AAG chr11 5314392 5314411 5314395 -
cctgtattcataagaactga

SEQ ID NO: 38544 - DNA, 20 bp, Artificial Sequence
  Synthetic oligonucleotide; TAG chr11 5314381 5314400 5314384 -
aagaactgaaagtaccattt

SEQ ID NO: 38545 - DNA, 20 bp, Artificial Sequence
  Synthetic oligonucleotide; AGG chr11 5314380 5314399 5314383 -
agaactgaaagtaccatttt

SEQ ID NO: 38546 - DNA, 20 bp, Artificial Sequence
  Synthetic oligonucleotide; AAG chr11 5314377 5314396 5314380 -
actgaaagtaccattttagg

SEQ ID NO: 38547 - DNA, 20 bp, Artificial Sequence
  Synthetic oligonucleotide; GAG chr11 5314375 5314394 5314378 -
tgaaagtaccattttaggaa

SEQ ID NO: 38548 - DNA, 20 bp, Artificial Sequence
  Synthetic oligonucleotide; AAG chr11 5314370 5314389 5314373 -
gtaccattttaggaagagtc

SEQ ID NO: 38549 - DNA, 20 bp, Artificial Sequence
  Synthetic oligonucleotide; TGG chr11 5314367 5314386 5314370 -
ccattttaggaagagtcaag

SEQ ID NO: 38550 - DNA, 20 bp, Artificial Sequence
  Synthetic oligonucleotide; CAG chr11 5314363 5314382 5314366 -
tttaggaagagtcaagtggc

SEQ ID NO: 38551 - DNA, 20 bp, Artificial Sequence
  Synthetic oligonucleotide; TAG chr11 5314358 5314377 5314361 -
gaagagtcaagtggccagtc

SEQ ID NO: 38552 - DNA, 20 bp, Artificial Sequence
  Synthetic oligonucleotide; AAG chr11 5314347 5314366 5314350 -
tggccagtctagttcaacca

SEQ ID NO: 38553 - DNA, 20 bp, Artificial Sequence
  Synthetic oligonucleotide; CAG chr11 5314340 5314359 5314343 -
tctagttcaaccaaagccta

SEQ ID NO: 38554 - DNA, 20 bp, Artificial Sequence
  Synthetic oligonucleotide; AAG chr11 5314337 5314356 5314340 -
agttcaaccaaagcctacag

SEQ ID NO: 38555 - DNA, 20 bp, Artificial Sequence
  Synthetic oligonucleotide; AGG chr11 5314336 5314355 5314339 -
gttcaaccaaagcctacaga

SEQ ID NO: 38556 - DNA, 20 bp, Artificial Sequence
  Synthetic oligonucleotide; CAG chr11 5314318 5314337 5314321 -
gaaggaaaaatgtgcaattg

SEQ ID NO: 38557 - DNA, 20 bp, Artificial Sequence
  Synthetic oligonucleotide; TAG chr11 5314312 5314331 5314315 -
aaaatgtgcaattgcagatc

SEQ ID NO: 38558 - DNA, 20 bp, Artificial Sequence
  Synthetic oligonucleotide; TGG chr11 5314306 5314325 5314309 -
tgcaattgcagatctagttt

SEQ ID NO: 38559 - DNA, 20 bp, Artificial Sequence
  Synthetic oligonucleotide; AAG chr11 5314296 5314315 5314299 -
gatctagttttggccatata

SEQ ID NO: 38560 - DNA, 20 bp, Artificial Sequence
  Synthetic oligonucleotide; TAG chr11 5314285 5314304 5314288 -
ggccatataaagatgaatta

SEQ ID NO: 38561 - DNA, 20 bp, Artificial Sequence
  Synthetic oligonucleotide; GAG chr11 5314272 5314291 5314275 -
tgaattatagcatgtgaatt

SEQ ID NO: 38562 - DNA, 20 bp, Artificial Sequence
  Synthetic oligonucleotide; AGG chr11 5314271 5314290 5314274 -
gaattatagcatgtgaattg

SEQ ID NO: 38563 - DNA, 20 bp, Artificial Sequence
  Synthetic oligonucleotide; TGG chr11 5314265 5314284 5314268 -
tagcatgtgaattgaggtca

SEQ ID NO: 38564 - DNA, 20 bp, Artificial Sequence
  Synthetic oligonucleotide; CAG chr11 5314230 5314249 5314233 -
atctcaaaactactctattt

SEQ ID NO: 38565 - DNA, 20 bp, Artificial Sequence
  Synthetic oligonucleotide; AGG chr11 5314229 5314248 5314232 -
tctcaaaactactctatttc

SEQ ID NO: 38566 - DNA, 20 bp, Artificial Sequence
  Synthetic oligonucleotide; GGG chr11 5314228 5314247 5314231 -
ctcaaaactactctatttca

SEQ ID NO: 38567 - DNA, 20 bp, Artificial Sequence
  Synthetic oligonucleotide; TAG chr11 5314225 5314244 5314228 -
aaaactactctatttcaggg

SEQ ID NO: 38568 - DNA, 20 bp, Artificial Sequence
  Synthetic oligonucleotide; TAG chr11 5314193 5314212 5314196 -
ttttttttttttttttaaaa

SEQ ID NO: 38569 - DNA, 20 bp, Artificial Sequence
  Synthetic oligonucleotide; TAG chr11 5314168 5314187 5314171 -
tttattttccttcaacttat

SEQ ID NO: 38570 - DNA, 20 bp, Artificial Sequence
  Synthetic oligonucleotide; AGG chr11 5314167 5314186 5314170 -
ttattttccttcaacttatt

SEQ ID NO: 38571 - DNA, 20 bp, Artificial Sequence
  Synthetic oligonucleotide; TAG chr11 5314164 5314183 5314167 -
ttttccttcaacttattagg

SEQ ID NO: 38572 - DNA, 20 bp, Artificial Sequence
  Synthetic oligonucleotide; AGG chr11 5314163 5314182 5314166 -
tttccttcaacttattaggt

SEQ ID NO: 38573 - DNA, 20 bp, Artificial Sequence
  Synthetic oligonucleotide; AAG chr11 5314156 5314175 5314159 -
caacttattaggtaggtgca

SEQ ID NO: 38574 - DNA, 20 bp, Artificial Sequence
  Synthetic oligonucleotide; AGG chr11 5314155 5314174 5314158 -
aacttattaggtaggtgcaa

SEQ ID NO: 38575 - DNA, 20 bp, Artificial Sequence
  Synthetic oligonucleotide; CAG chr11 5314146 5314165 5314149 -
ggtaggtgcaaaggtaattg

SEQ ID NO: 38576 - DNA, 20 bp, Artificial Sequence
  Synthetic oligonucleotide; CAG chr11 5314139 5314158 5314142 -
gcaaaggtaattgcagttca

SEQ ID NO: 38577 - DNA, 20 bp, Artificial Sequence
  Synthetic oligonucleotide; AAG chr11 5314105 5314124 5314108 -
gtaccaacataatatatttt

SEQ ID NO: 38578 - DNA, 20 bp, Artificial Sequence
  Synthetic oligonucleotide; CAG chr11 5314099 5314118 5314102 -
acataatatattttaagttc

SEQ ID NO: 38579 - DNA, 20 bp, Artificial Sequence
  Synthetic oligonucleotide; AGG chr11 5314098 5314117 5314101 -
cataatatattttaagttcc

SEQ ID NO: 38580 - DNA, 20 bp, Artificial Sequence
  Synthetic oligonucleotide; GGG chr11 5314097 5314116 5314100 -
ataatatattttaagttcca

SEQ ID NO: 38581 - DNA, 20 bp, Artificial Sequence
  Synthetic oligonucleotide; CAG chr11 5314086 5314105 5314089 -
taagttccagggcacatgtg

SEQ ID NO: 38582 - DNA, 20 bp, Artificial Sequence
  Synthetic oligonucleotide; AGG chr11 5314085 5314104 5314088 -
aagttccagggcacatgtgc

SEQ ID NO: 38583 - DNA, 20 bp, Artificial Sequence
  Synthetic oligonucleotide; CAG chr11 5314077 5314096 5314080 -
gggcacatgtgcaggatgtg

SEQ ID NO: 38584 - DNA, 20 bp, Artificial Sequence
  Synthetic oligonucleotide; AGG chr11 5314076 5314095 5314079 -
ggcacatgtgcaggatgtgc

SEQ ID NO: 38585 - DNA, 20 bp, Artificial Sequence
  Synthetic oligonucleotide; TAG chr11 5314064 5314083 5314067 -
ggatgtgcaggtttattaca

SEQ ID NO: 38586 - DNA, 20 bp, Artificial Sequence
  Synthetic oligonucleotide; AGG chr11 5314063 5314082 5314066 -
gatgtgcaggtttattacat

SEQ ID NO: 38587 - DNA, 20 bp, Artificial Sequence
  Synthetic oligonucleotide; CAG chr11 5314045 5314064 5314048 -
ataggtaaatgtgtgccatg

SEQ ID NO: 38588 - DNA, 20 bp, Artificial Sequence
  Synthetic oligonucleotide; AGG chr11 5314044 5314063 5314047 -
taggtaaatgtgtgccatgc

SEQ ID NO: 38589 - DNA, 20 bp, Artificial Sequence
  Synthetic oligonucleotide; TAG chr11 5314027 5314046 5314030 -
tgcaggtttgctgcattcgt

SEQ ID NO: 38590 - DNA, 20 bp, Artificial Sequence
  Synthetic oligonucleotide; TGG chr11 5314014 5314033 5314017 -
cattcgttagctattcttcc

SEQ ID NO: 38591 - DNA, 20 bp, Artificial Sequence
  Synthetic oligonucleotide; CGG chr11 5313983 5314002 5313986 -
ctctcctccccacccactac

SEQ ID NO: 38592 - DNA, 20 bp, Artificial Sequence
  Synthetic oligonucleotide; CAG chr11 5313979 5313998 5313982 -
cctccccacccactaccgga

SEQ ID NO: 38593 - DNA, 20 bp, Artificial Sequence
  Synthetic oligonucleotide; AGG chr11 5313978 5313997 5313981 -
ctccccacccactaccggac

SEQ ID NO: 38594 - DNA, 20 bp, Artificial Sequence
  Synthetic oligonucleotide; AAG chr11 5313952 5313971 5313955 -
ctgtgtgtgttgttccccac

SEQ ID NO: 38595 - DNA, 20 bp, Artificial Sequence
  Synthetic oligonucleotide; CAG chr11 5313928 5313947 5313931 -
gtccatgtgttctcactgtt

SEQ ID NO: 38596 - DNA, 20 bp, Artificial Sequence
  Synthetic oligonucleotide; GAG chr11 5313910 5313929 5313913 -
ttcagctcccatttctgtgt

SEQ ID NO: 38597 - DNA, 20 bp, Artificial Sequence
  Synthetic oligonucleotide; TGG chr11 5313895 5313914 5313898 -
tgtgtgagaacatgtgtgtt

SEQ ID NO: 38598 - DNA, 20 bp, Artificial Sequence
  Synthetic oligonucleotide; TAG chr11 5313876 5313895 5313879 -
ttggttttctgttcctgtgt

SEQ ID NO: 38599 - DNA, 20 bp, Artificial Sequence
  Synthetic oligonucleotide; GAG chr11 5313867 5313886 5313870 -
tgttcctgtgttagtttgat

SEQ ID NO: 38600 - DNA, 20 bp, Artificial Sequence
  Synthetic oligonucleotide; AGG chr11 5313866 5313885 5313869 -
gttcctgtgttagtttgatg

SEQ ID NO: 38601 - DNA, 20 bp, Artificial Sequence
  Synthetic oligonucleotide; TGG chr11 5313859 5313878 5313862 -
tgttagtttgatgaggataa

SEQ ID NO: 38602 - DNA, 20 bp, Artificial Sequence
  Synthetic oligonucleotide; CAG chr11 5313852 5313871 5313855 -
ttgatgaggataatggcttc

SEQ ID NO: 38603 - DNA, 20 bp, Artificial Sequence
  Synthetic oligonucleotide; AAG chr11 5313831 5313850 5313834 -
agctccattcatgtccctgc

SEQ ID NO: 38604 - DNA, 20 bp, Artificial Sequence
  Synthetic oligonucleotide; AGG chr11 5313830 5313849 5313833 -
gctccattcatgtccctgca

SEQ ID NO: 38605 - DNA, 20 bp, Artificial Sequence
  Synthetic oligonucleotide; TGG chr11 5313805 5313824 5313808 -
cacaatccttttccttttta

SEQ ID NO: 38606 - DNA, 20 bp, Artificial Sequence
  Synthetic oligonucleotide; TAG chr11 5313797 5313816 5313800 -
ttttcctttttatggctgta

SEQ ID NO: 38607 - DNA, 20 bp, Artificial Sequence
  Synthetic oligonucleotide; TGG chr11 5313787 5313806 5313790 -
tatggctgtatagtattcca

SEQ ID NO: 38608 - DNA, 20 bp, Artificial Sequence
  Synthetic oligonucleotide; TGG chr11 5313744 5313763 5313747 -
tttatccactctatcattga

SEQ ID NO: 38609 - DNA, 20 bp, Artificial Sequence
  Synthetic oligonucleotide; TGG chr11 5313736 5313755 5313739 -
ctctatcattgatggacatt

SEQ ID NO: 38610 - DNA, 20 bp, Artificial Sequence
  Synthetic oligonucleotide; GGG chr11 5313735 5313754 5313738 -
tctatcattgatggacattt

SEQ ID NO: 38611 - DNA, 20 bp, Artificial Sequence
  Synthetic oligonucleotide; TGG chr11 5313718 5313737 5313721 -
tttgggttgattccacatct

SEQ ID NO: 38612 - DNA, 20 bp, Artificial Sequence
  Synthetic oligonucleotide; AAG chr11 5313687 5313706 5313690 -
aataatgctgcaatgaacat

SEQ ID NO: 38613 - DNA, 20 bp, Artificial Sequence
  Synthetic oligonucleotide; TAG chr11 5313665 5313684 5313668 -
gcatgcctgtatttttataa

SEQ ID NO: 38614 - DNA, 20 bp, Artificial Sequence
  Synthetic oligonucleotide; TGG chr11 5313645 5313664 5313648 -
tagattgatttatattcctt

SEQ ID NO: 38615 - DNA, 20 bp, Artificial Sequence
  Synthetic oligonucleotide; GGG chr11 5313644 5313663 5313647 -
agattgatttatattccttt

SEQ ID NO: 38616 - DNA, 20 bp, Artificial Sequence
  Synthetic oligonucleotide; CAG chr11 5313633 5313652 5313636 -
tattcctttgggtatatacc

SEQ ID NO: 38617 - DNA, 20 bp, Artificial Sequence
  Synthetic oligonucleotide; GAG chr11 5313626 5313645 5313629 -
ttgggtatatacccagtaat

SEQ ID NO: 38618 - DNA, 20 bp, Artificial Sequence
  Synthetic oligonucleotide; GAG chr11 5313617 5313636 5313620 -
tacccagtaatgagattgct

SEQ ID NO: 38619 - DNA, 20 bp, Artificial Sequence
  Synthetic oligonucleotide; AAG chr11 5313612 5313631 5313615 -
agtaatgagattgctgagtc

SEQ ID NO: 38620 - DNA, 20 bp, Artificial Sequence
  Synthetic oligonucleotide; TGG chr11 5313609 5313628 5313612 -
aatgagattgctgagtcaag

SEQ ID NO: 38621 - DNA, 20 bp, Artificial Sequence
  Synthetic oligonucleotide; GAG chr11 5313585 5313604 5313588 -
atttctgcttctacatcttt

SEQ ID NO: 38622 - DNA, 20 bp, Artificial Sequence
  Synthetic oligonucleotide; AGG chr11 5313584 5313603 5313587 -
tttctgcttctacatctttg

SEQ ID NO: 38623 - DNA, 20 bp, Artificial Sequence
  Synthetic oligonucleotide; AAG chr11 5313580 5313599 5313583 -
tgcttctacatctttgagga

SEQ ID NO: 38624 - DNA, 20 bp, Artificial Sequence
  Synthetic oligonucleotide; AGG chr11 5313579 5313598 5313582 -
gcttctacatctttgaggaa

SEQ ID NO: 38625 - DNA, 20 bp, Artificial Sequence
  Synthetic oligonucleotide; CAG chr11 5313530 5313549 5313533 -
ctaatttactctcccgttaa

SEQ ID NO: 38626 - DNA, 20 bp, Artificial Sequence
  Synthetic oligonucleotide; AAG chr11 5313522 5313541 5313525 -
ctctcccgttaacagtgtaa

SEQ ID NO: 38627 - DNA, 20 bp, Artificial Sequence
  Synthetic oligonucleotide; CAG chr11 5313489 5313508 5313492 -
ctttctctctgcaaccttgc

SEQ ID NO: 38628 - DNA, 20 bp, Artificial Sequence
  Synthetic oligonucleotide; TGG chr11 5313445 5313464 5313448 -
ttaataattgccattctgac

SEQ ID NO: 38629 - DNA, 20 bp, Artificial Sequence
  Synthetic oligonucleotide; GAG chr11 5313439 5313458 5313442 -
attgccattctgactggtgt

SEQ ID NO: 38630 - DNA, 20 bp, Artificial Sequence
  Synthetic oligonucleotide; TGG chr11 5313435 5313454 5313438 -
ccattctgactggtgtgaga

SEQ ID NO: 38631 - DNA, 20 bp, Artificial Sequence
  Synthetic oligonucleotide; TGG chr11 5313422 5313441 5313425 -
tgtgagatggtatcccattg

SEQ ID NO: 38632 - DNA, 20 bp, Artificial Sequence
  Synthetic oligonucleotide; CAG chr11 5313394 5313413 5313397 -
atttgcatttttctaatgac

SEQ ID NO: 38633 - DNA, 20 bp, Artificial Sequence
  Synthetic oligonucleotide; AAG chr11 5313390 5313409 5313393 -
gcatttttctaatgaccagt

SEQ ID NO: 38634 - DNA, 20 bp, Artificial Sequence
  Synthetic oligonucleotide; AGG chr11 5313389 5313408 5313392 -
catttttctaatgaccagta

SEQ ID NO: 38635 - DNA, 20 bp, Artificial Sequence
  Synthetic oligonucleotide; GAG chr11 5313384 5313403 5313387 -
ttctaatgaccagtaaggtt

SEQ ID NO: 38636 - DNA, 20 bp, Artificial Sequence
  Synthetic oligonucleotide; TAG chr11 5313358 5313377 5313361 -
tttttttttcatatgtttat

SEQ ID NO: 38637 - DNA, 20 bp, Artificial Sequence
  Synthetic oligonucleotide; AAG chr11 5313355 5313374 5313358 -
ttttttcatatgtttattag

SEQ ID NO: 38638 - DNA, 20 bp, Artificial Sequence
  Synthetic oligonucleotide; TAG chr11 5313337 5313356 5313340 -
agaagcatgaatgtcttctt

SEQ ID NO: 38639 - DNA, 20 bp, Artificial Sequence
  Synthetic oligonucleotide; GAG chr11 5313335 5313354 5313338 -
aagcatgaatgtcttcttta

SEQ ID NO: 38640 - DNA, 20 bp, Artificial Sequence
  Synthetic oligonucleotide; AAG chr11 5313332 5313351 5313335 -
catgaatgtcttctttagag

SEQ ID NO: 38641 - DNA, 20 bp, Artificial Sequence
  Synthetic oligonucleotide; TGG chr11 5313299 5313318 5313302 -
tgtcattccccactttttaa

SEQ ID NO: 38642 - DNA, 20 bp, Artificial Sequence
  Synthetic oligonucleotide; GGG chr11 5313298 5313317 5313301 -
gtcattccccactttttaat

SEQ ID NO: 38643 - DNA, 20 bp, Artificial Sequence
  Synthetic oligonucleotide; GGG chr11 5313297 5313316 5313300 -
tcattccccactttttaatg

SEQ ID NO: 38644 - DNA, 20 bp, Artificial Sequence
  Synthetic oligonucleotide; TAG chr11 5313269 5313288 5313272 -
tttttcttgtaaatttgttt

SEQ ID NO: 38645 - DNA, 20 bp, Artificial Sequence
  Synthetic oligonucleotide; TAG chr11 5313259 5313278 5313262 -
aaatttgttttagttcctca

SEQ ID NO: 38646 - DNA, 20 bp, Artificial Sequence
  Synthetic oligonucleotide; CAG chr11 5313252 5313271 5313255 -
ttttagttcctcatagactc

SEQ ID NO: 38647 - DNA, 20 bp, Artificial Sequence
  Synthetic oligonucleotide; TAG chr11 5313245 5313264 5313248 -
tcctcatagactccagatat

SEQ ID NO: 38648 - DNA, 20 bp, Artificial Sequence
  Synthetic oligonucleotide; CAG chr11 5313234 5313253 5313237 -
tccagatattagacttttgt

SEQ ID NO: 38649 - DNA, 20 bp, Artificial Sequence
  Synthetic oligonucleotide; TGG chr11 5313230 5313249 5313233 -
gatattagacttttgtcaga

SEQ ID NO: 38650 - DNA, 20 bp, Artificial Sequence
  Synthetic oligonucleotide; GAG chr11 5313228 5313247 5313231 -
tattagacttttgtcagatg

SEQ ID NO: 38651 - DNA, 20 bp, Artificial Sequence
  Synthetic oligonucleotide; TAG chr11 5313198 5313217 5313201 -
aaaaattttcttctattctg

SEQ ID NO: 38652 - DNA, 20 bp, Artificial Sequence
  Synthetic oligonucleotide; AGG chr11 5313197 5313216 5313200 -
aaaattttcttctattctgt

SEQ ID NO: 38653 - DNA, 20 bp, Artificial Sequence
  Synthetic oligonucleotide; TAG chr11 5313174 5313193 5313177 -
ttgtctgttatctctgatga

SEQ ID NO: 38654 - DNA, 20 bp, Artificial Sequence
  Synthetic oligonucleotide; CAG chr11 5313157 5313176 5313160 -
tgatagtttcttttgctgtg

SEQ ID NO: 38655 - DNA, 20 bp, Artificial Sequence
  Synthetic oligonucleotide; AAG chr11 5313154 5313173 5313157 -
tagtttcttttgctgtgcag

SEQ ID NO: 38656 - DNA, 20 bp, Artificial Sequence
  Synthetic oligonucleotide; TAG chr11 5313137 5313156 5313140 -
cagaagctctttaatttaat

SEQ ID NO: 38657 - DNA, 20 bp, Artificial Sequence
  Synthetic oligonucleotide; CAG chr11 5313110 5313129 5313113 -
catttgtcaatttttttttg

SEQ ID NO: 38658 - DNA, 20 bp, Artificial Sequence
  Synthetic oligonucleotide; TGG chr11 5313100 5313119 5313103 -
tttttttttgcagttgcttt

SEQ ID NO: 38659 - DNA, 20 bp, Artificial Sequence
  Synthetic oligonucleotide; GAG chr11 5313091 5313110 5313094 -
gcagttgcttttggtgtctt

SEQ ID NO: 38660 - DNA, 20 bp, Artificial Sequence
  Synthetic oligonucleotide; AAG chr11 5313056 5313075 5313059 -
atgatacaatgtcatctata

SEQ ID NO: 38661 - DNA, 20 bp, Artificial Sequence
  Synthetic oligonucleotide; CAG chr11 5313048 5313067 5313051 -
atgtcatctataaagtttta

SEQ ID NO: 38662 - DNA, 20 bp, Artificial Sequence
  Synthetic oligonucleotide; TAG chr11 5313045 5313064 5313048 -
tcatctataaagttttacag

SEQ ID NO: 38663 - DNA, 20 bp, Artificial Sequence
  Synthetic oligonucleotide; GAG chr11 5313043 5313062 5313046 -
atctataaagttttacagta

SEQ ID NO: 38664 - DNA, 20 bp, Artificial Sequence
  Synthetic oligonucleotide; TAG chr11 5313017 5313036 5313020 -
ctctaaattcataaatttcc

SEQ ID NO: 38665 - DNA, 20 bp, Artificial Sequence
  Synthetic oligonucleotide; GAG chr11 5313001 5313020 5313004 -
ttcctagttgctcatttcat

SEQ ID NO: 38666 - DNA, 20 bp, Artificial Sequence
  Synthetic oligonucleotide; TGG chr11 5312959 5312978 5312962 -
cttgtgttctctctaaatgc

SEQ ID NO: 38667 - DNA, 20 bp, Artificial Sequence
  Synthetic oligonucleotide; TAG chr11 5312955 5312974 5312958 -
tgttctctctaaatgctgga

SEQ ID NO: 38668 - DNA, 20 bp, Artificial Sequence
  Synthetic oligonucleotide; TAG chr11 5312931 5312950 5312934 -
aacatttctgatatgtccaa

SEQ ID NO: 38669 - DNA, 20 bp, Artificial Sequence
  Synthetic oligonucleotide; AAG chr11 5312864 5312883 5312867 -
tttttattctaataaatcac

SEQ ID NO: 38670 - DNA, 20 bp, Artificial Sequence
  Synthetic oligonucleotide; CAG chr11 5312845 5312864 5312848 -
caagtgatctcaatttgttg

SEQ ID NO: 38671 - DNA, 20 bp, Artificial Sequence
  Synthetic oligonucleotide; TGG chr11 5312837 5312856 5312840 -
ctcaatttgttgcagcaact

SEQ ID NO: 38672 - DNA, 20 bp, Artificial Sequence
  Synthetic oligonucleotide; TAG chr11 5312825 5312844 5312828 -
cagcaacttggaaatctcac

SEQ ID NO: 38673 - DNA, 20 bp, Artificial Sequence
  Synthetic oligonucleotide; AGG chr11 5312824 5312843 5312827 -
agcaacttggaaatctcact

SEQ ID NO: 38674 - DNA, 20 bp, Artificial Sequence
  Synthetic oligonucleotide; AAG chr11 5312770 5312789 5312773 -
atccttttataattgatttt

SEQ ID NO: 38675 - DNA, 20 bp, Artificial Sequence
  Synthetic oligonucleotide; AAG chr11 5312767 5312786 5312770 -
cttttataattgattttaag

SEQ ID NO: 38676 - DNA, 20 bp, Artificial Sequence
  Synthetic oligonucleotide; TAG chr11 5312746 5312765 5312749 -
agtttattatgtattatctc

SEQ ID NO: 38677 - DNA, 20 bp, Artificial Sequence
  Synthetic oligonucleotide; TAG chr11 5312732 5312751 5312735 -
tatctctagtgttttatttt

SEQ ID NO: 38678 - DNA, 20 bp, Artificial Sequence
  Synthetic oligonucleotide; CAG chr11 5312715 5312734 5312718 -
ttttagtgtacgtattttcc

SEQ ID NO: 38679 - DNA, 20 bp, Artificial Sequence
  Synthetic oligonucleotide; AAG chr11 5312679 5312698 5312682 -
ttgctatatacacaatttaa

SEQ ID NO: 38680 - DNA, 20 bp, Artificial Sequence
  Synthetic oligonucleotide; AAG chr11 5312637 5312656 5312640 -
attatttactttatctactg

SEQ ID NO: 38681 - DNA, 20 bp, Artificial Sequence
  Synthetic oligonucleotide; TGG chr11 5312631 5312650 5312634 -
tactttatctactgaagtat

SEQ ID NO: 38682 - DNA, 20 bp, Artificial Sequence
  Synthetic oligonucleotide; GAG chr11 5312629 5312648 5312632 -
ctttatctactgaagtattg

SEQ ID NO: 38683 - DNA, 20 bp, Artificial Sequence
  Synthetic oligonucleotide; AAG chr11 5312615 5312634 5312618 -
gtattggagccatactatca

SEQ ID NO: 38684 - DNA, 20 bp, Artificial Sequence
  Synthetic oligonucleotide; CAG chr11 5312599 5312618 5312602 -
atcaaagcccttgctgactt

SEQ ID NO: 38685 - DNA, 20 bp, Artificial Sequence
  Synthetic oligonucleotide; AGG chr11 5312598 5312617 5312601 -
tcaaagcccttgctgacttc

SEQ ID NO: 38686 - DNA, 20 bp, Artificial Sequence
  Synthetic oligonucleotide; AAG chr11 5312535 5312554 5312538 -
tgtacatatcctatgtttaa

SEQ ID NO: 38687 - DNA, 20 bp, Artificial Sequence
  Synthetic oligonucleotide; AGG chr11 5312534 5312553 5312537 -
gtacatatcctatgtttaaa

SEQ ID NO: 38688 - DNA, 20 bp, Artificial Sequence
  Synthetic oligonucleotide; GGG chr11 5312533 5312552 5312536 -
tacatatcctatgtttaaaa

SEQ ID NO: 38689 - DNA, 20 bp, Artificial Sequence
  Synthetic oligonucleotide; TGG chr11 5312522 5312541 5312525 -
tgtttaaaagggtttgtgtt

SEQ ID NO: 38690 - DNA, 20 bp, Artificial Sequence
  Synthetic oligonucleotide; GAG chr11 5312520 5312539 5312523 -
tttaaaagggtttgtgtttg

SEQ ID NO: 38691 - DNA, 20 bp, Artificial Sequence
  Synthetic oligonucleotide; AGG chr11 5312519 5312538 5312522 -
ttaaaagggtttgtgtttgg

SEQ ID NO: 38692 - DNA, 20 bp, Artificial Sequence
  Synthetic oligonucleotide; GAG chr11 5312517 5312536 5312520 -
aaaagggtttgtgtttggag

SEQ ID NO: 38693 - DNA, 20 bp, Artificial Sequence
  Synthetic oligonucleotide; GAG chr11 5312515 5312534 5312518 -
aagggtttgtgtttggagga

SEQ ID NO: 38694 - DNA, 20 bp, Artificial Sequence
  Synthetic oligonucleotide; TAG chr11 5312512 5312531 5312515 -
ggtttgtgtttggaggagag

SEQ ID NO: 38695 - DNA, 20 bp, Artificial Sequence
  Synthetic oligonucleotide; AGG chr11 5312511 5312530 5312514 -
gtttgtgtttggaggagagt

SEQ ID NO: 38696 - DNA, 20 bp, Artificial Sequence
  Synthetic oligonucleotide; TGG chr11 5312476 5312495 5312479 -
tcctcatgtgcctattttcg

SEQ ID NO: 38697 - DNA, 20 bp, Artificial Sequence
  Synthetic oligonucleotide; TGG chr11 5312445 5312464 5312448 -
ctaatatttaatcattcctt

SEQ ID NO: 38698 - DNA, 20 bp, Artificial Sequence
  Synthetic oligonucleotide; AAG chr11 5312432 5312451 5312435 -
attcctttggttaatttttt

SEQ ID NO: 38699 - DNA, 20 bp, Artificial Sequence
  Synthetic oligonucleotide; AGG chr11 5312431 5312450 5312434 -
ttcctttggttaatttttta

SEQ ID NO: 38700 - DNA, 20 bp, Artificial Sequence
  Synthetic oligonucleotide; GGG chr11 5312430 5312449 5312433 -
tcctttggttaattttttaa

SEQ ID NO: 38701 - DNA, 20 bp, Artificial Sequence
  Synthetic oligonucleotide; TGG chr11 5312419 5312438 5312422 -
attttttaagggcactatta

SEQ ID NO: 38702 - DNA, 20 bp, Artificial Sequence
  Synthetic oligonucleotide; GGG chr11 5312418 5312437 5312421 -
ttttttaagggcactattat

SEQ ID NO: 38703 - DNA, 20 bp, Artificial Sequence
  Synthetic oligonucleotide; AAG chr11 5312405 5312424 5312408 -
ctattatgggtcaccttgct

SEQ ID NO: 38704 - DNA, 20 bp, Artificial Sequence
  Synthetic oligonucleotide; AAG chr11 5312390 5312409 5312393 -
ttgctaagcaaaaatgatat

SEQ ID NO: 38705 - DNA, 20 bp, Artificial Sequence
  Synthetic oligonucleotide; GAG chr11 5312388 5312407 5312391 -
gctaagcaaaaatgatataa

SEQ ID NO: 38706 - DNA, 20 bp, Artificial Sequence
  Synthetic oligonucleotide; GAG chr11 5312386 5312405 5312389 -
taagcaaaaatgatataaga

SEQ ID NO: 38707 - DNA, 20 bp, Artificial Sequence
  Synthetic oligonucleotide; TAG chr11 5312379 5312398 5312382 -
aaatgatataagagagcaaa

SEQ ID NO: 38708 - DNA, 20 bp, Artificial Sequence
  Synthetic oligonucleotide; AAG chr11 5312359 5312378 5312362 -
tagacaaacttttcttctta

SEQ ID NO: 38709 - DNA, 20 bp, Artificial Sequence
  Synthetic oligonucleotide; AAG chr11 5312347 5312366 5312350 -
tcttcttaaagtcttcaaat

SEQ ID NO: 38710 - DNA, 20 bp, Artificial Sequence
  Synthetic oligonucleotide; TGG chr11 5312344 5312363 5312347 -
tcttaaagtcttcaaataag

SEQ ID NO: 38711 - DNA, 20 bp, Artificial Sequence
  Synthetic oligonucleotide; GGG chr11 5312343 5312362 5312346 -
cttaaagtcttcaaataagt

SEQ ID NO: 38712 - DNA, 20 bp, Artificial Sequence
  Synthetic oligonucleotide; GGG chr11 5312342 5312361 5312345 -
ttaaagtcttcaaataagtg

SEQ ID NO: 38713 - DNA, 20 bp, Artificial Sequence
  Synthetic oligonucleotide; AAG chr11 5312334 5312353 5312337 -
ttcaaataagtggggactca

SEQ ID NO: 38714 - DNA, 20 bp, Artificial Sequence
  Synthetic oligonucleotide; AAG chr11 5312326 5312345 5312329 -
agtggggactcaaagaataa

SEQ ID NO: 38715 - DNA, 20 bp, Artificial Sequence
  Synthetic oligonucleotide; AAG chr11 5312306 5312325 5312309 -
aagaaatccaaatttaaaac

SEQ ID NO: 38716 - DNA, 20 bp, Artificial Sequence
  Synthetic oligonucleotide; AAG chr11 5312286 5312305 5312289 -
aagtgctgtgattaatcata

SEQ ID NO: 38717 - DNA, 20 bp, Artificial Sequence
  Synthetic oligonucleotide; CAG chr11 5312283 5312302 5312286 -
tgctgtgattaatcataaag

SEQ ID NO: 38718 - DNA, 20 bp, Artificial Sequence
  Synthetic oligonucleotide; AAG chr11 5312279 5312298 5312282 -
gtgattaatcataaagcaga

SEQ ID NO: 38719 - DNA, 20 bp, Artificial Sequence
  Synthetic oligonucleotide; AAG chr11 5312276 5312295 5312279 -
attaatcataaagcagaaag

SEQ ID NO: 38720 - DNA, 20 bp, Artificial Sequence
  Synthetic oligonucleotide; TGG chr11 5312265 5312284 5312268 -
agcagaaagaagacactgaa

SEQ ID NO: 38721 - DNA, 20 bp, Artificial Sequence
  Synthetic oligonucleotide; GAG chr11 5312263 5312282 5312266 -
cagaaagaagacactgaatg

SEQ ID NO: 38722 - DNA, 20 bp, Artificial Sequence
  Synthetic oligonucleotide; GAG chr11 5312261 5312280 5312264 -
gaaagaagacactgaatgga

SEQ ID NO: 38723 - DNA, 20 bp, Artificial Sequence
  Synthetic oligonucleotide; TGG chr11 5312256 5312275 5312259 -
aagacactgaatggagagtg

SEQ ID NO: 38724 - DNA, 20 bp, Artificial Sequence
  Synthetic oligonucleotide; GGG chr11 5312255 5312274 5312258 -
agacactgaatggagagtgt

SEQ ID NO: 38725 - DNA, 20 bp, Artificial Sequence
  Synthetic oligonucleotide; AAG chr11 5312244 5312263 5312247 -
ggagagtgtgggtctcaaaa

SEQ ID NO: 38726 - DNA, 20 bp, Artificial Sequence
  Synthetic oligonucleotide; AGG chr11 5312243 5312262 5312246 -
gagagtgtgggtctcaaaaa

SEQ ID NO: 38727 - DNA, 20 bp, Artificial Sequence
  Synthetic oligonucleotide; GAG chr11 5312237 5312256 5312240 -
gtgggtctcaaaaaaggctt

SEQ ID NO: 38728 - DNA, 20 bp, Artificial Sequence
  Synthetic oligonucleotide; AGG chr11 5312236 5312255 5312239 -
tgggtctcaaaaaaggcttg

SEQ ID NO: 38729 - DNA, 20 bp, Artificial Sequence
  Synthetic oligonucleotide; TGG chr11 5312230 5312249 5312233 -
tcaaaaaaggcttgaggtta

SEQ ID NO: 38730 - DNA, 20 bp, Artificial Sequence
  Synthetic oligonucleotide; AAG chr11 5312219 5312238 5312222 -
ttgaggttatggcttgaaat

SEQ ID NO: 38731 - DNA, 20 bp, Artificial Sequence
  Synthetic oligonucleotide; AGG chr11 5312218 5312237 5312221 -
tgaggttatggcttgaaata

SEQ ID NO: 38732 - DNA, 20 bp, Artificial Sequence
  Synthetic oligonucleotide; GGG chr11 5312217 5312236 5312220 -
gaggttatggcttgaaataa

SEQ ID NO: 38733 - DNA, 20 bp, Artificial Sequence
  Synthetic oligonucleotide; AAG chr11 5312213 5312232 5312216 -
ttatggcttgaaataagggt

SEQ ID NO: 38734 - DNA, 20 bp, Artificial Sequence
  Synthetic oligonucleotide; GAG chr11 5312203 5312222 5312206 -
aaataagggtaagattccct

SEQ ID NO: 38735 - DNA, 20 bp, Artificial Sequence
  Synthetic oligonucleotide; AAG chr11 5312199 5312218 5312202 -
aagggtaagattccctgaga

SEQ ID NO: 38736 - DNA, 20 bp, Artificial Sequence
  Synthetic oligonucleotide; CAG chr11 5312188 5312207 5312191 -
tccctgagaaagtgtccctt

SEQ ID NO: 38737 - DNA, 20 bp, Artificial Sequence
  Synthetic oligonucleotide; GAG chr11 5312183 5312202 5312186 -
gagaaagtgtcccttcagct

SEQ ID NO: 38738 - DNA, 20 bp, Artificial Sequence
  Synthetic oligonucleotide; TGG chr11 5312171 5312190 5312174 -
cttcagctgagacctgaaaa

SEQ ID NO: 38739 - DNA, 20 bp, Artificial Sequence
  Synthetic oligonucleotide; TAG chr11 5312166 5312185 5312169 -
gctgagacctgaaaatggat

SEQ ID NO: 38740 - DNA, 20 bp, Artificial Sequence
  Synthetic oligonucleotide; TGG chr11 5312155 5312174 5312158 -
aaaatggattagaaactaac

SEQ ID NO: 38741 - DNA, 20 bp, Artificial Sequence
  Synthetic oligonucleotide; CAG chr11 5312144 5312163 5312147 -
gaaactaactggtgaaaata

SEQ ID NO: 38742 - DNA, 20 bp, Artificial Sequence
  Synthetic oligonucleotide; AAG chr11 5312139 5312158 5312142 -
taactggtgaaaatacagac

SEQ ID NO: 38743 - DNA, 20 bp, Artificial Sequence
  Synthetic oligonucleotide; AAG chr11 5312128 5312147 5312131 -
aatacagacaagaatattct

SEQ ID NO: 38744 - DNA, 20 bp, Artificial Sequence
  Synthetic oligonucleotide; AAG chr11 5312121 5312140 5312124 -
acaagaatattctaagactg

SEQ ID NO: 38745 - DNA, 20 bp, Artificial Sequence
  Synthetic oligonucleotide; AGG chr11 5312120 5312139 5312123 -
caagaatattctaagactga

SEQ ID NO: 38746 - DNA, 20 bp, Artificial Sequence
  Synthetic oligonucleotide; GAG chr11 5312118 5312137 5312121 -
agaatattctaagactgaag

SEQ ID NO: 38747 - DNA, 20 bp, Artificial Sequence
  Synthetic oligonucleotide; TGG chr11 5312109 5312128 5312112 -
taagactgaaggagtgtgtg

SEQ ID NO: 38748 - DNA, 20 bp, Artificial Sequence
  Synthetic oligonucleotide; GAG chr11 5312107 5312126 5312110 -
agactgaaggagtgtgtgtg

SEQ ID NO: 38749 - DNA, 20 bp, Artificial Sequence
  Synthetic oligonucleotide; CAG chr11 5312100 5312119 5312103 -
aggagtgtgtgtggagacct

SEQ ID NO: 38750 - DNA, 20 bp, Artificial Sequence
  Synthetic oligonucleotide; TAG chr11 5312096 5312115 5312099 -
gtgtgtgtggagacctcagc

SEQ ID NO: 38751 - DNA, 20 bp, Artificial Sequence
  Synthetic oligonucleotide; AGG chr11 5312095 5312114 5312098 -
tgtgtgtggagacctcagct

SEQ ID NO: 38752 - DNA, 20 bp, Artificial Sequence
  Synthetic oligonucleotide; TGG chr11 5312091 5312110 5312094 -
tgtggagacctcagctaggt

SEQ ID NO: 38753 - DNA, 20 bp, Artificial Sequence
  Synthetic oligonucleotide; TAG chr11 5312081 5312100 5312084 -
tcagctaggttggtttatat

SEQ ID NO: 38754 - DNA, 20 bp, Artificial Sequence
  Synthetic oligonucleotide; AGG chr11 5312080 5312099 5312083 -
cagctaggttggtttatatt

SEQ ID NO: 38755 - DNA, 20 bp, Artificial Sequence
  Synthetic oligonucleotide; GGG chr11 5312079 5312098 5312082 -
agctaggttggtttatatta

SEQ ID NO: 38756 - DNA, 20 bp, Artificial Sequence
  Synthetic oligonucleotide; AAG chr11 5312076 5312095 5312079 -
taggttggtttatattaggg

SEQ ID NO: 38757 - DNA, 20 bp, Artificial Sequence
  Synthetic oligonucleotide; AGG chr11 5312075 5312094 5312078 -
aggttggtttatattaggga

SEQ ID NO: 38758 - DNA, 20 bp, Artificial Sequence
  Synthetic oligonucleotide; TGG chr11 5312072 5312091 5312075 -
ttggtttatattagggaagg

SEQ ID NO: 38759 - DNA, 20 bp, Artificial Sequence
  Synthetic oligonucleotide; TGG chr11 5312065 5312084 5312068 -
atattagggaaggtggctac

SEQ ID NO: 38760 - DNA, 20 bp, Artificial Sequence
  Synthetic oligonucleotide; AAG chr11 5312062 5312081 5312065 -
ttagggaaggtggctactgg

SEQ ID NO: 38761 - DNA, 20 bp, Artificial Sequence
  Synthetic oligonucleotide; GAG chr11 5312060 5312079 5312063 -
agggaaggtggctactggaa

SEQ ID NO: 38762 - DNA, 20 bp, Artificial Sequence
  Synthetic oligonucleotide; AGG chr11 5312059 5312078 5312062 -
gggaaggtggctactggaag

SEQ ID NO: 38763 - DNA, 20 bp, Artificial Sequence
  Synthetic oligonucleotide; GGG chr11 5312058 5312077 5312061 -
ggaaggtggctactggaaga

SEQ ID NO: 38764 - DNA, 20 bp, Artificial Sequence
  Synthetic oligonucleotide; GAG chr11 5312045 5312064 5312048 -
tggaagagggtgtttgcttt

SEQ ID NO: 38765 - DNA, 20 bp, Artificial Sequence
  Synthetic oligonucleotide; AAG chr11 5312042 5312061 5312045 -
aagagggtgtttgctttgag

SEQ ID NO: 38766 - DNA, 20 bp, Artificial Sequence
  Synthetic oligonucleotide; GAG chr11 5312040 5312059 5312043 -
gagggtgtttgctttgagaa

SEQ ID NO: 38767 - DNA, 20 bp, Artificial Sequence
  Synthetic oligonucleotide; AGG chr11 5312039 5312058 5312042 -
agggtgtttgctttgagaag

SEQ ID NO: 38768 - DNA, 20 bp, Artificial Sequence
  Synthetic oligonucleotide; AAG chr11 5312033 5312052 5312036 -
tttgctttgagaagaggctg

SEQ ID NO: 38769 - DNA, 20 bp, Artificial Sequence
  Synthetic oligonucleotide; GAG chr11 5312031 5312050 5312034 -
tgctttgagaagaggctgaa

SEQ ID NO: 38770 - DNA, 20 bp, Artificial Sequence
  Synthetic oligonucleotide; AGG chr11 5312030 5312049 5312033 -
gctttgagaagaggctgaag

SEQ ID NO: 38771 - DNA, 20 bp, Artificial Sequence
  Synthetic oligonucleotide; GGG chr11 5312029 5312048 5312032 -
ctttgagaagaggctgaaga

SEQ ID NO: 38772 - DNA, 20 bp, Artificial Sequence
  Synthetic oligonucleotide; AAG chr11 5312026 5312045 5312029 -
tgagaagaggctgaagaggg

SEQ ID NO: 38773 - DNA, 20 bp, Artificial Sequence
  Synthetic oligonucleotide; AGG chr11 5312025 5312044 5312028 -
gagaagaggctgaagaggga

SEQ ID NO: 38774 - DNA, 20 bp, Artificial Sequence
  Synthetic oligonucleotide; TGG chr11 5312020 5312039 5312023 -
gaggctgaagagggaaggaa

SEQ ID NO: 38775 - DNA, 20 bp, Artificial Sequence
  Synthetic oligonucleotide; TGG chr11 5312011 5312030 5312014 -
gagggaaggaatggccttat

SEQ ID NO: 38776 - DNA, 20 bp, Artificial Sequence
  Synthetic oligonucleotide; AAG chr11 5312001 5312020 5312004 -
atggccttattggtcatcat

SEQ ID NO: 38777 - DNA, 20 bp, Artificial Sequence
  Synthetic oligonucleotide; GAG chr11 5311999 5312018 5312002 -
ggccttattggtcatcataa

SEQ ID NO: 38778 - DNA, 20 bp, Artificial Sequence
  Synthetic oligonucleotide; GAG chr11 5311993 5312012 5311996 -
attggtcatcataagagttt

SEQ ID NO: 38779 - DNA, 20 bp, Artificial Sequence
  Synthetic oligonucleotide; CGG chr11 5311982 5312001 5311985 -
taagagtttgagtctctact

SEQ ID NO: 38780 - DNA, 20 bp, Artificial Sequence
  Synthetic oligonucleotide; GAG chr11 5311980 5311999 5311983 -
agagtttgagtctctactcg

SEQ ID NO: 38781 - DNA, 20 bp, Artificial Sequence
  Synthetic oligonucleotide; TGG chr11 5311974 5311993 5311977 -
tgagtctctactcggagtca

SEQ ID NO: 38782 - DNA, 20 bp, Artificial Sequence
  Synthetic oligonucleotide; AAG chr11 5311970 5311989 5311973 -
tctctactcggagtcatgga

SEQ ID NO: 38783 - DNA, 20 bp, Artificial Sequence
  Synthetic oligonucleotide; AAG chr11 5311960 5311979 5311963 -
gagtcatggaaagctactga

SEQ ID NO: 38784 - DNA, 20 bp, Artificial Sequence
  Synthetic oligonucleotide; AAG chr11 5311957 5311976 5311960 -
tcatggaaagctactgaaag

SEQ ID NO: 38785 - DNA, 20 bp, Artificial Sequence
  Synthetic oligonucleotide; TGG chr11 5311905 5311924 5311908 -
cttcaatattatttataaaa

SEQ ID NO: 38786 - DNA, 20 bp, Artificial Sequence
  Synthetic oligonucleotide; GAG chr11 5311898 5311917 5311901 -
attatttataaaatggaatt

SEQ ID NO: 38787 - DNA, 20 bp, Artificial Sequence
  Synthetic oligonucleotide; AGG chr11 5311897 5311916 5311900 -
ttatttataaaatggaattg

SEQ ID NO: 38788 - DNA, 20 bp, Artificial Sequence
  Synthetic oligonucleotide; GGG chr11 5311896 5311915 5311899 -
tatttataaaatggaattga

SEQ ID NO: 38789 - DNA, 20 bp, Artificial Sequence
  Synthetic oligonucleotide; GAG chr11 5311894 5311913 5311897 -
tttataaaatggaattgagg

SEQ ID NO: 38790 - DNA, 20 bp, Artificial Sequence
  Synthetic oligonucleotide; AGG chr11 5311893 5311912 5311896 -
ttataaaatggaattgaggg

SEQ ID NO: 38791 - DNA, 20 bp, Artificial Sequence
  Synthetic oligonucleotide; CAG chr11 5311890 5311909 5311893 -
taaaatggaattgagggagg

SEQ ID NO: 38792 - DNA, 20 bp, Artificial Sequence
  Synthetic oligonucleotide; AGG chr11 5311889 5311908 5311892 -
aaaatggaattgagggaggc

SEQ ID NO: 38793 - DNA, 20 bp, Artificial Sequence
  Synthetic oligonucleotide; GGG chr11 5311888 5311907 5311891 -
aaatggaattgagggaggca

SEQ ID NO: 38794 - DNA, 20 bp, Artificial Sequence
  Synthetic oligonucleotide; AAG chr11 5311884 5311903 5311887 -
ggaattgagggaggcaggga

SEQ ID NO: 38795 - DNA, 20 bp, Artificial Sequence
  Synthetic oligonucleotide; AGG chr11 5311883 5311902 5311886 -
gaattgagggaggcagggaa

SEQ ID NO: 38796 - DNA, 20 bp, Artificial Sequence
  Synthetic oligonucleotide; GGG chr11 5311882 5311901 5311885 -
aattgagggaggcagggaaa

SEQ ID NO: 38797 - DNA, 20 bp, Artificial Sequence
  Synthetic oligonucleotide; CAG chr11 5311879 5311898 5311882 -
tgagggaggcagggaaaggg

SEQ ID NO: 38798 - DNA, 20 bp, Artificial Sequence
  Synthetic oligonucleotide; TAG chr11 5311871 5311890 5311874 -
gcagggaaagggcagaatat

SEQ ID NO: 38799 - DNA, 20 bp, Artificial Sequence
  Synthetic oligonucleotide; GAG chr11 5311869 5311888 5311872 -
agggaaagggcagaatatta

SEQ ID NO: 38800 - DNA, 20 bp, Artificial Sequence
  Synthetic oligonucleotide; AAG chr11 5311859 5311878 5311862 -
cagaatattagagtaatttg

SEQ ID NO: 38801 - DNA, 20 bp, Artificial Sequence
  Synthetic oligonucleotide; AAG chr11 5311855 5311874 5311858 -
atattagagtaatttgaaga

SEQ ID NO: 38802 - DNA, 20 bp, Artificial Sequence
  Synthetic oligonucleotide; TAG chr11 5311848 5311867 5311851 -
agtaatttgaagaaagataa

SEQ ID NO: 38803 - DNA, 20 bp, Artificial Sequence
  Synthetic oligonucleotide; TAG chr11 5311835 5311854 5311838 -
aagataatagtaactcaatt

SEQ ID NO: 38804 - DNA, 20 bp, Artificial Sequence
  Synthetic oligonucleotide; AGG chr11 5311834 5311853 5311837 -
agataatagtaactcaattt

SEQ ID NO: 38805 - DNA, 20 bp, Artificial Sequence
  Synthetic oligonucleotide; AAG chr11 5311830 5311849 5311833 -
aatagtaactcaatttagga

SEQ ID NO: 38806 - DNA, 20 bp, Artificial Sequence
  Synthetic oligonucleotide; TGG chr11 5311827 5311846 5311830 -
agtaactcaatttaggaaag

SEQ ID NO: 38807 - DNA, 20 bp, Artificial Sequence
  Synthetic oligonucleotide; TGG chr11 5311821 5311840 5311824 -
tcaatttaggaaagtggaaa

SEQ ID NO: 38808 - DNA, 20 bp, Artificial Sequence
  Synthetic oligonucleotide; TGG chr11 5311815 5311834 5311818 -
taggaaagtggaaatggtaa

SEQ ID NO: 38809 - DNA, 20 bp, Artificial Sequence
  Synthetic oligonucleotide; GAG chr11 5311813 5311832 5311816 -
ggaaagtggaaatggtaatg

SEQ ID NO: 38810 - DNA, 20 bp, Artificial Sequence
  Synthetic oligonucleotide; GAG chr11 5311811 5311830 5311814 -
aaagtggaaatggtaatgga

SEQ ID NO: 38811 - DNA, 20 bp, Artificial Sequence
  Synthetic oligonucleotide; AAG chr11 5311793 5311812 5311796 -
gagagatatgacaaatattt

SEQ ID NO: 38812 - DNA, 20 bp, Artificial Sequence
  Synthetic oligonucleotide; AGG chr11 5311792 5311811 5311795 -
agagatatgacaaatattta

SEQ ID NO: 38813 - DNA, 20 bp, Artificial Sequence
  Synthetic oligonucleotide; AAG chr11 5311777 5311796 5311780 -
atttaaggtctaaatataat

SEQ ID NO: 38814 - DNA, 20 bp, Artificial Sequence
  Synthetic oligonucleotide; AGG chr11 5311776 5311795 5311779 -
tttaaggtctaaatataata

SEQ ID NO: 38815 - DNA, 20 bp, Artificial Sequence
  Synthetic oligonucleotide; CAG chr11 5311769 5311788 5311772 -
tctaaatataataaggttta

SEQ ID NO: 38816 - DNA, 20 bp, Artificial Sequence
  Synthetic oligonucleotide; AGG chr11 5311768 5311787 5311771 -
ctaaatataataaggtttac

SEQ ID NO: 38817 - DNA, 20 bp, Artificial Sequence
  Synthetic oligonucleotide; TAG chr11 5311760 5311779 5311763 -
aataaggtttacaggttatt

SEQ ID NO: 38818 - DNA, 20 bp, Artificial Sequence
  Synthetic oligonucleotide; AAG chr11 5311755 5311774 5311758 -
ggtttacaggttatttagaa

SEQ ID NO: 38819 - DNA, 20 bp, Artificial Sequence
  Synthetic oligonucleotide; CAG chr11 5311752 5311771 5311755 -
ttacaggttatttagaaaag

SEQ ID NO: 38820 - DNA, 20 bp, Artificial Sequence
  Synthetic oligonucleotide; GAG chr11 5311750 5311769 5311753 -
acaggttatttagaaaagca

SEQ ID NO: 38821 - DNA, 20 bp, Artificial Sequence
  Synthetic oligonucleotide; AGG chr11 5311749 5311768 5311752 -
caggttatttagaaaagcag

SEQ ID NO: 38822 - DNA, 20 bp, Artificial Sequence
  Synthetic oligonucleotide; AAG chr11 5311745 5311764 5311748 -
ttatttagaaaagcagagga

SEQ ID NO: 38823 - DNA, 20 bp, Artificial Sequence
  Synthetic oligonucleotide; AAG chr11 5311741 5311760 5311744 -
ttagaaaagcagaggaaaga

SEQ ID NO: 38824 - DNA, 20 bp, Artificial Sequence
  Synthetic oligonucleotide; GAG chr11 5311739 5311758 5311742 -
agaaaagcagaggaaagaaa

SEQ ID NO: 38825 - DNA, 20 bp, Artificial Sequence
  Synthetic oligonucleotide; TGG chr11 5311735 5311754 5311738 -
aagcagaggaaagaaagagt

SEQ ID NO: 38826 - DNA, 20 bp, Artificial Sequence
  Synthetic oligonucleotide; AAG chr11 5311731 5311750 5311734 -
agaggaaagaaagagttgga

SEQ ID NO: 38827 - DNA, 20 bp, Artificial Sequence
  Synthetic oligonucleotide; AGG chr11 5311730 5311749 5311733 -
gaggaaagaaagagttggaa

SEQ ID NO: 38828 - DNA, 20 bp, Artificial Sequence
  Synthetic oligonucleotide; GAG chr11 5311728 5311747 5311731 -
ggaaagaaagagttggaaag

SEQ ID NO: 38829 - DNA, 20 bp, Artificial Sequence
  Synthetic oligonucleotide; TGG chr11 5311694 5311713 5311697 -
atcaatttctgacatgttct

SEQ ID NO: 38830 - DNA, 20 bp, Artificial Sequence
  Synthetic oligonucleotide; AAG chr11 5311691 5311710 5311694 -
aatttctgacatgttcttgg

SEQ ID NO: 38831 - DNA, 20 bp, Artificial Sequence
  Synthetic oligonucleotide; AAG chr11 5311687 5311706 5311690 -
tctgacatgttcttggaaga

SEQ ID NO: 38832 - DNA, 20 bp, Artificial Sequence
  Synthetic oligonucleotide; AGG chr11 5311686 5311705 5311689 -
ctgacatgttcttggaagaa

SEQ ID NO: 38833 - DNA, 20 bp, Artificial Sequence
  Synthetic oligonucleotide; CAG chr11 5311683 5311702 5311686 -
acatgttcttggaagaaagg

SEQ ID NO: 38834 - DNA, 20 bp, Artificial Sequence
  Synthetic oligonucleotide; AAG chr11 5311674 5311693 5311677 -
tggaagaaaggcagtgccaa

SEQ ID NO: 38835 - DNA, 20 bp, Artificial Sequence
  Synthetic oligonucleotide; AAG chr11 5311670 5311689 5311673 -
agaaaggcagtgccaaaaga

SEQ ID NO: 38836 - DNA, 20 bp, Artificial Sequence
  Synthetic oligonucleotide; AGG chr11 5311669 5311688 5311672 -
gaaaggcagtgccaaaagaa

SEQ ID NO: 38837 - DNA, 20 bp, Artificial Sequence
  Synthetic oligonucleotide; CAG chr11 5311666 5311685 5311669 -
aggcagtgccaaaagaaagg

SEQ ID NO: 38838 - DNA, 20 bp, Artificial Sequence
  Synthetic oligonucleotide; AAG chr11 5311637 5311656 5311640 -
attatgtattgtctataaat

SEQ ID NO: 38839 - DNA, 20 bp, Artificial Sequence
  Synthetic oligonucleotide; AAG chr11 5311634 5311653 5311637 -
atgtattgtctataaataag

SEQ ID NO: 38840 - DNA, 20 bp, Artificial Sequence
  Synthetic oligonucleotide; AAG chr11 5311614 5311633 5311617 -
aagaatcattataattttta

SEQ ID NO: 38841 - DNA, 20 bp, Artificial Sequence
  Synthetic oligonucleotide; TGG chr11 5311608 5311627 5311611 -
cattataatttttaaagttg

SEQ ID NO: 38842 - DNA, 20 bp, Artificial Sequence
  Synthetic oligonucleotide; GGG chr11 5311607 5311626 5311610 -
attataatttttaaagttgt

SEQ ID NO: 38843 - DNA, 20 bp, Artificial Sequence
  Synthetic oligonucleotide; GAG chr11 5311599 5311618 5311602 -
ttttaaagttgtgggacact

SEQ ID NO: 38844 - DNA, 20 bp, Artificial Sequence
  Synthetic oligonucleotide; GAG chr11 5311593 5311612 5311596 -
agttgtgggacactgagaat

SEQ ID NO: 38845 - DNA, 20 bp, Artificial Sequence
  Synthetic oligonucleotide; AAG chr11 5311567 5311586 5311570 -
aaataataaacatgtgattt

SEQ ID NO: 38846 - DNA, 20 bp, Artificial Sequence
  Synthetic oligonucleotide; AAG chr11 5311563 5311582 5311566 -
aataaacatgtgatttaaga

SEQ ID NO: 38847 - DNA, 20 bp, Artificial Sequence
  Synthetic oligonucleotide; AAG chr11 5311554 5311573 5311557 -
gtgatttaagaaagcaattg

SEQ ID NO: 38848 - DNA, 20 bp, Artificial Sequence
  Synthetic oligonucleotide; AGG chr11 5311553 5311572 5311556 -
tgatttaagaaagcaattga

SEQ ID NO: 38849 - DNA, 20 bp, Artificial Sequence
  Synthetic oligonucleotide; AAG chr11 5311550 5311569 5311553 -
tttaagaaagcaattgaagg

SEQ ID NO: 38850 - DNA, 20 bp, Artificial Sequence
  Synthetic oligonucleotide; TAG chr11 5311535 5311554 5311538 -
gaaggaagtatttcaaactg

SEQ ID NO: 38851 - DNA, 20 bp, Artificial Sequence
  Synthetic oligonucleotide; TAG chr11 5311529 5311548 5311532 -
agtatttcaaactgtagaac

SEQ ID NO: 38852 - DNA, 20 bp, Artificial Sequence
  Synthetic oligonucleotide; TAG chr11 5311507 5311526 5311510 -
gacttttaaaaacaaaatat

SEQ ID NO: 38853 - DNA, 20 bp, Artificial Sequence
  Synthetic oligonucleotide; CAG chr11 5311468 5311487 5311471 -
atcattcattcaaatcattt

SEQ ID NO: 38854 - DNA, 20 bp, Artificial Sequence
  Synthetic oligonucleotide; AAG chr11 5311439 5311458 5311442 -
tttctttttgcctgatcatg

SEQ ID NO: 38855 - DNA, 20 bp, Artificial Sequence
  Synthetic oligonucleotide; GAG chr11 5311437 5311456 5311440 -
tctttttgcctgatcatgaa

SEQ ID NO: 38856 - DNA, 20 bp, Artificial Sequence
  Synthetic oligonucleotide; TAG chr11 5311431 5311450 5311434 -
tgcctgatcatgaagagtca

SEQ ID NO: 38857 - DNA, 20 bp, Artificial Sequence
  Synthetic oligonucleotide; AAG chr11 5311426 5311445 5311429 -
gatcatgaagagtcatagta

SEQ ID NO: 38858 - DNA, 20 bp, Artificial Sequence
  Synthetic oligonucleotide; AGG chr11 5311425 5311444 5311428 -
atcatgaagagtcatagtaa

SEQ ID NO: 38859 - DNA, 20 bp, Artificial Sequence
  Synthetic oligonucleotide; AAG chr11 5311421 5311440 5311424 -
tgaagagtcatagtaaaggc

SEQ ID NO: 38860 - DNA, 20 bp, Artificial Sequence
  Synthetic oligonucleotide; CAG chr11 5311410 5311429 5311413 -
agtaaaggcaagacatatgt

SEQ ID NO: 38861 - DNA, 20 bp, Artificial Sequence
  Synthetic oligonucleotide; GAG chr11 5311399 5311418 5311402 -
gacatatgtcagaaaatgat

SEQ ID NO: 38862 - DNA, 20 bp, Artificial Sequence
  Synthetic oligonucleotide; CAG chr11 5311390 5311409 5311393 -
cagaaaatgatgagaattta

SEQ ID NO: 38863 - DNA, 20 bp, Artificial Sequence
  Synthetic oligonucleotide; AAG chr11 5311383 5311402 5311386 -
tgatgagaatttacagatgc

SEQ ID NO: 38864 - DNA, 20 bp, Artificial Sequence
  Synthetic oligonucleotide; CAG chr11 5311376 5311395 5311379 -
aatttacagatgcaagacaa

SEQ ID NO: 38865 - DNA, 20 bp, Artificial Sequence
  Synthetic oligonucleotide; AAG chr11 5311363 5311382 5311366 -
aagacaacagaaacaaactg

SEQ ID NO: 38866 - DNA, 20 bp, Artificial Sequence
  Synthetic oligonucleotide; CAG chr11 5311360 5311379 5311363 -
acaacagaaacaaactgaag

SEQ ID NO: 38867 - DNA, 20 bp, Artificial Sequence
  Synthetic oligonucleotide; AAG chr11 5311347 5311366 5311350 -
actgaagcagatgacaccca

SEQ ID NO: 38868 - DNA, 20 bp, Artificial Sequence
  Synthetic oligonucleotide; AAG chr11 5311344 5311363 5311347 -
gaagcagatgacacccaaag

SEQ ID NO: 38869 - DNA, 20 bp, Artificial Sequence
  Synthetic oligonucleotide; AGG chr11 5311343 5311362 5311346 -
aagcagatgacacccaaaga

SEQ ID NO: 38870 - DNA, 20 bp, Artificial Sequence
  Synthetic oligonucleotide; CAG chr11 5311339 5311358 5311342 -
agatgacacccaaagaaggt

SEQ ID NO: 38871 - DNA, 20 bp, Artificial Sequence
  Synthetic oligonucleotide; GAG chr11 5311337 5311356 5311340 -
atgacacccaaagaaggtca

SEQ ID NO: 38872 - DNA, 20 bp, Artificial Sequence
  Synthetic oligonucleotide; AAG chr11 5311331 5311350 5311334 -
cccaaagaaggtcagagaat

SEQ ID NO: 38873 - DNA, 20 bp, Artificial Sequence
  Synthetic oligonucleotide; CAG chr11 5311323 5311342 5311326 -
aggtcagagaataagtgaaa

SEQ ID NO: 38874 - DNA, 20 bp, Artificial Sequence
  Synthetic oligonucleotide; TGG chr11 5311320 5311339 5311323 -
tcagagaataagtgaaacag

SEQ ID NO: 38875 - DNA, 20 bp, Artificial Sequence
  Synthetic oligonucleotide; TAG chr11 5311307 5311326 5311310 -
gaaacagtggctcactatcc

SEQ ID NO: 38876 - DNA, 20 bp, Artificial Sequence
  Synthetic oligonucleotide; AGG chr11 5311306 5311325 5311309 -
aaacagtggctcactatcct

SEQ ID NO: 38877 - DNA, 20 bp, Artificial Sequence
  Synthetic oligonucleotide; GAG chr11 5311304 5311323 5311307 -
acagtggctcactatcctag

SEQ ID NO: 38878 - DNA, 20 bp, Artificial Sequence
  Synthetic oligonucleotide; AAG chr11 5311300 5311319 5311303 -
tggctcactatcctaggaga

SEQ ID NO: 38879 - DNA, 20 bp, Artificial Sequence
  Synthetic oligonucleotide; CAG chr11 5311297 5311316 5311300 -
ctcactatcctaggagaaag

SEQ ID NO: 38880 - DNA, 20 bp, Artificial Sequence
  Synthetic oligonucleotide; AGG chr11 5311296 5311315 5311299 -
tcactatcctaggagaaagc

SEQ ID NO: 38881 - DNA, 20 bp, Artificial Sequence
  Synthetic oligonucleotide; TAG chr11 5311292 5311311 5311295 -
tatcctaggagaaagcagga

SEQ ID NO: 38882 - DNA, 20 bp, Artificial Sequence
  Synthetic oligonucleotide; CGG chr11 5311286 5311305 5311289 -
aggagaaagcaggatagatc

SEQ ID NO: 38883 - DNA, 20 bp, Artificial Sequence
  Synthetic oligonucleotide; GGG chr11 5311285 5311304 5311288 -
ggagaaagcaggatagatcc

SEQ ID NO: 38884 - DNA, 20 bp, Artificial Sequence
  Synthetic oligonucleotide; TGG chr11 5311275 5311294 5311278 -
ggatagatccgggtttttct

SEQ ID NO: 38885 - DNA, 20 bp, Artificial Sequence
  Synthetic oligonucleotide; GGG chr11 5311274 5311293 5311277 -
gatagatccgggtttttctt

SEQ ID NO: 38886 - DNA, 20 bp, Artificial Sequence
  Synthetic oligonucleotide; AAG chr11 5311259 5311278 5311262 -
ttcttgggtgtcattcactg

SEQ ID NO: 38887 - DNA, 20 bp, Artificial Sequence
  Synthetic oligonucleotide; TAG chr11 5311256 5311275 5311259 -
ttgggtgtcattcactgaag

SEQ ID NO: 38888 - DNA, 20 bp, Artificial Sequence
  Synthetic oligonucleotide; CAG chr11 5311250 5311269 5311253 -
gtcattcactgaagtagacc

SEQ ID NO: 38889 - DNA, 20 bp, Artificial Sequence
  Synthetic oligonucleotide; TAG chr11 5311239 5311258 5311242 -
aagtagacccagttttaaaa

SEQ ID NO: 38890 - DNA, 20 bp, Artificial Sequence
  Synthetic oligonucleotide; CAG chr11 5311236 5311255 5311239 -
tagacccagttttaaaatag

SEQ ID NO: 38891 - DNA, 20 bp, Artificial Sequence
  Synthetic oligonucleotide; GAG chr11 5311211 5311230 5311214 -
caaaaaatactgccaaacgt

SEQ ID NO: 38892 - DNA, 20 bp, Artificial Sequence
  Synthetic oligonucleotide; TGG chr11 5311182 5311201 5311185 -
tatcaattatatgatacaac

SEQ ID NO: 38893 - DNA, 20 bp, Artificial Sequence
  Synthetic oligonucleotide; TAG chr11 5311178 5311197 5311181 -
aattatatgatacaactggt

SEQ ID NO: 38894 - DNA, 20 bp, Artificial Sequence
  Synthetic oligonucleotide; GAG chr11 5311176 5311195 5311179 -
ttatatgatacaactggtta

SEQ ID NO: 38895 - DNA, 20 bp, Artificial Sequence
  Synthetic oligonucleotide; CAG chr11 5311172 5311191 5311175 -
atgatacaactggttagagc

SEQ ID NO: 38896 - DNA, 20 bp, Artificial Sequence
  Synthetic oligonucleotide; TAG chr11 5311148 5311167 5311151 -
taatctgatacaaacataaa

SEQ ID NO: 38897 - DNA, 20 bp, Artificial Sequence
  Synthetic oligonucleotide; AGG chr11 5311147 5311166 5311150 -
aatctgatacaaacataaat

SEQ ID NO: 38898 - DNA, 20 bp, Artificial Sequence
  Synthetic oligonucleotide; AAG chr11 5311144 5311163 5311147 -
ctgatacaaacataaatagg

SEQ ID NO: 38899 - DNA, 20 bp, Artificial Sequence
  Synthetic oligonucleotide; TGG chr11 5311140 5311159 5311143 -
tacaaacataaataggaaga

SEQ ID NO: 38900 - DNA, 20 bp, Artificial Sequence
  Synthetic oligonucleotide; CAG chr11 5311116 5311135 5311119 -
ttaactaaattctgaattac

SEQ ID NO: 38901 - DNA, 20 bp, Artificial Sequence
  Synthetic oligonucleotide; GAG chr11 5311111 5311130 5311114 -
taaattctgaattaccagat

SEQ ID NO: 38902 - DNA, 20 bp, Artificial Sequence
  Synthetic oligonucleotide; AAG chr11 5311100 5311119 5311103 -
ttaccagatgagtaaataac

SEQ ID NO: 38903 - DNA, 20 bp, Artificial Sequence
  Synthetic oligonucleotide; AAG chr11 5311081 5311100 5311084 -
caagaatttattgaaaaatg

SEQ ID NO: 38904 - DNA, 20 bp, Artificial Sequence
  Synthetic oligonucleotide; GAG chr11 5311069 5311088 5311072 -
gaaaaatgaagttttttcat

SEQ ID NO: 38905 - DNA, 20 bp, Artificial Sequence
  Synthetic oligonucleotide; TAG chr11 5311057 5311076 5311060 -
tttttcatgagtgcttatgt

SEQ ID NO: 38906 - DNA, 20 bp, Artificial Sequence
  Synthetic oligonucleotide; TAG chr11 5311048 5311067 5311051 -
agtgcttatgttagttaccc

SEQ ID NO: 38907 - DNA, 20 bp, Artificial Sequence
  Synthetic oligonucleotide; CGG chr11 5311040 5311059 5311043 -
tgttagttaccctagatttg

SEQ ID NO: 38908 - DNA, 20 bp, Artificial Sequence
  Synthetic oligonucleotide; CAG chr11 5311027 5311046 5311030 -
agatttgcggcatgccttca

SEQ ID NO: 38909 - DNA, 20 bp, Artificial Sequence
  Synthetic oligonucleotide; TAG chr11 5311013 5311032 5311016 -
ccttcacagatgtccaatca

SEQ ID NO: 38910 - DNA, 20 bp, Artificial Sequence
  Synthetic oligonucleotide; GAG chr11 5311004 5311023 5311007 -
atgtccaatcatagatattt

SEQ ID NO: 38911 - DNA, 20 bp, Artificial Sequence
  Synthetic oligonucleotide; AGG chr11 5311003 5311022 5311006 -
tgtccaatcatagatatttg

SEQ ID NO: 38912 - DNA, 20 bp, Artificial Sequence
  Synthetic oligonucleotide; GAG chr11 5311001 5311020 5311004 -
tccaatcatagatatttgag

SEQ ID NO: 38913 - DNA, 20 bp, Artificial Sequence
  Synthetic oligonucleotide; AGG chr11 5311000 5311019 5311003 -
ccaatcatagatatttgagg

SEQ ID NO: 38914 - DNA, 20 bp, Artificial Sequence
  Synthetic oligonucleotide; TGG chr11 5310991 5311010 5310994 -
gatatttgaggaggaccata

SEQ ID NO: 38915 - DNA, 20 bp, Artificial Sequence
  Synthetic oligonucleotide; AAG chr11 5310954 5310973 5310957 -
tatgcttgattctttctctc

SEQ ID NO: 38916 - DNA, 20 bp, Artificial Sequence
  Synthetic oligonucleotide; GAG chr11 5310941 5310960 5310944 -
ttctctcaagtgaaattgtt

SEQ ID NO: 38917 - DNA, 20 bp, Artificial Sequence
  Synthetic oligonucleotide; TGG chr11 5310902 5310921 5310905 -
atttattaaaatcaaataaa

SEQ ID NO: 38918 - DNA, 20 bp, Artificial Sequence
  Synthetic oligonucleotide; AAG chr11 5310894 5310913 5310897 -
aaatcaaataaatggtcttt

SEQ ID NO: 38919 - DNA, 20 bp, Artificial Sequence
  Synthetic oligonucleotide; AAG chr11 5310887 5310906 5310890 -
ataaatggtctttaagatat

SEQ ID NO: 38920 - DNA, 20 bp, Artificial Sequence
  Synthetic oligonucleotide; GAG chr11 5310885 5310904 5310888 -
aaatggtctttaagatataa

SEQ ID NO: 38921 - DNA, 20 bp, Artificial Sequence
  Synthetic oligonucleotide; TAG chr11 5310873 5310892 5310876 -
agatataagagactttatcc

SEQ ID NO: 38922 - DNA, 20 bp, Artificial Sequence
  Synthetic oligonucleotide; TAG chr11 5310858 5310877 5310861 -
tatcctagtatgtatatata

SEQ ID NO: 38923 - DNA, 20 bp, Artificial Sequence
  Synthetic oligonucleotide; TGG chr11 5310836 5310855 5310839 -
gttgtgtttgcatgtgtgtg

SEQ ID NO: 38924 - DNA, 20 bp, Artificial Sequence
  Synthetic oligonucleotide; TGG chr11 5310820 5310839 5310823 -
tgtgtggacacctgcacatg

SEQ ID NO: 38925 - DNA, 20 bp, Artificial Sequence
  Synthetic oligonucleotide; TAG chr11 5310793 5310812 5310796 -
aatcttttaatattttatct

SEQ ID NO: 38926 - DNA, 20 bp, Artificial Sequence
  Synthetic oligonucleotide; TAG chr11 5310705 5310724 5310708 -
catttattgttttattttta

SEQ ID NO: 38927 - DNA, 20 bp, Artificial Sequence
  Synthetic oligonucleotide; TGG chr11 5310702 5310721 5310705 -
ttattgttttatttttatag

SEQ ID NO: 38928 - DNA, 20 bp, Artificial Sequence
  Synthetic oligonucleotide; TAG chr11 5310677 5310696 5310680 -
atatatacaatttgccactt

SEQ ID NO: 38929 - DNA, 20 bp, Artificial Sequence
  Synthetic oligonucleotide; CAG chr11 5310654 5310673 5310657 -
cctttttataatgtataatg

SEQ ID NO: 38930 - DNA, 20 bp, Artificial Sequence
  Synthetic oligonucleotide; TGG chr11 5310651 5310670 5310654 -
ttttataatgtataatgcag

SEQ ID NO: 38931 - DNA, 20 bp, Artificial Sequence
  Synthetic oligonucleotide; CAG chr11 5310560 5310579 5310563 -
aaaactctatattgattaat

SEQ ID NO: 38932 - DNA, 20 bp, Artificial Sequence
  Synthetic oligonucleotide; TGG chr11 5310526 5310545 5310529 -
tccatgttcttcctacactc

SEQ ID NO: 38933 - DNA, 20 bp, Artificial Sequence
  Synthetic oligonucleotide; TAG chr11 5310481 5310500 5310484 -
ctctatgaatttgcctattc

SEQ ID NO: 38934 - DNA, 20 bp, Artificial Sequence
  Synthetic oligonucleotide; TAG chr11 5310477 5310496 5310480 -
atgaatttgcctattctaga

SEQ ID NO: 38935 - DNA, 20 bp, Artificial Sequence
  Synthetic oligonucleotide; AAG chr11 5310467 5310486 5310470 -
ctattctagatagctcatgt

SEQ ID NO: 38936 - DNA, 20 bp, Artificial Sequence
  Synthetic oligonucleotide; CAG chr11 5310458 5310477 5310461 -
atagctcatgtaagtgaaat

SEQ ID NO: 38937 - DNA, 20 bp, Artificial Sequence
  Synthetic oligonucleotide; TAG chr11 5310423 5310442 5310426 -
tgcgtatgacttattgcact

SEQ ID NO: 38938 - DNA, 20 bp, Artificial Sequence
  Synthetic oligonucleotide; AGG chr11 5310422 5310441 5310425 -
gcgtatgacttattgcactt

SEQ ID NO: 38939 - DNA, 20 bp, Artificial Sequence
  Synthetic oligonucleotide; TAG chr11 5310418 5310437 5310421 -
atgacttattgcacttagga

SEQ ID NO: 38940 - DNA, 20 bp, Artificial Sequence
  Synthetic oligonucleotide; AAG chr11 5310409 5310428 5310412 -
tgcacttaggatagtttttt

SEQ ID NO: 38941 - DNA, 20 bp, Artificial Sequence
  Synthetic oligonucleotide; AGG chr11 5310408 5310427 5310411 -
gcacttaggatagtttttta

SEQ ID NO: 38942 - DNA, 20 bp, Artificial Sequence
  Synthetic oligonucleotide; TAG chr11 5310392 5310411 5310395 -
tttaaggtttattcatgttg

SEQ ID NO: 38943 - DNA, 20 bp, Artificial Sequence
  Synthetic oligonucleotide; CAG chr11 5310382 5310401 5310385 -
attcatgttgtagcatgtgt

SEQ ID NO: 38944 - DNA, 20 bp, Artificial Sequence
  Synthetic oligonucleotide; TAG chr11 5310367 5310386 5310370 -
tgtgtcagacctacttttta

SEQ ID NO: 38945 - DNA, 20 bp, Artificial Sequence
  Synthetic oligonucleotide; AAG chr11 5310339 5310358 5310342 -
taatattctatcacatatat

SEQ ID NO: 38946 - DNA, 20 bp, Artificial Sequence
  Synthetic oligonucleotide; TAG chr11 5310308 5310327 5310311 -
ttgatatacgcatctgttga

SEQ ID NO: 38947 - DNA, 20 bp, Artificial Sequence
  Synthetic oligonucleotide; TGG chr11 5310282 5310301 5310285 -
cttgtattgtttctattcct

SEQ ID NO: 38948 - DNA, 20 bp, Artificial Sequence
  Synthetic oligonucleotide; CAG chr11 5310242 5310261 5310245 -
tgtcttcccttcaatatgcc

SEQ ID NO: 38949 - DNA, 20 bp, Artificial Sequence
  Synthetic oligonucleotide; AAG chr11 5310184 5310203 5310187 -
tctgaatattctgcttttca

SEQ ID NO: 38950 - DNA, 20 bp, Artificial Sequence
  Synthetic oligonucleotide; TGG chr11 5310172 5310191 5310175 -
gcttttcaaagaatattcct

SEQ ID NO: 38951 - DNA, 20 bp, Artificial Sequence
  Synthetic oligonucleotide; TGG chr11 5310160 5310179 5310163 -
atattccttggaatattcca

SEQ ID NO: 38952 - DNA, 20 bp, Artificial Sequence
  Synthetic oligonucleotide; AAG chr11 5310157 5310176 5310160 -
ttccttggaatattccatgg

SEQ ID NO: 38953 - DNA, 20 bp, Artificial Sequence
  Synthetic oligonucleotide; AAG chr11 5310154 5310173 5310157 -
cttggaatattccatggaag

SEQ ID NO: 38954 - DNA, 20 bp, Artificial Sequence
  Synthetic oligonucleotide; GAG chr11 5310146 5310165 5310149 -
attccatggaagaagaaaat

SEQ ID NO: 38955 - DNA, 20 bp, Artificial Sequence
  Synthetic oligonucleotide; AAG chr11 5310141 5310160 5310144 -
atggaagaagaaaatgagac

SEQ ID NO: 38956 - DNA, 20 bp, Artificial Sequence
  Synthetic oligonucleotide; TGG chr11 5310133 5310152 5310136 -
agaaaatgagacaagctttc

SEQ ID NO: 38957 - DNA, 20 bp, Artificial Sequence
  Synthetic oligonucleotide; GAG chr11 5310131 5310150 5310134 -
aaaatgagacaagctttctg

SEQ ID NO: 38958 - DNA, 20 bp, Artificial Sequence
  Synthetic oligonucleotide; AAG chr11 5310127 5310146 5310130 -
tgagacaagctttctggaga

SEQ ID NO: 38959 - DNA, 20 bp, Artificial Sequence
  Synthetic oligonucleotide; AGG chr11 5310126 5310145 5310129 -
gagacaagctttctggagaa

SEQ ID NO: 38960 - DNA, 20 bp, Artificial Sequence
  Synthetic oligonucleotide; AAG chr11 5310123 5310142 5310126 -
acaagctttctggagaaagg

SEQ ID NO: 38961 - DNA, 20 bp, Artificial Sequence
  Synthetic oligonucleotide; CAG chr11 5310116 5310135 5310119 -
ttctggagaaaggaagtttt

SEQ ID NO: 38962 - DNA, 20 bp, Artificial Sequence
  Synthetic oligonucleotide; CGG chr11 5310102 5310121 5310105 -
agttttcagtgccttgatct

SEQ ID NO: 38963 - DNA, 20 bp, Artificial Sequence
  Synthetic oligonucleotide; TGG chr11 5310078 5310097 5310081 -
tgactgcaacctctgcctcc

SEQ ID NO: 38964 - DNA, 20 bp, Artificial Sequence
  Synthetic oligonucleotide; GGG chr11 5310077 5310096 5310080 -
gactgcaacctctgcctcct

SEQ ID NO: 38965 - DNA, 20 bp, Artificial Sequence
  Synthetic oligonucleotide; CAG chr11 5310072 5310091 5310075 -
caacctctgcctcctgggtt

SEQ ID NO: 38966 - DNA, 20 bp, Artificial Sequence
  Synthetic oligonucleotide; CAG chr11 5310065 5310084 5310068 -
tgcctcctgggttcagtttt

SEQ ID NO: 38967 - DNA, 20 bp, Artificial Sequence
  Synthetic oligonucleotide; AAG chr11 5310059 5310078 5310062 -
ctgggttcagttttcagtta

SEQ ID NO: 38968 - DNA, 20 bp, Artificial Sequence
  Synthetic oligonucleotide; TAG chr11 5310027 5310046 5310030 -
aacaaattttttcactcaac

SEQ ID NO: 38969 - DNA, 20 bp, Artificial Sequence
  Synthetic oligonucleotide; GAG chr11 5310025 5310044 5310028 -
caaattttttcactcaacta

SEQ ID NO: 38970 - DNA, 20 bp, Artificial Sequence
  Synthetic oligonucleotide; CAG chr11 5310003 5310022 5310006 -
gattttatgataatgcaata

SEQ ID NO: 38971 - DNA, 20 bp, Artificial Sequence
  Synthetic oligonucleotide; AAG chr11 5309996 5310015 5309999 -
tgataatgcaatacagataa

SEQ ID NO: 38972 - DNA, 20 bp, Artificial Sequence
  Synthetic oligonucleotide; CAG chr11 5309978 5309997 5309981 -
aaaagataatgcaatccttc

SEQ ID NO: 38973 - DNA, 20 bp, Artificial Sequence
  Synthetic oligonucleotide; TGG chr11 5309962 5309981 5309965 -
cttccagacctaaaaatatg

SEQ ID NO: 38974 - DNA, 20 bp, Artificial Sequence
  Synthetic oligonucleotide; CAG chr11 5309946 5309965 5309949 -
tatgtggcatccacatttta

SEQ ID NO: 38975 - DNA, 20 bp, Artificial Sequence
  Synthetic oligonucleotide; AGG chr11 5309945 5309964 5309948 -
atgtggcatccacattttac

SEQ ID NO: 38976 - DNA, 20 bp, Artificial Sequence
  Synthetic oligonucleotide; CGG chr11 5309932 5309951 5309935 -
attttacaggtacattttca

SEQ ID NO: 38977 - DNA, 20 bp, Artificial Sequence
  Synthetic oligonucleotide; GAG chr11 5309930 5309949 5309933 -
tttacaggtacattttcacg

SEQ ID NO: 38978 - DNA, 20 bp, Artificial Sequence
  Synthetic oligonucleotide; AAG chr11 5309926 5309945 5309929 -
caggtacattttcacggaga

SEQ ID NO: 38979 - DNA, 20 bp, Artificial Sequence
  Synthetic oligonucleotide; AAG chr11 5309921 5309940 5309924 -
acattttcacggagaaagat

SEQ ID NO: 38980 - DNA, 20 bp, Artificial Sequence
  Synthetic oligonucleotide; TGG chr11 5309915 5309934 5309918 -
tcacggagaaagataagaac

SEQ ID NO: 38981 - DNA, 20 bp, Artificial Sequence
  Synthetic oligonucleotide; TGG chr11 5309885 5309904 5309888 -
tttgcaacaaatctttgctc

SEQ ID NO: 38982 - DNA, 20 bp, Artificial Sequence
  Synthetic oligonucleotide; GAG chr11 5309874 5309893 5309877 -
tctttgctctggacttcact

SEQ ID NO: 38983 - DNA, 20 bp, Artificial Sequence
  Synthetic oligonucleotide; AAG chr11 5309869 5309888 5309872 -
gctctggacttcactgagta

SEQ ID NO: 38984 - DNA, 20 bp, Artificial Sequence
  Synthetic oligonucleotide; GAG chr11 5309837 5309856 5309840 -
ctttgttttgttttgttttt

SEQ ID NO: 38985 - DNA, 20 bp, Artificial Sequence
  Synthetic oligonucleotide; TGG chr11 5309833 5309852 5309836 -
gttttgttttgtttttgaga

SEQ ID NO: 38986 - DNA, 20 bp, Artificial Sequence
  Synthetic oligonucleotide; GAG chr11 5309831 5309850 5309834 -
tttgttttgtttttgagatg

SEQ ID NO: 38987 - DNA, 20 bp, Artificial Sequence
  Synthetic oligonucleotide; CAG chr11 5309813 5309832 5309816 -
tggagtctcgctctgtcgcc

SEQ ID NO: 38988 - DNA, 20 bp, Artificial Sequence
  Synthetic oligonucleotide; AGG chr11 5309812 5309831 5309815 -
ggagtctcgctctgtcgccc

SEQ ID NO: 38989 - DNA, 20 bp, Artificial Sequence
  Synthetic oligonucleotide; TGG chr11 5309808 5309827 5309811 -
tctcgctctgtcgcccaggc

SEQ ID NO: 38990 - DNA, 20 bp, Artificial Sequence
  Synthetic oligonucleotide; GAG chr11 5309806 5309825 5309809 -
tcgctctgtcgcccaggctg

SEQ ID NO: 38991 - DNA, 20 bp, Artificial Sequence
  Synthetic oligonucleotide; CAG chr11 5309801 5309820 5309804 -
ctgtcgcccaggctggagtg

SEQ ID NO: 38992 - DNA, 20 bp, Artificial Sequence
  Synthetic oligonucleotide; TGG chr11 5309798 5309817 5309801 -
tcgcccaggctggagtgcag

SEQ ID NO: 38993 - DNA, 20 bp, Artificial Sequence
  Synthetic oligonucleotide; CAG chr11 5309787 5309806 5309790 -
ggagtgcagtggcgtgatct

SEQ ID NO: 38994 - DNA, 20 bp, Artificial Sequence
  Synthetic oligonucleotide; AAG chr11 5309776 5309795 5309779 -
gcgtgatctcagctcactgc

SEQ ID NO: 38995 - DNA, 20 bp, Artificial Sequence
  Synthetic oligonucleotide; CGG chr11 5309763 5309782 5309766 -
tcactgcaagctctgcctcc

SEQ ID NO: 38996 - DNA, 20 bp, Artificial Sequence
  Synthetic oligonucleotide; GGG chr11 5309762 5309781 5309765 -
cactgcaagctctgcctccc

SEQ ID NO: 38997 - DNA, 20 bp, Artificial Sequence
  Synthetic oligonucleotide; CAG chr11 5309739 5309758 5309742 -
ttcacgccattctcctgcct

SEQ ID NO: 38998 - DNA, 20 bp, Artificial Sequence
  Synthetic oligonucleotide; GAG chr11 5309730 5309749 5309733 -
ttctcctgcctcagcctccc

SEQ ID NO: 38999 - DNA, 20 bp, Artificial Sequence
  Synthetic oligonucleotide; TAG chr11 5309727 5309746 5309730 -
tcctgcctcagcctcccgag

SEQ ID NO: 39000 - DNA, 20 bp, Artificial Sequence
  Synthetic oligonucleotide; TGG chr11 5309723 5309742 5309726 -
gcctcagcctcccgagtagc

SEQ ID NO: 39001 - DNA, 20 bp, Artificial Sequence
  Synthetic oligonucleotide; GGG chr11 5309722 5309741 5309725 -
cctcagcctcccgagtagct

SEQ ID NO: 39002 - DNA, 20 bp, Artificial Sequence
  Synthetic oligonucleotide; CAG chr11 5309715 5309734 5309718 -
ctcccgagtagctgggacta

SEQ ID NO: 39003 - DNA, 20 bp, Artificial Sequence
  Synthetic oligonucleotide; AGG chr11 5309714 5309733 5309717 -
tcccgagtagctgggactac

SEQ ID NO: 39004 - DNA, 20 bp, Artificial Sequence
  Synthetic oligonucleotide; CAG chr11 5309696 5309715 5309699 -
acaggcgcccgccaccacgc

SEQ ID NO: 39005 - DNA, 20 bp, Artificial Sequence
  Synthetic oligonucleotide; AGG chr11 5309695 5309714 5309698 -
caggcgcccgccaccacgcc

SEQ ID NO: 39006 - DNA, 20 bp, Artificial Sequence
  Synthetic oligonucleotide; TAG chr11 5309674 5309693 5309677 -
ggcaaatttttttgtctttt

SEQ ID NO: 39007 - DNA, 20 bp, Artificial Sequence
  Synthetic oligonucleotide; TAG chr11 5309671 5309690 5309674 -
aaatttttttgtctttttag

SEQ ID NO: 39008 - DNA, 20 bp, Artificial Sequence
  Synthetic oligonucleotide; GAG chr11 5309669 5309688 5309672 -
atttttttgtctttttagta

SEQ ID NO: 39009 - DNA, 20 bp, Artificial Sequence
  Synthetic oligonucleotide; CGG chr11 5309665 5309684 5309668 -
ttttgtctttttagtagaga

SEQ ID NO: 39010 - DNA, 20 bp, Artificial Sequence
  Synthetic oligonucleotide; GGG chr11 5309664 5309683 5309667 -
tttgtctttttagtagagac

SEQ ID NO: 39011 - DNA, 20 bp, Artificial Sequence
  Synthetic oligonucleotide; GGG chr11 5309663 5309682 5309666 -
ttgtctttttagtagagacg

SEQ ID NO: 39012 - DNA, 20 bp, Artificial Sequence
  Synthetic oligonucleotide; TAG chr11 5309649 5309668 5309652 -
gagacggggtttcactgtgt

SEQ ID NO: 39013 - DNA, 20 bp, Artificial Sequence
  Synthetic oligonucleotide; CAG chr11 5309645 5309664 5309648 -
cggggtttcactgtgttagc

SEQ ID NO: 39014 - DNA, 20 bp, Artificial Sequence
  Synthetic oligonucleotide; AGG chr11 5309644 5309663 5309647 -
ggggtttcactgtgttagcc

SEQ ID NO: 39015 - DNA, 20 bp, Artificial Sequence
  Synthetic oligonucleotide; TGG chr11 5309640 5309659 5309643 -
tttcactgtgttagccagga

SEQ ID NO: 39016 - DNA, 20 bp, Artificial Sequence
  Synthetic oligonucleotide; CGG chr11 5309604 5309623 5309607 -
acctcgtgatccacccgcct

SEQ ID NO: 39017 - DNA, 20 bp, Artificial Sequence
  Synthetic oligonucleotide; AAG chr11 5309594 5309613 5309597 -
ccacccgcctcggcctccca

SEQ ID NO: 39018 - DNA, 20 bp, Artificial Sequence
  Synthetic oligonucleotide; TGG chr11 5309588 5309607 5309591 -
gcctcggcctcccaaagtgc

SEQ ID NO: 39019 - DNA, 20 bp, Artificial Sequence
  Synthetic oligonucleotide; GGG chr11 5309587 5309606 5309590 -
cctcggcctcccaaagtgct

SEQ ID NO: 39020 - DNA, 20 bp, Artificial Sequence
  Synthetic oligonucleotide; CAG chr11 5309580 5309599 5309583 -
ctcccaaagtgctgggatta

SEQ ID NO: 39021 - DNA, 20 bp, Artificial Sequence
  Synthetic oligonucleotide; AGG chr11 5309579 5309598 5309582 -
tcccaaagtgctgggattac

SEQ ID NO: 39022 - DNA, 20 bp, Artificial Sequence
  Synthetic oligonucleotide; GAG chr11 5309573 5309592 5309576 -
agtgctgggattacaggcgt

SEQ ID NO: 39023 - DNA, 20 bp, Artificial Sequence
  Synthetic oligonucleotide; CGG chr11 5309560 5309579 5309563 -
caggcgtgagccaccgcgcc

SEQ ID NO: 39024 - DNA, 20 bp, Artificial Sequence
  Synthetic oligonucleotide; GAG chr11 5309554 5309573 5309557 -
tgagccaccgcgcccggcct

SEQ ID NO: 39025 - DNA, 20 bp, Artificial Sequence
  Synthetic oligonucleotide; AAG chr11 5309549 5309568 5309552 -
caccgcgcccggcctgagta

SEQ ID NO: 39026 - DNA, 20 bp, Artificial Sequence
  Synthetic oligonucleotide; TGG chr11 5309538 5309557 5309541 -
gcctgagtaaagttttatat

SEQ ID NO: 39027 - DNA, 20 bp, Artificial Sequence
  Synthetic oligonucleotide; GGG chr11 5309537 5309556 5309540 -
cctgagtaaagttttatatt

SEQ ID NO: 39028 - DNA, 20 bp, Artificial Sequence
  Synthetic oligonucleotide; AAG chr11 5309534 5309553 5309537 -
gagtaaagttttatattggg

SEQ ID NO: 39029 - DNA, 20 bp, Artificial Sequence
  Synthetic oligonucleotide; TGG chr11 5309520 5309539 5309523 -
attgggaagacataaaaatg

SEQ ID NO: 39030 - DNA, 20 bp, Artificial Sequence
  Synthetic oligonucleotide; GAG chr11 5309518 5309537 5309521 -
tgggaagacataaaaatgtg

SEQ ID NO: 39031 - DNA, 20 bp, Artificial Sequence
  Synthetic oligonucleotide; GAG chr11 5309516 5309535 5309519 -
ggaagacataaaaatgtgga

SEQ ID NO: 39032 - DNA, 20 bp, Artificial Sequence
  Synthetic oligonucleotide; GAG chr11 5309509 5309528 5309512 -
ataaaaatgtggagagaaat

SEQ ID NO: 39033 - DNA, 20 bp, Artificial Sequence
  Synthetic oligonucleotide; TGG chr11 5309496 5309515 5309499 -
gagaaatgagatccaatcta

SEQ ID NO: 39034 - DNA, 20 bp, Artificial Sequence
  Synthetic oligonucleotide; TAG chr11 5309479 5309498 5309482 -
ctatggaatgcttaaaaaaa

SEQ ID NO: 39035 - DNA, 20 bp, Artificial Sequence
  Synthetic oligonucleotide; AGG chr11 5309478 5309497 5309481 -
tatggaatgcttaaaaaaat

SEQ ID NO: 39036 - DNA, 20 bp, Artificial Sequence
  Synthetic oligonucleotide; TAG chr11 5309473 5309492 5309476 -
aatgcttaaaaaaataggtg

SEQ ID NO: 39037 - DNA, 20 bp, Artificial Sequence
  Synthetic oligonucleotide; AGG chr11 5309472 5309491 5309475 -
atgcttaaaaaaataggtgt

SEQ ID NO: 39038 - DNA, 20 bp, Artificial Sequence
  Synthetic oligonucleotide; AAG chr11 5309466 5309485 5309469 -
aaaaaaataggtgtaggcgc

SEQ ID NO: 39039 - DNA, 20 bp, Artificial Sequence
  Synthetic oligonucleotide; AAG chr11 5309385 5309404 5309388 -
atttacccaatgcatgctgt

SEQ ID NO: 39040 - DNA, 20 bp, Artificial Sequence
  Synthetic oligonucleotide; GAG chr11 5309365 5309384 5309368 -
aagcaaaattatatgctatt

SEQ ID NO: 39041 - DNA, 20 bp, Artificial Sequence
  Synthetic oligonucleotide; AAG chr11 5309352 5309371 5309355 -
tgctattgagtacaatgttt

SEQ ID NO: 39042 - DNA, 20 bp, Artificial Sequence
  Synthetic oligonucleotide; GAG chr11 5309338 5309357 5309341 -
atgtttaagctattgatact

SEQ ID NO: 39043 - DNA, 20 bp, Artificial Sequence
  Synthetic oligonucleotide; TGG chr11 5309313 5309332 5309316 -
taaacacaaatcttaaaatc

SEQ ID NO: 39044 - DNA, 20 bp, Artificial Sequence
  Synthetic oligonucleotide; AAG chr11 5309300 5309319 5309303 -
taaaatctggttatccccca

SEQ ID NO: 39045 - DNA, 20 bp, Artificial Sequence
  Synthetic oligonucleotide; CAG chr11 5309272 5309291 5309275 -
tctgtttctcataatgtgcc

SEQ ID NO: 39046 - DNA, 20 bp, Artificial Sequence
  Synthetic oligonucleotide; AAG chr11 5309268 5309287 5309271 -
tttctcataatgtgcccagt

SEQ ID NO: 39047 - DNA, 20 bp, Artificial Sequence
  Synthetic oligonucleotide; TAG chr11 5309251 5309270 5309254 -
agtaagttcctaatgtttat

SEQ ID NO: 39048 - DNA, 20 bp, Artificial Sequence
  Synthetic oligonucleotide; TGG chr11 5309243 5309262 5309246 -
cctaatgtttattagtgtgt

SEQ ID NO: 39049 - DNA, 20 bp, Artificial Sequence
  Synthetic oligonucleotide; TAG chr11 5309240 5309259 5309243 -
aatgtttattagtgtgttgg

SEQ ID NO: 39050 - DNA, 20 bp, Artificial Sequence
  Synthetic oligonucleotide; AGG chr11 5309239 5309258 5309242 -
atgtttattagtgtgttggt

SEQ ID NO: 39051 - DNA, 20 bp, Artificial Sequence
  Synthetic oligonucleotide; TGG chr11 5309196 5309215 5309199 -
tccatcttgatttgctgacc

SEQ ID NO: 39052 - DNA, 20 bp, Artificial Sequence
  Synthetic oligonucleotide; GGG chr11 5309195 5309214 5309198 -
ccatcttgatttgctgacct

SEQ ID NO: 39053 - DNA, 20 bp, Artificial Sequence
  Synthetic oligonucleotide; CAG chr11 5309190 5309209 5309193 -
ttgatttgctgacctgggtg

SEQ ID NO: 39054 - DNA, 20 bp, Artificial Sequence
  Synthetic oligonucleotide; AGG chr11 5309189 5309208 5309192 -
tgatttgctgacctgggtgc

SEQ ID NO: 39055 - DNA, 20 bp, Artificial Sequence
  Synthetic oligonucleotide; CAG chr11 5309177 5309196 5309180 -
ctgggtgcaggttcttatga

SEQ ID NO: 39056 - DNA, 20 bp, Artificial Sequence
  Synthetic oligonucleotide; GAG chr11 5309175 5309194 5309178 -
gggtgcaggttcttatgaca

SEQ ID NO: 39057 - DNA, 20 bp, Artificial Sequence
  Synthetic oligonucleotide; AGG chr11 5309174 5309193 5309177 -
ggtgcaggttcttatgacag

SEQ ID NO: 39058 - DNA, 20 bp, Artificial Sequence
  Synthetic oligonucleotide; AAG chr11 5309170 5309189 5309173 -
caggttcttatgacagagga

SEQ ID NO: 39059 - DNA, 20 bp, Artificial Sequence
  Synthetic oligonucleotide; AAG chr11 5309156 5309175 5309159 -
agaggaaagactgtctttgt

SEQ ID NO: 39060 - DNA, 20 bp, Artificial Sequence
  Synthetic oligonucleotide; TGG chr11 5309147 5309166 5309150 -
actgtctttgtaagttattt

SEQ ID NO: 39061 - DNA, 20 bp, Artificial Sequence
  Synthetic oligonucleotide; AAG chr11 5309144 5309163 5309147 -
gtctttgtaagttattttgg

SEQ ID NO: 39062 - DNA, 20 bp, Artificial Sequence
  Synthetic oligonucleotide; TAG chr11 5309139 5309158 5309142 -
tgtaagttattttggaagaa

SEQ ID NO: 39063 - DNA, 20 bp, Artificial Sequence
  Synthetic oligonucleotide; TGG chr11 5309119 5309138 5309122 -
tagaaactgtgaaaaatata

SEQ ID NO: 39064 - DNA, 20 bp, Artificial Sequence
  Synthetic oligonucleotide; TGG chr11 5309110 5309129 5309113 -
tgaaaaatatatggcttctt

SEQ ID NO: 39065 - DNA, 20 bp, Artificial Sequence
  Synthetic oligonucleotide; GAG chr11 5309100 5309119 5309103 -
atggcttctttggtgctcat

SEQ ID NO: 39066 - DNA, 20 bp, Artificial Sequence
  Synthetic oligonucleotide; AGG chr11 5309099 5309118 5309102 -
tggcttctttggtgctcatg

SEQ ID NO: 39067 - DNA, 20 bp, Artificial Sequence
  Synthetic oligonucleotide; CAG chr11 5309040 5309059 5309043 -
atacatctgctcctctttta

SEQ ID NO: 39068 - DNA, 20 bp, Artificial Sequence
  Synthetic oligonucleotide; TAG chr11 5309029 5309048 5309032 -
cctcttttacagctttatct

SEQ ID NO: 39069 - DNA, 20 bp, Artificial Sequence
  Synthetic oligonucleotide; AGG chr11 5309028 5309047 5309031 -
ctcttttacagctttatctt

SEQ ID NO: 39070 - DNA, 20 bp, Artificial Sequence
  Synthetic oligonucleotide; TGG chr11 5309025 5309044 5309028 -
ttttacagctttatcttagg

SEQ ID NO: 39071 - DNA, 20 bp, Artificial Sequence
  Synthetic oligonucleotide; AAG chr11 5309022 5309041 5309025 -
tacagctttatcttaggtgg

SEQ ID NO: 39072 - DNA, 20 bp, Artificial Sequence
  Synthetic oligonucleotide; AGG chr11 5309021 5309040 5309024 -
acagctttatcttaggtgga

SEQ ID NO: 39073 - DNA, 20 bp, Artificial Sequence
  Synthetic oligonucleotide; GGG chr11 5309020 5309039 5309023 -
cagctttatcttaggtggaa

SEQ ID NO: 39074 - DNA, 20 bp, Artificial Sequence
  Synthetic oligonucleotide; CAG chr11 5309013 5309032 5309016 -
atcttaggtggaagggactt

SEQ ID NO: 39075 - DNA, 20 bp, Artificial Sequence
  Synthetic oligonucleotide; AAG chr11 5309008 5309027 5309011 -
aggtggaagggacttcagct

SEQ ID NO: 39076 - DNA, 20 bp, Artificial Sequence
  Synthetic oligonucleotide; TGG chr11 5309004 5309023 5309007 -
ggaagggacttcagctaagt

SEQ ID NO: 39077 - DNA, 20 bp, Artificial Sequence
  Synthetic oligonucleotide; AAG chr11 5308999 5309018 5309002 -
ggacttcagctaagttggct

SEQ ID NO: 39078 - DNA, 20 bp, Artificial Sequence
  Synthetic oligonucleotide; AGG chr11 5308998 5309017 5309001 -
gacttcagctaagttggcta

SEQ ID NO: 39079 - DNA, 20 bp, Artificial Sequence
  Synthetic oligonucleotide; TAG chr11 5308974 5308993 5308977 -
ccttcaaattaaaactctgt

SEQ ID NO: 39080 - DNA, 20 bp, Artificial Sequence
  Synthetic oligonucleotide; TAG chr11 5308958 5308977 5308961 -
ctgttagtttttctcatgct

SEQ ID NO: 39081 - DNA, 20 bp, Artificial Sequence
  Synthetic oligonucleotide; GAG chr11 5308954 5308973 5308957 -
tagtttttctcatgcttagt

SEQ ID NO: 39082 - DNA, 20 bp, Artificial Sequence
  Synthetic oligonucleotide; AAG chr11 5308950 5308969 5308953 -
ttttctcatgcttagtgaga

SEQ ID NO: 39083 - DNA, 20 bp, Artificial Sequence
  Synthetic oligonucleotide; AAG chr11 5308921 5308940 5308924 -
actttctgctatgaaacttc

SEQ ID NO: 39084 - DNA, 20 bp, Artificial Sequence
  Synthetic oligonucleotide; TAG chr11 5308915 5308934 5308918 -
tgctatgaaacttcaagtta

SEQ ID NO: 39085 - DNA, 20 bp, Artificial Sequence
  Synthetic oligonucleotide; AAG chr11 5308884 5308903 5308887 -
ataacctgcaatttacgtcc

SEQ ID NO: 39086 - DNA, 20 bp, Artificial Sequence
  Synthetic oligonucleotide; AAG chr11 5308881 5308900 5308884 -
acctgcaatttacgtccaag

SEQ ID NO: 39087 - DNA, 20 bp, Artificial Sequence
  Synthetic oligonucleotide; AAG chr11 5308877 5308896 5308880 -
gcaatttacgtccaagaaga

SEQ ID NO: 39088 - DNA, 20 bp, Artificial Sequence
  Synthetic oligonucleotide; AGG chr11 5308876 5308895 5308879 -
caatttacgtccaagaagaa

SEQ ID NO: 39089 - DNA, 20 bp, Artificial Sequence
  Synthetic oligonucleotide; AAG chr11 5308873 5308892 5308876 -
tttacgtccaagaagaaagg

SEQ ID NO: 39090 - DNA, 20 bp, Artificial Sequence
  Synthetic oligonucleotide; CAG chr11 5308856 5308875 5308859 -
aggaagattcaatctatctt

SEQ ID NO: 39091 - DNA, 20 bp, Artificial Sequence
  Synthetic oligonucleotide; CAG chr11 5308846 5308865 5308849 -
aatctatcttcagtgatgac

SEQ ID NO: 39092 - DNA, 20 bp, Artificial Sequence
  Synthetic oligonucleotide; CGG chr11 5308833 5308852 5308836 -
tgatgaccagcatcactgaa

SEQ ID NO: 39093 - DNA, 20 bp, Artificial Sequence
  Synthetic oligonucleotide; TGG chr11 5308825 5308844 5308828 -
agcatcactgaacggttatc

SEQ ID NO: 39094 - DNA, 20 bp, Artificial Sequence
  Synthetic oligonucleotide; GGG chr11 5308824 5308843 5308827 -
gcatcactgaacggttatct

SEQ ID NO: 39095 - DNA, 20 bp, Artificial Sequence
  Synthetic oligonucleotide; TGG chr11 5308814 5308833 5308817 -
acggttatctgggcctgttg

SEQ ID NO: 39096 - DNA, 20 bp, Artificial Sequence
  Synthetic oligonucleotide; GAG chr11 5308777 5308796 5308780 -
aatatttgaatctctctgac

SEQ ID NO: 39097 - DNA, 20 bp, Artificial Sequence
  Synthetic oligonucleotide; AGG chr11 5308776 5308795 5308779 -
atatttgaatctctctgacg

SEQ ID NO: 39098 - DNA, 20 bp, Artificial Sequence
  Synthetic oligonucleotide; AAG chr11 5308770 5308789 5308773 -
gaatctctctgacgaggtat

SEQ ID NO: 39099 - DNA, 20 bp, Artificial Sequence
  Synthetic oligonucleotide; GAG chr11 5308768 5308787 5308771 -
atctctctgacgaggtataa

SEQ ID NO: 39100 - DNA, 20 bp, Artificial Sequence
  Synthetic oligonucleotide; GAG chr11 5308766 5308785 5308769 -
ctctctgacgaggtataaga

SEQ ID NO: 39101 - DNA, 20 bp, Artificial Sequence
  Synthetic oligonucleotide; AGG chr11 5308765 5308784 5308768 -
tctctgacgaggtataagag

SEQ ID NO: 39102 - DNA, 20 bp, Artificial Sequence
  Synthetic oligonucleotide; GGG chr11 5308764 5308783 5308767 -
ctctgacgaggtataagaga

SEQ ID NO: 39103 - DNA, 20 bp, Artificial Sequence
  Synthetic oligonucleotide; CAG chr11 5308742 5308761 5308745 -
gacactcacttttgaatatg

SEQ ID NO: 39104 - DNA, 20 bp, Artificial Sequence
  Synthetic oligonucleotide; AGG chr11 5308741 5308760 5308744 -
acactcacttttgaatatgc

SEQ ID NO: 39105 - DNA, 20 bp, Artificial Sequence
  Synthetic oligonucleotide; GGG chr11 5308740 5308759 5308743 -
cactcacttttgaatatgca

SEQ ID NO: 39106 - DNA, 20 bp, Artificial Sequence
  Synthetic oligonucleotide; TGG chr11 5308725 5308744 5308728 -
atgcagggctgtttccatga

SEQ ID NO: 39107 - DNA, 20 bp, Artificial Sequence
  Synthetic oligonucleotide; GAG chr11 5308723 5308742 5308726 -
gcagggctgtttccatgatg

SEQ ID NO: 39108 - DNA, 20 bp, Artificial Sequence
  Synthetic oligonucleotide; AGG chr11 5308722 5308741 5308725 -
cagggctgtttccatgatgg

SEQ ID NO: 39109 - DNA, 20 bp, Artificial Sequence
  Synthetic oligonucleotide; AAG chr11 5308718 5308737 5308721 -
gctgtttccatgatggagga

SEQ ID NO: 39110 - DNA, 20 bp, Artificial Sequence
  Synthetic oligonucleotide; GAG chr11 5308716 5308735 5308719 -
tgtttccatgatggaggaaa

SEQ ID NO: 39111 - DNA, 20 bp, Artificial Sequence
  Synthetic oligonucleotide; TGG chr11 5308711 5308730 5308714 -
ccatgatggaggaaagagat

SEQ ID NO: 39112 - DNA, 20 bp, Artificial Sequence
  Synthetic oligonucleotide; GAG chr11 5308709 5308728 5308712 -
atgatggaggaaagagattg

SEQ ID NO: 39113 - DNA, 20 bp, Artificial Sequence
  Synthetic oligonucleotide; AGG chr11 5308708 5308727 5308711 -
tgatggaggaaagagattgg

SEQ ID NO: 39114 - DNA, 20 bp, Artificial Sequence
  Synthetic oligonucleotide; TAG chr11 5308701 5308720 5308704 -
ggaaagagattggaggaatg

SEQ ID NO: 39115 - DNA, 20 bp, Artificial Sequence
  Synthetic oligonucleotide; TGG chr11 5308693 5308712 5308696 -
attggaggaatgtagattta

SEQ ID NO: 39116 - DNA, 20 bp, Artificial Sequence
  Synthetic oligonucleotide; GGG chr11 5308692 5308711 5308695 -
ttggaggaatgtagatttat

SEQ ID NO: 39117 - DNA, 20 bp, Artificial Sequence
  Synthetic oligonucleotide; AAG chr11 5308687 5308706 5308690 -
ggaatgtagatttatgggtg

SEQ ID NO: 39118 - DNA, 20 bp, Artificial Sequence
  Synthetic oligonucleotide; TGG chr11 5308679 5308698 5308682 -
gatttatgggtgaagttgtt

SEQ ID NO: 39119 - DNA, 20 bp, Artificial Sequence
  Synthetic oligonucleotide; TGG chr11 5308674 5308693 5308677 -
atgggtgaagttgtttggct

SEQ ID NO: 39120 - DNA, 20 bp, Artificial Sequence
  Synthetic oligonucleotide; AAG chr11 5308671 5308690 5308674 -
ggtgaagttgtttggcttgg

SEQ ID NO: 39121 - DNA, 20 bp, Artificial Sequence
  Synthetic oligonucleotide; TGG chr11 5308667 5308686 5308670 -
aagttgtttggcttggaagt

SEQ ID NO: 39122 - DNA, 20 bp, Artificial Sequence
  Synthetic oligonucleotide; TGG chr11 5308663 5308682 5308666 -
tgtttggcttggaagttgga

SEQ ID NO: 39123 - DNA, 20 bp, Artificial Sequence
  Synthetic oligonucleotide; CAG chr11 5308659 5308678 5308662 -
tggcttggaagttggatggt

SEQ ID NO: 39124 - DNA, 20 bp, Artificial Sequence
  Synthetic oligonucleotide; CAG chr11 5308653 5308672 5308656 -
ggaagttggatggtcagttc

SEQ ID NO: 39125 - DNA, 20 bp, Artificial Sequence
  Synthetic oligonucleotide; AGG chr11 5308652 5308671 5308655 -
gaagttggatggtcagttcc

SEQ ID NO: 39126 - DNA, 20 bp, Artificial Sequence
  Synthetic oligonucleotide; TGG chr11 5308640 5308659 5308643 -
tcagttccaggtgctaccat

SEQ ID NO: 39127 - DNA, 20 bp, Artificial Sequence
  Synthetic oligonucleotide; AAG chr11 5308632 5308651 5308635 -
aggtgctaccattggtgctg

SEQ ID NO: 39128 - DNA, 20 bp, Artificial Sequence
  Synthetic oligonucleotide; AGG chr11 5308631 5308650 5308634 -
ggtgctaccattggtgctga

SEQ ID NO: 39129 - DNA, 20 bp, Artificial Sequence
  Synthetic oligonucleotide; GAG chr11 5308629 5308648 5308632 -
tgctaccattggtgctgaag

SEQ ID NO: 39130 - DNA, 20 bp, Artificial Sequence
  Synthetic oligonucleotide; TGG chr11 5308607 5308626 5308610 -
gaacgtttccaaaatgtctt

SEQ ID NO: 39131 - DNA, 20 bp, Artificial Sequence
  Synthetic oligonucleotide; GGG chr11 5308606 5308625 5308609 -
aacgtttccaaaatgtcttt

SEQ ID NO: 39132 - DNA, 20 bp, Artificial Sequence
  Synthetic oligonucleotide; GGG chr11 5308605 5308624 5308608 -
acgtttccaaaatgtctttg

SEQ ID NO: 39133 - DNA, 20 bp, Artificial Sequence
  Synthetic oligonucleotide; TAG chr11 5308577 5308596 5308580 -
caatttcctatcgttttgtt

SEQ ID NO: 39134 - DNA, 20 bp, Artificial Sequence
  Synthetic oligonucleotide; CAG chr11 5308556 5308575 5308559 -
agttgacacaaaatcttact

SEQ ID NO: 39135 - DNA, 20 bp, Artificial Sequence
  Synthetic oligonucleotide; CAG chr11 5308553 5308572 5308556 -
tgacacaaaatcttactcag

SEQ ID NO: 39136 - DNA, 20 bp, Artificial Sequence
  Synthetic oligonucleotide; AGG chr11 5308552 5308571 5308555 -
gacacaaaatcttactcagc

SEQ ID NO: 39137 - DNA, 20 bp, Artificial Sequence
  Synthetic oligonucleotide; GGG chr11 5308551 5308570 5308554 -
acacaaaatcttactcagca

SEQ ID NO: 39138 - DNA, 20 bp, Artificial Sequence
  Synthetic oligonucleotide; GGG chr11 5308550 5308569 5308553 -
cacaaaatcttactcagcag

SEQ ID NO: 39139 - DNA, 20 bp, Artificial Sequence
  Synthetic oligonucleotide; AAG chr11 5308543 5308562 5308546 -
tcttactcagcaggggccca

SEQ ID NO: 39140 - DNA, 20 bp, Artificial Sequence
  Synthetic oligonucleotide; TGG chr11 5308534 5308553 5308537 -
gcaggggcccaaagtgcaat

SEQ ID NO: 39141 - DNA, 20 bp, Artificial Sequence
  Synthetic oligonucleotide; TAG chr11 5308502 5308521 5308505 -
tcaactcctctatacatatt

SEQ ID NO: 39142 - DNA, 20 bp, Artificial Sequence
  Synthetic oligonucleotide; CAG chr11 5308491 5308510 5308494 -
atacatatttagacacttcg

SEQ ID NO: 39143 - DNA, 20 bp, Artificial Sequence
  Synthetic oligonucleotide; AGG chr11 5308490 5308509 5308493 -
tacatatttagacacttcgc

SEQ ID NO: 39144 - DNA, 20 bp, Artificial Sequence
  Synthetic oligonucleotide; AAG chr11 5308483 5308502 5308486 -
ttagacacttcgcaggtatc

SEQ ID NO: 39145 - DNA, 20 bp, Artificial Sequence
  Synthetic oligonucleotide; CAG chr11 5308473 5308492 5308476 -
cgcaggtatcaagtcattac

SEQ ID NO: 39146 - DNA, 20 bp, Artificial Sequence
  Synthetic oligonucleotide; AGG chr11 5308472 5308491 5308475 -
gcaggtatcaagtcattacc

SEQ ID NO: 39147 - DNA, 20 bp, Artificial Sequence
  Synthetic oligonucleotide; GAG chr11 5308470 5308489 5308473 -
aggtatcaagtcattaccag

SEQ ID NO: 39148 - DNA, 20 bp, Artificial Sequence
  Synthetic oligonucleotide; CAG chr11 5308464 5308483 5308467 -
caagtcattaccaggagcac

SEQ ID NO: 39149 - DNA, 20 bp, Artificial Sequence
  Synthetic oligonucleotide; TAG chr11 5308459 5308478 5308462 -
cattaccaggagcaccagct

SEQ ID NO: 39150 - DNA, 20 bp, Artificial Sequence
  Synthetic oligonucleotide; TAG chr11 5308432 5308451 5308435 -
ttcatcttctacaacctcat

SEQ ID NO: 39151 - DNA, 20 bp, Artificial Sequence
  Synthetic oligonucleotide; CAG chr11 5308395 5308414 5308398 -
acttctttcaacgtaatctc

SEQ ID NO: 39152 - DNA, 20 bp, Artificial Sequence
  Synthetic oligonucleotide; AAG chr11 5308387 5308406 5308390 -
caacgtaatctccagaaaac

SEQ ID NO: 39153 - DNA, 20 bp, Artificial Sequence
  Synthetic oligonucleotide; CAG chr11 5308347 5308366 5308350 -
aaccttaaaatgtctccttt

SEQ ID NO: 39154 - DNA, 20 bp, Artificial Sequence
  Synthetic oligonucleotide; TAG chr11 5308327 5308346 5308330 -
cagccttgtccctgtactat

SEQ ID NO: 39155 - DNA, 20 bp, Artificial Sequence
  Synthetic oligonucleotide; TAG chr11 5308308 5308327 5308311 -
ttagtcctatttgccttgca

SEQ ID NO: 39156 - DNA, 20 bp, Artificial Sequence
  Synthetic oligonucleotide; GAG chr11 5308301 5308320 5308304 -
tatttgccttgcatagatgt

SEQ ID NO: 39157 - DNA, 20 bp, Artificial Sequence
  Synthetic oligonucleotide; TGG chr11 5308297 5308316 5308300 -
tgccttgcatagatgtgaga

SEQ ID NO: 39158 - DNA, 20 bp, Artificial Sequence
  Synthetic oligonucleotide; CAG chr11 5308290 5308309 5308293 -
catagatgtgagatggtaca

SEQ ID NO: 39159 - DNA, 20 bp, Artificial Sequence
  Synthetic oligonucleotide; TGG chr11 5308253 5308272 5308256 -
attttctttctcttcctata

SEQ ID NO: 39160 - DNA, 20 bp, Artificial Sequence
  Synthetic oligonucleotide; AAG chr11 5308237 5308256 5308240 -
tatatggtaacataactgat

SEQ ID NO: 39161 - DNA, 20 bp, Artificial Sequence
  Synthetic oligonucleotide; AAG chr11 5308229 5308248 5308232 -
aacataactgataagacaca

SEQ ID NO: 39162 - DNA, 20 bp, Artificial Sequence
  Synthetic oligonucleotide; AAG chr11 5308226 5308245 5308229 -
ataactgataagacacaaag

SEQ ID NO: 39163 - DNA, 20 bp, Artificial Sequence
  Synthetic oligonucleotide; AAG chr11 5308217 5308236 5308220 -
aagacacaaagaagataaaa

SEQ ID NO: 39164 - DNA, 20 bp, Artificial Sequence
  Synthetic oligonucleotide; TGG chr11 5308188 5308207 5308191 -
aatgtctgatatattattgt

SEQ ID NO: 39165 - DNA, 20 bp, Artificial Sequence
  Synthetic oligonucleotide; GGG chr11 5308187 5308206 5308190 -
atgtctgatatattattgtt

SEQ ID NO: 39166 - DNA, 20 bp, Artificial Sequence
  Synthetic oligonucleotide; GGG chr11 5308186 5308205 5308189 -
tgtctgatatattattgttg

SEQ ID NO: 39167 - DNA, 20 bp, Artificial Sequence
  Synthetic oligonucleotide; CAG chr11 5308181 5308200 5308184 -
gatatattattgttggggta

SEQ ID NO: 39168 - DNA, 20 bp, Artificial Sequence
  Synthetic oligonucleotide; GAG chr11 5308169 5308188 5308172 -
ttggggtacagttctttatt

SEQ ID NO: 39169 - DNA, 20 bp, Artificial Sequence
  Synthetic oligonucleotide; AAG chr11 5308163 5308182 5308166 -
tacagttctttattgagaat

SEQ ID NO: 39170 - DNA, 20 bp, Artificial Sequence
  Synthetic oligonucleotide; GAG chr11 5308161 5308180 5308164 -
cagttctttattgagaataa

SEQ ID NO: 39171 - DNA, 20 bp, Artificial Sequence
  Synthetic oligonucleotide; TGG chr11 5308143 5308162 5308146 -
aagagtttcttttcatgtat

SEQ ID NO: 39172 - DNA, 20 bp, Artificial Sequence
  Synthetic oligonucleotide; TAG chr11 5308138 5308157 5308141 -
tttcttttcatgtattggtc

SEQ ID NO: 39173 - DNA, 20 bp, Artificial Sequence
  Synthetic oligonucleotide; TAG chr11 5308130 5308149 5308133 -
catgtattggtctagctatt

SEQ ID NO: 39174 - DNA, 20 bp, Artificial Sequence
  Synthetic oligonucleotide; TAG chr11 5308127 5308146 5308130 -
gtattggtctagctatttag

SEQ ID NO: 39175 - DNA, 20 bp, Artificial Sequence
  Synthetic oligonucleotide; TAG chr11 5308122 5308141 5308125 -
ggtctagctatttagtagta

SEQ ID NO: 39176 - DNA, 20 bp, Artificial Sequence
  Synthetic oligonucleotide; TAG chr11 5308118 5308137 5308121 -
tagctatttagtagtataga

SEQ ID NO: 39177 - DNA, 20 bp, Artificial Sequence
  Synthetic oligonucleotide; CAG chr11 5308111 5308130 5308114 -
ttagtagtatagatagatca

SEQ ID NO: 39178 - DNA, 20 bp, Artificial Sequence
  Synthetic oligonucleotide; AGG chr11 5308110 5308129 5308113 -
tagtagtatagatagatcac

SEQ ID NO: 39179 - DNA, 20 bp, Artificial Sequence
  Synthetic oligonucleotide; TAG chr11 5308101 5308120 5308104 -
agatagatcacaggaaattg

SEQ ID NO: 39180 - DNA, 20 bp, Artificial Sequence
  Synthetic oligonucleotide; TGG chr11 5308095 5308114 5308098 -
atcacaggaaattgtagact

SEQ ID NO: 39181 - DNA, 20 bp, Artificial Sequence
  Synthetic oligonucleotide; TAG chr11 5308086 5308105 5308089 -
aattgtagacttggtgtatt

SEQ ID NO: 39182 - DNA, 20 bp, Artificial Sequence
  Synthetic oligonucleotide; AAG chr11 5308062 5308081 5308065 -
catcaacaaaaacattttca

SEQ ID NO: 39183 - DNA, 20 bp, Artificial Sequence
  Synthetic oligonucleotide; TAG chr11 5308059 5308078 5308062 -
caacaaaaacattttcaaag

SEQ ID NO: 39184 - DNA, 20 bp, Artificial Sequence
  Synthetic oligonucleotide; TGG chr11 5308047 5308066 5308050 -
tttcaaagtagtcttttcat

SEQ ID NO: 39185 - DNA, 20 bp, Artificial Sequence
  Synthetic oligonucleotide; TGG chr11 5308042 5308061 5308045 -
aagtagtcttttcattggaa

SEQ ID NO: 39186 - DNA, 20 bp, Artificial Sequence
  Synthetic oligonucleotide; GGG chr11 5308041 5308060 5308044 -
agtagtcttttcattggaat

SEQ ID NO: 39187 - DNA, 20 bp, Artificial Sequence
  Synthetic oligonucleotide; GAG chr11 5308039 5308058 5308042 -
tagtcttttcattggaatgg

SEQ ID NO: 39188 - DNA, 20 bp, Artificial Sequence
  Synthetic oligonucleotide; AAG chr11 5308031 5308050 5308034 -
tcattggaatgggagaatat

SEQ ID NO: 39189 - DNA, 20 bp, Artificial Sequence
  Synthetic oligonucleotide; AAG chr11 5308022 5308041 5308025 -
tgggagaatataagttccat

SEQ ID NO: 39190 - DNA, 20 bp, Artificial Sequence
  Synthetic oligonucleotide; TGG chr11 5308019 5308038 5308022 -
gagaatataagttccataag

SEQ ID NO: 39191 - DNA, 20 bp, Artificial Sequence
  Synthetic oligonucleotide; GAG chr11 5307999 5308018 5308002 -
tggttaaaacatcttacctt

SEQ ID NO: 39192 - DNA, 20 bp, Artificial Sequence
  Synthetic oligonucleotide; CAG chr11 5307987 5308006 5307990 -
cttaccttgagactcacttg

SEQ ID NO: 39193 - DNA, 20 bp, Artificial Sequence
  Synthetic oligonucleotide; AAG chr11 5307981 5308000 5307984 -
ttgagactcacttgcagcca

SEQ ID NO: 39194 - DNA, 20 bp, Artificial Sequence
  Synthetic oligonucleotide; AAG chr11 5307974 5307993 5307977 -
tcacttgcagccaaagtact

SEQ ID NO: 39195 - DNA, 20 bp, Artificial Sequence
  Synthetic oligonucleotide; AAG chr11 5307971 5307990 5307974 -
cttgcagccaaagtactaag

SEQ ID NO: 39196 - DNA, 20 bp, Artificial Sequence
  Synthetic oligonucleotide; AGG chr11 5307970 5307989 5307973 -
ttgcagccaaagtactaaga

SEQ ID NO: 39197 - DNA, 20 bp, Artificial Sequence
  Synthetic oligonucleotide; TGG chr11 5307938 5307957 5307941 -
cataaatgtctcttctcatg

SEQ ID NO: 39198 - DNA, 20 bp, Artificial Sequence
  Synthetic oligonucleotide; CAG chr11 5307932 5307951 5307935 -
tgtctcttctcatgtggtca

SEQ ID NO: 39199 - DNA, 20 bp, Artificial Sequence
  Synthetic oligonucleotide; TGG chr11 5307924 5307943 5307927 -
ctcatgtggtcacagctatt

SEQ ID NO: 39200 - DNA, 20 bp, Artificial Sequence
  Synthetic oligonucleotide; GGG chr11 5307923 5307942 5307926 -
tcatgtggtcacagctattt

SEQ ID NO: 39201 - DNA, 20 bp, Artificial Sequence
  Synthetic oligonucleotide; GAG chr11 5307921 5307940 5307924 -
atgtggtcacagctatttgg

SEQ ID NO: 39202 - DNA, 20 bp, Artificial Sequence
  Synthetic oligonucleotide; AGG chr11 5307920 5307939 5307923 -
tgtggtcacagctatttggg

SEQ ID NO: 39203 - DNA, 20 bp, Artificial Sequence
  Synthetic oligonucleotide; GAG chr11 5307915 5307934 5307918 -
tcacagctatttgggaggct

SEQ ID NO: 39204 - DNA, 20 bp, Artificial Sequence
  Synthetic oligonucleotide; AGG chr11 5307914 5307933 5307917 -
cacagctatttgggaggctg

SEQ ID NO: 39205 - DNA, 20 bp, Artificial Sequence
  Synthetic oligonucleotide; AAG chr11 5307897 5307916 5307900 -
ctgaggtgtaaaaatcactt

SEQ ID NO: 39206 - DNA, 20 bp, Artificial Sequence
  Synthetic oligonucleotide; AAG chr11 5307889 5307908 5307892 -
taaaaatcacttaagcctaa

SEQ ID NO: 39207 - DNA, 20 bp, Artificial Sequence
  Synthetic oligonucleotide; GAG chr11 5307883 5307902 5307886 -
tcacttaagcctaaaagctt

SEQ ID NO: 39208 - DNA, 20 bp, Artificial Sequence
  Synthetic oligonucleotide; AGG chr11 5307882 5307901 5307885 -
cacttaagcctaaaagcttg

SEQ ID NO: 39209 - DNA, 20 bp, Artificial Sequence
  Synthetic oligonucleotide; CAG chr11 5307876 5307895 5307879 -
agcctaaaagcttgaggctg

SEQ ID NO: 39210 - DNA, 20 bp, Artificial Sequence
  Synthetic oligonucleotide; TGG chr11 5307842 5307861 5307845 -
ctcaccactgcactccctcc

SEQ ID NO: 39211 - DNA, 20 bp, Artificial Sequence
  Synthetic oligonucleotide; GGG chr11 5307841 5307860 5307844 -
tcaccactgcactccctcct

SEQ ID NO: 39212 - DNA, 20 bp, Artificial Sequence
  Synthetic oligonucleotide; CAG chr11 5307835 5307854 5307838 -
ctgcactccctcctgggtga

SEQ ID NO: 39213 - DNA, 20 bp, Artificial Sequence
  Synthetic oligonucleotide; GAG chr11 5307833 5307852 5307836 -
gcactccctcctgggtgaca

SEQ ID NO: 39214 - DNA, 20 bp, Artificial Sequence
  Synthetic oligonucleotide; AAG chr11 5307829 5307848 5307832 -
tccctcctgggtgacagagc

SEQ ID NO: 39215 - DNA, 20 bp, Artificial Sequence
  Synthetic oligonucleotide; AAG chr11 5307814 5307833 5307817 -
agagcaagacactgtctcaa

SEQ ID NO: 39216 - DNA, 20 bp, Artificial Sequence
  Synthetic oligonucleotide; GAG chr11 5307812 5307831 5307815 -
agcaagacactgtctcaaaa

SEQ ID NO: 39217 - DNA, 20 bp, Artificial Sequence
  Synthetic oligonucleotide; GAG chr11 5307810 5307829 5307813 -
caagacactgtctcaaaaga

SEQ ID NO: 39218 - DNA, 20 bp, Artificial Sequence
  Synthetic oligonucleotide; AGG chr11 5307809 5307828 5307812 -
aagacactgtctcaaaagag

SEQ ID NO: 39219 - DNA, 20 bp, Artificial Sequence
  Synthetic oligonucleotide; AAG chr11 5307805 5307824 5307808 -
cactgtctcaaaagagagga

SEQ ID NO: 39220 - DNA, 20 bp, Artificial Sequence
  Synthetic oligonucleotide; AAG chr11 5307800 5307819 5307803 -
tctcaaaagagaggaaagaa

SEQ ID NO: 39221 - DNA, 20 bp, Artificial Sequence
  Synthetic oligonucleotide; AAG chr11 5307795 5307814 5307798 -
aaagagaggaaagaaaagaa

SEQ ID NO: 39222 - DNA, 20 bp, Artificial Sequence
  Synthetic oligonucleotide; GAG chr11 5307793 5307812 5307796 -
agagaggaaagaaaagaaaa

SEQ ID NO: 39223 - DNA, 20 bp, Artificial Sequence
  Synthetic oligonucleotide; AAG chr11 5307785 5307804 5307788 -
aagaaaagaaaagagaataa

SEQ ID NO: 39224 - DNA, 20 bp, Artificial Sequence
  Synthetic oligonucleotide; AGG chr11 5307784 5307803 5307787 -
agaaaagaaaagagaataaa

SEQ ID NO: 39225 - DNA, 20 bp, Artificial Sequence
  Synthetic oligonucleotide; AAG chr11 5307780 5307799 5307783 -
aagaaaagagaataaaagga

SEQ ID NO: 39226 - DNA, 20 bp, Artificial Sequence
  Synthetic oligonucleotide; AGG chr11 5307779 5307798 5307782 -
agaaaagagaataaaaggaa

SEQ ID NO: 39227 - DNA, 20 bp, Artificial Sequence
  Synthetic oligonucleotide; AAG chr11 5307775 5307794 5307778 -
aagagaataaaaggaaagga

SEQ ID NO: 39228 - DNA, 20 bp, Artificial Sequence
  Synthetic oligonucleotide; AGG chr11 5307774 5307793 5307777 -
agagaataaaaggaaaggaa

SEQ ID NO: 39229 - DNA, 20 bp, Artificial Sequence
  Synthetic oligonucleotide; AAG chr11 5307770 5307789 5307773 -
aataaaaggaaaggaaagga

SEQ ID NO: 39230 - DNA, 20 bp, Artificial Sequence
  Synthetic oligonucleotide; AGG chr11 5307769 5307788 5307772 -
ataaaaggaaaggaaaggaa

SEQ ID NO: 39231 - DNA, 20 bp, Artificial Sequence
  Synthetic oligonucleotide; GGG chr11 5307768 5307787 5307771 -
taaaaggaaaggaaaggaaa

SEQ ID NO: 39232 - DNA, 20 bp, Artificial Sequence
  Synthetic oligonucleotide; GAG chr11 5307766 5307785 5307769 -
aaaggaaaggaaaggaaagg

SEQ ID NO: 39233 - DNA, 20 bp, Artificial Sequence
  Synthetic oligonucleotide; AAG chr11 5307762 5307781 5307765 -
gaaaggaaaggaaagggaga

SEQ ID NO: 39234 - DNA, 20 bp, Artificial Sequence
  Synthetic oligonucleotide; AAG chr11 5307758 5307777 5307761 -
ggaaaggaaagggagaaaga

SEQ ID NO: 39235 - DNA, 20 bp, Artificial Sequence
  Synthetic oligonucleotide; AGG chr11 5307757 5307776 5307760 -
gaaaggaaagggagaaagaa

SEQ ID NO: 39236 - DNA, 20 bp, Artificial Sequence
  Synthetic oligonucleotide; AAG chr11 5307754 5307773 5307757 -
aggaaagggagaaagaaagg

SEQ ID NO: 39237 - DNA, 20 bp, Artificial Sequence
  Synthetic oligonucleotide; AGG chr11 5307753 5307772 5307756 -
ggaaagggagaaagaaagga

SEQ ID NO: 39238 - DNA, 20 bp, Artificial Sequence
  Synthetic oligonucleotide; AAG chr11 5307750 5307769 5307753 -
aagggagaaagaaaggaagg

SEQ ID NO: 39239 - DNA, 20 bp, Artificial Sequence
  Synthetic oligonucleotide; AGG chr11 5307749 5307768 5307752 -
agggagaaagaaaggaagga

SEQ ID NO: 39240 - DNA, 20 bp, Artificial Sequence
  Synthetic oligonucleotide; AAG chr11 5307746 5307765 5307749 -
gagaaagaaaggaaggaagg

SEQ ID NO: 39241 - DNA, 20 bp, Artificial Sequence
  Synthetic oligonucleotide; AAG chr11 5307740 5307759 5307743 -
gaaaggaaggaaggaagaaa

SEQ ID NO: 39242 - DNA, 20 bp, Artificial Sequence
  Synthetic oligonucleotide; GAG chr11 5307738 5307757 5307741 -
aaggaaggaaggaagaaaaa

SEQ ID NO: 39243 - DNA, 20 bp, Artificial Sequence
  Synthetic oligonucleotide; GAG chr11 5307736 5307755 5307739 -
ggaaggaaggaagaaaaaga

SEQ ID NO: 39244 - DNA, 20 bp, Artificial Sequence
  Synthetic oligonucleotide; GAG chr11 5307734 5307753 5307737 -
aaggaaggaagaaaaagaga

SEQ ID NO: 39245 - DNA, 20 bp, Artificial Sequence
  Synthetic oligonucleotide; GAG chr11 5307732 5307751 5307735 -
ggaaggaagaaaaagagaga

SEQ ID NO: 39246 - DNA, 20 bp, Artificial Sequence
  Synthetic oligonucleotide; AAG chr11 5307725 5307744 5307728 -
agaaaaagagagagagaaat

SEQ ID NO: 39247 - DNA, 20 bp, Artificial Sequence
  Synthetic oligonucleotide; AGG chr11 5307724 5307743 5307727 -
gaaaaagagagagagaaata

SEQ ID NO: 39248 - DNA, 20 bp, Artificial Sequence
  Synthetic oligonucleotide; AAG chr11 5307720 5307739 5307723 -
aagagagagagaaataagga

SEQ ID NO: 39249 - DNA, 20 bp, Artificial Sequence
  Synthetic oligonucleotide; AAG chr11 5307716 5307735 5307719 -
gagagagaaataaggaaaga

SEQ ID NO: 39250 - DNA, 20 bp, Artificial Sequence
  Synthetic oligonucleotide; AAG chr11 5307709 5307728 5307712 -
aaataaggaaagaaagaaaa

SEQ ID NO: 39251 - DNA, 20 bp, Artificial Sequence
  Synthetic oligonucleotide; AAG chr11 5307705 5307724 5307708 -
aaggaaagaaagaaaaaaga

SEQ ID NO: 39252 - DNA, 20 bp, Artificial Sequence
  Synthetic oligonucleotide; AGG chr11 5307704 5307723 5307707 -
aggaaagaaagaaaaaagaa

SEQ ID NO: 39253 - DNA, 20 bp, Artificial Sequence
  Synthetic oligonucleotide; AAG chr11 5307701 5307720 5307704 -
aaagaaagaaaaaagaaagg

SEQ ID NO: 39254 - DNA, 20 bp, Artificial Sequence
  Synthetic oligonucleotide; AGG chr11 5307700 5307719 5307703 -
aagaaagaaaaaagaaagga

SEQ ID NO: 39255 - DNA, 20 bp, Artificial Sequence
  Synthetic oligonucleotide; GAG chr11 5307694 5307713 5307697 -
gaaaaaagaaaggaaggaat

SEQ ID NO: 39256 - DNA, 20 bp, Artificial Sequence
  Synthetic oligonucleotide; AGG chr11 5307693 5307712 5307696 -
aaaaaagaaaggaaggaatg

SEQ ID NO: 39257 - DNA, 20 bp, Artificial Sequence
  Synthetic oligonucleotide; GGG chr11 5307692 5307711 5307695 -
aaaaagaaaggaaggaatga

SEQ ID NO: 39258 - DNA, 20 bp, Artificial Sequence
  Synthetic oligonucleotide; AAG chr11 5307689 5307708 5307692 -
aagaaaggaaggaatgaggg

SEQ ID NO: 39259 - DNA, 20 bp, Artificial Sequence
  Synthetic oligonucleotide; AGG chr11 5307688 5307707 5307691 -
agaaaggaaggaatgaggga

SEQ ID NO: 39260 - DNA, 20 bp, Artificial Sequence
  Synthetic oligonucleotide; GAG chr11 5307686 5307705 5307689 -
aaaggaaggaatgagggaag

SEQ ID NO: 39261 - DNA, 20 bp, Artificial Sequence
  Synthetic oligonucleotide; AGG chr11 5307685 5307704 5307688 -
aaggaaggaatgagggaagg

SEQ ID NO: 39262 - DNA, 20 bp, Artificial Sequence
  Synthetic oligonucleotide; GGG chr11 5307684 5307703 5307687 -
aggaaggaatgagggaagga

SEQ ID NO: 39263 - DNA, 20 bp, Artificial Sequence
  Synthetic oligonucleotide; AAG chr11 5307681 5307700 5307684 -
aaggaatgagggaaggaggg

SEQ ID NO: 39264 - DNA, 20 bp, Artificial Sequence
  Synthetic oligonucleotide; AGG chr11 5307680 5307699 5307683 -
aggaatgagggaaggaggga

SEQ ID NO: 39265 - DNA, 20 bp, Artificial Sequence
  Synthetic oligonucleotide; GAG chr11 5307678 5307697 5307681 -
gaatgagggaaggagggaag

SEQ ID NO: 39266 - DNA, 20 bp, Artificial Sequence
  Synthetic oligonucleotide; AGG chr11 5307677 5307696 5307680 -
aatgagggaaggagggaagg

SEQ ID NO: 39267 - DNA, 20 bp, Artificial Sequence
  Synthetic oligonucleotide; GGG chr11 5307676 5307695 5307679 -
atgagggaaggagggaagga

SEQ ID NO: 39268 - DNA, 20 bp, Artificial Sequence
  Synthetic oligonucleotide; AAG chr11 5307673 5307692 5307676 -
agggaaggagggaaggaggg

SEQ ID NO: 39269 - DNA, 20 bp, Artificial Sequence
  Synthetic oligonucleotide; AGG chr11 5307672 5307691 5307675 -
gggaaggagggaaggaggga

SEQ ID NO: 39270 - DNA, 20 bp, Artificial Sequence
  Synthetic oligonucleotide; GGG chr11 5307671 5307690 5307674 -
ggaaggagggaaggagggaa

SEQ ID NO: 39271 - DNA, 20 bp, Artificial Sequence
  Synthetic oligonucleotide; GGG chr11 5307670 5307689 5307673 -
gaaggagggaaggagggaag

SEQ ID NO: 39272 - DNA, 20 bp, Artificial Sequence
  Synthetic oligonucleotide; GGG chr11 5307669 5307688 5307672 -
aaggagggaaggagggaagg

SEQ ID NO: 39273 - DNA, 20 bp, Artificial Sequence
  Synthetic oligonucleotide; AAG chr11 5307666 5307685 5307669 -
gagggaaggagggaaggggg

SEQ ID NO: 39274 - DNA, 20 bp, Artificial Sequence
  Synthetic oligonucleotide; AGG chr11 5307665 5307684 5307668 -
agggaaggagggaaggggga

SEQ ID NO: 39275 - DNA, 20 bp, Artificial Sequence
  Synthetic oligonucleotide; GGG chr11 5307664 5307683 5307667 -
gggaaggagggaagggggaa

SEQ ID NO: 39276 - DNA, 20 bp, Artificial Sequence
  Synthetic oligonucleotide; GGG chr11 5307663 5307682 5307666 -
ggaaggagggaagggggaag

SEQ ID NO: 39277 - DNA, 20 bp, Artificial Sequence
  Synthetic oligonucleotide; GGG chr11 5307662 5307681 5307665 -
gaaggagggaagggggaagg

SEQ ID NO: 39278 - DNA, 20 bp, Artificial Sequence
  Synthetic oligonucleotide; AAG chr11 5307659 5307678 5307662 -
ggagggaagggggaaggggg

SEQ ID NO: 39279 - DNA, 20 bp, Artificial Sequence
  Synthetic oligonucleotide; AGG chr11 5307658 5307677 5307661 -
gagggaagggggaaggggga

SEQ ID NO: 39280 - DNA, 20 bp, Artificial Sequence
  Synthetic oligonucleotide; GGG chr11 5307657 5307676 5307660 -
agggaagggggaagggggaa

SEQ ID NO: 39281 - DNA, 20 bp, Artificial Sequence
  Synthetic oligonucleotide; GGG chr11 5307656 5307675 5307659 -
gggaagggggaagggggaag

SEQ ID NO: 39282 - DNA, 20 bp, Artificial Sequence
  Synthetic oligonucleotide; GGG chr11 5307655 5307674 5307658 -
ggaagggggaagggggaagg

SEQ ID NO: 39283 - DNA, 20 bp, Artificial Sequence
  Synthetic oligonucleotide; GAG chr11 5307653 5307672 5307656 -
aagggggaagggggaagggg

SEQ ID NO: 39284 - DNA, 20 bp, Artificial Sequence
  Synthetic oligonucleotide; AGG chr11 5307652 5307671 5307655 -
agggggaagggggaaggggg

SEQ ID NO: 39285 - DNA, 20 bp, Artificial Sequence
  Synthetic oligonucleotide; GGG chr11 5307651 5307670 5307654 -
gggggaagggggaaggggga

SEQ ID NO: 39286 - DNA, 20 bp, Artificial Sequence
  Synthetic oligonucleotide; GAG chr11 5307649 5307668 5307652 -
gggaagggggaagggggagg

SEQ ID NO: 39287 - DNA, 20 bp, Artificial Sequence
  Synthetic oligonucleotide; AGG chr11 5307648 5307667 5307651 -
ggaagggggaagggggaggg

SEQ ID NO: 39288 - DNA, 20 bp, Artificial Sequence
  Synthetic oligonucleotide; GGG chr11 5307647 5307666 5307650 -
gaagggggaagggggaggga

SEQ ID NO: 39289 - DNA, 20 bp, Artificial Sequence
  Synthetic oligonucleotide; GAG chr11 5307645 5307664 5307648 -
agggggaagggggagggagg

SEQ ID NO: 39290 - DNA, 20 bp, Artificial Sequence
  Synthetic oligonucleotide; AGG chr11 5307644 5307663 5307647 -
gggggaagggggagggaggg

SEQ ID NO: 39291 - DNA, 20 bp, Artificial Sequence
  Synthetic oligonucleotide; GGG chr11 5307643 5307662 5307646 -
ggggaagggggagggaggga

SEQ ID NO: 39292 - DNA, 20 bp, Artificial Sequence
  Synthetic oligonucleotide; GAG chr11 5307641 5307660 5307644 -
ggaagggggagggagggagg

SEQ ID NO: 39293 - DNA, 20 bp, Artificial Sequence
  Synthetic oligonucleotide; AGG chr11 5307640 5307659 5307643 -
gaagggggagggagggaggg

SEQ ID NO: 39294 - DNA, 20 bp, Artificial Sequence
  Synthetic oligonucleotide; AAG chr11 5307637 5307656 5307640 -
gggggagggagggagggagg

SEQ ID NO: 39295 - DNA, 20 bp, Artificial Sequence
  Synthetic oligonucleotide; AGG chr11 5307636 5307655 5307639 -
ggggagggagggagggagga

SEQ ID NO: 39296 - DNA, 20 bp, Artificial Sequence
  Synthetic oligonucleotide; AAG chr11 5307633 5307652 5307636 -
gagggagggagggaggaagg

SEQ ID NO: 39297 - DNA, 20 bp, Artificial Sequence
  Synthetic oligonucleotide; AGG chr11 5307632 5307651 5307635 -
agggagggagggaggaagga

SEQ ID NO: 39298 - DNA, 20 bp, Artificial Sequence
  Synthetic oligonucleotide; TGG chr11 5307595 5307614 5307598 -
ctttcttcttgatgttgtta

SEQ ID NO: 39299 - DNA, 20 bp, Artificial Sequence
  Synthetic oligonucleotide; TAG chr11 5307560 5307579 5307563 -
accatgattgatgtaaaaat

SEQ ID NO: 39300 - DNA, 20 bp, Artificial Sequence
  Synthetic oligonucleotide; GAG chr11 5307558 5307577 5307561 -
catgattgatgtaaaaatta

SEQ ID NO: 39301 - DNA, 20 bp, Artificial Sequence
  Synthetic oligonucleotide; AAG chr11 5307549 5307568 5307552 -
tgtaaaaattagagacatcg

SEQ ID NO: 39302 - DNA, 20 bp, Artificial Sequence
  Synthetic oligonucleotide; AAG chr11 5307534 5307553 5307537 -
catcgaagtactaaacaata

SEQ ID NO: 39303 - DNA, 20 bp, Artificial Sequence
  Synthetic oligonucleotide; AAG chr11 5307529 5307548 5307532 -
aagtactaaacaataaagaa

SEQ ID NO: 39304 - DNA, 20 bp, Artificial Sequence
  Synthetic oligonucleotide; AGG chr11 5307528 5307547 5307531 -
agtactaaacaataaagaaa

SEQ ID NO: 39305 - DNA, 20 bp, Artificial Sequence
  Synthetic oligonucleotide; GAG chr11 5307526 5307545 5307529 -
tactaaacaataaagaaaag

SEQ ID NO: 39306 - DNA, 20 bp, Artificial Sequence
  Synthetic oligonucleotide; TAG chr11 5307522 5307541 5307525 -
aaacaataaagaaaaggaga

SEQ ID NO: 39307 - DNA, 20 bp, Artificial Sequence
  Synthetic oligonucleotide; TGG chr11 5307512 5307531 5307515 -
gaaaaggagatagcattgtt

SEQ ID NO: 39308 - DNA, 20 bp, Artificial Sequence
  Synthetic oligonucleotide; TAG chr11 5307498 5307517 5307501 -
attgtttggcatgcttgaac

SEQ ID NO: 39309 - DNA, 20 bp, Artificial Sequence
  Synthetic oligonucleotide; CAG chr11 5307480 5307499 5307483 -
actagtaatcttattacaaa

SEQ ID NO: 39310 - DNA, 20 bp, Artificial Sequence
  Synthetic oligonucleotide; TAG chr11 5307474 5307493 5307477 -
aatcttattacaaacagatg

SEQ ID NO: 39311 - DNA, 20 bp, Artificial Sequence
  Synthetic oligonucleotide; GAG chr11 5307472 5307491 5307475 -
tcttattacaaacagatgta

SEQ ID NO: 39312 - DNA, 20 bp, Artificial Sequence
  Synthetic oligonucleotide; AGG chr11 5307471 5307490 5307474 -
cttattacaaacagatgtag

SEQ ID NO: 39313 - DNA, 20 bp, Artificial Sequence
  Synthetic oligonucleotide; AAG chr11 5307463 5307482 5307466 -
aaacagatgtagaggttgta

SEQ ID NO: 39314 - DNA, 20 bp, Artificial Sequence
  Synthetic oligonucleotide; AGG chr11 5307462 5307481 5307465 -
aacagatgtagaggttgtaa

SEQ ID NO: 39315 - DNA, 20 bp, Artificial Sequence
  Synthetic oligonucleotide; TGG chr11 5307450 5307469 5307453 -
ggttgtaaaggtctacaatt

SEQ ID NO: 39316 - DNA, 20 bp, Artificial Sequence
  Synthetic oligonucleotide; TGG chr11 5307435 5307454 5307438 -
caatttggctacaaaaccaa

SEQ ID NO: 39317 - DNA, 20 bp, Artificial Sequence
  Synthetic oligonucleotide; AAG chr11 5307423 5307442 5307426 -
aaaaccaatggcttgatcac

SEQ ID NO: 39318 - DNA, 20 bp, Artificial Sequence
  Synthetic oligonucleotide; TAG chr11 5307418 5307437 5307421 -
caatggcttgatcacaagaa

SEQ ID NO: 39319 - DNA, 20 bp, Artificial Sequence
  Synthetic oligonucleotide; TAG chr11 5307399 5307418 5307402 -
atagcattcatttgcttaac

SEQ ID NO: 39320 - DNA, 20 bp, Artificial Sequence
  Synthetic oligonucleotide; GAG chr11 5307388 5307407 5307391 -
ttgcttaactagtacttact

SEQ ID NO: 39321 - DNA, 20 bp, Artificial Sequence
  Synthetic oligonucleotide; AAG chr11 5307370 5307389 5307373 -
ctgagcacccactatatgtt

SEQ ID NO: 39322 - DNA, 20 bp, Artificial Sequence
  Synthetic oligonucleotide; AAG chr11 5307358 5307377 5307361 -
tatatgttaagctccatttt

SEQ ID NO: 39323 - DNA, 20 bp, Artificial Sequence
  Synthetic oligonucleotide; CAG chr11 5307325 5307344 5307328 -
gtcactcacttaaaatcttt

SEQ ID NO: 39324 - DNA, 20 bp, Artificial Sequence
  Synthetic oligonucleotide; AAG chr11 5307322 5307341 5307325 -
actcacttaaaatctttcag

SEQ ID NO: 39325 - DNA, 20 bp, Artificial Sequence
  Synthetic oligonucleotide; GAG chr11 5307305 5307324 5307308 -
cagaagttttgttttactgt

SEQ ID NO: 39326 - DNA, 20 bp, Artificial Sequence
  Synthetic oligonucleotide; AAG chr11 5307298 5307317 5307301 -
tttgttttactgtgagtaca

SEQ ID NO: 39327 - DNA, 20 bp, Artificial Sequence
  Synthetic oligonucleotide; GAG chr11 5307296 5307315 5307299 -
tgttttactgtgagtacaaa

SEQ ID NO: 39328 - DNA, 20 bp, Artificial Sequence
  Synthetic oligonucleotide; TGG chr11 5307277 5307296 5307280 -
agagaactgactttatgata

SEQ ID NO: 39329 - DNA, 20 bp, Artificial Sequence
  Synthetic oligonucleotide; AAG chr11 5307265 5307284 5307268 -
ttatgatatggttatttacc

SEQ ID NO: 39330 - DNA, 20 bp, Artificial Sequence
  Synthetic oligonucleotide; TAG chr11 5307251 5307270 5307254 -
tttaccaagccgtcacttct

SEQ ID NO: 39331 - DNA, 20 bp, Artificial Sequence
  Synthetic oligonucleotide; AAG chr11 5307244 5307263 5307247 -
agccgtcacttcttagctac

SEQ ID NO: 39332 - DNA, 20 bp, Artificial Sequence
  Synthetic oligonucleotide; TAG chr11 5307239 5307258 5307242 -
tcacttcttagctacaagtc

SEQ ID NO: 39333 - DNA, 20 bp, Artificial Sequence
  Synthetic oligonucleotide; CAG chr11 5307230 5307249 5307233 -
agctacaagtctagaatcaa

SEQ ID NO: 39334 - DNA, 20 bp, Artificial Sequence
  Synthetic oligonucleotide; AGG chr11 5307229 5307248 5307232 -
gctacaagtctagaatcaac

SEQ ID NO: 39335 - DNA, 20 bp, Artificial Sequence
  Synthetic oligonucleotide; TGG chr11 5307209 5307228 5307212 -
aggttctgcaaaatgaattc

SEQ ID NO: 39336 - DNA, 20 bp, Artificial Sequence
  Synthetic oligonucleotide; TGG chr11 5307170 5307189 5307173 -
tatgacctaaaatcacgttt

SEQ ID NO: 39337 - DNA, 20 bp, Artificial Sequence
  Synthetic oligonucleotide; GAG chr11 5307146 5307165 5307149 -
aaaatcttacctgaatatat

SEQ ID NO: 39338 - DNA, 20 bp, Artificial Sequence
  Synthetic oligonucleotide; GAG chr11 5307144 5307163 5307147 -
aatcttacctgaatatatga

SEQ ID NO: 39339 - DNA, 20 bp, Artificial Sequence
  Synthetic oligonucleotide; AGG chr11 5307143 5307162 5307146 -
atcttacctgaatatatgag

SEQ ID NO: 39340 - DNA, 20 bp, Artificial Sequence
  Synthetic oligonucleotide; TAG chr11 5307135 5307154 5307138 -
tgaatatatgagaggatatt

SEQ ID NO: 39341 - DNA, 20 bp, Artificial Sequence
  Synthetic oligonucleotide; AGG chr11 5307134 5307153 5307137 -
gaatatatgagaggatattt

SEQ ID NO: 39342 - DNA, 20 bp, Artificial Sequence
  Synthetic oligonucleotide; AAG chr11 5307119 5307138 5307122 -
tatttaggtttttttcccct

SEQ ID NO: 39343 - DNA, 20 bp, Artificial Sequence
  Synthetic oligonucleotide; CAG chr11 5307110 5307129 5307113 -
ttttttcccctaagtataaa

SEQ ID NO: 39344 - DNA, 20 bp, Artificial Sequence
  Synthetic oligonucleotide; AGG chr11 5307109 5307128 5307112 -
tttttcccctaagtataaac

SEQ ID NO: 39345 - DNA, 20 bp, Artificial Sequence
  Synthetic oligonucleotide; TAG chr11 5307103 5307122 5307106 -
ccctaagtataaacaggtga

SEQ ID NO: 39346 - DNA, 20 bp, Artificial Sequence
  Synthetic oligonucleotide; TAG chr11 5307096 5307115 5307099 -
tataaacaggtgatagtaaa

SEQ ID NO: 39347 - DNA, 20 bp, Artificial Sequence
  Synthetic oligonucleotide; GAG chr11 5307094 5307113 5307097 -
taaacaggtgatagtaaata

SEQ ID NO: 39348 - DNA, 20 bp, Artificial Sequence
  Synthetic oligonucleotide; GAG chr11 5307080 5307099 5307083 -
taaatagagtaacttgctgc

SEQ ID NO: 39349 - DNA, 20 bp, Artificial Sequence
  Synthetic oligonucleotide; TAG chr11 5307061 5307080 5307064 -
cgagtgtcacatatattatg

SEQ ID NO: 39350 - DNA, 20 bp, Artificial Sequence
  Synthetic oligonucleotide; AAG chr11 5307027 5307046 5307030 -
tatcactattttaaatctga

SEQ ID NO: 39351 - DNA, 20 bp, Artificial Sequence
  Synthetic oligonucleotide; GAG chr11 5307005 5307024 5307008 -
gactgaatttgacatgtttt

SEQ ID NO: 39352 - DNA, 20 bp, Artificial Sequence
  Synthetic oligonucleotide; AAG chr11 5307000 5307019 5307003 -
aatttgacatgttttgagat

SEQ ID NO: 39353 - DNA, 20 bp, Artificial Sequence
  Synthetic oligonucleotide; GAG chr11 5306998 5307017 5307001 -
tttgacatgttttgagataa

SEQ ID NO: 39354 - DNA, 20 bp, Artificial Sequence
  Synthetic oligonucleotide; TAG chr11 5306993 5307012 5306996 -
catgttttgagataagagtt

SEQ ID NO: 39355 - DNA, 20 bp, Artificial Sequence
  Synthetic oligonucleotide; AGG chr11 5306992 5307011 5306995 -
atgttttgagataagagttt

SEQ ID NO: 39356 - DNA, 20 bp, Artificial Sequence
  Synthetic oligonucleotide; GGG chr11 5306991 5307010 5306994 -
tgttttgagataagagttta

SEQ ID NO: 39357 - DNA, 20 bp, Artificial Sequence
  Synthetic oligonucleotide; TAG chr11 5306988 5307007 5306991 -
tttgagataagagtttaggg

SEQ ID NO: 39358 - DNA, 20 bp, Artificial Sequence
  Synthetic oligonucleotide; GAG chr11 5306986 5307005 5306989 -
tgagataagagtttagggta

SEQ ID NO: 39359 - DNA, 20 bp, Artificial Sequence
  Synthetic oligonucleotide; TAG chr11 5306964 5306983 5306967 -
gttgtgtatctgcacgatct

SEQ ID NO: 39360 - DNA, 20 bp, Artificial Sequence
  Synthetic oligonucleotide; TAG chr11 5306951 5306970 5306954 -
acgatcttagactacttaaa

SEQ ID NO: 39361 - DNA, 20 bp, Artificial Sequence
  Synthetic oligonucleotide; CAG chr11 5306943 5306962 5306946 -
agactacttaaatagaaact

SEQ ID NO: 39362 - DNA, 20 bp, Artificial Sequence
  Synthetic oligonucleotide; AAG chr11 5306922 5306941 5306925 -
agcacataatccaatgaaaa

SEQ ID NO: 39363 - DNA, 20 bp, Artificial Sequence
  Synthetic oligonucleotide; GAG chr11 5306920 5306939 5306923 -
cacataatccaatgaaaaaa

SEQ ID NO: 39364 - DNA, 20 bp, Artificial Sequence
  Synthetic oligonucleotide; CAG chr11 5306913 5306932 5306916 -
tccaatgaaaaaagagattt

SEQ ID NO: 39365 - DNA, 20 bp, Artificial Sequence
  Synthetic oligonucleotide; TGG chr11 5306908 5306927 5306911 -
tgaaaaaagagatttcagaa

SEQ ID NO: 39366 - DNA, 20 bp, Artificial Sequence
  Synthetic oligonucleotide; GGG chr11 5306907 5306926 5306910 -
gaaaaaagagatttcagaat

SEQ ID NO: 39367 - DNA, 20 bp, Artificial Sequence
  Synthetic oligonucleotide; TGG chr11 5306887 5306906 5306890 -
gggactaatatgacaacatc

SEQ ID NO: 39368 - DNA, 20 bp, Artificial Sequence
  Synthetic oligonucleotide; AAG chr11 5306869 5306888 5306872 -
tctggattattatgttcaat

SEQ ID NO: 39369 - DNA, 20 bp, Artificial Sequence
  Synthetic oligonucleotide; AGG chr11 5306868 5306887 5306871 -
ctggattattatgttcaata

SEQ ID NO: 39370 - DNA, 20 bp, Artificial Sequence
  Synthetic oligonucleotide; TGG chr11 5306865 5306884 5306868 -
gattattatgttcaataagg

SEQ ID NO: 39371 - DNA, 20 bp, Artificial Sequence
  Synthetic oligonucleotide; GAG chr11 5306863 5306882 5306866 -
ttattatgttcaataaggtg

SEQ ID NO: 39372 - DNA, 20 bp, Artificial Sequence
  Synthetic oligonucleotide; TAG chr11 5306855 5306874 5306858 -
ttcaataaggtggagcatca

SEQ ID NO: 39373 - DNA, 20 bp, Artificial Sequence
  Synthetic oligonucleotide; AGG chr11 5306854 5306873 5306857 -
tcaataaggtggagcatcat

SEQ ID NO: 39374 - DNA, 20 bp, Artificial Sequence
  Synthetic oligonucleotide; CAG chr11 5306843 5306862 5306846 -
gagcatcataggaaataaat

SEQ ID NO: 39375 - DNA, 20 bp, Artificial Sequence
  Synthetic oligonucleotide; AGG chr11 5306842 5306861 5306845 -
agcatcataggaaataaatc

SEQ ID NO: 39376 - DNA, 20 bp, Artificial Sequence
  Synthetic oligonucleotide; TAG chr11 5306837 5306856 5306840 -
cataggaaataaatcaggat

SEQ ID NO: 39377 - DNA, 20 bp, Artificial Sequence
  Synthetic oligonucleotide; AGG chr11 5306836 5306855 5306839 -
ataggaaataaatcaggatt

SEQ ID NO: 39378 - DNA, 20 bp, Artificial Sequence
  Synthetic oligonucleotide; AAG chr11 5306810 5306829 5306813 -
aattacatgataaacattta

SEQ ID NO: 39379 - DNA, 20 bp, Artificial Sequence
  Synthetic oligonucleotide; AGG chr11 5306809 5306828 5306812 -
attacatgataaacatttaa

SEQ ID NO: 39380 - DNA, 20 bp, Artificial Sequence
  Synthetic oligonucleotide; TGG chr11 5306795 5306814 5306798 -
atttaaaggactgttgatat

SEQ ID NO: 39381 - DNA, 20 bp, Artificial Sequence
  Synthetic oligonucleotide; CAG chr11 5306783 5306802 5306786 -
gttgatattggttcacccat

SEQ ID NO: 39382 - DNA, 20 bp, Artificial Sequence
  Synthetic oligonucleotide; AGG chr11 5306782 5306801 5306785 -
ttgatattggttcacccatc

SEQ ID NO: 39383 - DNA, 20 bp, Artificial Sequence
  Synthetic oligonucleotide; AAG chr11 5306778 5306797 5306781 -
tattggttcacccatcagga

SEQ ID NO: 39384 - DNA, 20 bp, Artificial Sequence
  Synthetic oligonucleotide; AAG chr11 5306775 5306794 5306778 -
tggttcacccatcaggaaag

SEQ ID NO: 39385 - DNA, 20 bp, Artificial Sequence
  Synthetic oligonucleotide; TAG chr11 5306769 5306788 5306772 -
acccatcaggaaagaagtct

SEQ ID NO: 39386 - DNA, 20 bp, Artificial Sequence
  Synthetic oligonucleotide; AGG chr11 5306768 5306787 5306771 -
cccatcaggaaagaagtctt

SEQ ID NO: 39387 - DNA, 20 bp, Artificial Sequence
  Synthetic oligonucleotide; GGG chr11 5306767 5306786 5306770 -
ccatcaggaaagaagtctta

SEQ ID NO: 39388 - DNA, 20 bp, Artificial Sequence
  Synthetic oligonucleotide; CAG chr11 5306755 5306774 5306758 -
aagtcttagggtttttaatg

SEQ ID NO: 39389 - DNA, 20 bp, Artificial Sequence
  Synthetic oligonucleotide; TAG chr11 5306737 5306756 5306740 -
tgcagatatctttatacatc

SEQ ID NO: 39390 - DNA, 20 bp, Artificial Sequence
  Synthetic oligonucleotide; TGG chr11 5306711 5306730 5306714 -
aaaattatgtatgaatataa

SEQ ID NO: 39391 - DNA, 20 bp, Artificial Sequence
  Synthetic oligonucleotide; TGG chr11 5306700 5306719 5306703 -
tgaatataatggctaatata

SEQ ID NO: 39392 - DNA, 20 bp, Artificial Sequence
  Synthetic oligonucleotide; TGG chr11 5306686 5306705 5306689 -
aatatatggttattttattc

SEQ ID NO: 39393 - DNA, 20 bp, Artificial Sequence
  Synthetic oligonucleotide; GAG chr11 5306684 5306703 5306687 -
tatatggttattttattctg

SEQ ID NO: 39394 - DNA, 20 bp, Artificial Sequence
  Synthetic oligonucleotide; CAG chr11 5306679 5306698 5306682 -
ggttattttattctggagat

SEQ ID NO: 39395 - DNA, 20 bp, Artificial Sequence
  Synthetic oligonucleotide; AAG chr11 5306666 5306685 5306669 -
tggagatcagacctaaatat

SEQ ID NO: 39396 - DNA, 20 bp, Artificial Sequence
  Synthetic oligonucleotide; AGG chr11 5306665 5306684 5306668 -
ggagatcagacctaaatata

SEQ ID NO: 39397 - DNA, 20 bp, Artificial Sequence
  Synthetic oligonucleotide; GAG chr11 5306663 5306682 5306666 -
agatcagacctaaatataag

SEQ ID NO: 39398 - DNA, 20 bp, Artificial Sequence
  Synthetic oligonucleotide; TAG chr11 5306660 5306679 5306663 -
tcagacctaaatataaggag

SEQ ID NO: 39399 - DNA, 20 bp, Artificial Sequence
  Synthetic oligonucleotide; CAG chr11 5306644 5306663 5306647 -
ggagtagatattatatgttt

SEQ ID NO: 39400 - DNA, 20 bp, Artificial Sequence
  Synthetic oligonucleotide; GAG chr11 5306642 5306661 5306645 -
agtagatattatatgtttca

SEQ ID NO: 39401 - DNA, 20 bp, Artificial Sequence
  Synthetic oligonucleotide; AAG chr11 5306639 5306658 5306642 -
agatattatatgtttcagag

SEQ ID NO: 39402 - DNA, 20 bp, Artificial Sequence
  Synthetic oligonucleotide; TAG chr11 5306550 5306569 5306553 -
cctatgcatacatatattga

SEQ ID NO: 39403 - DNA, 20 bp, Artificial Sequence
  Synthetic oligonucleotide; GAG chr11 5306491 5306510 5306494 -
aaacccacatatatatgaat

SEQ ID NO: 39404 - DNA, 20 bp, Artificial Sequence
  Synthetic oligonucleotide; TAG chr11 5306487 5306506 5306490 -
ccacatatatatgaatgaga

SEQ ID NO: 39405 - DNA, 20 bp, Artificial Sequence
  Synthetic oligonucleotide; CAG chr11 5306482 5306501 5306485 -
tatatatgaatgagatagct

SEQ ID NO: 39406 - DNA, 20 bp, Artificial Sequence
  Synthetic oligonucleotide; AGG chr11 5306481 5306500 5306484 -
atatatgaatgagatagctc

SEQ ID NO: 39407 - DNA, 20 bp, Artificial Sequence
  Synthetic oligonucleotide; GGG chr11 5306480 5306499 5306483 -
tatatgaatgagatagctca

SEQ ID NO: 39408 - DNA, 20 bp, Artificial Sequence
  Synthetic oligonucleotide; TAG chr11 5306477 5306496 5306480 -
atgaatgagatagctcaggg

SEQ ID NO: 39409 - DNA, 20 bp, Artificial Sequence
  Synthetic oligonucleotide; AGG chr11 5306476 5306495 5306479 -
tgaatgagatagctcagggt

SEQ ID NO: 39410 - DNA, 20 bp, Artificial Sequence
  Synthetic oligonucleotide; GGG chr11 5306475 5306494 5306478 -
gaatgagatagctcagggta

SEQ ID NO: 39411 - DNA, 20 bp, Artificial Sequence
  Synthetic oligonucleotide; TAG chr11 5306472 5306491 5306475 -
tgagatagctcagggtaggg

SEQ ID NO: 39412 - DNA, 20 bp, Artificial Sequence
  Synthetic oligonucleotide; GAG chr11 5306468 5306487 5306471 -
atagctcagggtagggtagt

SEQ ID NO: 39413 - DNA, 20 bp, Artificial Sequence
  Synthetic oligonucleotide; TAG chr11 5306454 5306473 5306457 -
ggtagtgagttttgaatcaa

SEQ ID NO: 39414 - DNA, 20 bp, Artificial Sequence
  Synthetic oligonucleotide; AAG chr11 5306450 5306469 5306453 -
gtgagttttgaatcaataga

SEQ ID NO: 39415 - DNA, 20 bp, Artificial Sequence
  Synthetic oligonucleotide; AAG chr11 5306418 5306437 5306421 -
atgtctgatgaataatcatc

SEQ ID NO: 39416 - DNA, 20 bp, Artificial Sequence
  Synthetic oligonucleotide; AAG chr11 5306410 5306429 5306413 -
tgaataatcatcaagacgaa

SEQ ID NO: 39417 - DNA, 20 bp, Artificial Sequence
  Synthetic oligonucleotide; AGG chr11 5306409 5306428 5306412 -
gaataatcatcaagacgaaa

SEQ ID NO: 39418 - DNA, 20 bp, Artificial Sequence
  Synthetic oligonucleotide; TGG chr11 5306404 5306423 5306407 -
atcatcaagacgaaaaggtt

SEQ ID NO: 39419 - DNA, 20 bp, Artificial Sequence
  Synthetic oligonucleotide; TGG chr11 5306401 5306420 5306404 -
atcaagacgaaaaggtttgg

SEQ ID NO: 39420 - DNA, 20 bp, Artificial Sequence
  Synthetic oligonucleotide; TGG chr11 5306398 5306417 5306401 -
aagacgaaaaggtttggtgg

SEQ ID NO: 39421 - DNA, 20 bp, Artificial Sequence
  Synthetic oligonucleotide; AAG chr11 5306392 5306411 5306395 -
aaaaggtttggtggtggctc

SEQ ID NO: 39422 - DNA, 20 bp, Artificial Sequence
  Synthetic oligonucleotide; AGG chr11 5306391 5306410 5306394 -
aaaggtttggtggtggctca

SEQ ID NO: 39423 - DNA, 20 bp, Artificial Sequence
  Synthetic oligonucleotide; AAG chr11 5306380 5306399 5306383 -
ggtggctcaaggattttgta

SEQ ID NO: 39424 - DNA, 20 bp, Artificial Sequence
  Synthetic oligonucleotide; AGG chr11 5306379 5306398 5306382 -
gtggctcaaggattttgtaa

SEQ ID NO: 39425 - DNA, 20 bp, Artificial Sequence
  Synthetic oligonucleotide; GGG chr11 5306378 5306397 5306381 -
tggctcaaggattttgtaaa

SEQ ID NO: 39426 - DNA, 20 bp, Artificial Sequence
  Synthetic oligonucleotide; TAG chr11 5306369 5306388 5306372 -
gattttgtaaagggttgaat

SEQ ID NO: 39427 - DNA, 20 bp, Artificial Sequence
  Synthetic oligonucleotide; GAG chr11 5306367 5306386 5306370 -
ttttgtaaagggttgaatta

SEQ ID NO: 39428 - DNA, 20 bp, Artificial Sequence
  Synthetic oligonucleotide; CAG chr11 5306355 5306374 5306358 -
ttgaattagagaatataata

SEQ ID NO: 39429 - DNA, 20 bp, Artificial Sequence
  Synthetic oligonucleotide; AAG chr11 5306346 5306365 5306349 -
agaatataatacagtttgaa

SEQ ID NO: 39430 - DNA, 20 bp, Artificial Sequence
  Synthetic oligonucleotide; AGG chr11 5306345 5306364 5306348 -
gaatataatacagtttgaaa

SEQ ID NO: 39431 - DNA, 20 bp, Artificial Sequence
  Synthetic oligonucleotide; GGG chr11 5306344 5306363 5306347 -
aatataatacagtttgaaaa

SEQ ID NO: 39432 - DNA, 20 bp, Artificial Sequence
  Synthetic oligonucleotide; GGG chr11 5306343 5306362 5306346 -
atataatacagtttgaaaag

SEQ ID NO: 39433 - DNA, 20 bp, Artificial Sequence
  Synthetic oligonucleotide; AAG chr11 5306312 5306331 5306315 -
ttcaaatgttaacatttaca

SEQ ID NO: 39434 - DNA, 20 bp, Artificial Sequence
  Synthetic oligonucleotide; AAG chr11 5306306 5306325 5306309 -
tgttaacatttacaaagaca

SEQ ID NO: 39435 - DNA, 20 bp, Artificial Sequence
  Synthetic oligonucleotide; TGG chr11 5306299 5306318 5306302 -
atttacaaagacaaagtgac

SEQ ID NO: 39436 - DNA, 20 bp, Artificial Sequence
  Synthetic oligonucleotide; AAG chr11 5306284 5306303 5306287 -
gtgactggtcttcccactct

SEQ ID NO: 39437 - DNA, 20 bp, Artificial Sequence
  Synthetic oligonucleotide; TGG chr11 5306276 5306295 5306279 -
tcttcccactctaagaccaa

SEQ ID NO: 39438 - DNA, 20 bp, Artificial Sequence
  Synthetic oligonucleotide; GAG chr11 5306266 5306285 5306269 -
ctaagaccaatggaacactt

SEQ ID NO: 39439 - DNA, 20 bp, Artificial Sequence
  Synthetic oligonucleotide; GAG chr11 5306264 5306283 5306267 -
aagaccaatggaacacttga

SEQ ID NO: 39440 - DNA, 20 bp, Artificial Sequence
  Synthetic oligonucleotide; CGG chr11 5306251 5306270 5306254 -
cacttgagagtgactcattt

SEQ ID NO: 39441 - DNA, 20 bp, Artificial Sequence
  Synthetic oligonucleotide; TAG chr11 5306230 5306249 5306233 -
ggtcatgcctcatctgatgt

SEQ ID NO: 39442 - DNA, 20 bp, Artificial Sequence
  Synthetic oligonucleotide; GAG chr11 5306228 5306247 5306231 -
tcatgcctcatctgatgtta

SEQ ID NO: 39443 - DNA, 20 bp, Artificial Sequence
  Synthetic oligonucleotide; TAG chr11 5306212 5306231 5306215 -
gttagagacacaacttctct

SEQ ID NO: 39444 - DNA, 20 bp, Artificial Sequence
  Synthetic oligonucleotide; GAG chr11 5306210 5306229 5306213 -
tagagacacaacttctctta

SEQ ID NO: 39445 - DNA, 20 bp, Artificial Sequence
  Synthetic oligonucleotide; AAG chr11 5306195 5306214 5306198 -
tcttagagactctccttcca

SEQ ID NO: 39446 - DNA, 20 bp, Artificial Sequence
  Synthetic oligonucleotide; AAG chr11 5306184 5306203 5306187 -
ctccttccaaagaaaaaata

SEQ ID NO: 39447 - DNA, 20 bp, Artificial Sequence
  Synthetic oligonucleotide; AGG chr11 5306183 5306202 5306186 -
tccttccaaagaaaaaataa

SEQ ID NO: 39448 - DNA, 20 bp, Artificial Sequence
  Synthetic oligonucleotide; TGG chr11 5306177 5306196 5306180 -
caaagaaaaaataaaggcca

SEQ ID NO: 39449 - DNA, 20 bp, Artificial Sequence
  Synthetic oligonucleotide; GGG chr11 5306176 5306195 5306179 -
aaagaaaaaataaaggccat

SEQ ID NO: 39450 - DNA, 20 bp, Artificial Sequence
  Synthetic oligonucleotide; GGG chr11 5306175 5306194 5306178 -
aagaaaaaataaaggccatg

SEQ ID NO: 39451 - DNA, 20 bp, Artificial Sequence
  Synthetic oligonucleotide; CAG chr11 5306170 5306189 5306173 -
aaaataaaggccatggggac

SEQ ID NO: 39452 - DNA, 20 bp, Artificial Sequence
  Synthetic oligonucleotide; TGG chr11 5306161 5306180 5306164 -
gccatggggaccagtttcaa

SEQ ID NO: 39453 - DNA, 20 bp, Artificial Sequence
  Synthetic oligonucleotide; CAG chr11 5306156 5306175 5306159 -
ggggaccagtttcaatggcc

SEQ ID NO: 39454 - DNA, 20 bp, Artificial Sequence
  Synthetic oligonucleotide; CAG chr11 5306145 5306164 5306148 -
tcaatggcccagatctttcc

SEQ ID NO: 39455 - DNA, 20 bp, Artificial Sequence
  Synthetic oligonucleotide; AGG chr11 5306144 5306163 5306147 -
caatggcccagatctttccc

SEQ ID NO: 39456 - DNA, 20 bp, Artificial Sequence
  Synthetic oligonucleotide; TGG chr11 5306140 5306159 5306143 -
ggcccagatctttcccaggt

SEQ ID NO: 39457 - DNA, 20 bp, Artificial Sequence
  Synthetic oligonucleotide; GGG chr11 5306139 5306158 5306142 -
gcccagatctttcccaggtt

SEQ ID NO: 39458 - DNA, 20 bp, Artificial Sequence
  Synthetic oligonucleotide; GGG chr11 5306138 5306157 5306141 -
cccagatctttcccaggttg

SEQ ID NO: 39459 - DNA, 20 bp, Artificial Sequence
  Synthetic oligonucleotide; GAG chr11 5306136 5306155 5306139 -
cagatctttcccaggttggg

SEQ ID NO: 39460 - DNA, 20 bp, Artificial Sequence
  Synthetic oligonucleotide; AGG chr11 5306135 5306154 5306138 -
agatctttcccaggttgggg

SEQ ID NO: 39461 - DNA, 20 bp, Artificial Sequence
  Synthetic oligonucleotide; AAG chr11 5306130 5306149 5306133 -
tttcccaggttggggaggaa

SEQ ID NO: 39462 - DNA, 20 bp, Artificial Sequence
  Synthetic oligonucleotide; GAG chr11 5306128 5306147 5306131 -
tcccaggttggggaggaaaa

SEQ ID NO: 39463 - DNA, 20 bp, Artificial Sequence
  Synthetic oligonucleotide; TGG chr11 5306118 5306137 5306121 -
gggaggaaaagagaattatt

SEQ ID NO: 39464 - DNA, 20 bp, Artificial Sequence
  Synthetic oligonucleotide; TGG chr11 5306091 5306110 5306094 -
ctattcccaaatatcctatg

SEQ ID NO: 39465 - DNA, 20 bp, Artificial Sequence
  Synthetic oligonucleotide; GAG chr11 5306084 5306103 5306087 -
caaatatcctatgtggaaat

SEQ ID NO: 39466 - DNA, 20 bp, Artificial Sequence
  Synthetic oligonucleotide; TAG chr11 5306080 5306099 5306083 -
tatcctatgtggaaatgagc

SEQ ID NO: 39467 - DNA, 20 bp, Artificial Sequence
  Synthetic oligonucleotide; GAG chr11 5306066 5306085 5306069 -
atgagctagaataacccctt

SEQ ID NO: 39468 - DNA, 20 bp, Artificial Sequence
  Synthetic oligonucleotide; GAG chr11 5306064 5306083 5306067 -
gagctagaataaccccttga

SEQ ID NO: 39469 - DNA, 20 bp, Artificial Sequence
  Synthetic oligonucleotide; CAG chr11 5306033 5306052 5306036 -
gtaacaaatatatctctcat

SEQ ID NO: 39470 - DNA, 20 bp, Artificial Sequence
  Synthetic oligonucleotide; AAG chr11 5306026 5306045 5306029 -
atatatctctcatcagaatt

SEQ ID NO: 39471 - DNA, 20 bp, Artificial Sequence
  Synthetic oligonucleotide; GAG chr11 5306024 5306043 5306027 -
atatctctcatcagaattaa

SEQ ID NO: 39472 - DNA, 20 bp, Artificial Sequence
  Synthetic oligonucleotide; GAG chr11 5306013 5306032 5306016 -
cagaattaagagtaaatact

SEQ ID NO: 39473 - DNA, 20 bp, Artificial Sequence
  Synthetic oligonucleotide; AGG chr11 5306012 5306031 5306015 -
agaattaagagtaaatactg

SEQ ID NO: 39474 - DNA, 20 bp, Artificial Sequence
  Synthetic oligonucleotide; TAG chr11 5306006 5306025 5306009 -
aagagtaaatactgaggata

SEQ ID NO: 39475 - DNA, 20 bp, Artificial Sequence
  Synthetic oligonucleotide; CAG chr11 5305988 5306007 5305991 -
tatagcaaacaaccaatatt

SEQ ID NO: 39476 - DNA, 20 bp, Artificial Sequence
  Synthetic oligonucleotide; AGG chr11 5305987 5306006 5305990 -
atagcaaacaaccaatattc

SEQ ID NO: 39477 - DNA, 20 bp, Artificial Sequence
  Synthetic oligonucleotide; CAG chr11 5305977 5305996 5305980 -
accaatattcaggtcatgct

SEQ ID NO: 39478 - DNA, 20 bp, Artificial Sequence
  Synthetic oligonucleotide; AAG chr11 5305966 5305985 5305969 -
ggtcatgctcagaaaccgca

SEQ ID NO: 39479 - DNA, 20 bp, Artificial Sequence
  Synthetic oligonucleotide; GAG chr11 5305964 5305983 5305967 -
tcatgctcagaaaccgcaaa

SEQ ID NO: 39480 - DNA, 20 bp, Artificial Sequence
  Synthetic oligonucleotide; TGG chr11 5305954 5305973 5305957 -
aaaccgcaaagagaaaactg

SEQ ID NO: 39481 - DNA, 20 bp, Artificial Sequence
  Synthetic oligonucleotide; CAG chr11 5305949 5305968 5305952 -
gcaaagagaaaactgtggct

SEQ ID NO: 39482 - DNA, 20 bp, Artificial Sequence
  Synthetic oligonucleotide; AGG chr11 5305948 5305967 5305951 -
caaagagaaaactgtggctc

SEQ ID NO: 39483 - DNA, 20 bp, Artificial Sequence
  Synthetic oligonucleotide; AAG chr11 5305944 5305963 5305947 -
gagaaaactgtggctcaggt

SEQ ID NO: 39484 - DNA, 20 bp, Artificial Sequence
  Synthetic oligonucleotide; AAG chr11 5305939 5305958 5305942 -
aactgtggctcaggtaagaa

SEQ ID NO: 39485 - DNA, 20 bp, Artificial Sequence
  Synthetic oligonucleotide; AAG chr11 5305934 5305953 5305937 -
tggctcaggtaagaaaagcc

SEQ ID NO: 39486 - DNA, 20 bp, Artificial Sequence
  Synthetic oligonucleotide; AGG chr11 5305933 5305952 5305936 -
ggctcaggtaagaaaagcca

SEQ ID NO: 39487 - DNA, 20 bp, Artificial Sequence
  Synthetic oligonucleotide; CGG chr11 5305921 5305940 5305924 -
aaaagccaaggattcaaata

SEQ ID NO: 39488 - DNA, 20 bp, Artificial Sequence
  Synthetic oligonucleotide; GGG chr11 5305920 5305939 5305923 -
aaagccaaggattcaaatac

SEQ ID NO: 39489 - DNA, 20 bp, Artificial Sequence
  Synthetic oligonucleotide; AAG chr11 5305917 5305936 5305920 -
gccaaggattcaaatacggg

SEQ ID NO: 39490 - DNA, 20 bp, Artificial Sequence
  Synthetic oligonucleotide; AAG chr11 5305913 5305932 5305916 -
aggattcaaatacgggaagc

SEQ ID NO: 39491 - DNA, 20 bp, Artificial Sequence
  Synthetic oligonucleotide; TGG chr11 5305891 5305910 5305894 -
gtttaaccatttccatttga

SEQ ID NO: 39492 - DNA, 20 bp, Artificial Sequence
  Synthetic oligonucleotide; TGG chr11 5305884 5305903 5305887 -
catttccatttgatggacat

SEQ ID NO: 39493 - DNA, 20 bp, Artificial Sequence
  Synthetic oligonucleotide; GAG chr11 5305879 5305898 5305882 -
ccatttgatggacattggtt

SEQ ID NO: 39494 - DNA, 20 bp, Artificial Sequence
  Synthetic oligonucleotide; GAG chr11 5305871 5305890 5305874 -
tggacattggttgagaatat

SEQ ID NO: 39495 - DNA, 20 bp, Artificial Sequence
  Synthetic oligonucleotide; TGG chr11 5305866 5305885 5305869 -
attggttgagaatatgagct

SEQ ID NO: 39496 - DNA, 20 bp, Artificial Sequence
  Synthetic oligonucleotide; GGG chr11 5305865 5305884 5305868 -
ttggttgagaatatgagctt

SEQ ID NO: 39497 - DNA, 20 bp, Artificial Sequence
  Synthetic oligonucleotide; TGG chr11 5305859 5305878 5305862 -
gagaatatgagcttgggttt

SEQ ID NO: 39498 - DNA, 20 bp, Artificial Sequence
  Synthetic oligonucleotide; GGG chr11 5305858 5305877 5305861 -
agaatatgagcttgggtttt

SEQ ID NO: 39499 - DNA, 20 bp, Artificial Sequence
  Synthetic oligonucleotide; TAG chr11 5305854 5305873 5305857 -
tatgagcttgggttttgggt

SEQ ID NO: 39500 - DNA, 20 bp, Artificial Sequence
  Synthetic oligonucleotide; TAG chr11 5305816 5305835 5305819 -
aattcctttatgacacatat

SEQ ID NO: 39501 - DNA, 20 bp, Artificial Sequence
  Synthetic oligonucleotide; TAG chr11 5305802 5305821 5305805 -
acatattagttgcgtgatct

SEQ ID NO: 39502 - DNA, 20 bp, Artificial Sequence
  Synthetic oligonucleotide; AGG chr11 5305801 5305820 5305804 -
catattagttgcgtgatctt

SEQ ID NO: 39503 - DNA, 20 bp, Artificial Sequence
  Synthetic oligonucleotide; AAG chr11 5305779 5305798 5305782 -
gctaattgcttaacttgtct

SEQ ID NO: 39504 - DNA, 20 bp, Artificial Sequence
  Synthetic oligonucleotide; AGG chr11 5305778 5305797 5305781 -
ctaattgcttaacttgtcta

SEQ ID NO: 39505 - DNA, 20 bp, Artificial Sequence
  Synthetic oligonucleotide; CAG chr11 5305681 5305700 5305684 -
ttttctctctctctctttaa

SEQ ID NO: 39506 - DNA, 20 bp, Artificial Sequence
  Synthetic oligonucleotide; CAG chr11 5305662 5305681 5305665 -
acagatttttctctgttgcc

SEQ ID NO: 39507 - DNA, 20 bp, Artificial Sequence
  Synthetic oligonucleotide; AGG chr11 5305661 5305680 5305664 -
cagatttttctctgttgccc

SEQ ID NO: 39508 - DNA, 20 bp, Artificial Sequence
  Synthetic oligonucleotide; TAG chr11 5305657 5305676 5305660 -
tttttctctgttgcccaggc

SEQ ID NO: 39509 - DNA, 20 bp, Artificial Sequence
  Synthetic oligonucleotide; GAG chr11 5305655 5305674 5305658 -
tttctctgttgcccaggcta

SEQ ID NO: 39510 - DNA, 20 bp, Artificial Sequence
  Synthetic oligonucleotide; CAG chr11 5305650 5305669 5305653 -
ctgttgcccaggctagagtg

SEQ ID NO: 39511 - DNA, 20 bp, Artificial Sequence
  Synthetic oligonucleotide; TGG chr11 5305647 5305666 5305650 -
ttgcccaggctagagtgcag

SEQ ID NO: 39512 - DNA, 20 bp, Artificial Sequence
  Synthetic oligonucleotide; CAG chr11 5305636 5305655 5305639 -
agagtgcagtggtgcgatct

SEQ ID NO: 39513 - DNA, 20 bp, Artificial Sequence
  Synthetic oligonucleotide; CAG chr11 5305613 5305632 5305616 -
ctcactgcgacctcctccac

SEQ ID NO: 39514 - DNA, 20 bp, Artificial Sequence
  Synthetic oligonucleotide; AGG chr11 5305612 5305631 5305615 -
tcactgcgacctcctccacc

SEQ ID NO: 39515 - DNA, 20 bp, Artificial Sequence
  Synthetic oligonucleotide; GGG chr11 5305611 5305630 5305614 -
cactgcgacctcctccacca

SEQ ID NO: 39516 - DNA, 20 bp, Artificial Sequence
  Synthetic oligonucleotide; CAG chr11 5305606 5305625 5305609 -
cgacctcctccaccagggtt

SEQ ID NO: 39517 - DNA, 20 bp, Artificial Sequence
  Synthetic oligonucleotide; AGG chr11 5305605 5305624 5305608 -
gacctcctccaccagggttc

SEQ ID NO: 39518 - DNA, 20 bp, Artificial Sequence
  Synthetic oligonucleotide; GGG chr11 5305604 5305623 5305607 -
acctcctccaccagggttca

SEQ ID NO: 39519 - DNA, 20 bp, Artificial Sequence
  Synthetic oligonucleotide; GGG chr11 5305603 5305622 5305606 -
cctcctccaccagggttcag

SEQ ID NO: 39520 - DNA, 20 bp, Artificial Sequence
  Synthetic oligonucleotide; CAG chr11 5305588 5305607 5305591 -
ttcaggggattctcatgcct

SEQ ID NO: 39521 - DNA, 20 bp, Artificial Sequence
  Synthetic oligonucleotide; CAG chr11 5305581 5305600 5305584 -
gattctcatgcctcagcctc

SEQ ID NO: 39522 - DNA, 20 bp, Artificial Sequence
  Synthetic oligonucleotide; GAG chr11 5305579 5305598 5305582 -
ttctcatgcctcagcctcca

SEQ ID NO: 39523 - DNA, 20 bp, Artificial Sequence
  Synthetic oligonucleotide; TAG chr11 5305576 5305595 5305579 -
tcatgcctcagcctccagag

SEQ ID NO: 39524 - DNA, 20 bp, Artificial Sequence
  Synthetic oligonucleotide; TGG chr11 5305572 5305591 5305575 -
gcctcagcctccagagtagc

SEQ ID NO: 39525 - DNA, 20 bp, Artificial Sequence
  Synthetic oligonucleotide; GGG chr11 5305571 5305590 5305574 -
cctcagcctccagagtagct

SEQ ID NO: 39526 - DNA, 20 bp, Artificial Sequence
  Synthetic oligonucleotide; TGG chr11 5305544 5305563 5305547 -
tgatcatgtgccaccacacc

SEQ ID NO: 39527 - DNA, 20 bp, Artificial Sequence
  Synthetic oligonucleotide; TAG chr11 5305525 5305544 5305528 -
ctggcttatttttgtaatta

SEQ ID NO: 39528 - DNA, 20 bp, Artificial Sequence
  Synthetic oligonucleotide; TAG chr11 5305522 5305541 5305525 -
gcttatttttgtaattatag

SEQ ID NO: 39529 - DNA, 20 bp, Artificial Sequence
  Synthetic oligonucleotide; TGG chr11 5305516 5305535 5305519 -
ttttgtaattatagtagtga

SEQ ID NO: 39530 - DNA, 20 bp, Artificial Sequence
  Synthetic oligonucleotide; TGG chr11 5305500 5305519 5305503 -
gtgatggtgttttgccatgt

SEQ ID NO: 39531 - DNA, 20 bp, Artificial Sequence
  Synthetic oligonucleotide; CAG chr11 5305495 5305514 5305498 -
ggtgttttgccatgttggcc

SEQ ID NO: 39532 - DNA, 20 bp, Artificial Sequence
  Synthetic oligonucleotide; TGG chr11 5305491 5305510 5305494 -
ttttgccatgttggcccagc

SEQ ID NO: 39533 - DNA, 20 bp, Artificial Sequence
  Synthetic oligonucleotide; AAG chr11 5305470 5305489 5305473 -
ggtctcgaactcctgaactc

SEQ ID NO: 39534 - DNA, 20 bp, Artificial Sequence
  Synthetic oligonucleotide; CGG chr11 5305453 5305472 5305456 -
ctcaagtgatccaccctcct

SEQ ID NO: 39535 - DNA, 20 bp, Artificial Sequence
  Synthetic oligonucleotide; AAG chr11 5305443 5305462 5305446 -
ccaccctcctcggcctccca

SEQ ID NO: 39536 - DNA, 20 bp, Artificial Sequence
  Synthetic oligonucleotide; TGG chr11 5305437 5305456 5305440 -
tcctcggcctcccaaagtgc

SEQ ID NO: 39537 - DNA, 20 bp, Artificial Sequence
  Synthetic oligonucleotide; GGG chr11 5305436 5305455 5305439 -
cctcggcctcccaaagtgct

SEQ ID NO: 39538 - DNA, 20 bp, Artificial Sequence
  Synthetic oligonucleotide; TAG chr11 5305429 5305448 5305432 -
ctcccaaagtgctgggatta

SEQ ID NO: 39539 - DNA, 20 bp, Artificial Sequence
  Synthetic oligonucleotide; AGG chr11 5305428 5305447 5305431 -
tcccaaagtgctgggattat

SEQ ID NO: 39540 - DNA, 20 bp, Artificial Sequence
  Synthetic oligonucleotide; GAG chr11 5305422 5305441 5305425 -
agtgctgggattataggcat

SEQ ID NO: 39541 - DNA, 20 bp, Artificial Sequence
  Synthetic oligonucleotide; CAG chr11 5305409 5305428 5305412 -
taggcatgagccaccgtgcc

SEQ ID NO: 39542 - DNA, 20 bp, Artificial Sequence
  Synthetic oligonucleotide; CAG chr11 5305380 5305399 5305383 -
tttactcactttttgtctca

SEQ ID NO: 39543 - DNA, 20 bp, Artificial Sequence
  Synthetic oligonucleotide; TAG chr11 5305373 5305392 5305376 -
actttttgtctcacagtcat

SEQ ID NO: 39544 - DNA, 20 bp, Artificial Sequence
  Synthetic oligonucleotide; AGG chr11 5305372 5305391 5305375 -
ctttttgtctcacagtcatt

SEQ ID NO: 39545 - DNA, 20 bp, Artificial Sequence
  Synthetic oligonucleotide; AAG chr11 5305328 5305347 5305331 -
tgaaattgtcaatattacca

SEQ ID NO: 39546 - DNA, 20 bp, Artificial Sequence
  Synthetic oligonucleotide; TAG chr11 5305322 5305341 5305325 -
tgtcaatattaccaaagacc

SEQ ID NO: 39547 - DNA, 20 bp, Artificial Sequence
  Synthetic oligonucleotide; TAG chr11 5305247 5305266 5305250 -
ttttcactattaacctacca

SEQ ID NO: 39548 - DNA, 20 bp, Artificial Sequence
  Synthetic oligonucleotide; CAG chr11 5305199 5305218 5305202 -
tcattgtttttttgtaaata

SEQ ID NO: 39549 - DNA, 20 bp, Artificial Sequence
  Synthetic oligonucleotide; GAG chr11 5305143 5305162 5305146 -
cttctttgtctatctccttt

SEQ ID NO: 39550 - DNA, 20 bp, Artificial Sequence
  Synthetic oligonucleotide; GAG chr11 5305125 5305144 5305128 -
ttgagatctttctttttact

SEQ ID NO: 39551 - DNA, 20 bp, Artificial Sequence
  Synthetic oligonucleotide; GAG chr11 5305123 5305142 5305126 -
gagatctttctttttactga

SEQ ID NO: 39552 - DNA, 20 bp, Artificial Sequence
  Synthetic oligonucleotide; TAG chr11 5305108 5305127 5305111 -
actgagagcaaaatttgtcc

SEQ ID NO: 39553 - DNA, 20 bp, Artificial Sequence
  Synthetic oligonucleotide; GAG chr11 5305063 5305082 5305066 -
cctttttttttttttttttt

SEQ ID NO: 39554 - DNA, 20 bp, Artificial Sequence
  Synthetic oligonucleotide; CAG chr11 5305059 5305078 5305062 -
ttttttttttttttttgaga

SEQ ID NO: 39555 - DNA, 20 bp, Artificial Sequence
  Synthetic oligonucleotide; GAG chr11 5305057 5305076 5305060 -
ttttttttttttttgagaca

SEQ ID NO: 39556 - DNA, 20 bp, Artificial Sequence
  Synthetic oligonucleotide; CAG chr11 5305039 5305058 5305042 -
cagagccttgctttgtcgcc

SEQ ID NO: 39557 - DNA, 20 bp, Artificial Sequence
  Synthetic oligonucleotide; AGG chr11 5305038 5305057 5305041 -
agagccttgctttgtcgccc

SEQ ID NO: 39558 - DNA, 20 bp, Artificial Sequence
  Synthetic oligonucleotide; TAG chr11 5305032 5305051 5305035 -
ttgctttgtcgcccaggctg

SEQ ID NO: 39559 - DNA, 20 bp, Artificial Sequence
  Synthetic oligonucleotide; CAG chr11 5305027 5305046 5305030 -
ttgtcgcccaggctgtagtg

SEQ ID NO: 39560 - DNA, 20 bp, Artificial Sequence
  Synthetic oligonucleotide; TGG chr11 5305024 5305043 5305027 -
tcgcccaggctgtagtgcag

SEQ ID NO: 39561 - DNA, 20 bp, Artificial Sequence
  Synthetic oligonucleotide; TGG chr11 5305013 5305032 5305016 -
gtagtgcagtggcacaatct

SEQ ID NO: 39562 - DNA, 20 bp, Artificial Sequence
  Synthetic oligonucleotide; CAG chr11 5304986 5305005 5304989 -
ctgcgacgacctctgctccc

SEQ ID NO: 39563 - DNA, 20 bp, Artificial Sequence
  Synthetic oligonucleotide; AAG chr11 5304975 5304994 5304978 -
tctgctccccagttttttta

SEQ ID NO: 39564 - DNA, 20 bp, Artificial Sequence
  Synthetic oligonucleotide; CAG chr11 5304958 5304977 5304961 -
ttaaagcaattctcctgcct

SEQ ID NO: 39565 - DNA, 20 bp, Artificial Sequence
  Synthetic oligonucleotide; GAG chr11 5304949 5304968 5304952 -
ttctcctgcctcagcctccc

SEQ ID NO: 39566 - DNA, 20 bp, Artificial Sequence
  Synthetic oligonucleotide; TAG chr11 5304946 5304965 5304949 -
tcctgcctcagcctcccgag

SEQ ID NO: 39567 - DNA, 20 bp, Artificial Sequence
  Synthetic oligonucleotide; TGG chr11 5304942 5304961 5304945 -
gcctcagcctcccgagtagc

SEQ ID NO: 39568 - DNA, 20 bp, Artificial Sequence
  Synthetic oligonucleotide; GGG chr11 5304941 5304960 5304944 -
cctcagcctcccgagtagct

SEQ ID NO: 39569 - DNA, 20 bp, Artificial Sequence
  Synthetic oligonucleotide; CAG chr11 5304934 5304953 5304937 -
ctcccgagtagctgggatta

SEQ ID NO: 39570 - DNA, 20 bp, Artificial Sequence
  Synthetic oligonucleotide; AGG chr11 5304933 5304952 5304936 -
tcccgagtagctgggattac

SEQ ID NO: 39571 - DNA, 20 bp, Artificial Sequence
  Synthetic oligonucleotide; CAG chr11 5304914 5304933 5304917 -
caggcgctcaccaccacacc

SEQ ID NO: 39572 - DNA, 20 bp, Artificial Sequence
  Synthetic oligonucleotide; TAG chr11 5304895 5304914 5304898 -
ccagctaatttttgtatttt

SEQ ID NO: 39573 - DNA, 20 bp, Artificial Sequence
  Synthetic oligonucleotide; TAG chr11 5304892 5304911 5304895 -
gctaatttttgtatttttag

SEQ ID NO: 39574 - DNA, 20 bp, Artificial Sequence
  Synthetic oligonucleotide; GAG chr11 5304890 5304909 5304893 -
taatttttgtatttttagta

SEQ ID NO: 39575 - DNA, 20 bp, Artificial Sequence
  Synthetic oligonucleotide; CAG chr11 5304886 5304905 5304889 -
ttttgtatttttagtagaga

SEQ ID NO: 39576 - DNA, 20 bp, Artificial Sequence
  Synthetic oligonucleotide; AGG chr11 5304885 5304904 5304888 -
tttgtatttttagtagagac

SEQ ID NO: 39577 - DNA, 20 bp, Artificial Sequence
  Synthetic oligonucleotide; GGG chr11 5304884 5304903 5304887 -
ttgtatttttagtagagaca

SEQ ID NO: 39578 - DNA, 20 bp, Artificial Sequence
  Synthetic oligonucleotide; TGG chr11 5304870 5304889 5304873 -
gagacagggtttcaccatgt

SEQ ID NO: 39579 - DNA, 20 bp, Artificial Sequence
  Synthetic oligonucleotide; CAG chr11 5304866 5304885 5304869 -
cagggtttcaccatgttggc

SEQ ID NO: 39580 - DNA, 20 bp, Artificial Sequence
  Synthetic oligonucleotide; AGG chr11 5304865 5304884 5304868 -
agggtttcaccatgttggcc

SEQ ID NO: 39581 - DNA, 20 bp, Artificial Sequence
  Synthetic oligonucleotide; TAG chr11 5304861 5304880 5304864 -
tttcaccatgttggccaggc

SEQ ID NO: 39582 - DNA, 20 bp, Artificial Sequence
  Synthetic oligonucleotide; CAG chr11 5304829 5304848 5304832 -
gctgacctcgtgatccacct

SEQ ID NO: 39583 - DNA, 20 bp, Artificial Sequence
  Synthetic oligonucleotide; AAG chr11 5304819 5304838 5304822 -
tgatccacctcagccttcca

SEQ ID NO: 39584 - DNA, 20 bp, Artificial Sequence
  Synthetic oligonucleotide; TAG chr11 5304813 5304832 5304816 -
acctcagccttccaaagtgc

SEQ ID NO: 39585 - DNA, 20 bp, Artificial Sequence
  Synthetic oligonucleotide; AGG chr11 5304812 5304831 5304815 -
cctcagccttccaaagtgct

SEQ ID NO: 39586 - DNA, 20 bp, Artificial Sequence
  Synthetic oligonucleotide; CAG chr11 5304805 5304824 5304808 -
cttccaaagtgctaggatta

SEQ ID NO: 39587 - DNA, 20 bp, Artificial Sequence
  Synthetic oligonucleotide; AGG chr11 5304804 5304823 5304807 -
ttccaaagtgctaggattac

SEQ ID NO: 39588 - DNA, 20 bp, Artificial Sequence
  Synthetic oligonucleotide; GAG chr11 5304798 5304817 5304801 -
agtgctaggattacaggcat

SEQ ID NO: 39589 - DNA, 20 bp, Artificial Sequence
  Synthetic oligonucleotide; TGG chr11 5304785 5304804 5304788 -
caggcatgagcctctgtgcc

SEQ ID NO: 39590 - DNA, 20 bp, Artificial Sequence
  Synthetic oligonucleotide; AAG chr11 5304755 5304774 5304758 -
ttccattttaatttgtactt

SEQ ID NO: 39591 - DNA, 20 bp, Artificial Sequence
  Synthetic oligonucleotide; AGG chr11 5304754 5304773 5304757 -
tccattttaatttgtactta

SEQ ID NO: 39592 - DNA, 20 bp, Artificial Sequence
  Synthetic oligonucleotide; AAG chr11 5304750 5304769 5304753 -
ttttaatttgtacttaaggt

SEQ ID NO: 39593 - DNA, 20 bp, Artificial Sequence
  Synthetic oligonucleotide; AAG chr11 5304739 5304758 5304742 -
acttaaggtaagatataaaa

SEQ ID NO: 39594 - DNA, 20 bp, Artificial Sequence
  Synthetic oligonucleotide; AAG chr11 5304728 5304747 5304731 -
gatataaaaaagtcacttaa

SEQ ID NO: 39595 - DNA, 20 bp, Artificial Sequence
  Synthetic oligonucleotide; GAG chr11 5304723 5304742 5304726 -
aaaaaagtcacttaaaagct

SEQ ID NO: 39596 - DNA, 20 bp, Artificial Sequence
  Synthetic oligonucleotide; CAG chr11 5304714 5304733 5304717 -
acttaaaagctgagattttt

SEQ ID NO: 39597 - DNA, 20 bp, Artificial Sequence
  Synthetic oligonucleotide; TGG chr11 5304692 5304711 5304695 -
gatattttgtcttcatctca

SEQ ID NO: 39598 - DNA, 20 bp, Artificial Sequence
  Synthetic oligonucleotide; CAG chr11 5304678 5304697 5304681 -
atctcatggcttcccattgt

SEQ ID NO: 39599 - DNA, 20 bp, Artificial Sequence
  Synthetic oligonucleotide; TGG chr11 5304655 5304674 5304658 -
ttgactttaaatatttattt

SEQ ID NO: 39600 - DNA, 20 bp, Artificial Sequence
  Synthetic oligonucleotide; TAG chr11 5304631 5304650 5304634 -
atatttattaatttcttcta

SEQ ID NO: 39601 - DNA, 20 bp, Artificial Sequence
  Synthetic oligonucleotide; AGG chr11 5304630 5304649 5304633 -
tatttattaatttcttctat

SEQ ID NO: 39602 - DNA, 20 bp, Artificial Sequence
  Synthetic oligonucleotide; TGG chr11 5304617 5304636 5304620 -
cttctataggaacacaattt

SEQ ID NO: 39603 - DNA, 20 bp, Artificial Sequence
  Synthetic oligonucleotide; GGG chr11 5304616 5304635 5304619 -
ttctataggaacacaatttt

SEQ ID NO: 39604 - DNA, 20 bp, Artificial Sequence
  Synthetic oligonucleotide; GGG chr11 5304615 5304634 5304618 -
tctataggaacacaattttg

SEQ ID NO: 39605 - DNA, 20 bp, Artificial Sequence
  Synthetic oligonucleotide; TGG chr11 5304605 5304624 5304608 -
cacaattttggggcaatatg

SEQ ID NO: 39606 - DNA, 20 bp, Artificial Sequence
  Synthetic oligonucleotide; GAG chr11 5304603 5304622 5304606 -
caattttggggcaatatgtg

SEQ ID NO: 39607 - DNA, 20 bp, Artificial Sequence
  Synthetic oligonucleotide; AAG chr11 5304594 5304613 5304597 -
ggcaatatgtggagatgaaa

SEQ ID NO: 39608 - DNA, 20 bp, Artificial Sequence
  Synthetic oligonucleotide; TGG chr11 5304591 5304610 5304594 -
aatatgtggagatgaaaaag

SEQ ID NO: 39609 - DNA, 20 bp, Artificial Sequence
  Synthetic oligonucleotide; CAG chr11 5304585 5304604 5304588 -
tggagatgaaaaagtggatt

SEQ ID NO: 39610 - DNA, 20 bp, Artificial Sequence
  Synthetic oligonucleotide; AGG chr11 5304584 5304603 5304587 -
ggagatgaaaaagtggattc

SEQ ID NO: 39611 - DNA, 20 bp, Artificial Sequence
  Synthetic oligonucleotide; GGG chr11 5304583 5304602 5304586 -
gagatgaaaaagtggattca

SEQ ID NO: 39612 - DNA, 20 bp, Artificial Sequence
  Synthetic oligonucleotide; GGG chr11 5304582 5304601 5304585 -
agatgaaaaagtggattcag

SEQ ID NO: 39613 - DNA, 20 bp, Artificial Sequence
  Synthetic oligonucleotide; CAG chr11 5304567 5304586 5304570 -
ttcaggggacactgattgta

SEQ ID NO: 39614 - DNA, 20 bp, Artificial Sequence
  Synthetic oligonucleotide; AGG chr11 5304566 5304585 5304569 -
tcaggggacactgattgtac

SEQ ID NO: 39615 - DNA, 20 bp, Artificial Sequence
  Synthetic oligonucleotide; GGG chr11 5304565 5304584 5304568 -
caggggacactgattgtaca

SEQ ID NO: 39616 - DNA, 20 bp, Artificial Sequence
  Synthetic oligonucleotide; CAG chr11 5304556 5304575 5304559 -
ctgattgtacagggcacttg

SEQ ID NO: 39617 - DNA, 20 bp, Artificial Sequence
  Synthetic oligonucleotide; TGG chr11 5304547 5304566 5304550 -
cagggcacttgcagattatc

SEQ ID NO: 39618 - DNA, 20 bp, Artificial Sequence
  Synthetic oligonucleotide; CGG chr11 5304537 5304556 5304540 -
gcagattatctggaactaaa

SEQ ID NO: 39619 - DNA, 20 bp, Artificial Sequence
  Synthetic oligonucleotide; AAG chr11 5304534 5304553 5304537 -
gattatctggaactaaacgg

SEQ ID NO: 39620 - DNA, 20 bp, Artificial Sequence
  Synthetic oligonucleotide; TAG chr11 5304481 5304500 5304484 -
ctctttttgtcttctcattt

SEQ ID NO: 39621 - DNA, 20 bp, Artificial Sequence
  Synthetic oligonucleotide; TGG chr11 5304462 5304481 5304465 -
ttagtttatgtctttataaa

SEQ ID NO: 39622 - DNA, 20 bp, Artificial Sequence
  Synthetic oligonucleotide; CAG chr11 5304450 5304469 5304453 -
tttataaatggtttcctgaa

SEQ ID NO: 39623 - DNA, 20 bp, Artificial Sequence
  Synthetic oligonucleotide; AAG chr11 5304442 5304461 5304445 -
tggtttcctgaacagttcct

SEQ ID NO: 39624 - DNA, 20 bp, Artificial Sequence
  Synthetic oligonucleotide; CAG chr11 5304431 5304450 5304434 -
acagttcctaagctttttgt

SEQ ID NO: 39625 - DNA, 20 bp, Artificial Sequence
  Synthetic oligonucleotide; TGG chr11 5304426 5304445 5304429 -
tcctaagctttttgtcagca

SEQ ID NO: 39626 - DNA, 20 bp, Artificial Sequence
  Synthetic oligonucleotide; AAG chr11 5304422 5304441 5304425 -
aagctttttgtcagcatggc

SEQ ID NO: 39627 - DNA, 20 bp, Artificial Sequence
  Synthetic oligonucleotide; AAG chr11 5304416 5304435 5304419 -
tttgtcagcatggcaagttg

SEQ ID NO: 39628 - DNA, 20 bp, Artificial Sequence
  Synthetic oligonucleotide; AAG chr11 5304413 5304432 5304416 -
gtcagcatggcaagttgaag

SEQ ID NO: 39629 - DNA, 20 bp, Artificial Sequence
  Synthetic oligonucleotide; TGG chr11 5304407 5304426 5304410 -
atggcaagttgaagaagctc

SEQ ID NO: 39630 - DNA, 20 bp, Artificial Sequence
  Synthetic oligonucleotide; TGG chr11 5304400 5304419 5304403 -
gttgaagaagctctggatga

SEQ ID NO: 39631 - DNA, 20 bp, Artificial Sequence
  Synthetic oligonucleotide; CAG chr11 5304383 5304402 5304386 -
tgatggatctatgttacctt

SEQ ID NO: 39632 - DNA, 20 bp, Artificial Sequence
  Synthetic oligonucleotide; GAG chr11 5304372 5304391 5304375 -
tgttaccttcagaaactctt

SEQ ID NO: 39633 - DNA, 20 bp, Artificial Sequence
  Synthetic oligonucleotide; AGG chr11 5304371 5304390 5304374 -
gttaccttcagaaactcttg

SEQ ID NO: 39634 - DNA, 20 bp, Artificial Sequence
  Synthetic oligonucleotide; TGG chr11 5304364 5304383 5304367 -
tcagaaactcttgaggactc

SEQ ID NO: 39635 - DNA, 20 bp, Artificial Sequence
  Synthetic oligonucleotide; GGG chr11 5304363 5304382 5304366 -
cagaaactcttgaggactct

SEQ ID NO: 39636 - DNA, 20 bp, Artificial Sequence
  Synthetic oligonucleotide; TAG chr11 5304359 5304378 5304362 -
aactcttgaggactctggga

SEQ ID NO: 39637 - DNA, 20 bp, Artificial Sequence
  Synthetic oligonucleotide; AAG chr11 5304347 5304366 5304350 -
ctctgggatagttgctgtca

SEQ ID NO: 39638 - DNA, 20 bp, Artificial Sequence
  Synthetic oligonucleotide; CAG chr11 5304341 5304360 5304344 -
gatagttgctgtcaaagaat

SEQ ID NO: 39639 - DNA, 20 bp, Artificial Sequence
  Synthetic oligonucleotide; AAG chr11 5304334 5304353 5304337 -
gctgtcaaagaatcagtcca

SEQ ID NO: 39640 - DNA, 20 bp, Artificial Sequence
  Synthetic oligonucleotide; AGG chr11 5304333 5304352 5304336 -
ctgtcaaagaatcagtccaa

SEQ ID NO: 39641 - DNA, 20 bp, Artificial Sequence
  Synthetic oligonucleotide; CAG chr11 5304326 5304345 5304329 -
agaatcagtccaaaggcact

SEQ ID NO: 39642 - DNA, 20 bp, Artificial Sequence
  Synthetic oligonucleotide; AAG chr11 5304322 5304341 5304325 -
tcagtccaaaggcactcaga

SEQ ID NO: 39643 - DNA, 20 bp, Artificial Sequence
  Synthetic oligonucleotide; AGG chr11 5304321 5304340 5304324 -
cagtccaaaggcactcagaa

SEQ ID NO: 39644 - DNA, 20 bp, Artificial Sequence
  Synthetic oligonucleotide; GGG chr11 5304320 5304339 5304323 -
agtccaaaggcactcagaaa

SEQ ID NO: 39645 - DNA, 20 bp, Artificial Sequence
  Synthetic oligonucleotide; GGG chr11 5304319 5304338 5304322 -
gtccaaaggcactcagaaag

SEQ ID NO: 39646 - DNA, 20 bp, Artificial Sequence
  Synthetic oligonucleotide; AAG chr11 5304315 5304334 5304318 -
aaaggcactcagaaaggggc

SEQ ID NO: 39647 - DNA, 20 bp, Artificial Sequence
  Synthetic oligonucleotide; GAG chr11 5304313 5304332 5304316 -
aggcactcagaaaggggcaa

SEQ ID NO: 39648 - DNA, 20 bp, Artificial Sequence
  Synthetic oligonucleotide; CAG chr11 5304308 5304327 5304311 -
ctcagaaaggggcaagagaa

SEQ ID NO: 39649 - DNA, 20 bp, Artificial Sequence
  Synthetic oligonucleotide; GAG chr11 5304304 5304323 5304307 -
gaaaggggcaagagaacagt

SEQ ID NO: 39650 - DNA, 20 bp, Artificial Sequence
  Synthetic oligonucleotide; CAG chr11 5304300 5304319 5304303 -
ggggcaagagaacagtgagc

SEQ ID NO: 39651 - DNA, 20 bp, Artificial Sequence
  Synthetic oligonucleotide; CAG chr11 5304281 5304300 5304284 -
ccagtcatttttgcatccct

SEQ ID NO: 39652 - DNA, 20 bp, Artificial Sequence
  Synthetic oligonucleotide; AGG chr11 5304280 5304299 5304283 -
cagtcatttttgcatccctc

SEQ ID NO: 39653 - DNA, 20 bp, Artificial Sequence
  Synthetic oligonucleotide; GGG chr11 5304279 5304298 5304282 -
agtcatttttgcatccctca

SEQ ID NO: 39654 - DNA, 20 bp, Artificial Sequence
  Synthetic oligonucleotide; GGG chr11 5304278 5304297 5304281 -
gtcatttttgcatccctcag

SEQ ID NO: 39655 - DNA, 20 bp, Artificial Sequence
  Synthetic oligonucleotide; GGG chr11 5304277 5304296 5304280 -
tcatttttgcatccctcagg

SEQ ID NO: 39656 - DNA, 20 bp, Artificial Sequence
  Synthetic oligonucleotide; GAG chr11 5304259 5304278 5304262 -
gggggcctctatgcttgcct

SEQ ID NO: 39657 - DNA, 20 bp, Artificial Sequence
  Synthetic oligonucleotide; GAG chr11 5304257 5304276 5304260 -
gggcctctatgcttgcctga

SEQ ID NO: 39658 - DNA, 20 bp, Artificial Sequence
  Synthetic oligonucleotide; AAG chr11 5304239 5304258 5304242 -
gagagtgataaattccacta

SEQ ID NO: 39659 - DNA, 20 bp, Artificial Sequence
  Synthetic oligonucleotide; TAG chr11 5304203 5304222 5304206 -
ttttgtcatgtatcacattc

SEQ ID NO: 39660 - DNA, 20 bp, Artificial Sequence
  Synthetic oligonucleotide; AGG chr11 5304202 5304221 5304205 -
tttgtcatgtatcacattct

SEQ ID NO: 39661 - DNA, 20 bp, Artificial Sequence
  Synthetic oligonucleotide; GAG chr11 5304200 5304219 5304203 -
tgtcatgtatcacattctag

SEQ ID NO: 39662 - DNA, 20 bp, Artificial Sequence
  Synthetic oligonucleotide; TAG chr11 5304183 5304202 5304186 -
taggagactccctaaactat

SEQ ID NO: 39663 - DNA, 20 bp, Artificial Sequence
  Synthetic oligonucleotide; AGG chr11 5304182 5304201 5304185 -
aggagactccctaaactatt

SEQ ID NO: 39664 - DNA, 20 bp, Artificial Sequence
  Synthetic oligonucleotide; GGG chr11 5304181 5304200 5304184 -
ggagactccctaaactatta

SEQ ID NO: 39665 - DNA, 20 bp, Artificial Sequence
  Synthetic oligonucleotide; TGG chr11 5304165 5304184 5304168 -
attagggcaactattctccc

SEQ ID NO: 39666 - DNA, 20 bp, Artificial Sequence
  Synthetic oligonucleotide; TGG chr11 5304156 5304175 5304159 -
actattctccctggaatatt

SEQ ID NO: 39667 - DNA, 20 bp, Artificial Sequence
  Synthetic oligonucleotide; GGG chr11 5304155 5304174 5304158 -
ctattctccctggaatattt

SEQ ID NO: 39668 - DNA, 20 bp, Artificial Sequence
  Synthetic oligonucleotide; TGG chr11 5304148 5304167 5304151 -
ccctggaatatttgggtatg

SEQ ID NO: 39669 - DNA, 20 bp, Artificial Sequence
  Synthetic oligonucleotide; CAG chr11 5304144 5304163 5304147 -
ggaatatttgggtatgtgga

SEQ ID NO: 39670 - DNA, 20 bp, Artificial Sequence
  Synthetic oligonucleotide; TGG chr11 5304137 5304156 5304140 -
ttgggtatgtggacagtttc

SEQ ID NO: 39671 - DNA, 20 bp, Artificial Sequence
  Synthetic oligonucleotide; CAG chr11 5304106 5304125 5304109 -
aatttgccacaattaaatgc

SEQ ID NO: 39672 - DNA, 20 bp, Artificial Sequence
  Synthetic oligonucleotide; TAG chr11 5304101 5304120 5304104 -
gccacaattaaatgccagcg

SEQ ID NO: 39673 - DNA, 20 bp, Artificial Sequence
  Synthetic oligonucleotide; TAG chr11 5304089 5304108 5304092 -
tgccagcgtagctgttttgc

SEQ ID NO: 39674 - DNA, 20 bp, Artificial Sequence
  Synthetic oligonucleotide; GAG chr11 5304087 5304106 5304090 -
ccagcgtagctgttttgcta

SEQ ID NO: 39675 - DNA, 20 bp, Artificial Sequence
  Synthetic oligonucleotide; CAG chr11 5304080 5304099 5304083 -
agctgttttgctagagactg

SEQ ID NO: 39676 - DNA, 20 bp, Artificial Sequence
  Synthetic oligonucleotide; TAG chr11 5304069 5304088 5304072 -
tagagactgcagatgttaaa

SEQ ID NO: 39677 - DNA, 20 bp, Artificial Sequence
  Synthetic oligonucleotide; GAG chr11 5304067 5304086 5304070 -
gagactgcagatgttaaata

SEQ ID NO: 39678 - DNA, 20 bp, Artificial Sequence
  Synthetic oligonucleotide; AGG chr11 5304066 5304085 5304069 -
agactgcagatgttaaatag

SEQ ID NO: 39679 - DNA, 20 bp, Artificial Sequence
  Synthetic oligonucleotide; GGG chr11 5304065 5304084 5304068 -
gactgcagatgttaaataga

SEQ ID NO: 39680 - DNA, 20 bp, Artificial Sequence
  Synthetic oligonucleotide; TAG chr11 5304055 5304074 5304058 -
gttaaatagagggctatctt

SEQ ID NO: 39681 - DNA, 20 bp, Artificial Sequence
  Synthetic oligonucleotide; AGG chr11 5304054 5304073 5304057 -
ttaaatagagggctatcttt

SEQ ID NO: 39682 - DNA, 20 bp, Artificial Sequence
  Synthetic oligonucleotide; CAG chr11 5304012 5304031 5304015 -
aattgtattaactatttccc

SEQ ID NO: 39683 - DNA, 20 bp, Artificial Sequence
  Synthetic oligonucleotide; CAG chr11 5303998 5304017 5304001 -
tttccccagtaattaccaca

SEQ ID NO: 39684 - DNA, 20 bp, Artificial Sequence
  Synthetic oligonucleotide; CAG chr11 5303958 5303977 5303961 -
gcatccgcatgtcccaaacg

SEQ ID NO: 39685 - DNA, 20 bp, Artificial Sequence
  Synthetic oligonucleotide; CAG chr11 5303953 5303972 5303956 -
cgcatgtcccaaacgcagct

SEQ ID NO: 39686 - DNA, 20 bp, Artificial Sequence
  Synthetic oligonucleotide; AGG chr11 5303952 5303971 5303955 -
gcatgtcccaaacgcagctc

SEQ ID NO: 39687 - DNA, 20 bp, Artificial Sequence
  Synthetic oligonucleotide; TAG chr11 5303932 5303951 5303935 -
aggttttgaaaacacgacta

SEQ ID NO: 39688 - DNA, 20 bp, Artificial Sequence
  Synthetic oligonucleotide; AAG chr11 5303926 5303945 5303929 -
tgaaaacacgactatagttt

SEQ ID NO: 39689 - DNA, 20 bp, Artificial Sequence
  Synthetic oligonucleotide; CAG chr11 5303917 5303936 5303920 -
gactatagtttaagaataat

SEQ ID NO: 39690 - DNA, 20 bp, Artificial Sequence
  Synthetic oligonucleotide; AGG chr11 5303916 5303935 5303919 -
actatagtttaagaataatc

SEQ ID NO: 39691 - DNA, 20 bp, Artificial Sequence
  Synthetic oligonucleotide; CGG chr11 5303906 5303925 5303909 -
aagaataatcaggcctcctc

SEQ ID NO: 39692 - DNA, 20 bp, Artificial Sequence
  Synthetic oligonucleotide; TGG chr11 5303892 5303911 5303895 -
ctcctccggcttcctccatc

SEQ ID NO: 39693 - DNA, 20 bp, Artificial Sequence
  Synthetic oligonucleotide; TGG chr11 5303880 5303899 5303883 -
cctccatctggtccattatc

SEQ ID NO: 39694 - DNA, 20 bp, Artificial Sequence
  Synthetic oligonucleotide; GGG chr11 5303879 5303898 5303882 -
ctccatctggtccattatct

SEQ ID NO: 39695 - DNA, 20 bp, Artificial Sequence
  Synthetic oligonucleotide; CAG chr11 5303873 5303892 5303876 -
ctggtccattatctgggtga

SEQ ID NO: 39696 - DNA, 20 bp, Artificial Sequence
  Synthetic oligonucleotide; TAG chr11 5303870 5303889 5303873 -
gtccattatctgggtgacag

SEQ ID NO: 39697 - DNA, 20 bp, Artificial Sequence
  Synthetic oligonucleotide; AAG chr11 5303859 5303878 5303862 -
gggtgacagtagatccaaat

SEQ ID NO: 39698 - DNA, 20 bp, Artificial Sequence
  Synthetic oligonucleotide; TGG chr11 5303856 5303875 5303859 -
tgacagtagatccaaataag

SEQ ID NO: 39699 - DNA, 20 bp, Artificial Sequence
  Synthetic oligonucleotide; TAG chr11 5303852 5303871 5303855 -
agtagatccaaataagtggt

SEQ ID NO: 39700 - DNA, 20 bp, Artificial Sequence
  Synthetic oligonucleotide; TGG chr11 5303826 5303845 5303829 -
ttatcctgtacaacaaattt

SEQ ID NO: 39701 - DNA, 20 bp, Artificial Sequence
  Synthetic oligonucleotide; AAG chr11 5303804 5303823 5303807 -
gcattaatccattctcttat

SEQ ID NO: 39702 - DNA, 20 bp, Artificial Sequence
  Synthetic oligonucleotide; AGG chr11 5303803 5303822 5303806 -
cattaatccattctcttata

SEQ ID NO: 39703 - DNA, 20 bp, Artificial Sequence
  Synthetic oligonucleotide; TGG chr11 5303794 5303813 5303797 -
attctcttataaggcaacat

SEQ ID NO: 39704 - DNA, 20 bp, Artificial Sequence
  Synthetic oligonucleotide; AAG chr11 5303791 5303810 5303794 -
ctcttataaggcaacattgg

SEQ ID NO: 39705 - DNA, 20 bp, Artificial Sequence
  Synthetic oligonucleotide; AGG chr11 5303790 5303809 5303793 -
tcttataaggcaacattgga

SEQ ID NO: 39706 - DNA, 20 bp, Artificial Sequence
  Synthetic oligonucleotide; AAG chr11 5303785 5303804 5303788 -
taaggcaacattggaaggtt

SEQ ID NO: 39707 - DNA, 20 bp, Artificial Sequence
  Synthetic oligonucleotide; GAG chr11 5303783 5303802 5303786 -
aggcaacattggaaggttaa

SEQ ID NO: 39708 - DNA, 20 bp, Artificial Sequence
  Synthetic oligonucleotide; TGG chr11 5303751 5303770 5303754 -
tgatatacacatcactcctg

SEQ ID NO: 39709 - DNA, 20 bp, Artificial Sequence
  Synthetic oligonucleotide; CGG chr11 5303748 5303767 5303751 -
tatacacatcactcctgtgg

SEQ ID NO: 39710 - DNA, 20 bp, Artificial Sequence
  Synthetic oligonucleotide; TAG chr11 5303745 5303764 5303748 -
acacatcactcctgtggcgg

SEQ ID NO: 39711 - DNA, 20 bp, Artificial Sequence
  Synthetic oligonucleotide; AAG chr11 5303740 5303759 5303743 -
tcactcctgtggcggtagat

SEQ ID NO: 39712 - DNA, 20 bp, Artificial Sequence
  Synthetic oligonucleotide; AAG chr11 5303725 5303744 5303728 -
tagataagttctgccacatt

SEQ ID NO: 39713 - DNA, 20 bp, Artificial Sequence
  Synthetic oligonucleotide; CAG chr11 5303715 5303734 5303718 -
ctgccacattaagcactatg

SEQ ID NO: 39714 - DNA, 20 bp, Artificial Sequence
  Synthetic oligonucleotide; AGG chr11 5303714 5303733 5303717 -
tgccacattaagcactatgc

SEQ ID NO: 39715 - DNA, 20 bp, Artificial Sequence
  Synthetic oligonucleotide; CAG chr11 5303703 5303722 5303706 -
gcactatgcaggtcataatt

SEQ ID NO: 39716 - DNA, 20 bp, Artificial Sequence
  Synthetic oligonucleotide; TGG chr11 5303700 5303719 5303703 -
ctatgcaggtcataattcag

SEQ ID NO: 39717 - DNA, 20 bp, Artificial Sequence
  Synthetic oligonucleotide; AAG chr11 5303694 5303713 5303697 -
aggtcataattcagtggatc

SEQ ID NO: 39718 - DNA, 20 bp, Artificial Sequence
  Synthetic oligonucleotide; TAG chr11 5303690 5303709 5303693 -
cataattcagtggatcaagt

SEQ ID NO: 39719 - DNA, 20 bp, Artificial Sequence
  Synthetic oligonucleotide; TAG chr11 5303686 5303705 5303689 -
attcagtggatcaagttagt

SEQ ID NO: 39720 - DNA, 20 bp, Artificial Sequence
  Synthetic oligonucleotide; CAG chr11 5303683 5303702 5303686 -
cagtggatcaagttagttag

SEQ ID NO: 39721 - DNA, 20 bp, Artificial Sequence
  Synthetic oligonucleotide; TAG chr11 5303674 5303693 5303677 -
aagttagttagcagtgtttt

SEQ ID NO: 39722 - DNA, 20 bp, Artificial Sequence
  Synthetic oligonucleotide; TAG chr11 5303657 5303676 5303660 -
ttttagtatccatatgaaca

SEQ ID NO: 39723 - DNA, 20 bp, Artificial Sequence
  Synthetic oligonucleotide; CAG chr11 5303642 5303661 5303645 -
gaacatagtctctgctactg

SEQ ID NO: 39724 - DNA, 20 bp, Artificial Sequence
  Synthetic oligonucleotide; TAG chr11 5303635 5303654 5303638 -
gtctctgctactgcagtgcc

SEQ ID NO: 39725 - DNA, 20 bp, Artificial Sequence
  Synthetic oligonucleotide; CAG chr11 5303612 5303631 5303615 -
actgacatttttgttatcaa

SEQ ID NO: 39726 - DNA, 20 bp, Artificial Sequence
  Synthetic oligonucleotide; AAG chr11 5303600 5303619 5303603 -
gttatcaacagtgtcccctg

SEQ ID NO: 39727 - DNA, 20 bp, Artificial Sequence
  Synthetic oligonucleotide; TAG chr11 5303597 5303616 5303600 -
atcaacagtgtcccctgaag

SEQ ID NO: 39728 - DNA, 20 bp, Artificial Sequence
  Synthetic oligonucleotide; CAG chr11 5303594 5303613 5303597 -
aacagtgtcccctgaagtag

SEQ ID NO: 39729 - DNA, 20 bp, Artificial Sequence
  Synthetic oligonucleotide; AAG chr11 5303582 5303601 5303585 -
tgaagtagcagccctttcaa

SEQ ID NO: 39730 - DNA, 20 bp, Artificial Sequence
  Synthetic oligonucleotide; TAG chr11 5303529 5303548 5303532 -
ccaccaataattgcttatat

SEQ ID NO: 39731 - DNA, 20 bp, Artificial Sequence
  Synthetic oligonucleotide; GAG chr11 5303527 5303546 5303530 -
accaataattgcttatatta

SEQ ID NO: 39732 - DNA, 20 bp, Artificial Sequence
  Synthetic oligonucleotide; TAG chr11 5303475 5303494 5303478 -
tataattattattgtttcta

SEQ ID NO: 39733 - DNA, 20 bp, Artificial Sequence
  Synthetic oligonucleotide; AGG chr11 5303474 5303493 5303477 -
ataattattattgtttctat

SEQ ID NO: 39734 - DNA, 20 bp, Artificial Sequence
  Synthetic oligonucleotide; AAG chr11 5303455 5303474 5303458 -
taggtttttataaaataaaa

SEQ ID NO: 39735 - DNA, 20 bp, Artificial Sequence
  Synthetic oligonucleotide; AGG chr11 5303454 5303473 5303457 -
aggtttttataaaataaaaa

SEQ ID NO: 39736 - DNA, 20 bp, Artificial Sequence
  Synthetic oligonucleotide; AAG chr11 5303447 5303466 5303450 -
tataaaataaaaaaggtgca

SEQ ID NO: 39737 - DNA, 20 bp, Artificial Sequence
  Synthetic oligonucleotide; AAG chr11 5303408 5303427 5303411 -
ttttactgaattacacttca

SEQ ID NO: 39738 - DNA, 20 bp, Artificial Sequence
  Synthetic oligonucleotide; AGG chr11 5303407 5303426 5303410 -
tttactgaattacacttcaa

SEQ ID NO: 39739 - DNA, 20 bp, Artificial Sequence
  Synthetic oligonucleotide; CGG chr11 5303401 5303420 5303404 -
gaattacacttcaaaggtgt

SEQ ID NO: 39740 - DNA, 20 bp, Artificial Sequence
  Synthetic oligonucleotide; TAG chr11 5303398 5303417 5303401 -
ttacacttcaaaggtgtcgg

SEQ ID NO: 39741 - DNA, 20 bp, Artificial Sequence
  Synthetic oligonucleotide; AAG chr11 5303365 5303384 5303368 -
aatattgaatgatattttaa

SEQ ID NO: 39742 - DNA, 20 bp, Artificial Sequence
  Synthetic oligonucleotide; TGG chr11 5303358 5303377 5303361 -
aatgatattttaaaagactc

SEQ ID NO: 39743 - DNA, 20 bp, Artificial Sequence
  Synthetic oligonucleotide; CAG chr11 5303348 5303367 5303351 -
taaaagactctggacacata

SEQ ID NO: 39744 - DNA, 20 bp, Artificial Sequence
  Synthetic oligonucleotide; TGG chr11 5303332 5303351 5303335 -
catacagaatcaattgaatt

SEQ ID NO: 39745 - DNA, 20 bp, Artificial Sequence
  Synthetic oligonucleotide; GGG chr11 5303331 5303350 5303334 -
atacagaatcaattgaattt

SEQ ID NO: 39746 - DNA, 20 bp, Artificial Sequence
  Synthetic oligonucleotide; GAG chr11 5303329 5303348 5303332 -
acagaatcaattgaatttgg

SEQ ID NO: 39747 - DNA, 20 bp, Artificial Sequence
  Synthetic oligonucleotide; GAG chr11 5303321 5303340 5303324 -
aattgaatttgggagaaact

SEQ ID NO: 39748 - DNA, 20 bp, Artificial Sequence
  Synthetic oligonucleotide; TAG chr11 5303309 5303328 5303312 -
gagaaactgagtttcccttg

SEQ ID NO: 39749 - DNA, 20 bp, Artificial Sequence
  Synthetic oligonucleotide; TGG chr11 5303267 5303286 5303270 -
aaacctgctacaaaatttct

SEQ ID NO: 39750 - DNA, 20 bp, Artificial Sequence
  Synthetic oligonucleotide; AAG chr11 5303233 5303252 5303236 -
caaaaatcttgactttgtaa

SEQ ID NO: 39751 - DNA, 20 bp, Artificial Sequence
  Synthetic oligonucleotide; TAG chr11 5303195 5303214 5303198 -
aaataaatattaattataaa

SEQ ID NO: 39752 - DNA, 20 bp, Artificial Sequence
  Synthetic oligonucleotide; TAG chr11 5303186 5303205 5303189 -
ttaattataaatagacttca

SEQ ID NO: 39753 - DNA, 20 bp, Artificial Sequence
  Synthetic oligonucleotide; GAG chr11 5303175 5303194 5303178 -
tagacttcatagttccctat

SEQ ID NO: 39754 - DNA, 20 bp, Artificial Sequence
  Synthetic oligonucleotide; AGG chr11 5303174 5303193 5303177 -
agacttcatagttccctatg

SEQ ID NO: 39755 - DNA, 20 bp, Artificial Sequence
  Synthetic oligonucleotide; GAG chr11 5303147 5303166 5303150 -
ttgtgaatttttctcaatac

SEQ ID NO: 39756 - DNA, 20 bp, Artificial Sequence
  Synthetic oligonucleotide; CAG chr11 5303139 5303158 5303142 -
ttttctcaatacgagtctta

SEQ ID NO: 39757 - DNA, 20 bp, Artificial Sequence
  Synthetic oligonucleotide; TAG chr11 5303124 5303143 5303127 -
tcttacagattcataatgat

SEQ ID NO: 39758 - DNA, 20 bp, Artificial Sequence
  Synthetic oligonucleotide; GAG chr11 5303122 5303141 5303125 -
ttacagattcataatgatta

SEQ ID NO: 39759 - DNA, 20 bp, Artificial Sequence
  Synthetic oligonucleotide; AGG chr11 5303121 5303140 5303124 -
tacagattcataatgattag

SEQ ID NO: 39760 - DNA, 20 bp, Artificial Sequence
  Synthetic oligonucleotide; GGG chr11 5303120 5303139 5303123 -
acagattcataatgattaga

SEQ ID NO: 39761 - DNA, 20 bp, Artificial Sequence
  Synthetic oligonucleotide; AAG chr11 5303112 5303131 5303115 -
ataatgattagagggtctgt

SEQ ID NO: 39762 - DNA, 20 bp, Artificial Sequence
  Synthetic oligonucleotide; CAG chr11 5303098 5303117 5303101 -
gtctgtaagattgtctccat

SEQ ID NO: 39763 - DNA, 20 bp, Artificial Sequence
  Synthetic oligonucleotide; TAG chr11 5303090 5303109 5303093 -
gattgtctccatcagcaaca

SEQ ID NO: 39764 - DNA, 20 bp, Artificial Sequence
  Synthetic oligonucleotide; TGG chr11 5303070 5303089 5303073 -
tagttgccgtattttctctc

SEQ ID NO: 39765 - DNA, 20 bp, Artificial Sequence
  Synthetic oligonucleotide; GGG chr11 5303069 5303088 5303072 -
agttgccgtattttctctct

SEQ ID NO: 39766 - DNA, 20 bp, Artificial Sequence
  Synthetic oligonucleotide; GAG chr11 5303067 5303086 5303070 -
ttgccgtattttctctctgg

SEQ ID NO: 39767 - DNA, 20 bp, Artificial Sequence
  Synthetic oligonucleotide; TAG chr11 5303049 5303068 5303052 -
gggagtgcttatcttttccc

SEQ ID NO: 39768 - DNA, 20 bp, Artificial Sequence
  Synthetic oligonucleotide; TGG chr11 5303043 5303062 5303046 -
gcttatcttttccctagaac

SEQ ID NO: 39769 - DNA, 20 bp, Artificial Sequence
  Synthetic oligonucleotide; AAG chr11 5303033 5303052 5303036 -
tccctagaactggttgtgtg

SEQ ID NO: 39770 - DNA, 20 bp, Artificial Sequence
  Synthetic oligonucleotide; CAG chr11 5302987 5303006 5302990 -
ccgatattactattgccctt

SEQ ID NO: 39771 - DNA, 20 bp, Artificial Sequence
  Synthetic oligonucleotide; AAG chr11 5302953 5302972 5302956 -
tacgaatctatgactctaac

SEQ ID NO: 39772 - DNA, 20 bp, Artificial Sequence
  Synthetic oligonucleotide; TAG chr11 5302947 5302966 5302950 -
tctatgactctaacaagtat

SEQ ID NO: 39773 - DNA, 20 bp, Artificial Sequence
  Synthetic oligonucleotide; AGG chr11 5302946 5302965 5302949 -
ctatgactctaacaagtatt

SEQ ID NO: 39774 - DNA, 20 bp, Artificial Sequence
  Synthetic oligonucleotide; TGG chr11 5302937 5302956 5302940 -
taacaagtattaggcttttg

SEQ ID NO: 39775 - DNA, 20 bp, Artificial Sequence
  Synthetic oligonucleotide; GAG chr11 5302935 5302954 5302938 -
acaagtattaggcttttgtg

SEQ ID NO: 39776 - DNA, 20 bp, Artificial Sequence
  Synthetic oligonucleotide; AGG chr11 5302934 5302953 5302937 -
caagtattaggcttttgtgg

SEQ ID NO: 39777 - DNA, 20 bp, Artificial Sequence
  Synthetic oligonucleotide; TAG chr11 5302922 5302941 5302925 -
ttttgtggaggccctcattg

SEQ ID NO: 39778 - DNA, 20 bp, Artificial Sequence
  Synthetic oligonucleotide; AAG chr11 5302919 5302938 5302922 -
tgtggaggccctcattgtag

SEQ ID NO: 39779 - DNA, 20 bp, Artificial Sequence
  Synthetic oligonucleotide; GAG chr11 5302891 5302910 5302894 -
ccttaaaatatttccgttat

SEQ ID NO: 39780 - DNA, 20 bp, Artificial Sequence
  Synthetic oligonucleotide; GAG chr11 5302878 5302897 5302881 -
ccgttatgagcttccaacat

SEQ ID NO: 39781 - DNA, 20 bp, Artificial Sequence
  Synthetic oligonucleotide; CAG chr11 5302837 5302856 5302840 -
gtccctaatgtgccaaaact

SEQ ID NO: 39782 - DNA, 20 bp, Artificial Sequence
  Synthetic oligonucleotide; CAG chr11 5302826 5302845 5302829 -
gccaaaactcagactttttg

SEQ ID NO: 39783 - DNA, 20 bp, Artificial Sequence
  Synthetic oligonucleotide; TAG chr11 5302821 5302840 5302824 -
aactcagactttttgcagca

SEQ ID NO: 39784 - DNA, 20 bp, Artificial Sequence
  Synthetic oligonucleotide; AGG chr11 5302820 5302839 5302823 -
actcagactttttgcagcat

SEQ ID NO: 39785 - DNA, 20 bp, Artificial Sequence
  Synthetic oligonucleotide; GGG chr11 5302819 5302838 5302822 -
ctcagactttttgcagcata

SEQ ID NO: 39786 - DNA, 20 bp, Artificial Sequence
  Synthetic oligonucleotide; GAG chr11 5302808 5302827 5302811 -
tgcagcatagggaacttgct

SEQ ID NO: 39787 - DNA, 20 bp, Artificial Sequence
  Synthetic oligonucleotide; AAG chr11 5302801 5302820 5302804 -
tagggaacttgctgagtccc

SEQ ID NO: 39788 - DNA, 20 bp, Artificial Sequence
  Synthetic oligonucleotide; GAG chr11 5302792 5302811 5302795 -
tgctgagtcccaagtccact

SEQ ID NO: 39789 - DNA, 20 bp, Artificial Sequence
  Synthetic oligonucleotide; GAG chr11 5302769 5302788 5302772 -
taattacacctttctaaaat

SEQ ID NO: 39790 - DNA, 20 bp, Artificial Sequence
  Synthetic oligonucleotide; CAG chr11 5302743 5302762 5302746 -
actaactttacccacttgtt

SEQ ID NO: 39791 - DNA, 20 bp, Artificial Sequence
  Synthetic oligonucleotide; AGG chr11 5302742 5302761 5302745 -
ctaactttacccacttgttc

SEQ ID NO: 39792 - DNA, 20 bp, Artificial Sequence
  Synthetic oligonucleotide; CAG chr11 5302735 5302754 5302738 -
tacccacttgttcaggtgtt

SEQ ID NO: 39793 - DNA, 20 bp, Artificial Sequence
  Synthetic oligonucleotide; TGG chr11 5302725 5302744 5302728 -
ttcaggtgttcagatttctg

SEQ ID NO: 39794 - DNA, 20 bp, Artificial Sequence
  Synthetic oligonucleotide; TAG chr11 5302712 5302731 5302715 -
atttctgtggaaactcacaa

SEQ ID NO: 39795 - DNA, 20 bp, Artificial Sequence
  Synthetic oligonucleotide; GAG chr11 5302707 5302726 5302710 -
tgtggaaactcacaatagat

SEQ ID NO: 39796 - DNA, 20 bp, Artificial Sequence
  Synthetic oligonucleotide; TAG chr11 5302669 5302688 5302672 -
ttattttattttatttttta

SEQ ID NO: 39797 - DNA, 20 bp, Artificial Sequence
  Synthetic oligonucleotide; GAG chr11 5302667 5302686 5302670 -
attttattttattttttata

SEQ ID NO: 39798 - DNA, 20 bp, Artificial Sequence
  Synthetic oligonucleotide; CAG chr11 5302663 5302682 5302666 -
tattttattttttatagaga

SEQ ID NO: 39799 - DNA, 20 bp, Artificial Sequence
  Synthetic oligonucleotide; GAG chr11 5302661 5302680 5302664 -
ttttattttttatagagaca

SEQ ID NO: 39800 - DNA, 20 bp, Artificial Sequence
  Synthetic oligonucleotide; CAG chr11 5302643 5302662 5302646 -
cagagtctgactccgttgcc

SEQ ID NO: 39801 - DNA, 20 bp, Artificial Sequence
  Synthetic oligonucleotide; AGG chr11 5302642 5302661 5302645 -
agagtctgactccgttgccc

SEQ ID NO: 39802 - DNA, 20 bp, Artificial Sequence
  Synthetic oligonucleotide; TGG chr11 5302638 5302657 5302641 -
tctgactccgttgcccaggc

SEQ ID NO: 39803 - DNA, 20 bp, Artificial Sequence
  Synthetic oligonucleotide; GAG chr11 5302636 5302655 5302639 -
tgactccgttgcccaggctg

SEQ ID NO: 39804 - DNA, 20 bp, Artificial Sequence
  Synthetic oligonucleotide; GAG chr11 5302634 5302653 5302637 -
actccgttgcccaggctgga

SEQ ID NO: 39805 - DNA, 20 bp, Artificial Sequence
  Synthetic oligonucleotide; CAG chr11 5302631 5302650 5302634 -
ccgttgcccaggctggagag

SEQ ID NO: 39806 - DNA, 20 bp, Artificial Sequence
  Synthetic oligonucleotide; TAG chr11 5302617 5302636 5302620 -
ggagagcagtgctgcaatca

SEQ ID NO: 39807 - DNA, 20 bp, Artificial Sequence
  Synthetic oligonucleotide; CAG chr11 5302607 5302626 5302610 -
gctgcaatcatagctccctg

SEQ ID NO: 39808 - DNA, 20 bp, Artificial Sequence
  Synthetic oligonucleotide; CAG chr11 5302599 5302618 5302602 -
catagctccctgcagcctca

SEQ ID NO: 39809 - DNA, 20 bp, Artificial Sequence
  Synthetic oligonucleotide; TGG chr11 5302593 5302612 5302596 -
tccctgcagcctcacagtcc

SEQ ID NO: 39810 - DNA, 20 bp, Artificial Sequence
  Synthetic oligonucleotide; GGG chr11 5302592 5302611 5302595 -
ccctgcagcctcacagtcct

SEQ ID NO: 39811 - DNA, 20 bp, Artificial Sequence
  Synthetic oligonucleotide; CAG chr11 5302587 5302606 5302590 -
cagcctcacagtcctgggct

SEQ ID NO: 39812 - DNA, 20 bp, Artificial Sequence
  Synthetic oligonucleotide; AGG chr11 5302586 5302605 5302589 -
agcctcacagtcctgggctc

SEQ ID NO: 39813 - DNA, 20 bp, Artificial Sequence
  Synthetic oligonucleotide; CAG chr11 5302564 5302583 5302567 -
gtgatgtgtgcccctgtgcc

SEQ ID NO: 39814 - DNA, 20 bp, Artificial Sequence
  Synthetic oligonucleotide; TGG chr11 5302535 5302554 5302538 -
tttatcttttcttttttttt

SEQ ID NO: 39815 - DNA, 20 bp, Artificial Sequence
  Synthetic oligonucleotide; TGG chr11 5302532 5302551 5302535 -
atcttttcttttttttttgg

SEQ ID NO: 39816 - DNA, 20 bp, Artificial Sequence
  Synthetic oligonucleotide; GAG chr11 5302530 5302549 5302533 -
cttttcttttttttttggtg

SEQ ID NO: 39817 - DNA, 20 bp, Artificial Sequence
  Synthetic oligonucleotide; AGG chr11 5302529 5302548 5302532 -
ttttcttttttttttggtgg

SEQ ID NO: 39818 - DNA, 20 bp, Artificial Sequence
  Synthetic oligonucleotide; CAG chr11 5302526 5302545 5302529 -
tcttttttttttggtggagg

SEQ ID NO: 39819 - DNA, 20 bp, Artificial Sequence
  Synthetic oligonucleotide; AGG chr11 5302525 5302544 5302528 -
cttttttttttggtggaggc

SEQ ID NO: 39820 - DNA, 20 bp, Artificial Sequence
  Synthetic oligonucleotide; GGG chr11 5302524 5302543 5302527 -
ttttttttttggtggaggca

SEQ ID NO: 39821 - DNA, 20 bp, Artificial Sequence
  Synthetic oligonucleotide; TAG chr11 5302519 5302538 5302522 -
tttttggtggaggcagggtc

SEQ ID NO: 39822 - DNA, 20 bp, Artificial Sequence
  Synthetic oligonucleotide; CAG chr11 5302506 5302525 5302509 -
cagggtctagctatgttgcc

SEQ ID NO: 39823 - DNA, 20 bp, Artificial Sequence
  Synthetic oligonucleotide; AGG chr11 5302505 5302524 5302508 -
agggtctagctatgttgccc

SEQ ID NO: 39824 - DNA, 20 bp, Artificial Sequence
  Synthetic oligonucleotide; TGG chr11 5302501 5302520 5302504 -
tctagctatgttgcccaggc

SEQ ID NO: 39825 - DNA, 20 bp, Artificial Sequence
  Synthetic oligonucleotide; GGG chr11 5302500 5302519 5302503 -
ctagctatgttgcccaggct

SEQ ID NO: 39826 - DNA, 20 bp, Artificial Sequence
  Synthetic oligonucleotide; CAG chr11 5302482 5302501 5302485 -
ctgggttctcttcttattca

SEQ ID NO: 39827 - DNA, 20 bp, Artificial Sequence
  Synthetic oligonucleotide; GAG chr11 5302472 5302491 5302475 -
ttcttattcacagtccactt

SEQ ID NO: 39828 - DNA, 20 bp, Artificial Sequence
  Synthetic oligonucleotide; TAG chr11 5302468 5302487 5302471 -
tattcacagtccacttgaga

SEQ ID NO: 39829 - DNA, 20 bp, Artificial Sequence
  Synthetic oligonucleotide; CAG chr11 5302443 5302462 5302446 -
acattgatcacaatatttct

SEQ ID NO: 39830 - DNA, 20 bp, Artificial Sequence
  Synthetic oligonucleotide; AAG chr11 5302425 5302444 5302428 -
ctcagtcatttctattgaat

SEQ ID NO: 39831 - DNA, 20 bp, Artificial Sequence
  Synthetic oligonucleotide; CAG chr11 5302413 5302432 5302416 -
tattgaataagcattttcct

SEQ ID NO: 39832 - DNA, 20 bp, Artificial Sequence
  Synthetic oligonucleotide; TGG chr11 5302410 5302429 5302413 -
tgaataagcattttcctcag

SEQ ID NO: 39833 - DNA, 20 bp, Artificial Sequence
  Synthetic oligonucleotide; CAG chr11 5302394 5302413 5302397 -
tcagtggttaatcctaaata

SEQ ID NO: 39834 - DNA, 20 bp, Artificial Sequence
  Synthetic oligonucleotide; TAG chr11 5302382 5302401 5302385 -
cctaaatacagctgtcccat

SEQ ID NO: 39835 - DNA, 20 bp, Artificial Sequence
  Synthetic oligonucleotide; AAG chr11 5302375 5302394 5302378 -
acagctgtcccattagtttc

SEQ ID NO: 39836 - DNA, 20 bp, Artificial Sequence
  Synthetic oligonucleotide; GAG chr11 5302373 5302392 5302376 -
agctgtcccattagtttcaa

SEQ ID NO: 39837 - DNA, 20 bp, Artificial Sequence
  Synthetic oligonucleotide; TGG chr11 5302347 5302366 5302350 -
aaatttgaactgactcaact

SEQ ID NO: 39838 - DNA, 20 bp, Artificial Sequence
  Synthetic oligonucleotide; TAG chr11 5302343 5302362 5302346 -
ttgaactgactcaacttgga

SEQ ID NO: 39839 - DNA, 20 bp, Artificial Sequence
  Synthetic oligonucleotide; CAG chr11 5302335 5302354 5302338 -
actcaacttggatagtaaca

SEQ ID NO: 39840 - DNA, 20 bp, Artificial Sequence
  Synthetic oligonucleotide; AAG chr11 5302331 5302350 5302334 -
aacttggatagtaacacagt

SEQ ID NO: 39841 - DNA, 20 bp, Artificial Sequence
  Synthetic oligonucleotide; AGG chr11 5302330 5302349 5302333 -
acttggatagtaacacagta

SEQ ID NO: 39842 - DNA, 20 bp, Artificial Sequence
  Synthetic oligonucleotide; GGG chr11 5302329 5302348 5302332 -
cttggatagtaacacagtaa

SEQ ID NO: 39843 - DNA, 20 bp, Artificial Sequence
  Synthetic oligonucleotide; TAG chr11 5302310 5302329 5302313 -
agggcccatatgataaataa

SEQ ID NO: 39844 - DNA, 20 bp, Artificial Sequence
  Synthetic oligonucleotide; AGG chr11 5302309 5302328 5302312 -
gggcccatatgataaataat

SEQ ID NO: 39845 - DNA, 20 bp, Artificial Sequence
  Synthetic oligonucleotide; GAG chr11 5302307 5302326 5302310 -
gcccatatgataaataatag

SEQ ID NO: 39846 - DNA, 20 bp, Artificial Sequence
  Synthetic oligonucleotide; AGG chr11 5302306 5302325 5302309 -
cccatatgataaataatagg

SEQ ID NO: 39847 - DNA, 20 bp, Artificial Sequence
  Synthetic oligonucleotide; GAG chr11 5302304 5302323 5302307 -
catatgataaataataggag

SEQ ID NO: 39848 - DNA, 20 bp, Artificial Sequence
  Synthetic oligonucleotide; AGG chr11 5302303 5302322 5302306 -
atatgataaataataggagg

SEQ ID NO: 39849 - DNA, 20 bp, Artificial Sequence
  Synthetic oligonucleotide; AAG chr11 5302295 5302314 5302298 -
aataataggaggaggaataa

SEQ ID NO: 39850 - DNA, 20 bp, Artificial Sequence
  Synthetic oligonucleotide; GAG chr11 5302293 5302312 5302296 -
taataggaggaggaataaaa

SEQ ID NO: 39851 - DNA, 20 bp, Artificial Sequence
  Synthetic oligonucleotide; AAG chr11 5302288 5302307 5302291 -
ggaggaggaataaaagagta

SEQ ID NO: 39852 - DNA, 20 bp, Artificial Sequence
  Synthetic oligonucleotide; GAG chr11 5302286 5302305 5302289 -
aggaggaataaaagagtaaa

SEQ ID NO: 39853 - DNA, 20 bp, Artificial Sequence
  Synthetic oligonucleotide; AAG chr11 5302278 5302297 5302281 -
taaaagagtaaagagaataa

SEQ ID NO: 39854 - DNA, 20 bp, Artificial Sequence
  Synthetic oligonucleotide; AGG chr11 5302277 5302296 5302280 -
aaaagagtaaagagaataaa

SEQ ID NO: 39855 - DNA, 20 bp, Artificial Sequence
  Synthetic oligonucleotide; GGG chr11 5302276 5302295 5302279 -
aaagagtaaagagaataaaa

SEQ ID NO: 39856 - DNA, 20 bp, Artificial Sequence
  Synthetic oligonucleotide; AAG chr11 5302269 5302288 5302272 -
aaagagaataaaagggaaca

SEQ ID NO: 39857 - DNA, 20 bp, Artificial Sequence
  Synthetic oligonucleotide; AGG chr11 5302268 5302287 5302271 -
aagagaataaaagggaacaa

SEQ ID NO: 39858 - DNA, 20 bp, Artificial Sequence
  Synthetic oligonucleotide; GAG chr11 5302266 5302285 5302269 -
gagaataaaagggaacaaag

SEQ ID NO: 39859 - DNA, 20 bp, Artificial Sequence
  Synthetic oligonucleotide; TGG chr11 5302256 5302275 5302259 -
gggaacaaaggagtcctatt

SEQ ID NO: 39860 - DNA, 20 bp, Artificial Sequence
  Synthetic oligonucleotide; GGG chr11 5302255 5302274 5302258 -
ggaacaaaggagtcctattt

SEQ ID NO: 39861 - DNA, 20 bp, Artificial Sequence
  Synthetic oligonucleotide; AAG chr11 5302249 5302268 5302252 -
aaggagtcctatttgggacc

SEQ ID NO: 39862 - DNA, 20 bp, Artificial Sequence
  Synthetic oligonucleotide; GAG chr11 5302247 5302266 5302250 -
ggagtcctatttgggaccaa

SEQ ID NO: 39863 - DNA, 20 bp, Artificial Sequence
  Synthetic oligonucleotide; AAG chr11 5302242 5302261 5302245 -
cctatttgggaccaagagtc

SEQ ID NO: 39864 - DNA, 20 bp, Artificial Sequence
  Synthetic oligonucleotide; AGG chr11 5302241 5302260 5302244 -
ctatttgggaccaagagtca

SEQ ID NO: 39865 - DNA, 20 bp, Artificial Sequence
  Synthetic oligonucleotide; GAG chr11 5302234 5302253 5302237 -
ggaccaagagtcaaggctat

SEQ ID NO: 39866 - DNA, 20 bp, Artificial Sequence
  Synthetic oligonucleotide; CAG chr11 5302229 5302248 5302232 -
aagagtcaaggctatgagca

SEQ ID NO: 39867 - DNA, 20 bp, Artificial Sequence
  Synthetic oligonucleotide; AAG chr11 5302222 5302241 5302225 -
aaggctatgagcacagacgt

SEQ ID NO: 39868 - DNA, 20 bp, Artificial Sequence
  Synthetic oligonucleotide; GAG chr11 5302217 5302236 5302220 -
tatgagcacagacgtaagat

SEQ ID NO: 39869 - DNA, 20 bp, Artificial Sequence
  Synthetic oligonucleotide; AAG chr11 5302201 5302220 5302204 -
agatgagtgttgaaaaaata

SEQ ID NO: 39870 - DNA, 20 bp, Artificial Sequence
  Synthetic oligonucleotide; AGG chr11 5302200 5302219 5302203 -
gatgagtgttgaaaaaataa

SEQ ID NO: 39871 - DNA, 20 bp, Artificial Sequence
  Synthetic oligonucleotide; TAG chr11 5302185 5302204 5302188 -
aataaaggttgtatgcttca

SEQ ID NO: 39872 - DNA, 20 bp, Artificial Sequence
  Synthetic oligonucleotide; TGG chr11 5302177 5302196 5302180 -
ttgtatgcttcatagtgaat

SEQ ID NO: 39873 - DNA, 20 bp, Artificial Sequence
  Synthetic oligonucleotide; TAG chr11 5302135 5302154 5302138 -
atttttgttatttgttattc

SEQ ID NO: 39874 - DNA, 20 bp, Artificial Sequence
  Synthetic oligonucleotide; AGG chr11 5302134 5302153 5302137 -
tttttgttatttgttattct

SEQ ID NO: 39875 - DNA, 20 bp, Artificial Sequence
  Synthetic oligonucleotide; GGG chr11 5302133 5302152 5302136 -
ttttgttatttgttattcta

SEQ ID NO: 39876 - DNA, 20 bp, Artificial Sequence
  Synthetic oligonucleotide; AAG chr11 5302129 5302148 5302132 -
gttatttgttattctaggga

SEQ ID NO: 39877 - DNA, 20 bp, Artificial Sequence
  Synthetic oligonucleotide; AGG chr11 5302128 5302147 5302131 -
ttatttgttattctagggaa

SEQ ID NO: 39878 - DNA, 20 bp, Artificial Sequence
  Synthetic oligonucleotide; GAG chr11 5302119 5302138 5302122 -
attctagggaaaggccttgt

SEQ ID NO: 39879 - DNA, 20 bp, Artificial Sequence
  Synthetic oligonucleotide; CAG chr11 5302114 5302133 5302117 -
agggaaaggccttgtgagta

SEQ ID NO: 39880 - DNA, 20 bp, Artificial Sequence
  Synthetic oligonucleotide; AGG chr11 5302113 5302132 5302116 -
gggaaaggccttgtgagtac

SEQ ID NO: 39881 - DNA, 20 bp, Artificial Sequence
  Synthetic oligonucleotide; AAG chr11 5302097 5302116 5302100 -
gtacaggcttacaattaatt

SEQ ID NO: 39882 - DNA, 20 bp, Artificial Sequence
  Synthetic oligonucleotide; GAG chr11 5302091 5302110 5302094 -
gcttacaattaattaagtat

SEQ ID NO: 39883 - DNA, 20 bp, Artificial Sequence
  Synthetic oligonucleotide; CAG chr11 5302082 5302101 5302085 -
taattaagtatgagacaatc

SEQ ID NO: 39884 - DNA, 20 bp, Artificial Sequence
  Synthetic oligonucleotide; AAG chr11 5302069 5302088 5302072 -
gacaatccagaaaaatattt

SEQ ID NO: 39885 - DNA, 20 bp, Artificial Sequence
  Synthetic oligonucleotide; GAG chr11 5302062 5302081 5302065 -
cagaaaaatatttaagtttt

SEQ ID NO: 39886 - DNA, 20 bp, Artificial Sequence
  Synthetic oligonucleotide; AGG chr11 5302061 5302080 5302064 -
agaaaaatatttaagttttg

SEQ ID NO: 39887 - DNA, 20 bp, Artificial Sequence
  Synthetic oligonucleotide; TGG chr11 5302051 5302070 5302054 -
ttaagttttgaggtaaaaaa

SEQ ID NO: 39888 - DNA, 20 bp, Artificial Sequence
  Synthetic oligonucleotide; AAG chr11 5302032 5302051 5302035 -
atggcctgatgatgtgctac

SEQ ID NO: 39889 - DNA, 20 bp, Artificial Sequence
  Synthetic oligonucleotide; AAG chr11 5302029 5302048 5302032 -
gcctgatgatgtgctacaag

SEQ ID NO: 39890 - DNA, 20 bp, Artificial Sequence
  Synthetic oligonucleotide; GAG chr11 5302021 5302040 5302024 -
atgtgctacaagaagattgt

SEQ ID NO: 39891 - DNA, 20 bp, Artificial Sequence
  Synthetic oligonucleotide; GAG chr11 5302019 5302038 5302022 -
gtgctacaagaagattgtga

SEQ ID NO: 39892 - DNA, 20 bp, Artificial Sequence
  Synthetic oligonucleotide; AAG chr11 5302012 5302031 5302015 -
aagaagattgtgagagaaaa

SEQ ID NO: 39893 - DNA, 20 bp, Artificial Sequence
  Synthetic oligonucleotide; TGG chr11 5301996 5302015 5301999 -
aaaaaagaaaactgcatctt

SEQ ID NO: 39894 - DNA, 20 bp, Artificial Sequence
  Synthetic oligonucleotide; GAG chr11 5301994 5302013 5301997 -
aaaagaaaactgcatctttg

SEQ ID NO: 39895 - DNA, 20 bp, Artificial Sequence
  Synthetic oligonucleotide; AGG chr11 5301993 5302012 5301996 -
aaagaaaactgcatctttgg

SEQ ID NO: 39896 - DNA, 20 bp, Artificial Sequence
  Synthetic oligonucleotide; TGG chr11 5301944 5301963 5301947 -
cacctgcaaaacctaccatg

SEQ ID NO: 39897 - DNA, 20 bp, Artificial Sequence
  Synthetic oligonucleotide; CAG chr11 5301933 5301952 5301936 -
cctaccatgtggtataacaa

SEQ ID NO: 39898 - DNA, 20 bp, Artificial Sequence
  Synthetic oligonucleotide; TGG chr11 5301927 5301946 5301930 -
atgtggtataacaacagtgc

SEQ ID NO: 39899 - DNA, 20 bp, Artificial Sequence
  Synthetic oligonucleotide; TGG chr11 5301909 5301928 5301912 -
gctggccccttcttgctgac

SEQ ID NO: 39900 - DNA, 20 bp, Artificial Sequence
  Synthetic oligonucleotide; TGG chr11 5301901 5301920 5301904 -
cttcttgctgactggcttct

SEQ ID NO: 39901 - DNA, 20 bp, Artificial Sequence
  Synthetic oligonucleotide; GGG chr11 5301900 5301919 5301903 -
ttcttgctgactggcttctt

SEQ ID NO: 39902 - DNA, 20 bp, Artificial Sequence
  Synthetic oligonucleotide; CAG chr11 5301895 5301914 5301898 -
gctgactggcttcttgggct

SEQ ID NO: 39903 - DNA, 20 bp, Artificial Sequence
  Synthetic oligonucleotide; GAG chr11 5301893 5301912 5301896 -
tgactggcttcttgggctca

SEQ ID NO: 39904 - DNA, 20 bp, Artificial Sequence
  Synthetic oligonucleotide; AGG chr11 5301892 5301911 5301895 -
gactggcttcttgggctcag

SEQ ID NO: 39905 - DNA, 20 bp, Artificial Sequence
  Synthetic oligonucleotide; CAG chr11 5301889 5301908 5301892 -
tggcttcttgggctcagagg

SEQ ID NO: 39906 - DNA, 20 bp, Artificial Sequence
  Synthetic oligonucleotide; CGG chr11 5301878 5301897 5301881 -
gctcagaggcagttcactac

SEQ ID NO: 39907 - DNA, 20 bp, Artificial Sequence
  Synthetic oligonucleotide; TGG chr11 5301834 5301853 5301837 -
atctacttctccgtcctttt

SEQ ID NO: 39908 - DNA, 20 bp, Artificial Sequence
  Synthetic oligonucleotide; TGG chr11 5301828 5301847 5301831 -
ttctccgtcctttttggaaa

SEQ ID NO: 39909 - DNA, 20 bp, Artificial Sequence
  Synthetic oligonucleotide; TGG chr11 5301806 5301825 5301809 -
gcactcttcttgtcctcatt

SEQ ID NO: 39910 - DNA, 20 bp, Artificial Sequence
  Synthetic oligonucleotide; CAG chr11 5301795 5301814 5301798 -
gtcctcatttggaatgatca

SEQ ID NO: 39911 - DNA, 20 bp, Artificial Sequence
  Synthetic oligonucleotide; GAG chr11 5301785 5301804 5301788 -
ggaatgatcacagcctccat

SEQ ID NO: 39912 - DNA, 20 bp, Artificial Sequence
  Synthetic oligonucleotide; TGG chr11 5301766 5301785 5301769 -
tgagcccatgtactacttcc

SEQ ID NO: 39913 - DNA, 20 bp, Artificial Sequence
  Synthetic oligonucleotide; TGG chr11 5301757 5301776 5301760 -
gtactacttcctggctatgc

SEQ ID NO: 39914 - DNA, 20 bp, Artificial Sequence
  Synthetic oligonucleotide; CAG chr11 5301754 5301773 5301757 -
ctacttcctggctatgctgg

SEQ ID NO: 39915 - DNA, 20 bp, Artificial Sequence
  Synthetic oligonucleotide; CGG chr11 5301748 5301767 5301751 -
cctggctatgctggcagaca

SEQ ID NO: 39916 - DNA, 20 bp, Artificial Sequence
  Synthetic oligonucleotide; TGG chr11 5301741 5301760 5301744 -
atgctggcagacacggacct

SEQ ID NO: 39917 - DNA, 20 bp, Artificial Sequence
  Synthetic oligonucleotide; GGG chr11 5301740 5301759 5301743 -
tgctggcagacacggacctt

SEQ ID NO: 39918 - DNA, 20 bp, Artificial Sequence
  Synthetic oligonucleotide; CAG chr11 5301715 5301734 5301718 -
gacattcactacaatgccca

SEQ ID NO: 39919 - DNA, 20 bp, Artificial Sequence
  Synthetic oligonucleotide; TGG chr11 5301709 5301728 5301712 -
cactacaatgcccacagtcc

SEQ ID NO: 39920 - DNA, 20 bp, Artificial Sequence
  Synthetic oligonucleotide; GGG chr11 5301708 5301727 5301711 -
actacaatgcccacagtcct

SEQ ID NO: 39921 - DNA, 20 bp, Artificial Sequence
  Synthetic oligonucleotide; TAG chr11 5301694 5301713 5301697 -
agtcctgggtgtcctgctgc

SEQ ID NO: 39922 - DNA, 20 bp, Artificial Sequence
  Synthetic oligonucleotide; CAG chr11 5301689 5301708 5301692 -
tgggtgtcctgctgctagac

SEQ ID NO: 39923 - DNA, 20 bp, Artificial Sequence
  Synthetic oligonucleotide; GAG chr11 5301687 5301706 5301690 -
ggtgtcctgctgctagacca

SEQ ID NO: 39924 - DNA, 20 bp, Artificial Sequence
  Synthetic oligonucleotide; AGG chr11 5301686 5301705 5301689 -
gtgtcctgctgctagaccag

SEQ ID NO: 39925 - DNA, 20 bp, Artificial Sequence
  Synthetic oligonucleotide; GGG chr11 5301685 5301704 5301688 -
tgtcctgctgctagaccaga

SEQ ID NO: 39926 - DNA, 20 bp, Artificial Sequence
  Synthetic oligonucleotide; GAG chr11 5301683 5301702 5301686 -
tcctgctgctagaccagagg

SEQ ID NO: 39927 - DNA, 20 bp, Artificial Sequence
  Synthetic oligonucleotide; TGG chr11 5301637 5301656 5301640 -
ccaatccttcattcattcac

SEQ ID NO: 39928 - DNA, 20 bp, Artificial Sequence
  Synthetic oligonucleotide; TAG chr11 5301628 5301647 5301631 -
cattcattcactggccattg

SEQ ID NO: 39929 - DNA, 20 bp, Artificial Sequence
  Synthetic oligonucleotide; CAG chr11 5301622 5301641 5301625 -
ttcactggccattgtagaat

SEQ ID NO: 39930 - DNA, 20 bp, Artificial Sequence
  Synthetic oligonucleotide; AGG chr11 5301621 5301640 5301624 -
tcactggccattgtagaatc

SEQ ID NO: 39931 - DNA, 20 bp, Artificial Sequence
  Synthetic oligonucleotide; TGG chr11 5301604 5301623 5301607 -
atcaggtatcttgcttgttt

SEQ ID NO: 39932 - DNA, 20 bp, Artificial Sequence
  Synthetic oligonucleotide; GAG chr11 5301567 5301586 5301570 -
attgccatccgcacaccact

SEQ ID NO: 39933 - DNA, 20 bp, Artificial Sequence
  Synthetic oligonucleotide; AGG chr11 5301566 5301585 5301569 -
ttgccatccgcacaccactg

SEQ ID NO: 39934 - DNA, 20 bp, Artificial Sequence
  Synthetic oligonucleotide; GAG chr11 5301538 5301557 5301541 -
ctgcattcttaccaattccc

SEQ ID NO: 39935 - DNA, 20 bp, Artificial Sequence
  Synthetic oligonucleotide; TAG chr11 5301526 5301545 5301529 -
caattcccgagtgatgaaca

SEQ ID NO: 39936 - DNA, 20 bp, Artificial Sequence
  Synthetic oligonucleotide; AGG chr11 5301525 5301544 5301528 -
aattcccgagtgatgaacat

SEQ ID NO: 39937 - DNA, 20 bp, Artificial Sequence
  Synthetic oligonucleotide; TGG chr11 5301520 5301539 5301523 -
ccgagtgatgaacataggac

SEQ ID NO: 39938 - DNA, 20 bp, Artificial Sequence
  Synthetic oligonucleotide; GGG chr11 5301519 5301538 5301522 -
cgagtgatgaacataggact

SEQ ID NO: 39939 - DNA, 20 bp, Artificial Sequence
  Synthetic oligonucleotide; GGG chr11 5301518 5301537 5301521 -
gagtgatgaacataggactg

SEQ ID NO: 39940 - DNA, 20 bp, Artificial Sequence
  Synthetic oligonucleotide; GGG chr11 5301517 5301536 5301520 -
agtgatgaacataggactgg

SEQ ID NO: 39941 - DNA, 20 bp, Artificial Sequence
  Synthetic oligonucleotide; GAG chr11 5301507 5301526 5301510 -
ataggactgggggtactgat

SEQ ID NO: 39942 - DNA, 20 bp, Artificial Sequence
  Synthetic oligonucleotide; GAG chr11 5301505 5301524 5301508 -
aggactgggggtactgatga

SEQ ID NO: 39943 - DNA, 20 bp, Artificial Sequence
  Synthetic oligonucleotide; AGG chr11 5301504 5301523 5301507 -
ggactgggggtactgatgag

SEQ ID NO: 39944 - DNA, 20 bp, Artificial Sequence
  Synthetic oligonucleotide; TGG chr11 5301450 5301469 5301453 -
ctctactgctacccatattg

SEQ ID NO: 39945 - DNA, 20 bp, Artificial Sequence
  Synthetic oligonucleotide; AAG chr11 5301412 5301431 5301415 -
gcacacattttgcctccatc

SEQ ID NO: 39946 - DNA, 20 bp, Artificial Sequence
  Synthetic oligonucleotide; CAG chr11 5301353 5301372 5301356 -
atcacatatatccaattatt

SEQ ID NO: 39947 - DNA, 20 bp, Artificial Sequence
  Synthetic oligonucleotide; TAG chr11 5301331 5301350 5301334 -
gacttctttgactgtctttt

SEQ ID NO: 39948 - DNA, 20 bp, Artificial Sequence
  Synthetic oligonucleotide; AAG chr11 5301290 5301309 5301293 -
tttcttatatactaatcctc

SEQ ID NO: 39949 - DNA, 20 bp, Artificial Sequence
  Synthetic oligonucleotide; CAG chr11 5301286 5301305 5301289 -
ttatatactaatcctcaaga

SEQ ID NO: 39950 - DNA, 20 bp, Artificial Sequence
  Synthetic oligonucleotide; TGG chr11 5301280 5301299 5301283 -
actaatcctcaagacagtga

SEQ ID NO: 39951 - DNA, 20 bp, Artificial Sequence
  Synthetic oligonucleotide; GGG chr11 5301279 5301298 5301282 -
ctaatcctcaagacagtgat

SEQ ID NO: 39952 - DNA, 20 bp, Artificial Sequence
  Synthetic oligonucleotide; TGG chr11 5301267 5301286 5301270 -
acagtgatgggcattgcgtc

SEQ ID NO: 39953 - DNA, 20 bp, Artificial Sequence
  Synthetic oligonucleotide; AAG chr11 5301262 5301281 5301265 -
gatgggcattgcgtctggac

SEQ ID NO: 39954 - DNA, 20 bp, Artificial Sequence
  Synthetic oligonucleotide; GAG chr11 5301260 5301279 5301263 -
tgggcattgcgtctggacaa

SEQ ID NO: 39955 - DNA, 20 bp, Artificial Sequence
  Synthetic oligonucleotide; AGG chr11 5301259 5301278 5301262 -
gggcattgcgtctggacaag

SEQ ID NO: 39956 - DNA, 20 bp, Artificial Sequence
  Synthetic oligonucleotide; AAG chr11 5301256 5301275 5301259 -
cattgcgtctggacaagagg

SEQ ID NO: 39957 - DNA, 20 bp, Artificial Sequence
  Synthetic oligonucleotide; TAG chr11 5301222 5301241 5301225 -
aacacttgtgtctcccatat

SEQ ID NO: 39958 - DNA, 20 bp, Artificial Sequence
  Synthetic oligonucleotide; TAG chr11 5301211 5301230 5301214 -
ctcccatattagctgtgtcc

SEQ ID NO: 39959 - DNA, 20 bp, Artificial Sequence
  Synthetic oligonucleotide; TGG chr11 5301190 5301209 5301193 -
agtatttcacatcactgtga

SEQ ID NO: 39960 - DNA, 20 bp, Artificial Sequence
  Synthetic oligonucleotide; GGG chr11 5301189 5301208 5301192 -
gtatttcacatcactgtgat

SEQ ID NO: 39961 - DNA, 20 bp, Artificial Sequence
  Synthetic oligonucleotide; CAG chr11 5301171 5301190 5301174 -
atgggactgtcattcattca

SEQ ID NO: 39962 - DNA, 20 bp, Artificial Sequence
  Synthetic oligonucleotide; AGG chr11 5301170 5301189 5301173 -
tgggactgtcattcattcac

SEQ ID NO: 39963 - DNA, 20 bp, Artificial Sequence
  Synthetic oligonucleotide; TGG chr11 5301165 5301184 5301168 -
ctgtcattcattcacaggtt

SEQ ID NO: 39964 - DNA, 20 bp, Artificial Sequence
  Synthetic oligonucleotide; GGG chr11 5301164 5301183 5301167 -
tgtcattcattcacaggttt

SEQ ID NO: 39965 - DNA, 20 bp, Artificial Sequence
  Synthetic oligonucleotide; TGG chr11 5301145 5301164 5301148 -
tgggaaacatgcacctcatg

SEQ ID NO: 39966 - DNA, 20 bp, Artificial Sequence
  Synthetic oligonucleotide; GAG chr11 5301129 5301148 5301132 -
catgtggtccccattaccat

SEQ ID NO: 39967 - DNA, 20 bp, Artificial Sequence
  Synthetic oligonucleotide; TAG chr11 5301081 5301100 5301084 -
ttcgtgaatcctatcattta

SEQ ID NO: 39968 - DNA, 20 bp, Artificial Sequence
  Synthetic oligonucleotide; AAG chr11 5301074 5301093 5301077 -
atcctatcatttatagcatc

SEQ ID NO: 39969 - DNA, 20 bp, Artificial Sequence
  Synthetic oligonucleotide; AAG chr11 5301068 5301087 5301071 -
tcatttatagcatcaagacc

SEQ ID NO: 39970 - DNA, 20 bp, Artificial Sequence
  Synthetic oligonucleotide; CAG chr11 5301065 5301084 5301068 -
tttatagcatcaagaccaag

SEQ ID NO: 39971 - DNA, 20 bp, Artificial Sequence
  Synthetic oligonucleotide; AAG chr11 5301057 5301076 5301060 -
atcaagaccaagcagattca

SEQ ID NO: 39972 - DNA, 20 bp, Artificial Sequence
  Synthetic oligonucleotide; AAG chr11 5301054 5301073 5301057 -
aagaccaagcagattcaaag

SEQ ID NO: 39973 - DNA, 20 bp, Artificial Sequence
  Synthetic oligonucleotide; TGG chr11 5301033 5301052 5301036 -
agcattattcgcctattttc

SEQ ID NO: 39974 - DNA, 20 bp, Artificial Sequence
  Synthetic oligonucleotide; GGG chr11 5301032 5301051 5301035 -
gcattattcgcctattttct

SEQ ID NO: 39975 - DNA, 20 bp, Artificial Sequence
  Synthetic oligonucleotide; CAG chr11 5301029 5301048 5301032 -
ttattcgcctattttctggg

SEQ ID NO: 39976 - DNA, 20 bp, Artificial Sequence
  Synthetic oligonucleotide; GAG chr11 5301027 5301046 5301030 -
attcgcctattttctgggca

SEQ ID NO: 39977 - DNA, 20 bp, Artificial Sequence
  Synthetic oligonucleotide; TAG chr11 5301024 5301043 5301027 -
cgcctattttctgggcagag

SEQ ID NO: 39978 - DNA, 20 bp, Artificial Sequence
  Synthetic oligonucleotide; AGG chr11 5301023 5301042 5301026 -
gcctattttctgggcagagt

SEQ ID NO: 39979 - DNA, 20 bp, Artificial Sequence
  Synthetic oligonucleotide; GGG chr11 5301022 5301041 5301025 -
cctattttctgggcagagta

SEQ ID NO: 39980 - DNA, 20 bp, Artificial Sequence
  Synthetic oligonucleotide; GAG chr11 5301016 5301035 5301019 -
ttctgggcagagtagggctt

SEQ ID NO: 39981 - DNA, 20 bp, Artificial Sequence
  Synthetic oligonucleotide; CAG chr11 5301004 5301023 5301007 -
tagggcttgagcccttattt

SEQ ID NO: 39982 - DNA, 20 bp, Artificial Sequence
  Synthetic oligonucleotide; AAG chr11 5300995 5301014 5300998 -
agcccttatttcagaatctc

SEQ ID NO: 39983 - DNA, 20 bp, Artificial Sequence
  Synthetic oligonucleotide; TAG chr11 5300987 5301006 5300990 -
tttcagaatctcaagatctc

SEQ ID NO: 39984 - DNA, 20 bp, Artificial Sequence
  Synthetic oligonucleotide; AGG chr11 5300986 5301005 5300989 -
ttcagaatctcaagatctct

SEQ ID NO: 39985 - DNA, 20 bp, Artificial Sequence
  Synthetic oligonucleotide; TGG chr11 5300978 5300997 5300981 -
ctcaagatctctaggatttc

SEQ ID NO: 39986 - DNA, 20 bp, Artificial Sequence
  Synthetic oligonucleotide; GGG chr11 5300977 5300996 5300980 -
tcaagatctctaggatttct

SEQ ID NO: 39987 - DNA, 20 bp, Artificial Sequence
  Synthetic oligonucleotide; AAG chr11 5300957 5300976 5300960 -
gggcctctcccattactgaa

SEQ ID NO: 39988 - DNA, 20 bp, Artificial Sequence
  Synthetic oligonucleotide; AGG chr11 5300956 5300975 5300959 -
ggcctctcccattactgaaa

SEQ ID NO: 39989 - DNA, 20 bp, Artificial Sequence
  Synthetic oligonucleotide; TGG chr11 5300948 5300967 5300951 -
ccattactgaaaaggaaccc

SEQ ID NO: 39990 - DNA, 20 bp, Artificial Sequence
  Synthetic oligonucleotide; CAG chr11 5300920 5300939 5300923 -
tatccacacttttttttcct

SEQ ID NO: 39991 - DNA, 20 bp, Artificial Sequence
  Synthetic oligonucleotide; GAG chr11 5300918 5300937 5300921 -
tccacacttttttttcctca

SEQ ID NO: 39992 - DNA, 20 bp, Artificial Sequence
  Synthetic oligonucleotide; TAG chr11 5300914 5300933 5300917 -
cacttttttttcctcagagt

SEQ ID NO: 39993 - DNA, 20 bp, Artificial Sequence
  Synthetic oligonucleotide; AAG chr11 5300886 5300905 5300889 -
attttaattatcacatgaaa

SEQ ID NO: 39994 - DNA, 20 bp, Artificial Sequence
  Synthetic oligonucleotide; GAG chr11 5300876 5300895 5300879 -
tcacatgaaaaagctgatgt

SEQ ID NO: 39995 - DNA, 20 bp, Artificial Sequence
  Synthetic oligonucleotide; GAG chr11 5300872 5300891 5300875 -
atgaaaaagctgatgtgagc

SEQ ID NO: 39996 - DNA, 20 bp, Artificial Sequence
  Synthetic oligonucleotide; AAG chr11 5300806 5300825 5300809 -
tatatatatatcacctaata

SEQ ID NO: 39997 - DNA, 20 bp, Artificial Sequence
  Synthetic oligonucleotide; GAG chr11 5300804 5300823 5300807 -
tatatatatcacctaataaa

SEQ ID NO: 39998 - DNA, 20 bp, Artificial Sequence
  Synthetic oligonucleotide; AGG chr11 5300803 5300822 5300806 -
atatatatcacctaataaag

SEQ ID NO: 39999 - DNA, 20 bp, Artificial Sequence
  Synthetic oligonucleotide; GGG chr11 5300802 5300821 5300805 -
tatatatcacctaataaaga

SEQ ID NO: 40000 - DNA, 20 bp, Artificial Sequence
  Synthetic oligonucleotide; CAG chr11 5300794 5300813 5300797 -
acctaataaagagggaatgc

SEQ ID NO: 40001 - DNA, 20 bp, Artificial Sequence
  Synthetic oligonucleotide; AAG chr11 5300783 5300802 5300786 -
agggaatgccagtgatgctg

SEQ ID NO: 40002 - DNA, 20 bp, Artificial Sequence
  Synthetic oligonucleotide; AAG chr11 5300777 5300796 5300780 -
tgccagtgatgctgaagaaa

SEQ ID NO: 40003 - DNA, 20 bp, Artificial Sequence
  Synthetic oligonucleotide; CAG chr11 5300770 5300789 5300773 -
gatgctgaagaaaaagaata

SEQ ID NO: 40004 - DNA, 20 bp, Artificial Sequence
  Synthetic oligonucleotide; AGG chr11 5300769 5300788 5300772 -
atgctgaagaaaaagaatac

SEQ ID NO: 40005 - DNA, 20 bp, Artificial Sequence
  Synthetic oligonucleotide; AAG chr11 5300766 5300785 5300769 -
ctgaagaaaaagaatacagg

SEQ ID NO: 40006 - DNA, 20 bp, Artificial Sequence
  Synthetic oligonucleotide; CAG chr11 5300763 5300782 5300766 -
aagaaaaagaatacaggaag

SEQ ID NO: 40007 - DNA, 20 bp, Artificial Sequence
  Synthetic oligonucleotide; GAG chr11 5300761 5300780 5300764 -
gaaaaagaatacaggaagca

SEQ ID NO: 40008 - DNA, 20 bp, Artificial Sequence
  Synthetic oligonucleotide; AGG chr11 5300760 5300779 5300763 -
aaaaagaatacaggaagcag

SEQ ID NO: 40009 - DNA, 20 bp, Artificial Sequence
  Synthetic oligonucleotide; GAG chr11 5300758 5300777 5300761 -
aaagaatacaggaagcagag

SEQ ID NO: 40010 - DNA, 20 bp, Artificial Sequence
  Synthetic oligonucleotide; AAG chr11 5300741 5300760 5300744 -
gaggagatataacaatccaa

SEQ ID NO: 40011 - DNA, 20 bp, Artificial Sequence
  Synthetic oligonucleotide; AAG chr11 5300738 5300757 5300741 -
gagatataacaatccaaaag

SEQ ID NO: 40012 - DNA, 20 bp, Artificial Sequence
  Synthetic oligonucleotide; GAG chr11 5300736 5300755 5300739 -
gatataacaatccaaaagaa

SEQ ID NO: 40013 - DNA, 20 bp, Artificial Sequence
  Synthetic oligonucleotide; CAG chr11 5300721 5300740 5300724 -
aagaagagtaactatgattt

SEQ ID NO: 40014 - DNA, 20 bp, Artificial Sequence
  Synthetic oligonucleotide; TAG chr11 5300715 5300734 5300718 -
agtaactatgatttcagaaa

SEQ ID NO: 40015 - DNA, 20 bp, Artificial Sequence
  Synthetic oligonucleotide; AAG chr11 5300710 5300729 5300713 -
ctatgatttcagaaatagtc

SEQ ID NO: 40016 - DNA, 20 bp, Artificial Sequence
  Synthetic oligonucleotide; AAG chr11 5300705 5300724 5300708 -
atttcagaaatagtcaagat

SEQ ID NO: 40017 - DNA, 20 bp, Artificial Sequence
  Synthetic oligonucleotide; TGG chr11 5300702 5300721 5300705 -
tcagaaatagtcaagataag

SEQ ID NO: 40018 - DNA, 20 bp, Artificial Sequence
  Synthetic oligonucleotide; AAG chr11 5300695 5300714 5300698 -
tagtcaagataagtggacta

SEQ ID NO: 40019 - DNA, 20 bp, Artificial Sequence
  Synthetic oligonucleotide; CAG chr11 5300692 5300711 5300695 -
tcaagataagtggactaaag

SEQ ID NO: 40020 - DNA, 20 bp, Artificial Sequence
  Synthetic oligonucleotide; TGG chr11 5300687 5300706 5300690 -
ataagtggactaaagcagct

SEQ ID NO: 40021 - DNA, 20 bp, Artificial Sequence
  Synthetic oligonucleotide; GGG chr11 5300686 5300705 5300689 -
taagtggactaaagcagctt

SEQ ID NO: 40022 - DNA, 20 bp, Artificial Sequence
  Synthetic oligonucleotide; CAG chr11 5300676 5300695 5300679 -
aaagcagcttgggtcaaata

SEQ ID NO: 40023 - DNA, 20 bp, Artificial Sequence
  Synthetic oligonucleotide; AAG chr11 5300665 5300684 5300668 -
ggtcaaatacagttcatcta

SEQ ID NO: 40024 - DNA, 20 bp, Artificial Sequence
  Synthetic oligonucleotide; CAG chr11 5300653 5300672 5300656 -
ttcatctaaagaaaaatgtg

SEQ ID NO: 40025 - DNA, 20 bp, Artificial Sequence
  Synthetic oligonucleotide; TGG chr11 5300649 5300668 5300652 -
tctaaagaaaaatgtgcagt

SEQ ID NO: 40026 - DNA, 20 bp, Artificial Sequence
  Synthetic oligonucleotide; GAG chr11 5300647 5300666 5300650 -
taaagaaaaatgtgcagttg

SEQ ID NO: 40027 - DNA, 20 bp, Artificial Sequence
  Synthetic oligonucleotide; AGG chr11 5300646 5300665 5300649 -
aaagaaaaatgtgcagttgg

SEQ ID NO: 40028 - DNA, 20 bp, Artificial Sequence
  Synthetic oligonucleotide; AAG chr11 5300623 5300642 5300626 -
tacattttatgtgtcttata

SEQ ID NO: 40029 - DNA, 20 bp, Artificial Sequence
  Synthetic oligonucleotide; AGG chr11 5300622 5300641 5300625 -
acattttatgtgtcttataa

SEQ ID NO: 40030 - DNA, 20 bp, Artificial Sequence
  Synthetic oligonucleotide; TAG chr11 5300571 5300590 5300574 -
tcatctccatactttgaaac

SEQ ID NO: 40031 - DNA, 20 bp, Artificial Sequence
  Synthetic oligonucleotide; AAG chr11 5300558 5300577 5300561 -
ttgaaactagttactctgaa

SEQ ID NO: 40032 - DNA, 20 bp, Artificial Sequence
  Synthetic oligonucleotide; AGG chr11 5300557 5300576 5300560 -
tgaaactagttactctgaaa

SEQ ID NO: 40033 - DNA, 20 bp, Artificial Sequence
  Synthetic oligonucleotide; TAG chr11 5300542 5300561 5300545 -
tgaaaaggatcttgcttgat

SEQ ID NO: 40034 - DNA, 20 bp, Artificial Sequence
  Synthetic oligonucleotide; AAG chr11 5300538 5300557 5300541 -
aaggatcttgcttgattagt

SEQ ID NO: 40035 - DNA, 20 bp, Artificial Sequence
  Synthetic oligonucleotide; GAG chr11 5300524 5300543 5300527 -
attagtaagcaaacttgtgt

SEQ ID NO: 40036 - DNA, 20 bp, Artificial Sequence
  Synthetic oligonucleotide; AGG chr11 5300523 5300542 5300526 -
ttagtaagcaaacttgtgtg

SEQ ID NO: 40037 - DNA, 20 bp, Artificial Sequence
  Synthetic oligonucleotide; CAG chr11 5300515 5300534 5300518 -
caaacttgtgtgaggctaaa

SEQ ID NO: 40038 - DNA, 20 bp, Artificial Sequence
  Synthetic oligonucleotide; TAG chr11 5300504 5300523 5300507 -
gaggctaaacagcaaatatc

SEQ ID NO: 40039 - DNA, 20 bp, Artificial Sequence
  Synthetic oligonucleotide; TAG chr11 5300496 5300515 5300499 -
acagcaaatatctagaactt

SEQ ID NO: 40040 - DNA, 20 bp, Artificial Sequence
  Synthetic oligonucleotide; AGG chr11 5300495 5300514 5300498 -
cagcaaatatctagaacttt

SEQ ID NO: 40041 - DNA, 20 bp, Artificial Sequence
  Synthetic oligonucleotide; AAG chr11 5300492 5300511 5300495 -
caaatatctagaactttagg

SEQ ID NO: 40042 - DNA, 20 bp, Artificial Sequence
  Synthetic oligonucleotide; TAG chr11 5300464 5300483 5300467 -
tcatgaaatgtaatttccct

SEQ ID NO: 40043 - DNA, 20 bp, Artificial Sequence
  Synthetic oligonucleotide; TAG chr11 5300461 5300480 5300464 -
tgaaatgtaatttcccttag

SEQ ID NO: 40044 - DNA, 20 bp, Artificial Sequence
  Synthetic oligonucleotide; TGG chr11 5300456 5300475 5300459 -
tgtaatttcccttagtagac

SEQ ID NO: 40045 - DNA, 20 bp, Artificial Sequence
  Synthetic oligonucleotide; AAG chr11 5300437 5300456 5300440 -
ctggcatattttactactaa

SEQ ID NO: 40046 - DNA, 20 bp, Artificial Sequence
  Synthetic oligonucleotide; AGG chr11 5300436 5300455 5300439 -
tggcatattttactactaaa

SEQ ID NO: 40047 - DNA, 20 bp, Artificial Sequence
  Synthetic oligonucleotide; CAG chr11 5300424 5300443 5300427 -
ctactaaaaggcgtgtgata

SEQ ID NO: 40048 - DNA, 20 bp, Artificial Sequence
  Synthetic oligonucleotide; CAG chr11 5300416 5300435 5300419 -
aggcgtgtgatacagactaa

SEQ ID NO: 40049 - DNA, 20 bp, Artificial Sequence
  Synthetic oligonucleotide; TAG chr11 5300408 5300427 5300411 -
gatacagactaacagctaaa

SEQ ID NO: 40050 - DNA, 20 bp, Artificial Sequence
  Synthetic oligonucleotide; CAG chr11 5300405 5300424 5300408 -
acagactaacagctaaatag

SEQ ID NO: 40051 - DNA, 20 bp, Artificial Sequence
  Synthetic oligonucleotide; TGG chr11 5300379 5300398 5300382 -
acacatttcttatcatctcg

SEQ ID NO: 40052 - DNA, 20 bp, Artificial Sequence
  Synthetic oligonucleotide; AAG chr11 5300376 5300395 5300379 -
catttcttatcatctcgtgg

SEQ ID NO: 40053 - DNA, 20 bp, Artificial Sequence
  Synthetic oligonucleotide; CAG chr11 5300372 5300391 5300375 -
tcttatcatctcgtggaagc

SEQ ID NO: 40054 - DNA, 20 bp, Artificial Sequence
  Synthetic oligonucleotide; CAG chr11 5300363 5300382 5300366 -
ctcgtggaagccagatatcc

SEQ ID NO: 40055 - DNA, 20 bp, Artificial Sequence
  Synthetic oligonucleotide; CAG chr11 5300302 5300321 5300305 -
ttaatactttttcttctttc

SEQ ID NO: 40056 - DNA, 20 bp, Artificial Sequence
  Synthetic oligonucleotide; TAG chr11 5300243 5300262 5300246 -
aaaataaccaactataaatt

SEQ ID NO: 40057 - DNA, 20 bp, Artificial Sequence
  Synthetic oligonucleotide; GAG chr11 5300189 5300208 5300192 -
cttctcacataaaaaatctc

SEQ ID NO: 40058 - DNA, 20 bp, Artificial Sequence
  Synthetic oligonucleotide; TAG chr11 5300167 5300186 5300170 -
gactttttcacttcatgaaa

SEQ ID NO: 40059 - DNA, 20 bp, Artificial Sequence
  Synthetic oligonucleotide; TGG chr11 5300141 5300160 5300144 -
tgataattaatgcaaaaact

SEQ ID NO: 40060 - DNA, 20 bp, Artificial Sequence
  Synthetic oligonucleotide; AAG chr11 5300136 5300155 5300139 -
attaatgcaaaaacttggca

SEQ ID NO: 40061 - DNA, 20 bp, Artificial Sequence
  Synthetic oligonucleotide; AGG chr11 5300135 5300154 5300138 -
ttaatgcaaaaacttggcaa

SEQ ID NO: 40062 - DNA, 20 bp, Artificial Sequence
  Synthetic oligonucleotide; TAG chr11 5300119 5300138 5300122 -
gcaaaggtaatgttatattt

SEQ ID NO: 40063 - DNA, 20 bp, Artificial Sequence
  Synthetic oligonucleotide; TGG chr11 5300102 5300121 5300105 -
ttttagaaatttttcactga

SEQ ID NO: 40064 - DNA, 20 bp, Artificial Sequence
  Synthetic oligonucleotide; TAG chr11 5300097 5300116 5300100 -
gaaatttttcactgatggaa

SEQ ID NO: 40065 - DNA, 20 bp, Artificial Sequence
  Synthetic oligonucleotide; AAG chr11 5300072 5300091 5300075 -
tcttccttcaatcttcttca

SEQ ID NO: 40066 - DNA, 20 bp, Artificial Sequence
  Synthetic oligonucleotide; AAG chr11 5300062 5300081 5300065 -
atcttcttcaaagtgtttgt

SEQ ID NO: 40067 - DNA, 20 bp, Artificial Sequence
  Synthetic oligonucleotide; TGG chr11 5300043 5300062 5300046 -
taagtctttatgctgttcat

SEQ ID NO: 40068 - DNA, 20 bp, Artificial Sequence
  Synthetic oligonucleotide; GGG chr11 5300042 5300061 5300045 -
aagtctttatgctgttcatt

SEQ ID NO: 40069 - DNA, 20 bp, Artificial Sequence
  Synthetic oligonucleotide; CAG chr11 5300030 5300049 5300033 -
tgttcattgggtctgaaccg

SEQ ID NO: 40070 - DNA, 20 bp, Artificial Sequence
  Synthetic oligonucleotide; TAG chr11 5300012 5300031 5300015 -
cgcagtctaccacttgctat

SEQ ID NO: 40071 - DNA, 20 bp, Artificial Sequence
  Synthetic oligonucleotide; CAG chr11 5300004 5300023 5300007 -
accacttgctattagtgtaa

SEQ ID NO: 40072 - DNA, 20 bp, Artificial Sequence
  Synthetic oligonucleotide; AGG chr11 5300003 5300022 5300006 -
ccacttgctattagtgtaac

SEQ ID NO: 40073 - DNA, 20 bp, Artificial Sequence
  Synthetic oligonucleotide; GGG chr11 5300002 5300021 5300005 -
cacttgctattagtgtaaca

SEQ ID NO: 40074 - DNA, 20 bp, Artificial Sequence
  Synthetic oligonucleotide; GGG chr11 5300001 5300020 5300004 -
acttgctattagtgtaacag

SEQ ID NO: 40075 - DNA, 20 bp, Artificial Sequence
  Synthetic oligonucleotide; TAG chr11 5299975 5299994 5299978 -
acaatttcttcatctactgc

SEQ ID NO: 40076 - DNA, 20 bp, Artificial Sequence
  Synthetic oligonucleotide; TAG chr11 5299964 5299983 5299967 -
atctactgctagttctgcgc

SEQ ID NO: 40077 - DNA, 20 bp, Artificial Sequence
  Synthetic oligonucleotide; CAG chr11 5299955 5299974 5299958 -
tagttctgcgctagtatttg

SEQ ID NO: 40078 - DNA, 20 bp, Artificial Sequence
  Synthetic oligonucleotide; TAG chr11 5299940 5299959 5299943 -
atttgcagctgatctcctta

SEQ ID NO: 40079 - DNA, 20 bp, Artificial Sequence
  Synthetic oligonucleotide; AGG chr11 5299939 5299958 5299942 -
tttgcagctgatctccttat

SEQ ID NO: 40080 - DNA, 20 bp, Artificial Sequence
  Synthetic oligonucleotide; AAG chr11 5299923 5299942 5299926 -
ttataggaaactaatctcaa

SEQ ID NO: 40081 - DNA, 20 bp, Artificial Sequence
  Synthetic oligonucleotide; AAG chr11 5299901 5299920 5299904 -
gttgcattcattcctctctg

SEQ ID NO: 40082 - DNA, 20 bp, Artificial Sequence
  Synthetic oligonucleotide; AAG chr11 5299876 5299895 5299879 -
tgctgtttcttccaattttt

SEQ ID NO: 40083 - DNA, 20 bp, Artificial Sequence
  Synthetic oligonucleotide; GAG chr11 5299865 5299884 5299868 -
ccaatttttaagttctcgtt

SEQ ID NO: 40084 - DNA, 20 bp, Artificial Sequence
  Synthetic oligonucleotide; AAG chr11 5299832 5299851 5299835 -
atattttcttttctgattga

SEQ ID NO: 40085 - DNA, 20 bp, Artificial Sequence
  Synthetic oligonucleotide; CAG chr11 5299821 5299840 5299824 -
tctgattgaaagtccatgtt

SEQ ID NO: 40086 - DNA, 20 bp, Artificial Sequence
  Synthetic oligonucleotide; CAG chr11 5299814 5299833 5299817 -
gaaagtccatgttcagaacc

SEQ ID NO: 40087 - DNA, 20 bp, Artificial Sequence
  Synthetic oligonucleotide; AAG chr11 5299772 5299791 5299775 -
aaattctctctgcttcactt

SEQ ID NO: 40088 - DNA, 20 bp, Artificial Sequence
  Synthetic oligonucleotide; TGG chr11 5299744 5299763 5299747 -
tttcatatttattttacatc

SEQ ID NO: 40089 - DNA, 20 bp, Artificial Sequence
  Synthetic oligonucleotide; CAG chr11 5299740 5299759 5299743 -
atatttattttacatctgga

SEQ ID NO: 40090 - DNA, 20 bp, Artificial Sequence
  Synthetic oligonucleotide; GAG chr11 5299736 5299755 5299739 -
ttattttacatctggacagt

SEQ ID NO: 40091 - DNA, 20 bp, Artificial Sequence
  Synthetic oligonucleotide; CAG chr11 5299717 5299736 5299720 -
tgagcactctgaaaatattc

SEQ ID NO: 40092 - DNA, 20 bp, Artificial Sequence
  Synthetic oligonucleotide; GAG chr11 5299715 5299734 5299718 -
agcactctgaaaatattcca

SEQ ID NO: 40093 - DNA, 20 bp, Artificial Sequence
  Synthetic oligonucleotide; AAG chr11 5299705 5299724 5299708 -
aaatattccagagatttgat

SEQ ID NO: 40094 - DNA, 20 bp, Artificial Sequence
  Synthetic oligonucleotide; AAG chr11 5299682 5299701 5299685 -
aaaatacttactgaaaacta

SEQ ID NO: 40095 - DNA, 20 bp, Artificial Sequence
  Synthetic oligonucleotide; CAG chr11 5299669 5299688 5299672 -
aaaactaaagctaaataatg

SEQ ID NO: 40096 - DNA, 20 bp, Artificial Sequence
  Synthetic oligonucleotide; TAG chr11 5299653 5299672 5299656 -
aatgcagtatttctccaaat

SEQ ID NO: 40097 - DNA, 20 bp, Artificial Sequence
  Synthetic oligonucleotide; AAG chr11 5299650 5299669 5299653 -
gcagtatttctccaaattag

SEQ ID NO: 40098 - DNA, 20 bp, Artificial Sequence
  Synthetic oligonucleotide; AGG chr11 5299649 5299668 5299652 -
cagtatttctccaaattaga

SEQ ID NO: 40099 - DNA, 20 bp, Artificial Sequence
  Synthetic oligonucleotide; TGG chr11 5299640 5299659 5299643 -
tccaaattagaaggcccatt

SEQ ID NO: 40100 - DNA, 20 bp, Artificial Sequence
  Synthetic oligonucleotide; CAG chr11 5299634 5299653 5299637 -
ttagaaggcccatttggatg

SEQ ID NO: 40101 - DNA, 20 bp, Artificial Sequence
  Synthetic oligonucleotide; AGG chr11 5299633 5299652 5299636 -
tagaaggcccatttggatgc

SEQ ID NO: 40102 - DNA, 20 bp, Artificial Sequence
  Synthetic oligonucleotide; AAG chr11 5299599 5299618 5299602 -
ctaataaatgactactcctg

SEQ ID NO: 40103 - DNA, 20 bp, Artificial Sequence
  Synthetic oligonucleotide; AGG chr11 5299598 5299617 5299601 -
taataaatgactactcctga

SEQ ID NO: 40104 - DNA, 20 bp, Artificial Sequence
  Synthetic oligonucleotide; CAG chr11 5299592 5299611 5299595 -
atgactactcctgaaggatt

SEQ ID NO: 40105 - DNA, 20 bp, Artificial Sequence
  Synthetic oligonucleotide; GAG chr11 5299569 5299588 5299572 -
ttattgtgcgaattgtttgt

SEQ ID NO: 40106 - DNA, 20 bp, Artificial Sequence
  Synthetic oligonucleotide; GAG chr11 5299567 5299586 5299570 -
attgtgcgaattgtttgtga

SEQ ID NO: 40107 - DNA, 20 bp, Artificial Sequence
  Synthetic oligonucleotide; AAG chr11 5299556 5299575 5299559 -
tgtttgtgagagttctttga

SEQ ID NO: 40108 - DNA, 20 bp, Artificial Sequence
  Synthetic oligonucleotide; TAG chr11 5299553 5299572 5299556 -
ttgtgagagttctttgaaag

SEQ ID NO: 40109 - DNA, 20 bp, Artificial Sequence
  Synthetic oligonucleotide; AGG chr11 5299552 5299571 5299555 -
tgtgagagttctttgaaagt

SEQ ID NO: 40110 - DNA, 20 bp, Artificial Sequence
  Synthetic oligonucleotide; TGG chr11 5299546 5299565 5299549 -
agttctttgaaagtaggacg

SEQ ID NO: 40111 - DNA, 20 bp, Artificial Sequence
  Synthetic oligonucleotide; GGG chr11 5299545 5299564 5299548 -
gttctttgaaagtaggacgt

SEQ ID NO: 40112 - DNA, 20 bp, Artificial Sequence
  Synthetic oligonucleotide; GGG chr11 5299544 5299563 5299547 -
ttctttgaaagtaggacgtg

SEQ ID NO: 40113 - DNA, 20 bp, Artificial Sequence
  Synthetic oligonucleotide; GGG chr11 5299543 5299562 5299546 -
tctttgaaagtaggacgtgg

SEQ ID NO: 40114 - DNA, 20 bp, Artificial Sequence
  Synthetic oligonucleotide; GGG chr11 5299542 5299561 5299545 -
ctttgaaagtaggacgtggg

SEQ ID NO: 40115 - DNA, 20 bp, Artificial Sequence
  Synthetic oligonucleotide; TAG chr11 5299522 5299541 5299525 -
gggtttattcattgtcattt

SEQ ID NO: 40116 - DNA, 20 bp, Artificial Sequence
  Synthetic oligonucleotide; AAG chr11 5299479 5299498 5299482 -
tttatttatttgtttttcca

SEQ ID NO: 40117 - DNA, 20 bp, Artificial Sequence
  Synthetic oligonucleotide; TGG chr11 5299475 5299494 5299478 -
tttatttgtttttccaaagt

SEQ ID NO: 40118 - DNA, 20 bp, Artificial Sequence
  Synthetic oligonucleotide; CAG chr11 5299468 5299487 5299471 -
gtttttccaaagttggcata

SEQ ID NO: 40119 - DNA, 20 bp, Artificial Sequence
  Synthetic oligonucleotide; GAG chr11 5299466 5299485 5299469 -
ttttccaaagttggcataca

SEQ ID NO: 40120 - DNA, 20 bp, Artificial Sequence
  Synthetic oligonucleotide; TAG chr11 5299452 5299471 5299455 -
catacagagtttattctatt

SEQ ID NO: 40121 - DNA, 20 bp, Artificial Sequence
  Synthetic oligonucleotide; TGG chr11 5299436 5299455 5299439 -
tatttagaaacgtcgttttc

SEQ ID NO: 40122 - DNA, 20 bp, Artificial Sequence
  Synthetic oligonucleotide; TGG chr11 5299419 5299438 5299422 -
ttctggttgcctttgttgtt

SEQ ID NO: 40123 - DNA, 20 bp, Artificial Sequence
  Synthetic oligonucleotide; TAG chr11 5299379 5299398 5299382 -
gctaacatacaaactacatt

SEQ ID NO: 40124 - DNA, 20 bp, Artificial Sequence
  Synthetic oligonucleotide; AGG chr11 5299378 5299397 5299381 -
ctaacatacaaactacattt

SEQ ID NO: 40125 - DNA, 20 bp, Artificial Sequence
  Synthetic oligonucleotide; AAG chr11 5299374 5299393 5299377 -
catacaaactacatttagga

SEQ ID NO: 40126 - DNA, 20 bp, Artificial Sequence
  Synthetic oligonucleotide; AAG chr11 5299349 5299368 5299352 -
gcatctctattgaccactga

SEQ ID NO: 40127 - DNA, 20 bp, Artificial Sequence
  Synthetic oligonucleotide; AGG chr11 5299348 5299367 5299351 -
catctctattgaccactgaa

SEQ ID NO: 40128 - DNA, 20 bp, Artificial Sequence
  Synthetic oligonucleotide; AAG chr11 5299337 5299356 5299340 -
accactgaaaggatgtctgt

SEQ ID NO: 40129 - DNA, 20 bp, Artificial Sequence
  Synthetic oligonucleotide; GAG chr11 5299335 5299354 5299338 -
cactgaaaggatgtctgtaa

SEQ ID NO: 40130 - DNA, 20 bp, Artificial Sequence
  Synthetic oligonucleotide; TAG chr11 5299323 5299342 5299326 -
gtctgtaagagtaaaaaaca

SEQ ID NO: 40131 - DNA, 20 bp, Artificial Sequence
  Synthetic oligonucleotide; CGG chr11 5299320 5299339 5299323 -
tgtaagagtaaaaaacatag

SEQ ID NO: 40132 - DNA, 20 bp, Artificial Sequence
  Synthetic oligonucleotide; CAG chr11 5299305 5299324 5299308 -
catagcggtattaaaatttt

SEQ ID NO: 40133 - DNA, 20 bp, Artificial Sequence
  Synthetic oligonucleotide; AGG chr11 5299304 5299323 5299307 -
atagcggtattaaaattttc

SEQ ID NO: 40134 - DNA, 20 bp, Artificial Sequence
  Synthetic oligonucleotide; AAG chr11 5299296 5299315 5299299 -
attaaaattttcaggcgaat

SEQ ID NO: 40135 - DNA, 20 bp, Artificial Sequence
  Synthetic oligonucleotide; AGG chr11 5299295 5299314 5299298 -
ttaaaattttcaggcgaata

SEQ ID NO: 40136 - DNA, 20 bp, Artificial Sequence
  Synthetic oligonucleotide; GGG chr11 5299294 5299313 5299297 -
taaaattttcaggcgaataa

SEQ ID NO: 40137 - DNA, 20 bp, Artificial Sequence
  Synthetic oligonucleotide; TGG chr11 5299278 5299297 5299281 -
ataagggttttttgtaaaaa

SEQ ID NO: 40138 - DNA, 20 bp, Artificial Sequence
  Synthetic oligonucleotide; CAG chr11 5299262 5299281 5299265 -
aaaatggcaaatgtatttgt

SEQ ID NO: 40139 - DNA, 20 bp, Artificial Sequence
  Synthetic oligonucleotide; TAG chr11 5299259 5299278 5299262 -
atggcaaatgtatttgtcag

SEQ ID NO: 40140 - DNA, 20 bp, Artificial Sequence
  Synthetic oligonucleotide; AGG chr11 5299258 5299277 5299261 -
tggcaaatgtatttgtcagt

SEQ ID NO: 40141 - DNA, 20 bp, Artificial Sequence
  Synthetic oligonucleotide; GGG chr11 5299257 5299276 5299260 -
ggcaaatgtatttgtcagta

SEQ ID NO: 40142 - DNA, 20 bp, Artificial Sequence
  Synthetic oligonucleotide; GGG chr11 5299256 5299275 5299259 -
gcaaatgtatttgtcagtag

SEQ ID NO: 40143 - DNA, 20 bp, Artificial Sequence
  Synthetic oligonucleotide; AAG chr11 5299225 5299244 5299228 -
gctgttttcttgattgttat

SEQ ID NO: 40144 - DNA, 20 bp, Artificial Sequence
  Synthetic oligonucleotide; AAG chr11 5299222 5299241 5299225 -
gttttcttgattgttataag

SEQ ID NO: 40145 - DNA, 20 bp, Artificial Sequence
  Synthetic oligonucleotide; CAG chr11 5299218 5299237 5299221 -
tcttgattgttataagaaga

SEQ ID NO: 40146 - DNA, 20 bp, Artificial Sequence
  Synthetic oligonucleotide; TAG chr11 5299182 5299201 5299185 -
gtaaatgtgtaatgcaaact

SEQ ID NO: 40147 - DNA, 20 bp, Artificial Sequence
  Synthetic oligonucleotide; AGG chr11 5299181 5299200 5299184 -
taaatgtgtaatgcaaactt

SEQ ID NO: 40148 - DNA, 20 bp, Artificial Sequence
  Synthetic oligonucleotide; GGG chr11 5299180 5299199 5299183 -
aaatgtgtaatgcaaactta

SEQ ID NO: 40149 - DNA, 20 bp, Artificial Sequence
  Synthetic oligonucleotide; GGG chr11 5299179 5299198 5299182 -
aatgtgtaatgcaaacttag

SEQ ID NO: 40150 - DNA, 20 bp, Artificial Sequence
  Synthetic oligonucleotide; AAG chr11 5299161 5299180 5299164 -
aggggcgatgtgctgaaaat

SEQ ID NO: 40151 - DNA, 20 bp, Artificial Sequence
  Synthetic oligonucleotide; AGG chr11 5299160 5299179 5299163 -
ggggcgatgtgctgaaaata

SEQ ID NO: 40152 - DNA, 20 bp, Artificial Sequence
  Synthetic oligonucleotide; TAG chr11 5299152 5299171 5299155 -
gtgctgaaaataaggtatga

SEQ ID NO: 40153 - DNA, 20 bp, Artificial Sequence
  Synthetic oligonucleotide; AAG chr11 5299147 5299166 5299150 -
gaaaataaggtatgatagcg

SEQ ID NO: 40154 - DNA, 20 bp, Artificial Sequence
  Synthetic oligonucleotide; AAG chr11 5299141 5299160 5299144 -
aaggtatgatagcgaagtct

SEQ ID NO: 40155 - DNA, 20 bp, Artificial Sequence
  Synthetic oligonucleotide; CAG chr11 5299135 5299154 5299138 -
tgatagcgaagtctaagaaa

SEQ ID NO: 40156 - DNA, 20 bp, Artificial Sequence
  Synthetic oligonucleotide; GAG chr11 5299133 5299152 5299136 -
atagcgaagtctaagaaaca

SEQ ID NO: 40157 - DNA, 20 bp, Artificial Sequence
  Synthetic oligonucleotide; AGG chr11 5299132 5299151 5299135 -
tagcgaagtctaagaaacag

SEQ ID NO: 40158 - DNA, 20 bp, Artificial Sequence
  Synthetic oligonucleotide; AAG chr11 5299114 5299133 5299117 -
agaggtatctaattataaat

SEQ ID NO: 40159 - DNA, 20 bp, Artificial Sequence
  Synthetic oligonucleotide; AAG chr11 5299111 5299130 5299114 -
ggtatctaattataaataag

SEQ ID NO: 40160 - DNA, 20 bp, Artificial Sequence
  Synthetic oligonucleotide; AAG chr11 5299108 5299127 5299111 -
atctaattataaataagaag

SEQ ID NO: 40161 - DNA, 20 bp, Artificial Sequence
  Synthetic oligonucleotide; TGG chr11 5299105 5299124 5299108 -
taattataaataagaagaag

SEQ ID NO: 40162 - DNA, 20 bp, Artificial Sequence
  Synthetic oligonucleotide; GGG chr11 5299104 5299123 5299107 -
aattataaataagaagaagt

SEQ ID NO: 40163 - DNA, 20 bp, Artificial Sequence
  Synthetic oligonucleotide; AAG chr11 5299101 5299120 5299104 -
tataaataagaagaagtggg

SEQ ID NO: 40164 - DNA, 20 bp, Artificial Sequence
  Synthetic oligonucleotide; AAG chr11 5299095 5299114 5299098 -
taagaagaagtgggaagatc

SEQ ID NO: 40165 - DNA, 20 bp, Artificial Sequence
  Synthetic oligonucleotide; GAG chr11 5299090 5299109 5299093 -
agaagtgggaagatcaagtt

SEQ ID NO: 40166 - DNA, 20 bp, Artificial Sequence
  Synthetic oligonucleotide; GAG chr11 5299088 5299107 5299091 -
aagtgggaagatcaagttga

SEQ ID NO: 40167 - DNA, 20 bp, Artificial Sequence
  Synthetic oligonucleotide; AAG chr11 5299082 5299101 5299085 -
gaagatcaagttgagagctc

SEQ ID NO: 40168 - DNA, 20 bp, Artificial Sequence
  Synthetic oligonucleotide; TAG chr11 5299066 5299085 5299069 -
gctcaagtttactcatatgt

SEQ ID NO: 40169 - DNA, 20 bp, Artificial Sequence
  Synthetic oligonucleotide; AAG chr11 5299062 5299081 5299065 -
aagtttactcatatgttagc

SEQ ID NO: 40170 - DNA, 20 bp, Artificial Sequence
  Synthetic oligonucleotide; AGG chr11 5299061 5299080 5299064 -
agtttactcatatgttagca

SEQ ID NO: 40171 - DNA, 20 bp, Artificial Sequence
  Synthetic oligonucleotide; GGG chr11 5299060 5299079 5299063 -
gtttactcatatgttagcaa

SEQ ID NO: 40172 - DNA, 20 bp, Artificial Sequence
  Synthetic oligonucleotide; TAG chr11 5299038 5299057 5299041 -
gatgacataatatgatatta

SEQ ID NO: 40173 - DNA, 20 bp, Artificial Sequence
  Synthetic oligonucleotide; CAG chr11 5299019 5299038 5299022 -
atagcctattgatctttaaa

SEQ ID NO: 40174 - DNA, 20 bp, Artificial Sequence
  Synthetic oligonucleotide; TAG chr11 5299006 5299025 5299009 -
ctttaaacagcctgtatcaa

SEQ ID NO: 40175 - DNA, 20 bp, Artificial Sequence
  Synthetic oligonucleotide; AAG chr11 5298987 5299006 5298990 -
atagtcaaaaatcaattaaa

SEQ ID NO: 40176 - DNA, 20 bp, Artificial Sequence
  Synthetic oligonucleotide; AGG chr11 5298986 5299005 5298989 -
tagtcaaaaatcaattaaaa

SEQ ID NO: 40177 - DNA, 20 bp, Artificial Sequence
  Synthetic oligonucleotide; AAG chr11 5298955 5298974 5298958 -
taaaaatcactcattttctt

SEQ ID NO: 40178 - DNA, 20 bp, Artificial Sequence
  Synthetic oligonucleotide; TAG chr11 5298884 5298903 5298887 -
tattatattttacaacttct

SEQ ID NO: 40179 - DNA, 20 bp, Artificial Sequence
  Synthetic oligonucleotide; AAG chr11 5298859 5298878 5298862 -
tgaaaatcctttcaattatt

SEQ ID NO: 40180 - DNA, 20 bp, Artificial Sequence
  Synthetic oligonucleotide; CAG chr11 5298855 5298874 5298858 -
aatcctttcaattattaagt

SEQ ID NO: 40181 - DNA, 20 bp, Artificial Sequence
  Synthetic oligonucleotide; CAG chr11 5298836 5298855 5298839 -
tcagcatccacctgctgatc

SEQ ID NO: 40182 - DNA, 20 bp, Artificial Sequence
  Synthetic oligonucleotide; AAG chr11 5298825 5298844 5298828 -
ctgctgatccagtgatatat

SEQ ID NO: 40183 - DNA, 20 bp, Artificial Sequence
  Synthetic oligonucleotide; AGG chr11 5298824 5298843 5298827 -
tgctgatccagtgatatata

SEQ ID NO: 40184 - DNA, 20 bp, Artificial Sequence
  Synthetic oligonucleotide; AAG chr11 5298803 5298822 5298806 -
ggacatttattgcaccactg

SEQ ID NO: 40185 - DNA, 20 bp, Artificial Sequence
  Synthetic oligonucleotide; CAG chr11 5298794 5298813 5298797 -
ttgcaccactgaagtaaaat

SEQ ID NO: 40186 - DNA, 20 bp, Artificial Sequence
  Synthetic oligonucleotide; AAG chr11 5298778 5298797 5298781 -
aaatcagtgtcctttcaaac

SEQ ID NO: 40187 - DNA, 20 bp, Artificial Sequence
  Synthetic oligonucleotide; CAG chr11 5298773 5298792 5298776 -
agtgtcctttcaaacaagtg

SEQ ID NO: 40188 - DNA, 20 bp, Artificial Sequence
  Synthetic oligonucleotide; CAG chr11 5298766 5298785 5298769 -
tttcaaacaagtgcagcttc

SEQ ID NO: 40189 - DNA, 20 bp, Artificial Sequence
  Synthetic oligonucleotide; AAG chr11 5298761 5298780 5298764 -
aacaagtgcagcttccagac

SEQ ID NO: 40190 - DNA, 20 bp, Artificial Sequence
  Synthetic oligonucleotide; TAG chr11 5298753 5298772 5298756 -
cagcttccagacaagtctct

SEQ ID NO: 40191 - DNA, 20 bp, Artificial Sequence
  Synthetic oligonucleotide; CAG chr11 5298740 5298759 5298743 -
agtctcttagacctcatcct

SEQ ID NO: 40192 - DNA, 20 bp, Artificial Sequence
  Synthetic oligonucleotide; AAG chr11 5298721 5298740 5298724 -
tcagtctcaccctgactgac

SEQ ID NO: 40193 - DNA, 20 bp, Artificial Sequence
  Synthetic oligonucleotide; GAG chr11 5298706 5298725 5298709 -
ctgacaagtttgccatactt

SEQ ID NO: 40194 - DNA, 20 bp, Artificial Sequence
  Synthetic oligonucleotide; AAG chr11 5298694 5298713 5298697 -
ccatacttgagaaccttgtg

SEQ ID NO: 40195 - DNA, 20 bp, Artificial Sequence
  Synthetic oligonucleotide; CAG chr11 5298691 5298710 5298694 -
tacttgagaaccttgtgaag

SEQ ID NO: 40196 - DNA, 20 bp, Artificial Sequence
  Synthetic oligonucleotide; AGG chr11 5298690 5298709 5298693 -
acttgagaaccttgtgaagc

SEQ ID NO: 40197 - DNA, 20 bp, Artificial Sequence
  Synthetic oligonucleotide; AAG chr11 5298675 5298694 5298678 -
gaagcaggcgttgtgtctat

SEQ ID NO: 40198 - DNA, 20 bp, Artificial Sequence
  Synthetic oligonucleotide; TAG chr11 5298666 5298685 5298669 -
gttgtgtctataagctctct

SEQ ID NO: 40199 - DNA, 20 bp, Artificial Sequence
  Synthetic oligonucleotide; GAG chr11 5298664 5298683 5298667 -
tgtgtctataagctctctta

SEQ ID NO: 40200 - DNA, 20 bp, Artificial Sequence
  Synthetic oligonucleotide; GAG chr11 5298652 5298671 5298655 -
ctctcttagagatctgctct

SEQ ID NO: 40201 - DNA, 20 bp, Artificial Sequence
  Synthetic oligonucleotide; AGG chr11 5298651 5298670 5298654 -
tctcttagagatctgctctg

SEQ ID NO: 40202 - DNA, 20 bp, Artificial Sequence
  Synthetic oligonucleotide; AAG chr11 5298641 5298660 5298644 -
atctgctctgaggaattatc

SEQ ID NO: 40203 - DNA, 20 bp, Artificial Sequence
  Synthetic oligonucleotide; CAG chr11 5298637 5298656 5298640 -
gctctgaggaattatcaagt

SEQ ID NO: 40204 - DNA, 20 bp, Artificial Sequence
  Synthetic oligonucleotide; CAG chr11 5298632 5298651 5298635 -
gaggaattatcaagtcagca

SEQ ID NO: 40205 - DNA, 20 bp, Artificial Sequence
  Synthetic oligonucleotide; GAG chr11 5298609 5298628 5298612 -
ttaattctctgtcatactgt

SEQ ID NO: 40206 - DNA, 20 bp, Artificial Sequence
  Synthetic oligonucleotide; TAG chr11 5298604 5298623 5298607 -
tctctgtcatactgtgagtt

SEQ ID NO: 40207 - DNA, 20 bp, Artificial Sequence
  Synthetic oligonucleotide; CAG chr11 5298600 5298619 5298603 -
tgtcatactgtgagtttagt

SEQ ID NO: 40208 - DNA, 20 bp, Artificial Sequence
  Synthetic oligonucleotide; AGG chr11 5298599 5298618 5298602 -
gtcatactgtgagtttagtc

SEQ ID NO: 40209 - DNA, 20 bp, Artificial Sequence
  Synthetic oligonucleotide; GGG chr11 5298598 5298617 5298601 -
tcatactgtgagtttagtca

SEQ ID NO: 40210 - DNA, 20 bp, Artificial Sequence
  Synthetic oligonucleotide; CAG chr11 5298595 5298614 5298598 -
tactgtgagtttagtcaggg

SEQ ID NO: 40211 - DNA, 20 bp, Artificial Sequence
  Synthetic oligonucleotide; CAG chr11 5298575 5298594 5298578 -
cagtaattatatttccccat

SEQ ID NO: 40212 - DNA, 20 bp, Artificial Sequence
  Synthetic oligonucleotide; AAG chr11 5298558 5298577 5298561 -
catcagcatattgtcttccc

SEQ ID NO: 40213 - DNA, 20 bp, Artificial Sequence
  Synthetic oligonucleotide; AGG chr11 5298557 5298576 5298560 -
atcagcatattgtcttccca

SEQ ID NO: 40214 - DNA, 20 bp, Artificial Sequence
  Synthetic oligonucleotide; CAG chr11 5298513 5298532 5298516 -
aacccccaaatttattaatg

SEQ ID NO: 40215 - DNA, 20 bp, Artificial Sequence
  Synthetic oligonucleotide; TGG chr11 5298481 5298500 5298484 -
aatacacaatgttacttgtc

SEQ ID NO: 40216 - DNA, 20 bp, Artificial Sequence
  Synthetic oligonucleotide; TGG chr11 5298476 5298495 5298479 -
acaatgttacttgtctggtg

SEQ ID NO: 40217 - DNA, 20 bp, Artificial Sequence
  Synthetic oligonucleotide; AAG chr11 5298470 5298489 5298473 -
ttacttgtctggtgtggcta

SEQ ID NO: 40218 - DNA, 20 bp, Artificial Sequence
  Synthetic oligonucleotide; TAG chr11 5298437 5298456 5298440 -
tatttatttatttattttta

SEQ ID NO: 40219 - DNA, 20 bp, Artificial Sequence
  Synthetic oligonucleotide; CAG chr11 5298413 5298432 5298416 -
catgatcttgctctgttgcc

SEQ ID NO: 40220 - DNA, 20 bp, Artificial Sequence
  Synthetic oligonucleotide; AGG chr11 5298412 5298431 5298415 -
atgatcttgctctgttgccc

SEQ ID NO: 40221 - DNA, 20 bp, Artificial Sequence
  Synthetic oligonucleotide; TGG chr11 5298408 5298427 5298411 -
tcttgctctgttgcccaggc

SEQ ID NO: 40222 - DNA, 20 bp, Artificial Sequence
  Synthetic oligonucleotide; GAG chr11 5298406 5298425 5298409 -
ttgctctgttgcccaggctg

SEQ ID NO: 40223 - DNA, 20 bp, Artificial Sequence
  Synthetic oligonucleotide; CAG chr11 5298401 5298420 5298404 -
ctgttgcccaggctggagtg

SEQ ID NO: 40224 - DNA, 20 bp, Artificial Sequence
  Synthetic oligonucleotide; TGG chr11 5298398 5298417 5298401 -
ttgcccaggctggagtgcag

SEQ ID NO: 40225 - DNA, 20 bp, Artificial Sequence
  Synthetic oligonucleotide; CAG chr11 5298387 5298406 5298390 -
ggagtgcagtggtgccatca

SEQ ID NO: 40226 - DNA, 20 bp, Artificial Sequence
  Synthetic oligonucleotide; CAG chr11 5298377 5298396 5298380 -
ggtgccatcacagctcactg

SEQ ID NO: 40227 - DNA, 20 bp, Artificial Sequence
  Synthetic oligonucleotide; TGG chr11 5298363 5298382 5298366 -
tcactgcagccttgaaatcc

SEQ ID NO: 40228 - DNA, 20 bp, Artificial Sequence
  Synthetic oligonucleotide; GGG chr11 5298362 5298381 5298365 -
cactgcagccttgaaatcct

SEQ ID NO: 40229 - DNA, 20 bp, Artificial Sequence
  Synthetic oligonucleotide; AAG chr11 5298356 5298375 5298359 -
agccttgaaatcctgggctc

SEQ ID NO: 40230 - DNA, 20 bp, Artificial Sequence
  Synthetic oligonucleotide; CAG chr11 5298339 5298358 5298342 -
ctcaagcaatccttcttcct

SEQ ID NO: 40231 - DNA, 20 bp, Artificial Sequence
  Synthetic oligonucleotide; GAG chr11 5298330 5298349 5298333 -
tccttcttcctcagcttttt

SEQ ID NO: 40232 - DNA, 20 bp, Artificial Sequence
  Synthetic oligonucleotide; TAG chr11 5298323 5298342 5298326 -
tcctcagctttttgagtacc

SEQ ID NO: 40233 - DNA, 20 bp, Artificial Sequence
  Synthetic oligonucleotide; AGG chr11 5298322 5298341 5298325 -
cctcagctttttgagtacct

SEQ ID NO: 40234 - DNA, 20 bp, Artificial Sequence
  Synthetic oligonucleotide; CAG chr11 5298315 5298334 5298318 -
tttttgagtacctaggacta

SEQ ID NO: 40235 - DNA, 20 bp, Artificial Sequence
  Synthetic oligonucleotide; AGG chr11 5298314 5298333 5298317 -
ttttgagtacctaggactac

SEQ ID NO: 40236 - DNA, 20 bp, Artificial Sequence
  Synthetic oligonucleotide; TAG chr11 5298295 5298314 5298298 -
caggtttatgccactgcacc

SEQ ID NO: 40237 - DNA, 20 bp, Artificial Sequence
  Synthetic oligonucleotide; TGG chr11 5298267 5298286 5298270 -
gtttttattttttgtaaata

SEQ ID NO: 40238 - DNA, 20 bp, Artificial Sequence
  Synthetic oligonucleotide; GGG chr11 5298266 5298285 5298269 -
tttttattttttgtaaatat

SEQ ID NO: 40239 - DNA, 20 bp, Artificial Sequence
  Synthetic oligonucleotide; GAG chr11 5298247 5298266 5298250 -
tgggatcatgttatgttgcc

SEQ ID NO: 40240 - DNA, 20 bp, Artificial Sequence
  Synthetic oligonucleotide; AGG chr11 5298246 5298265 5298249 -
gggatcatgttatgttgccg

SEQ ID NO: 40241 - DNA, 20 bp, Artificial Sequence
  Synthetic oligonucleotide; AAG chr11 5298221 5298240 5298224 -
gctctccaattcctaacctc

SEQ ID NO: 40242 - DNA, 20 bp, Artificial Sequence
  Synthetic oligonucleotide; TGG chr11 5298204 5298223 5298207 -
ctcaagcaatcctcccaccc

SEQ ID NO: 40243 - DNA, 20 bp, Artificial Sequence
  Synthetic oligonucleotide; TAG chr11 5298190 5298209 5298193 -
ccaccctggcctcctaatga

SEQ ID NO: 40244 - DNA, 20 bp, Artificial Sequence
  Synthetic oligonucleotide; AGG chr11 5298189 5298208 5298192 -
caccctggcctcctaatgat

SEQ ID NO: 40245 - DNA, 20 bp, Artificial Sequence
  Synthetic oligonucleotide; GGG chr11 5298188 5298207 5298191 -
accctggcctcctaatgata

SEQ ID NO: 40246 - DNA, 20 bp, Artificial Sequence
  Synthetic oligonucleotide; CAG chr11 5298184 5298203 5298187 -
tggcctcctaatgataggga

SEQ ID NO: 40247 - DNA, 20 bp, Artificial Sequence
  Synthetic oligonucleotide; AGG chr11 5298183 5298202 5298186 -
ggcctcctaatgatagggac

SEQ ID NO: 40248 - DNA, 20 bp, Artificial Sequence
  Synthetic oligonucleotide; GAG chr11 5298181 5298200 5298184 -
cctcctaatgatagggacag

SEQ ID NO: 40249 - DNA, 20 bp, Artificial Sequence
  Synthetic oligonucleotide; AGG chr11 5298180 5298199 5298183 -
ctcctaatgatagggacagg

SEQ ID NO: 40250 - DNA, 20 bp, Artificial Sequence
  Synthetic oligonucleotide; CAG chr11 5298177 5298196 5298180 -
ctaatgatagggacaggagg

SEQ ID NO: 40251 - DNA, 20 bp, Artificial Sequence
  Synthetic oligonucleotide; GAG chr11 5298175 5298194 5298178 -
aatgatagggacaggaggca

SEQ ID NO: 40252 - DNA, 20 bp, Artificial Sequence
  Synthetic oligonucleotide; TAG chr11 5298166 5298185 5298169 -
gacaggaggcagagaaattt

SEQ ID NO: 40253 - DNA, 20 bp, Artificial Sequence
  Synthetic oligonucleotide; AGG chr11 5298165 5298184 5298168 -
acaggaggcagagaaatttt

SEQ ID NO: 40254 - DNA, 20 bp, Artificial Sequence
  Synthetic oligonucleotide; CAG chr11 5298162 5298181 5298165 -
ggaggcagagaaattttagg

SEQ ID NO: 40255 - DNA, 20 bp, Artificial Sequence
  Synthetic oligonucleotide; AAG chr11 5298157 5298176 5298160 -
cagagaaattttaggcagaa

SEQ ID NO: 40256 - DNA, 20 bp, Artificial Sequence
  Synthetic oligonucleotide; AGG chr11 5298156 5298175 5298159 -
agagaaattttaggcagaaa

SEQ ID NO: 40257 - DNA, 20 bp, Artificial Sequence
  Synthetic oligonucleotide; GGG chr11 5298155 5298174 5298158 -
gagaaattttaggcagaaaa

SEQ ID NO: 40258 - DNA, 20 bp, Artificial Sequence
  Synthetic oligonucleotide; CGG chr11 5298152 5298171 5298155 -
aaattttaggcagaaaaggg

SEQ ID NO: 40259 - DNA, 20 bp, Artificial Sequence
  Synthetic oligonucleotide; GGG chr11 5298151 5298170 5298154 -
aattttaggcagaaaagggc

SEQ ID NO: 40260 - DNA, 20 bp, Artificial Sequence
  Synthetic oligonucleotide; GGG chr11 5298150 5298169 5298153 -
attttaggcagaaaagggcg

SEQ ID NO: 40261 - DNA, 20 bp, Artificial Sequence
  Synthetic oligonucleotide; TGG chr11 5298143 5298162 5298146 -
gcagaaaagggcggggtccc

SEQ ID NO: 40262 - DNA, 20 bp, Artificial Sequence
  Synthetic oligonucleotide; TGG chr11 5298138 5298157 5298141 -
aaagggcggggtccctggca

SEQ ID NO: 40263 - DNA, 20 bp, Artificial Sequence
  Synthetic oligonucleotide; GGG chr11 5298137 5298156 5298140 -
aagggcggggtccctggcat

SEQ ID NO: 40264 - DNA, 20 bp, Artificial Sequence
  Synthetic oligonucleotide; AAG chr11 5298124 5298143 5298127 -
ctggcatgggtcctaccctg

SEQ ID NO: 40265 - DNA, 20 bp, Artificial Sequence
  Synthetic oligonucleotide; TGG chr11 5298119 5298138 5298122 -
atgggtcctaccctgaagcc

SEQ ID NO: 40266 - DNA, 20 bp, Artificial Sequence
  Synthetic oligonucleotide; TGG chr11 5298112 5298131 5298115 -
ctaccctgaagcctggaaca

SEQ ID NO: 40267 - DNA, 20 bp, Artificial Sequence
  Synthetic oligonucleotide; GAG chr11 5298101 5298120 5298104 -
cctggaacatggccattcct

SEQ ID NO: 40268 - DNA, 20 bp, Artificial Sequence
  Synthetic oligonucleotide; CAG chr11 5298088 5298107 5298091 -
cattcctgagatatttctct

SEQ ID NO: 40269 - DNA, 20 bp, Artificial Sequence
  Synthetic oligonucleotide; CAG chr11 5298084 5298103 5298087 -
cctgagatatttctctcagc

SEQ ID NO: 40270 - DNA, 20 bp, Artificial Sequence
  Synthetic oligonucleotide; AAG chr11 5298059 5298078 5298062 -
ctgtttcacattcacatttt

SEQ ID NO: 40271 - DNA, 20 bp, Artificial Sequence
  Synthetic oligonucleotide; CAG chr11 5298053 5298072 5298056 -
cacattcacattttaagtgc

SEQ ID NO: 40272 - DNA, 20 bp, Artificial Sequence
  Synthetic oligonucleotide; AGG chr11 5298052 5298071 5298055 -
acattcacattttaagtgcc

SEQ ID NO: 40273 - DNA, 20 bp, Artificial Sequence
  Synthetic oligonucleotide; TAG chr11 5298035 5298054 5298038 -
gccaggtctttctatctttc

SEQ ID NO: 40274 - DNA, 20 bp, Artificial Sequence
  Synthetic oligonucleotide; TAG chr11 5298011 5298030 5298014 -
tgtcttattcatgcactttc

SEQ ID NO: 40275 - DNA, 20 bp, Artificial Sequence
  Synthetic oligonucleotide; CAG chr11 5297924 5297943 5297927 -
ttgtctcatgaatattccct

SEQ ID NO: 40276 - DNA, 20 bp, Artificial Sequence
  Synthetic oligonucleotide; AGG chr11 5297923 5297942 5297926 -
tgtctcatgaatattccctc

SEQ ID NO: 40277 - DNA, 20 bp, Artificial Sequence
  Synthetic oligonucleotide; TAG chr11 5297891 5297910 5297894 -
cccacgccgttccctttatc

SEQ ID NO: 40278 - DNA, 20 bp, Artificial Sequence
  Synthetic oligonucleotide; TAG chr11 5297858 5297877 5297861 -
attcctcttgctgtactgat

SEQ ID NO: 40279 - DNA, 20 bp, Artificial Sequence
  Synthetic oligonucleotide; TAG chr11 5297840 5297859 5297843 -
attagccttgactcctctta

SEQ ID NO: 40280 - DNA, 20 bp, Artificial Sequence
  Synthetic oligonucleotide; CAG chr11 5297830 5297849 5297833 -
actcctcttatagctcaccc

SEQ ID NO: 40281 - DNA, 20 bp, Artificial Sequence
  Synthetic oligonucleotide; TGG chr11 5297822 5297841 5297825 -
tatagctcaccccagcctct

SEQ ID NO: 40282 - DNA, 20 bp, Artificial Sequence
  Synthetic oligonucleotide; AAG chr11 5297809 5297828 5297812 -
agcctcttggcattattatc

SEQ ID NO: 40283 - DNA, 20 bp, Artificial Sequence
  Synthetic oligonucleotide; CAG chr11 5297798 5297817 5297801 -
attattatcaagtgttacca

SEQ ID NO: 40284 - DNA, 20 bp, Artificial Sequence
  Synthetic oligonucleotide; CAG chr11 5297790 5297809 5297793 -
caagtgttaccacagttgaa

SEQ ID NO: 40285 - DNA, 20 bp, Artificial Sequence
  Synthetic oligonucleotide; TGG chr11 5297786 5297805 5297789 -
tgttaccacagttgaacagc

SEQ ID NO: 40286 - DNA, 20 bp, Artificial Sequence
  Synthetic oligonucleotide; AAG chr11 5297777 5297796 5297780 -
agttgaacagctggatccaa

SEQ ID NO: 40287 - DNA, 20 bp, Artificial Sequence
  Synthetic oligonucleotide; AAG chr11 5297763 5297782 5297766 -
atccaaaagtattgaccaat

SEQ ID NO: 40288 - DNA, 20 bp, Artificial Sequence
  Synthetic oligonucleotide; AGG chr11 5297762 5297781 5297765 -
tccaaaagtattgaccaata

SEQ ID NO: 40289 - DNA, 20 bp, Artificial Sequence
  Synthetic oligonucleotide; CAG chr11 5297757 5297776 5297760 -
aagtattgaccaataaggaa

SEQ ID NO: 40290 - DNA, 20 bp, Artificial Sequence
  Synthetic oligonucleotide; TGG chr11 5297724 5297743 5297727 -
ttgcaatgtaaattataata

SEQ ID NO: 40291 - DNA, 20 bp, Artificial Sequence
  Synthetic oligonucleotide; AAG chr11 5297719 5297738 5297722 -
atgtaaattataatatggat

SEQ ID NO: 40292 - DNA, 20 bp, Artificial Sequence
  Synthetic oligonucleotide; TGG chr11 5297713 5297732 5297716 -
attataatatggataagcat

SEQ ID NO: 40293 - DNA, 20 bp, Artificial Sequence
  Synthetic oligonucleotide; AAG chr11 5297699 5297718 5297702 -
aagcattggtactaaacctg

SEQ ID NO: 40294 - DNA, 20 bp, Artificial Sequence
  Synthetic oligonucleotide; TAG chr11 5297695 5297714 5297698 -
attggtactaaacctgaagt

SEQ ID NO: 40295 - DNA, 20 bp, Artificial Sequence
  Synthetic oligonucleotide; AAG chr11 5297673 5297692 5297676 -
gtattttactctatacctac

SEQ ID NO: 40296 - DNA, 20 bp, Artificial Sequence
  Synthetic oligonucleotide; AGG chr11 5297672 5297691 5297675 -
tattttactctatacctaca

SEQ ID NO: 40297 - DNA, 20 bp, Artificial Sequence
  Synthetic oligonucleotide; AAG chr11 5297669 5297688 5297672 -
tttactctatacctacaagg

SEQ ID NO: 40298 - DNA, 20 bp, Artificial Sequence
  Synthetic oligonucleotide; AAG chr11 5297660 5297679 5297663 -
tacctacaaggaagatatac

SEQ ID NO: 40299 - DNA, 20 bp, Artificial Sequence
  Synthetic oligonucleotide; AAG chr11 5297648 5297667 5297651 -
agatatacaagtatttctct

SEQ ID NO: 40300 - DNA, 20 bp, Artificial Sequence
  Synthetic oligonucleotide; AGG chr11 5297647 5297666 5297650 -
gatatacaagtatttctcta

SEQ ID NO: 40301 - DNA, 20 bp, Artificial Sequence
  Synthetic oligonucleotide; TAG chr11 5297644 5297663 5297647 -
atacaagtatttctctaagg

SEQ ID NO: 40302 - DNA, 20 bp, Artificial Sequence
  Synthetic oligonucleotide; AAG chr11 5297635 5297654 5297638 -
tttctctaaggtagtttgaa

SEQ ID NO: 40303 - DNA, 20 bp, Artificial Sequence
  Synthetic oligonucleotide; TAG chr11 5297630 5297649 5297633 -
ctaaggtagtttgaaaagcc

SEQ ID NO: 40304 - DNA, 20 bp, Artificial Sequence
  Synthetic oligonucleotide; TAG chr11 5297624 5297643 5297627 -
tagtttgaaaagcctagata

SEQ ID NO: 40305 - DNA, 20 bp, Artificial Sequence
  Synthetic oligonucleotide; TGG chr11 5297617 5297636 5297620 -
aaaagcctagatatagaaac

SEQ ID NO: 40306 - DNA, 20 bp, Artificial Sequence
  Synthetic oligonucleotide; GAG chr11 5297604 5297623 5297607 -
tagaaactggatcctcacat

SEQ ID NO: 40307 - DNA, 20 bp, Artificial Sequence
  Synthetic oligonucleotide; CAG chr11 5297599 5297618 5297602 -
actggatcctcacatgagtt

SEQ ID NO: 40308 - DNA, 20 bp, Artificial Sequence
  Synthetic oligonucleotide; CAG chr11 5297583 5297602 5297586 -
agttcagtatataattgtaa

SEQ ID NO: 40309 - DNA, 20 bp, Artificial Sequence
  Synthetic oligonucleotide; AAG chr11 5297557 5297576 5297560 -
aaaaaatcaattatgtattc

SEQ ID NO: 40310 - DNA, 20 bp, Artificial Sequence
  Synthetic oligonucleotide; TAG chr11 5297550 5297569 5297553 -
caattatgtattcaagttgc

SEQ ID NO: 40311 - DNA, 20 bp, Artificial Sequence
  Synthetic oligonucleotide; AAG chr11 5297541 5297560 5297544 -
attcaagttgctagtgtctt

SEQ ID NO: 40312 - DNA, 20 bp, Artificial Sequence
  Synthetic oligonucleotide; GAG chr11 5297539 5297558 5297542 -
tcaagttgctagtgtcttaa

SEQ ID NO: 40313 - DNA, 20 bp, Artificial Sequence
  Synthetic oligonucleotide; AGG chr11 5297538 5297557 5297541 -
caagttgctagtgtcttaag

SEQ ID NO: 40314 - DNA, 20 bp, Artificial Sequence
  Synthetic oligonucleotide; GAG chr11 5297496 5297515 5297499 -
gattatcacaaaaatacttc

SEQ ID NO: 40315 - DNA, 20 bp, Artificial Sequence
  Synthetic oligonucleotide; AAG chr11 5297461 5297480 5297464 -
ataattcctgactacacatg

SEQ ID NO: 40316 - DNA, 20 bp, Artificial Sequence
  Synthetic oligonucleotide; GAG chr11 5297459 5297478 5297462 -
aattcctgactacacatgaa

SEQ ID NO: 40317 - DNA, 20 bp, Artificial Sequence
  Synthetic oligonucleotide; TAG chr11 5297447 5297466 5297450 -
cacatgaagagactgacacg

SEQ ID NO: 40318 - DNA, 20 bp, Artificial Sequence
  Synthetic oligonucleotide; AGG chr11 5297446 5297465 5297449 -
acatgaagagactgacacgt

SEQ ID NO: 40319 - DNA, 20 bp, Artificial Sequence
  Synthetic oligonucleotide; TAG chr11 5297434 5297453 5297437 -
tgacacgtaggtgccttact

SEQ ID NO: 40320 - DNA, 20 bp, Artificial Sequence
  Synthetic oligonucleotide; AGG chr11 5297433 5297452 5297436 -
gacacgtaggtgccttactt

SEQ ID NO: 40321 - DNA, 20 bp, Artificial Sequence
  Synthetic oligonucleotide; TAG chr11 5297430 5297449 5297433 -
acgtaggtgccttacttagg

SEQ ID NO: 40322 - DNA, 20 bp, Artificial Sequence
  Synthetic oligonucleotide; AGG chr11 5297429 5297448 5297432 -
cgtaggtgccttacttaggt

SEQ ID NO: 40323 - DNA, 20 bp, Artificial Sequence
  Synthetic oligonucleotide; AAG chr11 5297424 5297443 5297427 -
gtgccttacttaggtaggtt

SEQ ID NO: 40324 - DNA, 20 bp, Artificial Sequence
  Synthetic oligonucleotide; TAG chr11 5297397 5297416 5297400 -
ttatccaaaaccacacaatg

SEQ ID NO: 40325 - DNA, 20 bp, Artificial Sequence
  Synthetic oligonucleotide; AAG chr11 5297389 5297408 5297392 -
aaccacacaatgtagaacct

SEQ ID NO: 40326 - DNA, 20 bp, Artificial Sequence
  Synthetic oligonucleotide; CGG chr11 5297380 5297399 5297383 -
atgtagaacctaagctgatt

SEQ ID NO: 40327 - DNA, 20 bp, Artificial Sequence
  Synthetic oligonucleotide; TAG chr11 5297374 5297393 5297377 -
aacctaagctgattcggcca

SEQ ID NO: 40328 - DNA, 20 bp, Artificial Sequence
  Synthetic oligonucleotide; TGG chr11 5297359 5297378 5297362 -
ggccatagaaacacaatatg

SEQ ID NO: 40329 - DNA, 20 bp, Artificial Sequence
  Synthetic oligonucleotide; GAG chr11 5297349 5297368 5297352 -
acacaatatgtggtataaat

SEQ ID NO: 40330 - DNA, 20 bp, Artificial Sequence
  Synthetic oligonucleotide; CAG chr11 5297345 5297364 5297348 -
aatatgtggtataaatgaga

SEQ ID NO: 40331 - DNA, 20 bp, Artificial Sequence
  Synthetic oligonucleotide; GAG chr11 5297343 5297362 5297346 -
tatgtggtataaatgagaca

SEQ ID NO: 40332 - DNA, 20 bp, Artificial Sequence
  Synthetic oligonucleotide; AGG chr11 5297342 5297361 5297345 -
atgtggtataaatgagacag

SEQ ID NO: 40333 - DNA, 20 bp, Artificial Sequence
  Synthetic oligonucleotide; GGG chr11 5297341 5297360 5297344 -
tgtggtataaatgagacaga

SEQ ID NO: 40334 - DNA, 20 bp, Artificial Sequence
  Synthetic oligonucleotide; CAG chr11 5297316 5297335 5297319 -
ttctctccttcctatgctgt

SEQ ID NO: 40335 - DNA, 20 bp, Artificial Sequence
  Synthetic oligonucleotide; GAG chr11 5297304 5297323 5297307 -
tatgctgtcagatgaatact

SEQ ID NO: 40336 - DNA, 20 bp, Artificial Sequence
  Synthetic oligonucleotide; TAG chr11 5297300 5297319 5297303 -
ctgtcagatgaatactgaga

SEQ ID NO: 40337 - DNA, 20 bp, Artificial Sequence
  Synthetic oligonucleotide; TAG chr11 5297291 5297310 5297294 -
gaatactgagatagaatatt

SEQ ID NO: 40338 - DNA, 20 bp, Artificial Sequence
  Synthetic oligonucleotide; CGG chr11 5297268 5297287 5297271 -
ttcatctatcacacattaaa

SEQ ID NO: 40339 - DNA, 20 bp, Artificial Sequence
  Synthetic oligonucleotide; GGG chr11 5297267 5297286 5297270 -
tcatctatcacacattaaac

SEQ ID NO: 40340 - DNA, 20 bp, Artificial Sequence
  Synthetic oligonucleotide; AAG chr11 5297243 5297262 5297246 -
ctttacatttctgtctgttg

SEQ ID NO: 40341 - DNA, 20 bp, Artificial Sequence
  Synthetic oligonucleotide; TGG chr11 5297237 5297256 5297240 -
atttctgtctgttgaagatt

SEQ ID NO: 40342 - DNA, 20 bp, Artificial Sequence
  Synthetic oligonucleotide; GGG chr11 5297236 5297255 5297239 -
tttctgtctgttgaagattt

SEQ ID NO: 40343 - DNA, 20 bp, Artificial Sequence
  Synthetic oligonucleotide; TGG chr11 5297231 5297250 5297234 -
gtctgttgaagatttgggtg

SEQ ID NO: 40344 - DNA, 20 bp, Artificial Sequence
  Synthetic oligonucleotide; GGG chr11 5297230 5297249 5297233 -
tctgttgaagatttgggtgt

SEQ ID NO: 40345 - DNA, 20 bp, Artificial Sequence
  Synthetic oligonucleotide; GGG chr11 5297229 5297248 5297232 -
ctgttgaagatttgggtgtg

SEQ ID NO: 40346 - DNA, 20 bp, Artificial Sequence
  Synthetic oligonucleotide; AAG chr11 5297219 5297238 5297222 -
tttgggtgtggggataactc

SEQ ID NO: 40347 - DNA, 20 bp, Artificial Sequence
  Synthetic oligonucleotide; AGG chr11 5297218 5297237 5297221 -
ttgggtgtggggataactca

SEQ ID NO: 40348 - DNA, 20 bp, Artificial Sequence
  Synthetic oligonucleotide; AAG chr11 5297205 5297224 5297208 -
taactcaaggtatcatatcc

SEQ ID NO: 40349 - DNA, 20 bp, Artificial Sequence
  Synthetic oligonucleotide; AGG chr11 5297204 5297223 5297207 -
aactcaaggtatcatatcca

SEQ ID NO: 40350 - DNA, 20 bp, Artificial Sequence
  Synthetic oligonucleotide; GGG chr11 5297203 5297222 5297206 -
actcaaggtatcatatccaa

SEQ ID NO: 40351 - DNA, 20 bp, Artificial Sequence
  Synthetic oligonucleotide; TGG chr11 5297199 5297218 5297202 -
aaggtatcatatccaaggga

SEQ ID NO: 40352 - DNA, 20 bp, Artificial Sequence
  Synthetic oligonucleotide; AAG chr11 5297193 5297212 5297196 -
tcatatccaagggatggatg

SEQ ID NO: 40353 - DNA, 20 bp, Artificial Sequence
  Synthetic oligonucleotide; AGG chr11 5297192 5297211 5297195 -
catatccaagggatggatga

SEQ ID NO: 40354 - DNA, 20 bp, Artificial Sequence
  Synthetic oligonucleotide; CAG chr11 5297189 5297208 5297192 -
atccaagggatggatgaagg

SEQ ID NO: 40355 - DNA, 20 bp, Artificial Sequence
  Synthetic oligonucleotide; AGG chr11 5297188 5297207 5297191 -
tccaagggatggatgaaggc

SEQ ID NO: 40356 - DNA, 20 bp, Artificial Sequence
  Synthetic oligonucleotide; CAG chr11 5297176 5297195 5297179 -
atgaaggcaggtgactctaa

SEQ ID NO: 40357 - DNA, 20 bp, Artificial Sequence
  Synthetic oligonucleotide; AAG chr11 5297172 5297191 5297175 -
aggcaggtgactctaacaga

SEQ ID NO: 40358 - DNA, 20 bp, Artificial Sequence
  Synthetic oligonucleotide; AGG chr11 5297171 5297190 5297174 -
ggcaggtgactctaacagaa

SEQ ID NO: 40359 - DNA, 20 bp, Artificial Sequence
  Synthetic oligonucleotide; GGG chr11 5297170 5297189 5297173 -
gcaggtgactctaacagaaa

SEQ ID NO: 40360 - DNA, 20 bp, Artificial Sequence
  Synthetic oligonucleotide; AAG chr11 5297166 5297185 5297169 -
gtgactctaacagaaaggga

SEQ ID NO: 40361 - DNA, 20 bp, Artificial Sequence
  Synthetic oligonucleotide; AGG chr11 5297165 5297184 5297168 -
tgactctaacagaaagggaa

SEQ ID NO: 40362 - DNA, 20 bp, Artificial Sequence
  Synthetic oligonucleotide; TGG chr11 5297158 5297177 5297161 -
aacagaaagggaaaggatgt

SEQ ID NO: 40363 - DNA, 20 bp, Artificial Sequence
  Synthetic oligonucleotide; AAG chr11 5297154 5297173 5297157 -
gaaagggaaaggatgttggc

SEQ ID NO: 40364 - DNA, 20 bp, Artificial Sequence
  Synthetic oligonucleotide; AGG chr11 5297153 5297172 5297156 -
aaagggaaaggatgttggca

SEQ ID NO: 40365 - DNA, 20 bp, Artificial Sequence
  Synthetic oligonucleotide; AAG chr11 5297138 5297157 5297141 -
tggcaaggctatgttcatga

SEQ ID NO: 40366 - DNA, 20 bp, Artificial Sequence
  Synthetic oligonucleotide; AAG chr11 5297116 5297135 5297119 -
gtatatgtaaaatccacatt

SEQ ID NO: 40367 - DNA, 20 bp, Artificial Sequence
  Synthetic oligonucleotide; TGG chr11 5297096 5297115 5297099 -
aagcttctttctgcatgcat

SEQ ID NO: 40368 - DNA, 20 bp, Artificial Sequence
  Synthetic oligonucleotide; AAG chr11 5297066 5297085 5297069 -
tatgaataatgtgtatgtaa

SEQ ID NO: 40369 - DNA, 20 bp, Artificial Sequence
  Synthetic oligonucleotide; AAG chr11 5297047 5297066 5297050 -
aaagtgtgctgtatattcaa

SEQ ID NO: 40370 - DNA, 20 bp, Artificial Sequence
  Synthetic oligonucleotide; TAG chr11 5297031 5297050 5297034 -
tcaaaagtgtttcatgtgcc

SEQ ID NO: 40371 - DNA, 20 bp, Artificial Sequence
  Synthetic oligonucleotide; AGG chr11 5297030 5297049 5297033 -
caaaagtgtttcatgtgcct

SEQ ID NO: 40372 - DNA, 20 bp, Artificial Sequence
  Synthetic oligonucleotide; GGG chr11 5297029 5297048 5297032 -
aaaagtgtttcatgtgccta

SEQ ID NO: 40373 - DNA, 20 bp, Artificial Sequence
  Synthetic oligonucleotide; GGG chr11 5297028 5297047 5297031 -
aaagtgtttcatgtgcctag

SEQ ID NO: 40374 - DNA, 20 bp, Artificial Sequence
  Synthetic oligonucleotide; GAG chr11 5297012 5297031 5297015 -
ctaggggtgtcaaatacttt

SEQ ID NO: 40375 - DNA, 20 bp, Artificial Sequence
  Synthetic oligonucleotide; AAG chr11 5297004 5297023 5297007 -
gtcaaatactttgagtttgt

SEQ ID NO: 40376 - DNA, 20 bp, Artificial Sequence
  Synthetic oligonucleotide; AAG chr11 5296949 5296968 5296952 -
ctatttacttgattctcaat

SEQ ID NO: 40377 - DNA, 20 bp, Artificial Sequence
  Synthetic oligonucleotide; TAG chr11 5296946 5296965 5296949 -
tttacttgattctcaataag

SEQ ID NO: 40378 - DNA, 20 bp, Artificial Sequence
  Synthetic oligonucleotide; AGG chr11 5296945 5296964 5296948 -
ttacttgattctcaataagt

SEQ ID NO: 40379 - DNA, 20 bp, Artificial Sequence
  Synthetic oligonucleotide; TAG chr11 5296937 5296956 5296940 -
ttctcaataagtaggtatca

SEQ ID NO: 40380 - DNA, 20 bp, Artificial Sequence
  Synthetic oligonucleotide; GAG chr11 5296914 5296933 5296917 -
tgaacatctgacaaatgttt

SEQ ID NO: 40381 - DNA, 20 bp, Artificial Sequence
  Synthetic oligonucleotide; AGG chr11 5296913 5296932 5296916 -
gaacatctgacaaatgtttg

SEQ ID NO: 40382 - DNA, 20 bp, Artificial Sequence
  Synthetic oligonucleotide; TAG chr11 5296903 5296922 5296906 -
caaatgtttgaggaacaatt

SEQ ID NO: 40383 - DNA, 20 bp, Artificial Sequence
  Synthetic oligonucleotide; CAG chr11 5296857 5296876 5296860 -
attaaatgcctaatctgtat

SEQ ID NO: 40384 - DNA, 20 bp, Artificial Sequence
  Synthetic oligonucleotide; TGG chr11 5296841 5296860 5296844 -
gtatcagatatacaattatc

SEQ ID NO: 40385 - DNA, 20 bp, Artificial Sequence
  Synthetic oligonucleotide; CAG chr11 5296813 5296832 5296816 -
tctgtaattcctaatttaaa

SEQ ID NO: 40386 - DNA, 20 bp, Artificial Sequence
  Synthetic oligonucleotide; TAG chr11 5296805 5296824 5296808 -
tcctaatttaaacagctgtg

SEQ ID NO: 40387 - DNA, 20 bp, Artificial Sequence
  Synthetic oligonucleotide; TAG chr11 5296796 5296815 5296799 -
aaacagctgtgtagcctaat

SEQ ID NO: 40388 - DNA, 20 bp, Artificial Sequence
  Synthetic oligonucleotide; AGG chr11 5296795 5296814 5296798 -
aacagctgtgtagcctaatt

SEQ ID NO: 40389 - DNA, 20 bp, Artificial Sequence
  Synthetic oligonucleotide; GGG chr11 5296794 5296813 5296797 -
acagctgtgtagcctaatta

SEQ ID NO: 40390 - DNA, 20 bp, Artificial Sequence
  Synthetic oligonucleotide; AAG chr11 5296788 5296807 5296791 -
gtgtagcctaattagggata

SEQ ID NO: 40391 - DNA, 20 bp, Artificial Sequence
  Synthetic oligonucleotide; AGG chr11 5296787 5296806 5296790 -
tgtagcctaattagggataa

SEQ ID NO: 40392 - DNA, 20 bp, Artificial Sequence
  Synthetic oligonucleotide; TAG chr11 5296763 5296782 5296766 -
atgcaaacccataatttgtg

SEQ ID NO: 40393 - DNA, 20 bp, Artificial Sequence
  Synthetic oligonucleotide; AGG chr11 5296762 5296781 5296765 -
tgcaaacccataatttgtgt

SEQ ID NO: 40394 - DNA, 20 bp, Artificial Sequence
  Synthetic oligonucleotide; GAG chr11 5296752 5296771 5296755 -
taatttgtgtaggttgaaat

SEQ ID NO: 40395 - DNA, 20 bp, Artificial Sequence
  Synthetic oligonucleotide; TAG chr11 5296746 5296765 5296749 -
gtgtaggttgaaatgagcta

SEQ ID NO: 40396 - DNA, 20 bp, Artificial Sequence
  Synthetic oligonucleotide; CAG chr11 5296736 5296755 5296739 -
aaatgagctatagaaaaatg

SEQ ID NO: 40397 - DNA, 20 bp, Artificial Sequence
  Synthetic oligonucleotide; CAG chr11 5296724 5296743 5296727 -
gaaaaatgcagtatatttat

SEQ ID NO: 40398 - DNA, 20 bp, Artificial Sequence
  Synthetic oligonucleotide; AAG chr11 5296721 5296740 5296724 -
aaatgcagtatatttatcag

SEQ ID NO: 40399 - DNA, 20 bp, Artificial Sequence
  Synthetic oligonucleotide; TAG chr11 5296714 5296733 5296717 -
gtatatttatcagaagtctt

SEQ ID NO: 40400 - DNA, 20 bp, Artificial Sequence
  Synthetic oligonucleotide; AGG chr11 5296713 5296732 5296716 -
tatatttatcagaagtcttt

SEQ ID NO: 40401 - DNA, 20 bp, Artificial Sequence
  Synthetic oligonucleotide; GGG chr11 5296712 5296731 5296715 -
atatttatcagaagtcttta

SEQ ID NO: 40402 - DNA, 20 bp, Artificial Sequence
  Synthetic oligonucleotide; AAG chr11 5296702 5296721 5296705 -
gaagtctttagggtcatgaa

SEQ ID NO: 40403 - DNA, 20 bp, Artificial Sequence
  Synthetic oligonucleotide; AGG chr11 5296701 5296720 5296704 -
aagtctttagggtcatgaaa

SEQ ID NO: 40404 - DNA, 20 bp, Artificial Sequence
  Synthetic oligonucleotide; TGG chr11 5296696 5296715 5296699 -
tttagggtcatgaaaaggaa

SEQ ID NO: 40405 - DNA, 20 bp, Artificial Sequence
  Synthetic oligonucleotide; CAG chr11 5296679 5296698 5296682 -
gaatggtcaactgacactgc

SEQ ID NO: 40406 - DNA, 20 bp, Artificial Sequence
  Synthetic oligonucleotide; AGG chr11 5296678 5296697 5296681 -
aatggtcaactgacactgcc

SEQ ID NO: 40407 - DNA, 20 bp, Artificial Sequence
  Synthetic oligonucleotide; GGG chr11 5296677 5296696 5296680 -
atggtcaactgacactgcca

SEQ ID NO: 40408 - DNA, 20 bp, Artificial Sequence
  Synthetic oligonucleotide; AAG chr11 5296664 5296683 5296667 -
actgccagggactcatatgt

SEQ ID NO: 40409 - DNA, 20 bp, Artificial Sequence
  Synthetic oligonucleotide; GAG chr11 5296662 5296681 5296665 -
tgccagggactcatatgtaa

SEQ ID NO: 40410 - DNA, 20 bp, Artificial Sequence
  Synthetic oligonucleotide; AAG chr11 5296647 5296666 5296650 -
tgtaagagataactaatgtg

SEQ ID NO: 40411 - DNA, 20 bp, Artificial Sequence
  Synthetic oligonucleotide; AAG chr11 5296636 5296655 5296639 -
actaatgtgaagtgacttta

SEQ ID NO: 40412 - DNA, 20 bp, Artificial Sequence
  Synthetic oligonucleotide; AGG chr11 5296635 5296654 5296638 -
ctaatgtgaagtgactttaa

SEQ ID NO: 40413 - DNA, 20 bp, Artificial Sequence
  Synthetic oligonucleotide; GAG chr11 5296633 5296652 5296636 -
aatgtgaagtgactttaaag

SEQ ID NO: 40414 - DNA, 20 bp, Artificial Sequence
  Synthetic oligonucleotide; TAG chr11 5296626 5296645 5296629 -
agtgactttaaaggagaaat

SEQ ID NO: 40415 - DNA, 20 bp, Artificial Sequence
  Synthetic oligonucleotide; CAG chr11 5296623 5296642 5296626 -
gactttaaaggagaaattag

SEQ ID NO: 40416 - DNA, 20 bp, Artificial Sequence
  Synthetic oligonucleotide; AAG chr11 5296620 5296639 5296623 -
tttaaaggagaaattagcag

SEQ ID NO: 40417 - DNA, 20 bp, Artificial Sequence
  Synthetic oligonucleotide; CGG chr11 5296582 5296601 5296585 -
tcctcatcatgttacaataa

SEQ ID NO: 40418 - DNA, 20 bp, Artificial Sequence
  Synthetic oligonucleotide; AAG chr11 5296579 5296598 5296582 -
tcatcatgttacaataacgg

SEQ ID NO: 40419 - DNA, 20 bp, Artificial Sequence
  Synthetic oligonucleotide; GAG chr11 5296577 5296596 5296580 -
atcatgttacaataacggaa

SEQ ID NO: 40420 - DNA, 20 bp, Artificial Sequence
  Synthetic oligonucleotide; TAG chr11 5296554 5296573 5296557 -
attaaaacaacaaatacatt

SEQ ID NO: 40421 - DNA, 20 bp, Artificial Sequence
  Synthetic oligonucleotide; CAG chr11 5296550 5296569 5296553 -
aaacaacaaatacatttaga

SEQ ID NO: 40422 - DNA, 20 bp, Artificial Sequence
  Synthetic oligonucleotide; TGG chr11 5296535 5296554 5296538 -
ttagacagcaatgtttatcc

SEQ ID NO: 40423 - DNA, 20 bp, Artificial Sequence
  Synthetic oligonucleotide; TAG chr11 5296531 5296550 5296534 -
acagcaatgtttatcctggt

SEQ ID NO: 40424 - DNA, 20 bp, Artificial Sequence
  Synthetic oligonucleotide; TGG chr11 5296506 5296525 5296509 -
gttttaatctaaatctatct

SEQ ID NO: 40425 - DNA, 20 bp, Artificial Sequence
  Synthetic oligonucleotide; GAG chr11 5296504 5296523 5296507 -
tttaatctaaatctatcttg

SEQ ID NO: 40426 - DNA, 20 bp, Artificial Sequence
  Synthetic oligonucleotide; AAG chr11 5296461 5296480 5296464 -
cctactttaaaatataaatg

SEQ ID NO: 40427 - DNA, 20 bp, Artificial Sequence
  Synthetic oligonucleotide; AGG chr11 5296460 5296479 5296463 -
ctactttaaaatataaatga

SEQ ID NO: 40428 - DNA, 20 bp, Artificial Sequence
  Synthetic oligonucleotide; TAG chr11 5296457 5296476 5296460 -
ctttaaaatataaatgaagg

SEQ ID NO: 40429 - DNA, 20 bp, Artificial Sequence
  Synthetic oligonucleotide; AGG chr11 5296456 5296475 5296459 -
tttaaaatataaatgaaggt

SEQ ID NO: 40430 - DNA, 20 bp, Artificial Sequence
  Synthetic oligonucleotide; TAG chr11 5296447 5296466 5296450 -
taaatgaaggtaggaacctg

SEQ ID NO: 40431 - DNA, 20 bp, Artificial Sequence
  Synthetic oligonucleotide; AAG chr11 5296437 5296456 5296440 -
taggaacctgtagatacaaa

SEQ ID NO: 40432 - DNA, 20 bp, Artificial Sequence
  Synthetic oligonucleotide; TGG chr11 5296433 5296452 5296436 -
aacctgtagatacaaaaagt

SEQ ID NO: 40433 - DNA, 20 bp, Artificial Sequence
  Synthetic oligonucleotide; GAG chr11 5296431 5296450 5296434 -
cctgtagatacaaaaagttg

SEQ ID NO: 40434 - DNA, 20 bp, Artificial Sequence
  Synthetic oligonucleotide; AAG chr11 5296423 5296442 5296426 -
tacaaaaagttggagaaaaa

SEQ ID NO: 40435 - DNA, 20 bp, Artificial Sequence
  Synthetic oligonucleotide; AAG chr11 5296414 5296433 5296417 -
ttggagaaaaaaagacaata

SEQ ID NO: 40436 - DNA, 20 bp, Artificial Sequence
  Synthetic oligonucleotide; TAG chr11 5296386 5296405 5296389 -
aaaaatctattaatccttga

SEQ ID NO: 40437 - DNA, 20 bp, Artificial Sequence
  Synthetic oligonucleotide; GAG chr11 5296378 5296397 5296381 -
attaatccttgatagaaaat

SEQ ID NO: 40438 - DNA, 20 bp, Artificial Sequence
  Synthetic oligonucleotide; AAG chr11 5296375 5296394 5296378 -
aatccttgatagaaaatgag

SEQ ID NO: 40439 - DNA, 20 bp, Artificial Sequence
  Synthetic oligonucleotide; GAG chr11 5296373 5296392 5296376 -
tccttgatagaaaatgagaa

SEQ ID NO: 40440 - DNA, 20 bp, Artificial Sequence
  Synthetic oligonucleotide; TGG chr11 5296361 5296380 5296364 -
aatgagaagagataaaacac

SEQ ID NO: 40441 - DNA, 20 bp, Artificial Sequence
  Synthetic oligonucleotide; AAG chr11 5296350 5296369 5296353 -
ataaaacactggtttacata

SEQ ID NO: 40442 - DNA, 20 bp, Artificial Sequence
  Synthetic oligonucleotide; AAG chr11 5296342 5296361 5296345 -
ctggtttacataaagaaaat

SEQ ID NO: 40443 - DNA, 20 bp, Artificial Sequence
  Synthetic oligonucleotide; TGG chr11 5296338 5296357 5296341 -
tttacataaagaaaataaga

SEQ ID NO: 40444 - DNA, 20 bp, Artificial Sequence
  Synthetic oligonucleotide; TAG chr11 5296334 5296353 5296337 -
cataaagaaaataagatgga

SEQ ID NO: 40445 - DNA, 20 bp, Artificial Sequence
  Synthetic oligonucleotide; TAG chr11 5296330 5296349 5296333 -
aagaaaataagatggataga

SEQ ID NO: 40446 - DNA, 20 bp, Artificial Sequence
  Synthetic oligonucleotide; CAG chr11 5296327 5296346 5296330 -
aaaataagatggatagatag

SEQ ID NO: 40447 - DNA, 20 bp, Artificial Sequence
  Synthetic oligonucleotide; AAG chr11 5296314 5296333 5296317 -
tagatagcagatccttataa

SEQ ID NO: 40448 - DNA, 20 bp, Artificial Sequence
  Synthetic oligonucleotide; GAG chr11 5296302 5296321 5296305 -
ccttataaaagtgataattt

SEQ ID NO: 40449 - DNA, 20 bp, Artificial Sequence
  Synthetic oligonucleotide; GAG chr11 5296278 5296297 5296281 -
aaaaaaatactccatattct

SEQ ID NO: 40450 - DNA, 20 bp, Artificial Sequence
  Synthetic oligonucleotide; TGG chr11 5296244 5296263 5296247 -
aaaataatacaaatctgctg

SEQ ID NO: 40451 - DNA, 20 bp, Artificial Sequence
  Synthetic oligonucleotide; AAG chr11 5296240 5296259 5296243 -
taatacaaatctgctgtggt

SEQ ID NO: 40452 - DNA, 20 bp, Artificial Sequence
  Synthetic oligonucleotide; AAG chr11 5296232 5296251 5296235 -
atctgctgtggtaagttaca

SEQ ID NO: 40453 - DNA, 20 bp, Artificial Sequence
  Synthetic oligonucleotide; GAG chr11 5296230 5296249 5296233 -
ctgctgtggtaagttacaaa

SEQ ID NO: 40454 - DNA, 20 bp, Artificial Sequence
  Synthetic oligonucleotide; TAG chr11 5296226 5296245 5296229 -
tgtggtaagttacaaagaga

SEQ ID NO: 40455 - DNA, 20 bp, Artificial Sequence
  Synthetic oligonucleotide; AAG chr11 5296204 5296223 5296207 -
gattttttatcattatataa

SEQ ID NO: 40456 - DNA, 20 bp, Artificial Sequence
  Synthetic oligonucleotide; CAG chr11 5296191 5296210 5296194 -
tatataaaagatattttaaa

SEQ ID NO: 40457 - DNA, 20 bp, Artificial Sequence
  Synthetic oligonucleotide; GAG chr11 5296189 5296208 5296192 -
tataaaagatattttaaaca

SEQ ID NO: 40458 - DNA, 20 bp, Artificial Sequence
  Synthetic oligonucleotide; AAG chr11 5296176 5296195 5296179 -
ttaaacagagttatacaaca

SEQ ID NO: 40459 - DNA, 20 bp, Artificial Sequence
  Synthetic oligonucleotide; AGG chr11 5296175 5296194 5296178 -
taaacagagttatacaacaa

SEQ ID NO: 40460 - DNA, 20 bp, Artificial Sequence
  Synthetic oligonucleotide; CAG chr11 5296170 5296189 5296173 -
agagttatacaacaaaggaa

SEQ ID NO: 40461 - DNA, 20 bp, Artificial Sequence
  Synthetic oligonucleotide; CAG chr11 5296129 5296148 5296132 -
acttatcactataaacatct

SEQ ID NO: 40462 - DNA, 20 bp, Artificial Sequence
  Synthetic oligonucleotide; TAG chr11 5296104 5296123 5296107 -
aaatctgcaaaatcatttca

SEQ ID NO: 40463 - DNA, 20 bp, Artificial Sequence
  Synthetic oligonucleotide; TAG chr11 5296092 5296111 5296095 -
tcatttcatagcattttaaa

SEQ ID NO: 40464 - DNA, 20 bp, Artificial Sequence
  Synthetic oligonucleotide; TAG chr11 5296088 5296107 5296091 -
ttcatagcattttaaatagt

SEQ ID NO: 40465 - DNA, 20 bp, Artificial Sequence
  Synthetic oligonucleotide; AGG chr11 5296087 5296106 5296090 -
tcatagcattttaaatagtt

SEQ ID NO: 40466 - DNA, 20 bp, Artificial Sequence
  Synthetic oligonucleotide; TAG chr11 5296077 5296096 5296080 -
ttaaatagttaggaataatg

SEQ ID NO: 40467 - DNA, 20 bp, Artificial Sequence
  Synthetic oligonucleotide; CAG chr11 5296064 5296083 5296067 -
aataatgtagaaaactgaaa

SEQ ID NO: 40468 - DNA, 20 bp, Artificial Sequence
  Synthetic oligonucleotide; AAG chr11 5296057 5296076 5296060 -
tagaaaactgaaacagttct

SEQ ID NO: 40469 - DNA, 20 bp, Artificial Sequence
  Synthetic oligonucleotide; TAG chr11 5296041 5296060 5296044 -
ttctaagtttcccacaaact

SEQ ID NO: 40470 - DNA, 20 bp, Artificial Sequence
  Synthetic oligonucleotide; GAG chr11 5296039 5296058 5296042 -
ctaagtttcccacaaactta

SEQ ID NO: 40471 - DNA, 20 bp, Artificial Sequence
  Synthetic oligonucleotide; TAG chr11 5295973 5295992 5295976 -
caaatttgcacatgctactc

SEQ ID NO: 40472 - DNA, 20 bp, Artificial Sequence
  Synthetic oligonucleotide; TGG chr11 5295950 5295969 5295953 -
tcaaaaatatatgtacatta

SEQ ID NO: 40473 - DNA, 20 bp, Artificial Sequence
  Synthetic oligonucleotide; GGG chr11 5295949 5295968 5295952 -
caaaaatatatgtacattat

SEQ ID NO: 40474 - DNA, 20 bp, Artificial Sequence
  Synthetic oligonucleotide; TGG chr11 5295928 5295947 5295931 -
ggtattttctgtgtgtaact

SEQ ID NO: 40475 - DNA, 20 bp, Artificial Sequence
  Synthetic oligonucleotide; TAG chr11 5295922 5295941 5295925 -
ttctgtgtgtaacttggttc

SEQ ID NO: 40476 - DNA, 20 bp, Artificial Sequence
  Synthetic oligonucleotide; CAG chr11 5295909 5295928 5295912 -
ttggttctagttgcttcttt

SEQ ID NO: 40477 - DNA, 20 bp, Artificial Sequence
  Synthetic oligonucleotide; TAG chr11 5295903 5295922 5295906 -
ctagttgcttctttcagaaa

SEQ ID NO: 40478 - DNA, 20 bp, Artificial Sequence
  Synthetic oligonucleotide; AAG chr11 5295858 5295877 5295861 -
taaaatcacattcctctcca

SEQ ID NO: 40479 - DNA, 20 bp, Artificial Sequence
  Synthetic oligonucleotide; CAG chr11 5295840 5295859 5295843 -
caaagccttctaaatacttc

SEQ ID NO: 40480 - DNA, 20 bp, Artificial Sequence
  Synthetic oligonucleotide; TAG chr11 5295824 5295843 5295827 -
cttccagactaactactttt

SEQ ID NO: 40481 - DNA, 20 bp, Artificial Sequence
  Synthetic oligonucleotide; AAG chr11 5295814 5295833 5295817 -
aactactttttagtacatct

SEQ ID NO: 40482 - DNA, 20 bp, Artificial Sequence
  Synthetic oligonucleotide; AAG chr11 5295811 5295830 5295814 -
tactttttagtacatctaag

SEQ ID NO: 40483 - DNA, 20 bp, Artificial Sequence
  Synthetic oligonucleotide; AAG chr11 5295806 5295825 5295809 -
tttagtacatctaagaagaa

SEQ ID NO: 40484 - DNA, 20 bp, Artificial Sequence
  Synthetic oligonucleotide; GAG chr11 5295804 5295823 5295807 -
tagtacatctaagaagaaaa

SEQ ID NO: 40485 - DNA, 20 bp, Artificial Sequence
  Synthetic oligonucleotide; GAG chr11 5295780 5295799 5295783 -
tttgtctcttatccacctct

SEQ ID NO: 40486 - DNA, 20 bp, Artificial Sequence
  Synthetic oligonucleotide; AAG chr11 5295772 5295791 5295775 -
ttatccacctctgagtcaaa

SEQ ID NO: 40487 - DNA, 20 bp, Artificial Sequence
  Synthetic oligonucleotide; CAG chr11 5295769 5295788 5295772 -
tccacctctgagtcaaaaag

SEQ ID NO: 40488 - DNA, 20 bp, Artificial Sequence
  Synthetic oligonucleotide; TGG chr11 5295753 5295772 5295756 -
aaagcagcatgtccatcaat

SEQ ID NO: 40489 - DNA, 20 bp, Artificial Sequence
  Synthetic oligonucleotide; TAG chr11 5295746 5295765 5295749 -
catgtccatcaattggtaca

SEQ ID NO: 40490 - DNA, 20 bp, Artificial Sequence
  Synthetic oligonucleotide; CAG chr11 5295737 5295756 5295740 -
caattggtacatagttccca

SEQ ID NO: 40491 - DNA, 20 bp, Artificial Sequence
  Synthetic oligonucleotide; TAG chr11 5295727 5295746 5295730 -
atagttcccacagccccact

SEQ ID NO: 40492 - DNA, 20 bp, Artificial Sequence
  Synthetic oligonucleotide; TGG chr11 5295721 5295740 5295724 -
cccacagccccacttagctc

SEQ ID NO: 40493 - DNA, 20 bp, Artificial Sequence
  Synthetic oligonucleotide; TGG chr11 5295716 5295735 5295719 -
agccccacttagctctggat

SEQ ID NO: 40494 - DNA, 20 bp, Artificial Sequence
  Synthetic oligonucleotide; GAG chr11 5295714 5295733 5295717 -
ccccacttagctctggattg

SEQ ID NO: 40495 - DNA, 20 bp, Artificial Sequence
  Synthetic oligonucleotide; TGG chr11 5295704 5295723 5295707 -
ctctggattggagttctact

SEQ ID NO: 40496 - DNA, 20 bp, Artificial Sequence
  Synthetic oligonucleotide; TGG chr11 5295684 5295703 5295687 -
tggcattgtttgcaactaca

SEQ ID NO: 40497 - DNA, 20 bp, Artificial Sequence
  Synthetic oligonucleotide; TGG chr11 5295669 5295688 5295672 -
ctacatggacgtaaaatgca

SEQ ID NO: 40498 - DNA, 20 bp, Artificial Sequence
  Synthetic oligonucleotide; AAG chr11 5295627 5295646 5295630 -
tctgccatgatgttctctga

SEQ ID NO: 40499 - DNA, 20 bp, Artificial Sequence
  Synthetic oligonucleotide; GAG chr11 5295625 5295644 5295628 -
tgccatgatgttctctgaaa

SEQ ID NO: 40500 - DNA, 20 bp, Artificial Sequence
  Synthetic oligonucleotide; CAG chr11 5295602 5295621 5295605 -
actaaccttccctcgctttg

SEQ ID NO: 40501 - DNA, 20 bp, Artificial Sequence
  Synthetic oligonucleotide; GAG chr11 5295600 5295619 5295603 -
taaccttccctcgctttgca

SEQ ID NO: 40502 - DNA, 20 bp, Artificial Sequence
  Synthetic oligonucleotide; AAG chr11 5295596 5295615 5295599 -
cttccctcgctttgcagaga

SEQ ID NO: 40503 - DNA, 20 bp, Artificial Sequence
  Synthetic oligonucleotide; AAG chr11 5295514 5295533 5295517 -
gaccttcatgtctttgctct

SEQ ID NO: 40504 - DNA, 20 bp, Artificial Sequence
  Synthetic oligonucleotide; TAG chr11 5295487 5295506 5295490 -
tacatcctcaatctacacac

SEQ ID NO: 40505 - DNA, 20 bp, Artificial Sequence
  Synthetic oligonucleotide; AGG chr11 5295486 5295505 5295489 -
acatcctcaatctacacact

SEQ ID NO: 40506 - DNA, 20 bp, Artificial Sequence
  Synthetic oligonucleotide; TAG chr11 5295482 5295501 5295485 -
cctcaatctacacactagga

SEQ ID NO: 40507 - DNA, 20 bp, Artificial Sequence
  Synthetic oligonucleotide; AAG chr11 5295474 5295493 5295477 -
tacacactaggatagtataa

SEQ ID NO: 40508 - DNA, 20 bp, Artificial Sequence
  Synthetic oligonucleotide; TAG chr11 5295468 5295487 5295471 -
ctaggatagtataaaagtaa

SEQ ID NO: 40509 - DNA, 20 bp, Artificial Sequence
  Synthetic oligonucleotide; TAG chr11 5295459 5295478 5295462 -
tataaaagtaatagtaataa

SEQ ID NO: 40510 - DNA, 20 bp, Artificial Sequence
  Synthetic oligonucleotide; TAG chr11 5295456 5295475 5295459 -
aaaagtaatagtaataatag

SEQ ID NO: 40511 - DNA, 20 bp, Artificial Sequence
  Synthetic oligonucleotide; TAG chr11 5295450 5295469 5295453 -
aatagtaataatagtagtaa

SEQ ID NO: 40512 - DNA, 20 bp, Artificial Sequence
  Synthetic oligonucleotide; TGG chr11 5295427 5295446 5295430 -
taataacaatacaatgatta

SEQ ID NO: 40513 - DNA, 20 bp, Artificial Sequence
  Synthetic oligonucleotide; AAG chr11 5295410 5295429 5295413 -
ttatggcttatactatacac

SEQ ID NO: 40514 - DNA, 20 bp, Artificial Sequence
  Synthetic oligonucleotide; TAG chr11 5295383 5295402 5295386 -
tgttgatatattatttcatt

SEQ ID NO: 40515 - DNA, 20 bp, Artificial Sequence
  Synthetic oligonucleotide; CAG chr11 5295374 5295393 5295377 -
attatttcatttagtattca

SEQ ID NO: 40516 - DNA, 20 bp, Artificial Sequence
  Synthetic oligonucleotide; AAG chr11 5295357 5295376 5295360 -
tcacagtaactctgtgcctc

SEQ ID NO: 40517 - DNA, 20 bp, Artificial Sequence
  Synthetic oligonucleotide; AAG chr11 5295335 5295354 5295338 -
gtactattgtaatacccttt

SEQ ID NO: 40518 - DNA, 20 bp, Artificial Sequence
  Synthetic oligonucleotide; GAG chr11 5295333 5295352 5295336 -
actattgtaataccctttaa

SEQ ID NO: 40519 - DNA, 20 bp, Artificial Sequence
  Synthetic oligonucleotide; AGG chr11 5295332 5295351 5295335 -
ctattgtaataccctttaag

SEQ ID NO: 40520 - DNA, 20 bp, Artificial Sequence
  Synthetic oligonucleotide; GAG chr11 5295330 5295349 5295333 -
attgtaataccctttaagag

SEQ ID NO: 40521 - DNA, 20 bp, Artificial Sequence
  Synthetic oligonucleotide; AGG chr11 5295329 5295348 5295332 -
ttgtaataccctttaagagg

SEQ ID NO: 40522 - DNA, 20 bp, Artificial Sequence
  Synthetic oligonucleotide; GAG chr11 5295321 5295340 5295324 -
ccctttaagaggaggaaact

SEQ ID NO: 40523 - DNA, 20 bp, Artificial Sequence
  Synthetic oligonucleotide; AGG chr11 5295320 5295339 5295323 -
cctttaagaggaggaaactg

SEQ ID NO: 40524 - DNA, 20 bp, Artificial Sequence
  Synthetic oligonucleotide; CAG chr11 5295315 5295334 5295318 -
aagaggaggaaactgaggca

SEQ ID NO: 40525 - DNA, 20 bp, Artificial Sequence
  Synthetic oligonucleotide; AGG chr11 5295314 5295333 5295317 -
agaggaggaaactgaggcac

SEQ ID NO: 40526 - DNA, 20 bp, Artificial Sequence
  Synthetic oligonucleotide; GGG chr11 5295313 5295332 5295316 -
gaggaggaaactgaggcaca

SEQ ID NO: 40527 - DNA, 20 bp, Artificial Sequence
  Synthetic oligonucleotide; AAG chr11 5295305 5295324 5295308 -
aactgaggcacagggcccta

SEQ ID NO: 40528 - DNA, 20 bp, Artificial Sequence
  Synthetic oligonucleotide; AAG chr11 5295293 5295312 5295296 -
gggccctaaagtaatattcc

SEQ ID NO: 40529 - DNA, 20 bp, Artificial Sequence
  Synthetic oligonucleotide; AAG chr11 5295287 5295306 5295290 -
taaagtaatattccaagatg

SEQ ID NO: 40530 - DNA, 20 bp, Artificial Sequence
  Synthetic oligonucleotide; TGG chr11 5295284 5295303 5295287 -
agtaatattccaagatgaag

SEQ ID NO: 40531 - DNA, 20 bp, Artificial Sequence
  Synthetic oligonucleotide; CAG chr11 5295270 5295289 5295273 -
atgaagtggctactaactga

SEQ ID NO: 40532 - DNA, 20 bp, Artificial Sequence
  Synthetic oligonucleotide; GAG chr11 5295268 5295287 5295271 -
gaagtggctactaactgaca

SEQ ID NO: 40533 - DNA, 20 bp, Artificial Sequence
  Synthetic oligonucleotide; AGG chr11 5295267 5295286 5295270 -
aagtggctactaactgacag

SEQ ID NO: 40534 - DNA, 20 bp, Artificial Sequence
  Synthetic oligonucleotide; GGG chr11 5295266 5295285 5295269 -
agtggctactaactgacaga

SEQ ID NO: 40535 - DNA, 20 bp, Artificial Sequence
  Synthetic oligonucleotide; TGG chr11 5295242 5295261 5295245 -
ataattcaactcatgatatt

SEQ ID NO: 40536 - DNA, 20 bp, Artificial Sequence
  Synthetic oligonucleotide; TAG chr11 5295236 5295255 5295239 -
caactcatgatatttggctc

SEQ ID NO: 40537 - DNA, 20 bp, Artificial Sequence
  Synthetic oligonucleotide; GAG chr11 5295196 5295215 5295199 -
attatacaataataattcat

SEQ ID NO: 40538 - DNA, 20 bp, Artificial Sequence
  Synthetic oligonucleotide; AGG chr11 5295195 5295214 5295198 -
ttatacaataataattcatg

SEQ ID NO: 40539 - DNA, 20 bp, Artificial Sequence
  Synthetic oligonucleotide; AAG chr11 5295180 5295199 5295183 -
tcatgaggaaacatttttta

SEQ ID NO: 40540 - DNA, 20 bp, Artificial Sequence
  Synthetic oligonucleotide; AAG chr11 5295174 5295193 5295177 -
ggaaacattttttaaagcct

SEQ ID NO: 40541 - DNA, 20 bp, Artificial Sequence
  Synthetic oligonucleotide; AAG chr11 5295155 5295174 5295158 -
taagttatttgctctgaaat

SEQ ID NO: 40542 - DNA, 20 bp, Artificial Sequence
  Synthetic oligonucleotide; TGG chr11 5295144 5295163 5295147 -
ctctgaaataagacataatt

SEQ ID NO: 40543 - DNA, 20 bp, Artificial Sequence
  Synthetic oligonucleotide; GGG chr11 5295143 5295162 5295146 -
tctgaaataagacataattt

SEQ ID NO: 40544 - DNA, 20 bp, Artificial Sequence
  Synthetic oligonucleotide; GGG chr11 5295142 5295161 5295145 -
ctgaaataagacataatttg

SEQ ID NO: 40545 - DNA, 20 bp, Artificial Sequence
  Synthetic oligonucleotide; GAG chr11 5295138 5295157 5295141 -
aataagacataatttggggt

SEQ ID NO: 40546 - DNA, 20 bp, Artificial Sequence
  Synthetic oligonucleotide; AAG chr11 5295134 5295153 5295137 -
agacataatttggggtgaga

SEQ ID NO: 40547 - DNA, 20 bp, Artificial Sequence
  Synthetic oligonucleotide; TAG chr11 5295129 5295148 5295132 -
taatttggggtgagaaagct

SEQ ID NO: 40548 - DNA, 20 bp, Artificial Sequence
  Synthetic oligonucleotide; AAG chr11 5295118 5295137 5295121 -
gagaaagcttagattccatg

SEQ ID NO: 40549 - DNA, 20 bp, Artificial Sequence
  Synthetic oligonucleotide; CAG chr11 5295110 5295129 5295113 -
ttagattccatgaagtatta

SEQ ID NO: 40550 - DNA, 20 bp, Artificial Sequence
  Synthetic oligonucleotide; TGG chr11 5295103 5295122 5295106 -
ccatgaagtattacagcatt

SEQ ID NO: 40551 - DNA, 20 bp, Artificial Sequence
  Synthetic oligonucleotide; TAG chr11 5295100 5295119 5295103 -
tgaagtattacagcatttgg

SEQ ID NO: 40552 - DNA, 20 bp, Artificial Sequence
  Synthetic oligonucleotide; CAG chr11 5295084 5295103 5295087 -
ttggtagtctttttgcactc

SEQ ID NO: 40553 - DNA, 20 bp, Artificial Sequence
  Synthetic oligonucleotide; AGG chr11 5295083 5295102 5295086 -
tggtagtctttttgcactcc

SEQ ID NO: 40554 - DNA, 20 bp, Artificial Sequence
  Synthetic oligonucleotide; TGG chr11 5295046 5295065 5295049 -
cttaaacataataaaacata

SEQ ID NO: 40555 - DNA, 20 bp, Artificial Sequence
  Synthetic oligonucleotide; CAG chr11 5295041 5295060 5295044 -
acataataaaacatatggtt

SEQ ID NO: 40556 - DNA, 20 bp, Artificial Sequence
  Synthetic oligonucleotide; TGG chr11 5295001 5295020 5295004 -
aataatattcctgttatttt

SEQ ID NO: 40557 - DNA, 20 bp, Artificial Sequence
  Synthetic oligonucleotide; AAG chr11 5294998 5295017 5295001 -
aatattcctgttatttttgg

SEQ ID NO: 40558 - DNA, 20 bp, Artificial Sequence
  Synthetic oligonucleotide; CAG chr11 5294993 5295012 5294996 -
tcctgttatttttggaagca

SEQ ID NO: 40559 - DNA, 20 bp, Artificial Sequence
  Synthetic oligonucleotide; AGG chr11 5294992 5295011 5294995 -
cctgttatttttggaagcac

SEQ ID NO: 40560 - DNA, 20 bp, Artificial Sequence
  Synthetic oligonucleotide; GGG chr11 5294991 5295010 5294994 -
ctgttatttttggaagcaca

SEQ ID NO: 40561 - DNA, 20 bp, Artificial Sequence
  Synthetic oligonucleotide; TGG chr11 5294986 5295005 5294989 -
atttttggaagcacagggtg

SEQ ID NO: 40562 - DNA, 20 bp, Artificial Sequence
  Synthetic oligonucleotide; GGG chr11 5294985 5295004 5294988 -
tttttggaagcacagggtgt

SEQ ID NO: 40563 - DNA, 20 bp, Artificial Sequence
  Synthetic oligonucleotide; TAG chr11 5294968 5294987 5294971 -
tgtgggataatgctaattac

SEQ ID NO: 40564 - DNA, 20 bp, Artificial Sequence
  Synthetic oligonucleotide; TAG chr11 5294961 5294980 5294964 -
taatgctaattactagtgat

SEQ ID NO: 40565 - DNA, 20 bp, Artificial Sequence
  Synthetic oligonucleotide; GAG chr11 5294954 5294973 5294957 -
aattactagtgattagtatt

SEQ ID NO: 40566 - DNA, 20 bp, Artificial Sequence
  Synthetic oligonucleotide; GAG chr11 5294952 5294971 5294955 -
ttactagtgattagtattga

SEQ ID NO: 40567 - DNA, 20 bp, Artificial Sequence
  Synthetic oligonucleotide; AGG chr11 5294951 5294970 5294954 -
tactagtgattagtattgag

SEQ ID NO: 40568 - DNA, 20 bp, Artificial Sequence
  Synthetic oligonucleotide; CAG chr11 5294945 5294964 5294948 -
tgattagtattgagaggtga

SEQ ID NO: 40569 - DNA, 20 bp, Artificial Sequence
  Synthetic oligonucleotide; TGG chr11 5294937 5294956 5294940 -
attgagaggtgacagcgtgc

SEQ ID NO: 40570 - DNA, 20 bp, Artificial Sequence
  Synthetic oligonucleotide; CAG chr11 5294934 5294953 5294937 -
gagaggtgacagcgtgctgg

SEQ ID NO: 40571 - DNA, 20 bp, Artificial Sequence
  Synthetic oligonucleotide; CAG chr11 5294925 5294944 5294928 -
cagcgtgctggcagtcctca

SEQ ID NO: 40572 - DNA, 20 bp, Artificial Sequence
  Synthetic oligonucleotide; TGG chr11 5294908 5294927 5294911 -
tcacagccctcgctcgctct

SEQ ID NO: 40573 - DNA, 20 bp, Artificial Sequence
  Synthetic oligonucleotide; TGG chr11 5294892 5294911 5294895 -
ctcttggcgcctcctctgcc

SEQ ID NO: 40574 - DNA, 20 bp, Artificial Sequence
  Synthetic oligonucleotide; GGG chr11 5294891 5294910 5294894 -
tcttggcgcctcctctgcct

SEQ ID NO: 40575 - DNA, 20 bp, Artificial Sequence
  Synthetic oligonucleotide; TGG chr11 5294879 5294898 5294882 -
ctctgcctgggctcccacat

SEQ ID NO: 40576 - DNA, 20 bp, Artificial Sequence
  Synthetic oligonucleotide; TGG chr11 5294876 5294895 5294879 -
tgcctgggctcccacattgg

SEQ ID NO: 40577 - DNA, 20 bp, Artificial Sequence
  Synthetic oligonucleotide; GAG chr11 5294868 5294887 5294871 -
ctcccacattggtggcactt

SEQ ID NO: 40578 - DNA, 20 bp, Artificial Sequence
  Synthetic oligonucleotide; AGG chr11 5294867 5294886 5294870 -
tcccacattggtggcacttg

SEQ ID NO: 40579 - DNA, 20 bp, Artificial Sequence
  Synthetic oligonucleotide; GAG chr11 5294865 5294884 5294868 -
ccacattggtggcacttgag

SEQ ID NO: 40580 - DNA, 20 bp, Artificial Sequence
  Synthetic oligonucleotide; CAG chr11 5294857 5294876 5294860 -
gtggcacttgaggagccctt

SEQ ID NO: 40581 - DNA, 20 bp, Artificial Sequence
  Synthetic oligonucleotide; CGG chr11 5294853 5294872 5294856 -
cacttgaggagcccttcagc

SEQ ID NO: 40582 - DNA, 20 bp, Artificial Sequence
  Synthetic oligonucleotide; TGG chr11 5294839 5294858 5294842 -
ttcagccggccgctgcactg

SEQ ID NO: 40583 - DNA, 20 bp, Artificial Sequence
  Synthetic oligonucleotide; GGG chr11 5294838 5294857 5294841 -
tcagccggccgctgcactgt

SEQ ID NO: 40584 - DNA, 20 bp, Artificial Sequence
  Synthetic oligonucleotide; GAG chr11 5294836 5294855 5294839 -
agccggccgctgcactgtgg

SEQ ID NO: 40585 - DNA, 20 bp, Artificial Sequence
  Synthetic oligonucleotide; TGG chr11 5294825 5294844 5294828 -
gcactgtgggagcccttttc

SEQ ID NO: 40586 - DNA, 20 bp, Artificial Sequence
  Synthetic oligonucleotide; GGG chr11 5294824 5294843 5294827 -
cactgtgggagcccttttct

SEQ ID NO: 40587 - DNA, 20 bp, Artificial Sequence
  Synthetic oligonucleotide; TGG chr11 5294820 5294839 5294823 -
gtgggagcccttttctgggc

SEQ ID NO: 40588 - DNA, 20 bp, Artificial Sequence
  Synthetic oligonucleotide; AAG chr11 5294815 5294834 5294818 -
agcccttttctgggctggcc

SEQ ID NO: 40589 - DNA, 20 bp, Artificial Sequence
  Synthetic oligonucleotide; AGG chr11 5294814 5294833 5294817 -
gcccttttctgggctggcca

SEQ ID NO: 40590 - DNA, 20 bp, Artificial Sequence
  Synthetic oligonucleotide; CAG chr11 5294810 5294829 5294813 -
ttttctgggctggccaaggc

SEQ ID NO: 40591 - DNA, 20 bp, Artificial Sequence
  Synthetic oligonucleotide; GAG chr11 5294808 5294827 5294811 -
ttctgggctggccaaggcca

SEQ ID NO: 40592 - DNA, 20 bp, Artificial Sequence
  Synthetic oligonucleotide; CGG chr11 5294804 5294823 5294807 -
gggctggccaaggccagagc

SEQ ID NO: 40593 - DNA, 20 bp, Artificial Sequence
  Synthetic oligonucleotide; CAG chr11 5294795 5294814 5294798 -
aaggccagagccggctccct

SEQ ID NO: 40594 - DNA, 20 bp, Artificial Sequence
  Synthetic oligonucleotide; CAG chr11 5294787 5294806 5294790 -
agccggctccctcagcttgc

SEQ ID NO: 40595 - DNA, 20 bp, Artificial Sequence
  Synthetic oligonucleotide; AGG chr11 5294786 5294805 5294789 -
gccggctccctcagcttgcc

SEQ ID NO: 40596 - DNA, 20 bp, Artificial Sequence
  Synthetic oligonucleotide; GAG chr11 5294784 5294803 5294787 -
cggctccctcagcttgccag

SEQ ID NO: 40597 - DNA, 20 bp, Artificial Sequence
  Synthetic oligonucleotide; AGG chr11 5294783 5294802 5294786 -
ggctccctcagcttgccagg

SEQ ID NO: 40598 - DNA, 20 bp, Artificial Sequence
  Synthetic oligonucleotide; TGG chr11 5294778 5294797 5294781 -
cctcagcttgccaggaggtg

SEQ ID NO: 40599 - DNA, 20 bp, Artificial Sequence
  Synthetic oligonucleotide; GAG chr11 5294776 5294795 5294779 -
tcagcttgccaggaggtgtg

SEQ ID NO: 40600 - DNA, 20 bp, Artificial Sequence
  Synthetic oligonucleotide; AGG chr11 5294775 5294794 5294778 -
cagcttgccaggaggtgtgg

SEQ ID NO: 40601 - DNA, 20 bp, Artificial Sequence
  Synthetic oligonucleotide; GGG chr11 5294774 5294793 5294777 -
agcttgccaggaggtgtgga

SEQ ID NO: 40602 - DNA, 20 bp, Artificial Sequence
  Synthetic oligonucleotide; CAG chr11 5294770 5294789 5294773 -
tgccaggaggtgtggaggga

SEQ ID NO: 40603 - DNA, 20 bp, Artificial Sequence
  Synthetic oligonucleotide; CGG chr11 5294764 5294783 5294767 -
gaggtgtggagggacagacg

SEQ ID NO: 40604 - DNA, 20 bp, Artificial Sequence
  Synthetic oligonucleotide; GGG chr11 5294763 5294782 5294766 -
aggtgtggagggacagacgc

SEQ ID NO: 40605 - DNA, 20 bp, Artificial Sequence
  Synthetic oligonucleotide; CAG chr11 5294760 5294779 5294763 -
tgtggagggacagacgcggg

SEQ ID NO: 40606 - DNA, 20 bp, Artificial Sequence
  Synthetic oligonucleotide; AGG chr11 5294759 5294778 5294762 -
gtggagggacagacgcgggc

SEQ ID NO: 40607 - DNA, 20 bp, Artificial Sequence
  Synthetic oligonucleotide; CGG chr11 5294753 5294772 5294756 -
ggacagacgcgggcaggaac

SEQ ID NO: 40608 - DNA, 20 bp, Artificial Sequence
  Synthetic oligonucleotide; GGG chr11 5294752 5294771 5294755 -
gacagacgcgggcaggaacc

SEQ ID NO: 40609 - DNA, 20 bp, Artificial Sequence
  Synthetic oligonucleotide; GAG chr11 5294734 5294753 5294737 -
ccgggctgtgcgccgtgctt

SEQ ID NO: 40610 - DNA, 20 bp, Artificial Sequence
  Synthetic oligonucleotide; AGG chr11 5294733 5294752 5294736 -
cgggctgtgcgccgtgcttg

SEQ ID NO: 40611 - DNA, 20 bp, Artificial Sequence
  Synthetic oligonucleotide; GGG chr11 5294732 5294751 5294735 -
gggctgtgcgccgtgcttga

SEQ ID NO: 40612 - DNA, 20 bp, Artificial Sequence
  Synthetic oligonucleotide; GAG chr11 5294730 5294749 5294733 -
gctgtgcgccgtgcttgagg

SEQ ID NO: 40613 - DNA, 20 bp, Artificial Sequence
  Synthetic oligonucleotide; CGG chr11 5294724 5294743 5294727 -
cgccgtgcttgagggagttc

SEQ ID NO: 40614 - DNA, 20 bp, Artificial Sequence
  Synthetic oligonucleotide; GGG chr11 5294723 5294742 5294726 -
gccgtgcttgagggagttcc

SEQ ID NO: 40615 - DNA, 20 bp, Artificial Sequence
  Synthetic oligonucleotide; TGG chr11 5294720 5294739 5294723 -
gtgcttgagggagttccggg

SEQ ID NO: 40616 - DNA, 20 bp, Artificial Sequence
  Synthetic oligonucleotide; GGG chr11 5294719 5294738 5294722 -
tgcttgagggagttccgggt

SEQ ID NO: 40617 - DNA, 20 bp, Artificial Sequence
  Synthetic oligonucleotide; TGG chr11 5294714 5294733 5294717 -
gagggagttccgggtgggca

SEQ ID NO: 40618 - DNA, 20 bp, Artificial Sequence
  Synthetic oligonucleotide; GGG chr11 5294713 5294732 5294716 -
agggagttccgggtgggcat

SEQ ID NO: 40619 - DNA, 20 bp, Artificial Sequence
  Synthetic oligonucleotide; GAG chr11 5294706 5294725 5294709 -
tccgggtgggcatgggctcc

SEQ ID NO: 40620 - DNA, 20 bp, Artificial Sequence
  Synthetic oligonucleotide; AGG chr11 5294705 5294724 5294708 -
ccgggtgggcatgggctccg

SEQ ID NO: 40621 - DNA, 20 bp, Artificial Sequence
  Synthetic oligonucleotide; CGG chr11 5294692 5294711 5294695 -
ggctccgaggaccccgcact

SEQ ID NO: 40622 - DNA, 20 bp, Artificial Sequence
  Synthetic oligonucleotide; GAG chr11 5294690 5294709 5294693 -
ctccgaggaccccgcactcg

SEQ ID NO: 40623 - DNA, 20 bp, Artificial Sequence
  Synthetic oligonucleotide; CAG chr11 5294683 5294702 5294686 -
gaccccgcactcggagccgc

SEQ ID NO: 40624 - DNA, 20 bp, Artificial Sequence
  Synthetic oligonucleotide; CGG chr11 5294679 5294698 5294682 -
ccgcactcggagccgccagc

SEQ ID NO: 40625 - DNA, 20 bp, Artificial Sequence
  Synthetic oligonucleotide; CGG chr11 5294670 5294689 5294673 -
gagccgccagccggccccac

SEQ ID NO: 40626 - DNA, 20 bp, Artificial Sequence
  Synthetic oligonucleotide; CGG chr11 5294664 5294683 5294667 -
ccagccggccccaccggccg

SEQ ID NO: 40627 - DNA, 20 bp, Artificial Sequence
  Synthetic oligonucleotide; GGG chr11 5294663 5294682 5294666 -
cagccggccccaccggccgc

SEQ ID NO: 40628 - DNA, 20 bp, Artificial Sequence
  Synthetic oligonucleotide; CAG chr11 5294660 5294679 5294663 -
ccggccccaccggccgcggg

SEQ ID NO: 40629 - DNA, 20 bp, Artificial Sequence
  Synthetic oligonucleotide; GAG chr11 5294656 5294675 5294659 -
ccccaccggccgcgggcagt

SEQ ID NO: 40630 - DNA, 20 bp, Artificial Sequence
  Synthetic oligonucleotide; AGG chr11 5294655 5294674 5294658 -
cccaccggccgcgggcagtg

SEQ ID NO: 40631 - DNA, 20 bp, Artificial Sequence
  Synthetic oligonucleotide; GGG chr11 5294654 5294673 5294657 -
ccaccggccgcgggcagtga

SEQ ID NO: 40632 - DNA, 20 bp, Artificial Sequence
  Synthetic oligonucleotide; GGG chr11 5294653 5294672 5294656 -
caccggccgcgggcagtgag

SEQ ID NO: 40633 - DNA, 20 bp, Artificial Sequence
  Synthetic oligonucleotide; TAG chr11 5294648 5294667 5294651 -
gccgcgggcagtgaggggct

SEQ ID NO: 40634 - DNA, 20 bp, Artificial Sequence
  Synthetic oligonucleotide; TGG chr11 5294641 5294660 5294644 -
gcagtgaggggcttagcacc

SEQ ID NO: 40635 - DNA, 20 bp, Artificial Sequence
  Synthetic oligonucleotide; GGG chr11 5294640 5294659 5294643 -
cagtgaggggcttagcacct

SEQ ID NO: 40636 - DNA, 20 bp, Artificial Sequence
  Synthetic oligonucleotide; CAG chr11 5294636 5294655 5294639 -
gaggggcttagcacctgggc

SEQ ID NO: 40637 - DNA, 20 bp, Artificial Sequence
  Synthetic oligonucleotide; CAG chr11 5294633 5294652 5294636 -
gggcttagcacctgggccag

SEQ ID NO: 40638 - DNA, 20 bp, Artificial Sequence
  Synthetic oligonucleotide; CGG chr11 5294609 5294628 5294612 -
tgctgtgctcaattcctcgc

SEQ ID NO: 40639 - DNA, 20 bp, Artificial Sequence
  Synthetic oligonucleotide; GGG chr11 5294608 5294627 5294611 -
gctgtgctcaattcctcgcc

SEQ ID NO: 40640 - DNA, 20 bp, Artificial Sequence
  Synthetic oligonucleotide; TAG chr11 5294602 5294621 5294605 -
ctcaattcctcgccgggcct

SEQ ID NO: 40641 - DNA, 20 bp, Artificial Sequence
  Synthetic oligonucleotide; CGG chr11 5294588 5294607 5294591 -
gggccttagctgccttcctg

SEQ ID NO: 40642 - DNA, 20 bp, Artificial Sequence
  Synthetic oligonucleotide; GGG chr11 5294587 5294606 5294590 -
ggccttagctgccttcctgc

SEQ ID NO: 40643 - DNA, 20 bp, Artificial Sequence
  Synthetic oligonucleotide; GGG chr11 5294586 5294605 5294589 -
gccttagctgccttcctgcg

SEQ ID NO: 40644 - DNA, 20 bp, Artificial Sequence
  Synthetic oligonucleotide; CAG chr11 5294583 5294602 5294586 -
ttagctgccttcctgcgggg

SEQ ID NO: 40645 - DNA, 20 bp, Artificial Sequence
  Synthetic oligonucleotide; AGG chr11 5294582 5294601 5294585 -
tagctgccttcctgcggggc

SEQ ID NO: 40646 - DNA, 20 bp, Artificial Sequence
  Synthetic oligonucleotide; GGG chr11 5294581 5294600 5294584 -
agctgccttcctgcggggca

SEQ ID NO: 40647 - DNA, 20 bp, Artificial Sequence
  Synthetic oligonucleotide; CGG chr11 5294576 5294595 5294579 -
ccttcctgcggggcagggct

SEQ ID NO: 40648 - DNA, 20 bp, Artificial Sequence
  Synthetic oligonucleotide; GGG chr11 5294575 5294594 5294578 -
cttcctgcggggcagggctc

SEQ ID NO: 40649 - DNA, 20 bp, Artificial Sequence
  Synthetic oligonucleotide; CAG chr11 5294567 5294586 5294570 -
ggggcagggctcgggacctg

SEQ ID NO: 40650 - DNA, 20 bp, Artificial Sequence
  Synthetic oligonucleotide; GAG chr11 5294552 5294571 5294555 -
acctgcagcgcgccatgcct

SEQ ID NO: 40651 - DNA, 20 bp, Artificial Sequence
  Synthetic oligonucleotide; TGG chr11 5294535 5294554 5294538 -
cctgagcctccccaccttca

SEQ ID NO: 40652 - DNA, 20 bp, Artificial Sequence
  Synthetic oligonucleotide; GGG chr11 5294534 5294553 5294537 -
ctgagcctccccaccttcat

SEQ ID NO: 40653 - DNA, 20 bp, Artificial Sequence
  Synthetic oligonucleotide; CGG chr11 5294523 5294542 5294526 -
caccttcatgggctcctgtg

SEQ ID NO: 40654 - DNA, 20 bp, Artificial Sequence
  Synthetic oligonucleotide; GAG chr11 5294517 5294536 5294520 -
catgggctcctgtgcggccc

SEQ ID NO: 40655 - DNA, 20 bp, Artificial Sequence
  Synthetic oligonucleotide; GAG chr11 5294504 5294523 5294507 -
gcggcccgagcctcgccgac

SEQ ID NO: 40656 - DNA, 20 bp, Artificial Sequence
  Synthetic oligonucleotide; CAG chr11 5294486 5294505 5294489 -
acgagcgccgccccctgctc

SEQ ID NO: 40657 - DNA, 20 bp, Artificial Sequence
  Synthetic oligonucleotide; AGG chr11 5294485 5294504 5294488 -
cgagcgccgccccctgctcc

SEQ ID NO: 40658 - DNA, 20 bp, Artificial Sequence
  Synthetic oligonucleotide; GGG chr11 5294484 5294503 5294487 -
gagcgccgccccctgctcca

SEQ ID NO: 40659 - DNA, 20 bp, Artificial Sequence
  Synthetic oligonucleotide; CAG chr11 5294477 5294496 5294480 -
gccccctgctccagggcacc

SEQ ID NO: 40660 - DNA, 20 bp, Artificial Sequence
  Synthetic oligonucleotide; AAG chr11 5294459 5294478 5294462 -
cccagtcccatcgaccaccc

SEQ ID NO: 40661 - DNA, 20 bp, Artificial Sequence
  Synthetic oligonucleotide; AGG chr11 5294458 5294477 5294461 -
ccagtcccatcgaccaccca

SEQ ID NO: 40662 - DNA, 20 bp, Artificial Sequence
  Synthetic oligonucleotide; GGG chr11 5294457 5294476 5294460 -
cagtcccatcgaccacccaa

SEQ ID NO: 40663 - DNA, 20 bp, Artificial Sequence
  Synthetic oligonucleotide; AAG chr11 5294451 5294470 5294454 -
catcgaccacccaagggctg

SEQ ID NO: 40664 - DNA, 20 bp, Artificial Sequence
  Synthetic oligonucleotide; GAG chr11 5294449 5294468 5294452 -
tcgaccacccaagggctgaa

SEQ ID NO: 40665 - DNA, 20 bp, Artificial Sequence
  Synthetic oligonucleotide; CGG chr11 5294444 5294463 5294447 -
cacccaagggctgaagagtg

SEQ ID NO: 40666 - DNA, 20 bp, Artificial Sequence
  Synthetic oligonucleotide; GGG chr11 5294443 5294462 5294446 -
acccaagggctgaagagtgc

SEQ ID NO: 40667 - DNA, 20 bp, Artificial Sequence
  Synthetic oligonucleotide; CGG chr11 5294436 5294455 5294439 -
ggctgaagagtgcgggcgca

SEQ ID NO: 40668 - DNA, 20 bp, Artificial Sequence
  Synthetic oligonucleotide; CAG chr11 5294433 5294452 5294436 -
tgaagagtgcgggcgcacgg

SEQ ID NO: 40669 - DNA, 20 bp, Artificial Sequence
  Synthetic oligonucleotide; AGG chr11 5294432 5294451 5294435 -
gaagagtgcgggcgcacggc

SEQ ID NO: 40670 - DNA, 20 bp, Artificial Sequence
  Synthetic oligonucleotide; GGG chr11 5294431 5294450 5294434 -
aagagtgcgggcgcacggca

SEQ ID NO: 40671 - DNA, 20 bp, Artificial Sequence
  Synthetic oligonucleotide; GGG chr11 5294430 5294449 5294433 -
agagtgcgggcgcacggcag

SEQ ID NO: 40672 - DNA, 20 bp, Artificial Sequence
  Synthetic oligonucleotide; TGG chr11 5294425 5294444 5294428 -
gcgggcgcacggcaggggac

SEQ ID NO: 40673 - DNA, 20 bp, Artificial Sequence
  Synthetic oligonucleotide; CAG chr11 5294422 5294441 5294425 -
ggcgcacggcaggggactgg

SEQ ID NO: 40674 - DNA, 20 bp, Artificial Sequence
  Synthetic oligonucleotide; AGG chr11 5294421 5294440 5294424 -
gcgcacggcaggggactggc

SEQ ID NO: 40675 - DNA, 20 bp, Artificial Sequence
  Synthetic oligonucleotide; CAG chr11 5294418 5294437 5294421 -
cacggcaggggactggcagg

SEQ ID NO: 40676 - DNA, 20 bp, Artificial Sequence
  Synthetic oligonucleotide; CAG chr11 5294406 5294425 5294409 -
ctggcaggcagctccccctg

SEQ ID NO: 40677 - DNA, 20 bp, Artificial Sequence
  Synthetic oligonucleotide; CAG chr11 5294401 5294420 5294404 -
aggcagctccccctgcagcc

SEQ ID NO: 40678 - DNA, 20 bp, Artificial Sequence
  Synthetic oligonucleotide; AGG chr11 5294400 5294419 5294403 -
ggcagctccccctgcagccc

SEQ ID NO: 40679 - DNA, 20 bp, Artificial Sequence
  Synthetic oligonucleotide; CGG chr11 5294395 5294414 5294398 -
ctccccctgcagcccaggtg

SEQ ID NO: 40680 - DNA, 20 bp, Artificial Sequence
  Synthetic oligonucleotide; GGG chr11 5294394 5294413 5294397 -
tccccctgcagcccaggtgc

SEQ ID NO: 40681 - DNA, 20 bp, Artificial Sequence
  Synthetic oligonucleotide; TGG chr11 5294385 5294404 5294388 -
agcccaggtgcgggatccac

SEQ ID NO: 40682 - DNA, 20 bp, Artificial Sequence
  Synthetic oligonucleotide; GGG chr11 5294384 5294403 5294387 -
gcccaggtgcgggatccact

SEQ ID NO: 40683 - DNA, 20 bp, Artificial Sequence
  Synthetic oligonucleotide; AAG chr11 5294379 5294398 5294382 -
ggtgcgggatccactgggtg

SEQ ID NO: 40684 - DNA, 20 bp, Artificial Sequence
  Synthetic oligonucleotide; CGG chr11 5294375 5294394 5294378 -
cgggatccactgggtgaagc

SEQ ID NO: 40685 - DNA, 20 bp, Artificial Sequence
  Synthetic oligonucleotide; TAG chr11 5294371 5294390 5294374 -
atccactgggtgaagccggc

SEQ ID NO: 40686 - DNA, 20 bp, Artificial Sequence
  Synthetic oligonucleotide; AGG chr11 5294370 5294389 5294373 -
tccactgggtgaagccggct

SEQ ID NO: 40687 - DNA, 20 bp, Artificial Sequence
  Synthetic oligonucleotide; GAG chr11 5294362 5294381 5294365 -
gtgaagccggctaggctcct

SEQ ID NO: 40688 - DNA, 20 bp, Artificial Sequence
  Synthetic oligonucleotide; TGG chr11 5294354 5294373 5294357 -
ggctaggctcctgagtttgc

SEQ ID NO: 40689 - DNA, 20 bp, Artificial Sequence
  Synthetic oligonucleotide; GGG chr11 5294353 5294372 5294356 -
gctaggctcctgagtttgct

SEQ ID NO: 40690 - DNA, 20 bp, Artificial Sequence
  Synthetic oligonucleotide; GGG chr11 5294352 5294371 5294355 -
ctaggctcctgagtttgctg

SEQ ID NO: 40691 - DNA, 20 bp, Artificial Sequence
  Synthetic oligonucleotide; AAG chr11 5294344 5294363 5294347 -
ctgagtttgctggggatgcg

SEQ ID NO: 40692 - DNA, 20 bp, Artificial Sequence
  Synthetic oligonucleotide; TAG chr11 5294329 5294348 5294332 -
atgcgaagaacccttatgtc

SEQ ID NO: 40693 - DNA, 20 bp, Artificial Sequence
  Synthetic oligonucleotide; AAG chr11 5294324 5294343 5294327 -
aagaacccttatgtctagat

SEQ ID NO: 40694 - DNA, 20 bp, Artificial Sequence
  Synthetic oligonucleotide; AGG chr11 5294323 5294342 5294326 -
agaacccttatgtctagata

SEQ ID NO: 40695 - DNA, 20 bp, Artificial Sequence
  Synthetic oligonucleotide; GGG chr11 5294322 5294341 5294325 -
gaacccttatgtctagataa

SEQ ID NO: 40696 - DNA, 20 bp, Artificial Sequence
  Synthetic oligonucleotide; TGG chr11 5294302 5294321 5294305 -
gggattgtaaatacaccaat

SEQ ID NO: 40697 - DNA, 20 bp, Artificial Sequence
  Synthetic oligonucleotide; TAG chr11 5294288 5294307 5294291 -
accaattggcactctgtatc

SEQ ID NO: 40698 - DNA, 20 bp, Artificial Sequence
  Synthetic oligonucleotide; AAG chr11 5294282 5294301 5294285 -
tggcactctgtatctagctc

SEQ ID NO: 40699 - DNA, 20 bp, Artificial Sequence
  Synthetic oligonucleotide; AGG chr11 5294281 5294300 5294284 -
ggcactctgtatctagctca

SEQ ID NO: 40700 - DNA, 20 bp, Artificial Sequence
  Synthetic oligonucleotide; CAG chr11 5294261 5294280 5294264 -
aggtttgtaaacacaccaat

SEQ ID NO: 40701 - DNA, 20 bp, Artificial Sequence
  Synthetic oligonucleotide; TAG chr11 5294247 5294266 5294250 -
accaatcagcaccctgtgtc

SEQ ID NO: 40702 - DNA, 20 bp, Artificial Sequence
  Synthetic oligonucleotide; CAG chr11 5294242 5294261 5294245 -
tcagcaccctgtgtctagct

SEQ ID NO: 40703 - DNA, 20 bp, Artificial Sequence
  Synthetic oligonucleotide; AGG chr11 5294241 5294260 5294244 -
cagcaccctgtgtctagctc

SEQ ID NO: 40704 - DNA, 20 bp, Artificial Sequence
  Synthetic oligonucleotide; GGG chr11 5294240 5294259 5294243 -
agcaccctgtgtctagctca

SEQ ID NO: 40705 - DNA, 20 bp, Artificial Sequence
  Synthetic oligonucleotide; TAG chr11 5294208 5294227 5294211 -
gcaccaatcaacactctatc

SEQ ID NO: 40706 - DNA, 20 bp, Artificial Sequence
  Synthetic oligonucleotide; TGG chr11 5294199 5294218 5294202 -
aacactctatctagctactc

SEQ ID NO: 40707 - DNA, 20 bp, Artificial Sequence
  Synthetic oligonucleotide; TGG chr11 5294196 5294215 5294199 -
actctatctagctactctgg

SEQ ID NO: 40708 - DNA, 20 bp, Artificial Sequence
  Synthetic oligonucleotide; GGG chr11 5294195 5294214 5294198 -
ctctatctagctactctggt

SEQ ID NO: 40709 - DNA, 20 bp, Artificial Sequence
  Synthetic oligonucleotide; GGG chr11 5294194 5294213 5294197 -
tctatctagctactctggtg

SEQ ID NO: 40710 - DNA, 20 bp, Artificial Sequence
  Synthetic oligonucleotide; TGG chr11 5294188 5294207 5294191 -
tagctactctggtggggcct

SEQ ID NO: 40711 - DNA, 20 bp, Artificial Sequence
  Synthetic oligonucleotide; GAG chr11 5294186 5294205 5294189 -
gctactctggtggggccttg

SEQ ID NO: 40712 - DNA, 20 bp, Artificial Sequence
  Synthetic oligonucleotide; TAG chr11 5294171 5294190 5294174 -
ccttggagaacctttatgtc

SEQ ID NO: 40713 - DNA, 20 bp, Artificial Sequence
  Synthetic oligonucleotide; CAG chr11 5294166 5294185 5294169 -
gagaacctttatgtctagct

SEQ ID NO: 40714 - DNA, 20 bp, Artificial Sequence
  Synthetic oligonucleotide; AGG chr11 5294165 5294184 5294168 -
agaacctttatgtctagctc

SEQ ID NO: 40715 - DNA, 20 bp, Artificial Sequence
  Synthetic oligonucleotide; GGG chr11 5294164 5294183 5294167 -
gaacctttatgtctagctca

SEQ ID NO: 40716 - DNA, 20 bp, Artificial Sequence
  Synthetic oligonucleotide; CGG chr11 5294144 5294163 5294147 -
gggattgtaaatacaccaat

SEQ ID NO: 40717 - DNA, 20 bp, Artificial Sequence
  Synthetic oligonucleotide; CAG chr11 5294141 5294160 5294144 -
attgtaaatacaccaatcgg

SEQ ID NO: 40718 - DNA, 20 bp, Artificial Sequence
  Synthetic oligonucleotide; TAG chr11 5294130 5294149 5294133 -
accaatcggcagtctgtatc

SEQ ID NO: 40719 - DNA, 20 bp, Artificial Sequence
  Synthetic oligonucleotide; AAG chr11 5294124 5294143 5294127 -
cggcagtctgtatctagctc

SEQ ID NO: 40720 - DNA, 20 bp, Artificial Sequence
  Synthetic oligonucleotide; AGG chr11 5294123 5294142 5294126 -
ggcagtctgtatctagctca

SEQ ID NO: 40721 - DNA, 20 bp, Artificial Sequence
  Synthetic oligonucleotide; CAG chr11 5294103 5294122 5294106 -
aggtttgtaaacacaccaat

SEQ ID NO: 40722 - DNA, 20 bp, Artificial Sequence
  Synthetic oligonucleotide; TAG chr11 5294089 5294108 5294092 -
accaatcagcaccctgtgtc

SEQ ID NO: 40723 - DNA, 20 bp, Artificial Sequence
  Synthetic oligonucleotide; CAG chr11 5294084 5294103 5294087 -
tcagcaccctgtgtctagct

SEQ ID NO: 40724 - DNA, 20 bp, Artificial Sequence
  Synthetic oligonucleotide; AGG chr11 5294083 5294102 5294086 -
cagcaccctgtgtctagctc

SEQ ID NO: 40725 - DNA, 20 bp, Artificial Sequence
  Synthetic oligonucleotide; GGG chr11 5294082 5294101 5294085 -
agcaccctgtgtctagctca

SEQ ID NO: 40726 - DNA, 20 bp, Artificial Sequence
  Synthetic oligonucleotide; TAG chr11 5294048 5294067 5294051 -
accaatcaacactctgtatc

SEQ ID NO: 40727 - DNA, 20 bp, Artificial Sequence
  Synthetic oligonucleotide; TGG chr11 5294039 5294058 5294042 -
cactctgtatctagctactc

SEQ ID NO: 40728 - DNA, 20 bp, Artificial Sequence
  Synthetic oligonucleotide; TGG chr11 5294036 5294055 5294039 -
tctgtatctagctactctgg

SEQ ID NO: 40729 - DNA, 20 bp, Artificial Sequence
  Synthetic oligonucleotide; GGG chr11 5294035 5294054 5294038 -
ctgtatctagctactctggt

SEQ ID NO: 40730 - DNA, 20 bp, Artificial Sequence
  Synthetic oligonucleotide; GGG chr11 5294034 5294053 5294037 -
tgtatctagctactctggtg

SEQ ID NO: 40731 - DNA, 20 bp, Artificial Sequence
  Synthetic oligonucleotide; TGG chr11 5294028 5294047 5294031 -
tagctactctggtggggacg

SEQ ID NO: 40732 - DNA, 20 bp, Artificial Sequence
  Synthetic oligonucleotide; GAG chr11 5294026 5294045 5294029 -
gctactctggtggggacgtg

SEQ ID NO: 40733 - DNA, 20 bp, Artificial Sequence
  Synthetic oligonucleotide; TAG chr11 5294011 5294030 5294014 -
acgtggagaacctttatgtc

SEQ ID NO: 40734 - DNA, 20 bp, Artificial Sequence
  Synthetic oligonucleotide; CAG chr11 5294006 5294025 5294009 -
gagaacctttatgtctagct

SEQ ID NO: 40735 - DNA, 20 bp, Artificial Sequence
  Synthetic oligonucleotide; AGG chr11 5294005 5294024 5294008 -
agaacctttatgtctagctc

SEQ ID NO: 40736 - DNA, 20 bp, Artificial Sequence
  Synthetic oligonucleotide; GGG chr11 5294004 5294023 5294007 -
gaacctttatgtctagctca

SEQ ID NO: 40737 - DNA, 20 bp, Artificial Sequence
  Synthetic oligonucleotide; CGG chr11 5293984 5294003 5293987 -
gggattgtaaatacaccact

SEQ ID NO: 40738 - DNA, 20 bp, Artificial Sequence
  Synthetic oligonucleotide; CAG chr11 5293981 5294000 5293984 -
attgtaaatacaccactcgg

SEQ ID NO: 40739 - DNA, 20 bp, Artificial Sequence
  Synthetic oligonucleotide; TAG chr11 5293970 5293989 5293973 -
accactcggcagtctgtatc

SEQ ID NO: 40740 - DNA, 20 bp, Artificial Sequence
  Synthetic oligonucleotide; AAG chr11 5293964 5293983 5293967 -
cggcagtctgtatctagctc

SEQ ID NO: 40741 - DNA, 20 bp, Artificial Sequence
  Synthetic oligonucleotide; AGG chr11 5293963 5293982 5293966 -
ggcagtctgtatctagctca

SEQ ID NO: 40742 - DNA, 20 bp, Artificial Sequence
  Synthetic oligonucleotide; CAG chr11 5293943 5293962 5293946 -
aggtttgtaaacacaccaat

SEQ ID NO: 40743 - DNA, 20 bp, Artificial Sequence
  Synthetic oligonucleotide; TAG chr11 5293929 5293948 5293932 -
accaatcagcaccctgtgtc

SEQ ID NO: 40744 - DNA, 20 bp, Artificial Sequence
  Synthetic oligonucleotide; CAG chr11 5293924 5293943 5293927 -
tcagcaccctgtgtctagct

SEQ ID NO: 40745 - DNA, 20 bp, Artificial Sequence
  Synthetic oligonucleotide; AGG chr11 5293923 5293942 5293926 -
cagcaccctgtgtctagctc

SEQ ID NO: 40746 - DNA, 20 bp, Artificial Sequence
  Synthetic oligonucleotide; GGG chr11 5293922 5293941 5293925 -
agcaccctgtgtctagctca

SEQ ID NO: 40747 - DNA, 20 bp, Artificial Sequence
  Synthetic oligonucleotide; TAG chr11 5293888 5293907 5293891 -
accaatcaacactctgtatc

SEQ ID NO: 40748 - DNA, 20 bp, Artificial Sequence
  Synthetic oligonucleotide; TGG chr11 5293879 5293898 5293882 -
cactctgtatctagctactc

SEQ ID NO: 40749 - DNA, 20 bp, Artificial Sequence
  Synthetic oligonucleotide; TGG chr11 5293876 5293895 5293879 -
tctgtatctagctactctgg

SEQ ID NO: 40750 - DNA, 20 bp, Artificial Sequence
  Synthetic oligonucleotide; GGG chr11 5293875 5293894 5293878 -
ctgtatctagctactctggt

SEQ ID NO: 40751 - DNA, 20 bp, Artificial Sequence
  Synthetic oligonucleotide; GGG chr11 5293874 5293893 5293877 -
tgtatctagctactctggtg

SEQ ID NO: 40752 - DNA, 20 bp, Artificial Sequence
  Synthetic oligonucleotide; TGG chr11 5293868 5293887 5293871 -
tagctactctggtggggact

SEQ ID NO: 40753 - DNA, 20 bp, Artificial Sequence
  Synthetic oligonucleotide; GAG chr11 5293866 5293885 5293869 -
gctactctggtggggacttg

SEQ ID NO: 40754 - DNA, 20 bp, Artificial Sequence
  Synthetic oligonucleotide; TGG chr11 5293853 5293872 5293856 -
ggacttggagaacctttgtg

SEQ ID NO: 40755 - DNA, 20 bp, Artificial Sequence
  Synthetic oligonucleotide; TAG chr11 5293838 5293857 5293841 -
ttgtgtggacactctgtatc

SEQ ID NO: 40756 - DNA, 20 bp, Artificial Sequence
  Synthetic oligonucleotide; TGG chr11 5293829 5293848 5293832 -
cactctgtatctagctaatc

SEQ ID NO: 40757 - DNA, 20 bp, Artificial Sequence
  Synthetic oligonucleotide; TGG chr11 5293826 5293845 5293829 -
tctgtatctagctaatctgg

SEQ ID NO: 40758 - DNA, 20 bp, Artificial Sequence
  Synthetic oligonucleotide; GGG chr11 5293825 5293844 5293828 -
ctgtatctagctaatctggt

SEQ ID NO: 40759 - DNA, 20 bp, Artificial Sequence
  Synthetic oligonucleotide; GGG chr11 5293824 5293843 5293827 -
tgtatctagctaatctggtg

SEQ ID NO: 40760 - DNA, 20 bp, Artificial Sequence
  Synthetic oligonucleotide; TGG chr11 5293818 5293837 5293821 -
tagctaatctggtggggacg

SEQ ID NO: 40761 - DNA, 20 bp, Artificial Sequence
  Synthetic oligonucleotide; GAG chr11 5293816 5293835 5293819 -
gctaatctggtggggacgtg

SEQ ID NO: 40762 - DNA, 20 bp, Artificial Sequence
  Synthetic oligonucleotide; TAG chr11 5293801 5293820 5293804 -
acgtggagaacctttgtgtc

SEQ ID NO: 40763 - DNA, 20 bp, Artificial Sequence
  Synthetic oligonucleotide; TGG chr11 5293794 5293813 5293797 -
gaacctttgtgtctagctca

SEQ ID NO: 40764 - DNA, 20 bp, Artificial Sequence
  Synthetic oligonucleotide; CAG chr11 5293774 5293793 5293777 -
tggattgtaaatgcaccaat

SEQ ID NO: 40765 - DNA, 20 bp, Artificial Sequence
  Synthetic oligonucleotide; CAG chr11 5293758 5293777 5293761 -
caatcagtgccctgtcaaaa

SEQ ID NO: 40766 - DNA, 20 bp, Artificial Sequence
  Synthetic oligonucleotide; TGG chr11 5293750 5293769 5293753 -
gccctgtcaaaacagaccac

SEQ ID NO: 40767 - DNA, 20 bp, Artificial Sequence
  Synthetic oligonucleotide; GGG chr11 5293749 5293768 5293752 -
ccctgtcaaaacagaccact

SEQ ID NO: 40768 - DNA, 20 bp, Artificial Sequence
  Synthetic oligonucleotide; CAG chr11 5293736 5293755 5293739 -
gaccactgggctctaccaat

SEQ ID NO: 40769 - DNA, 20 bp, Artificial Sequence
  Synthetic oligonucleotide; CAG chr11 5293733 5293752 5293736 -
cactgggctctaccaatcag

SEQ ID NO: 40770 - DNA, 20 bp, Artificial Sequence
  Synthetic oligonucleotide; AGG chr11 5293732 5293751 5293735 -
actgggctctaccaatcagc

SEQ ID NO: 40771 - DNA, 20 bp, Artificial Sequence
  Synthetic oligonucleotide; TGG chr11 5293726 5293745 5293729 -
ctctaccaatcagcaggatg

SEQ ID NO: 40772 - DNA, 20 bp, Artificial Sequence
  Synthetic oligonucleotide; GGG chr11 5293725 5293744 5293728 -
tctaccaatcagcaggatgt

SEQ ID NO: 40773 - DNA, 20 bp, Artificial Sequence
  Synthetic oligonucleotide; TGG chr11 5293722 5293741 5293725 -
accaatcagcaggatgtggg

SEQ ID NO: 40774 - DNA, 20 bp, Artificial Sequence
  Synthetic oligonucleotide; GGG chr11 5293721 5293740 5293724 -
ccaatcagcaggatgtgggt

SEQ ID NO: 40775 - DNA, 20 bp, Artificial Sequence
  Synthetic oligonucleotide; GGG chr11 5293720 5293739 5293723 -
caatcagcaggatgtgggtg

SEQ ID NO: 40776 - DNA, 20 bp, Artificial Sequence
  Synthetic oligonucleotide; CAG chr11 5293716 5293735 5293719 -
cagcaggatgtgggtggggc

SEQ ID NO: 40777 - DNA, 20 bp, Artificial Sequence
  Synthetic oligonucleotide; AAG chr11 5293711 5293730 5293714 -
ggatgtgggtggggccagat

SEQ ID NO: 40778 - DNA, 20 bp, Artificial Sequence
  Synthetic oligonucleotide; GAG chr11 5293709 5293728 5293712 -
atgtgggtggggccagataa

SEQ ID NO: 40779 - DNA, 20 bp, Artificial Sequence
  Synthetic oligonucleotide; AAG chr11 5293701 5293720 5293704 -
ggggccagataagagaataa

SEQ ID NO: 40780 - DNA, 20 bp, Artificial Sequence
  Synthetic oligonucleotide; CAG chr11 5293698 5293717 5293701 -
gccagataagagaataaaag

SEQ ID NO: 40781 - DNA, 20 bp, Artificial Sequence
  Synthetic oligonucleotide; AGG chr11 5293697 5293716 5293700 -
ccagataagagaataaaagc

SEQ ID NO: 40782 - DNA, 20 bp, Artificial Sequence
  Synthetic oligonucleotide; GAG chr11 5293688 5293707 5293691 -
agaataaaagcaggctgccc

SEQ ID NO: 40783 - DNA, 20 bp, Artificial Sequence
  Synthetic oligonucleotide; CAG chr11 5293684 5293703 5293687 -
taaaagcaggctgcccgagc

SEQ ID NO: 40784 - DNA, 20 bp, Artificial Sequence
  Synthetic oligonucleotide; CAG chr11 5293681 5293700 5293684 -
aagcaggctgcccgagccag

SEQ ID NO: 40785 - DNA, 20 bp, Artificial Sequence
  Synthetic oligonucleotide; TGG chr11 5293678 5293697 5293681 -
caggctgcccgagccagcag

SEQ ID NO: 40786 - DNA, 20 bp, Artificial Sequence
  Synthetic oligonucleotide; CGG chr11 5293666 5293685 5293669 -
gccagcagtggcaacccgct

SEQ ID NO: 40787 - DNA, 20 bp, Artificial Sequence
  Synthetic oligonucleotide; GGG chr11 5293665 5293684 5293668 -
ccagcagtggcaacccgctc

SEQ ID NO: 40788 - DNA, 20 bp, Artificial Sequence
  Synthetic oligonucleotide; TGG chr11 5293647 5293666 5293650 -
tcgggtccccttccacactg

SEQ ID NO: 40789 - DNA, 20 bp, Artificial Sequence
  Synthetic oligonucleotide; AAG chr11 5293644 5293663 5293647 -
ggtccccttccacactgtgg

SEQ ID NO: 40790 - DNA, 20 bp, Artificial Sequence
  Synthetic oligonucleotide; TGG chr11 5293594 5293613 5293597 -
tcttgctgctgctcactgtt

SEQ ID NO: 40791 - DNA, 20 bp, Artificial Sequence
  Synthetic oligonucleotide; GGG chr11 5293593 5293612 5293596 -
cttgctgctgctcactgttt

SEQ ID NO: 40792 - DNA, 20 bp, Artificial Sequence
  Synthetic oligonucleotide; GAG chr11 5293574 5293593 5293577 -
tgggtctacactgcctttat

SEQ ID NO: 40793 - DNA, 20 bp, Artificial Sequence
  Synthetic oligonucleotide; AAG chr11 5293554 5293573 5293557 -
gagctgtaacgctcaccgcg

SEQ ID NO: 40794 - DNA, 20 bp, Artificial Sequence
  Synthetic oligonucleotide; AGG chr11 5293553 5293572 5293556 -
agctgtaacgctcaccgcga

SEQ ID NO: 40795 - DNA, 20 bp, Artificial Sequence
  Synthetic oligonucleotide; CAG chr11 5293546 5293565 5293549 -
acgctcaccgcgaaggtctg

SEQ ID NO: 40796 - DNA, 20 bp, Artificial Sequence
  Synthetic oligonucleotide; AAG chr11 5293532 5293551 5293535 -
ggtctgcagcttcactcttg

SEQ ID NO: 40797 - DNA, 20 bp, Artificial Sequence
  Synthetic oligonucleotide; CAG chr11 5293528 5293547 5293531 -
tgcagcttcactcttgaagc

SEQ ID NO: 40798 - DNA, 20 bp, Artificial Sequence
  Synthetic oligonucleotide; GAG chr11 5293524 5293543 5293527 -
gcttcactcttgaagccagc

SEQ ID NO: 40799 - DNA, 20 bp, Artificial Sequence
  Synthetic oligonucleotide; CGG chr11 5293508 5293527 5293511 -
cagcgagaccacgaacccac

SEQ ID NO: 40800 - DNA, 20 bp, Artificial Sequence
  Synthetic oligonucleotide; GGG chr11 5293507 5293526 5293510 -
agcgagaccacgaacccacc

SEQ ID NO: 40801 - DNA, 20 bp, Artificial Sequence
  Synthetic oligonucleotide; GAG chr11 5293505 5293524 5293508 -
cgagaccacgaacccaccgg

SEQ ID NO: 40802 - DNA, 20 bp, Artificial Sequence
  Synthetic oligonucleotide; AGG chr11 5293504 5293523 5293507 -
gagaccacgaacccaccggg

SEQ ID NO: 40803 - DNA, 20 bp, Artificial Sequence
  Synthetic oligonucleotide; CAG chr11 5293489 5293508 5293492 -
ccgggaggaacgaacaactc

SEQ ID NO: 40804 - DNA, 20 bp, Artificial Sequence
  Synthetic oligonucleotide; GAG chr11 5293487 5293506 5293490 -
gggaggaacgaacaactcca

SEQ ID NO: 40805 - DNA, 20 bp, Artificial Sequence
  Synthetic oligonucleotide; AGG chr11 5293486 5293505 5293489 -
ggaggaacgaacaactccag

SEQ ID NO: 40806 - DNA, 20 bp, Artificial Sequence
  Synthetic oligonucleotide; AAG chr11 5293474 5293493 5293477 -
aactccagaggcgccgcctt

SEQ ID NO: 40807 - DNA, 20 bp, Artificial Sequence
  Synthetic oligonucleotide; GAG chr11 5293472 5293491 5293475 -
ctccagaggcgccgccttaa

SEQ ID NO: 40808 - DNA, 20 bp, Artificial Sequence
  Synthetic oligonucleotide; TGG chr11 5293468 5293487 5293471 -
agaggcgccgccttaagagc

SEQ ID NO: 40809 - DNA, 20 bp, Artificial Sequence
  Synthetic oligonucleotide; AAG chr11 5293452 5293471 5293455 -
gagctggaacgttcactgtg

SEQ ID NO: 40810 - DNA, 20 bp, Artificial Sequence
  Synthetic oligonucleotide; AGG chr11 5293451 5293470 5293454 -
agctggaacgttcactgtga

SEQ ID NO: 40811 - DNA, 20 bp, Artificial Sequence
  Synthetic oligonucleotide; CAG chr11 5293444 5293463 5293447 -
acgttcactgtgaaggtctg

SEQ ID NO: 40812 - DNA, 20 bp, Artificial Sequence
  Synthetic oligonucleotide; GAG chr11 5293431 5293450 5293434 -
aggtctgcagcttcactcct

SEQ ID NO: 40813 - DNA, 20 bp, Artificial Sequence
  Synthetic oligonucleotide; CAG chr11 5293427 5293446 5293430 -
ctgcagcttcactcctgagc

SEQ ID NO: 40814 - DNA, 20 bp, Artificial Sequence
  Synthetic oligonucleotide; GAG chr11 5293423 5293442 5293426 -
agcttcactcctgagccagc

SEQ ID NO: 40815 - DNA, 20 bp, Artificial Sequence
  Synthetic oligonucleotide; CAG chr11 5293407 5293426 5293410 -
cagcgagaccacgaacccat

SEQ ID NO: 40816 - DNA, 20 bp, Artificial Sequence
  Synthetic oligonucleotide; AAG chr11 5293404 5293423 5293407 -
cgagaccacgaacccatcag

SEQ ID NO: 40817 - DNA, 20 bp, Artificial Sequence
  Synthetic oligonucleotide; AGG chr11 5293403 5293422 5293406 -
gagaccacgaacccatcaga

SEQ ID NO: 40818 - DNA, 20 bp, Artificial Sequence
  Synthetic oligonucleotide; AAG chr11 5293400 5293419 5293403 -
accacgaacccatcagaagg

SEQ ID NO: 40819 - DNA, 20 bp, Artificial Sequence
  Synthetic oligonucleotide; CAG chr11 5293374 5293393 5293377 -
ctccgaacacatccaaacat

SEQ ID NO: 40820 - DNA, 20 bp, Artificial Sequence
  Synthetic oligonucleotide; CAG chr11 5293350 5293369 5293353 -
acgaacaaactccacacacg

SEQ ID NO: 40821 - DNA, 20 bp, Artificial Sequence
  Synthetic oligonucleotide; AAG chr11 5293342 5293361 5293345 -
actccacacacgcagccttt

SEQ ID NO: 40822 - DNA, 20 bp, Artificial Sequence
  Synthetic oligonucleotide; GAG chr11 5293321 5293340 5293324 -
agaactgtaacactcaccac

SEQ ID NO: 40823 - DNA, 20 bp, Artificial Sequence
  Synthetic oligonucleotide; AGG chr11 5293320 5293339 5293323 -
gaactgtaacactcaccacg

SEQ ID NO: 40824 - DNA, 20 bp, Artificial Sequence
  Synthetic oligonucleotide; GGG chr11 5293319 5293338 5293322 -
aactgtaacactcaccacga

SEQ ID NO: 40825 - DNA, 20 bp, Artificial Sequence
  Synthetic oligonucleotide; CGG chr11 5293312 5293331 5293315 -
acactcaccacgagggtccc

SEQ ID NO: 40826 - DNA, 20 bp, Artificial Sequence
  Synthetic oligonucleotide; AAG chr11 5293298 5293317 5293301 -
ggtccccggcttcattcttg

SEQ ID NO: 40827 - DNA, 20 bp, Artificial Sequence
  Synthetic oligonucleotide; CAG chr11 5293294 5293313 5293297 -
cccggcttcattcttgaagt

SEQ ID NO: 40828 - DNA, 20 bp, Artificial Sequence
  Synthetic oligonucleotide; AAG chr11 5293284 5293303 5293287 -
ttcttgaagtcagtgaaacc

SEQ ID NO: 40829 - DNA, 20 bp, Artificial Sequence
  Synthetic oligonucleotide; CGG chr11 5293268 5293287 5293271 -
aaccaagaacccaccaattc

SEQ ID NO: 40830 - DNA, 20 bp, Artificial Sequence
  Synthetic oligonucleotide; CAG chr11 5293262 5293281 5293265 -
gaacccaccaattccggaca

SEQ ID NO: 40831 - DNA, 20 bp, Artificial Sequence
  Synthetic oligonucleotide; CAG chr11 5293254 5293273 5293257 -
caattccggacacagtatgt

SEQ ID NO: 40832 - DNA, 20 bp, Artificial Sequence
  Synthetic oligonucleotide; GAG chr11 5293242 5293261 5293245 -
cagtatgtcagaaacaatat

SEQ ID NO: 40833 - DNA, 20 bp, Artificial Sequence
  Synthetic oligonucleotide; CAG chr11 5293205 5293224 5293208 -
tacttctcaacaatttccaa

SEQ ID NO: 40834 - DNA, 20 bp, Artificial Sequence
  Synthetic oligonucleotide; TGG chr11 5293187 5293206 5293190 -
aacagcccttgcaattaact

SEQ ID NO: 40835 - DNA, 20 bp, Artificial Sequence
  Synthetic oligonucleotide; TGG chr11 5293175 5293194 5293178 -
aattaacttggccatgtgac

SEQ ID NO: 40836 - DNA, 20 bp, Artificial Sequence
  Synthetic oligonucleotide; TGG chr11 5293155 5293174 5293158 -
tggttgtgactaaaataatg

SEQ ID NO: 40837 - DNA, 20 bp, Artificial Sequence
  Synthetic oligonucleotide; GAG chr11 5293153 5293172 5293156 -
gttgtgactaaaataatgtg

SEQ ID NO: 40838 - DNA, 20 bp, Artificial Sequence
  Synthetic oligonucleotide; AAG chr11 5293130 5293149 5293133 -
ataataatgtgttactccct

SEQ ID NO: 40839 - DNA, 20 bp, Artificial Sequence
  Synthetic oligonucleotide; AGG chr11 5293129 5293148 5293132 -
taataatgtgttactcccta

SEQ ID NO: 40840 - DNA, 20 bp, Artificial Sequence
  Synthetic oligonucleotide; CAG chr11 5293126 5293145 5293129 -
taatgtgttactccctaagg

SEQ ID NO: 40841 - DNA, 20 bp, Artificial Sequence
  Synthetic oligonucleotide; GAG chr11 5293124 5293143 5293127 -
atgtgttactccctaaggca

SEQ ID NO: 40842 - DNA, 20 bp, Artificial Sequence
  Synthetic oligonucleotide; TGG chr11 5293087 5293106 5293090 -
tctctttcccttcctctatg

SEQ ID NO: 40843 - DNA, 20 bp, Artificial Sequence
  Synthetic oligonucleotide; CAG chr11 5293084 5293103 5293087 -
ctttcccttcctctatgtgg

SEQ ID NO: 40844 - DNA, 20 bp, Artificial Sequence
  Synthetic oligonucleotide; AAG chr11 5293080 5293099 5293083 -
cccttcctctatgtggcaga

SEQ ID NO: 40845 - DNA, 20 bp, Artificial Sequence
  Synthetic oligonucleotide; AAG chr11 5293074 5293093 5293077 -
ctctatgtggcagaaagtaa

SEQ ID NO: 40846 - DNA, 20 bp, Artificial Sequence
  Synthetic oligonucleotide; AAG chr11 5293057 5293076 5293060 -
taaaagattctgaaatgata

SEQ ID NO: 40847 - DNA, 20 bp, Artificial Sequence
  Synthetic oligonucleotide; CAG chr11 5293047 5293066 5293050 -
tgaaatgataaagtcaatca

SEQ ID NO: 40848 - DNA, 20 bp, Artificial Sequence
  Synthetic oligonucleotide; AGG chr11 5293046 5293065 5293049 -
gaaatgataaagtcaatcac

SEQ ID NO: 40849 - DNA, 20 bp, Artificial Sequence
  Synthetic oligonucleotide; AAG chr11 5293043 5293062 5293046 -
atgataaagtcaatcacagg

SEQ ID NO: 40850 - DNA, 20 bp, Artificial Sequence
  Synthetic oligonucleotide; AGG chr11 5293042 5293061 5293045 -
tgataaagtcaatcacagga

SEQ ID NO: 40851 - DNA, 20 bp, Artificial Sequence
  Synthetic oligonucleotide; TGG chr11 5293035 5293054 5293038 -
gtcaatcacaggaaggcacc

SEQ ID NO: 40852 - DNA, 20 bp, Artificial Sequence
  Synthetic oligonucleotide; TGG chr11 5293027 5293046 5293030 -
caggaaggcacctggactcc

SEQ ID NO: 40853 - DNA, 20 bp, Artificial Sequence
  Synthetic oligonucleotide; TGG chr11 5293015 5293034 5293018 -
tggactcctggcccactgct

SEQ ID NO: 40854 - DNA, 20 bp, Artificial Sequence
  Synthetic oligonucleotide; GAG chr11 5293013 5293032 5293016 -
gactcctggcccactgcttg

SEQ ID NO: 40855 - DNA, 20 bp, Artificial Sequence
  Synthetic oligonucleotide; AGG chr11 5293012 5293031 5293015 -
actcctggcccactgcttgg

SEQ ID NO: 40856 - DNA, 20 bp, Artificial Sequence
  Synthetic oligonucleotide; GAG chr11 5293010 5293029 5293013 -
tcctggcccactgcttggag

SEQ ID NO: 40857 - DNA, 20 bp, Artificial Sequence
  Synthetic oligonucleotide; GAG chr11 5293008 5293027 5293011 -
ctggcccactgcttggagga

SEQ ID NO: 40858 - DNA, 20 bp, Artificial Sequence
  Synthetic oligonucleotide; CAG chr11 5293001 5293020 5293004 -
actgcttggaggagagcact

SEQ ID NO: 40859 - DNA, 20 bp, Artificial Sequence
  Synthetic oligonucleotide; AGG chr11 5293000 5293019 5293003 -
ctgcttggaggagagcactc

SEQ ID NO: 40860 - DNA, 20 bp, Artificial Sequence
  Synthetic oligonucleotide; TAG chr11 5292974 5292993 5292977 -
atgaacatctgactgtgacg

SEQ ID NO: 40861 - DNA, 20 bp, Artificial Sequence
  Synthetic oligonucleotide; AAG chr11 5292966 5292985 5292969 -
ctgactgtgacgtagcaata

SEQ ID NO: 40862 - DNA, 20 bp, Artificial Sequence
  Synthetic oligonucleotide; TGG chr11 5292928 5292947 5292931 -
atgaaactgcttaaaattaa

SEQ ID NO: 40863 - DNA, 20 bp, Artificial Sequence
  Synthetic oligonucleotide; AAG chr11 5292922 5292941 5292925 -
ctgcttaaaattaatggcac

SEQ ID NO: 40864 - DNA, 20 bp, Artificial Sequence
  Synthetic oligonucleotide; TGG chr11 5292884 5292903 5292887 -
tgcacatttgtctttatttg

SEQ ID NO: 40865 - DNA, 20 bp, Artificial Sequence
  Synthetic oligonucleotide; AAG chr11 5292853 5292872 5292856 -
gcttccacatcaatccactc

SEQ ID NO: 40866 - DNA, 20 bp, Artificial Sequence
  Synthetic oligonucleotide; AGG chr11 5292852 5292871 5292855 -
cttccacatcaatccactca

SEQ ID NO: 40867 - DNA, 20 bp, Artificial Sequence
  Synthetic oligonucleotide; AAG chr11 5292823 5292842 5292826 -
ttctgctataatgcaatttc

SEQ ID NO: 40868 - DNA, 20 bp, Artificial Sequence
  Synthetic oligonucleotide; CAG chr11 5292813 5292832 5292816 -
atgcaatttcaagttcttta

SEQ ID NO: 40869 - DNA, 20 bp, Artificial Sequence
  Synthetic oligonucleotide; AGG chr11 5292812 5292831 5292815 -
tgcaatttcaagttctttac

SEQ ID NO: 40870 - DNA, 20 bp, Artificial Sequence
  Synthetic oligonucleotide; GAG chr11 5292807 5292826 5292810 -
tttcaagttctttacaggcc

SEQ ID NO: 40871 - DNA, 20 bp, Artificial Sequence
  Synthetic oligonucleotide; AAG chr11 5292775 5292794 5292778 -
tctgaattcctgacctccaa

SEQ ID NO: 40872 - DNA, 20 bp, Artificial Sequence
  Synthetic oligonucleotide; AAG chr11 5292767 5292786 5292770 -
cctgacctccaaaagtgatc

SEQ ID NO: 40873 - DNA, 20 bp, Artificial Sequence
  Synthetic oligonucleotide; TAG chr11 5292757 5292776 5292760 -
aaaagtgatcaagatatttt

SEQ ID NO: 40874 - DNA, 20 bp, Artificial Sequence
  Synthetic oligonucleotide; CAG chr11 5292752 5292771 5292755 -
tgatcaagatatttttagtt

SEQ ID NO: 40875 - DNA, 20 bp, Artificial Sequence
  Synthetic oligonucleotide; AGG chr11 5292751 5292770 5292754 -
gatcaagatatttttagttc

SEQ ID NO: 40876 - DNA, 20 bp, Artificial Sequence
  Synthetic oligonucleotide; TAG chr11 5292726 5292745 5292729 -
ccaaaattttctcattttca

SEQ ID NO: 40877 - DNA, 20 bp, Artificial Sequence
  Synthetic oligonucleotide; AGG chr11 5292725 5292744 5292728 -
caaaattttctcattttcat

SEQ ID NO: 40878 - DNA, 20 bp, Artificial Sequence
  Synthetic oligonucleotide; AAG chr11 5292690 5292709 5292693 -
gatcattattcatgatttgc

SEQ ID NO: 40879 - DNA, 20 bp, Artificial Sequence
  Synthetic oligonucleotide; AGG chr11 5292689 5292708 5292692 -
atcattattcatgatttgca

SEQ ID NO: 40880 - DNA, 20 bp, Artificial Sequence
  Synthetic oligonucleotide; CAG chr11 5292622 5292641 5292625 -
atgacattttaactatgttc

SEQ ID NO: 40881 - DNA, 20 bp, Artificial Sequence
  Synthetic oligonucleotide; AAG chr11 5292608 5292627 5292611 -
atgttccagatttttgaatg

SEQ ID NO: 40882 - DNA, 20 bp, Artificial Sequence
  Synthetic oligonucleotide; GAG chr11 5292606 5292625 5292609 -
gttccagatttttgaatgaa

SEQ ID NO: 40883 - DNA, 20 bp, Artificial Sequence
  Synthetic oligonucleotide; AAG chr11 5292571 5292590 5292574 -
atgttttcaccacaaaaaat

SEQ ID NO: 40884 - DNA, 20 bp, Artificial Sequence
  Synthetic oligonucleotide; AAG chr11 5292562 5292581 5292565 -
ccacaaaaaataagtatgtg

SEQ ID NO: 40885 - DNA, 20 bp, Artificial Sequence
  Synthetic oligonucleotide; TGG chr11 5292559 5292578 5292562 -
caaaaaataagtatgtgaag

SEQ ID NO: 40886 - DNA, 20 bp, Artificial Sequence
  Synthetic oligonucleotide; TGG chr11 5292556 5292575 5292559 -
aaaataagtatgtgaagtgg

SEQ ID NO: 40887 - DNA, 20 bp, Artificial Sequence
  Synthetic oligonucleotide; TAG chr11 5292543 5292562 5292546 -
gaagtggtggatttgttaat

SEQ ID NO: 40888 - DNA, 20 bp, Artificial Sequence
  Synthetic oligonucleotide; AAG chr11 5292504 5292523 5292507 -
aatattgtacacgtacacca

SEQ ID NO: 40889 - DNA, 20 bp, Artificial Sequence
  Synthetic oligonucleotide; AAG chr11 5292430 5292449 5292433 -
tgaaataataaaaaataaca

SEQ ID NO: 40890 - DNA, 20 bp, Artificial Sequence
  Synthetic oligonucleotide; AGG chr11 5292429 5292448 5292432 -
gaaataataaaaaataacaa

SEQ ID NO: 40891 - DNA, 20 bp, Artificial Sequence
  Synthetic oligonucleotide; TAG chr11 5292423 5292442 5292426 -
ataaaaaataacaaaggcat

SEQ ID NO: 40892 - DNA, 20 bp, Artificial Sequence
  Synthetic oligonucleotide; CGG chr11 5292402 5292421 5292405 -
agcctctgcattgcctttac

SEQ ID NO: 40893 - DNA, 20 bp, Artificial Sequence
  Synthetic oligonucleotide; CGG chr11 5292390 5292409 5292393 -
gcctttaccggtcatcctca

SEQ ID NO: 40894 - DNA, 20 bp, Artificial Sequence
  Synthetic oligonucleotide; TAG chr11 5292322 5292341 5292325 -
atctttgatgcctctttgtc

SEQ ID NO: 40895 - DNA, 20 bp, Artificial Sequence
  Synthetic oligonucleotide; TGG chr11 5292282 5292301 5292285 -
ttttctctacgttatttata

SEQ ID NO: 40896 - DNA, 20 bp, Artificial Sequence
  Synthetic oligonucleotide; GGG chr11 5292281 5292300 5292284 -
tttctctacgttatttatat

SEQ ID NO: 40897 - DNA, 20 bp, Artificial Sequence
  Synthetic oligonucleotide; TGG chr11 5292264 5292283 5292267 -
tatgggtatcatcaccatcc

SEQ ID NO: 40898 - DNA, 20 bp, Artificial Sequence
  Synthetic oligonucleotide; CAG chr11 5292254 5292273 5292257 -
atcaccatcctggacaacat

SEQ ID NO: 40899 - DNA, 20 bp, Artificial Sequence
  Synthetic oligonucleotide; AGG chr11 5292253 5292272 5292256 -
tcaccatcctggacaacatc

SEQ ID NO: 40900 - DNA, 20 bp, Artificial Sequence
  Synthetic oligonucleotide; CAG chr11 5292249 5292268 5292252 -
catcctggacaacatcagga

SEQ ID NO: 40901 - DNA, 20 bp, Artificial Sequence
  Synthetic oligonucleotide; AAG chr11 5292234 5292253 5292237 -
caggacagatatccctcacc

SEQ ID NO: 40902 - DNA, 20 bp, Artificial Sequence
  Synthetic oligonucleotide; TGG chr11 5292212 5292231 5292215 -
gccaatgttcctctctatgt

SEQ ID NO: 40903 - DNA, 20 bp, Artificial Sequence
  Synthetic oligonucleotide; CAG chr11 5292170 5292189 5292173 -
tcctttcaccaccctttcca

SEQ ID NO: 40904 - DNA, 20 bp, Artificial Sequence
  Synthetic oligonucleotide; AAG chr11 5292163 5292182 5292166 -
accaccctttccacagtcaa

SEQ ID NO: 40905 - DNA, 20 bp, Artificial Sequence
  Synthetic oligonucleotide; AGG chr11 5292162 5292181 5292165 -
ccaccctttccacagtcaaa

SEQ ID NO: 40906 - DNA, 20 bp, Artificial Sequence
  Synthetic oligonucleotide; TAG chr11 5292153 5292172 5292156 -
ccacagtcaaaaggatattg

SEQ ID NO: 40907 - DNA, 20 bp, Artificial Sequence
  Synthetic oligonucleotide; CAG chr11 5292140 5292159 5292143 -
gatattgtagtttaatgcct

SEQ ID NO: 40908 - DNA, 20 bp, Artificial Sequence
  Synthetic oligonucleotide; GAG chr11 5292138 5292157 5292141 -
tattgtagtttaatgcctca

SEQ ID NO: 40909 - DNA, 20 bp, Artificial Sequence
  Synthetic oligonucleotide; CAG chr11 5292133 5292152 5292136 -
tagtttaatgcctcagagtt

SEQ ID NO: 40910 - DNA, 20 bp, Artificial Sequence
  Synthetic oligonucleotide; AAG chr11 5292125 5292144 5292128 -
tgcctcagagttcagctttt

SEQ ID NO: 40911 - DNA, 20 bp, Artificial Sequence
  Synthetic oligonucleotide; TAG chr11 5292097 5292116 5292100 -
gacaaattattcttcctctt

SEQ ID NO: 40912 - DNA, 20 bp, Artificial Sequence
  Synthetic oligonucleotide; AGG chr11 5292096 5292115 5292099 -
acaaattattcttcctcttt

SEQ ID NO: 40913 - DNA, 20 bp, Artificial Sequence
  Synthetic oligonucleotide; TGG chr11 5292083 5292102 5292086 -
cctctttaggttctccttta

SEQ ID NO: 40914 - DNA, 20 bp, Artificial Sequence
  Synthetic oligonucleotide; TGG chr11 5292065 5292084 5292068 -
tatggaatcttctgtactga

SEQ ID NO: 40915 - DNA, 20 bp, Artificial Sequence
  Synthetic oligonucleotide; TAG chr11 5292041 5292060 5292044 -
catgtcctttaactactatg

SEQ ID NO: 40916 - DNA, 20 bp, Artificial Sequence
  Synthetic oligonucleotide; TAG chr11 5292001 5292020 5292004 -
tattatgcctctacctttat

SEQ ID NO: 40917 - DNA, 20 bp, Artificial Sequence
  Synthetic oligonucleotide; CAG chr11 5291998 5292017 5292001 -
tatgcctctacctttattag

SEQ ID NO: 40918 - DNA, 20 bp, Artificial Sequence
  Synthetic oligonucleotide; GAG chr11 5291996 5292015 5291999 -
tgcctctacctttattagca

SEQ ID NO: 40919 - DNA, 20 bp, Artificial Sequence
  Synthetic oligonucleotide; TGG chr11 5291980 5291999 5291983 -
agcagagttatctgtactgt

SEQ ID NO: 40920 - DNA, 20 bp, Artificial Sequence
  Synthetic oligonucleotide; TGG chr11 5291919 5291938 5291922 -
ttctgctattcttgatcaaa

SEQ ID NO: 40921 - DNA, 20 bp, Artificial Sequence
  Synthetic oligonucleotide; TGG chr11 5291877 5291896 5291880 -
tcatttctcctgccttcact

SEQ ID NO: 40922 - DNA, 20 bp, Artificial Sequence
  Synthetic oligonucleotide; TAG chr11 5291862 5291881 5291865 -
tcacttggacgtgcttcacg

SEQ ID NO: 40923 - DNA, 20 bp, Artificial Sequence
  Synthetic oligonucleotide; TGG chr11 5291845 5291864 5291848 -
acgtagtctgtgcttatgac

SEQ ID NO: 40924 - DNA, 20 bp, Artificial Sequence
  Synthetic oligonucleotide; TGG chr11 5291828 5291847 5291831 -
gactggattaaaaattgata

SEQ ID NO: 40925 - DNA, 20 bp, Artificial Sequence
  Synthetic oligonucleotide; TGG chr11 5291797 5291816 5291800 -
taatgttgttcgtcataata

SEQ ID NO: 40926 - DNA, 20 bp, Artificial Sequence
  Synthetic oligonucleotide; GGG chr11 5291796 5291815 5291799 -
aatgttgttcgtcataatat

SEQ ID NO: 40927 - DNA, 20 bp, Artificial Sequence
  Synthetic oligonucleotide; TGG chr11 5291788 5291807 5291791 -
tcgtcataatatgggtttta

SEQ ID NO: 40928 - DNA, 20 bp, Artificial Sequence
  Synthetic oligonucleotide; TGG chr11 5291758 5291777 5291761 -
ttatttcctatgcattgatc

SEQ ID NO: 40929 - DNA, 20 bp, Artificial Sequence
  Synthetic oligonucleotide; GAG chr11 5291756 5291775 5291759 -
atttcctatgcattgatctg

SEQ ID NO: 40930 - DNA, 20 bp, Artificial Sequence
  Synthetic oligonucleotide; AAG chr11 5291753 5291772 5291756 -
tcctatgcattgatctggag

SEQ ID NO: 40931 - DNA, 20 bp, Artificial Sequence
  Synthetic oligonucleotide; AGG chr11 5291752 5291771 5291755 -
cctatgcattgatctggaga

SEQ ID NO: 40932 - DNA, 20 bp, Artificial Sequence
  Synthetic oligonucleotide; TGG chr11 5291728 5291747 5291731 -
ttcaatccttttactctttg

SEQ ID NO: 40933 - DNA, 20 bp, Artificial Sequence
  Synthetic oligonucleotide; TGG chr11 5291706 5291725 5291709 -
gaaaatatctgtaaaccttc

SEQ ID NO: 40934 - DNA, 20 bp, Artificial Sequence
  Synthetic oligonucleotide; TAG chr11 5291691 5291710 5291694 -
ccttctggttcactctgcta

SEQ ID NO: 40935 - DNA, 20 bp, Artificial Sequence
  Synthetic oligonucleotide; CAG chr11 5291682 5291701 5291685 -
tcactctgctatagcaattt

SEQ ID NO: 40936 - DNA, 20 bp, Artificial Sequence
  Synthetic oligonucleotide; TAG chr11 5291677 5291696 5291680 -
ctgctatagcaatttcagtt

SEQ ID NO: 40937 - DNA, 20 bp, Artificial Sequence
  Synthetic oligonucleotide; AGG chr11 5291676 5291695 5291679 -
tgctatagcaatttcagttt

SEQ ID NO: 40938 - DNA, 20 bp, Artificial Sequence
  Synthetic oligonucleotide; TAG chr11 5291672 5291691 5291675 -
atagcaatttcagtttaggc

SEQ ID NO: 40939 - DNA, 20 bp, Artificial Sequence
  Synthetic oligonucleotide; AAG chr11 5291668 5291687 5291671 -
caatttcagtttaggctagt

SEQ ID NO: 40940 - DNA, 20 bp, Artificial Sequence
  Synthetic oligonucleotide; GAG chr11 5291662 5291681 5291665 -
cagtttaggctagtaagcat

SEQ ID NO: 40941 - DNA, 20 bp, Artificial Sequence
  Synthetic oligonucleotide; AGG chr11 5291661 5291680 5291664 -
agtttaggctagtaagcatg

SEQ ID NO: 40942 - DNA, 20 bp, Artificial Sequence
  Synthetic oligonucleotide; CAG chr11 5291633 5291652 5291636 -
tccttctctgatttttccca

SEQ ID NO: 40943 - DNA, 20 bp, Artificial Sequence
  Synthetic oligonucleotide; TGG chr11 5291625 5291644 5291628 -
tgatttttcccacagtctgt

SEQ ID NO: 40944 - DNA, 20 bp, Artificial Sequence
  Synthetic oligonucleotide; CAG chr11 5291619 5291638 5291622 -
ttcccacagtctgttggtca

SEQ ID NO: 40945 - DNA, 20 bp, Artificial Sequence
  Synthetic oligonucleotide; GAG chr11 5291608 5291627 5291611 -
tgttggtcacagaataacct

SEQ ID NO: 40946 - DNA, 20 bp, Artificial Sequence
  Synthetic oligonucleotide; AAG chr11 5291592 5291611 5291595 -
acctgagtgattactgatga

SEQ ID NO: 40947 - DNA, 20 bp, Artificial Sequence
  Synthetic oligonucleotide; GAG chr11 5291590 5291609 5291593 -
ctgagtgattactgatgaaa

SEQ ID NO: 40948 - DNA, 20 bp, Artificial Sequence
  Synthetic oligonucleotide; GAG chr11 5291586 5291605 5291589 -
gtgattactgatgaaagagt

SEQ ID NO: 40949 - DNA, 20 bp, Artificial Sequence
  Synthetic oligonucleotide; TAG chr11 5291572 5291591 5291575 -
aagagtgagaatgttattga

SEQ ID NO: 40950 - DNA, 20 bp, Artificial Sequence
  Synthetic oligonucleotide; CAG chr11 5291543 5291562 5291546 -
tgacaaaaaacaaacaacta

SEQ ID NO: 40951 - DNA, 20 bp, Artificial Sequence
  Synthetic oligonucleotide; TAG chr11 5291519 5291538 5291522 -
caaaatgtttctctttttat

SEQ ID NO: 40952 - DNA, 20 bp, Artificial Sequence
  Synthetic oligonucleotide; TGG chr11 5291516 5291535 5291519 -
aatgtttctctttttattag

SEQ ID NO: 40953 - DNA, 20 bp, Artificial Sequence
  Synthetic oligonucleotide; TGG chr11 5291491 5291510 5291494 -
tatatttcctgacctatatc

SEQ ID NO: 40954 - DNA, 20 bp, Artificial Sequence
  Synthetic oligonucleotide; CAG chr11 5291488 5291507 5291491 -
atttcctgacctatatctgg

SEQ ID NO: 40955 - DNA, 20 bp, Artificial Sequence
  Synthetic oligonucleotide; AGG chr11 5291487 5291506 5291490 -
tttcctgacctatatctggc

SEQ ID NO: 40956 - DNA, 20 bp, Artificial Sequence
  Synthetic oligonucleotide; TAG chr11 5291478 5291497 5291481 -
ctatatctggcaggactctt

SEQ ID NO: 40957 - DNA, 20 bp, Artificial Sequence
  Synthetic oligonucleotide; GAG chr11 5291476 5291495 5291479 -
atatctggcaggactcttta

SEQ ID NO: 40958 - DNA, 20 bp, Artificial Sequence
  Synthetic oligonucleotide; GAG chr11 5291474 5291493 5291477 -
atctggcaggactctttaga

SEQ ID NO: 40959 - DNA, 20 bp, Artificial Sequence
  Synthetic oligonucleotide; AGG chr11 5291473 5291492 5291476 -
tctggcaggactctttagag

SEQ ID NO: 40960 - DNA, 20 bp, Artificial Sequence
  Synthetic oligonucleotide; TAG chr11 5291470 5291489 5291473 -
ggcaggactctttagagagg

SEQ ID NO: 40961 - DNA, 20 bp, Artificial Sequence
  Synthetic oligonucleotide; AAG chr11 5291464 5291483 5291467 -
actctttagagaggtagctg

SEQ ID NO: 40962 - DNA, 20 bp, Artificial Sequence
  Synthetic oligonucleotide; TAG chr11 5291445 5291464 5291448 -
gaagctgctgttatgaccac

SEQ ID NO: 40963 - DNA, 20 bp, Artificial Sequence
  Synthetic oligonucleotide; GAG chr11 5291443 5291462 5291446 -
agctgctgttatgaccacta

SEQ ID NO: 40964 - DNA, 20 bp, Artificial Sequence
  Synthetic oligonucleotide; AGG chr11 5291442 5291461 5291445 -
gctgctgttatgaccactag

SEQ ID NO: 40965 - DNA, 20 bp, Artificial Sequence
  Synthetic oligonucleotide; GGG chr11 5291441 5291460 5291444 -
ctgctgttatgaccactaga

SEQ ID NO: 40966 - DNA, 20 bp, Artificial Sequence
  Synthetic oligonucleotide; AAG chr11 5291438 5291457 5291441 -
ctgttatgaccactagaggg

SEQ ID NO: 40967 - DNA, 20 bp, Artificial Sequence
  Synthetic oligonucleotide; AAG chr11 5291435 5291454 5291438 -
ttatgaccactagagggaag

SEQ ID NO: 40968 - DNA, 20 bp, Artificial Sequence
  Synthetic oligonucleotide; TGG chr11 5291425 5291444 5291428 -
tagagggaagaagatacctg

SEQ ID NO: 40969 - DNA, 20 bp, Artificial Sequence
  Synthetic oligonucleotide; GAG chr11 5291423 5291442 5291426 -
gagggaagaagatacctgtg

SEQ ID NO: 40970 - DNA, 20 bp, Artificial Sequence
  Synthetic oligonucleotide; TGG chr11 5291416 5291435 5291419 -
gaagatacctgtggagctaa

SEQ ID NO: 40971 - DNA, 20 bp, Artificial Sequence
  Synthetic oligonucleotide; AAG chr11 5291410 5291429 5291413 -
acctgtggagctaatggtcc

SEQ ID NO: 40972 - DNA, 20 bp, Artificial Sequence
  Synthetic oligonucleotide; TGG chr11 5291406 5291425 5291409 -
gtggagctaatggtccaaga

SEQ ID NO: 40973 - DNA, 20 bp, Artificial Sequence
  Synthetic oligonucleotide; TGG chr11 5291403 5291422 5291406 -
gagctaatggtccaagatgg

SEQ ID NO: 40974 - DNA, 20 bp, Artificial Sequence
  Synthetic oligonucleotide; GAG chr11 5291401 5291420 5291404 -
gctaatggtccaagatggtg

SEQ ID NO: 40975 - DNA, 20 bp, Artificial Sequence
  Synthetic oligonucleotide; AAG chr11 5291394 5291413 5291397 -
gtccaagatggtggagcccc

SEQ ID NO: 40976 - DNA, 20 bp, Artificial Sequence
  Synthetic oligonucleotide; AAG chr11 5291390 5291409 5291393 -
aagatggtggagccccaagc

SEQ ID NO: 40977 - DNA, 20 bp, Artificial Sequence
  Synthetic oligonucleotide; AGG chr11 5291389 5291408 5291392 -
agatggtggagccccaagca

SEQ ID NO: 40978 - DNA, 20 bp, Artificial Sequence
  Synthetic oligonucleotide; AAG chr11 5291386 5291405 5291389 -
tggtggagccccaagcaagg

SEQ ID NO: 40979 - DNA, 20 bp, Artificial Sequence
  Synthetic oligonucleotide; AAG chr11 5291378 5291397 5291381 -
ccccaagcaaggaagttgtt

SEQ ID NO: 40980 - DNA, 20 bp, Artificial Sequence
  Synthetic oligonucleotide; AGG chr11 5291377 5291396 5291380 -
cccaagcaaggaagttgtta

SEQ ID NO: 40981 - DNA, 20 bp, Artificial Sequence
  Synthetic oligonucleotide; GAG chr11 5291375 5291394 5291378 -
caagcaaggaagttgttaag

SEQ ID NO: 40982 - DNA, 20 bp, Artificial Sequence
  Synthetic oligonucleotide; AAG chr11 5291360 5291379 5291363 -
ttaaggagcccttttgattg

SEQ ID NO: 40983 - DNA, 20 bp, Artificial Sequence
  Synthetic oligonucleotide; AGG chr11 5291359 5291378 5291362 -
taaggagcccttttgattga

SEQ ID NO: 40984 - DNA, 20 bp, Artificial Sequence
  Synthetic oligonucleotide; TGG chr11 5291356 5291375 5291359 -
ggagcccttttgattgaagg

SEQ ID NO: 40985 - DNA, 20 bp, Artificial Sequence
  Synthetic oligonucleotide; GGG chr11 5291355 5291374 5291358 -
gagcccttttgattgaaggt

SEQ ID NO: 40986 - DNA, 20 bp, Artificial Sequence
  Synthetic oligonucleotide; CAG chr11 5291339 5291358 5291342 -
aggtgggtgcccccacctta

SEQ ID NO: 40987 - DNA, 20 bp, Artificial Sequence
  Synthetic oligonucleotide; AGG chr11 5291338 5291357 5291341 -
ggtgggtgcccccaccttac

SEQ ID NO: 40988 - DNA, 20 bp, Artificial Sequence
  Synthetic oligonucleotide; GGG chr11 5291337 5291356 5291340 -
gtgggtgcccccaccttaca

SEQ ID NO: 40989 - DNA, 20 bp, Artificial Sequence
  Synthetic oligonucleotide; CAG chr11 5291333 5291352 5291336 -
gtgcccccaccttacaggga

SEQ ID NO: 40990 - DNA, 20 bp, Artificial Sequence
  Synthetic oligonucleotide; AGG chr11 5291332 5291351 5291335 -
tgcccccaccttacagggac

SEQ ID NO: 40991 - DNA, 20 bp, Artificial Sequence
  Synthetic oligonucleotide; TGG chr11 5291324 5291343 5291327 -
ccttacagggacaggacatc

SEQ ID NO: 40992 - DNA, 20 bp, Artificial Sequence
  Synthetic oligonucleotide; CAG chr11 5291311 5291330 5291314 -
ggacatctggatactcctcc

SEQ ID NO: 40993 - DNA, 20 bp, Artificial Sequence
  Synthetic oligonucleotide; CAG chr11 5291302 5291321 5291305 -
gatactcctcccagtttctc

SEQ ID NO: 40994 - DNA, 20 bp, Artificial Sequence
  Synthetic oligonucleotide; AAG chr11 5291234 5291253 5291237 -
cttccccatttctaataata

SEQ ID NO: 40995 - DNA, 20 bp, Artificial Sequence
  Synthetic oligonucleotide; AAG chr11 5291229 5291248 5291232 -
ccatttctaataataaagca

SEQ ID NO: 40996 - DNA, 20 bp, Artificial Sequence
  Synthetic oligonucleotide; AGG chr11 5291228 5291247 5291231 -
catttctaataataaagcaa

SEQ ID NO: 40997 - DNA, 20 bp, Artificial Sequence
  Synthetic oligonucleotide; TAG chr11 5291224 5291243 5291227 -
tctaataataaagcaaaggc

SEQ ID NO: 40998 - DNA, 20 bp, Artificial Sequence
  Synthetic oligonucleotide; TAG chr11 5291220 5291239 5291223 -
ataataaagcaaaggctagt

SEQ ID NO: 40999 - DNA, 20 bp, Artificial Sequence
  Synthetic oligonucleotide; AAG chr11 5291216 5291235 5291219 -
taaagcaaaggctagttagt

SEQ ID NO: 41000 - DNA, 20 bp, Artificial Sequence
  Synthetic oligonucleotide; TAG chr11 5291186 5291205 5291189 -
cttgcattttgaaaatgcca

SEQ ID NO: 41001 - DNA, 20 bp, Artificial Sequence
  Synthetic oligonucleotide; CGG chr11 5291160 5291179 5291163 -
ttcaaaattatttcatacat

SEQ ID NO: 41002 - DNA, 20 bp, Artificial Sequence
  Synthetic oligonucleotide; AAG chr11 5291143 5291162 5291146 -
catcggtctttctttatttc

SEQ ID NO: 41003 - DNA, 20 bp, Artificial Sequence
  Synthetic oligonucleotide; GAG chr11 5291141 5291160 5291144 -
tcggtctttctttatttcaa

SEQ ID NO: 41004 - DNA, 20 bp, Artificial Sequence
  Synthetic oligonucleotide; CAG chr11 5291136 5291155 5291139 -
ctttctttatttcaagagtc

SEQ ID NO: 41005 - DNA, 20 bp, Artificial Sequence
  Synthetic oligonucleotide; TGG chr11 5291130 5291149 5291133 -
ttatttcaagagtccagaaa

SEQ ID NO: 41006 - DNA, 20 bp, Artificial Sequence
  Synthetic oligonucleotide; TGG chr11 5291102 5291121 5291105 -
ttacctttgattcaatgtaa

SEQ ID NO: 41007 - DNA, 20 bp, Artificial Sequence
  Synthetic oligonucleotide; AAG chr11 5291098 5291117 5291101 -
ctttgattcaatgtaatgga

SEQ ID NO: 41008 - DNA, 20 bp, Artificial Sequence
  Synthetic oligonucleotide; GAG chr11 5291096 5291115 5291099 -
ttgattcaatgtaatggaaa

SEQ ID NO: 41009 - DNA, 20 bp, Artificial Sequence
  Synthetic oligonucleotide; AAG chr11 5291086 5291105 5291089 -
gtaatggaaagagctctttc

SEQ ID NO: 41010 - DNA, 20 bp, Artificial Sequence
  Synthetic oligonucleotide; GAG chr11 5291084 5291103 5291087 -
aatggaaagagctctttcaa

SEQ ID NO: 41011 - DNA, 20 bp, Artificial Sequence
  Synthetic oligonucleotide; CAG chr11 5291080 5291099 5291083 -
gaaagagctctttcaagaga

SEQ ID NO: 41012 - DNA, 20 bp, Artificial Sequence
  Synthetic oligonucleotide; GAG chr11 5291078 5291097 5291081 -
aagagctctttcaagagaca

SEQ ID NO: 41013 - DNA, 20 bp, Artificial Sequence
  Synthetic oligonucleotide; AAG chr11 5291073 5291092 5291076 -
ctctttcaagagacagagaa

SEQ ID NO: 41014 - DNA, 20 bp, Artificial Sequence
  Synthetic oligonucleotide; CAG chr11 5290980 5290999 5290983 -
catttctctctctcatttct

SEQ ID NO: 41015 - DNA, 20 bp, Artificial Sequence
  Synthetic oligonucleotide; AAG chr11 5290977 5290996 5290980 -
ttctctctctcatttctcag

SEQ ID NO: 41016 - DNA, 20 bp, Artificial Sequence
  Synthetic oligonucleotide; AAG chr11 5290964 5290983 5290967 -
ttctcagaagtatattttga

SEQ ID NO: 41017 - DNA, 20 bp, Artificial Sequence
  Synthetic oligonucleotide; AGG chr11 5290963 5290982 5290966 -
tctcagaagtatattttgaa

SEQ ID NO: 41018 - DNA, 20 bp, Artificial Sequence
  Synthetic oligonucleotide; TAG chr11 5290955 5290974 5290958 -
gtatattttgaaaggattca

SEQ ID NO: 41019 - DNA, 20 bp, Artificial Sequence
  Synthetic oligonucleotide; CAG chr11 5290952 5290971 5290955 -
tattttgaaaggattcatag

SEQ ID NO: 41020 - DNA, 20 bp, Artificial Sequence
  Synthetic oligonucleotide; CAG chr11 5290948 5290967 5290951 -
ttgaaaggattcatagcaga

SEQ ID NO: 41021 - DNA, 20 bp, Artificial Sequence
  Synthetic oligonucleotide; AAG chr11 5290943 5290962 5290946 -
aggattcatagcagacagct

SEQ ID NO: 41022 - DNA, 20 bp, Artificial Sequence
  Synthetic oligonucleotide; AGG chr11 5290942 5290961 5290945 -
ggattcatagcagacagcta

SEQ ID NO: 41023 - DNA, 20 bp, Artificial Sequence
  Synthetic oligonucleotide; TGG chr11 5290938 5290957 5290941 -
tcatagcagacagctaaggc

SEQ ID NO: 41024 - DNA, 20 bp, Artificial Sequence
  Synthetic oligonucleotide; AAG chr11 5290927 5290946 5290930 -
agctaaggctggttttttct

SEQ ID NO: 41025 - DNA, 20 bp, Artificial Sequence
  Synthetic oligonucleotide; AAG chr11 5290922 5290941 5290925 -
aggctggttttttctaagtg

SEQ ID NO: 41026 - DNA, 20 bp, Artificial Sequence
  Synthetic oligonucleotide; AAG chr11 5290919 5290938 5290922 -
ctggttttttctaagtgaag

SEQ ID NO: 41027 - DNA, 20 bp, Artificial Sequence
  Synthetic oligonucleotide; GAG chr11 5290909 5290928 5290912 -
ctaagtgaagaagtgatatt

SEQ ID NO: 41028 - DNA, 20 bp, Artificial Sequence
  Synthetic oligonucleotide; AAG chr11 5290906 5290925 5290909 -
agtgaagaagtgatattgag

SEQ ID NO: 41029 - DNA, 20 bp, Artificial Sequence
  Synthetic oligonucleotide; AGG chr11 5290905 5290924 5290908 -
gtgaagaagtgatattgaga

SEQ ID NO: 41030 - DNA, 20 bp, Artificial Sequence
  Synthetic oligonucleotide; TAG chr11 5290902 5290921 5290905 -
aagaagtgatattgagaagg

SEQ ID NO: 41031 - DNA, 20 bp, Artificial Sequence
  Synthetic oligonucleotide; AGG chr11 5290901 5290920 5290904 -
agaagtgatattgagaaggt

SEQ ID NO: 41032 - DNA, 20 bp, Artificial Sequence
  Synthetic oligonucleotide; GGG chr11 5290900 5290919 5290903 -
gaagtgatattgagaaggta

SEQ ID NO: 41033 - DNA, 20 bp, Artificial Sequence
  Synthetic oligonucleotide; GAG chr11 5290891 5290910 5290894 -
ttgagaaggtagggttgcat

SEQ ID NO: 41034 - DNA, 20 bp, Artificial Sequence
  Synthetic oligonucleotide; CAG chr11 5290882 5290901 5290885 -
tagggttgcatgagcccttt

SEQ ID NO: 41035 - DNA, 20 bp, Artificial Sequence
  Synthetic oligonucleotide; TAG chr11 5290874 5290893 5290877 -
catgagccctttcagttttt

SEQ ID NO: 41036 - DNA, 20 bp, Artificial Sequence
  Synthetic oligonucleotide; TAG chr11 5290851 5290870 5290854 -
tttatatacatctgtattgt

SEQ ID NO: 41037 - DNA, 20 bp, Artificial Sequence
  Synthetic oligonucleotide; CAG chr11 5290817 5290836 5290820 -
atataaataaaattatttct

SEQ ID NO: 41038 - DNA, 20 bp, Artificial Sequence
  Synthetic oligonucleotide; TAG chr11 5290806 5290825 5290809 -
attatttctcagttatatac

SEQ ID NO: 41039 - DNA, 20 bp, Artificial Sequence
  Synthetic oligonucleotide; TGG chr11 5290791 5290810 5290794 -
tatactagctatgtaacctg

SEQ ID NO: 41040 - DNA, 20 bp, Artificial Sequence
  Synthetic oligonucleotide; AAG chr11 5290778 5290797 5290781 -
taacctgtggatatttcctt

SEQ ID NO: 41041 - DNA, 20 bp, Artificial Sequence
  Synthetic oligonucleotide; AAG chr11 5290769 5290788 5290772 -
gatatttccttaagtattac

SEQ ID NO: 41042 - DNA, 20 bp, Artificial Sequence
  Synthetic oligonucleotide; TGG chr11 5290750 5290769 5290753 -
caagctatacttaactcact

SEQ ID NO: 41043 - DNA, 20 bp, Artificial Sequence
  Synthetic oligonucleotide; TAG chr11 5290722 5290741 5290725 -
tcaaataaatacctgcttca

SEQ ID NO: 41044 - DNA, 20 bp, Artificial Sequence
  Synthetic oligonucleotide; AAG chr11 5290711 5290730 5290714 -
cctgcttcatagttattaat

SEQ ID NO: 41045 - DNA, 20 bp, Artificial Sequence
  Synthetic oligonucleotide; AGG chr11 5290710 5290729 5290713 -
ctgcttcatagttattaata

SEQ ID NO: 41046 - DNA, 20 bp, Artificial Sequence
  Synthetic oligonucleotide; AAG chr11 5290704 5290723 5290707 -
catagttattaataaggatt

SEQ ID NO: 41047 - DNA, 20 bp, Artificial Sequence
  Synthetic oligonucleotide; GAG chr11 5290700 5290719 5290703 -
gttattaataaggattaagt

SEQ ID NO: 41048 - DNA, 20 bp, Artificial Sequence
  Synthetic oligonucleotide; AAG chr11 5290686 5290705 5290689 -
ttaagtgagataatgcccat

SEQ ID NO: 41049 - DNA, 20 bp, Artificial Sequence
  Synthetic oligonucleotide; CAG chr11 5290669 5290688 5290672 -
cataagattcctattaataa

SEQ ID NO: 41050 - DNA, 20 bp, Artificial Sequence
  Synthetic oligonucleotide; AAG chr11 5290637 5290656 5290640 -
tacacacacacacacattga

SEQ ID NO: 41051 - DNA, 20 bp, Artificial Sequence
  Synthetic oligonucleotide; AGG chr11 5290636 5290655 5290639 -
acacacacacacacattgaa

SEQ ID NO: 41052 - DNA, 20 bp, Artificial Sequence
  Synthetic oligonucleotide; TAG chr11 5290618 5290637 5290621 -
aaaggattcttactttgtgc

SEQ ID NO: 41053 - DNA, 20 bp, Artificial Sequence
  Synthetic oligonucleotide; AGG chr11 5290617 5290636 5290620 -
aaggattcttactttgtgct

SEQ ID NO: 41054 - DNA, 20 bp, Artificial Sequence
  Synthetic oligonucleotide; AAG chr11 5290605 5290624 5290608 -
tttgtgctaggaactataat

SEQ ID NO: 41055 - DNA, 20 bp, Artificial Sequence
  Synthetic oligonucleotide; AAG chr11 5290580 5290599 5290583 -
cattgatgcattatatcatt

SEQ ID NO: 41056 - DNA, 20 bp, Artificial Sequence
  Synthetic oligonucleotide; TAG chr11 5290562 5290581 5290565 -
ttaagttctaatttcaacac

SEQ ID NO: 41057 - DNA, 20 bp, Artificial Sequence
  Synthetic oligonucleotide; AAG chr11 5290559 5290578 5290562 -
agttctaatttcaacactag

SEQ ID NO: 41058 - DNA, 20 bp, Artificial Sequence
  Synthetic oligonucleotide; AGG chr11 5290558 5290577 5290561 -
gttctaatttcaacactaga

SEQ ID NO: 41059 - DNA, 20 bp, Artificial Sequence
  Synthetic oligonucleotide; CAG chr11 5290555 5290574 5290558 -
ctaatttcaacactagaagg

SEQ ID NO: 41060 - DNA, 20 bp, Artificial Sequence
  Synthetic oligonucleotide; AGG chr11 5290554 5290573 5290557 -
taatttcaacactagaaggc

SEQ ID NO: 41061 - DNA, 20 bp, Artificial Sequence
  Synthetic oligonucleotide; TGG chr11 5290532 5290551 5290535 -
gtattatctaaatttcatac

SEQ ID NO: 41062 - DNA, 20 bp, Artificial Sequence
  Synthetic oligonucleotide; AAG chr11 5290512 5290531 5290515 -
tggatacctccaaactcata

SEQ ID NO: 41063 - DNA, 20 bp, Artificial Sequence
  Synthetic oligonucleotide; AAG chr11 5290474 5290493 5290477 -
tttgtcatatatttattcaa

SEQ ID NO: 41064 - DNA, 20 bp, Artificial Sequence
  Synthetic oligonucleotide; AGG chr11 5290473 5290492 5290476 -
ttgtcatatatttattcaaa

SEQ ID NO: 41065 - DNA, 20 bp, Artificial Sequence
  Synthetic oligonucleotide; GGG chr11 5290472 5290491 5290475 -
tgtcatatatttattcaaaa

SEQ ID NO: 41066 - DNA, 20 bp, Artificial Sequence
  Synthetic oligonucleotide; TGG chr11 5290456 5290475 5290459 -
aaaagggtaaactcaaacta

SEQ ID NO: 41067 - DNA, 20 bp, Artificial Sequence
  Synthetic oligonucleotide; AAG chr11 5290386 5290405 5290389 -
tattttataaaattattctc

SEQ ID NO: 41068 - DNA, 20 bp, Artificial Sequence
  Synthetic oligonucleotide; GAG chr11 5290376 5290395 5290379 -
aattattctcaagttattat

SEQ ID NO: 41069 - DNA, 20 bp, Artificial Sequence
  Synthetic oligonucleotide; AGG chr11 5290375 5290394 5290378 -
attattctcaagttattatg

SEQ ID NO: 41070 - DNA, 20 bp, Artificial Sequence
  Synthetic oligonucleotide; AAG chr11 5290365 5290384 5290368 -
agttattatgaggatgttga

SEQ ID NO: 41071 - DNA, 20 bp, Artificial Sequence
  Synthetic oligonucleotide; CAG chr11 5290361 5290380 5290364 -
attatgaggatgttgaaaga

SEQ ID NO: 41072 - DNA, 20 bp, Artificial Sequence
  Synthetic oligonucleotide; GAG chr11 5290359 5290378 5290362 -
tatgaggatgttgaaagaca

SEQ ID NO: 41073 - DNA, 20 bp, Artificial Sequence
  Synthetic oligonucleotide; GAG chr11 5290357 5290376 5290360 -
tgaggatgttgaaagacaga

SEQ ID NO: 41074 - DNA, 20 bp, Artificial Sequence
  Synthetic oligonucleotide; AGG chr11 5290356 5290375 5290359 -
gaggatgttgaaagacagag

SEQ ID NO: 41075 - DNA, 20 bp, Artificial Sequence
  Synthetic oligonucleotide; TGG chr11 5290352 5290371 5290355 -
atgttgaaagacagagagga

SEQ ID NO: 41076 - DNA, 20 bp, Artificial Sequence
  Synthetic oligonucleotide; GGG chr11 5290351 5290370 5290354 -
tgttgaaagacagagaggat

SEQ ID NO: 41077 - DNA, 20 bp, Artificial Sequence
  Synthetic oligonucleotide; GGG chr11 5290350 5290369 5290353 -
gttgaaagacagagaggatg

SEQ ID NO: 41078 - DNA, 20 bp, Artificial Sequence
  Synthetic oligonucleotide; CAG chr11 5290332 5290351 5290335 -
tggggtgctatgccccaaat

SEQ ID NO: 41079 - DNA, 20 bp, Artificial Sequence
  Synthetic oligonucleotide; AAG chr11 5290319 5290338 5290322 -
cccaaatcagcctcacaatt

SEQ ID NO: 41080 - DNA, 20 bp, Artificial Sequence
  Synthetic oligonucleotide; AAG chr11 5290314 5290333 5290317 -
atcagcctcacaattaagct

SEQ ID NO: 41081 - DNA, 20 bp, Artificial Sequence
  Synthetic oligonucleotide; CAG chr11 5290311 5290330 5290314 -
agcctcacaattaagctaag

SEQ ID NO: 41082 - DNA, 20 bp, Artificial Sequence
  Synthetic oligonucleotide; AAG chr11 5290306 5290325 5290309 -
cacaattaagctaagcagct

SEQ ID NO: 41083 - DNA, 20 bp, Artificial Sequence
  Synthetic oligonucleotide; GAG chr11 5290304 5290323 5290307 -
caattaagctaagcagctaa

SEQ ID NO: 41084 - DNA, 20 bp, Artificial Sequence
  Synthetic oligonucleotide; CAG chr11 5290296 5290315 5290299 -
ctaagcagctaagagtcttg

SEQ ID NO: 41085 - DNA, 20 bp, Artificial Sequence
  Synthetic oligonucleotide; AGG chr11 5290295 5290314 5290298 -
taagcagctaagagtcttgc

SEQ ID NO: 41086 - DNA, 20 bp, Artificial Sequence
  Synthetic oligonucleotide; GGG chr11 5290294 5290313 5290297 -
aagcagctaagagtcttgca

SEQ ID NO: 41087 - DNA, 20 bp, Artificial Sequence
  Synthetic oligonucleotide; TAG chr11 5290291 5290310 5290294 -
cagctaagagtcttgcaggg

SEQ ID NO: 41088 - DNA, 20 bp, Artificial Sequence
  Synthetic oligonucleotide; TAG chr11 5290286 5290305 5290289 -
aagagtcttgcagggtagtg

SEQ ID NO: 41089 - DNA, 20 bp, Artificial Sequence
  Synthetic oligonucleotide; AGG chr11 5290285 5290304 5290288 -
agagtcttgcagggtagtgt

SEQ ID NO: 41090 - DNA, 20 bp, Artificial Sequence
  Synthetic oligonucleotide; GGG chr11 5290284 5290303 5290287 -
gagtcttgcagggtagtgta

SEQ ID NO: 41091 - DNA, 20 bp, Artificial Sequence
  Synthetic oligonucleotide; CAG chr11 5290277 5290296 5290280 -
gcagggtagtgtagggacca

SEQ ID NO: 41092 - DNA, 20 bp, Artificial Sequence
  Synthetic oligonucleotide; AGG chr11 5290276 5290295 5290279 -
cagggtagtgtagggaccac

SEQ ID NO: 41093 - DNA, 20 bp, Artificial Sequence
  Synthetic oligonucleotide; GGG chr11 5290275 5290294 5290278 -
agggtagtgtagggaccaca

SEQ ID NO: 41094 - DNA, 20 bp, Artificial Sequence
  Synthetic oligonucleotide; AAG chr11 5290270 5290289 5290273 -
agtgtagggaccacagggtt

SEQ ID NO: 41095 - DNA, 20 bp, Artificial Sequence
  Synthetic oligonucleotide; AGG chr11 5290269 5290288 5290272 -
gtgtagggaccacagggtta

SEQ ID NO: 41096 - DNA, 20 bp, Artificial Sequence
  Synthetic oligonucleotide; GGG chr11 5290268 5290287 5290271 -
tgtagggaccacagggttaa

SEQ ID NO: 41097 - DNA, 20 bp, Artificial Sequence
  Synthetic oligonucleotide; GGG chr11 5290267 5290286 5290270 -
gtagggaccacagggttaag

SEQ ID NO: 41098 - DNA, 20 bp, Artificial Sequence
  Synthetic oligonucleotide; GGG chr11 5290266 5290285 5290269 -
tagggaccacagggttaagg

SEQ ID NO: 41099 - DNA, 20 bp, Artificial Sequence
  Synthetic oligonucleotide; CAG chr11 5290263 5290282 5290266 -
ggaccacagggttaaggggg

SEQ ID NO: 41100 - DNA, 20 bp, Artificial Sequence
  Synthetic oligonucleotide; TAG chr11 5290260 5290279 5290263 -
ccacagggttaagggggcag

SEQ ID NO: 41101 - DNA, 20 bp, Artificial Sequence
  Synthetic oligonucleotide; TAG chr11 5290241 5290260 5290244 -
gtagaattatactcccactt

SEQ ID NO: 41102 - DNA, 20 bp, Artificial Sequence
  Synthetic oligonucleotide; CAG chr11 5290211 5290230 5290214 -
tcaaacaatccatacacaca

SEQ ID NO: 41103 - DNA, 20 bp, Artificial Sequence
  Synthetic oligonucleotide; GAG chr11 5290204 5290223 5290207 -
atccatacacacacagccct

SEQ ID NO: 41104 - DNA, 20 bp, Artificial Sequence
  Synthetic oligonucleotide; AAG chr11 5290152 5290171 5290155 -
ttttgtttaaatgtataaat

SEQ ID NO: 41105 - DNA, 20 bp, Artificial Sequence
  Synthetic oligonucleotide; TGG chr11 5290149 5290168 5290152 -
tgtttaaatgtataaataag

SEQ ID NO: 41106 - DNA, 20 bp, Artificial Sequence
  Synthetic oligonucleotide; AAG chr11 5290142 5290161 5290145 -
atgtataaataagtggatga

SEQ ID NO: 41107 - DNA, 20 bp, Artificial Sequence
  Synthetic oligonucleotide; TAG chr11 5290137 5290156 5290140 -
taaataagtggatgaaagaa

SEQ ID NO: 41108 - DNA, 20 bp, Artificial Sequence
  Synthetic oligonucleotide; TAG chr11 5290133 5290152 5290136 -
taagtggatgaaagaataga

SEQ ID NO: 41109 - DNA, 20 bp, Artificial Sequence
  Synthetic oligonucleotide; TAG chr11 5290129 5290148 5290132 -
tggatgaaagaatagataga

SEQ ID NO: 41110 - DNA, 20 bp, Artificial Sequence
  Synthetic oligonucleotide; TAG chr11 5290125 5290144 5290128 -
tgaaagaatagatagataga

SEQ ID NO: 41111 - DNA, 20 bp, Artificial Sequence
  Synthetic oligonucleotide; CAG chr11 5290121 5290140 5290124 -
agaatagatagatagataga

SEQ ID NO: 41112 - DNA, 20 bp, Artificial Sequence
  Synthetic oligonucleotide; TAG chr11 5290117 5290136 5290120 -
tagatagatagatagacaga

SEQ ID NO: 41113 - DNA, 20 bp, Artificial Sequence
  Synthetic oligonucleotide; TAG chr11 5290110 5290129 5290113 -
atagatagacagatagatga

SEQ ID NO: 41114 - DNA, 20 bp, Artificial Sequence
  Synthetic oligonucleotide; TAG chr11 5290106 5290125 5290109 -
atagacagatagatgataga

SEQ ID NO: 41115 - DNA, 20 bp, Artificial Sequence
  Synthetic oligonucleotide; TAG chr11 5290085 5290104 5290088 -
agaataaatgcttgccttca

SEQ ID NO: 41116 - DNA, 20 bp, Artificial Sequence
  Synthetic oligonucleotide; CAG chr11 5290049 5290068 5290052 -
ttgttcaaaatgttcctgtc

SEQ ID NO: 41117 - DNA, 20 bp, Artificial Sequence
  Synthetic oligonucleotide; AAG chr11 5290042 5290061 5290045 -
aaatgttcctgtccagacca

SEQ ID NO: 41118 - DNA, 20 bp, Artificial Sequence
  Synthetic oligonucleotide; AAG chr11 5290023 5290042 5290026 -
aaagtaccttgccttcactt

SEQ ID NO: 41119 - DNA, 20 bp, Artificial Sequence
  Synthetic oligonucleotide; TAG chr11 5290009 5290028 5290012 -
tcacttaagtaatcaattcc

SEQ ID NO: 41120 - DNA, 20 bp, Artificial Sequence
  Synthetic oligonucleotide; AGG chr11 5290008 5290027 5290011 -
cacttaagtaatcaattcct

SEQ ID NO: 41121 - DNA, 20 bp, Artificial Sequence
  Synthetic oligonucleotide; AAG chr11 5289989 5290008 5289992 -
taggttatattctgatgtca

SEQ ID NO: 41122 - DNA, 20 bp, Artificial Sequence
  Synthetic oligonucleotide; AGG chr11 5289988 5290007 5289991 -
aggttatattctgatgtcaa

SEQ ID NO: 41123 - DNA, 20 bp, Artificial Sequence
  Synthetic oligonucleotide; AAG chr11 5289985 5290004 5289988 -
ttatattctgatgtcaaagg

SEQ ID NO: 41124 - DNA, 20 bp, Artificial Sequence
  Synthetic oligonucleotide; AAG chr11 5289978 5289997 5289981 -
ctgatgtcaaaggaagtcaa

SEQ ID NO: 41125 - DNA, 20 bp, Artificial Sequence
  Synthetic oligonucleotide; TAG chr11 5289937 5289956 5289940 -
gacccacaactcatgctttg

SEQ ID NO: 41126 - DNA, 20 bp, Artificial Sequence
  Synthetic oligonucleotide; TAG chr11 5289929 5289948 5289932 -
actcatgctttgtagatgac

SEQ ID NO: 41127 - DNA, 20 bp, Artificial Sequence
  Synthetic oligonucleotide; CAG chr11 5289914 5289933 5289917 -
atgactagatcaaaaaattt

SEQ ID NO: 41128 - DNA, 20 bp, Artificial Sequence
  Synthetic oligonucleotide; CAG chr11 5289900 5289919 5289903 -
aaatttcagccatatcttaa

SEQ ID NO: 41129 - DNA, 20 bp, Artificial Sequence
  Synthetic oligonucleotide; GAG chr11 5289896 5289915 5289899 -
ttcagccatatcttaacagt

SEQ ID NO: 41130 - DNA, 20 bp, Artificial Sequence
  Synthetic oligonucleotide; CAG chr11 5289889 5289908 5289892 -
atatcttaacagtgagtgaa

SEQ ID NO: 41131 - DNA, 20 bp, Artificial Sequence
  Synthetic oligonucleotide; AGG chr11 5289888 5289907 5289891 -
tatcttaacagtgagtgaac

SEQ ID NO: 41132 - DNA, 20 bp, Artificial Sequence
  Synthetic oligonucleotide; GAG chr11 5289861 5289880 5289864 -
ctcctcttttccctacatct

SEQ ID NO: 41133 - DNA, 20 bp, Artificial Sequence
  Synthetic oligonucleotide; CAG chr11 5289854 5289873 5289857 -
tttccctacatctgagatcc

SEQ ID NO: 41134 - DNA, 20 bp, Artificial Sequence
  Synthetic oligonucleotide; AAG chr11 5289846 5289865 5289849 -
catctgagatcccagcttct

SEQ ID NO: 41135 - DNA, 20 bp, Artificial Sequence
  Synthetic oligonucleotide; CAG chr11 5289817 5289836 5289820 -
aattctcactcttgatgcaa

SEQ ID NO: 41136 - DNA, 20 bp, Artificial Sequence
  Synthetic oligonucleotide; TGG chr11 5289810 5289829 5289813 -
actcttgatgcaacagacct

SEQ ID NO: 41137 - DNA, 20 bp, Artificial Sequence
  Synthetic oligonucleotide; AAG chr11 5289807 5289826 5289810 -
cttgatgcaacagaccttgg

SEQ ID NO: 41138 - DNA, 20 bp, Artificial Sequence
  Synthetic oligonucleotide; CAG chr11 5289800 5289819 5289803 -
caacagaccttggaagcata

SEQ ID NO: 41139 - DNA, 20 bp, Artificial Sequence
  Synthetic oligonucleotide; AGG chr11 5289799 5289818 5289802 -
aacagaccttggaagcatac

SEQ ID NO: 41140 - DNA, 20 bp, Artificial Sequence
  Synthetic oligonucleotide; GAG chr11 5289797 5289816 5289800 -
cagaccttggaagcatacag

SEQ ID NO: 41141 - DNA, 20 bp, Artificial Sequence
  Synthetic oligonucleotide; GAG chr11 5289795 5289814 5289798 -
gaccttggaagcatacagga

SEQ ID NO: 41142 - DNA, 20 bp, Artificial Sequence
  Synthetic oligonucleotide; TGG chr11 5289785 5289804 5289788 -
gcatacaggagagctgaact

SEQ ID NO: 41143 - DNA, 20 bp, Artificial Sequence
  Synthetic oligonucleotide; AAG chr11 5289776 5289795 5289779 -
agagctgaacttggtcaaca

SEQ ID NO: 41144 - DNA, 20 bp, Artificial Sequence
  Synthetic oligonucleotide; AGG chr11 5289775 5289794 5289778 -
gagctgaacttggtcaacaa

SEQ ID NO: 41145 - DNA, 20 bp, Artificial Sequence
  Synthetic oligonucleotide; GAG chr11 5289773 5289792 5289776 -
gctgaacttggtcaacaaag

SEQ ID NO: 41146 - DNA, 20 bp, Artificial Sequence
  Synthetic oligonucleotide; AAG chr11 5289768 5289787 5289771 -
acttggtcaacaaaggagaa

SEQ ID NO: 41147 - DNA, 20 bp, Artificial Sequence
  Synthetic oligonucleotide; TGG chr11 5289760 5289779 5289763 -
aacaaaggagaaaagtttgt

SEQ ID NO: 41148 - DNA, 20 bp, Artificial Sequence
  Synthetic oligonucleotide; AAG chr11 5289751 5289770 5289754 -
gaaaagtttgttggcctcca

SEQ ID NO: 41149 - DNA, 20 bp, Artificial Sequence
  Synthetic oligonucleotide; AGG chr11 5289750 5289769 5289753 -
aaaagtttgttggcctccaa

SEQ ID NO: 41150 - DNA, 20 bp, Artificial Sequence
  Synthetic oligonucleotide; CAG chr11 5289745 5289764 5289748 -
tttgttggcctccaaaggca

SEQ ID NO: 41151 - DNA, 20 bp, Artificial Sequence
  Synthetic oligonucleotide; AAG chr11 5289730 5289749 5289733 -
aggcacagctcaaacttttc

SEQ ID NO: 41152 - DNA, 20 bp, Artificial Sequence
  Synthetic oligonucleotide; AAG chr11 5289712 5289731 5289715 -
tcaagccttctctaatctta

SEQ ID NO: 41153 - DNA, 20 bp, Artificial Sequence
  Synthetic oligonucleotide; AGG chr11 5289711 5289730 5289714 -
caagccttctctaatcttaa

SEQ ID NO: 41154 - DNA, 20 bp, Artificial Sequence
  Synthetic oligonucleotide; AAG chr11 5289703 5289722 5289706 -
ctctaatcttaaaggtaaac

SEQ ID NO: 41155 - DNA, 20 bp, Artificial Sequence
  Synthetic oligonucleotide; AGG chr11 5289702 5289721 5289705 -
tctaatcttaaaggtaaaca

SEQ ID NO: 41156 - DNA, 20 bp, Artificial Sequence
  Synthetic oligonucleotide; GGG chr11 5289701 5289720 5289704 -
ctaatcttaaaggtaaacaa

SEQ ID NO: 41157 - DNA, 20 bp, Artificial Sequence
  Synthetic oligonucleotide; GAG chr11 5289686 5289705 5289689 -
aacaagggtctcatttcttt

SEQ ID NO: 41158 - DNA, 20 bp, Artificial Sequence
  Synthetic oligonucleotide; CAG chr11 5289678 5289697 5289681 -
tctcatttctttgagaactt

SEQ ID NO: 41159 - DNA, 20 bp, Artificial Sequence
  Synthetic oligonucleotide; AGG chr11 5289677 5289696 5289680 -
ctcatttctttgagaacttc

SEQ ID NO: 41160 - DNA, 20 bp, Artificial Sequence
  Synthetic oligonucleotide; GGG chr11 5289676 5289695 5289679 -
tcatttctttgagaacttca

SEQ ID NO: 41161 - DNA, 20 bp, Artificial Sequence
  Synthetic oligonucleotide; TAG chr11 5289669 5289688 5289672 -
tttgagaacttcagggaaaa

SEQ ID NO: 41162 - DNA, 20 bp, Artificial Sequence
  Synthetic oligonucleotide; AAG chr11 5289664 5289683 5289667 -
gaacttcagggaaaatagac

SEQ ID NO: 41163 - DNA, 20 bp, Artificial Sequence
  Synthetic oligonucleotide; AGG chr11 5289663 5289682 5289666 -
aacttcagggaaaatagaca

SEQ ID NO: 41164 - DNA, 20 bp, Artificial Sequence
  Synthetic oligonucleotide; TGG chr11 5289653 5289672 5289656 -
aaaatagacaaggacttgcc

SEQ ID NO: 41165 - DNA, 20 bp, Artificial Sequence
  Synthetic oligonucleotide; TGG chr11 5289644 5289663 5289647 -
aaggacttgcctggtgcttt

SEQ ID NO: 41166 - DNA, 20 bp, Artificial Sequence
  Synthetic oligonucleotide; TAG chr11 5289641 5289660 5289644 -
gacttgcctggtgcttttgg

SEQ ID NO: 41167 - DNA, 20 bp, Artificial Sequence
  Synthetic oligonucleotide; AGG chr11 5289640 5289659 5289643 -
acttgcctggtgcttttggt

SEQ ID NO: 41168 - DNA, 20 bp, Artificial Sequence
  Synthetic oligonucleotide; GGG chr11 5289639 5289658 5289642 -
cttgcctggtgcttttggta

SEQ ID NO: 41169 - DNA, 20 bp, Artificial Sequence
  Synthetic oligonucleotide; GGG chr11 5289638 5289657 5289641 -
ttgcctggtgcttttggtag

SEQ ID NO: 41170 - DNA, 20 bp, Artificial Sequence
  Synthetic oligonucleotide; GAG chr11 5289636 5289655 5289639 -
gcctggtgcttttggtaggg

SEQ ID NO: 41171 - DNA, 20 bp, Artificial Sequence
  Synthetic oligonucleotide; TGG chr11 5289614 5289633 5289617 -
gcttgcactttccccctttc

SEQ ID NO: 41172 - DNA, 20 bp, Artificial Sequence
  Synthetic oligonucleotide; GAG chr11 5289612 5289631 5289615 -
ttgcactttccccctttctg

SEQ ID NO: 41173 - DNA, 20 bp, Artificial Sequence
  Synthetic oligonucleotide; AGG chr11 5289611 5289630 5289614 -
tgcactttccccctttctgg

SEQ ID NO: 41174 - DNA, 20 bp, Artificial Sequence
  Synthetic oligonucleotide; CAG chr11 5289595 5289614 5289598 -
ctggaggaaatatttatccc

SEQ ID NO: 41175 - DNA, 20 bp, Artificial Sequence
  Synthetic oligonucleotide; AGG chr11 5289594 5289613 5289597 -
tggaggaaatatttatcccc

SEQ ID NO: 41176 - DNA, 20 bp, Artificial Sequence
  Synthetic oligonucleotide; TAG chr11 5289591 5289610 5289594 -
aggaaatatttatccccagg

SEQ ID NO: 41177 - DNA, 20 bp, Artificial Sequence
  Synthetic oligonucleotide; CAG chr11 5289574 5289593 5289577 -
aggtagttccctttttgcac

SEQ ID NO: 41178 - DNA, 20 bp, Artificial Sequence
  Synthetic oligonucleotide; TGG chr11 5289571 5289590 5289574 -
tagttccctttttgcaccag

SEQ ID NO: 41179 - DNA, 20 bp, Artificial Sequence
  Synthetic oligonucleotide; AAG chr11 5289561 5289580 5289564 -
tttgcaccagtggttctttg

SEQ ID NO: 41180 - DNA, 20 bp, Artificial Sequence
  Synthetic oligonucleotide; GAG chr11 5289559 5289578 5289562 -
tgcaccagtggttctttgaa

SEQ ID NO: 41181 - DNA, 20 bp, Artificial Sequence
  Synthetic oligonucleotide; TGG chr11 5289547 5289566 5289550 -
tctttgaagagacttccacc

SEQ ID NO: 41182 - DNA, 20 bp, Artificial Sequence
  Synthetic oligonucleotide; GGG chr11 5289546 5289565 5289549 -
ctttgaagagacttccacct

SEQ ID NO: 41183 - DNA, 20 bp, Artificial Sequence
  Synthetic oligonucleotide; CAG chr11 5289541 5289560 5289544 -
aagagacttccacctgggaa

SEQ ID NO: 41184 - DNA, 20 bp, Artificial Sequence
  Synthetic oligonucleotide; CAG chr11 5289533 5289552 5289536 -
tccacctgggaacagttaaa

SEQ ID NO: 41185 - DNA, 20 bp, Artificial Sequence
  Synthetic oligonucleotide; CAG chr11 5289524 5289543 5289527 -
gaacagttaaacagcaacta

SEQ ID NO: 41186 - DNA, 20 bp, Artificial Sequence
  Synthetic oligonucleotide; AGG chr11 5289523 5289542 5289526 -
aacagttaaacagcaactac

SEQ ID NO: 41187 - DNA, 20 bp, Artificial Sequence
  Synthetic oligonucleotide; GGG chr11 5289522 5289541 5289525 -
acagttaaacagcaactaca

SEQ ID NO: 41188 - DNA, 20 bp, Artificial Sequence
  Synthetic oligonucleotide; CAG chr11 5289501 5289520 5289504 -
ggccttgaactgcacacttt

SEQ ID NO: 41189 - DNA, 20 bp, Artificial Sequence
  Synthetic oligonucleotide; CGG chr11 5289496 5289515 5289499 -
tgaactgcacactttcagtc

SEQ ID NO: 41190 - DNA, 20 bp, Artificial Sequence
  Synthetic oligonucleotide; CAG chr11 5289487 5289506 5289490 -
cactttcagtccggtcctca

SEQ ID NO: 41191 - DNA, 20 bp, Artificial Sequence
  Synthetic oligonucleotide; AAG chr11 5289479 5289498 5289482 -
gtccggtcctcacagttgaa

SEQ ID NO: 41192 - DNA, 20 bp, Artificial Sequence
  Synthetic oligonucleotide; AAG chr11 5289472 5289491 5289475 -
cctcacagttgaaaagacct

SEQ ID NO: 41193 - DNA, 20 bp, Artificial Sequence
  Synthetic oligonucleotide; AAG chr11 5289455 5289474 5289458 -
cctaagcttgtgcctgattt

SEQ ID NO: 41194 - DNA, 20 bp, Artificial Sequence
  Synthetic oligonucleotide; TGG chr11 5289446 5289465 5289449 -
gtgcctgatttaagcctttt

SEQ ID NO: 41195 - DNA, 20 bp, Artificial Sequence
  Synthetic oligonucleotide; CAG chr11 5289405 5289424 5289408 -
taatctccctctcaacccta

SEQ ID NO: 41196 - DNA, 20 bp, Artificial Sequence
  Synthetic oligonucleotide; TGG chr11 5289393 5289412 5289396 -
caaccctacagtcacccatt

SEQ ID NO: 41197 - DNA, 20 bp, Artificial Sequence
  Synthetic oligonucleotide; AAG chr11 5289383 5289402 5289386 -
gtcacccatttggtatatta

SEQ ID NO: 41198 - DNA, 20 bp, Artificial Sequence
  Synthetic oligonucleotide; TAG chr11 5289363 5289382 5289366 -
aagatgtgttgtctactgtc

SEQ ID NO: 41199 - DNA, 20 bp, Artificial Sequence
  Synthetic oligonucleotide; AAG chr11 5289352 5289371 5289355 -
tctactgtctagtatccctc

SEQ ID NO: 41200 - DNA, 20 bp, Artificial Sequence
  Synthetic oligonucleotide; TAG chr11 5289349 5289368 5289352 -
actgtctagtatccctcaag

SEQ ID NO: 41201 - DNA, 20 bp, Artificial Sequence
  Synthetic oligonucleotide; CAG chr11 5289343 5289362 5289346 -
tagtatccctcaagtagtgt

SEQ ID NO: 41202 - DNA, 20 bp, Artificial Sequence
  Synthetic oligonucleotide; AGG chr11 5289342 5289361 5289345 -
agtatccctcaagtagtgtc

SEQ ID NO: 41203 - DNA, 20 bp, Artificial Sequence
  Synthetic oligonucleotide; TAG chr11 5289336 5289355 5289339 -
cctcaagtagtgtcaggaat

SEQ ID NO: 41204 - DNA, 20 bp, Artificial Sequence
  Synthetic oligonucleotide; TAG chr11 5289324 5289343 5289327 -
tcaggaattagtcatttaaa

SEQ ID NO: 41205 - DNA, 20 bp, Artificial Sequence
  Synthetic oligonucleotide; AAG chr11 5289316 5289335 5289319 -
tagtcatttaaatagtctgc

SEQ ID NO: 41206 - DNA, 20 bp, Artificial Sequence
  Synthetic oligonucleotide; CAG chr11 5289312 5289331 5289315 -
catttaaatagtctgcaagc

SEQ ID NO: 41207 - DNA, 20 bp, Artificial Sequence
  Synthetic oligonucleotide; AGG chr11 5289311 5289330 5289314 -
atttaaatagtctgcaagcc

SEQ ID NO: 41208 - DNA, 20 bp, Artificial Sequence
  Synthetic oligonucleotide; GAG chr11 5289309 5289328 5289312 -
ttaaatagtctgcaagccag

SEQ ID NO: 41209 - DNA, 20 bp, Artificial Sequence
  Synthetic oligonucleotide; TGG chr11 5289306 5289325 5289309 -
aatagtctgcaagccaggag

SEQ ID NO: 41210 - DNA, 20 bp, Artificial Sequence
  Synthetic oligonucleotide; TGG chr11 5289303 5289322 5289306 -
agtctgcaagccaggagtgg

SEQ ID NO: 41211 - DNA, 20 bp, Artificial Sequence
  Synthetic oligonucleotide; CAG chr11 5289284 5289303 5289287 -
gtggctcatgtctgtaattc

SEQ ID NO: 41212 - DNA, 20 bp, Artificial Sequence
  Synthetic oligonucleotide; GAG chr11 5289276 5289295 5289279 -
tgtctgtaattccagcactt

SEQ ID NO: 41213 - DNA, 20 bp, Artificial Sequence
  Synthetic oligonucleotide; GAG chr11 5289274 5289293 5289277 -
tctgtaattccagcacttga

SEQ ID NO: 41214 - DNA, 20 bp, Artificial Sequence
  Synthetic oligonucleotide; AGG chr11 5289273 5289292 5289276 -
ctgtaattccagcacttgag

SEQ ID NO: 41215 - DNA, 20 bp, Artificial Sequence
  Synthetic oligonucleotide; TAG chr11 5289270 5289289 5289273 -
taattccagcacttgagagg

SEQ ID NO: 41216 - DNA, 20 bp, Artificial Sequence
  Synthetic oligonucleotide; AAG chr11 5289267 5289286 5289270 -
ttccagcacttgagaggtag

SEQ ID NO: 41217 - DNA, 20 bp, Artificial Sequence
  Synthetic oligonucleotide; TGG chr11 5289264 5289283 5289267 -
cagcacttgagaggtagaag

SEQ ID NO: 41218 - DNA, 20 bp, Artificial Sequence
  Synthetic oligonucleotide; GGG chr11 5289263 5289282 5289266 -
agcacttgagaggtagaagt

SEQ ID NO: 41219 - DNA, 20 bp, Artificial Sequence
  Synthetic oligonucleotide; GAG chr11 5289261 5289280 5289264 -
cacttgagaggtagaagtgg

SEQ ID NO: 41220 - DNA, 20 bp, Artificial Sequence
  Synthetic oligonucleotide; AGG chr11 5289260 5289279 5289263 -
acttgagaggtagaagtggg

SEQ ID NO: 41221 - DNA, 20 bp, Artificial Sequence
  Synthetic oligonucleotide; GAG chr11 5289250 5289269 5289253 -
tagaagtgggaggactgctt

SEQ ID NO: 41222 - DNA, 20 bp, Artificial Sequence
  Synthetic oligonucleotide; AAG chr11 5289244 5289263 5289247 -
tgggaggactgcttgagctc

SEQ ID NO: 41223 - DNA, 20 bp, Artificial Sequence
  Synthetic oligonucleotide; GAG chr11 5289242 5289261 5289245 -
ggaggactgcttgagctcaa

SEQ ID NO: 41224 - DNA, 20 bp, Artificial Sequence
  Synthetic oligonucleotide; TGG chr11 5289226 5289245 5289229 -
tcaagagtttgatattatcc

SEQ ID NO: 41225 - DNA, 20 bp, Artificial Sequence
  Synthetic oligonucleotide; TAG chr11 5289217 5289236 5289220 -
tgatattatcctggacaaca

SEQ ID NO: 41226 - DNA, 20 bp, Artificial Sequence
  Synthetic oligonucleotide; AAG chr11 5289213 5289232 5289216 -
attatcctggacaacatagc

SEQ ID NO: 41227 - DNA, 20 bp, Artificial Sequence
  Synthetic oligonucleotide; TAG chr11 5289178 5289197 5289181 -
cttaaaaaaaaaaaaaaaat

SEQ ID NO: 41228 - DNA, 20 bp, Artificial Sequence
  Synthetic oligonucleotide; CAG chr11 5289174 5289193 5289177 -
aaaaaaaaaaaaaaattagc

SEQ ID NO: 41229 - DNA, 20 bp, Artificial Sequence
  Synthetic oligonucleotide; AGG chr11 5289173 5289192 5289176 -
aaaaaaaaaaaaaattagcc

SEQ ID NO: 41230 - DNA, 20 bp, Artificial Sequence
  Synthetic oligonucleotide; TAG chr11 5289153 5289172 5289156 -
aggcatgtgatgtacacctg

SEQ ID NO: 41231 - DNA, 20 bp, Artificial Sequence
  Synthetic oligonucleotide; CAG chr11 5289147 5289166 5289150 -
gtgatgtacacctgtagtcc

SEQ ID NO: 41232 - DNA, 20 bp, Artificial Sequence
  Synthetic oligonucleotide; CAG chr11 5289139 5289158 5289142 -
cacctgtagtcccagctact

SEQ ID NO: 41233 - DNA, 20 bp, Artificial Sequence
  Synthetic oligonucleotide; AGG chr11 5289138 5289157 5289141 -
acctgtagtcccagctactc

SEQ ID NO: 41234 - DNA, 20 bp, Artificial Sequence
  Synthetic oligonucleotide; GAG chr11 5289136 5289155 5289139 -
ctgtagtcccagctactcag

SEQ ID NO: 41235 - DNA, 20 bp, Artificial Sequence
  Synthetic oligonucleotide; AGG chr11 5289135 5289154 5289138 -
tgtagtcccagctactcagg

SEQ ID NO: 41236 - DNA, 20 bp, Artificial Sequence
  Synthetic oligonucleotide; TGG chr11 5289126 5289145 5289129 -
agctactcaggaggccgaaa

SEQ ID NO: 41237 - DNA, 20 bp, Artificial Sequence
  Synthetic oligonucleotide; GGG chr11 5289125 5289144 5289128 -
gctactcaggaggccgaaat

SEQ ID NO: 41238 - DNA, 20 bp, Artificial Sequence
  Synthetic oligonucleotide; GAG chr11 5289123 5289142 5289126 -
tactcaggaggccgaaatgg

SEQ ID NO: 41239 - DNA, 20 bp, Artificial Sequence
  Synthetic oligonucleotide; AGG chr11 5289122 5289141 5289125 -
actcaggaggccgaaatggg

SEQ ID NO: 41240 - DNA, 20 bp, Artificial Sequence
  Synthetic oligonucleotide; GAG chr11 5289112 5289131 5289115 -
ccgaaatgggaggatccctt

SEQ ID NO: 41241 - DNA, 20 bp, Artificial Sequence
  Synthetic oligonucleotide; CAG chr11 5289107 5289126 5289110 -
atgggaggatcccttgagct

SEQ ID NO: 41242 - DNA, 20 bp, Artificial Sequence
  Synthetic oligonucleotide; AGG chr11 5289106 5289125 5289109 -
tgggaggatcccttgagctc

SEQ ID NO: 41243 - DNA, 20 bp, Artificial Sequence
  Synthetic oligonucleotide; GAG chr11 5289104 5289123 5289107 -
ggaggatcccttgagctcag

SEQ ID NO: 41244 - DNA, 20 bp, Artificial Sequence
  Synthetic oligonucleotide; AGG chr11 5289103 5289122 5289106 -
gaggatcccttgagctcagg

SEQ ID NO: 41245 - DNA, 20 bp, Artificial Sequence
  Synthetic oligonucleotide; AAG chr11 5289098 5289117 5289101 -
tcccttgagctcaggaggtc

SEQ ID NO: 41246 - DNA, 20 bp, Artificial Sequence
  Synthetic oligonucleotide; AGG chr11 5289097 5289116 5289100 -
cccttgagctcaggaggtca

SEQ ID NO: 41247 - DNA, 20 bp, Artificial Sequence
  Synthetic oligonucleotide; CAG chr11 5289091 5289110 5289094 -
agctcaggaggtcaaggctg

SEQ ID NO: 41248 - DNA, 20 bp, Artificial Sequence
  Synthetic oligonucleotide; GAG chr11 5289087 5289106 5289090 -
caggaggtcaaggctgcagt

SEQ ID NO: 41249 - DNA, 20 bp, Artificial Sequence
  Synthetic oligonucleotide; CAG chr11 5289062 5289081 5289065 -
atgatcttgccactgcactc

SEQ ID NO: 41250 - DNA, 20 bp, Artificial Sequence
  Synthetic oligonucleotide; TGG chr11 5289057 5289076 5289060 -
cttgccactgcactccagcc

SEQ ID NO: 41251 - DNA, 20 bp, Artificial Sequence
  Synthetic oligonucleotide; CAG chr11 5289053 5289072 5289056 -
ccactgcactccagcctgga

SEQ ID NO: 41252 - DNA, 20 bp, Artificial Sequence
  Synthetic oligonucleotide; CAG chr11 5289050 5289069 5289053 -
ctgcactccagcctggacag

SEQ ID NO: 41253 - DNA, 20 bp, Artificial Sequence
  Synthetic oligonucleotide; GAG chr11 5289048 5289067 5289051 -
gcactccagcctggacagca

SEQ ID NO: 41254 - DNA, 20 bp, Artificial Sequence
  Synthetic oligonucleotide; CAG chr11 5289025 5289044 5289028 -
tgaaaccttgcctcacgaaa

SEQ ID NO: 41255 - DNA, 20 bp, Artificial Sequence
  Synthetic oligonucleotide; TAG chr11 5288961 5288980 5288964 -
ttccttgatgctctaccaca

SEQ ID NO: 41256 - DNA, 20 bp, Artificial Sequence
  Synthetic oligonucleotide; AGG chr11 5288960 5288979 5288963 -
tccttgatgctctaccacat

SEQ ID NO: 41257 - DNA, 20 bp, Artificial Sequence
  Synthetic oligonucleotide; TGG chr11 5288955 5288974 5288958 -
gatgctctaccacataggtc

SEQ ID NO: 41258 - DNA, 20 bp, Artificial Sequence
  Synthetic oligonucleotide; GGG chr11 5288954 5288973 5288957 -
atgctctaccacataggtct

SEQ ID NO: 41259 - DNA, 20 bp, Artificial Sequence
  Synthetic oligonucleotide; TAG chr11 5288913 5288932 5288916 -
tcattgctgttcataattgt

SEQ ID NO: 41260 - DNA, 20 bp, Artificial Sequence
  Synthetic oligonucleotide; TAG chr11 5288882 5288901 5288885 -
tgtaatattgatattattcc

SEQ ID NO: 41261 - DNA, 20 bp, Artificial Sequence
  Synthetic oligonucleotide; AAG chr11 5288878 5288897 5288881 -
atattgatattattcctaga

SEQ ID NO: 41262 - DNA, 20 bp, Artificial Sequence
  Synthetic oligonucleotide; GAG chr11 5288873 5288892 5288876 -
gatattattcctagaaagct

SEQ ID NO: 41263 - DNA, 20 bp, Artificial Sequence
  Synthetic oligonucleotide; AGG chr11 5288872 5288891 5288875 -
atattattcctagaaagctg

SEQ ID NO: 41264 - DNA, 20 bp, Artificial Sequence
  Synthetic oligonucleotide; AAG chr11 5288865 5288884 5288868 -
tcctagaaagctgaggcctc

SEQ ID NO: 41265 - DNA, 20 bp, Artificial Sequence
  Synthetic oligonucleotide; TGG chr11 5288844 5288863 5288847 -
agatgataacttttattttc

SEQ ID NO: 41266 - DNA, 20 bp, Artificial Sequence
  Synthetic oligonucleotide; TAG chr11 5288833 5288852 5288836 -
tttattttctggacttgtaa

SEQ ID NO: 41267 - DNA, 20 bp, Artificial Sequence
  Synthetic oligonucleotide; TAG chr11 5288797 5288816 5288800 -
tcaccatgttgtaactttct

SEQ ID NO: 41268 - DNA, 20 bp, Artificial Sequence
  Synthetic oligonucleotide; GAG chr11 5288795 5288814 5288798 -
accatgttgtaactttctta

SEQ ID NO: 41269 - DNA, 20 bp, Artificial Sequence
  Synthetic oligonucleotide; TAG chr11 5288792 5288811 5288795 -
atgttgtaactttcttagag

SEQ ID NO: 41270 - DNA, 20 bp, Artificial Sequence
  Synthetic oligonucleotide; AAG chr11 5288779 5288798 5288782 -
cttagagtagtaacaatata

SEQ ID NO: 41271 - DNA, 20 bp, Artificial Sequence
  Synthetic oligonucleotide; GAG chr11 5288769 5288788 5288772 -
taacaatataaagttattgt

SEQ ID NO: 41272 - DNA, 20 bp, Artificial Sequence
  Synthetic oligonucleotide; CAG chr11 5288754 5288773 5288757 -
attgtgagtttttgcaaaca

SEQ ID NO: 41273 - DNA, 20 bp, Artificial Sequence
  Synthetic oligonucleotide; TAG chr11 5288733 5288752 5288736 -
agcaaacacaacgacccata

SEQ ID NO: 41274 - DNA, 20 bp, Artificial Sequence
  Synthetic oligonucleotide; TGG chr11 5288698 5288717 5288701 -
aattgtctattgtcaattta

SEQ ID NO: 41275 - DNA, 20 bp, Artificial Sequence
  Synthetic oligonucleotide; GGG chr11 5288697 5288716 5288700 -
attgtctattgtcaatttat

SEQ ID NO: 41276 - DNA, 20 bp, Artificial Sequence
  Synthetic oligonucleotide; AAG chr11 5288689 5288708 5288692 -
ttgtcaatttatgggaaaac

SEQ ID NO: 41277 - DNA, 20 bp, Artificial Sequence
  Synthetic oligonucleotide; AAG chr11 5288669 5288688 5288672 -
aagtatgtactttttctact

SEQ ID NO: 41278 - DNA, 20 bp, Artificial Sequence
  Synthetic oligonucleotide; CAG chr11 5288657 5288676 5288660 -
tttctactaagccattgaaa

SEQ ID NO: 41279 - DNA, 20 bp, Artificial Sequence
  Synthetic oligonucleotide; AGG chr11 5288656 5288675 5288659 -
ttctactaagccattgaaac

SEQ ID NO: 41280 - DNA, 20 bp, Artificial Sequence
  Synthetic oligonucleotide; CAG chr11 5288648 5288667 5288651 -
agccattgaaacaggaataa

SEQ ID NO: 41281 - DNA, 20 bp, Artificial Sequence
  Synthetic oligonucleotide; AAG chr11 5288642 5288661 5288645 -
tgaaacaggaataacagaac

SEQ ID NO: 41282 - DNA, 20 bp, Artificial Sequence
  Synthetic oligonucleotide; AAG chr11 5288634 5288653 5288637 -
gaataacagaacaagattga

SEQ ID NO: 41283 - DNA, 20 bp, Artificial Sequence
  Synthetic oligonucleotide; GAG chr11 5288609 5288628 5288612 -
tacattttccgaaattactt

SEQ ID NO: 41284 - DNA, 20 bp, Artificial Sequence
  Synthetic oligonucleotide; AAG chr11 5288597 5288616 5288600 -
aattacttgagtattataca

SEQ ID NO: 41285 - DNA, 20 bp, Artificial Sequence
  Synthetic oligonucleotide; AAG chr11 5288592 5288611 5288595 -
cttgagtattatacaaagac

SEQ ID NO: 41286 - DNA, 20 bp, Artificial Sequence
  Synthetic oligonucleotide; TGG chr11 5288585 5288604 5288588 -
attatacaaagacaagcacg

SEQ ID NO: 41287 - DNA, 20 bp, Artificial Sequence
  Synthetic oligonucleotide; TGG chr11 5288579 5288598 5288582 -
caaagacaagcacgtggacc

SEQ ID NO: 41288 - DNA, 20 bp, Artificial Sequence
  Synthetic oligonucleotide; GGG chr11 5288578 5288597 5288581 -
aaagacaagcacgtggacct

SEQ ID NO: 41289 - DNA, 20 bp, Artificial Sequence
  Synthetic oligonucleotide; GAG chr11 5288576 5288595 5288579 -
agacaagcacgtggacctgg

SEQ ID NO: 41290 - DNA, 20 bp, Artificial Sequence
  Synthetic oligonucleotide; AGG chr11 5288575 5288594 5288578 -
gacaagcacgtggacctggg

SEQ ID NO: 41291 - DNA, 20 bp, Artificial Sequence
  Synthetic oligonucleotide; GAG chr11 5288573 5288592 5288576 -
caagcacgtggacctgggag

SEQ ID NO: 41292 - DNA, 20 bp, Artificial Sequence
  Synthetic oligonucleotide; AGG chr11 5288572 5288591 5288575 -
aagcacgtggacctgggagg

SEQ ID NO: 41293 - DNA, 20 bp, Artificial Sequence
  Synthetic oligonucleotide; GGG chr11 5288571 5288590 5288574 -
agcacgtggacctgggagga

SEQ ID NO: 41294 - DNA, 20 bp, Artificial Sequence
  Synthetic oligonucleotide; TGG chr11 5288554 5288573 5288557 -
ggagggttattgtccatgac

SEQ ID NO: 41295 - DNA, 20 bp, Artificial Sequence
  Synthetic oligonucleotide; TGG chr11 5288547 5288566 5288550 -
tattgtccatgactggtgtg

SEQ ID NO: 41296 - DNA, 20 bp, Artificial Sequence
  Synthetic oligonucleotide; GAG chr11 5288545 5288564 5288548 -
ttgtccatgactggtgtgtg

SEQ ID NO: 41297 - DNA, 20 bp, Artificial Sequence
  Synthetic oligonucleotide; CAG chr11 5288535 5288554 5288538 -
ctggtgtgtggagacaaatg

SEQ ID NO: 41298 - DNA, 20 bp, Artificial Sequence
  Synthetic oligonucleotide; AGG chr11 5288534 5288553 5288537 -
tggtgtgtggagacaaatgc

SEQ ID NO: 41299 - DNA, 20 bp, Artificial Sequence
  Synthetic oligonucleotide; TAG chr11 5288524 5288543 5288527 -
agacaaatgcaggtttataa

SEQ ID NO: 41300 - DNA, 20 bp, Artificial Sequence
  Synthetic oligonucleotide; TGG chr11 5288520 5288539 5288523 -
aaatgcaggtttataataga

SEQ ID NO: 41301 - DNA, 20 bp, Artificial Sequence
  Synthetic oligonucleotide; GGG chr11 5288519 5288538 5288522 -
aatgcaggtttataatagat

SEQ ID NO: 41302 - DNA, 20 bp, Artificial Sequence
  Synthetic oligonucleotide; TGG chr11 5288515 5288534 5288518 -
caggtttataatagatggga

SEQ ID NO: 41303 - DNA, 20 bp, Artificial Sequence
  Synthetic oligonucleotide; TAG chr11 5288508 5288527 5288511 -
ataatagatgggatggcatc

SEQ ID NO: 41304 - DNA, 20 bp, Artificial Sequence
  Synthetic oligonucleotide; TAG chr11 5288482 5288501 5288485 -
aatgactttgccatcacttt

SEQ ID NO: 41305 - DNA, 20 bp, Artificial Sequence
  Synthetic oligonucleotide; GAG chr11 5288480 5288499 5288483 -
tgactttgccatcactttta

SEQ ID NO: 41306 - DNA, 20 bp, Artificial Sequence
  Synthetic oligonucleotide; GAG chr11 5288478 5288497 5288481 -
actttgccatcacttttaga

SEQ ID NO: 41307 - DNA, 20 bp, Artificial Sequence
  Synthetic oligonucleotide; TGG chr11 5288471 5288490 5288474 -
catcacttttagagagctct

SEQ ID NO: 41308 - DNA, 20 bp, Artificial Sequence
  Synthetic oligonucleotide; GGG chr11 5288470 5288489 5288473 -
atcacttttagagagctctt

SEQ ID NO: 41309 - DNA, 20 bp, Artificial Sequence
  Synthetic oligonucleotide; GGG chr11 5288469 5288488 5288472 -
tcacttttagagagctcttg

SEQ ID NO: 41310 - DNA, 20 bp, Artificial Sequence
  Synthetic oligonucleotide; CAG chr11 5288462 5288481 5288465 -
tagagagctcttggggaccc

SEQ ID NO: 41311 - DNA, 20 bp, Artificial Sequence
  Synthetic oligonucleotide; AAG chr11 5288454 5288473 5288457 -
tcttggggaccccagtacac

SEQ ID NO: 41312 - DNA, 20 bp, Artificial Sequence
  Synthetic oligonucleotide; GAG chr11 5288452 5288471 5288455 -
ttggggaccccagtacacaa

SEQ ID NO: 41313 - DNA, 20 bp, Artificial Sequence
  Synthetic oligonucleotide; AGG chr11 5288451 5288470 5288454 -
tggggaccccagtacacaag

SEQ ID NO: 41314 - DNA, 20 bp, Artificial Sequence
  Synthetic oligonucleotide; GGG chr11 5288450 5288469 5288453 -
ggggaccccagtacacaaga

SEQ ID NO: 41315 - DNA, 20 bp, Artificial Sequence
  Synthetic oligonucleotide; GGG chr11 5288449 5288468 5288452 -
gggaccccagtacacaagag

SEQ ID NO: 41316 - DNA, 20 bp, Artificial Sequence
  Synthetic oligonucleotide; CAG chr11 5288443 5288462 5288446 -
ccagtacacaagaggggacg

SEQ ID NO: 41317 - DNA, 20 bp, Artificial Sequence
  Synthetic oligonucleotide; AGG chr11 5288442 5288461 5288445 -
cagtacacaagaggggacgc

SEQ ID NO: 41318 - DNA, 20 bp, Artificial Sequence
  Synthetic oligonucleotide; GGG chr11 5288441 5288460 5288444 -
agtacacaagaggggacgca

SEQ ID NO: 41319 - DNA, 20 bp, Artificial Sequence
  Synthetic oligonucleotide; TAG chr11 5288432 5288451 5288435 -
gaggggacgcagggtatatg

SEQ ID NO: 41320 - DNA, 20 bp, Artificial Sequence
  Synthetic oligonucleotide; TAG chr11 5288411 5288430 5288414 -
agacatctcattctttttct

SEQ ID NO: 41321 - DNA, 20 bp, Artificial Sequence
  Synthetic oligonucleotide; GAG chr11 5288405 5288424 5288408 -
ctcattctttttcttagtgt

SEQ ID NO: 41322 - DNA, 20 bp, Artificial Sequence
  Synthetic oligonucleotide; AAG chr11 5288399 5288418 5288402 -
ctttttcttagtgtgagaat

SEQ ID NO: 41323 - DNA, 20 bp, Artificial Sequence
  Synthetic oligonucleotide; TAG chr11 5288394 5288413 5288397 -
tcttagtgtgagaataagaa

SEQ ID NO: 41324 - DNA, 20 bp, Artificial Sequence
  Synthetic oligonucleotide; GAG chr11 5288382 5288401 5288385 -
aataagaatagccatgacct

SEQ ID NO: 41325 - DNA, 20 bp, Artificial Sequence
  Synthetic oligonucleotide; TAG chr11 5288375 5288394 5288378 -
atagccatgacctgagttta

SEQ ID NO: 41326 - DNA, 20 bp, Artificial Sequence
  Synthetic oligonucleotide; GAG chr11 5288367 5288386 5288370 -
gacctgagtttatagacaat

SEQ ID NO: 41327 - DNA, 20 bp, Artificial Sequence
  Synthetic oligonucleotide; CAG chr11 5288345 5288364 5288348 -
gcccttttctctctcccact

SEQ ID NO: 41328 - DNA, 20 bp, Artificial Sequence
  Synthetic oligonucleotide; CAG chr11 5288342 5288361 5288345 -
cttttctctctcccactcag

SEQ ID NO: 41329 - DNA, 20 bp, Artificial Sequence
  Synthetic oligonucleotide; GAG chr11 5288335 5288354 5288338 -
ctctcccactcagcagctat

SEQ ID NO: 41330 - DNA, 20 bp, Artificial Sequence
  Synthetic oligonucleotide; TGG chr11 5288331 5288350 5288334 -
cccactcagcagctatgaga

SEQ ID NO: 41331 - DNA, 20 bp, Artificial Sequence
  Synthetic oligonucleotide; TAG chr11 5288310 5288329 5288313 -
ggcttgccctgcctctctac

SEQ ID NO: 41332 - DNA, 20 bp, Artificial Sequence
  Synthetic oligonucleotide; AGG chr11 5288309 5288328 5288312 -
gcttgccctgcctctctact

SEQ ID NO: 41333 - DNA, 20 bp, Artificial Sequence
  Synthetic oligonucleotide; AAG chr11 5288294 5288313 5288297 -
ctactaggctgactcactcc

SEQ ID NO: 41334 - DNA, 20 bp, Artificial Sequence
  Synthetic oligonucleotide; AGG chr11 5288293 5288312 5288296 -
tactaggctgactcactcca

SEQ ID NO: 41335 - DNA, 20 bp, Artificial Sequence
  Synthetic oligonucleotide; CAG chr11 5288288 5288307 5288291 -
ggctgactcactccaaggcc

SEQ ID NO: 41336 - DNA, 20 bp, Artificial Sequence
  Synthetic oligonucleotide; TGG chr11 5288282 5288301 5288285 -
ctcactccaaggcccagcaa

SEQ ID NO: 41337 - DNA, 20 bp, Artificial Sequence
  Synthetic oligonucleotide; GGG chr11 5288281 5288300 5288284 -
tcactccaaggcccagcaat

SEQ ID NO: 41338 - DNA, 20 bp, Artificial Sequence
  Synthetic oligonucleotide; CAG chr11 5288278 5288297 5288281 -
ctccaaggcccagcaatggg

SEQ ID NO: 41339 - DNA, 20 bp, Artificial Sequence
  Synthetic oligonucleotide; AGG chr11 5288277 5288296 5288280 -
tccaaggcccagcaatgggc

SEQ ID NO: 41340 - DNA, 20 bp, Artificial Sequence
  Synthetic oligonucleotide; GGG chr11 5288276 5288295 5288279 -
ccaaggcccagcaatgggca

SEQ ID NO: 41341 - DNA, 20 bp, Artificial Sequence
  Synthetic oligonucleotide; CAG chr11 5288267 5288286 5288270 -
agcaatgggcagggctctgt

SEQ ID NO: 41342 - DNA, 20 bp, Artificial Sequence
  Synthetic oligonucleotide; AGG chr11 5288266 5288285 5288269 -
gcaatgggcagggctctgtc

SEQ ID NO: 41343 - DNA, 20 bp, Artificial Sequence
  Synthetic oligonucleotide; GGG chr11 5288265 5288284 5288268 -
caatgggcagggctctgtca

SEQ ID NO: 41344 - DNA, 20 bp, Artificial Sequence
  Synthetic oligonucleotide; TAG chr11 5288256 5288275 5288259 -
gggctctgtcagggctttga

SEQ ID NO: 41345 - DNA, 20 bp, Artificial Sequence
  Synthetic oligonucleotide; CAG chr11 5288244 5288263 5288247 -
ggctttgatagcactatctg

SEQ ID NO: 41346 - DNA, 20 bp, Artificial Sequence
  Synthetic oligonucleotide; GAG chr11 5288242 5288261 5288245 -
ctttgatagcactatctgca

SEQ ID NO: 41347 - DNA, 20 bp, Artificial Sequence
  Synthetic oligonucleotide; CAG chr11 5288238 5288257 5288241 -
gatagcactatctgcagagc

SEQ ID NO: 41348 - DNA, 20 bp, Artificial Sequence
  Synthetic oligonucleotide; AGG chr11 5288237 5288256 5288240 -
atagcactatctgcagagcc

SEQ ID NO: 41349 - DNA, 20 bp, Artificial Sequence
  Synthetic oligonucleotide; GGG chr11 5288236 5288255 5288239 -
tagcactatctgcagagcca

SEQ ID NO: 41350 - DNA, 20 bp, Artificial Sequence
  Synthetic oligonucleotide; GAG chr11 5288231 5288250 5288234 -
ctatctgcagagccagggcc

SEQ ID NO: 41351 - DNA, 20 bp, Artificial Sequence
  Synthetic oligonucleotide; AAG chr11 5288228 5288247 5288231 -
tctgcagagccagggccgag

SEQ ID NO: 41352 - DNA, 20 bp, Artificial Sequence
  Synthetic oligonucleotide; AGG chr11 5288227 5288246 5288230 -
ctgcagagccagggccgaga

SEQ ID NO: 41353 - DNA, 20 bp, Artificial Sequence
  Synthetic oligonucleotide; GGG chr11 5288226 5288245 5288229 -
tgcagagccagggccgagaa

SEQ ID NO: 41354 - DNA, 20 bp, Artificial Sequence
  Synthetic oligonucleotide; GGG chr11 5288225 5288244 5288228 -
gcagagccagggccgagaag

SEQ ID NO: 41355 - DNA, 20 bp, Artificial Sequence
  Synthetic oligonucleotide; TGG chr11 5288222 5288241 5288225 -
gagccagggccgagaagggg

SEQ ID NO: 41356 - DNA, 20 bp, Artificial Sequence
  Synthetic oligonucleotide; CAG chr11 5288215 5288234 5288218 -
ggccgagaaggggtggactc

SEQ ID NO: 41357 - DNA, 20 bp, Artificial Sequence
  Synthetic oligonucleotide; GAG chr11 5288213 5288232 5288216 -
ccgagaaggggtggactcca

SEQ ID NO: 41358 - DNA, 20 bp, Artificial Sequence
  Synthetic oligonucleotide; GAG chr11 5288192 5288211 5288195 -
agactctccctcccattccc

SEQ ID NO: 41359 - DNA, 20 bp, Artificial Sequence
  Synthetic oligonucleotide; CAG chr11 5288189 5288208 5288192 -
ctctccctcccattcccgag

SEQ ID NO: 41360 - DNA, 20 bp, Artificial Sequence
  Synthetic oligonucleotide; AGG chr11 5288188 5288207 5288191 -
tctccctcccattcccgagc

SEQ ID NO: 41361 - DNA, 20 bp, Artificial Sequence
  Synthetic oligonucleotide; GGG chr11 5288187 5288206 5288190 -
ctccctcccattcccgagca

SEQ ID NO: 41362 - DNA, 20 bp, Artificial Sequence
  Synthetic oligonucleotide; AAG chr11 5288145 5288164 5288148 -
aaatgatatatttattttaa

SEQ ID NO: 41363 - DNA, 20 bp, Artificial Sequence
  Synthetic oligonucleotide; CAG chr11 5288136 5288155 5288139 -
atttattttaaaagaaataa

SEQ ID NO: 41364 - DNA, 20 bp, Artificial Sequence
  Synthetic oligonucleotide; AGG chr11 5288135 5288154 5288138 -
tttattttaaaagaaataac

SEQ ID NO: 41365 - DNA, 20 bp, Artificial Sequence
  Synthetic oligonucleotide; GAG chr11 5288133 5288152 5288136 -
tattttaaaagaaataacag

SEQ ID NO: 41366 - DNA, 20 bp, Artificial Sequence
  Synthetic oligonucleotide; CAG chr11 5288124 5288143 5288127 -
agaaataacaggagactgcc

SEQ ID NO: 41367 - DNA, 20 bp, Artificial Sequence
  Synthetic oligonucleotide; TGG chr11 5288118 5288137 5288121 -
aacaggagactgcccagccc

SEQ ID NO: 41368 - DNA, 20 bp, Artificial Sequence
  Synthetic oligonucleotide; TGG chr11 5288107 5288126 5288110 -
gcccagccctggctgtgaca

SEQ ID NO: 41369 - DNA, 20 bp, Artificial Sequence
  Synthetic oligonucleotide; TAG chr11 5288096 5288115 5288099 -
gctgtgacatggaaactatg

SEQ ID NO: 41370 - DNA, 20 bp, Artificial Sequence
  Synthetic oligonucleotide; TGG chr11 5288086 5288105 5288089 -
ggaaactatgtagaatattt

SEQ ID NO: 41371 - DNA, 20 bp, Artificial Sequence
  Synthetic oligonucleotide; GGG chr11 5288085 5288104 5288088 -
gaaactatgtagaatatttt

SEQ ID NO: 41372 - DNA, 20 bp, Artificial Sequence
  Synthetic oligonucleotide; CAG chr11 5288060 5288079 5288063 -
ccatttttttttccttcttt

SEQ ID NO: 41373 - DNA, 20 bp, Artificial Sequence
  Synthetic oligonucleotide; TAG chr11 5288056 5288075 5288059 -
ttttttttccttctttcagt

SEQ ID NO: 41374 - DNA, 20 bp, Artificial Sequence
  Synthetic oligonucleotide; GAG chr11 5288054 5288073 5288057 -
ttttttccttctttcagtta

SEQ ID NO: 41375 - DNA, 20 bp, Artificial Sequence
  Synthetic oligonucleotide; AGG chr11 5288053 5288072 5288056 -
tttttccttctttcagttag

SEQ ID NO: 41376 - DNA, 20 bp, Artificial Sequence
  Synthetic oligonucleotide; AAG chr11 5288048 5288067 5288051 -
ccttctttcagttagaggaa

SEQ ID NO: 41377 - DNA, 20 bp, Artificial Sequence
  Synthetic oligonucleotide; AGG chr11 5288047 5288066 5288050 -
cttctttcagttagaggaaa

SEQ ID NO: 41378 - DNA, 20 bp, Artificial Sequence
  Synthetic oligonucleotide; GGG chr11 5288046 5288065 5288049 -
ttctttcagttagaggaaaa

SEQ ID NO: 41379 - DNA, 20 bp, Artificial Sequence
  Synthetic oligonucleotide; GGG chr11 5288045 5288064 5288048 -
tctttcagttagaggaaaag

SEQ ID NO: 41380 - DNA, 20 bp, Artificial Sequence
  Synthetic oligonucleotide; TAG chr11 5288026 5288045 5288029 -
ggggctcactgcacatacac

SEQ ID NO: 41381 - DNA, 20 bp, Artificial Sequence
  Synthetic oligonucleotide; CAG chr11 5288022 5288041 5288025 -
ctcactgcacatacactaga

SEQ ID NO: 41382 - DNA, 20 bp, Artificial Sequence
  Synthetic oligonucleotide; AAG chr11 5288018 5288037 5288021 -
ctgcacatacactagacaga

SEQ ID NO: 41383 - DNA, 20 bp, Artificial Sequence
  Synthetic oligonucleotide; CAG chr11 5288014 5288033 5288017 -
acatacactagacagaaagt

SEQ ID NO: 41384 - DNA, 20 bp, Artificial Sequence
  Synthetic oligonucleotide; AGG chr11 5288013 5288032 5288016 -
catacactagacagaaagtc

SEQ ID NO: 41385 - DNA, 20 bp, Artificial Sequence
  Synthetic oligonucleotide; GAG chr11 5288011 5288030 5288014 -
tacactagacagaaagtcag

SEQ ID NO: 41386 - DNA, 20 bp, Artificial Sequence
  Synthetic oligonucleotide; AAG chr11 5287998 5288017 5288001 -
aagtcaggagctttgaatcc

SEQ ID NO: 41387 - DNA, 20 bp, Artificial Sequence
  Synthetic oligonucleotide; GAG chr11 5287972 5287991 5287975 -
gatcatttccatgtcatact

SEQ ID NO: 41388 - DNA, 20 bp, Artificial Sequence
  Synthetic oligonucleotide; AAG chr11 5287968 5287987 5287971 -
atttccatgtcatactgaga

SEQ ID NO: 41389 - DNA, 20 bp, Artificial Sequence
  Synthetic oligonucleotide; GAG chr11 5287950 5287969 5287953 -
gaaagtccccacccttctct

SEQ ID NO: 41390 - DNA, 20 bp, Artificial Sequence
  Synthetic oligonucleotide; CAG chr11 5287944 5287963 5287947 -
ccccacccttctctgagcct

SEQ ID NO: 41391 - DNA, 20 bp, Artificial Sequence
  Synthetic oligonucleotide; AAG chr11 5287928 5287947 5287931 -
gcctcagtttctctttttat

SEQ ID NO: 41392 - DNA, 20 bp, Artificial Sequence
  Synthetic oligonucleotide; TAG chr11 5287925 5287944 5287928 -
tcagtttctctttttataag

SEQ ID NO: 41393 - DNA, 20 bp, Artificial Sequence
  Synthetic oligonucleotide; AGG chr11 5287924 5287943 5287927 -
cagtttctctttttataagt

SEQ ID NO: 41394 - DNA, 20 bp, Artificial Sequence
  Synthetic oligonucleotide; GAG chr11 5287922 5287941 5287925 -
gtttctctttttataagtag

SEQ ID NO: 41395 - DNA, 20 bp, Artificial Sequence
  Synthetic oligonucleotide; TGG chr11 5287917 5287936 5287920 -
tctttttataagtaggagtc

SEQ ID NO: 41396 - DNA, 20 bp, Artificial Sequence
  Synthetic oligonucleotide; GAG chr11 5287915 5287934 5287918 -
tttttataagtaggagtctg

SEQ ID NO: 41397 - DNA, 20 bp, Artificial Sequence
  Synthetic oligonucleotide; TGG chr11 5287898 5287917 5287901 -
ctggagtaaatgatttccaa

SEQ ID NO: 41398 - DNA, 20 bp, Artificial Sequence
  Synthetic oligonucleotide; GAG chr11 5287856 5287875 5287859 -
tttccgtttattaaatgcat

SEQ ID NO: 41399 - DNA, 20 bp, Artificial Sequence
  Synthetic oligonucleotide; AAG chr11 5287840 5287859 5287843 -
gcatgagcttctgttactcc

SEQ ID NO: 41400 - DNA, 20 bp, Artificial Sequence
  Synthetic oligonucleotide; GAG chr11 5287834 5287853 5287837 -
gcttctgttactccaagact

SEQ ID NO: 41401 - DNA, 20 bp, Artificial Sequence
  Synthetic oligonucleotide; AAG chr11 5287831 5287850 5287834 -
tctgttactccaagactgag

SEQ ID NO: 41402 - DNA, 20 bp, Artificial Sequence
  Synthetic oligonucleotide; AGG chr11 5287830 5287849 5287833 -
ctgttactccaagactgaga

SEQ ID NO: 41403 - DNA, 20 bp, Artificial Sequence
  Synthetic oligonucleotide; GAG chr11 5287816 5287835 5287819 -
ctgagaaggaaattgaacct

SEQ ID NO: 41404 - DNA, 20 bp, Artificial Sequence
  Synthetic oligonucleotide; TGG chr11 5287803 5287822 5287806 -
tgaacctgagactcattgac

SEQ ID NO: 41405 - DNA, 20 bp, Artificial Sequence
  Synthetic oligonucleotide; AAG chr11 5287799 5287818 5287802 -
cctgagactcattgactggc

SEQ ID NO: 41406 - DNA, 20 bp, Artificial Sequence
  Synthetic oligonucleotide; CAG chr11 5287789 5287808 5287792 -
attgactggcaagatgtccc

SEQ ID NO: 41407 - DNA, 20 bp, Artificial Sequence
  Synthetic oligonucleotide; GAG chr11 5287787 5287806 5287790 -
tgactggcaagatgtcccca

SEQ ID NO: 41408 - DNA, 20 bp, Artificial Sequence
  Synthetic oligonucleotide; AGG chr11 5287786 5287805 5287789 -
gactggcaagatgtccccag

SEQ ID NO: 41409 - DNA, 20 bp, Artificial Sequence
  Synthetic oligonucleotide; CAG chr11 5287775 5287794 5287778 -
tgtccccagaggctctcatt

SEQ ID NO: 41410 - DNA, 20 bp, Artificial Sequence
  Synthetic oligonucleotide; CAG chr11 5287750 5287769 5287753 -
ataaaattctcaccttcacc

SEQ ID NO: 41411 - DNA, 20 bp, Artificial Sequence
  Synthetic oligonucleotide; AGG chr11 5287749 5287768 5287752 -
taaaattctcaccttcaccc

SEQ ID NO: 41412 - DNA, 20 bp, Artificial Sequence
  Synthetic oligonucleotide; GAG chr11 5287740 5287759 5287743 -
caccttcacccaggcccact

SEQ ID NO: 41413 - DNA, 20 bp, Artificial Sequence
  Synthetic oligonucleotide; CAG chr11 5287734 5287753 5287737 -
cacccaggcccactgagtgt

SEQ ID NO: 41414 - DNA, 20 bp, Artificial Sequence
  Synthetic oligonucleotide; TAG chr11 5287719 5287738 5287722 -
agtgtcagatttgcatgcac

SEQ ID NO: 41415 - DNA, 20 bp, Artificial Sequence
  Synthetic oligonucleotide; AAG chr11 5287702 5287721 5287705 -
cactagttcacgtgtgtaaa

SEQ ID NO: 41416 - DNA, 20 bp, Artificial Sequence
  Synthetic oligonucleotide; AGG chr11 5287701 5287720 5287704 -
actagttcacgtgtgtaaaa

SEQ ID NO: 41417 - DNA, 20 bp, Artificial Sequence
  Synthetic oligonucleotide; GAG chr11 5287699 5287718 5287702 -
tagttcacgtgtgtaaaaag

SEQ ID NO: 41418 - DNA, 20 bp, Artificial Sequence
  Synthetic oligonucleotide; AGG chr11 5287698 5287717 5287701 -
agttcacgtgtgtaaaaagg

SEQ ID NO: 41419 - DNA, 20 bp, Artificial Sequence
  Synthetic oligonucleotide; TAG chr11 5287663 5287682 5287666 -
tttgtattctcacatacctt

SEQ ID NO: 41420 - DNA, 20 bp, Artificial Sequence
  Synthetic oligonucleotide; AGG chr11 5287662 5287681 5287665 -
ttgtattctcacataccttt

SEQ ID NO: 41421 - DNA, 20 bp, Artificial Sequence
  Synthetic oligonucleotide; AAG chr11 5287658 5287677 5287661 -
attctcacatacctttagga

SEQ ID NO: 41422 - DNA, 20 bp, Artificial Sequence
  Synthetic oligonucleotide; TAG chr11 5287651 5287670 5287654 -
catacctttaggaaagaact

SEQ ID NO: 41423 - DNA, 20 bp, Artificial Sequence
  Synthetic oligonucleotide; CAG chr11 5287635 5287654 5287638 -
aacttagcacccttcccaca

SEQ ID NO: 41424 - DNA, 20 bp, Artificial Sequence
  Synthetic oligonucleotide; CAG chr11 5287613 5287632 5287616 -
gccatcccaataactcattt

SEQ ID NO: 41425 - DNA, 20 bp, Artificial Sequence
  Synthetic oligonucleotide; AAG chr11 5287587 5287606 5287590 -
ctcaacccttgactttataa

SEQ ID NO: 41426 - DNA, 20 bp, Artificial Sequence
  Synthetic oligonucleotide; TGG chr11 5287581 5287600 5287584 -
ccttgactttataaaagtct

SEQ ID NO: 41427 - DNA, 20 bp, Artificial Sequence
  Synthetic oligonucleotide; GGG chr11 5287580 5287599 5287583 -
cttgactttataaaagtctt

SEQ ID NO: 41428 - DNA, 20 bp, Artificial Sequence
  Synthetic oligonucleotide; CAG chr11 5287577 5287596 5287580 -
gactttataaaagtcttggg

SEQ ID NO: 41429 - DNA, 20 bp, Artificial Sequence
  Synthetic oligonucleotide; TAG chr11 5287572 5287591 5287575 -
tataaaagtcttgggcagta

SEQ ID NO: 41430 - DNA, 20 bp, Artificial Sequence
  Synthetic oligonucleotide; GAG chr11 5287570 5287589 5287573 -
taaaagtcttgggcagtata

SEQ ID NO: 41431 - DNA, 20 bp, Artificial Sequence
  Synthetic oligonucleotide; CAG chr11 5287567 5287586 5287570 -
aagtcttgggcagtatagag

SEQ ID NO: 41432 - DNA, 20 bp, Artificial Sequence
  Synthetic oligonucleotide; GAG chr11 5287565 5287584 5287568 -
gtcttgggcagtatagagca

SEQ ID NO: 41433 - DNA, 20 bp, Artificial Sequence
  Synthetic oligonucleotide; AAG chr11 5287559 5287578 5287562 -
ggcagtatagagcagagatt

SEQ ID NO: 41434 - DNA, 20 bp, Artificial Sequence
  Synthetic oligonucleotide; GAG chr11 5287557 5287576 5287560 -
cagtatagagcagagattaa

SEQ ID NO: 41435 - DNA, 20 bp, Artificial Sequence
  Synthetic oligonucleotide; CAG chr11 5287552 5287571 5287555 -
tagagcagagattaagagta

SEQ ID NO: 41436 - DNA, 20 bp, Artificial Sequence
  Synthetic oligonucleotide; TGG chr11 5287545 5287564 5287548 -
gagattaagagtacagatgc

SEQ ID NO: 41437 - DNA, 20 bp, Artificial Sequence
  Synthetic oligonucleotide; GAG chr11 5287543 5287562 5287546 -
gattaagagtacagatgctg

SEQ ID NO: 41438 - DNA, 20 bp, Artificial Sequence
  Synthetic oligonucleotide; CAG chr11 5287539 5287558 5287542 -
aagagtacagatgctggagc

SEQ ID NO: 41439 - DNA, 20 bp, Artificial Sequence
  Synthetic oligonucleotide; GAG chr11 5287529 5287548 5287532 -
atgctggagccagaccacct

SEQ ID NO: 41440 - DNA, 20 bp, Artificial Sequence
  Synthetic oligonucleotide; TAG chr11 5287522 5287541 5287525 -
agccagaccacctgagtgat

SEQ ID NO: 41441 - DNA, 20 bp, Artificial Sequence
  Synthetic oligonucleotide; CAG chr11 5287514 5287533 5287517 -
cacctgagtgattagtgact

SEQ ID NO: 41442 - DNA, 20 bp, Artificial Sequence
  Synthetic oligonucleotide; TAG chr11 5287504 5287523 5287507 -
attagtgactcagtttctct

SEQ ID NO: 41443 - DNA, 20 bp, Artificial Sequence
  Synthetic oligonucleotide; TAG chr11 5287501 5287520 5287504 -
agtgactcagtttctcttag

SEQ ID NO: 41444 - DNA, 20 bp, Artificial Sequence
  Synthetic oligonucleotide; CAG chr11 5287488 5287507 5287491 -
ctcttagtagttgtatgact

SEQ ID NO: 41445 - DNA, 20 bp, Artificial Sequence
  Synthetic oligonucleotide; TGG chr11 5287468 5287487 5287471 -
cagtttcttcatctgtaaaa

SEQ ID NO: 41446 - DNA, 20 bp, Artificial Sequence
  Synthetic oligonucleotide; GAG chr11 5287466 5287485 5287469 -
gtttcttcatctgtaaaatg

SEQ ID NO: 41447 - DNA, 20 bp, Artificial Sequence
  Synthetic oligonucleotide; AGG chr11 5287465 5287484 5287468 -
tttcttcatctgtaaaatgg

SEQ ID NO: 41448 - DNA, 20 bp, Artificial Sequence
  Synthetic oligonucleotide; GGG chr11 5287464 5287483 5287467 -
ttcttcatctgtaaaatgga

SEQ ID NO: 41449 - DNA, 20 bp, Artificial Sequence
  Synthetic oligonucleotide; TAG chr11 5287452 5287471 5287455 -
aaaatggagggttttttaat

SEQ ID NO: 41450 - DNA, 20 bp, Artificial Sequence
  Synthetic oligonucleotide; GAG chr11 5287440 5287459 5287443 -
tttttaattagtttgttttt

SEQ ID NO: 41451 - DNA, 20 bp, Artificial Sequence
  Synthetic oligonucleotide; AAG chr11 5287436 5287455 5287439 -
taattagtttgtttttgaga

SEQ ID NO: 41452 - DNA, 20 bp, Artificial Sequence
  Synthetic oligonucleotide; AGG chr11 5287435 5287454 5287438 -
aattagtttgtttttgagaa

SEQ ID NO: 41453 - DNA, 20 bp, Artificial Sequence
  Synthetic oligonucleotide; GGG chr11 5287434 5287453 5287437 -
attagtttgtttttgagaaa

SEQ ID NO: 41454 - DNA, 20 bp, Artificial Sequence
  Synthetic oligonucleotide; TGG chr11 5287412 5287431 5287415 -
gtctcactctgtcacccaaa

SEQ ID NO: 41455 - DNA, 20 bp, Artificial Sequence
  Synthetic oligonucleotide; GGG chr11 5287411 5287430 5287414 -
tctcactctgtcacccaaat

SEQ ID NO: 41456 - DNA, 20 bp, Artificial Sequence
  Synthetic oligonucleotide; GAG chr11 5287409 5287428 5287412 -
tcactctgtcacccaaatgg

SEQ ID NO: 41457 - DNA, 20 bp, Artificial Sequence
  Synthetic oligonucleotide; TAG chr11 5287404 5287423 5287407 -
ctgtcacccaaatgggagtg

SEQ ID NO: 41458 - DNA, 20 bp, Artificial Sequence
  Synthetic oligonucleotide; TGG chr11 5287401 5287420 5287404 -
tcacccaaatgggagtgtag

SEQ ID NO: 41459 - DNA, 20 bp, Artificial Sequence
  Synthetic oligonucleotide; CGG chr11 5287390 5287409 5287393 -
ggagtgtagtggcaaaatct

SEQ ID NO: 41460 - DNA, 20 bp, Artificial Sequence
  Synthetic oligonucleotide; CAG chr11 5287366 5287385 5287369 -
tcactgcaacttgcacttcc

SEQ ID NO: 41461 - DNA, 20 bp, Artificial Sequence
  Synthetic oligonucleotide; AGG chr11 5287365 5287384 5287368 -
cactgcaacttgcacttccc

SEQ ID NO: 41462 - DNA, 20 bp, Artificial Sequence
  Synthetic oligonucleotide; AAG chr11 5287359 5287378 5287362 -
aacttgcacttcccaggctc

SEQ ID NO: 41463 - DNA, 20 bp, Artificial Sequence
  Synthetic oligonucleotide; CGG chr11 5287356 5287375 5287359 -
ttgcacttcccaggctcaag

SEQ ID NO: 41464 - DNA, 20 bp, Artificial Sequence
  Synthetic oligonucleotide; GAG chr11 5287333 5287352 5287336 -
tcctcccacctcaacatcct

SEQ ID NO: 41465 - DNA, 20 bp, Artificial Sequence
  Synthetic oligonucleotide; TAG chr11 5287330 5287349 5287333 -
tcccacctcaacatcctgag

SEQ ID NO: 41466 - DNA, 20 bp, Artificial Sequence
  Synthetic oligonucleotide; TGG chr11 5287326 5287345 5287329 -
acctcaacatcctgagtagc

SEQ ID NO: 41467 - DNA, 20 bp, Artificial Sequence
  Synthetic oligonucleotide; CAG chr11 5287318 5287337 5287321 -
atcctgagtagctggaacca

SEQ ID NO: 41468 - DNA, 20 bp, Artificial Sequence
  Synthetic oligonucleotide; AGG chr11 5287317 5287336 5287320 -
tcctgagtagctggaaccac

SEQ ID NO: 41469 - DNA, 20 bp, Artificial Sequence
  Synthetic oligonucleotide; TGG chr11 5287278 5287297 5287281 -
tcgctaattttttgtatttt

SEQ ID NO: 41470 - DNA, 20 bp, Artificial Sequence
  Synthetic oligonucleotide; TAG chr11 5287275 5287294 5287278 -
ctaattttttgtatttttgg

SEQ ID NO: 41471 - DNA, 20 bp, Artificial Sequence
  Synthetic oligonucleotide; GAG chr11 5287273 5287292 5287276 -
aattttttgtatttttggta

SEQ ID NO: 41472 - DNA, 20 bp, Artificial Sequence
  Synthetic oligonucleotide; TGG chr11 5287269 5287288 5287272 -
ttttgtatttttggtagaga

SEQ ID NO: 41473 - DNA, 20 bp, Artificial Sequence
  Synthetic oligonucleotide; GGG chr11 5287268 5287287 5287271 -
tttgtatttttggtagagat

SEQ ID NO: 41474 - DNA, 20 bp, Artificial Sequence
  Synthetic oligonucleotide; GGG chr11 5287267 5287286 5287270 -
ttgtatttttggtagagatg

SEQ ID NO: 41475 - DNA, 20 bp, Artificial Sequence
  Synthetic oligonucleotide; CAG chr11 5287250 5287269 5287253 -
atggggtttcacatgttaca

SEQ ID NO: 41476 - DNA, 20 bp, Artificial Sequence
  Synthetic oligonucleotide; AGG chr11 5287249 5287268 5287252 -
tggggtttcacatgttacac

SEQ ID NO: 41477 - DNA, 20 bp, Artificial Sequence
  Synthetic oligonucleotide; TGG chr11 5287245 5287264 5287248 -
gtttcacatgttacacagga

SEQ ID NO: 41478 - DNA, 20 bp, Artificial Sequence
  Synthetic oligonucleotide; CAG chr11 5287239 5287258 5287242 -
catgttacacaggatggtct

SEQ ID NO: 41479 - DNA, 20 bp, Artificial Sequence
  Synthetic oligonucleotide; CGG chr11 5287232 5287251 5287235 -
cacaggatggtctcagactc

SEQ ID NO: 41480 - DNA, 20 bp, Artificial Sequence
  Synthetic oligonucleotide; GAG chr11 5287230 5287249 5287233 -
caggatggtctcagactccg

SEQ ID NO: 41481 - DNA, 20 bp, Artificial Sequence
  Synthetic oligonucleotide; AAG chr11 5287224 5287243 5287227 -
ggtctcagactccggagctc

SEQ ID NO: 41482 - DNA, 20 bp, Artificial Sequence
  Synthetic oligonucleotide; CAG chr11 5287207 5287226 5287210 -
ctcaagcaatctgcccacct

SEQ ID NO: 41483 - DNA, 20 bp, Artificial Sequence
  Synthetic oligonucleotide; AAG chr11 5287197 5287216 5287200 -
ctgcccacctcagccttcca

SEQ ID NO: 41484 - DNA, 20 bp, Artificial Sequence
  Synthetic oligonucleotide; TGG chr11 5287191 5287210 5287194 -
acctcagccttccaaagtgc

SEQ ID NO: 41485 - DNA, 20 bp, Artificial Sequence
  Synthetic oligonucleotide; GGG chr11 5287190 5287209 5287193 -
cctcagccttccaaagtgct

SEQ ID NO: 41486 - DNA, 20 bp, Artificial Sequence
  Synthetic oligonucleotide; AAG chr11 5287182 5287201 5287185 -
ttccaaagtgctgggattat

SEQ ID NO: 41487 - DNA, 20 bp, Artificial Sequence
  Synthetic oligonucleotide; CAG chr11 5287171 5287190 5287174 -
tgggattataagcatgatta

SEQ ID NO: 41488 - DNA, 20 bp, Artificial Sequence
  Synthetic oligonucleotide; AGG chr11 5287170 5287189 5287173 -
gggattataagcatgattac

SEQ ID NO: 41489 - DNA, 20 bp, Artificial Sequence
  Synthetic oligonucleotide; GAG chr11 5287168 5287187 5287171 -
gattataagcatgattacag

SEQ ID NO: 41490 - DNA, 20 bp, Artificial Sequence
  Synthetic oligonucleotide; CAG chr11 5287159 5287178 5287162 -
catgattacaggagttttaa

SEQ ID NO: 41491 - DNA, 20 bp, Artificial Sequence
  Synthetic oligonucleotide; AGG chr11 5287158 5287177 5287161 -
atgattacaggagttttaac

SEQ ID NO: 41492 - DNA, 20 bp, Artificial Sequence
  Synthetic oligonucleotide; AAG chr11 5287150 5287169 5287153 -
aggagttttaacaggctcat

SEQ ID NO: 41493 - DNA, 20 bp, Artificial Sequence
  Synthetic oligonucleotide; CAG chr11 5287138 5287157 5287141 -
aggctcataagattgttctg

SEQ ID NO: 41494 - DNA, 20 bp, Artificial Sequence
  Synthetic oligonucleotide; GAG chr11 5287132 5287151 5287135 -
ataagattgttctgcagccc

SEQ ID NO: 41495 - DNA, 20 bp, Artificial Sequence
  Synthetic oligonucleotide; GAG chr11 5287128 5287147 5287131 -
gattgttctgcagcccgagt

SEQ ID NO: 41496 - DNA, 20 bp, Artificial Sequence
  Synthetic oligonucleotide; AAG chr11 5287113 5287132 5287116 -
cgagtgagttaatacatgca

SEQ ID NO: 41497 - DNA, 20 bp, Artificial Sequence
  Synthetic oligonucleotide; GAG chr11 5287111 5287130 5287114 -
agtgagttaatacatgcaaa

SEQ ID NO: 41498 - DNA, 20 bp, Artificial Sequence
  Synthetic oligonucleotide; AAG chr11 5287104 5287123 5287107 -
taatacatgcaaagagttta

SEQ ID NO: 41499 - DNA, 20 bp, Artificial Sequence
  Synthetic oligonucleotide; CAG chr11 5287101 5287120 5287104 -
tacatgcaaagagtttaaag

SEQ ID NO: 41500 - DNA, 20 bp, Artificial Sequence
  Synthetic oligonucleotide; TAG chr11 5287075 5287094 5287078 -
cttataaatgctaactactc

SEQ ID NO: 41501 - DNA, 20 bp, Artificial Sequence
  Synthetic oligonucleotide; TAG chr11 5287062 5287081 5287065 -
actactctagaaatgtttgc

SEQ ID NO: 41502 - DNA, 20 bp, Artificial Sequence
  Synthetic oligonucleotide; CAG chr11 5287027 5287046 5287030 -
aactgcaatcattcttgctg

SEQ ID NO: 41503 - DNA, 20 bp, Artificial Sequence
  Synthetic oligonucleotide; AGG chr11 5287026 5287045 5287029 -
actgcaatcattcttgctgc

SEQ ID NO: 41504 - DNA, 20 bp, Artificial Sequence
  Synthetic oligonucleotide; TAG chr11 5287016 5287035 5287019 -
ttcttgctgcaggtgaaaac

SEQ ID NO: 41505 - DNA, 20 bp, Artificial Sequence
  Synthetic oligonucleotide; AAG chr11 5286951 5286970 5286954 -
aaaataactgacatttattg

SEQ ID NO: 41506 - DNA, 20 bp, Artificial Sequence
  Synthetic oligonucleotide; AGG chr11 5286950 5286969 5286953 -
aaataactgacatttattga

SEQ ID NO: 41507 - DNA, 20 bp, Artificial Sequence
  Synthetic oligonucleotide; CAG chr11 5286943 5286962 5286946 -
tgacatttattgaaggctat

SEQ ID NO: 41508 - DNA, 20 bp, Artificial Sequence
  Synthetic oligonucleotide; GAG chr11 5286941 5286960 5286944 -
acatttattgaaggctatca

SEQ ID NO: 41509 - DNA, 20 bp, Artificial Sequence
  Synthetic oligonucleotide; TAG chr11 5286930 5286949 5286933 -
aggctatcagagactgtaat

SEQ ID NO: 41510 - DNA, 20 bp, Artificial Sequence
  Synthetic oligonucleotide; TGG chr11 5286895 5286914 5286898 -
ttaatcatatttaatactct

SEQ ID NO: 41511 - DNA, 20 bp, Artificial Sequence
  Synthetic oligonucleotide; CAG chr11 5286885 5286904 5286888 -
ttaatactcttggattcttt

SEQ ID NO: 41512 - DNA, 20 bp, Artificial Sequence
  Synthetic oligonucleotide; AGG chr11 5286884 5286903 5286887 -
taatactcttggattctttc

SEQ ID NO: 41513 - DNA, 20 bp, Artificial Sequence
  Synthetic oligonucleotide; TAG chr11 5286881 5286900 5286884 -
tactcttggattctttcagg

SEQ ID NO: 41514 - DNA, 20 bp, Artificial Sequence
  Synthetic oligonucleotide; CAG chr11 5286852 5286871 5286855 -
ttattatccccattttacta

SEQ ID NO: 41515 - DNA, 20 bp, Artificial Sequence
  Synthetic oligonucleotide; AAG chr11 5286822 5286841 5286825 -
aactacctctcaacttgctc

SEQ ID NO: 41516 - DNA, 20 bp, Artificial Sequence
  Synthetic oligonucleotide; TAG chr11 5286787 5286806 5286790 -
cacacacaaacataaactac

SEQ ID NO: 41517 - DNA, 20 bp, Artificial Sequence
  Synthetic oligonucleotide; TAG chr11 5286780 5286799 5286783 -
aaacataaactactagcaaa

SEQ ID NO: 41518 - DNA, 20 bp, Artificial Sequence
  Synthetic oligonucleotide; TAG chr11 5286777 5286796 5286780 -
cataaactactagcaaatag

SEQ ID NO: 41519 - DNA, 20 bp, Artificial Sequence
  Synthetic oligonucleotide; GAG chr11 5286770 5286789 5286773 -
tactagcaaatagtagaatt

SEQ ID NO: 41520 - DNA, 20 bp, Artificial Sequence
  Synthetic oligonucleotide; TGG chr11 5286764 5286783 5286767 -
caaatagtagaattgagatt

SEQ ID NO: 41521 - DNA, 20 bp, Artificial Sequence
  Synthetic oligonucleotide; TGG chr11 5286707 5286726 5286710 -
atttattgacatgtacttct

SEQ ID NO: 41522 - DNA, 20 bp, Artificial Sequence
  Synthetic oligonucleotide; CAG chr11 5286704 5286723 5286707 -
tattgacatgtacttcttgg

SEQ ID NO: 41523 - DNA, 20 bp, Artificial Sequence
  Synthetic oligonucleotide; TGG chr11 5286692 5286711 5286695 -
cttcttggcagtctgtatgc

SEQ ID NO: 41524 - DNA, 20 bp, Artificial Sequence
  Synthetic oligonucleotide; TGG chr11 5286685 5286704 5286688 -
gcagtctgtatgctggatgc

SEQ ID NO: 41525 - DNA, 20 bp, Artificial Sequence
  Synthetic oligonucleotide; GGG chr11 5286684 5286703 5286687 -
cagtctgtatgctggatgct

SEQ ID NO: 41526 - DNA, 20 bp, Artificial Sequence
  Synthetic oligonucleotide; GGG chr11 5286683 5286702 5286686 -
agtctgtatgctggatgctg

SEQ ID NO: 41527 - DNA, 20 bp, Artificial Sequence
  Synthetic oligonucleotide; AAG chr11 5286675 5286694 5286678 -
tgctggatgctggggataca

SEQ ID NO: 41528 - DNA, 20 bp, Artificial Sequence
  Synthetic oligonucleotide; AAG chr11 5286660 5286679 5286663 -
atacaaagatgtttaaattt

SEQ ID NO: 41529 - DNA, 20 bp, Artificial Sequence
  Synthetic oligonucleotide; CAG chr11 5286654 5286673 5286657 -
agatgtttaaatttaagctc

SEQ ID NO: 41530 - DNA, 20 bp, Artificial Sequence
  Synthetic oligonucleotide; AAG chr11 5286639 5286658 5286642 -
agctccagtctctgcttcca

SEQ ID NO: 41531 - DNA, 20 bp, Artificial Sequence
  Synthetic oligonucleotide; AGG chr11 5286638 5286657 5286641 -
gctccagtctctgcttccaa

SEQ ID NO: 41532 - DNA, 20 bp, Artificial Sequence
  Synthetic oligonucleotide; CAG chr11 5286630 5286649 5286633 -
ctctgcttccaaaggcctcc

SEQ ID NO: 41533 - DNA, 20 bp, Artificial Sequence
  Synthetic oligonucleotide; AGG chr11 5286629 5286648 5286632 -
tctgcttccaaaggcctccc

SEQ ID NO: 41534 - DNA, 20 bp, Artificial Sequence
  Synthetic oligonucleotide; AAG chr11 5286624 5286643 5286627 -
ttccaaaggcctcccaggcc

SEQ ID NO: 41535 - DNA, 20 bp, Artificial Sequence
  Synthetic oligonucleotide; CAG chr11 5286612 5286631 5286615 -
cccaggccaagttatccatt

SEQ ID NO: 41536 - DNA, 20 bp, Artificial Sequence
  Synthetic oligonucleotide; AAG chr11 5286608 5286627 5286611 -
ggccaagttatccattcaga

SEQ ID NO: 41537 - DNA, 20 bp, Artificial Sequence
  Synthetic oligonucleotide; AAG chr11 5286571 5286590 5286574 -
tgcattccactgtttttcct

SEQ ID NO: 41538 - DNA, 20 bp, Artificial Sequence
  Synthetic oligonucleotide; TGG chr11 5286529 5286548 5286532 -
tattcgtctgtgtcctgctc

SEQ ID NO: 41539 - DNA, 20 bp, Artificial Sequence
  Synthetic oligonucleotide; GGG chr11 5286528 5286547 5286531 -
attcgtctgtgtcctgctct

SEQ ID NO: 41540 - DNA, 20 bp, Artificial Sequence
  Synthetic oligonucleotide; TAG chr11 5286521 5286540 5286524 -
tgtgtcctgctctgggatga

SEQ ID NO: 41541 - DNA, 20 bp, Artificial Sequence
  Synthetic oligonucleotide; GAG chr11 5286501 5286520 5286504 -
tagtctgactttcctaacct

SEQ ID NO: 41542 - DNA, 20 bp, Artificial Sequence
  Synthetic oligonucleotide; CAG chr11 5286481 5286500 5286484 -
gagcctaacatccctgacat

SEQ ID NO: 41543 - DNA, 20 bp, Artificial Sequence
  Synthetic oligonucleotide; AGG chr11 5286480 5286499 5286483 -
agcctaacatccctgacatc

SEQ ID NO: 41544 - DNA, 20 bp, Artificial Sequence
  Synthetic oligonucleotide; AAG chr11 5286476 5286495 5286479 -
taacatccctgacatcagga

SEQ ID NO: 41545 - DNA, 20 bp, Artificial Sequence
  Synthetic oligonucleotide; TGG chr11 5286462 5286481 5286465 -
tcaggaaagactacaccatg

SEQ ID NO: 41546 - DNA, 20 bp, Artificial Sequence
  Synthetic oligonucleotide; GAG chr11 5286460 5286479 5286463 -
aggaaagactacaccatgtg

SEQ ID NO: 41547 - DNA, 20 bp, Artificial Sequence
  Synthetic oligonucleotide; AAG chr11 5286457 5286476 5286460 -
aaagactacaccatgtggag

SEQ ID NO: 41548 - DNA, 20 bp, Artificial Sequence
  Synthetic oligonucleotide; AGG chr11 5286456 5286475 5286459 -
aagactacaccatgtggaga

SEQ ID NO: 41549 - DNA, 20 bp, Artificial Sequence
  Synthetic oligonucleotide; GGG chr11 5286455 5286474 5286458 -
agactacaccatgtggagaa

SEQ ID NO: 41550 - DNA, 20 bp, Artificial Sequence
  Synthetic oligonucleotide; GGG chr11 5286454 5286473 5286457 -
gactacaccatgtggagaag

SEQ ID NO: 41551 - DNA, 20 bp, Artificial Sequence
  Synthetic oligonucleotide; TGG chr11 5286451 5286470 5286454 -
tacaccatgtggagaagggg

SEQ ID NO: 41552 - DNA, 20 bp, Artificial Sequence
  Synthetic oligonucleotide; TGG chr11 5286448 5286467 5286451 -
accatgtggagaaggggtgg

SEQ ID NO: 41553 - DNA, 20 bp, Artificial Sequence
  Synthetic oligonucleotide; CAG chr11 5286426 5286445 5286429 -
gttttgattgctgctgtctt

SEQ ID NO: 41554 - DNA, 20 bp, Artificial Sequence
  Synthetic oligonucleotide; TAG chr11 5286422 5286441 5286425 -
tgattgctgctgtcttcagt

SEQ ID NO: 41555 - DNA, 20 bp, Artificial Sequence
  Synthetic oligonucleotide; TGG chr11 5286418 5286437 5286421 -
tgctgctgtcttcagttaga

SEQ ID NO: 41556 - DNA, 20 bp, Artificial Sequence
  Synthetic oligonucleotide; AAG chr11 5286404 5286423 5286407 -
gttagatggttaactttgtg

SEQ ID NO: 41557 - DNA, 20 bp, Artificial Sequence
  Synthetic oligonucleotide; TGG chr11 5286391 5286410 5286394 -
ctttgtgaagttgaaaactg

SEQ ID NO: 41558 - DNA, 20 bp, Artificial Sequence
  Synthetic oligonucleotide; TGG chr11 5286383 5286402 5286386 -
agttgaaaactgtggctctc

SEQ ID NO: 41559 - DNA, 20 bp, Artificial Sequence
  Synthetic oligonucleotide; TAG chr11 5286372 5286391 5286375 -
gtggctctctggttgactgt

SEQ ID NO: 41560 - DNA, 20 bp, Artificial Sequence
  Synthetic oligonucleotide; GAG chr11 5286370 5286389 5286373 -
ggctctctggttgactgtta

SEQ ID NO: 41561 - DNA, 20 bp, Artificial Sequence
  Synthetic oligonucleotide; TGG chr11 5286364 5286383 5286367 -
ctggttgactgttagagttc

SEQ ID NO: 41562 - DNA, 20 bp, Artificial Sequence
  Synthetic oligonucleotide; CAG chr11 5286318 5286337 5286321 -
taacaaatgcatgaatgctt

SEQ ID NO: 41563 - DNA, 20 bp, Artificial Sequence
  Synthetic oligonucleotide; TGG chr11 5286311 5286330 5286314 -
tgcatgaatgcttcagaata

SEQ ID NO: 41564 - DNA, 20 bp, Artificial Sequence
  Synthetic oligonucleotide; GGG chr11 5286310 5286329 5286313 -
gcatgaatgcttcagaatat

SEQ ID NO: 41565 - DNA, 20 bp, Artificial Sequence
  Synthetic oligonucleotide; TGG chr11 5286295 5286314 5286298 -
aatatgggaatattatcttc

SEQ ID NO: 41566 - DNA, 20 bp, Artificial Sequence
  Synthetic oligonucleotide; TAG chr11 5286290 5286309 5286293 -
gggaatattatcttctggaa

SEQ ID NO: 41567 - DNA, 20 bp, Artificial Sequence
  Synthetic oligonucleotide; AGG chr11 5286289 5286308 5286292 -
ggaatattatcttctggaat

SEQ ID NO: 41568 - DNA, 20 bp, Artificial Sequence
  Synthetic oligonucleotide; GGG chr11 5286288 5286307 5286291 -
gaatattatcttctggaata

SEQ ID NO: 41569 - DNA, 20 bp, Artificial Sequence
  Synthetic oligonucleotide; AAG chr11 5286281 5286300 5286284 -
atcttctggaatagggaatc

SEQ ID NO: 41570 - DNA, 20 bp, Artificial Sequence
  Synthetic oligonucleotide; CAG chr11 5286263 5286282 5286266 -
tcaagttatattatgtaacc

SEQ ID NO: 41571 - DNA, 20 bp, Artificial Sequence
  Synthetic oligonucleotide; AGG chr11 5286262 5286281 5286265 -
caagttatattatgtaaccc

SEQ ID NO: 41572 - DNA, 20 bp, Artificial Sequence
  Synthetic oligonucleotide; TAG chr11 5286257 5286276 5286260 -
tatattatgtaacccaggat

SEQ ID NO: 41573 - DNA, 20 bp, Artificial Sequence
  Synthetic oligonucleotide; AAG chr11 5286254 5286273 5286257 -
attatgtaacccaggattag

SEQ ID NO: 41574 - DNA, 20 bp, Artificial Sequence
  Synthetic oligonucleotide; AAG chr11 5286237 5286256 5286240 -
tagaagattcttctgtgtgt

SEQ ID NO: 41575 - DNA, 20 bp, Artificial Sequence
  Synthetic oligonucleotide; AAG chr11 5286219 5286238 5286222 -
gtaagaatttcataaacatt

SEQ ID NO: 41576 - DNA, 20 bp, Artificial Sequence
  Synthetic oligonucleotide; TAG chr11 5286211 5286230 5286214 -
ttcataaacattaagctgtc

SEQ ID NO: 41577 - DNA, 20 bp, Artificial Sequence
  Synthetic oligonucleotide; AAG chr11 5286205 5286224 5286208 -
aacattaagctgtctagcaa

SEQ ID NO: 41578 - DNA, 20 bp, Artificial Sequence
  Synthetic oligonucleotide; AAG chr11 5286201 5286220 5286204 -
ttaagctgtctagcaaaagc

SEQ ID NO: 41579 - DNA, 20 bp, Artificial Sequence
  Synthetic oligonucleotide; AGG chr11 5286200 5286219 5286203 -
taagctgtctagcaaaagca

SEQ ID NO: 41580 - DNA, 20 bp, Artificial Sequence
  Synthetic oligonucleotide; GGG chr11 5286199 5286218 5286202 -
aagctgtctagcaaaagcaa

SEQ ID NO: 41581 - DNA, 20 bp, Artificial Sequence
  Synthetic oligonucleotide; TGG chr11 5286194 5286213 5286197 -
gtctagcaaaagcaagggct

SEQ ID NO: 41582 - DNA, 20 bp, Artificial Sequence
  Synthetic oligonucleotide; GAG chr11 5286182 5286201 5286185 -
caagggcttggaaaatctgt

SEQ ID NO: 41583 - DNA, 20 bp, Artificial Sequence
  Synthetic oligonucleotide; TAG chr11 5286167 5286186 5286170 -
tctgtgagctcctcaccata

SEQ ID NO: 41584 - DNA, 20 bp, Artificial Sequence
  Synthetic oligonucleotide; AAG chr11 5286163 5286182 5286166 -
tgagctcctcaccatataga

SEQ ID NO: 41585 - DNA, 20 bp, Artificial Sequence
  Synthetic oligonucleotide; TAG chr11 5286131 5286150 5286134 -
catcattgaataaatcccta

SEQ ID NO: 41586 - DNA, 20 bp, Artificial Sequence
  Synthetic oligonucleotide; AGG chr11 5286130 5286149 5286133 -
atcattgaataaatccctat

SEQ ID NO: 41587 - DNA, 20 bp, Artificial Sequence
  Synthetic oligonucleotide; GGG chr11 5286129 5286148 5286132 -
tcattgaataaatccctata

SEQ ID NO: 41588 - DNA, 20 bp, Artificial Sequence
  Synthetic oligonucleotide; GGG chr11 5286128 5286147 5286131 -
cattgaataaatccctatag

SEQ ID NO: 41589 - DNA, 20 bp, Artificial Sequence
  Synthetic oligonucleotide; GAG chr11 5286114 5286133 5286117 -
ctataggggatttctaccct

SEQ ID NO: 41590 - DNA, 20 bp, Artificial Sequence
  Synthetic oligonucleotide; AAG chr11 5286108 5286127 5286111 -
gggatttctaccctgagcaa

SEQ ID NO: 41591 - DNA, 20 bp, Artificial Sequence
  Synthetic oligonucleotide; AGG chr11 5286107 5286126 5286110 -
ggatttctaccctgagcaaa

SEQ ID NO: 41592 - DNA, 20 bp, Artificial Sequence
  Synthetic oligonucleotide; TGG chr11 5286103 5286122 5286106 -
ttctaccctgagcaaaaggc

SEQ ID NO: 41593 - DNA, 20 bp, Artificial Sequence
  Synthetic oligonucleotide; TAG chr11 5286076 5286095 5286079 -
gattaattcccaaactcata

SEQ ID NO: 41594 - DNA, 20 bp, Artificial Sequence
  Synthetic oligonucleotide; GAG chr11 5286069 5286088 5286072 -
tcccaaactcatatagctct

SEQ ID NO: 41595 - DNA, 20 bp, Artificial Sequence
  Synthetic oligonucleotide; AAG chr11 5286065 5286084 5286068 -
aaactcatatagctctgaga

SEQ ID NO: 41596 - DNA, 20 bp, Artificial Sequence
  Synthetic oligonucleotide; CAG chr11 5286006 5286025 5286009 -
catatgcacaacaataaatg

SEQ ID NO: 41597 - DNA, 20 bp, Artificial Sequence
  Synthetic oligonucleotide; AGG chr11 5286005 5286024 5286008 -
atatgcacaacaataaatgc

SEQ ID NO: 41598 - DNA, 20 bp, Artificial Sequence
  Synthetic oligonucleotide; TAG chr11 5286000 5286019 5286003 -
cacaacaataaatgcaggcc

SEQ ID NO: 41599 - DNA, 20 bp, Artificial Sequence
  Synthetic oligonucleotide; AGG chr11 5285999 5286018 5286002 -
acaacaataaatgcaggcct

SEQ ID NO: 41600 - DNA, 20 bp, Artificial Sequence
  Synthetic oligonucleotide; AAG chr11 5285988 5286007 5285991 -
tgcaggcctaggcatgactg

SEQ ID NO: 41601 - DNA, 20 bp, Artificial Sequence
  Synthetic oligonucleotide; AGG chr11 5285987 5286006 5285990 -
gcaggcctaggcatgactga

SEQ ID NO: 41602 - DNA, 20 bp, Artificial Sequence
  Synthetic oligonucleotide; TGG chr11 5285969 5285988 5285972 -
gaaggctctctcataattct

SEQ ID NO: 41603 - DNA, 20 bp, Artificial Sequence
  Synthetic oligonucleotide; CAG chr11 5285956 5285975 5285959 -
taattcttggttgcatgaat

SEQ ID NO: 41604 - DNA, 20 bp, Artificial Sequence
  Synthetic oligonucleotide; CAG chr11 5285945 5285964 5285948 -
tgcatgaatcagattatcaa

SEQ ID NO: 41605 - DNA, 20 bp, Artificial Sequence
  Synthetic oligonucleotide; GAG chr11 5285935 5285954 5285938 -
agattatcaacagaaatgtt

SEQ ID NO: 41606 - DNA, 20 bp, Artificial Sequence
  Synthetic oligonucleotide; TGG chr11 5285924 5285943 5285927 -
agaaatgttgagacaaacta

SEQ ID NO: 41607 - DNA, 20 bp, Artificial Sequence
  Synthetic oligonucleotide; GGG chr11 5285923 5285942 5285926 -
gaaatgttgagacaaactat

SEQ ID NO: 41608 - DNA, 20 bp, Artificial Sequence
  Synthetic oligonucleotide; GGG chr11 5285922 5285941 5285925 -
aaatgttgagacaaactatg

SEQ ID NO: 41609 - DNA, 20 bp, Artificial Sequence
  Synthetic oligonucleotide; AAG chr11 5285919 5285938 5285922 -
tgttgagacaaactatgggg

SEQ ID NO: 41610 - DNA, 20 bp, Artificial Sequence
  Synthetic oligonucleotide; CAG chr11 5285916 5285935 5285919 -
tgagacaaactatggggaag

SEQ ID NO: 41611 - DNA, 20 bp, Artificial Sequence
  Synthetic oligonucleotide; AGG chr11 5285915 5285934 5285918 -
gagacaaactatggggaagc

SEQ ID NO: 41612 - DNA, 20 bp, Artificial Sequence
  Synthetic oligonucleotide; GGG chr11 5285914 5285933 5285917 -
agacaaactatggggaagca

SEQ ID NO: 41613 - DNA, 20 bp, Artificial Sequence
  Synthetic oligonucleotide; AAG chr11 5285906 5285925 5285909 -
tatggggaagcagggtatga

SEQ ID NO: 41614 - DNA, 20 bp, Artificial Sequence
  Synthetic oligonucleotide; GAG chr11 5285904 5285923 5285907 -
tggggaagcagggtatgaaa

SEQ ID NO: 41615 - DNA, 20 bp, Artificial Sequence
  Synthetic oligonucleotide; TGG chr11 5285889 5285908 5285892 -
tgaaagagctctgaatgaaa

SEQ ID NO: 41616 - DNA, 20 bp, Artificial Sequence
  Synthetic oligonucleotide; CAG chr11 5285862 5285881 5285865 -
cgcaatgcttcctgcccatt

SEQ ID NO: 41617 - DNA, 20 bp, Artificial Sequence
  Synthetic oligonucleotide; AGG chr11 5285861 5285880 5285864 -
gcaatgcttcctgcccattc

SEQ ID NO: 41618 - DNA, 20 bp, Artificial Sequence
  Synthetic oligonucleotide; GGG chr11 5285860 5285879 5285863 -
caatgcttcctgcccattca

SEQ ID NO: 41619 - DNA, 20 bp, Artificial Sequence
  Synthetic oligonucleotide; CAG chr11 5285854 5285873 5285857 -
ttcctgcccattcagggctc

SEQ ID NO: 41620 - DNA, 20 bp, Artificial Sequence
  Synthetic oligonucleotide; TAG chr11 5285847 5285866 5285850 -
ccattcagggctccagcatg

SEQ ID NO: 41621 - DNA, 20 bp, Artificial Sequence
  Synthetic oligonucleotide; TGG chr11 5285839 5285858 5285842 -
ggctccagcatgtagaaatc

SEQ ID NO: 41622 - DNA, 20 bp, Artificial Sequence
  Synthetic oligonucleotide; GGG chr11 5285838 5285857 5285841 -
gctccagcatgtagaaatct

SEQ ID NO: 41623 - DNA, 20 bp, Artificial Sequence
  Synthetic oligonucleotide; GGG chr11 5285837 5285856 5285840 -
ctccagcatgtagaaatctg

SEQ ID NO: 41624 - DNA, 20 bp, Artificial Sequence
  Synthetic oligonucleotide; AAG chr11 5285827 5285846 5285830 -
tagaaatctggggctttgtg

SEQ ID NO: 41625 - DNA, 20 bp, Artificial Sequence
  Synthetic oligonucleotide; TGG chr11 5285822 5285841 5285825 -
atctggggctttgtgaagac

SEQ ID NO: 41626 - DNA, 20 bp, Artificial Sequence
  Synthetic oligonucleotide; CAG chr11 5285811 5285830 5285814 -
tgtgaagactggcttaaaat

SEQ ID NO: 41627 - DNA, 20 bp, Artificial Sequence
  Synthetic oligonucleotide; AAG chr11 5285808 5285827 5285811 -
gaagactggcttaaaatcag

SEQ ID NO: 41628 - DNA, 20 bp, Artificial Sequence
  Synthetic oligonucleotide; TGG chr11 5285799 5285818 5285802 -
cttaaaatcagaagccccat

SEQ ID NO: 41629 - DNA, 20 bp, Artificial Sequence
  Synthetic oligonucleotide; AAG chr11 5285794 5285813 5285797 -
aatcagaagccccattggat

SEQ ID NO: 41630 - DNA, 20 bp, Artificial Sequence
  Synthetic oligonucleotide; GAG chr11 5285792 5285811 5285795 -
tcagaagccccattggataa

SEQ ID NO: 41631 - DNA, 20 bp, Artificial Sequence
  Synthetic oligonucleotide; TAG chr11 5285789 5285808 5285792 -
gaagccccattggataagag

SEQ ID NO: 41632 - DNA, 20 bp, Artificial Sequence
  Synthetic oligonucleotide; AGG chr11 5285788 5285807 5285791 -
aagccccattggataagagt

SEQ ID NO: 41633 - DNA, 20 bp, Artificial Sequence
  Synthetic oligonucleotide; GGG chr11 5285787 5285806 5285790 -
agccccattggataagagta

SEQ ID NO: 41634 - DNA, 20 bp, Artificial Sequence
  Synthetic oligonucleotide; AAG chr11 5285784 5285803 5285787 -
cccattggataagagtaggg

SEQ ID NO: 41635 - DNA, 20 bp, Artificial Sequence
  Synthetic oligonucleotide; TAG chr11 5285777 5285796 5285780 -
gataagagtagggaagaacc

SEQ ID NO: 41636 - DNA, 20 bp, Artificial Sequence
  Synthetic oligonucleotide; GAG chr11 5285775 5285794 5285778 -
taagagtagggaagaaccta

SEQ ID NO: 41637 - DNA, 20 bp, Artificial Sequence
  Synthetic oligonucleotide; GAG chr11 5285764 5285783 5285767 -
aagaacctagagcctacgct

SEQ ID NO: 41638 - DNA, 20 bp, Artificial Sequence
  Synthetic oligonucleotide; CAG chr11 5285761 5285780 5285764 -
aacctagagcctacgctgag

SEQ ID NO: 41639 - DNA, 20 bp, Artificial Sequence
  Synthetic oligonucleotide; AGG chr11 5285760 5285779 5285763 -
acctagagcctacgctgagc

SEQ ID NO: 41640 - DNA, 20 bp, Artificial Sequence
  Synthetic oligonucleotide; CAG chr11 5285743 5285762 5285746 -
agcaggtttccttcatgtga

SEQ ID NO: 41641 - DNA, 20 bp, Artificial Sequence
  Synthetic oligonucleotide; AGG chr11 5285742 5285761 5285745 -
gcaggtttccttcatgtgac

SEQ ID NO: 41642 - DNA, 20 bp, Artificial Sequence
  Synthetic oligonucleotide; GGG chr11 5285741 5285760 5285744 -
caggtttccttcatgtgaca

SEQ ID NO: 41643 - DNA, 20 bp, Artificial Sequence
  Synthetic oligonucleotide; GAG chr11 5285739 5285758 5285742 -
ggtttccttcatgtgacagg

SEQ ID NO: 41644 - DNA, 20 bp, Artificial Sequence
  Synthetic oligonucleotide; CAG chr11 5285718 5285737 5285721 -
agcctcctgccccgaacttc

SEQ ID NO: 41645 - DNA, 20 bp, Artificial Sequence
  Synthetic oligonucleotide; AGG chr11 5285717 5285736 5285720 -
gcctcctgccccgaacttcc

SEQ ID NO: 41646 - DNA, 20 bp, Artificial Sequence
  Synthetic oligonucleotide; GGG chr11 5285716 5285735 5285719 -
cctcctgccccgaacttcca

SEQ ID NO: 41647 - DNA, 20 bp, Artificial Sequence
  Synthetic oligonucleotide; AAG chr11 5285703 5285722 5285706 -
acttccagggatcctctctt

SEQ ID NO: 41648 - DNA, 20 bp, Artificial Sequence
  Synthetic oligonucleotide; TGG chr11 5285690 5285709 5285693 -
ctctcttaagtgtttcctgc

SEQ ID NO: 41649 - DNA, 20 bp, Artificial Sequence
  Synthetic oligonucleotide; TGG chr11 5285669 5285688 5285672 -
ggaatctcctcacttctatc

SEQ ID NO: 41650 - DNA, 20 bp, Artificial Sequence
  Synthetic oligonucleotide; TGG chr11 5285663 5285682 5285666 -
tcctcacttctatctggaaa

SEQ ID NO: 41651 - DNA, 20 bp, Artificial Sequence
  Synthetic oligonucleotide; CAG chr11 5285652 5285671 5285655 -
atctggaaatggtttctcca

SEQ ID NO: 41652 - DNA, 20 bp, Artificial Sequence
  Synthetic oligonucleotide; CAG chr11 5285647 5285666 5285650 -
gaaatggtttctccacagtc

SEQ ID NO: 41653 - DNA, 20 bp, Artificial Sequence
  Synthetic oligonucleotide; TGG chr11 5285640 5285659 5285643 -
tttctccacagtccagcccc

SEQ ID NO: 41654 - DNA, 20 bp, Artificial Sequence
  Synthetic oligonucleotide; TAG chr11 5285636 5285655 5285639 -
tccacagtccagcccctggc

SEQ ID NO: 41655 - DNA, 20 bp, Artificial Sequence
  Synthetic oligonucleotide; AAG chr11 5285629 5285648 5285632 -
tccagcccctggctagttga

SEQ ID NO: 41656 - DNA, 20 bp, Artificial Sequence
  Synthetic oligonucleotide; GAG chr11 5285627 5285646 5285630 -
cagcccctggctagttgaaa

SEQ ID NO: 41657 - DNA, 20 bp, Artificial Sequence
  Synthetic oligonucleotide; CAG chr11 5285615 5285634 5285618 -
agttgaaagagttacccatg

SEQ ID NO: 41658 - DNA, 20 bp, Artificial Sequence
  Synthetic oligonucleotide; GAG chr11 5285613 5285632 5285616 -
ttgaaagagttacccatgca

SEQ ID NO: 41659 - DNA, 20 bp, Artificial Sequence
  Synthetic oligonucleotide; AGG chr11 5285612 5285631 5285615 -
tgaaagagttacccatgcag

SEQ ID NO: 41660 - DNA, 20 bp, Artificial Sequence
  Synthetic oligonucleotide; TAG chr11 5285603 5285622 5285606 -
tacccatgcagaggccctcc

SEQ ID NO: 41661 - DNA, 20 bp, Artificial Sequence
  Synthetic oligonucleotide; CAG chr11 5285596 5285615 5285599 -
gcagaggccctcctagcatc

SEQ ID NO: 41662 - DNA, 20 bp, Artificial Sequence
  Synthetic oligonucleotide; GAG chr11 5285594 5285613 5285597 -
agaggccctcctagcatcca

SEQ ID NO: 41663 - DNA, 20 bp, Artificial Sequence
  Synthetic oligonucleotide; TAG chr11 5285589 5285608 5285592 -
ccctcctagcatccagagac

SEQ ID NO: 41664 - DNA, 20 bp, Artificial Sequence
  Synthetic oligonucleotide; TAG chr11 5285582 5285601 5285585 -
agcatccagagactagtgct

SEQ ID NO: 41665 - DNA, 20 bp, Artificial Sequence
  Synthetic oligonucleotide; CAG chr11 5285568 5285587 5285571 -
agtgcttagattcctacttt

SEQ ID NO: 41666 - DNA, 20 bp, Artificial Sequence
  Synthetic oligonucleotide; TGG chr11 5285562 5285581 5285565 -
tagattcctactttcagcgt

SEQ ID NO: 41667 - DNA, 20 bp, Artificial Sequence
  Synthetic oligonucleotide; TGG chr11 5285553 5285572 5285556 -
actttcagcgttggacaacc

SEQ ID NO: 41668 - DNA, 20 bp, Artificial Sequence
  Synthetic oligonucleotide; CAG chr11 5285539 5285558 5285542 -
acaacctggatccacttgcc

SEQ ID NO: 41669 - DNA, 20 bp, Artificial Sequence
  Synthetic oligonucleotide; TAG chr11 5285526 5285545 5285529 -
acttgcccagtgttcttcct

SEQ ID NO: 41670 - DNA, 20 bp, Artificial Sequence
  Synthetic oligonucleotide; GAG chr11 5285477 5285496 5285480 -
ttatcttcctgaaccctgct

SEQ ID NO: 41671 - DNA, 20 bp, Artificial Sequence
  Synthetic oligonucleotide; TGG chr11 5285464 5285483 5285467 -
ccctgctgagatgatctatg

SEQ ID NO: 41672 - DNA, 20 bp, Artificial Sequence
  Synthetic oligonucleotide; GGG chr11 5285463 5285482 5285466 -
cctgctgagatgatctatgt

SEQ ID NO: 41673 - DNA, 20 bp, Artificial Sequence
  Synthetic oligonucleotide; GGG chr11 5285462 5285481 5285465 -
ctgctgagatgatctatgtg

SEQ ID NO: 41674 - DNA, 20 bp, Artificial Sequence
  Synthetic oligonucleotide; GAG chr11 5285460 5285479 5285463 -
gctgagatgatctatgtggg

SEQ ID NO: 41675 - DNA, 20 bp, Artificial Sequence
  Synthetic oligonucleotide; TGG chr11 5285455 5285474 5285458 -
gatgatctatgtggggagaa

SEQ ID NO: 41676 - DNA, 20 bp, Artificial Sequence
  Synthetic oligonucleotide; GAG chr11 5285445 5285464 5285448 -
gtggggagaatggcttcttt

SEQ ID NO: 41677 - DNA, 20 bp, Artificial Sequence
  Synthetic oligonucleotide; TAG chr11 5285427 5285446 5285430 -
ttgagaaacatcttcttcgt

SEQ ID NO: 41678 - DNA, 20 bp, Artificial Sequence
  Synthetic oligonucleotide; TGG chr11 5285424 5285443 5285427 -
agaaacatcttcttcgttag

SEQ ID NO: 41679 - DNA, 20 bp, Artificial Sequence
  Synthetic oligonucleotide; CAG chr11 5285394 5285413 5285397 -
ctcattcccactttaatatc

SEQ ID NO: 41680 - DNA, 20 bp, Artificial Sequence
  Synthetic oligonucleotide; AAG chr11 5285382 5285401 5285385 -
ttaatatccagaatcactat

SEQ ID NO: 41681 - DNA, 20 bp, Artificial Sequence
  Synthetic oligonucleotide; AAG chr11 5285379 5285398 5285382 -
atatccagaatcactataag

SEQ ID NO: 41682 - DNA, 20 bp, Artificial Sequence
  Synthetic oligonucleotide; AAG chr11 5285368 5285387 5285371 -
cactataagaagaatataat

SEQ ID NO: 41683 - DNA, 20 bp, Artificial Sequence
  Synthetic oligonucleotide; GAG chr11 5285366 5285385 5285369 -
ctataagaagaatataataa

SEQ ID NO: 41684 - DNA, 20 bp, Artificial Sequence
  Synthetic oligonucleotide; AGG chr11 5285365 5285384 5285368 -
tataagaagaatataataag

SEQ ID NO: 41685 - DNA, 20 bp, Artificial Sequence
  Synthetic oligonucleotide; TAG chr11 5285348 5285367 5285351 -
aagaggaataactcttatta

SEQ ID NO: 41686 - DNA, 20 bp, Artificial Sequence
  Synthetic oligonucleotide; AGG chr11 5285347 5285366 5285350 -
agaggaataactcttattat

SEQ ID NO: 41687 - DNA, 20 bp, Artificial Sequence
  Synthetic oligonucleotide; AAG chr11 5285343 5285362 5285346 -
gaataactcttattataggt

SEQ ID NO: 41688 - DNA, 20 bp, Artificial Sequence
  Synthetic oligonucleotide; AGG chr11 5285342 5285361 5285345 -
aataactcttattataggta

SEQ ID NO: 41689 - DNA, 20 bp, Artificial Sequence
  Synthetic oligonucleotide; GGG chr11 5285341 5285360 5285344 -
ataactcttattataggtaa

SEQ ID NO: 41690 - DNA, 20 bp, Artificial Sequence
  Synthetic oligonucleotide; AAG chr11 5285332 5285351 5285335 -
attataggtaagggaaaatt

SEQ ID NO: 41691 - DNA, 20 bp, Artificial Sequence
  Synthetic oligonucleotide; GAG chr11 5285330 5285349 5285333 -
tataggtaagggaaaattaa

SEQ ID NO: 41692 - DNA, 20 bp, Artificial Sequence
  Synthetic oligonucleotide; AGG chr11 5285329 5285348 5285332 -
ataggtaagggaaaattaag

SEQ ID NO: 41693 - DNA, 20 bp, Artificial Sequence
  Synthetic oligonucleotide; TGG chr11 5285317 5285336 5285320 -
aaattaagaggcatacgtga

SEQ ID NO: 41694 - DNA, 20 bp, Artificial Sequence
  Synthetic oligonucleotide; GGG chr11 5285316 5285335 5285319 -
aattaagaggcatacgtgat

SEQ ID NO: 41695 - DNA, 20 bp, Artificial Sequence
  Synthetic oligonucleotide; GAG chr11 5285311 5285330 5285314 -
agaggcatacgtgatgggat

SEQ ID NO: 41696 - DNA, 20 bp, Artificial Sequence
  Synthetic oligonucleotide; AAG chr11 5285307 5285326 5285310 -
gcatacgtgatgggatgagt

SEQ ID NO: 41697 - DNA, 20 bp, Artificial Sequence
  Synthetic oligonucleotide; GAG chr11 5285305 5285324 5285308 -
atacgtgatgggatgagtaa

SEQ ID NO: 41698 - DNA, 20 bp, Artificial Sequence
  Synthetic oligonucleotide; GAG chr11 5285303 5285322 5285306 -
acgtgatgggatgagtaaga

SEQ ID NO: 41699 - DNA, 20 bp, Artificial Sequence
  Synthetic oligonucleotide; AGG chr11 5285302 5285321 5285305 -
cgtgatgggatgagtaagag

SEQ ID NO: 41700 - DNA, 20 bp, Artificial Sequence
  Synthetic oligonucleotide; GAG chr11 5285300 5285319 5285303 -
tgatgggatgagtaagagag

SEQ ID NO: 41701 - DNA, 20 bp, Artificial Sequence
  Synthetic oligonucleotide; GAG chr11 5285298 5285317 5285301 -
atgggatgagtaagagagga

SEQ ID NO: 41702 - DNA, 20 bp, Artificial Sequence
  Synthetic oligonucleotide; AGG chr11 5285297 5285316 5285300 -
tgggatgagtaagagaggag

SEQ ID NO: 41703 - DNA, 20 bp, Artificial Sequence
  Synthetic oligonucleotide; GGG chr11 5285296 5285315 5285299 -
gggatgagtaagagaggaga

SEQ ID NO: 41704 - DNA, 20 bp, Artificial Sequence
  Synthetic oligonucleotide; AAG chr11 5285293 5285312 5285296 -
atgagtaagagaggagaggg

SEQ ID NO: 41705 - DNA, 20 bp, Artificial Sequence
  Synthetic oligonucleotide; AGG chr11 5285292 5285311 5285295 -
tgagtaagagaggagaggga

SEQ ID NO: 41706 - DNA, 20 bp, Artificial Sequence
  Synthetic oligonucleotide; TGG chr11 5285284 5285303 5285287 -
agaggagagggaaggattaa

SEQ ID NO: 41707 - DNA, 20 bp, Artificial Sequence
  Synthetic oligonucleotide; GAG chr11 5285256 5285275 5285259 -
aaaatctactactatttgtt

SEQ ID NO: 41708 - DNA, 20 bp, Artificial Sequence
  Synthetic oligonucleotide; TAG chr11 5285245 5285264 5285248 -
ctatttgttgagacctttta

SEQ ID NO: 41709 - DNA, 20 bp, Artificial Sequence
  Synthetic oligonucleotide; AAG chr11 5285161 5285180 5285164 -
tatctttattttgccatgac

SEQ ID NO: 41710 - DNA, 20 bp, Artificial Sequence
  Synthetic oligonucleotide; GAG chr11 5285155 5285174 5285158 -
tattttgccatgacaagact

SEQ ID NO: 41711 - DNA, 20 bp, Artificial Sequence
  Synthetic oligonucleotide; CAG chr11 5285150 5285169 5285153 -
tgccatgacaagactgagct

SEQ ID NO: 41712 - DNA, 20 bp, Artificial Sequence
  Synthetic oligonucleotide; AAG chr11 5285147 5285166 5285150 -
catgacaagactgagctcag

SEQ ID NO: 41713 - DNA, 20 bp, Artificial Sequence
  Synthetic oligonucleotide; GAG chr11 5285145 5285164 5285148 -
tgacaagactgagctcagaa

SEQ ID NO: 41714 - DNA, 20 bp, Artificial Sequence
  Synthetic oligonucleotide; AAG chr11 5285140 5285159 5285143 -
agactgagctcagaagagtc

SEQ ID NO: 41715 - DNA, 20 bp, Artificial Sequence
  Synthetic oligonucleotide; AAG chr11 5285128 5285147 5285131 -
gaagagtcaagcatttgcct

SEQ ID NO: 41716 - DNA, 20 bp, Artificial Sequence
  Synthetic oligonucleotide; AGG chr11 5285127 5285146 5285130 -
aagagtcaagcatttgccta

SEQ ID NO: 41717 - DNA, 20 bp, Artificial Sequence
  Synthetic oligonucleotide; CGG chr11 5285123 5285142 5285126 -
gtcaagcatttgcctaaggt

SEQ ID NO: 41718 - DNA, 20 bp, Artificial Sequence
  Synthetic oligonucleotide; CAG chr11 5285114 5285133 5285117 -
ttgcctaaggtcggacatgt

SEQ ID NO: 41719 - DNA, 20 bp, Artificial Sequence
  Synthetic oligonucleotide; GAG chr11 5285112 5285131 5285115 -
gcctaaggtcggacatgtca

SEQ ID NO: 41720 - DNA, 20 bp, Artificial Sequence
  Synthetic oligonucleotide; AGG chr11 5285111 5285130 5285114 -
cctaaggtcggacatgtcag

SEQ ID NO: 41721 - DNA, 20 bp, Artificial Sequence
  Synthetic oligonucleotide; CAG chr11 5285108 5285127 5285111 -
aaggtcggacatgtcagagg

SEQ ID NO: 41722 - DNA, 20 bp, Artificial Sequence
  Synthetic oligonucleotide; CAG chr11 5285102 5285121 5285105 -
ggacatgtcagaggcagtgc

SEQ ID NO: 41723 - DNA, 20 bp, Artificial Sequence
  Synthetic oligonucleotide; GAG chr11 5285091 5285110 5285094 -
aggcagtgccagacctatgt

SEQ ID NO: 41724 - DNA, 20 bp, Artificial Sequence
  Synthetic oligonucleotide; CAG chr11 5285082 5285101 5285085 -
cagacctatgtgagactctg

SEQ ID NO: 41725 - DNA, 20 bp, Artificial Sequence
  Synthetic oligonucleotide; TGG chr11 5285069 5285088 5285072 -
gactctgcagctactgctca

SEQ ID NO: 41726 - DNA, 20 bp, Artificial Sequence
  Synthetic oligonucleotide; GGG chr11 5285068 5285087 5285071 -
actctgcagctactgctcat

SEQ ID NO: 41727 - DNA, 20 bp, Artificial Sequence
  Synthetic oligonucleotide; GAG chr11 5285048 5285067 5285051 -
gggccctgtgctgcactgat

SEQ ID NO: 41728 - DNA, 20 bp, Artificial Sequence
  Synthetic oligonucleotide; AGG chr11 5285047 5285066 5285050 -
ggccctgtgctgcactgatg

SEQ ID NO: 41729 - DNA, 20 bp, Artificial Sequence
  Synthetic oligonucleotide; GAG chr11 5285045 5285064 5285048 -
ccctgtgctgcactgatgag

SEQ ID NO: 41730 - DNA, 20 bp, Artificial Sequence
  Synthetic oligonucleotide; AGG chr11 5285044 5285063 5285047 -
cctgtgctgcactgatgagg

SEQ ID NO: 41731 - DNA, 20 bp, Artificial Sequence
  Synthetic oligonucleotide; CAG chr11 5285039 5285058 5285042 -
gctgcactgatgaggaggat

SEQ ID NO: 41732 - DNA, 20 bp, Artificial Sequence
  Synthetic oligonucleotide; TGG chr11 5285035 5285054 5285038 -
cactgatgaggaggatcaga

SEQ ID NO: 41733 - DNA, 20 bp, Artificial Sequence
  Synthetic oligonucleotide; TGG chr11 5285031 5285050 5285034 -
gatgaggaggatcagatgga

SEQ ID NO: 41734 - DNA, 20 bp, Artificial Sequence
  Synthetic oligonucleotide; GGG chr11 5285030 5285049 5285033 -
atgaggaggatcagatggat

SEQ ID NO: 41735 - DNA, 20 bp, Artificial Sequence
  Synthetic oligonucleotide; GGG chr11 5285029 5285048 5285032 -
tgaggaggatcagatggatg

SEQ ID NO: 41736 - DNA, 20 bp, Artificial Sequence
  Synthetic oligonucleotide; AAG chr11 5285021 5285040 5285024 -
atcagatggatggggcaatg

SEQ ID NO: 41737 - DNA, 20 bp, Artificial Sequence
  Synthetic oligonucleotide; AAG chr11 5285016 5285035 5285019 -
atggatggggcaatgaagca

SEQ ID NO: 41738 - DNA, 20 bp, Artificial Sequence
  Synthetic oligonucleotide; AGG chr11 5285015 5285034 5285018 -
tggatggggcaatgaagcaa

SEQ ID NO: 41739 - DNA, 20 bp, Artificial Sequence
  Synthetic oligonucleotide; TGG chr11 5285002 5285021 5285005 -
gaagcaaaggaatcattctg

SEQ ID NO: 41740 - DNA, 20 bp, Artificial Sequence
  Synthetic oligonucleotide; AAG chr11 5284996 5285015 5284999 -
aaggaatcattctgtggata

SEQ ID NO: 41741 - DNA, 20 bp, Artificial Sequence
  Synthetic oligonucleotide; AGG chr11 5284995 5285014 5284998 -
aggaatcattctgtggataa

SEQ ID NO: 41742 - DNA, 20 bp, Artificial Sequence
  Synthetic oligonucleotide; GAG chr11 5284993 5285012 5284996 -
gaatcattctgtggataaag

SEQ ID NO: 41743 - DNA, 20 bp, Artificial Sequence
  Synthetic oligonucleotide; CAG chr11 5284989 5285008 5284992 -
cattctgtggataaaggaga

SEQ ID NO: 41744 - DNA, 20 bp, Artificial Sequence
  Synthetic oligonucleotide; AAG chr11 5284981 5285000 5284984 -
ggataaaggagacagccatg

SEQ ID NO: 41745 - DNA, 20 bp, Artificial Sequence
  Synthetic oligonucleotide; AAG chr11 5284978 5284997 5284981 -
taaaggagacagccatgaag

SEQ ID NO: 41746 - DNA, 20 bp, Artificial Sequence
  Synthetic oligonucleotide; TGG chr11 5284959 5284978 5284962 -
gaagtctatgactgtaaatt

SEQ ID NO: 41747 - DNA, 20 bp, Artificial Sequence
  Synthetic oligonucleotide; GGG chr11 5284958 5284977 5284961 -
aagtctatgactgtaaattt

SEQ ID NO: 41748 - DNA, 20 bp, Artificial Sequence
  Synthetic oligonucleotide; GAG chr11 5284956 5284975 5284959 -
gtctatgactgtaaatttgg

SEQ ID NO: 41749 - DNA, 20 bp, Artificial Sequence
  Synthetic oligonucleotide; CAG chr11 5284953 5284972 5284956 -
tatgactgtaaatttgggag

SEQ ID NO: 41750 - DNA, 20 bp, Artificial Sequence
  Synthetic oligonucleotide; AGG chr11 5284952 5284971 5284955 -
atgactgtaaatttgggagc

SEQ ID NO: 41751 - DNA, 20 bp, Artificial Sequence
  Synthetic oligonucleotide; GAG chr11 5284950 5284969 5284953 -
gactgtaaatttgggagcag

SEQ ID NO: 41752 - DNA, 20 bp, Artificial Sequence
  Synthetic oligonucleotide; AAG chr11 5284942 5284961 5284945 -
atttgggagcaggagtctct

SEQ ID NO: 41753 - DNA, 20 bp, Artificial Sequence
  Synthetic oligonucleotide; AGG chr11 5284941 5284960 5284944 -
tttgggagcaggagtctcta

SEQ ID NO: 41754 - DNA, 20 bp, Artificial Sequence
  Synthetic oligonucleotide; TGG chr11 5284935 5284954 5284938 -
agcaggagtctctaaggact

SEQ ID NO: 41755 - DNA, 20 bp, Artificial Sequence
  Synthetic oligonucleotide; AAG chr11 5284927 5284946 5284930 -
tctctaaggacttggatttc

SEQ ID NO: 41756 - DNA, 20 bp, Artificial Sequence
  Synthetic oligonucleotide; AGG chr11 5284926 5284945 5284929 -
ctctaaggacttggatttca

SEQ ID NO: 41757 - DNA, 20 bp, Artificial Sequence
  Synthetic oligonucleotide; CAG chr11 5284913 5284932 5284916 -
gatttcaaggaattttgact

SEQ ID NO: 41758 - DNA, 20 bp, Artificial Sequence
  Synthetic oligonucleotide; AAG chr11 5284903 5284922 5284906 -
aattttgactcagcaaacac

SEQ ID NO: 41759 - DNA, 20 bp, Artificial Sequence
  Synthetic oligonucleotide; CGG chr11 5284893 5284912 5284896 -
cagcaaacacaagaccctca

SEQ ID NO: 41760 - DNA, 20 bp, Artificial Sequence
  Synthetic oligonucleotide; GAG chr11 5284881 5284900 5284884 -
gaccctcacggtgactttgc

SEQ ID NO: 41761 - DNA, 20 bp, Artificial Sequence
  Synthetic oligonucleotide; TGG chr11 5284877 5284896 5284880 -
ctcacggtgactttgcgagc

SEQ ID NO: 41762 - DNA, 20 bp, Artificial Sequence
  Synthetic oligonucleotide; CAG chr11 5284869 5284888 5284872 -
gactttgcgagctggtgtgc

SEQ ID NO: 41763 - DNA, 20 bp, Artificial Sequence
  Synthetic oligonucleotide; CAG chr11 5284856 5284875 5284859 -
ggtgtgccagatgtgtctat

SEQ ID NO: 41764 - DNA, 20 bp, Artificial Sequence
  Synthetic oligonucleotide; GAG chr11 5284854 5284873 5284857 -
tgtgccagatgtgtctatca

SEQ ID NO: 41765 - DNA, 20 bp, Artificial Sequence
  Synthetic oligonucleotide; AGG chr11 5284853 5284872 5284856 -
gtgccagatgtgtctatcag

SEQ ID NO: 41766 - DNA, 20 bp, Artificial Sequence
  Synthetic oligonucleotide; CAG chr11 5284847 5284866 5284850 -
gatgtgtctatcagaggttc

SEQ ID NO: 41767 - DNA, 20 bp, Artificial Sequence
  Synthetic oligonucleotide; AGG chr11 5284846 5284865 5284849 -
atgtgtctatcagaggttcc

SEQ ID NO: 41768 - DNA, 20 bp, Artificial Sequence
  Synthetic oligonucleotide; GGG chr11 5284845 5284864 5284848 -
tgtgtctatcagaggttcca

SEQ ID NO: 41769 - DNA, 20 bp, Artificial Sequence
  Synthetic oligonucleotide; GAG chr11 5284843 5284862 5284846 -
tgtctatcagaggttccagg

SEQ ID NO: 41770 - DNA, 20 bp, Artificial Sequence
  Synthetic oligonucleotide; AGG chr11 5284842 5284861 5284845 -
gtctatcagaggttccaggg

SEQ ID NO: 41771 - DNA, 20 bp, Artificial Sequence
  Synthetic oligonucleotide; GGG chr11 5284841 5284860 5284844 -
tctatcagaggttccaggga

SEQ ID NO: 41772 - DNA, 20 bp, Artificial Sequence
  Synthetic oligonucleotide; TGG chr11 5284838 5284857 5284841 -
atcagaggttccagggaggg

SEQ ID NO: 41773 - DNA, 20 bp, Artificial Sequence
  Synthetic oligonucleotide; GGG chr11 5284837 5284856 5284840 -
tcagaggttccagggagggt

SEQ ID NO: 41774 - DNA, 20 bp, Artificial Sequence
  Synthetic oligonucleotide; GGG chr11 5284836 5284855 5284839 -
cagaggttccagggagggtg

SEQ ID NO: 41775 - DNA, 20 bp, Artificial Sequence
  Synthetic oligonucleotide; TGG chr11 5284833 5284852 5284836 -
aggttccagggagggtgggg

SEQ ID NO: 41776 - DNA, 20 bp, Artificial Sequence
  Synthetic oligonucleotide; GGG chr11 5284832 5284851 5284835 -
ggttccagggagggtggggt

SEQ ID NO: 41777 - DNA, 20 bp, Artificial Sequence
  Synthetic oligonucleotide; GGG chr11 5284831 5284850 5284834 -
gttccagggagggtggggtg

SEQ ID NO: 41778 - DNA, 20 bp, Artificial Sequence
  Synthetic oligonucleotide; CAG chr11 5284827 5284846 5284830 -
cagggagggtggggtggggt

SEQ ID NO: 41779 - DNA, 20 bp, Artificial Sequence
  Synthetic oligonucleotide; AGG chr11 5284826 5284845 5284829 -
agggagggtggggtggggtc

SEQ ID NO: 41780 - DNA, 20 bp, Artificial Sequence
  Synthetic oligonucleotide; GGG chr11 5284825 5284844 5284828 -
gggagggtggggtggggtca

SEQ ID NO: 41781 - DNA, 20 bp, Artificial Sequence
  Synthetic oligonucleotide; TGG chr11 5284821 5284840 5284824 -
gggtggggtggggtcagggc

SEQ ID NO: 41782 - DNA, 20 bp, Artificial Sequence
  Synthetic oligonucleotide; CAG chr11 5284814 5284833 5284817 -
gtggggtcagggctggccac

SEQ ID NO: 41783 - DNA, 20 bp, Artificial Sequence
  Synthetic oligonucleotide; CAG chr11 5284807 5284826 5284810 -
cagggctggccaccagctat

SEQ ID NO: 41784 - DNA, 20 bp, Artificial Sequence
  Synthetic oligonucleotide; AGG chr11 5284806 5284825 5284809 -
agggctggccaccagctatc

SEQ ID NO: 41785 - DNA, 20 bp, Artificial Sequence
  Synthetic oligonucleotide; GGG chr11 5284805 5284824 5284808 -
gggctggccaccagctatca

SEQ ID NO: 41786 - DNA, 20 bp, Artificial Sequence
  Synthetic oligonucleotide; CAG chr11 5284800 5284819 5284803 -
ggccaccagctatcagggcc

SEQ ID NO: 41787 - DNA, 20 bp, Artificial Sequence
  Synthetic oligonucleotide; TGG chr11 5284796 5284815 5284799 -
accagctatcagggcccaga

SEQ ID NO: 41788 - DNA, 20 bp, Artificial Sequence
  Synthetic oligonucleotide; GGG chr11 5284795 5284814 5284798 -
ccagctatcagggcccagat

SEQ ID NO: 41789 - DNA, 20 bp, Artificial Sequence
  Synthetic oligonucleotide; TAG chr11 5284789 5284808 5284792 -
atcagggcccagatgggtta

SEQ ID NO: 41790 - DNA, 20 bp, Artificial Sequence
  Synthetic oligonucleotide; AGG chr11 5284788 5284807 5284791 -
tcagggcccagatgggttat

SEQ ID NO: 41791 - DNA, 20 bp, Artificial Sequence
  Synthetic oligonucleotide; TGG chr11 5284784 5284803 5284787 -
ggcccagatgggttataggc

SEQ ID NO: 41792 - DNA, 20 bp, Artificial Sequence
  Synthetic oligonucleotide; CAG chr11 5284781 5284800 5284784 -
ccagatgggttataggctgg

SEQ ID NO: 41793 - DNA, 20 bp, Artificial Sequence
  Synthetic oligonucleotide; AGG chr11 5284780 5284799 5284783 -
cagatgggttataggctggc

SEQ ID NO: 41794 - DNA, 20 bp, Artificial Sequence
  Synthetic oligonucleotide; CAG chr11 5284775 5284794 5284778 -
gggttataggctggcaggct

SEQ ID NO: 41795 - DNA, 20 bp, Artificial Sequence
  Synthetic oligonucleotide; TAG chr11 5284771 5284790 5284774 -
tataggctggcaggctcaga

SEQ ID NO: 41796 - DNA, 20 bp, Artificial Sequence
  Synthetic oligonucleotide; AGG chr11 5284770 5284789 5284773 -
ataggctggcaggctcagat

SEQ ID NO: 41797 - DNA, 20 bp, Artificial Sequence
  Synthetic oligonucleotide; TGG chr11 5284767 5284786 5284770 -
ggctggcaggctcagatagg

SEQ ID NO: 41798 - DNA, 20 bp, Artificial Sequence
  Synthetic oligonucleotide; TAG chr11 5284763 5284782 5284766 -
ggcaggctcagataggtggt

SEQ ID NO: 41799 - DNA, 20 bp, Artificial Sequence
  Synthetic oligonucleotide; AGG chr11 5284762 5284781 5284765 -
gcaggctcagataggtggtt

SEQ ID NO: 41800 - DNA, 20 bp, Artificial Sequence
  Synthetic oligonucleotide; CAG chr11 5284758 5284777 5284761 -
gctcagataggtggttaggt

SEQ ID NO: 41801 - DNA, 20 bp, Artificial Sequence
  Synthetic oligonucleotide; AGG chr11 5284757 5284776 5284760 -
ctcagataggtggttaggtc

SEQ ID NO: 41802 - DNA, 20 bp, Artificial Sequence
  Synthetic oligonucleotide; TGG chr11 5284753 5284772 5284756 -
gataggtggttaggtcaggt

SEQ ID NO: 41803 - DNA, 20 bp, Artificial Sequence
  Synthetic oligonucleotide; TGG chr11 5284750 5284769 5284753 -
aggtggttaggtcaggttgg

SEQ ID NO: 41804 - DNA, 20 bp, Artificial Sequence
  Synthetic oligonucleotide; TGG chr11 5284744 5284763 5284747 -
ttaggtcaggttggtggtgc

SEQ ID NO: 41805 - DNA, 20 bp, Artificial Sequence
  Synthetic oligonucleotide; GGG chr11 5284743 5284762 5284746 -
taggtcaggttggtggtgct

SEQ ID NO: 41806 - DNA, 20 bp, Artificial Sequence
  Synthetic oligonucleotide; TGG chr11 5284740 5284759 5284743 -
gtcaggttggtggtgctggg

SEQ ID NO: 41807 - DNA, 20 bp, Artificial Sequence
  Synthetic oligonucleotide; GAG chr11 5284738 5284757 5284741 -
caggttggtggtgctgggtg

SEQ ID NO: 41808 - DNA, 20 bp, Artificial Sequence
  Synthetic oligonucleotide; CAG chr11 5284724 5284743 5284727 -
tgggtggagtccatgactcc

SEQ ID NO: 41809 - DNA, 20 bp, Artificial Sequence
  Synthetic oligonucleotide; AGG chr11 5284723 5284742 5284726 -
gggtggagtccatgactccc

SEQ ID NO: 41810 - DNA, 20 bp, Artificial Sequence
  Synthetic oligonucleotide; GAG chr11 5284721 5284740 5284724 -
gtggagtccatgactcccag

SEQ ID NO: 41811 - DNA, 20 bp, Artificial Sequence
  Synthetic oligonucleotide; CAG chr11 5284717 5284736 5284720 -
agtccatgactcccaggagc

SEQ ID NO: 41812 - DNA, 20 bp, Artificial Sequence
  Synthetic oligonucleotide; AGG chr11 5284716 5284735 5284719 -
gtccatgactcccaggagcc

SEQ ID NO: 41813 - DNA, 20 bp, Artificial Sequence
  Synthetic oligonucleotide; GAG chr11 5284714 5284733 5284717 -
ccatgactcccaggagccag

SEQ ID NO: 41814 - DNA, 20 bp, Artificial Sequence
  Synthetic oligonucleotide; GAG chr11 5284712 5284731 5284715 -
atgactcccaggagccagga

SEQ ID NO: 41815 - DNA, 20 bp, Artificial Sequence
  Synthetic oligonucleotide; TAG chr11 5284708 5284727 5284711 -
ctcccaggagccaggagaga

SEQ ID NO: 41816 - DNA, 20 bp, Artificial Sequence
  Synthetic oligonucleotide; GAG chr11 5284700 5284719 5284703 -
agccaggagagatagaccat

SEQ ID NO: 41817 - DNA, 20 bp, Artificial Sequence
  Synthetic oligonucleotide; TAG chr11 5284697 5284716 5284700 -
caggagagatagaccatgag

SEQ ID NO: 41818 - DNA, 20 bp, Artificial Sequence
  Synthetic oligonucleotide; GAG chr11 5284695 5284714 5284698 -
ggagagatagaccatgagta

SEQ ID NO: 41819 - DNA, 20 bp, Artificial Sequence
  Synthetic oligonucleotide; AGG chr11 5284694 5284713 5284697 -
gagagatagaccatgagtag

SEQ ID NO: 41820 - DNA, 20 bp, Artificial Sequence
  Synthetic oligonucleotide; GGG chr11 5284693 5284712 5284696 -
agagatagaccatgagtaga

SEQ ID NO: 41821 - DNA, 20 bp, Artificial Sequence
  Synthetic oligonucleotide; CAG chr11 5284690 5284709 5284693 -
gatagaccatgagtagaggg

SEQ ID NO: 41822 - DNA, 20 bp, Artificial Sequence
  Synthetic oligonucleotide; TGG chr11 5284684 5284703 5284687 -
ccatgagtagagggcagaca

SEQ ID NO: 41823 - DNA, 20 bp, Artificial Sequence
  Synthetic oligonucleotide; GGG chr11 5284683 5284702 5284686 -
catgagtagagggcagacat

SEQ ID NO: 41824 - DNA, 20 bp, Artificial Sequence
  Synthetic oligonucleotide; AAG chr11 5284679 5284698 5284682 -
agtagagggcagacatggga

SEQ ID NO: 41825 - DNA, 20 bp, Artificial Sequence
  Synthetic oligonucleotide; AGG chr11 5284678 5284697 5284681 -
gtagagggcagacatgggaa

SEQ ID NO: 41826 - DNA, 20 bp, Artificial Sequence
  Synthetic oligonucleotide; TGG chr11 5284675 5284694 5284678 -
gagggcagacatgggaaagg

SEQ ID NO: 41827 - DNA, 20 bp, Artificial Sequence
  Synthetic oligonucleotide; GGG chr11 5284674 5284693 5284677 -
agggcagacatgggaaaggt

SEQ ID NO: 41828 - DNA, 20 bp, Artificial Sequence
  Synthetic oligonucleotide; GGG chr11 5284673 5284692 5284676 -
gggcagacatgggaaaggtg

SEQ ID NO: 41829 - DNA, 20 bp, Artificial Sequence
  Synthetic oligonucleotide; GGG chr11 5284672 5284691 5284675 -
ggcagacatgggaaaggtgg

SEQ ID NO: 41830 - DNA, 20 bp, Artificial Sequence
  Synthetic oligonucleotide; GAG chr11 5284670 5284689 5284673 -
cagacatgggaaaggtgggg

SEQ ID NO: 41831 - DNA, 20 bp, Artificial Sequence
  Synthetic oligonucleotide; AGG chr11 5284669 5284688 5284672 -
agacatgggaaaggtggggg

SEQ ID NO: 41832 - DNA, 20 bp, Artificial Sequence
  Synthetic oligonucleotide; CAG chr11 5284664 5284683 5284667 -
tgggaaaggtgggggaggca

SEQ ID NO: 41833 - DNA, 20 bp, Artificial Sequence
  Synthetic oligonucleotide; TAG chr11 5284659 5284678 5284662 -
aaggtgggggaggcacagca

SEQ ID NO: 41834 - DNA, 20 bp, Artificial Sequence
  Synthetic oligonucleotide; CAG chr11 5284656 5284675 5284659 -
gtgggggaggcacagcatag

SEQ ID NO: 41835 - DNA, 20 bp, Artificial Sequence
  Synthetic oligonucleotide; TGG chr11 5284631 5284650 5284634 -
tttttcattctactactaca

SEQ ID NO: 41836 - DNA, 20 bp, Artificial Sequence
  Synthetic oligonucleotide; GGG chr11 5284630 5284649 5284633 -
ttttcattctactactacat

SEQ ID NO: 41837 - DNA, 20 bp, Artificial Sequence
  Synthetic oligonucleotide; CAG chr11 5284609 5284628 5284612 -
ggactgctcccctatacccc

SEQ ID NO: 41838 - DNA, 20 bp, Artificial Sequence
  Synthetic oligonucleotide; TAG chr11 5284605 5284624 5284608 -
tgctcccctatacccccagc

SEQ ID NO: 41839 - DNA, 20 bp, Artificial Sequence
  Synthetic oligonucleotide; AGG chr11 5284604 5284623 5284607 -
gctcccctatacccccagct

SEQ ID NO: 41840 - DNA, 20 bp, Artificial Sequence
  Synthetic oligonucleotide; GGG chr11 5284603 5284622 5284606 -
ctcccctatacccccagcta

SEQ ID NO: 41841 - DNA, 20 bp, Artificial Sequence
  Synthetic oligonucleotide; GGG chr11 5284602 5284621 5284605 -
tcccctatacccccagctag

SEQ ID NO: 41842 - DNA, 20 bp, Artificial Sequence
  Synthetic oligonucleotide; AAG chr11 5284598 5284617 5284601 -
ctatacccccagctaggggc

SEQ ID NO: 41843 - DNA, 20 bp, Artificial Sequence
  Synthetic oligonucleotide; CAG chr11 5284575 5284594 5284578 -
tgccttgactcctatgtttt

SEQ ID NO: 41844 - DNA, 20 bp, Artificial Sequence
  Synthetic oligonucleotide; AGG chr11 5284574 5284593 5284577 -
gccttgactcctatgttttc

SEQ ID NO: 41845 - DNA, 20 bp, Artificial Sequence
  Synthetic oligonucleotide; AAG chr11 5284558 5284577 5284561 -
tttcaggatcatcatctata

SEQ ID NO: 41846 - DNA, 20 bp, Artificial Sequence
  Synthetic oligonucleotide; AAG chr11 5284554 5284573 5284557 -
aggatcatcatctataaagt

SEQ ID NO: 41847 - DNA, 20 bp, Artificial Sequence
  Synthetic oligonucleotide; GAG chr11 5284552 5284571 5284555 -
gatcatcatctataaagtaa

SEQ ID NO: 41848 - DNA, 20 bp, Artificial Sequence
  Synthetic oligonucleotide; TAG chr11 5284529 5284548 5284532 -
taataattgtgtctatctca

SEQ ID NO: 41849 - DNA, 20 bp, Artificial Sequence
  Synthetic oligonucleotide; AGG chr11 5284528 5284547 5284531 -
aataattgtgtctatctcat

SEQ ID NO: 41850 - DNA, 20 bp, Artificial Sequence
  Synthetic oligonucleotide; GGG chr11 5284527 5284546 5284530 -
ataattgtgtctatctcata

SEQ ID NO: 41851 - DNA, 20 bp, Artificial Sequence
  Synthetic oligonucleotide; GAG chr11 5284517 5284536 5284520 -
ctatctcatagggttattat

SEQ ID NO: 41852 - DNA, 20 bp, Artificial Sequence
  Synthetic oligonucleotide; AGG chr11 5284516 5284535 5284519 -
tatctcatagggttattatg

SEQ ID NO: 41853 - DNA, 20 bp, Artificial Sequence
  Synthetic oligonucleotide; AAG chr11 5284509 5284528 5284512 -
tagggttattatgaggatca

SEQ ID NO: 41854 - DNA, 20 bp, Artificial Sequence
  Synthetic oligonucleotide; AGG chr11 5284508 5284527 5284511 -
agggttattatgaggatcaa

SEQ ID NO: 41855 - DNA, 20 bp, Artificial Sequence
  Synthetic oligonucleotide; GAG chr11 5284506 5284525 5284509 -
ggttattatgaggatcaaag

SEQ ID NO: 41856 - DNA, 20 bp, Artificial Sequence
  Synthetic oligonucleotide; TGG chr11 5284491 5284510 5284494 -
caaaggagatgcacactctc

SEQ ID NO: 41857 - DNA, 20 bp, Artificial Sequence
  Synthetic oligonucleotide; CAG chr11 5284486 5284505 5284489 -
gagatgcacactctctggac

SEQ ID NO: 41858 - DNA, 20 bp, Artificial Sequence
  Synthetic oligonucleotide; TGG chr11 5284483 5284502 5284486 -
atgcacactctctggaccag

SEQ ID NO: 41859 - DNA, 20 bp, Artificial Sequence
  Synthetic oligonucleotide; CAG chr11 5284475 5284494 5284478 -
tctctggaccagtggcctaa

SEQ ID NO: 41860 - DNA, 20 bp, Artificial Sequence
  Synthetic oligonucleotide; CAG chr11 5284470 5284489 5284473 -
ggaccagtggcctaacagtt

SEQ ID NO: 41861 - DNA, 20 bp, Artificial Sequence
  Synthetic oligonucleotide; AGG chr11 5284469 5284488 5284472 -
gaccagtggcctaacagttc

SEQ ID NO: 41862 - DNA, 20 bp, Artificial Sequence
  Synthetic oligonucleotide; CAG chr11 5284465 5284484 5284468 -
agtggcctaacagttcagga

SEQ ID NO: 41863 - DNA, 20 bp, Artificial Sequence
  Synthetic oligonucleotide; GAG chr11 5284463 5284482 5284466 -
tggcctaacagttcaggaca

SEQ ID NO: 41864 - DNA, 20 bp, Artificial Sequence
  Synthetic oligonucleotide; TGG chr11 5284457 5284476 5284460 -
aacagttcaggacagagcta

SEQ ID NO: 41865 - DNA, 20 bp, Artificial Sequence
  Synthetic oligonucleotide; GGG chr11 5284456 5284475 5284459 -
acagttcaggacagagctat

SEQ ID NO: 41866 - DNA, 20 bp, Artificial Sequence
  Synthetic oligonucleotide; TGG chr11 5284442 5284461 5284445 -
agctatgggcttcctatgta

SEQ ID NO: 41867 - DNA, 20 bp, Artificial Sequence
  Synthetic oligonucleotide; GGG chr11 5284441 5284460 5284444 -
gctatgggcttcctatgtat

SEQ ID NO: 41868 - DNA, 20 bp, Artificial Sequence
  Synthetic oligonucleotide; CAG chr11 5284437 5284456 5284440 -
tgggcttcctatgtatgggt

SEQ ID NO: 41869 - DNA, 20 bp, Artificial Sequence
  Synthetic oligonucleotide; TGG chr11 5284434 5284453 5284437 -
gcttcctatgtatgggtcag

SEQ ID NO: 41870 - DNA, 20 bp, Artificial Sequence
  Synthetic oligonucleotide; TAG chr11 5284423 5284442 5284426 -
atgggtcagtggtctcaatg

SEQ ID NO: 41871 - DNA, 20 bp, Artificial Sequence
  Synthetic oligonucleotide; CAG chr11 5284420 5284439 5284423 -
ggtcagtggtctcaatgtag

SEQ ID NO: 41872 - DNA, 20 bp, Artificial Sequence
  Synthetic oligonucleotide; AGG chr11 5284419 5284438 5284422 -
gtcagtggtctcaatgtagc

SEQ ID NO: 41873 - DNA, 20 bp, Artificial Sequence
  Synthetic oligonucleotide; AAG chr11 5284415 5284434 5284418 -
gtggtctcaatgtagcaggc

SEQ ID NO: 41874 - DNA, 20 bp, Artificial Sequence
  Synthetic oligonucleotide; CAG chr11 5284409 5284428 5284412 -
tcaatgtagcaggcaagttc

SEQ ID NO: 41875 - DNA, 20 bp, Artificial Sequence
  Synthetic oligonucleotide; AAG chr11 5284406 5284425 5284409 -
atgtagcaggcaagttccag

SEQ ID NO: 41876 - DNA, 20 bp, Artificial Sequence
  Synthetic oligonucleotide; TAG chr11 5284402 5284421 5284405 -
agcaggcaagttccagaaga

SEQ ID NO: 41877 - DNA, 20 bp, Artificial Sequence
  Synthetic oligonucleotide; TAG chr11 5284386 5284405 5284389 -
aagatagcatcaaccactgt

SEQ ID NO: 41878 - DNA, 20 bp, Artificial Sequence
  Synthetic oligonucleotide; GAG chr11 5284384 5284403 5284387 -
gatagcatcaaccactgtta

SEQ ID NO: 41879 - DNA, 20 bp, Artificial Sequence
  Synthetic oligonucleotide; CAG chr11 5284372 5284391 5284375 -
cactgttagagatatactgc

SEQ ID NO: 41880 - DNA, 20 bp, Artificial Sequence
  Synthetic oligonucleotide; CAG chr11 5284366 5284385 5284369 -
tagagatatactgccagtct

SEQ ID NO: 41881 - DNA, 20 bp, Artificial Sequence
  Synthetic oligonucleotide; GAG chr11 5284364 5284383 5284367 -
gagatatactgccagtctca

SEQ ID NO: 41882 - DNA, 20 bp, Artificial Sequence
  Synthetic oligonucleotide; TAG chr11 5284348 5284367 5284351 -
ctcagagcctgatgttaatt

SEQ ID NO: 41883 - DNA, 20 bp, Artificial Sequence
  Synthetic oligonucleotide; TGG chr11 5284342 5284361 5284345 -
gcctgatgttaatttagcaa

SEQ ID NO: 41884 - DNA, 20 bp, Artificial Sequence
  Synthetic oligonucleotide; GGG chr11 5284341 5284360 5284344 -
cctgatgttaatttagcaat

SEQ ID NO: 41885 - DNA, 20 bp, Artificial Sequence
  Synthetic oligonucleotide; TGG chr11 5284337 5284356 5284340 -
atgttaatttagcaatgggc

SEQ ID NO: 41886 - DNA, 20 bp, Artificial Sequence
  Synthetic oligonucleotide; GGG chr11 5284336 5284355 5284339 -
tgttaatttagcaatgggct

SEQ ID NO: 41887 - DNA, 20 bp, Artificial Sequence
  Synthetic oligonucleotide; CAG chr11 5284324 5284343 5284327 -
aatgggctgggaccctcctc

SEQ ID NO: 41888 - DNA, 20 bp, Artificial Sequence
  Synthetic oligonucleotide; TAG chr11 5284321 5284340 5284324 -
gggctgggaccctcctccag

SEQ ID NO: 41889 - DNA, 20 bp, Artificial Sequence
  Synthetic oligonucleotide; CAG chr11 5284307 5284326 5284310 -
ctccagtagaaccttctaac

SEQ ID NO: 41890 - DNA, 20 bp, Artificial Sequence
  Synthetic oligonucleotide; CAG chr11 5284298 5284317 5284301 -
aaccttctaaccagctgctg

SEQ ID NO: 41891 - DNA, 20 bp, Artificial Sequence
  Synthetic oligonucleotide; AAG chr11 5284292 5284311 5284295 -
ctaaccagctgctgcagtca

SEQ ID NO: 41892 - DNA, 20 bp, Artificial Sequence
  Synthetic oligonucleotide; CAG chr11 5284282 5284301 5284285 -
gctgcagtcaaagtcgaatg

SEQ ID NO: 41893 - DNA, 20 bp, Artificial Sequence
  Synthetic oligonucleotide; TGG chr11 5284278 5284297 5284281 -
cagtcaaagtcgaatgcagc

SEQ ID NO: 41894 - DNA, 20 bp, Artificial Sequence
  Synthetic oligonucleotide; TAG chr11 5284274 5284293 5284277 -
caaagtcgaatgcagctggt

SEQ ID NO: 41895 - DNA, 20 bp, Artificial Sequence
  Synthetic oligonucleotide; AAG chr11 5284257 5284276 5284260 -
ggttagactttttttaatga

SEQ ID NO: 41896 - DNA, 20 bp, Artificial Sequence
  Synthetic oligonucleotide; TAG chr11 5284252 5284271 5284255 -
gactttttttaatgaaagct

SEQ ID NO: 41897 - DNA, 20 bp, Artificial Sequence
  Synthetic oligonucleotide; AAG chr11 5284240 5284259 5284243 -
tgaaagcttagctttcatta

SEQ ID NO: 41898 - DNA, 20 bp, Artificial Sequence
  Synthetic oligonucleotide; AAG chr11 5284234 5284253 5284237 -
cttagctttcattaaagatt

SEQ ID NO: 41899 - DNA, 20 bp, Artificial Sequence
  Synthetic oligonucleotide; AAG chr11 5284226 5284245 5284229 -
tcattaaagattaagctcct

SEQ ID NO: 41900 - DNA, 20 bp, Artificial Sequence
  Synthetic oligonucleotide; CAG chr11 5284223 5284242 5284226 -
ttaaagattaagctcctaag

SEQ ID NO: 41901 - DNA, 20 bp, Artificial Sequence
  Synthetic oligonucleotide; AGG chr11 5284222 5284241 5284225 -
taaagattaagctcctaagc

SEQ ID NO: 41902 - DNA, 20 bp, Artificial Sequence
  Synthetic oligonucleotide; GGG chr11 5284221 5284240 5284224 -
aaagattaagctcctaagca

SEQ ID NO: 41903 - DNA, 20 bp, Artificial Sequence
  Synthetic oligonucleotide; CAG chr11 5284216 5284235 5284219 -
ttaagctcctaagcagggca

SEQ ID NO: 41904 - DNA, 20 bp, Artificial Sequence
  Synthetic oligonucleotide; CAG chr11 5284199 5284218 5284202 -
gcacagatgaaattgtctaa

SEQ ID NO: 41905 - DNA, 20 bp, Artificial Sequence
  Synthetic oligonucleotide; TGG chr11 5284164 5284183 5284167 -
ctaaaaaaatctgacttcac

SEQ ID NO: 41906 - DNA, 20 bp, Artificial Sequence
  Synthetic oligonucleotide; TGG chr11 5284156 5284175 5284159 -
atctgacttcactggaaaca

SEQ ID NO: 41907 - DNA, 20 bp, Artificial Sequence
  Synthetic oligonucleotide; AAG chr11 5284153 5284172 5284156 -
tgacttcactggaaacatgg

SEQ ID NO: 41908 - DNA, 20 bp, Artificial Sequence
  Synthetic oligonucleotide; AAG chr11 5284147 5284166 5284150 -
cactggaaacatggaagccc

SEQ ID NO: 41909 - DNA, 20 bp, Artificial Sequence
  Synthetic oligonucleotide; AGG chr11 5284146 5284165 5284149 -
actggaaacatggaagccca

SEQ ID NO: 41910 - DNA, 20 bp, Artificial Sequence
  Synthetic oligonucleotide; GAG chr11 5284133 5284152 5284136 -
aagcccaaggttctgaacat

SEQ ID NO: 41911 - DNA, 20 bp, Artificial Sequence
  Synthetic oligonucleotide; TAG chr11 5284123 5284142 5284126 -
ttctgaacatgagaaatttt

SEQ ID NO: 41912 - DNA, 20 bp, Artificial Sequence
  Synthetic oligonucleotide; AGG chr11 5284122 5284141 5284125 -
tctgaacatgagaaattttt

SEQ ID NO: 41913 - DNA, 20 bp, Artificial Sequence
  Synthetic oligonucleotide; CAG chr11 5284111 5284130 5284114 -
gaaatttttaggaatctgca

SEQ ID NO: 41914 - DNA, 20 bp, Artificial Sequence
  Synthetic oligonucleotide; AGG chr11 5284110 5284129 5284113 -
aaatttttaggaatctgcac

SEQ ID NO: 41915 - DNA, 20 bp, Artificial Sequence
  Synthetic oligonucleotide; GAG chr11 5284108 5284127 5284111 -
atttttaggaatctgcacag

SEQ ID NO: 41916 - DNA, 20 bp, Artificial Sequence
  Synthetic oligonucleotide; GAG chr11 5284103 5284122 5284106 -
taggaatctgcacaggagtt

SEQ ID NO: 41917 - DNA, 20 bp, Artificial Sequence
  Synthetic oligonucleotide; GAG chr11 5284101 5284120 5284104 -
ggaatctgcacaggagttga

SEQ ID NO: 41918 - DNA, 20 bp, Artificial Sequence
  Synthetic oligonucleotide; AGG chr11 5284100 5284119 5284103 -
gaatctgcacaggagttgag

SEQ ID NO: 41919 - DNA, 20 bp, Artificial Sequence
  Synthetic oligonucleotide; GGG chr11 5284099 5284118 5284102 -
aatctgcacaggagttgaga

SEQ ID NO: 41920 - DNA, 20 bp, Artificial Sequence
  Synthetic oligonucleotide; AAG chr11 5284092 5284111 5284095 -
acaggagttgagagggaaac

SEQ ID NO: 41921 - DNA, 20 bp, Artificial Sequence
  Synthetic oligonucleotide; TGG chr11 5284088 5284107 5284091 -
gagttgagagggaaacaaga

SEQ ID NO: 41922 - DNA, 20 bp, Artificial Sequence
  Synthetic oligonucleotide; AAG chr11 5284083 5284102 5284086 -
gagagggaaacaagatggtg

SEQ ID NO: 41923 - DNA, 20 bp, Artificial Sequence
  Synthetic oligonucleotide; AGG chr11 5284082 5284101 5284085 -
agagggaaacaagatggtga

SEQ ID NO: 41924 - DNA, 20 bp, Artificial Sequence
  Synthetic oligonucleotide; GGG chr11 5284081 5284100 5284084 -
gagggaaacaagatggtgaa

SEQ ID NO: 41925 - DNA, 20 bp, Artificial Sequence
  Synthetic oligonucleotide; TAG chr11 5284076 5284095 5284079 -
aaacaagatggtgaagggac

SEQ ID NO: 41926 - DNA, 20 bp, Artificial Sequence
  Synthetic oligonucleotide; GAG chr11 5284064 5284083 5284067 -
gaagggactagaaaccacat

SEQ ID NO: 41927 - DNA, 20 bp, Artificial Sequence
  Synthetic oligonucleotide; GAG chr11 5284062 5284081 5284065 -
agggactagaaaccacatga

SEQ ID NO: 41928 - DNA, 20 bp, Artificial Sequence
  Synthetic oligonucleotide; GAG chr11 5284055 5284074 5284058 -
agaaaccacatgagagacac

SEQ ID NO: 41929 - DNA, 20 bp, Artificial Sequence
  Synthetic oligonucleotide; AGG chr11 5284054 5284073 5284057 -
gaaaccacatgagagacacg

SEQ ID NO: 41930 - DNA, 20 bp, Artificial Sequence
  Synthetic oligonucleotide; TAG chr11 5284048 5284067 5284051 -
acatgagagacacgaggaaa

SEQ ID NO: 41931 - DNA, 20 bp, Artificial Sequence
  Synthetic oligonucleotide; TAG chr11 5284043 5284062 5284046 -
agagacacgaggaaatagtg

SEQ ID NO: 41932 - DNA, 20 bp, Artificial Sequence
  Synthetic oligonucleotide; TAG chr11 5284037 5284056 5284040 -
acgaggaaatagtgtagatt

SEQ ID NO: 41933 - DNA, 20 bp, Artificial Sequence
  Synthetic oligonucleotide; AGG chr11 5284036 5284055 5284039 -
cgaggaaatagtgtagattt

SEQ ID NO: 41934 - DNA, 20 bp, Artificial Sequence
  Synthetic oligonucleotide; TGG chr11 5284032 5284051 5284035 -
gaaatagtgtagatttaggc

SEQ ID NO: 41935 - DNA, 20 bp, Artificial Sequence
  Synthetic oligonucleotide; GAG chr11 5284030 5284049 5284033 -
aatagtgtagatttaggctg

SEQ ID NO: 41936 - DNA, 20 bp, Artificial Sequence
  Synthetic oligonucleotide; AGG chr11 5284029 5284048 5284032 -
atagtgtagatttaggctgg

SEQ ID NO: 41937 - DNA, 20 bp, Artificial Sequence
  Synthetic oligonucleotide; AAG chr11 5284019 5284038 5284022 -
tttaggctggaggtaaatga

SEQ ID NO: 41938 - DNA, 20 bp, Artificial Sequence
  Synthetic oligonucleotide; GAG chr11 5284017 5284036 5284020 -
taggctggaggtaaatgaaa

SEQ ID NO: 41939 - DNA, 20 bp, Artificial Sequence
  Synthetic oligonucleotide; AAG chr11 5284014 5284033 5284017 -
gctggaggtaaatgaaagag

SEQ ID NO: 41940 - DNA, 20 bp, Artificial Sequence
  Synthetic oligonucleotide; TGG chr11 5284011 5284030 5284014 -
ggaggtaaatgaaagagaag

SEQ ID NO: 41941 - DNA, 20 bp, Artificial Sequence
  Synthetic oligonucleotide; GGG chr11 5284010 5284029 5284013 -
gaggtaaatgaaagagaagt

SEQ ID NO: 41942 - DNA, 20 bp, Artificial Sequence
  Synthetic oligonucleotide; CAG chr11 5283976 5283995 5283979 -
actgaaatctttctatatgt

SEQ ID NO: 41943 - DNA, 20 bp, Artificial Sequence
  Synthetic oligonucleotide; AGG chr11 5283975 5283994 5283978 -
ctgaaatctttctatatgtc

SEQ ID NO: 41944 - DNA, 20 bp, Artificial Sequence
  Synthetic oligonucleotide; TGG chr11 5283937 5283956 5283940 -
tttaataatctcattacata

SEQ ID NO: 41945 - DNA, 20 bp, Artificial Sequence
  Synthetic oligonucleotide; GAG chr11 5283925 5283944 5283928 -
attacatatggtaattctgt

SEQ ID NO: 41946 - DNA, 20 bp, Artificial Sequence
  Synthetic oligonucleotide; AAG chr11 5283883 5283902 5283886 -
ctataattaatactaatgat

SEQ ID NO: 41947 - DNA, 20 bp, Artificial Sequence
  Synthetic oligonucleotide; GAG chr11 5283869 5283888 5283872 -
aatgataagtaacacctctt

SEQ ID NO: 41948 - DNA, 20 bp, Artificial Sequence
  Synthetic oligonucleotide; TAG chr11 5283862 5283881 5283865 -
agtaacacctcttgagtact

SEQ ID NO: 41949 - DNA, 20 bp, Artificial Sequence
  Synthetic oligonucleotide; TAG chr11 5283852 5283871 5283855 -
cttgagtacttagtatatgc

SEQ ID NO: 41950 - DNA, 20 bp, Artificial Sequence
  Synthetic oligonucleotide; AAG chr11 5283839 5283858 5283842 -
tatatgctagaatcaaattt

SEQ ID NO: 41951 - DNA, 20 bp, Artificial Sequence
  Synthetic oligonucleotide; GAG chr11 5283826 5283845 5283829 -
caaatttaagtttatcatat

SEQ ID NO: 41952 - DNA, 20 bp, Artificial Sequence
  Synthetic oligonucleotide; AGG chr11 5283825 5283844 5283828 -
aaatttaagtttatcatatg

SEQ ID NO: 41953 - DNA, 20 bp, Artificial Sequence
  Synthetic oligonucleotide; CGG chr11 5283821 5283840 5283824 -
ttaagtttatcatatgaggc

SEQ ID NO: 41954 - DNA, 20 bp, Artificial Sequence
  Synthetic oligonucleotide; GGG chr11 5283820 5283839 5283823 -
taagtttatcatatgaggcc

SEQ ID NO: 41955 - DNA, 20 bp, Artificial Sequence
  Synthetic oligonucleotide; CGG chr11 5283815 5283834 5283818 -
ttatcatatgaggccgggca

SEQ ID NO: 41956 - DNA, 20 bp, Artificial Sequence
  Synthetic oligonucleotide; TGG chr11 5283812 5283831 5283815 -
tcatatgaggccgggcacgg

SEQ ID NO: 41957 - DNA, 20 bp, Artificial Sequence
  Synthetic oligonucleotide; TGG chr11 5283801 5283820 5283804 -
cgggcacggtggctcatata

SEQ ID NO: 41958 - DNA, 20 bp, Artificial Sequence
  Synthetic oligonucleotide; GGG chr11 5283800 5283819 5283803 -
gggcacggtggctcatatat

SEQ ID NO: 41959 - DNA, 20 bp, Artificial Sequence
  Synthetic oligonucleotide; CAG chr11 5283779 5283798 5283782 -
ggattacatgcctgtaatcc

SEQ ID NO: 41960 - DNA, 20 bp, Artificial Sequence
  Synthetic oligonucleotide; TGG chr11 5283771 5283790 5283774 -
tgcctgtaatcccagcactt

SEQ ID NO: 41961 - DNA, 20 bp, Artificial Sequence
  Synthetic oligonucleotide; GGG chr11 5283770 5283789 5283773 -
gcctgtaatcccagcacttt

SEQ ID NO: 41962 - DNA, 20 bp, Artificial Sequence
  Synthetic oligonucleotide; GAG chr11 5283768 5283787 5283771 -
ctgtaatcccagcactttgg

SEQ ID NO: 41963 - DNA, 20 bp, Artificial Sequence
  Synthetic oligonucleotide; AGG chr11 5283767 5283786 5283770 -
tgtaatcccagcactttggg

SEQ ID NO: 41964 - DNA, 20 bp, Artificial Sequence
  Synthetic oligonucleotide; AAG chr11 5283762 5283781 5283765 -
tcccagcactttgggaggcc

SEQ ID NO: 41965 - DNA, 20 bp, Artificial Sequence
  Synthetic oligonucleotide; AGG chr11 5283761 5283780 5283764 -
cccagcactttgggaggcca

SEQ ID NO: 41966 - DNA, 20 bp, Artificial Sequence
  Synthetic oligonucleotide; TGG chr11 5283754 5283773 5283757 -
ctttgggaggccaaggcaat

SEQ ID NO: 41967 - DNA, 20 bp, Artificial Sequence
  Synthetic oligonucleotide; GAG chr11 5283744 5283763 5283747 -
ccaaggcaattggatcacct

SEQ ID NO: 41968 - DNA, 20 bp, Artificial Sequence
  Synthetic oligonucleotide; AGG chr11 5283743 5283762 5283746 -
caaggcaattggatcacctg

SEQ ID NO: 41969 - DNA, 20 bp, Artificial Sequence
  Synthetic oligonucleotide; CAG chr11 5283739 5283758 5283742 -
gcaattggatcacctgaggt

SEQ ID NO: 41970 - DNA, 20 bp, Artificial Sequence
  Synthetic oligonucleotide; AGG chr11 5283738 5283757 5283741 -
caattggatcacctgaggtc

SEQ ID NO: 41971 - DNA, 20 bp, Artificial Sequence
  Synthetic oligonucleotide; GAG chr11 5283736 5283755 5283739 -
attggatcacctgaggtcag

SEQ ID NO: 41972 - DNA, 20 bp, Artificial Sequence
  Synthetic oligonucleotide; CAG chr11 5283730 5283749 5283733 -
tcacctgaggtcaggagttc

SEQ ID NO: 41973 - DNA, 20 bp, Artificial Sequence
  Synthetic oligonucleotide; CAG chr11 5283725 5283744 5283728 -
tgaggtcaggagttccagac

SEQ ID NO: 41974 - DNA, 20 bp, Artificial Sequence
  Synthetic oligonucleotide; TGG chr11 5283720 5283739 5283723 -
tcaggagttccagaccagcc

SEQ ID NO: 41975 - DNA, 20 bp, Artificial Sequence
  Synthetic oligonucleotide; TGG chr11 5283711 5283730 5283714 -
ccagaccagcctggccaaca

SEQ ID NO: 41976 - DNA, 20 bp, Artificial Sequence
  Synthetic oligonucleotide; CAG chr11 5283674 5283693 5283677 -
tactaaaaaatacaaaaaat

SEQ ID NO: 41977 - DNA, 20 bp, Artificial Sequence
  Synthetic oligonucleotide; CAG chr11 5283670 5283689 5283673 -
aaaaaatacaaaaaatcagc

SEQ ID NO: 41978 - DNA, 20 bp, Artificial Sequence
  Synthetic oligonucleotide; AGG chr11 5283669 5283688 5283672 -
aaaaatacaaaaaatcagcc

SEQ ID NO: 41979 - DNA, 20 bp, Artificial Sequence
  Synthetic oligonucleotide; TGG chr11 5283664 5283683 5283667 -
tacaaaaaatcagccaggtg

SEQ ID NO: 41980 - DNA, 20 bp, Artificial Sequence
  Synthetic oligonucleotide; TGG chr11 5283661 5283680 5283664 -
aaaaaatcagccaggtgtgg

SEQ ID NO: 41981 - DNA, 20 bp, Artificial Sequence
  Synthetic oligonucleotide; CAG chr11 5283642 5283661 5283645 -
gtggcacgcgtctataatcc

SEQ ID NO: 41982 - DNA, 20 bp, Artificial Sequence
  Synthetic oligonucleotide; CAG chr11 5283634 5283653 5283637 -
cgtctataatcccagctact

SEQ ID NO: 41983 - DNA, 20 bp, Artificial Sequence
  Synthetic oligonucleotide; AGG chr11 5283633 5283652 5283636 -
gtctataatcccagctactc

SEQ ID NO: 41984 - DNA, 20 bp, Artificial Sequence
  Synthetic oligonucleotide; GAG chr11 5283631 5283650 5283634 -
ctataatcccagctactcag

SEQ ID NO: 41985 - DNA, 20 bp, Artificial Sequence
  Synthetic oligonucleotide; AGG chr11 5283630 5283649 5283633 -
tataatcccagctactcagg

SEQ ID NO: 41986 - DNA, 20 bp, Artificial Sequence
  Synthetic oligonucleotide; GAG chr11 5283625 5283644 5283628 -
tcccagctactcaggaggct

SEQ ID NO: 41987 - DNA, 20 bp, Artificial Sequence
  Synthetic oligonucleotide; AGG chr11 5283624 5283643 5283627 -
cccagctactcaggaggctg

SEQ ID NO: 41988 - DNA, 20 bp, Artificial Sequence
  Synthetic oligonucleotide; CAG chr11 5283621 5283640 5283624 -
agctactcaggaggctgagg

SEQ ID NO: 41989 - DNA, 20 bp, Artificial Sequence
  Synthetic oligonucleotide; AGG chr11 5283620 5283639 5283623 -
gctactcaggaggctgaggc

SEQ ID NO: 41990 - DNA, 20 bp, Artificial Sequence
  Synthetic oligonucleotide; GAG chr11 5283618 5283637 5283621 -
tactcaggaggctgaggcag

SEQ ID NO: 41991 - DNA, 20 bp, Artificial Sequence
  Synthetic oligonucleotide; CAG chr11 5283602 5283621 5283605 -
gcaggagaatcacttgaacc

SEQ ID NO: 41992 - DNA, 20 bp, Artificial Sequence
  Synthetic oligonucleotide; AGG chr11 5283601 5283620 5283604 -
caggagaatcacttgaaccc

SEQ ID NO: 41993 - DNA, 20 bp, Artificial Sequence
  Synthetic oligonucleotide; GAG chr11 5283599 5283618 5283602 -
ggagaatcacttgaacccag

SEQ ID NO: 41994 - DNA, 20 bp, Artificial Sequence
  Synthetic oligonucleotide; AGG chr11 5283598 5283617 5283601 -
gagaatcacttgaacccagg

SEQ ID NO: 41995 - DNA, 20 bp, Artificial Sequence
  Synthetic oligonucleotide; TGG chr11 5283595 5283614 5283598 -
aatcacttgaacccaggagg

SEQ ID NO: 41996 - DNA, 20 bp, Artificial Sequence
  Synthetic oligonucleotide; GAG chr11 5283593 5283612 5283596 -
tcacttgaacccaggaggtg

SEQ ID NO: 41997 - DNA, 20 bp, Artificial Sequence
  Synthetic oligonucleotide; AGG chr11 5283592 5283611 5283595 -
cacttgaacccaggaggtgg

SEQ ID NO: 41998 - DNA, 20 bp, Artificial Sequence
  Synthetic oligonucleotide; CAG chr11 5283586 5283605 5283589 -
aacccaggaggtggaggttg

SEQ ID NO: 41999 - DNA, 20 bp, Artificial Sequence
  Synthetic oligonucleotide; GAG chr11 5283582 5283601 5283585 -
caggaggtggaggttgcagt

SEQ ID NO: 42000 - DNA, 20 bp, Artificial Sequence
  Synthetic oligonucleotide; AAG chr11 5283577 5283596 5283580 -
ggtggaggttgcagtgagct

SEQ ID NO: 42001 - DNA, 20 bp, Artificial Sequence
  Synthetic oligonucleotide; CAG chr11 5283557 5283576 5283560 -
aagattgcaccactgcactc

SEQ ID NO: 42002 - DNA, 20 bp, Artificial Sequence
  Synthetic oligonucleotide; TAG chr11 5283552 5283571 5283555 -
tgcaccactgcactccagcc

SEQ ID NO: 42003 - DNA, 20 bp, Artificial Sequence
  Synthetic oligonucleotide; AGG chr11 5283551 5283570 5283554 -
gcaccactgcactccagcct

SEQ ID NO: 42004 - DNA, 20 bp, Artificial Sequence
  Synthetic oligonucleotide; CAG chr11 5283545 5283564 5283548 -
ctgcactccagcctaggcga

SEQ ID NO: 42005 - DNA, 20 bp, Artificial Sequence
  Synthetic oligonucleotide; GAG chr11 5283543 5283562 5283546 -
gcactccagcctaggcgaca

SEQ ID NO: 42006 - DNA, 20 bp, Artificial Sequence
  Synthetic oligonucleotide; GAG chr11 5283539 5283558 5283542 -
tccagcctaggcgacagagt

SEQ ID NO: 42007 - DNA, 20 bp, Artificial Sequence
  Synthetic oligonucleotide; AAG chr11 5283515 5283534 5283518 -
ctccatctcaaaaaaaaaaa

SEQ ID NO: 42008 - DNA, 20 bp, Artificial Sequence
  Synthetic oligonucleotide; AAG chr11 5283512 5283531 5283515 -
catctcaaaaaaaaaaaaag

SEQ ID NO: 42009 - DNA, 20 bp, Artificial Sequence
  Synthetic oligonucleotide; TAG chr11 5283490 5283509 5283493 -
gtttattatatgaattaact

SEQ ID NO: 42010 - DNA, 20 bp, Artificial Sequence
  Synthetic oligonucleotide; CAG chr11 5283468 5283487 5283471 -
gttttactcacaccaatact

SEQ ID NO: 42011 - DNA, 20 bp, Artificial Sequence
  Synthetic oligonucleotide; AAG chr11 5283465 5283484 5283468 -
ttactcacaccaatactcag

SEQ ID NO: 42012 - DNA, 20 bp, Artificial Sequence
  Synthetic oligonucleotide; TAG chr11 5283462 5283481 5283465 -
ctcacaccaatactcagaag

SEQ ID NO: 42013 - DNA, 20 bp, Artificial Sequence
  Synthetic oligonucleotide; GAG chr11 5283438 5283457 5283441 -
ttattacctcatttattgat

SEQ ID NO: 42014 - DNA, 20 bp, Artificial Sequence
  Synthetic oligonucleotide; AGG chr11 5283437 5283456 5283440 -
tattacctcatttattgatg

SEQ ID NO: 42015 - DNA, 20 bp, Artificial Sequence
  Synthetic oligonucleotide; GAG chr11 5283435 5283454 5283438 -
ttacctcatttattgatgag

SEQ ID NO: 42016 - DNA, 20 bp, Artificial Sequence
  Synthetic oligonucleotide; TAG chr11 5283419 5283438 5283422 -
tgaggagcccaatgtacttg

SEQ ID NO: 42017 - DNA, 20 bp, Artificial Sequence
  Synthetic oligonucleotide; TAG chr11 5283414 5283433 5283417 -
agcccaatgtacttgtagtg

SEQ ID NO: 42018 - DNA, 20 bp, Artificial Sequence
  Synthetic oligonucleotide; AAG chr11 5283398 5283417 5283401 -
agtgtagatcaacttattga

SEQ ID NO: 42019 - DNA, 20 bp, Artificial Sequence
  Synthetic oligonucleotide; AAG chr11 5283392 5283411 5283395 -
gatcaacttattgaaagcac

SEQ ID NO: 42020 - DNA, 20 bp, Artificial Sequence
  Synthetic oligonucleotide; AAG chr11 5283384 5283403 5283387 -
tattgaaagcacaagctaat

SEQ ID NO: 42021 - DNA, 20 bp, Artificial Sequence
  Synthetic oligonucleotide; TAG chr11 5283381 5283400 5283384 -
tgaaagcacaagctaataag

SEQ ID NO: 42022 - DNA, 20 bp, Artificial Sequence
  Synthetic oligonucleotide; TAG chr11 5283373 5283392 5283376 -
caagctaataagtagacaat

SEQ ID NO: 42023 - DNA, 20 bp, Artificial Sequence
  Synthetic oligonucleotide; TAG chr11 5283366 5283385 5283369 -
ataagtagacaattagtaat

SEQ ID NO: 42024 - DNA, 20 bp, Artificial Sequence
  Synthetic oligonucleotide; AAG chr11 5283363 5283382 5283366 -
agtagacaattagtaattag

SEQ ID NO: 42025 - DNA, 20 bp, Artificial Sequence
  Synthetic oligonucleotide; CAG chr11 5283359 5283378 5283362 -
gacaattagtaattagaagt

SEQ ID NO: 42026 - DNA, 20 bp, Artificial Sequence
  Synthetic oligonucleotide; TGG chr11 5283355 5283374 5283358 -
attagtaattagaagtcaga

SEQ ID NO: 42027 - DNA, 20 bp, Artificial Sequence
  Synthetic oligonucleotide; GAG chr11 5283349 5283368 5283352 -
aattagaagtcagatggtct

SEQ ID NO: 42028 - DNA, 20 bp, Artificial Sequence
  Synthetic oligonucleotide; GAG chr11 5283323 5283342 5283326 -
tcctactgtctacattacat

SEQ ID NO: 42029 - DNA, 20 bp, Artificial Sequence
  Synthetic oligonucleotide; TGG chr11 5283309 5283328 5283312 -
ttacatgagctcttattaac

SEQ ID NO: 42030 - DNA, 20 bp, Artificial Sequence
  Synthetic oligonucleotide; GGG chr11 5283308 5283327 5283311 -
tacatgagctcttattaact

SEQ ID NO: 42031 - DNA, 20 bp, Artificial Sequence
  Synthetic oligonucleotide; GGG chr11 5283307 5283326 5283310 -
acatgagctcttattaactg

SEQ ID NO: 42032 - DNA, 20 bp, Artificial Sequence
  Synthetic oligonucleotide; AAG chr11 5283292 5283311 5283295 -
aactggggactcgaaaatca

SEQ ID NO: 42033 - DNA, 20 bp, Artificial Sequence
  Synthetic oligonucleotide; AAG chr11 5283271 5283290 5283274 -
agacatgaaataatttgtcc

SEQ ID NO: 42034 - DNA, 20 bp, Artificial Sequence
  Synthetic oligonucleotide; CAG chr11 5283264 5283283 5283267 -
aaataatttgtccaagctta

SEQ ID NO: 42035 - DNA, 20 bp, Artificial Sequence
  Synthetic oligonucleotide; AAG chr11 5283254 5283273 5283257 -
tccaagcttacagaaccacc

SEQ ID NO: 42036 - DNA, 20 bp, Artificial Sequence
  Synthetic oligonucleotide; TAG chr11 5283251 5283270 5283254 -
aagcttacagaaccaccaag

SEQ ID NO: 42037 - DNA, 20 bp, Artificial Sequence
  Synthetic oligonucleotide; AAG chr11 5283247 5283266 5283250 -
ttacagaaccaccaagtagt

SEQ ID NO: 42038 - DNA, 20 bp, Artificial Sequence
  Synthetic oligonucleotide; AGG chr11 5283246 5283265 5283249 -
tacagaaccaccaagtagta

SEQ ID NO: 42039 - DNA, 20 bp, Artificial Sequence
  Synthetic oligonucleotide; TAG chr11 5283242 5283261 5283245 -
gaaccaccaagtagtaaggc

SEQ ID NO: 42040 - DNA, 20 bp, Artificial Sequence
  Synthetic oligonucleotide; AGG chr11 5283241 5283260 5283244 -
aaccaccaagtagtaaggct

SEQ ID NO: 42041 - DNA, 20 bp, Artificial Sequence
  Synthetic oligonucleotide; TAG chr11 5283235 5283254 5283238 -
caagtagtaaggctaggatg

SEQ ID NO: 42042 - DNA, 20 bp, Artificial Sequence
  Synthetic oligonucleotide; CAG chr11 5283229 5283248 5283232 -
gtaaggctaggatgtagacc

SEQ ID NO: 42043 - DNA, 20 bp, Artificial Sequence
  Synthetic oligonucleotide; AAG chr11 5283212 5283231 5283215 -
acccagttctgctacctctg

SEQ ID NO: 42044 - DNA, 20 bp, Artificial Sequence
  Synthetic oligonucleotide; CAG chr11 5283208 5283227 5283211 -
agttctgctacctctgaaga

SEQ ID NO: 42045 - DNA, 20 bp, Artificial Sequence
  Synthetic oligonucleotide; CAG chr11 5283194 5283213 5283197 -
tgaagacagtgttttttcca

SEQ ID NO: 42046 - DNA, 20 bp, Artificial Sequence
  Synthetic oligonucleotide; CAG chr11 5283178 5283197 5283181 -
tccacagcaaaacacaaact

SEQ ID NO: 42047 - DNA, 20 bp, Artificial Sequence
  Synthetic oligonucleotide; TGG chr11 5283169 5283188 5283172 -
aaacacaaactcagatattg

SEQ ID NO: 42048 - DNA, 20 bp, Artificial Sequence
  Synthetic oligonucleotide; GAG chr11 5283162 5283181 5283165 -
aactcagatattgtggatgc

SEQ ID NO: 42049 - DNA, 20 bp, Artificial Sequence
  Synthetic oligonucleotide; TAG chr11 5283155 5283174 5283158 -
atattgtggatgcgagaaat

SEQ ID NO: 42050 - DNA, 20 bp, Artificial Sequence
  Synthetic oligonucleotide; AAG chr11 5283152 5283171 5283155 -
ttgtggatgcgagaaattag

SEQ ID NO: 42051 - DNA, 20 bp, Artificial Sequence
  Synthetic oligonucleotide; TAG chr11 5283149 5283168 5283152 -
tggatgcgagaaattagaag

SEQ ID NO: 42052 - DNA, 20 bp, Artificial Sequence
  Synthetic oligonucleotide; TGG chr11 5283132 5283151 5283135 -
aagtagatattcctgccctg

SEQ ID NO: 42053 - DNA, 20 bp, Artificial Sequence
  Synthetic oligonucleotide; TGG chr11 5283098 5283117 5283101 -
tacttttacttcttgtcgat

SEQ ID NO: 42054 - DNA, 20 bp, Artificial Sequence
  Synthetic oligonucleotide; AAG chr11 5283095 5283114 5283098 -
ttttacttcttgtcgattgg

SEQ ID NO: 42055 - DNA, 20 bp, Artificial Sequence
  Synthetic oligonucleotide; TGG chr11 5283089 5283108 5283092 -
ttcttgtcgattggaagttg

SEQ ID NO: 42056 - DNA, 20 bp, Artificial Sequence
  Synthetic oligonucleotide; AAG chr11 5283083 5283102 5283086 -
tcgattggaagttgtggtcc

SEQ ID NO: 42057 - DNA, 20 bp, Artificial Sequence
  Synthetic oligonucleotide; CAG chr11 5283077 5283096 5283080 -
ggaagttgtggtccaagcca

SEQ ID NO: 42058 - DNA, 20 bp, Artificial Sequence
  Synthetic oligonucleotide; CAG chr11 5283071 5283090 5283074 -
tgtggtccaagccacagttg

SEQ ID NO: 42059 - DNA, 20 bp, Artificial Sequence
  Synthetic oligonucleotide; CAG chr11 5283036 5283055 5283039 -
caaccataattgcatttctt

SEQ ID NO: 42060 - DNA, 20 bp, Artificial Sequence
  Synthetic oligonucleotide; AGG chr11 5283035 5283054 5283038 -
aaccataattgcatttcttc

SEQ ID NO: 42061 - DNA, 20 bp, Artificial Sequence
  Synthetic oligonucleotide; AAG chr11 5283031 5283050 5283034 -
ataattgcatttcttcagga

SEQ ID NO: 42062 - DNA, 20 bp, Artificial Sequence
  Synthetic oligonucleotide; GAG chr11 5283025 5283044 5283028 -
gcatttcttcaggaaagttt

SEQ ID NO: 42063 - DNA, 20 bp, Artificial Sequence
  Synthetic oligonucleotide; AGG chr11 5283024 5283043 5283027 -
catttcttcaggaaagtttg

SEQ ID NO: 42064 - DNA, 20 bp, Artificial Sequence
  Synthetic oligonucleotide; GGG chr11 5283023 5283042 5283026 -
atttcttcaggaaagtttga

SEQ ID NO: 42065 - DNA, 20 bp, Artificial Sequence
  Synthetic oligonucleotide; GAG chr11 5283021 5283040 5283024 -
ttcttcaggaaagtttgagg

SEQ ID NO: 42066 - DNA, 20 bp, Artificial Sequence
  Synthetic oligonucleotide; AAG chr11 5283015 5283034 5283018 -
aggaaagtttgagggagaaa

SEQ ID NO: 42067 - DNA, 20 bp, Artificial Sequence
  Synthetic oligonucleotide; AGG chr11 5283014 5283033 5283017 -
ggaaagtttgagggagaaaa

SEQ ID NO: 42068 - DNA, 20 bp, Artificial Sequence
  Synthetic oligonucleotide; AAG chr11 5283009 5283028 5283012 -
gtttgagggagaaaaaggta

SEQ ID NO: 42069 - DNA, 20 bp, Artificial Sequence
  Synthetic oligonucleotide; TAG chr11 5282999 5283018 5283002 -
gaaaaaggtaaagaaaaatt

SEQ ID NO: 42070 - DNA, 20 bp, Artificial Sequence
  Synthetic oligonucleotide; CAG chr11 5282987 5283006 5282990 -
gaaaaatttagaaacaactt

SEQ ID NO: 42071 - DNA, 20 bp, Artificial Sequence
  Synthetic oligonucleotide; AAG chr11 5282980 5282999 5282983 -
ttagaaacaacttcagaata

SEQ ID NO: 42072 - DNA, 20 bp, Artificial Sequence
  Synthetic oligonucleotide; GAG chr11 5282978 5282997 5282981 -
agaaacaacttcagaataaa

SEQ ID NO: 42073 - DNA, 20 bp, Artificial Sequence
  Synthetic oligonucleotide; TGG chr11 5282966 5282985 5282969 -
agaataaagagattttctct

SEQ ID NO: 42074 - DNA, 20 bp, Artificial Sequence
  Synthetic oligonucleotide; GGG chr11 5282965 5282984 5282968 -
gaataaagagattttctctt

SEQ ID NO: 42075 - DNA, 20 bp, Artificial Sequence
  Synthetic oligonucleotide; CAG chr11 5282959 5282978 5282962 -
agagattttctcttgggtta

SEQ ID NO: 42076 - DNA, 20 bp, Artificial Sequence
  Synthetic oligonucleotide; GAG chr11 5282957 5282976 5282960 -
agattttctcttgggttaca

SEQ ID NO: 42077 - DNA, 20 bp, Artificial Sequence
  Synthetic oligonucleotide; AAG chr11 5282934 5282953 5282937 -
attgtcatatgacaaattat

SEQ ID NO: 42078 - DNA, 20 bp, Artificial Sequence
  Synthetic oligonucleotide; CAG chr11 5282931 5282950 5282934 -
gtcatatgacaaattataag

SEQ ID NO: 42079 - DNA, 20 bp, Artificial Sequence
  Synthetic oligonucleotide; GAG chr11 5282922 5282941 5282925 -
caaattataagcagacactt

SEQ ID NO: 42080 - DNA, 20 bp, Artificial Sequence
  Synthetic oligonucleotide; AAG chr11 5282912 5282931 5282915 -
gcagacacttgagaaaactg

SEQ ID NO: 42081 - DNA, 20 bp, Artificial Sequence
  Synthetic oligonucleotide; AGG chr11 5282911 5282930 5282914 -
cagacacttgagaaaactga

SEQ ID NO: 42082 - DNA, 20 bp, Artificial Sequence
  Synthetic oligonucleotide; TGG chr11 5282876 5282895 5282879 -
caaattaccctttgacccct

SEQ ID NO: 42083 - DNA, 20 bp, Artificial Sequence
  Synthetic oligonucleotide; AAG chr11 5282871 5282890 5282874 -
taccctttgaccccttggtc

SEQ ID NO: 42084 - DNA, 20 bp, Artificial Sequence
  Synthetic oligonucleotide; TGG chr11 5282859 5282878 5282862 -
ccttggtcaagctgcaactt

SEQ ID NO: 42085 - DNA, 20 bp, Artificial Sequence
  Synthetic oligonucleotide; AAG chr11 5282853 5282872 5282856 -
tcaagctgcaactttggtta

SEQ ID NO: 42086 - DNA, 20 bp, Artificial Sequence
  Synthetic oligonucleotide; AGG chr11 5282852 5282871 5282855 -
caagctgcaactttggttaa

SEQ ID NO: 42087 - DNA, 20 bp, Artificial Sequence
  Synthetic oligonucleotide; GGG chr11 5282851 5282870 5282854 -
aagctgcaactttggttaaa

SEQ ID NO: 42088 - DNA, 20 bp, Artificial Sequence
  Synthetic oligonucleotide; GAG chr11 5282849 5282868 5282852 -
gctgcaactttggttaaagg

SEQ ID NO: 42089 - DNA, 20 bp, Artificial Sequence
  Synthetic oligonucleotide; TAG chr11 5282833 5282852 5282836 -
aagggagtgtttatgtgtta

SEQ ID NO: 42090 - DNA, 20 bp, Artificial Sequence
  Synthetic oligonucleotide; TGG chr11 5282814 5282833 5282817 -
atagtgttcatttactcttc

SEQ ID NO: 42091 - DNA, 20 bp, Artificial Sequence
  Synthetic oligonucleotide; TGG chr11 5282801 5282820 5282804 -
actcttctggtctaacccat

SEQ ID NO: 42092 - DNA, 20 bp, Artificial Sequence
  Synthetic oligonucleotide; CAG chr11 5282782 5282801 5282785 -
ttggctccgtcttcatcctg

SEQ ID NO: 42093 - DNA, 20 bp, Artificial Sequence
  Synthetic oligonucleotide; CAG chr11 5282773 5282792 5282776 -
tcttcatcctgcagtgacct

SEQ ID NO: 42094 - DNA, 20 bp, Artificial Sequence
  Synthetic oligonucleotide; CAG chr11 5282765 5282784 5282768 -
ctgcagtgacctcagtgcct

SEQ ID NO: 42095 - DNA, 20 bp, Artificial Sequence
  Synthetic oligonucleotide; TAG chr11 5282743 5282762 5282746 -
gaaacatacatatgtttgtc

SEQ ID NO: 42096 - DNA, 20 bp, Artificial Sequence
  Synthetic oligonucleotide; AAG chr11 5282737 5282756 5282740 -
tacatatgtttgtctagttt

SEQ ID NO: 42097 - DNA, 20 bp, Artificial Sequence
  Synthetic oligonucleotide; TAG chr11 5282716 5282735 5282719 -
agtttgtgtgaaattctaac

SEQ ID NO: 42098 - DNA, 20 bp, Artificial Sequence
  Synthetic oligonucleotide; AAG chr11 5282709 5282728 5282712 -
gtgaaattctaactagcgtc

SEQ ID NO: 42099 - DNA, 20 bp, Artificial Sequence
  Synthetic oligonucleotide; GAG chr11 5282702 5282721 5282705 -
tctaactagcgtcaagaact

SEQ ID NO: 42100 - DNA, 20 bp, Artificial Sequence
  Synthetic oligonucleotide; AGG chr11 5282701 5282720 5282704 -
ctaactagcgtcaagaactg

SEQ ID NO: 42101 - DNA, 20 bp, Artificial Sequence
  Synthetic oligonucleotide; GGG chr11 5282700 5282719 5282703 -
taactagcgtcaagaactga

SEQ ID NO: 42102 - DNA, 20 bp, Artificial Sequence
  Synthetic oligonucleotide; TAG chr11 5282684 5282703 5282687 -
ctgagggccctaaactatgc

SEQ ID NO: 42103 - DNA, 20 bp, Artificial Sequence
  Synthetic oligonucleotide; AGG chr11 5282683 5282702 5282686 -
tgagggccctaaactatgct

SEQ ID NO: 42104 - DNA, 20 bp, Artificial Sequence
  Synthetic oligonucleotide; TAG chr11 5282678 5282697 5282681 -
gccctaaactatgctaggaa

SEQ ID NO: 42105 - DNA, 20 bp, Artificial Sequence
  Synthetic oligonucleotide; TGG chr11 5282670 5282689 5282673 -
ctatgctaggaatagtgctg

SEQ ID NO: 42106 - DNA, 20 bp, Artificial Sequence
  Synthetic oligonucleotide; TAG chr11 5282659 5282678 5282662 -
atagtgctgtggtgctgtga

SEQ ID NO: 42107 - DNA, 20 bp, Artificial Sequence
  Synthetic oligonucleotide; AGG chr11 5282658 5282677 5282661 -
tagtgctgtggtgctgtgat

SEQ ID NO: 42108 - DNA, 20 bp, Artificial Sequence
  Synthetic oligonucleotide; AAG chr11 5282650 5282669 5282653 -
tggtgctgtgataggtacac

SEQ ID NO: 42109 - DNA, 20 bp, Artificial Sequence
  Synthetic oligonucleotide; GAG chr11 5282643 5282662 5282646 -
gtgataggtacacaagaaat

SEQ ID NO: 42110 - DNA, 20 bp, Artificial Sequence
  Synthetic oligonucleotide; AAG chr11 5282640 5282659 5282643 -
ataggtacacaagaaatgag

SEQ ID NO: 42111 - DNA, 20 bp, Artificial Sequence
  Synthetic oligonucleotide; CAG chr11 5282631 5282650 5282634 -
caagaaatgagaagaaactg

SEQ ID NO: 42112 - DNA, 20 bp, Artificial Sequence
  Synthetic oligonucleotide; CGG chr11 5282607 5282626 5282610 -
ttctctgcatctccctttgc

SEQ ID NO: 42113 - DNA, 20 bp, Artificial Sequence
  Synthetic oligonucleotide; GGG chr11 5282606 5282625 5282609 -
tctctgcatctccctttgcc

SEQ ID NO: 42114 - DNA, 20 bp, Artificial Sequence
  Synthetic oligonucleotide; AAG chr11 5282593 5282612 5282596 -
ctttgccgggtctgacaaca

SEQ ID NO: 42115 - DNA, 20 bp, Artificial Sequence
  Synthetic oligonucleotide; AAG chr11 5282568 5282587 5282571 -
tccccaaattttaccaatgc

SEQ ID NO: 42116 - DNA, 20 bp, Artificial Sequence
  Synthetic oligonucleotide; TGG chr11 5282530 5282549 5282533 -
ctaactactttaaaatcatt

SEQ ID NO: 42117 - DNA, 20 bp, Artificial Sequence
  Synthetic oligonucleotide; GGG chr11 5282529 5282548 5282532 -
taactactttaaaatcattt

SEQ ID NO: 42118 - DNA, 20 bp, Artificial Sequence
  Synthetic oligonucleotide; GGG chr11 5282528 5282547 5282531 -
aactactttaaaatcatttg

SEQ ID NO: 42119 - DNA, 20 bp, Artificial Sequence
  Synthetic oligonucleotide; AAG chr11 5282498 5282517 5282501 -
ttgtctttctcatctgtaaa

SEQ ID NO: 42120 - DNA, 20 bp, Artificial Sequence
  Synthetic oligonucleotide; TGG chr11 5282493 5282512 5282496 -
tttctcatctgtaaaaagaa

SEQ ID NO: 42121 - DNA, 20 bp, Artificial Sequence
  Synthetic oligonucleotide; AAG chr11 5282490 5282509 5282493 -
ctcatctgtaaaaagaatgg

SEQ ID NO: 42122 - DNA, 20 bp, Artificial Sequence
  Synthetic oligonucleotide; CAG chr11 5282475 5282494 5282478 -
aatggaagaactcattccta

SEQ ID NO: 42123 - DNA, 20 bp, Artificial Sequence
  Synthetic oligonucleotide; TGG chr11 5282451 5282470 5282454 -
actccctatgtcttccctga

SEQ ID NO: 42124 - DNA, 20 bp, Artificial Sequence
  Synthetic oligonucleotide; GGG chr11 5282450 5282469 5282453 -
ctccctatgtcttccctgat

SEQ ID NO: 42125 - DNA, 20 bp, Artificial Sequence
  Synthetic oligonucleotide; TAG chr11 5282446 5282465 5282449 -
ctatgtcttccctgatgggc

SEQ ID NO: 42126 - DNA, 20 bp, Artificial Sequence
  Synthetic oligonucleotide; GAG chr11 5282444 5282463 5282447 -
atgtcttccctgatgggcta

SEQ ID NO: 42127 - DNA, 20 bp, Artificial Sequence
  Synthetic oligonucleotide; TAG chr11 5282423 5282442 5282426 -
agttcctctttctcaaaaat

SEQ ID NO: 42128 - DNA, 20 bp, Artificial Sequence
  Synthetic oligonucleotide; AAG chr11 5282400 5282419 5282403 -
ccattattgtatttccttct

SEQ ID NO: 42129 - DNA, 20 bp, Artificial Sequence
  Synthetic oligonucleotide; AAG chr11 5282394 5282413 5282397 -
ttgtatttccttctaagcca

SEQ ID NO: 42130 - DNA, 20 bp, Artificial Sequence
  Synthetic oligonucleotide; CAG chr11 5282389 5282408 5282392 -
tttccttctaagccaaagct

SEQ ID NO: 42131 - DNA, 20 bp, Artificial Sequence
  Synthetic oligonucleotide; GAG chr11 5282387 5282406 5282390 -
tccttctaagccaaagctca

SEQ ID NO: 42132 - DNA, 20 bp, Artificial Sequence
  Synthetic oligonucleotide; AGG chr11 5282386 5282405 5282389 -
ccttctaagccaaagctcag

SEQ ID NO: 42133 - DNA, 20 bp, Artificial Sequence
  Synthetic oligonucleotide; CAG chr11 5282371 5282390 5282374 -
ctcagaggtcttgtattgcc

SEQ ID NO: 42134 - DNA, 20 bp, Artificial Sequence
  Synthetic oligonucleotide; TGG chr11 5282356 5282375 5282359 -
ttgcccagtgacatgcacac

SEQ ID NO: 42135 - DNA, 20 bp, Artificial Sequence
  Synthetic oligonucleotide; AAG chr11 5282349 5282368 5282352 -
gtgacatgcacactggtcaa

SEQ ID NO: 42136 - DNA, 20 bp, Artificial Sequence
  Synthetic oligonucleotide; TAG chr11 5282346 5282365 5282349 -
acatgcacactggtcaaaag

SEQ ID NO: 42137 - DNA, 20 bp, Artificial Sequence
  Synthetic oligonucleotide; AGG chr11 5282345 5282364 5282348 -
catgcacactggtcaaaagt

SEQ ID NO: 42138 - DNA, 20 bp, Artificial Sequence
  Synthetic oligonucleotide; AAG chr11 5282340 5282359 5282343 -
acactggtcaaaagtaggct

SEQ ID NO: 42139 - DNA, 20 bp, Artificial Sequence
  Synthetic oligonucleotide; TAG chr11 5282337 5282356 5282340 -
ctggtcaaaagtaggctaag

SEQ ID NO: 42140 - DNA, 20 bp, Artificial Sequence
  Synthetic oligonucleotide; AAG chr11 5282334 5282353 5282337 -
gtcaaaagtaggctaagtag

SEQ ID NO: 42141 - DNA, 20 bp, Artificial Sequence
  Synthetic oligonucleotide; AGG chr11 5282333 5282352 5282336 -
tcaaaagtaggctaagtaga

SEQ ID NO: 42142 - DNA, 20 bp, Artificial Sequence
  Synthetic oligonucleotide; GGG chr11 5282332 5282351 5282335 -
caaaagtaggctaagtagaa

SEQ ID NO: 42143 - DNA, 20 bp, Artificial Sequence
  Synthetic oligonucleotide; CAG chr11 5282321 5282340 5282324 -
taagtagaagggtactttca

SEQ ID NO: 42144 - DNA, 20 bp, Artificial Sequence
  Synthetic oligonucleotide; AGG chr11 5282320 5282339 5282323 -
aagtagaagggtactttcac

SEQ ID NO: 42145 - DNA, 20 bp, Artificial Sequence
  Synthetic oligonucleotide; CAG chr11 5282315 5282334 5282318 -
gaagggtactttcacaggaa

SEQ ID NO: 42146 - DNA, 20 bp, Artificial Sequence
  Synthetic oligonucleotide; GAG chr11 5282313 5282332 5282316 -
agggtactttcacaggaaca

SEQ ID NO: 42147 - DNA, 20 bp, Artificial Sequence
  Synthetic oligonucleotide; GAG chr11 5282311 5282330 5282314 -
ggtactttcacaggaacaga

SEQ ID NO: 42148 - DNA, 20 bp, Artificial Sequence
  Synthetic oligonucleotide; AAG chr11 5282305 5282324 5282308 -
ttcacaggaacagagagcaa

SEQ ID NO: 42149 - DNA, 20 bp, Artificial Sequence
  Synthetic oligonucleotide; GAG chr11 5282303 5282322 5282306 -
cacaggaacagagagcaaaa

SEQ ID NO: 42150 - DNA, 20 bp, Artificial Sequence
  Synthetic oligonucleotide; AGG chr11 5282302 5282321 5282305 -
acaggaacagagagcaaaag

SEQ ID NO: 42151 - DNA, 20 bp, Artificial Sequence
  Synthetic oligonucleotide; TGG chr11 5282299 5282318 5282302 -
ggaacagagagcaaaagagg

SEQ ID NO: 42152 - DNA, 20 bp, Artificial Sequence
  Synthetic oligonucleotide; GGG chr11 5282298 5282317 5282301 -
gaacagagagcaaaagaggt

SEQ ID NO: 42153 - DNA, 20 bp, Artificial Sequence
  Synthetic oligonucleotide; GAG chr11 5282290 5282309 5282293 -
agcaaaagaggtgggtgaat

SEQ ID NO: 42154 - DNA, 20 bp, Artificial Sequence
  Synthetic oligonucleotide; GAG chr11 5282288 5282307 5282291 -
caaaagaggtgggtgaatga

SEQ ID NO: 42155 - DNA, 20 bp, Artificial Sequence
  Synthetic oligonucleotide; AGG chr11 5282287 5282306 5282290 -
aaaagaggtgggtgaatgag

SEQ ID NO: 42156 - DNA, 20 bp, Artificial Sequence
  Synthetic oligonucleotide; GGG chr11 5282286 5282305 5282289 -
aaagaggtgggtgaatgaga

SEQ ID NO: 42157 - DNA, 20 bp, Artificial Sequence
  Synthetic oligonucleotide; AAG chr11 5282282 5282301 5282285 -
aggtgggtgaatgagagggt

SEQ ID NO: 42158 - DNA, 20 bp, Artificial Sequence
  Synthetic oligonucleotide; GAG chr11 5282278 5282297 5282281 -
gggtgaatgagagggtaagt

SEQ ID NO: 42159 - DNA, 20 bp, Artificial Sequence
  Synthetic oligonucleotide; AAG chr11 5282273 5282292 5282276 -
aatgagagggtaagtgagaa

SEQ ID NO: 42160 - DNA, 20 bp, Artificial Sequence
  Synthetic oligonucleotide; GAG chr11 5282264 5282283 5282267 -
gtaagtgagaaaagacaaat

SEQ ID NO: 42161 - DNA, 20 bp, Artificial Sequence
  Synthetic oligonucleotide; AAG chr11 5282261 5282280 5282264 -
agtgagaaaagacaaatgag

SEQ ID NO: 42162 - DNA, 20 bp, Artificial Sequence
  Synthetic oligonucleotide; TGG chr11 5282247 5282266 5282250 -
aatgagaagttacaacatga

SEQ ID NO: 42163 - DNA, 20 bp, Artificial Sequence
  Synthetic oligonucleotide; TAG chr11 5282224 5282243 5282227 -
cttgttgtctaaatatctcc

SEQ ID NO: 42164 - DNA, 20 bp, Artificial Sequence
  Synthetic oligonucleotide; AGG chr11 5282223 5282242 5282226 -
ttgttgtctaaatatctcct

SEQ ID NO: 42165 - DNA, 20 bp, Artificial Sequence
  Synthetic oligonucleotide; GGG chr11 5282222 5282241 5282225 -
tgttgtctaaatatctccta

SEQ ID NO: 42166 - DNA, 20 bp, Artificial Sequence
  Synthetic oligonucleotide; GAG chr11 5282210 5282229 5282213 -
atctcctagggaattattgt

SEQ ID NO: 42167 - DNA, 20 bp, Artificial Sequence
  Synthetic oligonucleotide; GAG chr11 5282208 5282227 5282211 -
ctcctagggaattattgtga

SEQ ID NO: 42168 - DNA, 20 bp, Artificial Sequence
  Synthetic oligonucleotide; AGG chr11 5282207 5282226 5282210 -
tcctagggaattattgtgag

SEQ ID NO: 42169 - DNA, 20 bp, Artificial Sequence
  Synthetic oligonucleotide; TAG chr11 5282198 5282217 5282201 -
attattgtgagaggtctgaa

SEQ ID NO: 42170 - DNA, 20 bp, Artificial Sequence
  Synthetic oligonucleotide; AAG chr11 5282184 5282203 5282187 -
tctgaatagtgttgtaaaat

SEQ ID NO: 42171 - DNA, 20 bp, Artificial Sequence
  Synthetic oligonucleotide; CAG chr11 5282159 5282178 5282162 -
gaatctgctgccaacattaa

SEQ ID NO: 42172 - DNA, 20 bp, Artificial Sequence
  Synthetic oligonucleotide; AAG chr11 5282154 5282173 5282157 -
tgctgccaacattaacagtc

SEQ ID NO: 42173 - DNA, 20 bp, Artificial Sequence
  Synthetic oligonucleotide; AAG chr11 5282114 5282133 5282117 -
tgtacctccaattattcttt

SEQ ID NO: 42174 - DNA, 20 bp, Artificial Sequence
  Synthetic oligonucleotide; AGG chr11 5282113 5282132 5282116 -
gtacctccaattattcttta

SEQ ID NO: 42175 - DNA, 20 bp, Artificial Sequence
  Synthetic oligonucleotide; TAG chr11 5282110 5282129 5282113 -
cctccaattattctttaagg

SEQ ID NO: 42176 - DNA, 20 bp, Artificial Sequence
  Synthetic oligonucleotide; TAG chr11 5282094 5282113 5282097 -
aaggtagcatgcaactgtaa

SEQ ID NO: 42177 - DNA, 20 bp, Artificial Sequence
  Synthetic oligonucleotide; CAG chr11 5282060 5282079 5282063 -
tatttatcataatactgtaa

SEQ ID NO: 42178 - DNA, 20 bp, Artificial Sequence
  Synthetic oligonucleotide; TAG chr11 5282027 5282046 5282030 -
ctgaatatatactgtgtccc

SEQ ID NO: 42179 - DNA, 20 bp, Artificial Sequence
  Synthetic oligonucleotide; TAG chr11 5281984 5282003 5281987 -
tctcatcctcataattctat

SEQ ID NO: 42180 - DNA, 20 bp, Artificial Sequence
  Synthetic oligonucleotide; CAG chr11 5281955 5281974 5281958 -
catattatcatcctatattt

SEQ ID NO: 42181 - DNA, 20 bp, Artificial Sequence
  Synthetic oligonucleotide; GAG chr11 5281953 5281972 5281956 -
tattatcatcctatatttca

SEQ ID NO: 42182 - DNA, 20 bp, Artificial Sequence
  Synthetic oligonucleotide; AAG chr11 5281945 5281964 5281948 -
tcctatatttcagagacttc

SEQ ID NO: 42183 - DNA, 20 bp, Artificial Sequence
  Synthetic oligonucleotide; AAG chr11 5281942 5281961 5281945 -
tatatttcagagacttcaag

SEQ ID NO: 42184 - DNA, 20 bp, Artificial Sequence
  Synthetic oligonucleotide; AAG chr11 5281937 5281956 5281940 -
ttcagagacttcaagaagtt

SEQ ID NO: 42185 - DNA, 20 bp, Artificial Sequence
  Synthetic oligonucleotide; AAG chr11 5281924 5281943 5281927 -
agaagttaagcaacttgctc

SEQ ID NO: 42186 - DNA, 20 bp, Artificial Sequence
  Synthetic oligonucleotide; AAG chr11 5281914 5281933 5281917 -
caacttgctcaagatcatct

SEQ ID NO: 42187 - DNA, 20 bp, Artificial Sequence
  Synthetic oligonucleotide; AAG chr11 5281911 5281930 5281914 -
cttgctcaagatcatctaag

SEQ ID NO: 42188 - DNA, 20 bp, Artificial Sequence
  Synthetic oligonucleotide; TAG chr11 5281908 5281927 5281911 -
gctcaagatcatctaagaag

SEQ ID NO: 42189 - DNA, 20 bp, Artificial Sequence
  Synthetic oligonucleotide; AGG chr11 5281907 5281926 5281910 -
ctcaagatcatctaagaagt

SEQ ID NO: 42190 - DNA, 20 bp, Artificial Sequence
  Synthetic oligonucleotide; TGG chr11 5281904 5281923 5281907 -
aagatcatctaagaagtagg

SEQ ID NO: 42191 - DNA, 20 bp, Artificial Sequence
  Synthetic oligonucleotide; TGG chr11 5281895 5281914 5281898 -
taagaagtaggtggtatttc

SEQ ID NO: 42192 - DNA, 20 bp, Artificial Sequence
  Synthetic oligonucleotide; GGG chr11 5281894 5281913 5281897 -
aagaagtaggtggtatttct

SEQ ID NO: 42193 - DNA, 20 bp, Artificial Sequence
  Synthetic oligonucleotide; TGG chr11 5281885 5281904 5281888 -
gtggtatttctgggctcatt

SEQ ID NO: 42194 - DNA, 20 bp, Artificial Sequence
  Synthetic oligonucleotide; TGG chr11 5281865 5281884 5281868 -
tggcccctcctaatctctca

SEQ ID NO: 42195 - DNA, 20 bp, Artificial Sequence
  Synthetic oligonucleotide; TGG chr11 5281857 5281876 5281860 -
cctaatctctcatggcaaca

SEQ ID NO: 42196 - DNA, 20 bp, Artificial Sequence
  Synthetic oligonucleotide; AAG chr11 5281847 5281866 5281850 -
catggcaacatggctgccta

SEQ ID NO: 42197 - DNA, 20 bp, Artificial Sequence
  Synthetic oligonucleotide; CAG chr11 5281824 5281843 5281827 -
tgttgattgccttaattcat

SEQ ID NO: 42198 - DNA, 20 bp, Artificial Sequence
  Synthetic oligonucleotide; AGG chr11 5281823 5281842 5281826 -
gttgattgccttaattcatc

SEQ ID NO: 42199 - DNA, 20 bp, Artificial Sequence
  Synthetic oligonucleotide; GGG chr11 5281822 5281841 5281825 -
ttgattgccttaattcatca

SEQ ID NO: 42200 - DNA, 20 bp, Artificial Sequence
  Synthetic oligonucleotide; TGG chr11 5281818 5281837 5281821 -
ttgccttaattcatcaggga

SEQ ID NO: 42201 - DNA, 20 bp, Artificial Sequence
  Synthetic oligonucleotide; GGG chr11 5281817 5281836 5281820 -
tgccttaattcatcagggat

SEQ ID NO: 42202 - DNA, 20 bp, Artificial Sequence
  Synthetic oligonucleotide; CAG chr11 5281801 5281820 5281804 -
ggatgggctcatactcactg

SEQ ID NO: 42203 - DNA, 20 bp, Artificial Sequence
  Synthetic oligonucleotide; TGG chr11 5281790 5281809 5281793 -
tactcactgcagaccttaac

SEQ ID NO: 42204 - DNA, 20 bp, Artificial Sequence
  Synthetic oligonucleotide; TAG chr11 5281755 5281774 5281758 -
ttatgtgatctgcctgaccc

SEQ ID NO: 42205 - DNA, 20 bp, Artificial Sequence
  Synthetic oligonucleotide; TAG chr11 5281752 5281771 5281755 -
tgtgatctgcctgaccctag

SEQ ID NO: 42206 - DNA, 20 bp, Artificial Sequence
  Synthetic oligonucleotide; GAG chr11 5281731 5281750 5281734 -
agacttatgaaatttctgat

SEQ ID NO: 42207 - DNA, 20 bp, Artificial Sequence
  Synthetic oligonucleotide; AAG chr11 5281727 5281746 5281730 -
ttatgaaatttctgatgaga

SEQ ID NO: 42208 - DNA, 20 bp, Artificial Sequence
  Synthetic oligonucleotide; AGG chr11 5281726 5281745 5281729 -
tatgaaatttctgatgagaa

SEQ ID NO: 42209 - DNA, 20 bp, Artificial Sequence
  Synthetic oligonucleotide; GAG chr11 5281724 5281743 5281727 -
tgaaatttctgatgagaaag

SEQ ID NO: 42210 - DNA, 20 bp, Artificial Sequence
  Synthetic oligonucleotide; GAG chr11 5281722 5281741 5281725 -
aaatttctgatgagaaagga

SEQ ID NO: 42211 - DNA, 20 bp, Artificial Sequence
  Synthetic oligonucleotide; GAG chr11 5281720 5281739 5281723 -
atttctgatgagaaaggaga

SEQ ID NO: 42212 - DNA, 20 bp, Artificial Sequence
  Synthetic oligonucleotide; AGG chr11 5281719 5281738 5281722 -
tttctgatgagaaaggagag

SEQ ID NO: 42213 - DNA, 20 bp, Artificial Sequence
  Synthetic oligonucleotide; GAG chr11 5281717 5281736 5281720 -
tctgatgagaaaggagagag

SEQ ID NO: 42214 - DNA, 20 bp, Artificial Sequence
  Synthetic oligonucleotide; AAG chr11 5281713 5281732 5281716 -
atgagaaaggagagaggaga

SEQ ID NO: 42215 - DNA, 20 bp, Artificial Sequence
  Synthetic oligonucleotide; AGG chr11 5281712 5281731 5281715 -
tgagaaaggagagaggagaa

SEQ ID NO: 42216 - DNA, 20 bp, Artificial Sequence
  Synthetic oligonucleotide; CAG chr11 5281709 5281728 5281712 -
gaaaggagagaggagaaagg

SEQ ID NO: 42217 - DNA, 20 bp, Artificial Sequence
  Synthetic oligonucleotide; GAG chr11 5281707 5281726 5281710 -
aaggagagaggagaaaggca

SEQ ID NO: 42218 - DNA, 20 bp, Artificial Sequence
  Synthetic oligonucleotide; GAG chr11 5281693 5281712 5281696 -
aaggcagagctgactgtgat

SEQ ID NO: 42219 - DNA, 20 bp, Artificial Sequence
  Synthetic oligonucleotide; AAG chr11 5281685 5281704 5281688 -
gctgactgtgatgagtgatg

SEQ ID NO: 42220 - DNA, 20 bp, Artificial Sequence
  Synthetic oligonucleotide; AGG chr11 5281684 5281703 5281687 -
ctgactgtgatgagtgatga

SEQ ID NO: 42221 - DNA, 20 bp, Artificial Sequence
  Synthetic oligonucleotide; TGG chr11 5281669 5281688 5281672 -
gatgaaggtgccttctcatc

SEQ ID NO: 42222 - DNA, 20 bp, Artificial Sequence
  Synthetic oligonucleotide; GGG chr11 5281668 5281687 5281671 -
atgaaggtgccttctcatct

SEQ ID NO: 42223 - DNA, 20 bp, Artificial Sequence
  Synthetic oligonucleotide; CAG chr11 5281662 5281681 5281665 -
gtgccttctcatctgggtac

SEQ ID NO: 42224 - DNA, 20 bp, Artificial Sequence
  Synthetic oligonucleotide; TGG chr11 5281659 5281678 5281662 -
ccttctcatctgggtaccag

SEQ ID NO: 42225 - DNA, 20 bp, Artificial Sequence
  Synthetic oligonucleotide; GGG chr11 5281658 5281677 5281661 -
cttctcatctgggtaccagt

SEQ ID NO: 42226 - DNA, 20 bp, Artificial Sequence
  Synthetic oligonucleotide; GGG chr11 5281657 5281676 5281660 -
ttctcatctgggtaccagtg

SEQ ID NO: 42227 - DNA, 20 bp, Artificial Sequence
  Synthetic oligonucleotide; AAG chr11 5281649 5281668 5281652 -
tgggtaccagtggggcctct

SEQ ID NO: 42228 - DNA, 20 bp, Artificial Sequence
  Synthetic oligonucleotide; AAG chr11 5281643 5281662 5281646 -
ccagtggggcctctaagact

SEQ ID NO: 42229 - DNA, 20 bp, Artificial Sequence
  Synthetic oligonucleotide; TAG chr11 5281619 5281638 5281622 -
cactctgtctcactgtgtct

SEQ ID NO: 42230 - DNA, 20 bp, Artificial Sequence
  Synthetic oligonucleotide; CAG chr11 5281615 5281634 5281618 -
ctgtctcactgtgtcttagc

SEQ ID NO: 42231 - DNA, 20 bp, Artificial Sequence
  Synthetic oligonucleotide; CAG chr11 5281605 5281624 5281608 -
gtgtcttagccagttcctta

SEQ ID NO: 42232 - DNA, 20 bp, Artificial Sequence
  Synthetic oligonucleotide; TGG chr11 5281592 5281611 5281595 -
ttccttacagcttgccctga

SEQ ID NO: 42233 - DNA, 20 bp, Artificial Sequence
  Synthetic oligonucleotide; GGG chr11 5281591 5281610 5281594 -
tccttacagcttgccctgat

SEQ ID NO: 42234 - DNA, 20 bp, Artificial Sequence
  Synthetic oligonucleotide; GAG chr11 5281589 5281608 5281592 -
cttacagcttgccctgatgg

SEQ ID NO: 42235 - DNA, 20 bp, Artificial Sequence
  Synthetic oligonucleotide; TAG chr11 5281585 5281604 5281588 -
cagcttgccctgatgggaga

SEQ ID NO: 42236 - DNA, 20 bp, Artificial Sequence
  Synthetic oligonucleotide; GAG chr11 5281583 5281602 5281586 -
gcttgccctgatgggagata

SEQ ID NO: 42237 - DNA, 20 bp, Artificial Sequence
  Synthetic oligonucleotide; TGG chr11 5281578 5281597 5281581 -
ccctgatgggagatagagaa

SEQ ID NO: 42238 - DNA, 20 bp, Artificial Sequence
  Synthetic oligonucleotide; GGG chr11 5281577 5281596 5281580 -
cctgatgggagatagagaat

SEQ ID NO: 42239 - DNA, 20 bp, Artificial Sequence
  Synthetic oligonucleotide; AAG chr11 5281540 5281559 5281543 -
aaaataaattttcatttctc

SEQ ID NO: 42240 - DNA, 20 bp, Artificial Sequence
  Synthetic oligonucleotide; AGG chr11 5281539 5281558 5281542 -
aaataaattttcatttctca

SEQ ID NO: 42241 - DNA, 20 bp, Artificial Sequence
  Synthetic oligonucleotide; CAG chr11 5281471 5281490 5281474 -
ccactctctaaaataatcca

SEQ ID NO: 42242 - DNA, 20 bp, Artificial Sequence
  Synthetic oligonucleotide; GAG chr11 5281467 5281486 5281470 -
tctctaaaataatccacagt

SEQ ID NO: 42243 - DNA, 20 bp, Artificial Sequence
  Synthetic oligonucleotide; GAG chr11 5281465 5281484 5281468 -
tctaaaataatccacagtga

SEQ ID NO: 42244 - DNA, 20 bp, Artificial Sequence
  Synthetic oligonucleotide; TGG chr11 5281420 5281439 5281423 -
ataaatacctctattaaata

SEQ ID NO: 42245 - DNA, 20 bp, Artificial Sequence
  Synthetic oligonucleotide; TGG chr11 5281411 5281430 5281414 -
tctattaaatatggaaaatc

SEQ ID NO: 42246 - DNA, 20 bp, Artificial Sequence
  Synthetic oligonucleotide; GGG chr11 5281410 5281429 5281413 -
ctattaaatatggaaaatct

SEQ ID NO: 42247 - DNA, 20 bp, Artificial Sequence
  Synthetic oligonucleotide; TGG chr11 5281405 5281424 5281408 -
aaatatggaaaatctgggca

SEQ ID NO: 42248 - DNA, 20 bp, Artificial Sequence
  Synthetic oligonucleotide; CAG chr11 5281383 5281402 5281386 -
gtgtctcacacctgtaatcc

SEQ ID NO: 42249 - DNA, 20 bp, Artificial Sequence
  Synthetic oligonucleotide; TGG chr11 5281375 5281394 5281378 -
cacctgtaatcccagcactt

SEQ ID NO: 42250 - DNA, 20 bp, Artificial Sequence
  Synthetic oligonucleotide; GGG chr11 5281374 5281393 5281377 -
acctgtaatcccagcacttt

SEQ ID NO: 42251 - DNA, 20 bp, Artificial Sequence
  Synthetic oligonucleotide; GAG chr11 5281372 5281391 5281375 -
ctgtaatcccagcactttgg

SEQ ID NO: 42252 - DNA, 20 bp, Artificial Sequence
  Synthetic oligonucleotide; AGG chr11 5281371 5281390 5281374 -
tgtaatcccagcactttggg

SEQ ID NO: 42253 - DNA, 20 bp, Artificial Sequence
  Synthetic oligonucleotide; GAG chr11 5281366 5281385 5281369 -
tcccagcactttgggaggct

SEQ ID NO: 42254 - DNA, 20 bp, Artificial Sequence
  Synthetic oligonucleotide; AGG chr11 5281365 5281384 5281368 -
cccagcactttgggaggctg

SEQ ID NO: 42255 - DNA, 20 bp, Artificial Sequence
  Synthetic oligonucleotide; TGG chr11 5281362 5281381 5281365 -
agcactttgggaggctgagg

SEQ ID NO: 42256 - DNA, 20 bp, Artificial Sequence
  Synthetic oligonucleotide; GGG chr11 5281361 5281380 5281364 -
gcactttgggaggctgaggt

SEQ ID NO: 42257 - DNA, 20 bp, Artificial Sequence
  Synthetic oligonucleotide; TGG chr11 5281358 5281377 5281361 -
ctttgggaggctgaggtggg

SEQ ID NO: 42258 - DNA, 20 bp, Artificial Sequence
  Synthetic oligonucleotide; TGG chr11 5281349 5281368 5281352 -
gctgaggtgggtggactgct

SEQ ID NO: 42259 - DNA, 20 bp, Artificial Sequence
  Synthetic oligonucleotide; GAG chr11 5281347 5281366 5281350 -
tgaggtgggtggactgcttg

SEQ ID NO: 42260 - DNA, 20 bp, Artificial Sequence
  Synthetic oligonucleotide; CAG chr11 5281342 5281361 5281345 -
tgggtggactgcttggagct

SEQ ID NO: 42261 - DNA, 20 bp, Artificial Sequence
  Synthetic oligonucleotide; AGG chr11 5281341 5281360 5281344 -
gggtggactgcttggagctc

SEQ ID NO: 42262 - DNA, 20 bp, Artificial Sequence
  Synthetic oligonucleotide; GAG chr11 5281339 5281358 5281342 -
gtggactgcttggagctcag

SEQ ID NO: 42263 - DNA, 20 bp, Artificial Sequence
  Synthetic oligonucleotide; AAG chr11 5281333 5281352 5281336 -
tgcttggagctcaggagttc

SEQ ID NO: 42264 - DNA, 20 bp, Artificial Sequence
  Synthetic oligonucleotide; TGG chr11 5281323 5281342 5281326 -
tcaggagttcaagaccatct

SEQ ID NO: 42265 - DNA, 20 bp, Artificial Sequence
  Synthetic oligonucleotide; TGG chr11 5281314 5281333 5281317 -
caagaccatcttggacaaca

SEQ ID NO: 42266 - DNA, 20 bp, Artificial Sequence
  Synthetic oligonucleotide; AAG chr11 5281291 5281310 5281294 -
tgataccctgcctctacaaa

SEQ ID NO: 42267 - DNA, 20 bp, Artificial Sequence
  Synthetic oligonucleotide; TAG chr11 5281279 5281298 5281282 -
tctacaaaaagtacaaaaat

SEQ ID NO: 42268 - DNA, 20 bp, Artificial Sequence
  Synthetic oligonucleotide; TGG chr11 5281274 5281293 5281277 -
aaaaagtacaaaaattagcc

SEQ ID NO: 42269 - DNA, 20 bp, Artificial Sequence
  Synthetic oligonucleotide; TGG chr11 5281269 5281288 5281272 -
gtacaaaaattagcctggca

SEQ ID NO: 42270 - DNA, 20 bp, Artificial Sequence
  Synthetic oligonucleotide; TGG chr11 5281266 5281285 5281269 -
caaaaattagcctggcatgg

SEQ ID NO: 42271 - DNA, 20 bp, Artificial Sequence
  Synthetic oligonucleotide; CAG chr11 5281247 5281266 5281250 -
gtggtgtgcacctgtaatcc

SEQ ID NO: 42272 - DNA, 20 bp, Artificial Sequence
  Synthetic oligonucleotide; TAG chr11 5281240 5281259 5281243 -
gcacctgtaatcccagctat

SEQ ID NO: 42273 - DNA, 20 bp, Artificial Sequence
  Synthetic oligonucleotide; AGG chr11 5281239 5281258 5281242 -
cacctgtaatcccagctatt

SEQ ID NO: 42274 - DNA, 20 bp, Artificial Sequence
  Synthetic oligonucleotide; GGG chr11 5281238 5281257 5281241 -
acctgtaatcccagctatta

SEQ ID NO: 42275 - DNA, 20 bp, Artificial Sequence
  Synthetic oligonucleotide; TGG chr11 5281235 5281254 5281238 -
tgtaatcccagctattaggg

SEQ ID NO: 42276 - DNA, 20 bp, Artificial Sequence
  Synthetic oligonucleotide; GAG chr11 5281230 5281249 5281233 -
tcccagctattagggtggct

SEQ ID NO: 42277 - DNA, 20 bp, Artificial Sequence
  Synthetic oligonucleotide; AGG chr11 5281229 5281248 5281232 -
cccagctattagggtggctg

SEQ ID NO: 42278 - DNA, 20 bp, Artificial Sequence
  Synthetic oligonucleotide; CAG chr11 5281226 5281245 5281229 -
agctattagggtggctgagg

SEQ ID NO: 42279 - DNA, 20 bp, Artificial Sequence
  Synthetic oligonucleotide; AGG chr11 5281225 5281244 5281228 -
gctattagggtggctgaggc

SEQ ID NO: 42280 - DNA, 20 bp, Artificial Sequence
  Synthetic oligonucleotide; GAG chr11 5281223 5281242 5281226 -
tattagggtggctgaggcag

SEQ ID NO: 42281 - DNA, 20 bp, Artificial Sequence
  Synthetic oligonucleotide; CGG chr11 5281207 5281226 5281210 -
gcaggagaattgcttgaacc

SEQ ID NO: 42282 - DNA, 20 bp, Artificial Sequence
  Synthetic oligonucleotide; GGG chr11 5281206 5281225 5281209 -
caggagaattgcttgaaccc

SEQ ID NO: 42283 - DNA, 20 bp, Artificial Sequence
  Synthetic oligonucleotide; GAG chr11 5281204 5281223 5281207 -
ggagaattgcttgaacccgg

SEQ ID NO: 42284 - DNA, 20 bp, Artificial Sequence
  Synthetic oligonucleotide; AGG chr11 5281203 5281222 5281206 -
gagaattgcttgaacccggg

SEQ ID NO: 42285 - DNA, 20 bp, Artificial Sequence
  Synthetic oligonucleotide; CGG chr11 5281200 5281219 5281203 -
aattgcttgaacccgggagg

SEQ ID NO: 42286 - DNA, 20 bp, Artificial Sequence
  Synthetic oligonucleotide; GAG chr11 5281198 5281217 5281201 -
ttgcttgaacccgggaggcg

SEQ ID NO: 42287 - DNA, 20 bp, Artificial Sequence
  Synthetic oligonucleotide; AGG chr11 5281197 5281216 5281200 -
tgcttgaacccgggaggcgg

SEQ ID NO: 42288 - DNA, 20 bp, Artificial Sequence
  Synthetic oligonucleotide; CAG chr11 5281191 5281210 5281194 -
aacccgggaggcggaggttg

SEQ ID NO: 42289 - DNA, 20 bp, Artificial Sequence
  Synthetic oligonucleotide; GAG chr11 5281187 5281206 5281190 -
cgggaggcggaggttgcagt

SEQ ID NO: 42290 - DNA, 20 bp, Artificial Sequence
  Synthetic oligonucleotide; GAG chr11 5281182 5281201 5281185 -
ggcggaggttgcagtgagct

SEQ ID NO: 42291 - DNA, 20 bp, Artificial Sequence
  Synthetic oligonucleotide; CAG chr11 5281162 5281181 5281165 -
gagatcgtgccactgcactc

SEQ ID NO: 42292 - DNA, 20 bp, Artificial Sequence
  Synthetic oligonucleotide; TGG chr11 5281157 5281176 5281160 -
cgtgccactgcactccagcc

SEQ ID NO: 42293 - DNA, 20 bp, Artificial Sequence
  Synthetic oligonucleotide; GGG chr11 5281156 5281175 5281159 -
gtgccactgcactccagcct

SEQ ID NO: 42294 - DNA, 20 bp, Artificial Sequence
  Synthetic oligonucleotide; GGG chr11 5281155 5281174 5281158 -
tgccactgcactccagcctg

SEQ ID NO: 42295 - DNA, 20 bp, Artificial Sequence
  Synthetic oligonucleotide; GGG chr11 5281154 5281173 5281157 -
gccactgcactccagcctgg

SEQ ID NO: 42296 - DNA, 20 bp, Artificial Sequence
  Synthetic oligonucleotide; CAG chr11 5281150 5281169 5281153 -
ctgcactccagcctggggga

SEQ ID NO: 42297 - DNA, 20 bp, Artificial Sequence
  Synthetic oligonucleotide; GAG chr11 5281148 5281167 5281151 -
gcactccagcctgggggaca

SEQ ID NO: 42298 - DNA, 20 bp, Artificial Sequence
  Synthetic oligonucleotide; TGG chr11 5281116 5281135 5281119 -
attaactgttattttttact

SEQ ID NO: 42299 - DNA, 20 bp, Artificial Sequence
  Synthetic oligonucleotide; TGG chr11 5281106 5281125 5281109 -
attttttacttggactcttg

SEQ ID NO: 42300 - DNA, 20 bp, Artificial Sequence
  Synthetic oligonucleotide; GGG chr11 5281105 5281124 5281108 -
ttttttacttggactcttgt

SEQ ID NO: 42301 - DNA, 20 bp, Artificial Sequence
  Synthetic oligonucleotide; GGG chr11 5281104 5281123 5281107 -
tttttacttggactcttgtg

SEQ ID NO: 42302 - DNA, 20 bp, Artificial Sequence
  Synthetic oligonucleotide; AAG chr11 5281098 5281117 5281101 -
cttggactcttgtggggaat

SEQ ID NO: 42303 - DNA, 20 bp, Artificial Sequence
  Synthetic oligonucleotide; AAG chr11 5281067 5281086 5281070 -
tttattcttatttatgattc

SEQ ID NO: 42304 - DNA, 20 bp, Artificial Sequence
  Synthetic oligonucleotide; TAG chr11 5281055 5281074 5281058 -
tatgattcaagcactgaaaa

SEQ ID NO: 42305 - DNA, 20 bp, Artificial Sequence
  Synthetic oligonucleotide; TAG chr11 5281048 5281067 5281051 -
caagcactgaaaatagtgtt

SEQ ID NO: 42306 - DNA, 20 bp, Artificial Sequence
  Synthetic oligonucleotide; CAG chr11 5281041 5281060 5281044 -
tgaaaatagtgtttagcatc

SEQ ID NO: 42307 - DNA, 20 bp, Artificial Sequence
  Synthetic oligonucleotide; CAG chr11 5281038 5281057 5281041 -
aaatagtgtttagcatccag

SEQ ID NO: 42308 - DNA, 20 bp, Artificial Sequence
  Synthetic oligonucleotide; AGG chr11 5281037 5281056 5281040 -
aatagtgtttagcatccagc

SEQ ID NO: 42309 - DNA, 20 bp, Artificial Sequence
  Synthetic oligonucleotide; AAG chr11 5280993 5281012 5280996 -
atgattactatactttttac

SEQ ID NO: 42310 - DNA, 20 bp, Artificial Sequence
  Synthetic oligonucleotide; CAG chr11 5280988 5281007 5280991 -
tactatactttttacaagct

SEQ ID NO: 42311 - DNA, 20 bp, Artificial Sequence
  Synthetic oligonucleotide; CAG chr11 5280969 5280988 5280972 -
tcagctccctctatcccttc

SEQ ID NO: 42312 - DNA, 20 bp, Artificial Sequence
  Synthetic oligonucleotide; AAG chr11 5280945 5280964 5280948 -
atcctcatctctgattaaat

SEQ ID NO: 42313 - DNA, 20 bp, Artificial Sequence
  Synthetic oligonucleotide; CAG chr11 5280939 5280958 5280942 -
atctctgattaaataagctt

SEQ ID NO: 42314 - DNA, 20 bp, Artificial Sequence
  Synthetic oligonucleotide; TAG chr11 5280928 5280947 5280931 -
aataagcttcagtttttcct

SEQ ID NO: 42315 - DNA, 20 bp, Artificial Sequence
  Synthetic oligonucleotide; TAG chr11 5280897 5280916 5280900 -
acatttctgtgtgtctccat

SEQ ID NO: 42316 - DNA, 20 bp, Artificial Sequence
  Synthetic oligonucleotide; TAG chr11 5280884 5280903 5280887 -
tctccattagtgacctccca

SEQ ID NO: 42317 - DNA, 20 bp, Artificial Sequence
  Synthetic oligonucleotide; AAG chr11 5280878 5280897 5280881 -
ttagtgacctcccatagtcc

SEQ ID NO: 42318 - DNA, 20 bp, Artificial Sequence
  Synthetic oligonucleotide; GAG chr11 5280872 5280891 5280875 -
acctcccatagtccaagcat

SEQ ID NO: 42319 - DNA, 20 bp, Artificial Sequence
  Synthetic oligonucleotide; CAG chr11 5280869 5280888 5280872 -
tcccatagtccaagcatgag

SEQ ID NO: 42320 - DNA, 20 bp, Artificial Sequence
  Synthetic oligonucleotide; TGG chr11 5280863 5280882 5280866 -
agtccaagcatgagcagttc

SEQ ID NO: 42321 - DNA, 20 bp, Artificial Sequence
  Synthetic oligonucleotide; CAG chr11 5280859 5280878 5280862 -
caagcatgagcagttctggc

SEQ ID NO: 42322 - DNA, 20 bp, Artificial Sequence
  Synthetic oligonucleotide; AGG chr11 5280858 5280877 5280861 -
aagcatgagcagttctggcc

SEQ ID NO: 42323 - DNA, 20 bp, Artificial Sequence
  Synthetic oligonucleotide; CGG chr11 5280848 5280867 5280851 -
agttctggccaggcccctgt

SEQ ID NO: 42324 - DNA, 20 bp, Artificial Sequence
  Synthetic oligonucleotide; GGG chr11 5280847 5280866 5280850 -
gttctggccaggcccctgtc

SEQ ID NO: 42325 - DNA, 20 bp, Artificial Sequence
  Synthetic oligonucleotide; GGG chr11 5280846 5280865 5280849 -
ttctggccaggcccctgtcg

SEQ ID NO: 42326 - DNA, 20 bp, Artificial Sequence
  Synthetic oligonucleotide; CAG chr11 5280842 5280861 5280845 -
ggccaggcccctgtcggggt

SEQ ID NO: 42327 - DNA, 20 bp, Artificial Sequence
  Synthetic oligonucleotide; TGG chr11 5280821 5280840 5280824 -
agtgccccacccccgccttc

SEQ ID NO: 42328 - DNA, 20 bp, Artificial Sequence
  Synthetic oligonucleotide; AAG chr11 5280802 5280821 5280805 -
ctggttctgtgtaaccttct

SEQ ID NO: 42329 - DNA, 20 bp, Artificial Sequence
  Synthetic oligonucleotide; TGG chr11 5280790 5280809 5280793 -
aaccttctaagcaaaccttc

SEQ ID NO: 42330 - DNA, 20 bp, Artificial Sequence
  Synthetic oligonucleotide; AAG chr11 5280784 5280803 5280787 -
ctaagcaaaccttctggctc

SEQ ID NO: 42331 - DNA, 20 bp, Artificial Sequence
  Synthetic oligonucleotide; CAG chr11 5280779 5280798 5280782 -
caaaccttctggctcaagca

SEQ ID NO: 42332 - DNA, 20 bp, Artificial Sequence
  Synthetic oligonucleotide; GAG chr11 5280769 5280788 5280772 -
ggctcaagcacagcaatgct

SEQ ID NO: 42333 - DNA, 20 bp, Artificial Sequence
  Synthetic oligonucleotide; GAG chr11 5280759 5280778 5280762 -
cagcaatgctgagtcatgat

SEQ ID NO: 42334 - DNA, 20 bp, Artificial Sequence
  Synthetic oligonucleotide; GAG chr11 5280749 5280768 5280752 -
gagtcatgatgagtcatgct

SEQ ID NO: 42335 - DNA, 20 bp, Artificial Sequence
  Synthetic oligonucleotide; AGG chr11 5280748 5280767 5280751 -
agtcatgatgagtcatgctg

SEQ ID NO: 42336 - DNA, 20 bp, Artificial Sequence
  Synthetic oligonucleotide; TAG chr11 5280743 5280762 5280746 -
tgatgagtcatgctgaggct

SEQ ID NO: 42337 - DNA, 20 bp, Artificial Sequence
  Synthetic oligonucleotide; AGG chr11 5280742 5280761 5280745 -
gatgagtcatgctgaggctt

SEQ ID NO: 42338 - DNA, 20 bp, Artificial Sequence
  Synthetic oligonucleotide; GGG chr11 5280741 5280760 5280744 -
atgagtcatgctgaggctta

SEQ ID NO: 42339 - DNA, 20 bp, Artificial Sequence
  Synthetic oligonucleotide; CAG chr11 5280730 5280749 5280733 -
tgaggcttagggtgtgtgcc

SEQ ID NO: 42340 - DNA, 20 bp, Artificial Sequence
  Synthetic oligonucleotide; CAG chr11 5280720 5280739 5280723 -
ggtgtgtgcccagatgttct

SEQ ID NO: 42341 - DNA, 20 bp, Artificial Sequence
  Synthetic oligonucleotide; TAG chr11 5280715 5280734 5280718 -
gtgcccagatgttctcagcc

SEQ ID NO: 42342 - DNA, 20 bp, Artificial Sequence
  Synthetic oligonucleotide; GAG chr11 5280713 5280732 5280716 -
gcccagatgttctcagccta

SEQ ID NO: 42343 - DNA, 20 bp, Artificial Sequence
  Synthetic oligonucleotide; TGG chr11 5280696 5280715 5280699 -
ctagagtgatgactcctatc

SEQ ID NO: 42344 - DNA, 20 bp, Artificial Sequence
  Synthetic oligonucleotide; GGG chr11 5280695 5280714 5280698 -
tagagtgatgactcctatct

SEQ ID NO: 42345 - DNA, 20 bp, Artificial Sequence
  Synthetic oligonucleotide; CAG chr11 5280688 5280707 5280691 -
atgactcctatctgggtccc

SEQ ID NO: 42346 - DNA, 20 bp, Artificial Sequence
  Synthetic oligonucleotide; CAG chr11 5280685 5280704 5280688 -
actcctatctgggtccccag

SEQ ID NO: 42347 - DNA, 20 bp, Artificial Sequence
  Synthetic oligonucleotide; AGG chr11 5280684 5280703 5280687 -
ctcctatctgggtccccagc

SEQ ID NO: 42348 - DNA, 20 bp, Artificial Sequence
  Synthetic oligonucleotide; CAG chr11 5280674 5280693 5280677 -
ggtccccagcaggatgctta

SEQ ID NO: 42349 - DNA, 20 bp, Artificial Sequence
  Synthetic oligonucleotide; AGG chr11 5280673 5280692 5280676 -
gtccccagcaggatgcttac

SEQ ID NO: 42350 - DNA, 20 bp, Artificial Sequence
  Synthetic oligonucleotide; GGG chr11 5280672 5280691 5280675 -
tccccagcaggatgcttaca

SEQ ID NO: 42351 - DNA, 20 bp, Artificial Sequence
  Synthetic oligonucleotide; CAG chr11 5280669 5280688 5280672 -
ccagcaggatgcttacaggg

SEQ ID NO: 42352 - DNA, 20 bp, Artificial Sequence
  Synthetic oligonucleotide; TGG chr11 5280665 5280684 5280668 -
caggatgcttacagggcaga

SEQ ID NO: 42353 - DNA, 20 bp, Artificial Sequence
  Synthetic oligonucleotide; AAG chr11 5280655 5280674 5280658 -
acagggcagatggcaaaaaa

SEQ ID NO: 42354 - DNA, 20 bp, Artificial Sequence
  Synthetic oligonucleotide; AGG chr11 5280654 5280673 5280657 -
cagggcagatggcaaaaaaa

SEQ ID NO: 42355 - DNA, 20 bp, Artificial Sequence
  Synthetic oligonucleotide; GAG chr11 5280652 5280671 5280655 -
gggcagatggcaaaaaaaag

SEQ ID NO: 42356 - DNA, 20 bp, Artificial Sequence
  Synthetic oligonucleotide; AAG chr11 5280649 5280668 5280652 -
cagatggcaaaaaaaaggag

SEQ ID NO: 42357 - DNA, 20 bp, Artificial Sequence
  Synthetic oligonucleotide; CGG chr11 5280616 5280635 5280619 -
gactaaaactccacctcaaa

SEQ ID NO: 42358 - DNA, 20 bp, Artificial Sequence
  Synthetic oligonucleotide; AAG chr11 5280606 5280625 5280609 -
ccacctcaaacggcatcata

SEQ ID NO: 42359 - DNA, 20 bp, Artificial Sequence
  Synthetic oligonucleotide; TGG chr11 5280599 5280618 5280602 -
aaacggcatcataaagaaaa

SEQ ID NO: 42360 - DNA, 20 bp, Artificial Sequence
  Synthetic oligonucleotide; GAG chr11 5280590 5280609 5280593 -
cataaagaaaatggatgcct

SEQ ID NO: 42361 - DNA, 20 bp, Artificial Sequence
  Synthetic oligonucleotide; CAG chr11 5280586 5280605 5280589 -
aagaaaatggatgcctgaga

SEQ ID NO: 42362 - DNA, 20 bp, Artificial Sequence
  Synthetic oligonucleotide; TAG chr11 5280569 5280588 5280572 -
agacagaatgtgacatattc

SEQ ID NO: 42363 - DNA, 20 bp, Artificial Sequence
  Synthetic oligonucleotide; TAG chr11 5280480 5280499 5280483 -
tttgttgttatcaattgcca

SEQ ID NO: 42364 - DNA, 20 bp, Artificial Sequence
  Synthetic oligonucleotide; TAG chr11 5280471 5280490 5280474 -
atcaattgccatagaatgat

SEQ ID NO: 42365 - DNA, 20 bp, Artificial Sequence
  Synthetic oligonucleotide; CAG chr11 5280442 5280461 5280445 -
tgaatcaaatatttatcttg

SEQ ID NO: 42366 - DNA, 20 bp, Artificial Sequence
  Synthetic oligonucleotide; AGG chr11 5280441 5280460 5280444 -
gaatcaaatatttatcttgc

SEQ ID NO: 42367 - DNA, 20 bp, Artificial Sequence
  Synthetic oligonucleotide; TGG chr11 5280438 5280457 5280441 -
tcaaatatttatcttgcagg

SEQ ID NO: 42368 - DNA, 20 bp, Artificial Sequence
  Synthetic oligonucleotide; TAG chr11 5280425 5280444 5280428 -
ttgcaggtggcctctatacc

SEQ ID NO: 42369 - DNA, 20 bp, Artificial Sequence
  Synthetic oligonucleotide; AAG chr11 5280422 5280441 5280425 -
caggtggcctctatacctag

SEQ ID NO: 42370 - DNA, 20 bp, Artificial Sequence
  Synthetic oligonucleotide; CGG chr11 5280419 5280438 5280422 -
gtggcctctatacctagaag

SEQ ID NO: 42371 - DNA, 20 bp, Artificial Sequence
  Synthetic oligonucleotide; CAG chr11 5280416 5280435 5280419 -
gcctctatacctagaagcgg

SEQ ID NO: 42372 - DNA, 20 bp, Artificial Sequence
  Synthetic oligonucleotide; CAG chr11 5280410 5280429 5280413 -
atacctagaagcggcagaat

SEQ ID NO: 42373 - DNA, 20 bp, Artificial Sequence
  Synthetic oligonucleotide; AGG chr11 5280409 5280428 5280412 -
tacctagaagcggcagaatc

SEQ ID NO: 42374 - DNA, 20 bp, Artificial Sequence
  Synthetic oligonucleotide; TAG chr11 5280387 5280406 5280390 -
gctttattaatacatgtgta

SEQ ID NO: 42375 - DNA, 20 bp, Artificial Sequence
  Synthetic oligonucleotide; TAG chr11 5280379 5280398 5280382 -
aatacatgtgtatagatttt

SEQ ID NO: 42376 - DNA, 20 bp, Artificial Sequence
  Synthetic oligonucleotide; AGG chr11 5280378 5280397 5280381 -
atacatgtgtatagattttt

SEQ ID NO: 42377 - DNA, 20 bp, Artificial Sequence
  Synthetic oligonucleotide; AAG chr11 5280348 5280367 5280351 -
cacatgtattaatatgaaac

SEQ ID NO: 42378 - DNA, 20 bp, Artificial Sequence
  Synthetic oligonucleotide; AGG chr11 5280347 5280366 5280350 -
acatgtattaatatgaaaca

SEQ ID NO: 42379 - DNA, 20 bp, Artificial Sequence
  Synthetic oligonucleotide; TGG chr11 5280341 5280360 5280344 -
attaatatgaaacaaggata

SEQ ID NO: 42380 - DNA, 20 bp, Artificial Sequence
  Synthetic oligonucleotide; AAG chr11 5280338 5280357 5280341 -
aatatgaaacaaggatatgg

SEQ ID NO: 42381 - DNA, 20 bp, Artificial Sequence
  Synthetic oligonucleotide; GAG chr11 5280336 5280355 5280339 -
tatgaaacaaggatatggaa

SEQ ID NO: 42382 - DNA, 20 bp, Artificial Sequence
  Synthetic oligonucleotide; AGG chr11 5280335 5280354 5280338 -
atgaaacaaggatatggaag

SEQ ID NO: 42383 - DNA, 20 bp, Artificial Sequence
  Synthetic oligonucleotide; AAG chr11 5280332 5280351 5280335 -
aaacaaggatatggaagagg

SEQ ID NO: 42384 - DNA, 20 bp, Artificial Sequence
  Synthetic oligonucleotide; AGG chr11 5280331 5280350 5280334 -
aacaaggatatggaagagga

SEQ ID NO: 42385 - DNA, 20 bp, Artificial Sequence
  Synthetic oligonucleotide; CAG chr11 5280320 5280339 5280323 -
ggaagaggaaggcatgaaaa

SEQ ID NO: 42386 - DNA, 20 bp, Artificial Sequence
  Synthetic oligonucleotide; AGG chr11 5280319 5280338 5280322 -
gaagaggaaggcatgaaaac

SEQ ID NO: 42387 - DNA, 20 bp, Artificial Sequence
  Synthetic oligonucleotide; AAG chr11 5280314 5280333 5280317 -
ggaaggcatgaaaacaggaa

SEQ ID NO: 42388 - DNA, 20 bp, Artificial Sequence
  Synthetic oligonucleotide; AAG chr11 5280287 5280306 5280290 -
caaaccttgtttgccatttt

SEQ ID NO: 42389 - DNA, 20 bp, Artificial Sequence
  Synthetic oligonucleotide; AGG chr11 5280286 5280305 5280289 -
aaaccttgtttgccatttta

SEQ ID NO: 42390 - DNA, 20 bp, Artificial Sequence
  Synthetic oligonucleotide; TGG chr11 5280277 5280296 5280280 -
ttgccattttaaggcacccc

SEQ ID NO: 42391 - DNA, 20 bp, Artificial Sequence
  Synthetic oligonucleotide; CAG chr11 5280273 5280292 5280276 -
cattttaaggcacccctgga

SEQ ID NO: 42392 - DNA, 20 bp, Artificial Sequence
  Synthetic oligonucleotide; TAG chr11 5280269 5280288 5280272 -
ttaaggcacccctggacagc

SEQ ID NO: 42393 - DNA, 20 bp, Artificial Sequence
  Synthetic oligonucleotide; AGG chr11 5280268 5280287 5280271 -
taaggcacccctggacagct

SEQ ID NO: 42394 - DNA, 20 bp, Artificial Sequence
  Synthetic oligonucleotide; TGG chr11 5280265 5280284 5280268 -
ggcacccctggacagctagg

SEQ ID NO: 42395 - DNA, 20 bp, Artificial Sequence
  Synthetic oligonucleotide; AAG chr11 5280259 5280278 5280262 -
cctggacagctaggtggcaa

SEQ ID NO: 42396 - DNA, 20 bp, Artificial Sequence
  Synthetic oligonucleotide; AGG chr11 5280258 5280277 5280261 -
ctggacagctaggtggcaaa

SEQ ID NO: 42397 - DNA, 20 bp, Artificial Sequence
  Synthetic oligonucleotide; TAG chr11 5280245 5280264 5280248 -
tggcaaaaggcctgtgctgt

SEQ ID NO: 42398 - DNA, 20 bp, Artificial Sequence
  Synthetic oligonucleotide; GAG chr11 5280243 5280262 5280246 -
gcaaaaggcctgtgctgtta

SEQ ID NO: 42399 - DNA, 20 bp, Artificial Sequence
  Synthetic oligonucleotide; AGG chr11 5280242 5280261 5280245 -
caaaaggcctgtgctgttag

SEQ ID NO: 42400 - DNA, 20 bp, Artificial Sequence
  Synthetic oligonucleotide; CGG chr11 5280224 5280243 5280227 -
agaggacacatgctcacata

SEQ ID NO: 42401 - DNA, 20 bp, Artificial Sequence
  Synthetic oligonucleotide; GGG chr11 5280223 5280242 5280226 -
gaggacacatgctcacatac

SEQ ID NO: 42402 - DNA, 20 bp, Artificial Sequence
  Synthetic oligonucleotide; GGG chr11 5280222 5280241 5280225 -
aggacacatgctcacatacg

SEQ ID NO: 42403 - DNA, 20 bp, Artificial Sequence
  Synthetic oligonucleotide; CAG chr11 5280218 5280237 5280221 -
cacatgctcacatacggggt

SEQ ID NO: 42404 - DNA, 20 bp, Artificial Sequence
  Synthetic oligonucleotide; TGG chr11 5280207 5280226 5280210 -
atacggggtcagatctgact

SEQ ID NO: 42405 - DNA, 20 bp, Artificial Sequence
  Synthetic oligonucleotide; GGG chr11 5280206 5280225 5280209 -
tacggggtcagatctgactt

SEQ ID NO: 42406 - DNA, 20 bp, Artificial Sequence
  Synthetic oligonucleotide; GGG chr11 5280205 5280224 5280208 -
acggggtcagatctgacttg

SEQ ID NO: 42407 - DNA, 20 bp, Artificial Sequence
  Synthetic oligonucleotide; TGG chr11 5280196 5280215 5280199 -
gatctgacttggggtgctac

SEQ ID NO: 42408 - DNA, 20 bp, Artificial Sequence
  Synthetic oligonucleotide; GGG chr11 5280195 5280214 5280198 -
atctgacttggggtgctact

SEQ ID NO: 42409 - DNA, 20 bp, Artificial Sequence
  Synthetic oligonucleotide; AAG chr11 5280192 5280211 5280195 -
tgacttggggtgctactggg

SEQ ID NO: 42410 - DNA, 20 bp, Artificial Sequence
  Synthetic oligonucleotide; AAG chr11 5280179 5280198 5280182 -
tactgggaagctctcatctt

SEQ ID NO: 42411 - DNA, 20 bp, Artificial Sequence
  Synthetic oligonucleotide; AGG chr11 5280178 5280197 5280181 -
actgggaagctctcatctta

SEQ ID NO: 42412 - DNA, 20 bp, Artificial Sequence
  Synthetic oligonucleotide; CAG chr11 5280167 5280186 5280170 -
ctcatcttaaggatacatct

SEQ ID NO: 42413 - DNA, 20 bp, Artificial Sequence
  Synthetic oligonucleotide; AGG chr11 5280166 5280185 5280169 -
tcatcttaaggatacatctc

SEQ ID NO: 42414 - DNA, 20 bp, Artificial Sequence
  Synthetic oligonucleotide; CAG chr11 5280162 5280181 5280165 -
cttaaggatacatctcaggc

SEQ ID NO: 42415 - DNA, 20 bp, Artificial Sequence
  Synthetic oligonucleotide; TGG chr11 5280156 5280175 5280159 -
gatacatctcaggccagtct

SEQ ID NO: 42416 - DNA, 20 bp, Artificial Sequence
  Synthetic oligonucleotide; TAG chr11 5280148 5280167 5280151 -
tcaggccagtcttggtgcat

SEQ ID NO: 42417 - DNA, 20 bp, Artificial Sequence
  Synthetic oligonucleotide; AGG chr11 5280147 5280166 5280150 -
caggccagtcttggtgcatt

SEQ ID NO: 42418 - DNA, 20 bp, Artificial Sequence
  Synthetic oligonucleotide; AAG chr11 5280144 5280163 5280147 -
gccagtcttggtgcattagg

SEQ ID NO: 42419 - DNA, 20 bp, Artificial Sequence
  Synthetic oligonucleotide; TAG chr11 5280138 5280157 5280141 -
cttggtgcattaggaagatg

SEQ ID NO: 42420 - DNA, 20 bp, Artificial Sequence
  Synthetic oligonucleotide; AGG chr11 5280137 5280156 5280140 -
ttggtgcattaggaagatgt

SEQ ID NO: 42421 - DNA, 20 bp, Artificial Sequence
  Synthetic oligonucleotide; GAG chr11 5280121 5280140 5280124 -
atgtaggcaactctgatcct

SEQ ID NO: 42422 - DNA, 20 bp, Artificial Sequence
  Synthetic oligonucleotide; GAG chr11 5280119 5280138 5280122 -
gtaggcaactctgatcctga

SEQ ID NO: 42423 - DNA, 20 bp, Artificial Sequence
  Synthetic oligonucleotide; AGG chr11 5280118 5280137 5280121 -
taggcaactctgatcctgag

SEQ ID NO: 42424 - DNA, 20 bp, Artificial Sequence
  Synthetic oligonucleotide; AAG chr11 5280114 5280133 5280117 -
caactctgatcctgagagga

SEQ ID NO: 42425 - DNA, 20 bp, Artificial Sequence
  Synthetic oligonucleotide; CAG chr11 5280100 5280119 5280103 -
agaggaaagaaacattcctc

SEQ ID NO: 42426 - DNA, 20 bp, Artificial Sequence
  Synthetic oligonucleotide; AGG chr11 5280099 5280118 5280102 -
gaggaaagaaacattcctcc

SEQ ID NO: 42427 - DNA, 20 bp, Artificial Sequence
  Synthetic oligonucleotide; GAG chr11 5280097 5280116 5280100 -
ggaaagaaacattcctccag

SEQ ID NO: 42428 - DNA, 20 bp, Artificial Sequence
  Synthetic oligonucleotide; GAG chr11 5280095 5280114 5280098 -
aaagaaacattcctccagga

SEQ ID NO: 42429 - DNA, 20 bp, Artificial Sequence
  Synthetic oligonucleotide; AAG chr11 5280088 5280107 5280091 -
cattcctccaggagagctaa

SEQ ID NO: 42430 - DNA, 20 bp, Artificial Sequence
  Synthetic oligonucleotide; AGG chr11 5280087 5280106 5280090 -
attcctccaggagagctaaa

SEQ ID NO: 42431 - DNA, 20 bp, Artificial Sequence
  Synthetic oligonucleotide; GGG chr11 5280086 5280105 5280089 -
ttcctccaggagagctaaaa

SEQ ID NO: 42432 - DNA, 20 bp, Artificial Sequence
  Synthetic oligonucleotide; TGG chr11 5280073 5280092 5280076 -
gctaaaagggttcacctgtg

SEQ ID NO: 42433 - DNA, 20 bp, Artificial Sequence
  Synthetic oligonucleotide; GGG chr11 5280072 5280091 5280075 -
ctaaaagggttcacctgtgt

SEQ ID NO: 42434 - DNA, 20 bp, Artificial Sequence
  Synthetic oligonucleotide; AAG chr11 5280061 5280080 5280064 -
cacctgtgtgggtaactgtg

SEQ ID NO: 42435 - DNA, 20 bp, Artificial Sequence
  Synthetic oligonucleotide; AGG chr11 5280060 5280079 5280063 -
acctgtgtgggtaactgtga

SEQ ID NO: 42436 - DNA, 20 bp, Artificial Sequence
  Synthetic oligonucleotide; AAG chr11 5280052 5280071 5280055 -
gggtaactgtgaaggactac

SEQ ID NO: 42437 - DNA, 20 bp, Artificial Sequence
  Synthetic oligonucleotide; GAG chr11 5280050 5280069 5280053 -
gtaactgtgaaggactacaa

SEQ ID NO: 42438 - DNA, 20 bp, Artificial Sequence
  Synthetic oligonucleotide; AGG chr11 5280049 5280068 5280052 -
taactgtgaaggactacaag

SEQ ID NO: 42439 - DNA, 20 bp, Artificial Sequence
  Synthetic oligonucleotide; CAG chr11 5280032 5280051 5280035 -
aagaggatgaaaaacaatga

SEQ ID NO: 42440 - DNA, 20 bp, Artificial Sequence
  Synthetic oligonucleotide; CAG chr11 5280028 5280047 5280031 -
ggatgaaaaacaatgacaga

SEQ ID NO: 42441 - DNA, 20 bp, Artificial Sequence
  Synthetic oligonucleotide; TGG chr11 5280013 5280032 5280016 -
acagacagacataatgcttg

SEQ ID NO: 42442 - DNA, 20 bp, Artificial Sequence
  Synthetic oligonucleotide; GGG chr11 5280012 5280031 5280015 -
cagacagacataatgcttgt

SEQ ID NO: 42443 - DNA, 20 bp, Artificial Sequence
  Synthetic oligonucleotide; GAG chr11 5280010 5280029 5280013 -
gacagacataatgcttgtgg

SEQ ID NO: 42444 - DNA, 20 bp, Artificial Sequence
  Synthetic oligonucleotide; CAG chr11 5280001 5280020 5280004 -
aatgcttgtgggagaaaaaa

SEQ ID NO: 42445 - DNA, 20 bp, Artificial Sequence
  Synthetic oligonucleotide; AGG chr11 5280000 5280019 5280003 -
atgcttgtgggagaaaaaac

SEQ ID NO: 42446 - DNA, 20 bp, Artificial Sequence
  Synthetic oligonucleotide; GAG chr11 5279998 5280017 5280001 -
gcttgtgggagaaaaaacag

SEQ ID NO: 42447 - DNA, 20 bp, Artificial Sequence
  Synthetic oligonucleotide; AGG chr11 5279997 5280016 5280000 -
cttgtgggagaaaaaacagg

SEQ ID NO: 42448 - DNA, 20 bp, Artificial Sequence
  Synthetic oligonucleotide; AAG chr11 5279992 5280011 5279995 -
gggagaaaaaacaggaggtc

SEQ ID NO: 42449 - DNA, 20 bp, Artificial Sequence
  Synthetic oligonucleotide; AGG chr11 5279991 5280010 5279994 -
ggagaaaaaacaggaggtca

SEQ ID NO: 42450 - DNA, 20 bp, Artificial Sequence
  Synthetic oligonucleotide; GGG chr11 5279990 5280009 5279993 -
gagaaaaaacaggaggtcaa

SEQ ID NO: 42451 - DNA, 20 bp, Artificial Sequence
  Synthetic oligonucleotide; GGG chr11 5279989 5280008 5279992 -
agaaaaaacaggaggtcaag

SEQ ID NO: 42452 - DNA, 20 bp, Artificial Sequence
  Synthetic oligonucleotide; TAG chr11 5279985 5280004 5279988 -
aaaacaggaggtcaagggga

SEQ ID NO: 42453 - DNA, 20 bp, Artificial Sequence
  Synthetic oligonucleotide; GAG chr11 5279983 5280002 5279986 -
aacaggaggtcaaggggata

SEQ ID NO: 42454 - DNA, 20 bp, Artificial Sequence
  Synthetic oligonucleotide; AAG chr11 5279980 5279999 5279983 -
aggaggtcaaggggatagag

SEQ ID NO: 42455 - DNA, 20 bp, Artificial Sequence
  Synthetic oligonucleotide; AGG chr11 5279979 5279998 5279982 -
ggaggtcaaggggatagaga

SEQ ID NO: 42456 - DNA, 20 bp, Artificial Sequence
  Synthetic oligonucleotide; CAG chr11 5279972 5279991 5279975 -
aaggggatagagaaggcttc

SEQ ID NO: 42457 - DNA, 20 bp, Artificial Sequence
  Synthetic oligonucleotide; AAG chr11 5279969 5279988 5279972 -
gggatagagaaggcttccag

SEQ ID NO: 42458 - DNA, 20 bp, Artificial Sequence
  Synthetic oligonucleotide; TGG chr11 5279964 5279983 5279967 -
agagaaggcttccagaagaa

SEQ ID NO: 42459 - DNA, 20 bp, Artificial Sequence
  Synthetic oligonucleotide; AAG chr11 5279956 5279975 5279959 -
cttccagaagaatggctttg

SEQ ID NO: 42460 - DNA, 20 bp, Artificial Sequence
  Synthetic oligonucleotide; TGG chr11 5279952 5279971 5279955 -
cagaagaatggctttgaagc

SEQ ID NO: 42461 - DNA, 20 bp, Artificial Sequence
  Synthetic oligonucleotide; TAG chr11 5279943 5279962 5279946 -
ggctttgaagctggcttctg

SEQ ID NO: 42462 - DNA, 20 bp, Artificial Sequence
  Synthetic oligonucleotide; AGG chr11 5279942 5279961 5279945 -
gctttgaagctggcttctgt

SEQ ID NO: 42463 - DNA, 20 bp, Artificial Sequence
  Synthetic oligonucleotide; GAG chr11 5279940 5279959 5279943 -
tttgaagctggcttctgtag

SEQ ID NO: 42464 - DNA, 20 bp, Artificial Sequence
  Synthetic oligonucleotide; CAG chr11 5279933 5279952 5279936 -
ctggcttctgtaggagttca

SEQ ID NO: 42465 - DNA, 20 bp, Artificial Sequence
  Synthetic oligonucleotide; TGG chr11 5279930 5279949 5279933 -
gcttctgtaggagttcacag

SEQ ID NO: 42466 - DNA, 20 bp, Artificial Sequence
  Synthetic oligonucleotide; AAG chr11 5279925 5279944 5279928 -
tgtaggagttcacagtggca

SEQ ID NO: 42467 - DNA, 20 bp, Artificial Sequence
  Synthetic oligonucleotide; CAG chr11 5279916 5279935 5279919 -
tcacagtggcaaagatgttt

SEQ ID NO: 42468 - DNA, 20 bp, Artificial Sequence
  Synthetic oligonucleotide; AAG chr11 5279897 5279916 5279900 -
tcagaaatgtgacatgactt

SEQ ID NO: 42469 - DNA, 20 bp, Artificial Sequence
  Synthetic oligonucleotide; AGG chr11 5279896 5279915 5279899 -
cagaaatgtgacatgactta

SEQ ID NO: 42470 - DNA, 20 bp, Artificial Sequence
  Synthetic oligonucleotide; AAG chr11 5279882 5279901 5279885 -
gacttaaggaactatacaaa

SEQ ID NO: 42471 - DNA, 20 bp, Artificial Sequence
  Synthetic oligonucleotide; AGG chr11 5279881 5279900 5279884 -
acttaaggaactatacaaaa

SEQ ID NO: 42472 - DNA, 20 bp, Artificial Sequence
  Synthetic oligonucleotide; AAG chr11 5279869 5279888 5279872 -
atacaaaaaggaacaaattt

SEQ ID NO: 42473 - DNA, 20 bp, Artificial Sequence
  Synthetic oligonucleotide; AGG chr11 5279868 5279887 5279871 -
tacaaaaaggaacaaattta

SEQ ID NO: 42474 - DNA, 20 bp, Artificial Sequence
  Synthetic oligonucleotide; GAG chr11 5279866 5279885 5279869 -
caaaaaggaacaaatttaag

SEQ ID NO: 42475 - DNA, 20 bp, Artificial Sequence
  Synthetic oligonucleotide; GAG chr11 5279864 5279883 5279867 -
aaaaggaacaaatttaagga

SEQ ID NO: 42476 - DNA, 20 bp, Artificial Sequence
  Synthetic oligonucleotide; AGG chr11 5279863 5279882 5279866 -
aaaggaacaaatttaaggag

SEQ ID NO: 42477 - DNA, 20 bp, Artificial Sequence
  Synthetic oligonucleotide; CAG chr11 5279860 5279879 5279863 -
ggaacaaatttaaggagagg

SEQ ID NO: 42478 - DNA, 20 bp, Artificial Sequence
  Synthetic oligonucleotide; TAG chr11 5279851 5279870 5279854 -
ttaaggagaggcagataaat

SEQ ID NO: 42479 - DNA, 20 bp, Artificial Sequence
  Synthetic oligonucleotide; CAG chr11 5279843 5279862 5279846 -
aggcagataaattagttcaa

SEQ ID NO: 42480 - DNA, 20 bp, Artificial Sequence
  Synthetic oligonucleotide; AAG chr11 5279834 5279853 5279837 -
aattagttcaacagacatgc

SEQ ID NO: 42481 - DNA, 20 bp, Artificial Sequence
  Synthetic oligonucleotide; AGG chr11 5279833 5279852 5279836 -
attagttcaacagacatgca

SEQ ID NO: 42482 - DNA, 20 bp, Artificial Sequence
  Synthetic oligonucleotide; CAG chr11 5279824 5279843 5279827 -
acagacatgcaaggaatttt

SEQ ID NO: 42483 - DNA, 20 bp, Artificial Sequence
  Synthetic oligonucleotide; GAG chr11 5279801 5279820 5279804 -
atgaatgttatgtctccact

SEQ ID NO: 42484 - DNA, 20 bp, Artificial Sequence
  Synthetic oligonucleotide; GAG chr11 5279792 5279811 5279795 -
atgtctccactgagcttctt

SEQ ID NO: 42485 - DNA, 20 bp, Artificial Sequence
  Synthetic oligonucleotide; AGG chr11 5279791 5279810 5279794 -
tgtctccactgagcttcttg

SEQ ID NO: 42486 - DNA, 20 bp, Artificial Sequence
  Synthetic oligonucleotide; TAG chr11 5279787 5279806 5279790 -
tccactgagcttcttgaggt

SEQ ID NO: 42487 - DNA, 20 bp, Artificial Sequence
  Synthetic oligonucleotide; CAG chr11 5279784 5279803 5279787 -
actgagcttcttgaggttag

SEQ ID NO: 42488 - DNA, 20 bp, Artificial Sequence
  Synthetic oligonucleotide; GAG chr11 5279777 5279796 5279780 -
ttcttgaggttagcagctgt

SEQ ID NO: 42489 - DNA, 20 bp, Artificial Sequence
  Synthetic oligonucleotide; AGG chr11 5279776 5279795 5279779 -
tcttgaggttagcagctgtg

SEQ ID NO: 42490 - DNA, 20 bp, Artificial Sequence
  Synthetic oligonucleotide; GGG chr11 5279775 5279794 5279778 -
cttgaggttagcagctgtga

SEQ ID NO: 42491 - DNA, 20 bp, Artificial Sequence
  Synthetic oligonucleotide; CAG chr11 5279767 5279786 5279770 -
tagcagctgtgagggttttg

SEQ ID NO: 42492 - DNA, 20 bp, Artificial Sequence
  Synthetic oligonucleotide; AGG chr11 5279766 5279785 5279769 -
agcagctgtgagggttttgc

SEQ ID NO: 42493 - DNA, 20 bp, Artificial Sequence
  Synthetic oligonucleotide; CAG chr11 5279761 5279780 5279764 -
ctgtgagggttttgcaggcc

SEQ ID NO: 42494 - DNA, 20 bp, Artificial Sequence
  Synthetic oligonucleotide; AGG chr11 5279760 5279779 5279763 -
tgtgagggttttgcaggccc

SEQ ID NO: 42495 - DNA, 20 bp, Artificial Sequence
  Synthetic oligonucleotide; CAG chr11 5279749 5279768 5279752 -
tgcaggcccaggacccatta

SEQ ID NO: 42496 - DNA, 20 bp, Artificial Sequence
  Synthetic oligonucleotide; AGG chr11 5279748 5279767 5279751 -
gcaggcccaggacccattac

SEQ ID NO: 42497 - DNA, 20 bp, Artificial Sequence
  Synthetic oligonucleotide; CAG chr11 5279687 5279706 5279690 -
gtgaatgaatgacctcttgt

SEQ ID NO: 42498 - DNA, 20 bp, Artificial Sequence
  Synthetic oligonucleotide; CGG chr11 5279678 5279697 5279681 -
tgacctcttgtcagtctact

SEQ ID NO: 42499 - DNA, 20 bp, Artificial Sequence
  Synthetic oligonucleotide; CAG chr11 5279648 5279667 5279651 -
gtgaatgaatgatgtcttgt

SEQ ID NO: 42500 - DNA, 20 bp, Artificial Sequence
  Synthetic oligonucleotide; TGG chr11 5279639 5279658 5279642 -
tgatgtcttgtcagcctact

SEQ ID NO: 42501 - DNA, 20 bp, Artificial Sequence
  Synthetic oligonucleotide; AAG chr11 5279629 5279648 5279632 -
tcagcctacttggtttcgct

SEQ ID NO: 42502 - DNA, 20 bp, Artificial Sequence
  Synthetic oligonucleotide; GAG chr11 5279627 5279646 5279630 -
agcctacttggtttcgctaa

SEQ ID NO: 42503 - DNA, 20 bp, Artificial Sequence
  Synthetic oligonucleotide; CAG chr11 5279622 5279641 5279625 -
acttggtttcgctaagagca

SEQ ID NO: 42504 - DNA, 20 bp, Artificial Sequence
  Synthetic oligonucleotide; GAG chr11 5279620 5279639 5279623 -
ttggtttcgctaagagcaca

SEQ ID NO: 42505 - DNA, 20 bp, Artificial Sequence
  Synthetic oligonucleotide; GAG chr11 5279618 5279637 5279621 -
ggtttcgctaagagcacaga

SEQ ID NO: 42506 - DNA, 20 bp, Artificial Sequence
  Synthetic oligonucleotide; AAG chr11 5279615 5279634 5279618 -
ttcgctaagagcacagagag

SEQ ID NO: 42507 - DNA, 20 bp, Artificial Sequence
  Synthetic oligonucleotide; TAG chr11 5279609 5279628 5279612 -
aagagcacagagagaagatt

SEQ ID NO: 42508 - DNA, 20 bp, Artificial Sequence
  Synthetic oligonucleotide; TGG chr11 5279581 5279600 5279584 -
ctatgtaaaaacttcctttt

SEQ ID NO: 42509 - DNA, 20 bp, Artificial Sequence
  Synthetic oligonucleotide; AAG chr11 5279575 5279594 5279578 -
aaaaacttcctttttggttc

SEQ ID NO: 42510 - DNA, 20 bp, Artificial Sequence
  Synthetic oligonucleotide; TAG chr11 5279559 5279578 5279562 -
gttcaagtgtatgtttgtga

SEQ ID NO: 42511 - DNA, 20 bp, Artificial Sequence
  Synthetic oligonucleotide; AAG chr11 5279551 5279570 5279554 -
gtatgtttgtgatagaaatg

SEQ ID NO: 42512 - DNA, 20 bp, Artificial Sequence
  Synthetic oligonucleotide; CAG chr11 5279547 5279566 5279550 -
gtttgtgatagaaatgaaga

SEQ ID NO: 42513 - DNA, 20 bp, Artificial Sequence
  Synthetic oligonucleotide; AGG chr11 5279546 5279565 5279549 -
tttgtgatagaaatgaagac

SEQ ID NO: 42514 - DNA, 20 bp, Artificial Sequence
  Synthetic oligonucleotide; AAG chr11 5279508 5279527 5279511 -
ctaacataaacacaaacatt

SEQ ID NO: 42515 - DNA, 20 bp, Artificial Sequence
  Synthetic oligonucleotide; AAG chr11 5279504 5279523 5279507 -
cataaacacaaacattaaga

SEQ ID NO: 42516 - DNA, 20 bp, Artificial Sequence
  Synthetic oligonucleotide; AGG chr11 5279503 5279522 5279506 -
ataaacacaaacattaagaa

SEQ ID NO: 42517 - DNA, 20 bp, Artificial Sequence
  Synthetic oligonucleotide; AAG chr11 5279489 5279508 5279492 -
taagaaaggaaatcaacctg

SEQ ID NO: 42518 - DNA, 20 bp, Artificial Sequence
  Synthetic oligonucleotide; GAG chr11 5279487 5279506 5279490 -
agaaaggaaatcaacctgaa

SEQ ID NO: 42519 - DNA, 20 bp, Artificial Sequence
  Synthetic oligonucleotide; CAG chr11 5279476 5279495 5279479 -
caacctgaagagtatttata

SEQ ID NO: 42520 - DNA, 20 bp, Artificial Sequence
  Synthetic oligonucleotide; CAG chr11 5279462 5279481 5279465 -
tttatacagataacaaaata

SEQ ID NO: 42521 - DNA, 20 bp, Artificial Sequence
  Synthetic oligonucleotide; GAG chr11 5279460 5279479 5279463 -
tatacagataacaaaataca

SEQ ID NO: 42522 - DNA, 20 bp, Artificial Sequence
  Synthetic oligonucleotide; GAG chr11 5279458 5279477 5279461 -
tacagataacaaaatacaga

SEQ ID NO: 42523 - DNA, 20 bp, Artificial Sequence
  Synthetic oligonucleotide; GAG chr11 5279454 5279473 5279457 -
gataacaaaatacagagagt

SEQ ID NO: 42524 - DNA, 20 bp, Artificial Sequence
  Synthetic oligonucleotide; TGG chr11 5279433 5279452 5279436 -
agttaaatgtgtaataactg

SEQ ID NO: 42525 - DNA, 20 bp, Artificial Sequence
  Synthetic oligonucleotide; CAG chr11 5279428 5279447 5279431 -
aatgtgtaataactgtggca

SEQ ID NO: 42526 - DNA, 20 bp, Artificial Sequence
  Synthetic oligonucleotide; AGG chr11 5279427 5279446 5279430 -
atgtgtaataactgtggcac

SEQ ID NO: 42527 - DNA, 20 bp, Artificial Sequence
  Synthetic oligonucleotide; TGG chr11 5279423 5279442 5279426 -
gtaataactgtggcacaggc

SEQ ID NO: 42528 - DNA, 20 bp, Artificial Sequence
  Synthetic oligonucleotide; GAG chr11 5279415 5279434 5279418 -
tgtggcacaggctggaatat

SEQ ID NO: 42529 - DNA, 20 bp, Artificial Sequence
  Synthetic oligonucleotide; TAG chr11 5279391 5279410 5279394 -
catttaaatcacaaattaat

SEQ ID NO: 42530 - DNA, 20 bp, Artificial Sequence
  Synthetic oligonucleotide; CAG chr11 5279380 5279399 5279383 -
caaattaattagaaaaaaaa

SEQ ID NO: 42531 - DNA, 20 bp, Artificial Sequence
  Synthetic oligonucleotide; TGG chr11 5279377 5279396 5279380 -
attaattagaaaaaaaacag

SEQ ID NO: 42532 - DNA, 20 bp, Artificial Sequence
  Synthetic oligonucleotide; GGG chr11 5279376 5279395 5279379 -
ttaattagaaaaaaaacagt

SEQ ID NO: 42533 - DNA, 20 bp, Artificial Sequence
  Synthetic oligonucleotide; GGG chr11 5279375 5279394 5279378 -
taattagaaaaaaaacagtg

SEQ ID NO: 42534 - DNA, 20 bp, Artificial Sequence
  Synthetic oligonucleotide; TGG chr11 5279361 5279380 5279364 -
acagtggggaaaaaattcca

SEQ ID NO: 42535 - DNA, 20 bp, Artificial Sequence
  Synthetic oligonucleotide; TGG chr11 5279357 5279376 5279360 -
tggggaaaaaattccatgga

SEQ ID NO: 42536 - DNA, 20 bp, Artificial Sequence
  Synthetic oligonucleotide; GGG chr11 5279356 5279375 5279359 -
ggggaaaaaattccatggat

SEQ ID NO: 42537 - DNA, 20 bp, Artificial Sequence
  Synthetic oligonucleotide; TAG chr11 5279351 5279370 5279354 -
aaaaattccatggatgggtc

SEQ ID NO: 42538 - DNA, 20 bp, Artificial Sequence
  Synthetic oligonucleotide; AAG chr11 5279347 5279366 5279350 -
attccatggatgggtctaga

SEQ ID NO: 42539 - DNA, 20 bp, Artificial Sequence
  Synthetic oligonucleotide; TAG chr11 5279342 5279361 5279345 -
atggatgggtctagaaagac

SEQ ID NO: 42540 - DNA, 20 bp, Artificial Sequence
  Synthetic oligonucleotide; TAG chr11 5279331 5279350 5279334 -
tagaaagactagcattgttt

SEQ ID NO: 42541 - DNA, 20 bp, Artificial Sequence
  Synthetic oligonucleotide; AGG chr11 5279330 5279349 5279333 -
agaaagactagcattgtttt

SEQ ID NO: 42542 - DNA, 20 bp, Artificial Sequence
  Synthetic oligonucleotide; GAG chr11 5279325 5279344 5279328 -
gactagcattgttttaggtt

SEQ ID NO: 42543 - DNA, 20 bp, Artificial Sequence
  Synthetic oligonucleotide; TGG chr11 5279322 5279341 5279325 -
tagcattgttttaggttgag

SEQ ID NO: 42544 - DNA, 20 bp, Artificial Sequence
  Synthetic oligonucleotide; CAG chr11 5279319 5279338 5279322 -
cattgttttaggttgagtgg

SEQ ID NO: 42545 - DNA, 20 bp, Artificial Sequence
  Synthetic oligonucleotide; AAG chr11 5279310 5279329 5279313 -
aggttgagtggcagtgttta

SEQ ID NO: 42546 - DNA, 20 bp, Artificial Sequence
  Synthetic oligonucleotide; AGG chr11 5279309 5279328 5279312 -
ggttgagtggcagtgtttaa

SEQ ID NO: 42547 - DNA, 20 bp, Artificial Sequence
  Synthetic oligonucleotide; GGG chr11 5279308 5279327 5279311 -
gttgagtggcagtgtttaaa

SEQ ID NO: 42548 - DNA, 20 bp, Artificial Sequence
  Synthetic oligonucleotide; CAG chr11 5279299 5279318 5279302 -
cagtgtttaaagggtgatat

SEQ ID NO: 42549 - DNA, 20 bp, Artificial Sequence
  Synthetic oligonucleotide; TGG chr11 5279279 5279298 5279282 -
cagactaaacttgaaatatg

SEQ ID NO: 42550 - DNA, 20 bp, Artificial Sequence
  Synthetic oligonucleotide; TAG chr11 5279267 5279286 5279270 -
gaaatatgtggctaaataac

SEQ ID NO: 42551 - DNA, 20 bp, Artificial Sequence
  Synthetic oligonucleotide; TAG chr11 5279236 5279255 5279239 -
ttattttttcgtatcatgaa

SEQ ID NO: 42552 - DNA, 20 bp, Artificial Sequence
  Synthetic oligonucleotide; CAG chr11 5279233 5279252 5279236 -
ttttttcgtatcatgaatag

SEQ ID NO: 42553 - DNA, 20 bp, Artificial Sequence
  Synthetic oligonucleotide; TAG chr11 5279227 5279246 5279230 -
cgtatcatgaatagcagata

SEQ ID NO: 42554 - DNA, 20 bp, Artificial Sequence
  Synthetic oligonucleotide; TGG chr11 5279219 5279238 5279222 -
gaatagcagatatagcttga

SEQ ID NO: 42555 - DNA, 20 bp, Artificial Sequence
  Synthetic oligonucleotide; TGG chr11 5279207 5279226 5279210 -
tagcttgatggccccatgct

SEQ ID NO: 42556 - DNA, 20 bp, Artificial Sequence
  Synthetic oligonucleotide; AAG chr11 5279158 5279177 5279161 -
gaaatccttaatttttgaca

SEQ ID NO: 42557 - DNA, 20 bp, Artificial Sequence
  Synthetic oligonucleotide; AGG chr11 5279157 5279176 5279160 -
aaatccttaatttttgacaa

SEQ ID NO: 42558 - DNA, 20 bp, Artificial Sequence
  Synthetic oligonucleotide; GGG chr11 5279156 5279175 5279159 -
aatccttaatttttgacaaa

SEQ ID NO: 42559 - DNA, 20 bp, Artificial Sequence
  Synthetic oligonucleotide; GGG chr11 5279155 5279174 5279158 -
atccttaatttttgacaaag

SEQ ID NO: 42560 - DNA, 20 bp, Artificial Sequence
  Synthetic oligonucleotide; TGG chr11 5279131 5279150 5279134 -
tattcattttcattttatat

SEQ ID NO: 42561 - DNA, 20 bp, Artificial Sequence
  Synthetic oligonucleotide; GGG chr11 5279130 5279149 5279133 -
attcattttcattttatatt

SEQ ID NO: 42562 - DNA, 20 bp, Artificial Sequence
  Synthetic oligonucleotide; TAG chr11 5279125 5279144 5279128 -
ttttcattttatattgggcc

SEQ ID NO: 42563 - DNA, 20 bp, Artificial Sequence
  Synthetic oligonucleotide; TAG chr11 5279114 5279133 5279117 -
tattgggcctagaaattatg

SEQ ID NO: 42564 - DNA, 20 bp, Artificial Sequence
  Synthetic oligonucleotide; TGG chr11 5279110 5279129 5279113 -
gggcctagaaattatgtaga

SEQ ID NO: 42565 - DNA, 20 bp, Artificial Sequence
  Synthetic oligonucleotide; GAG chr11 5279103 5279122 5279106 -
gaaattatgtagatggtcct

SEQ ID NO: 42566 - DNA, 20 bp, Artificial Sequence
  Synthetic oligonucleotide; AGG chr11 5279102 5279121 5279105 -
aaattatgtagatggtcctg

SEQ ID NO: 42567 - DNA, 20 bp, Artificial Sequence
  Synthetic oligonucleotide; AAG chr11 5279097 5279116 5279100 -
atgtagatggtcctgaggaa

SEQ ID NO: 42568 - DNA, 20 bp, Artificial Sequence
  Synthetic oligonucleotide; TAG chr11 5279090 5279109 5279093 -
tggtcctgaggaaaagttta

SEQ ID NO: 42569 - DNA, 20 bp, Artificial Sequence
  Synthetic oligonucleotide; TAG chr11 5279064 5279083 5279067 -
gtctatttctctctctaaca

SEQ ID NO: 42570 - DNA, 20 bp, Artificial Sequence
  Synthetic oligonucleotide; CAG chr11 5279057 5279076 5279060 -
tctctctctaacatagttgt

SEQ ID NO: 42571 - DNA, 20 bp, Artificial Sequence
  Synthetic oligonucleotide; TAG chr11 5279045 5279064 5279048 -
atagttgtcagcacaatgcc

SEQ ID NO: 42572 - DNA, 20 bp, Artificial Sequence
  Synthetic oligonucleotide; AGG chr11 5279044 5279063 5279047 -
tagttgtcagcacaatgcct

SEQ ID NO: 42573 - DNA, 20 bp, Artificial Sequence
  Synthetic oligonucleotide; TAG chr11 5279038 5279057 5279041 -
tcagcacaatgcctaggcta

SEQ ID NO: 42574 - DNA, 20 bp, Artificial Sequence
  Synthetic oligonucleotide; AGG chr11 5279037 5279056 5279040 -
cagcacaatgcctaggctat

SEQ ID NO: 42575 - DNA, 20 bp, Artificial Sequence
  Synthetic oligonucleotide; AAG chr11 5279034 5279053 5279037 -
cacaatgcctaggctatagg

SEQ ID NO: 42576 - DNA, 20 bp, Artificial Sequence
  Synthetic oligonucleotide; AAG chr11 5279025 5279044 5279028 -
taggctataggaagtactca

SEQ ID NO: 42577 - DNA, 20 bp, Artificial Sequence
  Synthetic oligonucleotide; TGG chr11 5278980 5278999 5278983 -
ttcttattcaattctacaca

SEQ ID NO: 42578 - DNA, 20 bp, Artificial Sequence
  Synthetic oligonucleotide; GAG chr11 5278978 5278997 5278981 -
cttattcaattctacacatg

SEQ ID NO: 42579 - DNA, 20 bp, Artificial Sequence
  Synthetic oligonucleotide; AGG chr11 5278977 5278996 5278980 -
ttattcaattctacacatgg

SEQ ID NO: 42580 - DNA, 20 bp, Artificial Sequence
  Synthetic oligonucleotide; CAG chr11 5278964 5278983 5278967 -
cacatggaggaaaaactcat

SEQ ID NO: 42581 - DNA, 20 bp, Artificial Sequence
  Synthetic oligonucleotide; AGG chr11 5278963 5278982 5278966 -
acatggaggaaaaactcatc

SEQ ID NO: 42582 - DNA, 20 bp, Artificial Sequence
  Synthetic oligonucleotide; GGG chr11 5278962 5278981 5278965 -
catggaggaaaaactcatca

SEQ ID NO: 42583 - DNA, 20 bp, Artificial Sequence
  Synthetic oligonucleotide; TGG chr11 5278958 5278977 5278961 -
gaggaaaaactcatcaggga

SEQ ID NO: 42584 - DNA, 20 bp, Artificial Sequence
  Synthetic oligonucleotide; GAG chr11 5278956 5278975 5278959 -
ggaaaaactcatcagggatg

SEQ ID NO: 42585 - DNA, 20 bp, Artificial Sequence
  Synthetic oligonucleotide; AGG chr11 5278955 5278974 5278958 -
gaaaaactcatcagggatgg

SEQ ID NO: 42586 - DNA, 20 bp, Artificial Sequence
  Synthetic oligonucleotide; AAG chr11 5278943 5278962 5278946 -
agggatggaggcacgcctct

SEQ ID NO: 42587 - DNA, 20 bp, Artificial Sequence
  Synthetic oligonucleotide; AGG chr11 5278942 5278961 5278945 -
gggatggaggcacgcctcta

SEQ ID NO: 42588 - DNA, 20 bp, Artificial Sequence
  Synthetic oligonucleotide; AAG chr11 5278939 5278958 5278942 -
atggaggcacgcctctaagg

SEQ ID NO: 42589 - DNA, 20 bp, Artificial Sequence
  Synthetic oligonucleotide; AGG chr11 5278938 5278957 5278941 -
tggaggcacgcctctaagga

SEQ ID NO: 42590 - DNA, 20 bp, Artificial Sequence
  Synthetic oligonucleotide; CAG chr11 5278935 5278954 5278938 -
aggcacgcctctaaggaagg

SEQ ID NO: 42591 - DNA, 20 bp, Artificial Sequence
  Synthetic oligonucleotide; AGG chr11 5278934 5278953 5278937 -
ggcacgcctctaaggaaggc

SEQ ID NO: 42592 - DNA, 20 bp, Artificial Sequence
  Synthetic oligonucleotide; TGG chr11 5278929 5278948 5278932 -
gcctctaaggaaggcaggtg

SEQ ID NO: 42593 - DNA, 20 bp, Artificial Sequence
  Synthetic oligonucleotide; CAG chr11 5278921 5278940 5278924 -
ggaaggcaggtgtggctctg

SEQ ID NO: 42594 - DNA, 20 bp, Artificial Sequence
  Synthetic oligonucleotide; TGG chr11 5278912 5278931 5278915 -
gtgtggctctgcagtgtgat

SEQ ID NO: 42595 - DNA, 20 bp, Artificial Sequence
  Synthetic oligonucleotide; GGG chr11 5278911 5278930 5278914 -
tgtggctctgcagtgtgatt

SEQ ID NO: 42596 - DNA, 20 bp, Artificial Sequence
  Synthetic oligonucleotide; CAG chr11 5278902 5278921 5278905 -
gcagtgtgattgggtacttg

SEQ ID NO: 42597 - DNA, 20 bp, Artificial Sequence
  Synthetic oligonucleotide; AGG chr11 5278901 5278920 5278904 -
cagtgtgattgggtacttgc

SEQ ID NO: 42598 - DNA, 20 bp, Artificial Sequence
  Synthetic oligonucleotide; AAG chr11 5278895 5278914 5278898 -
gattgggtacttgcaggacg

SEQ ID NO: 42599 - DNA, 20 bp, Artificial Sequence
  Synthetic oligonucleotide; AGG chr11 5278894 5278913 5278897 -
attgggtacttgcaggacga

SEQ ID NO: 42600 - DNA, 20 bp, Artificial Sequence
  Synthetic oligonucleotide; GGG chr11 5278893 5278912 5278896 -
ttgggtacttgcaggacgaa

SEQ ID NO: 42601 - DNA, 20 bp, Artificial Sequence
  Synthetic oligonucleotide; TGG chr11 5278890 5278909 5278893 -
ggtacttgcaggacgaaggg

SEQ ID NO: 42602 - DNA, 20 bp, Artificial Sequence
  Synthetic oligonucleotide; GGG chr11 5278889 5278908 5278892 -
gtacttgcaggacgaagggt

SEQ ID NO: 42603 - DNA, 20 bp, Artificial Sequence
  Synthetic oligonucleotide; GGG chr11 5278888 5278907 5278891 -
tacttgcaggacgaagggtg

SEQ ID NO: 42604 - DNA, 20 bp, Artificial Sequence
  Synthetic oligonucleotide; TGG chr11 5278885 5278904 5278888 -
ttgcaggacgaagggtgggg

SEQ ID NO: 42605 - DNA, 20 bp, Artificial Sequence
  Synthetic oligonucleotide; GGG chr11 5278884 5278903 5278887 -
tgcaggacgaagggtggggt

SEQ ID NO: 42606 - DNA, 20 bp, Artificial Sequence
  Synthetic oligonucleotide; GAG chr11 5278882 5278901 5278885 -
caggacgaagggtggggtgg

SEQ ID NO: 42607 - DNA, 20 bp, Artificial Sequence
  Synthetic oligonucleotide; TGG chr11 5278879 5278898 5278882 -
gacgaagggtggggtgggag

SEQ ID NO: 42608 - DNA, 20 bp, Artificial Sequence
  Synthetic oligonucleotide; TAG chr11 5278861 5278880 5278864 -
agtggctaaccttccattcc

SEQ ID NO: 42609 - DNA, 20 bp, Artificial Sequence
  Synthetic oligonucleotide; CAG chr11 5278856 5278875 5278859 -
ctaaccttccattcctagtg

SEQ ID NO: 42610 - DNA, 20 bp, Artificial Sequence
  Synthetic oligonucleotide; GAG chr11 5278854 5278873 5278857 -
aaccttccattcctagtgca

SEQ ID NO: 42611 - DNA, 20 bp, Artificial Sequence
  Synthetic oligonucleotide; AGG chr11 5278853 5278872 5278856 -
accttccattcctagtgcag

SEQ ID NO: 42612 - DNA, 20 bp, Artificial Sequence
  Synthetic oligonucleotide; CAG chr11 5278847 5278866 5278850 -
cattcctagtgcagaggtca

SEQ ID NO: 42613 - DNA, 20 bp, Artificial Sequence
  Synthetic oligonucleotide; GAG chr11 5278825 5278844 5278828 -
gcctaaacatcaaattcctt

SEQ ID NO: 42614 - DNA, 20 bp, Artificial Sequence
  Synthetic oligonucleotide; AGG chr11 5278824 5278843 5278827 -
cctaaacatcaaattccttg

SEQ ID NO: 42615 - DNA, 20 bp, Artificial Sequence
  Synthetic oligonucleotide; CGG chr11 5278819 5278838 5278822 -
acatcaaattccttgaggtg

SEQ ID NO: 42616 - DNA, 20 bp, Artificial Sequence
  Synthetic oligonucleotide; TGG chr11 5278816 5278835 5278819 -
tcaaattccttgaggtgcgg

SEQ ID NO: 42617 - DNA, 20 bp, Artificial Sequence
  Synthetic oligonucleotide; CAG chr11 5278797 5278816 5278800 -
gtggctcactcctgtaatca

SEQ ID NO: 42618 - DNA, 20 bp, Artificial Sequence
  Synthetic oligonucleotide; CAG chr11 5278794 5278813 5278797 -
gctcactcctgtaatcacag

SEQ ID NO: 42619 - DNA, 20 bp, Artificial Sequence
  Synthetic oligonucleotide; TGG chr11 5278789 5278808 5278792 -
ctcctgtaatcacagcagtt

SEQ ID NO: 42620 - DNA, 20 bp, Artificial Sequence
  Synthetic oligonucleotide; GGG chr11 5278788 5278807 5278791 -
tcctgtaatcacagcagttt

SEQ ID NO: 42621 - DNA, 20 bp, Artificial Sequence
  Synthetic oligonucleotide; AAG chr11 5278780 5278799 5278783 -
tcacagcagtttgggacgcc

SEQ ID NO: 42622 - DNA, 20 bp, Artificial Sequence
  Synthetic oligonucleotide; AGG chr11 5278779 5278798 5278782 -
cacagcagtttgggacgcca

SEQ ID NO: 42623 - DNA, 20 bp, Artificial Sequence
  Synthetic oligonucleotide; TGG chr11 5278776 5278795 5278779 -
agcagtttgggacgccaagg

SEQ ID NO: 42624 - DNA, 20 bp, Artificial Sequence
  Synthetic oligonucleotide; GGG chr11 5278775 5278794 5278778 -
gcagtttgggacgccaaggt

SEQ ID NO: 42625 - DNA, 20 bp, Artificial Sequence
  Synthetic oligonucleotide; CAG chr11 5278772 5278791 5278775 -
gtttgggacgccaaggtggg

SEQ ID NO: 42626 - DNA, 20 bp, Artificial Sequence
  Synthetic oligonucleotide; GAG chr11 5278762 5278781 5278765 -
ccaaggtgggcagatcactt

SEQ ID NO: 42627 - DNA, 20 bp, Artificial Sequence
  Synthetic oligonucleotide; AGG chr11 5278761 5278780 5278764 -
caaggtgggcagatcacttg

SEQ ID NO: 42628 - DNA, 20 bp, Artificial Sequence
  Synthetic oligonucleotide; CAG chr11 5278757 5278776 5278760 -
gtgggcagatcacttgaggt

SEQ ID NO: 42629 - DNA, 20 bp, Artificial Sequence
  Synthetic oligonucleotide; AGG chr11 5278756 5278775 5278759 -
tgggcagatcacttgaggtc

SEQ ID NO: 42630 - DNA, 20 bp, Artificial Sequence
  Synthetic oligonucleotide; GAG chr11 5278754 5278773 5278757 -
ggcagatcacttgaggtcag

SEQ ID NO: 42631 - DNA, 20 bp, Artificial Sequence
  Synthetic oligonucleotide; TGG chr11 5278750 5278769 5278753 -
gatcacttgaggtcaggagt

SEQ ID NO: 42632 - DNA, 20 bp, Artificial Sequence
  Synthetic oligonucleotide; CAG chr11 5278743 5278762 5278746 -
tgaggtcaggagttggacac

SEQ ID NO: 42633 - DNA, 20 bp, Artificial Sequence
  Synthetic oligonucleotide; CAG chr11 5278738 5278757 5278741 -
tcaggagttggacaccagcc

SEQ ID NO: 42634 - DNA, 20 bp, Artificial Sequence
  Synthetic oligonucleotide; TAG chr11 5278729 5278748 5278732 -
ggacaccagcccagccaaca

SEQ ID NO: 42635 - DNA, 20 bp, Artificial Sequence
  Synthetic oligonucleotide; TGG chr11 5278719 5278738 5278722 -
ccagccaacatagtgaaacc

SEQ ID NO: 42636 - DNA, 20 bp, Artificial Sequence
  Synthetic oligonucleotide; TAG chr11 5278693 5278712 5278696 -
ctgcttaaaaatataaaaat

SEQ ID NO: 42637 - DNA, 20 bp, Artificial Sequence
  Synthetic oligonucleotide; TGG chr11 5278689 5278708 5278692 -
ttaaaaatataaaaattagc

SEQ ID NO: 42638 - DNA, 20 bp, Artificial Sequence
  Synthetic oligonucleotide; TGG chr11 5278683 5278702 5278686 -
atataaaaattagctggacg

SEQ ID NO: 42639 - DNA, 20 bp, Artificial Sequence
  Synthetic oligonucleotide; CGG chr11 5278677 5278696 5278680 -
aaattagctggacgtggtga

SEQ ID NO: 42640 - DNA, 20 bp, Artificial Sequence
  Synthetic oligonucleotide; GGG chr11 5278676 5278695 5278679 -
aattagctggacgtggtgac

SEQ ID NO: 42641 - DNA, 20 bp, Artificial Sequence
  Synthetic oligonucleotide; GAG chr11 5278674 5278693 5278677 -
ttagctggacgtggtgacgg

SEQ ID NO: 42642 - DNA, 20 bp, Artificial Sequence
  Synthetic oligonucleotide; TGG chr11 5278654 5278673 5278657 -
gagcctgtaatccaactact

SEQ ID NO: 42643 - DNA, 20 bp, Artificial Sequence
  Synthetic oligonucleotide; GGG chr11 5278653 5278672 5278656 -
agcctgtaatccaactactt

SEQ ID NO: 42644 - DNA, 20 bp, Artificial Sequence
  Synthetic oligonucleotide; GAG chr11 5278651 5278670 5278654 -
cctgtaatccaactacttgg

SEQ ID NO: 42645 - DNA, 20 bp, Artificial Sequence
  Synthetic oligonucleotide; AGG chr11 5278650 5278669 5278653 -
ctgtaatccaactacttggg

SEQ ID NO: 42646 - DNA, 20 bp, Artificial Sequence
  Synthetic oligonucleotide; GAG chr11 5278645 5278664 5278648 -
atccaactacttgggaggct

SEQ ID NO: 42647 - DNA, 20 bp, Artificial Sequence
  Synthetic oligonucleotide; AGG chr11 5278644 5278663 5278647 -
tccaactacttgggaggctg

SEQ ID NO: 42648 - DNA, 20 bp, Artificial Sequence
  Synthetic oligonucleotide; CAG chr11 5278641 5278660 5278644 -
aactacttgggaggctgagg

SEQ ID NO: 42649 - DNA, 20 bp, Artificial Sequence
  Synthetic oligonucleotide; AGG chr11 5278640 5278659 5278643 -
actacttgggaggctgaggc

SEQ ID NO: 42650 - DNA, 20 bp, Artificial Sequence
  Synthetic oligonucleotide; GAG chr11 5278638 5278657 5278641 -
tacttgggaggctgaggcag

SEQ ID NO: 42651 - DNA, 20 bp, Artificial Sequence
  Synthetic oligonucleotide; CGG chr11 5278623 5278642 5278626 -
ggcaggagaatcgcttgaac

SEQ ID NO: 42652 - DNA, 20 bp, Artificial Sequence
  Synthetic oligonucleotide; GGG chr11 5278622 5278641 5278625 -
gcaggagaatcgcttgaacc

SEQ ID NO: 42653 - DNA, 20 bp, Artificial Sequence
  Synthetic oligonucleotide; GGG chr11 5278621 5278640 5278624 -
caggagaatcgcttgaaccg

SEQ ID NO: 42654 - DNA, 20 bp, Artificial Sequence
  Synthetic oligonucleotide; GAG chr11 5278619 5278638 5278622 -
ggagaatcgcttgaaccggg

SEQ ID NO: 42655 - DNA, 20 bp, Artificial Sequence
  Synthetic oligonucleotide; AGG chr11 5278618 5278637 5278621 -
gagaatcgcttgaaccgggg

SEQ ID NO: 42656 - DNA, 20 bp, Artificial Sequence
  Synthetic oligonucleotide; TGG chr11 5278615 5278634 5278618 -
aatcgcttgaaccggggagg

SEQ ID NO: 42657 - DNA, 20 bp, Artificial Sequence
  Synthetic oligonucleotide; GAG chr11 5278613 5278632 5278616 -
tcgcttgaaccggggaggtg

SEQ ID NO: 42658 - DNA, 20 bp, Artificial Sequence
  Synthetic oligonucleotide; GAG chr11 5278602 5278621 5278605 -
ggggaggtggagtttgcact

SEQ ID NO: 42659 - DNA, 20 bp, Artificial Sequence
  Synthetic oligonucleotide; CAG chr11 5278599 5278618 5278602 -
gaggtggagtttgcactgag

SEQ ID NO: 42660 - DNA, 20 bp, Artificial Sequence
  Synthetic oligonucleotide; GAG chr11 5278597 5278616 5278600 -
ggtggagtttgcactgagca

SEQ ID NO: 42661 - DNA, 20 bp, Artificial Sequence
  Synthetic oligonucleotide; CAG chr11 5278577 5278596 5278580 -
gagatcatgccattgcactc

SEQ ID NO: 42662 - DNA, 20 bp, Artificial Sequence
  Synthetic oligonucleotide; CAG chr11 5278570 5278589 5278573 -
tgccattgcactccagcctc

SEQ ID NO: 42663 - DNA, 20 bp, Artificial Sequence
  Synthetic oligonucleotide; GAG chr11 5278568 5278587 5278571 -
ccattgcactccagcctcca

SEQ ID NO: 42664 - DNA, 20 bp, Artificial Sequence
  Synthetic oligonucleotide; GAG chr11 5278564 5278583 5278567 -
tgcactccagcctccagagc

SEQ ID NO: 42665 - DNA, 20 bp, Artificial Sequence
  Synthetic oligonucleotide; AAG chr11 5278551 5278570 5278554 -
ccagagcgagactctgtcta

SEQ ID NO: 42666 - DNA, 20 bp, Artificial Sequence
  Synthetic oligonucleotide; CAG chr11 5278490 5278509 5278493 -
catcaaattccctgaccgaa

SEQ ID NO: 42667 - DNA, 20 bp, Artificial Sequence
  Synthetic oligonucleotide; AAG chr11 5278440 5278459 5278443 -
tctaccattttccctcctta

SEQ ID NO: 42668 - DNA, 20 bp, Artificial Sequence
  Synthetic oligonucleotide; CAG chr11 5278420 5278439 5278423 -
aagaaactgtgaacttcctt

SEQ ID NO: 42669 - DNA, 20 bp, Artificial Sequence
  Synthetic oligonucleotide; TAG chr11 5278416 5278435 5278419 -
aactgtgaacttccttcagc

SEQ ID NO: 42670 - DNA, 20 bp, Artificial Sequence
  Synthetic oligonucleotide; GAG chr11 5278414 5278433 5278417 -
ctgtgaacttccttcagcta

SEQ ID NO: 42671 - DNA, 20 bp, Artificial Sequence
  Synthetic oligonucleotide; AGG chr11 5278413 5278432 5278416 -
tgtgaacttccttcagctag

SEQ ID NO: 42672 - DNA, 20 bp, Artificial Sequence
  Synthetic oligonucleotide; GGG chr11 5278412 5278431 5278415 -
gtgaacttccttcagctaga

SEQ ID NO: 42673 - DNA, 20 bp, Artificial Sequence
  Synthetic oligonucleotide; GGG chr11 5278411 5278430 5278414 -
tgaacttccttcagctagag

SEQ ID NO: 42674 - DNA, 20 bp, Artificial Sequence
  Synthetic oligonucleotide; TGG chr11 5278406 5278425 5278409 -
ttccttcagctagaggggcc

SEQ ID NO: 42675 - DNA, 20 bp, Artificial Sequence
  Synthetic oligonucleotide; CAG chr11 5278401 5278420 5278404 -
tcagctagaggggcctggct

SEQ ID NO: 42676 - DNA, 20 bp, Artificial Sequence
  Synthetic oligonucleotide; AAG chr11 5278398 5278417 5278401 -
gctagaggggcctggctcag

SEQ ID NO: 42677 - DNA, 20 bp, Artificial Sequence
  Synthetic oligonucleotide; TGG chr11 5278391 5278410 5278394 -
gggcctggctcagaagcctc

SEQ ID NO: 42678 - DNA, 20 bp, Artificial Sequence
  Synthetic oligonucleotide; CAG chr11 5278387 5278406 5278390 -
ctggctcagaagcctctggt

SEQ ID NO: 42679 - DNA, 20 bp, Artificial Sequence
  Synthetic oligonucleotide; AAG chr11 5278379 5278398 5278382 -
gaagcctctggtcagcatcc

SEQ ID NO: 42680 - DNA, 20 bp, Artificial Sequence
  Synthetic oligonucleotide; TGG chr11 5278358 5278377 5278361 -
agaaatacttgatgtcactt

SEQ ID NO: 42681 - DNA, 20 bp, Artificial Sequence
  Synthetic oligonucleotide; AAG chr11 5278352 5278371 5278355 -
acttgatgtcactttggcta

SEQ ID NO: 42682 - DNA, 20 bp, Artificial Sequence
  Synthetic oligonucleotide; AGG chr11 5278351 5278370 5278354 -
cttgatgtcactttggctaa

SEQ ID NO: 42683 - DNA, 20 bp, Artificial Sequence
  Synthetic oligonucleotide; TAG chr11 5278339 5278358 5278342 -
ttggctaaaggtatgatgtg

SEQ ID NO: 42684 - DNA, 20 bp, Artificial Sequence
  Synthetic oligonucleotide; AAG chr11 5278334 5278353 5278337 -
taaaggtatgatgtgtagac

SEQ ID NO: 42685 - DNA, 20 bp, Artificial Sequence
  Synthetic oligonucleotide; CAG chr11 5278328 5278347 5278331 -
tatgatgtgtagacaagctc

SEQ ID NO: 42686 - DNA, 20 bp, Artificial Sequence
  Synthetic oligonucleotide; GAG chr11 5278326 5278345 5278329 -
tgatgtgtagacaagctcca

SEQ ID NO: 42687 - DNA, 20 bp, Artificial Sequence
  Synthetic oligonucleotide; TGG chr11 5278322 5278341 5278325 -
gtgtagacaagctccagaga

SEQ ID NO: 42688 - DNA, 20 bp, Artificial Sequence
  Synthetic oligonucleotide; CAG chr11 5278294 5278313 5278297 -
catttccatatccacccacc

SEQ ID NO: 42689 - DNA, 20 bp, Artificial Sequence
  Synthetic oligonucleotide; AAG chr11 5278278 5278297 5278281 -
cacccagctttccaatttta

SEQ ID NO: 42690 - DNA, 20 bp, Artificial Sequence
  Synthetic oligonucleotide; GAG chr11 5278267 5278286 5278270 -
ccaattttaaagccaattct

SEQ ID NO: 42691 - DNA, 20 bp, Artificial Sequence
  Synthetic oligonucleotide; AGG chr11 5278266 5278285 5278269 -
caattttaaagccaattctg

SEQ ID NO: 42692 - DNA, 20 bp, Artificial Sequence
  Synthetic oligonucleotide; TAG chr11 5278263 5278282 5278266 -
ttttaaagccaattctgagg

SEQ ID NO: 42693 - DNA, 20 bp, Artificial Sequence
  Synthetic oligonucleotide; GAG chr11 5278261 5278280 5278264 -
ttaaagccaattctgaggta

SEQ ID NO: 42694 - DNA, 20 bp, Artificial Sequence
  Synthetic oligonucleotide; AAG chr11 5278221 5278240 5278224 -
ccttgacaaaattcaaccca

SEQ ID NO: 42695 - DNA, 20 bp, Artificial Sequence
  Synthetic oligonucleotide; TAG chr11 5278206 5278225 5278209 -
acccaaagactcactttgcc

SEQ ID NO: 42696 - DNA, 20 bp, Artificial Sequence
  Synthetic oligonucleotide; CAG chr11 5278173 5278192 5278176 -
cttactctgacatatactca

SEQ ID NO: 42697 - DNA, 20 bp, Artificial Sequence
  Synthetic oligonucleotide; CAG chr11 5278169 5278188 5278172 -
ctctgacatatactcacagc

SEQ ID NO: 42698 - DNA, 20 bp, Artificial Sequence
  Synthetic oligonucleotide; TAG chr11 5278162 5278181 5278165 -
atatactcacagccagaaat

SEQ ID NO: 42699 - DNA, 20 bp, Artificial Sequence
  Synthetic oligonucleotide; TAG chr11 5278152 5278171 5278155 -
agccagaaattagcatgcac

SEQ ID NO: 42700 - DNA, 20 bp, Artificial Sequence
  Synthetic oligonucleotide; GAG chr11 5278150 5278169 5278153 -
ccagaaattagcatgcacta

SEQ ID NO: 42701 - DNA, 20 bp, Artificial Sequence
  Synthetic oligonucleotide; GAG chr11 5278140 5278159 5278143 -
gcatgcactagagtgtgcat

SEQ ID NO: 42702 - DNA, 20 bp, Artificial Sequence
  Synthetic oligonucleotide; CAG chr11 5278101 5278120 5278104 -
accaattccatattctctgt

SEQ ID NO: 42703 - DNA, 20 bp, Artificial Sequence
  Synthetic oligonucleotide; TGG chr11 5278088 5278107 5278091 -
tctctgtcagaaaatcctgt

SEQ ID NO: 42704 - DNA, 20 bp, Artificial Sequence
  Synthetic oligonucleotide; AAG chr11 5278075 5278094 5278078 -
atcctgttggtttttcgtga

SEQ ID NO: 42705 - DNA, 20 bp, Artificial Sequence
  Synthetic oligonucleotide; AGG chr11 5278074 5278093 5278077 -
tcctgttggtttttcgtgaa

SEQ ID NO: 42706 - DNA, 20 bp, Artificial Sequence
  Synthetic oligonucleotide; CAG chr11 5278064 5278083 5278067 -
ttttcgtgaaaggatgtttt

SEQ ID NO: 42707 - DNA, 20 bp, Artificial Sequence
  Synthetic oligonucleotide; GAG chr11 5278062 5278081 5278065 -
ttcgtgaaaggatgttttca

SEQ ID NO: 42708 - DNA, 20 bp, Artificial Sequence
  Synthetic oligonucleotide; AGG chr11 5278061 5278080 5278064 -
tcgtgaaaggatgttttcag

SEQ ID NO: 42709 - DNA, 20 bp, Artificial Sequence
  Synthetic oligonucleotide; TGG chr11 5278023 5278042 5278026 -
cacctccaatgctaccactc

SEQ ID NO: 42710 - DNA, 20 bp, Artificial Sequence
  Synthetic oligonucleotide; AAG chr11 5278017 5278036 5278020 -
caatgctaccactctggtct

SEQ ID NO: 42711 - DNA, 20 bp, Artificial Sequence
  Synthetic oligonucleotide; TAG chr11 5277990 5278009 5277993 -
tgtcaccaccacctaaatta

SEQ ID NO: 42712 - DNA, 20 bp, Artificial Sequence
  Synthetic oligonucleotide; TAG chr11 5277914 5277933 5277917 -
tcccaatatactatccaaat

SEQ ID NO: 42713 - DNA, 20 bp, Artificial Sequence
  Synthetic oligonucleotide; AAG chr11 5277897 5277916 5277900 -
aattagtcttttcaaaatgt

SEQ ID NO: 42714 - DNA, 20 bp, Artificial Sequence
  Synthetic oligonucleotide; TGG chr11 5277887 5277906 5277890 -
ttcaaaatgtaagtcatata

SEQ ID NO: 42715 - DNA, 20 bp, Artificial Sequence
  Synthetic oligonucleotide; AAG chr11 5277869 5277888 5277872 -
tatggtcacctctttgttca

SEQ ID NO: 42716 - DNA, 20 bp, Artificial Sequence
  Synthetic oligonucleotide; TAG chr11 5277858 5277877 5277861 -
ctttgttcaaagtcttctga

SEQ ID NO: 42717 - DNA, 20 bp, Artificial Sequence
  Synthetic oligonucleotide; TAG chr11 5277807 5277826 5277810 -
atccttacaattctctacaa

SEQ ID NO: 42718 - DNA, 20 bp, Artificial Sequence
  Synthetic oligonucleotide; CAG chr11 5277777 5277796 5277780 -
tgcatatattatgtttatta

SEQ ID NO: 42719 - DNA, 20 bp, Artificial Sequence
  Synthetic oligonucleotide; TAG chr11 5277763 5277782 5277766 -
ttattacagatacatatata

SEQ ID NO: 42720 - DNA, 20 bp, Artificial Sequence
  Synthetic oligonucleotide; TAG chr11 5277720 5277739 5277723 -
tatatttatgtgtatgtgtg

SEQ ID NO: 42721 - DNA, 20 bp, Artificial Sequence
  Synthetic oligonucleotide; GAG chr11 5277718 5277737 5277721 -
tatttatgtgtatgtgtgta

SEQ ID NO: 42722 - DNA, 20 bp, Artificial Sequence
  Synthetic oligonucleotide; TAG chr11 5277690 5277709 5277693 -
tttcttacaactctatgatg

SEQ ID NO: 42723 - DNA, 20 bp, Artificial Sequence
  Synthetic oligonucleotide; AGG chr11 5277689 5277708 5277692 -
ttcttacaactctatgatgt

SEQ ID NO: 42724 - DNA, 20 bp, Artificial Sequence
  Synthetic oligonucleotide; TAG chr11 5277680 5277699 5277683 -
ctctatgatgtaggtattat

SEQ ID NO: 42725 - DNA, 20 bp, Artificial Sequence
  Synthetic oligonucleotide; TAG chr11 5277658 5277677 5277661 -
gtgtcccaaattttataatt

SEQ ID NO: 42726 - DNA, 20 bp, Artificial Sequence
  Synthetic oligonucleotide; AGG chr11 5277657 5277676 5277660 -
tgtcccaaattttataattt

SEQ ID NO: 42727 - DNA, 20 bp, Artificial Sequence
  Synthetic oligonucleotide; TGG chr11 5277602 5277621 5277605 -
caccgaatctcatcctacat

SEQ ID NO: 42728 - DNA, 20 bp, Artificial Sequence
  Synthetic oligonucleotide; AAG chr11 5277573 5277592 5277576 -
tgatattccttgaaaattct

SEQ ID NO: 42729 - DNA, 20 bp, Artificial Sequence
  Synthetic oligonucleotide; TAG chr11 5277557 5277576 5277560 -
ttctaagcatcttacatctt

SEQ ID NO: 42730 - DNA, 20 bp, Artificial Sequence
  Synthetic oligonucleotide; AGG chr11 5277556 5277575 5277559 -
tctaagcatcttacatcttt

SEQ ID NO: 42731 - DNA, 20 bp, Artificial Sequence
  Synthetic oligonucleotide; GGG chr11 5277555 5277574 5277558 -
ctaagcatcttacatcttta

SEQ ID NO: 42732 - DNA, 20 bp, Artificial Sequence
  Synthetic oligonucleotide; TAG chr11 5277511 5277530 5277514 -
atgccctaaatatttaatca

SEQ ID NO: 42733 - DNA, 20 bp, Artificial Sequence
  Synthetic oligonucleotide; TGG chr11 5277497 5277516 5277500 -
taatcatagtttcatataaa

SEQ ID NO: 42734 - DNA, 20 bp, Artificial Sequence
  Synthetic oligonucleotide; GGG chr11 5277496 5277515 5277499 -
aatcatagtttcatataaat

SEQ ID NO: 42735 - DNA, 20 bp, Artificial Sequence
  Synthetic oligonucleotide; TGG chr11 5277479 5277498 5277482 -
aatgggttcctcatcatcta

SEQ ID NO: 42736 - DNA, 20 bp, Artificial Sequence
  Synthetic oligonucleotide; GGG chr11 5277478 5277497 5277481 -
atgggttcctcatcatctat

SEQ ID NO: 42737 - DNA, 20 bp, Artificial Sequence
  Synthetic oligonucleotide; CAG chr11 5277467 5277486 5277470 -
atcatctatgggtactctct

SEQ ID NO: 42738 - DNA, 20 bp, Artificial Sequence
  Synthetic oligonucleotide; AGG chr11 5277466 5277485 5277469 -
tcatctatgggtactctctc

SEQ ID NO: 42739 - DNA, 20 bp, Artificial Sequence
  Synthetic oligonucleotide; TAG chr11 5277452 5277471 5277455 -
tctctcaggtgttaacttta

SEQ ID NO: 42740 - DNA, 20 bp, Artificial Sequence
  Synthetic oligonucleotide; GAG chr11 5277448 5277467 5277451 -
tcaggtgttaactttatagt

SEQ ID NO: 42741 - DNA, 20 bp, Artificial Sequence
  Synthetic oligonucleotide; AGG chr11 5277447 5277466 5277450 -
caggtgttaactttatagtg

SEQ ID NO: 42742 - DNA, 20 bp, Artificial Sequence
  Synthetic oligonucleotide; AAG chr11 5277423 5277442 5277426 -
ctttcctgccatactactta

SEQ ID NO: 42743 - DNA, 20 bp, Artificial Sequence
  Synthetic oligonucleotide; TAG chr11 5277420 5277439 5277423 -
tcctgccatactacttaaag

SEQ ID NO: 42744 - DNA, 20 bp, Artificial Sequence
  Synthetic oligonucleotide; TGG chr11 5277385 5277404 5277388 -
accctgtcctaatcacactc

SEQ ID NO: 42745 - DNA, 20 bp, Artificial Sequence
  Synthetic oligonucleotide; CAG chr11 5277373 5277392 5277376 -
tcacactctggccttcattt

SEQ ID NO: 42746 - DNA, 20 bp, Artificial Sequence
  Synthetic oligonucleotide; TAG chr11 5277353 5277372 5277356 -
cagttttttttttttctcca

SEQ ID NO: 42747 - DNA, 20 bp, Artificial Sequence
  Synthetic oligonucleotide; TGG chr11 5277337 5277356 5277340 -
tccatagcacctaatctcat

SEQ ID NO: 42748 - DNA, 20 bp, Artificial Sequence
  Synthetic oligonucleotide; AAG chr11 5277301 5277320 5277304 -
tcatttgcttatttaatgtc

SEQ ID NO: 42749 - DNA, 20 bp, Artificial Sequence
  Synthetic oligonucleotide; AAG chr11 5277284 5277303 5277287 -
gtcaagctctttccactatc

SEQ ID NO: 42750 - DNA, 20 bp, Artificial Sequence
  Synthetic oligonucleotide; CAG chr11 5277271 5277290 5277274 -
cactatcaagtccatgaaaa

SEQ ID NO: 42751 - DNA, 20 bp, Artificial Sequence
  Synthetic oligonucleotide; AGG chr11 5277270 5277289 5277273 -
actatcaagtccatgaaaac

SEQ ID NO: 42752 - DNA, 20 bp, Artificial Sequence
  Synthetic oligonucleotide; TAG chr11 5277230 5277249 5277233 -
ctgtttttgtgctgtattct

SEQ ID NO: 42753 - DNA, 20 bp, Artificial Sequence
  Synthetic oligonucleotide; GAG chr11 5277200 5277219 5277203 -
acaattttgaatgaatgaat

SEQ ID NO: 42754 - DNA, 20 bp, Artificial Sequence
  Synthetic oligonucleotide; CAG chr11 5277197 5277216 5277200 -
attttgaatgaatgaatgag

SEQ ID NO: 42755 - DNA, 20 bp, Artificial Sequence
  Synthetic oligonucleotide; AAG chr11 5277168 5277187 5277171 -
acatatacaactataattaa

SEQ ID NO: 42756 - DNA, 20 bp, Artificial Sequence
  Synthetic oligonucleotide; AGG chr11 5277167 5277186 5277170 -
catatacaactataattaaa

SEQ ID NO: 42757 - DNA, 20 bp, Artificial Sequence
  Synthetic oligonucleotide; AAG chr11 5277129 5277148 5277132 -
tccactgctatgcacacaca

SEQ ID NO: 42758 - DNA, 20 bp, Artificial Sequence
  Synthetic oligonucleotide; CAG chr11 5277122 5277141 5277125 -
ctatgcacacacaaagaaat

SEQ ID NO: 42759 - DNA, 20 bp, Artificial Sequence
  Synthetic oligonucleotide; TGG chr11 5277119 5277138 5277122 -
tgcacacacaaagaaatcag

SEQ ID NO: 42760 - DNA, 20 bp, Artificial Sequence
  Synthetic oligonucleotide; GAG chr11 5277117 5277136 5277120 -
cacacacaaagaaatcagtg

SEQ ID NO: 42761 - DNA, 20 bp, Artificial Sequence
  Synthetic oligonucleotide; TAG chr11 5277114 5277133 5277117 -
acacaaagaaatcagtggag

SEQ ID NO: 42762 - DNA, 20 bp, Artificial Sequence
  Synthetic oligonucleotide; GAG chr11 5277112 5277131 5277115 -
acaaagaaatcagtggagta

SEQ ID NO: 42763 - DNA, 20 bp, Artificial Sequence
  Synthetic oligonucleotide; TGG chr11 5277108 5277127 5277111 -
agaaatcagtggagtagagc

SEQ ID NO: 42764 - DNA, 20 bp, Artificial Sequence
  Synthetic oligonucleotide; AAG chr11 5277105 5277124 5277108 -
aatcagtggagtagagctgg

SEQ ID NO: 42765 - DNA, 20 bp, Artificial Sequence
  Synthetic oligonucleotide; AAG chr11 5277098 5277117 5277101 -
ggagtagagctggaagtgct

SEQ ID NO: 42766 - DNA, 20 bp, Artificial Sequence
  Synthetic oligonucleotide; TAG chr11 5277089 5277108 5277092 -
ctggaagtgctaagcctgca

SEQ ID NO: 42767 - DNA, 20 bp, Artificial Sequence
  Synthetic oligonucleotide; GAG chr11 5277087 5277106 5277090 -
ggaagtgctaagcctgcata

SEQ ID NO: 42768 - DNA, 20 bp, Artificial Sequence
  Synthetic oligonucleotide; TAG chr11 5277083 5277102 5277086 -
gtgctaagcctgcatagagc

SEQ ID NO: 42769 - DNA, 20 bp, Artificial Sequence
  Synthetic oligonucleotide; TAG chr11 5277079 5277098 5277082 -
taagcctgcatagagctagt

SEQ ID NO: 42770 - DNA, 20 bp, Artificial Sequence
  Synthetic oligonucleotide; CAG chr11 5277069 5277088 5277072 -
tagagctagttagccctccg

SEQ ID NO: 42771 - DNA, 20 bp, Artificial Sequence
  Synthetic oligonucleotide; AGG chr11 5277068 5277087 5277071 -
agagctagttagccctccgc

SEQ ID NO: 42772 - DNA, 20 bp, Artificial Sequence
  Synthetic oligonucleotide; CAG chr11 5277065 5277084 5277068 -
gctagttagccctccgcagg

SEQ ID NO: 42773 - DNA, 20 bp, Artificial Sequence
  Synthetic oligonucleotide; GAG chr11 5277063 5277082 5277066 -
tagttagccctccgcaggca

SEQ ID NO: 42774 - DNA, 20 bp, Artificial Sequence
  Synthetic oligonucleotide; TGG chr11 5277054 5277073 5277057 -
ctccgcaggcagagccttga

SEQ ID NO: 42775 - DNA, 20 bp, Artificial Sequence
  Synthetic oligonucleotide; GGG chr11 5277053 5277072 5277056 -
tccgcaggcagagccttgat

SEQ ID NO: 42776 - DNA, 20 bp, Artificial Sequence
  Synthetic oligonucleotide; GAG chr11 5277044 5277063 5277047 -
agagccttgatgggattact

SEQ ID NO: 42777 - DNA, 20 bp, Artificial Sequence
  Synthetic oligonucleotide; TAG chr11 5277038 5277057 5277041 -
ttgatgggattactgagttc

SEQ ID NO: 42778 - DNA, 20 bp, Artificial Sequence
  Synthetic oligonucleotide; TGG chr11 5277032 5277051 5277035 -
ggattactgagttctagaat

SEQ ID NO: 42779 - DNA, 20 bp, Artificial Sequence
  Synthetic oligonucleotide; TAG chr11 5277015 5277034 5277018 -
aattggactcatttgttttg

SEQ ID NO: 42780 - DNA, 20 bp, Artificial Sequence
  Synthetic oligonucleotide; AGG chr11 5277014 5277033 5277017 -
attggactcatttgttttgt

SEQ ID NO: 42781 - DNA, 20 bp, Artificial Sequence
  Synthetic oligonucleotide; GAG chr11 5277009 5277028 5277012 -
actcatttgttttgtaggct

SEQ ID NO: 42782 - DNA, 20 bp, Artificial Sequence
  Synthetic oligonucleotide; AAG chr11 5276972 5276991 5276975 -
acttgttctgaccaaaataa

SEQ ID NO: 42783 - DNA, 20 bp, Artificial Sequence
  Synthetic oligonucleotide; AGG chr11 5276971 5276990 5276974 -
cttgttctgaccaaaataaa

SEQ ID NO: 42784 - DNA, 20 bp, Artificial Sequence
  Synthetic oligonucleotide; AAG chr11 5276963 5276982 5276966 -
gaccaaaataaaaggctcaa

SEQ ID NO: 42785 - DNA, 20 bp, Artificial Sequence
  Synthetic oligonucleotide; CAG chr11 5276946 5276965 5276949 -
caaaagatgaatatcgaaac

SEQ ID NO: 42786 - DNA, 20 bp, Artificial Sequence
  Synthetic oligonucleotide; AGG chr11 5276945 5276964 5276948 -
aaaagatgaatatcgaaacc

SEQ ID NO: 42787 - DNA, 20 bp, Artificial Sequence
  Synthetic oligonucleotide; GGG chr11 5276944 5276963 5276947 -
aaagatgaatatcgaaacca

SEQ ID NO: 42788 - DNA, 20 bp, Artificial Sequence
  Synthetic oligonucleotide; TGG chr11 5276929 5276948 5276932 -
aaccagggtgttttttacac

SEQ ID NO: 42789 - DNA, 20 bp, Artificial Sequence
  Synthetic oligonucleotide; TAG chr11 5276916 5276935 5276919 -
tttacactggaatttataac

SEQ ID NO: 42790 - DNA, 20 bp, Artificial Sequence
  Synthetic oligonucleotide; GAG chr11 5276914 5276933 5276917 -
tacactggaatttataacta

SEQ ID NO: 42791 - DNA, 20 bp, Artificial Sequence
  Synthetic oligonucleotide; AAG chr11 5276896 5276915 5276899 -
tagagcactcatgtttatgt

SEQ ID NO: 42792 - DNA, 20 bp, Artificial Sequence
  Synthetic oligonucleotide; CAG chr11 5276877 5276896 5276880 -
taagcaattaattgtttcat

SEQ ID NO: 42793 - DNA, 20 bp, Artificial Sequence
  Synthetic oligonucleotide; CAG chr11 5276873 5276892 5276876 -
caattaattgtttcatcagt

SEQ ID NO: 42794 - DNA, 20 bp, Artificial Sequence
  Synthetic oligonucleotide; AGG chr11 5276872 5276891 5276875 -
aattaattgtttcatcagtc

SEQ ID NO: 42795 - DNA, 20 bp, Artificial Sequence
  Synthetic oligonucleotide; AAG chr11 5276866 5276885 5276869 -
ttgtttcatcagtcaggtaa

SEQ ID NO: 42796 - DNA, 20 bp, Artificial Sequence
  Synthetic oligonucleotide; AAG chr11 5276861 5276880 5276864 -
tcatcagtcaggtaaaagta

SEQ ID NO: 42797 - DNA, 20 bp, Artificial Sequence
  Synthetic oligonucleotide; AAG chr11 5276846 5276865 5276849 -
aagtaaagaaaaactgtgcc

SEQ ID NO: 42798 - DNA, 20 bp, Artificial Sequence
  Synthetic oligonucleotide; AGG chr11 5276845 5276864 5276848 -
agtaaagaaaaactgtgcca

SEQ ID NO: 42799 - DNA, 20 bp, Artificial Sequence
  Synthetic oligonucleotide; CAG chr11 5276842 5276861 5276845 -
aaagaaaaactgtgccaagg

SEQ ID NO: 42800 - DNA, 20 bp, Artificial Sequence
  Synthetic oligonucleotide; AGG chr11 5276841 5276860 5276844 -
aagaaaaactgtgccaaggc

SEQ ID NO: 42801 - DNA, 20 bp, Artificial Sequence
  Synthetic oligonucleotide; TAG chr11 5276838 5276857 5276841 -
aaaaactgtgccaaggcagg

SEQ ID NO: 42802 - DNA, 20 bp, Artificial Sequence
  Synthetic oligonucleotide; AAG chr11 5276815 5276834 5276818 -
cctaatgcaatatgccacta

SEQ ID NO: 42803 - DNA, 20 bp, Artificial Sequence
  Synthetic oligonucleotide; TAG chr11 5276798 5276817 5276801 -
ctaaagtaaacattatttca

SEQ ID NO: 42804 - DNA, 20 bp, Artificial Sequence
  Synthetic oligonucleotide; AGG chr11 5276797 5276816 5276800 -
taaagtaaacattatttcat

SEQ ID NO: 42805 - DNA, 20 bp, Artificial Sequence
  Synthetic oligonucleotide; CAG chr11 5276791 5276810 5276794 -
aaacattatttcataggtgt

SEQ ID NO: 42806 - DNA, 20 bp, Artificial Sequence
  Synthetic oligonucleotide; TGG chr11 5276785 5276804 5276788 -
tatttcataggtgtcagata

SEQ ID NO: 42807 - DNA, 20 bp, Artificial Sequence
  Synthetic oligonucleotide; TGG chr11 5276764 5276783 5276767 -
ggcttattcatccatcttca

SEQ ID NO: 42808 - DNA, 20 bp, Artificial Sequence
  Synthetic oligonucleotide; GGG chr11 5276763 5276782 5276766 -
gcttattcatccatcttcat

SEQ ID NO: 42809 - DNA, 20 bp, Artificial Sequence
  Synthetic oligonucleotide; AAG chr11 5276760 5276779 5276763 -
tattcatccatcttcatggg

SEQ ID NO: 42810 - DNA, 20 bp, Artificial Sequence
  Synthetic oligonucleotide; AGG chr11 5276759 5276778 5276762 -
attcatccatcttcatggga

SEQ ID NO: 42811 - DNA, 20 bp, Artificial Sequence
  Synthetic oligonucleotide; TGG chr11 5276755 5276774 5276758 -
atccatcttcatgggaagga

SEQ ID NO: 42812 - DNA, 20 bp, Artificial Sequence
  Synthetic oligonucleotide; TGG chr11 5276749 5276768 5276752 -
cttcatgggaaggatggcct

SEQ ID NO: 42813 - DNA, 20 bp, Artificial Sequence
  Synthetic oligonucleotide; TGG chr11 5276744 5276763 5276747 -
tgggaaggatggccttggcc

SEQ ID NO: 42814 - DNA, 20 bp, Artificial Sequence
  Synthetic oligonucleotide; CAG chr11 5276737 5276756 5276740 -
gatggccttggcctggacat

SEQ ID NO: 42815 - DNA, 20 bp, Artificial Sequence
  Synthetic oligonucleotide; GAG chr11 5276726 5276745 5276729 -
cctggacatcagtgttatgt

SEQ ID NO: 42816 - DNA, 20 bp, Artificial Sequence
  Synthetic oligonucleotide; AGG chr11 5276725 5276744 5276728 -
ctggacatcagtgttatgtg

SEQ ID NO: 42817 - DNA, 20 bp, Artificial Sequence
  Synthetic oligonucleotide; TAG chr11 5276709 5276728 5276712 -
tgtgaggttcaaaacacctc

SEQ ID NO: 42818 - DNA, 20 bp, Artificial Sequence
  Synthetic oligonucleotide; AGG chr11 5276708 5276727 5276711 -
gtgaggttcaaaacacctct

SEQ ID NO: 42819 - DNA, 20 bp, Artificial Sequence
  Synthetic oligonucleotide; AAG chr11 5276701 5276720 5276704 -
tcaaaacacctctaggctat

SEQ ID NO: 42820 - DNA, 20 bp, Artificial Sequence
  Synthetic oligonucleotide; AGG chr11 5276700 5276719 5276703 -
caaaacacctctaggctata

SEQ ID NO: 42821 - DNA, 20 bp, Artificial Sequence
  Synthetic oligonucleotide; CAG chr11 5276694 5276713 5276697 -
acctctaggctataaggcaa

SEQ ID NO: 42822 - DNA, 20 bp, Artificial Sequence
  Synthetic oligonucleotide; GAG chr11 5276692 5276711 5276695 -
ctctaggctataaggcaaca

SEQ ID NO: 42823 - DNA, 20 bp, Artificial Sequence
  Synthetic oligonucleotide; TGG chr11 5276662 5276681 5276665 -
tttttttttctgtgctttcc

SEQ ID NO: 42824 - DNA, 20 bp, Artificial Sequence
  Synthetic oligonucleotide; AAG chr11 5276639 5276658 5276642 -
ctgtccaaatctctaatgat

SEQ ID NO: 42825 - DNA, 20 bp, Artificial Sequence
  Synthetic oligonucleotide; GAG chr11 5276620 5276639 5276623 -
taagcatacttctattcaat

SEQ ID NO: 42826 - DNA, 20 bp, Artificial Sequence
  Synthetic oligonucleotide; AAG chr11 5276607 5276626 5276610 -
attcaatgagaatattctgt

SEQ ID NO: 42827 - DNA, 20 bp, Artificial Sequence
  Synthetic oligonucleotide; TAG chr11 5276600 5276619 5276603 -
gagaatattctgtaagatta

SEQ ID NO: 42828 - DNA, 20 bp, Artificial Sequence
  Synthetic oligonucleotide; AAG chr11 5276595 5276614 5276598 -
tattctgtaagattatagtt

SEQ ID NO: 42829 - DNA, 20 bp, Artificial Sequence
  Synthetic oligonucleotide; TGG chr11 5276587 5276606 5276590 -
aagattatagttaagaattg

SEQ ID NO: 42830 - DNA, 20 bp, Artificial Sequence
  Synthetic oligonucleotide; GGG chr11 5276586 5276605 5276589 -
agattatagttaagaattgt

SEQ ID NO: 42831 - DNA, 20 bp, Artificial Sequence
  Synthetic oligonucleotide; GAG chr11 5276584 5276603 5276587 -
attatagttaagaattgtgg

SEQ ID NO: 42832 - DNA, 20 bp, Artificial Sequence
  Synthetic oligonucleotide; TAG chr11 5276566 5276585 5276569 -
gggagccattccgtctctta

SEQ ID NO: 42833 - DNA, 20 bp, Artificial Sequence
  Synthetic oligonucleotide; GAG chr11 5276555 5276574 5276558 -
cgtctcttatagttaaattt

SEQ ID NO: 42834 - DNA, 20 bp, Artificial Sequence
  Synthetic oligonucleotide; AAG chr11 5276517 5276536 5276520 -
ctgtttttttaatatgcttt

SEQ ID NO: 42835 - DNA, 20 bp, Artificial Sequence
  Synthetic oligonucleotide; TGG chr11 5276511 5276530 5276514 -
ttttaatatgctttaagttc

SEQ ID NO: 42836 - DNA, 20 bp, Artificial Sequence
  Synthetic oligonucleotide; GGG chr11 5276510 5276529 5276513 -
tttaatatgctttaagttct

SEQ ID NO: 42837 - DNA, 20 bp, Artificial Sequence
  Synthetic oligonucleotide; GGG chr11 5276509 5276528 5276512 -
ttaatatgctttaagttctg

SEQ ID NO: 42838 - DNA, 20 bp, Artificial Sequence
  Synthetic oligonucleotide; TGG chr11 5276495 5276514 5276498 -
gttctggggtacatgtgcca

SEQ ID NO: 42839 - DNA, 20 bp, Artificial Sequence
  Synthetic oligonucleotide; TGG chr11 5276492 5276511 5276495 -
ctggggtacatgtgccatgg

SEQ ID NO: 42840 - DNA, 20 bp, Artificial Sequence
  Synthetic oligonucleotide; TAG chr11 5276458 5276477 5276461 -
catcaacccgtcatctacat

SEQ ID NO: 42841 - DNA, 20 bp, Artificial Sequence
  Synthetic oligonucleotide; AGG chr11 5276457 5276476 5276460 -
atcaacccgtcatctacatt

SEQ ID NO: 42842 - DNA, 20 bp, Artificial Sequence
  Synthetic oligonucleotide; TAG chr11 5276428 5276447 5276431 -
tcctaatgctatccttcccc

SEQ ID NO: 42843 - DNA, 20 bp, Artificial Sequence
  Synthetic oligonucleotide; CAG chr11 5276411 5276430 5276414 -
ccctagccccccacccccaa

SEQ ID NO: 42844 - DNA, 20 bp, Artificial Sequence
  Synthetic oligonucleotide; AGG chr11 5276410 5276429 5276413 -
cctagccccccacccccaac

SEQ ID NO: 42845 - DNA, 20 bp, Artificial Sequence
  Synthetic oligonucleotide; CAG chr11 5276404 5276423 5276407 -
cccccacccccaacaggccc

SEQ ID NO: 42846 - DNA, 20 bp, Artificial Sequence
  Synthetic oligonucleotide; TGG chr11 5276374 5276393 5276377 -
tgttcccctccctgtgtcca

SEQ ID NO: 42847 - DNA, 20 bp, Artificial Sequence
  Synthetic oligonucleotide; TGG chr11 5276366 5276385 5276369 -
tccctgtgtccatggatcac

SEQ ID NO: 42848 - DNA, 20 bp, Artificial Sequence
  Synthetic oligonucleotide; AAG chr11 5276336 5276355 5276339 -
ttgtttttttttttttttta

SEQ ID NO: 42849 - DNA, 20 bp, Artificial Sequence
  Synthetic oligonucleotide; CAG chr11 5276330 5276349 5276333 -
tttttttttttttaaagtct

SEQ ID NO: 42850 - DNA, 20 bp, Artificial Sequence
  Synthetic oligonucleotide; TGG chr11 5276318 5276337 5276321 -
taaagtctcagttaaatttt

SEQ ID NO: 42851 - DNA, 20 bp, Artificial Sequence
  Synthetic oligonucleotide; TGG chr11 5276298 5276317 5276301 -
tggaatgtaatttattttcc

SEQ ID NO: 42852 - DNA, 20 bp, Artificial Sequence
  Synthetic oligonucleotide; TAG chr11 5276290 5276309 5276293 -
aatttattttcctggtatcc

SEQ ID NO: 42853 - DNA, 20 bp, Artificial Sequence
  Synthetic oligonucleotide; AGG chr11 5276289 5276308 5276292 -
atttattttcctggtatcct

SEQ ID NO: 42854 - DNA, 20 bp, Artificial Sequence
  Synthetic oligonucleotide; AAG chr11 5276280 5276299 5276283 -
cctggtatcctaggacttgc

SEQ ID NO: 42855 - DNA, 20 bp, Artificial Sequence
  Synthetic oligonucleotide; TGG chr11 5276272 5276291 5276275 -
cctaggacttgcaagttatc

SEQ ID NO: 42856 - DNA, 20 bp, Artificial Sequence
  Synthetic oligonucleotide; TAG chr11 5276263 5276282 5276266 -
tgcaagttatctggtcactt

SEQ ID NO: 42857 - DNA, 20 bp, Artificial Sequence
  Synthetic oligonucleotide; CGG chr11 5276145 5276164 5276148 -
aacacacataacatatttat

SEQ ID NO: 42858 - DNA, 20 bp, Artificial Sequence
  Synthetic oligonucleotide; GGG chr11 5276144 5276163 5276147 -
acacacataacatatttatc

SEQ ID NO: 42859 - DNA, 20 bp, Artificial Sequence
  Synthetic oligonucleotide; GAG chr11 5276134 5276153 5276137 -
catatttatcgggcatttct

SEQ ID NO: 42860 - DNA, 20 bp, Artificial Sequence
  Synthetic oligonucleotide; CAG chr11 5276119 5276138 5276122 -
tttctgagcaactaatcatg

SEQ ID NO: 42861 - DNA, 20 bp, Artificial Sequence
  Synthetic oligonucleotide; AGG chr11 5276118 5276137 5276121 -
ttctgagcaactaatcatgc

SEQ ID NO: 42862 - DNA, 20 bp, Artificial Sequence
  Synthetic oligonucleotide; TAG chr11 5276096 5276115 5276099 -
gactctcaaacactaaccta

SEQ ID NO: 42863 - DNA, 20 bp, Artificial Sequence
  Synthetic oligonucleotide; TAG chr11 5276070 5276089 5276073 -
tttctatgtatctacttgtg

SEQ ID NO: 42864 - DNA, 20 bp, Artificial Sequence
  Synthetic oligonucleotide; AAG chr11 5276062 5276081 5276065 -
tatctacttgtgtagaaacc

SEQ ID NO: 42865 - DNA, 20 bp, Artificial Sequence
  Synthetic oligonucleotide; TGG chr11 5276057 5276076 5276060 -
acttgtgtagaaaccaagcg

SEQ ID NO: 42866 - DNA, 20 bp, Artificial Sequence
  Synthetic oligonucleotide; GGG chr11 5276056 5276075 5276059 -
cttgtgtagaaaccaagcgt

SEQ ID NO: 42867 - DNA, 20 bp, Artificial Sequence
  Synthetic oligonucleotide; GGG chr11 5276055 5276074 5276058 -
ttgtgtagaaaccaagcgtg

SEQ ID NO: 42868 - DNA, 20 bp, Artificial Sequence
  Synthetic oligonucleotide; GAG chr11 5276049 5276068 5276052 -
agaaaccaagcgtggggact

SEQ ID NO: 42869 - DNA, 20 bp, Artificial Sequence
  Synthetic oligonucleotide; AAG chr11 5276046 5276065 5276049 -
aaccaagcgtggggactgag

SEQ ID NO: 42870 - DNA, 20 bp, Artificial Sequence
  Synthetic oligonucleotide; AGG chr11 5276045 5276064 5276048 -
accaagcgtggggactgaga

SEQ ID NO: 42871 - DNA, 20 bp, Artificial Sequence
  Synthetic oligonucleotide; TAG chr11 5276039 5276058 5276042 -
cgtggggactgagaaggcaa

SEQ ID NO: 42872 - DNA, 20 bp, Artificial Sequence
  Synthetic oligonucleotide; CAG chr11 5276036 5276055 5276039 -
ggggactgagaaggcaatag

SEQ ID NO: 42873 - DNA, 20 bp, Artificial Sequence
  Synthetic oligonucleotide; AGG chr11 5276035 5276054 5276038 -
gggactgagaaggcaatagc

SEQ ID NO: 42874 - DNA, 20 bp, Artificial Sequence
  Synthetic oligonucleotide; GAG chr11 5276033 5276052 5276036 -
gactgagaaggcaatagcag

SEQ ID NO: 42875 - DNA, 20 bp, Artificial Sequence
  Synthetic oligonucleotide; TAG chr11 5276009 5276028 5276012 -
attctgactctcactgcctt

SEQ ID NO: 42876 - DNA, 20 bp, Artificial Sequence
  Synthetic oligonucleotide; TAG chr11 5276005 5276024 5276008 -
tgactctcactgcctttagc

SEQ ID NO: 42877 - DNA, 20 bp, Artificial Sequence
  Synthetic oligonucleotide; AGG chr11 5276004 5276023 5276007 -
gactctcactgcctttagct

SEQ ID NO: 42878 - DNA, 20 bp, Artificial Sequence
  Synthetic oligonucleotide; CAG chr11 5275987 5276006 5275990 -
gctaggcccctccctcatca

SEQ ID NO: 42879 - DNA, 20 bp, Artificial Sequence
  Synthetic oligonucleotide; CAG chr11 5275982 5276001 5275985 -
gcccctccctcatcacagct

SEQ ID NO: 42880 - DNA, 20 bp, Artificial Sequence
  Synthetic oligonucleotide; TAG chr11 5275977 5275996 5275980 -
tccctcatcacagctcagca

SEQ ID NO: 42881 - DNA, 20 bp, Artificial Sequence
  Synthetic oligonucleotide; GAG chr11 5275970 5275989 5275973 -
tcacagctcagcatagtcct

SEQ ID NO: 42882 - DNA, 20 bp, Artificial Sequence
  Synthetic oligonucleotide; CAG chr11 5275947 5275966 5275950 -
ctcttatctatatccacaca

SEQ ID NO: 42883 - DNA, 20 bp, Artificial Sequence
  Synthetic oligonucleotide; CAG chr11 5275930 5275949 5275933 -
acacagtttctgacgctgcc

SEQ ID NO: 42884 - DNA, 20 bp, Artificial Sequence
  Synthetic oligonucleotide; AAG chr11 5275914 5275933 5275917 -
tgcccagctatcaccatccc

SEQ ID NO: 42885 - DNA, 20 bp, Artificial Sequence
  Synthetic oligonucleotide; AAG chr11 5275907 5275926 5275910 -
ctatcaccatcccaagtcta

SEQ ID NO: 42886 - DNA, 20 bp, Artificial Sequence
  Synthetic oligonucleotide; TGG chr11 5275894 5275913 5275897 -
aagtctaaagaaaaaaataa

SEQ ID NO: 42887 - DNA, 20 bp, Artificial Sequence
  Synthetic oligonucleotide; GGG chr11 5275893 5275912 5275896 -
agtctaaagaaaaaaataat

SEQ ID NO: 42888 - DNA, 20 bp, Artificial Sequence
  Synthetic oligonucleotide; TAG chr11 5275871 5275890 5275874 -
gtttgcccatctctgttgat

SEQ ID NO: 42889 - DNA, 20 bp, Artificial Sequence
  Synthetic oligonucleotide; AAG chr11 5275848 5275867 5275851 -
aaaacaaaacaaaataaaat

SEQ ID NO: 42890 - DNA, 20 bp, Artificial Sequence
  Synthetic oligonucleotide; AAG chr11 5275840 5275859 5275843 -
acaaaataaaataagcccct

SEQ ID NO: 42891 - DNA, 20 bp, Artificial Sequence
  Synthetic oligonucleotide; CAG chr11 5275833 5275852 5275836 -
aaaataagcccctaagctcc

SEQ ID NO: 42892 - DNA, 20 bp, Artificial Sequence
  Synthetic oligonucleotide; CAG chr11 5275815 5275834 5275818 -
cccagaaaacatgactaaac

SEQ ID NO: 42893 - DNA, 20 bp, Artificial Sequence
  Synthetic oligonucleotide; AAG chr11 5275811 5275830 5275814 -
gaaaacatgactaaaccagc

SEQ ID NO: 42894 - DNA, 20 bp, Artificial Sequence
  Synthetic oligonucleotide; AAG chr11 5275808 5275827 5275811 -
aacatgactaaaccagcaag

SEQ ID NO: 42895 - DNA, 20 bp, Artificial Sequence
  Synthetic oligonucleotide; AAG chr11 5275805 5275824 5275808 -
atgactaaaccagcaagaag

SEQ ID NO: 42896 - DNA, 20 bp, Artificial Sequence
  Synthetic oligonucleotide; TAG chr11 5275793 5275812 5275796 -
gcaagaagaagaaaatacaa

SEQ ID NO: 42897 - DNA, 20 bp, Artificial Sequence
  Synthetic oligonucleotide; AGG chr11 5275792 5275811 5275795 -
caagaagaagaaaatacaat

SEQ ID NO: 42898 - DNA, 20 bp, Artificial Sequence
  Synthetic oligonucleotide; GAG chr11 5275784 5275803 5275787 -
agaaaatacaataggtatat

SEQ ID NO: 42899 - DNA, 20 bp, Artificial Sequence
  Synthetic oligonucleotide; AGG chr11 5275783 5275802 5275786 -
gaaaatacaataggtatatg

SEQ ID NO: 42900 - DNA, 20 bp, Artificial Sequence
  Synthetic oligonucleotide; GAG chr11 5275781 5275800 5275784 -
aaatacaataggtatatgag

SEQ ID NO: 42901 - DNA, 20 bp, Artificial Sequence
  Synthetic oligonucleotide; TGG chr11 5275776 5275795 5275779 -
caataggtatatgaggagac

SEQ ID NO: 42902 - DNA, 20 bp, Artificial Sequence
  Synthetic oligonucleotide; TAG chr11 5275767 5275786 5275770 -
tatgaggagactggtgacac

SEQ ID NO: 42903 - DNA, 20 bp, Artificial Sequence
  Synthetic oligonucleotide; GAG chr11 5275755 5275774 5275758 -
ggtgacactagtgtctgaat

SEQ ID NO: 42904 - DNA, 20 bp, Artificial Sequence
  Synthetic oligonucleotide; AGG chr11 5275754 5275773 5275757 -
gtgacactagtgtctgaatg

SEQ ID NO: 42905 - DNA, 20 bp, Artificial Sequence
  Synthetic oligonucleotide; GAG chr11 5275748 5275767 5275751 -
ctagtgtctgaatgaggctt

SEQ ID NO: 42906 - DNA, 20 bp, Artificial Sequence
  Synthetic oligonucleotide; CAG chr11 5275743 5275762 5275746 -
gtctgaatgaggcttgagta

SEQ ID NO: 42907 - DNA, 20 bp, Artificial Sequence
  Synthetic oligonucleotide; AAG chr11 5275738 5275757 5275741 -
aatgaggcttgagtacagaa

SEQ ID NO: 42908 - DNA, 20 bp, Artificial Sequence
  Synthetic oligonucleotide; GAG chr11 5275736 5275755 5275739 -
tgaggcttgagtacagaaaa

SEQ ID NO: 42909 - DNA, 20 bp, Artificial Sequence
  Synthetic oligonucleotide; AGG chr11 5275735 5275754 5275738 -
gaggcttgagtacagaaaag

SEQ ID NO: 42910 - DNA, 20 bp, Artificial Sequence
  Synthetic oligonucleotide; TAG chr11 5275729 5275748 5275732 -
tgagtacagaaaagaggctc

SEQ ID NO: 42911 - DNA, 20 bp, Artificial Sequence
  Synthetic oligonucleotide; CAG chr11 5275726 5275745 5275729 -
gtacagaaaagaggctctag

SEQ ID NO: 42912 - DNA, 20 bp, Artificial Sequence
  Synthetic oligonucleotide; TAG chr11 5275721 5275740 5275724 -
gaaaagaggctctagcagca

SEQ ID NO: 42913 - DNA, 20 bp, Artificial Sequence
  Synthetic oligonucleotide; TGG chr11 5275718 5275737 5275721 -
aagaggctctagcagcatag

SEQ ID NO: 42914 - DNA, 20 bp, Artificial Sequence
  Synthetic oligonucleotide; TAG chr11 5275713 5275732 5275716 -
gctctagcagcatagtggtt

SEQ ID NO: 42915 - DNA, 20 bp, Artificial Sequence
  Synthetic oligonucleotide; GAG chr11 5275711 5275730 5275714 -
tctagcagcatagtggttta

SEQ ID NO: 42916 - DNA, 20 bp, Artificial Sequence
  Synthetic oligonucleotide; AGG chr11 5275710 5275729 5275713 -
ctagcagcatagtggtttag

SEQ ID NO: 42917 - DNA, 20 bp, Artificial Sequence
  Synthetic oligonucleotide; GAG chr11 5275708 5275727 5275711 -
agcagcatagtggtttagag

SEQ ID NO: 42918 - DNA, 20 bp, Artificial Sequence
  Synthetic oligonucleotide; CAG chr11 5275689 5275708 5275692 -
ggagatgtttctttccttca

SEQ ID NO: 42919 - DNA, 20 bp, Artificial Sequence
  Synthetic oligonucleotide; TAG chr11 5275680 5275699 5275683 -
tctttccttcacagatgcct

SEQ ID NO: 42920 - DNA, 20 bp, Artificial Sequence
  Synthetic oligonucleotide; AAG chr11 5275670 5275689 5275673 -
acagatgccttagcctcaat

SEQ ID NO: 42921 - DNA, 20 bp, Artificial Sequence
  Synthetic oligonucleotide; CGG chr11 5275663 5275682 5275666 -
ccttagcctcaataagcttg

SEQ ID NO: 42922 - DNA, 20 bp, Artificial Sequence
  Synthetic oligonucleotide; TGG chr11 5275657 5275676 5275660 -
cctcaataagcttgcggttg

SEQ ID NO: 42923 - DNA, 20 bp, Artificial Sequence
  Synthetic oligonucleotide; AAG chr11 5275654 5275673 5275657 -
caataagcttgcggttgtgg

SEQ ID NO: 42924 - DNA, 20 bp, Artificial Sequence
  Synthetic oligonucleotide; CAG chr11 5275643 5275662 5275646 -
cggttgtggaagtttacttt

SEQ ID NO: 42925 - DNA, 20 bp, Artificial Sequence
  Synthetic oligonucleotide; TGG chr11 5275628 5275647 5275631 -
actttcagaacaaactcctg

SEQ ID NO: 42926 - DNA, 20 bp, Artificial Sequence
  Synthetic oligonucleotide; GGG chr11 5275627 5275646 5275630 -
ctttcagaacaaactcctgt

SEQ ID NO: 42927 - DNA, 20 bp, Artificial Sequence
  Synthetic oligonucleotide; GGG chr11 5275626 5275645 5275629 -
tttcagaacaaactcctgtg

SEQ ID NO: 42928 - DNA, 20 bp, Artificial Sequence
  Synthetic oligonucleotide; TAG chr11 5275622 5275641 5275625 -
agaacaaactcctgtggggc

SEQ ID NO: 42929 - DNA, 20 bp, Artificial Sequence
  Synthetic oligonucleotide; TGG chr11 5275610 5275629 5275613 -
tgtggggctagaattattga

SEQ ID NO: 42930 - DNA, 20 bp, Artificial Sequence
  Synthetic oligonucleotide; AAG chr11 5275603 5275622 5275606 -
ctagaattattgatggctaa

SEQ ID NO: 42931 - DNA, 20 bp, Artificial Sequence
  Synthetic oligonucleotide; AAG chr11 5275600 5275619 5275603 -
gaattattgatggctaaaag

SEQ ID NO: 42932 - DNA, 20 bp, Artificial Sequence
  Synthetic oligonucleotide; CGG chr11 5275595 5275614 5275598 -
attgatggctaaaagaagcc

SEQ ID NO: 42933 - DNA, 20 bp, Artificial Sequence
  Synthetic oligonucleotide; GGG chr11 5275594 5275613 5275597 -
ttgatggctaaaagaagccc

SEQ ID NO: 42934 - DNA, 20 bp, Artificial Sequence
  Synthetic oligonucleotide; GGG chr11 5275593 5275612 5275596 -
tgatggctaaaagaagcccg

SEQ ID NO: 42935 - DNA, 20 bp, Artificial Sequence
  Synthetic oligonucleotide; GGG chr11 5275592 5275611 5275595 -
gatggctaaaagaagcccgg

SEQ ID NO: 42936 - DNA, 20 bp, Artificial Sequence
  Synthetic oligonucleotide; GAG chr11 5275590 5275609 5275593 -
tggctaaaagaagcccgggg

SEQ ID NO: 42937 - DNA, 20 bp, Artificial Sequence
  Synthetic oligonucleotide; AGG chr11 5275589 5275608 5275592 -
ggctaaaagaagcccggggg

SEQ ID NO: 42938 - DNA, 20 bp, Artificial Sequence
  Synthetic oligonucleotide; GGG chr11 5275588 5275607 5275591 -
gctaaaagaagcccggggga

SEQ ID NO: 42939 - DNA, 20 bp, Artificial Sequence
  Synthetic oligonucleotide; CAG chr11 5275575 5275594 5275578 -
cgggggagggaaaaatcatt

SEQ ID NO: 42940 - DNA, 20 bp, Artificial Sequence
  Synthetic oligonucleotide; TAG chr11 5275560 5275579 5275563 -
tcattcagcatcctcaccct

SEQ ID NO: 42941 - DNA, 20 bp, Artificial Sequence
  Synthetic oligonucleotide; CAG chr11 5275547 5275566 5275550 -
tcacccttagtgacacaaaa

SEQ ID NO: 42942 - DNA, 20 bp, Artificial Sequence
  Synthetic oligonucleotide; GAG chr11 5275545 5275564 5275548 -
acccttagtgacacaaaaca

SEQ ID NO: 42943 - DNA, 20 bp, Artificial Sequence
  Synthetic oligonucleotide; AGG chr11 5275544 5275563 5275547 -
cccttagtgacacaaaacag

SEQ ID NO: 42944 - DNA, 20 bp, Artificial Sequence
  Synthetic oligonucleotide; GGG chr11 5275543 5275562 5275546 -
ccttagtgacacaaaacaga

SEQ ID NO: 42945 - DNA, 20 bp, Artificial Sequence
  Synthetic oligonucleotide; GGG chr11 5275542 5275561 5275545 -
cttagtgacacaaaacagag

SEQ ID NO: 42946 - DNA, 20 bp, Artificial Sequence
  Synthetic oligonucleotide; GGG chr11 5275541 5275560 5275544 -
ttagtgacacaaaacagagg

SEQ ID NO: 42947 - DNA, 20 bp, Artificial Sequence
  Synthetic oligonucleotide; TGG chr11 5275536 5275555 5275539 -
gacacaaaacagagggggcc

SEQ ID NO: 42948 - DNA, 20 bp, Artificial Sequence
  Synthetic oligonucleotide; TGG chr11 5275513 5275532 5275516 -
ttttccatatttcctcatga

SEQ ID NO: 42949 - DNA, 20 bp, Artificial Sequence
  Synthetic oligonucleotide; AAG chr11 5275495 5275514 5275498 -
gatggatgatctcgttaatg

SEQ ID NO: 42950 - DNA, 20 bp, Artificial Sequence
  Synthetic oligonucleotide; AGG chr11 5275494 5275513 5275497 -
atggatgatctcgttaatga

SEQ ID NO: 42951 - DNA, 20 bp, Artificial Sequence
  Synthetic oligonucleotide; TGG chr11 5275491 5275510 5275494 -
gatgatctcgttaatgaagg

SEQ ID NO: 42952 - DNA, 20 bp, Artificial Sequence
  Synthetic oligonucleotide; GAG chr11 5275482 5275501 5275485 -
gttaatgaaggtggtctgac

SEQ ID NO: 42953 - DNA, 20 bp, Artificial Sequence
  Synthetic oligonucleotide; AAG chr11 5275460 5275479 5275463 -
gatcattgcttcttccattt

SEQ ID NO: 42954 - DNA, 20 bp, Artificial Sequence
  Synthetic oligonucleotide; CAG chr11 5275436 5275455 5275439 -
cttgctcacttgccaatcct

SEQ ID NO: 42955 - DNA, 20 bp, Artificial Sequence
  Synthetic oligonucleotide; CAG chr11 5275420 5275439 5275423 -
tcctcagttttaaccttctc

SEQ ID NO: 42956 - DNA, 20 bp, Artificial Sequence
  Synthetic oligonucleotide; GAG chr11 5275418 5275437 5275421 -
ctcagttttaaccttctcca

SEQ ID NO: 42957 - DNA, 20 bp, Artificial Sequence
  Synthetic oligonucleotide; CAG chr11 5275397 5275416 5275400 -
agaaatacacattttttatt

SEQ ID NO: 42958 - DNA, 20 bp, Artificial Sequence
  Synthetic oligonucleotide; AGG chr11 5275396 5275415 5275399 -
gaaatacacattttttattc

SEQ ID NO: 42959 - DNA, 20 bp, Artificial Sequence
  Synthetic oligonucleotide; TAG chr11 5275378 5275397 5275381 -
tcaggaaacatactatgtta

SEQ ID NO: 42960 - DNA, 20 bp, Artificial Sequence
  Synthetic oligonucleotide; AAG chr11 5275356 5275375 5275359 -
gtttcaatactaaataatca

SEQ ID NO: 42961 - DNA, 20 bp, Artificial Sequence
  Synthetic oligonucleotide; AAG chr11 5275348 5275367 5275351 -
actaaataatcaaagtactg

SEQ ID NO: 42962 - DNA, 20 bp, Artificial Sequence
  Synthetic oligonucleotide; TAG chr11 5275344 5275363 5275347 -
aataatcaaagtactgaaga

SEQ ID NO: 42963 - DNA, 20 bp, Artificial Sequence
  Synthetic oligonucleotide; TAG chr11 5275335 5275354 5275338 -
agtactgaagatagcatgca

SEQ ID NO: 42964 - DNA, 20 bp, Artificial Sequence
  Synthetic oligonucleotide; AGG chr11 5275334 5275353 5275337 -
gtactgaagatagcatgcat

SEQ ID NO: 42965 - DNA, 20 bp, Artificial Sequence
  Synthetic oligonucleotide; AAG chr11 5275330 5275349 5275333 -
tgaagatagcatgcataggc

SEQ ID NO: 42966 - DNA, 20 bp, Artificial Sequence
  Synthetic oligonucleotide; AAG chr11 5275324 5275343 5275327 -
tagcatgcataggcaagaaa

SEQ ID NO: 42967 - DNA, 20 bp, Artificial Sequence
  Synthetic oligonucleotide; TAG chr11 5275317 5275336 5275320 -
cataggcaagaaaaagtcct

SEQ ID NO: 42968 - DNA, 20 bp, Artificial Sequence
  Synthetic oligonucleotide; CAG chr11 5275295 5275314 5275298 -
gctttatgttgctgttgttt

SEQ ID NO: 42969 - DNA, 20 bp, Artificial Sequence
  Synthetic oligonucleotide; AAG chr11 5275283 5275302 5275286 -
tgttgtttcagaatttaaaa

SEQ ID NO: 42970 - DNA, 20 bp, Artificial Sequence
  Synthetic oligonucleotide; AAG chr11 5275274 5275293 5275277 -
agaatttaaaaaagatcacc

SEQ ID NO: 42971 - DNA, 20 bp, Artificial Sequence
  Synthetic oligonucleotide; AAG chr11 5275269 5275288 5275272 -
ttaaaaaagatcaccaagtc

SEQ ID NO: 42972 - DNA, 20 bp, Artificial Sequence
  Synthetic oligonucleotide; AGG chr11 5275268 5275287 5275271 -
taaaaaagatcaccaagtca

SEQ ID NO: 42973 - DNA, 20 bp, Artificial Sequence
  Synthetic oligonucleotide; CAG chr11 5275259 5275278 5275262 -
tcaccaagtcaaggacttct

SEQ ID NO: 42974 - DNA, 20 bp, Artificial Sequence
  Synthetic oligonucleotide; TAG chr11 5275253 5275272 5275256 -
agtcaaggacttctcagttc

SEQ ID NO: 42975 - DNA, 20 bp, Artificial Sequence
  Synthetic oligonucleotide; TAG chr11 5275247 5275266 5275250 -
ggacttctcagttctagcac

SEQ ID NO: 42976 - DNA, 20 bp, Artificial Sequence
  Synthetic oligonucleotide; GAG chr11 5275245 5275264 5275248 -
acttctcagttctagcacta

SEQ ID NO: 42977 - DNA, 20 bp, Artificial Sequence
  Synthetic oligonucleotide; AGG chr11 5275244 5275263 5275247 -
cttctcagttctagcactag

SEQ ID NO: 42978 - DNA, 20 bp, Artificial Sequence
  Synthetic oligonucleotide; TGG chr11 5275241 5275260 5275244 -
ctcagttctagcactagagg

SEQ ID NO: 42979 - DNA, 20 bp, Artificial Sequence
  Synthetic oligonucleotide; TAG chr11 5275233 5275252 5275236 -
tagcactagaggtggaatct

SEQ ID NO: 42980 - DNA, 20 bp, Artificial Sequence
  Synthetic oligonucleotide; CAG chr11 5275222 5275241 5275225 -
gtggaatcttagcatataat

SEQ ID NO: 42981 - DNA, 20 bp, Artificial Sequence
  Synthetic oligonucleotide; GAG chr11 5275220 5275239 5275223 -
ggaatcttagcatataatca

SEQ ID NO: 42982 - DNA, 20 bp, Artificial Sequence
  Synthetic oligonucleotide; AGG chr11 5275219 5275238 5275222 -
gaatcttagcatataatcag

SEQ ID NO: 42983 - DNA, 20 bp, Artificial Sequence
  Synthetic oligonucleotide; TAG chr11 5275202 5275221 5275205 -
cagaggtttttcaaaatttc

SEQ ID NO: 42984 - DNA, 20 bp, Artificial Sequence
  Synthetic oligonucleotide; AAG chr11 5275195 5275214 5275198 -
ttttcaaaatttctagacat

SEQ ID NO: 42985 - DNA, 20 bp, Artificial Sequence
  Synthetic oligonucleotide; AAG chr11 5275187 5275206 5275190 -
atttctagacataagattca

SEQ ID NO: 42986 - DNA, 20 bp, Artificial Sequence
  Synthetic oligonucleotide; TAG chr11 5275170 5275189 5275173 -
tcaaagccctgcacttaaaa

SEQ ID NO: 42987 - DNA, 20 bp, Artificial Sequence
  Synthetic oligonucleotide; AAG chr11 5275135 5275154 5275138 -
taactctttatataaattga

SEQ ID NO: 42988 - DNA, 20 bp, Artificial Sequence
  Synthetic oligonucleotide; CAG chr11 5275115 5275134 5275118 -
aagcacattctgaactactt

SEQ ID NO: 42989 - DNA, 20 bp, Artificial Sequence
  Synthetic oligonucleotide; GAG chr11 5275113 5275132 5275116 -
gcacattctgaactacttca

SEQ ID NO: 42990 - DNA, 20 bp, Artificial Sequence
  Synthetic oligonucleotide; TAG chr11 5275088 5275107 5275091 -
ttgttttatttctatgttct

SEQ ID NO: 42991 - DNA, 20 bp, Artificial Sequence
  Synthetic oligonucleotide; TAG chr11 5275072 5275091 5275075 -
ttcttagttcataaatacat

SEQ ID NO: 42992 - DNA, 20 bp, Artificial Sequence
  Synthetic oligonucleotide; AGG chr11 5275071 5275090 5275074 -
tcttagttcataaatacatt

SEQ ID NO: 42993 - DNA, 20 bp, Artificial Sequence
  Synthetic oligonucleotide; AAG chr11 5275043 5275062 5275046 -
caatttaattaaaaaaaccc

SEQ ID NO: 42994 - DNA, 20 bp, Artificial Sequence
  Synthetic oligonucleotide; TAG chr11 5275033 5275052 5275036 -
aaaaaaacccaagaatttct

SEQ ID NO: 42995 - DNA, 20 bp, Artificial Sequence
  Synthetic oligonucleotide; AAG chr11 5275007 5275026 5275010 -
tttaatcatgaaaataaatg

SEQ ID NO: 42996 - DNA, 20 bp, Artificial Sequence
  Synthetic oligonucleotide; AGG chr11 5275006 5275025 5275009 -
ttaatcatgaaaataaatga

SEQ ID NO: 42997 - DNA, 20 bp, Artificial Sequence
  Synthetic oligonucleotide; AAG chr11 5274988 5275007 5274991 -
gaaggcatctttacttactc

SEQ ID NO: 42998 - DNA, 20 bp, Artificial Sequence
  Synthetic oligonucleotide; AGG chr11 5274987 5275006 5274990 -
aaggcatctttacttactca

SEQ ID NO: 42999 - DNA, 20 bp, Artificial Sequence
  Synthetic oligonucleotide; AAG chr11 5274978 5274997 5274981 -
ttacttactcaaggtcccaa

SEQ ID NO: 43000 - DNA, 20 bp, Artificial Sequence
  Synthetic oligonucleotide; AGG chr11 5274977 5274996 5274980 -
tacttactcaaggtcccaaa

SEQ ID NO: 43001 - DNA, 20 bp, Artificial Sequence
  Synthetic oligonucleotide; AAG chr11 5274971 5274990 5274974 -
ctcaaggtcccaaaaggtca

SEQ ID NO: 43002 - DNA, 20 bp, Artificial Sequence
  Synthetic oligonucleotide; CAG chr11 5274964 5274983 5274967 -
tcccaaaaggtcaaagaaac

SEQ ID NO: 43003 - DNA, 20 bp, Artificial Sequence
  Synthetic oligonucleotide; AGG chr11 5274963 5274982 5274966 -
cccaaaaggtcaaagaaacc

SEQ ID NO: 43004 - DNA, 20 bp, Artificial Sequence
  Synthetic oligonucleotide; AAG chr11 5274959 5274978 5274962 -
aaaggtcaaagaaaccagga

SEQ ID NO: 43005 - DNA, 20 bp, Artificial Sequence
  Synthetic oligonucleotide; AAG chr11 5274954 5274973 5274957 -
tcaaagaaaccaggaaagta

SEQ ID NO: 43006 - DNA, 20 bp, Artificial Sequence
  Synthetic oligonucleotide; CAG chr11 5274943 5274962 5274946 -
aggaaagtaaagctatattt

SEQ ID NO: 43007 - DNA, 20 bp, Artificial Sequence
  Synthetic oligonucleotide; CGG chr11 5274940 5274959 5274943 -
aaagtaaagctatatttcag

SEQ ID NO: 43008 - DNA, 20 bp, Artificial Sequence
  Synthetic oligonucleotide; TGG chr11 5274933 5274952 5274936 -
agctatatttcagcggaaaa

SEQ ID NO: 43009 - DNA, 20 bp, Artificial Sequence
  Synthetic oligonucleotide; GGG chr11 5274932 5274951 5274935 -
gctatatttcagcggaaaat

SEQ ID NO: 43010 - DNA, 20 bp, Artificial Sequence
  Synthetic oligonucleotide; GAG chr11 5274921 5274940 5274924 -
gcggaaaatgggatatttat

SEQ ID NO: 43011 - DNA, 20 bp, Artificial Sequence
  Synthetic oligonucleotide; AAG chr11 5274912 5274931 5274915 -
gggatatttatgagttttct

SEQ ID NO: 43012 - DNA, 20 bp, Artificial Sequence
  Synthetic oligonucleotide; CAG chr11 5274905 5274924 5274908 -
ttatgagttttctaagttga

SEQ ID NO: 43013 - DNA, 20 bp, Artificial Sequence
  Synthetic oligonucleotide; AAG chr11 5274898 5274917 5274901 -
ttttctaagttgacagactc

SEQ ID NO: 43014 - DNA, 20 bp, Artificial Sequence
  Synthetic oligonucleotide; CAG chr11 5274885 5274904 5274888 -
cagactcaagttttaacctt

SEQ ID NO: 43015 - DNA, 20 bp, Artificial Sequence
  Synthetic oligonucleotide; TAG chr11 5274871 5274890 5274874 -
aaccttcagtgcccatcatg

SEQ ID NO: 43016 - DNA, 20 bp, Artificial Sequence
  Synthetic oligonucleotide; AGG chr11 5274870 5274889 5274873 -
accttcagtgcccatcatgt

SEQ ID NO: 43017 - DNA, 20 bp, Artificial Sequence
  Synthetic oligonucleotide; AAG chr11 5274866 5274885 5274869 -
tcagtgcccatcatgtagga

SEQ ID NO: 43018 - DNA, 20 bp, Artificial Sequence
  Synthetic oligonucleotide; TGG chr11 5274861 5274880 5274864 -
gcccatcatgtaggaaagtg

SEQ ID NO: 43019 - DNA, 20 bp, Artificial Sequence
  Synthetic oligonucleotide; TGG chr11 5274852 5274871 5274855 -
gtaggaaagtgtggcataac

SEQ ID NO: 43020 - DNA, 20 bp, Artificial Sequence
  Synthetic oligonucleotide; TGG chr11 5274842 5274861 5274845 -
gtggcataactggctgattc

SEQ ID NO: 43021 - DNA, 20 bp, Artificial Sequence
  Synthetic oligonucleotide; AAG chr11 5274816 5274835 5274819 -
tctactcctttttcccatta

SEQ ID NO: 43022 - DNA, 20 bp, Artificial Sequence
  Synthetic oligonucleotide; AAG chr11 5274787 5274806 5274790 -
cctgcttaattaacattcac

SEQ ID NO: 43023 - DNA, 20 bp, Artificial Sequence
  Synthetic oligonucleotide; TGG chr11 5274778 5274797 5274781 -
ttaacattcacaagtaactc

SEQ ID NO: 43024 - DNA, 20 bp, Artificial Sequence
  Synthetic oligonucleotide; TAG chr11 5274767 5274786 5274770 -
aagtaactctggttgtactt

SEQ ID NO: 43025 - DNA, 20 bp, Artificial Sequence
  Synthetic oligonucleotide; AGG chr11 5274766 5274785 5274769 -
agtaactctggttgtacttt

SEQ ID NO: 43026 - DNA, 20 bp, Artificial Sequence
  Synthetic oligonucleotide; CAG chr11 5274761 5274780 5274764 -
ctctggttgtactttaggca

SEQ ID NO: 43027 - DNA, 20 bp, Artificial Sequence
  Synthetic oligonucleotide; TGG chr11 5274758 5274777 5274761 -
tggttgtactttaggcacag

SEQ ID NO: 43028 - DNA, 20 bp, Artificial Sequence
  Synthetic oligonucleotide; GAG chr11 5274750 5274769 5274753 -
ctttaggcacagtggctccc

SEQ ID NO: 43029 - DNA, 20 bp, Artificial Sequence
  Synthetic oligonucleotide; AGG chr11 5274749 5274768 5274752 -
tttaggcacagtggctcccg

SEQ ID NO: 43030 - DNA, 20 bp, Artificial Sequence
  Synthetic oligonucleotide; CAG chr11 5274745 5274764 5274748 -
ggcacagtggctcccgaggt

SEQ ID NO: 43031 - DNA, 20 bp, Artificial Sequence
  Synthetic oligonucleotide; TAG chr11 5274734 5274753 5274737 -
tcccgaggtcagtcacacaa

SEQ ID NO: 43032 - DNA, 20 bp, Artificial Sequence
  Synthetic oligonucleotide; AGG chr11 5274733 5274752 5274736 -
cccgaggtcagtcacacaat

SEQ ID NO: 43033 - DNA, 20 bp, Artificial Sequence
  Synthetic oligonucleotide; AAG chr11 5274717 5274736 5274720 -
caataggatgtctgtgctcc

SEQ ID NO: 43034 - DNA, 20 bp, Artificial Sequence
  Synthetic oligonucleotide; CAG chr11 5274710 5274729 5274713 -
atgtctgtgctccaagttgc

SEQ ID NO: 43035 - DNA, 20 bp, Artificial Sequence
  Synthetic oligonucleotide; GAG chr11 5274708 5274727 5274711 -
gtctgtgctccaagttgcca

SEQ ID NO: 43036 - DNA, 20 bp, Artificial Sequence
  Synthetic oligonucleotide; GAG chr11 5274706 5274725 5274709 -
ctgtgctccaagttgccaga

SEQ ID NO: 43037 - DNA, 20 bp, Artificial Sequence
  Synthetic oligonucleotide; GAG chr11 5274704 5274723 5274707 -
gtgctccaagttgccagaga

SEQ ID NO: 43038 - DNA, 20 bp, Artificial Sequence
  Synthetic oligonucleotide; GAG chr11 5274702 5274721 5274705 -
gctccaagttgccagagaga

SEQ ID NO: 43039 - DNA, 20 bp, Artificial Sequence
  Synthetic oligonucleotide; GAG chr11 5274690 5274709 5274693 -
cagagagagagattactctt

SEQ ID NO: 43040 - DNA, 20 bp, Artificial Sequence
  Synthetic oligonucleotide; GAG chr11 5274684 5274703 5274687 -
gagagattactcttgagaat

SEQ ID NO: 43041 - DNA, 20 bp, Artificial Sequence
  Synthetic oligonucleotide; CAG chr11 5274678 5274697 5274681 -
ttactcttgagaatgagcct

SEQ ID NO: 43042 - DNA, 20 bp, Artificial Sequence
  Synthetic oligonucleotide; TGG chr11 5274672 5274691 5274675 -
ttgagaatgagcctcagccc

SEQ ID NO: 43043 - DNA, 20 bp, Artificial Sequence
  Synthetic oligonucleotide; GAG chr11 5274645 5274664 5274648 -
aactcacctgcaaacttcgt

SEQ ID NO: 43044 - DNA, 20 bp, Artificial Sequence
  Synthetic oligonucleotide; GAG chr11 5274643 5274662 5274646 -
ctcacctgcaaacttcgtga

SEQ ID NO: 43045 - DNA, 20 bp, Artificial Sequence
  Synthetic oligonucleotide; GAG chr11 5274638 5274657 5274641 -
ctgcaaacttcgtgagagat

SEQ ID NO: 43046 - DNA, 20 bp, Artificial Sequence
  Synthetic oligonucleotide; AGG chr11 5274637 5274656 5274640 -
tgcaaacttcgtgagagatg

SEQ ID NO: 43047 - DNA, 20 bp, Artificial Sequence
  Synthetic oligonucleotide; CAG chr11 5274634 5274653 5274637 -
aaacttcgtgagagatgagg

SEQ ID NO: 43048 - DNA, 20 bp, Artificial Sequence
  Synthetic oligonucleotide; GAG chr11 5274632 5274651 5274635 -
acttcgtgagagatgaggca

SEQ ID NO: 43049 - DNA, 20 bp, Artificial Sequence
  Synthetic oligonucleotide; AGG chr11 5274631 5274650 5274634 -
cttcgtgagagatgaggcag

SEQ ID NO: 43050 - DNA, 20 bp, Artificial Sequence
  Synthetic oligonucleotide; AAG chr11 5274618 5274637 5274621 -
gaggcagaggtacactacga

SEQ ID NO: 43051 - DNA, 20 bp, Artificial Sequence
  Synthetic oligonucleotide; CAG chr11 5274612 5274631 5274615 -
gaggtacactacgaaagcaa

SEQ ID NO: 43052 - DNA, 20 bp, Artificial Sequence
  Synthetic oligonucleotide; TAG chr11 5274608 5274627 5274611 -
tacactacgaaagcaacagt

SEQ ID NO: 43053 - DNA, 20 bp, Artificial Sequence
  Synthetic oligonucleotide; AAG chr11 5274605 5274624 5274608 -
actacgaaagcaacagttag

SEQ ID NO: 43054 - DNA, 20 bp, Artificial Sequence
  Synthetic oligonucleotide; GAG chr11 5274593 5274612 5274596 -
acagttagaagctaaatgat

SEQ ID NO: 43055 - DNA, 20 bp, Artificial Sequence
  Synthetic oligonucleotide; TGG chr11 5274584 5274603 5274587 -
agctaaatgatgagaacaca

SEQ ID NO: 43056 - DNA, 20 bp, Artificial Sequence
  Synthetic oligonucleotide; TAG chr11 5274576 5274595 5274579 -
gatgagaacacatggactca

SEQ ID NO: 43057 - DNA, 20 bp, Artificial Sequence
  Synthetic oligonucleotide; GAG chr11 5274574 5274593 5274577 -
tgagaacacatggactcata

SEQ ID NO: 43058 - DNA, 20 bp, Artificial Sequence
  Synthetic oligonucleotide; AGG chr11 5274573 5274592 5274576 -
gagaacacatggactcatag

SEQ ID NO: 43059 - DNA, 20 bp, Artificial Sequence
  Synthetic oligonucleotide; GGG chr11 5274572 5274591 5274575 -
agaacacatggactcataga

SEQ ID NO: 43060 - DNA, 20 bp, Artificial Sequence
  Synthetic oligonucleotide; TGG chr11 5274556 5274575 5274559 -
tagagggaaacaacgcatac

SEQ ID NO: 43061 - DNA, 20 bp, Artificial Sequence
  Synthetic oligonucleotide; GGG chr11 5274555 5274574 5274558 -
agagggaaacaacgcatact

SEQ ID NO: 43062 - DNA, 20 bp, Artificial Sequence
  Synthetic oligonucleotide; GGG chr11 5274554 5274573 5274557 -
gagggaaacaacgcatactg

SEQ ID NO: 43063 - DNA, 20 bp, Artificial Sequence
  Synthetic oligonucleotide; CAG chr11 5274546 5274565 5274549 -
caacgcatactggggcctat

SEQ ID NO: 43064 - DNA, 20 bp, Artificial Sequence
  Synthetic oligonucleotide; GAG chr11 5274544 5274563 5274547 -
acgcatactggggcctatca

SEQ ID NO: 43065 - DNA, 20 bp, Artificial Sequence
  Synthetic oligonucleotide; AGG chr11 5274543 5274562 5274546 -
cgcatactggggcctatcag

SEQ ID NO: 43066 - DNA, 20 bp, Artificial Sequence
  Synthetic oligonucleotide; GGG chr11 5274542 5274561 5274545 -
gcatactggggcctatcaga

SEQ ID NO: 43067 - DNA, 20 bp, Artificial Sequence
  Synthetic oligonucleotide; TGG chr11 5274539 5274558 5274542 -
tactggggcctatcagaggg

SEQ ID NO: 43068 - DNA, 20 bp, Artificial Sequence
  Synthetic oligonucleotide; GAG chr11 5274537 5274556 5274540 -
ctggggcctatcagagggtg

SEQ ID NO: 43069 - DNA, 20 bp, Artificial Sequence
  Synthetic oligonucleotide; AGG chr11 5274536 5274555 5274539 -
tggggcctatcagagggtgg

SEQ ID NO: 43070 - DNA, 20 bp, Artificial Sequence
  Synthetic oligonucleotide; GGG chr11 5274535 5274554 5274538 -
ggggcctatcagagggtgga

SEQ ID NO: 43071 - DNA, 20 bp, Artificial Sequence
  Synthetic oligonucleotide; GAG chr11 5274531 5274550 5274534 -
cctatcagagggtggagggt

SEQ ID NO: 43072 - DNA, 20 bp, Artificial Sequence
  Synthetic oligonucleotide; GAG chr11 5274529 5274548 5274532 -
tatcagagggtggagggtga

SEQ ID NO: 43073 - DNA, 20 bp, Artificial Sequence
  Synthetic oligonucleotide; AAG chr11 5274526 5274545 5274529 -
cagagggtggagggtgagag

SEQ ID NO: 43074 - DNA, 20 bp, Artificial Sequence
  Synthetic oligonucleotide; AGG chr11 5274525 5274544 5274528 -
agagggtggagggtgagaga

SEQ ID NO: 43075 - DNA, 20 bp, Artificial Sequence
  Synthetic oligonucleotide; GAG chr11 5274523 5274542 5274526 -
agggtggagggtgagagaag

SEQ ID NO: 43076 - DNA, 20 bp, Artificial Sequence
  Synthetic oligonucleotide; GAG chr11 5274521 5274540 5274524 -
ggtggagggtgagagaagga

SEQ ID NO: 43077 - DNA, 20 bp, Artificial Sequence
  Synthetic oligonucleotide; AGG chr11 5274520 5274539 5274523 -
gtggagggtgagagaaggag

SEQ ID NO: 43078 - DNA, 20 bp, Artificial Sequence
  Synthetic oligonucleotide; CAG chr11 5274515 5274534 5274518 -
gggtgagagaaggagaggat

SEQ ID NO: 43079 - DNA, 20 bp, Artificial Sequence
  Synthetic oligonucleotide; AGG chr11 5274514 5274533 5274517 -
ggtgagagaaggagaggatc

SEQ ID NO: 43080 - DNA, 20 bp, Artificial Sequence
  Synthetic oligonucleotide; TGG chr11 5274499 5274518 5274502 -
ggatcaggaaaaatcactaa

SEQ ID NO: 43081 - DNA, 20 bp, Artificial Sequence
  Synthetic oligonucleotide; AAG chr11 5274491 5274510 5274494 -
aaaaatcactaatggatgct

SEQ ID NO: 43082 - DNA, 20 bp, Artificial Sequence
  Synthetic oligonucleotide; GAG chr11 5274478 5274497 5274481 -
ggatgctaagcgtaatacct

SEQ ID NO: 43083 - DNA, 20 bp, Artificial Sequence
  Synthetic oligonucleotide; GAG chr11 5274471 5274490 5274474 -
aagcgtaatacctgagtgat

SEQ ID NO: 43084 - DNA, 20 bp, Artificial Sequence
  Synthetic oligonucleotide; AAG chr11 5274380 5274399 5274383 -
tacccctgaacttaaaataa

SEQ ID NO: 43085 - DNA, 20 bp, Artificial Sequence
  Synthetic oligonucleotide; AAG chr11 5274369 5274388 5274372 -
ttaaaataaaagttgaaaac

SEQ ID NO: 43086 - DNA, 20 bp, Artificial Sequence
  Synthetic oligonucleotide; AAG chr11 5274365 5274384 5274368 -
aataaaagttgaaaacaaga

SEQ ID NO: 43087 - DNA, 20 bp, Artificial Sequence
  Synthetic oligonucleotide; CAG chr11 5274359 5274378 5274362 -
agttgaaaacaagaaagcaa

SEQ ID NO: 43088 - DNA, 20 bp, Artificial Sequence
  Synthetic oligonucleotide; TGG chr11 5274341 5274360 5274344 -
aacagtttgaacacttgtta

SEQ ID NO: 43089 - DNA, 20 bp, Artificial Sequence
  Synthetic oligonucleotide; TAG chr11 5274310 5274329 5274313 -
ctcattctttacaattacac

SEQ ID NO: 43090 - DNA, 20 bp, Artificial Sequence
  Synthetic oligonucleotide; TAG chr11 5274303 5274322 5274306 -
tttacaattacactagaaaa

SEQ ID NO: 43091 - DNA, 20 bp, Artificial Sequence
  Synthetic oligonucleotide; CAG chr11 5274297 5274316 5274300 -
attacactagaaaatagcca

SEQ ID NO: 43092 - DNA, 20 bp, Artificial Sequence
  Synthetic oligonucleotide; AGG chr11 5274296 5274315 5274299 -
ttacactagaaaatagccac

SEQ ID NO: 43093 - DNA, 20 bp, Artificial Sequence
  Synthetic oligonucleotide; AAG chr11 5274285 5274304 5274288 -
aatagccacaggcttcctgc

SEQ ID NO: 43094 - DNA, 20 bp, Artificial Sequence
  Synthetic oligonucleotide; AGG chr11 5274284 5274303 5274287 -
atagccacaggcttcctgca

SEQ ID NO: 43095 - DNA, 20 bp, Artificial Sequence
  Synthetic oligonucleotide; CAG chr11 5274281 5274300 5274284 -
gccacaggcttcctgcaagg

SEQ ID NO: 43096 - DNA, 20 bp, Artificial Sequence
  Synthetic oligonucleotide; CAG chr11 5274275 5274294 5274278 -
ggcttcctgcaaggcagcca

SEQ ID NO: 43097 - DNA, 20 bp, Artificial Sequence
  Synthetic oligonucleotide; AAG chr11 5274251 5274270 5274254 -
atttatgacttgtgatatcc

SEQ ID NO: 43098 - DNA, 20 bp, Artificial Sequence
  Synthetic oligonucleotide; TGG chr11 5274241 5274260 5274244 -
tgtgatatccaagtcattcc

SEQ ID NO: 43099 - DNA, 20 bp, Artificial Sequence
  Synthetic oligonucleotide; TAG chr11 5274213 5274232 5274216 -
gcaaaatctaacacaaaatc

SEQ ID NO: 43100 - DNA, 20 bp, Artificial Sequence
  Synthetic oligonucleotide; TAG chr11 5274210 5274229 5274213 -
aaatctaacacaaaatctag

SEQ ID NO: 43101 - DNA, 20 bp, Artificial Sequence
  Synthetic oligonucleotide; GAG chr11 5274178 5274197 5274181 -
cttacatctatttttgttct

SEQ ID NO: 43102 - DNA, 20 bp, Artificial Sequence
  Synthetic oligonucleotide; TAG chr11 5274171 5274190 5274174 -
ctatttttgttctgagaata

SEQ ID NO: 43103 - DNA, 20 bp, Artificial Sequence
  Synthetic oligonucleotide; TAG chr11 5274165 5274184 5274168 -
ttgttctgagaatatagatt

SEQ ID NO: 43104 - DNA, 20 bp, Artificial Sequence
  Synthetic oligonucleotide; TGG chr11 5274154 5274173 5274157 -
atatagatttagatacataa

SEQ ID NO: 43105 - DNA, 20 bp, Artificial Sequence
  Synthetic oligonucleotide; AAG chr11 5274151 5274170 5274154 -
tagatttagatacataatgg

SEQ ID NO: 43106 - DNA, 20 bp, Artificial Sequence
  Synthetic oligonucleotide; CAG chr11 5274148 5274167 5274151 -
atttagatacataatggaag

SEQ ID NO: 43107 - DNA, 20 bp, Artificial Sequence
  Synthetic oligonucleotide; TGG chr11 5274131 5274150 5274134 -
aagcagaataatttaaaatc

SEQ ID NO: 43108 - DNA, 20 bp, Artificial Sequence
  Synthetic oligonucleotide; TAG chr11 5274122 5274141 5274125 -
aatttaaaatctggctaatt

SEQ ID NO: 43109 - DNA, 20 bp, Artificial Sequence
  Synthetic oligonucleotide; AAG chr11 5274113 5274132 5274116 -
tctggctaatttagaatcct

SEQ ID NO: 43110 - DNA, 20 bp, Artificial Sequence
  Synthetic oligonucleotide; CAG chr11 5274110 5274129 5274113 -
ggctaatttagaatcctaag

SEQ ID NO: 43111 - DNA, 20 bp, Artificial Sequence
  Synthetic oligonucleotide; CAG chr11 5274095 5274114 5274098 -
ctaagcagctcttttcctat

SEQ ID NO: 43112 - DNA, 20 bp, Artificial Sequence
  Synthetic oligonucleotide; TGG chr11 5274092 5274111 5274095 -
agcagctcttttcctatcag

SEQ ID NO: 43113 - DNA, 20 bp, Artificial Sequence
  Synthetic oligonucleotide; AAG chr11 5274084 5274103 5274087 -
ttttcctatcagtggtttac

SEQ ID NO: 43114 - DNA, 20 bp, Artificial Sequence
  Synthetic oligonucleotide; AAG chr11 5274044 5274063 5274047 -
ctattttaaaaataaaaata

SEQ ID NO: 43115 - DNA, 20 bp, Artificial Sequence
  Synthetic oligonucleotide; AAG chr11 5274040 5274059 5274043 -
tttaaaaataaaaataaagt

SEQ ID NO: 43116 - DNA, 20 bp, Artificial Sequence
  Synthetic oligonucleotide; TGG chr11 5274030 5274049 5274033 -
aaaataaagtaagttatttg

SEQ ID NO: 43117 - DNA, 20 bp, Artificial Sequence
  Synthetic oligonucleotide; AAG chr11 5274025 5274044 5274028 -
aaagtaagttatttgtggta

SEQ ID NO: 43118 - DNA, 20 bp, Artificial Sequence
  Synthetic oligonucleotide; AAG chr11 5274011 5274030 5274014 -
gtggtaaagaatattcatta

SEQ ID NO: 43119 - DNA, 20 bp, Artificial Sequence
  Synthetic oligonucleotide; TAG chr11 5273997 5274016 5274000 -
tcattaaagtatttatttct

SEQ ID NO: 43120 - DNA, 20 bp, Artificial Sequence
  Synthetic oligonucleotide; CAG chr11 5273974 5273993 5273977 -
ataataccatgaaaaacatt

SEQ ID NO: 43121 - DNA, 20 bp, Artificial Sequence
  Synthetic oligonucleotide; AAG chr11 5273969 5273988 5273972 -
accatgaaaaacattcagtg

SEQ ID NO: 43122 - DNA, 20 bp, Artificial Sequence
  Synthetic oligonucleotide; AAG chr11 5273964 5273983 5273967 -
gaaaaacattcagtgaagtg

SEQ ID NO: 43123 - DNA, 20 bp, Artificial Sequence
  Synthetic oligonucleotide; AGG chr11 5273963 5273982 5273966 -
aaaaacattcagtgaagtga

SEQ ID NO: 43124 - DNA, 20 bp, Artificial Sequence
  Synthetic oligonucleotide; GGG chr11 5273962 5273981 5273965 -
aaaacattcagtgaagtgaa

SEQ ID NO: 43125 - DNA, 20 bp, Artificial Sequence
  Synthetic oligonucleotide; AAG chr11 5273944 5273963 5273947 -
aagggcctactttacttaac

SEQ ID NO: 43126 - DNA, 20 bp, Artificial Sequence
  Synthetic oligonucleotide; TAG chr11 5273912 5273931 5273915 -
tatataatttttcatactaa

SEQ ID NO: 43127 - DNA, 20 bp, Artificial Sequence
  Synthetic oligonucleotide; AAG chr11 5273904 5273923 5273907 -
ttttcatactaatagcatct

SEQ ID NO: 43128 - DNA, 20 bp, Artificial Sequence
  Synthetic oligonucleotide; CAG chr11 5273899 5273918 5273902 -
atactaatagcatctaagaa

SEQ ID NO: 43129 - DNA, 20 bp, Artificial Sequence
  Synthetic oligonucleotide; CAG chr11 5273879 5273898 5273882 -
cagtacaatatttgactctt

SEQ ID NO: 43130 - DNA, 20 bp, Artificial Sequence
  Synthetic oligonucleotide; AGG chr11 5273878 5273897 5273881 -
agtacaatatttgactcttc

SEQ ID NO: 43131 - DNA, 20 bp, Artificial Sequence
  Synthetic oligonucleotide; TAG chr11 5273856 5273875 5273859 -
gttaaacatatgtcataaat

SEQ ID NO: 43132 - DNA, 20 bp, Artificial Sequence
  Synthetic oligonucleotide; CAG chr11 5273852 5273871 5273855 -
aacatatgtcataaattagc

SEQ ID NO: 43133 - DNA, 20 bp, Artificial Sequence
  Synthetic oligonucleotide; AAG chr11 5273848 5273867 5273851 -
tatgtcataaattagccaga

SEQ ID NO: 43134 - DNA, 20 bp, Artificial Sequence
  Synthetic oligonucleotide; AAG chr11 5273841 5273860 5273844 -
taaattagccagaaagattt

SEQ ID NO: 43135 - DNA, 20 bp, Artificial Sequence
  Synthetic oligonucleotide; TGG chr11 5273831 5273850 5273834 -
agaaagatttaagaaaatat

SEQ ID NO: 43136 - DNA, 20 bp, Artificial Sequence
  Synthetic oligonucleotide; TAG chr11 5273810 5273829 5273813 -
ggatgtttccttgtttaaat

SEQ ID NO: 43137 - DNA, 20 bp, Artificial Sequence
  Synthetic oligonucleotide; AGG chr11 5273809 5273828 5273812 -
gatgtttccttgtttaaatt

SEQ ID NO: 43138 - DNA, 20 bp, Artificial Sequence
  Synthetic oligonucleotide; CAG chr11 5273799 5273818 5273802 -
tgtttaaattaggcatctta

SEQ ID NO: 43139 - DNA, 20 bp, Artificial Sequence
  Synthetic oligonucleotide; TAG chr11 5273792 5273811 5273795 -
attaggcatcttacagtttt

SEQ ID NO: 43140 - DNA, 20 bp, Artificial Sequence
  Synthetic oligonucleotide; TAG chr11 5273780 5273799 5273783 -
acagtttttagaatcctgca

SEQ ID NO: 43141 - DNA, 20 bp, Artificial Sequence
  Synthetic oligonucleotide; AAG chr11 5273772 5273791 5273775 -
tagaatcctgcatagaactt

SEQ ID NO: 43142 - DNA, 20 bp, Artificial Sequence
  Synthetic oligonucleotide; AAG chr11 5273754 5273773 5273757 -
ttaagaaattacaaatgcta

SEQ ID NO: 43143 - DNA, 20 bp, Artificial Sequence
  Synthetic oligonucleotide; CAG chr11 5273741 5273760 5273744 -
aatgctaaagcaaacccaaa

SEQ ID NO: 43144 - DNA, 20 bp, Artificial Sequence
  Synthetic oligonucleotide; AGG chr11 5273740 5273759 5273743 -
atgctaaagcaaacccaaac

SEQ ID NO: 43145 - DNA, 20 bp, Artificial Sequence
  Synthetic oligonucleotide; CAG chr11 5273737 5273756 5273740 -
ctaaagcaaacccaaacagg

SEQ ID NO: 43146 - DNA, 20 bp, Artificial Sequence
  Synthetic oligonucleotide; AGG chr11 5273736 5273755 5273739 -
taaagcaaacccaaacaggc

SEQ ID NO: 43147 - DNA, 20 bp, Artificial Sequence
  Synthetic oligonucleotide; TGG chr11 5273714 5273733 5273717 -
gaattaatcttcatcgaatt

SEQ ID NO: 43148 - DNA, 20 bp, Artificial Sequence
  Synthetic oligonucleotide; GGG chr11 5273713 5273732 5273716 -
aattaatcttcatcgaattt

SEQ ID NO: 43149 - DNA, 20 bp, Artificial Sequence
  Synthetic oligonucleotide; AAG chr11 5273697 5273716 5273700 -
atttgggtgtttctttctaa

SEQ ID NO: 43150 - DNA, 20 bp, Artificial Sequence
  Synthetic oligonucleotide; AAG chr11 5273673 5273692 5273676 -
cctttatacttaaatgtctt

SEQ ID NO: 43151 - DNA, 20 bp, Artificial Sequence
  Synthetic oligonucleotide; TAG chr11 5273663 5273682 5273666 -
taaatgtcttaagacataca

SEQ ID NO: 43152 - DNA, 20 bp, Artificial Sequence
  Synthetic oligonucleotide; TAG chr11 5273634 5273653 5273637 -
ttttactaattttaattata

SEQ ID NO: 43153 - DNA, 20 bp, Artificial Sequence
  Synthetic oligonucleotide; TGG chr11 5273570 5273589 5273573 -
ctaatctttctgatctatcc

SEQ ID NO: 43154 - DNA, 20 bp, Artificial Sequence
  Synthetic oligonucleotide; TGG chr11 5273566 5273585 5273569 -
tctttctgatctatcctgga

SEQ ID NO: 43155 - DNA, 20 bp, Artificial Sequence
  Synthetic oligonucleotide; TGG chr11 5273538 5273557 5273541 -
acacttatctctctgaactt

SEQ ID NO: 43156 - DNA, 20 bp, Artificial Sequence
  Synthetic oligonucleotide; GGG chr11 5273537 5273556 5273540 -
cacttatctctctgaacttt

SEQ ID NO: 43157 - DNA, 20 bp, Artificial Sequence
  Synthetic oligonucleotide; TAG chr11 5273525 5273544 5273528 -
tgaactttgggcttttaata

SEQ ID NO: 43158 - DNA, 20 bp, Artificial Sequence
  Synthetic oligonucleotide; AGG chr11 5273524 5273543 5273527 -
gaactttgggcttttaatat

SEQ ID NO: 43159 - DNA, 20 bp, Artificial Sequence
  Synthetic oligonucleotide; AAG chr11 5273520 5273539 5273523 -
tttgggcttttaatatagga

SEQ ID NO: 43160 - DNA, 20 bp, Artificial Sequence
  Synthetic oligonucleotide; AAG chr11 5273515 5273534 5273518 -
gcttttaatataggaaagaa

SEQ ID NO: 43161 - DNA, 20 bp, Artificial Sequence
  Synthetic oligonucleotide; TGG chr11 5273495 5273514 5273498 -
aagcaataatccatttttca

SEQ ID NO: 43162 - DNA, 20 bp, Artificial Sequence
  Synthetic oligonucleotide; GAG chr11 5273456 5273475 5273459 -
caaataaaatgcttaaaaat

SEQ ID NO: 43163 - DNA, 20 bp, Artificial Sequence
  Synthetic oligonucleotide; CAG chr11 5273453 5273472 5273456 -
ataaaatgcttaaaaatgag

SEQ ID NO: 43164 - DNA, 20 bp, Artificial Sequence
  Synthetic oligonucleotide; AGG chr11 5273452 5273471 5273455 -
taaaatgcttaaaaatgagc

SEQ ID NO: 43165 - DNA, 20 bp, Artificial Sequence
  Synthetic oligonucleotide; AAG chr11 5273447 5273466 5273450 -
tgcttaaaaatgagcaggtg

SEQ ID NO: 43166 - DNA, 20 bp, Artificial Sequence
  Synthetic oligonucleotide; AAG chr11 5273425 5273444 5273428 -
gcaatttatcttgaaccaac

SEQ ID NO: 43167 - DNA, 20 bp, Artificial Sequence
  Synthetic oligonucleotide; AAG chr11 5273417 5273436 5273420 -
tcttgaaccaacaagcatcg

SEQ ID NO: 43168 - DNA, 20 bp, Artificial Sequence
  Synthetic oligonucleotide; GAG chr11 5273407 5273426 5273410 -
acaagcatcgaagcaataat

SEQ ID NO: 43169 - DNA, 20 bp, Artificial Sequence
  Synthetic oligonucleotide; CAG chr11 5273396 5273415 5273399 -
agcaataatgagactgcccg

SEQ ID NO: 43170 - DNA, 20 bp, Artificial Sequence
  Synthetic oligonucleotide; GAG chr11 5273379 5273398 5273382 -
ccgcagcctacctgacttct

SEQ ID NO: 43171 - DNA, 20 bp, Artificial Sequence
  Synthetic oligonucleotide; CAG chr11 5273375 5273394 5273378 -
agcctacctgacttctgagt

SEQ ID NO: 43172 - DNA, 20 bp, Artificial Sequence
  Synthetic oligonucleotide; AGG chr11 5273374 5273393 5273377 -
gcctacctgacttctgagtc

SEQ ID NO: 43173 - DNA, 20 bp, Artificial Sequence
  Synthetic oligonucleotide; AAG chr11 5273365 5273384 5273368 -
acttctgagtcaggatttat

SEQ ID NO: 43174 - DNA, 20 bp, Artificial Sequence
  Synthetic oligonucleotide; GAG chr11 5273352 5273371 5273355 -
gatttataagccttgttact

SEQ ID NO: 43175 - DNA, 20 bp, Artificial Sequence
  Synthetic oligonucleotide; TGG chr11 5273340 5273359 5273343 -
ttgttactgagacacaaacc

SEQ ID NO: 43176 - DNA, 20 bp, Artificial Sequence
  Synthetic oligonucleotide; GGG chr11 5273339 5273358 5273342 -
tgttactgagacacaaacct

SEQ ID NO: 43177 - DNA, 20 bp, Artificial Sequence
  Synthetic oligonucleotide; AAG chr11 5273311 5273330 5273314 -
caatgctataacctttcttg

SEQ ID NO: 43178 - DNA, 20 bp, Artificial Sequence
  Synthetic oligonucleotide; TAG chr11 5273291 5273310 5273294 -
aagctcctccctaccacctt

SEQ ID NO: 43179 - DNA, 20 bp, Artificial Sequence
  Synthetic oligonucleotide; AAG chr11 5273284 5273303 5273287 -
tccctaccacctttagccat

SEQ ID NO: 43180 - DNA, 20 bp, Artificial Sequence
  Synthetic oligonucleotide; AGG chr11 5273283 5273302 5273286 -
ccctaccacctttagccata

SEQ ID NO: 43181 - DNA, 20 bp, Artificial Sequence
  Synthetic oligonucleotide; TGG chr11 5273275 5273294 5273278 -
cctttagccataaggaaaca

SEQ ID NO: 43182 - DNA, 20 bp, Artificial Sequence
  Synthetic oligonucleotide; TGG chr11 5273270 5273289 5273273 -
agccataaggaaacatggaa

SEQ ID NO: 43183 - DNA, 20 bp, Artificial Sequence
  Synthetic oligonucleotide; GGG chr11 5273269 5273288 5273272 -
gccataaggaaacatggaat

SEQ ID NO: 43184 - DNA, 20 bp, Artificial Sequence
  Synthetic oligonucleotide; CAG chr11 5273265 5273284 5273268 -
taaggaaacatggaatgggt

SEQ ID NO: 43185 - DNA, 20 bp, Artificial Sequence
  Synthetic oligonucleotide; TGG chr11 5273257 5273276 5273260 -
catggaatgggtcagatccc

SEQ ID NO: 43186 - DNA, 20 bp, Artificial Sequence
  Synthetic oligonucleotide; AAG chr11 5273250 5273269 5273253 -
tgggtcagatccctggatgc

SEQ ID NO: 43187 - DNA, 20 bp, Artificial Sequence
  Synthetic oligonucleotide; CAG chr11 5273246 5273265 5273249 -
tcagatccctggatgcaagc

SEQ ID NO: 43188 - DNA, 20 bp, Artificial Sequence
  Synthetic oligonucleotide; AGG chr11 5273245 5273264 5273248 -
cagatccctggatgcaagcc

SEQ ID NO: 43189 - DNA, 20 bp, Artificial Sequence
  Synthetic oligonucleotide; TGG chr11 5273240 5273259 5273243 -
ccctggatgcaagccaggtc

SEQ ID NO: 43190 - DNA, 20 bp, Artificial Sequence
  Synthetic oligonucleotide; TAG chr11 5273232 5273251 5273235 -
gcaagccaggtctggaacca

SEQ ID NO: 43191 - DNA, 20 bp, Artificial Sequence
  Synthetic oligonucleotide; AGG chr11 5273231 5273250 5273234 -
caagccaggtctggaaccat

SEQ ID NO: 43192 - DNA, 20 bp, Artificial Sequence
  Synthetic oligonucleotide; CAG chr11 5273228 5273247 5273231 -
gccaggtctggaaccatagg

SEQ ID NO: 43193 - DNA, 20 bp, Artificial Sequence
  Synthetic oligonucleotide; AAG chr11 5273224 5273243 5273227 -
ggtctggaaccataggcagt

SEQ ID NO: 43194 - DNA, 20 bp, Artificial Sequence
  Synthetic oligonucleotide; AGG chr11 5273223 5273242 5273226 -
gtctggaaccataggcagta

SEQ ID NO: 43195 - DNA, 20 bp, Artificial Sequence
  Synthetic oligonucleotide; GAG chr11 5273221 5273240 5273224 -
ctggaaccataggcagtaag

SEQ ID NO: 43196 - DNA, 20 bp, Artificial Sequence
  Synthetic oligonucleotide; GAG chr11 5273219 5273238 5273222 -
ggaaccataggcagtaagga

SEQ ID NO: 43197 - DNA, 20 bp, Artificial Sequence
  Synthetic oligonucleotide; AAG chr11 5273216 5273235 5273219 -
accataggcagtaaggagag

SEQ ID NO: 43198 - DNA, 20 bp, Artificial Sequence
  Synthetic oligonucleotide; TGG chr11 5273207 5273226 5273210 -
agtaaggagagaagaaaatg

SEQ ID NO: 43199 - DNA, 20 bp, Artificial Sequence
  Synthetic oligonucleotide; GGG chr11 5273206 5273225 5273209 -
gtaaggagagaagaaaatgt

SEQ ID NO: 43200 - DNA, 20 bp, Artificial Sequence
  Synthetic oligonucleotide; TGG chr11 5273194 5273213 5273197 -
gaaaatgtgggctctgcaac

SEQ ID NO: 43201 - DNA, 20 bp, Artificial Sequence
  Synthetic oligonucleotide; GAG chr11 5273187 5273206 5273190 -
tgggctctgcaactggctcc

SEQ ID NO: 43202 - DNA, 20 bp, Artificial Sequence
  Synthetic oligonucleotide; AGG chr11 5273186 5273205 5273189 -
gggctctgcaactggctccg

SEQ ID NO: 43203 - DNA, 20 bp, Artificial Sequence
  Synthetic oligonucleotide; GGG chr11 5273185 5273204 5273188 -
ggctctgcaactggctccga

SEQ ID NO: 43204 - DNA, 20 bp, Artificial Sequence
  Synthetic oligonucleotide; GAG chr11 5273183 5273202 5273186 -
ctctgcaactggctccgagg

SEQ ID NO: 43205 - DNA, 20 bp, Artificial Sequence
  Synthetic oligonucleotide; CAG chr11 5273180 5273199 5273183 -
tgcaactggctccgagggag

SEQ ID NO: 43206 - DNA, 20 bp, Artificial Sequence
  Synthetic oligonucleotide; AGG chr11 5273179 5273198 5273182 -
gcaactggctccgagggagc

SEQ ID NO: 43207 - DNA, 20 bp, Artificial Sequence
  Synthetic oligonucleotide; GAG chr11 5273177 5273196 5273180 -
aactggctccgagggagcag

SEQ ID NO: 43208 - DNA, 20 bp, Artificial Sequence
  Synthetic oligonucleotide; GAG chr11 5273175 5273194 5273178 -
ctggctccgagggagcagga

SEQ ID NO: 43209 - DNA, 20 bp, Artificial Sequence
  Synthetic oligonucleotide; AGG chr11 5273174 5273193 5273177 -
tggctccgagggagcaggag

SEQ ID NO: 43210 - DNA, 20 bp, Artificial Sequence
  Synthetic oligonucleotide; AAG chr11 5273149 5273168 5273152 -
caaccccatactctgaatct

SEQ ID NO: 43211 - DNA, 20 bp, Artificial Sequence
  Synthetic oligonucleotide; GAG chr11 5273147 5273166 5273150 -
accccatactctgaatctaa

SEQ ID NO: 43212 - DNA, 20 bp, Artificial Sequence
  Synthetic oligonucleotide; AAG chr11 5273144 5273163 5273147 -
ccatactctgaatctaagag

SEQ ID NO: 43213 - DNA, 20 bp, Artificial Sequence
  Synthetic oligonucleotide; TGG chr11 5273139 5273158 5273142 -
ctctgaatctaagagaagac

SEQ ID NO: 43214 - DNA, 20 bp, Artificial Sequence
  Synthetic oligonucleotide; TGG chr11 5273121 5273140 5273124 -
actggtgtccatactctgaa

SEQ ID NO: 43215 - DNA, 20 bp, Artificial Sequence
  Synthetic oligonucleotide; GGG chr11 5273120 5273139 5273123 -
ctggtgtccatactctgaat

SEQ ID NO: 43216 - DNA, 20 bp, Artificial Sequence
  Synthetic oligonucleotide; AAG chr11 5273117 5273136 5273120 -
gtgtccatactctgaatggg

SEQ ID NO: 43217 - DNA, 20 bp, Artificial Sequence
  Synthetic oligonucleotide; TGG chr11 5273109 5273128 5273112 -
actctgaatgggaagaatga

SEQ ID NO: 43218 - DNA, 20 bp, Artificial Sequence
  Synthetic oligonucleotide; GGG chr11 5273108 5273127 5273111 -
ctctgaatgggaagaatgat

SEQ ID NO: 43219 - DNA, 20 bp, Artificial Sequence
  Synthetic oligonucleotide; TAG chr11 5273097 5273116 5273100 -
aagaatgatgggattaccca

SEQ ID NO: 43220 - DNA, 20 bp, Artificial Sequence
  Synthetic oligonucleotide; AGG chr11 5273096 5273115 5273099 -
agaatgatgggattacccat

SEQ ID NO: 43221 - DNA, 20 bp, Artificial Sequence
  Synthetic oligonucleotide; GGG chr11 5273095 5273114 5273098 -
gaatgatgggattacccata

SEQ ID NO: 43222 - DNA, 20 bp, Artificial Sequence
  Synthetic oligonucleotide; TAG chr11 5273085 5273104 5273088 -
attacccatagggcttgttt

SEQ ID NO: 43223 - DNA, 20 bp, Artificial Sequence
  Synthetic oligonucleotide; AGG chr11 5273084 5273103 5273087 -
ttacccatagggcttgtttt

SEQ ID NO: 43224 - DNA, 20 bp, Artificial Sequence
  Synthetic oligonucleotide; GGG chr11 5273083 5273102 5273086 -
tacccatagggcttgtttta

SEQ ID NO: 43225 - DNA, 20 bp, Artificial Sequence
  Synthetic oligonucleotide; GAG chr11 5273081 5273100 5273084 -
cccatagggcttgttttagg

SEQ ID NO: 43226 - DNA, 20 bp, Artificial Sequence
  Synthetic oligonucleotide; TGG chr11 5273058 5273077 5273061 -
aaacctgttctccaaactct

SEQ ID NO: 43227 - DNA, 20 bp, Artificial Sequence
  Synthetic oligonucleotide; GAG chr11 5273051 5273070 5273054 -
ttctccaaactcttggcctt

SEQ ID NO: 43228 - DNA, 20 bp, Artificial Sequence
  Synthetic oligonucleotide; TGG chr11 5273043 5273062 5273046 -
actcttggccttgagatacc

SEQ ID NO: 43229 - DNA, 20 bp, Artificial Sequence
  Synthetic oligonucleotide; TGG chr11 5273029 5273048 5273032 -
gatacctggtccttattcct

SEQ ID NO: 43230 - DNA, 20 bp, Artificial Sequence
  Synthetic oligonucleotide; TGG chr11 5273022 5273041 5273025 -
ggtccttattccttggactt

SEQ ID NO: 43231 - DNA, 20 bp, Artificial Sequence
  Synthetic oligonucleotide; AAG chr11 5272998 5273017 5273001 -
aatgtctgaccctcacattc

SEQ ID NO: 43232 - DNA, 20 bp, Artificial Sequence
  Synthetic oligonucleotide; GAG chr11 5272991 5273010 5272994 -
gaccctcacattcaagttct

SEQ ID NO: 43233 - DNA, 20 bp, Artificial Sequence
  Synthetic oligonucleotide; AGG chr11 5272990 5273009 5272993 -
accctcacattcaagttctg

SEQ ID NO: 43234 - DNA, 20 bp, Artificial Sequence
  Synthetic oligonucleotide; AAG chr11 5272987 5273006 5272990 -
ctcacattcaagttctgagg

SEQ ID NO: 43235 - DNA, 20 bp, Artificial Sequence
  Synthetic oligonucleotide; AGG chr11 5272986 5273005 5272989 -
tcacattcaagttctgagga

SEQ ID NO: 43236 - DNA, 20 bp, Artificial Sequence
  Synthetic oligonucleotide; GGG chr11 5272985 5273004 5272988 -
cacattcaagttctgaggaa

SEQ ID NO: 43237 - DNA, 20 bp, Artificial Sequence
  Synthetic oligonucleotide; TGG chr11 5272965 5272984 5272968 -
gggccactgccttcatactg

SEQ ID NO: 43238 - DNA, 20 bp, Artificial Sequence
  Synthetic oligonucleotide; TAG chr11 5272957 5272976 5272960 -
gccttcatactgtggatctg

SEQ ID NO: 43239 - DNA, 20 bp, Artificial Sequence
  Synthetic oligonucleotide; CAG chr11 5272935 5272954 5272938 -
gcaaattccccctgaaaacc

SEQ ID NO: 43240 - DNA, 20 bp, Artificial Sequence
  Synthetic oligonucleotide; GAG chr11 5272933 5272952 5272936 -
aaattccccctgaaaaccca

SEQ ID NO: 43241 - DNA, 20 bp, Artificial Sequence
  Synthetic oligonucleotide; TGG chr11 5272918 5272937 5272921 -
acccagagctgtatcttaat

SEQ ID NO: 43242 - DNA, 20 bp, Artificial Sequence
  Synthetic oligonucleotide; GAG chr11 5272876 5272895 5272879 -
ctcaacgactgttcttctct

SEQ ID NO: 43243 - DNA, 20 bp, Artificial Sequence
  Synthetic oligonucleotide; TAG chr11 5272873 5272892 5272876 -
aacgactgttcttctctgag

SEQ ID NO: 43244 - DNA, 20 bp, Artificial Sequence
  Synthetic oligonucleotide; AAG chr11 5272868 5272887 5272871 -
ctgttcttctctgagtagcc

SEQ ID NO: 43245 - DNA, 20 bp, Artificial Sequence
  Synthetic oligonucleotide; CAG chr11 5272863 5272882 5272866 -
cttctctgagtagccaagct

SEQ ID NO: 43246 - DNA, 20 bp, Artificial Sequence
  Synthetic oligonucleotide; TGG chr11 5272858 5272877 5272861 -
ctgagtagccaagctcagct

SEQ ID NO: 43247 - DNA, 20 bp, Artificial Sequence
  Synthetic oligonucleotide; AAG chr11 5272852 5272871 5272855 -
agccaagctcagcttggttc

SEQ ID NO: 43248 - DNA, 20 bp, Artificial Sequence
  Synthetic oligonucleotide; AAG chr11 5272845 5272864 5272848 -
ctcagcttggttcaagctac

SEQ ID NO: 43249 - DNA, 20 bp, Artificial Sequence
  Synthetic oligonucleotide; CAG chr11 5272842 5272861 5272845 -
agcttggttcaagctacaag

SEQ ID NO: 43250 - DNA, 20 bp, Artificial Sequence
  Synthetic oligonucleotide; GAG chr11 5272837 5272856 5272840 -
ggttcaagctacaagcagct

SEQ ID NO: 43251 - DNA, 20 bp, Artificial Sequence
  Synthetic oligonucleotide; TAG chr11 5272822 5272841 5272825 -
cagctgagctgctttttgtc

SEQ ID NO: 43252 - DNA, 20 bp, Artificial Sequence
  Synthetic oligonucleotide; CAG chr11 5272802 5272821 5272805 -
tagtcattgttcttttattt

SEQ ID NO: 43253 - DNA, 20 bp, Artificial Sequence
  Synthetic oligonucleotide; TGG chr11 5272799 5272818 5272802 -
tcattgttcttttatttcag

SEQ ID NO: 43254 - DNA, 20 bp, Artificial Sequence
  Synthetic oligonucleotide; TAG chr11 5272773 5272792 5272776 -
aaatacgttctttccaaacc

SEQ ID NO: 43255 - DNA, 20 bp, Artificial Sequence
  Synthetic oligonucleotide; AGG chr11 5272772 5272791 5272775 -
aatacgttctttccaaacct

SEQ ID NO: 43256 - DNA, 20 bp, Artificial Sequence
  Synthetic oligonucleotide; TAG chr11 5272757 5272776 5272760 -
aacctaggatcttgtcttcc

SEQ ID NO: 43257 - DNA, 20 bp, Artificial Sequence
  Synthetic oligonucleotide; AGG chr11 5272756 5272775 5272759 -
acctaggatcttgtcttcct

SEQ ID NO: 43258 - DNA, 20 bp, Artificial Sequence
  Synthetic oligonucleotide; CAG chr11 5272738 5272757 5272741 -
ctaggctatatattttgtcc

SEQ ID NO: 43259 - DNA, 20 bp, Artificial Sequence
  Synthetic oligonucleotide; AGG chr11 5272737 5272756 5272740 -
taggctatatattttgtccc

SEQ ID NO: 43260 - DNA, 20 bp, Artificial Sequence
  Synthetic oligonucleotide; AAG chr11 5272734 5272753 5272737 -
gctatatattttgtcccagg

SEQ ID NO: 43261 - DNA, 20 bp, Artificial Sequence
  Synthetic oligonucleotide; TGG chr11 5272723 5272742 5272726 -
tgtcccaggaagtcttaatc

SEQ ID NO: 43262 - DNA, 20 bp, Artificial Sequence
  Synthetic oligonucleotide; GGG chr11 5272722 5272741 5272725 -
gtcccaggaagtcttaatct

SEQ ID NO: 43263 - DNA, 20 bp, Artificial Sequence
  Synthetic oligonucleotide; GGG chr11 5272721 5272740 5272724 -
tcccaggaagtcttaatctg

SEQ ID NO: 43264 - DNA, 20 bp, Artificial Sequence
  Synthetic oligonucleotide; CAG chr11 5272714 5272733 5272717 -
aagtcttaatctggggtcca

SEQ ID NO: 43265 - DNA, 20 bp, Artificial Sequence
  Synthetic oligonucleotide; TAG chr11 5272706 5272725 5272709 -
atctggggtccacagaacac

SEQ ID NO: 43266 - DNA, 20 bp, Artificial Sequence
  Synthetic oligonucleotide; AGG chr11 5272705 5272724 5272708 -
tctggggtccacagaacact

SEQ ID NO: 43267 - DNA, 20 bp, Artificial Sequence
  Synthetic oligonucleotide; GGG chr11 5272704 5272723 5272707 -
ctggggtccacagaacacta

SEQ ID NO: 43268 - DNA, 20 bp, Artificial Sequence
  Synthetic oligonucleotide; GGG chr11 5272703 5272722 5272706 -
tggggtccacagaacactag

SEQ ID NO: 43269 - DNA, 20 bp, Artificial Sequence
  Synthetic oligonucleotide; GGG chr11 5272702 5272721 5272705 -
ggggtccacagaacactagg

SEQ ID NO: 43270 - DNA, 20 bp, Artificial Sequence
  Synthetic oligonucleotide; TGG chr11 5272698 5272717 5272701 -
tccacagaacactagggggc

SEQ ID NO: 43271 - DNA, 20 bp, Artificial Sequence
  Synthetic oligonucleotide; AAG chr11 5272693 5272712 5272696 -
agaacactagggggctggtg

SEQ ID NO: 43272 - DNA, 20 bp, Artificial Sequence
  Synthetic oligonucleotide; TAG chr11 5272686 5272705 5272689 -
tagggggctggtgaagttta

SEQ ID NO: 43273 - DNA, 20 bp, Artificial Sequence
  Synthetic oligonucleotide; TAG chr11 5272644 5272663 5272647 -
acttacatgtaactgaaatt

SEQ ID NO: 43274 - DNA, 20 bp, Artificial Sequence
  Synthetic oligonucleotide; AAG chr11 5272618 5272637 5272621 -
tttcttctactttgaatgca

SEQ ID NO: 43275 - DNA, 20 bp, Artificial Sequence
  Synthetic oligonucleotide; AGG chr11 5272617 5272636 5272620 -
ttcttctactttgaatgcaa

SEQ ID NO: 43276 - DNA, 20 bp, Artificial Sequence
  Synthetic oligonucleotide; TAG chr11 5272608 5272627 5272611 -
tttgaatgcaaaggacaaac

SEQ ID NO: 43277 - DNA, 20 bp, Artificial Sequence
  Synthetic oligonucleotide; CAG chr11 5272594 5272613 5272597 -
acaaactagaatgacatcat

SEQ ID NO: 43278 - DNA, 20 bp, Artificial Sequence
  Synthetic oligonucleotide; TAG chr11 5272580 5272599 5272583 -
catcatcagtacctattgca

SEQ ID NO: 43279 - DNA, 20 bp, Artificial Sequence
  Synthetic oligonucleotide; AAG chr11 5272572 5272591 5272575 -
gtacctattgcatagttata

SEQ ID NO: 43280 - DNA, 20 bp, Artificial Sequence
  Synthetic oligonucleotide; GAG chr11 5272570 5272589 5272573 -
acctattgcatagttataaa

SEQ ID NO: 43281 - DNA, 20 bp, Artificial Sequence
  Synthetic oligonucleotide; CAG chr11 5272561 5272580 5272564 -
atagttataaagagaaacca

SEQ ID NO: 43282 - DNA, 20 bp, Artificial Sequence
  Synthetic oligonucleotide; TAG chr11 5272539 5272558 5272542 -
gatattttcatactacacca

SEQ ID NO: 43283 - DNA, 20 bp, Artificial Sequence
  Synthetic oligonucleotide; AGG chr11 5272538 5272557 5272541 -
atattttcatactacaccat

SEQ ID NO: 43284 - DNA, 20 bp, Artificial Sequence
  Synthetic oligonucleotide; CAG chr11 5272530 5272549 5272533 -
atactacaccataggtattg

SEQ ID NO: 43285 - DNA, 20 bp, Artificial Sequence
  Synthetic oligonucleotide; GAG chr11 5272503 5272522 5272506 -
ttttgtttttgtttttgttt

SEQ ID NO: 43286 - DNA, 20 bp, Artificial Sequence
  Synthetic oligonucleotide; TGG chr11 5272499 5272518 5272502 -
gtttttgtttttgtttgaga

SEQ ID NO: 43287 - DNA, 20 bp, Artificial Sequence
  Synthetic oligonucleotide; GAG chr11 5272497 5272516 5272500 -
ttttgtttttgtttgagatg

SEQ ID NO: 43288 - DNA, 20 bp, Artificial Sequence
  Synthetic oligonucleotide; CAG chr11 5272478 5272497 5272481 -
ggagtttcgctcttattgcc

SEQ ID NO: 43289 - DNA, 20 bp, Artificial Sequence
  Synthetic oligonucleotide; AGG chr11 5272477 5272496 5272480 -
gagtttcgctcttattgccc

SEQ ID NO: 43290 - DNA, 20 bp, Artificial Sequence
  Synthetic oligonucleotide; TGG chr11 5272473 5272492 5272476 -
ttcgctcttattgcccaggc

SEQ ID NO: 43291 - DNA, 20 bp, Artificial Sequence
  Synthetic oligonucleotide; GAG chr11 5272471 5272490 5272474 -
cgctcttattgcccaggctg

SEQ ID NO: 43292 - DNA, 20 bp, Artificial Sequence
  Synthetic oligonucleotide; CAG chr11 5272466 5272485 5272469 -
ttattgcccaggctggagtg

SEQ ID NO: 43293 - DNA, 20 bp, Artificial Sequence
  Synthetic oligonucleotide; TGG chr11 5272463 5272482 5272466 -
ttgcccaggctggagtgcag

SEQ ID NO: 43294 - DNA, 20 bp, Artificial Sequence
  Synthetic oligonucleotide; CGG chr11 5272452 5272471 5272455 -
ggagtgcagtggcatgattt

SEQ ID NO: 43295 - DNA, 20 bp, Artificial Sequence
  Synthetic oligonucleotide; AAG chr11 5272421 5272440 5272424 -
aacctccccttcctgcattc

SEQ ID NO: 43296 - DNA, 20 bp, Artificial Sequence
  Synthetic oligonucleotide; TGG chr11 5272404 5272423 5272407 -
ttcaagcaattctcctgcct

SEQ ID NO: 43297 - DNA, 20 bp, Artificial Sequence
  Synthetic oligonucleotide; GAG chr11 5272395 5272414 5272398 -
ttctcctgccttggcctcct

SEQ ID NO: 43298 - DNA, 20 bp, Artificial Sequence
  Synthetic oligonucleotide; TAG chr11 5272392 5272411 5272395 -
tcctgccttggcctcctgag

SEQ ID NO: 43299 - DNA, 20 bp, Artificial Sequence
  Synthetic oligonucleotide; TGG chr11 5272388 5272407 5272391 -
gccttggcctcctgagtagc

SEQ ID NO: 43300 - DNA, 20 bp, Artificial Sequence
  Synthetic oligonucleotide; GGG chr11 5272387 5272406 5272390 -
ccttggcctcctgagtagct

SEQ ID NO: 43301 - DNA, 20 bp, Artificial Sequence
  Synthetic oligonucleotide; GGG chr11 5272386 5272405 5272389 -
cttggcctcctgagtagctg

SEQ ID NO: 43302 - DNA, 20 bp, Artificial Sequence
  Synthetic oligonucleotide; CAG chr11 5272379 5272398 5272382 -
tcctgagtagctggggatta

SEQ ID NO: 43303 - DNA, 20 bp, Artificial Sequence
  Synthetic oligonucleotide; AGG chr11 5272378 5272397 5272381 -
cctgagtagctggggattac

SEQ ID NO: 43304 - DNA, 20 bp, Artificial Sequence
  Synthetic oligonucleotide; CAG chr11 5272360 5272379 5272363 -
acaggcacctgccaccatgc

SEQ ID NO: 43305 - DNA, 20 bp, Artificial Sequence
  Synthetic oligonucleotide; TAG chr11 5272340 5272359 5272343 -
cagtctaatttttgtatttt

SEQ ID NO: 43306 - DNA, 20 bp, Artificial Sequence
  Synthetic oligonucleotide; TAG chr11 5272337 5272356 5272340 -
tctaatttttgtatttttag

SEQ ID NO: 43307 - DNA, 20 bp, Artificial Sequence
  Synthetic oligonucleotide; GAG chr11 5272335 5272354 5272338 -
taatttttgtatttttagta

SEQ ID NO: 43308 - DNA, 20 bp, Artificial Sequence
  Synthetic oligonucleotide; TGG chr11 5272331 5272350 5272334 -
ttttgtatttttagtagaga

SEQ ID NO: 43309 - DNA, 20 bp, Artificial Sequence
  Synthetic oligonucleotide; GGG chr11 5272330 5272349 5272333 -
tttgtatttttagtagagat

SEQ ID NO: 43310 - DNA, 20 bp, Artificial Sequence
  Synthetic oligonucleotide; GGG chr11 5272329 5272348 5272332 -
ttgtatttttagtagagatg

SEQ ID NO: 43311 - DNA, 20 bp, Artificial Sequence
  Synthetic oligonucleotide; TGG chr11 5272315 5272334 5272318 -
gagatggggtttcgccatgt

SEQ ID NO: 43312 - DNA, 20 bp, Artificial Sequence
  Synthetic oligonucleotide; CAG chr11 5272311 5272330 5272314 -
tggggtttcgccatgttggc

SEQ ID NO: 43313 - DNA, 20 bp, Artificial Sequence
  Synthetic oligonucleotide; AGG chr11 5272310 5272329 5272313 -
ggggtttcgccatgttggcc

SEQ ID NO: 43314 - DNA, 20 bp, Artificial Sequence
  Synthetic oligonucleotide; TGG chr11 5272306 5272325 5272309 -
tttcgccatgttggccaggc

SEQ ID NO: 43315 - DNA, 20 bp, Artificial Sequence
  Synthetic oligonucleotide; CAG chr11 5272286 5272305 5272289 -
tggtcttgaactcctgacct

SEQ ID NO: 43316 - DNA, 20 bp, Artificial Sequence
  Synthetic oligonucleotide; TGG chr11 5272268 5272287 5272271 -
ctcagatgatctgcccgcct

SEQ ID NO: 43317 - DNA, 20 bp, Artificial Sequence
  Synthetic oligonucleotide; AAG chr11 5272258 5272277 5272261 -
ctgcccgccttggcctcctg

SEQ ID NO: 43318 - DNA, 20 bp, Artificial Sequence
  Synthetic oligonucleotide; TGG chr11 5272252 5272271 5272255 -
gccttggcctcctgaagtgc

SEQ ID NO: 43319 - DNA, 20 bp, Artificial Sequence
  Synthetic oligonucleotide; GGG chr11 5272251 5272270 5272254 -
ccttggcctcctgaagtgct

SEQ ID NO: 43320 - DNA, 20 bp, Artificial Sequence
  Synthetic oligonucleotide; TAG chr11 5272244 5272263 5272247 -
ctcctgaagtgctgggatta

SEQ ID NO: 43321 - DNA, 20 bp, Artificial Sequence
  Synthetic oligonucleotide; AGG chr11 5272243 5272262 5272246 -
tcctgaagtgctgggattat

SEQ ID NO: 43322 - DNA, 20 bp, Artificial Sequence
  Synthetic oligonucleotide; GAG chr11 5272237 5272256 5272240 -
agtgctgggattataggtgt

SEQ ID NO: 43323 - DNA, 20 bp, Artificial Sequence
  Synthetic oligonucleotide; TGG chr11 5272224 5272243 5272227 -
taggtgtgagccaccacgcc

SEQ ID NO: 43324 - DNA, 20 bp, Artificial Sequence
  Synthetic oligonucleotide; CAG chr11 5272214 5272233 5272217 -
ccaccacgcctggcccattg

SEQ ID NO: 43325 - DNA, 20 bp, Artificial Sequence
  Synthetic oligonucleotide; TGG chr11 5272177 5272196 5272180 -
catttatctgcatcactact

SEQ ID NO: 43326 - DNA, 20 bp, Artificial Sequence
  Synthetic oligonucleotide; AAG chr11 5272169 5272188 5272172 -
tgcatcactacttggatctt

SEQ ID NO: 43327 - DNA, 20 bp, Artificial Sequence
  Synthetic oligonucleotide; AGG chr11 5272168 5272187 5272171 -
gcatcactacttggatctta

SEQ ID NO: 43328 - DNA, 20 bp, Artificial Sequence
  Synthetic oligonucleotide; TAG chr11 5272165 5272184 5272168 -
tcactacttggatcttaagg

SEQ ID NO: 43329 - DNA, 20 bp, Artificial Sequence
  Synthetic oligonucleotide; TAG chr11 5272159 5272178 5272162 -
cttggatcttaaggtagctg

SEQ ID NO: 43330 - DNA, 20 bp, Artificial Sequence
  Synthetic oligonucleotide; TAG chr11 5272147 5272166 5272150 -
ggtagctgtagacccaatcc

SEQ ID NO: 43331 - DNA, 20 bp, Artificial Sequence
  Synthetic oligonucleotide; AAG chr11 5272128 5272147 5272131 -
ctagatctaatgctttcata

SEQ ID NO: 43332 - DNA, 20 bp, Artificial Sequence
  Synthetic oligonucleotide; AAG chr11 5272125 5272144 5272128 -
gatctaatgctttcataaag

SEQ ID NO: 43333 - DNA, 20 bp, Artificial Sequence
  Synthetic oligonucleotide; CAG chr11 5272065 5272084 5272068 -
gatgtctgataatgatattt

SEQ ID NO: 43334 - DNA, 20 bp, Artificial Sequence
  Synthetic oligonucleotide; TAG chr11 5272050 5272069 5272053 -
tatttcagtgtaattaaact

SEQ ID NO: 43335 - DNA, 20 bp, Artificial Sequence
  Synthetic oligonucleotide; TAG chr11 5272004 5272023 5272007 -
gcaataaaaacatatttttt

SEQ ID NO: 43336 - DNA, 20 bp, Artificial Sequence
  Synthetic oligonucleotide; CAG chr11 5271995 5272014 5271998 -
acatatttttttagcactta

SEQ ID NO: 43337 - DNA, 20 bp, Artificial Sequence
  Synthetic oligonucleotide; TGG chr11 5271982 5272001 5271985 -
gcacttacagtctgccaaac

SEQ ID NO: 43338 - DNA, 20 bp, Artificial Sequence
  Synthetic oligonucleotide; AAG chr11 5271964 5271983 5271967 -
actggcctgtgacacaaaaa

SEQ ID NO: 43339 - DNA, 20 bp, Artificial Sequence
  Synthetic oligonucleotide; TAG chr11 5271959 5271978 5271962 -
cctgtgacacaaaaaaagtt

SEQ ID NO: 43340 - DNA, 20 bp, Artificial Sequence
  Synthetic oligonucleotide; AGG chr11 5271958 5271977 5271961 -
ctgtgacacaaaaaaagttt

SEQ ID NO: 43341 - DNA, 20 bp, Artificial Sequence
  Synthetic oligonucleotide; TGG chr11 5271949 5271968 5271952 -
aaaaaaagtttaggaattcc

SEQ ID NO: 43342 - DNA, 20 bp, Artificial Sequence
  Synthetic oligonucleotide; TAG chr11 5271934 5271953 5271937 -
attcctggttttgtctgtgt

SEQ ID NO: 43343 - DNA, 20 bp, Artificial Sequence
  Synthetic oligonucleotide; TGG chr11 5271927 5271946 5271930 -
gttttgtctgtgttagccaa

SEQ ID NO: 43344 - DNA, 20 bp, Artificial Sequence
  Synthetic oligonucleotide; TAG chr11 5271923 5271942 5271926 -
tgtctgtgttagccaatggt

SEQ ID NO: 43345 - DNA, 20 bp, Artificial Sequence
  Synthetic oligonucleotide; CAG chr11 5271910 5271929 5271913 -
caatggttagaatatatgct

SEQ ID NO: 43346 - DNA, 20 bp, Artificial Sequence
  Synthetic oligonucleotide; AAG chr11 5271906 5271925 5271909 -
ggttagaatatatgctcaga

SEQ ID NO: 43347 - DNA, 20 bp, Artificial Sequence
  Synthetic oligonucleotide; TGG chr11 5271896 5271915 5271899 -
tatgctcagaaagataccat

SEQ ID NO: 43348 - DNA, 20 bp, Artificial Sequence
  Synthetic oligonucleotide; TAG chr11 5271889 5271908 5271892 -
agaaagataccattggttaa

SEQ ID NO: 43349 - DNA, 20 bp, Artificial Sequence
  Synthetic oligonucleotide; AAG chr11 5271882 5271901 5271885 -
taccattggttaatagctaa

SEQ ID NO: 43350 - DNA, 20 bp, Artificial Sequence
  Synthetic oligonucleotide; TGG chr11 5271875 5271894 5271878 -
ggttaatagctaaaagaaaa

SEQ ID NO: 43351 - DNA, 20 bp, Artificial Sequence
  Synthetic oligonucleotide; GAG chr11 5271873 5271892 5271876 -
ttaatagctaaaagaaaatg

SEQ ID NO: 43352 - DNA, 20 bp, Artificial Sequence
  Synthetic oligonucleotide; TAG chr11 5271870 5271889 5271873 -
atagctaaaagaaaatggag

SEQ ID NO: 43353 - DNA, 20 bp, Artificial Sequence
  Synthetic oligonucleotide; CAG chr11 5271862 5271881 5271865 -
aagaaaatggagtagaaatt

SEQ ID NO: 43354 - DNA, 20 bp, Artificial Sequence
  Synthetic oligonucleotide; TGG chr11 5271859 5271878 5271862 -
aaaatggagtagaaattcag

SEQ ID NO: 43355 - DNA, 20 bp, Artificial Sequence
  Synthetic oligonucleotide; TGG chr11 5271854 5271873 5271857 -
ggagtagaaattcagtggcc

SEQ ID NO: 43356 - DNA, 20 bp, Artificial Sequence
  Synthetic oligonucleotide; TGG chr11 5271838 5271857 5271841 -
ggcctggaataataacaatt

SEQ ID NO: 43357 - DNA, 20 bp, Artificial Sequence
  Synthetic oligonucleotide; GGG chr11 5271837 5271856 5271840 -
gcctggaataataacaattt

SEQ ID NO: 43358 - DNA, 20 bp, Artificial Sequence
  Synthetic oligonucleotide; CAG chr11 5271834 5271853 5271837 -
tggaataataacaatttggg

SEQ ID NO: 43359 - DNA, 20 bp, Artificial Sequence
  Synthetic oligonucleotide; AAG chr11 5271826 5271845 5271829 -
taacaatttgggcagtcatt

SEQ ID NO: 43360 - DNA, 20 bp, Artificial Sequence
  Synthetic oligonucleotide; CAG chr11 5271822 5271841 5271825 -
aatttgggcagtcattaagt

SEQ ID NO: 43361 - DNA, 20 bp, Artificial Sequence
  Synthetic oligonucleotide; AGG chr11 5271821 5271840 5271824 -
atttgggcagtcattaagtc

SEQ ID NO: 43362 - DNA, 20 bp, Artificial Sequence
  Synthetic oligonucleotide; AAG chr11 5271816 5271835 5271819 -
ggcagtcattaagtcaggtg

SEQ ID NO: 43363 - DNA, 20 bp, Artificial Sequence
  Synthetic oligonucleotide; TGG chr11 5271808 5271827 5271811 -
ttaagtcaggtgaagacttc

SEQ ID NO: 43364 - DNA, 20 bp, Artificial Sequence
  Synthetic oligonucleotide; TGG chr11 5271800 5271819 5271803 -
ggtgaagacttctggaatca

SEQ ID NO: 43365 - DNA, 20 bp, Artificial Sequence
  Synthetic oligonucleotide; GGG chr11 5271799 5271818 5271802 -
gtgaagacttctggaatcat

SEQ ID NO: 43366 - DNA, 20 bp, Artificial Sequence
  Synthetic oligonucleotide; GAG chr11 5271797 5271816 5271800 -
gaagacttctggaatcatgg

SEQ ID NO: 43367 - DNA, 20 bp, Artificial Sequence
  Synthetic oligonucleotide; AAG chr11 5271792 5271811 5271795 -
cttctggaatcatgggagaa

SEQ ID NO: 43368 - DNA, 20 bp, Artificial Sequence
  Synthetic oligonucleotide; AAG chr11 5271788 5271807 5271791 -
tggaatcatgggagaaaagc

SEQ ID NO: 43369 - DNA, 20 bp, Artificial Sequence
  Synthetic oligonucleotide; AGG chr11 5271787 5271806 5271790 -
ggaatcatgggagaaaagca

SEQ ID NO: 43370 - DNA, 20 bp, Artificial Sequence
  Synthetic oligonucleotide; GGG chr11 5271786 5271805 5271789 -
gaatcatgggagaaaagcaa

SEQ ID NO: 43371 - DNA, 20 bp, Artificial Sequence
  Synthetic oligonucleotide; GAG chr11 5271784 5271803 5271787 -
atcatgggagaaaagcaagg

SEQ ID NO: 43372 - DNA, 20 bp, Artificial Sequence
  Synthetic oligonucleotide; AAG chr11 5271764 5271783 5271767 -
gagacattcttacttgccac

SEQ ID NO: 43373 - DNA, 20 bp, Artificial Sequence
  Synthetic oligonucleotide; AAG chr11 5271727 5271746 5271730 -
tttttttttatcacaaacat

SEQ ID NO: 43374 - DNA, 20 bp, Artificial Sequence
  Synthetic oligonucleotide; AAG chr11 5271706 5271725 5271709 -
agaaaatataataaataaca

SEQ ID NO: 43375 - DNA, 20 bp, Artificial Sequence
  Synthetic oligonucleotide; CAG chr11 5271702 5271721 5271705 -
aatataataaataacaaagt

SEQ ID NO: 43376 - DNA, 20 bp, Artificial Sequence
  Synthetic oligonucleotide; AGG chr11 5271701 5271720 5271704 -
atataataaataacaaagtc

SEQ ID NO: 43377 - DNA, 20 bp, Artificial Sequence
  Synthetic oligonucleotide; TAG chr11 5271695 5271714 5271698 -
taaataacaaagtcaggtta

SEQ ID NO: 43378 - DNA, 20 bp, Artificial Sequence
  Synthetic oligonucleotide; AAG chr11 5271692 5271711 5271695 -
ataacaaagtcaggttatag

SEQ ID NO: 43379 - DNA, 20 bp, Artificial Sequence
  Synthetic oligonucleotide; GAG chr11 5271690 5271709 5271693 -
aacaaagtcaggttatagaa

SEQ ID NO: 43380 - DNA, 20 bp, Artificial Sequence
  Synthetic oligonucleotide; GAG chr11 5271688 5271707 5271691 -
caaagtcaggttatagaaga

SEQ ID NO: 43381 - DNA, 20 bp, Artificial Sequence
  Synthetic oligonucleotide; TAG chr11 5271676 5271695 5271679 -
atagaagagagaaacgctct

SEQ ID NO: 43382 - DNA, 20 bp, Artificial Sequence
  Synthetic oligonucleotide; TGG chr11 5271667 5271686 5271670 -
agaaacgctcttagtaaact

SEQ ID NO: 43383 - DNA, 20 bp, Artificial Sequence
  Synthetic oligonucleotide; TGG chr11 5271660 5271679 5271663 -
ctcttagtaaacttggaata

SEQ ID NO: 43384 - DNA, 20 bp, Artificial Sequence
  Synthetic oligonucleotide; AAG chr11 5271649 5271668 5271652 -
cttggaatatggaatcccca

SEQ ID NO: 43385 - DNA, 20 bp, Artificial Sequence
  Synthetic oligonucleotide; AGG chr11 5271648 5271667 5271651 -
ttggaatatggaatccccaa

SEQ ID NO: 43386 - DNA, 20 bp, Artificial Sequence
  Synthetic oligonucleotide; TGG chr11 5271636 5271655 5271639 -
atccccaaaggcacttgact

SEQ ID NO: 43387 - DNA, 20 bp, Artificial Sequence
  Synthetic oligonucleotide; GGG chr11 5271635 5271654 5271638 -
tccccaaaggcacttgactt

SEQ ID NO: 43388 - DNA, 20 bp, Artificial Sequence
  Synthetic oligonucleotide; GAG chr11 5271633 5271652 5271636 -
cccaaaggcacttgacttgg

SEQ ID NO: 43389 - DNA, 20 bp, Artificial Sequence
  Synthetic oligonucleotide; CAG chr11 5271629 5271648 5271632 -
aaggcacttgacttgggaga

SEQ ID NO: 43390 - DNA, 20 bp, Artificial Sequence
  Synthetic oligonucleotide; AGG chr11 5271628 5271647 5271631 -
aggcacttgacttgggagac

SEQ ID NO: 43391 - DNA, 20 bp, Artificial Sequence
  Synthetic oligonucleotide; GAG chr11 5271626 5271645 5271629 -
gcacttgacttgggagacag

SEQ ID NO: 43392 - DNA, 20 bp, Artificial Sequence
  Synthetic oligonucleotide; AAG chr11 5271613 5271632 5271616 -
gagacaggagccatactgct

SEQ ID NO: 43393 - DNA, 20 bp, Artificial Sequence
  Synthetic oligonucleotide; AAG chr11 5271605 5271624 5271608 -
agccatactgctaagtgaaa

SEQ ID NO: 43394 - DNA, 20 bp, Artificial Sequence
  Synthetic oligonucleotide; AAG chr11 5271599 5271618 5271602 -
actgctaagtgaaaaagacg

SEQ ID NO: 43395 - DNA, 20 bp, Artificial Sequence
  Synthetic oligonucleotide; TAG chr11 5271590 5271609 5271593 -
tgaaaaagacgaagaacctc

SEQ ID NO: 43396 - DNA, 20 bp, Artificial Sequence
  Synthetic oligonucleotide; AGG chr11 5271589 5271608 5271592 -
gaaaaagacgaagaacctct

SEQ ID NO: 43397 - DNA, 20 bp, Artificial Sequence
  Synthetic oligonucleotide; GGG chr11 5271588 5271607 5271591 -
aaaaagacgaagaacctcta

SEQ ID NO: 43398 - DNA, 20 bp, Artificial Sequence
  Synthetic oligonucleotide; CAG chr11 5271575 5271594 5271578 -
acctctagggcctgaacata

SEQ ID NO: 43399 - DNA, 20 bp, Artificial Sequence
  Synthetic oligonucleotide; AGG chr11 5271574 5271593 5271577 -
cctctagggcctgaacatac

SEQ ID NO: 43400 - DNA, 20 bp, Artificial Sequence
  Synthetic oligonucleotide; TAG chr11 5271565 5271584 5271568 -
cctgaacatacaggaaattg

SEQ ID NO: 43401 - DNA, 20 bp, Artificial Sequence
  Synthetic oligonucleotide; AGG chr11 5271564 5271583 5271567 -
ctgaacatacaggaaattgt

SEQ ID NO: 43402 - DNA, 20 bp, Artificial Sequence
  Synthetic oligonucleotide; CAG chr11 5271559 5271578 5271562 -
catacaggaaattgtaggaa

SEQ ID NO: 43403 - DNA, 20 bp, Artificial Sequence
  Synthetic oligonucleotide; TAG chr11 5271549 5271568 5271552 -
attgtaggaacagaaattcc

SEQ ID NO: 43404 - DNA, 20 bp, Artificial Sequence
  Synthetic oligonucleotide; TGG chr11 5271543 5271562 5271546 -
ggaacagaaattcctagatc

SEQ ID NO: 43405 - DNA, 20 bp, Artificial Sequence
  Synthetic oligonucleotide; TGG chr11 5271540 5271559 5271543 -
acagaaattcctagatctgg

SEQ ID NO: 43406 - DNA, 20 bp, Artificial Sequence
  Synthetic oligonucleotide; GGG chr11 5271539 5271558 5271542 -
cagaaattcctagatctggt

SEQ ID NO: 43407 - DNA, 20 bp, Artificial Sequence
  Synthetic oligonucleotide; GGG chr11 5271538 5271557 5271541 -
agaaattcctagatctggtg

SEQ ID NO: 43408 - DNA, 20 bp, Artificial Sequence
  Synthetic oligonucleotide; AAG chr11 5271534 5271553 5271537 -
attcctagatctggtggggc

SEQ ID NO: 43409 - DNA, 20 bp, Artificial Sequence
  Synthetic oligonucleotide; AGG chr11 5271533 5271552 5271536 -
ttcctagatctggtggggca

SEQ ID NO: 43410 - DNA, 20 bp, Artificial Sequence
  Synthetic oligonucleotide; GGG chr11 5271532 5271551 5271535 -
tcctagatctggtggggcaa

SEQ ID NO: 43411 - DNA, 20 bp, Artificial Sequence
  Synthetic oligonucleotide; GGG chr11 5271531 5271550 5271534 -
cctagatctggtggggcaag

SEQ ID NO: 43412 - DNA, 20 bp, Artificial Sequence
  Synthetic oligonucleotide; GAG chr11 5271529 5271548 5271532 -
tagatctggtggggcaaggg

SEQ ID NO: 43413 - DNA, 20 bp, Artificial Sequence
  Synthetic oligonucleotide; TAG chr11 5271523 5271542 5271526 -
tggtggggcaaggggagcca

SEQ ID NO: 43414 - DNA, 20 bp, Artificial Sequence
  Synthetic oligonucleotide; AGG chr11 5271522 5271541 5271525 -
ggtggggcaaggggagccat

SEQ ID NO: 43415 - DNA, 20 bp, Artificial Sequence
  Synthetic oligonucleotide; GAG chr11 5271520 5271539 5271523 -
tggggcaaggggagccatag

SEQ ID NO: 43416 - DNA, 20 bp, Artificial Sequence
  Synthetic oligonucleotide; AAG chr11 5271516 5271535 5271519 -
gcaaggggagccataggaga

SEQ ID NO: 43417 - DNA, 20 bp, Artificial Sequence
  Synthetic oligonucleotide; TGG chr11 5271510 5271529 5271513 -
ggagccataggagaaagaaa

SEQ ID NO: 43418 - DNA, 20 bp, Artificial Sequence
  Synthetic oligonucleotide; TAG chr11 5271507 5271526 5271510 -
gccataggagaaagaaatgg

SEQ ID NO: 43419 - DNA, 20 bp, Artificial Sequence
  Synthetic oligonucleotide; TGG chr11 5271501 5271520 5271504 -
ggagaaagaaatggtagaaa

SEQ ID NO: 43420 - DNA, 20 bp, Artificial Sequence
  Synthetic oligonucleotide; TGG chr11 5271497 5271516 5271500 -
aaagaaatggtagaaatgga

SEQ ID NO: 43421 - DNA, 20 bp, Artificial Sequence
  Synthetic oligonucleotide; GAG chr11 5271495 5271514 5271498 -
agaaatggtagaaatggatg

SEQ ID NO: 43422 - DNA, 20 bp, Artificial Sequence
  Synthetic oligonucleotide; CGG chr11 5271491 5271510 5271494 -
atggtagaaatggatggaga

SEQ ID NO: 43423 - DNA, 20 bp, Artificial Sequence
  Synthetic oligonucleotide; GAG chr11 5271489 5271508 5271492 -
ggtagaaatggatggagacg

SEQ ID NO: 43424 - DNA, 20 bp, Artificial Sequence
  Synthetic oligonucleotide; AGG chr11 5271488 5271507 5271491 -
gtagaaatggatggagacgg

SEQ ID NO: 43425 - DNA, 20 bp, Artificial Sequence
  Synthetic oligonucleotide; CAG chr11 5271485 5271504 5271488 -
gaaatggatggagacggagg

SEQ ID NO: 43426 - DNA, 20 bp, Artificial Sequence
  Synthetic oligonucleotide; GAG chr11 5271483 5271502 5271486 -
aatggatggagacggaggca

SEQ ID NO: 43427 - DNA, 20 bp, Artificial Sequence
  Synthetic oligonucleotide; AGG chr11 5271482 5271501 5271485 -
atggatggagacggaggcag

SEQ ID NO: 43428 - DNA, 20 bp, Artificial Sequence
  Synthetic oligonucleotide; TGG chr11 5271479 5271498 5271482 -
gatggagacggaggcagagg

SEQ ID NO: 43429 - DNA, 20 bp, Artificial Sequence
  Synthetic oligonucleotide; GGG chr11 5271478 5271497 5271481 -
atggagacggaggcagaggt

SEQ ID NO: 43430 - DNA, 20 bp, Artificial Sequence
  Synthetic oligonucleotide; CAG chr11 5271475 5271494 5271478 -
gagacggaggcagaggtggg

SEQ ID NO: 43431 - DNA, 20 bp, Artificial Sequence
  Synthetic oligonucleotide; GAG chr11 5271467 5271486 5271470 -
ggcagaggtgggcagatcat

SEQ ID NO: 43432 - DNA, 20 bp, Artificial Sequence
  Synthetic oligonucleotide; AGG chr11 5271466 5271485 5271469 -
gcagaggtgggcagatcatg

SEQ ID NO: 43433 - DNA, 20 bp, Artificial Sequence
  Synthetic oligonucleotide; AAG chr11 5271461 5271480 5271464 -
ggtgggcagatcatgaggtc

SEQ ID NO: 43434 - DNA, 20 bp, Artificial Sequence
  Synthetic oligonucleotide; GAG chr11 5271459 5271478 5271462 -
tgggcagatcatgaggtcaa

SEQ ID NO: 43435 - DNA, 20 bp, Artificial Sequence
  Synthetic oligonucleotide; GAG chr11 5271453 5271472 5271456 -
gatcatgaggtcaagagatc

SEQ ID NO: 43436 - DNA, 20 bp, Artificial Sequence
  Synthetic oligonucleotide; TGG chr11 5271443 5271462 5271446 -
tcaagagatcgagaccatcc

SEQ ID NO: 43437 - DNA, 20 bp, Artificial Sequence
  Synthetic oligonucleotide; TGG chr11 5271434 5271453 5271437 -
cgagaccatcctggcaaaca

SEQ ID NO: 43438 - DNA, 20 bp, Artificial Sequence
  Synthetic oligonucleotide; TAG chr11 5271399 5271418 5271402 -
tctactaaaaataaaaaaat

SEQ ID NO: 43439 - DNA, 20 bp, Artificial Sequence
  Synthetic oligonucleotide; TGG chr11 5271395 5271414 5271398 -
ctaaaaataaaaaaattagc

SEQ ID NO: 43440 - DNA, 20 bp, Artificial Sequence
  Synthetic oligonucleotide; GGG chr11 5271394 5271413 5271397 -
taaaaataaaaaaattagct

SEQ ID NO: 43441 - DNA, 20 bp, Artificial Sequence
  Synthetic oligonucleotide; TGG chr11 5271389 5271408 5271392 -
ataaaaaaattagctgggca

SEQ ID NO: 43442 - DNA, 20 bp, Artificial Sequence
  Synthetic oligonucleotide; TGG chr11 5271386 5271405 5271389 -
aaaaaattagctgggcatgg

SEQ ID NO: 43443 - DNA, 20 bp, Artificial Sequence
  Synthetic oligonucleotide; TAG chr11 5271373 5271392 5271376 -
ggcatggtggcatgcgcctg

SEQ ID NO: 43444 - DNA, 20 bp, Artificial Sequence
  Synthetic oligonucleotide; CAG chr11 5271367 5271386 5271370 -
gtggcatgcgcctgtagtcc

SEQ ID NO: 43445 - DNA, 20 bp, Artificial Sequence
  Synthetic oligonucleotide; CGG chr11 5271359 5271378 5271362 -
cgcctgtagtcccagctgct

SEQ ID NO: 43446 - DNA, 20 bp, Artificial Sequence
  Synthetic oligonucleotide; GGG chr11 5271358 5271377 5271361 -
gcctgtagtcccagctgctc

SEQ ID NO: 43447 - DNA, 20 bp, Artificial Sequence
  Synthetic oligonucleotide; GAG chr11 5271356 5271375 5271359 -
ctgtagtcccagctgctcgg

SEQ ID NO: 43448 - DNA, 20 bp, Artificial Sequence
  Synthetic oligonucleotide; AGG chr11 5271355 5271374 5271358 -
tgtagtcccagctgctcggg

SEQ ID NO: 43449 - DNA, 20 bp, Artificial Sequence
  Synthetic oligonucleotide; GAG chr11 5271350 5271369 5271353 -
tcccagctgctcgggaggct

SEQ ID NO: 43450 - DNA, 20 bp, Artificial Sequence
  Synthetic oligonucleotide; AGG chr11 5271349 5271368 5271352 -
cccagctgctcgggaggctg

SEQ ID NO: 43451 - DNA, 20 bp, Artificial Sequence
  Synthetic oligonucleotide; CAG chr11 5271346 5271365 5271349 -
agctgctcgggaggctgagg

SEQ ID NO: 43452 - DNA, 20 bp, Artificial Sequence
  Synthetic oligonucleotide; AGG chr11 5271345 5271364 5271348 -
gctgctcgggaggctgaggc

SEQ ID NO: 43453 - DNA, 20 bp, Artificial Sequence
  Synthetic oligonucleotide; GAG chr11 5271343 5271362 5271346 -
tgctcgggaggctgaggcag

SEQ ID NO: 43454 - DNA, 20 bp, Artificial Sequence
  Synthetic oligonucleotide; CAG chr11 5271327 5271346 5271330 -
gcaggagaatcgtttgaacc

SEQ ID NO: 43455 - DNA, 20 bp, Artificial Sequence
  Synthetic oligonucleotide; AGG chr11 5271326 5271345 5271329 -
caggagaatcgtttgaaccc

SEQ ID NO: 43456 - DNA, 20 bp, Artificial Sequence
  Synthetic oligonucleotide; GAG chr11 5271324 5271343 5271327 -
ggagaatcgtttgaacccag

SEQ ID NO: 43457 - DNA, 20 bp, Artificial Sequence
  Synthetic oligonucleotide; AGG chr11 5271323 5271342 5271326 -
gagaatcgtttgaacccagg

SEQ ID NO: 43458 - DNA, 20 bp, Artificial Sequence
  Synthetic oligonucleotide; AAG chr11 5271318 5271337 5271321 -
tcgtttgaacccaggaggcg

SEQ ID NO: 43459 - DNA, 20 bp, Artificial Sequence
  Synthetic oligonucleotide; AGG chr11 5271317 5271336 5271320 -
cgtttgaacccaggaggcga

SEQ ID NO: 43460 - DNA, 20 bp, Artificial Sequence
  Synthetic oligonucleotide; CAG chr11 5271311 5271330 5271314 -
aacccaggaggcgaaggttg

SEQ ID NO: 43461 - DNA, 20 bp, Artificial Sequence
  Synthetic oligonucleotide; GAG chr11 5271307 5271326 5271310 -
caggaggcgaaggttgcagt

SEQ ID NO: 43462 - DNA, 20 bp, Artificial Sequence
  Synthetic oligonucleotide; GAG chr11 5271302 5271321 5271305 -
ggcgaaggttgcagtgagct

SEQ ID NO: 43463 - DNA, 20 bp, Artificial Sequence
  Synthetic oligonucleotide; TAG chr11 5271298 5271317 5271301 -
aaggttgcagtgagctgaga

SEQ ID NO: 43464 - DNA, 20 bp, Artificial Sequence
  Synthetic oligonucleotide; CAG chr11 5271282 5271301 5271285 -
gagatagtgccattgcactc

SEQ ID NO: 43465 - DNA, 20 bp, Artificial Sequence
  Synthetic oligonucleotide; TGG chr11 5271277 5271296 5271280 -
agtgccattgcactccagtc

SEQ ID NO: 43466 - DNA, 20 bp, Artificial Sequence
  Synthetic oligonucleotide; CAG chr11 5271271 5271290 5271274 -
attgcactccagtctggcaa

SEQ ID NO: 43467 - DNA, 20 bp, Artificial Sequence
  Synthetic oligonucleotide; GAG chr11 5271269 5271288 5271272 -
tgcactccagtctggcaaca

SEQ ID NO: 43468 - DNA, 20 bp, Artificial Sequence
  Synthetic oligonucleotide; GAG chr11 5271265 5271284 5271268 -
ctccagtctggcaacagagt

SEQ ID NO: 43469 - DNA, 20 bp, Artificial Sequence
  Synthetic oligonucleotide; AAG chr11 5271238 5271257 5271241 -
cgtctcaaaaaaaaaaaaaa

SEQ ID NO: 43470 - DNA, 20 bp, Artificial Sequence
  Synthetic oligonucleotide; AAG chr11 5271234 5271253 5271237 -
tcaaaaaaaaaaaaaaaaga

SEQ ID NO: 43471 - DNA, 20 bp, Artificial Sequence
  Synthetic oligonucleotide; AAG chr11 5271230 5271249 5271233 -
aaaaaaaaaaaaaagaaaga

SEQ ID NO: 43472 - DNA, 20 bp, Artificial Sequence
  Synthetic oligonucleotide; AAG chr11 5271225 5271244 5271228 -
aaaaaaaaagaaagaaagaa

SEQ ID NO: 43473 - DNA, 20 bp, Artificial Sequence
  Synthetic oligonucleotide; AAG chr11 5271219 5271238 5271222 -
aaagaaagaaagaaaagaaa

SEQ ID NO: 43474 - DNA, 20 bp, Artificial Sequence
  Synthetic oligonucleotide; AAG chr11 5271212 5271231 5271215 -
gaaagaaaagaaaaagaaaa

SEQ ID NO: 43475 - DNA, 20 bp, Artificial Sequence
  Synthetic oligonucleotide; TGG chr11 5271199 5271218 5271202 -
aagaaaaaagaaaaaataaa

SEQ ID NO: 43476 - DNA, 20 bp, Artificial Sequence
  Synthetic oligonucleotide; TAG chr11 5271193 5271212 5271196 -
aaagaaaaaataaatggatg

SEQ ID NO: 43477 - DNA, 20 bp, Artificial Sequence
  Synthetic oligonucleotide; AAG chr11 5271187 5271206 5271190 -
aaaataaatggatgtagaac

SEQ ID NO: 43478 - DNA, 20 bp, Artificial Sequence
  Synthetic oligonucleotide; CAG chr11 5271183 5271202 5271186 -
taaatggatgtagaacaagc

SEQ ID NO: 43479 - DNA, 20 bp, Artificial Sequence
  Synthetic oligonucleotide; AAG chr11 5271180 5271199 5271183 -
atggatgtagaacaagccag

SEQ ID NO: 43480 - DNA, 20 bp, Artificial Sequence
  Synthetic oligonucleotide; AGG chr11 5271179 5271198 5271182 -
tggatgtagaacaagccaga

SEQ ID NO: 43481 - DNA, 20 bp, Artificial Sequence
  Synthetic oligonucleotide; GAG chr11 5271177 5271196 5271180 -
gatgtagaacaagccagaag

SEQ ID NO: 43482 - DNA, 20 bp, Artificial Sequence
  Synthetic oligonucleotide; AGG chr11 5271176 5271195 5271179 -
atgtagaacaagccagaagg

SEQ ID NO: 43483 - DNA, 20 bp, Artificial Sequence
  Synthetic oligonucleotide; TGG chr11 5271170 5271189 5271173 -
aacaagccagaaggaggaac

SEQ ID NO: 43484 - DNA, 20 bp, Artificial Sequence
  Synthetic oligonucleotide; GGG chr11 5271169 5271188 5271172 -
acaagccagaaggaggaact

SEQ ID NO: 43485 - DNA, 20 bp, Artificial Sequence
  Synthetic oligonucleotide; TGG chr11 5271165 5271184 5271168 -
gccagaaggaggaactgggc

SEQ ID NO: 43486 - DNA, 20 bp, Artificial Sequence
  Synthetic oligonucleotide; GGG chr11 5271164 5271183 5271167 -
ccagaaggaggaactgggct

SEQ ID NO: 43487 - DNA, 20 bp, Artificial Sequence
  Synthetic oligonucleotide; GGG chr11 5271163 5271182 5271166 -
cagaaggaggaactgggctg

SEQ ID NO: 43488 - DNA, 20 bp, Artificial Sequence
  Synthetic oligonucleotide; GAG chr11 5271156 5271175 5271159 -
aggaactgggctggggcaat

SEQ ID NO: 43489 - DNA, 20 bp, Artificial Sequence
  Synthetic oligonucleotide; TGG chr11 5271149 5271168 5271152 -
gggctggggcaatgagatta

SEQ ID NO: 43490 - DNA, 20 bp, Artificial Sequence
  Synthetic oligonucleotide; AAG chr11 5271140 5271159 5271143 -
caatgagattatggtgatgt

SEQ ID NO: 43491 - DNA, 20 bp, Artificial Sequence
  Synthetic oligonucleotide; AGG chr11 5271139 5271158 5271142 -
aatgagattatggtgatgta

SEQ ID NO: 43492 - DNA, 20 bp, Artificial Sequence
  Synthetic oligonucleotide; GGG chr11 5271138 5271157 5271141 -
atgagattatggtgatgtaa

SEQ ID NO: 43493 - DNA, 20 bp, Artificial Sequence
  Synthetic oligonucleotide; TAG chr11 5271128 5271147 5271131 -
ggtgatgtaagggactttta

SEQ ID NO: 43494 - DNA, 20 bp, Artificial Sequence
  Synthetic oligonucleotide; TGG chr11 5271113 5271132 5271116 -
ttttatagaattaacaatgc

SEQ ID NO: 43495 - DNA, 20 bp, Artificial Sequence
  Synthetic oligonucleotide; TGG chr11 5271104 5271123 5271107 -
attaacaatgctggaatttg

SEQ ID NO: 43496 - DNA, 20 bp, Artificial Sequence
  Synthetic oligonucleotide; TAG chr11 5271055 5271074 5271058 -
cattacttctgtcacattga

SEQ ID NO: 43497 - DNA, 20 bp, Artificial Sequence
  Synthetic oligonucleotide; GAG chr11 5271011 5271030 5271014 -
attccttgattctaaaatat

SEQ ID NO: 43498 - DNA, 20 bp, Artificial Sequence
  Synthetic oligonucleotide; AGG chr11 5271010 5271029 5271013 -
ttccttgattctaaaatatg

SEQ ID NO: 43499 - DNA, 20 bp, Artificial Sequence
  Synthetic oligonucleotide; TGG chr11 5270997 5271016 5271000 -
aaatatgaggataatgacaa

SEQ ID NO: 43500 - DNA, 20 bp, Artificial Sequence
  Synthetic oligonucleotide; AAG chr11 5270988 5271007 5270991 -
gataatgacaatggtattat

SEQ ID NO: 43501 - DNA, 20 bp, Artificial Sequence
  Synthetic oligonucleotide; AGG chr11 5270987 5271006 5270990 -
ataatgacaatggtattata

SEQ ID NO: 43502 - DNA, 20 bp, Artificial Sequence
  Synthetic oligonucleotide; GGG chr11 5270986 5271005 5270989 -
taatgacaatggtattataa

SEQ ID NO: 43503 - DNA, 20 bp, Artificial Sequence
  Synthetic oligonucleotide; CAG chr11 5270983 5271002 5270986 -
tgacaatggtattataaggg

SEQ ID NO: 43504 - DNA, 20 bp, Artificial Sequence
  Synthetic oligonucleotide; AAG chr11 5270977 5270996 5270980 -
tggtattataagggcagatt

SEQ ID NO: 43505 - DNA, 20 bp, Artificial Sequence
  Synthetic oligonucleotide; TAG chr11 5270969 5270988 5270972 -
taagggcagattaagtgata

SEQ ID NO: 43506 - DNA, 20 bp, Artificial Sequence
  Synthetic oligonucleotide; GAG chr11 5270963 5270982 5270966 -
cagattaagtgatatagcat

SEQ ID NO: 43507 - DNA, 20 bp, Artificial Sequence
  Synthetic oligonucleotide; CAG chr11 5270950 5270969 5270953 -
atagcatgagcaatattctt

SEQ ID NO: 43508 - DNA, 20 bp, Artificial Sequence
  Synthetic oligonucleotide; AGG chr11 5270949 5270968 5270952 -
tagcatgagcaatattcttc

SEQ ID NO: 43509 - DNA, 20 bp, Artificial Sequence
  Synthetic oligonucleotide; TGG chr11 5270942 5270961 5270945 -
agcaatattcttcaggcaca

SEQ ID NO: 43510 - DNA, 20 bp, Artificial Sequence
  Synthetic oligonucleotide; CAG chr11 5270907 5270926 5270910 -
acactgtaaatcccaacttc
